United States Patent 7,250,289 (METHODS OF GENETIC ANALYSIS OF MOUSE) - sequence listing, part 10

SEQ ID NO: 363254 - DNA, 25 bp, Mus musculus
cggagaccttaacaacagatggaga

SEQ ID NO: 363255 - DNA, 25 bp, Mus musculus
cggagaccttaagaacagatggaga

SEQ ID NO: 363256 - DNA, 25 bp, Mus musculus
cggagacgccgtagataaatcctct

SEQ ID NO: 363257 - DNA, 25 bp, Mus musculus
cggagacgccgttgataaatcctct

SEQ ID NO: 363258 - DNA, 25 bp, Mus musculus
cggagagctgtcctttcagttgtag

SEQ ID NO: 363259 - DNA, 25 bp, Mus musculus
cggagagctgtcgtttcagttgtag

SEQ ID NO: 363260 - DNA, 25 bp, Mus musculus
cggagaggaggactcggcggcagct

SEQ ID NO: 363261 - DNA, 25 bp, Mus musculus
cggagaggaggagtcggcggcagct

SEQ ID NO: 363262 - DNA, 25 bp, Mus musculus
cggagagggcaacaacccattccta

SEQ ID NO: 363263 - DNA, 25 bp, Mus musculus
cggagagggcaagaacccattccta

SEQ ID NO: 363264 - DNA, 25 bp, Mus musculus
cggagagtctcactaaccgttcttg

SEQ ID NO: 363265 - DNA, 25 bp, Mus musculus
cggagagtctcagtaaccgttcttg

SEQ ID NO: 363266 - DNA, 25 bp, Mus musculus
cggagatcacctctaaatggccaca

SEQ ID NO: 363267 - DNA, 25 bp, Mus musculus
cggagatcacctgtaaatggccaca

SEQ ID NO: 363268 - DNA, 25 bp, Mus musculus
cggagatgccagacgcttggttctg

SEQ ID NO: 363269 - DNA, 25 bp, Mus musculus
cggagatgccagtcgcttggttctg

SEQ ID NO: 363270 - DNA, 25 bp, Mus musculus
cggagattttcaacacgtatactga

SEQ ID NO: 363271 - DNA, 25 bp, Mus musculus
cggagattttcatcacgtatactga

SEQ ID NO: 363272 - DNA, 25 bp, Mus musculus
cggagcaacggtcactttctggcaa

SEQ ID NO: 363273 - DNA, 25 bp, Mus musculus
cggagcaacggtgactttctggcaa

SEQ ID NO: 363274 - DNA, 25 bp, Mus musculus
cggagcaagattctgcggtgacctc

SEQ ID NO: 363275 - DNA, 25 bp, Mus musculus
cggagcaagattgtgcggtgacctc

SEQ ID NO: 363276 - DNA, 25 bp, Mus musculus
cggagcaaggtcagtatcccacttt

SEQ ID NO: 363277 - DNA, 25 bp, Mus musculus
cggagcaaggtctgtatcccacttt

SEQ ID NO: 363278 - DNA, 25 bp, Mus musculus
cggagcacgccaagcgcaagaccgt

SEQ ID NO: 363279 - DNA, 25 bp, Mus musculus
cggagcacgccatgcgcaagaccgt

SEQ ID NO: 363280 - DNA, 25 bp, Mus musculus
cggagcaggcccaacgattctcgtc

SEQ ID NO: 363281 - DNA, 25 bp, Mus musculus
cggagcaggccctacgattctcgtc

SEQ ID NO: 363282 - DNA, 25 bp, Mus musculus
cggagcatatgcagatcctgggcat

SEQ ID NO: 363283 - DNA, 25 bp, Mus musculus
cggagcatatgctgatcctgggcat

SEQ ID NO: 363284 - DNA, 25 bp, Mus musculus
cggagcatcatcctcgtgaatattg

SEQ ID NO: 363285 - DNA, 25 bp, Mus musculus
cggagcatcatcgtcgtgaatattg

SEQ ID NO: 363286 - DNA, 25 bp, Mus musculus
cggagccaatgtcaccagcacgata

SEQ ID NO: 363287 - DNA, 25 bp, Mus musculus
cggagccaatgtgaccagcacgata

SEQ ID NO: 363288 - DNA, 25 bp, Mus musculus
cggagccatagtaagccgttctcgg

SEQ ID NO: 363289 - DNA, 25 bp, Mus musculus
cggagccatagttagccgttctcgg

SEQ ID NO: 363290 - DNA, 25 bp, Mus musculus
cggagccccgagagtatcagctaca

SEQ ID NO: 363291 - DNA, 25 bp, Mus musculus
cggagccccgagtgtatcagctaca

SEQ ID NO: 363292 - DNA, 25 bp, Mus musculus
cggagcctccggataagcctgatca

SEQ ID NO: 363293 - DNA, 25 bp, Mus musculus
cggagcctccggttaagcctgatca

SEQ ID NO: 363294 - DNA, 25 bp, Mus musculus
cggagcgagatcacttacagtgcca

SEQ ID NO: 363295 - DNA, 25 bp, Mus musculus
cggagcgagatctcttacagtgcca

SEQ ID NO: 363296 - DNA, 25 bp, Mus musculus
cggagcgccacaattccgggctcag

SEQ ID NO: 363297 - DNA, 25 bp, Mus musculus
cggagcgccacatttccgggctcag

SEQ ID NO: 363298 - DNA, 25 bp, Mus musculus
cggagctaaaggaaacattgaggaa

SEQ ID NO: 363299 - DNA, 25 bp, Mus musculus
cggagctaaaggtaacattgaggaa

SEQ ID NO: 363300 - DNA, 25 bp, Mus musculus
cggagctaccctccctatcagtagg

SEQ ID NO: 363301 - DNA, 25 bp, Mus musculus
cggagctaccctgcctatcagtagg

SEQ ID NO: 363302 - DNA, 25 bp, Mus musculus
cggagctcaattccggcaggaaatt

SEQ ID NO: 363303 - DNA, 25 bp, Mus musculus
cggagctcaattgcggcaggaaatt

SEQ ID NO: 363304 - DNA, 25 bp, Mus musculus
cggagctcagcgagccgctcaggta

SEQ ID NO: 363305 - DNA, 25 bp, Mus musculus
cggagctcagcgtgccgctcaggta

SEQ ID NO: 363306 - DNA, 25 bp, Mus musculus
cggagctcccagaccaaatgatggt

SEQ ID NO: 363307 - DNA, 25 bp, Mus musculus
cggagctcccagtccaaatgatggt

SEQ ID NO: 363308 - DNA, 25 bp, Mus musculus
cggagctccccgacagttgttttct

SEQ ID NO: 363309 - DNA, 25 bp, Mus musculus
cggagctccccgtcagttgttttct

SEQ ID NO: 363310 - DNA, 25 bp, Mus musculus
cggagctcctgaaccttatttattt

SEQ ID NO: 363311 - DNA, 25 bp, Mus musculus
cggagctcctgatccttatttattt

SEQ ID NO: 363312 - DNA, 25 bp, Mus musculus
cggagctgcatgacggcttgccaga

SEQ ID NO: 363313 - DNA, 25 bp, Mus musculus
cggagctgcatgtcggcttgccaga

SEQ ID NO: 363314 - DNA, 25 bp, Mus musculus
cggagctgctgacccggtctaacaa

SEQ ID NO: 363315 - DNA, 25 bp, Mus musculus
cggagctgctgagccggtctaacaa

SEQ ID NO: 363316 - DNA, 25 bp, Mus musculus
cggaggaaacgcaatgcagaacata

SEQ ID NO: 363317 - DNA, 25 bp, Mus musculus
cggaggaaacgctatgcagaacata

SEQ ID NO: 363318 - DNA, 25 bp, Mus musculus
cggaggacacttcgccagaaggata

SEQ ID NO: 363319 - DNA, 25 bp, Mus musculus
cggaggacacttggccagaaggata

SEQ ID NO: 363320 - DNA, 25 bp, Mus musculus
cggaggacttcgctagagctcagaa

SEQ ID NO: 363321 - DNA, 25 bp, Mus musculus
cggaggacttcggtagagctcagaa

SEQ ID NO: 363322 - DNA, 25 bp, Mus musculus
cggaggagactcaggtgacttctaa

SEQ ID NO: 363323 - DNA, 25 bp, Mus musculus
cggaggagactctggtgacttctaa

SEQ ID NO: 363324 - DNA, 25 bp, Mus musculus
cggaggagctggacctagaagccca

SEQ ID NO: 363325 - DNA, 25 bp, Mus musculus
cggaggagctggtcctagaagccca

SEQ ID NO: 363326 - DNA, 25 bp, Mus musculus
cggaggatccgacgtccagctgcaa

SEQ ID NO: 363327 - DNA, 25 bp, Mus musculus
cggaggatccgaggtccagctgcaa

SEQ ID NO: 363328 - DNA, 25 bp, Mus musculus
cggaggattaggatttcaaacttat

SEQ ID NO: 363329 - DNA, 25 bp, Mus musculus
cggaggattaggttttcaaacttat

SEQ ID NO: 363330 - DNA, 25 bp, Mus musculus
cggaggcatactaccaactttttat

SEQ ID NO: 363331 - DNA, 25 bp, Mus musculus
cggaggcatacttccaactttttat

SEQ ID NO: 363332 - DNA, 25 bp, Mus musculus
cggaggccagcacagaattctttca

SEQ ID NO: 363333 - DNA, 25 bp, Mus musculus
cggaggccagcagagaattctttca

SEQ ID NO: 363334 - DNA, 25 bp, Mus musculus
cggaggccccccaaaactgatgcag

SEQ ID NO: 363335 - DNA, 25 bp, Mus musculus
cggaggcccccctaaactgatgcag

SEQ ID NO: 363336 - DNA, 25 bp, Mus musculus
cggaggccttcaaggcggagatcaa

SEQ ID NO: 363337 - DNA, 25 bp, Mus musculus
cggaggccttcatggcggagatcaa

SEQ ID NO: 363338 - DNA, 25 bp, Mus musculus
cggaggcgagcgagtccagtcccaa

SEQ ID NO: 363339 - DNA, 25 bp, Mus musculus
cggaggcgagcgtgtccagtcccaa

SEQ ID NO: 363340 - DNA, 25 bp, Mus musculus
cggaggctttcacaggtaaccccag

SEQ ID NO: 363341 - DNA, 25 bp, Mus musculus
cggaggctttcagaggtaaccccag

SEQ ID NO: 363342 - DNA, 25 bp, Mus musculus
cggagggagctaactgttcatgatt

SEQ ID NO: 363343 - DNA, 25 bp, Mus musculus
cggagggagctatctgttcatgatt

SEQ ID NO: 363344 - DNA, 25 bp, Mus musculus
cggagggttactagtgctctggtcc

SEQ ID NO: 363345 - DNA, 25 bp, Mus musculus
cggagggttacttgtgctctggtcc

SEQ ID NO: 363346 - DNA, 25 bp, Mus musculus
cggagggttcctaaagaggcagcta

SEQ ID NO: 363347 - DNA, 25 bp, Mus musculus
cggagggttccttaagaggcagcta

SEQ ID NO: 363348 - DNA, 25 bp, Mus musculus
cggagggttctgacactataatatt

SEQ ID NO: 363349 - DNA, 25 bp, Mus musculus
cggagggttctgtcactataatatt

SEQ ID NO: 363350 - DNA, 25 bp, Mus musculus
cggaggtaagcgacttgtagcccaa

SEQ ID NO: 363351 - DNA, 25 bp, Mus musculus
cggaggtaagcgtcttgtagcccaa

SEQ ID NO: 363352 - DNA, 25 bp, Mus musculus
cggaggtcacagactttgctgttgt

SEQ ID NO: 363353 - DNA, 25 bp, Mus musculus
cggaggtcacagtctttgctgttgt

SEQ ID NO: 363354 - DNA, 25 bp, Mus musculus
cggaggtcacctccctaaggaggaa

SEQ ID NO: 363355 - DNA, 25 bp, Mus musculus
cggaggtcacctgcctaaggaggaa

SEQ ID NO: 363356 - DNA, 25 bp, Mus musculus
cggaggtcacttatgcacgtggcat

SEQ ID NO: 363357 - DNA, 25 bp, Mus musculus
cggaggtcacttttgcacgtggcat

SEQ ID NO: 363358 - DNA, 25 bp, Mus musculus
cggaggtgtcgtcagcacagggtga

SEQ ID NO: 363359 - DNA, 25 bp, Mus musculus
cggaggtgtcgtgagcacagggtga

SEQ ID NO: 363360 - DNA, 25 bp, Mus musculus
cggaggtgtgttccaagtttgtcaa

SEQ ID NO: 363361 - DNA, 25 bp, Mus musculus
cggaggtgtgttgcaagtttgtcaa

SEQ ID NO: 363362 - DNA, 25 bp, Mus musculus
cggaggtgttgaatcctcctcacaa

SEQ ID NO: 363363 - DNA, 25 bp, Mus musculus
cggaggtgttgattcctcctcacaa

SEQ ID NO: 363364 - DNA, 25 bp, Mus musculus
cggaggttcactactgttacaagga

SEQ ID NO: 363365 - DNA, 25 bp, Mus musculus
cggaggttcacttctgttacaagga

SEQ ID NO: 363366 - DNA, 25 bp, Mus musculus
cggagtacaactcggcgccaaacac

SEQ ID NO: 363367 - DNA, 25 bp, Mus musculus
cggagtacaactgggcgccaaacac

SEQ ID NO: 363368 - DNA, 25 bp, Mus musculus
cggagtcaagagacctgcagggcaa

SEQ ID NO: 363369 - DNA, 25 bp, Mus musculus
cggagtcaagagtcctgcagggcaa

SEQ ID NO: 363370 - DNA, 25 bp, Mus musculus
cggagtcagtgcaatgccttgtttc

SEQ ID NO: 363371 - DNA, 25 bp, Mus musculus
cggagtcagtgctatgccttgtttc

SEQ ID NO: 363372 - DNA, 25 bp, Mus musculus
cggagtcccctgagtatttacaagc

SEQ ID NO: 363373 - DNA, 25 bp, Mus musculus
cggagtcccctgtgtatttacaagc

SEQ ID NO: 363374 - DNA, 25 bp, Mus musculus
cggagtccttgcaccatgatgagga

SEQ ID NO: 363375 - DNA, 25 bp, Mus musculus
cggagtccttgctccatgatgagga

SEQ ID NO: 363376 - DNA, 25 bp, Mus musculus
cggagtcggagtactcaatcatggt

SEQ ID NO: 363377 - DNA, 25 bp, Mus musculus
cggagtcggagttctcaatcatggt

SEQ ID NO: 363378 - DNA, 25 bp, Mus musculus
cggagtcgtgaaagtctgccgacgc

SEQ ID NO: 363379 - DNA, 25 bp, Mus musculus
cggagtcgtgaatgtctgccgacgc

SEQ ID NO: 363380 - DNA, 25 bp, Mus musculus
cggagtctaaccagggcattttata

SEQ ID NO: 363381 - DNA, 25 bp, Mus musculus
cggagtctaacctgggcattttata

SEQ ID NO: 363382 - DNA, 25 bp, Mus musculus
cggagtcttactctgtgacctagat

SEQ ID NO: 363383 - DNA, 25 bp, Mus musculus
cggagtcttactgtgtgacctagat

SEQ ID NO: 363384 - DNA, 25 bp, Mus musculus
cggagtcttcgtcccaacagtggaa

SEQ ID NO: 363385 - DNA, 25 bp, Mus musculus
cggagtcttcgtcctgtttgatgag

SEQ ID NO: 363386 - DNA, 25 bp, Mus musculus
cggagtcttcgtgccaacagtggaa

SEQ ID NO: 363387 - DNA, 25 bp, Mus musculus
cggagtcttcgtgctgtttgatgag

SEQ ID NO: 363388 - DNA, 25 bp, Mus musculus
cggagtgactgacaagcagcactga

SEQ ID NO: 363389 - DNA, 25 bp, Mus musculus
cggagtgactgagaagcagcactga

SEQ ID NO: 363390 - DNA, 25 bp, Mus musculus
cggagtgagcctcttgattcatgga

SEQ ID NO: 363391 - DNA, 25 bp, Mus musculus
cggagtgagcctgttgattcatgga

SEQ ID NO: 363392 - DNA, 25 bp, Mus musculus
cggagtgagctgatgggcatggaac

SEQ ID NO: 363393 - DNA, 25 bp, Mus musculus
cggagtgagctgttgggcatggaac

SEQ ID NO: 363394 - DNA, 25 bp, Mus musculus
cggagtgagtgacagatcgtattct

SEQ ID NO: 363395 - DNA, 25 bp, Mus musculus
cggagtgagtgagagatcgtattct

SEQ ID NO: 363396 - DNA, 25 bp, Mus musculus
cggagtggcgtcatgctcatggcat

SEQ ID NO: 363397 - DNA, 25 bp, Mus musculus
cggagtggcgtcttgctcatggcat

SEQ ID NO: 363398 - DNA, 25 bp, Mus musculus
cggagtgtcatgattgtcgtggcaa

SEQ ID NO: 363399 - DNA, 25 bp, Mus musculus
cggagtgtcatgtttgtcgtggcaa

SEQ ID NO: 363400 - DNA, 25 bp, Mus musculus
cggagtgtgatccttctggcgcaat

SEQ ID NO: 363401 - DNA, 25 bp, Mus musculus
cggagtgtgatcgttctggcgcaat

SEQ ID NO: 363402 - DNA, 25 bp, Mus musculus
cggagtgttctgcatgacttcttca

SEQ ID NO: 363403 - DNA, 25 bp, Mus musculus
cggagtgttctggatgacttcttca

SEQ ID NO: 363404 - DNA, 25 bp, Mus musculus
cggagttaggaacagaccccagcca

SEQ ID NO: 363405 - DNA, 25 bp, Mus musculus
cggagttaggaagagaccccagcca

SEQ ID NO: 363406 - DNA, 25 bp, Mus musculus
cggagttcacggctgccttcaggca

SEQ ID NO: 363407 - DNA, 25 bp, Mus musculus
cggagttcacgggtgccttcaggca

SEQ ID NO: 363408 - DNA, 25 bp, Mus musculus
cggagttcggcaccccagcagttaa

SEQ ID NO: 363409 - DNA, 25 bp, Mus musculus
cggagttcggcagcccagcagttaa

SEQ ID NO: 363410 - DNA, 25 bp, Mus musculus
cggagttctccccatctggaagtgg

SEQ ID NO: 363411 - DNA, 25 bp, Mus musculus
cggagttctcccgatctggaagtgg

SEQ ID NO: 363412 - DNA, 25 bp, Mus musculus
cggagttgcccaccagctttaatga

SEQ ID NO: 363413 - DNA, 25 bp, Mus musculus
cggagttgcccagcagctttaatga

SEQ ID NO: 363414 - DNA, 25 bp, Mus musculus
cggagttggctccacggcaactttg

SEQ ID NO: 363415 - DNA, 25 bp, Mus musculus
cggagttggctcgacggcaactttg

SEQ ID NO: 363416 - DNA, 25 bp, Mus musculus
cggagtttcaggctagttagaacta

SEQ ID NO: 363417 - DNA, 25 bp, Mus musculus
cggagtttcagggtagttagaacta

SEQ ID NO: 363418 - DNA, 25 bp, Mus musculus
cggataagacttacacgttcagagt

SEQ ID NO: 363419 - DNA, 25 bp, Mus musculus
cggataagactttcacgttcagagt

SEQ ID NO: 363420 - DNA, 25 bp, Mus musculus
cggatacagttcacgactacagaca

SEQ ID NO: 363421 - DNA, 25 bp, Mus musculus
cggatacagttctcgactacagaca

SEQ ID NO: 363422 - DNA, 25 bp, Mus musculus
cggatacatccacctatgtgcttgt

SEQ ID NO: 363423 - DNA, 25 bp, Mus musculus
cggatacatccagctatgtgcttgt

SEQ ID NO: 363424 - DNA, 25 bp, Mus musculus
cggataccacccagcgtacaaatgc

SEQ ID NO: 363425 - DNA, 25 bp, Mus musculus
cggataccaccctgcgtacaaatgc

SEQ ID NO: 363426 - DNA, 25 bp, Mus musculus
cggatacttcctccagttttgtgta

SEQ ID NO: 363427 - DNA, 25 bp, Mus musculus
cggatacttcctgcagttttgtgta

SEQ ID NO: 363428 - DNA, 25 bp, Mus musculus
cggatagccaggaaggctctcccct

SEQ ID NO: 363429 - DNA, 25 bp, Mus musculus
cggatagccaggtaggctctcccct

SEQ ID NO: 363430 - DNA, 25 bp, Mus musculus
cggatagcttttaattccagctcca

SEQ ID NO: 363431 - DNA, 25 bp, Mus musculus
cggatagctttttattccagctcca

SEQ ID NO: 363432 - DNA, 25 bp, Mus musculus
cggatattgtccactcatcttgaga

SEQ ID NO: 363433 - DNA, 25 bp, Mus musculus
cggatattgtcctctcatcttgaga

SEQ ID NO: 363434 - DNA, 25 bp, Mus musculus
cggatcaatatgattgacctgtact

SEQ ID NO: 363435 - DNA, 25 bp, Mus musculus
cggatcaatatgtttgacctgtact

SEQ ID NO: 363436 - DNA, 25 bp, Mus musculus
cggatcactgctacatgacttcaag

SEQ ID NO: 363437 - DNA, 25 bp, Mus musculus
cggatcactgcttcatgacttcaag

SEQ ID NO: 363438 - DNA, 25 bp, Mus musculus
cggatcagtggcattctaagagact

SEQ ID NO: 363439 - DNA, 25 bp, Mus musculus
cggatcagtggctttctaagagact

SEQ ID NO: 363440 - DNA, 25 bp, Mus musculus
cggatccaagaactcagtcggcctg

SEQ ID NO: 363441 - DNA, 25 bp, Mus musculus
cggatccaagaagtcagtcggcctg

SEQ ID NO: 363442 - DNA, 25 bp, Mus musculus
cggatccctgctaccaggtgggcga

SEQ ID NO: 363443 - DNA, 25 bp, Mus musculus
cggatccctgcttccaggtgggcga

SEQ ID NO: 363444 - DNA, 25 bp, Mus musculus
cggatccctttgatgattgcttctc

SEQ ID NO: 363445 - DNA, 25 bp, Mus musculus
cggatccctttgttgattgcttctc

SEQ ID NO: 363446 - DNA, 25 bp, Mus musculus
cggatcctaggccacattctcaacg

SEQ ID NO: 363447 - DNA, 25 bp, Mus musculus
cggatcctaggcgacattctcaacg

SEQ ID NO: 363448 - DNA, 25 bp, Mus musculus
cggatctagtatacagggcggacca

SEQ ID NO: 363449 - DNA, 25 bp, Mus musculus
cggatctagtattcagggcggacca

SEQ ID NO: 363450 - DNA, 25 bp, Mus musculus
cggatctattgcattatttcctcta

SEQ ID NO: 363451 - DNA, 25 bp, Mus musculus
cggatctattgctttatttcctcta

SEQ ID NO: 363452 - DNA, 25 bp, Mus musculus
cggatctcagacagaaagctaaaaa

SEQ ID NO: 363453 - DNA, 25 bp, Mus musculus
cggatctcagactgaaagctaaaaa

SEQ ID NO: 363454 - DNA, 25 bp, Mus musculus
cggatctcatgcagcggcacggctg

SEQ ID NO: 363455 - DNA, 25 bp, Mus musculus
cggatctcatgctgcggcacggctg

SEQ ID NO: 363456 - DNA, 25 bp, Mus musculus
cggatctctgtgctggcgcctgctc

SEQ ID NO: 363457 - DNA, 25 bp, Mus musculus
cggatctctgtggtggcgcctgctc

SEQ ID NO: 363458 - DNA, 25 bp, Mus musculus
cggatctggtggctactggtcggag

SEQ ID NO: 363459 - DNA, 25 bp, Mus musculus
cggatctggtgggtactggtcggag

SEQ ID NO: 363460 - DNA, 25 bp, Mus musculus
cggatctgtgatcacctcatctcta

SEQ ID NO: 363461 - DNA, 25 bp, Mus musculus
cggatctgtgatgacctcatctcta

SEQ ID NO: 363462 - DNA, 25 bp, Mus musculus
cggatcttttccacacagttgcaca

SEQ ID NO: 363463 - DNA, 25 bp, Mus musculus
cggatcttttcctcacagttgcaca

SEQ ID NO: 363464 - DNA, 25 bp, Mus musculus
cggatgaagctcagcaggcctttgg

SEQ ID NO: 363465 - DNA, 25 bp, Mus musculus
cggatgaagctctgcaggcctttgg

SEQ ID NO: 363466 - DNA, 25 bp, Mus musculus
cggatgaagtccaaatgcacaccaa

SEQ ID NO: 363467 - DNA, 25 bp, Mus musculus
cggatgaagtcctaatgcacaccaa

SEQ ID NO: 363468 - DNA, 25 bp, Mus musculus
cggatgacatgcagagggacctaca

SEQ ID NO: 363469 - DNA, 25 bp, Mus musculus
cggatgacatgcctatttaagcttc

SEQ ID NO: 363470 - DNA, 25 bp, Mus musculus
cggatgacatgcgtatttaagcttc

SEQ ID NO: 363471 - DNA, 25 bp, Mus musculus
cggatgacatgctgagggacctaca

SEQ ID NO: 363472 - DNA, 25 bp, Mus musculus
cggatgagccctatgagtttgtgga

SEQ ID NO: 363473 - DNA, 25 bp, Mus musculus
cggatgagccctttgagtttgtgga

SEQ ID NO: 363474 - DNA, 25 bp, Mus musculus
cggatgcaacgaattgcccagcagc

SEQ ID NO: 363475 - DNA, 25 bp, Mus musculus
cggatgcaacgatttgcccagcagc

SEQ ID NO: 363476 - DNA, 25 bp, Mus musculus
cggatgcacagtaactccagatcta

SEQ ID NO: 363477 - DNA, 25 bp, Mus musculus
cggatgcacagttactccagatcta

SEQ ID NO: 363478 - DNA, 25 bp, Mus musculus
cggatgccaaaaccctaactggtaa

SEQ ID NO: 363479 - DNA, 25 bp, Mus musculus
cggatgccaaaagcctaactggtaa

SEQ ID NO: 363480 - DNA, 25 bp, Mus musculus
cggatgccagcaacttggatctgat

SEQ ID NO: 363481 - DNA, 25 bp, Mus musculus
cggatgccagcatcttggatctgat

SEQ ID NO: 363482 - DNA, 25 bp, Mus musculus
cggatgctgcaacttcacggttagt

SEQ ID NO: 363483 - DNA, 25 bp, Mus musculus
cggatgctgcaagttcacggttagt

SEQ ID NO: 363484 - DNA, 25 bp, Mus musculus
cggatggattgtcctgggcccttac

SEQ ID NO: 363485 - DNA, 25 bp, Mus musculus
cggatggattgtgctgggcccttac

SEQ ID NO: 363486 - DNA, 25 bp, Mus musculus
cggatggcacatacgtagtcaggac

SEQ ID NO: 363487 - DNA, 25 bp, Mus musculus
cggatggcacattcgtagtcaggac

SEQ ID NO: 363488 - DNA, 25 bp, Mus musculus
cggatggcgcccaacaagggatctg

SEQ ID NO: 363489 - DNA, 25 bp, Mus musculus
cggatggcgccctacaagggatctg

SEQ ID NO: 363490 - DNA, 25 bp, Mus musculus
cggatgggccctaggcagactcctg

SEQ ID NO: 363491 - DNA, 25 bp, Mus musculus
cggatgggcccttggcagactcctg

SEQ ID NO: 363492 - DNA, 25 bp, Mus musculus
cggatgtaaaaactgccaagtgagc

SEQ ID NO: 363493 - DNA, 25 bp, Mus musculus
cggatgtaaaaagtgccaagtgagc

SEQ ID NO: 363494 - DNA, 25 bp, Mus musculus
cggatgtcctcaacagacagagcct

SEQ ID NO: 363495 - DNA, 25 bp, Mus musculus
cggatgtcctcatcagacagagcct

SEQ ID NO: 363496 - DNA, 25 bp, Mus musculus
cggatgtgagagaaccgttcctcta

SEQ ID NO: 363497 - DNA, 25 bp, Mus musculus
cggatgtgagagtaccgttcctcta

SEQ ID NO: 363498 - DNA, 25 bp, Mus musculus
cggatgttaactcctggacgctaag

SEQ ID NO: 363499 - DNA, 25 bp, Mus musculus
cggatgttaactgctggacgctaag

SEQ ID NO: 363500 - DNA, 25 bp, Mus musculus
cggatgttttgtctagcctgcttca

SEQ ID NO: 363501 - DNA, 25 bp, Mus musculus
cggatgttttgtgtagcctgcttca

SEQ ID NO: 363502 - DNA, 25 bp, Mus musculus
cggattacctttcttcctgaacaag

SEQ ID NO: 363503 - DNA, 25 bp, Mus musculus
cggattacctttgttcctgaacaag

SEQ ID NO: 363504 - DNA, 25 bp, Mus musculus
cggattactcccatgcaaggcaatg

SEQ ID NO: 363505 - DNA, 25 bp, Mus musculus
cggattactcccttgcaaggcaatg

SEQ ID NO: 363506 - DNA, 25 bp, Mus musculus
cggattcacaagaaattcactggga

SEQ ID NO: 363507 - DNA, 25 bp, Mus musculus
cggattcacaagtaattcactggga

SEQ ID NO: 363508 - DNA, 25 bp, Mus musculus
cggattcatttacatgcctatggct

SEQ ID NO: 363509 - DNA, 25 bp, Mus musculus
cggattcatttagatgcctatggct

SEQ ID NO: 363510 - DNA, 25 bp, Mus musculus
cggattccaatcctattttatcatt

SEQ ID NO: 363511 - DNA, 25 bp, Mus musculus
cggattccaatcgtattttatcatt

SEQ ID NO: 363512 - DNA, 25 bp, Mus musculus
cggattcgaagcaacatggccaagg

SEQ ID NO: 363513 - DNA, 25 bp, Mus musculus
cggattcgaagctacatggccaagg

SEQ ID NO: 363514 - DNA, 25 bp, Mus musculus
cggattcggaccatctatgtgcaag

SEQ ID NO: 363515 - DNA, 25 bp, Mus musculus
cggattcggaccttctatgtgcaag

SEQ ID NO: 363516 - DNA, 25 bp, Mus musculus
cggattgaacacaccaagttactag

SEQ ID NO: 363517 - DNA, 25 bp, Mus musculus
cggattgaacactccaagttactag

SEQ ID NO: 363518 - DNA, 25 bp, Mus musculus
cggattgcacatcatcgaccataat

SEQ ID NO: 363519 - DNA, 25 bp, Mus musculus
cggattgcacatgatcgaccataat

SEQ ID NO: 363520 - DNA, 25 bp, Mus musculus
cggattgtcataatcttccatcttt

SEQ ID NO: 363521 - DNA, 25 bp, Mus musculus
cggattgtcatattcttccatcttt

SEQ ID NO: 363522 - DNA, 25 bp, Mus musculus
cggattgtggcacaggccattgcta

SEQ ID NO: 363523 - DNA, 25 bp, Mus musculus
cggattgtggcagaggccattgcta

SEQ ID NO: 363524 - DNA, 25 bp, Mus musculus
cggattttcagtcatctcgacacct

SEQ ID NO: 363525 - DNA, 25 bp, Mus musculus
cggattttcagtgatctcgacacct

SEQ ID NO: 363526 - DNA, 25 bp, Mus musculus
cggcaaaaacacattctgggatgtg

SEQ ID NO: 363527 - DNA, 25 bp, Mus musculus
cggcaaaaacactttctgggatgtg

SEQ ID NO: 363528 - DNA, 25 bp, Mus musculus
cggcaaacatcaattgtatggattt

SEQ ID NO: 363529 - DNA, 25 bp, Mus musculus
cggcaaacatcatttgtatggattt

SEQ ID NO: 363530 - DNA, 25 bp, Mus musculus
cggcaaatccacaacacatttctaa

SEQ ID NO: 363531 - DNA, 25 bp, Mus musculus
cggcaaatccactacacatttctaa

SEQ ID NO: 363532 - DNA, 25 bp, Mus musculus
cggcaaattaaaagcttaccaatgc

SEQ ID NO: 363533 - DNA, 25 bp, Mus musculus
cggcaaattaaatgcttaccaatgc

SEQ ID NO: 363534 - DNA, 25 bp, Mus musculus
cggcaacacacaagtccagactgta

SEQ ID NO: 363535 - DNA, 25 bp, Mus musculus
cggcaacacacatgtccagactgta

SEQ ID NO: 363536 - DNA, 25 bp, Mus musculus
cggcaacactgtatccattgagact

SEQ ID NO: 363537 - DNA, 25 bp, Mus musculus
cggcaacactgtttccattgagact

SEQ ID NO: 363538 - DNA, 25 bp, Mus musculus
cggcaacggctgagcgtgcaaagcc

SEQ ID NO: 363539 - DNA, 25 bp, Mus musculus
cggcaacggctgtgcgtgcaaagcc

SEQ ID NO: 363540 - DNA, 25 bp, Mus musculus
cggcaactcaacacacattcggtag

SEQ ID NO: 363541 - DNA, 25 bp, Mus musculus
cggcaactcaactcacattcggtag

SEQ ID NO: 363542 - DNA, 25 bp, Mus musculus
cggcaacttcatcgatccctctgtg

SEQ ID NO: 363543 - DNA, 25 bp, Mus musculus
cggcaacttcatggatccctctgtg

SEQ ID NO: 363544 - DNA, 25 bp, Mus musculus
cggcaactttggctttgatgatcta

SEQ ID NO: 363545 - DNA, 25 bp, Mus musculus
cggcaactttgggtttgatgatcta

SEQ ID NO: 363546 - DNA, 25 bp, Mus musculus
cggcaagaaggaacgccgatgcgct

SEQ ID NO: 363547 - DNA, 25 bp, Mus musculus
cggcaagaaggatcgccgatgcgct

SEQ ID NO: 363548 - DNA, 25 bp, Mus musculus
cggcaagaccacagtgctctaccag

SEQ ID NO: 363549 - DNA, 25 bp, Mus musculus
cggcaagaccactgtgctctaccag

SEQ ID NO: 363550 - DNA, 25 bp, Mus musculus
cggcaagatattaatcaacccctct

SEQ ID NO: 363551 - DNA, 25 bp, Mus musculus
cggcaagatatttatcaacccctct

SEQ ID NO: 363552 - DNA, 25 bp, Mus musculus
cggcaagatgacagcctggtgctca

SEQ ID NO: 363553 - DNA, 25 bp, Mus musculus
cggcaagatgactgcctggtgctca

SEQ ID NO: 363554 - DNA, 25 bp, Mus musculus
cggcaagcggctaaacagaggacat

SEQ ID NO: 363555 - DNA, 25 bp, Mus musculus
cggcaagcggcttaacagaggacat

SEQ ID NO: 363556 - DNA, 25 bp, Mus musculus
cggcaagtacggcacccgctatggt

SEQ ID NO: 363557 - DNA, 25 bp, Mus musculus
cggcaagtacgggacccgctatggt

SEQ ID NO: 363558 - DNA, 25 bp, Mus musculus
cggcaagttctgattgtgctgtgaa

SEQ ID NO: 363559 - DNA, 25 bp, Mus musculus
cggcaagttctgtttgtgctgtgaa

SEQ ID NO: 363560 - DNA, 25 bp, Mus musculus
cggcaatgctttaaacggttctgta

SEQ ID NO: 363561 - DNA, 25 bp, Mus musculus
cggcaatgcttttaacggttctgta

SEQ ID NO: 363562 - DNA, 25 bp, Mus musculus
cggcacactgcacgaggttgttact

SEQ ID NO: 363563 - DNA, 25 bp, Mus musculus
cggcacactgcaggaggttgttact

SEQ ID NO: 363564 - DNA, 25 bp, Mus musculus
cggcacaggcggacgtttatgagca

SEQ ID NO: 363565 - DNA, 25 bp, Mus musculus
cggcacaggcggtcgtttatgagca

SEQ ID NO: 363566 - DNA, 25 bp, Mus musculus
cggcacatcggtcggcgcacaggct

SEQ ID NO: 363567 - DNA, 25 bp, Mus musculus
cggcacatcggtgggcgcacaggct

SEQ ID NO: 363568 - DNA, 25 bp, Mus musculus
cggcacatttggaaactttacagaa

SEQ ID NO: 363569 - DNA, 25 bp, Mus musculus
cggcacatttggtaactttacagaa

SEQ ID NO: 363570 - DNA, 25 bp, Mus musculus
cggcaccagagtattgaaggatcct

SEQ ID NO: 363571 - DNA, 25 bp, Mus musculus
cggcaccagagttttgaaggatcct

SEQ ID NO: 363572 - DNA, 25 bp, Mus musculus
cggcaccagcttagggaacggaatt

SEQ ID NO: 363573 - DNA, 25 bp, Mus musculus
cggcaccagctttgggaacggaatt

SEQ ID NO: 363574 - DNA, 25 bp, Mus musculus
cggcaccatgtgatttccatacact

SEQ ID NO: 363575 - DNA, 25 bp, Mus musculus
cggcaccatgtgttttccatacact

SEQ ID NO: 363576 - DNA, 25 bp, Mus musculus
cggcacccttatatattgaccagac

SEQ ID NO: 363577 - DNA, 25 bp, Mus musculus
cggcacccttatttattgaccagac

SEQ ID NO: 363578 - DNA, 25 bp, Mus musculus
cggcaccgcctacgaccgcaaggac

SEQ ID NO: 363579 - DNA, 25 bp, Mus musculus
cggcaccgcctaggaccgcaaggac

SEQ ID NO: 363580 - DNA, 25 bp, Mus musculus
cggcacctgctaatgaccatgctag

SEQ ID NO: 363581 - DNA, 25 bp, Mus musculus
cggcacctgctattgaccatgctag

SEQ ID NO: 363582 - DNA, 25 bp, Mus musculus
cggcacctggtaaattgtcctgata

SEQ ID NO: 363583 - DNA, 25 bp, Mus musculus
cggcacctggtatattgtcctgata

SEQ ID NO: 363584 - DNA, 25 bp, Mus musculus
cggcacgatgggagtcttggtcctt

SEQ ID NO: 363585 - DNA, 25 bp, Mus musculus
cggcacgatgggtgtcttggtcctt

SEQ ID NO: 363586 - DNA, 25 bp, Mus musculus
cggcactggagcaaacgcttgttaa

SEQ ID NO: 363587 - DNA, 25 bp, Mus musculus
cggcactggagctaacgcttgttaa

SEQ ID NO: 363588 - DNA, 25 bp, Mus musculus
cggcacttgagtcgcgccagcatca

SEQ ID NO: 363589 - DNA, 25 bp, Mus musculus
cggcacttgagtggcgccagcatca

SEQ ID NO: 363590 - DNA, 25 bp, Mus musculus
cggcacttggcaaagcttcggcaaa

SEQ ID NO: 363591 - DNA, 25 bp, Mus musculus
cggcacttggcatagcttcggcaaa

SEQ ID NO: 363592 - DNA, 25 bp, Mus musculus
cggcactttttcacagactatctga

SEQ ID NO: 363593 - DNA, 25 bp, Mus musculus
cggcactttttctcagactatctga

SEQ ID NO: 363594 - DNA, 25 bp, Mus musculus
cggcagaagatcctagagctagctc

SEQ ID NO: 363595 - DNA, 25 bp, Mus musculus
cggcagaagatcgtagagctagctc

SEQ ID NO: 363596 - DNA, 25 bp, Mus musculus
cggcagactgacacggaggcacata

SEQ ID NO: 363597 - DNA, 25 bp, Mus musculus
cggcagactgactcggaggcacata

SEQ ID NO: 363598 - DNA, 25 bp, Mus musculus
cggcagagtcctcttgtaggaagac

SEQ ID NO: 363599 - DNA, 25 bp, Mus musculus
cggcagagtcctgttgtaggaagac

SEQ ID NO: 363600 - DNA, 25 bp, Mus musculus
cggcagatgacgagaaccaactcct

SEQ ID NO: 363601 - DNA, 25 bp, Mus musculus
cggcagatgacgtgaaccaactcct

SEQ ID NO: 363602 - DNA, 25 bp, Mus musculus
cggcagatttgacttccagggctga

SEQ ID NO: 363603 - DNA, 25 bp, Mus musculus
cggcagatttgagttccagggctga

SEQ ID NO: 363604 - DNA, 25 bp, Mus musculus
cggcagcacttgagttctggtcctc

SEQ ID NO: 363605 - DNA, 25 bp, Mus musculus
cggcagcacttgtgttctggtcctc

SEQ ID NO: 363606 - DNA, 25 bp, Mus musculus
cggcagcatatgcagcccgtgctaa

SEQ ID NO: 363607 - DNA, 25 bp, Mus musculus
cggcagcatatggagcccgtgctaa

SEQ ID NO: 363608 - DNA, 25 bp, Mus musculus
cggcagcatttcacccctacaagat

SEQ ID NO: 363609 - DNA, 25 bp, Mus musculus
cggcagcatttctcccctacaagat

SEQ ID NO: 363610 - DNA, 25 bp, Mus musculus
cggcagccagatctaccagtagatg

SEQ ID NO: 363611 - DNA, 25 bp, Mus musculus
cggcagccagatgtaccagtagatg

SEQ ID NO: 363612 - DNA, 25 bp, Mus musculus
cggcagctacggctggcctatcgac

SEQ ID NO: 363613 - DNA, 25 bp, Mus musculus
cggcagctacgggtggcctatcgac

SEQ ID NO: 363614 - DNA, 25 bp, Mus musculus
cggcagctacttaaacgacgttcaa

SEQ ID NO: 363615 - DNA, 25 bp, Mus musculus
cggcagctactttaacgacgttcaa

SEQ ID NO: 363616 - DNA, 25 bp, Mus musculus
cggcagctgaaacttgttgtctcca

SEQ ID NO: 363617 - DNA, 25 bp, Mus musculus
cggcagctgaaagttgttgtctcca

SEQ ID NO: 363618 - DNA, 25 bp, Mus musculus
cggcagcttggcactgtctcaatat

SEQ ID NO: 363619 - DNA, 25 bp, Mus musculus
cggcagcttggctctgtctcaatat

SEQ ID NO: 363620 - DNA, 25 bp, Mus musculus
cggcaggaccccactgtgaagagga

SEQ ID NO: 363621 - DNA, 25 bp, Mus musculus
cggcaggacccctctgtgaagagga

SEQ ID NO: 363622 - DNA, 25 bp, Mus musculus
cggcaggagcacatgagcgaaatat

SEQ ID NO: 363623 - DNA, 25 bp, Mus musculus
cggcaggagcacttgagcgaaatat

SEQ ID NO: 363624 - DNA, 25 bp, Mus musculus
cggcaggatcgacgcgcttctgtat

SEQ ID NO: 363625 - DNA, 25 bp, Mus musculus
cggcaggatcgaggcgcttctgtat

SEQ ID NO: 363626 - DNA, 25 bp, Mus musculus
cggcagggatttctaccgctgtgcc

SEQ ID NO: 363627 - DNA, 25 bp, Mus musculus
cggcagggatttgtaccgctgtgcc

SEQ ID NO: 363628 - DNA, 25 bp, Mus musculus
cggcagggctgaacttctcatacag

SEQ ID NO: 363629 - DNA, 25 bp, Mus musculus
cggcagggctgatcttctcatacag

SEQ ID NO: 363630 - DNA, 25 bp, Mus musculus
cggcagggctgcatcaatgagatta

SEQ ID NO: 363631 - DNA, 25 bp, Mus musculus
cggcagggctgcttcaatgagatta

SEQ ID NO: 363632 - DNA, 25 bp, Mus musculus
cggcagggtcatcttcctaggacaa

SEQ ID NO: 363633 - DNA, 25 bp, Mus musculus
cggcagggtcatgttcctaggacaa

SEQ ID NO: 363634 - DNA, 25 bp, Mus musculus
cggcagtaatccaacagtaccatac

SEQ ID NO: 363635 - DNA, 25 bp, Mus musculus
cggcagtaatcctacagtaccatac

SEQ ID NO: 363636 - DNA, 25 bp, Mus musculus
cggcagtcctgcaagctgctagtga

SEQ ID NO: 363637 - DNA, 25 bp, Mus musculus
cggcagtcctgctagctgctagtga

SEQ ID NO: 363638 - DNA, 25 bp, Mus musculus
cggcatagctatctaccagagtgta

SEQ ID NO: 363639 - DNA, 25 bp, Mus musculus
cggcatagctatgtaccagagtgta

SEQ ID NO: 363640 - DNA, 25 bp, Mus musculus
cggcatattctcctcattggtaaat

SEQ ID NO: 363641 - DNA, 25 bp, Mus musculus
cggcatattctcgtcattggtaaat

SEQ ID NO: 363642 - DNA, 25 bp, Mus musculus
cggcatcacttactaacacacaaca

SEQ ID NO: 363643 - DNA, 25 bp, Mus musculus
cggcatcacttagtaacacacaaca

SEQ ID NO: 363644 - DNA, 25 bp, Mus musculus
cggcatcattcaagctctggccagc

SEQ ID NO: 363645 - DNA, 25 bp, Mus musculus
cggcatcattcatgctctggccagc

SEQ ID NO: 363646 - DNA, 25 bp, Mus musculus
cggcatccactgacgggaaactgtg

SEQ ID NO: 363647 - DNA, 25 bp, Mus musculus
cggcatccactgtcgggaaactgtg

SEQ ID NO: 363648 - DNA, 25 bp, Mus musculus
cggcatccataactgttccatcaat

SEQ ID NO: 363649 - DNA, 25 bp, Mus musculus
cggcatccataagtgttccatcaat

SEQ ID NO: 363650 - DNA, 25 bp, Mus musculus
cggcatctaagcacactgggaacaa

SEQ ID NO: 363651 - DNA, 25 bp, Mus musculus
cggcatctaagctcactgggaacaa

SEQ ID NO: 363652 - DNA, 25 bp, Mus musculus
cggcatctacctctttggcgagaag

SEQ ID NO: 363653 - DNA, 25 bp, Mus musculus
cggcatctacctgtttggcgagaag

SEQ ID NO: 363654 - DNA, 25 bp, Mus musculus
cggcatctagtgaacctcaccagag

SEQ ID NO: 363655 - DNA, 25 bp, Mus musculus
cggcatctagtgtacctcaccagag

SEQ ID NO: 363656 - DNA, 25 bp, Mus musculus
cggcatctccggctgggccttaaag

SEQ ID NO: 363657 - DNA, 25 bp, Mus musculus
cggcatctccgggtgggccttaaag

SEQ ID NO: 363658 - DNA, 25 bp, Mus musculus
cggcatctcggacagcgacctggca

SEQ ID NO: 363659 - DNA, 25 bp, Mus musculus
cggcatctcggagagcgacctggca

SEQ ID NO: 363660 - DNA, 25 bp, Mus musculus
cggcatcttacaacaacggaggcta

SEQ ID NO: 363661 - DNA, 25 bp, Mus musculus
cggcatcttacatcaacggaggcta

SEQ ID NO: 363662 - DNA, 25 bp, Mus musculus
cggcatctttcactgcagcatggaa

SEQ ID NO: 363663 - DNA, 25 bp, Mus musculus
cggcatctttcagtgcagcatggaa

SEQ ID NO: 363664 - DNA, 25 bp, Mus musculus
cggcatgacccaacaaagcctgtat

SEQ ID NO: 363665 - DNA, 25 bp, Mus musculus
cggcatgacccatcaaagcctgtat

SEQ ID NO: 363666 - DNA, 25 bp, Mus musculus
cggcatgagggacatgaattactac

SEQ ID NO: 363667 - DNA, 25 bp, Mus musculus
cggcatgagggagatgaattactac

SEQ ID NO: 363668 - DNA, 25 bp, Mus musculus
cggcatgcgctgaggattttcacaa

SEQ ID NO: 363669 - DNA, 25 bp, Mus musculus
cggcatgcgctgtggattttcacaa

SEQ ID NO: 363670 - DNA, 25 bp, Mus musculus
cggccaacaggcatcggatgattaa

SEQ ID NO: 363671 - DNA, 25 bp, Mus musculus
cggccaacaggcttcggatgattaa

SEQ ID NO: 363672 - DNA, 25 bp, Mus musculus
cggccaagatggctttctgcatgga

SEQ ID NO: 363673 - DNA, 25 bp, Mus musculus
cggccaagatgggtttctgcatgga

SEQ ID NO: 363674 - DNA, 25 bp, Mus musculus
cggccacatcctcgctctgtgtgtg

SEQ ID NO: 363675 - DNA, 25 bp, Mus musculus
cggccacatcctggctctgtgtgtg

SEQ ID NO: 363676 - DNA, 25 bp, Mus musculus
cggccacatgtgctcacctggagga

SEQ ID NO: 363677 - DNA, 25 bp, Mus musculus
cggccacatgtggtcacctggagga

SEQ ID NO: 363678 - DNA, 25 bp, Mus musculus
cggccaccttgtactttgtgagagc

SEQ ID NO: 363679 - DNA, 25 bp, Mus musculus
cggccaccttgttctttgtgagagc

SEQ ID NO: 363680 - DNA, 25 bp, Mus musculus
cggccactttcgctggcattgaaaa

SEQ ID NO: 363681 - DNA, 25 bp, Mus musculus
cggccactttcggtggcattgaaaa

SEQ ID NO: 363682 - DNA, 25 bp, Mus musculus
cggccagatcgcactgcttgagatg

SEQ ID NO: 363683 - DNA, 25 bp, Mus musculus
cggccagatcgctctgcttgagatg

SEQ ID NO: 363684 - DNA, 25 bp, Mus musculus
cggccagattcgcaacagcgtcaac

SEQ ID NO: 363685 - DNA, 25 bp, Mus musculus
cggccagattcggaacagcgtcaac

SEQ ID NO: 363686 - DNA, 25 bp, Mus musculus
cggccagctagtccgtgacaaagtt

SEQ ID NO: 363687 - DNA, 25 bp, Mus musculus
cggccagctagtgcgtgacaaagtt

SEQ ID NO: 363688 - DNA, 25 bp, Mus musculus
cggccagctatcctgtcgtgaattg

SEQ ID NO: 363689 - DNA, 25 bp, Mus musculus
cggccagctatcgtgtcgtgaattg

SEQ ID NO: 363690 - DNA, 25 bp, Mus musculus
cggccagcttcactttctctgtggg

SEQ ID NO: 363691 - DNA, 25 bp, Mus musculus
cggccagcttcagtttctctgtggg

SEQ ID NO: 363692 - DNA, 25 bp, Mus musculus
cggccagtcattattccaactgcag

SEQ ID NO: 363693 - DNA, 25 bp, Mus musculus
cggccagtcatttttccaactgcag

SEQ ID NO: 363694 - DNA, 25 bp, Mus musculus
cggccagtgagtcctttcatgaaca

SEQ ID NO: 363695 - DNA, 25 bp, Mus musculus
cggccagtgagtgctttcatgaaca

SEQ ID NO: 363696 - DNA, 25 bp, Mus musculus
cggccagtgattaccttccttaaat

SEQ ID NO: 363697 - DNA, 25 bp, Mus musculus
cggccagtgatttccttccttaaat

SEQ ID NO: 363698 - DNA, 25 bp, Mus musculus
cggccagttcctaaatgggagcatt

SEQ ID NO: 363699 - DNA, 25 bp, Mus musculus
cggccagttccttaatgggagcatt

SEQ ID NO: 363700 - DNA, 25 bp, Mus musculus
cggccatcggatcagtttgatcacg

SEQ ID NO: 363701 - DNA, 25 bp, Mus musculus
cggccatcggatgagtttgatcacg

SEQ ID NO: 363702 - DNA, 25 bp, Mus musculus
cggccatggaaacccacttcatgaa

SEQ ID NO: 363703 - DNA, 25 bp, Mus musculus
cggccatggaaagccacttcatgaa

SEQ ID NO: 363704 - DNA, 25 bp, Mus musculus
cggccatgtggcaatgcggcaatgc

SEQ ID NO: 363705 - DNA, 25 bp, Mus musculus
cggccatgtggctatgcggcaatgc

SEQ ID NO: 363706 - DNA, 25 bp, Mus musculus
cggccattccccatgattgatgaga

SEQ ID NO: 363707 - DNA, 25 bp, Mus musculus
cggccattccccttgattgatgaga

SEQ ID NO: 363708 - DNA, 25 bp, Mus musculus
cggccattcgcgaggttcattgagg

SEQ ID NO: 363709 - DNA, 25 bp, Mus musculus
cggccattcgcgtggttcattgagg

SEQ ID NO: 363710 - DNA, 25 bp, Mus musculus
cggcccaaaagtaattttctggcat

SEQ ID NO: 363711 - DNA, 25 bp, Mus musculus
cggcccaaaagttattttctggcat

SEQ ID NO: 363712 - DNA, 25 bp, Mus musculus
cggcccagaccactgactcggagaa

SEQ ID NO: 363713 - DNA, 25 bp, Mus musculus
cggcccagaccagtgactcggagaa

SEQ ID NO: 363714 - DNA, 25 bp, Mus musculus
cggcccagtttgatgatcacgtaat

SEQ ID NO: 363715 - DNA, 25 bp, Mus musculus
cggcccagtttgttgatcacgtaat

SEQ ID NO: 363716 - DNA, 25 bp, Mus musculus
cggccccatggcagagctctacggg

SEQ ID NO: 363717 - DNA, 25 bp, Mus musculus
cggccccatggctgagctctacggg

SEQ ID NO: 363718 - DNA, 25 bp, Mus musculus
cggccccatggtatacacagagtct

SEQ ID NO: 363719 - DNA, 25 bp, Mus musculus
cggccccatggtttacacagagtct

SEQ ID NO: 363720 - DNA, 25 bp, Mus musculus
cggccccctcggcagaaagatgact

SEQ ID NO: 363721 - DNA, 25 bp, Mus musculus
cggccccctcgggagaaagatgact

SEQ ID NO: 363722 - DNA, 25 bp, Mus musculus
cggccccgccgaagcacagggtgat

SEQ ID NO: 363723 - DNA, 25 bp, Mus musculus
cggccccgccgatgcacagggtgat

SEQ ID NO: 363724 - DNA, 25 bp, Mus musculus
cggcccctgaagaccttgagaacat

SEQ ID NO: 363725 - DNA, 25 bp, Mus musculus
cggcccctgaagtccttgagaacat

SEQ ID NO: 363726 - DNA, 25 bp, Mus musculus
cggcccggacacagggaggacattc

SEQ ID NO: 363727 - DNA, 25 bp, Mus musculus
cggcccggacactgggaggacattc

SEQ ID NO: 363728 - DNA, 25 bp, Mus musculus
cggccctcgagtagattggattgtt

SEQ ID NO: 363729 - DNA, 25 bp, Mus musculus
cggccctcgagttgattggattgtt

SEQ ID NO: 363730 - DNA, 25 bp, Mus musculus
cggccctgagtaattcccagttatt

SEQ ID NO: 363731 - DNA, 25 bp, Mus musculus
cggccctgagtatttcccagttatt

SEQ ID NO: 363732 - DNA, 25 bp, Mus musculus
cggccctgcctgaattgtggataga

SEQ ID NO: 363733 - DNA, 25 bp, Mus musculus
cggccctgcctgtattgtggataga

SEQ ID NO: 363734 - DNA, 25 bp, Mus musculus
cggccctgctgtcttggtttagcaa

SEQ ID NO: 363735 - DNA, 25 bp, Mus musculus
cggccctgctgtgttggtttagcaa

SEQ ID NO: 363736 - DNA, 25 bp, Mus musculus
cggccctggctcaggattaaggcca

SEQ ID NO: 363737 - DNA, 25 bp, Mus musculus
cggccctggctctggattaaggcca

SEQ ID NO: 363738 - DNA, 25 bp, Mus musculus
cggccgccatgtctaaatacgtgaa

SEQ ID NO: 363739 - DNA, 25 bp, Mus musculus
cggccgccatgtgtaaatacgtgaa

SEQ ID NO: 363740 - DNA, 25 bp, Mus musculus
cggccgccttcaatagagcaacgag

SEQ ID NO: 363741 - DNA, 25 bp, Mus musculus
cggccgccttcattagagcaacgag

SEQ ID NO: 363742 - DNA, 25 bp, Mus musculus
cggccgtaatgcaagaatgtcagca

SEQ ID NO: 363743 - DNA, 25 bp, Mus musculus
cggccgtaatgctagaatgtcagca

SEQ ID NO: 363744 - DNA, 25 bp, Mus musculus
cggccgtccgacagcagctggcaga

SEQ ID NO: 363745 - DNA, 25 bp, Mus musculus
cggccgtccgactgcagctggcaga

SEQ ID NO: 363746 - DNA, 25 bp, Mus musculus
cggccgttcctgatggtgatatatt

SEQ ID NO: 363747 - DNA, 25 bp, Mus musculus
cggccgttcctgttggtgatatatt

SEQ ID NO: 363748 - DNA, 25 bp, Mus musculus
cggcctaagtcactgtgggtacagc

SEQ ID NO: 363749 - DNA, 25 bp, Mus musculus
cggcctaagtcagtgtgggtacagc

SEQ ID NO: 363750 - DNA, 25 bp, Mus musculus
cggcctagctttaccaacctggaag

SEQ ID NO: 363751 - DNA, 25 bp, Mus musculus
cggcctagcttttccaacctggaag

SEQ ID NO: 363752 - DNA, 25 bp, Mus musculus
cggcctagtaaaatctgcttcttga

SEQ ID NO: 363753 - DNA, 25 bp, Mus musculus
cggcctagtaaattctgcttcttga

SEQ ID NO: 363754 - DNA, 25 bp, Mus musculus
cggcctcaatgtctccacagggaaa

SEQ ID NO: 363755 - DNA, 25 bp, Mus musculus
cggcctcaatgtgtccacagggaaa

SEQ ID NO: 363756 - DNA, 25 bp, Mus musculus
cggcctcagagcactacgatgatga

SEQ ID NO: 363757 - DNA, 25 bp, Mus musculus
cggcctcagagctctacgatgatga

SEQ ID NO: 363758 - DNA, 25 bp, Mus musculus
cggcctcatgaaccgcaggagctcg

SEQ ID NO: 363759 - DNA, 25 bp, Mus musculus
cggcctcatgaagcgcaggagctcg

SEQ ID NO: 363760 - DNA, 25 bp, Mus musculus
cggcctcattgaatcgctcatctac

SEQ ID NO: 363761 - DNA, 25 bp, Mus musculus
cggcctcattgattcgctcatctac

SEQ ID NO: 363762 - DNA, 25 bp, Mus musculus
cggcctccagctctactaaagatat

SEQ ID NO: 363763 - DNA, 25 bp, Mus musculus
cggcctccagctgtactaaagatat

SEQ ID NO: 363764 - DNA, 25 bp, Mus musculus
cggcctccattaaaggacacctgta

SEQ ID NO: 363765 - DNA, 25 bp, Mus musculus
cggcctccattataggacacctgta

SEQ ID NO: 363766 - DNA, 25 bp, Mus musculus
cggcctcccaataacggacagaagt

SEQ ID NO: 363767 - DNA, 25 bp, Mus musculus
cggcctcccaattacggacagaagt

SEQ ID NO: 363768 - DNA, 25 bp, Mus musculus
cggcctgatgctcttcgctagggta

SEQ ID NO: 363769 - DNA, 25 bp, Mus musculus
cggcctgatgctgttcgctagggta

SEQ ID NO: 363770 - DNA, 25 bp, Mus musculus
cggcctgcatgacgatgacgagacc

SEQ ID NO: 363771 - DNA, 25 bp, Mus musculus
cggcctgcatgaggatgacgagacc

SEQ ID NO: 363772 - DNA, 25 bp, Mus musculus
cggcctgctgctctagaactgcata

SEQ ID NO: 363773 - DNA, 25 bp, Mus musculus
cggcctgctgctgtagaactgcata

SEQ ID NO: 363774 - DNA, 25 bp, Mus musculus
cggcctggattcactgcacaagaac

SEQ ID NO: 363775 - DNA, 25 bp, Mus musculus
cggcctggattctctgcacaagaac

SEQ ID NO: 363776 - DNA, 25 bp, Mus musculus
cggcctgtacacatccaattagcgt

SEQ ID NO: 363777 - DNA, 25 bp, Mus musculus
cggcctgtacacttccaattagcgt

SEQ ID NO: 363778 - DNA, 25 bp, Mus musculus
cggcctgtgcaaaagtcctgtgaca

SEQ ID NO: 363779 - DNA, 25 bp, Mus musculus
cggcctgtgcaatagtcctgtgaca

SEQ ID NO: 363780 - DNA, 25 bp, Mus musculus
cggcctgttttactcaatgcatcat

SEQ ID NO: 363781 - DNA, 25 bp, Mus musculus
cggcctgttttagtcaatgcatcat

SEQ ID NO: 363782 - DNA, 25 bp, Mus musculus
cggccttactgtcctctgtctgaaa

SEQ ID NO: 363783 - DNA, 25 bp, Mus musculus
cggccttactgtgctctgtctgaaa

SEQ ID NO: 363784 - DNA, 25 bp, Mus musculus
cggccttctaagcacacagtttcaa

SEQ ID NO: 363785 - DNA, 25 bp, Mus musculus
cggccttctaaggacacagtttcaa

SEQ ID NO: 363786 - DNA, 25 bp, Mus musculus
cggccttgcagccaggaaagcaact

SEQ ID NO: 363787 - DNA, 25 bp, Mus musculus
cggccttgcagcgaggaaagcaact

SEQ ID NO: 363788 - DNA, 25 bp, Mus musculus
cggccttggcatatacatcactggt

SEQ ID NO: 363789 - DNA, 25 bp, Mus musculus
cggccttggcatttacatcactggt

SEQ ID NO: 363790 - DNA, 25 bp, Mus musculus
cggccttggtggaacgtgtctgtaa

SEQ ID NO: 363791 - DNA, 25 bp, Mus musculus
cggccttggtggtacgtgtctgtaa

SEQ ID NO: 363792 - DNA, 25 bp, Mus musculus
cggccttgtgggacctgtatgcttt

SEQ ID NO: 363793 - DNA, 25 bp, Mus musculus
cggccttgtgggtcctgtatgcttt

SEQ ID NO: 363794 - DNA, 25 bp, Mus musculus
cggcctttgaccaaactccacacac

SEQ ID NO: 363795 - DNA, 25 bp, Mus musculus
cggcctttgacctaactccacacac

SEQ ID NO: 363796 - DNA, 25 bp, Mus musculus
cggcctttgcagcatcgtggatgat

SEQ ID NO: 363797 - DNA, 25 bp, Mus musculus
cggcctttgcaggatcgtggatgat

SEQ ID NO: 363798 - DNA, 25 bp, Mus musculus
cggccttttgccaaccatctttcga

SEQ ID NO: 363799 - DNA, 25 bp, Mus musculus
cggccttttgcctaccatctttcga

SEQ ID NO: 363800 - DNA, 25 bp, Mus musculus
cggcgaacctcactacgtgcagtat

SEQ ID NO: 363801 - DNA, 25 bp, Mus musculus
cggcgaacctcagtacgtgcagtat

SEQ ID NO: 363802 - DNA, 25 bp, Mus musculus
cggcgaactgttcggtctctgacct

SEQ ID NO: 363803 - DNA, 25 bp, Mus musculus
cggcgaactgttgggtctctgacct

SEQ ID NO: 363804 - DNA, 25 bp, Mus musculus
cggcgacagcggaaagatcgtgatc

SEQ ID NO: 363805 - DNA, 25 bp, Mus musculus
cggcgacagcggtaagatcgtgatc

SEQ ID NO: 363806 - DNA, 25 bp, Mus musculus
cggcgacttccacacagaggtgtga

SEQ ID NO: 363807 - DNA, 25 bp, Mus musculus
cggcgacttccagacagaggtgtga

SEQ ID NO: 363808 - DNA, 25 bp, Mus musculus
cggcgagtgaagagaaccaaggctt

SEQ ID NO: 363809 - DNA, 25 bp, Mus musculus
cggcgagtgaagtgaaccaaggctt

SEQ ID NO: 363810 - DNA, 25 bp, Mus musculus
cggcgatgctcgcaggtttcagata

SEQ ID NO: 363811 - DNA, 25 bp, Mus musculus
cggcgatgctcggaggtttcagata

SEQ ID NO: 363812 - DNA, 25 bp, Mus musculus
cggcgatggcagagtgttcttgctc

SEQ ID NO: 363813 - DNA, 25 bp, Mus musculus
cggcgatggcagtgtgttcttgctc

SEQ ID NO: 363814 - DNA, 25 bp, Mus musculus
cggcgatgtagaatgcacgtctcat

SEQ ID NO: 363815 - DNA, 25 bp, Mus musculus
cggcgatgtagattgcacgtctcat

SEQ ID NO: 363816 - DNA, 25 bp, Mus musculus
cggcgcagagaaagagtagctcttg

SEQ ID NO: 363817 - DNA, 25 bp, Mus musculus
cggcgcagagaatgagtagctcttg

SEQ ID NO: 363818 - DNA, 25 bp, Mus musculus
cggcgcctgtctatcaagggcttgt

SEQ ID NO: 363819 - DNA, 25 bp, Mus musculus
cggcgcctgtctttcaagggcttgt

SEQ ID NO: 363820 - DNA, 25 bp, Mus musculus
cggcgcgatattcgcctcattttcc

SEQ ID NO: 363821 - DNA, 25 bp, Mus musculus
cggcgcgatattggcctcattttcc

SEQ ID NO: 363822 - DNA, 25 bp, Mus musculus
cggcgcgcatctccaggtaaaggca

SEQ ID NO: 363823 - DNA, 25 bp, Mus musculus
cggcgcgcatctgcaggtaaaggca

SEQ ID NO: 363824 - DNA, 25 bp, Mus musculus
cggcgcgtcggtcacaaggttgcga

SEQ ID NO: 363825 - DNA, 25 bp, Mus musculus
cggcgcgtcggtgacaaggttgcga

SEQ ID NO: 363826 - DNA, 25 bp, Mus musculus
cggcgctactatcagaactacgtgg

SEQ ID NO: 363827 - DNA, 25 bp, Mus musculus
cggcgctactatgagaactacgtgg

SEQ ID NO: 363828 - DNA, 25 bp, Mus musculus
cggcgctgcgtgacctacctgatgg

SEQ ID NO: 363829 - DNA, 25 bp, Mus musculus
cggcgctgcgtgtcctacctgatgg

SEQ ID NO: 363830 - DNA, 25 bp, Mus musculus
cggcgctttgctctgttggatttct

SEQ ID NO: 363831 - DNA, 25 bp, Mus musculus
cggcgctttgctgtgttggatttct

SEQ ID NO: 363832 - DNA, 25 bp, Mus musculus
cggcggacttgtcatcggcctgcat

SEQ ID NO: 363833 - DNA, 25 bp, Mus musculus
cggcggacttgtgatcggcctgcat

SEQ ID NO: 363834 - DNA, 25 bp, Mus musculus
cggcggatttcgcaactggaaatga

SEQ ID NO: 363835 - DNA, 25 bp, Mus musculus
cggcggatttcggaactggaaatga

SEQ ID NO: 363836 - DNA, 25 bp, Mus musculus
cggcggcagctcagccgaaggaaca

SEQ ID NO: 363837 - DNA, 25 bp, Mus musculus
cggcggcagctctgccgaaggaaca

SEQ ID NO: 363838 - DNA, 25 bp, Mus musculus
cggcggcccgggaaggtcactatgg

SEQ ID NO: 363839 - DNA, 25 bp, Mus musculus
cggcggcccgggtaggtcactatgg

SEQ ID NO: 363840 - DNA, 25 bp, Mus musculus
cggcggcgcatcaactgtgagcagt

SEQ ID NO: 363841 - DNA, 25 bp, Mus musculus
cggcggcgcatctactgtgagcagt

SEQ ID NO: 363842 - DNA, 25 bp, Mus musculus
cggcggctggctattcaaaactgat

SEQ ID NO: 363843 - DNA, 25 bp, Mus musculus
cggcggctggcttttcaaaactgat

SEQ ID NO: 363844 - DNA, 25 bp, Mus musculus
cggcggcttgaacagcccaatgtcg

SEQ ID NO: 363845 - DNA, 25 bp, Mus musculus
cggcggcttgaagagcccaatgtcg

SEQ ID NO: 363846 - DNA, 25 bp, Mus musculus
cggcgggcatatcgcacgaactaca

SEQ ID NO: 363847 - DNA, 25 bp, Mus musculus
cggcgggcatatggcacgaactaca

SEQ ID NO: 363848 - DNA, 25 bp, Mus musculus
cggcgggtaccgagaagatagaact

SEQ ID NO: 363849 - DNA, 25 bp, Mus musculus
cggcgggtaccgtgaagatagaact

SEQ ID NO: 363850 - DNA, 25 bp, Mus musculus
cggcggtcttcgaccctgaaggaga

SEQ ID NO: 363851 - DNA, 25 bp, Mus musculus
cggcggtcttcgtccctgaaggaga

SEQ ID NO: 363852 - DNA, 25 bp, Mus musculus
cggcggtgtcggaagaaaacttcat

SEQ ID NO: 363853 - DNA, 25 bp, Mus musculus
cggcggtgtcggtagaaaacttcat

SEQ ID NO: 363854 - DNA, 25 bp, Mus musculus
cggcgtagacgacaggaagagatga

SEQ ID NO: 363855 - DNA, 25 bp, Mus musculus
cggcgtagacgagaggaagagatga

SEQ ID NO: 363856 - DNA, 25 bp, Mus musculus
cggcgtccgggcaaaatgtacttag

SEQ ID NO: 363857 - DNA, 25 bp, Mus musculus
cggcgtccgggctaaatgtacttag

SEQ ID NO: 363858 - DNA, 25 bp, Mus musculus
cggcgtgtcctgaagctgctagagt

SEQ ID NO: 363859 - DNA, 25 bp, Mus musculus
cggcgtgtcctgtagctgctagagt

SEQ ID NO: 363860 - DNA, 25 bp, Mus musculus
cggcgtgttggacgtctagcacata

SEQ ID NO: 363861 - DNA, 25 bp, Mus musculus
cggcgtgttggaggtctagcacata

SEQ ID NO: 363862 - DNA, 25 bp, Mus musculus
cggcgttcctcgataacagcaagtt

SEQ ID NO: 363863 - DNA, 25 bp, Mus musculus
cggcgttcctcgttaacagcaagtt

SEQ ID NO: 363864 - DNA, 25 bp, Mus musculus
cggctacaccagagactatcgggca

SEQ ID NO: 363865 - DNA, 25 bp, Mus musculus
cggctacaccagtgactatcgggca

SEQ ID NO: 363866 - DNA, 25 bp, Mus musculus
cggctacagcctccatttttatgca

SEQ ID NO: 363867 - DNA, 25 bp, Mus musculus
cggctacagcctgcatttttatgca

SEQ ID NO: 363868 - DNA, 25 bp, Mus musculus
cggctaccacatccaaggaaggcag

SEQ ID NO: 363869 - DNA, 25 bp, Mus musculus
cggctaccacatgcaaggaaggcag

SEQ ID NO: 363870 - DNA, 25 bp, Mus musculus
cggctagaactgaggcgtcgcacaa

SEQ ID NO: 363871 - DNA, 25 bp, Mus musculus
cggctagaactgtggcgtcgcacaa

SEQ ID NO: 363872 - DNA, 25 bp, Mus musculus
cggctatctctgattgcacatgtaa

SEQ ID NO: 363873 - DNA, 25 bp, Mus musculus
cggctatctctgtttgcacatgtaa

SEQ ID NO: 363874 - DNA, 25 bp, Mus musculus
cggctatctcttactgcttaggtaa

SEQ ID NO: 363875 - DNA, 25 bp, Mus musculus
cggctatctctttctgcttaggtaa

SEQ ID NO: 363876 - DNA, 25 bp, Mus musculus
cggctattctcccagaggttccagg

SEQ ID NO: 363877 - DNA, 25 bp, Mus musculus
cggctattctccgagaggttccagg

SEQ ID NO: 363878 - DNA, 25 bp, Mus musculus
cggctcaagataaggctatggctgt

SEQ ID NO: 363879 - DNA, 25 bp, Mus musculus
cggctcaagatatggctatggctgt

SEQ ID NO: 363880 - DNA, 25 bp, Mus musculus
cggctcacacagaacatggacggaa

SEQ ID NO: 363881 - DNA, 25 bp, Mus musculus
cggctcacacagtacatggacggaa

SEQ ID NO: 363882 - DNA, 25 bp, Mus musculus
cggctcagacgacggcagtgttatc

SEQ ID NO: 363883 - DNA, 25 bp, Mus musculus
cggctcagacgagggcagtgttatc

SEQ ID NO: 363884 - DNA, 25 bp, Mus musculus
cggctcagagcgcgtcatctccgga

SEQ ID NO: 363885 - DNA, 25 bp, Mus musculus
cggctcagagcgggtcatctccgga

SEQ ID NO: 363886 - DNA, 25 bp, Mus musculus
cggctcagtgtgaatgcttttcctt

SEQ ID NO: 363887 - DNA, 25 bp, Mus musculus
cggctcagtgtgtatgcttttcctt

SEQ ID NO: 363888 - DNA, 25 bp, Mus musculus
cggctcatcacaaccatattcaaaa

SEQ ID NO: 363889 - DNA, 25 bp, Mus musculus
cggctcatcacatccatattcaaaa

SEQ ID NO: 363890 - DNA, 25 bp, Mus musculus
cggctcattgtgcttggttctgaaa

SEQ ID NO: 363891 - DNA, 25 bp, Mus musculus
cggctcattgtggttggttctgaaa

SEQ ID NO: 363892 - DNA, 25 bp, Mus musculus
cggctcatttatccttttagacaga

SEQ ID NO: 363893 - DNA, 25 bp, Mus musculus
cggctcatttatgcttttagacaga

SEQ ID NO: 363894 - DNA, 25 bp, Mus musculus
cggctccagatcatacttcacgtgg

SEQ ID NO: 363895 - DNA, 25 bp, Mus musculus
cggctccagatcttacttcacgtgg

SEQ ID NO: 363896 - DNA, 25 bp, Mus musculus
cggctccctatcagggtcctgaaga

SEQ ID NO: 363897 - DNA, 25 bp, Mus musculus
cggctccctatctgggtcctgaaga

SEQ ID NO: 363898 - DNA, 25 bp, Mus musculus
cggctccctgttcatagtaaaccag

SEQ ID NO: 363899 - DNA, 25 bp, Mus musculus
cggctccctgttgatagtaaaccag

SEQ ID NO: 363900 - DNA, 25 bp, Mus musculus
cggctcgactaccaaaggacgtctg

SEQ ID NO: 363901 - DNA, 25 bp, Mus musculus
cggctcgactacgaaaggacgtctg

SEQ ID NO: 363902 - DNA, 25 bp, Mus musculus
cggctcgtctatctggtgctagaag

SEQ ID NO: 363903 - DNA, 25 bp, Mus musculus
cggctcgtctatgtggtgctagaag

SEQ ID NO: 363904 - DNA, 25 bp, Mus musculus
cggctctcagagcacttagtgctac

SEQ ID NO: 363905 - DNA, 25 bp, Mus musculus
cggctctcagaggacttagtgctac

SEQ ID NO: 363906 - DNA, 25 bp, Mus musculus
cggctctcctagctctggaagaaaa

SEQ ID NO: 363907 - DNA, 25 bp, Mus musculus
cggctctcctaggtctggaagaaaa

SEQ ID NO: 363908 - DNA, 25 bp, Mus musculus
cggctctcgtttatggtcatccaat

SEQ ID NO: 363909 - DNA, 25 bp, Mus musculus
cggctctcgtttttggtcatccaat

SEQ ID NO: 363910 - DNA, 25 bp, Mus musculus
cggctctgcacaacccagggagtgg

SEQ ID NO: 363911 - DNA, 25 bp, Mus musculus
cggctctgcacatcccagggagtgg

SEQ ID NO: 363912 - DNA, 25 bp, Mus musculus
cggctctggtagaccgttctggaat

SEQ ID NO: 363913 - DNA, 25 bp, Mus musculus
cggctctggtagtccgttctggaat

SEQ ID NO: 363914 - DNA, 25 bp, Mus musculus
cggctctgtaggatgctgcagtgaa

SEQ ID NO: 363915 - DNA, 25 bp, Mus musculus
cggctctgtaggttgctgcagtgaa

SEQ ID NO: 363916 - DNA, 25 bp, Mus musculus
cggctcttcactactttattgatgg

SEQ ID NO: 363917 - DNA, 25 bp, Mus musculus
cggctcttcacttctttattgatgg

SEQ ID NO: 363918 - DNA, 25 bp, Mus musculus
cggctgaagagtccatctggagaat

SEQ ID NO: 363919 - DNA, 25 bp, Mus musculus
cggctgaagagtgcatctggagaat

SEQ ID NO: 363920 - DNA, 25 bp, Mus musculus
cggctgacggataagttattcctgt

SEQ ID NO: 363921 - DNA, 25 bp, Mus musculus
cggctgacggattagttattcctgt

SEQ ID NO: 363922 - DNA, 25 bp, Mus musculus
cggctgagagcgctcatgactttct

SEQ ID NO: 363923 - DNA, 25 bp, Mus musculus
cggctgagagcggtcatgactttct

SEQ ID NO: 363924 - DNA, 25 bp, Mus musculus
cggctgatttcccagggattcattt

SEQ ID NO: 363925 - DNA, 25 bp, Mus musculus
cggctgatttccctagcctgaagaa

SEQ ID NO: 363926 - DNA, 25 bp, Mus musculus
cggctgatttccgagggattcattt

SEQ ID NO: 363927 - DNA, 25 bp, Mus musculus
cggctgatttccgtagcctgaagaa

SEQ ID NO: 363928 - DNA, 25 bp, Mus musculus
cggctgcaccggcaatcaatgcctg

SEQ ID NO: 363929 - DNA, 25 bp, Mus musculus
cggctgcaccgggaatcaatgcctg

SEQ ID NO: 363930 - DNA, 25 bp, Mus musculus
cggctgcagattaactgcgcctatt

SEQ ID NO: 363931 - DNA, 25 bp, Mus musculus
cggctgcagatttactgcgcctatt

SEQ ID NO: 363932 - DNA, 25 bp, Mus musculus
cggctgccacgtattccctcatgaa

SEQ ID NO: 363933 - DNA, 25 bp, Mus musculus
cggctgccacgttttccctcatgaa

SEQ ID NO: 363934 - DNA, 25 bp, Mus musculus
cggctgccacttcgattcttatatg

SEQ ID NO: 363935 - DNA, 25 bp, Mus musculus
cggctgccacttggattcttatatg

SEQ ID NO: 363936 - DNA, 25 bp, Mus musculus
cggctgctaggaaggaatgctttct

SEQ ID NO: 363937 - DNA, 25 bp, Mus musculus
cggctgctaggatggaatgctttct

SEQ ID NO: 363938 - DNA, 25 bp, Mus musculus
cggctggagtcacagattgccacct

SEQ ID NO: 363939 - DNA, 25 bp, Mus musculus
cggctggagtcagagattgccacct

SEQ ID NO: 363940 - DNA, 25 bp, Mus musculus
cggctggccaagacgggaccaccgc

SEQ ID NO: 363941 - DNA, 25 bp, Mus musculus
cggctggccaagtcgggaccaccgc

SEQ ID NO: 363942 - DNA, 25 bp, Mus musculus
cggctggtggatcccatctgcgata

SEQ ID NO: 363943 - DNA, 25 bp, Mus musculus
cggctggtggatgccatctgcgata

SEQ ID NO: 363944 - DNA, 25 bp, Mus musculus
cggctggttctcaacgtggtaatga

SEQ ID NO: 363945 - DNA, 25 bp, Mus musculus
cggctggttctctacgtggtaatga

SEQ ID NO: 363946 - DNA, 25 bp, Mus musculus
cggctgtagtctatataaacttgta

SEQ ID NO: 363947 - DNA, 25 bp, Mus musculus
cggctgtagtctttataaacttgta

SEQ ID NO: 363948 - DNA, 25 bp, Mus musculus
cggctgtccaagaataacacagagg

SEQ ID NO: 363949 - DNA, 25 bp, Mus musculus
cggctgtccaagtataacacagagg

SEQ ID NO: 363950 - DNA, 25 bp, Mus musculus
cggctgtcctgcagatgaaacctag

SEQ ID NO: 363951 - DNA, 25 bp, Mus musculus
cggctgtcctgctgatgaaacctag

SEQ ID NO: 363952 - DNA, 25 bp, Mus musculus
cggctgtcgcttcctctccggagga

SEQ ID NO: 363953 - DNA, 25 bp, Mus musculus
cggctgtcgcttgctctccggagga

SEQ ID NO: 363954 - DNA, 25 bp, Mus musculus
cggctgtgcaaacgcggttagacat

SEQ ID NO: 363955 - DNA, 25 bp, Mus musculus
cggctgtgcaaaggcggttagacat

SEQ ID NO: 363956 - DNA, 25 bp, Mus musculus
cggctgtgccagataggaacgacct

SEQ ID NO: 363957 - DNA, 25 bp, Mus musculus
cggctgtgccagttaggaacgacct

SEQ ID NO: 363958 - DNA, 25 bp, Mus musculus
cggctgttagtgattgttgttggtt

SEQ ID NO: 363959 - DNA, 25 bp, Mus musculus
cggctgttagtgtttgttgttggtt

SEQ ID NO: 363960 - DNA, 25 bp, Mus musculus
cggcttaaacggcagtatctgcttc

SEQ ID NO: 363961 - DNA, 25 bp, Mus musculus
cggcttaaacgggagtatctgcttc

SEQ ID NO: 363962 - DNA, 25 bp, Mus musculus
cggcttagggctacttgacatctta

SEQ ID NO: 363963 - DNA, 25 bp, Mus musculus
cggcttagggcttcttgacatctta

SEQ ID NO: 363964 - DNA, 25 bp, Mus musculus
cggcttcagtctatggcttgttatt

SEQ ID NO: 363965 - DNA, 25 bp, Mus musculus
cggcttcagtctttggcttgttatt

SEQ ID NO: 363966 - DNA, 25 bp, Mus musculus
cggcttcatggaccctatgcaatga

SEQ ID NO: 363967 - DNA, 25 bp, Mus musculus
cggcttcatggagcctatgcaatga

SEQ ID NO: 363968 - DNA, 25 bp, Mus musculus
cggcttcctgtgcacataggacaga

SEQ ID NO: 363969 - DNA, 25 bp, Mus musculus
cggcttcctgtggacataggacaga

SEQ ID NO: 363970 - DNA, 25 bp, Mus musculus
cggcttcctgttcctgcggctgtga

SEQ ID NO: 363971 - DNA, 25 bp, Mus musculus
cggcttcctgttgctgcggctgtga

SEQ ID NO: 363972 - DNA, 25 bp, Mus musculus
cggcttccttgacctctgaaatgaa

SEQ ID NO: 363973 - DNA, 25 bp, Mus musculus
cggcttccttgagctctgaaatgaa

SEQ ID NO: 363974 - DNA, 25 bp, Mus musculus
cggcttcgtgtactcattcctggga

SEQ ID NO: 363975 - DNA, 25 bp, Mus musculus
cggcttcgtgtagtcattcctggga

SEQ ID NO: 363976 - DNA, 25 bp, Mus musculus
cggcttctagtcacattgcttaatt

SEQ ID NO: 363977 - DNA, 25 bp, Mus musculus
cggcttctagtctcattgcttaatt

SEQ ID NO: 363978 - DNA, 25 bp, Mus musculus
cggcttctattacttcaacttccaa

SEQ ID NO: 363979 - DNA, 25 bp, Mus musculus
cggcttctattagttcaacttccaa

SEQ ID NO: 363980 - DNA, 25 bp, Mus musculus
cggcttctcaggatccttatttatt

SEQ ID NO: 363981 - DNA, 25 bp, Mus musculus
cggcttctcaggttccttatttatt

SEQ ID NO: 363982 - DNA, 25 bp, Mus musculus
cggcttctgggaacgacaagggcaa

SEQ ID NO: 363983 - DNA, 25 bp, Mus musculus
cggcttctgggatcgacaagggcaa

SEQ ID NO: 363984 - DNA, 25 bp, Mus musculus
cggcttctgggcaaggcttataatt

SEQ ID NO: 363985 - DNA, 25 bp, Mus musculus
cggcttctgggctaggcttataatt

SEQ ID NO: 363986 - DNA, 25 bp, Mus musculus
cggcttcttcgaaacagtgttctgt

SEQ ID NO: 363987 - DNA, 25 bp, Mus musculus
cggcttcttcgatacagtgttctgt

SEQ ID NO: 363988 - DNA, 25 bp, Mus musculus
cggcttgctccgctcgcagaatctg

SEQ ID NO: 363989 - DNA, 25 bp, Mus musculus
cggcttgctccggtcgcagaatctg

SEQ ID NO: 363990 - DNA, 25 bp, Mus musculus
cggcttggaatacctgtgcagtgca

SEQ ID NO: 363991 - DNA, 25 bp, Mus musculus
cggcttggaatagctgtgcagtgca

SEQ ID NO: 363992 - DNA, 25 bp, Mus musculus
cggcttggcaacagcgctttattta

SEQ ID NO: 363993 - DNA, 25 bp, Mus musculus
cggcttggcaactgcgctttattta

SEQ ID NO: 363994 - DNA, 25 bp, Mus musculus
cggcttgtcagtctaggctcaggta

SEQ ID NO: 363995 - DNA, 25 bp, Mus musculus
cggcttgtcagtgtaggctcaggta

SEQ ID NO: 363996 - DNA, 25 bp, Mus musculus
cggctttaaagcatcgtcttcgatt

SEQ ID NO: 363997 - DNA, 25 bp, Mus musculus
cggctttaaagcttcgtcttcgatt

SEQ ID NO: 363998 - DNA, 25 bp, Mus musculus
cggctttcacatcccttgaattcta

SEQ ID NO: 363999 - DNA, 25 bp, Mus musculus
cggctttcacatgccttgaattcta

SEQ ID NO: 364000 - DNA, 25 bp, Mus musculus
cggctttgatggacgaggctgcctc

SEQ ID NO: 364001 - DNA, 25 bp, Mus musculus
cggctttgatggtcgaggctgcctc

SEQ ID NO: 364002 - DNA, 25 bp, Mus musculus
cggcttttagagagcccagctcagg

SEQ ID NO: 364003 - DNA, 25 bp, Mus musculus
cggcttttagagtgcccagctcagg

SEQ ID NO: 364004 - DNA, 25 bp, Mus musculus
cggcttttggcacctggttgtggat

SEQ ID NO: 364005 - DNA, 25 bp, Mus musculus
cggcttttggcagctggttgtggat

SEQ ID NO: 364006 - DNA, 25 bp, Mus musculus
cgggaaaagtcgcatctacctcaag

SEQ ID NO: 364007 - DNA, 25 bp, Mus musculus
cgggaaaagtcggatctacctcaag

SEQ ID NO: 364008 - DNA, 25 bp, Mus musculus
cgggaaaccatcagtctgagcttct

SEQ ID NO: 364009 - DNA, 25 bp, Mus musculus
cgggaaaccatctgtctgagcttct

SEQ ID NO: 364010 - DNA, 25 bp, Mus musculus
cgggaaactctgcaaggcggctaca

SEQ ID NO: 364011 - DNA, 25 bp, Mus musculus
cgggaaactctggaaggcggctaca

SEQ ID NO: 364012 - DNA, 25 bp, Mus musculus
cgggaaaggctgctctggaaataaa

SEQ ID NO: 364013 - DNA, 25 bp, Mus musculus
cgggaaaggctggtctggaaataaa

SEQ ID NO: 364014 - DNA, 25 bp, Mus musculus
cgggaaccccatcgcaataatggga

SEQ ID NO: 364015 - DNA, 25 bp, Mus musculus
cgggaaccccatggcaataatggga

SEQ ID NO: 364016 - DNA, 25 bp, Mus musculus
cgggaacctcaactgtgcaactgaa

SEQ ID NO: 364017 - DNA, 25 bp, Mus musculus
cgggaacctcaagtgtgcaactgaa

SEQ ID NO: 364018 - DNA, 25 bp, Mus musculus
cgggaacgcacccaccagtgggcaa

SEQ ID NO: 364019 - DNA, 25 bp, Mus musculus
cgggaacgcaccgaccagtgggcaa

SEQ ID NO: 364020 - DNA, 25 bp, Mus musculus
cgggaagaaggcatcgtaggatttt

SEQ ID NO: 364021 - DNA, 25 bp, Mus musculus
cgggaagaaggcttcgtaggatttt

SEQ ID NO: 364022 - DNA, 25 bp, Mus musculus
cgggaagaccttccagaacctctga

SEQ ID NO: 364023 - DNA, 25 bp, Mus musculus
cgggaagaccttgcagaacctctga

SEQ ID NO: 364024 - DNA, 25 bp, Mus musculus
cgggaagccttaatccagttcttgg

SEQ ID NO: 364025 - DNA, 25 bp, Mus musculus
cgggaagccttattccagttcttgg

SEQ ID NO: 364026 - DNA, 25 bp, Mus musculus
cgggaaggcattatcttagaatatt

SEQ ID NO: 364027 - DNA, 25 bp, Mus musculus
cgggaaggcattttcttagaatatt

SEQ ID NO: 364028 - DNA, 25 bp, Mus musculus
cgggaaggcctaagcaagttgcgca

SEQ ID NO: 364029 - DNA, 25 bp, Mus musculus
cgggaaggcctatgcaagttgcgca

SEQ ID NO: 364030 - DNA, 25 bp, Mus musculus
cgggaaggtgctcccgtcctgtgac

SEQ ID NO: 364031 - DNA, 25 bp, Mus musculus
cgggaaggtgctgccgtcctgtgac

SEQ ID NO: 364032 - DNA, 25 bp, Mus musculus
cgggaagtcgttatgtgtgaagtca

SEQ ID NO: 364033 - DNA, 25 bp, Mus musculus
cgggaagtcgttttgtgtgaagtca

SEQ ID NO: 364034 - DNA, 25 bp, Mus musculus
cgggaatagcagctgcatttctttt

SEQ ID NO: 364035 - DNA, 25 bp, Mus musculus
cgggaatagcaggtgcatttctttt

SEQ ID NO: 364036 - DNA, 25 bp, Mus musculus
cgggaatattttcgccagatcttga

SEQ ID NO: 364037 - DNA, 25 bp, Mus musculus
cgggaatattttggccagatcttga

SEQ ID NO: 364038 - DNA, 25 bp, Mus musculus
cgggaatgttctacttcgagtgatt

SEQ ID NO: 364039 - DNA, 25 bp, Mus musculus
cgggaatgttcttcttcgagtgatt

SEQ ID NO: 364040 - DNA, 25 bp, Mus musculus
cgggacaaacataagccacgcgatt

SEQ ID NO: 364041 - DNA, 25 bp, Mus musculus
cgggacaaacattagccacgcgatt

SEQ ID NO: 364042 - DNA, 25 bp, Mus musculus
cgggacacgaccagctgattgtaga

SEQ ID NO: 364043 - DNA, 25 bp, Mus musculus
cgggacacgacctgctgattgtaga

SEQ ID NO: 364044 - DNA, 25 bp, Mus musculus
cgggacacgtgcaactcgagccttg

SEQ ID NO: 364045 - DNA, 25 bp, Mus musculus
cgggacacgtgctactcgagccttg

SEQ ID NO: 364046 - DNA, 25 bp, Mus musculus
cgggacagctctccagaattttgtt

SEQ ID NO: 364047 - DNA, 25 bp, Mus musculus
cgggacagctctgcagaattttgtt

SEQ ID NO: 364048 - DNA, 25 bp, Mus musculus
cgggacaggacgaggtgtaccacaa

SEQ ID NO: 364049 - DNA, 25 bp, Mus musculus
cgggacaggacgtggtgtaccacaa

SEQ ID NO: 364050 - DNA, 25 bp, Mus musculus
cgggacagtgagacctagctggcct

SEQ ID NO: 364051 - DNA, 25 bp, Mus musculus
cgggacagtgagtcctagctggcct

SEQ ID NO: 364052 - DNA, 25 bp, Mus musculus
cgggaccagcccatgtgaagacaat

SEQ ID NO: 364053 - DNA, 25 bp, Mus musculus
cgggaccagcccttgtgaagacaat

SEQ ID NO: 364054 - DNA, 25 bp, Mus musculus
cgggacctaactcttggctttatca

SEQ ID NO: 364055 - DNA, 25 bp, Mus musculus
cgggacctaactgttggctttatca

SEQ ID NO: 364056 - DNA, 25 bp, Mus musculus
cgggaccttaagagtgagaacgcct

SEQ ID NO: 364057 - DNA, 25 bp, Mus musculus
cgggaccttaagtgtgagaacgcct

SEQ ID NO: 364058 - DNA, 25 bp, Mus musculus
cgggacggcaacattctgaacatcc

SEQ ID NO: 364059 - DNA, 25 bp, Mus musculus
cgggacggcaactttctgaacatcc

SEQ ID NO: 364060 - DNA, 25 bp, Mus musculus
cgggactctgttacctacgaggaat

SEQ ID NO: 364061 - DNA, 25 bp, Mus musculus
cgggactctgtttcctacgaggaat

SEQ ID NO: 364062 - DNA, 25 bp, Mus musculus
cgggagaaagctcctcgcaagctgc

SEQ ID NO: 364063 - DNA, 25 bp, Mus musculus
cgggagaaagctgctcgcaagctgc

SEQ ID NO: 364064 - DNA, 25 bp, Mus musculus
cgggagaagcccatgctgcggtttt

SEQ ID NO: 364065 - DNA, 25 bp, Mus musculus
cgggagaagcccttgctgcggtttt

SEQ ID NO: 364066 - DNA, 25 bp, Mus musculus
cgggagaaggcaccctatttgtcaa

SEQ ID NO: 364067 - DNA, 25 bp, Mus musculus
cgggagaaggcagcctatttgtcaa

SEQ ID NO: 364068 - DNA, 25 bp, Mus musculus
cgggagacctagcagatcccttcct

SEQ ID NO: 364069 - DNA, 25 bp, Mus musculus
cgggagacctaggagatcccttcct

SEQ ID NO: 364070 - DNA, 25 bp, Mus musculus
cgggagactggacgcccacgtcaaa

SEQ ID NO: 364071 - DNA, 25 bp, Mus musculus
cgggagactggaggcccacgtcaaa

SEQ ID NO: 364072 - DNA, 25 bp, Mus musculus
cgggagagcagaaagaacgtcttag

SEQ ID NO: 364073 - DNA, 25 bp, Mus musculus
cgggagagcagatagaacgtcttag

SEQ ID NO: 364074 - DNA, 25 bp, Mus musculus
cgggagcagcagagtctctgcacaa

SEQ ID NO: 364075 - DNA, 25 bp, Mus musculus
cgggagcagcagtgtctctgcacaa

SEQ ID NO: 364076 - DNA, 25 bp, Mus musculus
cgggagcagctcctgtacctgtatg

SEQ ID NO: 364077 - DNA, 25 bp, Mus musculus
cgggagcagctcgtgtacctgtatg

SEQ ID NO: 364078 - DNA, 25 bp, Mus musculus
cgggagcctgtcagaaaaggtctct

SEQ ID NO: 364079 - DNA, 25 bp, Mus musculus
cgggagcctgtctgaaaaggtctct

SEQ ID NO: 364080 - DNA, 25 bp, Mus musculus
cgggagccttttcagagtgccagct

SEQ ID NO: 364081 - DNA, 25 bp, Mus musculus
cgggagccttttgagagtgccagct

SEQ ID NO: 364082 - DNA, 25 bp, Mus musculus
cgggagctcctgcataagtacgcag

SEQ ID NO: 364083 - DNA, 25 bp, Mus musculus
cgggagctcctggataagtacgcag

SEQ ID NO: 364084 - DNA, 25 bp, Mus musculus
cgggagctcgtacatctatggctat

SEQ ID NO: 364085 - DNA, 25 bp, Mus musculus
cgggagctcgtagatctatggctat

SEQ ID NO: 364086 - DNA, 25 bp, Mus musculus
cgggagctgagacccagatgcaatt

SEQ ID NO: 364087 - DNA, 25 bp, Mus musculus
cgggagctgagagccagatgcaatt

SEQ ID NO: 364088 - DNA, 25 bp, Mus musculus
cgggagctgcttagagtggaaccat

SEQ ID NO: 364089 - DNA, 25 bp, Mus musculus
cgggagctgctttgagtggaaccat

SEQ ID NO: 364090 - DNA, 25 bp, Mus musculus
cgggaggacatcagatcacctggaa

SEQ ID NO: 364091 - DNA, 25 bp, Mus musculus
cgggaggacatctgatcacctggaa

SEQ ID NO: 364092 - DNA, 25 bp, Mus musculus
cgggaggagctgagaactattagaa

SEQ ID NO: 364093 - DNA, 25 bp, Mus musculus
cgggaggagctgtgaactattagaa

SEQ ID NO: 364094 - DNA, 25 bp, Mus musculus
cgggaggcaccacccgcgagctaaa

SEQ ID NO: 364095 - DNA, 25 bp, Mus musculus
cgggaggcaccagccgcgagctaaa

SEQ ID NO: 364096 - DNA, 25 bp, Mus musculus
cgggaggcttctagacatgttccaa

SEQ ID NO: 364097 - DNA, 25 bp, Mus musculus
cgggaggcttcttgacatgttccaa

SEQ ID NO: 364098 - DNA, 25 bp, Mus musculus
cgggaggtatttcagatggccactc

SEQ ID NO: 364099 - DNA, 25 bp, Mus musculus
cgggaggtatttgagatggccactc

SEQ ID NO: 364100 - DNA, 25 bp, Mus musculus
cgggagtatgagatgcggaaaaata

SEQ ID NO: 364101 - DNA, 25 bp, Mus musculus
cgggagtatgagttgcggaaaaata

SEQ ID NO: 364102 - DNA, 25 bp, Mus musculus
cgggagtcatccatacagtatcatt

SEQ ID NO: 364103 - DNA, 25 bp, Mus musculus
cgggagtcatccttacagtatcatt

SEQ ID NO: 364104 - DNA, 25 bp, Mus musculus
cgggatcaaagtctgttctggcggc

SEQ ID NO: 364105 - DNA, 25 bp, Mus musculus
cgggatcaaagtgtgttctggcggc

SEQ ID NO: 364106 - DNA, 25 bp, Mus musculus
cgggatcaaattctacatgctgttt

SEQ ID NO: 364107 - DNA, 25 bp, Mus musculus
cgggatcaaattgtacatgctgttt

SEQ ID NO: 364108 - DNA, 25 bp, Mus musculus
cgggatcaccatagcggtggcatgt

SEQ ID NO: 364109 - DNA, 25 bp, Mus musculus
cgggatcaccattgcggtggcatgt

SEQ ID NO: 364110 - DNA, 25 bp, Mus musculus
cgggatccccgtcttaacaggatga

SEQ ID NO: 364111 - DNA, 25 bp, Mus musculus
cgggatccccgtgttaacaggatga

SEQ ID NO: 364112 - DNA, 25 bp, Mus musculus
cgggatccgggtactcctgtgaaga

SEQ ID NO: 364113 - DNA, 25 bp, Mus musculus
cgggatccgggttctcctgtgaaga

SEQ ID NO: 364114 - DNA, 25 bp, Mus musculus
cgggatgacgaaagctccagcacat

SEQ ID NO: 364115 - DNA, 25 bp, Mus musculus
cgggatgacgaatgctccagcacat

SEQ ID NO: 364116 - DNA, 25 bp, Mus musculus
cgggatgcagatactacctcttgat

SEQ ID NO: 364117 - DNA, 25 bp, Mus musculus
cgggatgcagattctacctcttgat

SEQ ID NO: 364118 - DNA, 25 bp, Mus musculus
cgggatgctcctcccagcacagggt

SEQ ID NO: 364119 - DNA, 25 bp, Mus musculus
cgggatgctcctgccagcacagggt

SEQ ID NO: 364120 - DNA, 25 bp, Mus musculus
cgggatggacacactaacatctgtg

SEQ ID NO: 364121 - DNA, 25 bp, Mus musculus
cgggatggacactctaacatctgtg

SEQ ID NO: 364122 - DNA, 25 bp, Mus musculus
cgggatgggctcaccagtactgagc

SEQ ID NO: 364123 - DNA, 25 bp, Mus musculus
cgggatgggctctccagtactgagc

SEQ ID NO: 364124 - DNA, 25 bp, Mus musculus
cgggattagtggctcaaagctcatt

SEQ ID NO: 364125 - DNA, 25 bp, Mus musculus
cgggattagtgggtcaaagctcatt

SEQ ID NO: 364126 - DNA, 25 bp, Mus musculus
cgggattcctctatccttagagata

SEQ ID NO: 364127 - DNA, 25 bp, Mus musculus
cgggattcctctttccttagagata

SEQ ID NO: 364128 - DNA, 25 bp, Mus musculus
cgggattggtgacgtcctgagcaag

SEQ ID NO: 364129 - DNA, 25 bp, Mus musculus
cgggattggtgaggtcctgagcaag

SEQ ID NO: 364130 - DNA, 25 bp, Mus musculus
cgggatttcttaatttacgtagcat

SEQ ID NO: 364131 - DNA, 25 bp, Mus musculus
cgggatttcttattttacgtagcat

SEQ ID NO: 364132 - DNA, 25 bp, Mus musculus
cgggcaagaagtaccaccaagctgt

SEQ ID NO: 364133 - DNA, 25 bp, Mus musculus
cgggcaagaagttccaccaagctgt

SEQ ID NO: 364134 - DNA, 25 bp, Mus musculus
cgggcaatatgaagctctcagtaaa

SEQ ID NO: 364135 - DNA, 25 bp, Mus musculus
cgggcaatatgatgctctcagtaaa

SEQ ID NO: 364136 - DNA, 25 bp, Mus musculus
cgggcaatctctacatcctaattga

SEQ ID NO: 364137 - DNA, 25 bp, Mus musculus
cgggcaatctcttcatcctaattga

SEQ ID NO: 364138 - DNA, 25 bp, Mus musculus
cgggcaatggtaatgagggctcacc

SEQ ID NO: 364139 - DNA, 25 bp, Mus musculus
cgggcaatggtattgagggctcacc

SEQ ID NO: 364140 - DNA, 25 bp, Mus musculus
cgggcaccaggtcctgtacaacgtc

SEQ ID NO: 364141 - DNA, 25 bp, Mus musculus
cgggcaccaggtgctgtacaacgtc

SEQ ID NO: 364142 - DNA, 25 bp, Mus musculus
cgggcacgttgtaaaactgttgccg

SEQ ID NO: 364143 - DNA, 25 bp, Mus musculus
cgggcacgttgttaaactgttgccg

SEQ ID NO: 364144 - DNA, 25 bp, Mus musculus
cgggcactgcttaaaagatagaaac

SEQ ID NO: 364145 - DNA, 25 bp, Mus musculus
cgggcactgctttaaagatagaaac

SEQ ID NO: 364146 - DNA, 25 bp, Mus musculus
cgggcactttggacctcacggtgag

SEQ ID NO: 364147 - DNA, 25 bp, Mus musculus
cgggcactttggtcctcacggtgag

SEQ ID NO: 364148 - DNA, 25 bp, Mus musculus
cgggcactttttcagcttgctataa

SEQ ID NO: 364149 - DNA, 25 bp, Mus musculus
cgggcactttttgagcttgctataa

SEQ ID NO: 364150 - DNA, 25 bp, Mus musculus
cgggcagagcgcaaggcatacacca

SEQ ID NO: 364151 - DNA, 25 bp, Mus musculus
cgggcagagcgctaggcatacacca

SEQ ID NO: 364152 - DNA, 25 bp, Mus musculus
cgggcagccctcaaagctctgctgg

SEQ ID NO: 364153 - DNA, 25 bp, Mus musculus
cgggcagccctctaagctctgctgg

SEQ ID NO: 364154 - DNA, 25 bp, Mus musculus
cgggcagcggttacaccagcgggaa

SEQ ID NO: 364155 - DNA, 25 bp, Mus musculus
cgggcagcggtttcaccagcgggaa

SEQ ID NO: 364156 - DNA, 25 bp, Mus musculus
cgggcagctacacttctagaaggtt

SEQ ID NO: 364157 - DNA, 25 bp, Mus musculus
cgggcagctacagttctagaaggtt

SEQ ID NO: 364158 - DNA, 25 bp, Mus musculus
cgggcagctagaattccaagagttt

SEQ ID NO: 364159 - DNA, 25 bp, Mus musculus
cgggcagctagatttccaagagttt

SEQ ID NO: 364160 - DNA, 25 bp, Mus musculus
cgggcagctccgaagacgacgcaga

SEQ ID NO: 364161 - DNA, 25 bp, Mus musculus
cgggcagctccgtagacgacgcaga

SEQ ID NO: 364162 - DNA, 25 bp, Mus musculus
cgggcagctggaaaagggaacttaa

SEQ ID NO: 364163 - DNA, 25 bp, Mus musculus
cgggcagctggataagggaacttaa

SEQ ID NO: 364164 - DNA, 25 bp, Mus musculus
cgggcagctggtccagttgatgctc

SEQ ID NO: 364165 - DNA, 25 bp, Mus musculus
cgggcagctggtgcagttgatgctc

SEQ ID NO: 364166 - DNA, 25 bp, Mus musculus
cgggcagctttccaactcagatgta

SEQ ID NO: 364167 - DNA, 25 bp, Mus musculus
cgggcagctttcgaactcagatgta

SEQ ID NO: 364168 - DNA, 25 bp, Mus musculus
cgggcaggaattcatatgttctcat

SEQ ID NO: 364169 - DNA, 25 bp, Mus musculus
cgggcaggaattgatatgttctcat

SEQ ID NO: 364170 - DNA, 25 bp, Mus musculus
cgggcaggacccactgctggaaaag

SEQ ID NO: 364171 - DNA, 25 bp, Mus musculus
cgggcaggaccctctgctggaaaag

SEQ ID NO: 364172 - DNA, 25 bp, Mus musculus
cgggcaggcacaactcagagctaag

SEQ ID NO: 364173 - DNA, 25 bp, Mus musculus
cgggcaggcacatctcagagctaag

SEQ ID NO: 364174 - DNA, 25 bp, Mus musculus
cgggcaggggtccatcccataatca

SEQ ID NO: 364175 - DNA, 25 bp, Mus musculus
cgggcaggggtcgatcccataatca

SEQ ID NO: 364176 - DNA, 25 bp, Mus musculus
cgggcaggtccaccttgagaaagtc

SEQ ID NO: 364177 - DNA, 25 bp, Mus musculus
cgggcaggtccagcttgagaaagtc

SEQ ID NO: 364178 - DNA, 25 bp, Mus musculus
cgggcagtgctgagttctaaggaca

SEQ ID NO: 364179 - DNA, 25 bp, Mus musculus
cgggcagtgctgatggatctatgta

SEQ ID NO: 364180 - DNA, 25 bp, Mus musculus
cgggcagtgctgtgttctaaggaca

SEQ ID NO: 364181 - DNA, 25 bp, Mus musculus
cgggcagtgctgttggatctatgta

SEQ ID NO: 364182 - DNA, 25 bp, Mus musculus
cgggcagtttggagtcggattctac

SEQ ID NO: 364183 - DNA, 25 bp, Mus musculus
cgggcagtttggtgtcggattctac

SEQ ID NO: 364184 - DNA, 25 bp, Mus musculus
cgggcatactgtaccaacagggtgt

SEQ ID NO: 364185 - DNA, 25 bp, Mus musculus
cgggcatactgttccaacagggtgt

SEQ ID NO: 364186 - DNA, 25 bp, Mus musculus
cgggcatattctccggtcactgaag

SEQ ID NO: 364187 - DNA, 25 bp, Mus musculus
cgggcatattctgcggtcactgaag

SEQ ID NO: 364188 - DNA, 25 bp, Mus musculus
cgggcatccgctcgccatgggtggg

SEQ ID NO: 364189 - DNA, 25 bp, Mus musculus
cgggcatccgctggccatgggtggg

SEQ ID NO: 364190 - DNA, 25 bp, Mus musculus
cgggcatctcacatgtttctaataa

SEQ ID NO: 364191 - DNA, 25 bp, Mus musculus
cgggcatctcacttgtttctaataa

SEQ ID NO: 364192 - DNA, 25 bp, Mus musculus
cgggcatgcttgacaggtgaagaaa

SEQ ID NO: 364193 - DNA, 25 bp, Mus musculus
cgggcatgcttgtcaggtgaagaaa

SEQ ID NO: 364194 - DNA, 25 bp, Mus musculus
cgggcatggacactcactgtttcta

SEQ ID NO: 364195 - DNA, 25 bp, Mus musculus
cgggcatggacagtcactgtttcta

SEQ ID NO: 364196 - DNA, 25 bp, Mus musculus
cgggcattattgctccatattggag

SEQ ID NO: 364197 - DNA, 25 bp, Mus musculus
cgggcattattggtccatattggag

SEQ ID NO: 364198 - DNA, 25 bp, Mus musculus
cgggcattctctatgtcactatgat

SEQ ID NO: 364199 - DNA, 25 bp, Mus musculus
cgggcattctctttgtcactatgat

SEQ ID NO: 364200 - DNA, 25 bp, Mus musculus
cgggcattctggctctgactggcca

SEQ ID NO: 364201 - DNA, 25 bp, Mus musculus
cgggcattctgggtctgactggcca

SEQ ID NO: 364202 - DNA, 25 bp, Mus musculus
cgggccaacctcaagtctgtgaaga

SEQ ID NO: 364203 - DNA, 25 bp, Mus musculus
cgggccaacctctagtctgtgaaga

SEQ ID NO: 364204 - DNA, 25 bp, Mus musculus
cgggccaccagcattgatagtcaag

SEQ ID NO: 364205 - DNA, 25 bp, Mus musculus
cgggccaccagctttgatagtcaag

SEQ ID NO: 364206 - DNA, 25 bp, Mus musculus
cgggccaggaatcgttacatggata

SEQ ID NO: 364207 - DNA, 25 bp, Mus musculus
cgggccaggaatggttacatggata

SEQ ID NO: 364208 - DNA, 25 bp, Mus musculus
cgggccatccagaagaaaattgacc

SEQ ID NO: 364209 - DNA, 25 bp, Mus musculus
cgggccatccagtagaaaattgacc

SEQ ID NO: 364210 - DNA, 25 bp, Mus musculus
cgggccatcttcagaaccatttaat

SEQ ID NO: 364211 - DNA, 25 bp, Mus musculus
cgggccatcttctgaaccatttaat

SEQ ID NO: 364212 - DNA, 25 bp, Mus musculus
cgggcccctgttcattgtcaatgaa

SEQ ID NO: 364213 - DNA, 25 bp, Mus musculus
cgggcccctgttgattgtcaatgaa

SEQ ID NO: 364214 - DNA, 25 bp, Mus musculus
cgggccctggacattgtaagctctc

SEQ ID NO: 364215 - DNA, 25 bp, Mus musculus
cgggccctggactttgtaagctctc

SEQ ID NO: 364216 - DNA, 25 bp, Mus musculus
cgggccgggttaacgccagtgatct

SEQ ID NO: 364217 - DNA, 25 bp, Mus musculus
cgggccgggttatcgccagtgatct

SEQ ID NO: 364218 - DNA, 25 bp, Mus musculus
cgggccgttctcacgtgggagacgc

SEQ ID NO: 364219 - DNA, 25 bp, Mus musculus
cgggccgttctctcgtgggagacgc

SEQ ID NO: 364220 - DNA, 25 bp, Mus musculus
cgggcctatccgagaccattgaaga

SEQ ID NO: 364221 - DNA, 25 bp, Mus musculus
cgggcctatccgtgaccattgaaga

SEQ ID NO: 364222 - DNA, 25 bp, Mus musculus
cgggcctcactaatttcattctgtt

SEQ ID NO: 364223 - DNA, 25 bp, Mus musculus
cgggcctcactattttcattctgtt

SEQ ID NO: 364224 - DNA, 25 bp, Mus musculus
cgggcctctaggcaagatgtccctg

SEQ ID NO: 364225 - DNA, 25 bp, Mus musculus
cgggcctctagggaagatgtccctg

SEQ ID NO: 364226 - DNA, 25 bp, Mus musculus
cgggcctgcaagaggatgacgaaat

SEQ ID NO: 364227 - DNA, 25 bp, Mus musculus
cgggcctgcaagtggatgacgaaat

SEQ ID NO: 364228 - DNA, 25 bp, Mus musculus
cgggcctggcctagtgtagaaagtc

SEQ ID NO: 364229 - DNA, 25 bp, Mus musculus
cgggcctggccttgtgtagaaagtc

SEQ ID NO: 364230 - DNA, 25 bp, Mus musculus
cgggcctgttccagagttctcaggg

SEQ ID NO: 364231 - DNA, 25 bp, Mus musculus
cgggcctgttcctgagttctcaggg

SEQ ID NO: 364232 - DNA, 25 bp, Mus musculus
cgggccttctttccagtacaatttg

SEQ ID NO: 364233 - DNA, 25 bp, Mus musculus
cgggccttctttgcagtacaatttg

SEQ ID NO: 364234 - DNA, 25 bp, Mus musculus
cgggcctttacgagaaacgctgcaa

SEQ ID NO: 364235 - DNA, 25 bp, Mus musculus
cgggcctttacgtgaaacgctgcaa

SEQ ID NO: 364236 - DNA, 25 bp, Mus musculus
cgggcgactgccactctgtgtggaa

SEQ ID NO: 364237 - DNA, 25 bp, Mus musculus
cgggcgactgcctctctgtgtggaa

SEQ ID NO: 364238 - DNA, 25 bp, Mus musculus
cgggcgcagcctaagcagccatggc

SEQ ID NO: 364239 - DNA, 25 bp, Mus musculus
cgggcgcagccttagcagccatggc

SEQ ID NO: 364240 - DNA, 25 bp, Mus musculus
cgggcgcatctcacgaatgggcctg

SEQ ID NO: 364241 - DNA, 25 bp, Mus musculus
cgggcgcatctctcgaatgggcctg

SEQ ID NO: 364242 - DNA, 25 bp, Mus musculus
cgggcggaacgcacaacagtaaacg

SEQ ID NO: 364243 - DNA, 25 bp, Mus musculus
cgggcggaacgctcaacagtaaacg

SEQ ID NO: 364244 - DNA, 25 bp, Mus musculus
cgggcggactccatctaaaatcgag

SEQ ID NO: 364245 - DNA, 25 bp, Mus musculus
cgggcggactccttctaaaatcgag

SEQ ID NO: 364246 - DNA, 25 bp, Mus musculus
cgggcggataacagagctctctgct

SEQ ID NO: 364247 - DNA, 25 bp, Mus musculus
cgggcggataactgagctctctgct

SEQ ID NO: 364248 - DNA, 25 bp, Mus musculus
cgggcggcaagacagaggcgtgttc

SEQ ID NO: 364249 - DNA, 25 bp, Mus musculus
cgggcggcaagagagaggcgtgttc

SEQ ID NO: 364250 - DNA, 25 bp, Mus musculus
cgggcgtgtttaccatgagccacat

SEQ ID NO: 364251 - DNA, 25 bp, Mus musculus
cgggcgtgtttagcatgagccacat

SEQ ID NO: 364252 - DNA, 25 bp, Mus musculus
cgggctagagcgacatcatggtatt

SEQ ID NO: 364253 - DNA, 25 bp, Mus musculus
cgggctagagcgtcatcatggtatt

SEQ ID NO: 364254 - DNA, 25 bp, Mus musculus
cgggctagcccacaacttactatat

SEQ ID NO: 364255 - DNA, 25 bp, Mus musculus
cgggctagcccagaacttactatat

SEQ ID NO: 364256 - DNA, 25 bp, Mus musculus
cgggctaggctacctgctatgagca

SEQ ID NO: 364257 - DNA, 25 bp, Mus musculus
cgggctaggctagctgctatgagca

SEQ ID NO: 364258 - DNA, 25 bp, Mus musculus
cgggctcaagacaatatcattattt

SEQ ID NO: 364259 - DNA, 25 bp, Mus musculus
cgggctcaagactatatcattattt

SEQ ID NO: 364260 - DNA, 25 bp, Mus musculus
cgggctcagcacattttgctcactt

SEQ ID NO: 364261 - DNA, 25 bp, Mus musculus
cgggctcagcactttttgctcactt

SEQ ID NO: 364262 - DNA, 25 bp, Mus musculus
cgggctcagcccaccgaccctggga

SEQ ID NO: 364263 - DNA, 25 bp, Mus musculus
cgggctcagccctccgaccctggga

SEQ ID NO: 364264 - DNA, 25 bp, Mus musculus
cgggctcatttgagcagggattctc

SEQ ID NO: 364265 - DNA, 25 bp, Mus musculus
cgggctcatttgtgcagggattctc

SEQ ID NO: 364266 - DNA, 25 bp, Mus musculus
cgggctcggactaggctagtttgtt

SEQ ID NO: 364267 - DNA, 25 bp, Mus musculus
cgggctcggacttggctagtttgtt

SEQ ID NO: 364268 - DNA, 25 bp, Mus musculus
cgggctctagacagcgacatgcaga

SEQ ID NO: 364269 - DNA, 25 bp, Mus musculus
cgggctctagactgcgacatgcaga

SEQ ID NO: 364270 - DNA, 25 bp, Mus musculus
cgggctctccatctaatgacttcag

SEQ ID NO: 364271 - DNA, 25 bp, Mus musculus
cgggctctccatgtaatgacttcag

SEQ ID NO: 364272 - DNA, 25 bp, Mus musculus
cgggctgaccagagagactaaacat

SEQ ID NO: 364273 - DNA, 25 bp, Mus musculus
cgggctgaccagtgagactaaacat

SEQ ID NO: 364274 - DNA, 25 bp, Mus musculus
cgggctgacctaaatccaggagctt

SEQ ID NO: 364275 - DNA, 25 bp, Mus musculus
cgggctgacctatatccaggagctt

SEQ ID NO: 364276 - DNA, 25 bp, Mus musculus
cgggctgatgctatgtgcacaaaac

SEQ ID NO: 364277 - DNA, 25 bp, Mus musculus
cgggctgatgctttgtgcacaaaac

SEQ ID NO: 364278 - DNA, 25 bp, Mus musculus
cgggctggcgagcacaattctctat

SEQ ID NO: 364279 - DNA, 25 bp, Mus musculus
cgggctggcgaggacaattctctat

SEQ ID NO: 364280 - DNA, 25 bp, Mus musculus
cgggctgtattcccctccatcgtgg

SEQ ID NO: 364281 - DNA, 25 bp, Mus musculus
cgggctgtattcgcctccatcgtgg

SEQ ID NO: 364282 - DNA, 25 bp, Mus musculus
cgggctgtatttattgatttctcct

SEQ ID NO: 364283 - DNA, 25 bp, Mus musculus
cgggctgtattttttgatttctcct

SEQ ID NO: 364284 - DNA, 25 bp, Mus musculus
cgggctgtgcaaaacgctcactaaa

SEQ ID NO: 364285 - DNA, 25 bp, Mus musculus
cgggctgtgcaatacgctcactaaa

SEQ ID NO: 364286 - DNA, 25 bp, Mus musculus
cgggctgtgcgacacttgtcttcat

SEQ ID NO: 364287 - DNA, 25 bp, Mus musculus
cgggctgtgcgagacttgtcttcat

SEQ ID NO: 364288 - DNA, 25 bp, Mus musculus
cgggcttacaagcagatactcactc

SEQ ID NO: 364289 - DNA, 25 bp, Mus musculus
cgggcttacaaggagatactcactc

SEQ ID NO: 364290 - DNA, 25 bp, Mus musculus
cgggcttcccctactcaggagagga

SEQ ID NO: 364291 - DNA, 25 bp, Mus musculus
cgggcttccccttctcaggagagga

SEQ ID NO: 364292 - DNA, 25 bp, Mus musculus
cgggcttcgaacacgggctctgcgg

SEQ ID NO: 364293 - DNA, 25 bp, Mus musculus
cgggcttcgaactcgggctctgcgg

SEQ ID NO: 364294 - DNA, 25 bp, Mus musculus
cgggcttctgtccacatttggaagg

SEQ ID NO: 364295 - DNA, 25 bp, Mus musculus
cgggcttctgtcgacatttggaagg

SEQ ID NO: 364296 - DNA, 25 bp, Mus musculus
cgggcttgctgcacctaagtgaagg

SEQ ID NO: 364297 - DNA, 25 bp, Mus musculus
cgggcttgctgctcctaagtgaagg

SEQ ID NO: 364298 - DNA, 25 bp, Mus musculus
cgggcttgtgtaactctgctcatag

SEQ ID NO: 364299 - DNA, 25 bp, Mus musculus
cgggcttgtgtatctctgctcatag

SEQ ID NO: 364300 - DNA, 25 bp, Mus musculus
cgggctttgcacagtgagtatggaa

SEQ ID NO: 364301 - DNA, 25 bp, Mus musculus
cgggctttgcactgtgagtatggaa

SEQ ID NO: 364302 - DNA, 25 bp, Mus musculus
cggggaacgaggcttcttctacaca

SEQ ID NO: 364303 - DNA, 25 bp, Mus musculus
cggggaacgagggttcttctacaca

SEQ ID NO: 364304 - DNA, 25 bp, Mus musculus
cggggcgctgcaaagagtgctgtct

SEQ ID NO: 364305 - DNA, 25 bp, Mus musculus
cggggcgctgcatagagtgctgtct

SEQ ID NO: 364306 - DNA, 25 bp, Mus musculus
cggggctggcatagctctcaatgac

SEQ ID NO: 364307 - DNA, 25 bp, Mus musculus
cggggctggcattgctctcaatgac

SEQ ID NO: 364308 - DNA, 25 bp, Mus musculus
cgggtaaccattccaataccacact

SEQ ID NO: 364309 - DNA, 25 bp, Mus musculus
cgggtaaccattgcaataccacact

SEQ ID NO: 364310 - DNA, 25 bp, Mus musculus
cgggtacagacacagcggccacagc

SEQ ID NO: 364311 - DNA, 25 bp, Mus musculus
cgggtacagacagagcggccacagc

SEQ ID NO: 364312 - DNA, 25 bp, Mus musculus
cgggtacagactacccagcaaaggg

SEQ ID NO: 364313 - DNA, 25 bp, Mus musculus
cgggtacagacttcccagcaaaggg

SEQ ID NO: 364314 - DNA, 25 bp, Mus musculus
cgggtaccccaaccacattaaggag

SEQ ID NO: 364315 - DNA, 25 bp, Mus musculus
cgggtaccccaagcacattaaggag

SEQ ID NO: 364316 - DNA, 25 bp, Mus musculus
cgggtaccggtcaagcatctctcag

SEQ ID NO: 364317 - DNA, 25 bp, Mus musculus
cgggtaccggtctagcatctctcag

SEQ ID NO: 364318 - DNA, 25 bp, Mus musculus
cgggtaccggttaggcatctctcag

SEQ ID NO: 364319 - DNA, 25 bp, Mus musculus
cgggtaccggtttggcatctctcag

SEQ ID NO: 364320 - DNA, 25 bp, Mus musculus
cgggtacgacctcgcgtcgaatcaa

SEQ ID NO: 364321 - DNA, 25 bp, Mus musculus
cgggtacgacctggcgtcgaatcaa

SEQ ID NO: 364322 - DNA, 25 bp, Mus musculus
cgggtacttgtgagccattcattta

SEQ ID NO: 364323 - DNA, 25 bp, Mus musculus
cgggtacttgtgtgccattcattta

SEQ ID NO: 364324 - DNA, 25 bp, Mus musculus
cgggtatagagaatgtccctgccct

SEQ ID NO: 364325 - DNA, 25 bp, Mus musculus
cgggtatagagattgtccctgccct

SEQ ID NO: 364326 - DNA, 25 bp, Mus musculus
cgggtatttcttactggcacagtag

SEQ ID NO: 364327 - DNA, 25 bp, Mus musculus
cgggtatttctttctggcacagtag

SEQ ID NO: 364328 - DNA, 25 bp, Mus musculus
cgggtcaagcagagtttccaggtca

SEQ ID NO: 364329 - DNA, 25 bp, Mus musculus
cgggtcaagcagtgtttccaggtca

SEQ ID NO: 364330 - DNA, 25 bp, Mus musculus
cgggtcatataaacccttgagaatt

SEQ ID NO: 364331 - DNA, 25 bp, Mus musculus
cgggtcatataatcccttgagaatt

SEQ ID NO: 364332 - DNA, 25 bp, Mus musculus
cgggtcatgcagcacatagtgtata

SEQ ID NO: 364333 - DNA, 25 bp, Mus musculus
cgggtcatgcaggacatagtgtata

SEQ ID NO: 364334 - DNA, 25 bp, Mus musculus
cgggtccatgcaacctcagtgtcat

SEQ ID NO: 364335 - DNA, 25 bp, Mus musculus
cgggtccatgcatcctcagtgtcat

SEQ ID NO: 364336 - DNA, 25 bp, Mus musculus
cgggtcccgggaaggcatctgcact

SEQ ID NO: 364337 - DNA, 25 bp, Mus musculus
cgggtcccgggatggcatctgcact

SEQ ID NO: 364338 - DNA, 25 bp, Mus musculus
cgggtcgtgttacgtgctattacct

SEQ ID NO: 364339 - DNA, 25 bp, Mus musculus
cgggtcgtgttaggtgctattacct

SEQ ID NO: 364340 - DNA, 25 bp, Mus musculus
cgggtctcaggtctggccttttgaa

SEQ ID NO: 364341 - DNA, 25 bp, Mus musculus
cgggtctcaggtgtggccttttgaa

SEQ ID NO: 364342 - DNA, 25 bp, Mus musculus
cgggtctcggtgcagtacagctacc

SEQ ID NO: 364343 - DNA, 25 bp, Mus musculus
cgggtctcggtggagtacagctacc

SEQ ID NO: 364344 - DNA, 25 bp, Mus musculus
cgggtctgggtcattgtttctgagc

SEQ ID NO: 364345 - DNA, 25 bp, Mus musculus
cgggtctgggtctttgtttctgagc

SEQ ID NO: 364346 - DNA, 25 bp, Mus musculus
cgggtcttaaagactctgtgagaaa

SEQ ID NO: 364347 - DNA, 25 bp, Mus musculus
cgggtcttaaagtctctgtgagaaa

SEQ ID NO: 364348 - DNA, 25 bp, Mus musculus
cgggtcttgcggagccagttaaata

SEQ ID NO: 364349 - DNA, 25 bp, Mus musculus
cgggtcttgcggtgccagttaaata

SEQ ID NO: 364350 - DNA, 25 bp, Mus musculus
cgggtctttgagaggtctgtgtaca

SEQ ID NO: 364351 - DNA, 25 bp, Mus musculus
cgggtctttgagtggtctgtgtaca

SEQ ID NO: 364352 - DNA, 25 bp, Mus musculus
cgggtgaatgctccagactgcacac

SEQ ID NO: 364353 - DNA, 25 bp, Mus musculus
cgggtgaatgctgcagactgcacac

SEQ ID NO: 364354 - DNA, 25 bp, Mus musculus
cgggtgacatgcatctaatcacctt

SEQ ID NO: 364355 - DNA, 25 bp, Mus musculus
cgggtgacatgcttctaatcacctt

SEQ ID NO: 364356 - DNA, 25 bp, Mus musculus
cgggtgcaggctagagaagaatctg

SEQ ID NO: 364357 - DNA, 25 bp, Mus musculus
cgggtgcaggcttgagaagaatctg

SEQ ID NO: 364358 - DNA, 25 bp, Mus musculus
cgggtgccatatcgcatttctgcca

SEQ ID NO: 364359 - DNA, 25 bp, Mus musculus
cgggtgccatatggcatttctgcca

SEQ ID NO: 364360 - DNA, 25 bp, Mus musculus
cgggtgccttgtacgcctggtcctg

SEQ ID NO: 364361 - DNA, 25 bp, Mus musculus
cgggtgccttgttcgcctggtcctg

SEQ ID NO: 364362 - DNA, 25 bp, Mus musculus
cgggtgctcacaactttggtttaga

SEQ ID NO: 364363 - DNA, 25 bp, Mus musculus
cgggtgctcacatctttggtttaga

SEQ ID NO: 364364 - DNA, 25 bp, Mus musculus
cgggtggagcgtataaaaacacatc

SEQ ID NO: 364365 - DNA, 25 bp, Mus musculus
cgggtggagcgtttaaaaacacatc

SEQ ID NO: 364366 - DNA, 25 bp, Mus musculus
cgggtggatggtctcatttctgaaa

SEQ ID NO: 364367 - DNA, 25 bp, Mus musculus
cgggtggatggtgtcatttctgaaa

SEQ ID NO: 364368 - DNA, 25 bp, Mus musculus
cgggtggctcctctagtatgtctca

SEQ ID NO: 364369 - DNA, 25 bp, Mus musculus
cgggtggctcctgtagtatgtctca

SEQ ID NO: 364370 - DNA, 25 bp, Mus musculus
cgggtgggtcttattatgaagcctg

SEQ ID NO: 364371 - DNA, 25 bp, Mus musculus
cgggtgggtctttttatgaagcctg

SEQ ID NO: 364372 - DNA, 25 bp, Mus musculus
cgggtgtcctgtctcttcaaagtgt

SEQ ID NO: 364373 - DNA, 25 bp, Mus musculus
cgggtgtcctgtgtcttcaaagtgt

SEQ ID NO: 364374 - DNA, 25 bp, Mus musculus
cgggtgtgacctatgaacacagaaa

SEQ ID NO: 364375 - DNA, 25 bp, Mus musculus
cgggtgtgacctttgaacacagaaa

SEQ ID NO: 364376 - DNA, 25 bp, Mus musculus
cgggtgtgcaggactctgacctaga

SEQ ID NO: 364377 - DNA, 25 bp, Mus musculus
cgggtgtgcaggtctctgacctaga

SEQ ID NO: 364378 - DNA, 25 bp, Mus musculus
cgggtgtggctgagtccccattcta

SEQ ID NO: 364379 - DNA, 25 bp, Mus musculus
cgggtgtggctgtgtccccattcta

SEQ ID NO: 364380 - DNA, 25 bp, Mus musculus
cgggtgttgcccattgaagaagaat

SEQ ID NO: 364381 - DNA, 25 bp, Mus musculus
cgggtgttgccctttgaagaagaat

SEQ ID NO: 364382 - DNA, 25 bp, Mus musculus
cgggtgttttctacttggatgttag

SEQ ID NO: 364383 - DNA, 25 bp, Mus musculus
cgggtgttttcttcttggatgttag

SEQ ID NO: 364384 - DNA, 25 bp, Mus musculus
cgggttaatcgtagtaatcttgtca

SEQ ID NO: 364385 - DNA, 25 bp, Mus musculus
cgggttaatcgttgtaatcttgtca

SEQ ID NO: 364386 - DNA, 25 bp, Mus musculus
cgggttactccaacaaggtgttcga

SEQ ID NO: 364387 - DNA, 25 bp, Mus musculus
cgggttactccatcaaggtgttcga

SEQ ID NO: 364388 - DNA, 25 bp, Mus musculus
cgggttcaccagactctagtaagtt

SEQ ID NO: 364389 - DNA, 25 bp, Mus musculus
cgggttcaccagtctctagtaagtt

SEQ ID NO: 364390 - DNA, 25 bp, Mus musculus
cgggttccaagtataagcctgcgcc

SEQ ID NO: 364391 - DNA, 25 bp, Mus musculus
cgggttccaagtttaagcctgcgcc

SEQ ID NO: 364392 - DNA, 25 bp, Mus musculus
cgggttcccagaatgacatcctaat

SEQ ID NO: 364393 - DNA, 25 bp, Mus musculus
cgggttcccagattgacatcctaat

SEQ ID NO: 364394 - DNA, 25 bp, Mus musculus
cgggttcttaccctgtgcacgtgtg

SEQ ID NO: 364395 - DNA, 25 bp, Mus musculus
cgggttcttaccgtgtgcacgtgtg

SEQ ID NO: 364396 - DNA, 25 bp, Mus musculus
cgggttgagggtaagcaagctccac

SEQ ID NO: 364397 - DNA, 25 bp, Mus musculus
cgggttgagggttagcaagctccac

SEQ ID NO: 364398 - DNA, 25 bp, Mus musculus
cgggttgcagcgcatcctattttga

SEQ ID NO: 364399 - DNA, 25 bp, Mus musculus
cgggttgcagcggatcctattttga

SEQ ID NO: 364400 - DNA, 25 bp, Mus musculus
cgggttgcctggacgttatctttga

SEQ ID NO: 364401 - DNA, 25 bp, Mus musculus
cgggttgcctggtcgttatctttga

SEQ ID NO: 364402 - DNA, 25 bp, Mus musculus
cgggttgctcctaaagacttactca

SEQ ID NO: 364403 - DNA, 25 bp, Mus musculus
cgggttgctccttaagacttactca

SEQ ID NO: 364404 - DNA, 25 bp, Mus musculus
cgggttgctcggatcaaagagctct

SEQ ID NO: 364405 - DNA, 25 bp, Mus musculus
cgggttgctcggttcaaagagctct

SEQ ID NO: 364406 - DNA, 25 bp, Mus musculus
cgggtttcacttaagtggtgccaat

SEQ ID NO: 364407 - DNA, 25 bp, Mus musculus
cgggtttcactttagtggtgccaat

SEQ ID NO: 364408 - DNA, 25 bp, Mus musculus
cgggtttcctgaccagtactgttta

SEQ ID NO: 364409 - DNA, 25 bp, Mus musculus
cgggtttcctgagcagtactgttta

SEQ ID NO: 364410 - DNA, 25 bp, Mus musculus
cgggtttgatctcccactgttgata

SEQ ID NO: 364411 - DNA, 25 bp, Mus musculus
cgggtttgatctgccactgttgata

SEQ ID NO: 364412 - DNA, 25 bp, Mus musculus
cggtaaataggaagctcgggcgaca

SEQ ID NO: 364413 - DNA, 25 bp, Mus musculus
cggtaaataggatgctcgggcgaca

SEQ ID NO: 364414 - DNA, 25 bp, Mus musculus
cggtaaccgtgactgctcatgcaga

SEQ ID NO: 364415 - DNA, 25 bp, Mus musculus
cggtaaccgtgagtgctcatgcaga

SEQ ID NO: 364416 - DNA, 25 bp, Mus musculus
cggtaactccaaatcattcaggtta

SEQ ID NO: 364417 - DNA, 25 bp, Mus musculus
cggtaactccaattcattcaggtta

SEQ ID NO: 364418 - DNA, 25 bp, Mus musculus
cggtacacactcaagtcccgatact

SEQ ID NO: 364419 - DNA, 25 bp, Mus musculus
cggtacacactctagtcccgatact

SEQ ID NO: 364420 - DNA, 25 bp, Mus musculus
cggtacactactcactactctggta

SEQ ID NO: 364421 - DNA, 25 bp, Mus musculus
cggtacactactgactactctggta

SEQ ID NO: 364422 - DNA, 25 bp, Mus musculus
cggtaccacagacccgtgagcatct

SEQ ID NO: 364423 - DNA, 25 bp, Mus musculus
cggtaccacagagccgtgagcatct

SEQ ID NO: 364424 - DNA, 25 bp, Mus musculus
cggtacggcctaaggtgcacagatg

SEQ ID NO: 364425 - DNA, 25 bp, Mus musculus
cggtacggcctatggtgcacagatg

SEQ ID NO: 364426 - DNA, 25 bp, Mus musculus
cggtactaactcctgttgatttcta

SEQ ID NO: 364427 - DNA, 25 bp, Mus musculus
cggtactaactcgtgttgatttcta

SEQ ID NO: 364428 - DNA, 25 bp, Mus musculus
cggtacttgtacatggcgtagagga

SEQ ID NO: 364429 - DNA, 25 bp, Mus musculus
cggtacttgtacttggcgtagagga

SEQ ID NO: 364430 - DNA, 25 bp, Mus musculus
cggtagagtacaatcgtgcgctgca

SEQ ID NO: 364431 - DNA, 25 bp, Mus musculus
cggtagagtacattcgtgcgctgca

SEQ ID NO: 364432 - DNA, 25 bp, Mus musculus
cggtagctaggccttgcaaaaacaa

SEQ ID NO: 364433 - DNA, 25 bp, Mus musculus
cggtagctaggcgttgcaaaaacaa

SEQ ID NO: 364434 - DNA, 25 bp, Mus musculus
cggtaggaatatattcttctgcctt

SEQ ID NO: 364435 - DNA, 25 bp, Mus musculus
cggtaggaatattttcttctgcctt

SEQ ID NO: 364436 - DNA, 25 bp, Mus musculus
cggtagggcaccagaagcttcggtc

SEQ ID NO: 364437 - DNA, 25 bp, Mus musculus
cggtagggcacctgaagcttcggtc

SEQ ID NO: 364438 - DNA, 25 bp, Mus musculus
cggtagggcccaaagagttgtctta

SEQ ID NO: 364439 - DNA, 25 bp, Mus musculus
cggtagggcccatagagttgtctta

SEQ ID NO: 364440 - DNA, 25 bp, Mus musculus
cggtagtacgtgagtctttttgctg

SEQ ID NO: 364441 - DNA, 25 bp, Mus musculus
cggtagtacgtgtgtctttttgctg

SEQ ID NO: 364442 - DNA, 25 bp, Mus musculus
cggtagtagctcctttgcttactgg

SEQ ID NO: 364443 - DNA, 25 bp, Mus musculus
cggtagtagctcgtttgcttactgg

SEQ ID NO: 364444 - DNA, 25 bp, Mus musculus
cggtagtcaccacaatgttcacaat

SEQ ID NO: 364445 - DNA, 25 bp, Mus musculus
cggtagtcaccagaatgttcacaat

SEQ ID NO: 364446 - DNA, 25 bp, Mus musculus
cggtagtcttttccctggcaagaag

SEQ ID NO: 364447 - DNA, 25 bp, Mus musculus
cggtagtcttttgcctggcaagaag

SEQ ID NO: 364448 - DNA, 25 bp, Mus musculus
cggtagtgcaacatccctggaggaa

SEQ ID NO: 364449 - DNA, 25 bp, Mus musculus
cggtagtgcaacttccctggaggaa

SEQ ID NO: 364450 - DNA, 25 bp, Mus musculus
cggtagtgtggtagcctgcagcatc

SEQ ID NO: 364451 - DNA, 25 bp, Mus musculus
cggtagtgtggttgcctgcagcatc

SEQ ID NO: 364452 - DNA, 25 bp, Mus musculus
cggtatctgtacaagctggagcctg

SEQ ID NO: 364453 - DNA, 25 bp, Mus musculus
cggtatctgtactagctggagcctg

SEQ ID NO: 364454 - DNA, 25 bp, Mus musculus
cggtatctgtttcaagtgaagggac

SEQ ID NO: 364455 - DNA, 25 bp, Mus musculus
cggtatctgtttgaagtgaagggac

SEQ ID NO: 364456 - DNA, 25 bp, Mus musculus
cggtatgcccatatctaatctttaa

SEQ ID NO: 364457 - DNA, 25 bp, Mus musculus
cggtatgcccatttctaatctttaa

SEQ ID NO: 364458 - DNA, 25 bp, Mus musculus
cggtatgctattattctggtttgga

SEQ ID NO: 364459 - DNA, 25 bp, Mus musculus
cggtatgctatttttctggtttgga

SEQ ID NO: 364460 - DNA, 25 bp, Mus musculus
cggtatggtagaccatcctttgggt

SEQ ID NO: 364461 - DNA, 25 bp, Mus musculus
cggtatggtagagcatcctttgggt

SEQ ID NO: 364462 - DNA, 25 bp, Mus musculus
cggtatgtacatacacagtactgaa

SEQ ID NO: 364463 - DNA, 25 bp, Mus musculus
cggtatgtacattcacagtactgaa

SEQ ID NO: 364464 - DNA, 25 bp, Mus musculus
cggtatgtcggcaccgggatcaatg

SEQ ID NO: 364465 - DNA, 25 bp, Mus musculus
cggtatgtcggctccgggatcaatg

SEQ ID NO: 364466 - DNA, 25 bp, Mus musculus
cggtatgttcatcgccctcagtaag

SEQ ID NO: 364467 - DNA, 25 bp, Mus musculus
cggtatgttcatggccctcagtaag

SEQ ID NO: 364468 - DNA, 25 bp, Mus musculus
cggtattcttcaactgtagaggaga

SEQ ID NO: 364469 - DNA, 25 bp, Mus musculus
cggtattcttcatctgtagaggaga

SEQ ID NO: 364470 - DNA, 25 bp, Mus musculus
cggtatttttccacagcacagccat

SEQ ID NO: 364471 - DNA, 25 bp, Mus musculus
cggtatttttcctcagcacagccat

SEQ ID NO: 364472 - DNA, 25 bp, Mus musculus
cggtcaactggaagtgagaagcttt

SEQ ID NO: 364473 - DNA, 25 bp, Mus musculus
cggtcaactggatgtgagaagcttt

SEQ ID NO: 364474 - DNA, 25 bp, Mus musculus
cggtcaagaacaacacgcaagtgct

SEQ ID NO: 364475 - DNA, 25 bp, Mus musculus
cggtcaagaacatcacgcaagtgct

SEQ ID NO: 364476 - DNA, 25 bp, Mus musculus
cggtcaagcatcactcagcctgata

SEQ ID NO: 364477 - DNA, 25 bp, Mus musculus
cggtcaagcatctctcagcctgata

SEQ ID NO: 364478 - DNA, 25 bp, Mus musculus
cggtcaattttcatagtgcagaaga

SEQ ID NO: 364479 - DNA, 25 bp, Mus musculus
cggtcaattttcttagtgcagaaga

SEQ ID NO: 364480 - DNA, 25 bp, Mus musculus
cggtcacaaatgcagttttactatc

SEQ ID NO: 364481 - DNA, 25 bp, Mus musculus
cggtcacaaatggagttttactatc

SEQ ID NO: 364482 - DNA, 25 bp, Mus musculus
cggtcacagatgatgtgcggattct

SEQ ID NO: 364483 - DNA, 25 bp, Mus musculus
cggtcacagatgttgtgcggattct

SEQ ID NO: 364484 - DNA, 25 bp, Mus musculus
cggtcacagcgcaataagaacagaa

SEQ ID NO: 364485 - DNA, 25 bp, Mus musculus
cggtcacagcgctataagaacagaa

SEQ ID NO: 364486 - DNA, 25 bp, Mus musculus
cggtcacataaaatcatctggctag

SEQ ID NO: 364487 - DNA, 25 bp, Mus musculus
cggtcacataaattcatctggctag

SEQ ID NO: 364488 - DNA, 25 bp, Mus musculus
cggtcacgtgctatgggcctcggat

SEQ ID NO: 364489 - DNA, 25 bp, Mus musculus
cggtcacgtgctttgggcctcggat

SEQ ID NO: 364490 - DNA, 25 bp, Mus musculus
cggtcactccccaagattgagcgga

SEQ ID NO: 364491 - DNA, 25 bp, Mus musculus
cggtcactcccctagattgagcgga

SEQ ID NO: 364492 - DNA, 25 bp, Mus musculus
cggtcacttggcctttcataattaa

SEQ ID NO: 364493 - DNA, 25 bp, Mus musculus
cggtcacttggcgtttcataattaa

SEQ ID NO: 364494 - DNA, 25 bp, Mus musculus
cggtcactttgaagggattctatat

SEQ ID NO: 364495 - DNA, 25 bp, Mus musculus
cggtcactttgatgggattctatat

SEQ ID NO: 364496 - DNA, 25 bp, Mus musculus
cggtcagagtacaaatggttccaaa

SEQ ID NO: 364497 - DNA, 25 bp, Mus musculus
cggtcagagtactaatggttccaaa

SEQ ID NO: 364498 - DNA, 25 bp, Mus musculus
cggtcagccctaactgtccatcaga

SEQ ID NO: 364499 - DNA, 25 bp, Mus musculus
cggtcagccctatctgtccatcaga

SEQ ID NO: 364500 - DNA, 25 bp, Mus musculus
cggtcagccgctcagcgcgataagt

SEQ ID NO: 364501 - DNA, 25 bp, Mus musculus
cggtcagccgctgagcgcgataagt

SEQ ID NO: 364502 - DNA, 25 bp, Mus musculus
cggtcagctcctcctattacagaga

SEQ ID NO: 364503 - DNA, 25 bp, Mus musculus
cggtcagctcctgctattacagaga

SEQ ID NO: 364504 - DNA, 25 bp, Mus musculus
cggtcaggcaggacactggatgtct

SEQ ID NO: 364505 - DNA, 25 bp, Mus musculus
cggtcaggcaggtcactggatgtct

SEQ ID NO: 364506 - DNA, 25 bp, Mus musculus
cggtcaggcattacgtcattcacat

SEQ ID NO: 364507 - DNA, 25 bp, Mus musculus
cggtcaggcatttcgtcattcacat

SEQ ID NO: 364508 - DNA, 25 bp, Mus musculus
cggtcatgatcgattatcccatggg

SEQ ID NO: 364509 - DNA, 25 bp, Mus musculus
cggtcatgatcgtttatcccatggg

SEQ ID NO: 364510 - DNA, 25 bp, Mus musculus
cggtccacagagcatgggctacaag

SEQ ID NO: 364511 - DNA, 25 bp, Mus musculus
cggtccacagaggatgggctacaag

SEQ ID NO: 364512 - DNA, 25 bp, Mus musculus
cggtccagcatcatttgcaattcta

SEQ ID NO: 364513 - DNA, 25 bp, Mus musculus
cggtccagcatcttttgcaattcta

SEQ ID NO: 364514 - DNA, 25 bp, Mus musculus
cggtccagttttcaggatccaatag

SEQ ID NO: 364515 - DNA, 25 bp, Mus musculus
cggtccagttttgaggatccaatag

SEQ ID NO: 364516 - DNA, 25 bp, Mus musculus
cggtccatcctcaaggagcaaggtt

SEQ ID NO: 364517 - DNA, 25 bp, Mus musculus
cggtccatcctctaggagcaaggtt

SEQ ID NO: 364518 - DNA, 25 bp, Mus musculus
cggtccccacttcagtatctaacat

SEQ ID NO: 364519 - DNA, 25 bp, Mus musculus
cggtccccacttgagtatctaacat

SEQ ID NO: 364520 - DNA, 25 bp, Mus musculus
cggtcctaatagaattcccagctgc

SEQ ID NO: 364521 - DNA, 25 bp, Mus musculus
cggtcctaatagtattcccagctgc

SEQ ID NO: 364522 - DNA, 25 bp, Mus musculus
cggtcctcaagccagatcaatattc

SEQ ID NO: 364523 - DNA, 25 bp, Mus musculus
cggtcctcaagcgagatcaatattc

SEQ ID NO: 364524 - DNA, 25 bp, Mus musculus
cggtcctgagaccttaccagagaga

SEQ ID NO: 364525 - DNA, 25 bp, Mus musculus
cggtcctgagacgttaccagagaga

SEQ ID NO: 364526 - DNA, 25 bp, Mus musculus
cggtcctgtgtacgctcgtcggcaa

SEQ ID NO: 364527 - DNA, 25 bp, Mus musculus
cggtcctgtgtaggctcgtcggcaa

SEQ ID NO: 364528 - DNA, 25 bp, Mus musculus
cggtccttgcggctgctactgctgc

SEQ ID NO: 364529 - DNA, 25 bp, Mus musculus
cggtccttgcgggtgctactgctgc

SEQ ID NO: 364530 - DNA, 25 bp, Mus musculus
cggtcgcaagcacatttaccagctg

SEQ ID NO: 364531 - DNA, 25 bp, Mus musculus
cggtcgcaagcagatttaccagctg

SEQ ID NO: 364532 - DNA, 25 bp, Mus musculus
cggtcgcttgtcacgggccgaaaat

SEQ ID NO: 364533 - DNA, 25 bp, Mus musculus
cggtcgcttgtctcgggccgaaaat

SEQ ID NO: 364534 - DNA, 25 bp, Mus musculus
cggtcgtacacacaacgcttcttag

SEQ ID NO: 364535 - DNA, 25 bp, Mus musculus
cggtcgtacacagaacgcttcttag

SEQ ID NO: 364536 - DNA, 25 bp, Mus musculus
cggtcgtgcagtacttgggcgtgcc

SEQ ID NO: 364537 - DNA, 25 bp, Mus musculus
cggtcgtgcagttcttgggcgtgcc

SEQ ID NO: 364538 - DNA, 25 bp, Mus musculus
cggtcgtttgccatctttagctgtg

SEQ ID NO: 364539 - DNA, 25 bp, Mus musculus
cggtcgtttgccttctttagctgtg

SEQ ID NO: 364540 - DNA, 25 bp, Mus musculus
cggtctaagcacacatgattttata

SEQ ID NO: 364541 - DNA, 25 bp, Mus musculus
cggtctaagcactcatgattttata

SEQ ID NO: 364542 - DNA, 25 bp, Mus musculus
cggtctataatgcaaaagctgttac

SEQ ID NO: 364543 - DNA, 25 bp, Mus musculus
cggtctataatggaaaagctgttac

SEQ ID NO: 364544 - DNA, 25 bp, Mus musculus
cggtctcccagccatgtgtagcagc

SEQ ID NO: 364545 - DNA, 25 bp, Mus musculus
cggtctcccagcgatgtgtagcagc

SEQ ID NO: 364546 - DNA, 25 bp, Mus musculus
cggtctctaaccagtgcatctgtct

SEQ ID NO: 364547 - DNA, 25 bp, Mus musculus
cggtctctaacctgtgcatctgtct

SEQ ID NO: 364548 - DNA, 25 bp, Mus musculus
cggtctctccttccaagacttcaga

SEQ ID NO: 364549 - DNA, 25 bp, Mus musculus
cggtctctccttgcaagacttcaga

SEQ ID NO: 364550 - DNA, 25 bp, Mus musculus
cggtctgagcagagcaccttacagt

SEQ ID NO: 364551 - DNA, 25 bp, Mus musculus
cggtctgagcagtgcaccttacagt

SEQ ID NO: 364552 - DNA, 25 bp, Mus musculus
cggtctgattatattctgggatttt

SEQ ID NO: 364553 - DNA, 25 bp, Mus musculus
cggtctgattattttctgggatttt

SEQ ID NO: 364554 - DNA, 25 bp, Mus musculus
cggtctgcagctctgtatggtatta

SEQ ID NO: 364555 - DNA, 25 bp, Mus musculus
cggtctgcagctgtgtatggtatta

SEQ ID NO: 364556 - DNA, 25 bp, Mus musculus
cggtctggacagctgtttcttgttg

SEQ ID NO: 364557 - DNA, 25 bp, Mus musculus
cggtctggacaggtgtttcttgttg

SEQ ID NO: 364558 - DNA, 25 bp, Mus musculus
cggtctgtctctccgatggcagcag

SEQ ID NO: 364559 - DNA, 25 bp, Mus musculus
cggtctgtctctgcgatggcagcag

SEQ ID NO: 364560 - DNA, 25 bp, Mus musculus
cggtcttcgggcctgacaaatggaa

SEQ ID NO: 364561 - DNA, 25 bp, Mus musculus
cggtcttcgggcgtgacaaatggaa

SEQ ID NO: 364562 - DNA, 25 bp, Mus musculus
cggtctttggtgagacatcctacaa

SEQ ID NO: 364563 - DNA, 25 bp, Mus musculus
cggtctttggtgtgacatcctacaa

SEQ ID NO: 364564 - DNA, 25 bp, Mus musculus
cggtgaaccttcatgtttacagatt

SEQ ID NO: 364565 - DNA, 25 bp, Mus musculus
cggtgaaccttcttgtttacagatt

SEQ ID NO: 364566 - DNA, 25 bp, Mus musculus
cggtgaagacatcgccaggcagcca

SEQ ID NO: 364567 - DNA, 25 bp, Mus musculus
cggtgaagacatggccaggcagcca

SEQ ID NO: 364568 - DNA, 25 bp, Mus musculus
cggtgaagacgcagacatgccagaa

SEQ ID NO: 364569 - DNA, 25 bp, Mus musculus
cggtgaagacgctgacatgccagaa

SEQ ID NO: 364570 - DNA, 25 bp, Mus musculus
cggtgaatgagaaccgcgttcgtgt

SEQ ID NO: 364571 - DNA, 25 bp, Mus musculus
cggtgaatgagatccgcgttcgtgt

SEQ ID NO: 364572 - DNA, 25 bp, Mus musculus
cggtgaatgggtatctcctactgac

SEQ ID NO: 364573 - DNA, 25 bp, Mus musculus
cggtgaatgggtttctcctactgac

SEQ ID NO: 364574 - DNA, 25 bp, Mus musculus
cggtgaatgtcgatctgagcacttc

SEQ ID NO: 364575 - DNA, 25 bp, Mus musculus
cggtgaatgtcgttctgagcacttc

SEQ ID NO: 364576 - DNA, 25 bp, Mus musculus
cggtgacaggtcatcccttagggat

SEQ ID NO: 364577 - DNA, 25 bp, Mus musculus
cggtgacaggtcttcccttagggat

SEQ ID NO: 364578 - DNA, 25 bp, Mus musculus
cggtgaccgcatacttctccgttgc

SEQ ID NO: 364579 - DNA, 25 bp, Mus musculus
cggtgaccgcattcttctccgttgc

SEQ ID NO: 364580 - DNA, 25 bp, Mus musculus
cggtgactgggacaggtattacata

SEQ ID NO: 364581 - DNA, 25 bp, Mus musculus
cggtgactgggagaggtattacata

SEQ ID NO: 364582 - DNA, 25 bp, Mus musculus
cggtgacttgttaacagctgggtgt

SEQ ID NO: 364583 - DNA, 25 bp, Mus musculus
cggtgacttgtttacagctgggtgt

SEQ ID NO: 364584 - DNA, 25 bp, Mus musculus
cggtgactttaaacttaatgcattt

SEQ ID NO: 364585 - DNA, 25 bp, Mus musculus
cggtgactttaatcttaatgcattt

SEQ ID NO: 364586 - DNA, 25 bp, Mus musculus
cggtgagcgcctcgtcagtgatcca

SEQ ID NO: 364587 - DNA, 25 bp, Mus musculus
cggtgagcgcctggtcagtgatcca

SEQ ID NO: 364588 - DNA, 25 bp, Mus musculus
cggtgaggcgcactaaacagaagca

SEQ ID NO: 364589 - DNA, 25 bp, Mus musculus
cggtgaggcgcagtaaacagaagca

SEQ ID NO: 364590 - DNA, 25 bp, Mus musculus
cggtgagtggtgcaaggctcagtcc

SEQ ID NO: 364591 - DNA, 25 bp, Mus musculus
cggtgagtggtggaaggctcagtcc

SEQ ID NO: 364592 - DNA, 25 bp, Mus musculus
cggtgattcggaagcccctcgagac

SEQ ID NO: 364593 - DNA, 25 bp, Mus musculus
cggtgattcggatgcccctcgagac

SEQ ID NO: 364594 - DNA, 25 bp, Mus musculus
cggtgcagatcccaatgctgtggat

SEQ ID NO: 364595 - DNA, 25 bp, Mus musculus
cggtgcagatccgaatgctgtggat

SEQ ID NO: 364596 - DNA, 25 bp, Mus musculus
cggtgcaggcaaatgtaagatactt

SEQ ID NO: 364597 - DNA, 25 bp, Mus musculus
cggtgcaggcaattgtaagatactt

SEQ ID NO: 364598 - DNA, 25 bp, Mus musculus
cggtgcagtggtcctcccggaaact

SEQ ID NO: 364599 - DNA, 25 bp, Mus musculus
cggtgcagtggtgctcccggaaact

SEQ ID NO: 364600 - DNA, 25 bp, Mus musculus
cggtgcattggcctttttcataaga

SEQ ID NO: 364601 - DNA, 25 bp, Mus musculus
cggtgcattggcgtttttcataaga

SEQ ID NO: 364602 - DNA, 25 bp, Mus musculus
cggtgcatttacatatagactgaat

SEQ ID NO: 364603 - DNA, 25 bp, Mus musculus
cggtgcatttacttatagactgaat

SEQ ID NO: 364604 - DNA, 25 bp, Mus musculus
cggtgccacgcaacttcatgaaggg

SEQ ID NO: 364605 - DNA, 25 bp, Mus musculus
cggtgccacgcaattgaaaaagagt

SEQ ID NO: 364606 - DNA, 25 bp, Mus musculus
cggtgccacgcatcttcatgaaggg

SEQ ID NO: 364607 - DNA, 25 bp, Mus musculus
cggtgccacgcatttgaaaaagagt

SEQ ID NO: 364608 - DNA, 25 bp, Mus musculus
cggtgccatccaccctggcagaaga

SEQ ID NO: 364609 - DNA, 25 bp, Mus musculus
cggtgccatccagcctggcagaaga

SEQ ID NO: 364610 - DNA, 25 bp, Mus musculus
cggtgcccttcacgaggctagcgaa

SEQ ID NO: 364611 - DNA, 25 bp, Mus musculus
cggtgcccttcaggaggctagcgaa

SEQ ID NO: 364612 - DNA, 25 bp, Mus musculus
cggtgcctgtatccctcatgctttt

SEQ ID NO: 364613 - DNA, 25 bp, Mus musculus
cggtgcctgtatgcctcatgctttt

SEQ ID NO: 364614 - DNA, 25 bp, Mus musculus
cggtgccttttcaaagacaacgacg

SEQ ID NO: 364615 - DNA, 25 bp, Mus musculus
cggtgccttttctaagacaacgacg

SEQ ID NO: 364616 - DNA, 25 bp, Mus musculus
cggtgcgcatctcatcagaattgtt

SEQ ID NO: 364617 - DNA, 25 bp, Mus musculus
cggtgcgcatctgatcagaattgtt

SEQ ID NO: 364618 - DNA, 25 bp, Mus musculus
cggtgctacgcaatccaatgagttt

SEQ ID NO: 364619 - DNA, 25 bp, Mus musculus
cggtgctacgcattccaatgagttt

SEQ ID NO: 364620 - DNA, 25 bp, Mus musculus
cggtgctcaagtctgctgaagcctt

SEQ ID NO: 364621 - DNA, 25 bp, Mus musculus
cggtgctcaagtgtgctgaagcctt

SEQ ID NO: 364622 - DNA, 25 bp, Mus musculus
cggtgctcagcaagaccgccgtcag

SEQ ID NO: 364623 - DNA, 25 bp, Mus musculus
cggtgctcagcatgaccgccgtcag

SEQ ID NO: 364624 - DNA, 25 bp, Mus musculus
cggtgctcggcaaccgggccagatt

SEQ ID NO: 364625 - DNA, 25 bp, Mus musculus
cggtgctcggcatccgggccagatt

SEQ ID NO: 364626 - DNA, 25 bp, Mus musculus
cggtgctctgtcaacgcaggataaa

SEQ ID NO: 364627 - DNA, 25 bp, Mus musculus
cggtgctctgtctacgcaggataaa

SEQ ID NO: 364628 - DNA, 25 bp, Mus musculus
cggtgctggcagagaaagccctgca

SEQ ID NO: 364629 - DNA, 25 bp, Mus musculus
cggtgctggcagtgaaagccctgca

SEQ ID NO: 364630 - DNA, 25 bp, Mus musculus
cggtgctgtttcagactggaacgtg

SEQ ID NO: 364631 - DNA, 25 bp, Mus musculus
cggtgctgtttctgactggaacgtg

SEQ ID NO: 364632 - DNA, 25 bp, Mus musculus
cggtggaatgaaacccttgagattt

SEQ ID NO: 364633 - DNA, 25 bp, Mus musculus
cggtggaatgaatcccttgagattt

SEQ ID NO: 364634 - DNA, 25 bp, Mus musculus
cggtggagactcagctagcttgaca

SEQ ID NO: 364635 - DNA, 25 bp, Mus musculus
cggtggagactctgctagcttgaca

SEQ ID NO: 364636 - DNA, 25 bp, Mus musculus
cggtggatccacatgtaaactgttt

SEQ ID NO: 364637 - DNA, 25 bp, Mus musculus
cggtggatccacttgtaaactgttt

SEQ ID NO: 364638 - DNA, 25 bp, Mus musculus
cggtggcgtgctaacctagtatgtg

SEQ ID NO: 364639 - DNA, 25 bp, Mus musculus
cggtggcgtgcttacctagtatgtg

SEQ ID NO: 364640 - DNA, 25 bp, Mus musculus
cggtggctataccagggaatctgtt

SEQ ID NO: 364641 - DNA, 25 bp, Mus musculus
cggtggctatacgagggaatctgtt

SEQ ID NO: 364642 - DNA, 25 bp, Mus musculus
cggtggctatgcataatcctgtggc

SEQ ID NO: 364643 - DNA, 25 bp, Mus musculus
cggtggctatgcttaatcctgtggc

SEQ ID NO: 364644 - DNA, 25 bp, Mus musculus
cggtggcttatgactatgatcctag

SEQ ID NO: 364645 - DNA, 25 bp, Mus musculus
cggtggcttatgtctatgatcctag

SEQ ID NO: 364646 - DNA, 25 bp, Mus musculus
cggtggcttctcaattcatgaattt

SEQ ID NO: 364647 - DNA, 25 bp, Mus musculus
cggtggcttctctattcatgaattt

SEQ ID NO: 364648 - DNA, 25 bp, Mus musculus
cggtggcttttgattaattggcttg

SEQ ID NO: 364649 - DNA, 25 bp, Mus musculus
cggtggcttttgtttaattggcttg

SEQ ID NO: 364650 - DNA, 25 bp, Mus musculus
cggtgggcacggaactcgcgacctc

SEQ ID NO: 364651 - DNA, 25 bp, Mus musculus
cggtgggcacggtactcgcgacctc

SEQ ID NO: 364652 - DNA, 25 bp, Mus musculus
cggtgggctcagaaggtgaaaacca

SEQ ID NO: 364653 - DNA, 25 bp, Mus musculus
cggtgggctcagtaggtgaaaacca

SEQ ID NO: 364654 - DNA, 25 bp, Mus musculus
cggtgggtggcaagtctataatcct

SEQ ID NO: 364655 - DNA, 25 bp, Mus musculus
cggtgggtggcatgtctataatcct

SEQ ID NO: 364656 - DNA, 25 bp, Mus musculus
cggtggtcaaaacgctcgcttttag

SEQ ID NO: 364657 - DNA, 25 bp, Mus musculus
cggtggtcaaaaggctcgcttttag

SEQ ID NO: 364658 - DNA, 25 bp, Mus musculus
cggtggtcagagacgtgaagcctat

SEQ ID NO: 364659 - DNA, 25 bp, Mus musculus
cggtggtcagagtcgtgaagcctat

SEQ ID NO: 364660 - DNA, 25 bp, Mus musculus
cggtggtcagggatcacaggtctct

SEQ ID NO: 364661 - DNA, 25 bp, Mus musculus
cggtggtcagggttcacaggtctct

SEQ ID NO: 364662 - DNA, 25 bp, Mus musculus
cggtggtcattgcttctcaacccag

SEQ ID NO: 364663 - DNA, 25 bp, Mus musculus
cggtggtcattggttctcaacccag

SEQ ID NO: 364664 - DNA, 25 bp, Mus musculus
cggtggtcggtcacagcttgattag

SEQ ID NO: 364665 - DNA, 25 bp, Mus musculus
cggtggtcggtctcagcttgattag

SEQ ID NO: 364666 - DNA, 25 bp, Mus musculus
cggtggtgtcacatatgaatggcat

SEQ ID NO: 364667 - DNA, 25 bp, Mus musculus
cggtggtgtcacttatgaatggcat

SEQ ID NO: 364668 - DNA, 25 bp, Mus musculus
cggtgtatggatctgtggtcatttc

SEQ ID NO: 364669 - DNA, 25 bp, Mus musculus
cggtgtatggatgtgtggtcatttc

SEQ ID NO: 364670 - DNA, 25 bp, Mus musculus
cggtgtcacaccagccacagcaagg

SEQ ID NO: 364671 - DNA, 25 bp, Mus musculus
cggtgtcacacctgccacagcaagg

SEQ ID NO: 364672 - DNA, 25 bp, Mus musculus
cggtgtcacatgaaatatcaacttt

SEQ ID NO: 364673 - DNA, 25 bp, Mus musculus
cggtgtcacatgtaatatcaacttt

SEQ ID NO: 364674 - DNA, 25 bp, Mus musculus
cggtgtcacttacctgctagtgtga

SEQ ID NO: 364675 - DNA, 25 bp, Mus musculus
cggtgtcacttagctgctagtgtga

SEQ ID NO: 364676 - DNA, 25 bp, Mus musculus
cggtgtccctggaggaacgcaagta

SEQ ID NO: 364677 - DNA, 25 bp, Mus musculus
cggtgtccctggtggaacgcaagta

SEQ ID NO: 364678 - DNA, 25 bp, Mus musculus
cggtgtcgagctacgtggcctatca

SEQ ID NO: 364679 - DNA, 25 bp, Mus musculus
cggtgtcgagcttcgtggcctatca

SEQ ID NO: 364680 - DNA, 25 bp, Mus musculus
cggtgtgcaaagctgtgtctagtat

SEQ ID NO: 364681 - DNA, 25 bp, Mus musculus
cggtgtgcaaaggtgtgtctagtat

SEQ ID NO: 364682 - DNA, 25 bp, Mus musculus
cggtgtgccctgataagtgcaagca

SEQ ID NO: 364683 - DNA, 25 bp, Mus musculus
cggtgtgccctgttaagtgcaagca

SEQ ID NO: 364684 - DNA, 25 bp, Mus musculus
cggtgtgcctaacttaacttactat

SEQ ID NO: 364685 - DNA, 25 bp, Mus musculus
cggtgtgcctaagttaacttactat

SEQ ID NO: 364686 - DNA, 25 bp, Mus musculus
cggtgtgggactacgacattggcaa

SEQ ID NO: 364687 - DNA, 25 bp, Mus musculus
cggtgtgggacttcgacattggcaa

SEQ ID NO: 364688 - DNA, 25 bp, Mus musculus
cggtgtgggagcacaagcgcatcat

SEQ ID NO: 364689 - DNA, 25 bp, Mus musculus
cggtgtgggagctcaagcgcatcat

SEQ ID NO: 364690 - DNA, 25 bp, Mus musculus
cggtgtgttaatccgtagaggttta

SEQ ID NO: 364691 - DNA, 25 bp, Mus musculus
cggtgtgttaatgcgtagaggttta

SEQ ID NO: 364692 - DNA, 25 bp, Mus musculus
cggtgtgtttcaatagtttactgga

SEQ ID NO: 364693 - DNA, 25 bp, Mus musculus
cggtgtgtttcattagtttactgga

SEQ ID NO: 364694 - DNA, 25 bp, Mus musculus
cggtgttacgacagatcccctctca

SEQ ID NO: 364695 - DNA, 25 bp, Mus musculus
cggtgttacgactgatcccctctca

SEQ ID NO: 364696 - DNA, 25 bp, Mus musculus
cggtgttactcgcaggccagagaaa

SEQ ID NO: 364697 - DNA, 25 bp, Mus musculus
cggtgttactcggaggccagagaaa

SEQ ID NO: 364698 - DNA, 25 bp, Mus musculus
cggtgttccccgatgggacatttgt

SEQ ID NO: 364699 - DNA, 25 bp, Mus musculus
cggtgttccccgttgggacatttgt

SEQ ID NO: 364700 - DNA, 25 bp, Mus musculus
cggtgttcttccatctcaaaaggtg

SEQ ID NO: 364701 - DNA, 25 bp, Mus musculus
cggtgttcttccttctcaaaaggtg

SEQ ID NO: 364702 - DNA, 25 bp, Mus musculus
cggtgttgagtcctgttctgtgcca

SEQ ID NO: 364703 - DNA, 25 bp, Mus musculus
cggtgttgagtcgtgttctgtgcca

SEQ ID NO: 364704 - DNA, 25 bp, Mus musculus
cggtgttgcatccatacaggcaggt

SEQ ID NO: 364705 - DNA, 25 bp, Mus musculus
cggtgttgcatcgatacaggcaggt

SEQ ID NO: 364706 - DNA, 25 bp, Mus musculus
cggtgtttcatccagagacttgctt

SEQ ID NO: 364707 - DNA, 25 bp, Mus musculus
cggtgtttcatcgagagacttgctt

SEQ ID NO: 364708 - DNA, 25 bp, Mus musculus
cggtgtttctgaccacttctagggc

SEQ ID NO: 364709 - DNA, 25 bp, Mus musculus
cggtgtttctgagcacttctagggc

SEQ ID NO: 364710 - DNA, 25 bp, Mus musculus
cggtgttttagacagtgcttcctca

SEQ ID NO: 364711 - DNA, 25 bp, Mus musculus
cggtgttttagagagtgcttcctca

SEQ ID NO: 364712 - DNA, 25 bp, Mus musculus
cggttaagagcaatacttctcttcc

SEQ ID NO: 364713 - DNA, 25 bp, Mus musculus
cggttaagagcattacttctcttcc

SEQ ID NO: 364714 - DNA, 25 bp, Mus musculus
cggttagaggcgcttcatcagctga

SEQ ID NO: 364715 - DNA, 25 bp, Mus musculus
cggttagaggcggttcatcagctga

SEQ ID NO: 364716 - DNA, 25 bp, Mus musculus
cggttagtgtcacacaccctgaatc

SEQ ID NO: 364717 - DNA, 25 bp, Mus musculus
cggttagtgtcagacaccctgaatc

SEQ ID NO: 364718 - DNA, 25 bp, Mus musculus
cggttatataatctgtttggtctac

SEQ ID NO: 364719 - DNA, 25 bp, Mus musculus
cggttatataatgtgtttggtctac

SEQ ID NO: 364720 - DNA, 25 bp, Mus musculus
cggttatctataatcattttgtttc

SEQ ID NO: 364721 - DNA, 25 bp, Mus musculus
cggttatctatattcattttgtttc

SEQ ID NO: 364722 - DNA, 25 bp, Mus musculus
cggttatgtctcatttcagttgcgc

SEQ ID NO: 364723 - DNA, 25 bp, Mus musculus
cggttatgtctcttttcagttgcgc

SEQ ID NO: 364724 - DNA, 25 bp, Mus musculus
cggttatgtgccattcccaggagcc

SEQ ID NO: 364725 - DNA, 25 bp, Mus musculus
cggttatgtgcctttcccaggagcc

SEQ ID NO: 364726 - DNA, 25 bp, Mus musculus
cggttcaagctgctgatgattcgcc

SEQ ID NO: 364727 - DNA, 25 bp, Mus musculus
cggttcaagctggtgatgattcgcc

SEQ ID NO: 364728 - DNA, 25 bp, Mus musculus
cggttcactgaacgcgtcctgtata

SEQ ID NO: 364729 - DNA, 25 bp, Mus musculus
cggttcactgaaggcgtcctgtata

SEQ ID NO: 364730 - DNA, 25 bp, Mus musculus
cggttcactgtaagcttaataaatt

SEQ ID NO: 364731 - DNA, 25 bp, Mus musculus
cggttcactgtatgcttaataaatt

SEQ ID NO: 364732 - DNA, 25 bp, Mus musculus
cggttcactgtcactgtttctgttg

SEQ ID NO: 364733 - DNA, 25 bp, Mus musculus
cggttcactgtctctgtttctgttg

SEQ ID NO: 364734 - DNA, 25 bp, Mus musculus
cggttcagtgtcaaatagtacagaa

SEQ ID NO: 364735 - DNA, 25 bp, Mus musculus
cggttcagtgtctaatagtacagaa

SEQ ID NO: 364736 - DNA, 25 bp, Mus musculus
cggttcatcactcccaatcagtatg

SEQ ID NO: 364737 - DNA, 25 bp, Mus musculus
cggttcatcactgccaatcagtatg

SEQ ID NO: 364738 - DNA, 25 bp, Mus musculus
cggttcatcaggctcactctaaaga

SEQ ID NO: 364739 - DNA, 25 bp, Mus musculus
cggttcatcagggtcactctaaaga

SEQ ID NO: 364740 - DNA, 25 bp, Mus musculus
cggttcattcctatgcctctctaag

SEQ ID NO: 364741 - DNA, 25 bp, Mus musculus
cggttcattcctttgcctctctaag

SEQ ID NO: 364742 - DNA, 25 bp, Mus musculus
cggttccacagcaacttcaagatca

SEQ ID NO: 364743 - DNA, 25 bp, Mus musculus
cggttccacagctacttcaagatca

SEQ ID NO: 364744 - DNA, 25 bp, Mus musculus
cggttccacattagactgatttgtg

SEQ ID NO: 364745 - DNA, 25 bp, Mus musculus
cggttccacatttgactgatttgtg

SEQ ID NO: 364746 - DNA, 25 bp, Mus musculus
cggttccagtatcttcttgagaaag

SEQ ID NO: 364747 - DNA, 25 bp, Mus musculus
cggttccagtatgttcttgagaaag

SEQ ID NO: 364748 - DNA, 25 bp, Mus musculus
cggttcccagttatttatctgcact

SEQ ID NO: 364749 - DNA, 25 bp, Mus musculus
cggttcccagttttttatctgcact

SEQ ID NO: 364750 - DNA, 25 bp, Mus musculus
cggttccggaacagtgttggctcac

SEQ ID NO: 364751 - DNA, 25 bp, Mus musculus
cggttccggaactgtgttggctcac

SEQ ID NO: 364752 - DNA, 25 bp, Mus musculus
cggttcgttgacaggcattgcattc

SEQ ID NO: 364753 - DNA, 25 bp, Mus musculus
cggttcgttgactggcattgcattc

SEQ ID NO: 364754 - DNA, 25 bp, Mus musculus
cggttctcggccatgatgttaaatt

SEQ ID NO: 364755 - DNA, 25 bp, Mus musculus
cggttctcggccttgatgttaaatt

SEQ ID NO: 364756 - DNA, 25 bp, Mus musculus
cggttctgatcaactctgtctgcta

SEQ ID NO: 364757 - DNA, 25 bp, Mus musculus
cggttctgatcatctctgtctgcta

SEQ ID NO: 364758 - DNA, 25 bp, Mus musculus
cggttctggccacgctgaacagtga

SEQ ID NO: 364759 - DNA, 25 bp, Mus musculus
cggttctggccaggctgaacagtga

SEQ ID NO: 364760 - DNA, 25 bp, Mus musculus
cggttcttgaatatggactgtcctc

SEQ ID NO: 364761 - DNA, 25 bp, Mus musculus
cggttcttgaatttggactgtcctc

SEQ ID NO: 364762 - DNA, 25 bp, Mus musculus
cggttctttcagacacaaacagggt

SEQ ID NO: 364763 - DNA, 25 bp, Mus musculus
cggttctttcagtcacaaacagggt

SEQ ID NO: 364764 - DNA, 25 bp, Mus musculus
cggttgccgcttcccatggaagtca

SEQ ID NO: 364765 - DNA, 25 bp, Mus musculus
cggttgccgcttgccatggaagtca

SEQ ID NO: 364766 - DNA, 25 bp, Mus musculus
cggttgcctctgaggtgggttcaaa

SEQ ID NO: 364767 - DNA, 25 bp, Mus musculus
cggttgcctctgtggtgggttcaaa

SEQ ID NO: 364768 - DNA, 25 bp, Mus musculus
cggttggcatcgatttcaaagtaaa

SEQ ID NO: 364769 - DNA, 25 bp, Mus musculus
cggttggcatcgttttcaaagtaaa

SEQ ID NO: 364770 - DNA, 25 bp, Mus musculus
cggttggcatgcaaatttttaaata

SEQ ID NO: 364771 - DNA, 25 bp, Mus musculus
cggttggcatgctaatttttaaata

SEQ ID NO: 364772 - DNA, 25 bp, Mus musculus
cggttgggatgaacgagagcttcaa

SEQ ID NO: 364773 - DNA, 25 bp, Mus musculus
cggttgggatgatcgagagcttcaa

SEQ ID NO: 364774 - DNA, 25 bp, Mus musculus
cggttgggctccagatgccagcaag

SEQ ID NO: 364775 - DNA, 25 bp, Mus musculus
cggttgggctcctgatgccagcaag

SEQ ID NO: 364776 - DNA, 25 bp, Mus musculus
cggttggttttcagctctaaggaca

SEQ ID NO: 364777 - DNA, 25 bp, Mus musculus
cggttggttttctgctctaaggaca

SEQ ID NO: 364778 - DNA, 25 bp, Mus musculus
cggttgtttttcactcagacttaat

SEQ ID NO: 364779 - DNA, 25 bp, Mus musculus
cggttgtttttctctcagacttaat

SEQ ID NO: 364780 - DNA, 25 bp, Mus musculus
cggtttatctgtatcatcattctac

SEQ ID NO: 364781 - DNA, 25 bp, Mus musculus
cggtttatctgtttcatcattctac

SEQ ID NO: 364782 - DNA, 25 bp, Mus musculus
cggtttcaattccaagcctgagagg

SEQ ID NO: 364783 - DNA, 25 bp, Mus musculus
cggtttcaattcgaagcctgagagg

SEQ ID NO: 364784 - DNA, 25 bp, Mus musculus
cggtttccacacctgacgtagaaga

SEQ ID NO: 364785 - DNA, 25 bp, Mus musculus
cggtttccacacgtgacgtagaaga

SEQ ID NO: 364786 - DNA, 25 bp, Mus musculus
cggtttccgtcaatagctcgcgtac

SEQ ID NO: 364787 - DNA, 25 bp, Mus musculus
cggtttccgtcattagctcgcgtac

SEQ ID NO: 364788 - DNA, 25 bp, Mus musculus
cggtttcctgtaactagcattgttc

SEQ ID NO: 364789 - DNA, 25 bp, Mus musculus
cggtttcctgtatctagcattgttc

SEQ ID NO: 364790 - DNA, 25 bp, Mus musculus
cggtttgattgaaggaggctttgaa

SEQ ID NO: 364791 - DNA, 25 bp, Mus musculus
cggtttgattgatggaggctttgaa

SEQ ID NO: 364792 - DNA, 25 bp, Mus musculus
cggtttgcacaaatactcagttaac

SEQ ID NO: 364793 - DNA, 25 bp, Mus musculus
cggtttgcacaattactcagttaac

SEQ ID NO: 364794 - DNA, 25 bp, Mus musculus
cggtttgtgctcaatggcggtgcac

SEQ ID NO: 364795 - DNA, 25 bp, Mus musculus
cggtttgtgctctatggcggtgcac

SEQ ID NO: 364796 - DNA, 25 bp, Mus musculus
cggtttgtggaaattgtgactgcag

SEQ ID NO: 364797 - DNA, 25 bp, Mus musculus
cggtttgtggaatttgtgactgcag

SEQ ID NO: 364798 - DNA, 25 bp, Mus musculus
cggtttgttcagacgatgcttagac

SEQ ID NO: 364799 - DNA, 25 bp, Mus musculus
cggtttgttcagtcgatgcttagac

SEQ ID NO: 364800 - DNA, 25 bp, Mus musculus
cggtttgtttaaagtgttatctcca

SEQ ID NO: 364801 - DNA, 25 bp, Mus musculus
cggtttgtttaatgtgttatctcca

SEQ ID NO: 364802 - DNA, 25 bp, Mus musculus
cggttttaaagcagtgtatcggatc

SEQ ID NO: 364803 - DNA, 25 bp, Mus musculus
cggttttaaagctgtgtatcggatc

SEQ ID NO: 364804 - DNA, 25 bp, Mus musculus
cggttttcaaacatgctatggcagc

SEQ ID NO: 364805 - DNA, 25 bp, Mus musculus
cggttttcaaacttgctatggcagc

SEQ ID NO: 364806 - DNA, 25 bp, Mus musculus
cggttttcttcaatctgcctgaaat

SEQ ID NO: 364807 - DNA, 25 bp, Mus musculus
cggttttcttcattctgcctgaaat

SEQ ID NO: 364808 - DNA, 25 bp, Mus musculus
cggttttttgctactgtctccaata

SEQ ID NO: 364809 - DNA, 25 bp, Mus musculus
cggttttttgcttctgtctccaata

SEQ ID NO: 364810 - DNA, 25 bp, Mus musculus
cgtaaaagaaagcccgtgcacggtg

SEQ ID NO: 364811 - DNA, 25 bp, Mus musculus
cgtaaaagaaaggccgtgcacggtg

SEQ ID NO: 364812 - DNA, 25 bp, Mus musculus
cgtaaaaggacaccgtggccctcag

SEQ ID NO: 364813 - DNA, 25 bp, Mus musculus
cgtaaaaggacagcgtggccctcag

SEQ ID NO: 364814 - DNA, 25 bp, Mus musculus
cgtaaacaacaaacttggctcagtg

SEQ ID NO: 364815 - DNA, 25 bp, Mus musculus
cgtaaacaacaatcttggctcagtg

SEQ ID NO: 364816 - DNA, 25 bp, Mus musculus
cgtaaacccatcaaagactcgctgt

SEQ ID NO: 364817 - DNA, 25 bp, Mus musculus
cgtaaacccatctaagactcgctgt

SEQ ID NO: 364818 - DNA, 25 bp, Mus musculus
cgtaaactgaagagtgcaccgcaaa

SEQ ID NO: 364819 - DNA, 25 bp, Mus musculus
cgtaaactgaagtgtgcaccgcaaa

SEQ ID NO: 364820 - DNA, 25 bp, Mus musculus
cgtaaatcaggcctgattttccatt

SEQ ID NO: 364821 - DNA, 25 bp, Mus musculus
cgtaaatcaggcgtgattttccatt

SEQ ID NO: 364822 - DNA, 25 bp, Mus musculus
cgtaaatgccatcttgatgatgatg

SEQ ID NO: 364823 - DNA, 25 bp, Mus musculus
cgtaaatgccatgttgatgatgatg

SEQ ID NO: 364824 - DNA, 25 bp, Mus musculus
cgtaacaatttgaggaggactttga

SEQ ID NO: 364825 - DNA, 25 bp, Mus musculus
cgtaacaatttgtggaggactttga

SEQ ID NO: 364826 - DNA, 25 bp, Mus musculus
cgtaacagaattcccctctgggatt

SEQ ID NO: 364827 - DNA, 25 bp, Mus musculus
cgtaacagaattgccctctgggatt

SEQ ID NO: 364828 - DNA, 25 bp, Mus musculus
cgtaaccagtgcaaagaccttccga

SEQ ID NO: 364829 - DNA, 25 bp, Mus musculus
cgtaaccagtgctaagaccttccga

SEQ ID NO: 364830 - DNA, 25 bp, Mus musculus
cgtaaccataggctttcttcctcat

SEQ ID NO: 364831 - DNA, 25 bp, Mus musculus
cgtaaccatagggtttcttcctcat

SEQ ID NO: 364832 - DNA, 25 bp, Mus musculus
cgtaacccatcaccactaacattat

SEQ ID NO: 364833 - DNA, 25 bp, Mus musculus
cgtaacccatcagcactaacattat

SEQ ID NO: 364834 - DNA, 25 bp, Mus musculus
cgtaactgatcgagaattcttcaag

SEQ ID NO: 364835 - DNA, 25 bp, Mus musculus
cgtaactgatcgtgaattcttcaag

SEQ ID NO: 364836 - DNA, 25 bp, Mus musculus
cgtaagagatctcggcctccctgga

SEQ ID NO: 364837 - DNA, 25 bp, Mus musculus
cgtaagagatctgggcctccctgga

SEQ ID NO: 364838 - DNA, 25 bp, Mus musculus
cgtaagagcgttcggttgagccttc

SEQ ID NO: 364839 - DNA, 25 bp, Mus musculus
cgtaagagcgttgggttgagccttc

SEQ ID NO: 364840 - DNA, 25 bp, Mus musculus
cgtaagattccacttacctcatttg

SEQ ID NO: 364841 - DNA, 25 bp, Mus musculus
cgtaagattccagttacctcatttg

SEQ ID NO: 364842 - DNA, 25 bp, Mus musculus
cgtaagcggcttactctgggtggaa

SEQ ID NO: 364843 - DNA, 25 bp, Mus musculus
cgtaagcggctttctctgggtggaa

SEQ ID NO: 364844 - DNA, 25 bp, Mus musculus
cgtaaggtgtccacgtcgggccaga

SEQ ID NO: 364845 - DNA, 25 bp, Mus musculus
cgtaaggtgtcctcgtcgggccaga

SEQ ID NO: 364846 - DNA, 25 bp, Mus musculus
cgtaagtacagacaagccatcacct

SEQ ID NO: 364847 - DNA, 25 bp, Mus musculus
cgtaagtacagagaagccatcacct

SEQ ID NO: 364848 - DNA, 25 bp, Mus musculus
cgtaagtggcccagatgcgagtgaa

SEQ ID NO: 364849 - DNA, 25 bp, Mus musculus
cgtaagtggccctgatgcgagtgaa

SEQ ID NO: 364850 - DNA, 25 bp, Mus musculus
cgtaagtggtagacccttggctgga

SEQ ID NO: 364851 - DNA, 25 bp, Mus musculus
cgtaagtggtagtcccttggctgga

SEQ ID NO: 364852 - DNA, 25 bp, Mus musculus
cgtaatctacgaccttgggcaagct

SEQ ID NO: 364853 - DNA, 25 bp, Mus musculus
cgtaatctacgagcttgggcaagct

SEQ ID NO: 364854 - DNA, 25 bp, Mus musculus
cgtaatttatggctggtgccgtaat

SEQ ID NO: 364855 - DNA, 25 bp, Mus musculus
cgtaatttatgggtggtgccgtaat

SEQ ID NO: 364856 - DNA, 25 bp, Mus musculus
cgtacaacacataatctcaccagat

SEQ ID NO: 364857 - DNA, 25 bp, Mus musculus
cgtacaacacattatctcaccagat

SEQ ID NO: 364858 - DNA, 25 bp, Mus musculus
cgtacacatgctcgccttgggaaaa

SEQ ID NO: 364859 - DNA, 25 bp, Mus musculus
cgtacacatgctggccttgggaaaa

SEQ ID NO: 364860 - DNA, 25 bp, Mus musculus
cgtacaccacccagatagactacaa

SEQ ID NO: 364861 - DNA, 25 bp, Mus musculus
cgtacaccaccctgatagactacaa

SEQ ID NO: 364862 - DNA, 25 bp, Mus musculus
cgtacacttccaaggcttcagataa

SEQ ID NO: 364863 - DNA, 25 bp, Mus musculus
cgtacacttccatggcttcagataa

SEQ ID NO: 364864 - DNA, 25 bp, Mus musculus
cgtacagaaaaaccgctcaccgtat

SEQ ID NO: 364865 - DNA, 25 bp, Mus musculus
cgtacagaaaaagcgctcaccgtat

SEQ ID NO: 364866 - DNA, 25 bp, Mus musculus
cgtacagttttccacccactcagag

SEQ ID NO: 364867 - DNA, 25 bp, Mus musculus
cgtacagttttcgacccactcagag

SEQ ID NO: 364868 - DNA, 25 bp, Mus musculus
cgtaccaagttcatcgctgtcaaga

SEQ ID NO: 364869 - DNA, 25 bp, Mus musculus
cgtaccaagttcttcgctgtcaaga

SEQ ID NO: 364870 - DNA, 25 bp, Mus musculus
cgtaccacatatacacagcctgaca

SEQ ID NO: 364871 - DNA, 25 bp, Mus musculus
cgtaccacatattcacagcctgaca

SEQ ID NO: 364872 - DNA, 25 bp, Mus musculus
cgtaccactggcatctgtgacaagt

SEQ ID NO: 364873 - DNA, 25 bp, Mus musculus
cgtaccactggcttctgtgacaagt

SEQ ID NO: 364874 - DNA, 25 bp, Mus musculus
cgtaccctgtgaataaaatggcttt

SEQ ID NO: 364875 - DNA, 25 bp, Mus musculus
cgtaccctgtgattaaaatggcttt

SEQ ID NO: 364876 - DNA, 25 bp, Mus musculus
cgtaccgcgttaacagcctgggaat

SEQ ID NO: 364877 - DNA, 25 bp, Mus musculus
cgtaccgcgttatcagcctgggaat

SEQ ID NO: 364878 - DNA, 25 bp, Mus musculus
cgtaccgtggcaatactggactgta

SEQ ID NO: 364879 - DNA, 25 bp, Mus musculus
cgtaccgtggcattactggactgta

SEQ ID NO: 364880 - DNA, 25 bp, Mus musculus
cgtacctccttgaactacttcataa

SEQ ID NO: 364881 - DNA, 25 bp, Mus musculus
cgtacctccttgtactacttcataa

SEQ ID NO: 364882 - DNA, 25 bp, Mus musculus
cgtacctgtcatagtgtccaatttc

SEQ ID NO: 364883 - DNA, 25 bp, Mus musculus
cgtacctgtcatccatttcattaga

SEQ ID NO: 364884 - DNA, 25 bp, Mus musculus
cgtacctgtcatgcatttcattaga

SEQ ID NO: 364885 - DNA, 25 bp, Mus musculus
cgtacctgtcattgtgtccaatttc

SEQ ID NO: 364886 - DNA, 25 bp, Mus musculus
cgtacgattttaacttcttcattta

SEQ ID NO: 364887 - DNA, 25 bp, Mus musculus
cgtacgattttatcttcttcattta

SEQ ID NO: 364888 - DNA, 25 bp, Mus musculus
cgtacgttttacacctgattgtttg

SEQ ID NO: 364889 - DNA, 25 bp, Mus musculus
cgtacgttttactcctgattgtttg

SEQ ID NO: 364890 - DNA, 25 bp, Mus musculus
cgtactcgcgagagcatcctgcgag

SEQ ID NO: 364891 - DNA, 25 bp, Mus musculus
cgtactcgcgagtgcatcctgcgag

SEQ ID NO: 364892 - DNA, 25 bp, Mus musculus
cgtactcgtacgaggcgctcatcgc

SEQ ID NO: 364893 - DNA, 25 bp, Mus musculus
cgtactcgtacgtggcgctcatcgc

SEQ ID NO: 364894 - DNA, 25 bp, Mus musculus
cgtactctacgtatcctggaagtgt

SEQ ID NO: 364895 - DNA, 25 bp, Mus musculus
cgtactctacgtttcctggaagtgt

SEQ ID NO: 364896 - DNA, 25 bp, Mus musculus
cgtactgttataatctcttggtcca

SEQ ID NO: 364897 - DNA, 25 bp, Mus musculus
cgtactgttatattctcttggtcca

SEQ ID NO: 364898 - DNA, 25 bp, Mus musculus
cgtacttagattcgaacccagggct

SEQ ID NO: 364899 - DNA, 25 bp, Mus musculus
cgtacttagattggaacccagggct

SEQ ID NO: 364900 - DNA, 25 bp, Mus musculus
cgtacttcccgtcgcgtttgtagat

SEQ ID NO: 364901 - DNA, 25 bp, Mus musculus
cgtacttcccgtggcgtttgtagat

SEQ ID NO: 364902 - DNA, 25 bp, Mus musculus
cgtactttgtggatgcttgtgctaa

SEQ ID NO: 364903 - DNA, 25 bp, Mus musculus
cgtactttgtggttgcttgtgctaa

SEQ ID NO: 364904 - DNA, 25 bp, Mus musculus
cgtagaagacttagggctctgggaa

SEQ ID NO: 364905 - DNA, 25 bp, Mus musculus
cgtagaagactttgggctctgggaa

SEQ ID NO: 364906 - DNA, 25 bp, Mus musculus
cgtagacgtcatatcaagggcacac

SEQ ID NO: 364907 - DNA, 25 bp, Mus musculus
cgtagacgtcatttcaagggcacac

SEQ ID NO: 364908 - DNA, 25 bp, Mus musculus
cgtagaggacttacttcagggcccg

SEQ ID NO: 364909 - DNA, 25 bp, Mus musculus
cgtagaggactttcttcagggcccg

SEQ ID NO: 364910 - DNA, 25 bp, Mus musculus
cgtagaggcagccagatcccagcac

SEQ ID NO: 364911 - DNA, 25 bp, Mus musculus
cgtagaggcagcgagatcccagcac

SEQ ID NO: 364912 - DNA, 25 bp, Mus musculus
cgtagatgctagcagatgtaggact

SEQ ID NO: 364913 - DNA, 25 bp, Mus musculus
cgtagatgctaggagatgtaggact

SEQ ID NO: 364914 - DNA, 25 bp, Mus musculus
cgtagattgataccgccctccagtg

SEQ ID NO: 364915 - DNA, 25 bp, Mus musculus
cgtagattgatagcgccctccagtg

SEQ ID NO: 364916 - DNA, 25 bp, Mus musculus
cgtagcaggagcataagccccattt

SEQ ID NO: 364917 - DNA, 25 bp, Mus musculus
cgtagcaggagcttaagccccattt

SEQ ID NO: 364918 - DNA, 25 bp, Mus musculus
cgtagcccctggcatgggtgtcctt

SEQ ID NO: 364919 - DNA, 25 bp, Mus musculus
cgtagcccctgggatgggtgtcctt

SEQ ID NO: 364920 - DNA, 25 bp, Mus musculus
cgtagctcagctatcagagcgctaa

SEQ ID NO: 364921 - DNA, 25 bp, Mus musculus
cgtagctcagctttcagagcgctaa

SEQ ID NO: 364922 - DNA, 25 bp, Mus musculus
cgtagctcgaaaaatggagaccgga

SEQ ID NO: 364923 - DNA, 25 bp, Mus musculus
cgtagctcgaaatatggagaccgga

SEQ ID NO: 364924 - DNA, 25 bp, Mus musculus
cgtagctgcgctcaactagaattgc

SEQ ID NO: 364925 - DNA, 25 bp, Mus musculus
cgtagctgcgctgaactagaattgc

SEQ ID NO: 364926 - DNA, 25 bp, Mus musculus
cgtaggattataacacaggcgaccg

SEQ ID NO: 364927 - DNA, 25 bp, Mus musculus
cgtaggattatatcacaggcgaccg

SEQ ID NO: 364928 - DNA, 25 bp, Mus musculus
cgtaggccaagtatagacgtgtata

SEQ ID NO: 364929 - DNA, 25 bp, Mus musculus
cgtaggccaagtttagacgtgtata

SEQ ID NO: 364930 - DNA, 25 bp, Mus musculus
cgtaggctgcaaaagtaactggaca

SEQ ID NO: 364931 - DNA, 25 bp, Mus musculus
cgtaggctgcaatagtaactggaca

SEQ ID NO: 364932 - DNA, 25 bp, Mus musculus
cgtagggcgctcacgggccaaccta

SEQ ID NO: 364933 - DNA, 25 bp, Mus musculus
cgtagggcgctctcgggccaaccta

SEQ ID NO: 364934 - DNA, 25 bp, Mus musculus
cgtaggttgcgcatctggagcccga

SEQ ID NO: 364935 - DNA, 25 bp, Mus musculus
cgtaggttgcgcttctggagcccga

SEQ ID NO: 364936 - DNA, 25 bp, Mus musculus
cgtagtaaatgtccgcaggcgtcag

SEQ ID NO: 364937 - DNA, 25 bp, Mus musculus
cgtagtaaatgtgcgcaggcgtcag

SEQ ID NO: 364938 - DNA, 25 bp, Mus musculus
cgtagtacctttctgttgacggcgt

SEQ ID NO: 364939 - DNA, 25 bp, Mus musculus
cgtagtacctttgtgttgacggcgt

SEQ ID NO: 364940 - DNA, 25 bp, Mus musculus
cgtagtagtggcacggtgacttcaa

SEQ ID NO: 364941 - DNA, 25 bp, Mus musculus
cgtagtagtggctcggtgacttcaa

SEQ ID NO: 364942 - DNA, 25 bp, Mus musculus
cgtagtcccagcaaggctttgagta

SEQ ID NO: 364943 - DNA, 25 bp, Mus musculus
cgtagtcccagctaggctttgagta

SEQ ID NO: 364944 - DNA, 25 bp, Mus musculus
cgtagtctagaacccggatgctgct

SEQ ID NO: 364945 - DNA, 25 bp, Mus musculus
cgtagtctagaagccggatgctgct

SEQ ID NO: 364946 - DNA, 25 bp, Mus musculus
cgtagtcttgtaaatgtgcagacgt

SEQ ID NO: 364947 - DNA, 25 bp, Mus musculus
cgtagtcttgtatatgtgcagacgt

SEQ ID NO: 364948 - DNA, 25 bp, Mus musculus
cgtagtctttcaccctgatcagaaa

SEQ ID NO: 364949 - DNA, 25 bp, Mus musculus
cgtagtctttcagcctgatcagaaa

SEQ ID NO: 364950 - DNA, 25 bp, Mus musculus
cgtagtgagatgcagcaaacctgtt

SEQ ID NO: 364951 - DNA, 25 bp, Mus musculus
cgtagtgagatggagcaaacctgtt

SEQ ID NO: 364952 - DNA, 25 bp, Mus musculus
cgtagtgcctccacgggcttttggc

SEQ ID NO: 364953 - DNA, 25 bp, Mus musculus
cgtagtgcctcctcgggcttttggc

SEQ ID NO: 364954 - DNA, 25 bp, Mus musculus
cgtagtggttaacgactatggcaaa

SEQ ID NO: 364955 - DNA, 25 bp, Mus musculus
cgtagtggttaaggactatggcaaa

SEQ ID NO: 364956 - DNA, 25 bp, Mus musculus
cgtagtgtggaacgcctgctcaaac

SEQ ID NO: 364957 - DNA, 25 bp, Mus musculus
cgtagtgtggaaggcctgctcaaac

SEQ ID NO: 364958 - DNA, 25 bp, Mus musculus
cgtagtttatacagtgggccctgga

SEQ ID NO: 364959 - DNA, 25 bp, Mus musculus
cgtagtttatactgtgggccctgga

SEQ ID NO: 364960 - DNA, 25 bp, Mus musculus
cgtagttttaggctagctgtccaaa

SEQ ID NO: 364961 - DNA, 25 bp, Mus musculus
cgtagttttagggtagctgtccaaa

SEQ ID NO: 364962 - DNA, 25 bp, Mus musculus
cgtagttttcttcgactagtgacaa

SEQ ID NO: 364963 - DNA, 25 bp, Mus musculus
cgtagttttcttggactagtgacaa

SEQ ID NO: 364964 - DNA, 25 bp, Mus musculus
cgtataccattactgtccatctctg

SEQ ID NO: 364965 - DNA, 25 bp, Mus musculus
cgtataccattagtgtccatctctg

SEQ ID NO: 364966 - DNA, 25 bp, Mus musculus
cgtatagctaggcacatggctggat

SEQ ID NO: 364967 - DNA, 25 bp, Mus musculus
cgtatagctagggacatggctggat

SEQ ID NO: 364968 - DNA, 25 bp, Mus musculus
cgtatagtctctactcagtctcaga

SEQ ID NO: 364969 - DNA, 25 bp, Mus musculus
cgtatagtctcttctcagtctcaga

SEQ ID NO: 364970 - DNA, 25 bp, Mus musculus
cgtatcagaactcgtgaaagtgtct

SEQ ID NO: 364971 - DNA, 25 bp, Mus musculus
cgtatcagaactggtgaaagtgtct

SEQ ID NO: 364972 - DNA, 25 bp, Mus musculus
cgtatcatctgtccctcttaaaaaa

SEQ ID NO: 364973 - DNA, 25 bp, Mus musculus
cgtatcatctgtgcctcttaaaaaa

SEQ ID NO: 364974 - DNA, 25 bp, Mus musculus
cgtatcccagacattgcaactgatg

SEQ ID NO: 364975 - DNA, 25 bp, Mus musculus
cgtatcccagactttgcaactgatg

SEQ ID NO: 364976 - DNA, 25 bp, Mus musculus
cgtatcccatgcatctgtgttgaga

SEQ ID NO: 364977 - DNA, 25 bp, Mus musculus
cgtatcccatgcttctgtgttgaga

SEQ ID NO: 364978 - DNA, 25 bp, Mus musculus
cgtatcctggccattatatcgagaa

SEQ ID NO: 364979 - DNA, 25 bp, Mus musculus
cgtatcctggcctttatatcgagaa

SEQ ID NO: 364980 - DNA, 25 bp, Mus musculus
cgtatctgctccaacttcctagaag

SEQ ID NO: 364981 - DNA, 25 bp, Mus musculus
cgtatctgctcctacttcctagaag

SEQ ID NO: 364982 - DNA, 25 bp, Mus musculus
cgtatgaagtcgacagtggcagtgt

SEQ ID NO: 364983 - DNA, 25 bp, Mus musculus
cgtatgaagtcgtcagtggcagtgt

SEQ ID NO: 364984 - DNA, 25 bp, Mus musculus
cgtatgacagttccccaatagttgc

SEQ ID NO: 364985 - DNA, 25 bp, Mus musculus
cgtatgacagttgcccaatagttgc

SEQ ID NO: 364986 - DNA, 25 bp, Mus musculus
cgtatgaggagaacgccagccttgt

SEQ ID NO: 364987 - DNA, 25 bp, Mus musculus
cgtatgaggagatcgccagccttgt

SEQ ID NO: 364988 - DNA, 25 bp, Mus musculus
cgtatgatacggctcatactctgcg

SEQ ID NO: 364989 - DNA, 25 bp, Mus musculus
cgtatgatacgggtcatactctgcg

SEQ ID NO: 364990 - DNA, 25 bp, Mus musculus
cgtatgcaagcaacagtgactgagc

SEQ ID NO: 364991 - DNA, 25 bp, Mus musculus
cgtatgcaagcatcagtgactgagc

SEQ ID NO: 364992 - DNA, 25 bp, Mus musculus
cgtatgcaagggacgcggtgctcaa

SEQ ID NO: 364993 - DNA, 25 bp, Mus musculus
cgtatgcaagggtcgcggtgctcaa

SEQ ID NO: 364994 - DNA, 25 bp, Mus musculus
cgtatgccctggattttgctgtgga

SEQ ID NO: 364995 - DNA, 25 bp, Mus musculus
cgtatgccctggtttttgctgtgga

SEQ ID NO: 364996 - DNA, 25 bp, Mus musculus
cgtatggtactaagctatggactac

SEQ ID NO: 364997 - DNA, 25 bp, Mus musculus
cgtatggtactatgctatggactac

SEQ ID NO: 364998 - DNA, 25 bp, Mus musculus
cgtatggtgtgcacggttgtctgcc

SEQ ID NO: 364999 - DNA, 25 bp, Mus musculus
cgtatggtgtgctcggttgtctgcc

SEQ ID NO: 365000 - DNA, 25 bp, Mus musculus
cgtatgtactggctcatactctgcg

SEQ ID NO: 365001 - DNA, 25 bp, Mus musculus
cgtatgtactgggtcatactctgcg

SEQ ID NO: 365002 - DNA, 25 bp, Mus musculus
cgtatgtatcatctcgggctcgaat

SEQ ID NO: 365003 - DNA, 25 bp, Mus musculus
cgtatgtatcatgtcgggctcgaat

SEQ ID NO: 365004 - DNA, 25 bp, Mus musculus
cgtatgtgacgcagctcttagcgca

SEQ ID NO: 365005 - DNA, 25 bp, Mus musculus
cgtatgtgacgctgctcttagcgca

SEQ ID NO: 365006 - DNA, 25 bp, Mus musculus
cgtattataacactttcgtagcaaa

SEQ ID NO: 365007 - DNA, 25 bp, Mus musculus
cgtattataacagtttcgtagcaaa

SEQ ID NO: 365008 - DNA, 25 bp, Mus musculus
cgtattgaacagctgcagtcagaaa

SEQ ID NO: 365009 - DNA, 25 bp, Mus musculus
cgtattgaacaggtgcagtcagaaa

SEQ ID NO: 365010 - DNA, 25 bp, Mus musculus
cgtattgccccacatgtcatagtgt

SEQ ID NO: 365011 - DNA, 25 bp, Mus musculus
cgtattgccccagatgtcatagtgt

SEQ ID NO: 365012 - DNA, 25 bp, Mus musculus
cgtattgcttgcaataacaaggata

SEQ ID NO: 365013 - DNA, 25 bp, Mus musculus
cgtattgcttgctataacaaggata

SEQ ID NO: 365014 - DNA, 25 bp, Mus musculus
cgtatttctgtcctgttcggagtga

SEQ ID NO: 365015 - DNA, 25 bp, Mus musculus
cgtatttctgtcgtgttcggagtga

SEQ ID NO: 365016 - DNA, 25 bp, Mus musculus
cgtatttgcccaatataaactcagg

SEQ ID NO: 365017 - DNA, 25 bp, Mus musculus
cgtatttgcccattataaactcagg

SEQ ID NO: 365018 - DNA, 25 bp, Mus musculus
cgtcaaaactatatgtatgctgtga

SEQ ID NO: 365019 - DNA, 25 bp, Mus musculus
cgtcaaaactatttgtatgctgtga

SEQ ID NO: 365020 - DNA, 25 bp, Mus musculus
cgtcaaccctttccgcaaatgtagt

SEQ ID NO: 365021 - DNA, 25 bp, Mus musculus
cgtcaaccctttgcgcaaatgtagt

SEQ ID NO: 365022 - DNA, 25 bp, Mus musculus
cgtcaactctgtcgctgctatttaa

SEQ ID NO: 365023 - DNA, 25 bp, Mus musculus
cgtcaactctgtggctgctatttaa

SEQ ID NO: 365024 - DNA, 25 bp, Mus musculus
cgtcaagggcataggcaaagaccat

SEQ ID NO: 365025 - DNA, 25 bp, Mus musculus
cgtcaagggcattggcaaagaccat

SEQ ID NO: 365026 - DNA, 25 bp, Mus musculus
cgtcaatcaggcaatgtgttttgtt

SEQ ID NO: 365027 - DNA, 25 bp, Mus musculus
cgtcaatcaggctatgtgttttgtt

SEQ ID NO: 365028 - DNA, 25 bp, Mus musculus
cgtcacaaggcaaccttctaacttt

SEQ ID NO: 365029 - DNA, 25 bp, Mus musculus
cgtcacaaggcatccttctaacttt

SEQ ID NO: 365030 - DNA, 25 bp, Mus musculus
cgtcacatgctgctcagtactgttc

SEQ ID NO: 365031 - DNA, 25 bp, Mus musculus
cgtcacatgctggtcagtactgttc

SEQ ID NO: 365032 - DNA, 25 bp, Mus musculus
cgtcacccagatatagacctcaaat

SEQ ID NO: 365033 - DNA, 25 bp, Mus musculus
cgtcacccagatttagacctcaaat

SEQ ID NO: 365034 - DNA, 25 bp, Mus musculus
cgtcacgctgaaaatatgaccacgc

SEQ ID NO: 365035 - DNA, 25 bp, Mus musculus
cgtcacgctgaatatatgaccacgc

SEQ ID NO: 365036 - DNA, 25 bp, Mus musculus
cgtcactatcatcggctaacttcca

SEQ ID NO: 365037 - DNA, 25 bp, Mus musculus
cgtcactatcatgggctaacttcca

SEQ ID NO: 365038 - DNA, 25 bp, Mus musculus
cgtcactgatgtcgcttttggcttt

SEQ ID NO: 365039 - DNA, 25 bp, Mus musculus
cgtcactgatgtggcttttggcttt

SEQ ID NO: 365040 - DNA, 25 bp, Mus musculus
cgtcactggtacacaacatgctgga

SEQ ID NO: 365041 - DNA, 25 bp, Mus musculus
cgtcactggtactcaacatgctgga

SEQ ID NO: 365042 - DNA, 25 bp, Mus musculus
cgtcactgtggtatttaaggacatt

SEQ ID NO: 365043 - DNA, 25 bp, Mus musculus
cgtcactgtggtttttaaggacatt

SEQ ID NO: 365044 - DNA, 25 bp, Mus musculus
cgtcacttatctaccccaaatttgg

SEQ ID NO: 365045 - DNA, 25 bp, Mus musculus
cgtcacttatcttccccaaatttgg

SEQ ID NO: 365046 - DNA, 25 bp, Mus musculus
cgtcacttggtgaatgcaatctttt

SEQ ID NO: 365047 - DNA, 25 bp, Mus musculus
cgtcacttggtgtatgcaatctttt

SEQ ID NO: 365048 - DNA, 25 bp, Mus musculus
cgtcagcaaggtatccttttctcta

SEQ ID NO: 365049 - DNA, 25 bp, Mus musculus
cgtcagcaaggtttccttttctcta

SEQ ID NO: 365050 - DNA, 25 bp, Mus musculus
cgtcagcacctaaacatgttctttg

SEQ ID NO: 365051 - DNA, 25 bp, Mus musculus
cgtcagcacctatacatgttctttg

SEQ ID NO: 365052 - DNA, 25 bp, Mus musculus
cgtcagcattctatcccagttaaag

SEQ ID NO: 365053 - DNA, 25 bp, Mus musculus
cgtcagcattctttcccagttaaag

SEQ ID NO: 365054 - DNA, 25 bp, Mus musculus
cgtcagcttcgacgactttgtggct

SEQ ID NO: 365055 - DNA, 25 bp, Mus musculus
cgtcagcttcgaggactttgtggct

SEQ ID NO: 365056 - DNA, 25 bp, Mus musculus
cgtcaggttttccacggagaccact

SEQ ID NO: 365057 - DNA, 25 bp, Mus musculus
cgtcaggttttcgacggagaccact

SEQ ID NO: 365058 - DNA, 25 bp, Mus musculus
cgtcagtattcgatgccaagagtgt

SEQ ID NO: 365059 - DNA, 25 bp, Mus musculus
cgtcagtattcgttgccaagagtgt

SEQ ID NO: 365060 - DNA, 25 bp, Mus musculus
cgtcagtgctctccagatgatgggt

SEQ ID NO: 365061 - DNA, 25 bp, Mus musculus
cgtcagtgctctgcagatgatgggt

SEQ ID NO: 365062 - DNA, 25 bp, Mus musculus
cgtcagtggcagagtatactgtaca

SEQ ID NO: 365063 - DNA, 25 bp, Mus musculus
cgtcagtggcagtgtatactgtaca

SEQ ID NO: 365064 - DNA, 25 bp, Mus musculus
cgtcagtgtgggagctctttcagaa

SEQ ID NO: 365065 - DNA, 25 bp, Mus musculus
cgtcagtgtgggtgctctttcagaa

SEQ ID NO: 365066 - DNA, 25 bp, Mus musculus
cgtcatatacgaacccgcagatgat

SEQ ID NO: 365067 - DNA, 25 bp, Mus musculus
cgtcatatacgatcccgcagatgat

SEQ ID NO: 365068 - DNA, 25 bp, Mus musculus
cgtcatcaggatcagtgggcattct

SEQ ID NO: 365069 - DNA, 25 bp, Mus musculus
cgtcatcaggatgagtgggcattct

SEQ ID NO: 365070 - DNA, 25 bp, Mus musculus
cgtcatcctcataatactttttgcc

SEQ ID NO: 365071 - DNA, 25 bp, Mus musculus
cgtcatcctcattatactttttgcc

SEQ ID NO: 365072 - DNA, 25 bp, Mus musculus
cgtcatctacgccttcataggagag

SEQ ID NO: 365073 - DNA, 25 bp, Mus musculus
cgtcatctacgcgttcataggagag

SEQ ID NO: 365074 - DNA, 25 bp, Mus musculus
cgtcatctagagcaatttgccccaa

SEQ ID NO: 365075 - DNA, 25 bp, Mus musculus
cgtcatctagaggaatttgccccaa

SEQ ID NO: 365076 - DNA, 25 bp, Mus musculus
cgtcatgcccatcttgcccgagatg

SEQ ID NO: 365077 - DNA, 25 bp, Mus musculus
cgtcatgcccatgttgcccgagatg

SEQ ID NO: 365078 - DNA, 25 bp, Mus musculus
cgtcatgctaacagatacacgctgc

SEQ ID NO: 365079 - DNA, 25 bp, Mus musculus
cgtcatgctaactgatacacgctgc

SEQ ID NO: 365080 - DNA, 25 bp, Mus musculus
cgtcatggacaaatccaattccaga

SEQ ID NO: 365081 - DNA, 25 bp, Mus musculus
cgtcatggacaattccaattccaga

SEQ ID NO: 365082 - DNA, 25 bp, Mus musculus
cgtcatgtaaacaaggtgggcctca

SEQ ID NO: 365083 - DNA, 25 bp, Mus musculus
cgtcatgtaaactaggtgggcctca

SEQ ID NO: 365084 - DNA, 25 bp, Mus musculus
cgtcatgtgaaaacgctacttataa

SEQ ID NO: 365085 - DNA, 25 bp, Mus musculus
cgtcatgtgaaatcgctacttataa

SEQ ID NO: 365086 - DNA, 25 bp, Mus musculus
cgtcattcctgccaacttatggaag

SEQ ID NO: 365087 - DNA, 25 bp, Mus musculus
cgtcattcctgcgaacttatggaag

SEQ ID NO: 365088 - DNA, 25 bp, Mus musculus
cgtcatttcatacggtgatccaaat

SEQ ID NO: 365089 - DNA, 25 bp, Mus musculus
cgtcatttcatagggtgatccaaat

SEQ ID NO: 365090 - DNA, 25 bp, Mus musculus
cgtcatttccttagtaactgcaaga

SEQ ID NO: 365091 - DNA, 25 bp, Mus musculus
cgtcatttcctttgtaactgcaaga

SEQ ID NO: 365092 - DNA, 25 bp, Mus musculus
cgtcatttttctcttgaatcacatt

SEQ ID NO: 365093 - DNA, 25 bp, Mus musculus
cgtcatttttctgttgaatcacatt

SEQ ID NO: 365094 - DNA, 25 bp, Mus musculus
cgtccaaacatcagaatctcctctt

SEQ ID NO: 365095 - DNA, 25 bp, Mus musculus
cgtccaaacatctgaatctcctctt

SEQ ID NO: 365096 - DNA, 25 bp, Mus musculus
cgtccaactgtgaccgctgtgtggg

SEQ ID NO: 365097 - DNA, 25 bp, Mus musculus
cgtccaactgtgtccgctgtgtggg

SEQ ID NO: 365098 - DNA, 25 bp, Mus musculus
cgtccaagccaaccctaggatatgt

SEQ ID NO: 365099 - DNA, 25 bp, Mus musculus
cgtccaagccaagcctaggatatgt

SEQ ID NO: 365100 - DNA, 25 bp, Mus musculus
cgtccaagcctcaacatgtgtatgt

SEQ ID NO: 365101 - DNA, 25 bp, Mus musculus
cgtccaagcctctacatgtgtatgt

SEQ ID NO: 365102 - DNA, 25 bp, Mus musculus
cgtccaaggagaagcaagccaccat

SEQ ID NO: 365103 - DNA, 25 bp, Mus musculus
cgtccaaggagatgcaagccaccat

SEQ ID NO: 365104 - DNA, 25 bp, Mus musculus
cgtccacacacaaacagcttcctcc

SEQ ID NO: 365105 - DNA, 25 bp, Mus musculus
cgtccacacacatacagcttcctcc

SEQ ID NO: 365106 - DNA, 25 bp, Mus musculus
cgtccactctcaccttaggtttttg

SEQ ID NO: 365107 - DNA, 25 bp, Mus musculus
cgtccactctcagcttaggtttttg

SEQ ID NO: 365108 - DNA, 25 bp, Mus musculus
cgtccactctgaccagatccagata

SEQ ID NO: 365109 - DNA, 25 bp, Mus musculus
cgtccactctgagcagatccagata

SEQ ID NO: 365110 - DNA, 25 bp, Mus musculus
cgtccactcttgctggacttggtgc

SEQ ID NO: 365111 - DNA, 25 bp, Mus musculus
cgtccactcttggtggacttggtgc

SEQ ID NO: 365112 - DNA, 25 bp, Mus musculus
cgtccactgggcagggtacagatgt

SEQ ID NO: 365113 - DNA, 25 bp, Mus musculus
cgtccactgggctgggtacagatgt

SEQ ID NO: 365114 - DNA, 25 bp, Mus musculus
cgtccactgtccagtgtttgactac

SEQ ID NO: 365115 - DNA, 25 bp, Mus musculus
cgtccactgtcctgtgtttgactac

SEQ ID NO: 365116 - DNA, 25 bp, Mus musculus
cgtccagaagttatgattgtaccga

SEQ ID NO: 365117 - DNA, 25 bp, Mus musculus
cgtccagaagttttgattgtaccga

SEQ ID NO: 365118 - DNA, 25 bp, Mus musculus
cgtccagactcacagcccaaagaaa

SEQ ID NO: 365119 - DNA, 25 bp, Mus musculus
cgtccagactcagagcccaaagaaa

SEQ ID NO: 365120 - DNA, 25 bp, Mus musculus
cgtccagctttcactttacaatggg

SEQ ID NO: 365121 - DNA, 25 bp, Mus musculus
cgtccagctttctctttacaatggg

SEQ ID NO: 365122 - DNA, 25 bp, Mus musculus
cgtccagggtggatgcacgttacta

SEQ ID NO: 365123 - DNA, 25 bp, Mus musculus
cgtccagggtggttgcacgttacta

SEQ ID NO: 365124 - DNA, 25 bp, Mus musculus
cgtccagtaattctcctttgatccc

SEQ ID NO: 365125 - DNA, 25 bp, Mus musculus
cgtccagtaattgtcctttgatccc

SEQ ID NO: 365126 - DNA, 25 bp, Mus musculus
cgtccagtttacagagtatcctctc

SEQ ID NO: 365127 - DNA, 25 bp, Mus musculus
cgtccagtttactgagtatcctctc

SEQ ID NO: 365128 - DNA, 25 bp, Mus musculus
cgtccatccatcacacgggatgtga

SEQ ID NO: 365129 - DNA, 25 bp, Mus musculus
cgtccatccatctcacgggatgtga

SEQ ID NO: 365130 - DNA, 25 bp, Mus musculus
cgtccatcgactactttacctatag

SEQ ID NO: 365131 - DNA, 25 bp, Mus musculus
cgtccatcgacttctttacctatag

SEQ ID NO: 365132 - DNA, 25 bp, Mus musculus
cgtccatgctccacaaagtacaaga

SEQ ID NO: 365133 - DNA, 25 bp, Mus musculus
cgtccatgctcctcaaagtacaaga

SEQ ID NO: 365134 - DNA, 25 bp, Mus musculus
cgtccatgtgtcctttagtttcaaa

SEQ ID NO: 365135 - DNA, 25 bp, Mus musculus
cgtccatgtgtcgtttagtttcaaa

SEQ ID NO: 365136 - DNA, 25 bp, Mus musculus
cgtcccaatgtcagcatctggtttg

SEQ ID NO: 365137 - DNA, 25 bp, Mus musculus
cgtcccaatgtctgcatctggtttg

SEQ ID NO: 365138 - DNA, 25 bp, Mus musculus
cgtcccactcttatggaatggcagt

SEQ ID NO: 365139 - DNA, 25 bp, Mus musculus
cgtcccactcttttggaatggcagt

SEQ ID NO: 365140 - DNA, 25 bp, Mus musculus
cgtcccagtgctctgattgcaggaa

SEQ ID NO: 365141 - DNA, 25 bp, Mus musculus
cgtcccagtgctgtgattgcaggaa

SEQ ID NO: 365142 - DNA, 25 bp, Mus musculus
cgtcccataagtactgcatattggt

SEQ ID NO: 365143 - DNA, 25 bp, Mus musculus
cgtcccataagttctgcatattggt

SEQ ID NO: 365144 - DNA, 25 bp, Mus musculus
cgtcccatgtctacccataagagga

SEQ ID NO: 365145 - DNA, 25 bp, Mus musculus
cgtcccatgtcttcccataagagga

SEQ ID NO: 365146 - DNA, 25 bp, Mus musculus
cgtccccaacgcagctggaaatgag

SEQ ID NO: 365147 - DNA, 25 bp, Mus musculus
cgtccccaacgctgctggaaatgag

SEQ ID NO: 365148 - DNA, 25 bp, Mus musculus
cgtcccctatcaataccaaacagta

SEQ ID NO: 365149 - DNA, 25 bp, Mus musculus
cgtcccctatcattaccaaacagta

SEQ ID NO: 365150 - DNA, 25 bp, Mus musculus
cgtccctaacagatttgatggtaga

SEQ ID NO: 365151 - DNA, 25 bp, Mus musculus
cgtccctaacagttttgatggtaga

SEQ ID NO: 365152 - DNA, 25 bp, Mus musculus
cgtccctcccagagcaaactaactc

SEQ ID NO: 365153 - DNA, 25 bp, Mus musculus
cgtccctcccagtgcaaactaactc

SEQ ID NO: 365154 - DNA, 25 bp, Mus musculus
cgtccctcctgcaaacttgagctga

SEQ ID NO: 365155 - DNA, 25 bp, Mus musculus
cgtccctcctgctaacttgagctga

SEQ ID NO: 365156 - DNA, 25 bp, Mus musculus
cgtccctctgcactggatagatttg

SEQ ID NO: 365157 - DNA, 25 bp, Mus musculus
cgtccctctgcagtggatagatttg

SEQ ID NO: 365158 - DNA, 25 bp, Mus musculus
cgtcccttatctctcatcgtagatg

SEQ ID NO: 365159 - DNA, 25 bp, Mus musculus
cgtcccttatctgtcatcgtagatg

SEQ ID NO: 365160 - DNA, 25 bp, Mus musculus
cgtcccttcaagatgttcctggcag

SEQ ID NO: 365161 - DNA, 25 bp, Mus musculus
cgtcccttcaagttgttcctggcag

SEQ ID NO: 365162 - DNA, 25 bp, Mus musculus
cgtcccttcactactggagagaaca

SEQ ID NO: 365163 - DNA, 25 bp, Mus musculus
cgtcccttcacttctggagagaaca

SEQ ID NO: 365164 - DNA, 25 bp, Mus musculus
cgtccctttgacattaaatatcttt

SEQ ID NO: 365165 - DNA, 25 bp, Mus musculus
cgtccctttgactttaaatatcttt

SEQ ID NO: 365166 - DNA, 25 bp, Mus musculus
cgtccgatttttacaagagcttttg

SEQ ID NO: 365167 - DNA, 25 bp, Mus musculus
cgtccgattttttcaagagcttttg

SEQ ID NO: 365168 - DNA, 25 bp, Mus musculus
cgtccgcatgctaatcgctttttac

SEQ ID NO: 365169 - DNA, 25 bp, Mus musculus
cgtccgcatgcttatcgctttttac

SEQ ID NO: 365170 - DNA, 25 bp, Mus musculus
cgtccgccacgaagcagacgggcta

SEQ ID NO: 365171 - DNA, 25 bp, Mus musculus
cgtccgccacgatgcagacgggcta

SEQ ID NO: 365172 - DNA, 25 bp, Mus musculus
cgtccggatctcattaggagtggtt

SEQ ID NO: 365173 - DNA, 25 bp, Mus musculus
cgtccggatctctttaggagtggtt

SEQ ID NO: 365174 - DNA, 25 bp, Mus musculus
cgtccggcctgtcctatgtgcagaa

SEQ ID NO: 365175 - DNA, 25 bp, Mus musculus
cgtccggcctgtgctatgtgcagaa

SEQ ID NO: 365176 - DNA, 25 bp, Mus musculus
cgtccgggctccaggtacgagcact

SEQ ID NO: 365177 - DNA, 25 bp, Mus musculus
cgtccgggctcctggtacgagcact

SEQ ID NO: 365178 - DNA, 25 bp, Mus musculus
cgtcctactactcgcattttaccta

SEQ ID NO: 365179 - DNA, 25 bp, Mus musculus
cgtcctactactggcattttaccta

SEQ ID NO: 365180 - DNA, 25 bp, Mus musculus
cgtcctccactgagtcttgtgataa

SEQ ID NO: 365181 - DNA, 25 bp, Mus musculus
cgtcctccactgtgtcttgtgataa

SEQ ID NO: 365182 - DNA, 25 bp, Mus musculus
cgtcctctcttcaaagggttgtgag

SEQ ID NO: 365183 - DNA, 25 bp, Mus musculus
cgtcctctcttctaagggttgtgag

SEQ ID NO: 365184 - DNA, 25 bp, Mus musculus
cgtcctgctcttcgcctgtgaatgt

SEQ ID NO: 365185 - DNA, 25 bp, Mus musculus
cgtcctgctcttggcctgtgaatgt

SEQ ID NO: 365186 - DNA, 25 bp, Mus musculus
cgtcctggaggcagtgatcctggtt

SEQ ID NO: 365187 - DNA, 25 bp, Mus musculus
cgtcctggaggctgtgatcctggtt

SEQ ID NO: 365188 - DNA, 25 bp, Mus musculus
cgtcctgtagcaaagcttgctggga

SEQ ID NO: 365189 - DNA, 25 bp, Mus musculus
cgtcctgtagcatagcttgctggga

SEQ ID NO: 365190 - DNA, 25 bp, Mus musculus
cgtccttactttctaacctggctga

SEQ ID NO: 365191 - DNA, 25 bp, Mus musculus
cgtccttactttgtaacctggctga

SEQ ID NO: 365192 - DNA, 25 bp, Mus musculus
cgtccttcatgcatgtgtccttgaa

SEQ ID NO: 365193 - DNA, 25 bp, Mus musculus
cgtccttcatgcttgtgtccttgaa

SEQ ID NO: 365194 - DNA, 25 bp, Mus musculus
cgtccttcctggacatactgataaa

SEQ ID NO: 365195 - DNA, 25 bp, Mus musculus
cgtccttcctggtcatactgataaa

SEQ ID NO: 365196 - DNA, 25 bp, Mus musculus
cgtccttcctttagctgagtcactg

SEQ ID NO: 365197 - DNA, 25 bp, Mus musculus
cgtccttccttttgctgagtcactg

SEQ ID NO: 365198 - DNA, 25 bp, Mus musculus
cgtccttgtcaaaggtttaggctag

SEQ ID NO: 365199 - DNA, 25 bp, Mus musculus
cgtccttgtcaatggtttaggctag

SEQ ID NO: 365200 - DNA, 25 bp, Mus musculus
cgtccttgtctcctgtaatatactg

SEQ ID NO: 365201 - DNA, 25 bp, Mus musculus
cgtccttgtctcgtgtaatatactg

SEQ ID NO: 365202 - DNA, 25 bp, Mus musculus
cgtccttttctgactttatgcaatt

SEQ ID NO: 365203 - DNA, 25 bp, Mus musculus
cgtccttttctgtctttatgcaatt

SEQ ID NO: 365204 - DNA, 25 bp, Mus musculus
cgtcgacaacggctccggcatgtgc

SEQ ID NO: 365205 - DNA, 25 bp, Mus musculus
cgtcgacaacgggtccggcatgtgc

SEQ ID NO: 365206 - DNA, 25 bp, Mus musculus
cgtcgagcagcacactttggccaaa

SEQ ID NO: 365207 - DNA, 25 bp, Mus musculus
cgtcgagcagcagactttggccaaa

SEQ ID NO: 365208 - DNA, 25 bp, Mus musculus
cgtcgaggcgcgagcagctcagcca

SEQ ID NO: 365209 - DNA, 25 bp, Mus musculus
cgtcgaggcgcgtgcagctcagcca

SEQ ID NO: 365210 - DNA, 25 bp, Mus musculus
cgtcgatttattatactctgcgtaa

SEQ ID NO: 365211 - DNA, 25 bp, Mus musculus
cgtcgatttattttactctgcgtaa

SEQ ID NO: 365212 - DNA, 25 bp, Mus musculus
cgtcgcatactcatgctgactaaag

SEQ ID NO: 365213 - DNA, 25 bp, Mus musculus
cgtcgcatactcttgctgactaaag

SEQ ID NO: 365214 - DNA, 25 bp, Mus musculus
cgtcgccatggtcaagctgagcaaa

SEQ ID NO: 365215 - DNA, 25 bp, Mus musculus
cgtcgccatggtgaagctgagcaaa

SEQ ID NO: 365216 - DNA, 25 bp, Mus musculus
cgtcgcctggtgactggagcattta

SEQ ID NO: 365217 - DNA, 25 bp, Mus musculus
cgtcgcctggtgtctggagcattta

SEQ ID NO: 365218 - DNA, 25 bp, Mus musculus
cgtcgctgtttgaatcgtctggcaa

SEQ ID NO: 365219 - DNA, 25 bp, Mus musculus
cgtcgctgtttgtatcgtctggcaa

SEQ ID NO: 365220 - DNA, 25 bp, Mus musculus
cgtcggactgtgagattgagcccaa

SEQ ID NO: 365221 - DNA, 25 bp, Mus musculus
cgtcggactgtgtgattgagcccaa

SEQ ID NO: 365222 - DNA, 25 bp, Mus musculus
cgtcggagcactaactggagtccaa

SEQ ID NO: 365223 - DNA, 25 bp, Mus musculus
cgtcggagcacttactggagtccaa

SEQ ID NO: 365224 - DNA, 25 bp, Mus musculus
cgtcggcagttccagtcacagctgg

SEQ ID NO: 365225 - DNA, 25 bp, Mus musculus
cgtcggcagttcgagtcacagctgg

SEQ ID NO: 365226 - DNA, 25 bp, Mus musculus
cgtcggcatcgaagaggctagagaa

SEQ ID NO: 365227 - DNA, 25 bp, Mus musculus
cgtcggcatcgatgaggctagagaa

SEQ ID NO: 365228 - DNA, 25 bp, Mus musculus
cgtcggcccgcgactctgtgatata

SEQ ID NO: 365229 - DNA, 25 bp, Mus musculus
cgtcggcccgcgtctctgtgatata

SEQ ID NO: 365230 - DNA, 25 bp, Mus musculus
cgtcggcgccttaatgctggagagc

SEQ ID NO: 365231 - DNA, 25 bp, Mus musculus
cgtcggcgcctttatgctggagagc

SEQ ID NO: 365232 - DNA, 25 bp, Mus musculus
cgtcggtgggacagatcaacagtat

SEQ ID NO: 365233 - DNA, 25 bp, Mus musculus
cgtcggtgggactgatcaacagtat

SEQ ID NO: 365234 - DNA, 25 bp, Mus musculus
cgtcgtaggtccagctcgatgtgaa

SEQ ID NO: 365235 - DNA, 25 bp, Mus musculus
cgtcgtaggtcctgctcgatgtgaa

SEQ ID NO: 365236 - DNA, 25 bp, Mus musculus
cgtcgtccgacgacgagttcgaaga

SEQ ID NO: 365237 - DNA, 25 bp, Mus musculus
cgtcgtccgacgtcgagttcgaaga

SEQ ID NO: 365238 - DNA, 25 bp, Mus musculus
cgtcgtccgggaactgaaagcacag

SEQ ID NO: 365239 - DNA, 25 bp, Mus musculus
cgtcgtccgggatctgaaagcacag

SEQ ID NO: 365240 - DNA, 25 bp, Mus musculus
cgtcgtcggacgacgaagagcccga

SEQ ID NO: 365241 - DNA, 25 bp, Mus musculus
cgtcgtcggacgtcgaagagcccga

SEQ ID NO: 365242 - DNA, 25 bp, Mus musculus
cgtcgtgaacacctgccatgatgct

SEQ ID NO: 365243 - DNA, 25 bp, Mus musculus
cgtcgtgaacacgtgccatgatgct

SEQ ID NO: 365244 - DNA, 25 bp, Mus musculus
cgtcgtgcggcaatatttttagctg

SEQ ID NO: 365245 - DNA, 25 bp, Mus musculus
cgtcgtgcggcattatttttagctg

SEQ ID NO: 365246 - DNA, 25 bp, Mus musculus
cgtcgtttggctatggcggtctgca

SEQ ID NO: 365247 - DNA, 25 bp, Mus musculus
cgtcgtttggctttggcggtctgca

SEQ ID NO: 365248 - DNA, 25 bp, Mus musculus
cgtctacatcaaccccagaaagctg

SEQ ID NO: 365249 - DNA, 25 bp, Mus musculus
cgtctacatcaagcccagaaagctg

SEQ ID NO: 365250 - DNA, 25 bp, Mus musculus
cgtctagagaacatttggtcaggat

SEQ ID NO: 365251 - DNA, 25 bp, Mus musculus
cgtctagagaacttttggtcaggat

SEQ ID NO: 365252 - DNA, 25 bp, Mus musculus
cgtctagagcccctttttcttatat

SEQ ID NO: 365253 - DNA, 25 bp, Mus musculus
cgtctagagcccgtttttcttatat

SEQ ID NO: 365254 - DNA, 25 bp, Mus musculus
cgtctagggccaactgccttttgga

SEQ ID NO: 365255 - DNA, 25 bp, Mus musculus
cgtctagggccatctgccttttgga

SEQ ID NO: 365256 - DNA, 25 bp, Mus musculus
cgtctcacagacagcctctataaaa

SEQ ID NO: 365257 - DNA, 25 bp, Mus musculus
cgtctcacagactgcctctataaaa

SEQ ID NO: 365258 - DNA, 25 bp, Mus musculus
cgtctcagggatcgttgacctgcgt

SEQ ID NO: 365259 - DNA, 25 bp, Mus musculus
cgtctcagggatggttgacctgcgt

SEQ ID NO: 365260 - DNA, 25 bp, Mus musculus
cgtctcatacttcatttcagcattg

SEQ ID NO: 365261 - DNA, 25 bp, Mus musculus
cgtctcatacttgatttcagcattg

SEQ ID NO: 365262 - DNA, 25 bp, Mus musculus
cgtctccaatttcgctctccttagg

SEQ ID NO: 365263 - DNA, 25 bp, Mus musculus
cgtctccaatttggctctccttagg

SEQ ID NO: 365264 - DNA, 25 bp, Mus musculus
cgtctccaccaaccagcagaatatg

SEQ ID NO: 365265 - DNA, 25 bp, Mus musculus
cgtctccaccaagcagcagaatatg

SEQ ID NO: 365266 - DNA, 25 bp, Mus musculus
cgtctcccaaggcagtctctggatg

SEQ ID NO: 365267 - DNA, 25 bp, Mus musculus
cgtctcccaagggagtctctggatg

SEQ ID NO: 365268 - DNA, 25 bp, Mus musculus
cgtctccctagcaggaggcggcagt

SEQ ID NO: 365269 - DNA, 25 bp, Mus musculus
cgtctccctagctggaggcggcagt

SEQ ID NO: 365270 - DNA, 25 bp, Mus musculus
cgtctcctccaactatccaggtaaa

SEQ ID NO: 365271 - DNA, 25 bp, Mus musculus
cgtctcctccaagtatccaggtaaa

SEQ ID NO: 365272 - DNA, 25 bp, Mus musculus
cgtctcctcctaagcaatacaattt

SEQ ID NO: 365273 - DNA, 25 bp, Mus musculus
cgtctcctcctatgcaatacaattt

SEQ ID NO: 365274 - DNA, 25 bp, Mus musculus
cgtctctcagaaccttttacaagta

SEQ ID NO: 365275 - DNA, 25 bp, Mus musculus
cgtctctcagaagcttttacaagta

SEQ ID NO: 365276 - DNA, 25 bp, Mus musculus
cgtctctccagtactatagttcagg

SEQ ID NO: 365277 - DNA, 25 bp, Mus musculus
cgtctctccagttctatagttcagg

SEQ ID NO: 365278 - DNA, 25 bp, Mus musculus
cgtctctccatgcaacgaggttaga

SEQ ID NO: 365279 - DNA, 25 bp, Mus musculus
cgtctctccatggaacgaggttaga

SEQ ID NO: 365280 - DNA, 25 bp, Mus musculus
cgtctctgccatcagtatttttagc

SEQ ID NO: 365281 - DNA, 25 bp, Mus musculus
cgtctctgccatgagtatttttagc

SEQ ID NO: 365282 - DNA, 25 bp, Mus musculus
cgtctctgcggaagtctgtctatgt

SEQ ID NO: 365283 - DNA, 25 bp, Mus musculus
cgtctctgcggatgtctgtctatgt

SEQ ID NO: 365284 - DNA, 25 bp, Mus musculus
cgtctcttctctccctctgataata

SEQ ID NO: 365285 - DNA, 25 bp, Mus musculus
cgtctcttctctgcctctgataata

SEQ ID NO: 365286 - DNA, 25 bp, Mus musculus
cgtctctttgtgcttgccaatttta

SEQ ID NO: 365287 - DNA, 25 bp, Mus musculus
cgtctctttgtggttgccaatttta

SEQ ID NO: 365288 - DNA, 25 bp, Mus musculus
cgtctgaccctgctattgtcacaga

SEQ ID NO: 365289 - DNA, 25 bp, Mus musculus
cgtctgaccctggtattgtcacaga

SEQ ID NO: 365290 - DNA, 25 bp, Mus musculus
cgtctgacttccacattatctcaga

SEQ ID NO: 365291 - DNA, 25 bp, Mus musculus
cgtctgacttcctcattatctcaga

SEQ ID NO: 365292 - DNA, 25 bp, Mus musculus
cgtctgagagctctgacctctgcag

SEQ ID NO: 365293 - DNA, 25 bp, Mus musculus
cgtctgagagctgtgacctctgcag

SEQ ID NO: 365294 - DNA, 25 bp, Mus musculus
cgtctgatgaccacgtatcatgtta

SEQ ID NO: 365295 - DNA, 25 bp, Mus musculus
cgtctgatgacctcgtatcatgtta

SEQ ID NO: 365296 - DNA, 25 bp, Mus musculus
cgtctgccttcaatattgaaacatt

SEQ ID NO: 365297 - DNA, 25 bp, Mus musculus
cgtctgccttcattattgaaacatt

SEQ ID NO: 365298 - DNA, 25 bp, Mus musculus
cgtctgctaggtcgtcggtgataaa

SEQ ID NO: 365299 - DNA, 25 bp, Mus musculus
cgtctgctaggtggtcggtgataaa

SEQ ID NO: 365300 - DNA, 25 bp, Mus musculus
cgtctggatcccaggaaactggtct

SEQ ID NO: 365301 - DNA, 25 bp, Mus musculus
cgtctggatccctggaaactggtct

SEQ ID NO: 365302 - DNA, 25 bp, Mus musculus
cgtctggctctaacatccgatttgc

SEQ ID NO: 365303 - DNA, 25 bp, Mus musculus
cgtctggctctatcatccgatttgc

SEQ ID NO: 365304 - DNA, 25 bp, Mus musculus
cgtctgggacccaccaagggcttgg

SEQ ID NO: 365305 - DNA, 25 bp, Mus musculus
cgtctgggaccctccaagggcttgg

SEQ ID NO: 365306 - DNA, 25 bp, Mus musculus
cgtctgtaaatgcatccaagccttt

SEQ ID NO: 365307 - DNA, 25 bp, Mus musculus
cgtctgtaaatggatccaagccttt

SEQ ID NO: 365308 - DNA, 25 bp, Mus musculus
cgtctgtaactgatgttccagggca

SEQ ID NO: 365309 - DNA, 25 bp, Mus musculus
cgtctgtaactgttgttccagggca

SEQ ID NO: 365310 - DNA, 25 bp, Mus musculus
cgtctgtccagtactccttagagaa

SEQ ID NO: 365311 - DNA, 25 bp, Mus musculus
cgtctgtccagttctccttagagaa

SEQ ID NO: 365312 - DNA, 25 bp, Mus musculus
cgtctgtctgcgcttgagaaggata

SEQ ID NO: 365313 - DNA, 25 bp, Mus musculus
cgtctgtctgcggttgagaaggata

SEQ ID NO: 365314 - DNA, 25 bp, Mus musculus
cgtctgtgacttacctactgtgtaa

SEQ ID NO: 365315 - DNA, 25 bp, Mus musculus
cgtctgtgactttcctactgtgtaa

SEQ ID NO: 365316 - DNA, 25 bp, Mus musculus
cgtctgtttcaccactgtttgtgat

SEQ ID NO: 365317 - DNA, 25 bp, Mus musculus
cgtctgtttcacgactgtttgtgat

SEQ ID NO: 365318 - DNA, 25 bp, Mus musculus
cgtctgtttgaacgcaatgctctcc

SEQ ID NO: 365319 - DNA, 25 bp, Mus musculus
cgtctgtttgaaggcaatgctctcc

SEQ ID NO: 365320 - DNA, 25 bp, Mus musculus
cgtcttagtgctcaggctgtctgaa

SEQ ID NO: 365321 - DNA, 25 bp, Mus musculus
cgtcttagtgctgaggctgtctgaa

SEQ ID NO: 365322 - DNA, 25 bp, Mus musculus
cgtcttcaccccaagcaaaatgtat

SEQ ID NO: 365323 - DNA, 25 bp, Mus musculus
cgtcttcacccctagcaaaatgtat

SEQ ID NO: 365324 - DNA, 25 bp, Mus musculus
cgtcttcatatcattcacagctata

SEQ ID NO: 365325 - DNA, 25 bp, Mus musculus
cgtcttcatatctttcacagctata

SEQ ID NO: 365326 - DNA, 25 bp, Mus musculus
cgtcttcatgccctgtactaaaagt

SEQ ID NO: 365327 - DNA, 25 bp, Mus musculus
cgtcttcatgccgtgtactaaaagt

SEQ ID NO: 365328 - DNA, 25 bp, Mus musculus
cgtcttccaatgcttctgcctcaag

SEQ ID NO: 365329 - DNA, 25 bp, Mus musculus
cgtcttccaatggttctgcctcaag

SEQ ID NO: 365330 - DNA, 25 bp, Mus musculus
cgtcttctatcaatgccttcaagga

SEQ ID NO: 365331 - DNA, 25 bp, Mus musculus
cgtcttctatcattgccttcaagga

SEQ ID NO: 365332 - DNA, 25 bp, Mus musculus
cgtcttgaacagccgctgatgaccc

SEQ ID NO: 365333 - DNA, 25 bp, Mus musculus
cgtcttgaacaggcgctgatgaccc

SEQ ID NO: 365334 - DNA, 25 bp, Mus musculus
cgtcttgcggcaacttatagttaac

SEQ ID NO: 365335 - DNA, 25 bp, Mus musculus
cgtcttgcggcatcttatagttaac

SEQ ID NO: 365336 - DNA, 25 bp, Mus musculus
cgtcttgttcttatttagctggtca

SEQ ID NO: 365337 - DNA, 25 bp, Mus musculus
cgtcttgttcttttttagctggtca

SEQ ID NO: 365338 - DNA, 25 bp, Mus musculus
cgtctttaagacatgggccttctct

SEQ ID NO: 365339 - DNA, 25 bp, Mus musculus
cgtctttaagacttgggccttctct

SEQ ID NO: 365340 - DNA, 25 bp, Mus musculus
cgtctttacagtcccttgagttgta

SEQ ID NO: 365341 - DNA, 25 bp, Mus musculus
cgtctttacagtgccttgagttgta

SEQ ID NO: 365342 - DNA, 25 bp, Mus musculus
cgtctttagaagaacaacctgggat

SEQ ID NO: 365343 - DNA, 25 bp, Mus musculus
cgtctttagaagtacaacctgggat

SEQ ID NO: 365344 - DNA, 25 bp, Mus musculus
cgtctttaggccagggatatagttt

SEQ ID NO: 365345 - DNA, 25 bp, Mus musculus
cgtctttaggcctgggatatagttt

SEQ ID NO: 365346 - DNA, 25 bp, Mus musculus
cgtctttcatataatttcagtccat

SEQ ID NO: 365347 - DNA, 25 bp, Mus musculus
cgtctttcatattatttcagtccat

SEQ ID NO: 365348 - DNA, 25 bp, Mus musculus
cgtctttcctggatcactacagtga

SEQ ID NO: 365349 - DNA, 25 bp, Mus musculus
cgtctttcctggttcactacagtga

SEQ ID NO: 365350 - DNA, 25 bp, Mus musculus
cgtctttgagccaagtaccaaacag

SEQ ID NO: 365351 - DNA, 25 bp, Mus musculus
cgtctttgagcctagtaccaaacag

SEQ ID NO: 365352 - DNA, 25 bp, Mus musculus
cgtctttgccgtaagctagtattat

SEQ ID NO: 365353 - DNA, 25 bp, Mus musculus
cgtctttgccgttagctagtattat

SEQ ID NO: 365354 - DNA, 25 bp, Mus musculus
cgtctttttccgatttcaggttgtg

SEQ ID NO: 365355 - DNA, 25 bp, Mus musculus
cgtctttttccgttttcaggttgtg

SEQ ID NO: 365356 - DNA, 25 bp, Mus musculus
cgtctttttgccacgtgttatgaga

SEQ ID NO: 365357 - DNA, 25 bp, Mus musculus
cgtctttttgcctcgtgttatgaga

SEQ ID NO: 365358 - DNA, 25 bp, Mus musculus
cgtgaaaggttcactcagtcggcgg

SEQ ID NO: 365359 - DNA, 25 bp, Mus musculus
cgtgaaaggttctctcagtcggcgg

SEQ ID NO: 365360 - DNA, 25 bp, Mus musculus
cgtgaaagttgcatgtttcctatgt

SEQ ID NO: 365361 - DNA, 25 bp, Mus musculus
cgtgaaagttgcttgtttcctatgt

SEQ ID NO: 365362 - DNA, 25 bp, Mus musculus
cgtgaacacgttcggtcttgatgac

SEQ ID NO: 365363 - DNA, 25 bp, Mus musculus
cgtgaacacgttgggtcttgatgac

SEQ ID NO: 365364 - DNA, 25 bp, Mus musculus
cgtgaacctcaactactgctggata

SEQ ID NO: 365365 - DNA, 25 bp, Mus musculus
cgtgaacctcaagtactgctggata

SEQ ID NO: 365366 - DNA, 25 bp, Mus musculus
cgtgaacgttgtcaattgtttacat

SEQ ID NO: 365367 - DNA, 25 bp, Mus musculus
cgtgaacgttgtgaattgtttacat

SEQ ID NO: 365368 - DNA, 25 bp, Mus musculus
cgtgaagacttcagtgggaggcccc

SEQ ID NO: 365369 - DNA, 25 bp, Mus musculus
cgtgaagacttctgtgggaggcccc

SEQ ID NO: 365370 - DNA, 25 bp, Mus musculus
cgtgaagccaaacgacctaggactt

SEQ ID NO: 365371 - DNA, 25 bp, Mus musculus
cgtgaagccaaaggacctaggactt

SEQ ID NO: 365372 - DNA, 25 bp, Mus musculus
cgtgaagccctcagacctggagcct

SEQ ID NO: 365373 - DNA, 25 bp, Mus musculus
cgtgaagccctctgacctggagcct

SEQ ID NO: 365374 - DNA, 25 bp, Mus musculus
cgtgaaggccccatcgtgttaagat

SEQ ID NO: 365375 - DNA, 25 bp, Mus musculus
cgtgaaggccccttcgtgttaagat

SEQ ID NO: 365376 - DNA, 25 bp, Mus musculus
cgtgaagtaggaacccagaactata

SEQ ID NO: 365377 - DNA, 25 bp, Mus musculus
cgtgaagtaggatcccagaactata

SEQ ID NO: 365378 - DNA, 25 bp, Mus musculus
cgtgaagtgtgcagtgtttccttta

SEQ ID NO: 365379 - DNA, 25 bp, Mus musculus
cgtgaagtgtgctgtgtttccttta

SEQ ID NO: 365380 - DNA, 25 bp, Mus musculus
cgtgaagtttttctctggagatgct

SEQ ID NO: 365381 - DNA, 25 bp, Mus musculus
cgtgaagtttttgtctggagatgct

SEQ ID NO: 365382 - DNA, 25 bp, Mus musculus
cgtgaatgtgttatccgggaacagt

SEQ ID NO: 365383 - DNA, 25 bp, Mus musculus
cgtgaatgtgttttccgggaacagt

SEQ ID NO: 365384 - DNA, 25 bp, Mus musculus
cgtgacacacccatttcaacaaggc

SEQ ID NO: 365385 - DNA, 25 bp, Mus musculus
cgtgacacacccttttcaacaaggc

SEQ ID NO: 365386 - DNA, 25 bp, Mus musculus
cgtgacactacaagaagcggacatt

SEQ ID NO: 365387 - DNA, 25 bp, Mus musculus
cgtgacactacatgaagcggacatt

SEQ ID NO: 365388 - DNA, 25 bp, Mus musculus
cgtgacattgaactacagggcttcc

SEQ ID NO: 365389 - DNA, 25 bp, Mus musculus
cgtgacattgaactccaggattttc

SEQ ID NO: 365390 - DNA, 25 bp, Mus musculus
cgtgacattgaagtacagggcttcc

SEQ ID NO: 365391 - DNA, 25 bp, Mus musculus
cgtgacattgaagtccaggattttc

SEQ ID NO: 365392 - DNA, 25 bp, Mus musculus
cgtgaccaaatcctgcaacgtgcag

SEQ ID NO: 365393 - DNA, 25 bp, Mus musculus
cgtgaccaaatcgtgcaacgtgcag

SEQ ID NO: 365394 - DNA, 25 bp, Mus musculus
cgtgaccacaacacggccatgggct

SEQ ID NO: 365395 - DNA, 25 bp, Mus musculus
cgtgaccacaactcggccatgggct

SEQ ID NO: 365396 - DNA, 25 bp, Mus musculus
cgtgaccatgagaagcagcagcctt

SEQ ID NO: 365397 - DNA, 25 bp, Mus musculus
cgtgaccatgagtagcagcagcctt

SEQ ID NO: 365398 - DNA, 25 bp, Mus musculus
cgtgaccatgttcctttcttatttc

SEQ ID NO: 365399 - DNA, 25 bp, Mus musculus
cgtgaccatgttgctttcttatttc

SEQ ID NO: 365400 - DNA, 25 bp, Mus musculus
cgtgacccgttgaatctgatccaaa

SEQ ID NO: 365401 - DNA, 25 bp, Mus musculus
cgtgacccgttgtatctgatccaaa

SEQ ID NO: 365402 - DNA, 25 bp, Mus musculus
cgtgaccctacaattccatgcacag

SEQ ID NO: 365403 - DNA, 25 bp, Mus musculus
cgtgaccctacatttccatgcacag

SEQ ID NO: 365404 - DNA, 25 bp, Mus musculus
cgtgacctgaaaaggacctgttggg

SEQ ID NO: 365405 - DNA, 25 bp, Mus musculus
cgtgacctgaaatggacctgttggg

SEQ ID NO: 365406 - DNA, 25 bp, Mus musculus
cgtgacgcttcaccgtctagcggta

SEQ ID NO: 365407 - DNA, 25 bp, Mus musculus
cgtgacgcttcagcgtctagcggta

SEQ ID NO: 365408 - DNA, 25 bp, Mus musculus
cgtgacggtgccagcatgaagctaa

SEQ ID NO: 365409 - DNA, 25 bp, Mus musculus
cgtgacggtgcctgcatgaagctaa

SEQ ID NO: 365410 - DNA, 25 bp, Mus musculus
cgtgactcacttaattattcccagg

SEQ ID NO: 365411 - DNA, 25 bp, Mus musculus
cgtgactcactttattattcccagg

SEQ ID NO: 365412 - DNA, 25 bp, Mus musculus
cgtgactgatgacgataagaaccgt

SEQ ID NO: 365413 - DNA, 25 bp, Mus musculus
cgtgactgatgaggataagaaccgt

SEQ ID NO: 365414 - DNA, 25 bp, Mus musculus
cgtgacttttccagcataactgttt

SEQ ID NO: 365415 - DNA, 25 bp, Mus musculus
cgtgacttttcctgcataactgttt

SEQ ID NO: 365416 - DNA, 25 bp, Mus musculus
cgtgagaattttaccagacttcaag

SEQ ID NO: 365417 - DNA, 25 bp, Mus musculus
cgtgagaatttttccagacttcaag

SEQ ID NO: 365418 - DNA, 25 bp, Mus musculus
cgtgagactgtgacttggtcctgca

SEQ ID NO: 365419 - DNA, 25 bp, Mus musculus
cgtgagactgtgtcttggtcctgca

SEQ ID NO: 365420 - DNA, 25 bp, Mus musculus
cgtgagccgaaaaaagcccttacat

SEQ ID NO: 365421 - DNA, 25 bp, Mus musculus
cgtgagccgaaataagcccttacat

SEQ ID NO: 365422 - DNA, 25 bp, Mus musculus
cgtgagccggtgacgtcccaataca

SEQ ID NO: 365423 - DNA, 25 bp, Mus musculus
cgtgagccggtgtcgtcccaataca

SEQ ID NO: 365424 - DNA, 25 bp, Mus musculus
cgtgagcgctcactgttagtttact

SEQ ID NO: 365425 - DNA, 25 bp, Mus musculus
cgtgagcgctcagtgttagtttact

SEQ ID NO: 365426 - DNA, 25 bp, Mus musculus
cgtgagcggatgacaggaaatctgt

SEQ ID NO: 365427 - DNA, 25 bp, Mus musculus
cgtgagcggatgtcaggaaatctgt

SEQ ID NO: 365428 - DNA, 25 bp, Mus musculus
cgtgagcgtgagctgtcagtaccat

SEQ ID NO: 365429 - DNA, 25 bp, Mus musculus
cgtgagcgtgaggtgtcagtaccat

SEQ ID NO: 365430 - DNA, 25 bp, Mus musculus
cgtgagcttagccatgtcttttcaa

SEQ ID NO: 365431 - DNA, 25 bp, Mus musculus
cgtgagcttagcgatgtcttttcaa

SEQ ID NO: 365432 - DNA, 25 bp, Mus musculus
cgtgagggagctacgagacgccttc

SEQ ID NO: 365433 - DNA, 25 bp, Mus musculus
cgtgagggagcttcgagacgccttc

SEQ ID NO: 365434 - DNA, 25 bp, Mus musculus
cgtgagggcaccaggtcatggtaaa

SEQ ID NO: 365435 - DNA, 25 bp, Mus musculus
cgtgagggcacctggtcatggtaaa

SEQ ID NO: 365436 - DNA, 25 bp, Mus musculus
cgtgagggtcacaggatgtaatact

SEQ ID NO: 365437 - DNA, 25 bp, Mus musculus
cgtgagggtcactggatgtaatact

SEQ ID NO: 365438 - DNA, 25 bp, Mus musculus
cgtgaggtccctcttactttggctt

SEQ ID NO: 365439 - DNA, 25 bp, Mus musculus
cgtgaggtccctgttactttggctt

SEQ ID NO: 365440 - DNA, 25 bp, Mus musculus
cgtgaggtctcacgtccagcagcag

SEQ ID NO: 365441 - DNA, 25 bp, Mus musculus
cgtgaggtctcaggtccagcagcag

SEQ ID NO: 365442 - DNA, 25 bp, Mus musculus
cgtgagtcgccaatgctggagtcaa

SEQ ID NO: 365443 - DNA, 25 bp, Mus musculus
cgtgagtcgccattgctggagtcaa

SEQ ID NO: 365444 - DNA, 25 bp, Mus musculus
cgtgagtcgggaaagcctcagcttt

SEQ ID NO: 365445 - DNA, 25 bp, Mus musculus
cgtgagtcgggatagcctcagcttt

SEQ ID NO: 365446 - DNA, 25 bp, Mus musculus
cgtgataaaaatccgccacctgctg

SEQ ID NO: 365447 - DNA, 25 bp, Mus musculus
cgtgataaaaatgcgccacctgctg

SEQ ID NO: 365448 - DNA, 25 bp, Mus musculus
cgtgatatttgtacgtgtgtttcta

SEQ ID NO: 365449 - DNA, 25 bp, Mus musculus
cgtgatatttgttcgtgtgtttcta

SEQ ID NO: 365450 - DNA, 25 bp, Mus musculus
cgtgatctgagtctcggcaccagtg

SEQ ID NO: 365451 - DNA, 25 bp, Mus musculus
cgtgatctgagtgtcggcaccagtg

SEQ ID NO: 365452 - DNA, 25 bp, Mus musculus
cgtgatgagtgaatacagaggcttt

SEQ ID NO: 365453 - DNA, 25 bp, Mus musculus
cgtgatgagtgattacagaggcttt

SEQ ID NO: 365454 - DNA, 25 bp, Mus musculus
cgtgatgctcttaatgaaaggaaac

SEQ ID NO: 365455 - DNA, 25 bp, Mus musculus
cgtgatgctctttatgaaaggaaac

SEQ ID NO: 365456 - DNA, 25 bp, Mus musculus
cgtgatggctttacttcgaatatgt

SEQ ID NO: 365457 - DNA, 25 bp, Mus musculus
cgtgatggcttttcttcgaatatgt

SEQ ID NO: 365458 - DNA, 25 bp, Mus musculus
cgtgatgtcccaaacatgctggatg

SEQ ID NO: 365459 - DNA, 25 bp, Mus musculus
cgtgatgtcccatacatgctggatg

SEQ ID NO: 365460 - DNA, 25 bp, Mus musculus
cgtgatgtccggacgtggcaagcaa

SEQ ID NO: 365461 - DNA, 25 bp, Mus musculus
cgtgatgtccggtcgtggcaagcaa

SEQ ID NO: 365462 - DNA, 25 bp, Mus musculus
cgtgatttcctacagccttgagcct

SEQ ID NO: 365463 - DNA, 25 bp, Mus musculus
cgtgatttcctagagccttgagcct

SEQ ID NO: 365464 - DNA, 25 bp, Mus musculus
cgtgcaaatgcacagggagcctgca

SEQ ID NO: 365465 - DNA, 25 bp, Mus musculus
cgtgcaaatgcagagggagcctgca

SEQ ID NO: 365466 - DNA, 25 bp, Mus musculus
cgtgcaaattgtaaggtagccccat

SEQ ID NO: 365467 - DNA, 25 bp, Mus musculus
cgtgcaaattgttaggtagccccat

SEQ ID NO: 365468 - DNA, 25 bp, Mus musculus
cgtgcaacacacacgtgcgaaggtt

SEQ ID NO: 365469 - DNA, 25 bp, Mus musculus
cgtgcaacacactcgtgcgaaggtt

SEQ ID NO: 365470 - DNA, 25 bp, Mus musculus
cgtgcaagggcactatctgttctca

SEQ ID NO: 365471 - DNA, 25 bp, Mus musculus
cgtgcaagggcagtatctgttctca

SEQ ID NO: 365472 - DNA, 25 bp, Mus musculus
cgtgcaatagctccgtgctcatgtg

SEQ ID NO: 365473 - DNA, 25 bp, Mus musculus
cgtgcaatagctgcgtgctcatgtg

SEQ ID NO: 365474 - DNA, 25 bp, Mus musculus
cgtgcacaacctcaaagcagtccta

SEQ ID NO: 365475 - DNA, 25 bp, Mus musculus
cgtgcacaacctgaaagcagtccta

SEQ ID NO: 365476 - DNA, 25 bp, Mus musculus
cgtgcaccatcaaatgcaatttttg

SEQ ID NO: 365477 - DNA, 25 bp, Mus musculus
cgtgcaccatcatatgcaatttttg

SEQ ID NO: 365478 - DNA, 25 bp, Mus musculus
cgtgcagcggtcctcaccgaaagat

SEQ ID NO: 365479 - DNA, 25 bp, Mus musculus
cgtgcagcggtcgtcaccgaaagat

SEQ ID NO: 365480 - DNA, 25 bp, Mus musculus
cgtgcagctcgccttaagacatttc

SEQ ID NO: 365481 - DNA, 25 bp, Mus musculus
cgtgcagctcgcgttaagacatttc

SEQ ID NO: 365482 - DNA, 25 bp, Mus musculus
cgtgcagtccggcagaatatctttc

SEQ ID NO: 365483 - DNA, 25 bp, Mus musculus
cgtgcagtccgggagaatatctttc

SEQ ID NO: 365484 - DNA, 25 bp, Mus musculus
cgtgcatattataccgtgacagctt

SEQ ID NO: 365485 - DNA, 25 bp, Mus musculus
cgtgcatattattccgtgacagctt

SEQ ID NO: 365486 - DNA, 25 bp, Mus musculus
cgtgcatgaagacctcgcttgggat

SEQ ID NO: 365487 - DNA, 25 bp, Mus musculus
cgtgcatgaagagctcgcttgggat

SEQ ID NO: 365488 - DNA, 25 bp, Mus musculus
cgtgcatgcgccagggccacagacg

SEQ ID NO: 365489 - DNA, 25 bp, Mus musculus
cgtgcatgcgcctgggccacagacg

SEQ ID NO: 365490 - DNA, 25 bp, Mus musculus
cgtgcatggcataccgttcatcaaa

SEQ ID NO: 365491 - DNA, 25 bp, Mus musculus
cgtgcatggcattccgttcatcaaa

SEQ ID NO: 365492 - DNA, 25 bp, Mus musculus
cgtgcattcatacccagtctgcttg

SEQ ID NO: 365493 - DNA, 25 bp, Mus musculus
cgtgcattcatagccagtctgcttg

SEQ ID NO: 365494 - DNA, 25 bp, Mus musculus
cgtgccaaccagcacaaggagcagc

SEQ ID NO: 365495 - DNA, 25 bp, Mus musculus
cgtgccaaccaggacaaggagcagc

SEQ ID NO: 365496 - DNA, 25 bp, Mus musculus
cgtgccactaacacttaaatgtgag

SEQ ID NO: 365497 - DNA, 25 bp, Mus musculus
cgtgccactaactcttaaatgtgag

SEQ ID NO: 365498 - DNA, 25 bp, Mus musculus
cgtgccactgttagattaaagtgtt

SEQ ID NO: 365499 - DNA, 25 bp, Mus musculus
cgtgccactgtttgattaaagtgtt

SEQ ID NO: 365500 - DNA, 25 bp, Mus musculus
cgtgccactttaactctggaactga

SEQ ID NO: 365501 - DNA, 25 bp, Mus musculus
cgtgccactttatctctggaactga

SEQ ID NO: 365502 - DNA, 25 bp, Mus musculus
cgtgccaggttcagccaaagtgtgg

SEQ ID NO: 365503 - DNA, 25 bp, Mus musculus
cgtgccaggttctgccaaagtgtgg

SEQ ID NO: 365504 - DNA, 25 bp, Mus musculus
cgtgccagtgtaagaggaattctct

SEQ ID NO: 365505 - DNA, 25 bp, Mus musculus
cgtgccagtgtatgaggaattctct

SEQ ID NO: 365506 - DNA, 25 bp, Mus musculus
cgtgccataatacactatcttctgc

SEQ ID NO: 365507 - DNA, 25 bp, Mus musculus
cgtgccataatagactatcttctgc

SEQ ID NO: 365508 - DNA, 25 bp, Mus musculus
cgtgccatggaacatgtgatgcccc

SEQ ID NO: 365509 - DNA, 25 bp, Mus musculus
cgtgccatggaagatgtgatgcccc

SEQ ID NO: 365510 - DNA, 25 bp, Mus musculus
cgtgcccatgctaccattatgaaaa

SEQ ID NO: 365511 - DNA, 25 bp, Mus musculus
cgtgcccatgcttccattatgaaaa

SEQ ID NO: 365512 - DNA, 25 bp, Mus musculus
cgtgcccattcgagaacagttcttt

SEQ ID NO: 365513 - DNA, 25 bp, Mus musculus
cgtgcccattcgtgaacagttcttt

SEQ ID NO: 365514 - DNA, 25 bp, Mus musculus
cgtgccccaaatcaggtggcgacaa

SEQ ID NO: 365515 - DNA, 25 bp, Mus musculus
cgtgccccaaatgaggtggcgacaa

SEQ ID NO: 365516 - DNA, 25 bp, Mus musculus
cgtgcccctgaacaatgctgacctt

SEQ ID NO: 365517 - DNA, 25 bp, Mus musculus
cgtgcccctgaagaatgctgacctt

SEQ ID NO: 365518 - DNA, 25 bp, Mus musculus
cgtgccctaccgcttttcgacagat

SEQ ID NO: 365519 - DNA, 25 bp, Mus musculus
cgtgccctaccggttttcgacagat

SEQ ID NO: 365520 - DNA, 25 bp, Mus musculus
cgtgccctggacactcggaaaacag

SEQ ID NO: 365521 - DNA, 25 bp, Mus musculus
cgtgccctggactctcggaaaacag

SEQ ID NO: 365522 - DNA, 25 bp, Mus musculus
cgtgcctaatttagtcttgctgttt

SEQ ID NO: 365523 - DNA, 25 bp, Mus musculus
cgtgcctaattttgtcttgctgttt

SEQ ID NO: 365524 - DNA, 25 bp, Mus musculus
cgtgcctcatctctgtaataactac

SEQ ID NO: 365525 - DNA, 25 bp, Mus musculus
cgtgcctcatctgtgtaataactac

SEQ ID NO: 365526 - DNA, 25 bp, Mus musculus
cgtgcctcctttaaatatctcatta

SEQ ID NO: 365527 - DNA, 25 bp, Mus musculus
cgtgcctccttttaatatctcatta

SEQ ID NO: 365528 - DNA, 25 bp, Mus musculus
cgtgcctggtctctcaaatttttgg

SEQ ID NO: 365529 - DNA, 25 bp, Mus musculus
cgtgcctggtctgtcaaatttttgg

SEQ ID NO: 365530 - DNA, 25 bp, Mus musculus
cgtgcctttgcactgggtgcagact

SEQ ID NO: 365531 - DNA, 25 bp, Mus musculus
cgtgcctttgcagtgggtgcagact

SEQ ID NO: 365532 - DNA, 25 bp, Mus musculus
cgtgcctttttcaacaaggtgatat

SEQ ID NO: 365533 - DNA, 25 bp, Mus musculus
cgtgcctttttctacaaggtgatat

SEQ ID NO: 365534 - DNA, 25 bp, Mus musculus
cgtgcgaacagaagataagttcctt

SEQ ID NO: 365535 - DNA, 25 bp, Mus musculus
cgtgcgaacagatgataagttcctt

SEQ ID NO: 365536 - DNA, 25 bp, Mus musculus
cgtgcgacatttcccgaattctgca

SEQ ID NO: 365537 - DNA, 25 bp, Mus musculus
cgtgcgacatttgccgaattctgca

SEQ ID NO: 365538 - DNA, 25 bp, Mus musculus
cgtgcgatgggtcctcgcttcgtct

SEQ ID NO: 365539 - DNA, 25 bp, Mus musculus
cgtgcgatgggtgctcgcttcgtct

SEQ ID NO: 365540 - DNA, 25 bp, Mus musculus
cgtgcgccattgctctgatacttaa

SEQ ID NO: 365541 - DNA, 25 bp, Mus musculus
cgtgcgccattggtctgatacttaa

SEQ ID NO: 365542 - DNA, 25 bp, Mus musculus
cgtgcgctcactcagtcaagagtta

SEQ ID NO: 365543 - DNA, 25 bp, Mus musculus
cgtgcgctcactgagtcaagagtta

SEQ ID NO: 365544 - DNA, 25 bp, Mus musculus
cgtgcgggaacgcttatgattgcca

SEQ ID NO: 365545 - DNA, 25 bp, Mus musculus
cgtgcgggaacggttatgattgcca

SEQ ID NO: 365546 - DNA, 25 bp, Mus musculus
cgtgcgggaccacagccctgaaagt

SEQ ID NO: 365547 - DNA, 25 bp, Mus musculus
cgtgcgggaccagagccctgaaagt

SEQ ID NO: 365548 - DNA, 25 bp, Mus musculus
cgtgcgggatgcctacactgtgcat

SEQ ID NO: 365549 - DNA, 25 bp, Mus musculus
cgtgcgggatgcgtacactgtgcat

SEQ ID NO: 365550 - DNA, 25 bp, Mus musculus
cgtgcgggcgctatttgttgacaaa

SEQ ID NO: 365551 - DNA, 25 bp, Mus musculus
cgtgcgggcgctttttgttgacaaa

SEQ ID NO: 365552 - DNA, 25 bp, Mus musculus
cgtgcggttcttctggatgtccaaa

SEQ ID NO: 365553 - DNA, 25 bp, Mus musculus
cgtgcggttcttgtggatgtccaaa

SEQ ID NO: 365554 - DNA, 25 bp, Mus musculus
cgtgcgtccatgagccgaaggtcag

SEQ ID NO: 365555 - DNA, 25 bp, Mus musculus
cgtgcgtccatgtgccgaaggtcag

SEQ ID NO: 365556 - DNA, 25 bp, Mus musculus
cgtgcgtggcctaggtacagaacat

SEQ ID NO: 365557 - DNA, 25 bp, Mus musculus
cgtgcgtggccttggtacagaacat

SEQ ID NO: 365558 - DNA, 25 bp, Mus musculus
cgtgcgtgttcaaccctgggagata

SEQ ID NO: 365559 - DNA, 25 bp, Mus musculus
cgtgcgtgttcatccctgggagata

SEQ ID NO: 365560 - DNA, 25 bp, Mus musculus
cgtgcgttgcttacactagtgtgga

SEQ ID NO: 365561 - DNA, 25 bp, Mus musculus
cgtgcgttgctttcactagtgtgga

SEQ ID NO: 365562 - DNA, 25 bp, Mus musculus
cgtgctaaacagaattcccaggctt

SEQ ID NO: 365563 - DNA, 25 bp, Mus musculus
cgtgctaaacagtattcccaggctt

SEQ ID NO: 365564 - DNA, 25 bp, Mus musculus
cgtgctaagcgtcccggagtctaca

SEQ ID NO: 365565 - DNA, 25 bp, Mus musculus
cgtgctaagcgtgccggagtctaca

SEQ ID NO: 365566 - DNA, 25 bp, Mus musculus
cgtgctacggcacatgggttcacac

SEQ ID NO: 365567 - DNA, 25 bp, Mus musculus
cgtgctacggcagatgggttcacac

SEQ ID NO: 365568 - DNA, 25 bp, Mus musculus
cgtgctcagagccttttatttattt

SEQ ID NO: 365569 - DNA, 25 bp, Mus musculus
cgtgctcagagcgttttatttattt

SEQ ID NO: 365570 - DNA, 25 bp, Mus musculus
cgtgctcagggcctcgggactcagg

SEQ ID NO: 365571 - DNA, 25 bp, Mus musculus
cgtgctcagggcgtcgggactcagg

SEQ ID NO: 365572 - DNA, 25 bp, Mus musculus
cgtgctctagtgcttcttgctgctg

SEQ ID NO: 365573 - DNA, 25 bp, Mus musculus
cgtgctctagtggttcttgctgctg

SEQ ID NO: 365574 - DNA, 25 bp, Mus musculus
cgtgctctcattactcaccataaaa

SEQ ID NO: 365575 - DNA, 25 bp, Mus musculus
cgtgctctcattcgcttggaagtgg

SEQ ID NO: 365576 - DNA, 25 bp, Mus musculus
cgtgctctcattggcttggaagtgg

SEQ ID NO: 365577 - DNA, 25 bp, Mus musculus
cgtgctctcatttctcaccataaaa

SEQ ID NO: 365578 - DNA, 25 bp, Mus musculus
cgtgctctttatcactttgctcagc

SEQ ID NO: 365579 - DNA, 25 bp, Mus musculus
cgtgctctttatgactttgctcagc

SEQ ID NO: 365580 - DNA, 25 bp, Mus musculus
cgtgctgactccctgtacactggca

SEQ ID NO: 365581 - DNA, 25 bp, Mus musculus
cgtgctgactccgtgtacactggca

SEQ ID NO: 365582 - DNA, 25 bp, Mus musculus
cgtgctgagaaactgttgagtgtac

SEQ ID NO: 365583 - DNA, 25 bp, Mus musculus
cgtgctgagaaagtgttgagtgtac

SEQ ID NO: 365584 - DNA, 25 bp, Mus musculus
cgtgctgccattcttaaaatgccaa

SEQ ID NO: 365585 - DNA, 25 bp, Mus musculus
cgtgctgccattgttaaaatgccaa

SEQ ID NO: 365586 - DNA, 25 bp, Mus musculus
cgtgctgccctaaatcttctggaat

SEQ ID NO: 365587 - DNA, 25 bp, Mus musculus
cgtgctgccctatatcttctggaat

SEQ ID NO: 365588 - DNA, 25 bp, Mus musculus
cgtgctggcccaagtatattcattt

SEQ ID NO: 365589 - DNA, 25 bp, Mus musculus
cgtgctggcccatgtatattcattt

SEQ ID NO: 365590 - DNA, 25 bp, Mus musculus
cgtgctggcgttcaacatgctgtgc

SEQ ID NO: 365591 - DNA, 25 bp, Mus musculus
cgtgctggcgttgaacatgctgtgc

SEQ ID NO: 365592 - DNA, 25 bp, Mus musculus
cgtgctggtagccatcactggacag

SEQ ID NO: 365593 - DNA, 25 bp, Mus musculus
cgtgctggtagcgatcactggacag

SEQ ID NO: 365594 - DNA, 25 bp, Mus musculus
cgtgctgtccctaaagtttgcttat

SEQ ID NO: 365595 - DNA, 25 bp, Mus musculus
cgtgctgtcccttaagtttgcttat

SEQ ID NO: 365596 - DNA, 25 bp, Mus musculus
cgtgctgttgggaaataggcctttt

SEQ ID NO: 365597 - DNA, 25 bp, Mus musculus
cgtgctgttgggtaataggcctttt

SEQ ID NO: 365598 - DNA, 25 bp, Mus musculus
cgtgcttaagagaccactatgaggg

SEQ ID NO: 365599 - DNA, 25 bp, Mus musculus
cgtgcttaagagtccactatgaggg

SEQ ID NO: 365600 - DNA, 25 bp, Mus musculus
cgtgcttaagcaatcctgagttcta

SEQ ID NO: 365601 - DNA, 25 bp, Mus musculus
cgtgcttaagcattcctgagttcta

SEQ ID NO: 365602 - DNA, 25 bp, Mus musculus
cgtgcttacccactagtagctagat

SEQ ID NO: 365603 - DNA, 25 bp, Mus musculus
cgtgcttacccagtagtagctagat

SEQ ID NO: 365604 - DNA, 25 bp, Mus musculus
cgtgcttatgttcgcctcttgagat

SEQ ID NO: 365605 - DNA, 25 bp, Mus musculus
cgtgcttatgttggcctcttgagat

SEQ ID NO: 365606 - DNA, 25 bp, Mus musculus
cgtgcttcagtaatgccaactaata

SEQ ID NO: 365607 - DNA, 25 bp, Mus musculus
cgtgcttcagtattgccaactaata

SEQ ID NO: 365608 - DNA, 25 bp, Mus musculus
cgtgcttgaaaacgccaccaacaca

SEQ ID NO: 365609 - DNA, 25 bp, Mus musculus
cgtgcttgaaaaggccaccaacaca

SEQ ID NO: 365610 - DNA, 25 bp, Mus musculus
cgtgcttgagatctttggagtcttg

SEQ ID NO: 365611 - DNA, 25 bp, Mus musculus
cgtgcttgagatgtttggagtcttg

SEQ ID NO: 365612 - DNA, 25 bp, Mus musculus
cgtgcttgcacaagtggctgtcaaa

SEQ ID NO: 365613 - DNA, 25 bp, Mus musculus
cgtgcttgcacatgtggctgtcaaa

SEQ ID NO: 365614 - DNA, 25 bp, Mus musculus
cgtgcttgggaaaaggttttgccaa

SEQ ID NO: 365615 - DNA, 25 bp, Mus musculus
cgtgcttgggaataggttttgccaa

SEQ ID NO: 365616 - DNA, 25 bp, Mus musculus
cgtgctttcgcgcatgctatggaag

SEQ ID NO: 365617 - DNA, 25 bp, Mus musculus
cgtgctttcgcggatgctatggaag

SEQ ID NO: 365618 - DNA, 25 bp, Mus musculus
cgtgcttttctgcttcatacttgga

SEQ ID NO: 365619 - DNA, 25 bp, Mus musculus
cgtgcttttctggttcatacttgga

SEQ ID NO: 365620 - DNA, 25 bp, Mus musculus
cgtggaaaccacaatgcaggaggat

SEQ ID NO: 365621 - DNA, 25 bp, Mus musculus
cgtggaaaccactatgcaggaggat

SEQ ID NO: 365622 - DNA, 25 bp, Mus musculus
cgtggaaagttcagacggctctagg

SEQ ID NO: 365623 - DNA, 25 bp, Mus musculus
cgtggaaagttctgacggctctagg

SEQ ID NO: 365624 - DNA, 25 bp, Mus musculus
cgtggaacagagatcagagcgcgct

SEQ ID NO: 365625 - DNA, 25 bp, Mus musculus
cgtggaacagagttcagagcgcgct

SEQ ID NO: 365626 - DNA, 25 bp, Mus musculus
cgtggaacaggcacagggcgcctac

SEQ ID NO: 365627 - DNA, 25 bp, Mus musculus
cgtggaacaggctcagggcgcctac

SEQ ID NO: 365628 - DNA, 25 bp, Mus musculus
cgtggaacccttatggaatcatgat

SEQ ID NO: 365629 - DNA, 25 bp, Mus musculus
cgtggaacccttttggaatcatgat

SEQ ID NO: 365630 - DNA, 25 bp, Mus musculus
cgtggaacctgcctcaagatgatga

SEQ ID NO: 365631 - DNA, 25 bp, Mus musculus
cgtggaacctgcgtcaagatgatga

SEQ ID NO: 365632 - DNA, 25 bp, Mus musculus
cgtggaactggtaagcctgcagcaa

SEQ ID NO: 365633 - DNA, 25 bp, Mus musculus
cgtggaactggttagcctgcagcaa

SEQ ID NO: 365634 - DNA, 25 bp, Mus musculus
cgtggaagaatgaatttacgttcta

SEQ ID NO: 365635 - DNA, 25 bp, Mus musculus
cgtggaagaatgtatttacgttcta

SEQ ID NO: 365636 - DNA, 25 bp, Mus musculus
cgtggaatcctgacccgtgggagaa

SEQ ID NO: 365637 - DNA, 25 bp, Mus musculus
cgtggaatcctgtcccgtgggagaa

SEQ ID NO: 365638 - DNA, 25 bp, Mus musculus
cgtggacaatttcaagatctagccc

SEQ ID NO: 365639 - DNA, 25 bp, Mus musculus
cgtggacaatttgaagatctagccc

SEQ ID NO: 365640 - DNA, 25 bp, Mus musculus
cgtggacacaaactccctccttggg

SEQ ID NO: 365641 - DNA, 25 bp, Mus musculus
cgtggacacaaagtccctccttggg

SEQ ID NO: 365642 - DNA, 25 bp, Mus musculus
cgtggacagaccaataacgccgctt

SEQ ID NO: 365643 - DNA, 25 bp, Mus musculus
cgtggacagacctataacgccgctt

SEQ ID NO: 365644 - DNA, 25 bp, Mus musculus
cgtggacagcttctatctcatctta

SEQ ID NO: 365645 - DNA, 25 bp, Mus musculus
cgtggacagcttgtatctcatctta

SEQ ID NO: 365646 - DNA, 25 bp, Mus musculus
cgtggaccctcgacgggagcacgaa

SEQ ID NO: 365647 - DNA, 25 bp, Mus musculus
cgtggaccctcgtcgggagcacgaa

SEQ ID NO: 365648 - DNA, 25 bp, Mus musculus
cgtggaccgagtctgaagtgacaaa

SEQ ID NO: 365649 - DNA, 25 bp, Mus musculus
cgtggaccgagtgtgaagtgacaaa

SEQ ID NO: 365650 - DNA, 25 bp, Mus musculus
cgtggactatgcatcagtcactgga

SEQ ID NO: 365651 - DNA, 25 bp, Mus musculus
cgtggactatgcttcagtcactgga

SEQ ID NO: 365652 - DNA, 25 bp, Mus musculus
cgtggactcccaagtgagacacctt

SEQ ID NO: 365653 - DNA, 25 bp, Mus musculus
cgtggactcccatgtgagacacctt

SEQ ID NO: 365654 - DNA, 25 bp, Mus musculus
cgtggagaccttcttatcgagtttg

SEQ ID NO: 365655 - DNA, 25 bp, Mus musculus
cgtggagaccttgttatcgagtttg

SEQ ID NO: 365656 - DNA, 25 bp, Mus musculus
cgtggagatgagcaccattatcaat

SEQ ID NO: 365657 - DNA, 25 bp, Mus musculus
cgtggagatgaggaccattatcaat

SEQ ID NO: 365658 - DNA, 25 bp, Mus musculus
cgtggagcagctcatgtacgtcaag

SEQ ID NO: 365659 - DNA, 25 bp, Mus musculus
cgtggagcagctgatgtacgtcaag

SEQ ID NO: 365660 - DNA, 25 bp, Mus musculus
cgtggagtctgtcttgcttctgcct

SEQ ID NO: 365661 - DNA, 25 bp, Mus musculus
cgtggagtctgtgttgcttctgcct

SEQ ID NO: 365662 - DNA, 25 bp, Mus musculus
cgtggatacatgcacccaggctgct

SEQ ID NO: 365663 - DNA, 25 bp, Mus musculus
cgtggatacatggacccaggctgct

SEQ ID NO: 365664 - DNA, 25 bp, Mus musculus
cgtggatgagaactaacctgctcgt

SEQ ID NO: 365665 - DNA, 25 bp, Mus musculus
cgtggatgagaagtaacctgctcgt

SEQ ID NO: 365666 - DNA, 25 bp, Mus musculus
cgtggatgcattcacagggacagct

SEQ ID NO: 365667 - DNA, 25 bp, Mus musculus
cgtggatgcattgacagggacagct

SEQ ID NO: 365668 - DNA, 25 bp, Mus musculus
cgtggattcctaaaacatgcctgtg

SEQ ID NO: 365669 - DNA, 25 bp, Mus musculus
cgtggattcctataacatgcctgtg

SEQ ID NO: 365670 - DNA, 25 bp, Mus musculus
cgtggcaaacacattaggagcgcga

SEQ ID NO: 365671 - DNA, 25 bp, Mus musculus
cgtggcaaacactttaggagcgcga

SEQ ID NO: 365672 - DNA, 25 bp, Mus musculus
cgtggcacaaatacagtcgctatgg

SEQ ID NO: 365673 - DNA, 25 bp, Mus musculus
cgtggcacaaattcagtcgctatgg

SEQ ID NO: 365674 - DNA, 25 bp, Mus musculus
cgtggcactgttcgaagaccggttc

SEQ ID NO: 365675 - DNA, 25 bp, Mus musculus
cgtggcactgttggaagaccggttc

SEQ ID NO: 365676 - DNA, 25 bp, Mus musculus
cgtggcataacacgagaactcggga

SEQ ID NO: 365677 - DNA, 25 bp, Mus musculus
cgtggcataacaggagaactcggga

SEQ ID NO: 365678 - DNA, 25 bp, Mus musculus
cgtggcatgccaaataacttctctg

SEQ ID NO: 365679 - DNA, 25 bp, Mus musculus
cgtggcatgccatataacttctctg

SEQ ID NO: 365680 - DNA, 25 bp, Mus musculus
cgtggcatgtttccacgttctgcca

SEQ ID NO: 365681 - DNA, 25 bp, Mus musculus
cgtggcatgtttgcacgttctgcca

SEQ ID NO: 365682 - DNA, 25 bp, Mus musculus
cgtggccaatttcatccgacagcgg

SEQ ID NO: 365683 - DNA, 25 bp, Mus musculus
cgtggccaatttgatccgacagcgg

SEQ ID NO: 365684 - DNA, 25 bp, Mus musculus
cgtggcccacaaagtcagatctgta

SEQ ID NO: 365685 - DNA, 25 bp, Mus musculus
cgtggcccacaatgtcagatctgta

SEQ ID NO: 365686 - DNA, 25 bp, Mus musculus
cgtggcccagagattgcttacaatt

SEQ ID NO: 365687 - DNA, 25 bp, Mus musculus
cgtggcccagagtttgcttacaatt

SEQ ID NO: 365688 - DNA, 25 bp, Mus musculus
cgtggcccagtcagctgaccagcta

SEQ ID NO: 365689 - DNA, 25 bp, Mus musculus
cgtggcccagtctgctgaccagcta

SEQ ID NO: 365690 - DNA, 25 bp, Mus musculus
cgtggcccctgaccaaggacagtat

SEQ ID NO: 365691 - DNA, 25 bp, Mus musculus
cgtggcccctgagcaaggacagtat

SEQ ID NO: 365692 - DNA, 25 bp, Mus musculus
cgtggccgaggtagataggaccaca

SEQ ID NO: 365693 - DNA, 25 bp, Mus musculus
cgtggccgaggttgataggaccaca

SEQ ID NO: 365694 - DNA, 25 bp, Mus musculus
cgtggcctgaggctactaagcacta

SEQ ID NO: 365695 - DNA, 25 bp, Mus musculus
cgtggcctgagggtactaagcacta

SEQ ID NO: 365696 - DNA, 25 bp, Mus musculus
cgtggccttctccagtgttagtcat

SEQ ID NO: 365697 - DNA, 25 bp, Mus musculus
cgtggccttctcgagtgttagtcat

SEQ ID NO: 365698 - DNA, 25 bp, Mus musculus
cgtggccttttgaatgctgggtttt

SEQ ID NO: 365699 - DNA, 25 bp, Mus musculus
cgtggccttttgtatgctgggtttt

SEQ ID NO: 365700 - DNA, 25 bp, Mus musculus
cgtggcgtataaagtctctccgagc

SEQ ID NO: 365701 - DNA, 25 bp, Mus musculus
cgtggcgtataatgtctctccgagc

SEQ ID NO: 365702 - DNA, 25 bp, Mus musculus
cgtggcgtgtgcattgctcgtagtc

SEQ ID NO: 365703 - DNA, 25 bp, Mus musculus
cgtggcgtgtgctttgctcgtagtc

SEQ ID NO: 365704 - DNA, 25 bp, Mus musculus
cgtggcgtttgacgagcttcctgca

SEQ ID NO: 365705 - DNA, 25 bp, Mus musculus
cgtggcgtttgaggagcttcctgca

SEQ ID NO: 365706 - DNA, 25 bp, Mus musculus
cgtggctcaaaccacttaagccaaa

SEQ ID NO: 365707 - DNA, 25 bp, Mus musculus
cgtggctcaaacgacttaagccaaa

SEQ ID NO: 365708 - DNA, 25 bp, Mus musculus
cgtggctccggtcgcgtgctaacct

SEQ ID NO: 365709 - DNA, 25 bp, Mus musculus
cgtggctccggtggcgtgctaacct

SEQ ID NO: 365710 - DNA, 25 bp, Mus musculus
cgtggctctgccagagactattgaa

SEQ ID NO: 365711 - DNA, 25 bp, Mus musculus
cgtggctctgcctgagactattgaa

SEQ ID NO: 365712 - DNA, 25 bp, Mus musculus
cgtggctgacctaaatctgtggtta

SEQ ID NO: 365713 - DNA, 25 bp, Mus musculus
cgtggctgaccttaatctgtggtta

SEQ ID NO: 365714 - DNA, 25 bp, Mus musculus
cgtggctgagggagagttctttatc

SEQ ID NO: 365715 - DNA, 25 bp, Mus musculus
cgtggctgagggtgagttctttatc

SEQ ID NO: 365716 - DNA, 25 bp, Mus musculus
cgtggctgtaggctaagcagtttct

SEQ ID NO: 365717 - DNA, 25 bp, Mus musculus
cgtggctgtagggtaagcagtttct

SEQ ID NO: 365718 - DNA, 25 bp, Mus musculus
cgtggctgttttaagttgcttgctt

SEQ ID NO: 365719 - DNA, 25 bp, Mus musculus
cgtggctgtttttagttgcttgctt

SEQ ID NO: 365720 - DNA, 25 bp, Mus musculus
cgtggcttaggacgcgcttgccaaa

SEQ ID NO: 365721 - DNA, 25 bp, Mus musculus
cgtggcttaggaggcgcttgccaaa

SEQ ID NO: 365722 - DNA, 25 bp, Mus musculus
cgtggcttgtctccgcatgttgttg

SEQ ID NO: 365723 - DNA, 25 bp, Mus musculus
cgtggcttgtctgcgcatgttgttg

SEQ ID NO: 365724 - DNA, 25 bp, Mus musculus
cgtggctttttaagaagaatcccga

SEQ ID NO: 365725 - DNA, 25 bp, Mus musculus
cgtggctttttatgaagaatcccga

SEQ ID NO: 365726 - DNA, 25 bp, Mus musculus
cgtgggacagtcagcgtatgctcat

SEQ ID NO: 365727 - DNA, 25 bp, Mus musculus
cgtgggacagtctgcgtatgctcat

SEQ ID NO: 365728 - DNA, 25 bp, Mus musculus
cgtgggagctgtcccttcagaagaa

SEQ ID NO: 365729 - DNA, 25 bp, Mus musculus
cgtgggagctgtgccttcagaagaa

SEQ ID NO: 365730 - DNA, 25 bp, Mus musculus
cgtgggaggcgacagggccgcgaca

SEQ ID NO: 365731 - DNA, 25 bp, Mus musculus
cgtgggaggcgagagggccgcgaca

SEQ ID NO: 365732 - DNA, 25 bp, Mus musculus
cgtgggagtcgacagactgaccaac

SEQ ID NO: 365733 - DNA, 25 bp, Mus musculus
cgtgggagtcgagagactgaccaac

SEQ ID NO: 365734 - DNA, 25 bp, Mus musculus
cgtgggcaacatcgctagaaagcag

SEQ ID NO: 365735 - DNA, 25 bp, Mus musculus
cgtgggcaacatggctagaaagcag

SEQ ID NO: 365736 - DNA, 25 bp, Mus musculus
cgtgggcaccaaccatatatgtggt

SEQ ID NO: 365737 - DNA, 25 bp, Mus musculus
cgtgggcaccaagcatatatgtggt

SEQ ID NO: 365738 - DNA, 25 bp, Mus musculus
cgtgggccaatgcagaggactctta

SEQ ID NO: 365739 - DNA, 25 bp, Mus musculus
cgtgggccaatggagaggactctta

SEQ ID NO: 365740 - DNA, 25 bp, Mus musculus
cgtgggccagttagtcagcagtgtc

SEQ ID NO: 365741 - DNA, 25 bp, Mus musculus
cgtgggccagtttgtcagcagtgtc

SEQ ID NO: 365742 - DNA, 25 bp, Mus musculus
cgtgggcgccaacctcctggtgatt

SEQ ID NO: 365743 - DNA, 25 bp, Mus musculus
cgtgggcgccaagctcctggtgatt

SEQ ID NO: 365744 - DNA, 25 bp, Mus musculus
cgtgggcgccgaagggcttaacttt

SEQ ID NO: 365745 - DNA, 25 bp, Mus musculus
cgtgggcgccgatgggcttaacttt

SEQ ID NO: 365746 - DNA, 25 bp, Mus musculus
cgtgggctgagtagctataggcatt

SEQ ID NO: 365747 - DNA, 25 bp, Mus musculus
cgtgggctgagttgctataggcatt

SEQ ID NO: 365748 - DNA, 25 bp, Mus musculus
cgtgggctgcgtatctgtaattgtt

SEQ ID NO: 365749 - DNA, 25 bp, Mus musculus
cgtgggctgcgtttctgtaattgtt

SEQ ID NO: 365750 - DNA, 25 bp, Mus musculus
cgtgggctgtgtcctcatccggaaa

SEQ ID NO: 365751 - DNA, 25 bp, Mus musculus
cgtgggctgtgtgctcatccggaaa

SEQ ID NO: 365752 - DNA, 25 bp, Mus musculus
cgtgggtattcgcttctgccaggaa

SEQ ID NO: 365753 - DNA, 25 bp, Mus musculus
cgtgggtattcggttctgccaggaa

SEQ ID NO: 365754 - DNA, 25 bp, Mus musculus
cgtgggtctgcgagtgtcaatcaca

SEQ ID NO: 365755 - DNA, 25 bp, Mus musculus
cgtgggtctgcgtgtgtcaatcaca

SEQ ID NO: 365756 - DNA, 25 bp, Mus musculus
cgtgggtctgtgagagccattctca

SEQ ID NO: 365757 - DNA, 25 bp, Mus musculus
cgtgggtctgtgtgagccattctca

SEQ ID NO: 365758 - DNA, 25 bp, Mus musculus
cgtgggtgaataacacactcgtcaa

SEQ ID NO: 365759 - DNA, 25 bp, Mus musculus
cgtgggtgaatatcacactcgtcaa

SEQ ID NO: 365760 - DNA, 25 bp, Mus musculus
cgtgggtgccacaatattttgtatt

SEQ ID NO: 365761 - DNA, 25 bp, Mus musculus
cgtgggtgccactatattttgtatt

SEQ ID NO: 365762 - DNA, 25 bp, Mus musculus
cgtgggtgtttaaatctgtgtagat

SEQ ID NO: 365763 - DNA, 25 bp, Mus musculus
cgtgggtgtttatatctgtgtagat

SEQ ID NO: 365764 - DNA, 25 bp, Mus musculus
cgtgggtttcacaccttagttctca

SEQ ID NO: 365765 - DNA, 25 bp, Mus musculus
cgtgggtttcactccttagttctca

SEQ ID NO: 365766 - DNA, 25 bp, Mus musculus
cgtgggttttgaagtgactgttact

SEQ ID NO: 365767 - DNA, 25 bp, Mus musculus
cgtgggttttgatgtgactgttact

SEQ ID NO: 365768 - DNA, 25 bp, Mus musculus
cgtggtatcaggagtactggatgca

SEQ ID NO: 365769 - DNA, 25 bp, Mus musculus
cgtggtatcaggtgtactggatgca

SEQ ID NO: 365770 - DNA, 25 bp, Mus musculus
cgtggtcacatcagctgctactcct

SEQ ID NO: 365771 - DNA, 25 bp, Mus musculus
cgtggtcacatctgctgctactcct

SEQ ID NO: 365772 - DNA, 25 bp, Mus musculus
cgtggtcagagtcagccccttgcag

SEQ ID NO: 365773 - DNA, 25 bp, Mus musculus
cgtggtcagagtgagccccttgcag

SEQ ID NO: 365774 - DNA, 25 bp, Mus musculus
cgtggtcatactatctgcaggttga

SEQ ID NO: 365775 - DNA, 25 bp, Mus musculus
cgtggtcatactttctgcaggttga

SEQ ID NO: 365776 - DNA, 25 bp, Mus musculus
cgtggtcatgttagtggtagttgct

SEQ ID NO: 365777 - DNA, 25 bp, Mus musculus
cgtggtcatgtttgtggtagttgct

SEQ ID NO: 365778 - DNA, 25 bp, Mus musculus
cgtggtccactgataatcctgtgag

SEQ ID NO: 365779 - DNA, 25 bp, Mus musculus
cgtggtccactgttaatcctgtgag

SEQ ID NO: 365780 - DNA, 25 bp, Mus musculus
cgtggtccagtcagctttctgaata

SEQ ID NO: 365781 - DNA, 25 bp, Mus musculus
cgtggtccagtctgctttctgaata

SEQ ID NO: 365782 - DNA, 25 bp, Mus musculus
cgtggtcgacgcagtgaatagtatc

SEQ ID NO: 365783 - DNA, 25 bp, Mus musculus
cgtggtcgacgctgtgaatagtatc

SEQ ID NO: 365784 - DNA, 25 bp, Mus musculus
cgtggtgaacacagcctacgggcga

SEQ ID NO: 365785 - DNA, 25 bp, Mus musculus
cgtggtgaacactgcctacgggcga

SEQ ID NO: 365786 - DNA, 25 bp, Mus musculus
cgtggtgagctgcaactttgactgt

SEQ ID NO: 365787 - DNA, 25 bp, Mus musculus
cgtggtgagctggaactttgactgt

SEQ ID NO: 365788 - DNA, 25 bp, Mus musculus
cgtggtgattgcctccaacatcggg

SEQ ID NO: 365789 - DNA, 25 bp, Mus musculus
cgtggtgattgcgtccaacatcggg

SEQ ID NO: 365790 - DNA, 25 bp, Mus musculus
cgtggtgccagcacaacagcccgtg

SEQ ID NO: 365791 - DNA, 25 bp, Mus musculus
cgtggtgccagctcaacagcccgtg

SEQ ID NO: 365792 - DNA, 25 bp, Mus musculus
cgtggtgctctaaagggaaaatatc

SEQ ID NO: 365793 - DNA, 25 bp, Mus musculus
cgtggtgctctatagggaaaatatc

SEQ ID NO: 365794 - DNA, 25 bp, Mus musculus
cgtggtggatatctgaacttctgtg

SEQ ID NO: 365795 - DNA, 25 bp, Mus musculus
cgtggtggatatgtgaacttctgtg

SEQ ID NO: 365796 - DNA, 25 bp, Mus musculus
cgtggtggcctactttgtgaatgaa

SEQ ID NO: 365797 - DNA, 25 bp, Mus musculus
cgtggtggcctagtttgtgaatgaa

SEQ ID NO: 365798 - DNA, 25 bp, Mus musculus
cgtggtggctctaagcgggtaccct

SEQ ID NO: 365799 - DNA, 25 bp, Mus musculus
cgtggtggctcttagcgggtaccct

SEQ ID NO: 365800 - DNA, 25 bp, Mus musculus
cgtggtgtcccacagagttgtagat

SEQ ID NO: 365801 - DNA, 25 bp, Mus musculus
cgtggtgtcccagagagttgtagat

SEQ ID NO: 365802 - DNA, 25 bp, Mus musculus
cgtggtgtgtctatttgtaggatac

SEQ ID NO: 365803 - DNA, 25 bp, Mus musculus
cgtggtgtgtctttttgtaggatac

SEQ ID NO: 365804 - DNA, 25 bp, Mus musculus
cgtggttctcgtccactgtaatgca

SEQ ID NO: 365805 - DNA, 25 bp, Mus musculus
cgtggttctcgtgcactgtaatgca

SEQ ID NO: 365806 - DNA, 25 bp, Mus musculus
cgtggttctgtcatccgaggcagaa

SEQ ID NO: 365807 - DNA, 25 bp, Mus musculus
cgtggttctgtcttccgaggcagaa

SEQ ID NO: 365808 - DNA, 25 bp, Mus musculus
cgtggttcttttaatgcagttgcat

SEQ ID NO: 365809 - DNA, 25 bp, Mus musculus
cgtggttctttttatgcagttgcat

SEQ ID NO: 365810 - DNA, 25 bp, Mus musculus
cgtggtttagttagagtctctttct

SEQ ID NO: 365811 - DNA, 25 bp, Mus musculus
cgtggtttagtttgagtctctttct

SEQ ID NO: 365812 - DNA, 25 bp, Mus musculus
cgtggtttatccaggcaatgataat

SEQ ID NO: 365813 - DNA, 25 bp, Mus musculus
cgtggtttatcctggcaatgataat

SEQ ID NO: 365814 - DNA, 25 bp, Mus musculus
cgtggtttccgccagcagagagatt

SEQ ID NO: 365815 - DNA, 25 bp, Mus musculus
cgtggtttccgcgagcagagagatt

SEQ ID NO: 365816 - DNA, 25 bp, Mus musculus
cgtggtttcgtcactgtcctggaaa

SEQ ID NO: 365817 - DNA, 25 bp, Mus musculus
cgtggtttcgtctctgtcctggaaa

SEQ ID NO: 365818 - DNA, 25 bp, Mus musculus
cgtggtttctacatctcctgggatg

SEQ ID NO: 365819 - DNA, 25 bp, Mus musculus
cgtggtttctacttctcctgggatg

SEQ ID NO: 365820 - DNA, 25 bp, Mus musculus
cgtgtaaaacagagcctgtcacttt

SEQ ID NO: 365821 - DNA, 25 bp, Mus musculus
cgtgtaaaacagtgcctgtcacttt

SEQ ID NO: 365822 - DNA, 25 bp, Mus musculus
cgtgtaacacacagcttgaatatat

SEQ ID NO: 365823 - DNA, 25 bp, Mus musculus
cgtgtaacacactgcttgaatatat

SEQ ID NO: 365824 - DNA, 25 bp, Mus musculus
cgtgtaagggaacctgaagtttttg

SEQ ID NO: 365825 - DNA, 25 bp, Mus musculus
cgtgtaagggaagctgaagtttttg

SEQ ID NO: 365826 - DNA, 25 bp, Mus musculus
cgtgtactgttgagctgggagctca

SEQ ID NO: 365827 - DNA, 25 bp, Mus musculus
cgtgtactgttgtgctgggagctca

SEQ ID NO: 365828 - DNA, 25 bp, Mus musculus
cgtgtagcagctaaaacccacatct

SEQ ID NO: 365829 - DNA, 25 bp, Mus musculus
cgtgtagcagcttaaacccacatct

SEQ ID NO: 365830 - DNA, 25 bp, Mus musculus
cgtgtagcaggaacatccaggctct

SEQ ID NO: 365831 - DNA, 25 bp, Mus musculus
cgtgtagcaggatcatccaggctct

SEQ ID NO: 365832 - DNA, 25 bp, Mus musculus
cgtgtaggatcgaacggctgtaaca

SEQ ID NO: 365833 - DNA, 25 bp, Mus musculus
cgtgtaggatcgtacggctgtaaca

SEQ ID NO: 365834 - DNA, 25 bp, Mus musculus
cgtgtaggtgtcaaatacatcgtga

SEQ ID NO: 365835 - DNA, 25 bp, Mus musculus
cgtgtaggtgtctaatacatcgtga

SEQ ID NO: 365836 - DNA, 25 bp, Mus musculus
cgtgtatcagctcttcggaatgttt

SEQ ID NO: 365837 - DNA, 25 bp, Mus musculus
cgtgtatcagctgttcggaatgttt

SEQ ID NO: 365838 - DNA, 25 bp, Mus musculus
cgtgtattggtccacttttccttgt

SEQ ID NO: 365839 - DNA, 25 bp, Mus musculus
cgtgtattggtcgacttttccttgt

SEQ ID NO: 365840 - DNA, 25 bp, Mus musculus
cgtgtatttcggacgatggttgttg

SEQ ID NO: 365841 - DNA, 25 bp, Mus musculus
cgtgtatttcggtcgatggttgttg

SEQ ID NO: 365842 - DNA, 25 bp, Mus musculus
cgtgtcaaacttccaggtctccaga

SEQ ID NO: 365843 - DNA, 25 bp, Mus musculus
cgtgtcaaacttgcaggtctccaga

SEQ ID NO: 365844 - DNA, 25 bp, Mus musculus
cgtgtcaagccgagtaagctctggg

SEQ ID NO: 365845 - DNA, 25 bp, Mus musculus
cgtgtcaagccgtgtaagctctggg

SEQ ID NO: 365846 - DNA, 25 bp, Mus musculus
cgtgtcatcaccattgcaaaccgga

SEQ ID NO: 365847 - DNA, 25 bp, Mus musculus
cgtgtcatcacctttgcaaaccgga

SEQ ID NO: 365848 - DNA, 25 bp, Mus musculus
cgtgtcatgttgatctgacctgtat

SEQ ID NO: 365849 - DNA, 25 bp, Mus musculus
cgtgtcatgttgttctgacctgtat

SEQ ID NO: 365850 - DNA, 25 bp, Mus musculus
cgtgtccattggcttggactgctaa

SEQ ID NO: 365851 - DNA, 25 bp, Mus musculus
cgtgtccattgggttggactgctaa

SEQ ID NO: 365852 - DNA, 25 bp, Mus musculus
cgtgtcccatctcatctgttcagca

SEQ ID NO: 365853 - DNA, 25 bp, Mus musculus
cgtgtcccatctgatctgttcagca

SEQ ID NO: 365854 - DNA, 25 bp, Mus musculus
cgtgtccctaggctaggcagttatt

SEQ ID NO: 365855 - DNA, 25 bp, Mus musculus
cgtgtccctagggtaggcagttatt

SEQ ID NO: 365856 - DNA, 25 bp, Mus musculus
cgtgtcctcaccaatactacataat

SEQ ID NO: 365857 - DNA, 25 bp, Mus musculus
cgtgtcctcacctatactacataat

SEQ ID NO: 365858 - DNA, 25 bp, Mus musculus
cgtgtcctgcgcctgaagaatcagc

SEQ ID NO: 365859 - DNA, 25 bp, Mus musculus
cgtgtcctgcgcgtgaagaatcagc

SEQ ID NO: 365860 - DNA, 25 bp, Mus musculus
cgtgtccttgtgaattgcttggttt

SEQ ID NO: 365861 - DNA, 25 bp, Mus musculus
cgtgtccttgtgtattgcttggttt

SEQ ID NO: 365862 - DNA, 25 bp, Mus musculus
cgtgtcgaatgcagtactttaatac

SEQ ID NO: 365863 - DNA, 25 bp, Mus musculus
cgtgtcgaatgctgtactttaatac

SEQ ID NO: 365864 - DNA, 25 bp, Mus musculus
cgtgtcgacggacgtgttgtctcca

SEQ ID NO: 365865 - DNA, 25 bp, Mus musculus
cgtgtcgacggaggtgttgtctcca

SEQ ID NO: 365866 - DNA, 25 bp, Mus musculus
cgtgtcgctcatcctgagtcgctag

SEQ ID NO: 365867 - DNA, 25 bp, Mus musculus
cgtgtcgctcatgctgagtcgctag

SEQ ID NO: 365868 - DNA, 25 bp, Mus musculus
cgtgtctagtgaatcgaggtcggct

SEQ ID NO: 365869 - DNA, 25 bp, Mus musculus
cgtgtctagtgattcgaggtcggct

SEQ ID NO: 365870 - DNA, 25 bp, Mus musculus
cgtgtctccccgagtatatgtatgt

SEQ ID NO: 365871 - DNA, 25 bp, Mus musculus
cgtgtctccccgtgtatatgtatgt

SEQ ID NO: 365872 - DNA, 25 bp, Mus musculus
cgtgtctctattatactgttgcaat

SEQ ID NO: 365873 - DNA, 25 bp, Mus musculus
cgtgtctctattttactgttgcaat

SEQ ID NO: 365874 - DNA, 25 bp, Mus musculus
cgtgtctctcatatgtctgtgtctt

SEQ ID NO: 365875 - DNA, 25 bp, Mus musculus
cgtgtctctcatttgtctgtgtctt

SEQ ID NO: 365876 - DNA, 25 bp, Mus musculus
cgtgtctctcggattctgcatctgt

SEQ ID NO: 365877 - DNA, 25 bp, Mus musculus
cgtgtctctcggtttctgcatctgt

SEQ ID NO: 365878 - DNA, 25 bp, Mus musculus
cgtgtctctgggaggtggctctcaa

SEQ ID NO: 365879 - DNA, 25 bp, Mus musculus
cgtgtctctgggtggtggctctcaa

SEQ ID NO: 365880 - DNA, 25 bp, Mus musculus
cgtgtctgaacccttgcttgtggat

SEQ ID NO: 365881 - DNA, 25 bp, Mus musculus
cgtgtctgaaccgttgcttgtggat

SEQ ID NO: 365882 - DNA, 25 bp, Mus musculus
cgtgtctgtgccagttgccgttgga

SEQ ID NO: 365883 - DNA, 25 bp, Mus musculus
cgtgtctgtgcctgttgccgttgga

SEQ ID NO: 365884 - DNA, 25 bp, Mus musculus
cgtgtcttcagtaacggcgtagaga

SEQ ID NO: 365885 - DNA, 25 bp, Mus musculus
cgtgtcttcagttacggcgtagaga

SEQ ID NO: 365886 - DNA, 25 bp, Mus musculus
cgtgtcttccacactacagtgaaga

SEQ ID NO: 365887 - DNA, 25 bp, Mus musculus
cgtgtcttccactctacagtgaaga

SEQ ID NO: 365888 - DNA, 25 bp, Mus musculus
cgtgtgagtcttccctgtggaccaa

SEQ ID NO: 365889 - DNA, 25 bp, Mus musculus
cgtgtgagtcttgcctgtggaccaa

SEQ ID NO: 365890 - DNA, 25 bp, Mus musculus
cgtgtgatgggaccactggcaccaa

SEQ ID NO: 365891 - DNA, 25 bp, Mus musculus
cgtgtgatgggagcactggcaccaa

SEQ ID NO: 365892 - DNA, 25 bp, Mus musculus
cgtgtgcaccaccaacgtttggtga

SEQ ID NO: 365893 - DNA, 25 bp, Mus musculus
cgtgtgcaccacgaacgtttggtga

SEQ ID NO: 365894 - DNA, 25 bp, Mus musculus
cgtgtgcacgtgcttttactcagca

SEQ ID NO: 365895 - DNA, 25 bp, Mus musculus
cgtgtgcacgtggttttactcagca

SEQ ID NO: 365896 - DNA, 25 bp, Mus musculus
cgtgtgccatacagacctcagaagc

SEQ ID NO: 365897 - DNA, 25 bp, Mus musculus
cgtgtgccatactgacctcagaagc

SEQ ID NO: 365898 - DNA, 25 bp, Mus musculus
cgtgtgccccaaatatctgtcagaa

SEQ ID NO: 365899 - DNA, 25 bp, Mus musculus
cgtgtgccccaattatctgtcagaa

SEQ ID NO: 365900 - DNA, 25 bp, Mus musculus
cgtgtgcccctgagactacagagaa

SEQ ID NO: 365901 - DNA, 25 bp, Mus musculus
cgtgtgcccctgtgactacagagaa

SEQ ID NO: 365902 - DNA, 25 bp, Mus musculus
cgtgtgcccgggaacataagctgta

SEQ ID NO: 365903 - DNA, 25 bp, Mus musculus
cgtgtgcccgggtacataagctgta

SEQ ID NO: 365904 - DNA, 25 bp, Mus musculus
cgtgtgcggctgaccagaaaacgta

SEQ ID NO: 365905 - DNA, 25 bp, Mus musculus
cgtgtgcggctgtccagaaaacgta

SEQ ID NO: 365906 - DNA, 25 bp, Mus musculus
cgtgtgctaccaccgctaggctctt

SEQ ID NO: 365907 - DNA, 25 bp, Mus musculus
cgtgtgctaccagcgctaggctctt

SEQ ID NO: 365908 - DNA, 25 bp, Mus musculus
cgtgtgctcgttataatttctcagt

SEQ ID NO: 365909 - DNA, 25 bp, Mus musculus
cgtgtgctcgttttaatttctcagt

SEQ ID NO: 365910 - DNA, 25 bp, Mus musculus
cgtgtgctgaatcaactcctgggtt

SEQ ID NO: 365911 - DNA, 25 bp, Mus musculus
cgtgtgctgaatgaactcctgggtt

SEQ ID NO: 365912 - DNA, 25 bp, Mus musculus
cgtgtgctgctgaaatgggctctga

SEQ ID NO: 365913 - DNA, 25 bp, Mus musculus
cgtgtgctgctgctggttatgtcac

SEQ ID NO: 365914 - DNA, 25 bp, Mus musculus
cgtgtgctgctggtggttatgtcac

SEQ ID NO: 365915 - DNA, 25 bp, Mus musculus
cgtgtgctgctgtaatgggctctga

SEQ ID NO: 365916 - DNA, 25 bp, Mus musculus
cgtgtggagatgaaatgtgcttttc

SEQ ID NO: 365917 - DNA, 25 bp, Mus musculus
cgtgtggagatgtaatgtgcttttc

SEQ ID NO: 365918 - DNA, 25 bp, Mus musculus
cgtgtggccaccattggtgttagaa

SEQ ID NO: 365919 - DNA, 25 bp, Mus musculus
cgtgtggccacctttggtgttagaa

SEQ ID NO: 365920 - DNA, 25 bp, Mus musculus
cgtgtggcccacaaattcttaataa

SEQ ID NO: 365921 - DNA, 25 bp, Mus musculus
cgtgtggcccactaattcttaataa

SEQ ID NO: 365922 - DNA, 25 bp, Mus musculus
cgtgtggcctacattagcctatatt

SEQ ID NO: 365923 - DNA, 25 bp, Mus musculus
cgtgtggcctactttagcctatatt

SEQ ID NO: 365924 - DNA, 25 bp, Mus musculus
cgtgtggctatacttgtggatgaca

SEQ ID NO: 365925 - DNA, 25 bp, Mus musculus
cgtgtggctatagttgtggatgaca

SEQ ID NO: 365926 - DNA, 25 bp, Mus musculus
cgtgtgggatttaataatgctcatt

SEQ ID NO: 365927 - DNA, 25 bp, Mus musculus
cgtgtgggattttataatgctcatt

SEQ ID NO: 365928 - DNA, 25 bp, Mus musculus
cgtgtggtataacccaactaaggca

SEQ ID NO: 365929 - DNA, 25 bp, Mus musculus
cgtgtggtataagccaactaaggca

SEQ ID NO: 365930 - DNA, 25 bp, Mus musculus
cgtgtggtccttactgggtttatca

SEQ ID NO: 365931 - DNA, 25 bp, Mus musculus
cgtgtggtcctttctgggtttatca

SEQ ID NO: 365932 - DNA, 25 bp, Mus musculus
cgtgtgtatattaaagaccctgttg

SEQ ID NO: 365933 - DNA, 25 bp, Mus musculus
cgtgtgtatatttaagaccctgttg

SEQ ID NO: 365934 - DNA, 25 bp, Mus musculus
cgtgtgtcgcacacggacctcaagc

SEQ ID NO: 365935 - DNA, 25 bp, Mus musculus
cgtgtgtcgcactcggacctcaagc

SEQ ID NO: 365936 - DNA, 25 bp, Mus musculus
cgtgtgtctgtgaccttgctgcaag

SEQ ID NO: 365937 - DNA, 25 bp, Mus musculus
cgtgtgtctgtgtccttgctgcaag

SEQ ID NO: 365938 - DNA, 25 bp, Mus musculus
cgtgtgtgaccgagagttagtgtac

SEQ ID NO: 365939 - DNA, 25 bp, Mus musculus
cgtgtgtgaccgtgagttagtgtac

SEQ ID NO: 365940 - DNA, 25 bp, Mus musculus
cgtgtgtgcattcatgccttaactt

SEQ ID NO: 365941 - DNA, 25 bp, Mus musculus
cgtgtgtgcattgatgccttaactt

SEQ ID NO: 365942 - DNA, 25 bp, Mus musculus
cgtgtgtgtaacagtagtgtagtca

SEQ ID NO: 365943 - DNA, 25 bp, Mus musculus
cgtgtgtgtaactgtagtgtagtca

SEQ ID NO: 365944 - DNA, 25 bp, Mus musculus
cgtgtgttgctccaataaagtttgt

SEQ ID NO: 365945 - DNA, 25 bp, Mus musculus
cgtgtgttgctcgaataaagtttgt

SEQ ID NO: 365946 - DNA, 25 bp, Mus musculus
cgtgtgtttgatatcagtggcaagg

SEQ ID NO: 365947 - DNA, 25 bp, Mus musculus
cgtgtgtttgatttcagtggcaagg

SEQ ID NO: 365948 - DNA, 25 bp, Mus musculus
cgtgtgtttgtccaaatagggagac

SEQ ID NO: 365949 - DNA, 25 bp, Mus musculus
cgtgtgtttgtcgaaatagggagac

SEQ ID NO: 365950 - DNA, 25 bp, Mus musculus
cgtgttacactaataccgtcctggt

SEQ ID NO: 365951 - DNA, 25 bp, Mus musculus
cgtgttacactattaccgtcctggt

SEQ ID NO: 365952 - DNA, 25 bp, Mus musculus
cgtgttagcataaccccaagagtcc

SEQ ID NO: 365953 - DNA, 25 bp, Mus musculus
cgtgttagcatatccccaagagtcc

SEQ ID NO: 365954 - DNA, 25 bp, Mus musculus
cgtgttattaaacaggtggcttgtt

SEQ ID NO: 365955 - DNA, 25 bp, Mus musculus
cgtgttattaaagaggtggcttgtt

SEQ ID NO: 365956 - DNA, 25 bp, Mus musculus
cgtgttccctttctgtgactagaag

SEQ ID NO: 365957 - DNA, 25 bp, Mus musculus
cgtgttccctttgtgtgactagaag

SEQ ID NO: 365958 - DNA, 25 bp, Mus musculus
cgtgttcctcacaagaagaaaatgc

SEQ ID NO: 365959 - DNA, 25 bp, Mus musculus
cgtgttcctcactagaagaaaatgc

SEQ ID NO: 365960 - DNA, 25 bp, Mus musculus
cgtgttcgaactcaagcgcatcgtc

SEQ ID NO: 365961 - DNA, 25 bp, Mus musculus
cgtgttcgaactgaagcgcatcgtc

SEQ ID NO: 365962 - DNA, 25 bp, Mus musculus
cgtgttctcggccagtgactgcatg

SEQ ID NO: 365963 - DNA, 25 bp, Mus musculus
cgtgttctcggcgagtgactgcatg

SEQ ID NO: 365964 - DNA, 25 bp, Mus musculus
cgtgttgagtttcttcttcctgatc

SEQ ID NO: 365965 - DNA, 25 bp, Mus musculus
cgtgttgagtttgttcttcctgatc

SEQ ID NO: 365966 - DNA, 25 bp, Mus musculus
cgtgttgccttgattgggagccatt

SEQ ID NO: 365967 - DNA, 25 bp, Mus musculus
cgtgttgccttgtttgggagccatt

SEQ ID NO: 365968 - DNA, 25 bp, Mus musculus
cgtgttgcttgacgtgagaatcctt

SEQ ID NO: 365969 - DNA, 25 bp, Mus musculus
cgtgttgcttgaggtgagaatcctt

SEQ ID NO: 365970 - DNA, 25 bp, Mus musculus
cgtgttggccagactcggcacaccg

SEQ ID NO: 365971 - DNA, 25 bp, Mus musculus
cgtgttggccagtctcggcacaccg

SEQ ID NO: 365972 - DNA, 25 bp, Mus musculus
cgtgttgggcagatcctcaagcaaa

SEQ ID NO: 365973 - DNA, 25 bp, Mus musculus
cgtgttgggcagttcctcaagcaaa

SEQ ID NO: 365974 - DNA, 25 bp, Mus musculus
cgtgttgggtttaacatgcctgtac

SEQ ID NO: 365975 - DNA, 25 bp, Mus musculus
cgtgttgggttttacatgcctgtac

SEQ ID NO: 365976 - DNA, 25 bp, Mus musculus
cgtgttgttgctctacgtgctgagt

SEQ ID NO: 365977 - DNA, 25 bp, Mus musculus
cgtgttgttgctgtacgtgctgagt

SEQ ID NO: 365978 - DNA, 25 bp, Mus musculus
cgtgtttaatttacacttagcaact

SEQ ID NO: 365979 - DNA, 25 bp, Mus musculus
cgtgtttaattttcacttagcaact

SEQ ID NO: 365980 - DNA, 25 bp, Mus musculus
cgtgtttctcatcctctgtttgctt

SEQ ID NO: 365981 - DNA, 25 bp, Mus musculus
cgtgtttctcatgctctgtttgctt

SEQ ID NO: 365982 - DNA, 25 bp, Mus musculus
cgtgtttgctgacctcttctggaac

SEQ ID NO: 365983 - DNA, 25 bp, Mus musculus
cgtgtttgctgagctcttctggaac

SEQ ID NO: 365984 - DNA, 25 bp, Mus musculus
cgtgtttgctttcatatattgtcat

SEQ ID NO: 365985 - DNA, 25 bp, Mus musculus
cgtgtttgctttgatatattgtcat

SEQ ID NO: 365986 - DNA, 25 bp, Mus musculus
cgtgtttgggttagttcattcctgt

SEQ ID NO: 365987 - DNA, 25 bp, Mus musculus
cgtgtttgggtttgttcattcctgt

SEQ ID NO: 365988 - DNA, 25 bp, Mus musculus
cgtgtttgttttagttcctgtggat

SEQ ID NO: 365989 - DNA, 25 bp, Mus musculus
cgtgtttgtttttgttcctgtggat

SEQ ID NO: 365990 - DNA, 25 bp, Mus musculus
cgtgtttttaacatcaatctgcttg

SEQ ID NO: 365991 - DNA, 25 bp, Mus musculus
cgtgtttttaacttcaatctgcttg

SEQ ID NO: 365992 - DNA, 25 bp, Mus musculus
cgtgttttttagcactgtctgctct

SEQ ID NO: 365993 - DNA, 25 bp, Mus musculus
cgtgttttttaggactgtctgctct

SEQ ID NO: 365994 - DNA, 25 bp, Mus musculus
cgttaaaaggaactgtcatgtggga

SEQ ID NO: 365995 - DNA, 25 bp, Mus musculus
cgttaaaaggaagtgtcatgtggga

SEQ ID NO: 365996 - DNA, 25 bp, Mus musculus
cgttaaaatggaaattctgctgaat

SEQ ID NO: 365997 - DNA, 25 bp, Mus musculus
cgttaaaatggatattctgctgaat

SEQ ID NO: 365998 - DNA, 25 bp, Mus musculus
cgttaaggctttccgagcacatcgg

SEQ ID NO: 365999 - DNA, 25 bp, Mus musculus
cgttaaggctttgcgagcacatcgg

SEQ ID NO: 366000 - DNA, 25 bp, Mus musculus
cgttaatcagtcacacaaacttttc

SEQ ID NO: 366001 - DNA, 25 bp, Mus musculus
cgttaatcagtctcacaaacttttc

SEQ ID NO: 366002 - DNA, 25 bp, Mus musculus
cgttacacttatacaccctcttgac

SEQ ID NO: 366003 - DNA, 25 bp, Mus musculus
cgttacacttattcaccctcttgac

SEQ ID NO: 366004 - DNA, 25 bp, Mus musculus
cgttacagagagatcgctatgcaat

SEQ ID NO: 366005 - DNA, 25 bp, Mus musculus
cgttacagagagttcgctatgcaat

SEQ ID NO: 366006 - DNA, 25 bp, Mus musculus
cgttacagcgcaacagcagcctgca

SEQ ID NO: 366007 - DNA, 25 bp, Mus musculus
cgttacagcgcatcagcagcctgca

SEQ ID NO: 366008 - DNA, 25 bp, Mus musculus
cgttaccaacatcaccagcatttta

SEQ ID NO: 366009 - DNA, 25 bp, Mus musculus
cgttaccaacatgaccagcatttta

SEQ ID NO: 366010 - DNA, 25 bp, Mus musculus
cgttacctcacacacttaccagttt

SEQ ID NO: 366011 - DNA, 25 bp, Mus musculus
cgttacctcacagacttaccagttt

SEQ ID NO: 366012 - DNA, 25 bp, Mus musculus
cgttacctgcctaacacttgaagat

SEQ ID NO: 366013 - DNA, 25 bp, Mus musculus
cgttacctgccttacacttgaagat

SEQ ID NO: 366014 - DNA, 25 bp, Mus musculus
cgttacgtccttagtctttgctgga

SEQ ID NO: 366015 - DNA, 25 bp, Mus musculus
cgttacgtcctttgtctttgctgga

SEQ ID NO: 366016 - DNA, 25 bp, Mus musculus
cgttacgtcttaccggcagtcattt

SEQ ID NO: 366017 - DNA, 25 bp, Mus musculus
cgttacgtcttagcggcagtcattt

SEQ ID NO: 366018 - DNA, 25 bp, Mus musculus
cgttactctgacattcatcatcact

SEQ ID NO: 366019 - DNA, 25 bp, Mus musculus
cgttactctgactttcatcatcact

SEQ ID NO: 366020 - DNA, 25 bp, Mus musculus
cgttactgcatgacctttgctgata

SEQ ID NO: 366021 - DNA, 25 bp, Mus musculus
cgttactgcatgcagctggcccaga

SEQ ID NO: 366022 - DNA, 25 bp, Mus musculus
cgttactgcatggagctggcccaga

SEQ ID NO: 366023 - DNA, 25 bp, Mus musculus
cgttactgcatgtcctttgctgata

SEQ ID NO: 366024 - DNA, 25 bp, Mus musculus
cgttactgtgggattgactgggttc

SEQ ID NO: 366025 - DNA, 25 bp, Mus musculus
cgttactgtgggtttgactgggttc

SEQ ID NO: 366026 - DNA, 25 bp, Mus musculus
cgttagcactccatactgcttcaac

SEQ ID NO: 366027 - DNA, 25 bp, Mus musculus
cgttagcactccttactgcttcaac

SEQ ID NO: 366028 - DNA, 25 bp, Mus musculus
cgttagcgactgcgacgttcgatct

SEQ ID NO: 366029 - DNA, 25 bp, Mus musculus
cgttagcgactgggacgttcgatct

SEQ ID NO: 366030 - DNA, 25 bp, Mus musculus
cgttagcgtcgtctcttgggagaaa

SEQ ID NO: 366031 - DNA, 25 bp, Mus musculus
cgttagcgtcgtgtcttgggagaaa

SEQ ID NO: 366032 - DNA, 25 bp, Mus musculus
cgttaggatccccaagctcagcaag

SEQ ID NO: 366033 - DNA, 25 bp, Mus musculus
cgttaggatcccgaagctcagcaag

SEQ ID NO: 366034 - DNA, 25 bp, Mus musculus
cgttagtctttgatgcagttcttgc

SEQ ID NO: 366035 - DNA, 25 bp, Mus musculus
cgttagtctttgttgcagttcttgc

SEQ ID NO: 366036 - DNA, 25 bp, Mus musculus
cgttagtgctctcaagacagccagt

SEQ ID NO: 366037 - DNA, 25 bp, Mus musculus
cgttagtgctctgaagacagccagt

SEQ ID NO: 366038 - DNA, 25 bp, Mus musculus
cgttagttagtaatgcctgctgtgg

SEQ ID NO: 366039 - DNA, 25 bp, Mus musculus
cgttagttagtattgcctgctgtgg

SEQ ID NO: 366040 - DNA, 25 bp, Mus musculus
cgttataaaactagatctttcttca

SEQ ID NO: 366041 - DNA, 25 bp, Mus musculus
cgttataaaacttgatctttcttca

SEQ ID NO: 366042 - DNA, 25 bp, Mus musculus
cgttatatgagaaccacgggctgga

SEQ ID NO: 366043 - DNA, 25 bp, Mus musculus
cgttatatgagatccacgggctgga

SEQ ID NO: 366044 - DNA, 25 bp, Mus musculus
cgttatcattcaaagctgaactgtc

SEQ ID NO: 366045 - DNA, 25 bp, Mus musculus
cgttatcattcatagctgaactgtc

SEQ ID NO: 366046 - DNA, 25 bp, Mus musculus
cgttatccaaaacctgggcggccag

SEQ ID NO: 366047 - DNA, 25 bp, Mus musculus
cgttatccaaaagctgggcggccag

SEQ ID NO: 366048 - DNA, 25 bp, Mus musculus
cgttatccgtagattagctcccagg

SEQ ID NO: 366049 - DNA, 25 bp, Mus musculus
cgttatccgtagtttagctcccagg

SEQ ID NO: 366050 - DNA, 25 bp, Mus musculus
cgttatgccgaccattcctttacat

SEQ ID NO: 366051 - DNA, 25 bp, Mus musculus
cgttatgccgacgattcctttacat

SEQ ID NO: 366052 - DNA, 25 bp, Mus musculus
cgttatttggagagcttttgttctt

SEQ ID NO: 366053 - DNA, 25 bp, Mus musculus
cgttatttggagtgcttttgttctt

SEQ ID NO: 366054 - DNA, 25 bp, Mus musculus
cgttcaacagttcttgttaccaagt

SEQ ID NO: 366055 - DNA, 25 bp, Mus musculus
cgttcaacagttgttgttaccaagt

SEQ ID NO: 366056 - DNA, 25 bp, Mus musculus
cgttcaccaggacagcatcagccaa

SEQ ID NO: 366057 - DNA, 25 bp, Mus musculus
cgttcaccaggagagcatcagccaa

SEQ ID NO: 366058 - DNA, 25 bp, Mus musculus
cgttcagaaacccatcgtagctttt

SEQ ID NO: 366059 - DNA, 25 bp, Mus musculus
cgttcagaaaccgatcgtagctttt

SEQ ID NO: 366060 - DNA, 25 bp, Mus musculus
cgttcagactggcagatcttctctt

SEQ ID NO: 366061 - DNA, 25 bp, Mus musculus
cgttcagactgggagatcttctctt

SEQ ID NO: 366062 - DNA, 25 bp, Mus musculus
cgttcaggtgtgagcttttggaatg

SEQ ID NO: 366063 - DNA, 25 bp, Mus musculus
cgttcaggtgtgtgcttttggaatg

SEQ ID NO: 366064 - DNA, 25 bp, Mus musculus
cgttcatcagaaccaggaagtacca

SEQ ID NO: 366065 - DNA, 25 bp, Mus musculus
cgttcatcagaagcaggaagtacca

SEQ ID NO: 366066 - DNA, 25 bp, Mus musculus
cgttcatcctatctgtgccataaag

SEQ ID NO: 366067 - DNA, 25 bp, Mus musculus
cgttcatcctatgtgtgccataaag

SEQ ID NO: 366068 - DNA, 25 bp, Mus musculus
cgttcatctgaacaacccaagtcta

SEQ ID NO: 366069 - DNA, 25 bp, Mus musculus
cgttcatctgaagaacccaagtcta

SEQ ID NO: 366070 - DNA, 25 bp, Mus musculus
cgttcattgctcatgagatgatcag

SEQ ID NO: 366071 - DNA, 25 bp, Mus musculus
cgttcattgctcttgagatgatcag

SEQ ID NO: 366072 - DNA, 25 bp, Mus musculus
cgttcattttctagcgaggcgcaaa

SEQ ID NO: 366073 - DNA, 25 bp, Mus musculus
cgttcattttcttgcgaggcgcaaa

SEQ ID NO: 366074 - DNA, 25 bp, Mus musculus
cgttccacagctccagggtgagatg

SEQ ID NO: 366075 - DNA, 25 bp, Mus musculus
cgttccacagctgcagggtgagatg

SEQ ID NO: 366076 - DNA, 25 bp, Mus musculus
cgttccagccaccagtggtatggtg

SEQ ID NO: 366077 - DNA, 25 bp, Mus musculus
cgttccagccacgagtggtatggtg

SEQ ID NO: 366078 - DNA, 25 bp, Mus musculus
cgttcccagaacatcttacagtaat

SEQ ID NO: 366079 - DNA, 25 bp, Mus musculus
cgttcccagaacttcttacagtaat

SEQ ID NO: 366080 - DNA, 25 bp, Mus musculus
cgttcccagcatccacgggatggct

SEQ ID NO: 366081 - DNA, 25 bp, Mus musculus
cgttcccagcatgcacgggatggct

SEQ ID NO: 366082 - DNA, 25 bp, Mus musculus
cgttccccaggcagccagggtgtga

SEQ ID NO: 366083 - DNA, 25 bp, Mus musculus
cgttccccaggctgccagggtgtga

SEQ ID NO: 366084 - DNA, 25 bp, Mus musculus
cgttcccctgggagtagcgagttca

SEQ ID NO: 366085 - DNA, 25 bp, Mus musculus
cgttcccctgggtgtagcgagttca

SEQ ID NO: 366086 - DNA, 25 bp, Mus musculus
cgttccctacagcaatccagggcgt

SEQ ID NO: 366087 - DNA, 25 bp, Mus musculus
cgttccctacaggaatccagggcgt

SEQ ID NO: 366088 - DNA, 25 bp, Mus musculus
cgttccctgggcattcgagtggtga

SEQ ID NO: 366089 - DNA, 25 bp, Mus musculus
cgttccctgggctttcgagtggtga

SEQ ID NO: 366090 - DNA, 25 bp, Mus musculus
cgttccgagagccaggacgtgtcaa

SEQ ID NO: 366091 - DNA, 25 bp, Mus musculus
cgttccgagagcgaggacgtgtcaa

SEQ ID NO: 366092 - DNA, 25 bp, Mus musculus
cgttccgcgcatcagcagtgaggct

SEQ ID NO: 366093 - DNA, 25 bp, Mus musculus
cgttccgcgcatgagcagtgaggct

SEQ ID NO: 366094 - DNA, 25 bp, Mus musculus
cgttccgggaagcacattggtgtct

SEQ ID NO: 366095 - DNA, 25 bp, Mus musculus
cgttccgggaaggacattggtgtct

SEQ ID NO: 366096 - DNA, 25 bp, Mus musculus
cgttccgtagtaaaggtcacctcag

SEQ ID NO: 366097 - DNA, 25 bp, Mus musculus
cgttccgtagtataggtcacctcag

SEQ ID NO: 366098 - DNA, 25 bp, Mus musculus
cgttcctctagtcattgctctatag

SEQ ID NO: 366099 - DNA, 25 bp, Mus musculus
cgttcctctagtgattgctctatag

SEQ ID NO: 366100 - DNA, 25 bp, Mus musculus
cgttcctgcattatctttccatgtt

SEQ ID NO: 366101 - DNA, 25 bp, Mus musculus
cgttcctgcattttctttccatgtt

SEQ ID NO: 366102 - DNA, 25 bp, Mus musculus
cgttcctgcctgctaatgagagcaa

SEQ ID NO: 366103 - DNA, 25 bp, Mus musculus
cgttcctgcctggtaatgagagcaa

SEQ ID NO: 366104 - DNA, 25 bp, Mus musculus
cgttccttacaaccagggctgcatg

SEQ ID NO: 366105 - DNA, 25 bp, Mus musculus
cgttccttacaagcagggctgcatg

SEQ ID NO: 366106 - DNA, 25 bp, Mus musculus
cgttccttcaagacctacgacaaga

SEQ ID NO: 366107 - DNA, 25 bp, Mus musculus
cgttccttcaagtcctacgacaaga

SEQ ID NO: 366108 - DNA, 25 bp, Mus musculus
cgttcctttttcacagctccagaag

SEQ ID NO: 366109 - DNA, 25 bp, Mus musculus
cgttcctttttctcagctccagaag

SEQ ID NO: 366110 - DNA, 25 bp, Mus musculus
cgttcgaatctcatttatgcactca

SEQ ID NO: 366111 - DNA, 25 bp, Mus musculus
cgttcgaatctcttttatgcactca

SEQ ID NO: 366112 - DNA, 25 bp, Mus musculus
cgttcgggctgtatcaatttcttga

SEQ ID NO: 366113 - DNA, 25 bp, Mus musculus
cgttcgggctgtttcaatttcttga

SEQ ID NO: 366114 - DNA, 25 bp, Mus musculus
cgttcgtctgttagcgctttcgtga

SEQ ID NO: 366115 - DNA, 25 bp, Mus musculus
cgttcgtctgtttgcgctttcgtga

SEQ ID NO: 366116 - DNA, 25 bp, Mus musculus
cgttcgttctgactcctcgaaggaa

SEQ ID NO: 366117 - DNA, 25 bp, Mus musculus
cgttcgttctgagtcctcgaaggaa

SEQ ID NO: 366118 - DNA, 25 bp, Mus musculus
cgttctagatctcgttcaaggtcca

SEQ ID NO: 366119 - DNA, 25 bp, Mus musculus
cgttctagatctggttcaaggtcca

SEQ ID NO: 366120 - DNA, 25 bp, Mus musculus
cgttctataattacgtcagtccata

SEQ ID NO: 366121 - DNA, 25 bp, Mus musculus
cgttctataatttcgtcagtccata

SEQ ID NO: 366122 - DNA, 25 bp, Mus musculus
cgttctatccatcggactttccttt

SEQ ID NO: 366123 - DNA, 25 bp, Mus musculus
cgttctatccatgggactttccttt

SEQ ID NO: 366124 - DNA, 25 bp, Mus musculus
cgttctatggacacaagcaggtgga

SEQ ID NO: 366125 - DNA, 25 bp, Mus musculus
cgttctatggactcaagcaggtgga

SEQ ID NO: 366126 - DNA, 25 bp, Mus musculus
cgttctcatatcacggatgggcttg

SEQ ID NO: 366127 - DNA, 25 bp, Mus musculus
cgttctcatatctcggatgggcttg

SEQ ID NO: 366128 - DNA, 25 bp, Mus musculus
cgttctccatcacggtgacgcgctt

SEQ ID NO: 366129 - DNA, 25 bp, Mus musculus
cgttctccatcagggtgacgcgctt

SEQ ID NO: 366130 - DNA, 25 bp, Mus musculus
cgttctccccctaggacagattggg

SEQ ID NO: 366131 - DNA, 25 bp, Mus musculus
cgttctcccccttggacagattggg

SEQ ID NO: 366132 - DNA, 25 bp, Mus musculus
cgttctcctgtgagcaagctgtaat

SEQ ID NO: 366133 - DNA, 25 bp, Mus musculus
cgttctcctgtgtgcaagctgtaat

SEQ ID NO: 366134 - DNA, 25 bp, Mus musculus
cgttctcgcagacaactgtgttacc

SEQ ID NO: 366135 - DNA, 25 bp, Mus musculus
cgttctcgcagagaactgtgttacc

SEQ ID NO: 366136 - DNA, 25 bp, Mus musculus
cgttctcgtcgtattcgtagcagaa

SEQ ID NO: 366137 - DNA, 25 bp, Mus musculus
cgttctcgtcgttttcgtagcagaa

SEQ ID NO: 366138 - DNA, 25 bp, Mus musculus
cgttctctttgaccagtattaattt

SEQ ID NO: 366139 - DNA, 25 bp, Mus musculus
cgttctctttgagcagtattaattt

SEQ ID NO: 366140 - DNA, 25 bp, Mus musculus
cgttctgacagtatatggaggccat

SEQ ID NO: 366141 - DNA, 25 bp, Mus musculus
cgttctgacagtttatggaggccat

SEQ ID NO: 366142 - DNA, 25 bp, Mus musculus
cgttctgacatcacacggaggaatc

SEQ ID NO: 366143 - DNA, 25 bp, Mus musculus
cgttctgacatctcacggaggaatc

SEQ ID NO: 366144 - DNA, 25 bp, Mus musculus
cgttctgcatcaagtcctggagtta

SEQ ID NO: 366145 - DNA, 25 bp, Mus musculus
cgttctgcatcatgtcctggagtta

SEQ ID NO: 366146 - DNA, 25 bp, Mus musculus
cgttctgctgcgacaatgacattga

SEQ ID NO: 366147 - DNA, 25 bp, Mus musculus
cgttctgctgcgtcaatgacattga

SEQ ID NO: 366148 - DNA, 25 bp, Mus musculus
cgttctggacatcgtgctttttcta

SEQ ID NO: 366149 - DNA, 25 bp, Mus musculus
cgttctggacatggtgctttttcta

SEQ ID NO: 366150 - DNA, 25 bp, Mus musculus
cgttctggcccaacgatgtatttat

SEQ ID NO: 366151 - DNA, 25 bp, Mus musculus
cgttctggcccatcgatgtatttat

SEQ ID NO: 366152 - DNA, 25 bp, Mus musculus
cgttctgggccaccgctttctgtgg

SEQ ID NO: 366153 - DNA, 25 bp, Mus musculus
cgttctgggccagcgctttctgtgg

SEQ ID NO: 366154 - DNA, 25 bp, Mus musculus
cgttctgtacggactctgggatcaa

SEQ ID NO: 366155 - DNA, 25 bp, Mus musculus
cgttctgtacggtctctgggatcaa

SEQ ID NO: 366156 - DNA, 25 bp, Mus musculus
cgttctgtccacagttgtttaatca

SEQ ID NO: 366157 - DNA, 25 bp, Mus musculus
cgttctgtccactgttgtttaatca

SEQ ID NO: 366158 - DNA, 25 bp, Mus musculus
cgttctgtgaagataccctgcgtgt

SEQ ID NO: 366159 - DNA, 25 bp, Mus musculus
cgttctgtgaagttaccctgcgtgt

SEQ ID NO: 366160 - DNA, 25 bp, Mus musculus
cgttctttcagaactctcagtctat

SEQ ID NO: 366161 - DNA, 25 bp, Mus musculus
cgttctttcagatctctcagtctat

SEQ ID NO: 366162 - DNA, 25 bp, Mus musculus
cgttctttcccacttagctgcagaa

SEQ ID NO: 366163 - DNA, 25 bp, Mus musculus
cgttctttcccagttagctgcagaa

SEQ ID NO: 366164 - DNA, 25 bp, Mus musculus
cgttctttgctacagcttactaagt

SEQ ID NO: 366165 - DNA, 25 bp, Mus musculus
cgttctttgctagagcttactaagt

SEQ ID NO: 366166 - DNA, 25 bp, Mus musculus
cgttcttttcacaggtttatctaca

SEQ ID NO: 366167 - DNA, 25 bp, Mus musculus
cgttcttttcactggtttatctaca

SEQ ID NO: 366168 - DNA, 25 bp, Mus musculus
cgttgaaagtgtagttccttcatat

SEQ ID NO: 366169 - DNA, 25 bp, Mus musculus
cgttgaaagtgttgttccttcatat

SEQ ID NO: 366170 - DNA, 25 bp, Mus musculus
cgttgaaccatcagtgactgttaag

SEQ ID NO: 366171 - DNA, 25 bp, Mus musculus
cgttgaaccatctgtgactgttaag

SEQ ID NO: 366172 - DNA, 25 bp, Mus musculus
cgttgacatccgaaaagacctctat

SEQ ID NO: 366173 - DNA, 25 bp, Mus musculus
cgttgacatccgtaaagacctctat

SEQ ID NO: 366174 - DNA, 25 bp, Mus musculus
cgttgagactatcgtgctgtacaca

SEQ ID NO: 366175 - DNA, 25 bp, Mus musculus
cgttgagactatggtgctgtacaca

SEQ ID NO: 366176 - DNA, 25 bp, Mus musculus
cgttgataccatctagcttcaccac

SEQ ID NO: 366177 - DNA, 25 bp, Mus musculus
cgttgataccatgtagcttcaccac

SEQ ID NO: 366178 - DNA, 25 bp, Mus musculus
cgttgatgttacagaaccgggcggt

SEQ ID NO: 366179 - DNA, 25 bp, Mus musculus
cgttgatgttactgaaccgggcggt

SEQ ID NO: 366180 - DNA, 25 bp, Mus musculus
cgttgattgatccacgtgcttgagg

SEQ ID NO: 366181 - DNA, 25 bp, Mus musculus
cgttgattgatcgacgtgcttgagg

SEQ ID NO: 366182 - DNA, 25 bp, Mus musculus
cgttgcaaccacagtattcatagct

SEQ ID NO: 366183 - DNA, 25 bp, Mus musculus
cgttgcaaccactgtattcatagct

SEQ ID NO: 366184 - DNA, 25 bp, Mus musculus
cgttgcagaattctgcccagcactg

SEQ ID NO: 366185 - DNA, 25 bp, Mus musculus
cgttgcagaattgtgcccagcactg

SEQ ID NO: 366186 - DNA, 25 bp, Mus musculus
cgttgcattgctctttatcctgaag

SEQ ID NO: 366187 - DNA, 25 bp, Mus musculus
cgttgcattgctgtttatcctgaag

SEQ ID NO: 366188 - DNA, 25 bp, Mus musculus
cgttgccatgaaaatccgtgttcta

SEQ ID NO: 366189 - DNA, 25 bp, Mus musculus
cgttgccatgaatatccgtgttcta

SEQ ID NO: 366190 - DNA, 25 bp, Mus musculus
cgttgccatggcagcaacacttaca

SEQ ID NO: 366191 - DNA, 25 bp, Mus musculus
cgttgccatggctgcaacacttaca

SEQ ID NO: 366192 - DNA, 25 bp, Mus musculus
cgttgccgaaacaagccatcgcttg

SEQ ID NO: 366193 - DNA, 25 bp, Mus musculus
cgttgccgaaactagccatcgcttg

SEQ ID NO: 366194 - DNA, 25 bp, Mus musculus
cgttgcctgcgtctgcatgtgacca

SEQ ID NO: 366195 - DNA, 25 bp, Mus musculus
cgttgcctgcgtgtgcatgtgacca

SEQ ID NO: 366196 - DNA, 25 bp, Mus musculus
cgttgcctgctaattttccgttagt

SEQ ID NO: 366197 - DNA, 25 bp, Mus musculus
cgttgcctgctatttttccgttagt

SEQ ID NO: 366198 - DNA, 25 bp, Mus musculus
cgttgctactgcagggtgtggacac

SEQ ID NO: 366199 - DNA, 25 bp, Mus musculus
cgttgctactgctgggtgtggacac

SEQ ID NO: 366200 - DNA, 25 bp, Mus musculus
cgttgctattttaggtacgattcct

SEQ ID NO: 366201 - DNA, 25 bp, Mus musculus
cgttgctatttttggtacgattcct

SEQ ID NO: 366202 - DNA, 25 bp, Mus musculus
cgttgctcttctctatttatgactt

SEQ ID NO: 366203 - DNA, 25 bp, Mus musculus
cgttgctcttctgtatttatgactt

SEQ ID NO: 366204 - DNA, 25 bp, Mus musculus
cgttgctgccgcacaccgggtagcg

SEQ ID NO: 366205 - DNA, 25 bp, Mus musculus
cgttgctgccgctcaccgggtagcg

SEQ ID NO: 366206 - DNA, 25 bp, Mus musculus
cgttgcttaggtcctttttcctttg

SEQ ID NO: 366207 - DNA, 25 bp, Mus musculus
cgttgcttaggtgctttttcctttg

SEQ ID NO: 366208 - DNA, 25 bp, Mus musculus
cgttgcttcagtcgtaaggtcgtca

SEQ ID NO: 366209 - DNA, 25 bp, Mus musculus
cgttgcttcagtggtaaggtcgtca

SEQ ID NO: 366210 - DNA, 25 bp, Mus musculus
cgttgcttgaggagactgctggccc

SEQ ID NO: 366211 - DNA, 25 bp, Mus musculus
cgttgcttgaggtgactgctggccc

SEQ ID NO: 366212 - DNA, 25 bp, Mus musculus
cgttgcttgtggatttagtagttga

SEQ ID NO: 366213 - DNA, 25 bp, Mus musculus
cgttgcttgtggttttagtagttga

SEQ ID NO: 366214 - DNA, 25 bp, Mus musculus
cgttggagccatcaaaacctagtct

SEQ ID NO: 366215 - DNA, 25 bp, Mus musculus
cgttggagccatgaaaacctagtct

SEQ ID NO: 366216 - DNA, 25 bp, Mus musculus
cgttggcggcctctaatggttcaaa

SEQ ID NO: 366217 - DNA, 25 bp, Mus musculus
cgttggcggcctgtaatggttcaaa

SEQ ID NO: 366218 - DNA, 25 bp, Mus musculus
cgttggctgaaaacgagtctcagga

SEQ ID NO: 366219 - DNA, 25 bp, Mus musculus
cgttggctgaaatcgagtctcagga

SEQ ID NO: 366220 - DNA, 25 bp, Mus musculus
cgttggctggccaaacagtggacct

SEQ ID NO: 366221 - DNA, 25 bp, Mus musculus
cgttggctggcctaacagtggacct

SEQ ID NO: 366222 - DNA, 25 bp, Mus musculus
cgttgggaaagcaggctctgaagct

SEQ ID NO: 366223 - DNA, 25 bp, Mus musculus
cgttgggaaagctggctctgaagct

SEQ ID NO: 366224 - DNA, 25 bp, Mus musculus
cgttgggaaataaccgtgccggcaa

SEQ ID NO: 366225 - DNA, 25 bp, Mus musculus
cgttgggaaatatccgtgccggcaa

SEQ ID NO: 366226 - DNA, 25 bp, Mus musculus
cgttggtggcaacaggcctcagcaa

SEQ ID NO: 366227 - DNA, 25 bp, Mus musculus
cgttggtggcaagaggcctcagcaa

SEQ ID NO: 366228 - DNA, 25 bp, Mus musculus
cgttggttgaggagtggccacccat

SEQ ID NO: 366229 - DNA, 25 bp, Mus musculus
cgttggttgaggtgtggccacccat

SEQ ID NO: 366230 - DNA, 25 bp, Mus musculus
cgttgtaaagatccgtgttttgttt

SEQ ID NO: 366231 - DNA, 25 bp, Mus musculus
cgttgtaaagatgcgtgttttgttt

SEQ ID NO: 366232 - DNA, 25 bp, Mus musculus
cgttgtacgcatccgtcagcctcta

SEQ ID NO: 366233 - DNA, 25 bp, Mus musculus
cgttgtacgcatgcgtcagcctcta

SEQ ID NO: 366234 - DNA, 25 bp, Mus musculus
cgttgtagacttacgcagagtgcat

SEQ ID NO: 366235 - DNA, 25 bp, Mus musculus
cgttgtagactttcgcagagtgcat

SEQ ID NO: 366236 - DNA, 25 bp, Mus musculus
cgttgtcgcttcatcctgtttgtgg

SEQ ID NO: 366237 - DNA, 25 bp, Mus musculus
cgttgtcgcttcttcctgtttgtgg

SEQ ID NO: 366238 - DNA, 25 bp, Mus musculus
cgttgtctgcttacttttcatgaag

SEQ ID NO: 366239 - DNA, 25 bp, Mus musculus
cgttgtctgctttcttttcatgaag

SEQ ID NO: 366240 - DNA, 25 bp, Mus musculus
cgttgtctgtgccattagatgatgt

SEQ ID NO: 366241 - DNA, 25 bp, Mus musculus
cgttgtctgtgcgattagatgatgt

SEQ ID NO: 366242 - DNA, 25 bp, Mus musculus
cgttgtctgtttacttcatgtttac

SEQ ID NO: 366243 - DNA, 25 bp, Mus musculus
cgttgtctgttttcttcatgtttac

SEQ ID NO: 366244 - DNA, 25 bp, Mus musculus
cgttgtgaactacaagctgctggat

SEQ ID NO: 366245 - DNA, 25 bp, Mus musculus
cgttgtgaactagaagctgctggat

SEQ ID NO: 366246 - DNA, 25 bp, Mus musculus
cgttgtggctggcatgacttaagat

SEQ ID NO: 366247 - DNA, 25 bp, Mus musculus
cgttgtggctgggatgacttaagat

SEQ ID NO: 366248 - DNA, 25 bp, Mus musculus
cgttgtgtggtaattcgaatataaa

SEQ ID NO: 366249 - DNA, 25 bp, Mus musculus
cgttgtgtggtatttcgaatataaa

SEQ ID NO: 366250 - DNA, 25 bp, Mus musculus
cgttgtgttaaaagaggagcctacc

SEQ ID NO: 366251 - DNA, 25 bp, Mus musculus
cgttgtgttaaatgaggagcctacc

SEQ ID NO: 366252 - DNA, 25 bp, Mus musculus
cgttgtgtttgtctgcgagctagtt

SEQ ID NO: 366253 - DNA, 25 bp, Mus musculus
cgttgtgtttgtgtgcgagctagtt

SEQ ID NO: 366254 - DNA, 25 bp, Mus musculus
cgttgttcggtgatgagtgttccta

SEQ ID NO: 366255 - DNA, 25 bp, Mus musculus
cgttgttcggtgttgagtgttccta

SEQ ID NO: 366256 - DNA, 25 bp, Mus musculus
cgttgttgaactagcgtaccctgta

SEQ ID NO: 366257 - DNA, 25 bp, Mus musculus
cgttgttgaacttgcgtaccctgta

SEQ ID NO: 366258 - DNA, 25 bp, Mus musculus
cgttgttgctctacttgtaggtgaa

SEQ ID NO: 366259 - DNA, 25 bp, Mus musculus
cgttgttgctcttcttgtaggtgaa

SEQ ID NO: 366260 - DNA, 25 bp, Mus musculus
cgttgtttctgccattggtatgtac

SEQ ID NO: 366261 - DNA, 25 bp, Mus musculus
cgttgtttctgcgattggtatgtac

SEQ ID NO: 366262 - DNA, 25 bp, Mus musculus
cgtttacgacgaatgggcctgatgt

SEQ ID NO: 366263 - DNA, 25 bp, Mus musculus
cgtttacgacgattgggcctgatgt

SEQ ID NO: 366264 - DNA, 25 bp, Mus musculus
cgtttaggcaacacaggttctgatt

SEQ ID NO: 366265 - DNA, 25 bp, Mus musculus
cgtttaggcaactcaggttctgatt

SEQ ID NO: 366266 - DNA, 25 bp, Mus musculus
cgtttatccgttccgaggatacaat

SEQ ID NO: 366267 - DNA, 25 bp, Mus musculus
cgtttatccgttgcgaggatacaat

SEQ ID NO: 366268 - DNA, 25 bp, Mus musculus
cgtttatgttcaagtctctgaatgt

SEQ ID NO: 366269 - DNA, 25 bp, Mus musculus
cgtttatgttcatgtctctgaatgt

SEQ ID NO: 366270 - DNA, 25 bp, Mus musculus
cgtttcaacttgagcccctatgttt

SEQ ID NO: 366271 - DNA, 25 bp, Mus musculus
cgtttcaacttgtgcccctatgttt

SEQ ID NO: 366272 - DNA, 25 bp, Mus musculus
cgtttcacatgtccatttaccacaa

SEQ ID NO: 366273 - DNA, 25 bp, Mus musculus
cgtttcacatgtgcatttaccacaa

SEQ ID NO: 366274 - DNA, 25 bp, Mus musculus
cgtttcagcagtagatgggtggttt

SEQ ID NO: 366275 - DNA, 25 bp, Mus musculus
cgtttcagcagttgatgggtggttt

SEQ ID NO: 366276 - DNA, 25 bp, Mus musculus
cgtttcataagtctgttgctctcta

SEQ ID NO: 366277 - DNA, 25 bp, Mus musculus
cgtttcataagtgtgttgctctcta

SEQ ID NO: 366278 - DNA, 25 bp, Mus musculus
cgtttcatcattcggcgtgcgaatt

SEQ ID NO: 366279 - DNA, 25 bp, Mus musculus
cgtttcatcattgggcgtgcgaatt

SEQ ID NO: 366280 - DNA, 25 bp, Mus musculus
cgtttccacactcatctgtaaagca

SEQ ID NO: 366281 - DNA, 25 bp, Mus musculus
cgtttccacactgatctgtaaagca

SEQ ID NO: 366282 - DNA, 25 bp, Mus musculus
cgtttccgtactaactccaattgat

SEQ ID NO: 366283 - DNA, 25 bp, Mus musculus
cgtttccgtacttactccaattgat

SEQ ID NO: 366284 - DNA, 25 bp, Mus musculus
cgtttcctacgcatttcttcatgaa

SEQ ID NO: 366285 - DNA, 25 bp, Mus musculus
cgtttcctacgcttttcttcatgaa

SEQ ID NO: 366286 - DNA, 25 bp, Mus musculus
cgtttcctcaagacggacgccttgg

SEQ ID NO: 366287 - DNA, 25 bp, Mus musculus
cgtttcctcaagtcggacgccttgg

SEQ ID NO: 366288 - DNA, 25 bp, Mus musculus
cgtttcctctaacactggccattaa

SEQ ID NO: 366289 - DNA, 25 bp, Mus musculus
cgtttcctctaagactggccattaa

SEQ ID NO: 366290 - DNA, 25 bp, Mus musculus
cgtttccttcctattgctagtgatg

SEQ ID NO: 366291 - DNA, 25 bp, Mus musculus
cgtttccttccttttgctagtgatg

SEQ ID NO: 366292 - DNA, 25 bp, Mus musculus
cgtttccttcttcataggcctagaa

SEQ ID NO: 366293 - DNA, 25 bp, Mus musculus
cgtttccttcttgataggcctagaa

SEQ ID NO: 366294 - DNA, 25 bp, Mus musculus
cgtttctaacccaagtcacagggag

SEQ ID NO: 366295 - DNA, 25 bp, Mus musculus
cgtttctaaccctagtcacagggag

SEQ ID NO: 366296 - DNA, 25 bp, Mus musculus
cgtttctacactcgattcttctggg

SEQ ID NO: 366297 - DNA, 25 bp, Mus musculus
cgtttctacactggattcttctggg

SEQ ID NO: 366298 - DNA, 25 bp, Mus musculus
cgtttctcaccaatgcatgtacatt

SEQ ID NO: 366299 - DNA, 25 bp, Mus musculus
cgtttctcaccattgcatgtacatt

SEQ ID NO: 366300 - DNA, 25 bp, Mus musculus
cgtttctccacgatcatttgtgtgt

SEQ ID NO: 366301 - DNA, 25 bp, Mus musculus
cgtttctccacgttcatttgtgtgt

SEQ ID NO: 366302 - DNA, 25 bp, Mus musculus
cgtttctcgcacaatattcacacaa

SEQ ID NO: 366303 - DNA, 25 bp, Mus musculus
cgtttctcgcactatattcacacaa

SEQ ID NO: 366304 - DNA, 25 bp, Mus musculus
cgtttctctagacagctttcatatt

SEQ ID NO: 366305 - DNA, 25 bp, Mus musculus
cgtttctctagagagctttcatatt

SEQ ID NO: 366306 - DNA, 25 bp, Mus musculus
cgtttcttaccgattaatgtctcat

SEQ ID NO: 366307 - DNA, 25 bp, Mus musculus
cgtttcttaccgtttaatgtctcat

SEQ ID NO: 366308 - DNA, 25 bp, Mus musculus
cgtttcttctggattcaatcattgg

SEQ ID NO: 366309 - DNA, 25 bp, Mus musculus
cgtttcttctggtttcaatcattgg

SEQ ID NO: 366310 - DNA, 25 bp, Mus musculus
cgtttcttggctcgagtcccgactc

SEQ ID NO: 366311 - DNA, 25 bp, Mus musculus
cgtttcttggctggagtcccgactc

SEQ ID NO: 366312 - DNA, 25 bp, Mus musculus
cgtttcttgtggatgtgctgttaat

SEQ ID NO: 366313 - DNA, 25 bp, Mus musculus
cgtttcttgtggttgtgctgttaat

SEQ ID NO: 366314 - DNA, 25 bp, Mus musculus
cgtttctttgcccatttttgaatgt

SEQ ID NO: 366315 - DNA, 25 bp, Mus musculus
cgtttctttgccgatttttgaatgt

SEQ ID NO: 366316 - DNA, 25 bp, Mus musculus
cgtttgaatgctcccaagggtccct

SEQ ID NO: 366317 - DNA, 25 bp, Mus musculus
cgtttgaatgctgccaagggtccct

SEQ ID NO: 366318 - DNA, 25 bp, Mus musculus
cgtttgatgcagctgggtattacca

SEQ ID NO: 366319 - DNA, 25 bp, Mus musculus
cgtttgatgcaggtgggtattacca

SEQ ID NO: 366320 - DNA, 25 bp, Mus musculus
cgtttgcaggttcttcttgatgtta

SEQ ID NO: 366321 - DNA, 25 bp, Mus musculus
cgtttgcaggttgttcttgatgtta

SEQ ID NO: 366322 - DNA, 25 bp, Mus musculus
cgtttgctactaaggctgggtgcca

SEQ ID NO: 366323 - DNA, 25 bp, Mus musculus
cgtttgctactatggctgggtgcca

SEQ ID NO: 366324 - DNA, 25 bp, Mus musculus
cgtttggaagtgagtctcttaacaa

SEQ ID NO: 366325 - DNA, 25 bp, Mus musculus
cgtttggaagtgtgtctcttaacaa

SEQ ID NO: 366326 - DNA, 25 bp, Mus musculus
cgtttggattgaagtcagcagattt

SEQ ID NO: 366327 - DNA, 25 bp, Mus musculus
cgtttggattgatgtcagcagattt

SEQ ID NO: 366328 - DNA, 25 bp, Mus musculus
cgtttggccaatccggactctgtgt

SEQ ID NO: 366329 - DNA, 25 bp, Mus musculus
cgtttggccaatgcggactctgtgt

SEQ ID NO: 366330 - DNA, 25 bp, Mus musculus
cgtttggcggcacaagctggacttt

SEQ ID NO: 366331 - DNA, 25 bp, Mus musculus
cgtttggcggcagaagctggacttt

SEQ ID NO: 366332 - DNA, 25 bp, Mus musculus
cgtttggtcaggctgcatcccttat

SEQ ID NO: 366333 - DNA, 25 bp, Mus musculus
cgtttggtcagggtgcatcccttat

SEQ ID NO: 366334 - DNA, 25 bp, Mus musculus
cgtttgtattaaacgcactagcccc

SEQ ID NO: 366335 - DNA, 25 bp, Mus musculus
cgtttgtattaatcgcactagcccc

SEQ ID NO: 366336 - DNA, 25 bp, Mus musculus
cgtttgtctgggaaaaggcccagct

SEQ ID NO: 366337 - DNA, 25 bp, Mus musculus
cgtttgtctgggtaaaggcccagct

SEQ ID NO: 366338 - DNA, 25 bp, Mus musculus
cgtttgttgaatagcacaattcttt

SEQ ID NO: 366339 - DNA, 25 bp, Mus musculus
cgtttgttgaattgcacaattcttt

SEQ ID NO: 366340 - DNA, 25 bp, Mus musculus
cgtttgtttcaaatttggtgcttca

SEQ ID NO: 366341 - DNA, 25 bp, Mus musculus
cgtttgtttcaattttggtgcttca

SEQ ID NO: 366342 - DNA, 25 bp, Mus musculus
cgtttgtttcataaccttattagag

SEQ ID NO: 366343 - DNA, 25 bp, Mus musculus
cgtttgtttcattaccttattagag

SEQ ID NO: 366344 - DNA, 25 bp, Mus musculus
cgttttattaacattgccataaatg

SEQ ID NO: 366345 - DNA, 25 bp, Mus musculus
cgttttattaactttgccataaatg

SEQ ID NO: 366346 - DNA, 25 bp, Mus musculus
cgttttcaacgaaatgatttccata

SEQ ID NO: 366347 - DNA, 25 bp, Mus musculus
cgttttcaacgatatgatttccata

SEQ ID NO: 366348 - DNA, 25 bp, Mus musculus
cgttttcactccaggttctttctag

SEQ ID NO: 366349 - DNA, 25 bp, Mus musculus
cgttttcactcctggttctttctag

SEQ ID NO: 366350 - DNA, 25 bp, Mus musculus
cgttttccaccaagttagcctcatt

SEQ ID NO: 366351 - DNA, 25 bp, Mus musculus
cgttttccaccatgttagcctcatt

SEQ ID NO: 366352 - DNA, 25 bp, Mus musculus
cgttttccatgtacagggcccgcca

SEQ ID NO: 366353 - DNA, 25 bp, Mus musculus
cgttttccatgttcagggcccgcca

SEQ ID NO: 366354 - DNA, 25 bp, Mus musculus
cgttttcctccacaaagttgctctc

SEQ ID NO: 366355 - DNA, 25 bp, Mus musculus
cgttttcctccagaaagttgctctc

SEQ ID NO: 366356 - DNA, 25 bp, Mus musculus
cgttttctaggtctccactgtggat

SEQ ID NO: 366357 - DNA, 25 bp, Mus musculus
cgttttctaggtgtccactgtggat

SEQ ID NO: 366358 - DNA, 25 bp, Mus musculus
cgttttctcttcactcttgctatga

SEQ ID NO: 366359 - DNA, 25 bp, Mus musculus
cgttttctcttctctcttgctatga

SEQ ID NO: 366360 - DNA, 25 bp, Mus musculus
cgttttctgcgaagtgaggtctgtc

SEQ ID NO: 366361 - DNA, 25 bp, Mus musculus
cgttttctgcgatgtgaggtctgtc

SEQ ID NO: 366362 - DNA, 25 bp, Mus musculus
cgttttctttataggcaccgaggtg

SEQ ID NO: 366363 - DNA, 25 bp, Mus musculus
cgttttctttattggcaccgaggtg

SEQ ID NO: 366364 - DNA, 25 bp, Mus musculus
cgttttgagtgtctaataccgcatt

SEQ ID NO: 366365 - DNA, 25 bp, Mus musculus
cgttttgagtgtgtaataccgcatt

SEQ ID NO: 366366 - DNA, 25 bp, Mus musculus
cgttttgagttgaacctatgtggtc

SEQ ID NO: 366367 - DNA, 25 bp, Mus musculus
cgttttgagttgtacctatgtggtc

SEQ ID NO: 366368 - DNA, 25 bp, Mus musculus
cgttttgataacagcgacctctccg

SEQ ID NO: 366369 - DNA, 25 bp, Mus musculus
cgttttgataactgcgacctctccg

SEQ ID NO: 366370 - DNA, 25 bp, Mus musculus
cgttttgttctcctttcagttatgg

SEQ ID NO: 366371 - DNA, 25 bp, Mus musculus
cgttttgttctcgtttcagttatgg

SEQ ID NO: 366372 - DNA, 25 bp, Mus musculus
cgtttttccaggaggacatgccagc

SEQ ID NO: 366373 - DNA, 25 bp, Mus musculus
cgtttttccaggtggacatgccagc

SEQ ID NO: 366374 - DNA, 25 bp, Mus musculus
cgtttttgcagtcgtggcttttgtg

SEQ ID NO: 366375 - DNA, 25 bp, Mus musculus
cgtttttgcagtggtggcttttgtg

SEQ ID NO: 366376 - DNA, 25 bp, Mus musculus
ctaaaaaagaataggcagcctggcc

SEQ ID NO: 366377 - DNA, 25 bp, Mus musculus
ctaaaaaagaattggcagcctggcc

SEQ ID NO: 366378 - DNA, 25 bp, Mus musculus
ctaaaaacctatatacagctgggca

SEQ ID NO: 366379 - DNA, 25 bp, Mus musculus
ctaaaaacctatttacagctgggca

SEQ ID NO: 366380 - DNA, 25 bp, Mus musculus
ctaaaaaggcctcattctgcagtga

SEQ ID NO: 366381 - DNA, 25 bp, Mus musculus
ctaaaaaggcctgattctgcagtga

SEQ ID NO: 366382 - DNA, 25 bp, Mus musculus
ctaaaacatcccaattatgtgagtg

SEQ ID NO: 366383 - DNA, 25 bp, Mus musculus
ctaaaacatccctattatgtgagtg

SEQ ID NO: 366384 - DNA, 25 bp, Mus musculus
ctaaaacccagaactgaattttgag

SEQ ID NO: 366385 - DNA, 25 bp, Mus musculus
ctaaaacccagatctgaattttgag

SEQ ID NO: 366386 - DNA, 25 bp, Mus musculus
ctaaaacccattcttggtcgtgtca

SEQ ID NO: 366387 - DNA, 25 bp, Mus musculus
ctaaaacccattgttggtcgtgtca

SEQ ID NO: 366388 - DNA, 25 bp, Mus musculus
ctaaaacctggtattggctctagct

SEQ ID NO: 366389 - DNA, 25 bp, Mus musculus
ctaaaacctggttttggctctagct

SEQ ID NO: 366390 - DNA, 25 bp, Mus musculus
ctaaaacgtgcaaatttcttcaaca

SEQ ID NO: 366391 - DNA, 25 bp, Mus musculus
ctaaaacgtgcatatttcttcaaca

SEQ ID NO: 366392 - DNA, 25 bp, Mus musculus
ctaaaactgtctctcatctcatggg

SEQ ID NO: 366393 - DNA, 25 bp, Mus musculus
ctaaaactgtctgtcatctcatggg

SEQ ID NO: 366394 - DNA, 25 bp, Mus musculus
ctaaaagagaatacattgcttctgt

SEQ ID NO: 366395 - DNA, 25 bp, Mus musculus
ctaaaagagaattcattgcttctgt

SEQ ID NO: 366396 - DNA, 25 bp, Mus musculus
ctaaaagcatcaacatggctcagat

SEQ ID NO: 366397 - DNA, 25 bp, Mus musculus
ctaaaagcatcatcatggctcagat

SEQ ID NO: 366398 - DNA, 25 bp, Mus musculus
ctaaaagcctccactgggactgcag

SEQ ID NO: 366399 - DNA, 25 bp, Mus musculus
ctaaaagcctcctctgggactgcag

SEQ ID NO: 366400 - DNA, 25 bp, Mus musculus
ctaaaaggcggtctcagaggattct

SEQ ID NO: 366401 - DNA, 25 bp, Mus musculus
ctaaaaggcggtgtcagaggattct

SEQ ID NO: 366402 - DNA, 25 bp, Mus musculus
ctaaaaggtctacgcgctctcgctc

SEQ ID NO: 366403 - DNA, 25 bp, Mus musculus
ctaaaaggtctaggcgctctcgctc

SEQ ID NO: 366404 - DNA, 25 bp, Mus musculus
ctaaaaggtgttagggcaacaatat

SEQ ID NO: 366405 - DNA, 25 bp, Mus musculus
ctaaaaggtgtttgggcaacaatat

SEQ ID NO: 366406 - DNA, 25 bp, Mus musculus
ctaaaatcatgtcccagcttgcctg

SEQ ID NO: 366407 - DNA, 25 bp, Mus musculus
ctaaaatcatgtgccagcttgcctg

SEQ ID NO: 366408 - DNA, 25 bp, Mus musculus
ctaaaatccaacacagctgctcaag

SEQ ID NO: 366409 - DNA, 25 bp, Mus musculus
ctaaaatccaactcagctgctcaag

SEQ ID NO: 366410 - DNA, 25 bp, Mus musculus
ctaaaatcgcatctcgttggtcaca

SEQ ID NO: 366411 - DNA, 25 bp, Mus musculus
ctaaaatcgcatgtcgttggtcaca

SEQ ID NO: 366412 - DNA, 25 bp, Mus musculus
ctaaaatcgcttccttggccgggat

SEQ ID NO: 366413 - DNA, 25 bp, Mus musculus
ctaaaatcgcttgcttggccgggat

SEQ ID NO: 366414 - DNA, 25 bp, Mus musculus
ctaaaatgatgccttgtaacgtgtt

SEQ ID NO: 366415 - DNA, 25 bp, Mus musculus
ctaaaatgatgcgttgtaacgtgtt

SEQ ID NO: 366416 - DNA, 25 bp, Mus musculus
ctaaaatggcacctcaatcctttgt

SEQ ID NO: 366417 - DNA, 25 bp, Mus musculus
ctaaaatggcacgtcaatcctttgt

SEQ ID NO: 366418 - DNA, 25 bp, Mus musculus
ctaaaatggtatcctctgagctgaa

SEQ ID NO: 366419 - DNA, 25 bp, Mus musculus
ctaaaatggtatgctctgagctgaa

SEQ ID NO: 366420 - DNA, 25 bp, Mus musculus
ctaaaatgtttaaacctggtctgag

SEQ ID NO: 366421 - DNA, 25 bp, Mus musculus
ctaaaatgtttatacctggtctgag

SEQ ID NO: 366422 - DNA, 25 bp, Mus musculus
ctaaaatgtttcatgccagcactaa

SEQ ID NO: 366423 - DNA, 25 bp, Mus musculus
ctaaaatgtttcttgccagcactaa

SEQ ID NO: 366424 - DNA, 25 bp, Mus musculus
ctaaacaaatccctgaccaagtcct

SEQ ID NO: 366425 - DNA, 25 bp, Mus musculus
ctaaacaaatccgtgaccaagtcct

SEQ ID NO: 366426 - DNA, 25 bp, Mus musculus
ctaaacaacttgagctcctggaagc

SEQ ID NO: 366427 - DNA, 25 bp, Mus musculus
ctaaacaacttgtgctcctggaagc

SEQ ID NO: 366428 - DNA, 25 bp, Mus musculus
ctaaacaaggctcgcaagttcccct

SEQ ID NO: 366429 - DNA, 25 bp, Mus musculus
ctaaacaaggctggcaagttcccct

SEQ ID NO: 366430 - DNA, 25 bp, Mus musculus
ctaaacaagtctctgcactgagctg

SEQ ID NO: 366431 - DNA, 25 bp, Mus musculus
ctaaacaagtctgtgcactgagctg

SEQ ID NO: 366432 - DNA, 25 bp, Mus musculus
ctaaacagatgacagccaaggcaat

SEQ ID NO: 366433 - DNA, 25 bp, Mus musculus
ctaaacagatgagagccaaggcaat

SEQ ID NO: 366434 - DNA, 25 bp, Mus musculus
ctaaacaggctcaatttatgaatgc

SEQ ID NO: 366435 - DNA, 25 bp, Mus musculus
ctaaacaggctctatttatgaatgc

SEQ ID NO: 366436 - DNA, 25 bp, Mus musculus
ctaaacaggttcatctttgccctat

SEQ ID NO: 366437 - DNA, 25 bp, Mus musculus
ctaaacaggttcttctttgccctat

SEQ ID NO: 366438 - DNA, 25 bp, Mus musculus
ctaaacatgggcaaaggagatccta

SEQ ID NO: 366439 - DNA, 25 bp, Mus musculus
ctaaacatgggctaaggagatccta

SEQ ID NO: 366440 - DNA, 25 bp, Mus musculus
ctaaacattaggatcagcactgatt

SEQ ID NO: 366441 - DNA, 25 bp, Mus musculus
ctaaacattaggttcagcactgatt

SEQ ID NO: 366442 - DNA, 25 bp, Mus musculus
ctaaacctacaaactgccagcagca

SEQ ID NO: 366443 - DNA, 25 bp, Mus musculus
ctaaacctacaatctgccagcagca

SEQ ID NO: 366444 - DNA, 25 bp, Mus musculus
ctaaacctaggacagtccatggtgt

SEQ ID NO: 366445 - DNA, 25 bp, Mus musculus
ctaaacctaggagagtccatggtgt

SEQ ID NO: 366446 - DNA, 25 bp, Mus musculus
ctaaacctgaatcactgagcagctt

SEQ ID NO: 366447 - DNA, 25 bp, Mus musculus
ctaaacctgaatgactgagcagctt

SEQ ID NO: 366448 - DNA, 25 bp, Mus musculus
ctaaacctgcacagtccaagacaat

SEQ ID NO: 366449 - DNA, 25 bp, Mus musculus
ctaaacctgcactgtccaagacaat

SEQ ID NO: 366450 - DNA, 25 bp, Mus musculus
ctaaaccttcacctatatctatatc

SEQ ID NO: 366451 - DNA, 25 bp, Mus musculus
ctaaaccttcacgtatatctatatc

SEQ ID NO: 366452 - DNA, 25 bp, Mus musculus
ctaaacctttctctactgggagaca

SEQ ID NO: 366453 - DNA, 25 bp, Mus musculus
ctaaacctttctgtactgggagaca

SEQ ID NO: 366454 - DNA, 25 bp, Mus musculus
ctaaactcaggcattcagatgtgct

SEQ ID NO: 366455 - DNA, 25 bp, Mus musculus
ctaaactcaggctttcagatgtgct

SEQ ID NO: 366456 - DNA, 25 bp, Mus musculus
ctaaactcgttgaggctagggccaa

SEQ ID NO: 366457 - DNA, 25 bp, Mus musculus
ctaaactcgttgtggctagggccaa

SEQ ID NO: 366458 - DNA, 25 bp, Mus musculus
ctaaactctcatcgcagacactgca

SEQ ID NO: 366459 - DNA, 25 bp, Mus musculus
ctaaactctcatggcagacactgca

SEQ ID NO: 366460 - DNA, 25 bp, Mus musculus
ctaaactcttgtcccttggattcaa

SEQ ID NO: 366461 - DNA, 25 bp, Mus musculus
ctaaactcttgtgccttggattcaa

SEQ ID NO: 366462 - DNA, 25 bp, Mus musculus
ctaaactgaaccagacttcctggaa

SEQ ID NO: 366463 - DNA, 25 bp, Mus musculus
ctaaactgaacctgacttcctggaa

SEQ ID NO: 366464 - DNA, 25 bp, Mus musculus
ctaaactgaatcctcctggttaggt

SEQ ID NO: 366465 - DNA, 25 bp, Mus musculus
ctaaactgaatcgtcctggttaggt

SEQ ID NO: 366466 - DNA, 25 bp, Mus musculus
ctaaactgctgccttttacaacaag

SEQ ID NO: 366467 - DNA, 25 bp, Mus musculus
ctaaactgctgcgttttacaacaag

SEQ ID NO: 366468 - DNA, 25 bp, Mus musculus
ctaaactgtaaaaatatctgtgggt

SEQ ID NO: 366469 - DNA, 25 bp, Mus musculus
ctaaactgtaaatatatctgtgggt

SEQ ID NO: 366470 - DNA, 25 bp, Mus musculus
ctaaacttcaacactccttcaaaag

SEQ ID NO: 366471 - DNA, 25 bp, Mus musculus
ctaaacttcaactctccttcaaaag

SEQ ID NO: 366472 - DNA, 25 bp, Mus musculus
ctaaagaaagctcgccatgtactgg

SEQ ID NO: 366473 - DNA, 25 bp, Mus musculus
ctaaagaaagctggccatgtactgg

SEQ ID NO: 366474 - DNA, 25 bp, Mus musculus
ctaaagaagcacaggccccacgaag

SEQ ID NO: 366475 - DNA, 25 bp, Mus musculus
ctaaagaagcactggccccacgaag

SEQ ID NO: 366476 - DNA, 25 bp, Mus musculus
ctaaagaagtgcaggtgcgatggct

SEQ ID NO: 366477 - DNA, 25 bp, Mus musculus
ctaaagaagtgctggtgcgatggct

SEQ ID NO: 366478 - DNA, 25 bp, Mus musculus
ctaaagacaattagctttcagctgg

SEQ ID NO: 366479 - DNA, 25 bp, Mus musculus
ctaaagacaatttgctttcagctgg

SEQ ID NO: 366480 - DNA, 25 bp, Mus musculus
ctaaagaccgtgagagccctgctgg

SEQ ID NO: 366481 - DNA, 25 bp, Mus musculus
ctaaagaccgtgtgagccctgctgg

SEQ ID NO: 366482 - DNA, 25 bp, Mus musculus
ctaaagacgtcacgcccctaacaag

SEQ ID NO: 366483 - DNA, 25 bp, Mus musculus
ctaaagacgtcaggcccctaacaag

SEQ ID NO: 366484 - DNA, 25 bp, Mus musculus
ctaaagactcctaagtctgagggaa

SEQ ID NO: 366485 - DNA, 25 bp, Mus musculus
ctaaagactccttagtctgagggaa

SEQ ID NO: 366486 - DNA, 25 bp, Mus musculus
ctaaagagatcacactttctggccc

SEQ ID NO: 366487 - DNA, 25 bp, Mus musculus
ctaaagagatcagactttctggccc

SEQ ID NO: 366488 - DNA, 25 bp, Mus musculus
ctaaagagcaccatcgctttgttat

SEQ ID NO: 366489 - DNA, 25 bp, Mus musculus
ctaaagagcaccttcgctttgttat

SEQ ID NO: 366490 - DNA, 25 bp, Mus musculus
ctaaagaggtcaacagcacgggcag

SEQ ID NO: 366491 - DNA, 25 bp, Mus musculus
ctaaagaggtcatcagcacgggcag

SEQ ID NO: 366492 - DNA, 25 bp, Mus musculus
ctaaagaggttcatctcatctcaag

SEQ ID NO: 366493 - DNA, 25 bp, Mus musculus
ctaaagaggttcttctcatctcaag

SEQ ID NO: 366494 - DNA, 25 bp, Mus musculus
ctaaagataatgcatgttttacagt

SEQ ID NO: 366495 - DNA, 25 bp, Mus musculus
ctaaagataatggatgttttacagt

SEQ ID NO: 366496 - DNA, 25 bp, Mus musculus
ctaaagatataactggtgccgtgca

SEQ ID NO: 366497 - DNA, 25 bp, Mus musculus
ctaaagatataagtggtgccgtgca

SEQ ID NO: 366498 - DNA, 25 bp, Mus musculus
ctaaagatcctcagtcttgatataa

SEQ ID NO: 366499 - DNA, 25 bp, Mus musculus
ctaaagatcctctgtcttgatataa

SEQ ID NO: 366500 - DNA, 25 bp, Mus musculus
ctaaagatggttctagccatgccct

SEQ ID NO: 366501 - DNA, 25 bp, Mus musculus
ctaaagatggttgtagccatgccct

SEQ ID NO: 366502 - DNA, 25 bp, Mus musculus
ctaaagatttttcagaccccacaca

SEQ ID NO: 366503 - DNA, 25 bp, Mus musculus
ctaaagatttttgagaccccacaca

SEQ ID NO: 366504 - DNA, 25 bp, Mus musculus
ctaaagcaaacacccgggacggacg

SEQ ID NO: 366505 - DNA, 25 bp, Mus musculus
ctaaagcaaacagccgggacggacg

SEQ ID NO: 366506 - DNA, 25 bp, Mus musculus
ctaaagcatgaaagttccttccggg

SEQ ID NO: 366507 - DNA, 25 bp, Mus musculus
ctaaagcatgaatgttccttccggg

SEQ ID NO: 366508 - DNA, 25 bp, Mus musculus
ctaaagcctgggatggtctggtgcc

SEQ ID NO: 366509 - DNA, 25 bp, Mus musculus
ctaaagcctgggttggtctggtgcc

SEQ ID NO: 366510 - DNA, 25 bp, Mus musculus
ctaaagcttatcacaggtctactgg

SEQ ID NO: 366511 - DNA, 25 bp, Mus musculus
ctaaagcttatctcaggtctactgg

SEQ ID NO: 366512 - DNA, 25 bp, Mus musculus
ctaaagcttgccatttccaatttat

SEQ ID NO: 366513 - DNA, 25 bp, Mus musculus
ctaaagcttgccttttccaatttat

SEQ ID NO: 366514 - DNA, 25 bp, Mus musculus
ctaaagctttgaaaatctgtggcag

SEQ ID NO: 366515 - DNA, 25 bp, Mus musculus
ctaaagctttgataatctgtggcag

SEQ ID NO: 366516 - DNA, 25 bp, Mus musculus
ctaaaggacctgcatattaaagatt

SEQ ID NO: 366517 - DNA, 25 bp, Mus musculus
ctaaaggacctggatattaaagatt

SEQ ID NO: 366518 - DNA, 25 bp, Mus musculus
ctaaaggatactcaccattgggaga

SEQ ID NO: 366519 - DNA, 25 bp, Mus musculus
ctaaaggatactgaccattgggaga

SEQ ID NO: 366520 - DNA, 25 bp, Mus musculus
ctaaaggcaggtatgatttcccaat

SEQ ID NO: 366521 - DNA, 25 bp, Mus musculus
ctaaaggcaggtttgatttcccaat

SEQ ID NO: 366522 - DNA, 25 bp, Mus musculus
ctaaaggctgtaatgatggctcaac

SEQ ID NO: 366523 - DNA, 25 bp, Mus musculus
ctaaaggctgtattgatggctcaac

SEQ ID NO: 366524 - DNA, 25 bp, Mus musculus
ctaaaggtcacacagcgatggcatt

SEQ ID NO: 366525 - DNA, 25 bp, Mus musculus
ctaaaggtcacagagcgatggcatt

SEQ ID NO: 366526 - DNA, 25 bp, Mus musculus
ctaaaggtcccaatcagtgtgtgtg

SEQ ID NO: 366527 - DNA, 25 bp, Mus musculus
ctaaaggtcccattcagtgtgtgtg

SEQ ID NO: 366528 - DNA, 25 bp, Mus musculus
ctaaaggtctttatctgctttctgt

SEQ ID NO: 366529 - DNA, 25 bp, Mus musculus
ctaaaggtctttttctgctttctgt

SEQ ID NO: 366530 - DNA, 25 bp, Mus musculus
ctaaagtcatcacaggaggaagcct

SEQ ID NO: 366531 - DNA, 25 bp, Mus musculus
ctaaagtcatcagaggaggaagcct

SEQ ID NO: 366532 - DNA, 25 bp, Mus musculus
ctaaagtcattcagctgcctcctgc

SEQ ID NO: 366533 - DNA, 25 bp, Mus musculus
ctaaagtcattctgctgcctcctgc

SEQ ID NO: 366534 - DNA, 25 bp, Mus musculus
ctaaagtccactcccaggtgtttgt

SEQ ID NO: 366535 - DNA, 25 bp, Mus musculus
ctaaagtccactgccaggtgtttgt

SEQ ID NO: 366536 - DNA, 25 bp, Mus musculus
ctaaagtcccctatccgaggagatg

SEQ ID NO: 366537 - DNA, 25 bp, Mus musculus
ctaaagtcccctttccgaggagatg

SEQ ID NO: 366538 - DNA, 25 bp, Mus musculus
ctaaagtctgtaagttgtactgtaa

SEQ ID NO: 366539 - DNA, 25 bp, Mus musculus
ctaaagtctgtatgttgtactgtaa

SEQ ID NO: 366540 - DNA, 25 bp, Mus musculus
ctaaagtgacctcggctggaaatta

SEQ ID NO: 366541 - DNA, 25 bp, Mus musculus
ctaaagtgacctgggctggaaatta

SEQ ID NO: 366542 - DNA, 25 bp, Mus musculus
ctaaagtgagtgataccttacttat

SEQ ID NO: 366543 - DNA, 25 bp, Mus musculus
ctaaagtgagtgttaccttacttat

SEQ ID NO: 366544 - DNA, 25 bp, Mus musculus
ctaaagttccacagcgcgaggcctc

SEQ ID NO: 366545 - DNA, 25 bp, Mus musculus
ctaaagttccactgcgcgaggcctc

SEQ ID NO: 366546 - DNA, 25 bp, Mus musculus
ctaaagttcctaaccttggcatatg

SEQ ID NO: 366547 - DNA, 25 bp, Mus musculus
ctaaagttcctatccttggcatatg

SEQ ID NO: 366548 - DNA, 25 bp, Mus musculus
ctaaagttgccacatcttcgatctt

SEQ ID NO: 366549 - DNA, 25 bp, Mus musculus
ctaaagttgccagatcttcgatctt

SEQ ID NO: 366550 - DNA, 25 bp, Mus musculus
ctaaagtttaaaaagctgtctgctt

SEQ ID NO: 366551 - DNA, 25 bp, Mus musculus
ctaaagtttaaatagctgtctgctt

SEQ ID NO: 366552 - DNA, 25 bp, Mus musculus
ctaaagttttagacacagttgtgtt

SEQ ID NO: 366553 - DNA, 25 bp, Mus musculus
ctaaagttttagtcacagttgtgtt

SEQ ID NO: 366554 - DNA, 25 bp, Mus musculus
ctaaataagctaagtctgcagaagt

SEQ ID NO: 366555 - DNA, 25 bp, Mus musculus
ctaaataagctatgtctgcagaagt

SEQ ID NO: 366556 - DNA, 25 bp, Mus musculus
ctaaatacaggtaggattgcttctt

SEQ ID NO: 366557 - DNA, 25 bp, Mus musculus
ctaaatacaggtcccaatcccattc

SEQ ID NO: 366558 - DNA, 25 bp, Mus musculus
ctaaatacaggtgccaatcccattc

SEQ ID NO: 366559 - DNA, 25 bp, Mus musculus
ctaaatacaggttggattgcttctt

SEQ ID NO: 366560 - DNA, 25 bp, Mus musculus
ctaaatacctcacttgccatgcttt

SEQ ID NO: 366561 - DNA, 25 bp, Mus musculus
ctaaatacctcagttgccatgcttt

SEQ ID NO: 366562 - DNA, 25 bp, Mus musculus
ctaaatactgtcagtactaaactgt

SEQ ID NO: 366563 - DNA, 25 bp, Mus musculus
ctaaatactgtctgtactaaactgt

SEQ ID NO: 366564 - DNA, 25 bp, Mus musculus
ctaaatacttgtacagctactggct

SEQ ID NO: 366565 - DNA, 25 bp, Mus musculus
ctaaatacttgttcagctactggct

SEQ ID NO: 366566 - DNA, 25 bp, Mus musculus
ctaaatagaaggatctttctctctt

SEQ ID NO: 366567 - DNA, 25 bp, Mus musculus
ctaaatagaaggttctttctctctt

SEQ ID NO: 366568 - DNA, 25 bp, Mus musculus
ctaaatatgatcacccaggctgtgg

SEQ ID NO: 366569 - DNA, 25 bp, Mus musculus
ctaaatatgatctcccaggctgtgg

SEQ ID NO: 366570 - DNA, 25 bp, Mus musculus
ctaaatatgctcagggttacccttt

SEQ ID NO: 366571 - DNA, 25 bp, Mus musculus
ctaaatatgctctgggttacccttt

SEQ ID NO: 366572 - DNA, 25 bp, Mus musculus
ctaaatattcataccatacagctgg

SEQ ID NO: 366573 - DNA, 25 bp, Mus musculus
ctaaatattcattccatacagctgg

SEQ ID NO: 366574 - DNA, 25 bp, Mus musculus
ctaaatattgcccagtgactataat

SEQ ID NO: 366575 - DNA, 25 bp, Mus musculus
ctaaatattgccgagtgactataat

SEQ ID NO: 366576 - DNA, 25 bp, Mus musculus
ctaaatcagcatactcagtgcctgc

SEQ ID NO: 366577 - DNA, 25 bp, Mus musculus
ctaaatcagcattctcagtgcctgc

SEQ ID NO: 366578 - DNA, 25 bp, Mus musculus
ctaaatccaaaaccagacactgtcg

SEQ ID NO: 366579 - DNA, 25 bp, Mus musculus
ctaaatccaaaagcagacactgtcg

SEQ ID NO: 366580 - DNA, 25 bp, Mus musculus
ctaaatcctttacctacagaaagct

SEQ ID NO: 366581 - DNA, 25 bp, Mus musculus
ctaaatcctttagctacagaaagct

SEQ ID NO: 366582 - DNA, 25 bp, Mus musculus
ctaaatctagatcaagtgctcagtc

SEQ ID NO: 366583 - DNA, 25 bp, Mus musculus
ctaaatctagatgaagtgctcagtc

SEQ ID NO: 366584 - DNA, 25 bp, Mus musculus
ctaaatctatggagacatgacactg

SEQ ID NO: 366585 - DNA, 25 bp, Mus musculus
ctaaatctatggtgacatgacactg

SEQ ID NO: 366586 - DNA, 25 bp, Mus musculus
ctaaatctcatcccaggtttccctt

SEQ ID NO: 366587 - DNA, 25 bp, Mus musculus
ctaaatctcatcgcaggtttccctt

SEQ ID NO: 366588 - DNA, 25 bp, Mus musculus
ctaaatctctagatctgagtcctgg

SEQ ID NO: 366589 - DNA, 25 bp, Mus musculus
ctaaatctctagttctgagtcctgg

SEQ ID NO: 366590 - DNA, 25 bp, Mus musculus
ctaaatctgatgcttaaattttctt

SEQ ID NO: 366591 - DNA, 25 bp, Mus musculus
ctaaatctgatggttaaattttctt

SEQ ID NO: 366592 - DNA, 25 bp, Mus musculus
ctaaatctgggtcctgtttctgtgc

SEQ ID NO: 366593 - DNA, 25 bp, Mus musculus
ctaaatctgggtgctgtttctgtgc

SEQ ID NO: 366594 - DNA, 25 bp, Mus musculus
ctaaatgaaggacatgagctctaat

SEQ ID NO: 366595 - DNA, 25 bp, Mus musculus
ctaaatgaaggagatgagctctaat

SEQ ID NO: 366596 - DNA, 25 bp, Mus musculus
ctaaatgaatgacccactgtgtata

SEQ ID NO: 366597 - DNA, 25 bp, Mus musculus
ctaaatgaatgagccactgtgtata

SEQ ID NO: 366598 - DNA, 25 bp, Mus musculus
ctaaatgccagccacacgagggagg

SEQ ID NO: 366599 - DNA, 25 bp, Mus musculus
ctaaatgccagcgacacgagggagg

SEQ ID NO: 366600 - DNA, 25 bp, Mus musculus
ctaaatgctgtgagatagacaattt

SEQ ID NO: 366601 - DNA, 25 bp, Mus musculus
ctaaatgctgtgtgatagacaattt

SEQ ID NO: 366602 - DNA, 25 bp, Mus musculus
ctaaatgtcagtctgttcaaacccc

SEQ ID NO: 366603 - DNA, 25 bp, Mus musculus
ctaaatgtcagtgtgttcaaacccc

SEQ ID NO: 366604 - DNA, 25 bp, Mus musculus
ctaaatgtcataatctgtggatctc

SEQ ID NO: 366605 - DNA, 25 bp, Mus musculus
ctaaatgtcatattctgtggatctc

SEQ ID NO: 366606 - DNA, 25 bp, Mus musculus
ctaaatgtctctaagcccctatgaa

SEQ ID NO: 366607 - DNA, 25 bp, Mus musculus
ctaaatgtctcttagcccctatgaa

SEQ ID NO: 366608 - DNA, 25 bp, Mus musculus
ctaaatgttgcgagggtggcatgaa

SEQ ID NO: 366609 - DNA, 25 bp, Mus musculus
ctaaatgttgcgtgggtggcatgaa

SEQ ID NO: 366610 - DNA, 25 bp, Mus musculus
ctaaattaattgagtgcggctggaa

SEQ ID NO: 366611 - DNA, 25 bp, Mus musculus
ctaaattaattgtgtgcggctggaa

SEQ ID NO: 366612 - DNA, 25 bp, Mus musculus
ctaaattatgttcctgctctactgc

SEQ ID NO: 366613 - DNA, 25 bp, Mus musculus
ctaaattatgttgctgctctactgc

SEQ ID NO: 366614 - DNA, 25 bp, Mus musculus
ctaaattcacatcgcagcagttcca

SEQ ID NO: 366615 - DNA, 25 bp, Mus musculus
ctaaattcacatggcagcagttcca

SEQ ID NO: 366616 - DNA, 25 bp, Mus musculus
ctaaattctcttatccatgtagttt

SEQ ID NO: 366617 - DNA, 25 bp, Mus musculus
ctaaattctcttttccatgtagttt

SEQ ID NO: 366618 - DNA, 25 bp, Mus musculus
ctaaattttcctatcatgtgttcaa

SEQ ID NO: 366619 - DNA, 25 bp, Mus musculus
ctaaattttcctatgtttactgagt

SEQ ID NO: 366620 - DNA, 25 bp, Mus musculus
ctaaattttcctttcatgtgttcaa

SEQ ID NO: 366621 - DNA, 25 bp, Mus musculus
ctaaattttcctttgtttactgagt

SEQ ID NO: 366622 - DNA, 25 bp, Mus musculus
ctaacaacacacaagcatccttcag

SEQ ID NO: 366623 - DNA, 25 bp, Mus musculus
ctaacaacacactagcatccttcag

SEQ ID NO: 366624 - DNA, 25 bp, Mus musculus
ctaacaacacctcgctgtatcttaa

SEQ ID NO: 366625 - DNA, 25 bp, Mus musculus
ctaacaacacctggctgtatcttaa

SEQ ID NO: 366626 - DNA, 25 bp, Mus musculus
ctaacaacatttcggagtacacggt

SEQ ID NO: 366627 - DNA, 25 bp, Mus musculus
ctaacaacatttgggagtacacggt

SEQ ID NO: 366628 - DNA, 25 bp, Mus musculus
ctaacaactggaaattgctatcggg

SEQ ID NO: 366629 - DNA, 25 bp, Mus musculus
ctaacaactggatattgctatcggg

SEQ ID NO: 366630 - DNA, 25 bp, Mus musculus
ctaacaatcacgcaacctggacttg

SEQ ID NO: 366631 - DNA, 25 bp, Mus musculus
ctaacaatcacggaacctggacttg

SEQ ID NO: 366632 - DNA, 25 bp, Mus musculus
ctaacacactgaccacactgtattg

SEQ ID NO: 366633 - DNA, 25 bp, Mus musculus
ctaacacactgagcacactgtattg

SEQ ID NO: 366634 - DNA, 25 bp, Mus musculus
ctaacacaggtccacacacttaaat

SEQ ID NO: 366635 - DNA, 25 bp, Mus musculus
ctaacacaggtcgacacacttaaat

SEQ ID NO: 366636 - DNA, 25 bp, Mus musculus
ctaacaccagcacccgttgtgtggg

SEQ ID NO: 366637 - DNA, 25 bp, Mus musculus
ctaacaccagcagccgttgtgtggg

SEQ ID NO: 366638 - DNA, 25 bp, Mus musculus
ctaacaccatgtatttgtacagaat

SEQ ID NO: 366639 - DNA, 25 bp, Mus musculus
ctaacaccatgtttttgtacagaat

SEQ ID NO: 366640 - DNA, 25 bp, Mus musculus
ctaacaccgcgtccagcatagaggg

SEQ ID NO: 366641 - DNA, 25 bp, Mus musculus
ctaacaccgcgtgcagcatagaggg

SEQ ID NO: 366642 - DNA, 25 bp, Mus musculus
ctaacaccttatctaacaaaatctg

SEQ ID NO: 366643 - DNA, 25 bp, Mus musculus
ctaacaccttatgtaacaaaatctg

SEQ ID NO: 366644 - DNA, 25 bp, Mus musculus
ctaacacgaatcatgggtcaaatta

SEQ ID NO: 366645 - DNA, 25 bp, Mus musculus
ctaacacgaatcttgggtcaaatta

SEQ ID NO: 366646 - DNA, 25 bp, Mus musculus
ctaacacgcgagacgctcagggttt

SEQ ID NO: 366647 - DNA, 25 bp, Mus musculus
ctaacacgcgagtcgctcagggttt

SEQ ID NO: 366648 - DNA, 25 bp, Mus musculus
ctaacactacataaatcagggctgt

SEQ ID NO: 366649 - DNA, 25 bp, Mus musculus
ctaacactacattaatcagggctgt

SEQ ID NO: 366650 - DNA, 25 bp, Mus musculus
ctaacactgccaactgtcggtagtt

SEQ ID NO: 366651 - DNA, 25 bp, Mus musculus
ctaacactgccatctgtcggtagtt

SEQ ID NO: 366652 - DNA, 25 bp, Mus musculus
ctaacactggttactgaaggctaaa

SEQ ID NO: 366653 - DNA, 25 bp, Mus musculus
ctaacactggtttctgaaggctaaa

SEQ ID NO: 366654 - DNA, 25 bp, Mus musculus
ctaacagatgacaacaacaagatgt

SEQ ID NO: 366655 - DNA, 25 bp, Mus musculus
ctaacagatgactacaacaagatgt

SEQ ID NO: 366656 - DNA, 25 bp, Mus musculus
ctaacagatgtactaccttgtggaa

SEQ ID NO: 366657 - DNA, 25 bp, Mus musculus
ctaacagatgtagtaccttgtggaa

SEQ ID NO: 366658 - DNA, 25 bp, Mus musculus
ctaacagatttcctcagcaggcctg

SEQ ID NO: 366659 - DNA, 25 bp, Mus musculus
ctaacagatttcgtcagcaggcctg

SEQ ID NO: 366660 - DNA, 25 bp, Mus musculus
ctaacagcactgattccgtctaaac

SEQ ID NO: 366661 - DNA, 25 bp, Mus musculus
ctaacagcactgtttccgtctaaac

SEQ ID NO: 366662 - DNA, 25 bp, Mus musculus
ctaacagcagtaaagggcagttctt

SEQ ID NO: 366663 - DNA, 25 bp, Mus musculus
ctaacagcagtatagggcagttctt

SEQ ID NO: 366664 - DNA, 25 bp, Mus musculus
ctaacagctagacgcctgtgcggac

SEQ ID NO: 366665 - DNA, 25 bp, Mus musculus
ctaacagctagaggcctgtgcggac

SEQ ID NO: 366666 - DNA, 25 bp, Mus musculus
ctaacaggaatcagctcactctact

SEQ ID NO: 366667 - DNA, 25 bp, Mus musculus
ctaacaggaatctgctcactctact

SEQ ID NO: 366668 - DNA, 25 bp, Mus musculus
ctaacaggacccaagtattttcatt

SEQ ID NO: 366669 - DNA, 25 bp, Mus musculus
ctaacaggaccctagtattttcatt

SEQ ID NO: 366670 - DNA, 25 bp, Mus musculus
ctaacaggagacataattattcaat

SEQ ID NO: 366671 - DNA, 25 bp, Mus musculus
ctaacaggagacttaattattcaat

SEQ ID NO: 366672 - DNA, 25 bp, Mus musculus
ctaacaggttcaaagctctgggttc

SEQ ID NO: 366673 - DNA, 25 bp, Mus musculus
ctaacaggttcatagctctgggttc

SEQ ID NO: 366674 - DNA, 25 bp, Mus musculus
ctaacaggttttcaatgccactaaa

SEQ ID NO: 366675 - DNA, 25 bp, Mus musculus
ctaacaggttttgaatgccactaaa

SEQ ID NO: 366676 - DNA, 25 bp, Mus musculus
ctaacagtcgtacttttataaagcg

SEQ ID NO: 366677 - DNA, 25 bp, Mus musculus
ctaacagtcgtagttttataaagcg

SEQ ID NO: 366678 - DNA, 25 bp, Mus musculus
ctaacagtcttccttgtgagtgaaa

SEQ ID NO: 366679 - DNA, 25 bp, Mus musculus
ctaacagtcttcgttgtgagtgaaa

SEQ ID NO: 366680 - DNA, 25 bp, Mus musculus
ctaacagtgtgtactggtcgggctc

SEQ ID NO: 366681 - DNA, 25 bp, Mus musculus
ctaacagtgtgttctggtcgggctc

SEQ ID NO: 366682 - DNA, 25 bp, Mus musculus
ctaacatcagcacggctggcgtcgt

SEQ ID NO: 366683 - DNA, 25 bp, Mus musculus
ctaacatcagcagggctggcgtcgt

SEQ ID NO: 366684 - DNA, 25 bp, Mus musculus
ctaacatcccacaacagtaaccttg

SEQ ID NO: 366685 - DNA, 25 bp, Mus musculus
ctaacatcccactacagtaaccttg

SEQ ID NO: 366686 - DNA, 25 bp, Mus musculus
ctaacatcttgtacacctcacaaaa

SEQ ID NO: 366687 - DNA, 25 bp, Mus musculus
ctaacatcttgttcacctcacaaaa

SEQ ID NO: 366688 - DNA, 25 bp, Mus musculus
ctaacattcactcggctaggtgtgc

SEQ ID NO: 366689 - DNA, 25 bp, Mus musculus
ctaacattcactgggctaggtgtgc

SEQ ID NO: 366690 - DNA, 25 bp, Mus musculus
ctaacatttgatatgccattgtgga

SEQ ID NO: 366691 - DNA, 25 bp, Mus musculus
ctaacatttgatttgccattgtgga

SEQ ID NO: 366692 - DNA, 25 bp, Mus musculus
ctaaccaaatacagcctcatgtctc

SEQ ID NO: 366693 - DNA, 25 bp, Mus musculus
ctaaccaaatactgcctcatgtctc

SEQ ID NO: 366694 - DNA, 25 bp, Mus musculus
ctaaccacttaactatctgtaatta

SEQ ID NO: 366695 - DNA, 25 bp, Mus musculus
ctaaccacttaagtatctgtaatta

SEQ ID NO: 366696 - DNA, 25 bp, Mus musculus
ctaaccagtcctagcttctggtgac

SEQ ID NO: 366697 - DNA, 25 bp, Mus musculus
ctaaccagtccttgcttctggtgac

SEQ ID NO: 366698 - DNA, 25 bp, Mus musculus
ctaaccagtgataaatgtgaccttg

SEQ ID NO: 366699 - DNA, 25 bp, Mus musculus
ctaaccagtgattaatgtgaccttg

SEQ ID NO: 366700 - DNA, 25 bp, Mus musculus
ctaaccagtggactttccgtctctg

SEQ ID NO: 366701 - DNA, 25 bp, Mus musculus
ctaaccagtggagtttccgtctctg

SEQ ID NO: 366702 - DNA, 25 bp, Mus musculus
ctaaccagttctccgtgaccaggca

SEQ ID NO: 366703 - DNA, 25 bp, Mus musculus
ctaaccagttctgcgtgaccaggca

SEQ ID NO: 366704 - DNA, 25 bp, Mus musculus
ctaaccatacaccagcattgcatca

SEQ ID NO: 366705 - DNA, 25 bp, Mus musculus
ctaaccatacacgagcattgcatca

SEQ ID NO: 366706 - DNA, 25 bp, Mus musculus
ctaaccatagaaacggctccctgag

SEQ ID NO: 366707 - DNA, 25 bp, Mus musculus
ctaaccatagaatcggctccctgag

SEQ ID NO: 366708 - DNA, 25 bp, Mus musculus
ctaaccattttcatactcttacctg

SEQ ID NO: 366709 - DNA, 25 bp, Mus musculus
ctaaccattttcttactcttacctg

SEQ ID NO: 366710 - DNA, 25 bp, Mus musculus
ctaaccccatctaactgcttatgat

SEQ ID NO: 366711 - DNA, 25 bp, Mus musculus
ctaaccccatcttactgcttatgat

SEQ ID NO: 366712 - DNA, 25 bp, Mus musculus
ctaaccctcaatatgcgcaagcatt

SEQ ID NO: 366713 - DNA, 25 bp, Mus musculus
ctaaccctcaatttgcgcaagcatt

SEQ ID NO: 366714 - DNA, 25 bp, Mus musculus
ctaaccctgattagtgggcttgtac

SEQ ID NO: 366715 - DNA, 25 bp, Mus musculus
ctaaccctgatttgtgggcttgtac

SEQ ID NO: 366716 - DNA, 25 bp, Mus musculus
ctaacccttcctacaatatggagcc

SEQ ID NO: 366717 - DNA, 25 bp, Mus musculus
ctaacccttccttcaatatggagcc

SEQ ID NO: 366718 - DNA, 25 bp, Mus musculus
ctaaccctttctaacaacactacag

SEQ ID NO: 366719 - DNA, 25 bp, Mus musculus
ctaaccctttcttacaacactacag

SEQ ID NO: 366720 - DNA, 25 bp, Mus musculus
ctaacccttttacgccaggctcatt

SEQ ID NO: 366721 - DNA, 25 bp, Mus musculus
ctaacccttttaggccaggctcatt

SEQ ID NO: 366722 - DNA, 25 bp, Mus musculus
ctaaccggttagcatatgacaaaat

SEQ ID NO: 366723 - DNA, 25 bp, Mus musculus
ctaaccggttaggatatgacaaaat

SEQ ID NO: 366724 - DNA, 25 bp, Mus musculus
ctaaccgtgcacaacattgcctatc

SEQ ID NO: 366725 - DNA, 25 bp, Mus musculus
ctaaccgtgcacacattatttctaa

SEQ ID NO: 366726 - DNA, 25 bp, Mus musculus
ctaaccgtgcactacattgcctatc

SEQ ID NO: 366727 - DNA, 25 bp, Mus musculus
ctaaccgtgcactcattatttctaa

SEQ ID NO: 366728 - DNA, 25 bp, Mus musculus
ctaacctacattactatgtgtgcat

SEQ ID NO: 366729 - DNA, 25 bp, Mus musculus
ctaacctacatttctatgtgtgcat

SEQ ID NO: 366730 - DNA, 25 bp, Mus musculus
ctaacctatctccatgtttctcata

SEQ ID NO: 366731 - DNA, 25 bp, Mus musculus
ctaacctatctcgatgtttctcata

SEQ ID NO: 366732 - DNA, 25 bp, Mus musculus
ctaacctcatctagaagcttcctca

SEQ ID NO: 366733 - DNA, 25 bp, Mus musculus
ctaacctcatcttgaagcttcctca

SEQ ID NO: 366734 - DNA, 25 bp, Mus musculus
ctaacctccagaatgggcccattta

SEQ ID NO: 366735 - DNA, 25 bp, Mus musculus
ctaacctccagattgggcccattta

SEQ ID NO: 366736 - DNA, 25 bp, Mus musculus
ctaacctctagaaagcacagctgct

SEQ ID NO: 366737 - DNA, 25 bp, Mus musculus
ctaacctctagatagcacagctgct

SEQ ID NO: 366738 - DNA, 25 bp, Mus musculus
ctaacctctgtgcagacatggacat

SEQ ID NO: 366739 - DNA, 25 bp, Mus musculus
ctaacctctgtggagacatggacat

SEQ ID NO: 366740 - DNA, 25 bp, Mus musculus
ctaacctgattgatgtgtggcctta

SEQ ID NO: 366741 - DNA, 25 bp, Mus musculus
ctaacctgattgttgtgtggcctta

SEQ ID NO: 366742 - DNA, 25 bp, Mus musculus
ctaacctgcctactaatcaaacttc

SEQ ID NO: 366743 - DNA, 25 bp, Mus musculus
ctaacctgcctagtaatcaaacttc

SEQ ID NO: 366744 - DNA, 25 bp, Mus musculus
ctaacctgctataagggtgcttcct

SEQ ID NO: 366745 - DNA, 25 bp, Mus musculus
ctaacctgctattagggtgcttcct

SEQ ID NO: 366746 - DNA, 25 bp, Mus musculus
ctaacctggactatgctgtcaagtg

SEQ ID NO: 366747 - DNA, 25 bp, Mus musculus
ctaacctggactttgctgtcaagtg

SEQ ID NO: 366748 - DNA, 25 bp, Mus musculus
ctaaccttagctacctgactcaaaa

SEQ ID NO: 366749 - DNA, 25 bp, Mus musculus
ctaaccttagcttcctgactcaaaa

SEQ ID NO: 366750 - DNA, 25 bp, Mus musculus
ctaaccttgctgacctggcagtgta

SEQ ID NO: 366751 - DNA, 25 bp, Mus musculus
ctaaccttgctgtcctggcagtgta

SEQ ID NO: 366752 - DNA, 25 bp, Mus musculus
ctaaccttttagattgtaccttcag

SEQ ID NO: 366753 - DNA, 25 bp, Mus musculus
ctaaccttttagtttgtaccttcag

SEQ ID NO: 366754 - DNA, 25 bp, Mus musculus
ctaaccttttgaagctgttttcatt

SEQ ID NO: 366755 - DNA, 25 bp, Mus musculus
ctaaccttttgatgctgttttcatt

SEQ ID NO: 366756 - DNA, 25 bp, Mus musculus
ctaacgaatctgcgacgtgcctaag

SEQ ID NO: 366757 - DNA, 25 bp, Mus musculus
ctaacgaatctgggacgtgcctaag

SEQ ID NO: 366758 - DNA, 25 bp, Mus musculus
ctaacgaatgggatgcttgctggga

SEQ ID NO: 366759 - DNA, 25 bp, Mus musculus
ctaacgaatgggttgcttgctggga

SEQ ID NO: 366760 - DNA, 25 bp, Mus musculus
ctaacgataggcactgaattactca

SEQ ID NO: 366761 - DNA, 25 bp, Mus musculus
ctaacgataggctctgaattactca

SEQ ID NO: 366762 - DNA, 25 bp, Mus musculus
ctaacggcttgaagccccagcatag

SEQ ID NO: 366763 - DNA, 25 bp, Mus musculus
ctaacggcttgatgccccagcatag

SEQ ID NO: 366764 - DNA, 25 bp, Mus musculus
ctaacgtgccgaagtcaggtgacca

SEQ ID NO: 366765 - DNA, 25 bp, Mus musculus
ctaacgtgccgatgtcaggtgacca

SEQ ID NO: 366766 - DNA, 25 bp, Mus musculus
ctaacgttctggagcttttcatata

SEQ ID NO: 366767 - DNA, 25 bp, Mus musculus
ctaacgttctggtgcttttcatata

SEQ ID NO: 366768 - DNA, 25 bp, Mus musculus
ctaactaactcaactgcagctcagt

SEQ ID NO: 366769 - DNA, 25 bp, Mus musculus
ctaactaactcatctgcagctcagt

SEQ ID NO: 366770 - DNA, 25 bp, Mus musculus
ctaactagctttctgtgacggtgga

SEQ ID NO: 366771 - DNA, 25 bp, Mus musculus
ctaactagctttgtgtgacggtgga

SEQ ID NO: 366772 - DNA, 25 bp, Mus musculus
ctaactaggctgatgcacagtgcaa

SEQ ID NO: 366773 - DNA, 25 bp, Mus musculus
ctaactaggctgttgcacagtgcaa

SEQ ID NO: 366774 - DNA, 25 bp, Mus musculus
ctaactaggtcaacctggacgacag

SEQ ID NO: 366775 - DNA, 25 bp, Mus musculus
ctaactaggtcatcctggacgacag

SEQ ID NO: 366776 - DNA, 25 bp, Mus musculus
ctaactatccatattacttctgtaa

SEQ ID NO: 366777 - DNA, 25 bp, Mus musculus
ctaactatccattttacttctgtaa

SEQ ID NO: 366778 - DNA, 25 bp, Mus musculus
ctaactatgtggaggaagactattc

SEQ ID NO: 366779 - DNA, 25 bp, Mus musculus
ctaactatgtggtggaagactattc

SEQ ID NO: 366780 - DNA, 25 bp, Mus musculus
ctaactattacaataggcaggcact

SEQ ID NO: 366781 - DNA, 25 bp, Mus musculus
ctaactattacattaggcaggcact

SEQ ID NO: 366782 - DNA, 25 bp, Mus musculus
ctaactcaccccagtcattaaagat

SEQ ID NO: 366783 - DNA, 25 bp, Mus musculus
ctaactcacccctgtcattaaagat

SEQ ID NO: 366784 - DNA, 25 bp, Mus musculus
ctaactcactgacactctgcagaca

SEQ ID NO: 366785 - DNA, 25 bp, Mus musculus
ctaactcactgagactctgcagaca

SEQ ID NO: 366786 - DNA, 25 bp, Mus musculus
ctaactcagaacagttagaggcttc

SEQ ID NO: 366787 - DNA, 25 bp, Mus musculus
ctaactcagaactgttagaggcttc

SEQ ID NO: 366788 - DNA, 25 bp, Mus musculus
ctaactcatctgacttaatatgcat

SEQ ID NO: 366789 - DNA, 25 bp, Mus musculus
ctaactcatctgtcttaatatgcat

SEQ ID NO: 366790 - DNA, 25 bp, Mus musculus
ctaactcatgctcggatgcaccctg

SEQ ID NO: 366791 - DNA, 25 bp, Mus musculus
ctaactcatgctgggatgcaccctg

SEQ ID NO: 366792 - DNA, 25 bp, Mus musculus
ctaactccaaggagctgtttcttag

SEQ ID NO: 366793 - DNA, 25 bp, Mus musculus
ctaactccaaggtgctgtttcttag

SEQ ID NO: 366794 - DNA, 25 bp, Mus musculus
ctaactccagtgctatttatgtaag

SEQ ID NO: 366795 - DNA, 25 bp, Mus musculus
ctaactccagtggtatttatgtaag

SEQ ID NO: 366796 - DNA, 25 bp, Mus musculus
ctaactccagttatatgattaccta

SEQ ID NO: 366797 - DNA, 25 bp, Mus musculus
ctaactccagttttatgattaccta

SEQ ID NO: 366798 - DNA, 25 bp, Mus musculus
ctaactcccaccatgtagaacttga

SEQ ID NO: 366799 - DNA, 25 bp, Mus musculus
ctaactcccaccttgtagaacttga

SEQ ID NO: 366800 - DNA, 25 bp, Mus musculus
ctaactcccaggctaataatcttaa

SEQ ID NO: 366801 - DNA, 25 bp, Mus musculus
ctaactcccagggtaataatcttaa

SEQ ID NO: 366802 - DNA, 25 bp, Mus musculus
ctaactcccgttaagagactgcagc

SEQ ID NO: 366803 - DNA, 25 bp, Mus musculus
ctaactcccgtttagagactgcagc

SEQ ID NO: 366804 - DNA, 25 bp, Mus musculus
ctaactcctaatcctatccacaggg

SEQ ID NO: 366805 - DNA, 25 bp, Mus musculus
ctaactcctaatgctatccacaggg

SEQ ID NO: 366806 - DNA, 25 bp, Mus musculus
ctaactcctacaattctccattgga

SEQ ID NO: 366807 - DNA, 25 bp, Mus musculus
ctaactcctacatttctccattgga

SEQ ID NO: 366808 - DNA, 25 bp, Mus musculus
ctaactctactgagaagtcccacca

SEQ ID NO: 366809 - DNA, 25 bp, Mus musculus
ctaactctactgtgaagtcccacca

SEQ ID NO: 366810 - DNA, 25 bp, Mus musculus
ctaactctacttaccaaccatattg

SEQ ID NO: 366811 - DNA, 25 bp, Mus musculus
ctaactctactttccaaccatattg

SEQ ID NO: 366812 - DNA, 25 bp, Mus musculus
ctaactctagtccagagaccagtgt

SEQ ID NO: 366813 - DNA, 25 bp, Mus musculus
ctaactctagtcgagagaccagtgt

SEQ ID NO: 366814 - DNA, 25 bp, Mus musculus
ctaactctcatgactggctttttaa

SEQ ID NO: 366815 - DNA, 25 bp, Mus musculus
ctaactctcatgtctggctttttaa

SEQ ID NO: 366816 - DNA, 25 bp, Mus musculus
ctaactctctggagtcgtggttata

SEQ ID NO: 366817 - DNA, 25 bp, Mus musculus
ctaactctctggtgtcgtggttata

SEQ ID NO: 366818 - DNA, 25 bp, Mus musculus
ctaactcttgtcacaaattcaacta

SEQ ID NO: 366819 - DNA, 25 bp, Mus musculus
ctaactcttgtctcaaattcaacta

SEQ ID NO: 366820 - DNA, 25 bp, Mus musculus
ctaactctttatctgtttgttgaga

SEQ ID NO: 366821 - DNA, 25 bp, Mus musculus
ctaactctttatgtgtttgttgaga

SEQ ID NO: 366822 - DNA, 25 bp, Mus musculus
ctaactgaacaactgatctctcaaa

SEQ ID NO: 366823 - DNA, 25 bp, Mus musculus
ctaactgaacaagtgatctctcaaa

SEQ ID NO: 366824 - DNA, 25 bp, Mus musculus
ctaactgaacagaggctagggagaa

SEQ ID NO: 366825 - DNA, 25 bp, Mus musculus
ctaactgaacagtggctagggagaa

SEQ ID NO: 366826 - DNA, 25 bp, Mus musculus
ctaactgaagcactttgagaacact

SEQ ID NO: 366827 - DNA, 25 bp, Mus musculus
ctaactgaagcagtttgagaacact

SEQ ID NO: 366828 - DNA, 25 bp, Mus musculus
ctaactgactacaggcaaagactgg

SEQ ID NO: 366829 - DNA, 25 bp, Mus musculus
ctaactgactactggcaaagactgg

SEQ ID NO: 366830 - DNA, 25 bp, Mus musculus
ctaactgactgtagcatagggctgt

SEQ ID NO: 366831 - DNA, 25 bp, Mus musculus
ctaactgactgttgcatagggctgt

SEQ ID NO: 366832 - DNA, 25 bp, Mus musculus
ctaactgatgtgcagctgggaagct

SEQ ID NO: 366833 - DNA, 25 bp, Mus musculus
ctaactgatgtggagctgggaagct

SEQ ID NO: 366834 - DNA, 25 bp, Mus musculus
ctaactgcattaacatcccactgat

SEQ ID NO: 366835 - DNA, 25 bp, Mus musculus
ctaactgcattatcatcccactgat

SEQ ID NO: 366836 - DNA, 25 bp, Mus musculus
ctaactgctagcaagcctcagagat

SEQ ID NO: 366837 - DNA, 25 bp, Mus musculus
ctaactgctagctagcctcagagat

SEQ ID NO: 366838 - DNA, 25 bp, Mus musculus
ctaactgctcctacagagatataca

SEQ ID NO: 366839 - DNA, 25 bp, Mus musculus
ctaactgctccttcagagatataca

SEQ ID NO: 366840 - DNA, 25 bp, Mus musculus
ctaactgctttgactctgtaaaatg

SEQ ID NO: 366841 - DNA, 25 bp, Mus musculus
ctaactgctttgtctctgtaaaatg

SEQ ID NO: 366842 - DNA, 25 bp, Mus musculus
ctaactgggttgctatggactactg

SEQ ID NO: 366843 - DNA, 25 bp, Mus musculus
ctaactgggttggtatggactactg

SEQ ID NO: 366844 - DNA, 25 bp, Mus musculus
ctaactggtttgctgctgcctaagt

SEQ ID NO: 366845 - DNA, 25 bp, Mus musculus
ctaactggtttggtgctgcctaagt

SEQ ID NO: 366846 - DNA, 25 bp, Mus musculus
ctaactgtaactcagcaactgtaaa

SEQ ID NO: 366847 - DNA, 25 bp, Mus musculus
ctaactgtaactgagcaactgtaaa

SEQ ID NO: 366848 - DNA, 25 bp, Mus musculus
ctaactgtattgaaatgctggtgac

SEQ ID NO: 366849 - DNA, 25 bp, Mus musculus
ctaactgtattgtaatgctggtgac

SEQ ID NO: 366850 - DNA, 25 bp, Mus musculus
ctaactgtcgataggagctgcctaa

SEQ ID NO: 366851 - DNA, 25 bp, Mus musculus
ctaactgtcgattggagctgcctaa

SEQ ID NO: 366852 - DNA, 25 bp, Mus musculus
ctaactgtgcttagtttgccgagca

SEQ ID NO: 366853 - DNA, 25 bp, Mus musculus
ctaactgtgctttgtttgccgagca

SEQ ID NO: 366854 - DNA, 25 bp, Mus musculus
ctaactgttagaatgctgggcttca

SEQ ID NO: 366855 - DNA, 25 bp, Mus musculus
ctaactgttagattgctgggcttca

SEQ ID NO: 366856 - DNA, 25 bp, Mus musculus
ctaacttaaaacagtgtttctggat

SEQ ID NO: 366857 - DNA, 25 bp, Mus musculus
ctaacttaaaactgtgtttctggat

SEQ ID NO: 366858 - DNA, 25 bp, Mus musculus
ctaacttactcaacgtgaacaggat

SEQ ID NO: 366859 - DNA, 25 bp, Mus musculus
ctaacttactcatcgtgaacaggat

SEQ ID NO: 366860 - DNA, 25 bp, Mus musculus
ctaacttcactgagtgtaggcgttt

SEQ ID NO: 366861 - DNA, 25 bp, Mus musculus
ctaacttcactgtgtgtaggcgttt

SEQ ID NO: 366862 - DNA, 25 bp, Mus musculus
ctaacttcctaaccgaaagcacagg

SEQ ID NO: 366863 - DNA, 25 bp, Mus musculus
ctaacttcctaagcgaaagcacagg

SEQ ID NO: 366864 - DNA, 25 bp, Mus musculus
ctaacttgagtaatcctgtaggtga

SEQ ID NO: 366865 - DNA, 25 bp, Mus musculus
ctaacttgagtattcctgtaggtga

SEQ ID NO: 366866 - DNA, 25 bp, Mus musculus
ctaacttgcaacctgtgacagccag

SEQ ID NO: 366867 - DNA, 25 bp, Mus musculus
ctaacttgcaacgtgtgacagccag

SEQ ID NO: 366868 - DNA, 25 bp, Mus musculus
ctaacttgcaatctcatgtccttat

SEQ ID NO: 366869 - DNA, 25 bp, Mus musculus
ctaacttgcaatgtcatgtccttat

SEQ ID NO: 366870 - DNA, 25 bp, Mus musculus
ctaactttaatccacattcctgtgt

SEQ ID NO: 366871 - DNA, 25 bp, Mus musculus
ctaactttaatcgacattcctgtgt

SEQ ID NO: 366872 - DNA, 25 bp, Mus musculus
ctaactttagacactttggcatata

SEQ ID NO: 366873 - DNA, 25 bp, Mus musculus
ctaactttagactctttggcatata

SEQ ID NO: 366874 - DNA, 25 bp, Mus musculus
ctaactttagtacgtgctgagcttt

SEQ ID NO: 366875 - DNA, 25 bp, Mus musculus
ctaactttagtaggtgctgagcttt

SEQ ID NO: 366876 - DNA, 25 bp, Mus musculus
ctaactttctgtccaaaagcagtaa

SEQ ID NO: 366877 - DNA, 25 bp, Mus musculus
ctaactttctgtgcaaaagcagtaa

SEQ ID NO: 366878 - DNA, 25 bp, Mus musculus
ctaactttgcctcctggtgtacttt

SEQ ID NO: 366879 - DNA, 25 bp, Mus musculus
ctaactttgcctgctggtgtacttt

SEQ ID NO: 366880 - DNA, 25 bp, Mus musculus
ctaactttgggacggcagctttaat

SEQ ID NO: 366881 - DNA, 25 bp, Mus musculus
ctaactttgggagggcagctttaat

SEQ ID NO: 366882 - DNA, 25 bp, Mus musculus
ctaactttgttcaggtgaggcacat

SEQ ID NO: 366883 - DNA, 25 bp, Mus musculus
ctaactttgttctggtgaggcacat

SEQ ID NO: 366884 - DNA, 25 bp, Mus musculus
ctaacttttgtgatggtgcgagcaa

SEQ ID NO: 366885 - DNA, 25 bp, Mus musculus
ctaacttttgtgttggtgcgagcaa

SEQ ID NO: 366886 - DNA, 25 bp, Mus musculus
ctaagaaagtggagggagacatgta

SEQ ID NO: 366887 - DNA, 25 bp, Mus musculus
ctaagaaagtggtgggagacatgta

SEQ ID NO: 366888 - DNA, 25 bp, Mus musculus
ctaagaacccagagccccagaagac

SEQ ID NO: 366889 - DNA, 25 bp, Mus musculus
ctaagaacccagtgccccagaagac

SEQ ID NO: 366890 - DNA, 25 bp, Mus musculus
ctaagaacgtttacagagctgggaa

SEQ ID NO: 366891 - DNA, 25 bp, Mus musculus
ctaagaacgttttcagagctgggaa

SEQ ID NO: 366892 - DNA, 25 bp, Mus musculus
ctaagaactactcgcccatgaaaga

SEQ ID NO: 366893 - DNA, 25 bp, Mus musculus
ctaagaactactggcccatgaaaga

SEQ ID NO: 366894 - DNA, 25 bp, Mus musculus
ctaagaactgtgattggagcccatg

SEQ ID NO: 366895 - DNA, 25 bp, Mus musculus
ctaagaactgtgtttggagcccatg

SEQ ID NO: 366896 - DNA, 25 bp, Mus musculus
ctaagaagcctcaggagttatccaa

SEQ ID NO: 366897 - DNA, 25 bp, Mus musculus
ctaagaagcctctggagttatccaa

SEQ ID NO: 366898 - DNA, 25 bp, Mus musculus
ctaagaagctcacttttgcggtttt

SEQ ID NO: 366899 - DNA, 25 bp, Mus musculus
ctaagaagctcagttttgcggtttt

SEQ ID NO: 366900 - DNA, 25 bp, Mus musculus
ctaagaagtcaacccagggctggtt

SEQ ID NO: 366901 - DNA, 25 bp, Mus musculus
ctaagaagtcaagccagggctggtt

SEQ ID NO: 366902 - DNA, 25 bp, Mus musculus
ctaagaatcaccacagaacacgctg

SEQ ID NO: 366903 - DNA, 25 bp, Mus musculus
ctaagaatcacctcagaacacgctg

SEQ ID NO: 366904 - DNA, 25 bp, Mus musculus
ctaagaatctgtcggcgctctgact

SEQ ID NO: 366905 - DNA, 25 bp, Mus musculus
ctaagaatctgtgggcgctctgact

SEQ ID NO: 366906 - DNA, 25 bp, Mus musculus
ctaagaatggaaaaggtgaccctac

SEQ ID NO: 366907 - DNA, 25 bp, Mus musculus
ctaagaatggaataggtgaccctac

SEQ ID NO: 366908 - DNA, 25 bp, Mus musculus
ctaagaatggccagtgtccctgatt

SEQ ID NO: 366909 - DNA, 25 bp, Mus musculus
ctaagaatggcctgtgtccctgatt

SEQ ID NO: 366910 - DNA, 25 bp, Mus musculus
ctaagaattcagaatgcacccctct

SEQ ID NO: 366911 - DNA, 25 bp, Mus musculus
ctaagaattcagtatgcacccctct

SEQ ID NO: 366912 - DNA, 25 bp, Mus musculus
ctaagacaccctccattgtttgttc

SEQ ID NO: 366913 - DNA, 25 bp, Mus musculus
ctaagacaccctgcattgtttgttc

SEQ ID NO: 366914 - DNA, 25 bp, Mus musculus
ctaagacacctgagcttctgtgacc

SEQ ID NO: 366915 - DNA, 25 bp, Mus musculus
ctaagacacctgtgcttctgtgacc

SEQ ID NO: 366916 - DNA, 25 bp, Mus musculus
ctaagacatcgtcagctggtttgaa

SEQ ID NO: 366917 - DNA, 25 bp, Mus musculus
ctaagacatcgtgagctggtttgaa

SEQ ID NO: 366918 - DNA, 25 bp, Mus musculus
ctaagacatcttctgatagtaagga

SEQ ID NO: 366919 - DNA, 25 bp, Mus musculus
ctaagacatcttgtgatagtaagga

SEQ ID NO: 366920 - DNA, 25 bp, Mus musculus
ctaagacatgcactgggacgtggaa

SEQ ID NO: 366921 - DNA, 25 bp, Mus musculus
ctaagacatgcagtgggacgtggaa

SEQ ID NO: 366922 - DNA, 25 bp, Mus musculus
ctaagacgataaccagcgcttccat

SEQ ID NO: 366923 - DNA, 25 bp, Mus musculus
ctaagacgataagcagcgcttccat

SEQ ID NO: 366924 - DNA, 25 bp, Mus musculus
ctaagactcacacggtatggccagg

SEQ ID NO: 366925 - DNA, 25 bp, Mus musculus
ctaagactcacagggtatggccagg

SEQ ID NO: 366926 - DNA, 25 bp, Mus musculus
ctaagactgggtccttgacatggct

SEQ ID NO: 366927 - DNA, 25 bp, Mus musculus
ctaagactgggtgcttgacatggct

SEQ ID NO: 366928 - DNA, 25 bp, Mus musculus
ctaagacttgccactagagctgagc

SEQ ID NO: 366929 - DNA, 25 bp, Mus musculus
ctaagacttgcctctagagctgagc

SEQ ID NO: 366930 - DNA, 25 bp, Mus musculus
ctaagagacatcctgtttcccatct

SEQ ID NO: 366931 - DNA, 25 bp, Mus musculus
ctaagagacatcgtgtttcccatct

SEQ ID NO: 366932 - DNA, 25 bp, Mus musculus
ctaagagagcaaagcccagacatta

SEQ ID NO: 366933 - DNA, 25 bp, Mus musculus
ctaagagagcaatgcccagacatta

SEQ ID NO: 366934 - DNA, 25 bp, Mus musculus
ctaagagatgatccgacttctgcct

SEQ ID NO: 366935 - DNA, 25 bp, Mus musculus
ctaagagatgatgcgacttctgcct

SEQ ID NO: 366936 - DNA, 25 bp, Mus musculus
ctaagagccaccaaaactgctcggg

SEQ ID NO: 366937 - DNA, 25 bp, Mus musculus
ctaagagccacctaaactgctcggg

SEQ ID NO: 366938 - DNA, 25 bp, Mus musculus
ctaagagccgagatagcttcctgaa

SEQ ID NO: 366939 - DNA, 25 bp, Mus musculus
ctaagagccgagttagcttcctgaa

SEQ ID NO: 366940 - DNA, 25 bp, Mus musculus
ctaagagctaatcctgtacatggct

SEQ ID NO: 366941 - DNA, 25 bp, Mus musculus
ctaagagctaatgctgtacatggct

SEQ ID NO: 366942 - DNA, 25 bp, Mus musculus
ctaagagctcatcttttccagatcg

SEQ ID NO: 366943 - DNA, 25 bp, Mus musculus
ctaagagctcatgttttccagatcg

SEQ ID NO: 366944 - DNA, 25 bp, Mus musculus
ctaagagcttgtctttattccagcc

SEQ ID NO: 366945 - DNA, 25 bp, Mus musculus
ctaagagcttgtgtttattccagcc

SEQ ID NO: 366946 - DNA, 25 bp, Mus musculus
ctaagaggaattccccaaggtttct

SEQ ID NO: 366947 - DNA, 25 bp, Mus musculus
ctaagaggaattgcccaaggtttct

SEQ ID NO: 366948 - DNA, 25 bp, Mus musculus
ctaagagggctaaccagactggtga

SEQ ID NO: 366949 - DNA, 25 bp, Mus musculus
ctaagagggctatccagactggtga

SEQ ID NO: 366950 - DNA, 25 bp, Mus musculus
ctaagagggtgtacgctgaaggatt

SEQ ID NO: 366951 - DNA, 25 bp, Mus musculus
ctaagagggtgttcgctgaaggatt

SEQ ID NO: 366952 - DNA, 25 bp, Mus musculus
ctaagagggtttactgagcacttca

SEQ ID NO: 366953 - DNA, 25 bp, Mus musculus
ctaagagggttttctgagcacttca

SEQ ID NO: 366954 - DNA, 25 bp, Mus musculus
ctaagaggttaactgtgcaactata

SEQ ID NO: 366955 - DNA, 25 bp, Mus musculus
ctaagaggttaagtgtgcaactata

SEQ ID NO: 366956 - DNA, 25 bp, Mus musculus
ctaagagtacccagcttgtcagcag

SEQ ID NO: 366957 - DNA, 25 bp, Mus musculus
ctaagagtaccctgcttgtcagcag

SEQ ID NO: 366958 - DNA, 25 bp, Mus musculus
ctaagagtccctagaggtttagcta

SEQ ID NO: 366959 - DNA, 25 bp, Mus musculus
ctaagagtcccttgaggtttagcta

SEQ ID NO: 366960 - DNA, 25 bp, Mus musculus
ctaagagtcttgacaccaactgtaa

SEQ ID NO: 366961 - DNA, 25 bp, Mus musculus
ctaagagtcttgtcaccaactgtaa

SEQ ID NO: 366962 - DNA, 25 bp, Mus musculus
ctaagagtgagcatcccggtttgta

SEQ ID NO: 366963 - DNA, 25 bp, Mus musculus
ctaagagtgagcttcccggtttgta

SEQ ID NO: 366964 - DNA, 25 bp, Mus musculus
ctaagagtgagtacgtgagttccag

SEQ ID NO: 366965 - DNA, 25 bp, Mus musculus
ctaagagtgagttcgtgagttccag

SEQ ID NO: 366966 - DNA, 25 bp, Mus musculus
ctaagagtgcttagctattttcccc

SEQ ID NO: 366967 - DNA, 25 bp, Mus musculus
ctaagagtgctttgctattttcccc

SEQ ID NO: 366968 - DNA, 25 bp, Mus musculus
ctaagagtgttcagtttattgcaga

SEQ ID NO: 366969 - DNA, 25 bp, Mus musculus
ctaagagtgttctgtttattgcaga

SEQ ID NO: 366970 - DNA, 25 bp, Mus musculus
ctaagagttgctatctctcgttttg

SEQ ID NO: 366971 - DNA, 25 bp, Mus musculus
ctaagagttgctttctctcgttttg

SEQ ID NO: 366972 - DNA, 25 bp, Mus musculus
ctaagatatctcaaaggcgctttat

SEQ ID NO: 366973 - DNA, 25 bp, Mus musculus
ctaagatatctctaaggcgctttat

SEQ ID NO: 366974 - DNA, 25 bp, Mus musculus
ctaagatctctgcaacctggacaat

SEQ ID NO: 366975 - DNA, 25 bp, Mus musculus
ctaagatctctggaacctggacaat

SEQ ID NO: 366976 - DNA, 25 bp, Mus musculus
ctaagatgaaggcactttctccctg

SEQ ID NO: 366977 - DNA, 25 bp, Mus musculus
ctaagatgaagggactttctccctg

SEQ ID NO: 366978 - DNA, 25 bp, Mus musculus
ctaagatggcgcacggcctggcctg

SEQ ID NO: 366979 - DNA, 25 bp, Mus musculus
ctaagatggcgctcggcctggcctg

SEQ ID NO: 366980 - DNA, 25 bp, Mus musculus
ctaagattaaaaattcacagtgact

SEQ ID NO: 366981 - DNA, 25 bp, Mus musculus
ctaagattaaaatttcacagtgact

SEQ ID NO: 366982 - DNA, 25 bp, Mus musculus
ctaagattccttcgcagcgtttgac

SEQ ID NO: 366983 - DNA, 25 bp, Mus musculus
ctaagattccttggcagcgtttgac

SEQ ID NO: 366984 - DNA, 25 bp, Mus musculus
ctaagattgtccatgtagacaaacc

SEQ ID NO: 366985 - DNA, 25 bp, Mus musculus
ctaagattgtccttgtagacaaacc

SEQ ID NO: 366986 - DNA, 25 bp, Mus musculus
ctaagcaactgcacgggtacaaggt

SEQ ID NO: 366987 - DNA, 25 bp, Mus musculus
ctaagcaactgctcgggtacaaggt

SEQ ID NO: 366988 - DNA, 25 bp, Mus musculus
ctaagcaagaggctgccatcactgt

SEQ ID NO: 366989 - DNA, 25 bp, Mus musculus
ctaagcaagagggtgccatcactgt

SEQ ID NO: 366990 - DNA, 25 bp, Mus musculus
ctaagcaaggctaatgtaggccaga

SEQ ID NO: 366991 - DNA, 25 bp, Mus musculus
ctaagcaaggcttatgtaggccaga

SEQ ID NO: 366992 - DNA, 25 bp, Mus musculus
ctaagcaagtctactgtggaaaaat

SEQ ID NO: 366993 - DNA, 25 bp, Mus musculus
ctaagcaagtcttctgtggaaaaat

SEQ ID NO: 366994 - DNA, 25 bp, Mus musculus
ctaagcaatctcatttgatgcctct

SEQ ID NO: 366995 - DNA, 25 bp, Mus musculus
ctaagcaatctcttttgatgcctct

SEQ ID NO: 366996 - DNA, 25 bp, Mus musculus
ctaagcactgagaggttgcctggaa

SEQ ID NO: 366997 - DNA, 25 bp, Mus musculus
ctaagcactgagtggttgcctggaa

SEQ ID NO: 366998 - DNA, 25 bp, Mus musculus
ctaagcactgggagtgagcgactgt

SEQ ID NO: 366999 - DNA, 25 bp, Mus musculus
ctaagcactgggtgtgagcgactgt

SEQ ID NO: 367000 - DNA, 25 bp, Mus musculus
ctaagcagaacacagcagctgaaga

SEQ ID NO: 367001 - DNA, 25 bp, Mus musculus
ctaagcagaacagagcagctgaaga

SEQ ID NO: 367002 - DNA, 25 bp, Mus musculus
ctaagcagcagcaatgggtggagat

SEQ ID NO: 367003 - DNA, 25 bp, Mus musculus
ctaagcagcagctatgggtggagat

SEQ ID NO: 367004 - DNA, 25 bp, Mus musculus
ctaagcagtagtcaagtccttggta

SEQ ID NO: 367005 - DNA, 25 bp, Mus musculus
ctaagcagtagtgaagtccttggta

SEQ ID NO: 367006 - DNA, 25 bp, Mus musculus
ctaagcatacaaagggccccgtgtt

SEQ ID NO: 367007 - DNA, 25 bp, Mus musculus
ctaagcatacaatgggccccgtgtt

SEQ ID NO: 367008 - DNA, 25 bp, Mus musculus
ctaagcatcaccaaggacgtttaat

SEQ ID NO: 367009 - DNA, 25 bp, Mus musculus
ctaagcatcacctaggacgtttaat

SEQ ID NO: 367010 - DNA, 25 bp, Mus musculus
ctaagcatctgaaccatggctgatt

SEQ ID NO: 367011 - DNA, 25 bp, Mus musculus
ctaagcatctgatccatggctgatt

SEQ ID NO: 367012 - DNA, 25 bp, Mus musculus
ctaagccaaggtaggccagccaact

SEQ ID NO: 367013 - DNA, 25 bp, Mus musculus
ctaagccaaggttggccagccaact

SEQ ID NO: 367014 - DNA, 25 bp, Mus musculus
ctaagccagctgaagggtctcgtat

SEQ ID NO: 367015 - DNA, 25 bp, Mus musculus
ctaagccagctgtagggtctcgtat

SEQ ID NO: 367016 - DNA, 25 bp, Mus musculus
ctaagccatctaaccagaccaaaat

SEQ ID NO: 367017 - DNA, 25 bp, Mus musculus
ctaagccatctatccagaccaaaat

SEQ ID NO: 367018 - DNA, 25 bp, Mus musculus
ctaagccatttcagtcatctctagg

SEQ ID NO: 367019 - DNA, 25 bp, Mus musculus
ctaagccatttctgtcatctctagg

SEQ ID NO: 367020 - DNA, 25 bp, Mus musculus
ctaagccccttgaagatccttcttt

SEQ ID NO: 367021 - DNA, 25 bp, Mus musculus
ctaagccccttgtagatccttcttt

SEQ ID NO: 367022 - DNA, 25 bp, Mus musculus
ctaagcccggaacccgagttatcag

SEQ ID NO: 367023 - DNA, 25 bp, Mus musculus
ctaagcccggaagccgagttatcag

SEQ ID NO: 367024 - DNA, 25 bp, Mus musculus
ctaagcccttagatggtcagtatga

SEQ ID NO: 367025 - DNA, 25 bp, Mus musculus
ctaagcccttagttggtcagtatga

SEQ ID NO: 367026 - DNA, 25 bp, Mus musculus
ctaagcccttggaagccacgtgtgg

SEQ ID NO: 367027 - DNA, 25 bp, Mus musculus
ctaagcccttggtagccacgtgtgg

SEQ ID NO: 367028 - DNA, 25 bp, Mus musculus
ctaagccgacgacttgagaaacact

SEQ ID NO: 367029 - DNA, 25 bp, Mus musculus
ctaagccgacgagttgagaaacact

SEQ ID NO: 367030 - DNA, 25 bp, Mus musculus
ctaagcctaagaaggatggagcctc

SEQ ID NO: 367031 - DNA, 25 bp, Mus musculus
ctaagcctaagatggatggagcctc

SEQ ID NO: 367032 - DNA, 25 bp, Mus musculus
ctaagcctacctagttgtggataaa

SEQ ID NO: 367033 - DNA, 25 bp, Mus musculus
ctaagcctaccttgttgtggataaa

SEQ ID NO: 367034 - DNA, 25 bp, Mus musculus
ctaagcctccggaagtggctgtttt

SEQ ID NO: 367035 - DNA, 25 bp, Mus musculus
ctaagcctccggtagtggctgtttt

SEQ ID NO: 367036 - DNA, 25 bp, Mus musculus
ctaagcctctatcccatgccaaaag

SEQ ID NO: 367037 - DNA, 25 bp, Mus musculus
ctaagcctctatgccatgccaaaag

SEQ ID NO: 367038 - DNA, 25 bp, Mus musculus
ctaagcctggagctgtcccatgagg

SEQ ID NO: 367039 - DNA, 25 bp, Mus musculus
ctaagcctggaggtgtcccatgagg

SEQ ID NO: 367040 - DNA, 25 bp, Mus musculus
ctaagccttaggagttgtggcaaga

SEQ ID NO: 367041 - DNA, 25 bp, Mus musculus
ctaagccttaggtgttgtggcaaga

SEQ ID NO: 367042 - DNA, 25 bp, Mus musculus
ctaagcgacagcagccccgcagctg

SEQ ID NO: 367043 - DNA, 25 bp, Mus musculus
ctaagcgacagctgccccgcagctg

SEQ ID NO: 367044 - DNA, 25 bp, Mus musculus
ctaagcgaggaacactaacccaatg

SEQ ID NO: 367045 - DNA, 25 bp, Mus musculus
ctaagcgaggaagactaacccaatg

SEQ ID NO: 367046 - DNA, 25 bp, Mus musculus
ctaagcgagggccatgctgagcttc

SEQ ID NO: 367047 - DNA, 25 bp, Mus musculus
ctaagcgagggcgatgctgagcttc

SEQ ID NO: 367048 - DNA, 25 bp, Mus musculus
ctaagcgcccttcggtcagggaaga

SEQ ID NO: 367049 - DNA, 25 bp, Mus musculus
ctaagcgcccttgggtcagggaaga

SEQ ID NO: 367050 - DNA, 25 bp, Mus musculus
ctaagcggaccaattgtgaagcgat

SEQ ID NO: 367051 - DNA, 25 bp, Mus musculus
ctaagcggaccatttgtgaagcgat

SEQ ID NO: 367052 - DNA, 25 bp, Mus musculus
ctaagcgtcctccacactggagaga

SEQ ID NO: 367053 - DNA, 25 bp, Mus musculus
ctaagcgtcctcgacactggagaga

SEQ ID NO: 367054 - DNA, 25 bp, Mus musculus
ctaagctagctgacctttatctggg

SEQ ID NO: 367055 - DNA, 25 bp, Mus musculus
ctaagctagctgtcctttatctggg

SEQ ID NO: 367056 - DNA, 25 bp, Mus musculus
ctaagctcactgatgatagactatc

SEQ ID NO: 367057 - DNA, 25 bp, Mus musculus
ctaagctcactgttgatagactatc

SEQ ID NO: 367058 - DNA, 25 bp, Mus musculus
ctaagctcagagaagcatgccacaa

SEQ ID NO: 367059 - DNA, 25 bp, Mus musculus
ctaagctcagagtagcatgccacaa

SEQ ID NO: 367060 - DNA, 25 bp, Mus musculus
ctaagctcagcccattcagtctttc

SEQ ID NO: 367061 - DNA, 25 bp, Mus musculus
ctaagctcagccgattcagtctttc

SEQ ID NO: 367062 - DNA, 25 bp, Mus musculus
ctaagctcctggatcgagatgcgaa

SEQ ID NO: 367063 - DNA, 25 bp, Mus musculus
ctaagctcctggttcgagatgcgaa

SEQ ID NO: 367064 - DNA, 25 bp, Mus musculus
ctaagctgaatgatgcaaaggcaag

SEQ ID NO: 367065 - DNA, 25 bp, Mus musculus
ctaagctgaatgttgcaaaggcaag

SEQ ID NO: 367066 - DNA, 25 bp, Mus musculus
ctaagctgagtaaatattgccaatt

SEQ ID NO: 367067 - DNA, 25 bp, Mus musculus
ctaagctgagtatatattgccaatt

SEQ ID NO: 367068 - DNA, 25 bp, Mus musculus
ctaagctgtaatctacgggaagaac

SEQ ID NO: 367069 - DNA, 25 bp, Mus musculus
ctaagctgtaatgtacgggaagaac

SEQ ID NO: 367070 - DNA, 25 bp, Mus musculus
ctaagctgtactcggcaagcctggc

SEQ ID NO: 367071 - DNA, 25 bp, Mus musculus
ctaagctgtactgggcaagcctggc

SEQ ID NO: 367072 - DNA, 25 bp, Mus musculus
ctaagctgtgagcttctaagaggtc

SEQ ID NO: 367073 - DNA, 25 bp, Mus musculus
ctaagctgtgaggttctaagaggtc

SEQ ID NO: 367074 - DNA, 25 bp, Mus musculus
ctaagctgtgccatgtgtgtccaca

SEQ ID NO: 367075 - DNA, 25 bp, Mus musculus
ctaagctgtgccttgtgtgtccaca

SEQ ID NO: 367076 - DNA, 25 bp, Mus musculus
ctaagctgtggtaccttcatgaaaa

SEQ ID NO: 367077 - DNA, 25 bp, Mus musculus
ctaagctgtggtctcatgtgcactt

SEQ ID NO: 367078 - DNA, 25 bp, Mus musculus
ctaagctgtggtgtcatgtgcactt

SEQ ID NO: 367079 - DNA, 25 bp, Mus musculus
ctaagctgtggttccttcatgaaaa

SEQ ID NO: 367080 - DNA, 25 bp, Mus musculus
ctaagcttccttcttgcacaaagaa

SEQ ID NO: 367081 - DNA, 25 bp, Mus musculus
ctaagcttccttgttgcacaaagaa

SEQ ID NO: 367082 - DNA, 25 bp, Mus musculus
ctaagcttctggatctcttctcaca

SEQ ID NO: 367083 - DNA, 25 bp, Mus musculus
ctaagcttctggttctcttctcaca

SEQ ID NO: 367084 - DNA, 25 bp, Mus musculus
ctaagcttgtgacagctgctgcata

SEQ ID NO: 367085 - DNA, 25 bp, Mus musculus
ctaagcttgtgagagctgctgcata

SEQ ID NO: 367086 - DNA, 25 bp, Mus musculus
ctaaggaacataatctaccctccct

SEQ ID NO: 367087 - DNA, 25 bp, Mus musculus
ctaaggaacatattctaccctccct

SEQ ID NO: 367088 - DNA, 25 bp, Mus musculus
ctaaggaagcacacaaggcccctgt

SEQ ID NO: 367089 - DNA, 25 bp, Mus musculus
ctaaggaagcactcaaggcccctgt

SEQ ID NO: 367090 - DNA, 25 bp, Mus musculus
ctaaggaagtggatttcccagtagg

SEQ ID NO: 367091 - DNA, 25 bp, Mus musculus
ctaaggaagtggttttcccagtagg

SEQ ID NO: 367092 - DNA, 25 bp, Mus musculus
ctaaggaatggtaacctgagcagta

SEQ ID NO: 367093 - DNA, 25 bp, Mus musculus
ctaaggaatggttacctgagcagta

SEQ ID NO: 367094 - DNA, 25 bp, Mus musculus
ctaaggacattcatatctacacccc

SEQ ID NO: 367095 - DNA, 25 bp, Mus musculus
ctaaggacattcttatctacacccc

SEQ ID NO: 367096 - DNA, 25 bp, Mus musculus
ctaaggacctgtaggctgacttgat

SEQ ID NO: 367097 - DNA, 25 bp, Mus musculus
ctaaggacctgttggctgacttgat

SEQ ID NO: 367098 - DNA, 25 bp, Mus musculus
ctaaggactcccaaggccaacagtt

SEQ ID NO: 367099 - DNA, 25 bp, Mus musculus
ctaaggactccctaggccaacagtt

SEQ ID NO: 367100 - DNA, 25 bp, Mus musculus
ctaaggacttaactgctattgctac

SEQ ID NO: 367101 - DNA, 25 bp, Mus musculus
ctaaggacttaagtgctattgctac

SEQ ID NO: 367102 - DNA, 25 bp, Mus musculus
ctaaggagagacatactggtatatc

SEQ ID NO: 367103 - DNA, 25 bp, Mus musculus
ctaaggagagacttactggtatatc

SEQ ID NO: 367104 - DNA, 25 bp, Mus musculus
ctaaggagggatcgctttgcctgcc

SEQ ID NO: 367105 - DNA, 25 bp, Mus musculus
ctaaggagggatggctttgcctgcc

SEQ ID NO: 367106 - DNA, 25 bp, Mus musculus
ctaaggataatgatgacctggcggc

SEQ ID NO: 367107 - DNA, 25 bp, Mus musculus
ctaaggataatgttgacctggcggc

SEQ ID NO: 367108 - DNA, 25 bp, Mus musculus
ctaaggatcaaacccagcacttcat

SEQ ID NO: 367109 - DNA, 25 bp, Mus musculus
ctaaggatcaaagccagcacttcat

SEQ ID NO: 367110 - DNA, 25 bp, Mus musculus
ctaaggatggcaatggctttctctg

SEQ ID NO: 367111 - DNA, 25 bp, Mus musculus
ctaaggatggcattggctttctctg

SEQ ID NO: 367112 - DNA, 25 bp, Mus musculus
ctaaggcaggaacagtgtcacacta

SEQ ID NO: 367113 - DNA, 25 bp, Mus musculus
ctaaggcaggaagagtgtcacacta

SEQ ID NO: 367114 - DNA, 25 bp, Mus musculus
ctaaggcataaaccaactccttggg

SEQ ID NO: 367115 - DNA, 25 bp, Mus musculus
ctaaggcataaagcaactccttggg

SEQ ID NO: 367116 - DNA, 25 bp, Mus musculus
ctaaggccgactcctgaaggaacat

SEQ ID NO: 367117 - DNA, 25 bp, Mus musculus
ctaaggccgactgctgaaggaacat

SEQ ID NO: 367118 - DNA, 25 bp, Mus musculus
ctaaggcgccatacagcatgtgcta

SEQ ID NO: 367119 - DNA, 25 bp, Mus musculus
ctaaggcgccattcagcatgtgcta

SEQ ID NO: 367120 - DNA, 25 bp, Mus musculus
ctaaggcgctttatgtttgcaaaac

SEQ ID NO: 367121 - DNA, 25 bp, Mus musculus
ctaaggcgctttttgtttgcaaaac

SEQ ID NO: 367122 - DNA, 25 bp, Mus musculus
ctaaggcgtcatatgtattattgtt

SEQ ID NO: 367123 - DNA, 25 bp, Mus musculus
ctaaggcgtcatttgtattattgtt

SEQ ID NO: 367124 - DNA, 25 bp, Mus musculus
ctaaggctactgacttagccaggat

SEQ ID NO: 367125 - DNA, 25 bp, Mus musculus
ctaaggctactgtcttagccaggat

SEQ ID NO: 367126 - DNA, 25 bp, Mus musculus
ctaaggctgcttcgtgtttgttctc

SEQ ID NO: 367127 - DNA, 25 bp, Mus musculus
ctaaggctgcttggtgtttgttctc

SEQ ID NO: 367128 - DNA, 25 bp, Mus musculus
ctaaggcttaggatgttccaggcat

SEQ ID NO: 367129 - DNA, 25 bp, Mus musculus
ctaaggcttaggttgttccaggcat

SEQ ID NO: 367130 - DNA, 25 bp, Mus musculus
ctaagggacattagcaagctgctgt

SEQ ID NO: 367131 - DNA, 25 bp, Mus musculus
ctaagggacatttgcaagctgctgt

SEQ ID NO: 367132 - DNA, 25 bp, Mus musculus
ctaagggagactcttccagacttct

SEQ ID NO: 367133 - DNA, 25 bp, Mus musculus
ctaagggagactgttccagacttct

SEQ ID NO: 367134 - DNA, 25 bp, Mus musculus
ctaagggagcttccctctatagctc

SEQ ID NO: 367135 - DNA, 25 bp, Mus musculus
ctaagggagcttgcctctatagctc

SEQ ID NO: 367136 - DNA, 25 bp, Mus musculus
ctaagggatcttatcatgcctgcag

SEQ ID NO: 367137 - DNA, 25 bp, Mus musculus
ctaagggatcttttcatgcctgcag

SEQ ID NO: 367138 - DNA, 25 bp, Mus musculus
ctaagggccccaagcggcacggcag

SEQ ID NO: 367139 - DNA, 25 bp, Mus musculus
ctaagggccccatgcggcacggcag

SEQ ID NO: 367140 - DNA, 25 bp, Mus musculus
ctaagggctactccagtcattcatt

SEQ ID NO: 367141 - DNA, 25 bp, Mus musculus
ctaagggctactgcagtcattcatt

SEQ ID NO: 367142 - DNA, 25 bp, Mus musculus
ctaagggctattcagttctggctgc

SEQ ID NO: 367143 - DNA, 25 bp, Mus musculus
ctaagggctattgagttctggctgc

SEQ ID NO: 367144 - DNA, 25 bp, Mus musculus
ctaagggctggcccagattattaag

SEQ ID NO: 367145 - DNA, 25 bp, Mus musculus
ctaagggctggcgcagattattaag

SEQ ID NO: 367146 - DNA, 25 bp, Mus musculus
ctaagggctttgctacctgggctat

SEQ ID NO: 367147 - DNA, 25 bp, Mus musculus
ctaagggctttggtacctgggctat

SEQ ID NO: 367148 - DNA, 25 bp, Mus musculus
ctaagggtgggtacctccattgcga

SEQ ID NO: 367149 - DNA, 25 bp, Mus musculus
ctaagggtgggttcctccattgcga

SEQ ID NO: 367150 - DNA, 25 bp, Mus musculus
ctaaggtcagcaattgtcatccaaa

SEQ ID NO: 367151 - DNA, 25 bp, Mus musculus
ctaaggtcagcatttgtcatccaaa

SEQ ID NO: 367152 - DNA, 25 bp, Mus musculus
ctaaggtcatgtattcgatccctga

SEQ ID NO: 367153 - DNA, 25 bp, Mus musculus
ctaaggtcatgttttcgatccctga

SEQ ID NO: 367154 - DNA, 25 bp, Mus musculus
ctaaggtcccggcatgccaggaaga

SEQ ID NO: 367155 - DNA, 25 bp, Mus musculus
ctaaggtcccgggatgccaggaaga

SEQ ID NO: 367156 - DNA, 25 bp, Mus musculus
ctaaggtctcatcctgttgctgcta

SEQ ID NO: 367157 - DNA, 25 bp, Mus musculus
ctaaggtctcatgctgttgctgcta

SEQ ID NO: 367158 - DNA, 25 bp, Mus musculus
ctaaggtctgctccgtgggtgtcct

SEQ ID NO: 367159 - DNA, 25 bp, Mus musculus
ctaaggtctgctgcgtgggtgtcct

SEQ ID NO: 367160 - DNA, 25 bp, Mus musculus
ctaaggtcttggaccctgagaaact

SEQ ID NO: 367161 - DNA, 25 bp, Mus musculus
ctaaggtcttggtccctgagaaact

SEQ ID NO: 367162 - DNA, 25 bp, Mus musculus
ctaaggtgaccacggttggcagcaa

SEQ ID NO: 367163 - DNA, 25 bp, Mus musculus
ctaaggtgaccagggttggcagcaa

SEQ ID NO: 367164 - DNA, 25 bp, Mus musculus
ctaaggtgcctaatgggtcccaaag

SEQ ID NO: 367165 - DNA, 25 bp, Mus musculus
ctaaggtgcctattgggtcccaaag

SEQ ID NO: 367166 - DNA, 25 bp, Mus musculus
ctaaggtgctatcgcatccgaatgt

SEQ ID NO: 367167 - DNA, 25 bp, Mus musculus
ctaaggtgctatggcatccgaatgt

SEQ ID NO: 367168 - DNA, 25 bp, Mus musculus
ctaaggtggtccacataaactcctg

SEQ ID NO: 367169 - DNA, 25 bp, Mus musculus
ctaaggtggtcctcataaactcctg

SEQ ID NO: 367170 - DNA, 25 bp, Mus musculus
ctaaggtgtctgaaataaagttgct

SEQ ID NO: 367171 - DNA, 25 bp, Mus musculus
ctaaggtgtctgtaataaagttgct

SEQ ID NO: 367172 - DNA, 25 bp, Mus musculus
ctaaggttccttaggactggctggt

SEQ ID NO: 367173 - DNA, 25 bp, Mus musculus
ctaaggttcctttggactggctggt

SEQ ID NO: 367174 - DNA, 25 bp, Mus musculus
ctaaggtttaggacactttgtatat

SEQ ID NO: 367175 - DNA, 25 bp, Mus musculus
ctaaggtttaggtcactttgtatat

SEQ ID NO: 367176 - DNA, 25 bp, Mus musculus
ctaagtaatccaactgctttgtctg

SEQ ID NO: 367177 - DNA, 25 bp, Mus musculus
ctaagtaatccatctgctttgtctg

SEQ ID NO: 367178 - DNA, 25 bp, Mus musculus
ctaagtactggaactgaaggcctgg

SEQ ID NO: 367179 - DNA, 25 bp, Mus musculus
ctaagtactggatctgaaggcctgg

SEQ ID NO: 367180 - DNA, 25 bp, Mus musculus
ctaagtactgtacgctctgggtgtt

SEQ ID NO: 367181 - DNA, 25 bp, Mus musculus
ctaagtactgtaggctctgggtgtt

SEQ ID NO: 367182 - DNA, 25 bp, Mus musculus
ctaagtagctacactccgacagcta

SEQ ID NO: 367183 - DNA, 25 bp, Mus musculus
ctaagtagctactctccgacagcta

SEQ ID NO: 367184 - DNA, 25 bp, Mus musculus
ctaagtaggcccctttctgtcatta

SEQ ID NO: 367185 - DNA, 25 bp, Mus musculus
ctaagtaggcccgtttctgtcatta

SEQ ID NO: 367186 - DNA, 25 bp, Mus musculus
ctaagtatcggcagtcccatagatt

SEQ ID NO: 367187 - DNA, 25 bp, Mus musculus
ctaagtatcggctgtcccatagatt

SEQ ID NO: 367188 - DNA, 25 bp, Mus musculus
ctaagtcaaacaatgcagcagggaa

SEQ ID NO: 367189 - DNA, 25 bp, Mus musculus
ctaagtcaaacattgcagcagggaa

SEQ ID NO: 367190 - DNA, 25 bp, Mus musculus
ctaagtcaagtgagctcccgtgtga

SEQ ID NO: 367191 - DNA, 25 bp, Mus musculus
ctaagtcaagtgtgctcccgtgtga

SEQ ID NO: 367192 - DNA, 25 bp, Mus musculus
ctaagtcagcgtatgagttctcggc

SEQ ID NO: 367193 - DNA, 25 bp, Mus musculus
ctaagtcagcgtttgagttctcggc

SEQ ID NO: 367194 - DNA, 25 bp, Mus musculus
ctaagtcatcatcctagttcctaga

SEQ ID NO: 367195 - DNA, 25 bp, Mus musculus
ctaagtcatcatgctagttcctaga

SEQ ID NO: 367196 - DNA, 25 bp, Mus musculus
ctaagtccctgtacataacccatat

SEQ ID NO: 367197 - DNA, 25 bp, Mus musculus
ctaagtccctgttcataacccatat

SEQ ID NO: 367198 - DNA, 25 bp, Mus musculus
ctaagtcctgcaagctgggtcctgg

SEQ ID NO: 367199 - DNA, 25 bp, Mus musculus
ctaagtcctgcatgctgggtcctgg

SEQ ID NO: 367200 - DNA, 25 bp, Mus musculus
ctaagtccttccctcaatgcaggaa

SEQ ID NO: 367201 - DNA, 25 bp, Mus musculus
ctaagtccttccgtcaatgcaggaa

SEQ ID NO: 367202 - DNA, 25 bp, Mus musculus
ctaagtcgtgtgcagtcagtgctga

SEQ ID NO: 367203 - DNA, 25 bp, Mus musculus
ctaagtcgtgtggagtcagtgctga

SEQ ID NO: 367204 - DNA, 25 bp, Mus musculus
ctaagtctatagaacgaatctttaa

SEQ ID NO: 367205 - DNA, 25 bp, Mus musculus
ctaagtctatagtacgaatctttaa

SEQ ID NO: 367206 - DNA, 25 bp, Mus musculus
ctaagtctgactactaagatccttg

SEQ ID NO: 367207 - DNA, 25 bp, Mus musculus
ctaagtctgacttctaagatccttg

SEQ ID NO: 367208 - DNA, 25 bp, Mus musculus
ctaagtctgtgtcaactggatacca

SEQ ID NO: 367209 - DNA, 25 bp, Mus musculus
ctaagtctgtgtgaactggatacca

SEQ ID NO: 367210 - DNA, 25 bp, Mus musculus
ctaagtgaatctatgtccttggact

SEQ ID NO: 367211 - DNA, 25 bp, Mus musculus
ctaagtgaatctttgtccttggact

SEQ ID NO: 367212 - DNA, 25 bp, Mus musculus
ctaagtgagatgagccaggcccagt

SEQ ID NO: 367213 - DNA, 25 bp, Mus musculus
ctaagtgagatgtgccaggcccagt

SEQ ID NO: 367214 - DNA, 25 bp, Mus musculus
ctaagtgattgaagtagtcatgtct

SEQ ID NO: 367215 - DNA, 25 bp, Mus musculus
ctaagtgattgatgtagtcatgtct

SEQ ID NO: 367216 - DNA, 25 bp, Mus musculus
ctaagtgccattacatgtatcttga

SEQ ID NO: 367217 - DNA, 25 bp, Mus musculus
ctaagtgccatttcatgtatcttga

SEQ ID NO: 367218 - DNA, 25 bp, Mus musculus
ctaagtgctaggactaccgaaatac

SEQ ID NO: 367219 - DNA, 25 bp, Mus musculus
ctaagtgctaggtctaccgaaatac

SEQ ID NO: 367220 - DNA, 25 bp, Mus musculus
ctaagtgctcataagaggccctttt

SEQ ID NO: 367221 - DNA, 25 bp, Mus musculus
ctaagtgctcattagaggccctttt

SEQ ID NO: 367222 - DNA, 25 bp, Mus musculus
ctaagtgctgcaccagtgagtggca

SEQ ID NO: 367223 - DNA, 25 bp, Mus musculus
ctaagtgctgcagcagtgagtggca

SEQ ID NO: 367224 - DNA, 25 bp, Mus musculus
ctaagtgcttttaagattgcttaaa

SEQ ID NO: 367225 - DNA, 25 bp, Mus musculus
ctaagtgctttttagattgcttaaa

SEQ ID NO: 367226 - DNA, 25 bp, Mus musculus
ctaagtggaggcaagttgtactgca

SEQ ID NO: 367227 - DNA, 25 bp, Mus musculus
ctaagtggaggctagttgtactgca

SEQ ID NO: 367228 - DNA, 25 bp, Mus musculus
ctaagtggatcaatgctactgaccc

SEQ ID NO: 367229 - DNA, 25 bp, Mus musculus
ctaagtggatcattgctactgaccc

SEQ ID NO: 367230 - DNA, 25 bp, Mus musculus
ctaagtggctccactctggagtata

SEQ ID NO: 367231 - DNA, 25 bp, Mus musculus
ctaagtggctcctctctggagtata

SEQ ID NO: 367232 - DNA, 25 bp, Mus musculus
ctaagtggctggaatgactgagaca

SEQ ID NO: 367233 - DNA, 25 bp, Mus musculus
ctaagtggctggtatgactgagaca

SEQ ID NO: 367234 - DNA, 25 bp, Mus musculus
ctaagtggtactcctttgagttcct

SEQ ID NO: 367235 - DNA, 25 bp, Mus musculus
ctaagtggtactgctttgagttcct

SEQ ID NO: 367236 - DNA, 25 bp, Mus musculus
ctaagtggtcacaggaagatcctgg

SEQ ID NO: 367237 - DNA, 25 bp, Mus musculus
ctaagtggtcactggaagatcctgg

SEQ ID NO: 367238 - DNA, 25 bp, Mus musculus
ctaagtgtaccccttcagagaagat

SEQ ID NO: 367239 - DNA, 25 bp, Mus musculus
ctaagtgtacccgttcagagaagat

SEQ ID NO: 367240 - DNA, 25 bp, Mus musculus
ctaagtgtccatattatgtagtaaa

SEQ ID NO: 367241 - DNA, 25 bp, Mus musculus
ctaagtgtccattttatgtagtaaa

SEQ ID NO: 367242 - DNA, 25 bp, Mus musculus
ctaagtgtggagcaattctgggtct

SEQ ID NO: 367243 - DNA, 25 bp, Mus musculus
ctaagtgtggaggaattctgggtct

SEQ ID NO: 367244 - DNA, 25 bp, Mus musculus
ctaagtgtgtatctctctctaagga

SEQ ID NO: 367245 - DNA, 25 bp, Mus musculus
ctaagtgtgtatgtctctctaagga

SEQ ID NO: 367246 - DNA, 25 bp, Mus musculus
ctaagtgtgtggctctacccagaag

SEQ ID NO: 367247 - DNA, 25 bp, Mus musculus
ctaagtgtgtgggtctacccagaag

SEQ ID NO: 367248 - DNA, 25 bp, Mus musculus
ctaagtgttagcctttgggtgtcct

SEQ ID NO: 367249 - DNA, 25 bp, Mus musculus
ctaagtgttagcgtttgggtgtcct

SEQ ID NO: 367250 - DNA, 25 bp, Mus musculus
ctaagttacacaataacagacatga

SEQ ID NO: 367251 - DNA, 25 bp, Mus musculus
ctaagttacacattaacagacatga

SEQ ID NO: 367252 - DNA, 25 bp, Mus musculus
ctaagttaggacatggagcccagat

SEQ ID NO: 367253 - DNA, 25 bp, Mus musculus
ctaagttaggacttggagcccagat

SEQ ID NO: 367254 - DNA, 25 bp, Mus musculus
ctaagttatgggatcctcacgccac

SEQ ID NO: 367255 - DNA, 25 bp, Mus musculus
ctaagttatgggttcctcacgccac

SEQ ID NO: 367256 - DNA, 25 bp, Mus musculus
ctaagttcccagacaagtggtgccc

SEQ ID NO: 367257 - DNA, 25 bp, Mus musculus
ctaagttcccagtcaagtggtgccc

SEQ ID NO: 367258 - DNA, 25 bp, Mus musculus
ctaagttcgaggcaaagccactgct

SEQ ID NO: 367259 - DNA, 25 bp, Mus musculus
ctaagttcgagggaaagccactgct

SEQ ID NO: 367260 - DNA, 25 bp, Mus musculus
ctaagttctaaactgcgggcagtgc

SEQ ID NO: 367261 - DNA, 25 bp, Mus musculus
ctaagttctaaagtgcgggcagtgc

SEQ ID NO: 367262 - DNA, 25 bp, Mus musculus
ctaagttctctaacagggtgatgcc

SEQ ID NO: 367263 - DNA, 25 bp, Mus musculus
ctaagttctctatcagggtgatgcc

SEQ ID NO: 367264 - DNA, 25 bp, Mus musculus
ctaagttctgctaccggtgctaaag

SEQ ID NO: 367265 - DNA, 25 bp, Mus musculus
ctaagttctgcttccggtgctaaag

SEQ ID NO: 367266 - DNA, 25 bp, Mus musculus
ctaagttctttgaccacagcgggac

SEQ ID NO: 367267 - DNA, 25 bp, Mus musculus
ctaagttctttgtccacagcgggac

SEQ ID NO: 367268 - DNA, 25 bp, Mus musculus
ctaagttgccctccatgtccagaga

SEQ ID NO: 367269 - DNA, 25 bp, Mus musculus
ctaagttgccctgcatgtccagaga

SEQ ID NO: 367270 - DNA, 25 bp, Mus musculus
ctaagttgcctaagactctctcaat

SEQ ID NO: 367271 - DNA, 25 bp, Mus musculus
ctaagttgcctatgactctctcaat

SEQ ID NO: 367272 - DNA, 25 bp, Mus musculus
ctaagttgctctctgttgttaacat

SEQ ID NO: 367273 - DNA, 25 bp, Mus musculus
ctaagttgctctgtgttgttaacat

SEQ ID NO: 367274 - DNA, 25 bp, Mus musculus
ctaagtttcctcatggagcctcaca

SEQ ID NO: 367275 - DNA, 25 bp, Mus musculus
ctaagtttcctcttggagcctcaca

SEQ ID NO: 367276 - DNA, 25 bp, Mus musculus
ctaataaagtgcatgaagccagcct

SEQ ID NO: 367277 - DNA, 25 bp, Mus musculus
ctaataaagtgcttgaagccagcct

SEQ ID NO: 367278 - DNA, 25 bp, Mus musculus
ctaataagacttcgttccacacctc

SEQ ID NO: 367279 - DNA, 25 bp, Mus musculus
ctaataagacttggttccacacctc

SEQ ID NO: 367280 - DNA, 25 bp, Mus musculus
ctaataagccaacgaatcgacatat

SEQ ID NO: 367281 - DNA, 25 bp, Mus musculus
ctaataagccaaggaatcgacatat

SEQ ID NO: 367282 - DNA, 25 bp, Mus musculus
ctaataattcagactcagagttgtt

SEQ ID NO: 367283 - DNA, 25 bp, Mus musculus
ctaataattcagtctcagagttgtt

SEQ ID NO: 367284 - DNA, 25 bp, Mus musculus
ctaataattttgctcttactgctga

SEQ ID NO: 367285 - DNA, 25 bp, Mus musculus
ctaataattttggtcttactgctga

SEQ ID NO: 367286 - DNA, 25 bp, Mus musculus
ctaatacagggcaaacacaagtcta

SEQ ID NO: 367287 - DNA, 25 bp, Mus musculus
ctaatacagggctaacacaagtcta

SEQ ID NO: 367288 - DNA, 25 bp, Mus musculus
ctaataccctaaatcattaaactct

SEQ ID NO: 367289 - DNA, 25 bp, Mus musculus
ctaataccctaattcattaaactct

SEQ ID NO: 367290 - DNA, 25 bp, Mus musculus
ctaatacgctcacgtcagaataaag

SEQ ID NO: 367291 - DNA, 25 bp, Mus musculus
ctaatacgctcaggtcagaataaag

SEQ ID NO: 367292 - DNA, 25 bp, Mus musculus
ctaatagaggagatgaggcacacac

SEQ ID NO: 367293 - DNA, 25 bp, Mus musculus
ctaatagaggagttgaggcacacac

SEQ ID NO: 367294 - DNA, 25 bp, Mus musculus
ctaatagagtagcttatcgaaatat

SEQ ID NO: 367295 - DNA, 25 bp, Mus musculus
ctaatagagtaggttatcgaaatat

SEQ ID NO: 367296 - DNA, 25 bp, Mus musculus
ctaatagcaccgcttttctgacact

SEQ ID NO: 367297 - DNA, 25 bp, Mus musculus
ctaatagcaccggttttctgacact

SEQ ID NO: 367298 - DNA, 25 bp, Mus musculus
ctaatagcctctacctttcgaaaag

SEQ ID NO: 367299 - DNA, 25 bp, Mus musculus
ctaatagcctcttcctttcgaaaag

SEQ ID NO: 367300 - DNA, 25 bp, Mus musculus
ctaataggatgcagcgtgtgcgcat

SEQ ID NO: 367301 - DNA, 25 bp, Mus musculus
ctaataggatgctgcgtgtgcgcat

SEQ ID NO: 367302 - DNA, 25 bp, Mus musculus
ctaataggttttcacaggaactaat

SEQ ID NO: 367303 - DNA, 25 bp, Mus musculus
ctaataggttttgacaggaactaat

SEQ ID NO: 367304 - DNA, 25 bp, Mus musculus
ctaatagtaggcacttctgttcttt

SEQ ID NO: 367305 - DNA, 25 bp, Mus musculus
ctaatagtaggctcttctgttcttt

SEQ ID NO: 367306 - DNA, 25 bp, Mus musculus
ctaatataagtacacctggtgcctt

SEQ ID NO: 367307 - DNA, 25 bp, Mus musculus
ctaatataagtagacctggtgcctt

SEQ ID NO: 367308 - DNA, 25 bp, Mus musculus
ctaatatcaattcactcttctggga

SEQ ID NO: 367309 - DNA, 25 bp, Mus musculus
ctaatatcaattgactcttctggga

SEQ ID NO: 367310 - DNA, 25 bp, Mus musculus
ctaatatcttctatcccatggcatg

SEQ ID NO: 367311 - DNA, 25 bp, Mus musculus
ctaatatcttctttcccatggcatg

SEQ ID NO: 367312 - DNA, 25 bp, Mus musculus
ctaatatgcaccaacaaacctatgt

SEQ ID NO: 367313 - DNA, 25 bp, Mus musculus
ctaatatgcacctacaaacctatgt

SEQ ID NO: 367314 - DNA, 25 bp, Mus musculus
ctaatatgcccacgttcagtaaata

SEQ ID NO: 367315 - DNA, 25 bp, Mus musculus
ctaatatgcccaggttcagtaaata

SEQ ID NO: 367316 - DNA, 25 bp, Mus musculus
ctaatattgggcctacagtttccat

SEQ ID NO: 367317 - DNA, 25 bp, Mus musculus
ctaatattgggcgtacagtttccat

SEQ ID NO: 367318 - DNA, 25 bp, Mus musculus
ctaatcagggcaccaagggcatgtc

SEQ ID NO: 367319 - DNA, 25 bp, Mus musculus
ctaatcagggcagcaagggcatgtc

SEQ ID NO: 367320 - DNA, 25 bp, Mus musculus
ctaatcatctggatgctcacacaga

SEQ ID NO: 367321 - DNA, 25 bp, Mus musculus
ctaatcatctggttgctcacacaga

SEQ ID NO: 367322 - DNA, 25 bp, Mus musculus
ctaatccagcatattgacagcccaa

SEQ ID NO: 367323 - DNA, 25 bp, Mus musculus
ctaatccagcattttgacagcccaa

SEQ ID NO: 367324 - DNA, 25 bp, Mus musculus
ctaatccagtttccagcaggttaaa

SEQ ID NO: 367325 - DNA, 25 bp, Mus musculus
ctaatccagtttgcagcaggttaaa

SEQ ID NO: 367326 - DNA, 25 bp, Mus musculus
ctaatccatcttaagggttgggtgt

SEQ ID NO: 367327 - DNA, 25 bp, Mus musculus
ctaatccatctttagggttgggtgt

SEQ ID NO: 367328 - DNA, 25 bp, Mus musculus
ctaatcccagagaaatgtacaccct

SEQ ID NO: 367329 - DNA, 25 bp, Mus musculus
ctaatcccagagtaatgtacaccct

SEQ ID NO: 367330 - DNA, 25 bp, Mus musculus
ctaatcccagggactatggtagaga

SEQ ID NO: 367331 - DNA, 25 bp, Mus musculus
ctaatcccagggtctatggtagaga

SEQ ID NO: 367332 - DNA, 25 bp, Mus musculus
ctaatcccatagaaacctgttgcat

SEQ ID NO: 367333 - DNA, 25 bp, Mus musculus
ctaatcccatagtaacctgttgcat

SEQ ID NO: 367334 - DNA, 25 bp, Mus musculus
ctaatcccgagtactctcaggtaaa

SEQ ID NO: 367335 - DNA, 25 bp, Mus musculus
ctaatcccgagttctctcaggtaaa

SEQ ID NO: 367336 - DNA, 25 bp, Mus musculus
ctaatcccttcactcttactttggc

SEQ ID NO: 367337 - DNA, 25 bp, Mus musculus
ctaatcccttcagtcttactttggc

SEQ ID NO: 367338 - DNA, 25 bp, Mus musculus
ctaatcctaccaatcagaaagctag

SEQ ID NO: 367339 - DNA, 25 bp, Mus musculus
ctaatcctaccattcagaaagctag

SEQ ID NO: 367340 - DNA, 25 bp, Mus musculus
ctaatcctagtacctgagaagacaa

SEQ ID NO: 367341 - DNA, 25 bp, Mus musculus
ctaatcctagtagctgagaagacaa

SEQ ID NO: 367342 - DNA, 25 bp, Mus musculus
ctaatcctttgccagctgtttgaac

SEQ ID NO: 367343 - DNA, 25 bp, Mus musculus
ctaatcctttgcgagctgtttgaac

SEQ ID NO: 367344 - DNA, 25 bp, Mus musculus
ctaatcctttgtacaggatggagca

SEQ ID NO: 367345 - DNA, 25 bp, Mus musculus
ctaatcctttgttcaggatggagca

SEQ ID NO: 367346 - DNA, 25 bp, Mus musculus
ctaatctagaatatatcccgtggat

SEQ ID NO: 367347 - DNA, 25 bp, Mus musculus
ctaatctagaatttatcccgtggat

SEQ ID NO: 367348 - DNA, 25 bp, Mus musculus
ctaatctaggaaccgccgctgcctg

SEQ ID NO: 367349 - DNA, 25 bp, Mus musculus
ctaatctaggaagcgccgctgcctg

SEQ ID NO: 367350 - DNA, 25 bp, Mus musculus
ctaatctcctcactcttatctataa

SEQ ID NO: 367351 - DNA, 25 bp, Mus musculus
ctaatctcctcagtcttatctataa

SEQ ID NO: 367352 - DNA, 25 bp, Mus musculus
ctaatctcttgaataccaccactat

SEQ ID NO: 367353 - DNA, 25 bp, Mus musculus
ctaatctcttgattaccaccactat

SEQ ID NO: 367354 - DNA, 25 bp, Mus musculus
ctaatctgagctacatagtgtgtgt

SEQ ID NO: 367355 - DNA, 25 bp, Mus musculus
ctaatctgagcttcatagtgtgtgt

SEQ ID NO: 367356 - DNA, 25 bp, Mus musculus
ctaatctgcccaagtacacatcatt

SEQ ID NO: 367357 - DNA, 25 bp, Mus musculus
ctaatctgcccatgtacacatcatt

SEQ ID NO: 367358 - DNA, 25 bp, Mus musculus
ctaatctgctgcagctctcaagctg

SEQ ID NO: 367359 - DNA, 25 bp, Mus musculus
ctaatctgctgctgctctcaagctg

SEQ ID NO: 367360 - DNA, 25 bp, Mus musculus
ctaatctggtttagttctcctcaac

SEQ ID NO: 367361 - DNA, 25 bp, Mus musculus
ctaatctggttttgttctcctcaac

SEQ ID NO: 367362 - DNA, 25 bp, Mus musculus
ctaatctgtattcggttctgctggc

SEQ ID NO: 367363 - DNA, 25 bp, Mus musculus
ctaatctgtattgggttctgctggc

SEQ ID NO: 367364 - DNA, 25 bp, Mus musculus
ctaatcttatgacagttgatactgc

SEQ ID NO: 367365 - DNA, 25 bp, Mus musculus
ctaatcttatgagagttgatactgc

SEQ ID NO: 367366 - DNA, 25 bp, Mus musculus
ctaatctttcacctcatatcacatg

SEQ ID NO: 367367 - DNA, 25 bp, Mus musculus
ctaatctttcacgtcatatcacatg

SEQ ID NO: 367368 - DNA, 25 bp, Mus musculus
ctaatgaaaagtcccttacctgcct

SEQ ID NO: 367369 - DNA, 25 bp, Mus musculus
ctaatgaaaagtgccttacctgcct

SEQ ID NO: 367370 - DNA, 25 bp, Mus musculus
ctaatgaagacaccggacattttaa

SEQ ID NO: 367371 - DNA, 25 bp, Mus musculus
ctaatgaagacagcggacattttaa

SEQ ID NO: 367372 - DNA, 25 bp, Mus musculus
ctaatgaatttcctgtacctgcttg

SEQ ID NO: 367373 - DNA, 25 bp, Mus musculus
ctaatgaatttcgtgtacctgcttg

SEQ ID NO: 367374 - DNA, 25 bp, Mus musculus
ctaatgaggaatcgctacagcttca

SEQ ID NO: 367375 - DNA, 25 bp, Mus musculus
ctaatgaggaatggctacagcttca

SEQ ID NO: 367376 - DNA, 25 bp, Mus musculus
ctaatgcaccataattagctttgcc

SEQ ID NO: 367377 - DNA, 25 bp, Mus musculus
ctaatgcaccattattagctttgcc

SEQ ID NO: 367378 - DNA, 25 bp, Mus musculus
ctaatgccaacaacaccacattttg

SEQ ID NO: 367379 - DNA, 25 bp, Mus musculus
ctaatgccaacatcaccacattttg

SEQ ID NO: 367380 - DNA, 25 bp, Mus musculus
ctaatgccagggacttgtctcgtaa

SEQ ID NO: 367381 - DNA, 25 bp, Mus musculus
ctaatgccagggtcttgtctcgtaa

SEQ ID NO: 367382 - DNA, 25 bp, Mus musculus
ctaatgcccacgagccaagtgatgg

SEQ ID NO: 367383 - DNA, 25 bp, Mus musculus
ctaatgcccacgtgccaagtgatgg

SEQ ID NO: 367384 - DNA, 25 bp, Mus musculus
ctaatgctctctattggcctctggg

SEQ ID NO: 367385 - DNA, 25 bp, Mus musculus
ctaatgctctcttttggcctctggg

SEQ ID NO: 367386 - DNA, 25 bp, Mus musculus
ctaatgctgagcaagttaatctggc

SEQ ID NO: 367387 - DNA, 25 bp, Mus musculus
ctaatgctgagctagttaatctggc

SEQ ID NO: 367388 - DNA, 25 bp, Mus musculus
ctaatgctgtctcttatctgttgga

SEQ ID NO: 367389 - DNA, 25 bp, Mus musculus
ctaatgctgtctgttatctgttgga

SEQ ID NO: 367390 - DNA, 25 bp, Mus musculus
ctaatggcacaaccgtccatgtggg

SEQ ID NO: 367391 - DNA, 25 bp, Mus musculus
ctaatggcacaagcgtccatgtggg

SEQ ID NO: 367392 - DNA, 25 bp, Mus musculus
ctaatggcacagagggctcccaaat

SEQ ID NO: 367393 - DNA, 25 bp, Mus musculus
ctaatggcacagtgggctcccaaat

SEQ ID NO: 367394 - DNA, 25 bp, Mus musculus
ctaatggctttacacagctaaggat

SEQ ID NO: 367395 - DNA, 25 bp, Mus musculus
ctaatggctttagacagctaaggat

SEQ ID NO: 367396 - DNA, 25 bp, Mus musculus
ctaatgggagttagtcactgaccta

SEQ ID NO: 367397 - DNA, 25 bp, Mus musculus
ctaatgggagtttgtcactgaccta

SEQ ID NO: 367398 - DNA, 25 bp, Mus musculus
ctaatgggatgtacttttggcatgc

SEQ ID NO: 367399 - DNA, 25 bp, Mus musculus
ctaatgggatgttcttttggcatgc

SEQ ID NO: 367400 - DNA, 25 bp, Mus musculus
ctaatgggcaatccctgtgtgtgct

SEQ ID NO: 367401 - DNA, 25 bp, Mus musculus
ctaatgggcaatgcctgtgtgtgct

SEQ ID NO: 367402 - DNA, 25 bp, Mus musculus
ctaatgggctctcgtatgtctttta

SEQ ID NO: 367403 - DNA, 25 bp, Mus musculus
ctaatgggctctggtatgtctttta

SEQ ID NO: 367404 - DNA, 25 bp, Mus musculus
ctaatgggtgttctgtatcttcttt

SEQ ID NO: 367405 - DNA, 25 bp, Mus musculus
ctaatgggtgttgtgtatcttcttt

SEQ ID NO: 367406 - DNA, 25 bp, Mus musculus
ctaatggtacagctccagcagctac

SEQ ID NO: 367407 - DNA, 25 bp, Mus musculus
ctaatggtacaggtccagcagctac

SEQ ID NO: 367408 - DNA, 25 bp, Mus musculus
ctaatggtacccagcagacacttgc

SEQ ID NO: 367409 - DNA, 25 bp, Mus musculus
ctaatggtaccctgcagacacttgc

SEQ ID NO: 367410 - DNA, 25 bp, Mus musculus
ctaatggtagtactggtgaccacac

SEQ ID NO: 367411 - DNA, 25 bp, Mus musculus
ctaatggtagtagtggtgaccacac

SEQ ID NO: 367412 - DNA, 25 bp, Mus musculus
ctaatggtcctaacagtcttcactg

SEQ ID NO: 367413 - DNA, 25 bp, Mus musculus
ctaatggtcctatcagtcttcactg

SEQ ID NO: 367414 - DNA, 25 bp, Mus musculus
ctaatgtaacctctagcctactctt

SEQ ID NO: 367415 - DNA, 25 bp, Mus musculus
ctaatgtaacctgtagcctactctt

SEQ ID NO: 367416 - DNA, 25 bp, Mus musculus
ctaatgtacataccatgtcttcagt

SEQ ID NO: 367417 - DNA, 25 bp, Mus musculus
ctaatgtacatagcatgtcttcagt

SEQ ID NO: 367418 - DNA, 25 bp, Mus musculus
ctaatgtatttacagtgccagctac

SEQ ID NO: 367419 - DNA, 25 bp, Mus musculus
ctaatgtatttagagtgccagctac

SEQ ID NO: 367420 - DNA, 25 bp, Mus musculus
ctaatgtgacagacatcaaggcaga

SEQ ID NO: 367421 - DNA, 25 bp, Mus musculus
ctaatgtgacagtcatcaaggcaga

SEQ ID NO: 367422 - DNA, 25 bp, Mus musculus
ctaatgtgactaatcttgggcgatt

SEQ ID NO: 367423 - DNA, 25 bp, Mus musculus
ctaatgtgactattcttgggcgatt

SEQ ID NO: 367424 - DNA, 25 bp, Mus musculus
ctaatgtgcttgactggatgtgtca

SEQ ID NO: 367425 - DNA, 25 bp, Mus musculus
ctaatgtgcttgtctggatgtgtca

SEQ ID NO: 367426 - DNA, 25 bp, Mus musculus
ctaatgtgtcctcccctagctataa

SEQ ID NO: 367427 - DNA, 25 bp, Mus musculus
ctaatgtgtcctgccctagctataa

SEQ ID NO: 367428 - DNA, 25 bp, Mus musculus
ctaatgtgtgttactcaatgttaca

SEQ ID NO: 367429 - DNA, 25 bp, Mus musculus
ctaatgtgtgtttctcaatgttaca

SEQ ID NO: 367430 - DNA, 25 bp, Mus musculus
ctaatgttactgagggttcttacca

SEQ ID NO: 367431 - DNA, 25 bp, Mus musculus
ctaatgttactgtgggttcttacca

SEQ ID NO: 367432 - DNA, 25 bp, Mus musculus
ctaattacacatagttattcataac

SEQ ID NO: 367433 - DNA, 25 bp, Mus musculus
ctaattacacattgttattcataac

SEQ ID NO: 367434 - DNA, 25 bp, Mus musculus
ctaattacagcccaacctctccaag

SEQ ID NO: 367435 - DNA, 25 bp, Mus musculus
ctaattacagccgaacctctccaag

SEQ ID NO: 367436 - DNA, 25 bp, Mus musculus
ctaattagaaaacacatggccatga

SEQ ID NO: 367437 - DNA, 25 bp, Mus musculus
ctaattagaaaagacatggccatga

SEQ ID NO: 367438 - DNA, 25 bp, Mus musculus
ctaattagtttgacagttcgcagat

SEQ ID NO: 367439 - DNA, 25 bp, Mus musculus
ctaattagtttgtcagttcgcagat

SEQ ID NO: 367440 - DNA, 25 bp, Mus musculus
ctaattatctccctgacactgctgt

SEQ ID NO: 367441 - DNA, 25 bp, Mus musculus
ctaattatctccgtgacactgctgt

SEQ ID NO: 367442 - DNA, 25 bp, Mus musculus
ctaattattccaattcaaaagtgtt

SEQ ID NO: 367443 - DNA, 25 bp, Mus musculus
ctaattattccatttcaaaagtgtt

SEQ ID NO: 367444 - DNA, 25 bp, Mus musculus
ctaattcagtggaggcagtgctaag

SEQ ID NO: 367445 - DNA, 25 bp, Mus musculus
ctaattcagtggtggcagtgctaag

SEQ ID NO: 367446 - DNA, 25 bp, Mus musculus
ctaattcatttcagttgtagtcact

SEQ ID NO: 367447 - DNA, 25 bp, Mus musculus
ctaattcatttctgttgtagtcact

SEQ ID NO: 367448 - DNA, 25 bp, Mus musculus
ctaattccacgacaccaacttactg

SEQ ID NO: 367449 - DNA, 25 bp, Mus musculus
ctaattccacgagaccaacttactg

SEQ ID NO: 367450 - DNA, 25 bp, Mus musculus
ctaattcctttcattcttagggact

SEQ ID NO: 367451 - DNA, 25 bp, Mus musculus
ctaattcctttctttcttagggact

SEQ ID NO: 367452 - DNA, 25 bp, Mus musculus
ctaattcgttgtaaattgcttctac

SEQ ID NO: 367453 - DNA, 25 bp, Mus musculus
ctaattcgttgttaattgcttctac

SEQ ID NO: 367454 - DNA, 25 bp, Mus musculus
ctaattctaataatcactccccatg

SEQ ID NO: 367455 - DNA, 25 bp, Mus musculus
ctaattctaatattcactccccatg

SEQ ID NO: 367456 - DNA, 25 bp, Mus musculus
ctaattctaggcagcccctgttttc

SEQ ID NO: 367457 - DNA, 25 bp, Mus musculus
ctaattctaggctgcccctgttttc

SEQ ID NO: 367458 - DNA, 25 bp, Mus musculus
ctaattcttcacataaggctggaga

SEQ ID NO: 367459 - DNA, 25 bp, Mus musculus
ctaattcttcacttaaggctggaga

SEQ ID NO: 367460 - DNA, 25 bp, Mus musculus
ctaattgagtcaaatcctgtcttcc

SEQ ID NO: 367461 - DNA, 25 bp, Mus musculus
ctaattgagtcatatcctgtcttcc

SEQ ID NO: 367462 - DNA, 25 bp, Mus musculus
ctaattgctgttacccctgtatttc

SEQ ID NO: 367463 - DNA, 25 bp, Mus musculus
ctaattgctgtttcccctgtatttc

SEQ ID NO: 367464 - DNA, 25 bp, Mus musculus
ctaattggaacaagtgggtggcact

SEQ ID NO: 367465 - DNA, 25 bp, Mus musculus
ctaattggaacatgtgggtggcact

SEQ ID NO: 367466 - DNA, 25 bp, Mus musculus
ctaattgggatcatgctttcagcag

SEQ ID NO: 367467 - DNA, 25 bp, Mus musculus
ctaattgggatcttgctttcagcag

SEQ ID NO: 367468 - DNA, 25 bp, Mus musculus
ctaattggtccacaactcaaataat

SEQ ID NO: 367469 - DNA, 25 bp, Mus musculus
ctaattggtccagaactcaaataat

SEQ ID NO: 367470 - DNA, 25 bp, Mus musculus
ctaattgtgtatagtacccaaagaa

SEQ ID NO: 367471 - DNA, 25 bp, Mus musculus
ctaattgtgtattgtacccaaagaa

SEQ ID NO: 367472 - DNA, 25 bp, Mus musculus
ctaattgttttcctcatcagccata

SEQ ID NO: 367473 - DNA, 25 bp, Mus musculus
ctaattgttttcgtcatcagccata

SEQ ID NO: 367474 - DNA, 25 bp, Mus musculus
ctaatttataatcatccctaccctc

SEQ ID NO: 367475 - DNA, 25 bp, Mus musculus
ctaatttataatgatccctaccctc

SEQ ID NO: 367476 - DNA, 25 bp, Mus musculus
ctaatttcaattcacactcccaagt

SEQ ID NO: 367477 - DNA, 25 bp, Mus musculus
ctaatttcaattgacactcccaagt

SEQ ID NO: 367478 - DNA, 25 bp, Mus musculus
ctaatttcagccctgtgtgaggatg

SEQ ID NO: 367479 - DNA, 25 bp, Mus musculus
ctaatttcagccgtgtgtgaggatg

SEQ ID NO: 367480 - DNA, 25 bp, Mus musculus
ctaatttcctgccttgagtggagct

SEQ ID NO: 367481 - DNA, 25 bp, Mus musculus
ctaatttcctgcgttgagtggagct

SEQ ID NO: 367482 - DNA, 25 bp, Mus musculus
ctaatttctatacttctccattctc

SEQ ID NO: 367483 - DNA, 25 bp, Mus musculus
ctaatttctatagttctccattctc

SEQ ID NO: 367484 - DNA, 25 bp, Mus musculus
ctaatttgatgtaggctattggcct

SEQ ID NO: 367485 - DNA, 25 bp, Mus musculus
ctaatttgatgttggctattggcct

SEQ ID NO: 367486 - DNA, 25 bp, Mus musculus
ctaatttgctggagtttctatttgt

SEQ ID NO: 367487 - DNA, 25 bp, Mus musculus
ctaatttgctggtgtttctatttgt

SEQ ID NO: 367488 - DNA, 25 bp, Mus musculus
ctaatttgttctatatagcagtgga

SEQ ID NO: 367489 - DNA, 25 bp, Mus musculus
ctaatttgttctttatagcagtgga

SEQ ID NO: 367490 - DNA, 25 bp, Mus musculus
ctaattttcccaatgttggtggcga

SEQ ID NO: 367491 - DNA, 25 bp, Mus musculus
ctaattttcccattgttggtggcga

SEQ ID NO: 367492 - DNA, 25 bp, Mus musculus
ctaattttgggaatctgtgcataca

SEQ ID NO: 367493 - DNA, 25 bp, Mus musculus
ctaattttgggattctgtgcataca

SEQ ID NO: 367494 - DNA, 25 bp, Mus musculus
ctaattttttgcaagaacctggtag

SEQ ID NO: 367495 - DNA, 25 bp, Mus musculus
ctaattttttgctagaacctggtag

SEQ ID NO: 367496 - DNA, 25 bp, Mus musculus
ctacaaaacattcctggtgtcccct

SEQ ID NO: 367497 - DNA, 25 bp, Mus musculus
ctacaaaacattgctggtgtcccct

SEQ ID NO: 367498 - DNA, 25 bp, Mus musculus
ctacaaacacatcccctgtgtggat

SEQ ID NO: 367499 - DNA, 25 bp, Mus musculus
ctacaaacacatgccctgtgtggat

SEQ ID NO: 367500 - DNA, 25 bp, Mus musculus
ctacaaaccactcctgactgacata

SEQ ID NO: 367501 - DNA, 25 bp, Mus musculus
ctacaaaccactgctgactgacata

SEQ ID NO: 367502 - DNA, 25 bp, Mus musculus
ctacaaactgtacggacccctgact

SEQ ID NO: 367503 - DNA, 25 bp, Mus musculus
ctacaaactgtagggacccctgact

SEQ ID NO: 367504 - DNA, 25 bp, Mus musculus
ctacaaacttctcaagctcaacctt

SEQ ID NO: 367505 - DNA, 25 bp, Mus musculus
ctacaaacttctgaagctcaacctt

SEQ ID NO: 367506 - DNA, 25 bp, Mus musculus
ctacaaagacccaacattgatgttc

SEQ ID NO: 367507 - DNA, 25 bp, Mus musculus
ctacaaagaccctacattgatgttc

SEQ ID NO: 367508 - DNA, 25 bp, Mus musculus
ctacaacaataactcacacagtgaa

SEQ ID NO: 367509 - DNA, 25 bp, Mus musculus
ctacaacaataagtcacacagtgaa

SEQ ID NO: 367510 - DNA, 25 bp, Mus musculus
ctacaaccctaactctgaagctttt

SEQ ID NO: 367511 - DNA, 25 bp, Mus musculus
ctacaaccctaagtctgaagctttt

SEQ ID NO: 367512 - DNA, 25 bp, Mus musculus
ctacaacctgtgaatctggcgaatt

SEQ ID NO: 367513 - DNA, 25 bp, Mus musculus
ctacaacctgtgtatctggcgaatt

SEQ ID NO: 367514 - DNA, 25 bp, Mus musculus
ctacaactctcgactgcagcgggaa

SEQ ID NO: 367515 - DNA, 25 bp, Mus musculus
ctacaactctcgtctgcagcgggaa

SEQ ID NO: 367516 - DNA, 25 bp, Mus musculus
ctacaactgcccactaactttagca

SEQ ID NO: 367517 - DNA, 25 bp, Mus musculus
ctacaactgccctctaactttagca

SEQ ID NO: 367518 - DNA, 25 bp, Mus musculus
ctacaagagctgacctgtttttgac

SEQ ID NO: 367519 - DNA, 25 bp, Mus musculus
ctacaagagctgtcctgtttttgac

SEQ ID NO: 367520 - DNA, 25 bp, Mus musculus
ctacaagatggacacatcatagcat

SEQ ID NO: 367521 - DNA, 25 bp, Mus musculus
ctacaagatggagacatcatagcat

SEQ ID NO: 367522 - DNA, 25 bp, Mus musculus
ctacaagcaaggaacatttctaata

SEQ ID NO: 367523 - DNA, 25 bp, Mus musculus
ctacaagcaaggtacatttctaata

SEQ ID NO: 367524 - DNA, 25 bp, Mus musculus
ctacaagcatgaaccttccctagag

SEQ ID NO: 367525 - DNA, 25 bp, Mus musculus
ctacaagcatgatccttccctagag

SEQ ID NO: 367526 - DNA, 25 bp, Mus musculus
ctacaaggcccacagctacaggaag

SEQ ID NO: 367527 - DNA, 25 bp, Mus musculus
ctacaaggcccagagctacaggaag

SEQ ID NO: 367528 - DNA, 25 bp, Mus musculus
ctacaagggtacacacaagcactga

SEQ ID NO: 367529 - DNA, 25 bp, Mus musculus
ctacaagggtactcacaagcactga

SEQ ID NO: 367530 - DNA, 25 bp, Mus musculus
ctacaaggtcacagaggtgcaggag

SEQ ID NO: 367531 - DNA, 25 bp, Mus musculus
ctacaaggtcactgaggtgcaggag

SEQ ID NO: 367532 - DNA, 25 bp, Mus musculus
ctacaaggtggacccagtcggatct

SEQ ID NO: 367533 - DNA, 25 bp, Mus musculus
ctacaaggtggagccagtcggatct

SEQ ID NO: 367534 - DNA, 25 bp, Mus musculus
ctacaagtcagtcattattcttctg

SEQ ID NO: 367535 - DNA, 25 bp, Mus musculus
ctacaagtcagtgattattcttctg

SEQ ID NO: 367536 - DNA, 25 bp, Mus musculus
ctacaagtgcagctgagaggcgcct

SEQ ID NO: 367537 - DNA, 25 bp, Mus musculus
ctacaagtgcaggtgagaggcgcct

SEQ ID NO: 367538 - DNA, 25 bp, Mus musculus
ctacaagtgcccaagctgcgataaa

SEQ ID NO: 367539 - DNA, 25 bp, Mus musculus
ctacaagtgccctagctgcgataaa

SEQ ID NO: 367540 - DNA, 25 bp, Mus musculus
ctacaatcatgcaagtctcttcctg

SEQ ID NO: 367541 - DNA, 25 bp, Mus musculus
ctacaatcatgctagtctcttcctg

SEQ ID NO: 367542 - DNA, 25 bp, Mus musculus
ctacaatcatttccaccttttaact

SEQ ID NO: 367543 - DNA, 25 bp, Mus musculus
ctacaatcatttgcaccttttaact

SEQ ID NO: 367544 - DNA, 25 bp, Mus musculus
ctacaatgtgtgctaccacccggac

SEQ ID NO: 367545 - DNA, 25 bp, Mus musculus
ctacaatgtgtggtaccacccggac

SEQ ID NO: 367546 - DNA, 25 bp, Mus musculus
ctacaatttccaatggtggcagctg

SEQ ID NO: 367547 - DNA, 25 bp, Mus musculus
ctacaatttccattggtggcagctg

SEQ ID NO: 367548 - DNA, 25 bp, Mus musculus
ctacacaaccatcccaactgaagtt

SEQ ID NO: 367549 - DNA, 25 bp, Mus musculus
ctacacaaccatgccaactgaagtt

SEQ ID NO: 367550 - DNA, 25 bp, Mus musculus
ctacacagcaaaaccggtgacatgt

SEQ ID NO: 367551 - DNA, 25 bp, Mus musculus
ctacacagcaaatccggtgacatgt

SEQ ID NO: 367552 - DNA, 25 bp, Mus musculus
ctacacaggcccagaggacacaagt

SEQ ID NO: 367553 - DNA, 25 bp, Mus musculus
ctacacaggccctgaggacacaagt

SEQ ID NO: 367554 - DNA, 25 bp, Mus musculus
ctacacagggttcatcatgacattc

SEQ ID NO: 367555 - DNA, 25 bp, Mus musculus
ctacacagggttgatcatgacattc

SEQ ID NO: 367556 - DNA, 25 bp, Mus musculus
ctacacagtaaacacttgccctggg

SEQ ID NO: 367557 - DNA, 25 bp, Mus musculus
ctacacagtaaagacttgccctggg

SEQ ID NO: 367558 - DNA, 25 bp, Mus musculus
ctacacagtacaatttcatttccag

SEQ ID NO: 367559 - DNA, 25 bp, Mus musculus
ctacacagtacattttcatttccag

SEQ ID NO: 367560 - DNA, 25 bp, Mus musculus
ctacacagtaggctgatggcaaaaa

SEQ ID NO: 367561 - DNA, 25 bp, Mus musculus
ctacacagtagggtgatggcaaaaa

SEQ ID NO: 367562 - DNA, 25 bp, Mus musculus
ctacacagtgagatgtcagactgta

SEQ ID NO: 367563 - DNA, 25 bp, Mus musculus
ctacacagtgagttgtcagactgta

SEQ ID NO: 367564 - DNA, 25 bp, Mus musculus
ctacacagttgaactttttggcctg

SEQ ID NO: 367565 - DNA, 25 bp, Mus musculus
ctacacagttgaagtctggttggtt

SEQ ID NO: 367566 - DNA, 25 bp, Mus musculus
ctacacagttgatctttttggcctg

SEQ ID NO: 367567 - DNA, 25 bp, Mus musculus
ctacacagttgatgtctggttggtt

SEQ ID NO: 367568 - DNA, 25 bp, Mus musculus
ctacacatatttacccattctgcta

SEQ ID NO: 367569 - DNA, 25 bp, Mus musculus
ctacacatattttcccattctgcta

SEQ ID NO: 367570 - DNA, 25 bp, Mus musculus
ctacacatcctcatggcaatgggag

SEQ ID NO: 367571 - DNA, 25 bp, Mus musculus
ctacacatcctcttggcaatgggag

SEQ ID NO: 367572 - DNA, 25 bp, Mus musculus
ctacacatgctcaatatcctgacta

SEQ ID NO: 367573 - DNA, 25 bp, Mus musculus
ctacacatgctctatatcctgacta

SEQ ID NO: 367574 - DNA, 25 bp, Mus musculus
ctacaccacagtattacttcccttt

SEQ ID NO: 367575 - DNA, 25 bp, Mus musculus
ctacaccacagttttacttcccttt

SEQ ID NO: 367576 - DNA, 25 bp, Mus musculus
ctacaccacctgatccttcattttc

SEQ ID NO: 367577 - DNA, 25 bp, Mus musculus
ctacaccacctgttccttcattttc

SEQ ID NO: 367578 - DNA, 25 bp, Mus musculus
ctacacccaaggacttcagctttaa

SEQ ID NO: 367579 - DNA, 25 bp, Mus musculus
ctacacccaaggtcttcagctttaa

SEQ ID NO: 367580 - DNA, 25 bp, Mus musculus
ctacacccctttcttgggattctgg

SEQ ID NO: 367581 - DNA, 25 bp, Mus musculus
ctacacccctttgttgggattctgg

SEQ ID NO: 367582 - DNA, 25 bp, Mus musculus
ctacaccctcaactgttgcaagaac

SEQ ID NO: 367583 - DNA, 25 bp, Mus musculus
ctacaccctcaagtgttgcaagaac

SEQ ID NO: 367584 - DNA, 25 bp, Mus musculus
ctacaccgtctgaaaacgtcacact

SEQ ID NO: 367585 - DNA, 25 bp, Mus musculus
ctacaccgtctgtaaacgtcacact

SEQ ID NO: 367586 - DNA, 25 bp, Mus musculus
ctacacctcggcagcaaagtatgaa

SEQ ID NO: 367587 - DNA, 25 bp, Mus musculus
ctacacctcggctgcaaagtatgaa

SEQ ID NO: 367588 - DNA, 25 bp, Mus musculus
ctacacctctctacaggatctaata

SEQ ID NO: 367589 - DNA, 25 bp, Mus musculus
ctacacctctcttcaggatctaata

SEQ ID NO: 367590 - DNA, 25 bp, Mus musculus
ctacaccttaatcactgcattgggc

SEQ ID NO: 367591 - DNA, 25 bp, Mus musculus
ctacaccttaatgactgcattgggc

SEQ ID NO: 367592 - DNA, 25 bp, Mus musculus
ctacacctttcaatctgttcattgg

SEQ ID NO: 367593 - DNA, 25 bp, Mus musculus
ctacacctttcattctgttcattgg

SEQ ID NO: 367594 - DNA, 25 bp, Mus musculus
ctacacgattaaccattctgaggag

SEQ ID NO: 367595 - DNA, 25 bp, Mus musculus
ctacacgattaagcattctgaggag

SEQ ID NO: 367596 - DNA, 25 bp, Mus musculus
ctacacgcgtctcggtaatgacttc

SEQ ID NO: 367597 - DNA, 25 bp, Mus musculus
ctacacgcgtctgggtaatgacttc

SEQ ID NO: 367598 - DNA, 25 bp, Mus musculus
ctacacggagcacgccaagcgcaag

SEQ ID NO: 367599 - DNA, 25 bp, Mus musculus
ctacacggagcaggccaagcgcaag

SEQ ID NO: 367600 - DNA, 25 bp, Mus musculus
ctacacgtggagcaacgaggagttc

SEQ ID NO: 367601 - DNA, 25 bp, Mus musculus
ctacacgtggaggaacgaggagttc

SEQ ID NO: 367602 - DNA, 25 bp, Mus musculus
ctacacgtgtgaagcctgcggcaaa

SEQ ID NO: 367603 - DNA, 25 bp, Mus musculus
ctacacgtgtgatgcctgcggcaaa

SEQ ID NO: 367604 - DNA, 25 bp, Mus musculus
ctacactaacgtcggaaggacagga

SEQ ID NO: 367605 - DNA, 25 bp, Mus musculus
ctacactaacgtgggaaggacagga

SEQ ID NO: 367606 - DNA, 25 bp, Mus musculus
ctacactaatccaggtgacctgagt

SEQ ID NO: 367607 - DNA, 25 bp, Mus musculus
ctacactaatcctggtgacctgagt

SEQ ID NO: 367608 - DNA, 25 bp, Mus musculus
ctacactaccttaatttgatcacat

SEQ ID NO: 367609 - DNA, 25 bp, Mus musculus
ctacactacctttatttgatcacat

SEQ ID NO: 367610 - DNA, 25 bp, Mus musculus
ctacactcagaaacatacacccaaa

SEQ ID NO: 367611 - DNA, 25 bp, Mus musculus
ctacactcagaatcatacacccaaa

SEQ ID NO: 367612 - DNA, 25 bp, Mus musculus
ctacactctgttccgcacactgtgg

SEQ ID NO: 367613 - DNA, 25 bp, Mus musculus
ctacactctgttgcgcacactgtgg

SEQ ID NO: 367614 - DNA, 25 bp, Mus musculus
ctacactctttgctgctcattaaaa

SEQ ID NO: 367615 - DNA, 25 bp, Mus musculus
ctacactctttggtgctcattaaaa

SEQ ID NO: 367616 - DNA, 25 bp, Mus musculus
ctacactgtgctcccttgaaagttt

SEQ ID NO: 367617 - DNA, 25 bp, Mus musculus
ctacactgtgctgccttgaaagttt

SEQ ID NO: 367618 - DNA, 25 bp, Mus musculus
ctacactgtttcatcgctatactta

SEQ ID NO: 367619 - DNA, 25 bp, Mus musculus
ctacactgtttcttcgctatactta

SEQ ID NO: 367620 - DNA, 25 bp, Mus musculus
ctacacttaccacttcctataatat

SEQ ID NO: 367621 - DNA, 25 bp, Mus musculus
ctacacttaccagttcctataatat

SEQ ID NO: 367622 - DNA, 25 bp, Mus musculus
ctacacttcagtatttgatgaggtc

SEQ ID NO: 367623 - DNA, 25 bp, Mus musculus
ctacacttcagtttttgatgaggtc

SEQ ID NO: 367624 - DNA, 25 bp, Mus musculus
ctacacttgtgtagcctggagactg

SEQ ID NO: 367625 - DNA, 25 bp, Mus musculus
ctacacttgtgttgcctggagactg

SEQ ID NO: 367626 - DNA, 25 bp, Mus musculus
ctacactttcctattgctctggaat

SEQ ID NO: 367627 - DNA, 25 bp, Mus musculus
ctacactttccttttgctctggaat

SEQ ID NO: 367628 - DNA, 25 bp, Mus musculus
ctacagaagggcatttgttctaatt

SEQ ID NO: 367629 - DNA, 25 bp, Mus musculus
ctacagaagggcttttgttctaatt

SEQ ID NO: 367630 - DNA, 25 bp, Mus musculus
ctacagaatctaaccgatacccagc

SEQ ID NO: 367631 - DNA, 25 bp, Mus musculus
ctacagaatctatccgatacccagc

SEQ ID NO: 367632 - DNA, 25 bp, Mus musculus
ctacagacctacaccacagacttaa

SEQ ID NO: 367633 - DNA, 25 bp, Mus musculus
ctacagacctactccacagacttaa

SEQ ID NO: 367634 - DNA, 25 bp, Mus musculus
ctacagacctatccttggatgcaga

SEQ ID NO: 367635 - DNA, 25 bp, Mus musculus
ctacagacctatgcttggatgcaga

SEQ ID NO: 367636 - DNA, 25 bp, Mus musculus
ctacagagatgcctactccggaggg

SEQ ID NO: 367637 - DNA, 25 bp, Mus musculus
ctacagagatgcgtactccggaggg

SEQ ID NO: 367638 - DNA, 25 bp, Mus musculus
ctacagagcagtcgctgcagcgaca

SEQ ID NO: 367639 - DNA, 25 bp, Mus musculus
ctacagagcagtggctgcagcgaca

SEQ ID NO: 367640 - DNA, 25 bp, Mus musculus
ctacagaggagcatcgaatttgaca

SEQ ID NO: 367641 - DNA, 25 bp, Mus musculus
ctacagaggagcttcgaatttgaca

SEQ ID NO: 367642 - DNA, 25 bp, Mus musculus
ctacagaggataatcttgttctatg

SEQ ID NO: 367643 - DNA, 25 bp, Mus musculus
ctacagaggatattcttgttctatg

SEQ ID NO: 367644 - DNA, 25 bp, Mus musculus
ctacagaggtggatttgaacccaaa

SEQ ID NO: 367645 - DNA, 25 bp, Mus musculus
ctacagaggtggttttgaacccaaa

SEQ ID NO: 367646 - DNA, 25 bp, Mus musculus
ctacagatcccacaaagttcttgaa

SEQ ID NO: 367647 - DNA, 25 bp, Mus musculus
ctacagatcccagaaagttcttgaa

SEQ ID NO: 367648 - DNA, 25 bp, Mus musculus
ctacagatctccaaaagcctttttc

SEQ ID NO: 367649 - DNA, 25 bp, Mus musculus
ctacagatctcctaaagcctttttc

SEQ ID NO: 367650 - DNA, 25 bp, Mus musculus
ctacagatgtttacttagcttcctt

SEQ ID NO: 367651 - DNA, 25 bp, Mus musculus
ctacagatgttttcttagcttcctt

SEQ ID NO: 367652 - DNA, 25 bp, Mus musculus
ctacagattactacttgctgctgcc

SEQ ID NO: 367653 - DNA, 25 bp, Mus musculus
ctacagattacttcttgctgctgcc

SEQ ID NO: 367654 - DNA, 25 bp, Mus musculus
ctacagattagtatttcctctggcc

SEQ ID NO: 367655 - DNA, 25 bp, Mus musculus
ctacagattagtttttcctctggcc

SEQ ID NO: 367656 - DNA, 25 bp, Mus musculus
ctacagattctacgtcagaccctca

SEQ ID NO: 367657 - DNA, 25 bp, Mus musculus
ctacagattctaggtcagaccctca

SEQ ID NO: 367658 - DNA, 25 bp, Mus musculus
ctacagatttcaatcaagacagact

SEQ ID NO: 367659 - DNA, 25 bp, Mus musculus
ctacagatttcattcaagacagact

SEQ ID NO: 367660 - DNA, 25 bp, Mus musculus
ctacagcaccatcagggagtcaata

SEQ ID NO: 367661 - DNA, 25 bp, Mus musculus
ctacagcaccatgagggagtcaata

SEQ ID NO: 367662 - DNA, 25 bp, Mus musculus
ctacagcacctcctgccatgattag

SEQ ID NO: 367663 - DNA, 25 bp, Mus musculus
ctacagcacctcgtgccatgattag

SEQ ID NO: 367664 - DNA, 25 bp, Mus musculus
ctacagccaaggctggcagacgcga

SEQ ID NO: 367665 - DNA, 25 bp, Mus musculus
ctacagccaagggtggcagacgcga

SEQ ID NO: 367666 - DNA, 25 bp, Mus musculus
ctacagccaatcctccaattaaatg

SEQ ID NO: 367667 - DNA, 25 bp, Mus musculus
ctacagccaatcgtccaattaaatg

SEQ ID NO: 367668 - DNA, 25 bp, Mus musculus
ctacagccagctcaggctgtgactt

SEQ ID NO: 367669 - DNA, 25 bp, Mus musculus
ctacagccagctgaggctgtgactt

SEQ ID NO: 367670 - DNA, 25 bp, Mus musculus
ctacagcctatgagcttctttgatt

SEQ ID NO: 367671 - DNA, 25 bp, Mus musculus
ctacagcctatgtgcttctttgatt

SEQ ID NO: 367672 - DNA, 25 bp, Mus musculus
ctacagcctcagaattgatggtcat

SEQ ID NO: 367673 - DNA, 25 bp, Mus musculus
ctacagcctcagtattgatggtcat

SEQ ID NO: 367674 - DNA, 25 bp, Mus musculus
ctacagcctgctatcttcatatttt

SEQ ID NO: 367675 - DNA, 25 bp, Mus musculus
ctacagcctgctttcttcatatttt

SEQ ID NO: 367676 - DNA, 25 bp, Mus musculus
ctacagcgctagattcaggacaggt

SEQ ID NO: 367677 - DNA, 25 bp, Mus musculus
ctacagcgctagtttcaggacaggt

SEQ ID NO: 367678 - DNA, 25 bp, Mus musculus
ctacagctacataccagctctttga

SEQ ID NO: 367679 - DNA, 25 bp, Mus musculus
ctacagctacattccagctctttga

SEQ ID NO: 367680 - DNA, 25 bp, Mus musculus
ctacagctggacatataggcagttc

SEQ ID NO: 367681 - DNA, 25 bp, Mus musculus
ctacagctggacttataggcagttc

SEQ ID NO: 367682 - DNA, 25 bp, Mus musculus
ctacagcttcagaggccgacataaa

SEQ ID NO: 367683 - DNA, 25 bp, Mus musculus
ctacagcttcagtggccgacataaa

SEQ ID NO: 367684 - DNA, 25 bp, Mus musculus
ctacaggaactgaggcacatcggta

SEQ ID NO: 367685 - DNA, 25 bp, Mus musculus
ctacaggaactgtggcacatcggta

SEQ ID NO: 367686 - DNA, 25 bp, Mus musculus
ctacaggacggcaggttccaggaca

SEQ ID NO: 367687 - DNA, 25 bp, Mus musculus
ctacaggacggctggttccaggaca

SEQ ID NO: 367688 - DNA, 25 bp, Mus musculus
ctacaggagaggcaagaccttcttc

SEQ ID NO: 367689 - DNA, 25 bp, Mus musculus
ctacaggagagggaagaccttcttc

SEQ ID NO: 367690 - DNA, 25 bp, Mus musculus
ctacaggagcccacatgagtgtgca

SEQ ID NO: 367691 - DNA, 25 bp, Mus musculus
ctacaggagccctcatgagtgtgca

SEQ ID NO: 367692 - DNA, 25 bp, Mus musculus
ctacaggcacctcctaggcgtggag

SEQ ID NO: 367693 - DNA, 25 bp, Mus musculus
ctacaggcacctgctaggcgtggag

SEQ ID NO: 367694 - DNA, 25 bp, Mus musculus
ctacaggcgtcgattcgcggtcgcg

SEQ ID NO: 367695 - DNA, 25 bp, Mus musculus
ctacaggcgtcgctttaacttagag

SEQ ID NO: 367696 - DNA, 25 bp, Mus musculus
ctacaggcgtcggtttaacttagag

SEQ ID NO: 367697 - DNA, 25 bp, Mus musculus
ctacaggcgtcgtttcgcggtcgcg

SEQ ID NO: 367698 - DNA, 25 bp, Mus musculus
ctacaggcgtgaaaaagaggatctt

SEQ ID NO: 367699 - DNA, 25 bp, Mus musculus
ctacaggcgtgataaagaggatctt

SEQ ID NO: 367700 - DNA, 25 bp, Mus musculus
ctacagggaattcaagcttaccttt

SEQ ID NO: 367701 - DNA, 25 bp, Mus musculus
ctacagggaattgaagcttaccttt

SEQ ID NO: 367702 - DNA, 25 bp, Mus musculus
ctacagggacatcgagggaatctca

SEQ ID NO: 367703 - DNA, 25 bp, Mus musculus
ctacagggacatggagggaatctca

SEQ ID NO: 367704 - DNA, 25 bp, Mus musculus
ctacagggactcattaaagccaatc

SEQ ID NO: 367705 - DNA, 25 bp, Mus musculus
ctacagggactctttaaagccaatc

SEQ ID NO: 367706 - DNA, 25 bp, Mus musculus
ctacagggcctacagaggatgactt

SEQ ID NO: 367707 - DNA, 25 bp, Mus musculus
ctacagggcctagagaggatgactt

SEQ ID NO: 367708 - DNA, 25 bp, Mus musculus
ctacagggtccacatgtgcgctctg

SEQ ID NO: 367709 - DNA, 25 bp, Mus musculus
ctacagggtccagatgtgcgctctg

SEQ ID NO: 367710 - DNA, 25 bp, Mus musculus
ctacagggtcctcatgaaacctacc

SEQ ID NO: 367711 - DNA, 25 bp, Mus musculus
ctacagggtcctgatgaaacctacc

SEQ ID NO: 367712 - DNA, 25 bp, Mus musculus
ctacaggtaatacaggagagctcca

SEQ ID NO: 367713 - DNA, 25 bp, Mus musculus
ctacaggtaatagaggagagctcca

SEQ ID NO: 367714 - DNA, 25 bp, Mus musculus
ctacaggtccggaagaataagcgcc

SEQ ID NO: 367715 - DNA, 25 bp, Mus musculus
ctacaggtccggtagaataagcgcc

SEQ ID NO: 367716 - DNA, 25 bp, Mus musculus
ctacaggtcgaaaagaagtcatcaa

SEQ ID NO: 367717 - DNA, 25 bp, Mus musculus
ctacaggtcgaatagaagtcatcaa

SEQ ID NO: 367718 - DNA, 25 bp, Mus musculus
ctacaggtggaaaagcaaggctgac

SEQ ID NO: 367719 - DNA, 25 bp, Mus musculus
ctacaggtggaatagcaaggctgac

SEQ ID NO: 367720 - DNA, 25 bp, Mus musculus
ctacagtaatatcaacttcgaagtg

SEQ ID NO: 367721 - DNA, 25 bp, Mus musculus
ctacagtaatatgaacttcgaagtg

SEQ ID NO: 367722 - DNA, 25 bp, Mus musculus
ctacagtacagccatggtgaatgat

SEQ ID NO: 367723 - DNA, 25 bp, Mus musculus
ctacagtacagcgatggtgaatgat

SEQ ID NO: 367724 - DNA, 25 bp, Mus musculus
ctacagtcagagctatcttccattt

SEQ ID NO: 367725 - DNA, 25 bp, Mus musculus
ctacagtcagaggtatcttccattt

SEQ ID NO: 367726 - DNA, 25 bp, Mus musculus
ctacagtcattaatcaaggctcatg

SEQ ID NO: 367727 - DNA, 25 bp, Mus musculus
ctacagtcattattcaaggctcatg

SEQ ID NO: 367728 - DNA, 25 bp, Mus musculus
ctacagtccccacgcagaatgtgag

SEQ ID NO: 367729 - DNA, 25 bp, Mus musculus
ctacagtccccaggcagaatgtgag

SEQ ID NO: 367730 - DNA, 25 bp, Mus musculus
ctacagtctttgaagccgttcctat

SEQ ID NO: 367731 - DNA, 25 bp, Mus musculus
ctacagtctttgtagccgttcctat

SEQ ID NO: 367732 - DNA, 25 bp, Mus musculus
ctacagtgagggagagcagtttgca

SEQ ID NO: 367733 - DNA, 25 bp, Mus musculus
ctacagtgagggtgagcagtttgca

SEQ ID NO: 367734 - DNA, 25 bp, Mus musculus
ctacagtgtagccagtgcaaaaact

SEQ ID NO: 367735 - DNA, 25 bp, Mus musculus
ctacagtgtagcgagtgcaaaaact

SEQ ID NO: 367736 - DNA, 25 bp, Mus musculus
ctacagtgtattctttcccatgcaa

SEQ ID NO: 367737 - DNA, 25 bp, Mus musculus
ctacagtgtattgtttcccatgcaa

SEQ ID NO: 367738 - DNA, 25 bp, Mus musculus
ctacagtgtgatcccgcagattcag

SEQ ID NO: 367739 - DNA, 25 bp, Mus musculus
ctacagtgtgatgccgcagattcag

SEQ ID NO: 367740 - DNA, 25 bp, Mus musculus
ctacagtgtgtacgcagggtacagc

SEQ ID NO: 367741 - DNA, 25 bp, Mus musculus
ctacagtgtgtaggcagggtacagc

SEQ ID NO: 367742 - DNA, 25 bp, Mus musculus
ctacagtgttgtccccagctgggtg

SEQ ID NO: 367743 - DNA, 25 bp, Mus musculus
ctacagtgttgtgcccagctgggtg

SEQ ID NO: 367744 - DNA, 25 bp, Mus musculus
ctacagttagatataaagcttttga

SEQ ID NO: 367745 - DNA, 25 bp, Mus musculus
ctacagttagatttaaagcttttga

SEQ ID NO: 367746 - DNA, 25 bp, Mus musculus
ctacagttctgtaccaagggtactt

SEQ ID NO: 367747 - DNA, 25 bp, Mus musculus
ctacagttctgttccaagggtactt

SEQ ID NO: 367748 - DNA, 25 bp, Mus musculus
ctacagttgttcacggaatcccaca

SEQ ID NO: 367749 - DNA, 25 bp, Mus musculus
ctacagttgttctcggaatcccaca

SEQ ID NO: 367750 - DNA, 25 bp, Mus musculus
ctacagtttcctattatgcagtttt

SEQ ID NO: 367751 - DNA, 25 bp, Mus musculus
ctacagtttccttttatgcagtttt

SEQ ID NO: 367752 - DNA, 25 bp, Mus musculus
ctacagtttgacaaggtccttccta

SEQ ID NO: 367753 - DNA, 25 bp, Mus musculus
ctacagtttgactaggtccttccta

SEQ ID NO: 367754 - DNA, 25 bp, Mus musculus
ctacagttttgtcatttcgaggtga

SEQ ID NO: 367755 - DNA, 25 bp, Mus musculus
ctacagttttgtgatttcgaggtga

SEQ ID NO: 367756 - DNA, 25 bp, Mus musculus
ctacatacagccattggttccctga

SEQ ID NO: 367757 - DNA, 25 bp, Mus musculus
ctacatacagcctttggttccctga

SEQ ID NO: 367758 - DNA, 25 bp, Mus musculus
ctacatacatccctgcagcaggaaa

SEQ ID NO: 367759 - DNA, 25 bp, Mus musculus
ctacatacatccgtgcagcaggaaa

SEQ ID NO: 367760 - DNA, 25 bp, Mus musculus
ctacataggagacgcagagacattt

SEQ ID NO: 367761 - DNA, 25 bp, Mus musculus
ctacataggagaggcagagacattt

SEQ ID NO: 367762 - DNA, 25 bp, Mus musculus
ctacatagtaacatgtgcctcaaaa

SEQ ID NO: 367763 - DNA, 25 bp, Mus musculus
ctacatagtaacttgtgcctcaaaa

SEQ ID NO: 367764 - DNA, 25 bp, Mus musculus
ctacatagtaagctctaggtcagtc

SEQ ID NO: 367765 - DNA, 25 bp, Mus musculus
ctacatagtaaggtctaggtcagtc

SEQ ID NO: 367766 - DNA, 25 bp, Mus musculus
ctacatagttatcgccggatttgct

SEQ ID NO: 367767 - DNA, 25 bp, Mus musculus
ctacatagttatggccggatttgct

SEQ ID NO: 367768 - DNA, 25 bp, Mus musculus
ctacatattgagatgtctggcagag

SEQ ID NO: 367769 - DNA, 25 bp, Mus musculus
ctacatattgagttgtctggcagag

SEQ ID NO: 367770 - DNA, 25 bp, Mus musculus
ctacatcaagcacctgtcattcggg

SEQ ID NO: 367771 - DNA, 25 bp, Mus musculus
ctacatcaagcagctgtcattcggg

SEQ ID NO: 367772 - DNA, 25 bp, Mus musculus
ctacatcaatgaccttcggactttt

SEQ ID NO: 367773 - DNA, 25 bp, Mus musculus
ctacatcaatgagcttcggactttt

SEQ ID NO: 367774 - DNA, 25 bp, Mus musculus
ctacatcagcggcagattgacttag

SEQ ID NO: 367775 - DNA, 25 bp, Mus musculus
ctacatcagcgggagattgacttag

SEQ ID NO: 367776 - DNA, 25 bp, Mus musculus
ctacatcagggtccgcttttatgaa

SEQ ID NO: 367777 - DNA, 25 bp, Mus musculus
ctacatcagggtccggttctatgag

SEQ ID NO: 367778 - DNA, 25 bp, Mus musculus
ctacatcagggtgcgcttttatgaa

SEQ ID NO: 367779 - DNA, 25 bp, Mus musculus
ctacatcagggtgcggttctatgag

SEQ ID NO: 367780 - DNA, 25 bp, Mus musculus
ctacatcatccgaatgagcaccagt

SEQ ID NO: 367781 - DNA, 25 bp, Mus musculus
ctacatcatccgtatgagcaccagt

SEQ ID NO: 367782 - DNA, 25 bp, Mus musculus
ctacatccggttatcccagatctgt

SEQ ID NO: 367783 - DNA, 25 bp, Mus musculus
ctacatccggttttcccagatctgt

SEQ ID NO: 367784 - DNA, 25 bp, Mus musculus
ctacatcctgacacgtggctggtta

SEQ ID NO: 367785 - DNA, 25 bp, Mus musculus
ctacatcctgactcgtggctggtta

SEQ ID NO: 367786 - DNA, 25 bp, Mus musculus
ctacatcgttgaacttgaagccagg

SEQ ID NO: 367787 - DNA, 25 bp, Mus musculus
ctacatcgttgatcttgaagccagg

SEQ ID NO: 367788 - DNA, 25 bp, Mus musculus
ctacatctaaggcatcatgtgctac

SEQ ID NO: 367789 - DNA, 25 bp, Mus musculus
ctacatctaagggatcatgtgctac

SEQ ID NO: 367790 - DNA, 25 bp, Mus musculus
ctacatctagcacccagtagtagaa

SEQ ID NO: 367791 - DNA, 25 bp, Mus musculus
ctacatctagcagccagtagtagaa

SEQ ID NO: 367792 - DNA, 25 bp, Mus musculus
ctacatctgatcaagggctaatata

SEQ ID NO: 367793 - DNA, 25 bp, Mus musculus
ctacatctgatctagggctaatata

SEQ ID NO: 367794 - DNA, 25 bp, Mus musculus
ctacatcttccaaatcctgacaaag

SEQ ID NO: 367795 - DNA, 25 bp, Mus musculus
ctacatcttccatatcctgacaaag

SEQ ID NO: 367796 - DNA, 25 bp, Mus musculus
ctacatgaatatagccctggaacag

SEQ ID NO: 367797 - DNA, 25 bp, Mus musculus
ctacatgaatattgccctggaacag

SEQ ID NO: 367798 - DNA, 25 bp, Mus musculus
ctacatgacaggcacaggacaagca

SEQ ID NO: 367799 - DNA, 25 bp, Mus musculus
ctacatgacagggacaggacaagca

SEQ ID NO: 367800 - DNA, 25 bp, Mus musculus
ctacatgacatacaattgagcccca

SEQ ID NO: 367801 - DNA, 25 bp, Mus musculus
ctacatgacatagaattgagcccca

SEQ ID NO: 367802 - DNA, 25 bp, Mus musculus
ctacatgacttgctatcctgtgttc

SEQ ID NO: 367803 - DNA, 25 bp, Mus musculus
ctacatgacttggtatcctgtgttc

SEQ ID NO: 367804 - DNA, 25 bp, Mus musculus
ctacatgagctcagggcctgtggtg

SEQ ID NO: 367805 - DNA, 25 bp, Mus musculus
ctacatgagctctgggcctgtggtg

SEQ ID NO: 367806 - DNA, 25 bp, Mus musculus
ctacatgattgtaaccacattgtgg

SEQ ID NO: 367807 - DNA, 25 bp, Mus musculus
ctacatgattgttaccacattgtgg

SEQ ID NO: 367808 - DNA, 25 bp, Mus musculus
ctacatgccagtcttacctcattac

SEQ ID NO: 367809 - DNA, 25 bp, Mus musculus
ctacatgccagtgttacctcattac

SEQ ID NO: 367810 - DNA, 25 bp, Mus musculus
ctacatgcctgcaggagatgcccag

SEQ ID NO: 367811 - DNA, 25 bp, Mus musculus
ctacatgcctgctggagatgcccag

SEQ ID NO: 367812 - DNA, 25 bp, Mus musculus
ctacatgctaacactgactttcaga

SEQ ID NO: 367813 - DNA, 25 bp, Mus musculus
ctacatgctaactctgactttcaga

SEQ ID NO: 367814 - DNA, 25 bp, Mus musculus
ctacatgctgaaaaccatctattac

SEQ ID NO: 367815 - DNA, 25 bp, Mus musculus
ctacatgctgaataccatctattac

SEQ ID NO: 367816 - DNA, 25 bp, Mus musculus
ctacatggcatacaacatagcattc

SEQ ID NO: 367817 - DNA, 25 bp, Mus musculus
ctacatggcatagaacatagcattc

SEQ ID NO: 367818 - DNA, 25 bp, Mus musculus
ctacatggctcacggctgactgggc

SEQ ID NO: 367819 - DNA, 25 bp, Mus musculus
ctacatggctcagggctgactgggc

SEQ ID NO: 367820 - DNA, 25 bp, Mus musculus
ctacatgggagcctctctctaaaag

SEQ ID NO: 367821 - DNA, 25 bp, Mus musculus
ctacatgggagcgtctctctaaaag

SEQ ID NO: 367822 - DNA, 25 bp, Mus musculus
ctacatgggtgtatttctaggacta

SEQ ID NO: 367823 - DNA, 25 bp, Mus musculus
ctacatgggtgtttttctaggacta

SEQ ID NO: 367824 - DNA, 25 bp, Mus musculus
ctacatggtcctcgctatcctataa

SEQ ID NO: 367825 - DNA, 25 bp, Mus musculus
ctacatggtcctggctatcctataa

SEQ ID NO: 367826 - DNA, 25 bp, Mus musculus
ctacatggtggtaggagagaacaga

SEQ ID NO: 367827 - DNA, 25 bp, Mus musculus
ctacatggtggttggagagaacaga

SEQ ID NO: 367828 - DNA, 25 bp, Mus musculus
ctacatgtattgatgtggttttatt

SEQ ID NO: 367829 - DNA, 25 bp, Mus musculus
ctacatgtattgttgtggttttatt

SEQ ID NO: 367830 - DNA, 25 bp, Mus musculus
ctacatgtgtttaagcagtcacctt

SEQ ID NO: 367831 - DNA, 25 bp, Mus musculus
ctacatgtgttttagcagtcacctt

SEQ ID NO: 367832 - DNA, 25 bp, Mus musculus
ctacatgttccactatgactccact

SEQ ID NO: 367833 - DNA, 25 bp, Mus musculus
ctacatgttccagtatgactccact

SEQ ID NO: 367834 - DNA, 25 bp, Mus musculus
ctacattagtttccctttctgattc

SEQ ID NO: 367835 - DNA, 25 bp, Mus musculus
ctacattagtttgcctttctgattc

SEQ ID NO: 367836 - DNA, 25 bp, Mus musculus
ctacattcacgtaatttattggtgt

SEQ ID NO: 367837 - DNA, 25 bp, Mus musculus
ctacattcacgttatttattggtgt

SEQ ID NO: 367838 - DNA, 25 bp, Mus musculus
ctacattcacttactcttgactctg

SEQ ID NO: 367839 - DNA, 25 bp, Mus musculus
ctacattcactttctcttgactctg

SEQ ID NO: 367840 - DNA, 25 bp, Mus musculus
ctacattcatggaagcagccaggct

SEQ ID NO: 367841 - DNA, 25 bp, Mus musculus
ctacattcatggtagcagccaggct

SEQ ID NO: 367842 - DNA, 25 bp, Mus musculus
ctacattcgtctcattgctgcagtg

SEQ ID NO: 367843 - DNA, 25 bp, Mus musculus
ctacattcgtctgattgctgcagtg

SEQ ID NO: 367844 - DNA, 25 bp, Mus musculus
ctacattctctgagaatatggcgtt

SEQ ID NO: 367845 - DNA, 25 bp, Mus musculus
ctacattctctgtgaatatggcgtt

SEQ ID NO: 367846 - DNA, 25 bp, Mus musculus
ctacattctttaatttgaccccaga

SEQ ID NO: 367847 - DNA, 25 bp, Mus musculus
ctacattctttattttgaccccaga

SEQ ID NO: 367848 - DNA, 25 bp, Mus musculus
ctacattcttttcagttgcagcaca

SEQ ID NO: 367849 - DNA, 25 bp, Mus musculus
ctacattcttttgagttgcagcaca

SEQ ID NO: 367850 - DNA, 25 bp, Mus musculus
ctacattgaacaacccagtgggttt

SEQ ID NO: 367851 - DNA, 25 bp, Mus musculus
ctacattgaacatcccagtgggttt

SEQ ID NO: 367852 - DNA, 25 bp, Mus musculus
ctacattgcgaacgacatcacagat

SEQ ID NO: 367853 - DNA, 25 bp, Mus musculus
ctacattgcgaaggacatcacagat

SEQ ID NO: 367854 - DNA, 25 bp, Mus musculus
ctacattgtcttcgcctcttttgag

SEQ ID NO: 367855 - DNA, 25 bp, Mus musculus
ctacattgtcttggcctcttttgag

SEQ ID NO: 367856 - DNA, 25 bp, Mus musculus
ctacatttacacatctagcagtcag

SEQ ID NO: 367857 - DNA, 25 bp, Mus musculus
ctacatttacacttctagcagtcag

SEQ ID NO: 367858 - DNA, 25 bp, Mus musculus
ctacatttatgaccaggagacccaa

SEQ ID NO: 367859 - DNA, 25 bp, Mus musculus
ctacatttatgagcaggagacccaa

SEQ ID NO: 367860 - DNA, 25 bp, Mus musculus
ctacattttaacatggacctttagg

SEQ ID NO: 367861 - DNA, 25 bp, Mus musculus
ctacattttaacttggacctttagg

SEQ ID NO: 367862 - DNA, 25 bp, Mus musculus
ctaccaaaagtacagagcagacaaa

SEQ ID NO: 367863 - DNA, 25 bp, Mus musculus
ctaccaaaagtagagagcagacaaa

SEQ ID NO: 367864 - DNA, 25 bp, Mus musculus
ctaccaaacttcaccagctgataaa

SEQ ID NO: 367865 - DNA, 25 bp, Mus musculus
ctaccaaacttctccagctgataaa

SEQ ID NO: 367866 - DNA, 25 bp, Mus musculus
ctaccaaattgcactttttctacct

SEQ ID NO: 367867 - DNA, 25 bp, Mus musculus
ctaccaaattgctctttttctacct

SEQ ID NO: 367868 - DNA, 25 bp, Mus musculus
ctaccaacacagctatctcttgatg

SEQ ID NO: 367869 - DNA, 25 bp, Mus musculus
ctaccaacacaggtatctcttgatg

SEQ ID NO: 367870 - DNA, 25 bp, Mus musculus
ctaccaacgccgaggtgctcaaggt

SEQ ID NO: 367871 - DNA, 25 bp, Mus musculus
ctaccaacgccgtggtgctcaaggt

SEQ ID NO: 367872 - DNA, 25 bp, Mus musculus
ctaccaactccaaccagagctgctg

SEQ ID NO: 367873 - DNA, 25 bp, Mus musculus
ctaccaactccatccagagctgctg

SEQ ID NO: 367874 - DNA, 25 bp, Mus musculus
ctaccaactcttacacatcacaaaa

SEQ ID NO: 367875 - DNA, 25 bp, Mus musculus
ctaccaactctttcacatcacaaaa

SEQ ID NO: 367876 - DNA, 25 bp, Mus musculus
ctaccaagaacgctcaaagtgccaa

SEQ ID NO: 367877 - DNA, 25 bp, Mus musculus
ctaccaagaacggtcaaagtgccaa

SEQ ID NO: 367878 - DNA, 25 bp, Mus musculus
ctaccaagagctataccttcttcaa

SEQ ID NO: 367879 - DNA, 25 bp, Mus musculus
ctaccaagagctttaccttcttcaa

SEQ ID NO: 367880 - DNA, 25 bp, Mus musculus
ctaccaagggtgagctttgtgatct

SEQ ID NO: 367881 - DNA, 25 bp, Mus musculus
ctaccaagggtgtgctttgtgatct

SEQ ID NO: 367882 - DNA, 25 bp, Mus musculus
ctaccaagtgcaccagtgcaggacc

SEQ ID NO: 367883 - DNA, 25 bp, Mus musculus
ctaccaagtgcagcagtgcaggacc

SEQ ID NO: 367884 - DNA, 25 bp, Mus musculus
ctaccaagtgggatcaggacaacca

SEQ ID NO: 367885 - DNA, 25 bp, Mus musculus
ctaccaagtgggttcaggacaacca

SEQ ID NO: 367886 - DNA, 25 bp, Mus musculus
ctaccaattaagcacatcctaccat

SEQ ID NO: 367887 - DNA, 25 bp, Mus musculus
ctaccaattaaggacatcctaccat

SEQ ID NO: 367888 - DNA, 25 bp, Mus musculus
ctaccaatttcaatttggacagttt

SEQ ID NO: 367889 - DNA, 25 bp, Mus musculus
ctaccaatttcattttggacagttt

SEQ ID NO: 367890 - DNA, 25 bp, Mus musculus
ctaccacaaggactttgcctctgaa

SEQ ID NO: 367891 - DNA, 25 bp, Mus musculus
ctaccacaaggagtttgcctctgaa

SEQ ID NO: 367892 - DNA, 25 bp, Mus musculus
ctaccacatgtacgcagatccaaat

SEQ ID NO: 367893 - DNA, 25 bp, Mus musculus
ctaccacatgtaggcagatccaaat

SEQ ID NO: 367894 - DNA, 25 bp, Mus musculus
ctaccaccaagtcaagcttttacaa

SEQ ID NO: 367895 - DNA, 25 bp, Mus musculus
ctaccaccaagtgaagcttttacaa

SEQ ID NO: 367896 - DNA, 25 bp, Mus musculus
ctaccacccttgcaactgttgtgaa

SEQ ID NO: 367897 - DNA, 25 bp, Mus musculus
ctaccacccttggaactgttgtgaa

SEQ ID NO: 367898 - DNA, 25 bp, Mus musculus
ctaccaccgctgactgactttgggt

SEQ ID NO: 367899 - DNA, 25 bp, Mus musculus
ctaccaccgctgtctgactttgggt

SEQ ID NO: 367900 - DNA, 25 bp, Mus musculus
ctaccacctagcattgctttctcaa

SEQ ID NO: 367901 - DNA, 25 bp, Mus musculus
ctaccacctagctttgctttctcaa

SEQ ID NO: 367902 - DNA, 25 bp, Mus musculus
ctaccaccttcacttcatttatgtt

SEQ ID NO: 367903 - DNA, 25 bp, Mus musculus
ctaccaccttcagttcatttatgtt

SEQ ID NO: 367904 - DNA, 25 bp, Mus musculus
ctaccacggagcaatgacacaggat

SEQ ID NO: 367905 - DNA, 25 bp, Mus musculus
ctaccacggagctatgacacaggat

SEQ ID NO: 367906 - DNA, 25 bp, Mus musculus
ctaccacggtatctatcataacact

SEQ ID NO: 367907 - DNA, 25 bp, Mus musculus
ctaccacggtatgtatcataacact

SEQ ID NO: 367908 - DNA, 25 bp, Mus musculus
ctaccacgtgttactcagatacatc

SEQ ID NO: 367909 - DNA, 25 bp, Mus musculus
ctaccacgtgtttctcagatacatc

SEQ ID NO: 367910 - DNA, 25 bp, Mus musculus
ctaccactaaaccaatgggtctcct

SEQ ID NO: 367911 - DNA, 25 bp, Mus musculus
ctaccactaaacgaatgggtctcct

SEQ ID NO: 367912 - DNA, 25 bp, Mus musculus
ctaccactcgctcggcatcttggga

SEQ ID NO: 367913 - DNA, 25 bp, Mus musculus
ctaccactcgctgggcatcttggga

SEQ ID NO: 367914 - DNA, 25 bp, Mus musculus
ctaccactgcaacggctatcttagg

SEQ ID NO: 367915 - DNA, 25 bp, Mus musculus
ctaccactgcaagggctatcttagg

SEQ ID NO: 367916 - DNA, 25 bp, Mus musculus
ctaccactgctaaaggctagttcca

SEQ ID NO: 367917 - DNA, 25 bp, Mus musculus
ctaccactgctataggctagttcca

SEQ ID NO: 367918 - DNA, 25 bp, Mus musculus
ctaccacttagacactcaacagctt

SEQ ID NO: 367919 - DNA, 25 bp, Mus musculus
ctaccacttagagactcaacagctt

SEQ ID NO: 367920 - DNA, 25 bp, Mus musculus
ctaccactttcacaagttgaattat

SEQ ID NO: 367921 - DNA, 25 bp, Mus musculus
ctaccactttcagaagttgaattat

SEQ ID NO: 367922 - DNA, 25 bp, Mus musculus
ctaccagaatggcatcagactcgaa

SEQ ID NO: 367923 - DNA, 25 bp, Mus musculus
ctaccagaatgggatcagactcgaa

SEQ ID NO: 367924 - DNA, 25 bp, Mus musculus
ctaccagagcatattttccgagata

SEQ ID NO: 367925 - DNA, 25 bp, Mus musculus
ctaccagagcattttttccgagata

SEQ ID NO: 367926 - DNA, 25 bp, Mus musculus
ctaccagcatcccagtttggaaagt

SEQ ID NO: 367927 - DNA, 25 bp, Mus musculus
ctaccagcatccgagtttggaaagt

SEQ ID NO: 367928 - DNA, 25 bp, Mus musculus
ctaccagcgcttcatgacagaaaac

SEQ ID NO: 367929 - DNA, 25 bp, Mus musculus
ctaccagcgcttgatgacagaaaac

SEQ ID NO: 367930 - DNA, 25 bp, Mus musculus
ctaccagctggtctgcgaaagcgat

SEQ ID NO: 367931 - DNA, 25 bp, Mus musculus
ctaccagctggtgtgcgaaagcgat

SEQ ID NO: 367932 - DNA, 25 bp, Mus musculus
ctaccagggccacttttcaacggag

SEQ ID NO: 367933 - DNA, 25 bp, Mus musculus
ctaccagggccagttttcaacggag

SEQ ID NO: 367934 - DNA, 25 bp, Mus musculus
ctaccagtactgactgctcactgaa

SEQ ID NO: 367935 - DNA, 25 bp, Mus musculus
ctaccagtactgtctgctcactgaa

SEQ ID NO: 367936 - DNA, 25 bp, Mus musculus
ctaccagtctttaccatgtatgcat

SEQ ID NO: 367937 - DNA, 25 bp, Mus musculus
ctaccagtcttttccatgtatgcat

SEQ ID NO: 367938 - DNA, 25 bp, Mus musculus
ctaccagtgaaaatgctagcattga

SEQ ID NO: 367939 - DNA, 25 bp, Mus musculus
ctaccagtgaaattgctagcattga

SEQ ID NO: 367940 - DNA, 25 bp, Mus musculus
ctaccagtgtatcggctgttgcttc

SEQ ID NO: 367941 - DNA, 25 bp, Mus musculus
ctaccagtgtatgggctgttgcttc

SEQ ID NO: 367942 - DNA, 25 bp, Mus musculus
ctaccagtgtctatatgggaggaag

SEQ ID NO: 367943 - DNA, 25 bp, Mus musculus
ctaccagtgtctttatgggaggaag

SEQ ID NO: 367944 - DNA, 25 bp, Mus musculus
ctaccagttctccatggtgggcgga

SEQ ID NO: 367945 - DNA, 25 bp, Mus musculus
ctaccagttctcgatggtgggcgga

SEQ ID NO: 367946 - DNA, 25 bp, Mus musculus
ctaccatatatcaggttggccttca

SEQ ID NO: 367947 - DNA, 25 bp, Mus musculus
ctaccatatatctggttggccttca

SEQ ID NO: 367948 - DNA, 25 bp, Mus musculus
ctaccatccgcactgagagtattcg

SEQ ID NO: 367949 - DNA, 25 bp, Mus musculus
ctaccatccgcagtgagagtattcg

SEQ ID NO: 367950 - DNA, 25 bp, Mus musculus
ctaccatccttaatctctgagtcag

SEQ ID NO: 367951 - DNA, 25 bp, Mus musculus
ctaccatccttattctctgagtcag

SEQ ID NO: 367952 - DNA, 25 bp, Mus musculus
ctaccatgagtcattcttctttcca

SEQ ID NO: 367953 - DNA, 25 bp, Mus musculus
ctaccatgagtctttcttctttcca

SEQ ID NO: 367954 - DNA, 25 bp, Mus musculus
ctaccatggcgaccgtaactggcta

SEQ ID NO: 367955 - DNA, 25 bp, Mus musculus
ctaccatggcgagcgtaactggcta

SEQ ID NO: 367956 - DNA, 25 bp, Mus musculus
ctaccatggctgactttactcaaga

SEQ ID NO: 367957 - DNA, 25 bp, Mus musculus
ctaccatggctgtctttactcaaga

SEQ ID NO: 367958 - DNA, 25 bp, Mus musculus
ctaccatgttggagtgttcacctgt

SEQ ID NO: 367959 - DNA, 25 bp, Mus musculus
ctaccatgttggtgtgttcacctgt

SEQ ID NO: 367960 - DNA, 25 bp, Mus musculus
ctaccatgtttgctcccgataaata

SEQ ID NO: 367961 - DNA, 25 bp, Mus musculus
ctaccatgtttggtcccgataaata

SEQ ID NO: 367962 - DNA, 25 bp, Mus musculus
ctaccattataactagatctacacc

SEQ ID NO: 367963 - DNA, 25 bp, Mus musculus
ctaccattataagtagatctacacc

SEQ ID NO: 367964 - DNA, 25 bp, Mus musculus
ctaccattgggtattaacatactaa

SEQ ID NO: 367965 - DNA, 25 bp, Mus musculus
ctaccattgggttttaacatactaa

SEQ ID NO: 367966 - DNA, 25 bp, Mus musculus
ctacccaaatcgattcttttctcta

SEQ ID NO: 367967 - DNA, 25 bp, Mus musculus
ctacccaaatcgtttcttttctcta

SEQ ID NO: 367968 - DNA, 25 bp, Mus musculus
ctacccaatttcactctacttgagt

SEQ ID NO: 367969 - DNA, 25 bp, Mus musculus
ctacccaatttctctctacttgagt

SEQ ID NO: 367970 - DNA, 25 bp, Mus musculus
ctacccacagctactttaacatctg

SEQ ID NO: 367971 - DNA, 25 bp, Mus musculus
ctacccacagcttctttaacatctg

SEQ ID NO: 367972 - DNA, 25 bp, Mus musculus
ctacccacctttctcatttacatat

SEQ ID NO: 367973 - DNA, 25 bp, Mus musculus
ctacccacctttgtcatttacatat

SEQ ID NO: 367974 - DNA, 25 bp, Mus musculus
ctacccacttgtactaatgacctat

SEQ ID NO: 367975 - DNA, 25 bp, Mus musculus
ctacccacttgttctaatgacctat

SEQ ID NO: 367976 - DNA, 25 bp, Mus musculus
ctacccagaaaacgccaggctattt

SEQ ID NO: 367977 - DNA, 25 bp, Mus musculus
ctacccagaaaaggccaggctattt

SEQ ID NO: 367978 - DNA, 25 bp, Mus musculus
ctacccagagacatgatgagacctt

SEQ ID NO: 367979 - DNA, 25 bp, Mus musculus
ctacccagagacttgatgagacctt

SEQ ID NO: 367980 - DNA, 25 bp, Mus musculus
ctacccagatgtccttgaaccactg

SEQ ID NO: 367981 - DNA, 25 bp, Mus musculus
ctacccagatgtgcttgaaccactg

SEQ ID NO: 367982 - DNA, 25 bp, Mus musculus
ctacccagcaggcttcagcaggctt

SEQ ID NO: 367983 - DNA, 25 bp, Mus musculus
ctacccagcagggttcagcaggctt

SEQ ID NO: 367984 - DNA, 25 bp, Mus musculus
ctacccagcgagaacagtttttaat

SEQ ID NO: 367985 - DNA, 25 bp, Mus musculus
ctacccagcgagtacagtttttaat

SEQ ID NO: 367986 - DNA, 25 bp, Mus musculus
ctacccagctccatcattttacaga

SEQ ID NO: 367987 - DNA, 25 bp, Mus musculus
ctacccagctccttcattttacaga

SEQ ID NO: 367988 - DNA, 25 bp, Mus musculus
ctacccagctggcagggagctccgt

SEQ ID NO: 367989 - DNA, 25 bp, Mus musculus
ctacccagctgggagggagctccgt

SEQ ID NO: 367990 - DNA, 25 bp, Mus musculus
ctacccagcttgacctttatattat

SEQ ID NO: 367991 - DNA, 25 bp, Mus musculus
ctacccagcttgtcctttatattat

SEQ ID NO: 367992 - DNA, 25 bp, Mus musculus
ctacccaggcatatgagagagggca

SEQ ID NO: 367993 - DNA, 25 bp, Mus musculus
ctacccaggcatttgagagagggca

SEQ ID NO: 367994 - DNA, 25 bp, Mus musculus
ctacccaggcggctttagacaagta

SEQ ID NO: 367995 - DNA, 25 bp, Mus musculus
ctacccaggcgggtttagacaagta

SEQ ID NO: 367996 - DNA, 25 bp, Mus musculus
ctacccagtgccaagggatggatgt

SEQ ID NO: 367997 - DNA, 25 bp, Mus musculus
ctacccagtgcctagggatggatgt

SEQ ID NO: 367998 - DNA, 25 bp, Mus musculus
ctacccagttggcacaagacacagt

SEQ ID NO: 367999 - DNA, 25 bp, Mus musculus
ctacccagttgggacaagacacagt

SEQ ID NO: 368000 - DNA, 25 bp, Mus musculus
ctacccatggaccctgagacttggg

SEQ ID NO: 368001 - DNA, 25 bp, Mus musculus
ctacccatggacgctgagacttggg

SEQ ID NO: 368002 - DNA, 25 bp, Mus musculus
ctaccccaagacaggacaggcttat

SEQ ID NO: 368003 - DNA, 25 bp, Mus musculus
ctaccccaagactggacaggcttat

SEQ ID NO: 368004 - DNA, 25 bp, Mus musculus
ctaccccaagctatgtgatggacgg

SEQ ID NO: 368005 - DNA, 25 bp, Mus musculus
ctaccccaagctttgtgatggacgg

SEQ ID NO: 368006 - DNA, 25 bp, Mus musculus
ctaccccatggaaccattagtgttt

SEQ ID NO: 368007 - DNA, 25 bp, Mus musculus
ctaccccatggatccattagtgttt

SEQ ID NO: 368008 - DNA, 25 bp, Mus musculus
ctaccccatgtgattgtaaatactc

SEQ ID NO: 368009 - DNA, 25 bp, Mus musculus
ctaccccatgtgtttgtaaatactc

SEQ ID NO: 368010 - DNA, 25 bp, Mus musculus
ctacccctaactcgtgagaggctga

SEQ ID NO: 368011 - DNA, 25 bp, Mus musculus
ctacccctaactggtgagaggctga

SEQ ID NO: 368012 - DNA, 25 bp, Mus musculus
ctacccctccagattatcttgtatt

SEQ ID NO: 368013 - DNA, 25 bp, Mus musculus
ctacccctccagtttatcttgtatt

SEQ ID NO: 368014 - DNA, 25 bp, Mus musculus
ctacccctgagtaaacagtgatcta

SEQ ID NO: 368015 - DNA, 25 bp, Mus musculus
ctacccctgagttaacagtgatcta

SEQ ID NO: 368016 - DNA, 25 bp, Mus musculus
ctacccctgtctccaaagtaatggt

SEQ ID NO: 368017 - DNA, 25 bp, Mus musculus
ctacccctgtctgcaaagtaatggt

SEQ ID NO: 368018 - DNA, 25 bp, Mus musculus
ctacccctttggcacagaggtttat

SEQ ID NO: 368019 - DNA, 25 bp, Mus musculus
ctacccctttgggacagaggtttat

SEQ ID NO: 368020 - DNA, 25 bp, Mus musculus
ctacccgctgagagcctacaagagg

SEQ ID NO: 368021 - DNA, 25 bp, Mus musculus
ctacccgctgagtgcctacaagagg

SEQ ID NO: 368022 - DNA, 25 bp, Mus musculus
ctaccctacgggacctaacagatgg

SEQ ID NO: 368023 - DNA, 25 bp, Mus musculus
ctaccctacgggtcctaacagatgg

SEQ ID NO: 368024 - DNA, 25 bp, Mus musculus
ctaccctagagtcaggcgctggttt

SEQ ID NO: 368025 - DNA, 25 bp, Mus musculus
ctaccctagagtgaggcgctggttt

SEQ ID NO: 368026 - DNA, 25 bp, Mus musculus
ctaccctatctcatcatttagcact

SEQ ID NO: 368027 - DNA, 25 bp, Mus musculus
ctaccctatctcttcatttagcact

SEQ ID NO: 368028 - DNA, 25 bp, Mus musculus
ctaccctccaacactaggaacaggg

SEQ ID NO: 368029 - DNA, 25 bp, Mus musculus
ctaccctccaactctaggaacaggg

SEQ ID NO: 368030 - DNA, 25 bp, Mus musculus
ctaccctccactagctgagattata

SEQ ID NO: 368031 - DNA, 25 bp, Mus musculus
ctaccctccacttgctgagattata

SEQ ID NO: 368032 - DNA, 25 bp, Mus musculus
ctaccctccatgctgttagaataca

SEQ ID NO: 368033 - DNA, 25 bp, Mus musculus
ctaccctccatggtgttagaataca

SEQ ID NO: 368034 - DNA, 25 bp, Mus musculus
ctaccctctatgctataccagaatg

SEQ ID NO: 368035 - DNA, 25 bp, Mus musculus
ctaccctctatggtataccagaatg

SEQ ID NO: 368036 - DNA, 25 bp, Mus musculus
ctaccctctctgcaaatcattgcaa

SEQ ID NO: 368037 - DNA, 25 bp, Mus musculus
ctaccctctctggaaatcattgcaa

SEQ ID NO: 368038 - DNA, 25 bp, Mus musculus
ctaccctcttatcgccaactatttt

SEQ ID NO: 368039 - DNA, 25 bp, Mus musculus
ctaccctcttatggccaactatttt

SEQ ID NO: 368040 - DNA, 25 bp, Mus musculus
ctaccctgacctacaactatcatat

SEQ ID NO: 368041 - DNA, 25 bp, Mus musculus
ctaccctgaccttcaactatcatat

SEQ ID NO: 368042 - DNA, 25 bp, Mus musculus
ctaccctgcgtcacattggtacaga

SEQ ID NO: 368043 - DNA, 25 bp, Mus musculus
ctaccctgcgtctcattggtacaga

SEQ ID NO: 368044 - DNA, 25 bp, Mus musculus
ctaccctgctatcttccttgattct

SEQ ID NO: 368045 - DNA, 25 bp, Mus musculus
ctaccctgctatgttccttgattct

SEQ ID NO: 368046 - DNA, 25 bp, Mus musculus
ctaccctgctggcttttaggaatag

SEQ ID NO: 368047 - DNA, 25 bp, Mus musculus
ctaccctgctgggttttaggaatag

SEQ ID NO: 368048 - DNA, 25 bp, Mus musculus
ctaccctggctgagaggcaaaggaa

SEQ ID NO: 368049 - DNA, 25 bp, Mus musculus
ctaccctggctgtgaggcaaaggaa

SEQ ID NO: 368050 - DNA, 25 bp, Mus musculus
ctaccctgtaaaccatatttctgta

SEQ ID NO: 368051 - DNA, 25 bp, Mus musculus
ctaccctgtaaagcatatttctgta

SEQ ID NO: 368052 - DNA, 25 bp, Mus musculus
ctaccctgtcaaccctgaagatatt

SEQ ID NO: 368053 - DNA, 25 bp, Mus musculus
ctaccctgtcaagcctgaagatatt

SEQ ID NO: 368054 - DNA, 25 bp, Mus musculus
ctaccctgtgctcgctaactcaaga

SEQ ID NO: 368055 - DNA, 25 bp, Mus musculus
ctaccctgtgctggctaactcaaga

SEQ ID NO: 368056 - DNA, 25 bp, Mus musculus
ctaccctgtgttcgctagagttcta

SEQ ID NO: 368057 - DNA, 25 bp, Mus musculus
ctaccctgtgttggctagagttcta

SEQ ID NO: 368058 - DNA, 25 bp, Mus musculus
ctaccctgtttcactgtattccaga

SEQ ID NO: 368059 - DNA, 25 bp, Mus musculus
ctaccctgtttctctgtattccaga

SEQ ID NO: 368060 - DNA, 25 bp, Mus musculus
ctacccttcttgaatctgatggcat

SEQ ID NO: 368061 - DNA, 25 bp, Mus musculus
ctacccttcttgtatctgatggcat

SEQ ID NO: 368062 - DNA, 25 bp, Mus musculus
ctacccttgggccagagagaccaaa

SEQ ID NO: 368063 - DNA, 25 bp, Mus musculus
ctacccttgggcgagagagaccaaa

SEQ ID NO: 368064 - DNA, 25 bp, Mus musculus
ctaccgagatctcttcacaatcaat

SEQ ID NO: 368065 - DNA, 25 bp, Mus musculus
ctaccgagatctgttcacaatcaat

SEQ ID NO: 368066 - DNA, 25 bp, Mus musculus
ctaccgagctggactgctggcgtat

SEQ ID NO: 368067 - DNA, 25 bp, Mus musculus
ctaccgagctggtctgctggcgtat

SEQ ID NO: 368068 - DNA, 25 bp, Mus musculus
ctaccgagtattacctcagtacttt

SEQ ID NO: 368069 - DNA, 25 bp, Mus musculus
ctaccgagtatttcctcagtacttt

SEQ ID NO: 368070 - DNA, 25 bp, Mus musculus
ctaccgcatcagcatggcagactat

SEQ ID NO: 368071 - DNA, 25 bp, Mus musculus
ctaccgcatcaggatggcagactat

SEQ ID NO: 368072 - DNA, 25 bp, Mus musculus
ctaccgcatggaccagagtgttcac

SEQ ID NO: 368073 - DNA, 25 bp, Mus musculus
ctaccgcatggagcagagtgttcac

SEQ ID NO: 368074 - DNA, 25 bp, Mus musculus
ctaccgccgcttcctggaggatgga

SEQ ID NO: 368075 - DNA, 25 bp, Mus musculus
ctaccgccgcttgctggaggatgga

SEQ ID NO: 368076 - DNA, 25 bp, Mus musculus
ctaccgctccatcgcttagagacat

SEQ ID NO: 368077 - DNA, 25 bp, Mus musculus
ctaccgctccatggcttagagacat

SEQ ID NO: 368078 - DNA, 25 bp, Mus musculus
ctaccgctttctcgctataattatg

SEQ ID NO: 368079 - DNA, 25 bp, Mus musculus
ctaccgctttctggctataattatg

SEQ ID NO: 368080 - DNA, 25 bp, Mus musculus
ctaccggagtttcagcttcacagca

SEQ ID NO: 368081 - DNA, 25 bp, Mus musculus
ctaccggagtttgagcttcacagca

SEQ ID NO: 368082 - DNA, 25 bp, Mus musculus
ctaccggtgattcctttagcaagaa

SEQ ID NO: 368083 - DNA, 25 bp, Mus musculus
ctaccggtgattgctttagcaagaa

SEQ ID NO: 368084 - DNA, 25 bp, Mus musculus
ctaccggtggcccttgtggatgcaa

SEQ ID NO: 368085 - DNA, 25 bp, Mus musculus
ctaccggtggccgttgtggatgcaa

SEQ ID NO: 368086 - DNA, 25 bp, Mus musculus
ctaccgtacacaagctttggacttt

SEQ ID NO: 368087 - DNA, 25 bp, Mus musculus
ctaccgtacacatgctttggacttt

SEQ ID NO: 368088 - DNA, 25 bp, Mus musculus
ctaccgtccagcatcattaacaatg

SEQ ID NO: 368089 - DNA, 25 bp, Mus musculus
ctaccgtccagcttcattaacaatg

SEQ ID NO: 368090 - DNA, 25 bp, Mus musculus
ctaccgtgccctacgagatggtggt

SEQ ID NO: 368091 - DNA, 25 bp, Mus musculus
ctaccgtgcccttcgagatggtggt

SEQ ID NO: 368092 - DNA, 25 bp, Mus musculus
ctaccgtggcgtagacctcgaccaa

SEQ ID NO: 368093 - DNA, 25 bp, Mus musculus
ctaccgtggcgttgacctcgaccaa

SEQ ID NO: 368094 - DNA, 25 bp, Mus musculus
ctaccgtttgtgcacttgatttgca

SEQ ID NO: 368095 - DNA, 25 bp, Mus musculus
ctaccgtttgtggacttgatttgca

SEQ ID NO: 368096 - DNA, 25 bp, Mus musculus
ctacctacacctcacaagtggatta

SEQ ID NO: 368097 - DNA, 25 bp, Mus musculus
ctacctacacctgacaagtggatta

SEQ ID NO: 368098 - DNA, 25 bp, Mus musculus
ctacctacactgatttaccagtaga

SEQ ID NO: 368099 - DNA, 25 bp, Mus musculus
ctacctacactgttttaccagtaga

SEQ ID NO: 368100 - DNA, 25 bp, Mus musculus
ctacctacagagctgcgcagtgcag

SEQ ID NO: 368101 - DNA, 25 bp, Mus musculus
ctacctacagaggtgcgcagtgcag

SEQ ID NO: 368102 - DNA, 25 bp, Mus musculus
ctacctaccctaaaaagcacatgat

SEQ ID NO: 368103 - DNA, 25 bp, Mus musculus
ctacctaccctataaagcacatgat

SEQ ID NO: 368104 - DNA, 25 bp, Mus musculus
ctacctacctagaaaatctcgtcac

SEQ ID NO: 368105 - DNA, 25 bp, Mus musculus
ctacctacctagtaaatctcgtcac

SEQ ID NO: 368106 - DNA, 25 bp, Mus musculus
ctacctagtgttagagcccctaaag

SEQ ID NO: 368107 - DNA, 25 bp, Mus musculus
ctacctagtgtttgagcccctaaag

SEQ ID NO: 368108 - DNA, 25 bp, Mus musculus
ctacctagttaactctctctgaaga

SEQ ID NO: 368109 - DNA, 25 bp, Mus musculus
ctacctagttaagtctctctgaaga

SEQ ID NO: 368110 - DNA, 25 bp, Mus musculus
ctacctagtttgattcttctgagac

SEQ ID NO: 368111 - DNA, 25 bp, Mus musculus
ctacctagtttgtttcttctgagac

SEQ ID NO: 368112 - DNA, 25 bp, Mus musculus
ctacctatacctagccctcaagcat

SEQ ID NO: 368113 - DNA, 25 bp, Mus musculus
ctacctataccttgccctcaagcat

SEQ ID NO: 368114 - DNA, 25 bp, Mus musculus
ctacctatcctaattccgtgagttt

SEQ ID NO: 368115 - DNA, 25 bp, Mus musculus
ctacctatcctacagtgaagactcc

SEQ ID NO: 368116 - DNA, 25 bp, Mus musculus
ctacctatcctagagtgaagactcc

SEQ ID NO: 368117 - DNA, 25 bp, Mus musculus
ctacctatcctatttccgtgagttt

SEQ ID NO: 368118 - DNA, 25 bp, Mus musculus
ctacctatgattcaactgtttccaa

SEQ ID NO: 368119 - DNA, 25 bp, Mus musculus
ctacctatgattgaactgtttccaa

SEQ ID NO: 368120 - DNA, 25 bp, Mus musculus
ctacctatttcaaacagctacctac

SEQ ID NO: 368121 - DNA, 25 bp, Mus musculus
ctacctatttcatacagctacctac

SEQ ID NO: 368122 - DNA, 25 bp, Mus musculus
ctacctcaggcccaagggcaaagtt

SEQ ID NO: 368123 - DNA, 25 bp, Mus musculus
ctacctcaggccgaagggcaaagtt

SEQ ID NO: 368124 - DNA, 25 bp, Mus musculus
ctacctcatattcagccaaaagcct

SEQ ID NO: 368125 - DNA, 25 bp, Mus musculus
ctacctcatattgagccaaaagcct

SEQ ID NO: 368126 - DNA, 25 bp, Mus musculus
ctacctcatccaatcaatccaaaaa

SEQ ID NO: 368127 - DNA, 25 bp, Mus musculus
ctacctcatccattcaatccaaaaa

SEQ ID NO: 368128 - DNA, 25 bp, Mus musculus
ctacctcatgaacgtgttctattaa

SEQ ID NO: 368129 - DNA, 25 bp, Mus musculus
ctacctcatgaaggtgttctattaa

SEQ ID NO: 368130 - DNA, 25 bp, Mus musculus
ctacctcatgctctctgatttgtga

SEQ ID NO: 368131 - DNA, 25 bp, Mus musculus
ctacctcatgctgtctgatttgtga

SEQ ID NO: 368132 - DNA, 25 bp, Mus musculus
ctacctcatttgcagtcagggactt

SEQ ID NO: 368133 - DNA, 25 bp, Mus musculus
ctacctcatttggagtcagggactt

SEQ ID NO: 368134 - DNA, 25 bp, Mus musculus
ctacctccacctactgaatgttagt

SEQ ID NO: 368135 - DNA, 25 bp, Mus musculus
ctacctccaccttctgaatgttagt

SEQ ID NO: 368136 - DNA, 25 bp, Mus musculus
ctacctccagacatccttgaaatat

SEQ ID NO: 368137 - DNA, 25 bp, Mus musculus
ctacctccagacttccttgaaatat

SEQ ID NO: 368138 - DNA, 25 bp, Mus musculus
ctacctcccaacaagtgtgtacaat

SEQ ID NO: 368139 - DNA, 25 bp, Mus musculus
ctacctcccaactagtgtgtacaat

SEQ ID NO: 368140 - DNA, 25 bp, Mus musculus
ctacctcctaccatataaattattt

SEQ ID NO: 368141 - DNA, 25 bp, Mus musculus
ctacctcctaccttataaattattt

SEQ ID NO: 368142 - DNA, 25 bp, Mus musculus
ctacctcctagtcaggagggctgaa

SEQ ID NO: 368143 - DNA, 25 bp, Mus musculus
ctacctcctagtgaggagggctgaa

SEQ ID NO: 368144 - DNA, 25 bp, Mus musculus
ctacctcctttccagttgataaaca

SEQ ID NO: 368145 - DNA, 25 bp, Mus musculus
ctacctcctttcgagttgataaaca

SEQ ID NO: 368146 - DNA, 25 bp, Mus musculus
ctacctctatacattctcaattctt

SEQ ID NO: 368147 - DNA, 25 bp, Mus musculus
ctacctctatactttctcaattctt

SEQ ID NO: 368148 - DNA, 25 bp, Mus musculus
ctacctctatatcctctaattcttt

SEQ ID NO: 368149 - DNA, 25 bp, Mus musculus
ctacctctatatgctctaattcttt

SEQ ID NO: 368150 - DNA, 25 bp, Mus musculus
ctacctctcaacacccttaagagta

SEQ ID NO: 368151 - DNA, 25 bp, Mus musculus
ctacctctcaactcccttaagagta

SEQ ID NO: 368152 - DNA, 25 bp, Mus musculus
ctacctctcccaagatgagactgac

SEQ ID NO: 368153 - DNA, 25 bp, Mus musculus
ctacctctcccatgatgagactgac

SEQ ID NO: 368154 - DNA, 25 bp, Mus musculus
ctacctctctcacctaagtttctaa

SEQ ID NO: 368155 - DNA, 25 bp, Mus musculus
ctacctctctcagctaagtttctaa

SEQ ID NO: 368156 - DNA, 25 bp, Mus musculus
ctacctctggctagcaaatgctgga

SEQ ID NO: 368157 - DNA, 25 bp, Mus musculus
ctacctctggcttgcaaatgctgga

SEQ ID NO: 368158 - DNA, 25 bp, Mus musculus
ctacctctgggtagccaggagctga

SEQ ID NO: 368159 - DNA, 25 bp, Mus musculus
ctacctctgggttgccaggagctga

SEQ ID NO: 368160 - DNA, 25 bp, Mus musculus
ctacctctggtgaggaacccaatag

SEQ ID NO: 368161 - DNA, 25 bp, Mus musculus
ctacctctggtgtggaacccaatag

SEQ ID NO: 368162 - DNA, 25 bp, Mus musculus
ctacctctgtctcagctactaagaa

SEQ ID NO: 368163 - DNA, 25 bp, Mus musculus
ctacctctgtctgagctactaagaa

SEQ ID NO: 368164 - DNA, 25 bp, Mus musculus
ctacctcttactattcaattgtgaa

SEQ ID NO: 368165 - DNA, 25 bp, Mus musculus
ctacctcttacttttcaattgtgaa

SEQ ID NO: 368166 - DNA, 25 bp, Mus musculus
ctacctcttttcacatactaaacct

SEQ ID NO: 368167 - DNA, 25 bp, Mus musculus
ctacctcttttctcatactaaacct

SEQ ID NO: 368168 - DNA, 25 bp, Mus musculus
ctacctgaagctattcggcaccctt

SEQ ID NO: 368169 - DNA, 25 bp, Mus musculus
ctacctgaagcttttcggcaccctt

SEQ ID NO: 368170 - DNA, 25 bp, Mus musculus
ctacctgaggcaaaattgaagagtt

SEQ ID NO: 368171 - DNA, 25 bp, Mus musculus
ctacctgaggcataattgaagagtt

SEQ ID NO: 368172 - DNA, 25 bp, Mus musculus
ctacctgattaaacctcacacgagt

SEQ ID NO: 368173 - DNA, 25 bp, Mus musculus
ctacctgattaatcctcacacgagt

SEQ ID NO: 368174 - DNA, 25 bp, Mus musculus
ctacctgattggattgctgctaaag

SEQ ID NO: 368175 - DNA, 25 bp, Mus musculus
ctacctgattggtttgctgctaaag

SEQ ID NO: 368176 - DNA, 25 bp, Mus musculus
ctacctgcagcacgaaattgccctg

SEQ ID NO: 368177 - DNA, 25 bp, Mus musculus
ctacctgcagcaggaaattgccctg

SEQ ID NO: 368178 - DNA, 25 bp, Mus musculus
ctacctgcaggcagaaattagactt

SEQ ID NO: 368179 - DNA, 25 bp, Mus musculus
ctacctgcaggctgaaattagactt

SEQ ID NO: 368180 - DNA, 25 bp, Mus musculus
ctacctgcagtcaaaggttgtccgt

SEQ ID NO: 368181 - DNA, 25 bp, Mus musculus
ctacctgcagtctaaggttgtccgt

SEQ ID NO: 368182 - DNA, 25 bp, Mus musculus
ctacctgcagtgatcatcgggagac

SEQ ID NO: 368183 - DNA, 25 bp, Mus musculus
ctacctgcagtgttcatcgggagac

SEQ ID NO: 368184 - DNA, 25 bp, Mus musculus
ctacctgcgggaccattttagctga

SEQ ID NO: 368185 - DNA, 25 bp, Mus musculus
ctacctgcgggagcattttagctga

SEQ ID NO: 368186 - DNA, 25 bp, Mus musculus
ctacctgcgggtcatgaagtttcgc

SEQ ID NO: 368187 - DNA, 25 bp, Mus musculus
ctacctgcgggtgatgaagtttcgc

SEQ ID NO: 368188 - DNA, 25 bp, Mus musculus
ctacctgcgtagacacttaagaact

SEQ ID NO: 368189 - DNA, 25 bp, Mus musculus
ctacctgcgtagtcacttaagaact

SEQ ID NO: 368190 - DNA, 25 bp, Mus musculus
ctacctgctagtatatgcctctata

SEQ ID NO: 368191 - DNA, 25 bp, Mus musculus
ctacctgctagtttatgcctctata

SEQ ID NO: 368192 - DNA, 25 bp, Mus musculus
ctacctgctctgagtcgaaagatgg

SEQ ID NO: 368193 - DNA, 25 bp, Mus musculus
ctacctgctctgtgtcgaaagatgg

SEQ ID NO: 368194 - DNA, 25 bp, Mus musculus
ctacctgctgagagctgtgctaggg

SEQ ID NO: 368195 - DNA, 25 bp, Mus musculus
ctacctgctgagtgctgtgctaggg

SEQ ID NO: 368196 - DNA, 25 bp, Mus musculus
ctacctggagaccaactgcattgtt

SEQ ID NO: 368197 - DNA, 25 bp, Mus musculus
ctacctggagacgaactgcattgtt

SEQ ID NO: 368198 - DNA, 25 bp, Mus musculus
ctacctggatagaattgatttcccc

SEQ ID NO: 368199 - DNA, 25 bp, Mus musculus
ctacctggatagtattgatttcccc

SEQ ID NO: 368200 - DNA, 25 bp, Mus musculus
ctacctggcaggaggtgataccatc

SEQ ID NO: 368201 - DNA, 25 bp, Mus musculus
ctacctggcaggtggtgataccatc

SEQ ID NO: 368202 - DNA, 25 bp, Mus musculus
ctacctggccgtccaagtaaggtca

SEQ ID NO: 368203 - DNA, 25 bp, Mus musculus
ctacctggccgtgcaagtaaggtca

SEQ ID NO: 368204 - DNA, 25 bp, Mus musculus
ctacctggtaccatatctgtggatt

SEQ ID NO: 368205 - DNA, 25 bp, Mus musculus
ctacctggtaccttatctgtggatt

SEQ ID NO: 368206 - DNA, 25 bp, Mus musculus
ctacctggtatgcaaggaactcgga

SEQ ID NO: 368207 - DNA, 25 bp, Mus musculus
ctacctggtatggaaggaactcgga

SEQ ID NO: 368208 - DNA, 25 bp, Mus musculus
ctacctggtcctcgcagagcatctg

SEQ ID NO: 368209 - DNA, 25 bp, Mus musculus
ctacctggtcctggcagagcatctg

SEQ ID NO: 368210 - DNA, 25 bp, Mus musculus
ctacctggtctgctgcaaaatcaca

SEQ ID NO: 368211 - DNA, 25 bp, Mus musculus
ctacctggtctggtgcaaaatcaca

SEQ ID NO: 368212 - DNA, 25 bp, Mus musculus
ctacctggtgacaagcgtgttgcgt

SEQ ID NO: 368213 - DNA, 25 bp, Mus musculus
ctacctggtgactagcgtgttgcgt

SEQ ID NO: 368214 - DNA, 25 bp, Mus musculus
ctacctggtgctcagcgaaggtgca

SEQ ID NO: 368215 - DNA, 25 bp, Mus musculus
ctacctggtgctgagcgaaggtgca

SEQ ID NO: 368216 - DNA, 25 bp, Mus musculus
ctacctgtagtgaccagttggctat

SEQ ID NO: 368217 - DNA, 25 bp, Mus musculus
ctacctgtagtgtccagttggctat

SEQ ID NO: 368218 - DNA, 25 bp, Mus musculus
ctacctgtccacacagatggtgtat

SEQ ID NO: 368219 - DNA, 25 bp, Mus musculus
ctacctgtccactcagatggtgtat

SEQ ID NO: 368220 - DNA, 25 bp, Mus musculus
ctacctgtgagtaacaaccctttca

SEQ ID NO: 368221 - DNA, 25 bp, Mus musculus
ctacctgtgagttacaaccctttca

SEQ ID NO: 368222 - DNA, 25 bp, Mus musculus
ctacctgtgcatcaccgatgagtgg

SEQ ID NO: 368223 - DNA, 25 bp, Mus musculus
ctacctgtgcatgaccgatgagtgg

SEQ ID NO: 368224 - DNA, 25 bp, Mus musculus
ctacctgtgctcctttcctgtgagt

SEQ ID NO: 368225 - DNA, 25 bp, Mus musculus
ctacctgtgctcgtttcctgtgagt

SEQ ID NO: 368226 - DNA, 25 bp, Mus musculus
ctacctgtgcttccttatattctaa

SEQ ID NO: 368227 - DNA, 25 bp, Mus musculus
ctacctgtgcttgcttatattctaa

SEQ ID NO: 368228 - DNA, 25 bp, Mus musculus
ctacctgtggacacttttccagaat

SEQ ID NO: 368229 - DNA, 25 bp, Mus musculus
ctacctgtggactcttttccagaat

SEQ ID NO: 368230 - DNA, 25 bp, Mus musculus
ctacctgtgggtctgatagttgtac

SEQ ID NO: 368231 - DNA, 25 bp, Mus musculus
ctacctgtgggtgtgatagttgtac

SEQ ID NO: 368232 - DNA, 25 bp, Mus musculus
ctacctgttctgactgctgtattca

SEQ ID NO: 368233 - DNA, 25 bp, Mus musculus
ctacctgttctgtctgctgtattca

SEQ ID NO: 368234 - DNA, 25 bp, Mus musculus
ctacctgtttctatgcactgcagaa

SEQ ID NO: 368235 - DNA, 25 bp, Mus musculus
ctacctgtttctttgcactgcagaa

SEQ ID NO: 368236 - DNA, 25 bp, Mus musculus
ctaccttatagtccccacatagctg

SEQ ID NO: 368237 - DNA, 25 bp, Mus musculus
ctaccttatagtgcccacatagctg

SEQ ID NO: 368238 - DNA, 25 bp, Mus musculus
ctaccttcatgtaggctactttttt

SEQ ID NO: 368239 - DNA, 25 bp, Mus musculus
ctaccttcatgttggctactttttt

SEQ ID NO: 368240 - DNA, 25 bp, Mus musculus
ctaccttccaagagttctgattata

SEQ ID NO: 368241 - DNA, 25 bp, Mus musculus
ctaccttccaagtgttctgattata

SEQ ID NO: 368242 - DNA, 25 bp, Mus musculus
ctaccttcccagacctatgaaaaat

SEQ ID NO: 368243 - DNA, 25 bp, Mus musculus
ctaccttcccagtcctatgaaaaat

SEQ ID NO: 368244 - DNA, 25 bp, Mus musculus
ctaccttcgtgtatctgtgcaatat

SEQ ID NO: 368245 - DNA, 25 bp, Mus musculus
ctaccttcgtgtttctgtgcaatat

SEQ ID NO: 368246 - DNA, 25 bp, Mus musculus
ctaccttctatccaaccactttgat

SEQ ID NO: 368247 - DNA, 25 bp, Mus musculus
ctaccttctatcgaaccactttgat

SEQ ID NO: 368248 - DNA, 25 bp, Mus musculus
ctaccttctcggaagcttcttggaa

SEQ ID NO: 368249 - DNA, 25 bp, Mus musculus
ctaccttctcggtagcttcttggaa

SEQ ID NO: 368250 - DNA, 25 bp, Mus musculus
ctaccttctgctatcctggaaaaga

SEQ ID NO: 368251 - DNA, 25 bp, Mus musculus
ctaccttctgctttcctggaaaaga

SEQ ID NO: 368252 - DNA, 25 bp, Mus musculus
ctaccttgaatgaatcttcttacac

SEQ ID NO: 368253 - DNA, 25 bp, Mus musculus
ctaccttgaatgtatcttcttacac

SEQ ID NO: 368254 - DNA, 25 bp, Mus musculus
ctaccttgccctagtttgtgttaag

SEQ ID NO: 368255 - DNA, 25 bp, Mus musculus
ctaccttgcccttgtttgtgttaag

SEQ ID NO: 368256 - DNA, 25 bp, Mus musculus
ctaccttgtgtgattaactgtataa

SEQ ID NO: 368257 - DNA, 25 bp, Mus musculus
ctaccttgtgtgtttaactgtataa

SEQ ID NO: 368258 - DNA, 25 bp, Mus musculus
ctacctttagccacatcaacagaaa

SEQ ID NO: 368259 - DNA, 25 bp, Mus musculus
ctacctttagcctcatcaacagaaa

SEQ ID NO: 368260 - DNA, 25 bp, Mus musculus
ctacctttcagcagttgtctggttt

SEQ ID NO: 368261 - DNA, 25 bp, Mus musculus
ctacctttcagctgttgtctggttt

SEQ ID NO: 368262 - DNA, 25 bp, Mus musculus
ctacctttcctaccttgtggaattg

SEQ ID NO: 368263 - DNA, 25 bp, Mus musculus
ctacctttcctagcttgtggaattg

SEQ ID NO: 368264 - DNA, 25 bp, Mus musculus
ctacctttctaccatatgtcatcag

SEQ ID NO: 368265 - DNA, 25 bp, Mus musculus
ctacctttctacgatatgtcatcag

SEQ ID NO: 368266 - DNA, 25 bp, Mus musculus
ctacctttctttcgagacctaacag

SEQ ID NO: 368267 - DNA, 25 bp, Mus musculus
ctacctttctttggagacctaacag

SEQ ID NO: 368268 - DNA, 25 bp, Mus musculus
ctacctttgtatctatgatctactt

SEQ ID NO: 368269 - DNA, 25 bp, Mus musculus
ctacctttgtatgtatgatctactt

SEQ ID NO: 368270 - DNA, 25 bp, Mus musculus
ctaccttttgtgaggcatactggct

SEQ ID NO: 368271 - DNA, 25 bp, Mus musculus
ctaccttttgtgtggcatactggct

SEQ ID NO: 368272 - DNA, 25 bp, Mus musculus
ctacgaactagtcaatcatgccaag

SEQ ID NO: 368273 - DNA, 25 bp, Mus musculus
ctacgaactagtgaatcatgccaag

SEQ ID NO: 368274 - DNA, 25 bp, Mus musculus
ctacgaactgttccacggagctggc

SEQ ID NO: 368275 - DNA, 25 bp, Mus musculus
ctacgaactgttgcacggagctggc

SEQ ID NO: 368276 - DNA, 25 bp, Mus musculus
ctacgaagcattctgtgcatgtttc

SEQ ID NO: 368277 - DNA, 25 bp, Mus musculus
ctacgaagcattgtgtgcatgtttc

SEQ ID NO: 368278 - DNA, 25 bp, Mus musculus
ctacgaagcctaagtcaagtgtcaa

SEQ ID NO: 368279 - DNA, 25 bp, Mus musculus
ctacgaagcctatgtcaagtgtcaa

SEQ ID NO: 368280 - DNA, 25 bp, Mus musculus
ctacgacacaatccagtacatcctg

SEQ ID NO: 368281 - DNA, 25 bp, Mus musculus
ctacgacacaatgcagtacatcctg

SEQ ID NO: 368282 - DNA, 25 bp, Mus musculus
ctacgacatgaacggctgctactca

SEQ ID NO: 368283 - DNA, 25 bp, Mus musculus
ctacgacatgaagggctgctactca

SEQ ID NO: 368284 - DNA, 25 bp, Mus musculus
ctacgaccatctattactccagttc

SEQ ID NO: 368285 - DNA, 25 bp, Mus musculus
ctacgaccatcttttactccagttc

SEQ ID NO: 368286 - DNA, 25 bp, Mus musculus
ctacgagaactacagggcacagtgt

SEQ ID NO: 368287 - DNA, 25 bp, Mus musculus
ctacgagaactagagggcacagtgt

SEQ ID NO: 368288 - DNA, 25 bp, Mus musculus
ctacgagctcccagaagttgatcat

SEQ ID NO: 368289 - DNA, 25 bp, Mus musculus
ctacgagctccctgaagttgatcat

SEQ ID NO: 368290 - DNA, 25 bp, Mus musculus
ctacgagctgttactggctcttggc

SEQ ID NO: 368291 - DNA, 25 bp, Mus musculus
ctacgagctgtttctggctcttggc

SEQ ID NO: 368292 - DNA, 25 bp, Mus musculus
ctacgagtacgaccactgggacgcg

SEQ ID NO: 368293 - DNA, 25 bp, Mus musculus
ctacgagtacgagcactgggacgcg

SEQ ID NO: 368294 - DNA, 25 bp, Mus musculus
ctacgagtgtgccatttgccagagg

SEQ ID NO: 368295 - DNA, 25 bp, Mus musculus
ctacgagtgtgcgatttgccagagg

SEQ ID NO: 368296 - DNA, 25 bp, Mus musculus
ctacgagttgtacggccttgctgga

SEQ ID NO: 368297 - DNA, 25 bp, Mus musculus
ctacgagttgtagggccttgctgga

SEQ ID NO: 368298 - DNA, 25 bp, Mus musculus
ctacgatccaaacactcaggtgttt

SEQ ID NO: 368299 - DNA, 25 bp, Mus musculus
ctacgatccaaagactcaggtgttt

SEQ ID NO: 368300 - DNA, 25 bp, Mus musculus
ctacgatccgatcctaaggttcttc

SEQ ID NO: 368301 - DNA, 25 bp, Mus musculus
ctacgatccgatgctaaggttcttc

SEQ ID NO: 368302 - DNA, 25 bp, Mus musculus
ctacgattcaggcataattttatat

SEQ ID NO: 368303 - DNA, 25 bp, Mus musculus
ctacgattcagggataattttatat

SEQ ID NO: 368304 - DNA, 25 bp, Mus musculus
ctacgcaattagaccctgtctcaaa

SEQ ID NO: 368305 - DNA, 25 bp, Mus musculus
ctacgcaattagtccctgtctcaaa

SEQ ID NO: 368306 - DNA, 25 bp, Mus musculus
ctacgcagcgtcatgaacaaggtca

SEQ ID NO: 368307 - DNA, 25 bp, Mus musculus
ctacgcagcgtcttgaacaaggtca

SEQ ID NO: 368308 - DNA, 25 bp, Mus musculus
ctacgcaggtagacttggcctatat

SEQ ID NO: 368309 - DNA, 25 bp, Mus musculus
ctacgcaggtagccagtgactgagc

SEQ ID NO: 368310 - DNA, 25 bp, Mus musculus
ctacgcaggtaggcagtgactgagc

SEQ ID NO: 368311 - DNA, 25 bp, Mus musculus
ctacgcaggtagtcttggcctatat

SEQ ID NO: 368312 - DNA, 25 bp, Mus musculus
ctacgcatccctacacttcattgtt

SEQ ID NO: 368313 - DNA, 25 bp, Mus musculus
ctacgcatcccttcacttcattgtt

SEQ ID NO: 368314 - DNA, 25 bp, Mus musculus
ctacgcatttagatcaaggctagcc

SEQ ID NO: 368315 - DNA, 25 bp, Mus musculus
ctacgcatttagttcaaggctagcc

SEQ ID NO: 368316 - DNA, 25 bp, Mus musculus
ctacgccaggccataggtcaataga

SEQ ID NO: 368317 - DNA, 25 bp, Mus musculus
ctacgccaggccttaggtcaataga

SEQ ID NO: 368318 - DNA, 25 bp, Mus musculus
ctacgccaggtacggaaggaaccag

SEQ ID NO: 368319 - DNA, 25 bp, Mus musculus
ctacgccaggtagggaaggaaccag

SEQ ID NO: 368320 - DNA, 25 bp, Mus musculus
ctacgccatagcaactgaggtgagt

SEQ ID NO: 368321 - DNA, 25 bp, Mus musculus
ctacgccatagctactgaggtgagt

SEQ ID NO: 368322 - DNA, 25 bp, Mus musculus
ctacgcccagggactgtttagtaag

SEQ ID NO: 368323 - DNA, 25 bp, Mus musculus
ctacgcccagggtctgtttagtaag

SEQ ID NO: 368324 - DNA, 25 bp, Mus musculus
ctacgcccagtcctgcaggtataaa

SEQ ID NO: 368325 - DNA, 25 bp, Mus musculus
ctacgcccagtcgtgcaggtataaa

SEQ ID NO: 368326 - DNA, 25 bp, Mus musculus
ctacgcctctaaagcagtgtctgag

SEQ ID NO: 368327 - DNA, 25 bp, Mus musculus
ctacgcctctaatgcagtgtctgag

SEQ ID NO: 368328 - DNA, 25 bp, Mus musculus
ctacgctacctcaccatggttctga

SEQ ID NO: 368329 - DNA, 25 bp, Mus musculus
ctacgctacctctccatggttctga

SEQ ID NO: 368330 - DNA, 25 bp, Mus musculus
ctacgctcacatatcagtcagtcta

SEQ ID NO: 368331 - DNA, 25 bp, Mus musculus
ctacgctcacatttcagtcagtcta

SEQ ID NO: 368332 - DNA, 25 bp, Mus musculus
ctacgctcggcaccagccaatggga

SEQ ID NO: 368333 - DNA, 25 bp, Mus musculus
ctacgctcggcagcagccaatggga

SEQ ID NO: 368334 - DNA, 25 bp, Mus musculus
ctacgctgcccgcatctgggatggg

SEQ ID NO: 368335 - DNA, 25 bp, Mus musculus
ctacgctgcccggatctgggatggg

SEQ ID NO: 368336 - DNA, 25 bp, Mus musculus
ctacgcttaatactggtgacttctg

SEQ ID NO: 368337 - DNA, 25 bp, Mus musculus
ctacgcttaatagtggtgacttctg

SEQ ID NO: 368338 - DNA, 25 bp, Mus musculus
ctacgctttcaccacctgaaggaaa

SEQ ID NO: 368339 - DNA, 25 bp, Mus musculus
ctacgctttcacgacctgaaggaaa

SEQ ID NO: 368340 - DNA, 25 bp, Mus musculus
ctacggaacaggctggcacagctgc

SEQ ID NO: 368341 - DNA, 25 bp, Mus musculus
ctacggaacagggtggcacagctgc

SEQ ID NO: 368342 - DNA, 25 bp, Mus musculus
ctacggacccttaaagctgacatgt

SEQ ID NO: 368343 - DNA, 25 bp, Mus musculus
ctacggaccctttaagctgacatgt

SEQ ID NO: 368344 - DNA, 25 bp, Mus musculus
ctacggactgcgagccaagagaaaa

SEQ ID NO: 368345 - DNA, 25 bp, Mus musculus
ctacggactgcgtgccaagagaaaa

SEQ ID NO: 368346 - DNA, 25 bp, Mus musculus
ctacggcagcagaatggtccatgtc

SEQ ID NO: 368347 - DNA, 25 bp, Mus musculus
ctacggcagcagtatggtccatgtc

SEQ ID NO: 368348 - DNA, 25 bp, Mus musculus
ctacggcctgggaagatgttctcca

SEQ ID NO: 368349 - DNA, 25 bp, Mus musculus
ctacggcctgggtagatgttctcca

SEQ ID NO: 368350 - DNA, 25 bp, Mus musculus
ctacggcgacagacgagcgagcttg

SEQ ID NO: 368351 - DNA, 25 bp, Mus musculus
ctacggcgacagtcgagcgagcttg

SEQ ID NO: 368352 - DNA, 25 bp, Mus musculus
ctacggcgcgcaagcaactgctgga

SEQ ID NO: 368353 - DNA, 25 bp, Mus musculus
ctacggcgcgcatgcaactgctgga

SEQ ID NO: 368354 - DNA, 25 bp, Mus musculus
ctacggctcctgctttgagcatgtt

SEQ ID NO: 368355 - DNA, 25 bp, Mus musculus
ctacggctcctggtttgagcatgtt

SEQ ID NO: 368356 - DNA, 25 bp, Mus musculus
ctacggctgggaagatgaccttctt

SEQ ID NO: 368357 - DNA, 25 bp, Mus musculus
ctacggctgggatgatgaccttctt

SEQ ID NO: 368358 - DNA, 25 bp, Mus musculus
ctacggcttaatctcaggtcatcaa

SEQ ID NO: 368359 - DNA, 25 bp, Mus musculus
ctacggcttaatgtcaggtcatcaa

SEQ ID NO: 368360 - DNA, 25 bp, Mus musculus
ctacgggctcaaagtgaggaactgt

SEQ ID NO: 368361 - DNA, 25 bp, Mus musculus
ctacgggctcaatgtgaggaactgt

SEQ ID NO: 368362 - DNA, 25 bp, Mus musculus
ctacgggctgccagagtggaaacct

SEQ ID NO: 368363 - DNA, 25 bp, Mus musculus
ctacgggctgcctgagtggaaacct

SEQ ID NO: 368364 - DNA, 25 bp, Mus musculus
ctacgggtctttaacctgttcaatg

SEQ ID NO: 368365 - DNA, 25 bp, Mus musculus
ctacgggtcttttacctgttcaatg

SEQ ID NO: 368366 - DNA, 25 bp, Mus musculus
ctacgggtgtttcgccttgctgcga

SEQ ID NO: 368367 - DNA, 25 bp, Mus musculus
ctacgggtgtttggccttgctgcga

SEQ ID NO: 368368 - DNA, 25 bp, Mus musculus
ctacggtacaggatttactctgaga

SEQ ID NO: 368369 - DNA, 25 bp, Mus musculus
ctacggtacaggttttactctgaga

SEQ ID NO: 368370 - DNA, 25 bp, Mus musculus
ctacggtagtagctcgtttgcttac

SEQ ID NO: 368371 - DNA, 25 bp, Mus musculus
ctacggtagtaggtcgtttgcttac

SEQ ID NO: 368372 - DNA, 25 bp, Mus musculus
ctacggtgctccagatggcttggga

SEQ ID NO: 368373 - DNA, 25 bp, Mus musculus
ctacggtgctcctgatggcttggga

SEQ ID NO: 368374 - DNA, 25 bp, Mus musculus
ctacggtgtactagtggaggtctga

SEQ ID NO: 368375 - DNA, 25 bp, Mus musculus
ctacggtgtacttgtggaggtctga

SEQ ID NO: 368376 - DNA, 25 bp, Mus musculus
ctacggttttgaagcccttgtggaa

SEQ ID NO: 368377 - DNA, 25 bp, Mus musculus
ctacggttttgatgcccttgtggaa

SEQ ID NO: 368378 - DNA, 25 bp, Mus musculus
ctacgtacagtccatggatgtggct

SEQ ID NO: 368379 - DNA, 25 bp, Mus musculus
ctacgtacagtcgatggatgtggct

SEQ ID NO: 368380 - DNA, 25 bp, Mus musculus
ctacgtacattgaccttgctgtgga

SEQ ID NO: 368381 - DNA, 25 bp, Mus musculus
ctacgtacattgtccttgctgtgga

SEQ ID NO: 368382 - DNA, 25 bp, Mus musculus
ctacgtaccgggatgtttggctgga

SEQ ID NO: 368383 - DNA, 25 bp, Mus musculus
ctacgtaccgggttgtttggctgga

SEQ ID NO: 368384 - DNA, 25 bp, Mus musculus
ctacgtagttctaggataggtataa

SEQ ID NO: 368385 - DNA, 25 bp, Mus musculus
ctacgtagttcttggataggtataa

SEQ ID NO: 368386 - DNA, 25 bp, Mus musculus
ctacgtatcgggaaggcatgaccaa

SEQ ID NO: 368387 - DNA, 25 bp, Mus musculus
ctacgtatcgggtaggcatgaccaa

SEQ ID NO: 368388 - DNA, 25 bp, Mus musculus
ctacgtattcgtactgtgcgttcat

SEQ ID NO: 368389 - DNA, 25 bp, Mus musculus
ctacgtattcgttctgtgcgttcat

SEQ ID NO: 368390 - DNA, 25 bp, Mus musculus
ctacgtcaagctcgacaaggctgtt

SEQ ID NO: 368391 - DNA, 25 bp, Mus musculus
ctacgtcaagctggacaaggctgtt

SEQ ID NO: 368392 - DNA, 25 bp, Mus musculus
ctacgtcgcctcacggagtaatcgc

SEQ ID NO: 368393 - DNA, 25 bp, Mus musculus
ctacgtcgcctctcggagtaatcgc

SEQ ID NO: 368394 - DNA, 25 bp, Mus musculus
ctacgtctattcatcctcttgatat

SEQ ID NO: 368395 - DNA, 25 bp, Mus musculus
ctacgtctattcttcctcttgatat

SEQ ID NO: 368396 - DNA, 25 bp, Mus musculus
ctacgtctcagaatgttttgtgcga

SEQ ID NO: 368397 - DNA, 25 bp, Mus musculus
ctacgtctcagattgttttgtgcga

SEQ ID NO: 368398 - DNA, 25 bp, Mus musculus
ctacgtggagagatccagttcagtc

SEQ ID NO: 368399 - DNA, 25 bp, Mus musculus
ctacgtggagagttccagttcagtc

SEQ ID NO: 368400 - DNA, 25 bp, Mus musculus
ctacgtggctctagcagtcggagta

SEQ ID NO: 368401 - DNA, 25 bp, Mus musculus
ctacgtggctcttgcagtcggagta

SEQ ID NO: 368402 - DNA, 25 bp, Mus musculus
ctacgtgggactagctttcggcatt

SEQ ID NO: 368403 - DNA, 25 bp, Mus musculus
ctacgtgggacttgctttcggcatt

SEQ ID NO: 368404 - DNA, 25 bp, Mus musculus
ctacgtgggataaatgctcattctg

SEQ ID NO: 368405 - DNA, 25 bp, Mus musculus
ctacgtgggatatatgctcattctg

SEQ ID NO: 368406 - DNA, 25 bp, Mus musculus
ctacgtgtgtttcatttcagtggca

SEQ ID NO: 368407 - DNA, 25 bp, Mus musculus
ctacgtgtgtttgatttcagtggca

SEQ ID NO: 368408 - DNA, 25 bp, Mus musculus
ctacgttgccacaggaccatgagga

SEQ ID NO: 368409 - DNA, 25 bp, Mus musculus
ctacgttgccactggaccatgagga

SEQ ID NO: 368410 - DNA, 25 bp, Mus musculus
ctacgttgtgaactctgggcttcag

SEQ ID NO: 368411 - DNA, 25 bp, Mus musculus
ctacgttgtgaagtctgggcttcag

SEQ ID NO: 368412 - DNA, 25 bp, Mus musculus
ctacgtttcctgcagactcttaaga

SEQ ID NO: 368413 - DNA, 25 bp, Mus musculus
ctacgtttcctggagactcttaaga

SEQ ID NO: 368414 - DNA, 25 bp, Mus musculus
ctactaactctacatggtacagtta

SEQ ID NO: 368415 - DNA, 25 bp, Mus musculus
ctactaactctagatggtacagtta

SEQ ID NO: 368416 - DNA, 25 bp, Mus musculus
ctactaatcagcatgagtcagggaa

SEQ ID NO: 368417 - DNA, 25 bp, Mus musculus
ctactaatcagcttgagtcagggaa

SEQ ID NO: 368418 - DNA, 25 bp, Mus musculus
ctactaatgaatacttgttcctggg

SEQ ID NO: 368419 - DNA, 25 bp, Mus musculus
ctactaatgaattcttgttcctggg

SEQ ID NO: 368420 - DNA, 25 bp, Mus musculus
ctactaatgttgattgatctgtgtt

SEQ ID NO: 368421 - DNA, 25 bp, Mus musculus
ctactaatgttgtttgatctgtgtt

SEQ ID NO: 368422 - DNA, 25 bp, Mus musculus
ctactaattttacctatcttgatct

SEQ ID NO: 368423 - DNA, 25 bp, Mus musculus
ctactaattttagctatcttgatct

SEQ ID NO: 368424 - DNA, 25 bp, Mus musculus
ctactacagttcatgcttccatgca

SEQ ID NO: 368425 - DNA, 25 bp, Mus musculus
ctactacagttcttgcttccatgca

SEQ ID NO: 368426 - DNA, 25 bp, Mus musculus
ctactacataggaggcacagcccag

SEQ ID NO: 368427 - DNA, 25 bp, Mus musculus
ctactacataggtggcacagcccag

SEQ ID NO: 368428 - DNA, 25 bp, Mus musculus
ctactacgagcgctggactttcttc

SEQ ID NO: 368429 - DNA, 25 bp, Mus musculus
ctactacgagcggtggactttcttc

SEQ ID NO: 368430 - DNA, 25 bp, Mus musculus
ctactacgtgccaagaggaggtcgc

SEQ ID NO: 368431 - DNA, 25 bp, Mus musculus
ctactacgtgcctagaggaggtcgc

SEQ ID NO: 368432 - DNA, 25 bp, Mus musculus
ctactactatgaaaggcgccggtcc

SEQ ID NO: 368433 - DNA, 25 bp, Mus musculus
ctactactatgataggcgccggtcc

SEQ ID NO: 368434 - DNA, 25 bp, Mus musculus
ctactactccagagtcaactttgac

SEQ ID NO: 368435 - DNA, 25 bp, Mus musculus
ctactactccagtgtcaactttgac

SEQ ID NO: 368436 - DNA, 25 bp, Mus musculus
ctactactgcttcctgagagagcct

SEQ ID NO: 368437 - DNA, 25 bp, Mus musculus
ctactactgcttgctgagagagcct

SEQ ID NO: 368438 - DNA, 25 bp, Mus musculus
ctactacttagcaggattttgacta

SEQ ID NO: 368439 - DNA, 25 bp, Mus musculus
ctactacttagctggattttgacta

SEQ ID NO: 368440 - DNA, 25 bp, Mus musculus
ctactagtgcaacaggacccagttt

SEQ ID NO: 368441 - DNA, 25 bp, Mus musculus
ctactagtgcaagaggacccagttt

SEQ ID NO: 368442 - DNA, 25 bp, Mus musculus
ctactagttgtcacggccatatttt

SEQ ID NO: 368443 - DNA, 25 bp, Mus musculus
ctactagttgtctcggccatatttt

SEQ ID NO: 368444 - DNA, 25 bp, Mus musculus
ctactagtttgcctgtccttttgaa

SEQ ID NO: 368445 - DNA, 25 bp, Mus musculus
ctactagtttgcgtgtccttttgaa

SEQ ID NO: 368446 - DNA, 25 bp, Mus musculus
ctactatatgtcatagccctggaga

SEQ ID NO: 368447 - DNA, 25 bp, Mus musculus
ctactatatgtcttagccctggaga

SEQ ID NO: 368448 - DNA, 25 bp, Mus musculus
ctactatcagccataccatttccgt

SEQ ID NO: 368449 - DNA, 25 bp, Mus musculus
ctactatcagccttaccatttccgt

SEQ ID NO: 368450 - DNA, 25 bp, Mus musculus
ctactatgcctcatgttgcctacct

SEQ ID NO: 368451 - DNA, 25 bp, Mus musculus
ctactatgcctcttgttgcctacct

SEQ ID NO: 368452 - DNA, 25 bp, Mus musculus
ctactatgtctaattgctcactctg

SEQ ID NO: 368453 - DNA, 25 bp, Mus musculus
ctactatgtctatttgctcactctg

SEQ ID NO: 368454 - DNA, 25 bp, Mus musculus
ctactattatctctggtcctgggag

SEQ ID NO: 368455 - DNA, 25 bp, Mus musculus
ctactattatctgtggtcctgggag

SEQ ID NO: 368456 - DNA, 25 bp, Mus musculus
ctactattccatctttgcatctcac

SEQ ID NO: 368457 - DNA, 25 bp, Mus musculus
ctactattccatgtttgcatctcac

SEQ ID NO: 368458 - DNA, 25 bp, Mus musculus
ctactatttaacactctagctctag

SEQ ID NO: 368459 - DNA, 25 bp, Mus musculus
ctactatttaactctctagctctag

SEQ ID NO: 368460 - DNA, 25 bp, Mus musculus
ctactcaaccagaccttctaggaat

SEQ ID NO: 368461 - DNA, 25 bp, Mus musculus
ctactcaaccagtccttctaggaat

SEQ ID NO: 368462 - DNA, 25 bp, Mus musculus
ctactcaaccatacaattttccttc

SEQ ID NO: 368463 - DNA, 25 bp, Mus musculus
ctactcaaccattcaattttccttc

SEQ ID NO: 368464 - DNA, 25 bp, Mus musculus
ctactcacagctaatttcgcatcag

SEQ ID NO: 368465 - DNA, 25 bp, Mus musculus
ctactcacagcttatttcgcatcag

SEQ ID NO: 368466 - DNA, 25 bp, Mus musculus
ctactcactttcagtgctgtctaaa

SEQ ID NO: 368467 - DNA, 25 bp, Mus musculus
ctactcactttctgtgctgtctaaa

SEQ ID NO: 368468 - DNA, 25 bp, Mus musculus
ctactcagaggtccgtaacttattt

SEQ ID NO: 368469 - DNA, 25 bp, Mus musculus
ctactcagaggtgcgtaacttattt

SEQ ID NO: 368470 - DNA, 25 bp, Mus musculus
ctactcaggcggattttgcaacacc

SEQ ID NO: 368471 - DNA, 25 bp, Mus musculus
ctactcaggcggtttttgcaacacc

SEQ ID NO: 368472 - DNA, 25 bp, Mus musculus
ctactcagtgcaacagccagctcta

SEQ ID NO: 368473 - DNA, 25 bp, Mus musculus
ctactcagtgcatcagccagctcta

SEQ ID NO: 368474 - DNA, 25 bp, Mus musculus
ctactcagttcacaatactgccctt

SEQ ID NO: 368475 - DNA, 25 bp, Mus musculus
ctactcagttcagaatactgccctt

SEQ ID NO: 368476 - DNA, 25 bp, Mus musculus
ctactccagaatcggttacttggtt

SEQ ID NO: 368477 - DNA, 25 bp, Mus musculus
ctactccagaatgggttacttggtt

SEQ ID NO: 368478 - DNA, 25 bp, Mus musculus
ctactccattcacacttacctgtgg

SEQ ID NO: 368479 - DNA, 25 bp, Mus musculus
ctactccattcagacttacctgtgg

SEQ ID NO: 368480 - DNA, 25 bp, Mus musculus
ctactcccagctagtcgatggataa

SEQ ID NO: 368481 - DNA, 25 bp, Mus musculus
ctactcccagcttgtcgatggataa

SEQ ID NO: 368482 - DNA, 25 bp, Mus musculus
ctactcccgcttatccttgaaatga

SEQ ID NO: 368483 - DNA, 25 bp, Mus musculus
ctactcccgcttttccttgaaatga

SEQ ID NO: 368484 - DNA, 25 bp, Mus musculus
ctactcctctgacgaatgggtatat

SEQ ID NO: 368485 - DNA, 25 bp, Mus musculus
ctactcctctgaggaatgggtatat

SEQ ID NO: 368486 - DNA, 25 bp, Mus musculus
ctactcctgactatataaggtccaa

SEQ ID NO: 368487 - DNA, 25 bp, Mus musculus
ctactcctgactttataaggtccaa

SEQ ID NO: 368488 - DNA, 25 bp, Mus musculus
ctactcctgattaacctcggtgaag

SEQ ID NO: 368489 - DNA, 25 bp, Mus musculus
ctactcctgatttacctcggtgaag

SEQ ID NO: 368490 - DNA, 25 bp, Mus musculus
ctactcctgctacgaattattccaa

SEQ ID NO: 368491 - DNA, 25 bp, Mus musculus
ctactcctgctaggaattattccaa

SEQ ID NO: 368492 - DNA, 25 bp, Mus musculus
ctactcctggttaaagagactttat

SEQ ID NO: 368493 - DNA, 25 bp, Mus musculus
ctactcctggtttaagagactttat

SEQ ID NO: 368494 - DNA, 25 bp, Mus musculus
ctactccttagcctggccagagaac

SEQ ID NO: 368495 - DNA, 25 bp, Mus musculus
ctactccttagcgtggccagagaac

SEQ ID NO: 368496 - DNA, 25 bp, Mus musculus
ctactcgaacagcaagggaagcaac

SEQ ID NO: 368497 - DNA, 25 bp, Mus musculus
ctactcgaacaggaagggaagcaac

SEQ ID NO: 368498 - DNA, 25 bp, Mus musculus
ctactcggttgtacgtggctgtgac

SEQ ID NO: 368499 - DNA, 25 bp, Mus musculus
ctactcggttgttcgtggctgtgac

SEQ ID NO: 368500 - DNA, 25 bp, Mus musculus
ctactcgttttcatcaatgaacaga

SEQ ID NO: 368501 - DNA, 25 bp, Mus musculus
ctactcgttttcttcaatgaacaga

SEQ ID NO: 368502 - DNA, 25 bp, Mus musculus
ctactctaacatactggcctaagca

SEQ ID NO: 368503 - DNA, 25 bp, Mus musculus
ctactctaacattctggcctaagca

SEQ ID NO: 368504 - DNA, 25 bp, Mus musculus
ctactctacctgaatggcttttgta

SEQ ID NO: 368505 - DNA, 25 bp, Mus musculus
ctactctacctgtatggcttttgta

SEQ ID NO: 368506 - DNA, 25 bp, Mus musculus
ctactctattttccatgcactcaaa

SEQ ID NO: 368507 - DNA, 25 bp, Mus musculus
ctactctattttgcatgcactcaaa

SEQ ID NO: 368508 - DNA, 25 bp, Mus musculus
ctactctctgccagagatactgcgg

SEQ ID NO: 368509 - DNA, 25 bp, Mus musculus
ctactctctgcctgagatactgcgg

SEQ ID NO: 368510 - DNA, 25 bp, Mus musculus
ctactctcttgtctggcaaccacta

SEQ ID NO: 368511 - DNA, 25 bp, Mus musculus
ctactctcttgtcttgcagtcacta

SEQ ID NO: 368512 - DNA, 25 bp, Mus musculus
ctactctcttgtgtggcaaccacta

SEQ ID NO: 368513 - DNA, 25 bp, Mus musculus
ctactctcttgtgttgcagtcacta

SEQ ID NO: 368514 - DNA, 25 bp, Mus musculus
ctactctgaggcaggcgttgtcagg

SEQ ID NO: 368515 - DNA, 25 bp, Mus musculus
ctactctgaggctggcgttgtcagg

SEQ ID NO: 368516 - DNA, 25 bp, Mus musculus
ctactctgctttctctgtaactcaa

SEQ ID NO: 368517 - DNA, 25 bp, Mus musculus
ctactctgctttgtctgtaactcaa

SEQ ID NO: 368518 - DNA, 25 bp, Mus musculus
ctactcttcggaatagcttcttatt

SEQ ID NO: 368519 - DNA, 25 bp, Mus musculus
ctactcttcggattagcttcttatt

SEQ ID NO: 368520 - DNA, 25 bp, Mus musculus
ctactcttgagtagtcagtgggcgg

SEQ ID NO: 368521 - DNA, 25 bp, Mus musculus
ctactcttgagttgtcagtgggcgg

SEQ ID NO: 368522 - DNA, 25 bp, Mus musculus
ctactcttggctccggcgcttttct

SEQ ID NO: 368523 - DNA, 25 bp, Mus musculus
ctactcttggctgcggcgcttttct

SEQ ID NO: 368524 - DNA, 25 bp, Mus musculus
ctactgaaaatcctggccactgagc

SEQ ID NO: 368525 - DNA, 25 bp, Mus musculus
ctactgaaaatcgtggccactgagc

SEQ ID NO: 368526 - DNA, 25 bp, Mus musculus
ctactgaacactccgactcctgggt

SEQ ID NO: 368527 - DNA, 25 bp, Mus musculus
ctactgaacactgcgactcctgggt

SEQ ID NO: 368528 - DNA, 25 bp, Mus musculus
ctactgaacgagaatgccaggccct

SEQ ID NO: 368529 - DNA, 25 bp, Mus musculus
ctactgaacgagtatgccaggccct

SEQ ID NO: 368530 - DNA, 25 bp, Mus musculus
ctactgaaggcaattctgcactctt

SEQ ID NO: 368531 - DNA, 25 bp, Mus musculus
ctactgaaggcatttctgcactctt

SEQ ID NO: 368532 - DNA, 25 bp, Mus musculus
ctactgagaaagcataaggtgactc

SEQ ID NO: 368533 - DNA, 25 bp, Mus musculus
ctactgagaaaggataaggtgactc

SEQ ID NO: 368534 - DNA, 25 bp, Mus musculus
ctactgataccacatctcaaatata

SEQ ID NO: 368535 - DNA, 25 bp, Mus musculus
ctactgataccagatctcaaatata

SEQ ID NO: 368536 - DNA, 25 bp, Mus musculus
ctactgatatctatcatttcctgga

SEQ ID NO: 368537 - DNA, 25 bp, Mus musculus
ctactgatatctttcatttcctgga

SEQ ID NO: 368538 - DNA, 25 bp, Mus musculus
ctactgatgtgtcacccctgggaaa

SEQ ID NO: 368539 - DNA, 25 bp, Mus musculus
ctactgatgtgtgacccctgggaaa

SEQ ID NO: 368540 - DNA, 25 bp, Mus musculus
ctactgattgtgacttaagtctttt

SEQ ID NO: 368541 - DNA, 25 bp, Mus musculus
ctactgattgtgtcttaagtctttt

SEQ ID NO: 368542 - DNA, 25 bp, Mus musculus
ctactgcaactacacccaccactac

SEQ ID NO: 368543 - DNA, 25 bp, Mus musculus
ctactgcaactagacccaccactac

SEQ ID NO: 368544 - DNA, 25 bp, Mus musculus
ctactgcacccacaagggtaatgtt

SEQ ID NO: 368545 - DNA, 25 bp, Mus musculus
ctactgcacccagaagggtaatgtt

SEQ ID NO: 368546 - DNA, 25 bp, Mus musculus
ctactgcataaaataactaacgtcg

SEQ ID NO: 368547 - DNA, 25 bp, Mus musculus
ctactgcataaattaactaacgtcg

SEQ ID NO: 368548 - DNA, 25 bp, Mus musculus
ctactgccaaggatctgatgtcctt

SEQ ID NO: 368549 - DNA, 25 bp, Mus musculus
ctactgccaaggttctgatgtcctt

SEQ ID NO: 368550 - DNA, 25 bp, Mus musculus
ctactgccatatcctactttctttt

SEQ ID NO: 368551 - DNA, 25 bp, Mus musculus
ctactgccatatgctactttctttt

SEQ ID NO: 368552 - DNA, 25 bp, Mus musculus
ctactgccgctgaggtggcccagag

SEQ ID NO: 368553 - DNA, 25 bp, Mus musculus
ctactgccgctgtggtggcccagag

SEQ ID NO: 368554 - DNA, 25 bp, Mus musculus
ctactgcctatgagaaaacgtctga

SEQ ID NO: 368555 - DNA, 25 bp, Mus musculus
ctactgcctatgtgaaaacgtctga

SEQ ID NO: 368556 - DNA, 25 bp, Mus musculus
ctactgcctggaacacaacgaaaag

SEQ ID NO: 368557 - DNA, 25 bp, Mus musculus
ctactgcctggatcacaacgaaaag

SEQ ID NO: 368558 - DNA, 25 bp, Mus musculus
ctactgcggttcagaggcagggaaa

SEQ ID NO: 368559 - DNA, 25 bp, Mus musculus
ctactgcggttctgaggcagggaaa

SEQ ID NO: 368560 - DNA, 25 bp, Mus musculus
ctactgctaactcctgtattctgta

SEQ ID NO: 368561 - DNA, 25 bp, Mus musculus
ctactgctaactgctgtattctgta

SEQ ID NO: 368562 - DNA, 25 bp, Mus musculus
ctactgctgccaaaggaggatgtct

SEQ ID NO: 368563 - DNA, 25 bp, Mus musculus
ctactgctgccataggaggatgtct

SEQ ID NO: 368564 - DNA, 25 bp, Mus musculus
ctactgctgtcaatttctgtgggtt

SEQ ID NO: 368565 - DNA, 25 bp, Mus musculus
ctactgctgtcattttctgtgggtt

SEQ ID NO: 368566 - DNA, 25 bp, Mus musculus
ctactgcttctgagctctgaataaa

SEQ ID NO: 368567 - DNA, 25 bp, Mus musculus
ctactgcttctgtgctctgaataaa

SEQ ID NO: 368568 - DNA, 25 bp, Mus musculus
ctactgcttggtcatttgatggaat

SEQ ID NO: 368569 - DNA, 25 bp, Mus musculus
ctactgcttggtgatttgatggaat

SEQ ID NO: 368570 - DNA, 25 bp, Mus musculus
ctactgcttttacacaactactctt

SEQ ID NO: 368571 - DNA, 25 bp, Mus musculus
ctactgcttttagacaactactctt

SEQ ID NO: 368572 - DNA, 25 bp, Mus musculus
ctactggacacacactgagtgcatt

SEQ ID NO: 368573 - DNA, 25 bp, Mus musculus
ctactggacacagactgagtgcatt

SEQ ID NO: 368574 - DNA, 25 bp, Mus musculus
ctactggaccctcaatttgctgaac

SEQ ID NO: 368575 - DNA, 25 bp, Mus musculus
ctactggaccctgaatttgctgaac

SEQ ID NO: 368576 - DNA, 25 bp, Mus musculus
ctactggaccttccccaggtagaag

SEQ ID NO: 368577 - DNA, 25 bp, Mus musculus
ctactggaccttgcccaggtagaag

SEQ ID NO: 368578 - DNA, 25 bp, Mus musculus
ctactggactgcaatatttttccct

SEQ ID NO: 368579 - DNA, 25 bp, Mus musculus
ctactggactgctatatttttccct

SEQ ID NO: 368580 - DNA, 25 bp, Mus musculus
ctactggacttgctgactgcgtgca

SEQ ID NO: 368581 - DNA, 25 bp, Mus musculus
ctactggacttggtgactgcgtgca

SEQ ID NO: 368582 - DNA, 25 bp, Mus musculus
ctactggatattccctttgtgcttc

SEQ ID NO: 368583 - DNA, 25 bp, Mus musculus
ctactggatattgcctttgtgcttc

SEQ ID NO: 368584 - DNA, 25 bp, Mus musculus
ctactggcccagctaagtgtgctta

SEQ ID NO: 368585 - DNA, 25 bp, Mus musculus
ctactggcccaggtaagtgtgctta

SEQ ID NO: 368586 - DNA, 25 bp, Mus musculus
ctactggcgggccacactgctggca

SEQ ID NO: 368587 - DNA, 25 bp, Mus musculus
ctactggcgggcgacactgctggca

SEQ ID NO: 368588 - DNA, 25 bp, Mus musculus
ctactggctgtacaagctccacggc

SEQ ID NO: 368589 - DNA, 25 bp, Mus musculus
ctactggctgtagaagctccacggc

SEQ ID NO: 368590 - DNA, 25 bp, Mus musculus
ctactgggcgccattgagagcctgg

SEQ ID NO: 368591 - DNA, 25 bp, Mus musculus
ctactgggcgcctttgagagcctgg

SEQ ID NO: 368592 - DNA, 25 bp, Mus musculus
ctactggtcggtagacaagctcggg

SEQ ID NO: 368593 - DNA, 25 bp, Mus musculus
ctactggtcggttgacaagctcggg

SEQ ID NO: 368594 - DNA, 25 bp, Mus musculus
ctactggtgaaacaggctggcctca

SEQ ID NO: 368595 - DNA, 25 bp, Mus musculus
ctactggtgaaagaggctggcctca

SEQ ID NO: 368596 - DNA, 25 bp, Mus musculus
ctactggtgtagatcctggtaccaa

SEQ ID NO: 368597 - DNA, 25 bp, Mus musculus
ctactggtgtagttcctggtaccaa

SEQ ID NO: 368598 - DNA, 25 bp, Mus musculus
ctactggttaccaggttgtcccctg

SEQ ID NO: 368599 - DNA, 25 bp, Mus musculus
ctactggttacctggttgtcccctg

SEQ ID NO: 368600 - DNA, 25 bp, Mus musculus
ctactggtttaaaagctgctgagat

SEQ ID NO: 368601 - DNA, 25 bp, Mus musculus
ctactggtttaatagctgctgagat

SEQ ID NO: 368602 - DNA, 25 bp, Mus musculus
ctactggtttctagtctgtggctga

SEQ ID NO: 368603 - DNA, 25 bp, Mus musculus
ctactggtttcttgtctgtggctga

SEQ ID NO: 368604 - DNA, 25 bp, Mus musculus
ctactgtaaaaactgagtctccgtt

SEQ ID NO: 368605 - DNA, 25 bp, Mus musculus
ctactgtaaaaagtgagtctccgtt

SEQ ID NO: 368606 - DNA, 25 bp, Mus musculus
ctactgtaggaacgaggctgtgtct

SEQ ID NO: 368607 - DNA, 25 bp, Mus musculus
ctactgtaggaaggaggctgtgtct

SEQ ID NO: 368608 - DNA, 25 bp, Mus musculus
ctactgtagttccttttgtttgcgt

SEQ ID NO: 368609 - DNA, 25 bp, Mus musculus
ctactgtagttcgttttgtttgcgt

SEQ ID NO: 368610 - DNA, 25 bp, Mus musculus
ctactgtataccagtgggcgatgag

SEQ ID NO: 368611 - DNA, 25 bp, Mus musculus
ctactgtatacctgtgggcgatgag

SEQ ID NO: 368612 - DNA, 25 bp, Mus musculus
ctactgtcaataccagtcaccttaa

SEQ ID NO: 368613 - DNA, 25 bp, Mus musculus
ctactgtcaatagcagtcaccttaa

SEQ ID NO: 368614 - DNA, 25 bp, Mus musculus
ctactgtcacctacacttttcaaag

SEQ ID NO: 368615 - DNA, 25 bp, Mus musculus
ctactgtcaccttcacttttcaaag

SEQ ID NO: 368616 - DNA, 25 bp, Mus musculus
ctactgtccgacactcaagaaaaaa

SEQ ID NO: 368617 - DNA, 25 bp, Mus musculus
ctactgtccgactctcaagaaaaaa

SEQ ID NO: 368618 - DNA, 25 bp, Mus musculus
ctactgtccttgatcttgagcacta

SEQ ID NO: 368619 - DNA, 25 bp, Mus musculus
ctactgtccttgttcttgagcacta

SEQ ID NO: 368620 - DNA, 25 bp, Mus musculus
ctactgtctgaaccggaagcttgtg

SEQ ID NO: 368621 - DNA, 25 bp, Mus musculus
ctactgtctgaagcggaagcttgtg

SEQ ID NO: 368622 - DNA, 25 bp, Mus musculus
ctactgtctgtgaacagcgccacct

SEQ ID NO: 368623 - DNA, 25 bp, Mus musculus
ctactgtctgtgtacagcgccacct

SEQ ID NO: 368624 - DNA, 25 bp, Mus musculus
ctactgtctgttatttgcttttata

SEQ ID NO: 368625 - DNA, 25 bp, Mus musculus
ctactgtctgttttttgcttttata

SEQ ID NO: 368626 - DNA, 25 bp, Mus musculus
ctactgtggctgacttaaaagaacg

SEQ ID NO: 368627 - DNA, 25 bp, Mus musculus
ctactgtggctgtcttaaaagaacg

SEQ ID NO: 368628 - DNA, 25 bp, Mus musculus
ctactgtgtaggagccccctgcttc

SEQ ID NO: 368629 - DNA, 25 bp, Mus musculus
ctactgtgtaggtgccccctgcttc

SEQ ID NO: 368630 - DNA, 25 bp, Mus musculus
ctactgtgtgccagagcttaacttc

SEQ ID NO: 368631 - DNA, 25 bp, Mus musculus
ctactgtgtgcctgagcttaacttc

SEQ ID NO: 368632 - DNA, 25 bp, Mus musculus
ctactgtgtgctagctgagctctaa

SEQ ID NO: 368633 - DNA, 25 bp, Mus musculus
ctactgtgtgcttgctgagctctaa

SEQ ID NO: 368634 - DNA, 25 bp, Mus musculus
ctactgtgtggcatgtcaggagctc

SEQ ID NO: 368635 - DNA, 25 bp, Mus musculus
ctactgtgtggcttgtcaggagctc

SEQ ID NO: 368636 - DNA, 25 bp, Mus musculus
ctactgttacccatctgaaaattca

SEQ ID NO: 368637 - DNA, 25 bp, Mus musculus
ctactgttacccttctgaaaattca

SEQ ID NO: 368638 - DNA, 25 bp, Mus musculus
ctactgttagagcagccagaggctc

SEQ ID NO: 368639 - DNA, 25 bp, Mus musculus
ctactgttagaggagccagaggctc

SEQ ID NO: 368640 - DNA, 25 bp, Mus musculus
ctactgttagtgctggaccaccagg

SEQ ID NO: 368641 - DNA, 25 bp, Mus musculus
ctactgttagtggtggaccaccagg

SEQ ID NO: 368642 - DNA, 25 bp, Mus musculus
ctactgttatagatggtgcctttta

SEQ ID NO: 368643 - DNA, 25 bp, Mus musculus
ctactgttatagttggtgcctttta

SEQ ID NO: 368644 - DNA, 25 bp, Mus musculus
ctactgttatcaatgctctcagcac

SEQ ID NO: 368645 - DNA, 25 bp, Mus musculus
ctactgttatcattgctctcagcac

SEQ ID NO: 368646 - DNA, 25 bp, Mus musculus
ctactgttcatgagcaaatggacca

SEQ ID NO: 368647 - DNA, 25 bp, Mus musculus
ctactgttcatgtgcaaatggacca

SEQ ID NO: 368648 - DNA, 25 bp, Mus musculus
ctactgttctcgcagaggatctgag

SEQ ID NO: 368649 - DNA, 25 bp, Mus musculus
ctactgttctcggagaggatctgag

SEQ ID NO: 368650 - DNA, 25 bp, Mus musculus
ctactgtttagcaaagttcaagcgc

SEQ ID NO: 368651 - DNA, 25 bp, Mus musculus
ctactgtttagcatctacacattga

SEQ ID NO: 368652 - DNA, 25 bp, Mus musculus
ctactgtttagctaagttcaagcgc

SEQ ID NO: 368653 - DNA, 25 bp, Mus musculus
ctactgtttagcttctacacattga

SEQ ID NO: 368654 - DNA, 25 bp, Mus musculus
ctactgtttagtattatagacatgt

SEQ ID NO: 368655 - DNA, 25 bp, Mus musculus
ctactgtttagttttatagacatgt

SEQ ID NO: 368656 - DNA, 25 bp, Mus musculus
ctactgtttattcccatcttgtata

SEQ ID NO: 368657 - DNA, 25 bp, Mus musculus
ctactgtttattgccatcttgtata

SEQ ID NO: 368658 - DNA, 25 bp, Mus musculus
ctactgtttcaaaagctctggtggt

SEQ ID NO: 368659 - DNA, 25 bp, Mus musculus
ctactgtttcaatagctctggtggt

SEQ ID NO: 368660 - DNA, 25 bp, Mus musculus
ctactgtttgtgagccagtggaaac

SEQ ID NO: 368661 - DNA, 25 bp, Mus musculus
ctactgtttgtgtgccagtggaaac

SEQ ID NO: 368662 - DNA, 25 bp, Mus musculus
ctacttaaacctctcttcttattat

SEQ ID NO: 368663 - DNA, 25 bp, Mus musculus
ctacttaaacctgtcttcttattat

SEQ ID NO: 368664 - DNA, 25 bp, Mus musculus
ctacttaagtgtcgcgttgaggatc

SEQ ID NO: 368665 - DNA, 25 bp, Mus musculus
ctacttaagtgtggcgttgaggatc

SEQ ID NO: 368666 - DNA, 25 bp, Mus musculus
ctacttaataaaagtgtggatcttt

SEQ ID NO: 368667 - DNA, 25 bp, Mus musculus
ctacttaataaatgtgtggatcttt

SEQ ID NO: 368668 - DNA, 25 bp, Mus musculus
ctacttaccaggctgtgtcgctaag

SEQ ID NO: 368669 - DNA, 25 bp, Mus musculus
ctacttaccagggtgtgtcgctaag

SEQ ID NO: 368670 - DNA, 25 bp, Mus musculus
ctacttacctggctgactatgggca

SEQ ID NO: 368671 - DNA, 25 bp, Mus musculus
ctacttacctgggtgactatgggca

SEQ ID NO: 368672 - DNA, 25 bp, Mus musculus
ctacttactaacagctgacatcact

SEQ ID NO: 368673 - DNA, 25 bp, Mus musculus
ctacttactaactgctgacatcact

SEQ ID NO: 368674 - DNA, 25 bp, Mus musculus
ctacttactgagctcctgggacaaa

SEQ ID NO: 368675 - DNA, 25 bp, Mus musculus
ctacttactgaggtcctgggacaaa

SEQ ID NO: 368676 - DNA, 25 bp, Mus musculus
ctacttagacttatgcaaattcatc

SEQ ID NO: 368677 - DNA, 25 bp, Mus musculus
ctacttagacttttgcaaattcatc

SEQ ID NO: 368678 - DNA, 25 bp, Mus musculus
ctacttagagctattgttcaacccc

SEQ ID NO: 368679 - DNA, 25 bp, Mus musculus
ctacttagagcttttgttcaacccc

SEQ ID NO: 368680 - DNA, 25 bp, Mus musculus
ctacttagggccaccagatactgga

SEQ ID NO: 368681 - DNA, 25 bp, Mus musculus
ctacttagggcctccagatactgga

SEQ ID NO: 368682 - DNA, 25 bp, Mus musculus
ctacttagtgtgcattctgctcacc

SEQ ID NO: 368683 - DNA, 25 bp, Mus musculus
ctacttagtgtggattctgctcacc

SEQ ID NO: 368684 - DNA, 25 bp, Mus musculus
ctacttatcccaactcatttattga

SEQ ID NO: 368685 - DNA, 25 bp, Mus musculus
ctacttatcccatctcatttattga

SEQ ID NO: 368686 - DNA, 25 bp, Mus musculus
ctacttatctagcacacttgtttcc

SEQ ID NO: 368687 - DNA, 25 bp, Mus musculus
ctacttatctaggacacttgtttcc

SEQ ID NO: 368688 - DNA, 25 bp, Mus musculus
ctacttatgagcatcgtttcgtgga

SEQ ID NO: 368689 - DNA, 25 bp, Mus musculus
ctacttatgagcttcgtttcgtgga

SEQ ID NO: 368690 - DNA, 25 bp, Mus musculus
ctacttatttctaaaagagggcatc

SEQ ID NO: 368691 - DNA, 25 bp, Mus musculus
ctacttatttcttaaagagggcatc

SEQ ID NO: 368692 - DNA, 25 bp, Mus musculus
ctacttcacgtgctgcgttaggagg

SEQ ID NO: 368693 - DNA, 25 bp, Mus musculus
ctacttcacgtggtgcgttaggagg

SEQ ID NO: 368694 - DNA, 25 bp, Mus musculus
ctacttcactccaatgagagacagt

SEQ ID NO: 368695 - DNA, 25 bp, Mus musculus
ctacttcactcctatgagagacagt

SEQ ID NO: 368696 - DNA, 25 bp, Mus musculus
ctacttcagaagaggcatgttgcac

SEQ ID NO: 368697 - DNA, 25 bp, Mus musculus
ctacttcagaagtggcatgttgcac

SEQ ID NO: 368698 - DNA, 25 bp, Mus musculus
ctacttcaggcaaggcttcttcatg

SEQ ID NO: 368699 - DNA, 25 bp, Mus musculus
ctacttcaggcatggcttcttcatg

SEQ ID NO: 368700 - DNA, 25 bp, Mus musculus
ctacttcatctgacatccccaaagg

SEQ ID NO: 368701 - DNA, 25 bp, Mus musculus
ctacttcatctgtcatccccaaagg

SEQ ID NO: 368702 - DNA, 25 bp, Mus musculus
ctacttcatggcagaatccttgtga

SEQ ID NO: 368703 - DNA, 25 bp, Mus musculus
ctacttcatggctgaatccttgtga

SEQ ID NO: 368704 - DNA, 25 bp, Mus musculus
ctacttccacacacttatcattatc

SEQ ID NO: 368705 - DNA, 25 bp, Mus musculus
ctacttccacactcttatcattatc

SEQ ID NO: 368706 - DNA, 25 bp, Mus musculus
ctacttccccttagacaatctgatg

SEQ ID NO: 368707 - DNA, 25 bp, Mus musculus
ctacttcccctttgacaatctgatg

SEQ ID NO: 368708 - DNA, 25 bp, Mus musculus
ctacttccctcactttgatgtaagc

SEQ ID NO: 368709 - DNA, 25 bp, Mus musculus
ctacttccctcagtttgatgtaagc

SEQ ID NO: 368710 - DNA, 25 bp, Mus musculus
ctacttctaagtctgagtccagtca

SEQ ID NO: 368711 - DNA, 25 bp, Mus musculus
ctacttctaagtgtgagtccagtca

SEQ ID NO: 368712 - DNA, 25 bp, Mus musculus
ctacttctaggacctttagtctctg

SEQ ID NO: 368713 - DNA, 25 bp, Mus musculus
ctacttctaggagctttagtctctg

SEQ ID NO: 368714 - DNA, 25 bp, Mus musculus
ctacttctcggaagtctgctgtggt

SEQ ID NO: 368715 - DNA, 25 bp, Mus musculus
ctacttctcggatgtctgctgtggt

SEQ ID NO: 368716 - DNA, 25 bp, Mus musculus
ctacttcttcctccatcattgacaa

SEQ ID NO: 368717 - DNA, 25 bp, Mus musculus
ctacttcttcctgcatcattgacaa

SEQ ID NO: 368718 - DNA, 25 bp, Mus musculus
ctacttgagctaatcttctgcatgg

SEQ ID NO: 368719 - DNA, 25 bp, Mus musculus
ctacttgagctattcttctgcatgg

SEQ ID NO: 368720 - DNA, 25 bp, Mus musculus
ctacttgaggcccttgctagcaaag

SEQ ID NO: 368721 - DNA, 25 bp, Mus musculus
ctacttgaggccgttgctagcaaag

SEQ ID NO: 368722 - DNA, 25 bp, Mus musculus
ctacttgagtatcatatctgtctcc

SEQ ID NO: 368723 - DNA, 25 bp, Mus musculus
ctacttgagtatgatatctgtctcc

SEQ ID NO: 368724 - DNA, 25 bp, Mus musculus
ctacttgcccaacaacatcgaggag

SEQ ID NO: 368725 - DNA, 25 bp, Mus musculus
ctacttgcccaagaacatcgaggag

SEQ ID NO: 368726 - DNA, 25 bp, Mus musculus
ctacttggaattcttgttcaggaaa

SEQ ID NO: 368727 - DNA, 25 bp, Mus musculus
ctacttggaattgttgttcaggaaa

SEQ ID NO: 368728 - DNA, 25 bp, Mus musculus
ctacttggagccagttcactgtgtt

SEQ ID NO: 368729 - DNA, 25 bp, Mus musculus
ctacttggagcctgttcactgtgtt

SEQ ID NO: 368730 - DNA, 25 bp, Mus musculus
ctacttggagtacgctcctgtttgg

SEQ ID NO: 368731 - DNA, 25 bp, Mus musculus
ctacttggagtaggctcctgtttgg

SEQ ID NO: 368732 - DNA, 25 bp, Mus musculus
ctacttggagttcgacatctgacac

SEQ ID NO: 368733 - DNA, 25 bp, Mus musculus
ctacttggagttggacatctgacac

SEQ ID NO: 368734 - DNA, 25 bp, Mus musculus
ctacttggatagctgaatatgtcag

SEQ ID NO: 368735 - DNA, 25 bp, Mus musculus
ctacttggataggtgaatatgtcag

SEQ ID NO: 368736 - DNA, 25 bp, Mus musculus
ctacttgggaggctggcaagcaaaa

SEQ ID NO: 368737 - DNA, 25 bp, Mus musculus
ctacttgggagggtggcaagcaaaa

SEQ ID NO: 368738 - DNA, 25 bp, Mus musculus
ctacttgggatgactgtgatgctac

SEQ ID NO: 368739 - DNA, 25 bp, Mus musculus
ctacttgggatgtctgtgatgctac

SEQ ID NO: 368740 - DNA, 25 bp, Mus musculus
ctacttggtagtagtgtggctctgt

SEQ ID NO: 368741 - DNA, 25 bp, Mus musculus
ctacttggtagttgtgtggctctgt

SEQ ID NO: 368742 - DNA, 25 bp, Mus musculus
ctacttggtgttcctcttggtgaaa

SEQ ID NO: 368743 - DNA, 25 bp, Mus musculus
ctacttggtgttgctcttggtgaaa

SEQ ID NO: 368744 - DNA, 25 bp, Mus musculus
ctacttgtacctagtgcccatggag

SEQ ID NO: 368745 - DNA, 25 bp, Mus musculus
ctacttgtaccttgtgcccatggag

SEQ ID NO: 368746 - DNA, 25 bp, Mus musculus
ctacttgtagttctcagtgcaacca

SEQ ID NO: 368747 - DNA, 25 bp, Mus musculus
ctacttgtagttgtcagtgcaacca

SEQ ID NO: 368748 - DNA, 25 bp, Mus musculus
ctacttgtggtcctgcttgataata

SEQ ID NO: 368749 - DNA, 25 bp, Mus musculus
ctacttgtggtcgtgcttgataata

SEQ ID NO: 368750 - DNA, 25 bp, Mus musculus
ctactttaacttatcttgtcagacg

SEQ ID NO: 368751 - DNA, 25 bp, Mus musculus
ctactttaacttttcttgtcagacg

SEQ ID NO: 368752 - DNA, 25 bp, Mus musculus
ctactttataccattgggcatccaa

SEQ ID NO: 368753 - DNA, 25 bp, Mus musculus
ctactttatacctttgggcatccaa

SEQ ID NO: 368754 - DNA, 25 bp, Mus musculus
ctactttccccgcgatggagatgag

SEQ ID NO: 368755 - DNA, 25 bp, Mus musculus
ctactttccccgggatggagatgag

SEQ ID NO: 368756 - DNA, 25 bp, Mus musculus
ctactttctaagactggagtccagt

SEQ ID NO: 368757 - DNA, 25 bp, Mus musculus
ctactttctaagtctggagtccagt

SEQ ID NO: 368758 - DNA, 25 bp, Mus musculus
ctactttctcatccctaaattgtgg

SEQ ID NO: 368759 - DNA, 25 bp, Mus musculus
ctactttctcatgcctaaattgtgg

SEQ ID NO: 368760 - DNA, 25 bp, Mus musculus
ctactttgctatatctgttctttga

SEQ ID NO: 368761 - DNA, 25 bp, Mus musculus
ctactttgctatttctgttctttga

SEQ ID NO: 368762 - DNA, 25 bp, Mus musculus
ctactttgtcagaggcacatgccaa

SEQ ID NO: 368763 - DNA, 25 bp, Mus musculus
ctactttgtcagtggcacatgccaa

SEQ ID NO: 368764 - DNA, 25 bp, Mus musculus
ctacttttaagcagctggtggaagc

SEQ ID NO: 368765 - DNA, 25 bp, Mus musculus
ctacttttaagctgctggtggaagc

SEQ ID NO: 368766 - DNA, 25 bp, Mus musculus
ctacttttaattctcttgtaaagat

SEQ ID NO: 368767 - DNA, 25 bp, Mus musculus
ctacttttaattgtcttgtaaagat

SEQ ID NO: 368768 - DNA, 25 bp, Mus musculus
ctacttttccatattttctcactga

SEQ ID NO: 368769 - DNA, 25 bp, Mus musculus
ctacttttccattttttctcactga

SEQ ID NO: 368770 - DNA, 25 bp, Mus musculus
ctacttttcctcatgaggctctgaa

SEQ ID NO: 368771 - DNA, 25 bp, Mus musculus
ctacttttcctcttgaggctctgaa

SEQ ID NO: 368772 - DNA, 25 bp, Mus musculus
ctacttttctctagggtcttgacat

SEQ ID NO: 368773 - DNA, 25 bp, Mus musculus
ctacttttctcttgggtcttgacat

SEQ ID NO: 368774 - DNA, 25 bp, Mus musculus
ctacttttctggctgatggccacaa

SEQ ID NO: 368775 - DNA, 25 bp, Mus musculus
ctacttttctgggtgatggccacaa

SEQ ID NO: 368776 - DNA, 25 bp, Mus musculus
ctacttttttacacttgcatttgca

SEQ ID NO: 368777 - DNA, 25 bp, Mus musculus
ctacttttttactcttgcatttgca

SEQ ID NO: 368778 - DNA, 25 bp, Mus musculus
ctagaaaacaggaatgcaggccatg

SEQ ID NO: 368779 - DNA, 25 bp, Mus musculus
ctagaaaacaggtatgcaggccatg

SEQ ID NO: 368780 - DNA, 25 bp, Mus musculus
ctagaaaactcaactttgggctggg

SEQ ID NO: 368781 - DNA, 25 bp, Mus musculus
ctagaaaactcatctttgggctggg

SEQ ID NO: 368782 - DNA, 25 bp, Mus musculus
ctagaaaatgcacgcagtgttttca

SEQ ID NO: 368783 - DNA, 25 bp, Mus musculus
ctagaaaatgcaggcagtgttttca

SEQ ID NO: 368784 - DNA, 25 bp, Mus musculus
ctagaaacctacctactgccgctgt

SEQ ID NO: 368785 - DNA, 25 bp, Mus musculus
ctagaaacctacgtactgccgctgt

SEQ ID NO: 368786 - DNA, 25 bp, Mus musculus
ctagaaacgtagaatctggctttag

SEQ ID NO: 368787 - DNA, 25 bp, Mus musculus
ctagaaacgtagtatctggctttag

SEQ ID NO: 368788 - DNA, 25 bp, Mus musculus
ctagaaactaccataacttcggagt

SEQ ID NO: 368789 - DNA, 25 bp, Mus musculus
ctagaaactaccttaacttcggagt

SEQ ID NO: 368790 - DNA, 25 bp, Mus musculus
ctagaaactattcgccactgaaggg

SEQ ID NO: 368791 - DNA, 25 bp, Mus musculus
ctagaaactattggccactgaaggg

SEQ ID NO: 368792 - DNA, 25 bp, Mus musculus
ctagaaactcctaaccttctactga

SEQ ID NO: 368793 - DNA, 25 bp, Mus musculus
ctagaaactccttaccttctactga

SEQ ID NO: 368794 - DNA, 25 bp, Mus musculus
ctagaaactgccatacccagggatc

SEQ ID NO: 368795 - DNA, 25 bp, Mus musculus
ctagaaactgccttacccagggatc

SEQ ID NO: 368796 - DNA, 25 bp, Mus musculus
ctagaaagctagatctcttgttggg

SEQ ID NO: 368797 - DNA, 25 bp, Mus musculus
ctagaaagctagttctcttgttggg

SEQ ID NO: 368798 - DNA, 25 bp, Mus musculus
ctagaaaggctcacggttacagtta

SEQ ID NO: 368799 - DNA, 25 bp, Mus musculus
ctagaaaggctctcggttacagtta

SEQ ID NO: 368800 - DNA, 25 bp, Mus musculus
ctagaaaggtctctgacttcgctgt

SEQ ID NO: 368801 - DNA, 25 bp, Mus musculus
ctagaaaggtctgtgacttcgctgt

SEQ ID NO: 368802 - DNA, 25 bp, Mus musculus
ctagaaatctggacctcttatgaga

SEQ ID NO: 368803 - DNA, 25 bp, Mus musculus
ctagaaatctggtcctcttatgaga

SEQ ID NO: 368804 - DNA, 25 bp, Mus musculus
ctagaaatgattctgtgtgactgga

SEQ ID NO: 368805 - DNA, 25 bp, Mus musculus
ctagaaatgattgtgtgtgactgga

SEQ ID NO: 368806 - DNA, 25 bp, Mus musculus
ctagaacagtgacagccaggcggtc

SEQ ID NO: 368807 - DNA, 25 bp, Mus musculus
ctagaacagtgagagccaggcggtc

SEQ ID NO: 368808 - DNA, 25 bp, Mus musculus
ctagaacagttgagcctggagagat

SEQ ID NO: 368809 - DNA, 25 bp, Mus musculus
ctagaacagttgtgcctggagagat

SEQ ID NO: 368810 - DNA, 25 bp, Mus musculus
ctagaacagtttccccgtggtgttg

SEQ ID NO: 368811 - DNA, 25 bp, Mus musculus
ctagaacagtttgcccgtggtgttg

SEQ ID NO: 368812 - DNA, 25 bp, Mus musculus
ctagaacattgcagcttattttgta

SEQ ID NO: 368813 - DNA, 25 bp, Mus musculus
ctagaacattgctgcttattttgta

SEQ ID NO: 368814 - DNA, 25 bp, Mus musculus
ctagaacctgtcaagctgagagcca

SEQ ID NO: 368815 - DNA, 25 bp, Mus musculus
ctagaacctgtctagctgagagcca

SEQ ID NO: 368816 - DNA, 25 bp, Mus musculus
ctagaacgaaatccgcagctggctt

SEQ ID NO: 368817 - DNA, 25 bp, Mus musculus
ctagaacgaaatgcgcagctggctt

SEQ ID NO: 368818 - DNA, 25 bp, Mus musculus
ctagaacggcagaagttaggaggta

SEQ ID NO: 368819 - DNA, 25 bp, Mus musculus
ctagaacggcagtagttaggaggta

SEQ ID NO: 368820 - DNA, 25 bp, Mus musculus
ctagaactcctccagcagttactta

SEQ ID NO: 368821 - DNA, 25 bp, Mus musculus
ctagaactcctcgagcagttactta

SEQ ID NO: 368822 - DNA, 25 bp, Mus musculus
ctagaactgccaaacttaatttttt

SEQ ID NO: 368823 - DNA, 25 bp, Mus musculus
ctagaactgccatacttaatttttt

SEQ ID NO: 368824 - DNA, 25 bp, Mus musculus
ctagaactgggaattactggtaaca

SEQ ID NO: 368825 - DNA, 25 bp, Mus musculus
ctagaactgggatttactggtaaca

SEQ ID NO: 368826 - DNA, 25 bp, Mus musculus
ctagaacttaatccctgtttccctg

SEQ ID NO: 368827 - DNA, 25 bp, Mus musculus
ctagaacttaatgcctgtttccctg

SEQ ID NO: 368828 - DNA, 25 bp, Mus musculus
ctagaacttgaccagtccatgcggt

SEQ ID NO: 368829 - DNA, 25 bp, Mus musculus
ctagaacttgacgagtccatgcggt

SEQ ID NO: 368830 - DNA, 25 bp, Mus musculus
ctagaagacactcagggagtcgctg

SEQ ID NO: 368831 - DNA, 25 bp, Mus musculus
ctagaagacactgagggagtcgctg

SEQ ID NO: 368832 - DNA, 25 bp, Mus musculus
ctagaagacatgatggaaagcggga

SEQ ID NO: 368833 - DNA, 25 bp, Mus musculus
ctagaagacatgttggaaagcggga

SEQ ID NO: 368834 - DNA, 25 bp, Mus musculus
ctagaagaccagatttcaattccca

SEQ ID NO: 368835 - DNA, 25 bp, Mus musculus
ctagaagaccagttttcaattccca

SEQ ID NO: 368836 - DNA, 25 bp, Mus musculus
ctagaagacgcaccaaagttctccg

SEQ ID NO: 368837 - DNA, 25 bp, Mus musculus
ctagaagacgcagcaaagttctccg

SEQ ID NO: 368838 - DNA, 25 bp, Mus musculus
ctagaagatgtactttgatatgtgt

SEQ ID NO: 368839 - DNA, 25 bp, Mus musculus
ctagaagatgtagtttgatatgtgt

SEQ ID NO: 368840 - DNA, 25 bp, Mus musculus
ctagaagatttcacattcaatccct

SEQ ID NO: 368841 - DNA, 25 bp, Mus musculus
ctagaagatttctcattcaatccct

SEQ ID NO: 368842 - DNA, 25 bp, Mus musculus
ctagaagcccctagtcatagccctt

SEQ ID NO: 368843 - DNA, 25 bp, Mus musculus
ctagaagccccttgtcatagccctt

SEQ ID NO: 368844 - DNA, 25 bp, Mus musculus
ctagaagctctcacttggaagtcaa

SEQ ID NO: 368845 - DNA, 25 bp, Mus musculus
ctagaagctctctcttggaagtcaa

SEQ ID NO: 368846 - DNA, 25 bp, Mus musculus
ctagaagctgagcatcacccttcca

SEQ ID NO: 368847 - DNA, 25 bp, Mus musculus
ctagaagctgaggatcacccttcca

SEQ ID NO: 368848 - DNA, 25 bp, Mus musculus
ctagaagctgctcgccgattcttac

SEQ ID NO: 368849 - DNA, 25 bp, Mus musculus
ctagaagctgctggccgattcttac

SEQ ID NO: 368850 - DNA, 25 bp, Mus musculus
ctagaagctggtctggcatggccac

SEQ ID NO: 368851 - DNA, 25 bp, Mus musculus
ctagaagctggtgtggcatggccac

SEQ ID NO: 368852 - DNA, 25 bp, Mus musculus
ctagaaggagacagtgacaacccca

SEQ ID NO: 368853 - DNA, 25 bp, Mus musculus
ctagaaggagactgtgacaacccca

SEQ ID NO: 368854 - DNA, 25 bp, Mus musculus
ctagaaggagcacgtctgttcccat

SEQ ID NO: 368855 - DNA, 25 bp, Mus musculus
ctagaaggagcaggtctgttcccat

SEQ ID NO: 368856 - DNA, 25 bp, Mus musculus
ctagaaggatttcagctgctgcagc

SEQ ID NO: 368857 - DNA, 25 bp, Mus musculus
ctagaaggatttgagctgctgcagc

SEQ ID NO: 368858 - DNA, 25 bp, Mus musculus
ctagaaggcactatggattaattgt

SEQ ID NO: 368859 - DNA, 25 bp, Mus musculus
ctagaaggcactttggattaattgt

SEQ ID NO: 368860 - DNA, 25 bp, Mus musculus
ctagaagggtcactggttccagtct

SEQ ID NO: 368861 - DNA, 25 bp, Mus musculus
ctagaagggtcagtggttccagtct

SEQ ID NO: 368862 - DNA, 25 bp, Mus musculus
ctagaaggtccacctaggcctggca

SEQ ID NO: 368863 - DNA, 25 bp, Mus musculus
ctagaaggtccagctaggcctggca

SEQ ID NO: 368864 - DNA, 25 bp, Mus musculus
ctagaaggtcgtccgcactatggga

SEQ ID NO: 368865 - DNA, 25 bp, Mus musculus
ctagaaggtcgtgcgcactatggga

SEQ ID NO: 368866 - DNA, 25 bp, Mus musculus
ctagaagtcaccagagagagccaag

SEQ ID NO: 368867 - DNA, 25 bp, Mus musculus
ctagaagtcacctgagagagccaag

SEQ ID NO: 368868 - DNA, 25 bp, Mus musculus
ctagaagtctagctttgaggccaga

SEQ ID NO: 368869 - DNA, 25 bp, Mus musculus
ctagaagtctaggtttgaggccaga

SEQ ID NO: 368870 - DNA, 25 bp, Mus musculus
ctagaagtctcaaggcctatggcga

SEQ ID NO: 368871 - DNA, 25 bp, Mus musculus
ctagaagtctcatggcctatggcga

SEQ ID NO: 368872 - DNA, 25 bp, Mus musculus
ctagaagtgtttcatgcttgcctaa

SEQ ID NO: 368873 - DNA, 25 bp, Mus musculus
ctagaagtgtttgatgcttgcctaa

SEQ ID NO: 368874 - DNA, 25 bp, Mus musculus
ctagaagttgtgatcctttgcccat

SEQ ID NO: 368875 - DNA, 25 bp, Mus musculus
ctagaagttgtgttcctttgcccat

SEQ ID NO: 368876 - DNA, 25 bp, Mus musculus
ctagaatacggaaagcgaactggtt

SEQ ID NO: 368877 - DNA, 25 bp, Mus musculus
ctagaatacggatagcgaactggtt

SEQ ID NO: 368878 - DNA, 25 bp, Mus musculus
ctagaatactatatacagctgcttc

SEQ ID NO: 368879 - DNA, 25 bp, Mus musculus
ctagaatactatttacagctgcttc

SEQ ID NO: 368880 - DNA, 25 bp, Mus musculus
ctagaatagactccagaaacacctc

SEQ ID NO: 368881 - DNA, 25 bp, Mus musculus
ctagaatagactgcagaaacacctc

SEQ ID NO: 368882 - DNA, 25 bp, Mus musculus
ctagaatcccagctgactgcttgtg

SEQ ID NO: 368883 - DNA, 25 bp, Mus musculus
ctagaatcccaggtgactgcttgtg

SEQ ID NO: 368884 - DNA, 25 bp, Mus musculus
ctagaatgacccactaacctctatt

SEQ ID NO: 368885 - DNA, 25 bp, Mus musculus
ctagaatgaccctctaacctctatt

SEQ ID NO: 368886 - DNA, 25 bp, Mus musculus
ctagaatgtcatccctgcttgtcaa

SEQ ID NO: 368887 - DNA, 25 bp, Mus musculus
ctagaatgtcatgcctgcttgtcaa

SEQ ID NO: 368888 - DNA, 25 bp, Mus musculus
ctagaatgtgttatcatgcccggcc

SEQ ID NO: 368889 - DNA, 25 bp, Mus musculus
ctagaatgtgttttcatgcccggcc

SEQ ID NO: 368890 - DNA, 25 bp, Mus musculus
ctagaattctccataccctgaaggg

SEQ ID NO: 368891 - DNA, 25 bp, Mus musculus
ctagaattctccttaccctgaaggg

SEQ ID NO: 368892 - DNA, 25 bp, Mus musculus
ctagaattgtttcactatccacata

SEQ ID NO: 368893 - DNA, 25 bp, Mus musculus
ctagaattgtttgactatccacata

SEQ ID NO: 368894 - DNA, 25 bp, Mus musculus
ctagaatttgggaactgcacagtgt

SEQ ID NO: 368895 - DNA, 25 bp, Mus musculus
ctagaatttgggtactgcacagtgt

SEQ ID NO: 368896 - DNA, 25 bp, Mus musculus
ctagacaagaggaatgttgcgggct

SEQ ID NO: 368897 - DNA, 25 bp, Mus musculus
ctagacaagaggtatgttgcgggct

SEQ ID NO: 368898 - DNA, 25 bp, Mus musculus
ctagacacacgacacacctgatatt

SEQ ID NO: 368899 - DNA, 25 bp, Mus musculus
ctagacacacgagacacctgatatt

SEQ ID NO: 368900 - DNA, 25 bp, Mus musculus
ctagacacatctacattgcgagcgt

SEQ ID NO: 368901 - DNA, 25 bp, Mus musculus
ctagacacatcttcattgcgagcgt

SEQ ID NO: 368902 - DNA, 25 bp, Mus musculus
ctagacagcctgcaagtagttgcct

SEQ ID NO: 368903 - DNA, 25 bp, Mus musculus
ctagacagcctggaagtagttgcct

SEQ ID NO: 368904 - DNA, 25 bp, Mus musculus
ctagacagcgacatgcagaccctgg

SEQ ID NO: 368905 - DNA, 25 bp, Mus musculus
ctagacagcgacttgcagaccctgg

SEQ ID NO: 368906 - DNA, 25 bp, Mus musculus
ctagacagcgctaggcccgtggcat

SEQ ID NO: 368907 - DNA, 25 bp, Mus musculus
ctagacagcgcttggcccgtggcat

SEQ ID NO: 368908 - DNA, 25 bp, Mus musculus
ctagacagtgaactgccagggccca

SEQ ID NO: 368909 - DNA, 25 bp, Mus musculus
ctagacagtgaagtgccagggccca

SEQ ID NO: 368910 - DNA, 25 bp, Mus musculus
ctagacatctggatggtagcctgta

SEQ ID NO: 368911 - DNA, 25 bp, Mus musculus
ctagacatctggttggtagcctgta

SEQ ID NO: 368912 - DNA, 25 bp, Mus musculus
ctagacatggcacgaggacatcatc

SEQ ID NO: 368913 - DNA, 25 bp, Mus musculus
ctagacatggcaggaggacatcatc

SEQ ID NO: 368914 - DNA, 25 bp, Mus musculus
ctagacattaaaccgacagcaactg

SEQ ID NO: 368915 - DNA, 25 bp, Mus musculus
ctagacattaaagcgacagcaactg

SEQ ID NO: 368916 - DNA, 25 bp, Mus musculus
ctagaccagctcatcaaaggcatta

SEQ ID NO: 368917 - DNA, 25 bp, Mus musculus
ctagaccagctcttcaaaggcatta

SEQ ID NO: 368918 - DNA, 25 bp, Mus musculus
ctagaccatggtaccttgcaacata

SEQ ID NO: 368919 - DNA, 25 bp, Mus musculus
ctagaccatggttccttgcaacata

SEQ ID NO: 368920 - DNA, 25 bp, Mus musculus
ctagacccagctatatgcaggcggg

SEQ ID NO: 368921 - DNA, 25 bp, Mus musculus
ctagacccagctttatgcaggcggg

SEQ ID NO: 368922 - DNA, 25 bp, Mus musculus
ctagaccctctgatggttacagtca

SEQ ID NO: 368923 - DNA, 25 bp, Mus musculus
ctagaccctctgttggttacagtca

SEQ ID NO: 368924 - DNA, 25 bp, Mus musculus
ctagaccttctcacatgtcttaaac

SEQ ID NO: 368925 - DNA, 25 bp, Mus musculus
ctagaccttctctcatgtcttaaac

SEQ ID NO: 368926 - DNA, 25 bp, Mus musculus
ctagaccttggaaagtagattcttt

SEQ ID NO: 368927 - DNA, 25 bp, Mus musculus
ctagaccttggatagtagattcttt

SEQ ID NO: 368928 - DNA, 25 bp, Mus musculus
ctagacctttccagcacatgtgaaa

SEQ ID NO: 368929 - DNA, 25 bp, Mus musculus
ctagacctttcctgcacatgtgaaa

SEQ ID NO: 368930 - DNA, 25 bp, Mus musculus
ctagacgacgagaatgagtttcccc

SEQ ID NO: 368931 - DNA, 25 bp, Mus musculus
ctagacgacgagtatgagtttcccc

SEQ ID NO: 368932 - DNA, 25 bp, Mus musculus
ctagacggagagaaaatcagaaaga

SEQ ID NO: 368933 - DNA, 25 bp, Mus musculus
ctagacggagagtaaatcagaaaga

SEQ ID NO: 368934 - DNA, 25 bp, Mus musculus
ctagactaacagcaactgctttggg

SEQ ID NO: 368935 - DNA, 25 bp, Mus musculus
ctagactaacaggaactgctttggg

SEQ ID NO: 368936 - DNA, 25 bp, Mus musculus
ctagactagataatggttggccaac

SEQ ID NO: 368937 - DNA, 25 bp, Mus musculus
ctagactagatattggttggccaac

SEQ ID NO: 368938 - DNA, 25 bp, Mus musculus
ctagactagtcaatgagcgtcccac

SEQ ID NO: 368939 - DNA, 25 bp, Mus musculus
ctagactagtcattgagcgtcccac

SEQ ID NO: 368940 - DNA, 25 bp, Mus musculus
ctagactcattgcacagggacgagt

SEQ ID NO: 368941 - DNA, 25 bp, Mus musculus
ctagactcattggacagggacgagt

SEQ ID NO: 368942 - DNA, 25 bp, Mus musculus
ctagactcggatataaaagcatatt

SEQ ID NO: 368943 - DNA, 25 bp, Mus musculus
ctagactcggatttaaaagcatatt

SEQ ID NO: 368944 - DNA, 25 bp, Mus musculus
ctagactgaaatcccacctgtgaaa

SEQ ID NO: 368945 - DNA, 25 bp, Mus musculus
ctagactgaaatgccacctgtgaaa

SEQ ID NO: 368946 - DNA, 25 bp, Mus musculus
ctagactgcggaatggcgtgacaaa

SEQ ID NO: 368947 - DNA, 25 bp, Mus musculus
ctagactgcggattggcgtgacaaa

SEQ ID NO: 368948 - DNA, 25 bp, Mus musculus
ctagactggacactcagatcatgga

SEQ ID NO: 368949 - DNA, 25 bp, Mus musculus
ctagactggacagtcagatcatgga

SEQ ID NO: 368950 - DNA, 25 bp, Mus musculus
ctagactggagtattgttacataaa

SEQ ID NO: 368951 - DNA, 25 bp, Mus musculus
ctagactggagttttgttacataaa

SEQ ID NO: 368952 - DNA, 25 bp, Mus musculus
ctagactgtaggaggtgctgtgctc

SEQ ID NO: 368953 - DNA, 25 bp, Mus musculus
ctagactgtaggtggtgctgtgctc

SEQ ID NO: 368954 - DNA, 25 bp, Mus musculus
ctagactgtctaatagccatgcact

SEQ ID NO: 368955 - DNA, 25 bp, Mus musculus
ctagactgtctattagccatgcact

SEQ ID NO: 368956 - DNA, 25 bp, Mus musculus
ctagacttggttacttttgggctgt

SEQ ID NO: 368957 - DNA, 25 bp, Mus musculus
ctagacttggtttcttttgggctgt

SEQ ID NO: 368958 - DNA, 25 bp, Mus musculus
ctagacttgttcatgatagcttagt

SEQ ID NO: 368959 - DNA, 25 bp, Mus musculus
ctagacttgttcttgatagcttagt

SEQ ID NO: 368960 - DNA, 25 bp, Mus musculus
ctagactttacaccaatggtcctgt

SEQ ID NO: 368961 - DNA, 25 bp, Mus musculus
ctagactttacagcaatggtcctgt

SEQ ID NO: 368962 - DNA, 25 bp, Mus musculus
ctagagaacgtccttatgtcctggg

SEQ ID NO: 368963 - DNA, 25 bp, Mus musculus
ctagagaacgtcgttatgtcctggg

SEQ ID NO: 368964 - DNA, 25 bp, Mus musculus
ctagagaactccacatgtctccagg

SEQ ID NO: 368965 - DNA, 25 bp, Mus musculus
ctagagaactcctcatgtctccagg

SEQ ID NO: 368966 - DNA, 25 bp, Mus musculus
ctagagacatggatcagcagttaca

SEQ ID NO: 368967 - DNA, 25 bp, Mus musculus
ctagagacatggttcagcagttaca

SEQ ID NO: 368968 - DNA, 25 bp, Mus musculus
ctagagactcagaatctacaacaaa

SEQ ID NO: 368969 - DNA, 25 bp, Mus musculus
ctagagactcagtatctacaacaaa

SEQ ID NO: 368970 - DNA, 25 bp, Mus musculus
ctagagactgttaatgtaccttttc

SEQ ID NO: 368971 - DNA, 25 bp, Mus musculus
ctagagactgtttatgtaccttttc

SEQ ID NO: 368972 - DNA, 25 bp, Mus musculus
ctagagagttcacatcaagtggttg

SEQ ID NO: 368973 - DNA, 25 bp, Mus musculus
ctagagagttcagatcaagtggttg

SEQ ID NO: 368974 - DNA, 25 bp, Mus musculus
ctagagatcagacttgcgcagggtt

SEQ ID NO: 368975 - DNA, 25 bp, Mus musculus
ctagagatcagagttgcgcagggtt

SEQ ID NO: 368976 - DNA, 25 bp, Mus musculus
ctagagcaacatactttggaggcat

SEQ ID NO: 368977 - DNA, 25 bp, Mus musculus
ctagagcaacattctttggaggcat

SEQ ID NO: 368978 - DNA, 25 bp, Mus musculus
ctagagcaactaccccaagaggtga

SEQ ID NO: 368979 - DNA, 25 bp, Mus musculus
ctagagcaactagcccaagaggtga

SEQ ID NO: 368980 - DNA, 25 bp, Mus musculus
ctagagcaggatcccctcatcttta

SEQ ID NO: 368981 - DNA, 25 bp, Mus musculus
ctagagcaggatgccctcatcttta

SEQ ID NO: 368982 - DNA, 25 bp, Mus musculus
ctagagcatatgactccagtgcgct

SEQ ID NO: 368983 - DNA, 25 bp, Mus musculus
ctagagcatatgtctccagtgcgct

SEQ ID NO: 368984 - DNA, 25 bp, Mus musculus
ctagagccagtaaccaggtgtcact

SEQ ID NO: 368985 - DNA, 25 bp, Mus musculus
ctagagccagtatccaggtgtcact

SEQ ID NO: 368986 - DNA, 25 bp, Mus musculus
ctagagccccagatgagtaaggact

SEQ ID NO: 368987 - DNA, 25 bp, Mus musculus
ctagagccccagttgagtaaggact

SEQ ID NO: 368988 - DNA, 25 bp, Mus musculus
ctagagcccctgattgacaaactgg

SEQ ID NO: 368989 - DNA, 25 bp, Mus musculus
ctagagcccctgtttgacaaactgg

SEQ ID NO: 368990 - DNA, 25 bp, Mus musculus
ctagagcctgtgatcgggcagtaga

SEQ ID NO: 368991 - DNA, 25 bp, Mus musculus
ctagagcctgtgttcgggcagtaga

SEQ ID NO: 368992 - DNA, 25 bp, Mus musculus
ctagagcctttacccatagcaaatg

SEQ ID NO: 368993 - DNA, 25 bp, Mus musculus
ctagagcctttagccatagcaaatg

SEQ ID NO: 368994 - DNA, 25 bp, Mus musculus
ctagagcgggttactgactatgcgg

SEQ ID NO: 368995 - DNA, 25 bp, Mus musculus
ctagagcgggtttctgactatgcgg

SEQ ID NO: 368996 - DNA, 25 bp, Mus musculus
ctagagctagaacgcagtatgataa

SEQ ID NO: 368997 - DNA, 25 bp, Mus musculus
ctagagctagaaggcagtatgataa

SEQ ID NO: 368998 - DNA, 25 bp, Mus musculus
ctagagctagcaagttgactttgga

SEQ ID NO: 368999 - DNA, 25 bp, Mus musculus
ctagagctagcatgttgactttgga

SEQ ID NO: 369000 - DNA, 25 bp, Mus musculus
ctagagctcagtcctgtgctgggct

SEQ ID NO: 369001 - DNA, 25 bp, Mus musculus
ctagagctcagtgctgtgctgggct

SEQ ID NO: 369002 - DNA, 25 bp, Mus musculus
ctagagctcctgagtaaggttaggg

SEQ ID NO: 369003 - DNA, 25 bp, Mus musculus
ctagagctcctgtgtaaggttaggg

SEQ ID NO: 369004 - DNA, 25 bp, Mus musculus
ctagagctgcaccagctggcccagt

SEQ ID NO: 369005 - DNA, 25 bp, Mus musculus
ctagagctgcacgagctggcccagt

SEQ ID NO: 369006 - DNA, 25 bp, Mus musculus
ctagagcttagcctcatctgcattt

SEQ ID NO: 369007 - DNA, 25 bp, Mus musculus
ctagagcttagcgtcatctgcattt

SEQ ID NO: 369008 - DNA, 25 bp, Mus musculus
ctagaggaccaccaacttcccaagg

SEQ ID NO: 369009 - DNA, 25 bp, Mus musculus
ctagaggaccacgaacttcccaagg

SEQ ID NO: 369010 - DNA, 25 bp, Mus musculus
ctagaggaggagagttcatctgcaa

SEQ ID NO: 369011 - DNA, 25 bp, Mus musculus
ctagaggaggagtgttcatctgcaa

SEQ ID NO: 369012 - DNA, 25 bp, Mus musculus
ctagaggatcagacgcctaagggcg

SEQ ID NO: 369013 - DNA, 25 bp, Mus musculus
ctagaggatcagtcgcctaagggcg

SEQ ID NO: 369014 - DNA, 25 bp, Mus musculus
ctagaggattggactttggctcttt

SEQ ID NO: 369015 - DNA, 25 bp, Mus musculus
ctagaggattggtctttggctcttt

SEQ ID NO: 369016 - DNA, 25 bp, Mus musculus
ctagaggctcatcaaatggctcagt

SEQ ID NO: 369017 - DNA, 25 bp, Mus musculus
ctagaggctcatgaaatggctcagt

SEQ ID NO: 369018 - DNA, 25 bp, Mus musculus
ctagagggccagcatatggaagaaa

SEQ ID NO: 369019 - DNA, 25 bp, Mus musculus
ctagagggccaggatatggaagaaa

SEQ ID NO: 369020 - DNA, 25 bp, Mus musculus
ctagagggctaacggtgtcgtctca

SEQ ID NO: 369021 - DNA, 25 bp, Mus musculus
ctagagggctaagggtgtcgtctca

SEQ ID NO: 369022 - DNA, 25 bp, Mus musculus
ctagaggtatctctcggtttgcaaa

SEQ ID NO: 369023 - DNA, 25 bp, Mus musculus
ctagaggtatctgtcggtttgcaaa

SEQ ID NO: 369024 - DNA, 25 bp, Mus musculus
ctagaggtggtcattccatcctgga

SEQ ID NO: 369025 - DNA, 25 bp, Mus musculus
ctagaggtggtctttccatcctgga

SEQ ID NO: 369026 - DNA, 25 bp, Mus musculus
ctagagtatatcaaacataggcagt

SEQ ID NO: 369027 - DNA, 25 bp, Mus musculus
ctagagtatatctaacataggcagt

SEQ ID NO: 369028 - DNA, 25 bp, Mus musculus
ctagagtatgcacaccatgccctgg

SEQ ID NO: 369029 - DNA, 25 bp, Mus musculus
ctagagtatgcagaccatgccctgg

SEQ ID NO: 369030 - DNA, 25 bp, Mus musculus
ctagagtatttcagggacagaccca

SEQ ID NO: 369031 - DNA, 25 bp, Mus musculus
ctagagtatttctgggacagaccca

SEQ ID NO: 369032 - DNA, 25 bp, Mus musculus
ctagagtcacgtatgtagtgtggca

SEQ ID NO: 369033 - DNA, 25 bp, Mus musculus
ctagagtcacgtttgtagtgtggca

SEQ ID NO: 369034 - DNA, 25 bp, Mus musculus
ctagagtccactcagtcacaatggg

SEQ ID NO: 369035 - DNA, 25 bp, Mus musculus
ctagagtccactgagtcacaatggg

SEQ ID NO: 369036 - DNA, 25 bp, Mus musculus
ctagagtccatcatctgggccagta

SEQ ID NO: 369037 - DNA, 25 bp, Mus musculus
ctagagtccatcttctgggccagta

SEQ ID NO: 369038 - DNA, 25 bp, Mus musculus
ctagagtcctccagggttaccagta

SEQ ID NO: 369039 - DNA, 25 bp, Mus musculus
ctagagtcctcctgggttaccagta

SEQ ID NO: 369040 - DNA, 25 bp, Mus musculus
ctagagtcctctcgcctggccaaaa

SEQ ID NO: 369041 - DNA, 25 bp, Mus musculus
ctagagtcctctggcctggccaaaa

SEQ ID NO: 369042 - DNA, 25 bp, Mus musculus
ctagagtctccaaggcagctggttt

SEQ ID NO: 369043 - DNA, 25 bp, Mus musculus
ctagagtctccatggcagctggttt

SEQ ID NO: 369044 - DNA, 25 bp, Mus musculus
ctagagtgtgatctctgttctgttg

SEQ ID NO: 369045 - DNA, 25 bp, Mus musculus
ctagagtgtgatgtctgttctgttg

SEQ ID NO: 369046 - DNA, 25 bp, Mus musculus
ctagagttggaaatccccatttctt

SEQ ID NO: 369047 - DNA, 25 bp, Mus musculus
ctagagttggaattccccatttctt

SEQ ID NO: 369048 - DNA, 25 bp, Mus musculus
ctagagttttcactattgggtggtc

SEQ ID NO: 369049 - DNA, 25 bp, Mus musculus
ctagagttttcagtattgggtggtc

SEQ ID NO: 369050 - DNA, 25 bp, Mus musculus
ctagatagcgcacgtctgggagcca

SEQ ID NO: 369051 - DNA, 25 bp, Mus musculus
ctagatagcgcaggtctgggagcca

SEQ ID NO: 369052 - DNA, 25 bp, Mus musculus
ctagataggcaactgccagccaggc

SEQ ID NO: 369053 - DNA, 25 bp, Mus musculus
ctagataggcaagtgccagccaggc

SEQ ID NO: 369054 - DNA, 25 bp, Mus musculus
ctagataggtgaattgtacctcaga

SEQ ID NO: 369055 - DNA, 25 bp, Mus musculus
ctagataggtgatttgtacctcaga

SEQ ID NO: 369056 - DNA, 25 bp, Mus musculus
ctagatagttttcccttcaagtcaa

SEQ ID NO: 369057 - DNA, 25 bp, Mus musculus
ctagatagttttgccttcaagtcaa

SEQ ID NO: 369058 - DNA, 25 bp, Mus musculus
ctagatatcacaccacacgttacag

SEQ ID NO: 369059 - DNA, 25 bp, Mus musculus
ctagatatcacagcacacgttacag

SEQ ID NO: 369060 - DNA, 25 bp, Mus musculus
ctagatcagtgtcttcatgtcctca

SEQ ID NO: 369061 - DNA, 25 bp, Mus musculus
ctagatcagtgtgttcatgtcctca

SEQ ID NO: 369062 - DNA, 25 bp, Mus musculus
ctagatcatggcagtctatgagcat

SEQ ID NO: 369063 - DNA, 25 bp, Mus musculus
ctagatcatggctgtctatgagcat

SEQ ID NO: 369064 - DNA, 25 bp, Mus musculus
ctagatccaaggatcggctggcaga

SEQ ID NO: 369065 - DNA, 25 bp, Mus musculus
ctagatccaaggttcggctggcaga

SEQ ID NO: 369066 - DNA, 25 bp, Mus musculus
ctagatccatttcccaaaattctgt

SEQ ID NO: 369067 - DNA, 25 bp, Mus musculus
ctagatccatttgccaaaattctgt

SEQ ID NO: 369068 - DNA, 25 bp, Mus musculus
ctagatcccggtacttgagtgattt

SEQ ID NO: 369069 - DNA, 25 bp, Mus musculus
ctagatcccggttcttgagtgattt

SEQ ID NO: 369070 - DNA, 25 bp, Mus musculus
ctagatcctatcacatggaaataga

SEQ ID NO: 369071 - DNA, 25 bp, Mus musculus
ctagatcctatctcatggaaataga

SEQ ID NO: 369072 - DNA, 25 bp, Mus musculus
ctagatctaagacccaggagcctgc

SEQ ID NO: 369073 - DNA, 25 bp, Mus musculus
ctagatctaagagccaggagcctgc

SEQ ID NO: 369074 - DNA, 25 bp, Mus musculus
ctagatctatgtatgctgcaccagt

SEQ ID NO: 369075 - DNA, 25 bp, Mus musculus
ctagatctatgtttgctgcaccagt

SEQ ID NO: 369076 - DNA, 25 bp, Mus musculus
ctagatctgaggacggtggcccagc

SEQ ID NO: 369077 - DNA, 25 bp, Mus musculus
ctagatctgaggtcggtggcccagc

SEQ ID NO: 369078 - DNA, 25 bp, Mus musculus
ctagatctggatattcatgcttctt

SEQ ID NO: 369079 - DNA, 25 bp, Mus musculus
ctagatctggattttcatgcttctt

SEQ ID NO: 369080 - DNA, 25 bp, Mus musculus
ctagatgaaagcatgcggctccagt

SEQ ID NO: 369081 - DNA, 25 bp, Mus musculus
ctagatgaaagcttgcggctccagt

SEQ ID NO: 369082 - DNA, 25 bp, Mus musculus
ctagatgaggctacatttaccaatg

SEQ ID NO: 369083 - DNA, 25 bp, Mus musculus
ctagatgaggcttcatttaccaatg

SEQ ID NO: 369084 - DNA, 25 bp, Mus musculus
ctagatgagtaacgtcctcttccct

SEQ ID NO: 369085 - DNA, 25 bp, Mus musculus
ctagatgagtaaggtcctcttccct

SEQ ID NO: 369086 - DNA, 25 bp, Mus musculus
ctagatgcacacaatttgtagttat

SEQ ID NO: 369087 - DNA, 25 bp, Mus musculus
ctagatgcacactatttgtagttat

SEQ ID NO: 369088 - DNA, 25 bp, Mus musculus
ctagatgcccgtcatgcccatcttg

SEQ ID NO: 369089 - DNA, 25 bp, Mus musculus
ctagatgcccgtgatgcccatcttg

SEQ ID NO: 369090 - DNA, 25 bp, Mus musculus
ctagatgccctgctggcccgtgaga

SEQ ID NO: 369091 - DNA, 25 bp, Mus musculus
ctagatgccctggtggcccgtgaga

SEQ ID NO: 369092 - DNA, 25 bp, Mus musculus
ctagatgctggacaactaatagtta

SEQ ID NO: 369093 - DNA, 25 bp, Mus musculus
ctagatgctggagaactaatagtta

SEQ ID NO: 369094 - DNA, 25 bp, Mus musculus
ctagatgctgtacgctttgttgtat

SEQ ID NO: 369095 - DNA, 25 bp, Mus musculus
ctagatgctgtaggctttgttgtat

SEQ ID NO: 369096 - DNA, 25 bp, Mus musculus
ctagatggctatatgctttgttgca

SEQ ID NO: 369097 - DNA, 25 bp, Mus musculus
ctagatggctatttgctttgttgca

SEQ ID NO: 369098 - DNA, 25 bp, Mus musculus
ctagatgggagtcctctactgctca

SEQ ID NO: 369099 - DNA, 25 bp, Mus musculus
ctagatgggagtgctctactgctca

SEQ ID NO: 369100 - DNA, 25 bp, Mus musculus
ctagatgggtggactgctctcggtc

SEQ ID NO: 369101 - DNA, 25 bp, Mus musculus
ctagatgggtggtctgctctcggtc

SEQ ID NO: 369102 - DNA, 25 bp, Mus musculus
ctagatgtagcaaatgtatccggaa

SEQ ID NO: 369103 - DNA, 25 bp, Mus musculus
ctagatgtagcatatgtatccggaa

SEQ ID NO: 369104 - DNA, 25 bp, Mus musculus
ctagattatttcacacttctctcac

SEQ ID NO: 369105 - DNA, 25 bp, Mus musculus
ctagattatttctcacttctctcac

SEQ ID NO: 369106 - DNA, 25 bp, Mus musculus
ctagattcagttatgctccctctgg

SEQ ID NO: 369107 - DNA, 25 bp, Mus musculus
ctagattcagttttgctccctctgg

SEQ ID NO: 369108 - DNA, 25 bp, Mus musculus
ctagattcctccacctggattgaat

SEQ ID NO: 369109 - DNA, 25 bp, Mus musculus
ctagattcctcctcctggattgaat

SEQ ID NO: 369110 - DNA, 25 bp, Mus musculus
ctagattccttcatgagttcatggc

SEQ ID NO: 369111 - DNA, 25 bp, Mus musculus
ctagattccttcttgagttcatggc

SEQ ID NO: 369112 - DNA, 25 bp, Mus musculus
ctagattctaaaagtgagcagcgat

SEQ ID NO: 369113 - DNA, 25 bp, Mus musculus
ctagattctaaatgtgagcagcgat

SEQ ID NO: 369114 - DNA, 25 bp, Mus musculus
ctagattctaggatctacctcccag

SEQ ID NO: 369115 - DNA, 25 bp, Mus musculus
ctagattctaggttctacctcccag

SEQ ID NO: 369116 - DNA, 25 bp, Mus musculus
ctagattctgctaattatgggttat

SEQ ID NO: 369117 - DNA, 25 bp, Mus musculus
ctagattctgcttattatgggttat

SEQ ID NO: 369118 - DNA, 25 bp, Mus musculus
ctagattgacctaagccccagagca

SEQ ID NO: 369119 - DNA, 25 bp, Mus musculus
ctagattgaccttagccccagagca

SEQ ID NO: 369120 - DNA, 25 bp, Mus musculus
ctagattgctgactgctggtgtatc

SEQ ID NO: 369121 - DNA, 25 bp, Mus musculus
ctagattgctgagtgctggtgtatc

SEQ ID NO: 369122 - DNA, 25 bp, Mus musculus
ctagattggaagaacctgggccggt

SEQ ID NO: 369123 - DNA, 25 bp, Mus musculus
ctagattggaagtacctgggccggt

SEQ ID NO: 369124 - DNA, 25 bp, Mus musculus
ctagatttacatccgcaagttataa

SEQ ID NO: 369125 - DNA, 25 bp, Mus musculus
ctagatttacatgcgcaagttataa

SEQ ID NO: 369126 - DNA, 25 bp, Mus musculus
ctagatttagggagcgcctgtcatc

SEQ ID NO: 369127 - DNA, 25 bp, Mus musculus
ctagatttagggtgcgcctgtcatc

SEQ ID NO: 369128 - DNA, 25 bp, Mus musculus
ctagatttcaggaagagtccactcc

SEQ ID NO: 369129 - DNA, 25 bp, Mus musculus
ctagatttcaggtagagtccactcc

SEQ ID NO: 369130 - DNA, 25 bp, Mus musculus
ctagatttgcagaccgaacccacct

SEQ ID NO: 369131 - DNA, 25 bp, Mus musculus
ctagatttgcagtccgaacccacct

SEQ ID NO: 369132 - DNA, 25 bp, Mus musculus
ctagattttgctatctggcagagtg

SEQ ID NO: 369133 - DNA, 25 bp, Mus musculus
ctagattttgctttctggcagagtg

SEQ ID NO: 369134 - DNA, 25 bp, Mus musculus
ctagcaaaacgtatcagccagcata

SEQ ID NO: 369135 - DNA, 25 bp, Mus musculus
ctagcaaaacgtttcagccagcata

SEQ ID NO: 369136 - DNA, 25 bp, Mus musculus
ctagcaaagtcgagactgctgtctg

SEQ ID NO: 369137 - DNA, 25 bp, Mus musculus
ctagcaaagtcgtgactgctgtctg

SEQ ID NO: 369138 - DNA, 25 bp, Mus musculus
ctagcaaatgacaacttcggcctgt

SEQ ID NO: 369139 - DNA, 25 bp, Mus musculus
ctagcaaatgactacttcggcctgt

SEQ ID NO: 369140 - DNA, 25 bp, Mus musculus
ctagcaacatgtactgtctgggctt

SEQ ID NO: 369141 - DNA, 25 bp, Mus musculus
ctagcaacatgttctgtctgggctt

SEQ ID NO: 369142 - DNA, 25 bp, Mus musculus
ctagcaacccagcttcaatctctga

SEQ ID NO: 369143 - DNA, 25 bp, Mus musculus
ctagcaacccaggttcaatctctga

SEQ ID NO: 369144 - DNA, 25 bp, Mus musculus
ctagcaaccccgaggccaactggat

SEQ ID NO: 369145 - DNA, 25 bp, Mus musculus
ctagcaaccccgtggccaactggat

SEQ ID NO: 369146 - DNA, 25 bp, Mus musculus
ctagcaagactgatgtggatgatga

SEQ ID NO: 369147 - DNA, 25 bp, Mus musculus
ctagcaagactgttgtggatgatga

SEQ ID NO: 369148 - DNA, 25 bp, Mus musculus
ctagcaagcgcaaggccctgggttc

SEQ ID NO: 369149 - DNA, 25 bp, Mus musculus
ctagcaagcgcatggccctgggttc

SEQ ID NO: 369150 - DNA, 25 bp, Mus musculus
ctagcaagcttacagagaaaatctg

SEQ ID NO: 369151 - DNA, 25 bp, Mus musculus
ctagcaagcttagagagaaaatctg

SEQ ID NO: 369152 - DNA, 25 bp, Mus musculus
ctagcaagtgcaaagccctgaattt

SEQ ID NO: 369153 - DNA, 25 bp, Mus musculus
ctagcaagtgcatagccctgaattt

SEQ ID NO: 369154 - DNA, 25 bp, Mus musculus
ctagcaagttgtactttgaggcttt

SEQ ID NO: 369155 - DNA, 25 bp, Mus musculus
ctagcaagttgttctttgaggcttt

SEQ ID NO: 369156 - DNA, 25 bp, Mus musculus
ctagcaatctatctctttaaaactg

SEQ ID NO: 369157 - DNA, 25 bp, Mus musculus
ctagcaatctatgtctttaaaactg

SEQ ID NO: 369158 - DNA, 25 bp, Mus musculus
ctagcaatttatcgtcaggcagaac

SEQ ID NO: 369159 - DNA, 25 bp, Mus musculus
ctagcaatttatggtcaggcagaac

SEQ ID NO: 369160 - DNA, 25 bp, Mus musculus
ctagcacaccacagaggcaggagag

SEQ ID NO: 369161 - DNA, 25 bp, Mus musculus
ctagcacaccactgaggcaggagag

SEQ ID NO: 369162 - DNA, 25 bp, Mus musculus
ctagcacactatcccttggtgacag

SEQ ID NO: 369163 - DNA, 25 bp, Mus musculus
ctagcacactatgccttggtgacag

SEQ ID NO: 369164 - DNA, 25 bp, Mus musculus
ctagcacaggcccattggagaggaa

SEQ ID NO: 369165 - DNA, 25 bp, Mus musculus
ctagcacaggccgattggagaggaa

SEQ ID NO: 369166 - DNA, 25 bp, Mus musculus
ctagcacagttaagtaggcgtcatt

SEQ ID NO: 369167 - DNA, 25 bp, Mus musculus
ctagcacagttatgtaggcgtcatt

SEQ ID NO: 369168 - DNA, 25 bp, Mus musculus
ctagcacataggaggcactgggtct

SEQ ID NO: 369169 - DNA, 25 bp, Mus musculus
ctagcacataggtggcactgggtct

SEQ ID NO: 369170 - DNA, 25 bp, Mus musculus
ctagcacatattcctgggcctgaaa

SEQ ID NO: 369171 - DNA, 25 bp, Mus musculus
ctagcacatattgctgggcctgaaa

SEQ ID NO: 369172 - DNA, 25 bp, Mus musculus
ctagcacatgttactaatcccagca

SEQ ID NO: 369173 - DNA, 25 bp, Mus musculus
ctagcacatgtttctaatcccagca

SEQ ID NO: 369174 - DNA, 25 bp, Mus musculus
ctagcactcactcgcatctggatat

SEQ ID NO: 369175 - DNA, 25 bp, Mus musculus
ctagcactcactggcatctggatat

SEQ ID NO: 369176 - DNA, 25 bp, Mus musculus
ctagcactgccaaggcggatagaga

SEQ ID NO: 369177 - DNA, 25 bp, Mus musculus
ctagcactgccatggcggatagaga

SEQ ID NO: 369178 - DNA, 25 bp, Mus musculus
ctagcagactgaccctgttcccagg

SEQ ID NO: 369179 - DNA, 25 bp, Mus musculus
ctagcagactgagcctgttcccagg

SEQ ID NO: 369180 - DNA, 25 bp, Mus musculus
ctagcagagagacactgaacactct

SEQ ID NO: 369181 - DNA, 25 bp, Mus musculus
ctagcagagagagactgaacactct

SEQ ID NO: 369182 - DNA, 25 bp, Mus musculus
ctagcagagctgctggcactttagg

SEQ ID NO: 369183 - DNA, 25 bp, Mus musculus
ctagcagagctggtggcactttagg

SEQ ID NO: 369184 - DNA, 25 bp, Mus musculus
ctagcagcccttacgagtgttggtg

SEQ ID NO: 369185 - DNA, 25 bp, Mus musculus
ctagcagccctttcgagtgttggtg

SEQ ID NO: 369186 - DNA, 25 bp, Mus musculus
ctagcaggcgtcaggatccgcagag

SEQ ID NO: 369187 - DNA, 25 bp, Mus musculus
ctagcaggcgtctggatccgcagag

SEQ ID NO: 369188 - DNA, 25 bp, Mus musculus
ctagcaggctagcaggctggcacta

SEQ ID NO: 369189 - DNA, 25 bp, Mus musculus
ctagcaggctaggaggctggcacta

SEQ ID NO: 369190 - DNA, 25 bp, Mus musculus
ctagcaggtcgtccctcctggagtc

SEQ ID NO: 369191 - DNA, 25 bp, Mus musculus
ctagcaggtcgtgcctcctggagtc

SEQ ID NO: 369192 - DNA, 25 bp, Mus musculus
ctagcagtatgcagggtctttacat

SEQ ID NO: 369193 - DNA, 25 bp, Mus musculus
ctagcagtatgctgggtctttacat

SEQ ID NO: 369194 - DNA, 25 bp, Mus musculus
ctagcagtcctactatgtgtcagcc

SEQ ID NO: 369195 - DNA, 25 bp, Mus musculus
ctagcagtcctagtatgtgtcagcc

SEQ ID NO: 369196 - DNA, 25 bp, Mus musculus
ctagcagttaacctgttgggaacac

SEQ ID NO: 369197 - DNA, 25 bp, Mus musculus
ctagcagttaacgtgttgggaacac

SEQ ID NO: 369198 - DNA, 25 bp, Mus musculus
ctagcagtttagatgaggacccgtt

SEQ ID NO: 369199 - DNA, 25 bp, Mus musculus
ctagcagtttagttgaggacccgtt

SEQ ID NO: 369200 - DNA, 25 bp, Mus musculus
ctagcatcaggacagccatcacagt

SEQ ID NO: 369201 - DNA, 25 bp, Mus musculus
ctagcatcaggagagccatcacagt

SEQ ID NO: 369202 - DNA, 25 bp, Mus musculus
ctagcatcaggtacagtttctacaa

SEQ ID NO: 369203 - DNA, 25 bp, Mus musculus
ctagcatcaggttcagtttctacaa

SEQ ID NO: 369204 - DNA, 25 bp, Mus musculus
ctagcatccacaactgatggctcat

SEQ ID NO: 369205 - DNA, 25 bp, Mus musculus
ctagcatccacatctgatggctcat

SEQ ID NO: 369206 - DNA, 25 bp, Mus musculus
ctagcatgcagtcattttaggcatt

SEQ ID NO: 369207 - DNA, 25 bp, Mus musculus
ctagcatgcagtgattttaggcatt

SEQ ID NO: 369208 - DNA, 25 bp, Mus musculus
ctagcatgcatgcaaccctgggttg

SEQ ID NO: 369209 - DNA, 25 bp, Mus musculus
ctagcatgcatggaaccctgggttg

SEQ ID NO: 369210 - DNA, 25 bp, Mus musculus
ctagcatggcctacatagactttaa

SEQ ID NO: 369211 - DNA, 25 bp, Mus musculus
ctagcatggccttcatagactttaa

SEQ ID NO: 369212 - DNA, 25 bp, Mus musculus
ctagcatgggcaccaaagcttcctt

SEQ ID NO: 369213 - DNA, 25 bp, Mus musculus
ctagcatgggcagcaaagcttcctt

SEQ ID NO: 369214 - DNA, 25 bp, Mus musculus
ctagcatgtataaggcctgcatggt

SEQ ID NO: 369215 - DNA, 25 bp, Mus musculus
ctagcatgtatatggcctgcatggt

SEQ ID NO: 369216 - DNA, 25 bp, Mus musculus
ctagcatgtatgagagggcctctcc

SEQ ID NO: 369217 - DNA, 25 bp, Mus musculus
ctagcatgtatgtgagggcctctcc

SEQ ID NO: 369218 - DNA, 25 bp, Mus musculus
ctagcattcctcaatgctgggacat

SEQ ID NO: 369219 - DNA, 25 bp, Mus musculus
ctagcattcctctatgctgggacat

SEQ ID NO: 369220 - DNA, 25 bp, Mus musculus
ctagcattttctatgtgagttacca

SEQ ID NO: 369221 - DNA, 25 bp, Mus musculus
ctagcattttctttgtgagttacca

SEQ ID NO: 369222 - DNA, 25 bp, Mus musculus
ctagccaattgcctttcagagtcga

SEQ ID NO: 369223 - DNA, 25 bp, Mus musculus
ctagccaattgcgtttcagagtcga

SEQ ID NO: 369224 - DNA, 25 bp, Mus musculus
ctagccacacaaccctttaaagaat

SEQ ID NO: 369225 - DNA, 25 bp, Mus musculus
ctagccacacaagcctttaaagaat

SEQ ID NO: 369226 - DNA, 25 bp, Mus musculus
ctagccacagtcaccagttttctct

SEQ ID NO: 369227 - DNA, 25 bp, Mus musculus
ctagccacagtctccagttttctct

SEQ ID NO: 369228 - DNA, 25 bp, Mus musculus
ctagccactcaccaacatttttaaa

SEQ ID NO: 369229 - DNA, 25 bp, Mus musculus
ctagccactcacgaacatttttaaa

SEQ ID NO: 369230 - DNA, 25 bp, Mus musculus
ctagccactgcaacacttgctgaat

SEQ ID NO: 369231 - DNA, 25 bp, Mus musculus
ctagccactgcatcacttgctgaat

SEQ ID NO: 369232 - DNA, 25 bp, Mus musculus
ctagccacttaaatctctgaccggg

SEQ ID NO: 369233 - DNA, 25 bp, Mus musculus
ctagccacttaattctctgaccggg

SEQ ID NO: 369234 - DNA, 25 bp, Mus musculus
ctagccagaggtcccatgtccttgg

SEQ ID NO: 369235 - DNA, 25 bp, Mus musculus
ctagccagaggtgccatgtccttgg

SEQ ID NO: 369236 - DNA, 25 bp, Mus musculus
ctagccagcaacatgcagcagggat

SEQ ID NO: 369237 - DNA, 25 bp, Mus musculus
ctagccagcaacttgcagcagggat

SEQ ID NO: 369238 - DNA, 25 bp, Mus musculus
ctagccagggctatcaggaccaaat

SEQ ID NO: 369239 - DNA, 25 bp, Mus musculus
ctagccagggctttcaggaccaaat

SEQ ID NO: 369240 - DNA, 25 bp, Mus musculus
ctagccagtacactggctctgtgta

SEQ ID NO: 369241 - DNA, 25 bp, Mus musculus
ctagccagtacagtggctctgtgta

SEQ ID NO: 369242 - DNA, 25 bp, Mus musculus
ctagccatgcataccaaagcagcgt

SEQ ID NO: 369243 - DNA, 25 bp, Mus musculus
ctagccatgcattccaaagcagcgt

SEQ ID NO: 369244 - DNA, 25 bp, Mus musculus
ctagccatgctcacttccaagtatc

SEQ ID NO: 369245 - DNA, 25 bp, Mus musculus
ctagccatgctctcttccaagtatc

SEQ ID NO: 369246 - DNA, 25 bp, Mus musculus
ctagccattcagacgtgcatgcaat

SEQ ID NO: 369247 - DNA, 25 bp, Mus musculus
ctagccattcagtcgtgcatgcaat

SEQ ID NO: 369248 - DNA, 25 bp, Mus musculus
ctagccattgccagagctgttcata

SEQ ID NO: 369249 - DNA, 25 bp, Mus musculus
ctagccattgcctgagctgttcata

SEQ ID NO: 369250 - DNA, 25 bp, Mus musculus
ctagccattgtgcaggcactcgtgg

SEQ ID NO: 369251 - DNA, 25 bp, Mus musculus
ctagccattgtggaggcactcgtgg

SEQ ID NO: 369252 - DNA, 25 bp, Mus musculus
ctagcccaatctaaatgtcatcctt

SEQ ID NO: 369253 - DNA, 25 bp, Mus musculus
ctagcccaatcttaatgtcatcctt

SEQ ID NO: 369254 - DNA, 25 bp, Mus musculus
ctagcccacccaaggatgcatagtg

SEQ ID NO: 369255 - DNA, 25 bp, Mus musculus
ctagcccacccatggatgcatagtg

SEQ ID NO: 369256 - DNA, 25 bp, Mus musculus
ctagcccacttcaggatggccagtg

SEQ ID NO: 369257 - DNA, 25 bp, Mus musculus
ctagcccacttctggatggccagtg

SEQ ID NO: 369258 - DNA, 25 bp, Mus musculus
ctagcccattggagattgattgaaa

SEQ ID NO: 369259 - DNA, 25 bp, Mus musculus
ctagcccattggtgattgattgaaa

SEQ ID NO: 369260 - DNA, 25 bp, Mus musculus
ctagccccaaacacatgcaagtgtt

SEQ ID NO: 369261 - DNA, 25 bp, Mus musculus
ctagccccaaactcatgcaagtgtt

SEQ ID NO: 369262 - DNA, 25 bp, Mus musculus
ctagccccatagcattggctcttct

SEQ ID NO: 369263 - DNA, 25 bp, Mus musculus
ctagccccataggattggctcttct

SEQ ID NO: 369264 - DNA, 25 bp, Mus musculus
ctagccccggctaaacaacatggag

SEQ ID NO: 369265 - DNA, 25 bp, Mus musculus
ctagccccggcttaacaacatggag

SEQ ID NO: 369266 - DNA, 25 bp, Mus musculus
ctagcccctgagcacaggacatgga

SEQ ID NO: 369267 - DNA, 25 bp, Mus musculus
ctagcccctgaggacaggacatgga

SEQ ID NO: 369268 - DNA, 25 bp, Mus musculus
ctagcccgatatactgccctattgg

SEQ ID NO: 369269 - DNA, 25 bp, Mus musculus
ctagcccgatattctgccctattgg

SEQ ID NO: 369270 - DNA, 25 bp, Mus musculus
ctagccctaaggagctcagcatttt

SEQ ID NO: 369271 - DNA, 25 bp, Mus musculus
ctagccctaaggtgctcagcatttt

SEQ ID NO: 369272 - DNA, 25 bp, Mus musculus
ctagccctgggcatattcatttgtt

SEQ ID NO: 369273 - DNA, 25 bp, Mus musculus
ctagccctgggcttattcatttgtt

SEQ ID NO: 369274 - DNA, 25 bp, Mus musculus
ctagcccttcctatagaaacctatg

SEQ ID NO: 369275 - DNA, 25 bp, Mus musculus
ctagcccttcctttagaaacctatg

SEQ ID NO: 369276 - DNA, 25 bp, Mus musculus
ctagccgccactatggtattttgtt

SEQ ID NO: 369277 - DNA, 25 bp, Mus musculus
ctagccgccactttggtattttgtt

SEQ ID NO: 369278 - DNA, 25 bp, Mus musculus
ctagccggaggacaagagcgaaaca

SEQ ID NO: 369279 - DNA, 25 bp, Mus musculus
ctagccggaggagaagagcgaaaca

SEQ ID NO: 369280 - DNA, 25 bp, Mus musculus
ctagccgtgctgagtgctgaactga

SEQ ID NO: 369281 - DNA, 25 bp, Mus musculus
ctagccgtgctgtgtgctgaactga

SEQ ID NO: 369282 - DNA, 25 bp, Mus musculus
ctagccgtttctcatcttgacaact

SEQ ID NO: 369283 - DNA, 25 bp, Mus musculus
ctagccgtttctgatcttgacaact

SEQ ID NO: 369284 - DNA, 25 bp, Mus musculus
ctagcctacaacaccagtcaaggat

SEQ ID NO: 369285 - DNA, 25 bp, Mus musculus
ctagcctacaactccagtcaaggat

SEQ ID NO: 369286 - DNA, 25 bp, Mus musculus
ctagcctactctacattgcaaatgt

SEQ ID NO: 369287 - DNA, 25 bp, Mus musculus
ctagcctactcttcattgcaaatgt

SEQ ID NO: 369288 - DNA, 25 bp, Mus musculus
ctagcctatcgtaaagtcaatccct

SEQ ID NO: 369289 - DNA, 25 bp, Mus musculus
ctagcctatcgttaagtcaatccct

SEQ ID NO: 369290 - DNA, 25 bp, Mus musculus
ctagcctatctcacctaaagactaa

SEQ ID NO: 369291 - DNA, 25 bp, Mus musculus
ctagcctatctctcctaaagactaa

SEQ ID NO: 369292 - DNA, 25 bp, Mus musculus
ctagcctcaaaaatgcaattctcag

SEQ ID NO: 369293 - DNA, 25 bp, Mus musculus
ctagcctcaaaattgcaattctcag

SEQ ID NO: 369294 - DNA, 25 bp, Mus musculus
ctagcctcatggattagccttggat

SEQ ID NO: 369295 - DNA, 25 bp, Mus musculus
ctagcctcatggtttagccttggat

SEQ ID NO: 369296 - DNA, 25 bp, Mus musculus
ctagcctccgggagcaccaggcatg

SEQ ID NO: 369297 - DNA, 25 bp, Mus musculus
ctagcctccgggtgcaccaggcatg

SEQ ID NO: 369298 - DNA, 25 bp, Mus musculus
ctagcctcctaactgagagtagaca

SEQ ID NO: 369299 - DNA, 25 bp, Mus musculus
ctagcctcctaagtgagagtagaca

SEQ ID NO: 369300 - DNA, 25 bp, Mus musculus
ctagcctcctgcaataggaaatgtc

SEQ ID NO: 369301 - DNA, 25 bp, Mus musculus
ctagcctcctgctataggaaatgtc

SEQ ID NO: 369302 - DNA, 25 bp, Mus musculus
ctagcctctcttcttcaatggttgg

SEQ ID NO: 369303 - DNA, 25 bp, Mus musculus
ctagcctctcttgttcaatggttgg

SEQ ID NO: 369304 - DNA, 25 bp, Mus musculus
ctagcctgaggtactcatcagctga

SEQ ID NO: 369305 - DNA, 25 bp, Mus musculus
ctagcctgaggttctcatcagctga

SEQ ID NO: 369306 - DNA, 25 bp, Mus musculus
ctagcctgcaataaacgggttattt

SEQ ID NO: 369307 - DNA, 25 bp, Mus musculus
ctagcctgcaattaacgggttattt

SEQ ID NO: 369308 - DNA, 25 bp, Mus musculus
ctagcctgcggcacaaagccaagca

SEQ ID NO: 369309 - DNA, 25 bp, Mus musculus
ctagcctgcggctcaaagccaagca

SEQ ID NO: 369310 - DNA, 25 bp, Mus musculus
ctagcctggtgtaacgttttgtcaa

SEQ ID NO: 369311 - DNA, 25 bp, Mus musculus
ctagcctggtgttacgttttgtcaa

SEQ ID NO: 369312 - DNA, 25 bp, Mus musculus
ctagcctggtttacccttagacaat

SEQ ID NO: 369313 - DNA, 25 bp, Mus musculus
ctagcctggtttcatgaaagcgcat

SEQ ID NO: 369314 - DNA, 25 bp, Mus musculus
ctagcctggtttgatgaaagcgcat

SEQ ID NO: 369315 - DNA, 25 bp, Mus musculus
ctagcctggttttcccttagacaat

SEQ ID NO: 369316 - DNA, 25 bp, Mus musculus
ctagccttagctaacatgagatcgt

SEQ ID NO: 369317 - DNA, 25 bp, Mus musculus
ctagccttagcttacatgagatcgt

SEQ ID NO: 369318 - DNA, 25 bp, Mus musculus
ctagccttatagacttgatgtgcca

SEQ ID NO: 369319 - DNA, 25 bp, Mus musculus
ctagccttatagtcttgatgtgcca

SEQ ID NO: 369320 - DNA, 25 bp, Mus musculus
ctagccttctccctggcagtgtgag

SEQ ID NO: 369321 - DNA, 25 bp, Mus musculus
ctagccttctccgtggcagtgtgag

SEQ ID NO: 369322 - DNA, 25 bp, Mus musculus
ctagccttggagcttgactgtgcaa

SEQ ID NO: 369323 - DNA, 25 bp, Mus musculus
ctagccttggaggttgactgtgcaa

SEQ ID NO: 369324 - DNA, 25 bp, Mus musculus
ctagccttggtgacttgagccaatt

SEQ ID NO: 369325 - DNA, 25 bp, Mus musculus
ctagccttggtgtcttgagccaatt

SEQ ID NO: 369326 - DNA, 25 bp, Mus musculus
ctagccttgtcaacctgatggtgta

SEQ ID NO: 369327 - DNA, 25 bp, Mus musculus
ctagccttgtcatcctgatggtgta

SEQ ID NO: 369328 - DNA, 25 bp, Mus musculus
ctagccttgtctcttacataagtaa

SEQ ID NO: 369329 - DNA, 25 bp, Mus musculus
ctagccttgtctctttatggtgcaa

SEQ ID NO: 369330 - DNA, 25 bp, Mus musculus
ctagccttgtctgttacataagtaa

SEQ ID NO: 369331 - DNA, 25 bp, Mus musculus
ctagccttgtctgtttatggtgcaa

SEQ ID NO: 369332 - DNA, 25 bp, Mus musculus
ctagccttgttacctgggttgatct

SEQ ID NO: 369333 - DNA, 25 bp, Mus musculus
ctagccttgttagctgggttgatct

SEQ ID NO: 369334 - DNA, 25 bp, Mus musculus
ctagcgactctgaggttgtgcacgc

SEQ ID NO: 369335 - DNA, 25 bp, Mus musculus
ctagcgactctgtggttgtgcacgc

SEQ ID NO: 369336 - DNA, 25 bp, Mus musculus
ctagcgatgggacgagacgttccac

SEQ ID NO: 369337 - DNA, 25 bp, Mus musculus
ctagcgatgggaggagacgttccac

SEQ ID NO: 369338 - DNA, 25 bp, Mus musculus
ctagcgccaaagacatcaagaaaat

SEQ ID NO: 369339 - DNA, 25 bp, Mus musculus
ctagcgccaaagtcatcaagaaaat

SEQ ID NO: 369340 - DNA, 25 bp, Mus musculus
ctagcgccaccaatctcataatagg

SEQ ID NO: 369341 - DNA, 25 bp, Mus musculus
ctagcgccaccattctcataatagg

SEQ ID NO: 369342 - DNA, 25 bp, Mus musculus
ctagcgcctacaccaagagtggaag

SEQ ID NO: 369343 - DNA, 25 bp, Mus musculus
ctagcgcctacagcaagagtggaag

SEQ ID NO: 369344 - DNA, 25 bp, Mus musculus
ctagcgctcacacgatgacttgcaa

SEQ ID NO: 369345 - DNA, 25 bp, Mus musculus
ctagcgctcacaggatgacttgcaa

SEQ ID NO: 369346 - DNA, 25 bp, Mus musculus
ctagcgctgctcagaaggcagctgc

SEQ ID NO: 369347 - DNA, 25 bp, Mus musculus
ctagcgctgctctgaaggcagctgc

SEQ ID NO: 369348 - DNA, 25 bp, Mus musculus
ctagcggaatccaaccagacttact

SEQ ID NO: 369349 - DNA, 25 bp, Mus musculus
ctagcggaatcctaccagacttact

SEQ ID NO: 369350 - DNA, 25 bp, Mus musculus
ctagcggatctgagccaggcagcaa

SEQ ID NO: 369351 - DNA, 25 bp, Mus musculus
ctagcggatctgtgccaggcagcaa

SEQ ID NO: 369352 - DNA, 25 bp, Mus musculus
ctagcgggccataccttagcaaaat

SEQ ID NO: 369353 - DNA, 25 bp, Mus musculus
ctagcgggccattccttagcaaaat

SEQ ID NO: 369354 - DNA, 25 bp, Mus musculus
ctagcgtctggccttttgaaccaac

SEQ ID NO: 369355 - DNA, 25 bp, Mus musculus
ctagcgtctggcgttttgaaccaac

SEQ ID NO: 369356 - DNA, 25 bp, Mus musculus
ctagcgtgcagtaaaggaagacctt

SEQ ID NO: 369357 - DNA, 25 bp, Mus musculus
ctagcgtgcagttaaggaagacctt

SEQ ID NO: 369358 - DNA, 25 bp, Mus musculus
ctagcgtgtctaccatgtggcttta

SEQ ID NO: 369359 - DNA, 25 bp, Mus musculus
ctagcgtgtctagcatgtggcttta

SEQ ID NO: 369360 - DNA, 25 bp, Mus musculus
ctagcgtgtgctcaagatactttta

SEQ ID NO: 369361 - DNA, 25 bp, Mus musculus
ctagcgtgtgctgaagatactttta

SEQ ID NO: 369362 - DNA, 25 bp, Mus musculus
ctagcgtgtggtctgcaggattcca

SEQ ID NO: 369363 - DNA, 25 bp, Mus musculus
ctagcgtgtggtgtgcaggattcca

SEQ ID NO: 369364 - DNA, 25 bp, Mus musculus
ctagctaagcggatgctgtgtcact

SEQ ID NO: 369365 - DNA, 25 bp, Mus musculus
ctagctaagcggttgctgtgtcact

SEQ ID NO: 369366 - DNA, 25 bp, Mus musculus
ctagctaagctcagggacgctggag

SEQ ID NO: 369367 - DNA, 25 bp, Mus musculus
ctagctaagctctgggacgctggag

SEQ ID NO: 369368 - DNA, 25 bp, Mus musculus
ctagctaataatccaatcagcacat

SEQ ID NO: 369369 - DNA, 25 bp, Mus musculus
ctagctaataatgcaatcagcacat

SEQ ID NO: 369370 - DNA, 25 bp, Mus musculus
ctagctacagagcacggcagtacct

SEQ ID NO: 369371 - DNA, 25 bp, Mus musculus
ctagctacagaggacggcagtacct

SEQ ID NO: 369372 - DNA, 25 bp, Mus musculus
ctagctacagctaatctttaccatc

SEQ ID NO: 369373 - DNA, 25 bp, Mus musculus
ctagctacagcttatctttaccatc

SEQ ID NO: 369374 - DNA, 25 bp, Mus musculus
ctagctacctacatttgagtttcct

SEQ ID NO: 369375 - DNA, 25 bp, Mus musculus
ctagctacctacttttgagtttcct

SEQ ID NO: 369376 - DNA, 25 bp, Mus musculus
ctagctactagtactgggagccagt

SEQ ID NO: 369377 - DNA, 25 bp, Mus musculus
ctagctactagttctgggagccagt

SEQ ID NO: 369378 - DNA, 25 bp, Mus musculus
ctagctagactacttggatctgtga

SEQ ID NO: 369379 - DNA, 25 bp, Mus musculus
ctagctagactagttggatctgtga

SEQ ID NO: 369380 - DNA, 25 bp, Mus musculus
ctagctagtgctcggctgctctaat

SEQ ID NO: 369381 - DNA, 25 bp, Mus musculus
ctagctagtgctgggctgctctaat

SEQ ID NO: 369382 - DNA, 25 bp, Mus musculus
ctagctagtttgagcttggaggctt

SEQ ID NO: 369383 - DNA, 25 bp, Mus musculus
ctagctagtttgtgcttggaggctt

SEQ ID NO: 369384 - DNA, 25 bp, Mus musculus
ctagctatcttcatttgggaggatt

SEQ ID NO: 369385 - DNA, 25 bp, Mus musculus
ctagctatcttcttttgggaggatt

SEQ ID NO: 369386 - DNA, 25 bp, Mus musculus
ctagctcaactaaatatccatggaa

SEQ ID NO: 369387 - DNA, 25 bp, Mus musculus
ctagctcaactatatatccatggaa

SEQ ID NO: 369388 - DNA, 25 bp, Mus musculus
ctagctcacctgaacagattcggga

SEQ ID NO: 369389 - DNA, 25 bp, Mus musculus
ctagctcacctgtacagattcggga

SEQ ID NO: 369390 - DNA, 25 bp, Mus musculus
ctagctcagccaatctggtaatctg

SEQ ID NO: 369391 - DNA, 25 bp, Mus musculus
ctagctcagccattctggtaatctg

SEQ ID NO: 369392 - DNA, 25 bp, Mus musculus
ctagctcagttcactggacatgaaa

SEQ ID NO: 369393 - DNA, 25 bp, Mus musculus
ctagctcagttctctggacatgaaa

SEQ ID NO: 369394 - DNA, 25 bp, Mus musculus
ctagctccaaggaactgcagcaaat

SEQ ID NO: 369395 - DNA, 25 bp, Mus musculus
ctagctccaaggtactgcagcaaat

SEQ ID NO: 369396 - DNA, 25 bp, Mus musculus
ctagctccacagaattgctctcaga

SEQ ID NO: 369397 - DNA, 25 bp, Mus musculus
ctagctccacagtattgctctcaga

SEQ ID NO: 369398 - DNA, 25 bp, Mus musculus
ctagctcccttgaaaactttagagt

SEQ ID NO: 369399 - DNA, 25 bp, Mus musculus
ctagctcccttgtaaactttagagt

SEQ ID NO: 369400 - DNA, 25 bp, Mus musculus
ctagctccgattctgctcctgagag

SEQ ID NO: 369401 - DNA, 25 bp, Mus musculus
ctagctccgattgtgctcctgagag

SEQ ID NO: 369402 - DNA, 25 bp, Mus musculus
ctagctcctcacacatcgaatagag

SEQ ID NO: 369403 - DNA, 25 bp, Mus musculus
ctagctcctcactcatcgaatagag

SEQ ID NO: 369404 - DNA, 25 bp, Mus musculus
ctagctccttccctgatcctagtaa

SEQ ID NO: 369405 - DNA, 25 bp, Mus musculus
ctagctccttccgtgatcctagtaa

SEQ ID NO: 369406 - DNA, 25 bp, Mus musculus
ctagctccttgtatggtaaatgcct

SEQ ID NO: 369407 - DNA, 25 bp, Mus musculus
ctagctccttgtttggtaaatgcct

SEQ ID NO: 369408 - DNA, 25 bp, Mus musculus
ctagctctagcacgacttcagggtt

SEQ ID NO: 369409 - DNA, 25 bp, Mus musculus
ctagctctagcaggacttcagggtt

SEQ ID NO: 369410 - DNA, 25 bp, Mus musculus
ctagctctgcttctcaaatctgaag

SEQ ID NO: 369411 - DNA, 25 bp, Mus musculus
ctagctctgcttgtcaaatctgaag

SEQ ID NO: 369412 - DNA, 25 bp, Mus musculus
ctagctgaagtaaaatgcttgaagc

SEQ ID NO: 369413 - DNA, 25 bp, Mus musculus
ctagctgaagtataatgcttgaagc

SEQ ID NO: 369414 - DNA, 25 bp, Mus musculus
ctagctgaatagctgttgtttttaa

SEQ ID NO: 369415 - DNA, 25 bp, Mus musculus
ctagctgaataggtgttgtttttaa

SEQ ID NO: 369416 - DNA, 25 bp, Mus musculus
ctagctgacatgaggtttgaggaga

SEQ ID NO: 369417 - DNA, 25 bp, Mus musculus
ctagctgacatgtggtttgaggaga

SEQ ID NO: 369418 - DNA, 25 bp, Mus musculus
ctagctgaccagagtttacaatgat

SEQ ID NO: 369419 - DNA, 25 bp, Mus musculus
ctagctgaccagtgtttacaatgat

SEQ ID NO: 369420 - DNA, 25 bp, Mus musculus
ctagctgactggcttatcctaaact

SEQ ID NO: 369421 - DNA, 25 bp, Mus musculus
ctagctgactgggttatcctaaact

SEQ ID NO: 369422 - DNA, 25 bp, Mus musculus
ctagctgagagcaagaacgaggaga

SEQ ID NO: 369423 - DNA, 25 bp, Mus musculus
ctagctgagagctagaacgaggaga

SEQ ID NO: 369424 - DNA, 25 bp, Mus musculus
ctagctgagcccagattgcccatct

SEQ ID NO: 369425 - DNA, 25 bp, Mus musculus
ctagctgagccctgattgcccatct

SEQ ID NO: 369426 - DNA, 25 bp, Mus musculus
ctagctgaggctcacgctcttgagg

SEQ ID NO: 369427 - DNA, 25 bp, Mus musculus
ctagctgaggctgacgctcttgagg

SEQ ID NO: 369428 - DNA, 25 bp, Mus musculus
ctagctgagtcacagcctggattgg

SEQ ID NO: 369429 - DNA, 25 bp, Mus musculus
ctagctgagtcagagcctggattgg

SEQ ID NO: 369430 - DNA, 25 bp, Mus musculus
ctagctgcagtgctgagtggaacct

SEQ ID NO: 369431 - DNA, 25 bp, Mus musculus
ctagctgcagtggtgagtggaacct

SEQ ID NO: 369432 - DNA, 25 bp, Mus musculus
ctagctgcatgtatcgtgttggtga

SEQ ID NO: 369433 - DNA, 25 bp, Mus musculus
ctagctgcatgtttcgtgttggtga

SEQ ID NO: 369434 - DNA, 25 bp, Mus musculus
ctagctgccgtcatgtagatatgga

SEQ ID NO: 369435 - DNA, 25 bp, Mus musculus
ctagctgccgtcttgtagatatgga

SEQ ID NO: 369436 - DNA, 25 bp, Mus musculus
ctagctgctagcaggcatctgcttg

SEQ ID NO: 369437 - DNA, 25 bp, Mus musculus
ctagctgctagctggcatctgcttg

SEQ ID NO: 369438 - DNA, 25 bp, Mus musculus
ctagctgctataaaggagttgctct

SEQ ID NO: 369439 - DNA, 25 bp, Mus musculus
ctagctgctatataggagttgctct

SEQ ID NO: 369440 - DNA, 25 bp, Mus musculus
ctagctgcttttcgttttgcttttt

SEQ ID NO: 369441 - DNA, 25 bp, Mus musculus
ctagctgcttttggttttgcttttt

SEQ ID NO: 369442 - DNA, 25 bp, Mus musculus
ctagctgtaggtcatcctgatgtgt

SEQ ID NO: 369443 - DNA, 25 bp, Mus musculus
ctagctgtaggtgatcctgatgtgt

SEQ ID NO: 369444 - DNA, 25 bp, Mus musculus
ctagctgtatttctggtctctgtat

SEQ ID NO: 369445 - DNA, 25 bp, Mus musculus
ctagctgtatttgtggtctctgtat

SEQ ID NO: 369446 - DNA, 25 bp, Mus musculus
ctagctgtgcttcgccacctcggga

SEQ ID NO: 369447 - DNA, 25 bp, Mus musculus
ctagctgtgcttggccacctcggga

SEQ ID NO: 369448 - DNA, 25 bp, Mus musculus
ctagctgttgccagagtcctcatgt

SEQ ID NO: 369449 - DNA, 25 bp, Mus musculus
ctagctgttgcctgagtcctcatgt

SEQ ID NO: 369450 - DNA, 25 bp, Mus musculus
ctagcttaaacgctactgggcagag

SEQ ID NO: 369451 - DNA, 25 bp, Mus musculus
ctagcttaaacggtactgggcagag

SEQ ID NO: 369452 - DNA, 25 bp, Mus musculus
ctagcttacattccccagatgtgga

SEQ ID NO: 369453 - DNA, 25 bp, Mus musculus
ctagcttacattgcccagatgtgga

SEQ ID NO: 369454 - DNA, 25 bp, Mus musculus
ctagcttagaacacttgagcctcaa

SEQ ID NO: 369455 - DNA, 25 bp, Mus musculus
ctagcttagaactcttgagcctcaa

SEQ ID NO: 369456 - DNA, 25 bp, Mus musculus
ctagcttatatgattggagtgagag

SEQ ID NO: 369457 - DNA, 25 bp, Mus musculus
ctagcttatatgtttggagtgagag

SEQ ID NO: 369458 - DNA, 25 bp, Mus musculus
ctagcttcagctctttatggtgatg

SEQ ID NO: 369459 - DNA, 25 bp, Mus musculus
ctagcttcagctgtttatggtgatg

SEQ ID NO: 369460 - DNA, 25 bp, Mus musculus
ctagcttcagtcacaatgctgttga

SEQ ID NO: 369461 - DNA, 25 bp, Mus musculus
ctagcttcagtctcaatgctgttga

SEQ ID NO: 369462 - DNA, 25 bp, Mus musculus
ctagcttccgttctggtcatcgtgt

SEQ ID NO: 369463 - DNA, 25 bp, Mus musculus
ctagcttccgttgtggtcatcgtgt

SEQ ID NO: 369464 - DNA, 25 bp, Mus musculus
ctagcttcctttccctcttaacgag

SEQ ID NO: 369465 - DNA, 25 bp, Mus musculus
ctagcttcctttgcctcttaacgag

SEQ ID NO: 369466 - DNA, 25 bp, Mus musculus
ctagcttgccggcttcaattaaacc

SEQ ID NO: 369467 - DNA, 25 bp, Mus musculus
ctagcttgccgggttcaattaaacc

SEQ ID NO: 369468 - DNA, 25 bp, Mus musculus
ctagcttggccacctgatggagatt

SEQ ID NO: 369469 - DNA, 25 bp, Mus musculus
ctagcttggccagctgatggagatt

SEQ ID NO: 369470 - DNA, 25 bp, Mus musculus
ctagcttgtatgacctgtactttgc

SEQ ID NO: 369471 - DNA, 25 bp, Mus musculus
ctagcttgtatgtcctgtactttgc

SEQ ID NO: 369472 - DNA, 25 bp, Mus musculus
ctagctttacttcagagaacagaaa

SEQ ID NO: 369473 - DNA, 25 bp, Mus musculus
ctagctttacttgagagaacagaaa

SEQ ID NO: 369474 - DNA, 25 bp, Mus musculus
ctagctttcctacagaatgtgttta

SEQ ID NO: 369475 - DNA, 25 bp, Mus musculus
ctagctttcctagagaatgtgttta

SEQ ID NO: 369476 - DNA, 25 bp, Mus musculus
ctagctttcttcatggttctttttg

SEQ ID NO: 369477 - DNA, 25 bp, Mus musculus
ctagctttcttccagttgctggtaa

SEQ ID NO: 369478 - DNA, 25 bp, Mus musculus
ctagctttcttcgagttgctggtaa

SEQ ID NO: 369479 - DNA, 25 bp, Mus musculus
ctagctttcttcttggttctttttg

SEQ ID NO: 369480 - DNA, 25 bp, Mus musculus
ctagctttgaacagtatcctcatcc

SEQ ID NO: 369481 - DNA, 25 bp, Mus musculus
ctagctttgaactgtatcctcatcc

SEQ ID NO: 369482 - DNA, 25 bp, Mus musculus
ctagctttgcccctatggaggacaa

SEQ ID NO: 369483 - DNA, 25 bp, Mus musculus
ctagctttgcccgtatggaggacaa

SEQ ID NO: 369484 - DNA, 25 bp, Mus musculus
ctagctttgtatcccacagtttgtc

SEQ ID NO: 369485 - DNA, 25 bp, Mus musculus
ctagctttgtatgccacagtttgtc

SEQ ID NO: 369486 - DNA, 25 bp, Mus musculus
ctagcttttccaacctggaagggct

SEQ ID NO: 369487 - DNA, 25 bp, Mus musculus
ctagcttttccatcctggaagggct

SEQ ID NO: 369488 - DNA, 25 bp, Mus musculus
ctagcttttcctcgcagccttcaga

SEQ ID NO: 369489 - DNA, 25 bp, Mus musculus
ctagcttttcctggcagccttcaga

SEQ ID NO: 369490 - DNA, 25 bp, Mus musculus
ctagcttttgccctttactgaagaa

SEQ ID NO: 369491 - DNA, 25 bp, Mus musculus
ctagcttttgccgtttactgaagaa

SEQ ID NO: 369492 - DNA, 25 bp, Mus musculus
ctagctttttggaattatgtctgta

SEQ ID NO: 369493 - DNA, 25 bp, Mus musculus
ctagctttttggattaatatcctgt

SEQ ID NO: 369494 - DNA, 25 bp, Mus musculus
ctagctttttggtattatgtctgta

SEQ ID NO: 369495 - DNA, 25 bp, Mus musculus
ctagctttttggtttaatatcctgt

SEQ ID NO: 369496 - DNA, 25 bp, Mus musculus
ctaggaaaagacctcgcctgggctc

SEQ ID NO: 369497 - DNA, 25 bp, Mus musculus
ctaggaaaagacgtcgcctgggctc

SEQ ID NO: 369498 - DNA, 25 bp, Mus musculus
ctaggaaagcctcccctggtcagta

SEQ ID NO: 369499 - DNA, 25 bp, Mus musculus
ctaggaaagcctgccctggtcagta

SEQ ID NO: 369500 - DNA, 25 bp, Mus musculus
ctaggaaaggtgagccccgtactgg

SEQ ID NO: 369501 - DNA, 25 bp, Mus musculus
ctaggaaaggtgtgccccgtactgg

SEQ ID NO: 369502 - DNA, 25 bp, Mus musculus
ctaggaacctcaaccctgtgtgcgg

SEQ ID NO: 369503 - DNA, 25 bp, Mus musculus
ctaggaacctcatccctgtgtgcgg

SEQ ID NO: 369504 - DNA, 25 bp, Mus musculus
ctaggaaccttaagtgttattgcac

SEQ ID NO: 369505 - DNA, 25 bp, Mus musculus
ctaggaaccttatgtgttattgcac

SEQ ID NO: 369506 - DNA, 25 bp, Mus musculus
ctaggaacttccagttgtgctaaat

SEQ ID NO: 369507 - DNA, 25 bp, Mus musculus
ctaggaacttcctgttgtgctaaat

SEQ ID NO: 369508 - DNA, 25 bp, Mus musculus
ctaggaagattcaatggtcaccctt

SEQ ID NO: 369509 - DNA, 25 bp, Mus musculus
ctaggaagattctatggtcaccctt

SEQ ID NO: 369510 - DNA, 25 bp, Mus musculus
ctaggaagcagtcccgccacgagta

SEQ ID NO: 369511 - DNA, 25 bp, Mus musculus
ctaggaagcagtgccgccacgagta

SEQ ID NO: 369512 - DNA, 25 bp, Mus musculus
ctaggaagctgtctttcctttgcac

SEQ ID NO: 369513 - DNA, 25 bp, Mus musculus
ctaggaagctgtgtttcctttgcac

SEQ ID NO: 369514 - DNA, 25 bp, Mus musculus
ctaggaaggtggaaaagtgttgctc

SEQ ID NO: 369515 - DNA, 25 bp, Mus musculus
ctaggaaggtggtaaagtgttgctc

SEQ ID NO: 369516 - DNA, 25 bp, Mus musculus
ctaggaatagcgaacattttgcaat

SEQ ID NO: 369517 - DNA, 25 bp, Mus musculus
ctaggaatagcgtacattttgcaat

SEQ ID NO: 369518 - DNA, 25 bp, Mus musculus
ctaggaatccaacggttttgtgcat

SEQ ID NO: 369519 - DNA, 25 bp, Mus musculus
ctaggaatccaagggttttgtgcat

SEQ ID NO: 369520 - DNA, 25 bp, Mus musculus
ctaggaatggacagcccctgaaatg

SEQ ID NO: 369521 - DNA, 25 bp, Mus musculus
ctaggaatggactgcccctgaaatg

SEQ ID NO: 369522 - DNA, 25 bp, Mus musculus
ctaggaatggtgctaagagctgaca

SEQ ID NO: 369523 - DNA, 25 bp, Mus musculus
ctaggaatggtggtaagagctgaca

SEQ ID NO: 369524 - DNA, 25 bp, Mus musculus
ctaggacactgcagttggaggcccc

SEQ ID NO: 369525 - DNA, 25 bp, Mus musculus
ctaggacactgctgttggaggcccc

SEQ ID NO: 369526 - DNA, 25 bp, Mus musculus
ctaggacatattcaactcctgtgga

SEQ ID NO: 369527 - DNA, 25 bp, Mus musculus
ctaggacatattgaactcctgtgga

SEQ ID NO: 369528 - DNA, 25 bp, Mus musculus
ctaggaccacagatgcatgccagcc

SEQ ID NO: 369529 - DNA, 25 bp, Mus musculus
ctaggaccacagttgcatgccagcc

SEQ ID NO: 369530 - DNA, 25 bp, Mus musculus
ctaggacccaggacaggccggttag

SEQ ID NO: 369531 - DNA, 25 bp, Mus musculus
ctaggacccaggtcaggccggttag

SEQ ID NO: 369532 - DNA, 25 bp, Mus musculus
ctaggaccctagcagttcacaaaac

SEQ ID NO: 369533 - DNA, 25 bp, Mus musculus
ctaggaccctaggagttcacaaaac

SEQ ID NO: 369534 - DNA, 25 bp, Mus musculus
ctaggaccgtcacccagtctggaga

SEQ ID NO: 369535 - DNA, 25 bp, Mus musculus
ctaggaccgtcagccagtctggaga

SEQ ID NO: 369536 - DNA, 25 bp, Mus musculus
ctaggacctcatatatgttcagtga

SEQ ID NO: 369537 - DNA, 25 bp, Mus musculus
ctaggacctcatttatgttcagtga

SEQ ID NO: 369538 - DNA, 25 bp, Mus musculus
ctaggacctgaacatattaatggat

SEQ ID NO: 369539 - DNA, 25 bp, Mus musculus
ctaggacctgaagatattaatggat

SEQ ID NO: 369540 - DNA, 25 bp, Mus musculus
ctaggaccttttctggtactctgga

SEQ ID NO: 369541 - DNA, 25 bp, Mus musculus
ctaggaccttttgtggtactctgga

SEQ ID NO: 369542 - DNA, 25 bp, Mus musculus
ctaggacgaaatctgtaagctcttt

SEQ ID NO: 369543 - DNA, 25 bp, Mus musculus
ctaggacgaaatgtgtaagctcttt

SEQ ID NO: 369544 - DNA, 25 bp, Mus musculus
ctaggactcagaaggtgctcctgcc

SEQ ID NO: 369545 - DNA, 25 bp, Mus musculus
ctaggactcagatggtgctcctgcc

SEQ ID NO: 369546 - DNA, 25 bp, Mus musculus
ctaggactctgtccacctgttgtgt

SEQ ID NO: 369547 - DNA, 25 bp, Mus musculus
ctaggactctgtgcacctgttgtgt

SEQ ID NO: 369548 - DNA, 25 bp, Mus musculus
ctaggactgcatcttacaggtacac

SEQ ID NO: 369549 - DNA, 25 bp, Mus musculus
ctaggactgcatgttacaggtacac

SEQ ID NO: 369550 - DNA, 25 bp, Mus musculus
ctaggactgctaaattcaggaatgt

SEQ ID NO: 369551 - DNA, 25 bp, Mus musculus
ctaggactgctatattcaggaatgt

SEQ ID NO: 369552 - DNA, 25 bp, Mus musculus
ctaggagactcaaccctgggcattt

SEQ ID NO: 369553 - DNA, 25 bp, Mus musculus
ctaggagactcatccctgggcattt

SEQ ID NO: 369554 - DNA, 25 bp, Mus musculus
ctaggagagggaccgctccatccat

SEQ ID NO: 369555 - DNA, 25 bp, Mus musculus
ctaggagagggagcgctccatccat

SEQ ID NO: 369556 - DNA, 25 bp, Mus musculus
ctaggagatcctatgcagacttaaa

SEQ ID NO: 369557 - DNA, 25 bp, Mus musculus
ctaggagatcctttgcagacttaaa

SEQ ID NO: 369558 - DNA, 25 bp, Mus musculus
ctaggagatcgcctctttgtttaag

SEQ ID NO: 369559 - DNA, 25 bp, Mus musculus
ctaggagatcgcgtctttgtttaag

SEQ ID NO: 369560 - DNA, 25 bp, Mus musculus
ctaggagatgtcatggtacccgtct

SEQ ID NO: 369561 - DNA, 25 bp, Mus musculus
ctaggagatgtcttggtacccgtct

SEQ ID NO: 369562 - DNA, 25 bp, Mus musculus
ctaggagctcctcatcaaataaagt

SEQ ID NO: 369563 - DNA, 25 bp, Mus musculus
ctaggagctcctgatcaaataaagt

SEQ ID NO: 369564 - DNA, 25 bp, Mus musculus
ctaggaggccaaacagagtctgcaa

SEQ ID NO: 369565 - DNA, 25 bp, Mus musculus
ctaggaggccaatcagagtctgcaa

SEQ ID NO: 369566 - DNA, 25 bp, Mus musculus
ctaggaggctttccgaagcaagact

SEQ ID NO: 369567 - DNA, 25 bp, Mus musculus
ctaggaggctttgcgaagcaagact

SEQ ID NO: 369568 - DNA, 25 bp, Mus musculus
ctaggagtgtggctcatatcagata

SEQ ID NO: 369569 - DNA, 25 bp, Mus musculus
ctaggagtgtgggtcatatcagata

SEQ ID NO: 369570 - DNA, 25 bp, Mus musculus
ctaggagttcatagtcttcccacaa

SEQ ID NO: 369571 - DNA, 25 bp, Mus musculus
ctaggagttcattgtcttcccacaa

SEQ ID NO: 369572 - DNA, 25 bp, Mus musculus
ctaggagttgtgagccttgttctcc

SEQ ID NO: 369573 - DNA, 25 bp, Mus musculus
ctaggagttgtgtgccttgttctcc

SEQ ID NO: 369574 - DNA, 25 bp, Mus musculus
ctaggatagactcaccaggatggtt

SEQ ID NO: 369575 - DNA, 25 bp, Mus musculus
ctaggatagactgaccaggatggtt

SEQ ID NO: 369576 - DNA, 25 bp, Mus musculus
ctaggatccgcaattgggtggactc

SEQ ID NO: 369577 - DNA, 25 bp, Mus musculus
ctaggatccgcatttgggtggactc

SEQ ID NO: 369578 - DNA, 25 bp, Mus musculus
ctaggatggcagctgtgcacactat

SEQ ID NO: 369579 - DNA, 25 bp, Mus musculus
ctaggatggcaggtgtgcacactat

SEQ ID NO: 369580 - DNA, 25 bp, Mus musculus
ctaggatgtcaacttcacttgggtg

SEQ ID NO: 369581 - DNA, 25 bp, Mus musculus
ctaggatgtcaagttcacttgggtg

SEQ ID NO: 369582 - DNA, 25 bp, Mus musculus
ctaggattcataaatgtatctctga

SEQ ID NO: 369583 - DNA, 25 bp, Mus musculus
ctaggattcatatatgtatctctga

SEQ ID NO: 369584 - DNA, 25 bp, Mus musculus
ctaggattccgtcactgctgtgtgc

SEQ ID NO: 369585 - DNA, 25 bp, Mus musculus
ctaggattccgtgactgctgtgtgc

SEQ ID NO: 369586 - DNA, 25 bp, Mus musculus
ctaggattcctaaggcttggtgcca

SEQ ID NO: 369587 - DNA, 25 bp, Mus musculus
ctaggattcctatggcttggtgcca

SEQ ID NO: 369588 - DNA, 25 bp, Mus musculus
ctaggattcgttcctctagcagaga

SEQ ID NO: 369589 - DNA, 25 bp, Mus musculus
ctaggattcgttgctctagcagaga

SEQ ID NO: 369590 - DNA, 25 bp, Mus musculus
ctaggcacacagcactctaaagtat

SEQ ID NO: 369591 - DNA, 25 bp, Mus musculus
ctaggcacacaggactctaaagtat

SEQ ID NO: 369592 - DNA, 25 bp, Mus musculus
ctaggcacattcatactgccatgaa

SEQ ID NO: 369593 - DNA, 25 bp, Mus musculus
ctaggcacattcttactgccatgaa

SEQ ID NO: 369594 - DNA, 25 bp, Mus musculus
ctaggcagagatctactcccatgat

SEQ ID NO: 369595 - DNA, 25 bp, Mus musculus
ctaggcagagatgtactcccatgat

SEQ ID NO: 369596 - DNA, 25 bp, Mus musculus
ctaggcagattaagcccttcaccca

SEQ ID NO: 369597 - DNA, 25 bp, Mus musculus
ctaggcagattatgcccttcaccca

SEQ ID NO: 369598 - DNA, 25 bp, Mus musculus
ctaggcaggactccccagtagaagg

SEQ ID NO: 369599 - DNA, 25 bp, Mus musculus
ctaggcaggactgcccagtagaagg

SEQ ID NO: 369600 - DNA, 25 bp, Mus musculus
ctaggcaggcacactgacattgaat

SEQ ID NO: 369601 - DNA, 25 bp, Mus musculus
ctaggcaggcactctgacattgaat

SEQ ID NO: 369602 - DNA, 25 bp, Mus musculus
ctaggcatcattcttttagtaccaa

SEQ ID NO: 369603 - DNA, 25 bp, Mus musculus
ctaggcatcattgttttagtaccaa

SEQ ID NO: 369604 - DNA, 25 bp, Mus musculus
ctaggcatccacatgaagctcaaat

SEQ ID NO: 369605 - DNA, 25 bp, Mus musculus
ctaggcatccacttgaagctcaaat

SEQ ID NO: 369606 - DNA, 25 bp, Mus musculus
ctaggcatctgacccattgtgtaag

SEQ ID NO: 369607 - DNA, 25 bp, Mus musculus
ctaggcatctgagccattgtgtaag

SEQ ID NO: 369608 - DNA, 25 bp, Mus musculus
ctaggcatgtctaggcttagccagt

SEQ ID NO: 369609 - DNA, 25 bp, Mus musculus
ctaggcatgtcttggcttagccagt

SEQ ID NO: 369610 - DNA, 25 bp, Mus musculus
ctaggcatttggacattggtgttca

SEQ ID NO: 369611 - DNA, 25 bp, Mus musculus
ctaggcatttggtcattggtgttca

SEQ ID NO: 369612 - DNA, 25 bp, Mus musculus
ctaggccaactgacaggtcctggtg

SEQ ID NO: 369613 - DNA, 25 bp, Mus musculus
ctaggccaactgtcaggtcctggtg

SEQ ID NO: 369614 - DNA, 25 bp, Mus musculus
ctaggccacccaacaacagggagat

SEQ ID NO: 369615 - DNA, 25 bp, Mus musculus
ctaggccacccatcaacagggagat

SEQ ID NO: 369616 - DNA, 25 bp, Mus musculus
ctaggccagtatatataactctaca

SEQ ID NO: 369617 - DNA, 25 bp, Mus musculus
ctaggccagtatttataactctaca

SEQ ID NO: 369618 - DNA, 25 bp, Mus musculus
ctaggccatccaagagtctcccagg

SEQ ID NO: 369619 - DNA, 25 bp, Mus musculus
ctaggccatccatgagtctcccagg

SEQ ID NO: 369620 - DNA, 25 bp, Mus musculus
ctaggccatctgagcggtatgtgaa

SEQ ID NO: 369621 - DNA, 25 bp, Mus musculus
ctaggccatctgtgcggtatgtgaa

SEQ ID NO: 369622 - DNA, 25 bp, Mus musculus
ctaggccattgtaaacacttgtata

SEQ ID NO: 369623 - DNA, 25 bp, Mus musculus
ctaggccattgttaacacttgtata

SEQ ID NO: 369624 - DNA, 25 bp, Mus musculus
ctaggcccatatatcctggctttca

SEQ ID NO: 369625 - DNA, 25 bp, Mus musculus
ctaggcccatatttcctggctttca

SEQ ID NO: 369626 - DNA, 25 bp, Mus musculus
ctaggccctaaacccatattcagag

SEQ ID NO: 369627 - DNA, 25 bp, Mus musculus
ctaggccctaaagccatattcagag

SEQ ID NO: 369628 - DNA, 25 bp, Mus musculus
ctaggccctggaaagaatcttaatt

SEQ ID NO: 369629 - DNA, 25 bp, Mus musculus
ctaggccctggatagaatcttaatt

SEQ ID NO: 369630 - DNA, 25 bp, Mus musculus
ctaggccctgtaatcgcactgcgtc

SEQ ID NO: 369631 - DNA, 25 bp, Mus musculus
ctaggccctgtattcgcactgcgtc

SEQ ID NO: 369632 - DNA, 25 bp, Mus musculus
ctaggcctatctactatctaggtaa

SEQ ID NO: 369633 - DNA, 25 bp, Mus musculus
ctaggcctatcttctatctaggtaa

SEQ ID NO: 369634 - DNA, 25 bp, Mus musculus
ctaggcctcagtatataaatttcag

SEQ ID NO: 369635 - DNA, 25 bp, Mus musculus
ctaggcctcagtttataaatttcag

SEQ ID NO: 369636 - DNA, 25 bp, Mus musculus
ctaggcctcgataagattttacgga

SEQ ID NO: 369637 - DNA, 25 bp, Mus musculus
ctaggcctcgattagattttacgga

SEQ ID NO: 369638 - DNA, 25 bp, Mus musculus
ctaggcctgacaagggctttttgaa

SEQ ID NO: 369639 - DNA, 25 bp, Mus musculus
ctaggcctgacatgggctttttgaa

SEQ ID NO: 369640 - DNA, 25 bp, Mus musculus
ctaggcctggaacctgtggctctct

SEQ ID NO: 369641 - DNA, 25 bp, Mus musculus
ctaggcctggaagctgtggctctct

SEQ ID NO: 369642 - DNA, 25 bp, Mus musculus
ctaggcctgggcatcgatgaagatg

SEQ ID NO: 369643 - DNA, 25 bp, Mus musculus
ctaggcctgggcttcgatgaagatg

SEQ ID NO: 369644 - DNA, 25 bp, Mus musculus
ctaggccttgatcagcacatgagct

SEQ ID NO: 369645 - DNA, 25 bp, Mus musculus
ctaggccttgatgagcacatgagct

SEQ ID NO: 369646 - DNA, 25 bp, Mus musculus
ctaggcgaagcaagcggcggcaacc

SEQ ID NO: 369647 - DNA, 25 bp, Mus musculus
ctaggcgaagcatgcggcggcaacc

SEQ ID NO: 369648 - DNA, 25 bp, Mus musculus
ctaggcgaatacatcaggagtcttt

SEQ ID NO: 369649 - DNA, 25 bp, Mus musculus
ctaggcgaatacttcaggagtcttt

SEQ ID NO: 369650 - DNA, 25 bp, Mus musculus
ctaggcgaggttagtgtcttgtttt

SEQ ID NO: 369651 - DNA, 25 bp, Mus musculus
ctaggcgaggtttgtgtcttgtttt

SEQ ID NO: 369652 - DNA, 25 bp, Mus musculus
ctaggcgccgagataaagggctatt

SEQ ID NO: 369653 - DNA, 25 bp, Mus musculus
ctaggcgccgagttaaagggctatt

SEQ ID NO: 369654 - DNA, 25 bp, Mus musculus
ctaggcggctgcaggtgacagccaa

SEQ ID NO: 369655 - DNA, 25 bp, Mus musculus
ctaggcggctgctggtgacagccaa

SEQ ID NO: 369656 - DNA, 25 bp, Mus musculus
ctaggcgtccggaaacagccgaagt

SEQ ID NO: 369657 - DNA, 25 bp, Mus musculus
ctaggcgtccggtaacagccgaagt

SEQ ID NO: 369658 - DNA, 25 bp, Mus musculus
ctaggcgtgctccatttcgaagtga

SEQ ID NO: 369659 - DNA, 25 bp, Mus musculus
ctaggcgtgctcgatttcgaagtga

SEQ ID NO: 369660 - DNA, 25 bp, Mus musculus
ctaggcgtgggaaaagagactgctt

SEQ ID NO: 369661 - DNA, 25 bp, Mus musculus
ctaggcgtgggataagagactgctt

SEQ ID NO: 369662 - DNA, 25 bp, Mus musculus
ctaggctaagtccatccagagtgtt

SEQ ID NO: 369663 - DNA, 25 bp, Mus musculus
ctaggctaagtcgatccagagtgtt

SEQ ID NO: 369664 - DNA, 25 bp, Mus musculus
ctaggctacagactgggctcaacat

SEQ ID NO: 369665 - DNA, 25 bp, Mus musculus
ctaggctacagagtgggctcaacat

SEQ ID NO: 369666 - DNA, 25 bp, Mus musculus
ctaggctacatactgctacgaaaat

SEQ ID NO: 369667 - DNA, 25 bp, Mus musculus
ctaggctacatagtgctacgaaaat

SEQ ID NO: 369668 - DNA, 25 bp, Mus musculus
ctaggctacctccagtagttacaag

SEQ ID NO: 369669 - DNA, 25 bp, Mus musculus
ctaggctacctcgagtagttacaag

SEQ ID NO: 369670 - DNA, 25 bp, Mus musculus
ctaggctagtcccaggttcagtgag

SEQ ID NO: 369671 - DNA, 25 bp, Mus musculus
ctaggctagtccgaggttcagtgag

SEQ ID NO: 369672 - DNA, 25 bp, Mus musculus
ctaggctagtgcactacttcggaac

SEQ ID NO: 369673 - DNA, 25 bp, Mus musculus
ctaggctagtgctctacttcggaac

SEQ ID NO: 369674 - DNA, 25 bp, Mus musculus
ctaggctccaacatgttatgaaaag

SEQ ID NO: 369675 - DNA, 25 bp, Mus musculus
ctaggctccaacttgttatgaaaag

SEQ ID NO: 369676 - DNA, 25 bp, Mus musculus
ctaggctccactccctggaagagaa

SEQ ID NO: 369677 - DNA, 25 bp, Mus musculus
ctaggctccactgcctggaagagaa

SEQ ID NO: 369678 - DNA, 25 bp, Mus musculus
ctaggctcgggacttttcctgttgt

SEQ ID NO: 369679 - DNA, 25 bp, Mus musculus
ctaggctcgggagttttcctgttgt

SEQ ID NO: 369680 - DNA, 25 bp, Mus musculus
ctaggctgcctacttcattatgaga

SEQ ID NO: 369681 - DNA, 25 bp, Mus musculus
ctaggctgcctagttcattatgaga

SEQ ID NO: 369682 - DNA, 25 bp, Mus musculus
ctaggctggagtaagctttgctgtg

SEQ ID NO: 369683 - DNA, 25 bp, Mus musculus
ctaggctggagtcgaatgctatatc

SEQ ID NO: 369684 - DNA, 25 bp, Mus musculus
ctaggctggagtggaatgctatatc

SEQ ID NO: 369685 - DNA, 25 bp, Mus musculus
ctaggctggagttagctttgctgtg

SEQ ID NO: 369686 - DNA, 25 bp, Mus musculus
ctaggctggctacctttagcacagt

SEQ ID NO: 369687 - DNA, 25 bp, Mus musculus
ctaggctggctagctttagcacagt

SEQ ID NO: 369688 - DNA, 25 bp, Mus musculus
ctaggctgtagaatctgcaccgaca

SEQ ID NO: 369689 - DNA, 25 bp, Mus musculus
ctaggctgtagattctgcaccgaca

SEQ ID NO: 369690 - DNA, 25 bp, Mus musculus
ctaggcttcaatatatcagtgttta

SEQ ID NO: 369691 - DNA, 25 bp, Mus musculus
ctaggcttcaatttatcagtgttta

SEQ ID NO: 369692 - DNA, 25 bp, Mus musculus
ctaggcttcatgatgcatttctaaa

SEQ ID NO: 369693 - DNA, 25 bp, Mus musculus
ctaggcttcatgttgcatttctaaa

SEQ ID NO: 369694 - DNA, 25 bp, Mus musculus
ctaggcttgagaattcatctgctct

SEQ ID NO: 369695 - DNA, 25 bp, Mus musculus
ctaggcttgagatttcatctgctct

SEQ ID NO: 369696 - DNA, 25 bp, Mus musculus
ctaggctttctgctaagtgcaggct

SEQ ID NO: 369697 - DNA, 25 bp, Mus musculus
ctaggctttctggtaagtgcaggct

SEQ ID NO: 369698 - DNA, 25 bp, Mus musculus
ctagggaagagactggttattgcaa

SEQ ID NO: 369699 - DNA, 25 bp, Mus musculus
ctagggaagagagtggttattgcaa

SEQ ID NO: 369700 - DNA, 25 bp, Mus musculus
ctagggaagattccactggtcctcc

SEQ ID NO: 369701 - DNA, 25 bp, Mus musculus
ctagggaagattgcactggtcctcc

SEQ ID NO: 369702 - DNA, 25 bp, Mus musculus
ctagggaatccccaggattgtgccg

SEQ ID NO: 369703 - DNA, 25 bp, Mus musculus
ctagggaatcccgaggattgtgccg

SEQ ID NO: 369704 - DNA, 25 bp, Mus musculus
ctagggaatgctcgctattatctct

SEQ ID NO: 369705 - DNA, 25 bp, Mus musculus
ctagggaatgctggctattatctct

SEQ ID NO: 369706 - DNA, 25 bp, Mus musculus
ctagggaattgtcccgcccacagta

SEQ ID NO: 369707 - DNA, 25 bp, Mus musculus
ctagggaattgtgccgcccacagta

SEQ ID NO: 369708 - DNA, 25 bp, Mus musculus
ctagggacagagcacacacatggct

SEQ ID NO: 369709 - DNA, 25 bp, Mus musculus
ctagggacagaggacacacatggct

SEQ ID NO: 369710 - DNA, 25 bp, Mus musculus
ctagggacagccatcccaaagcttg

SEQ ID NO: 369711 - DNA, 25 bp, Mus musculus
ctagggacagccttcccaaagcttg

SEQ ID NO: 369712 - DNA, 25 bp, Mus musculus
ctagggactagaagggctcctgcat

SEQ ID NO: 369713 - DNA, 25 bp, Mus musculus
ctagggactagatgggctcctgcat

SEQ ID NO: 369714 - DNA, 25 bp, Mus musculus
ctagggagggctatgatgcatgacc

SEQ ID NO: 369715 - DNA, 25 bp, Mus musculus
ctagggagggctttgatgcatgacc

SEQ ID NO: 369716 - DNA, 25 bp, Mus musculus
ctagggatccaaattgggtccaggg

SEQ ID NO: 369717 - DNA, 25 bp, Mus musculus
ctagggatccaatttgggtccaggg

SEQ ID NO: 369718 - DNA, 25 bp, Mus musculus
ctagggatcgtgatgggactttgac

SEQ ID NO: 369719 - DNA, 25 bp, Mus musculus
ctagggatcgtgttgggactttgac

SEQ ID NO: 369720 - DNA, 25 bp, Mus musculus
ctagggatctcaactgactcctctt

SEQ ID NO: 369721 - DNA, 25 bp, Mus musculus
ctagggatctcatctgactcctctt

SEQ ID NO: 369722 - DNA, 25 bp, Mus musculus
ctagggatctctcgcctgtggagta

SEQ ID NO: 369723 - DNA, 25 bp, Mus musculus
ctagggatctctggcctgtggagta

SEQ ID NO: 369724 - DNA, 25 bp, Mus musculus
ctagggattggcacctatgctgggc

SEQ ID NO: 369725 - DNA, 25 bp, Mus musculus
ctagggattggctcctatgctgggc

SEQ ID NO: 369726 - DNA, 25 bp, Mus musculus
ctagggatttatcttgtttgaggca

SEQ ID NO: 369727 - DNA, 25 bp, Mus musculus
ctagggatttatgttgtttgaggca

SEQ ID NO: 369728 - DNA, 25 bp, Mus musculus
ctagggcacgttacaccagtgagat

SEQ ID NO: 369729 - DNA, 25 bp, Mus musculus
ctagggcacgtttcaccagtgagat

SEQ ID NO: 369730 - DNA, 25 bp, Mus musculus
ctagggcactgcatgtattgactgc

SEQ ID NO: 369731 - DNA, 25 bp, Mus musculus
ctagggcactgcttgtattgactgc

SEQ ID NO: 369732 - DNA, 25 bp, Mus musculus
ctagggcattcgcttggacaggaat

SEQ ID NO: 369733 - DNA, 25 bp, Mus musculus
ctagggcattcggttggacaggaat

SEQ ID NO: 369734 - DNA, 25 bp, Mus musculus
ctagggccagagaccatgcatgtga

SEQ ID NO: 369735 - DNA, 25 bp, Mus musculus
ctagggccagagtccatgcatgtga

SEQ ID NO: 369736 - DNA, 25 bp, Mus musculus
ctagggcccctgcttggaaggctca

SEQ ID NO: 369737 - DNA, 25 bp, Mus musculus
ctagggcccctggttggaaggctca

SEQ ID NO: 369738 - DNA, 25 bp, Mus musculus
ctagggcccggcagatgctctggaa

SEQ ID NO: 369739 - DNA, 25 bp, Mus musculus
ctagggcccggctgatgctctggaa

SEQ ID NO: 369740 - DNA, 25 bp, Mus musculus
ctagggccctaaagatataatcccc

SEQ ID NO: 369741 - DNA, 25 bp, Mus musculus
ctagggccctaatgatataatcccc

SEQ ID NO: 369742 - DNA, 25 bp, Mus musculus
ctagggcccttgacgctgaggacaa

SEQ ID NO: 369743 - DNA, 25 bp, Mus musculus
ctagggcccttgtcgctgaggacaa

SEQ ID NO: 369744 - DNA, 25 bp, Mus musculus
ctagggccgataataaagtctcaga

SEQ ID NO: 369745 - DNA, 25 bp, Mus musculus
ctagggccgatattaaagtctcaga

SEQ ID NO: 369746 - DNA, 25 bp, Mus musculus
ctagggcgatgccaacagtttttaa

SEQ ID NO: 369747 - DNA, 25 bp, Mus musculus
ctagggcgatgcgaacagtttttaa

SEQ ID NO: 369748 - DNA, 25 bp, Mus musculus
ctagggctactacttacttaacatt

SEQ ID NO: 369749 - DNA, 25 bp, Mus musculus
ctagggctactagttacttaacatt

SEQ ID NO: 369750 - DNA, 25 bp, Mus musculus
ctagggctcagcatcgcatcagtta

SEQ ID NO: 369751 - DNA, 25 bp, Mus musculus
ctagggctcagcttcgcatcagtta

SEQ ID NO: 369752 - DNA, 25 bp, Mus musculus
ctagggctccacctgcagggcaaag

SEQ ID NO: 369753 - DNA, 25 bp, Mus musculus
ctagggctccacgtgcagggcaaag

SEQ ID NO: 369754 - DNA, 25 bp, Mus musculus
ctagggctgtagagtgagctgccct

SEQ ID NO: 369755 - DNA, 25 bp, Mus musculus
ctagggctgtagtgtgagctgccct

SEQ ID NO: 369756 - DNA, 25 bp, Mus musculus
ctagggctgtgcacgtgctatctgt

SEQ ID NO: 369757 - DNA, 25 bp, Mus musculus
ctagggctgtgcatcggttgataga

SEQ ID NO: 369758 - DNA, 25 bp, Mus musculus
ctagggctgtgctcgtgctatctgt

SEQ ID NO: 369759 - DNA, 25 bp, Mus musculus
ctagggctgtgcttcggttgataga

SEQ ID NO: 369760 - DNA, 25 bp, Mus musculus
ctagggctgtggaaaatgactttat

SEQ ID NO: 369761 - DNA, 25 bp, Mus musculus
ctagggctgtggtaaatgactttat

SEQ ID NO: 369762 - DNA, 25 bp, Mus musculus
ctagggcttctaacggaggctaaat

SEQ ID NO: 369763 - DNA, 25 bp, Mus musculus
ctagggcttctatcggaggctaaat

SEQ ID NO: 369764 - DNA, 25 bp, Mus musculus
ctagggcttgccagatgtgtctaaa

SEQ ID NO: 369765 - DNA, 25 bp, Mus musculus
ctagggcttgcctgatgtgtctaaa

SEQ ID NO: 369766 - DNA, 25 bp, Mus musculus
ctagggctttgactgcattttcaat

SEQ ID NO: 369767 - DNA, 25 bp, Mus musculus
ctagggctttgagtgcattttcaat

SEQ ID NO: 369768 - DNA, 25 bp, Mus musculus
ctagggctttggctcagatttactg

SEQ ID NO: 369769 - DNA, 25 bp, Mus musculus
ctagggctttgggtcagatttactg

SEQ ID NO: 369770 - DNA, 25 bp, Mus musculus
ctagggtacttgaggctgacttgca

SEQ ID NO: 369771 - DNA, 25 bp, Mus musculus
ctagggtacttgtggctgacttgca

SEQ ID NO: 369772 - DNA, 25 bp, Mus musculus
ctagggtagtttactgttctgtcat

SEQ ID NO: 369773 - DNA, 25 bp, Mus musculus
ctagggtagttttctgttctgtcat

SEQ ID NO: 369774 - DNA, 25 bp, Mus musculus
ctagggtcacagacggtcagcttgg

SEQ ID NO: 369775 - DNA, 25 bp, Mus musculus
ctagggtcacagtcggtcagcttgg

SEQ ID NO: 369776 - DNA, 25 bp, Mus musculus
ctagggtcactcctagcggtctgtg

SEQ ID NO: 369777 - DNA, 25 bp, Mus musculus
ctagggtcactcgtagcggtctgtg

SEQ ID NO: 369778 - DNA, 25 bp, Mus musculus
ctagggtcaggcaactatgatttta

SEQ ID NO: 369779 - DNA, 25 bp, Mus musculus
ctagggtcaggctactatgatttta

SEQ ID NO: 369780 - DNA, 25 bp, Mus musculus
ctagggtgtctgaatgaatccattt

SEQ ID NO: 369781 - DNA, 25 bp, Mus musculus
ctagggtgtctgtatgaatccattt

SEQ ID NO: 369782 - DNA, 25 bp, Mus musculus
ctagggtgtgagacagtagcagatc

SEQ ID NO: 369783 - DNA, 25 bp, Mus musculus
ctagggtgtgagtcagtagcagatc

SEQ ID NO: 369784 - DNA, 25 bp, Mus musculus
ctagggtgtttgacatcttctgcaa

SEQ ID NO: 369785 - DNA, 25 bp, Mus musculus
ctagggtgtttgtcatcttctgcaa

SEQ ID NO: 369786 - DNA, 25 bp, Mus musculus
ctagggttctacctggtggacagtc

SEQ ID NO: 369787 - DNA, 25 bp, Mus musculus
ctagggttctacgtggtggacagtc

SEQ ID NO: 369788 - DNA, 25 bp, Mus musculus
ctagggtttcagcaagtcatacttc

SEQ ID NO: 369789 - DNA, 25 bp, Mus musculus
ctagggtttcaggaagtcatacttc

SEQ ID NO: 369790 - DNA, 25 bp, Mus musculus
ctaggtaagccacaactctttggtg

SEQ ID NO: 369791 - DNA, 25 bp, Mus musculus
ctaggtaagccagaactctttggtg

SEQ ID NO: 369792 - DNA, 25 bp, Mus musculus
ctaggtaaggcccatgtggctttac

SEQ ID NO: 369793 - DNA, 25 bp, Mus musculus
ctaggtaaggccgatgtggctttac

SEQ ID NO: 369794 - DNA, 25 bp, Mus musculus
ctaggtaagtctagaatacctgatc

SEQ ID NO: 369795 - DNA, 25 bp, Mus musculus
ctaggtaagtcttgaatacctgatc

SEQ ID NO: 369796 - DNA, 25 bp, Mus musculus
ctaggtaatttaacgtggcccagac

SEQ ID NO: 369797 - DNA, 25 bp, Mus musculus
ctaggtaatttatcgtggcccagac

SEQ ID NO: 369798 - DNA, 25 bp, Mus musculus
ctaggtacaacaaccccagaaccat

SEQ ID NO: 369799 - DNA, 25 bp, Mus musculus
ctaggtacaacatccccagaaccat

SEQ ID NO: 369800 - DNA, 25 bp, Mus musculus
ctaggtacacgtcctgcttttctgt

SEQ ID NO: 369801 - DNA, 25 bp, Mus musculus
ctaggtacacgtgctgcttttctgt

SEQ ID NO: 369802 - DNA, 25 bp, Mus musculus
ctaggtacccgtctgcaggtgtctt

SEQ ID NO: 369803 - DNA, 25 bp, Mus musculus
ctaggtacccgtgtgcaggtgtctt

SEQ ID NO: 369804 - DNA, 25 bp, Mus musculus
ctaggtacgctgattttcctctgac

SEQ ID NO: 369805 - DNA, 25 bp, Mus musculus
ctaggtacgctgtttttcctctgac

SEQ ID NO: 369806 - DNA, 25 bp, Mus musculus
ctaggtaggattcttgggtctctca

SEQ ID NO: 369807 - DNA, 25 bp, Mus musculus
ctaggtaggattgttgggtctctca

SEQ ID NO: 369808 - DNA, 25 bp, Mus musculus
ctaggtaggttaatcctgtgttcca

SEQ ID NO: 369809 - DNA, 25 bp, Mus musculus
ctaggtaggttattcctgtgttcca

SEQ ID NO: 369810 - DNA, 25 bp, Mus musculus
ctaggtagtcagatgcaagtggcag

SEQ ID NO: 369811 - DNA, 25 bp, Mus musculus
ctaggtagtcagttgcaagtggcag

SEQ ID NO: 369812 - DNA, 25 bp, Mus musculus
ctaggtatggccataaagctgcagt

SEQ ID NO: 369813 - DNA, 25 bp, Mus musculus
ctaggtatggccttaaagctgcagt

SEQ ID NO: 369814 - DNA, 25 bp, Mus musculus
ctaggtcaaaggacgctgatggctt

SEQ ID NO: 369815 - DNA, 25 bp, Mus musculus
ctaggtcaaaggtcgctgatggctt

SEQ ID NO: 369816 - DNA, 25 bp, Mus musculus
ctaggtcacgagcaggctgtccaaa

SEQ ID NO: 369817 - DNA, 25 bp, Mus musculus
ctaggtcacgaggaggctgtccaaa

SEQ ID NO: 369818 - DNA, 25 bp, Mus musculus
ctaggtcaggttctcgcttggtaaa

SEQ ID NO: 369819 - DNA, 25 bp, Mus musculus
ctaggtcaggttgtcgcttggtaaa

SEQ ID NO: 369820 - DNA, 25 bp, Mus musculus
ctaggtcatgatattgctgctttgt

SEQ ID NO: 369821 - DNA, 25 bp, Mus musculus
ctaggtcatgattttgctgctttgt

SEQ ID NO: 369822 - DNA, 25 bp, Mus musculus
ctaggtccccagatggctttagatt

SEQ ID NO: 369823 - DNA, 25 bp, Mus musculus
ctaggtccccagttggctttagatt

SEQ ID NO: 369824 - DNA, 25 bp, Mus musculus
ctaggtcctttccttagtgaacttg

SEQ ID NO: 369825 - DNA, 25 bp, Mus musculus
ctaggtcctttcgttagtgaacttg

SEQ ID NO: 369826 - DNA, 25 bp, Mus musculus
ctaggtctacagctgtttccatgaa

SEQ ID NO: 369827 - DNA, 25 bp, Mus musculus
ctaggtctacaggtgtttccatgaa

SEQ ID NO: 369828 - DNA, 25 bp, Mus musculus
ctaggtctagctactcacggttgta

SEQ ID NO: 369829 - DNA, 25 bp, Mus musculus
ctaggtctagcttctcacggttgta

SEQ ID NO: 369830 - DNA, 25 bp, Mus musculus
ctaggtctatctacctttctagagg

SEQ ID NO: 369831 - DNA, 25 bp, Mus musculus
ctaggtctatcttcctttctagagg

SEQ ID NO: 369832 - DNA, 25 bp, Mus musculus
ctaggtctctctctgaatggttctt

SEQ ID NO: 369833 - DNA, 25 bp, Mus musculus
ctaggtctctctgtgaatggttctt

SEQ ID NO: 369834 - DNA, 25 bp, Mus musculus
ctaggtctggaaatttggctctgga

SEQ ID NO: 369835 - DNA, 25 bp, Mus musculus
ctaggtctggaattttggctctgga

SEQ ID NO: 369836 - DNA, 25 bp, Mus musculus
ctaggtcttgggaaatactcctttg

SEQ ID NO: 369837 - DNA, 25 bp, Mus musculus
ctaggtcttgggtaatactcctttg

SEQ ID NO: 369838 - DNA, 25 bp, Mus musculus
ctaggtcttttacttccatggaaca

SEQ ID NO: 369839 - DNA, 25 bp, Mus musculus
ctaggtcttttagttccatggaaca

SEQ ID NO: 369840 - DNA, 25 bp, Mus musculus
ctaggtgacccacgagcaagcaggc

SEQ ID NO: 369841 - DNA, 25 bp, Mus musculus
ctaggtgacccaggagcaagcaggc

SEQ ID NO: 369842 - DNA, 25 bp, Mus musculus
ctaggtgcccacaggtaagaggtgt

SEQ ID NO: 369843 - DNA, 25 bp, Mus musculus
ctaggtgcccactggtaagaggtgt

SEQ ID NO: 369844 - DNA, 25 bp, Mus musculus
ctaggtgcccctccaagggctttgg

SEQ ID NO: 369845 - DNA, 25 bp, Mus musculus
ctaggtgcccctgcaagggctttgg

SEQ ID NO: 369846 - DNA, 25 bp, Mus musculus
ctaggtgcccgaagaacgtcatgat

SEQ ID NO: 369847 - DNA, 25 bp, Mus musculus
ctaggtgcccgatgaacgtcatgat

SEQ ID NO: 369848 - DNA, 25 bp, Mus musculus
ctaggtgcgggtctgcgtgaggacc

SEQ ID NO: 369849 - DNA, 25 bp, Mus musculus
ctaggtgcgggtgtgcgtgaggacc

SEQ ID NO: 369850 - DNA, 25 bp, Mus musculus
ctaggtgctaatctgaatccgattc

SEQ ID NO: 369851 - DNA, 25 bp, Mus musculus
ctaggtgctaatgtgaatccgattc

SEQ ID NO: 369852 - DNA, 25 bp, Mus musculus
ctaggtgctccaaggtgggccagct

SEQ ID NO: 369853 - DNA, 25 bp, Mus musculus
ctaggtgctccatggtgggccagct

SEQ ID NO: 369854 - DNA, 25 bp, Mus musculus
ctaggtgctgcacagacttgtcaag

SEQ ID NO: 369855 - DNA, 25 bp, Mus musculus
ctaggtgctgcagagacttgtcaag

SEQ ID NO: 369856 - DNA, 25 bp, Mus musculus
ctaggtgctgtcaggcttacaagcc

SEQ ID NO: 369857 - DNA, 25 bp, Mus musculus
ctaggtgctgtctggcttacaagcc

SEQ ID NO: 369858 - DNA, 25 bp, Mus musculus
ctaggtgcttcccttgaaaacaaag

SEQ ID NO: 369859 - DNA, 25 bp, Mus musculus
ctaggtgcttccgttgaaaacaaag

SEQ ID NO: 369860 - DNA, 25 bp, Mus musculus
ctaggtgtcctccagtcaatgaacg

SEQ ID NO: 369861 - DNA, 25 bp, Mus musculus
ctaggtgtcctcgagtcaatgaacg

SEQ ID NO: 369862 - DNA, 25 bp, Mus musculus
ctaggtgttcctaaagctttatctt

SEQ ID NO: 369863 - DNA, 25 bp, Mus musculus
ctaggtgttccttaagctttatctt

SEQ ID NO: 369864 - DNA, 25 bp, Mus musculus
ctaggtgtttagctgctctgtgttc

SEQ ID NO: 369865 - DNA, 25 bp, Mus musculus
ctaggtgtttaggtgctctgtgttc

SEQ ID NO: 369866 - DNA, 25 bp, Mus musculus
ctaggtgtttataggtatattgcag

SEQ ID NO: 369867 - DNA, 25 bp, Mus musculus
ctaggtgtttattggtatattgcag

SEQ ID NO: 369868 - DNA, 25 bp, Mus musculus
ctaggttagccgactctggagataa

SEQ ID NO: 369869 - DNA, 25 bp, Mus musculus
ctaggttagccgtctctggagataa

SEQ ID NO: 369870 - DNA, 25 bp, Mus musculus
ctaggttatagaaaggcaggttctt

SEQ ID NO: 369871 - DNA, 25 bp, Mus musculus
ctaggttatagataggcaggttctt

SEQ ID NO: 369872 - DNA, 25 bp, Mus musculus
ctaggttccactaatcctttctgtt

SEQ ID NO: 369873 - DNA, 25 bp, Mus musculus
ctaggttccacttatcctttctgtt

SEQ ID NO: 369874 - DNA, 25 bp, Mus musculus
ctaggttcccatagctttatacatt

SEQ ID NO: 369875 - DNA, 25 bp, Mus musculus
ctaggttcccattgctttatacatt

SEQ ID NO: 369876 - DNA, 25 bp, Mus musculus
ctaggttcctataaccagaacgatt

SEQ ID NO: 369877 - DNA, 25 bp, Mus musculus
ctaggttcctattaccagaacgatt

SEQ ID NO: 369878 - DNA, 25 bp, Mus musculus
ctaggttctcacaggcaaatgggta

SEQ ID NO: 369879 - DNA, 25 bp, Mus musculus
ctaggttctcactggcaaatgggta

SEQ ID NO: 369880 - DNA, 25 bp, Mus musculus
ctaggttctgctctttgaattcctg

SEQ ID NO: 369881 - DNA, 25 bp, Mus musculus
ctaggttctgctgtttgaattcctg

SEQ ID NO: 369882 - DNA, 25 bp, Mus musculus
ctaggttggaacaaggtggcagaaa

SEQ ID NO: 369883 - DNA, 25 bp, Mus musculus
ctaggttggaactaggtggcagaaa

SEQ ID NO: 369884 - DNA, 25 bp, Mus musculus
ctaggttggcttaggccatttcttg

SEQ ID NO: 369885 - DNA, 25 bp, Mus musculus
ctaggttggctttggccatttcttg

SEQ ID NO: 369886 - DNA, 25 bp, Mus musculus
ctaggttgtcttatcttgcttgagc

SEQ ID NO: 369887 - DNA, 25 bp, Mus musculus
ctaggttgtcttttcttgcttgagc

SEQ ID NO: 369888 - DNA, 25 bp, Mus musculus
ctaggtttatatcctcagcaaggag

SEQ ID NO: 369889 - DNA, 25 bp, Mus musculus
ctaggtttatatgctcagcaaggag

SEQ ID NO: 369890 - DNA, 25 bp, Mus musculus
ctaggtttcagacccacttgatgtc

SEQ ID NO: 369891 - DNA, 25 bp, Mus musculus
ctaggtttcagagccacttgatgtc

SEQ ID NO: 369892 - DNA, 25 bp, Mus musculus
ctaggtttgcagaagcccctctgaa

SEQ ID NO: 369893 - DNA, 25 bp, Mus musculus
ctaggtttgcagtagcccctctgaa

SEQ ID NO: 369894 - DNA, 25 bp, Mus musculus
ctaggtttgccaccttgttgcaaaa

SEQ ID NO: 369895 - DNA, 25 bp, Mus musculus
ctaggtttgccagcttgttgcaaaa

SEQ ID NO: 369896 - DNA, 25 bp, Mus musculus
ctaggttttatcacttatcaaatct

SEQ ID NO: 369897 - DNA, 25 bp, Mus musculus
ctaggttttatctcttatcaaatct

SEQ ID NO: 369898 - DNA, 25 bp, Mus musculus
ctaggtttttctcgtatgcttacaa

SEQ ID NO: 369899 - DNA, 25 bp, Mus musculus
ctaggtttttctggtatgcttacaa

SEQ ID NO: 369900 - DNA, 25 bp, Mus musculus
ctagtaaccagacggtgactaacca

SEQ ID NO: 369901 - DNA, 25 bp, Mus musculus
ctagtaaccagagggtgactaacca

SEQ ID NO: 369902 - DNA, 25 bp, Mus musculus
ctagtaacttggattatcatgatcc

SEQ ID NO: 369903 - DNA, 25 bp, Mus musculus
ctagtaacttggtttatcatgatcc

SEQ ID NO: 369904 - DNA, 25 bp, Mus musculus
ctagtaatgtacaagggcccctcct

SEQ ID NO: 369905 - DNA, 25 bp, Mus musculus
ctagtaatgtactagggcccctcct

SEQ ID NO: 369906 - DNA, 25 bp, Mus musculus
ctagtaattatgctgccgcaggtag

SEQ ID NO: 369907 - DNA, 25 bp, Mus musculus
ctagtaattatggtgccgcaggtag

SEQ ID NO: 369908 - DNA, 25 bp, Mus musculus
ctagtaatttacattggctcagaaa

SEQ ID NO: 369909 - DNA, 25 bp, Mus musculus
ctagtaatttactttggctcagaaa

SEQ ID NO: 369910 - DNA, 25 bp, Mus musculus
ctagtacacaaaagatttccaaagt

SEQ ID NO: 369911 - DNA, 25 bp, Mus musculus
ctagtacacaaatgatttccaaagt

SEQ ID NO: 369912 - DNA, 25 bp, Mus musculus
ctagtacagtgtcccagcaagtcaa

SEQ ID NO: 369913 - DNA, 25 bp, Mus musculus
ctagtacagtgtgccagcaagtcaa

SEQ ID NO: 369914 - DNA, 25 bp, Mus musculus
ctagtaccttagaaagagctgttta

SEQ ID NO: 369915 - DNA, 25 bp, Mus musculus
ctagtaccttagtaagagctgttta

SEQ ID NO: 369916 - DNA, 25 bp, Mus musculus
ctagtagaagggagttgtgcgaaaa

SEQ ID NO: 369917 - DNA, 25 bp, Mus musculus
ctagtagaagggtgttgtgcgaaaa

SEQ ID NO: 369918 - DNA, 25 bp, Mus musculus
ctagtagcactactgtagggttcct

SEQ ID NO: 369919 - DNA, 25 bp, Mus musculus
ctagtagcactagtgtagggttcct

SEQ ID NO: 369920 - DNA, 25 bp, Mus musculus
ctagtagctggacagacacttccca

SEQ ID NO: 369921 - DNA, 25 bp, Mus musculus
ctagtagctggagagacacttccca

SEQ ID NO: 369922 - DNA, 25 bp, Mus musculus
ctagtagctgggattgggagatatt

SEQ ID NO: 369923 - DNA, 25 bp, Mus musculus
ctagtagctgggtttgggagatatt

SEQ ID NO: 369924 - DNA, 25 bp, Mus musculus
ctagtaggcaatatgctttgcattt

SEQ ID NO: 369925 - DNA, 25 bp, Mus musculus
ctagtaggcaatttgctttgcattt

SEQ ID NO: 369926 - DNA, 25 bp, Mus musculus
ctagtaggcggacccaccttgctgc

SEQ ID NO: 369927 - DNA, 25 bp, Mus musculus
ctagtaggcggagccaccttgctgc

SEQ ID NO: 369928 - DNA, 25 bp, Mus musculus
ctagtagtatgccaggatcctctcc

SEQ ID NO: 369929 - DNA, 25 bp, Mus musculus
ctagtagtatgcgaggatcctctcc

SEQ ID NO: 369930 - DNA, 25 bp, Mus musculus
ctagtagtctaccattaatatcctt

SEQ ID NO: 369931 - DNA, 25 bp, Mus musculus
ctagtagtctacgattaatatcctt

SEQ ID NO: 369932 - DNA, 25 bp, Mus musculus
ctagtagtgacacgatcccatcagg

SEQ ID NO: 369933 - DNA, 25 bp, Mus musculus
ctagtagtgacaggatcccatcagg

SEQ ID NO: 369934 - DNA, 25 bp, Mus musculus
ctagtataatacagtgtgctcacat

SEQ ID NO: 369935 - DNA, 25 bp, Mus musculus
ctagtataatactgtgtgctcacat

SEQ ID NO: 369936 - DNA, 25 bp, Mus musculus
ctagtatactacacatttcccattc

SEQ ID NO: 369937 - DNA, 25 bp, Mus musculus
ctagtatactactcatttcccattc

SEQ ID NO: 369938 - DNA, 25 bp, Mus musculus
ctagtatctaaaccttgaccaggag

SEQ ID NO: 369939 - DNA, 25 bp, Mus musculus
ctagtatctaaagcttgaccaggag

SEQ ID NO: 369940 - DNA, 25 bp, Mus musculus
ctagtatctcaactggaaggccagc

SEQ ID NO: 369941 - DNA, 25 bp, Mus musculus
ctagtatctcaagtggaaggccagc

SEQ ID NO: 369942 - DNA, 25 bp, Mus musculus
ctagtatctcacacctctaatcgaa

SEQ ID NO: 369943 - DNA, 25 bp, Mus musculus
ctagtatctcactcctctaatcgaa

SEQ ID NO: 369944 - DNA, 25 bp, Mus musculus
ctagtatgaaacaaccctgggtttg

SEQ ID NO: 369945 - DNA, 25 bp, Mus musculus
ctagtatgaaactaccctgggtttg

SEQ ID NO: 369946 - DNA, 25 bp, Mus musculus
ctagtatggcagacatttcttaatg

SEQ ID NO: 369947 - DNA, 25 bp, Mus musculus
ctagtatggcagtcatttcttaatg

SEQ ID NO: 369948 - DNA, 25 bp, Mus musculus
ctagtatgtcagattttcagagttc

SEQ ID NO: 369949 - DNA, 25 bp, Mus musculus
ctagtatgtcagtttttcagagttc

SEQ ID NO: 369950 - DNA, 25 bp, Mus musculus
ctagtattcacactgttcggccaca

SEQ ID NO: 369951 - DNA, 25 bp, Mus musculus
ctagtattcacagtgttcggccaca

SEQ ID NO: 369952 - DNA, 25 bp, Mus musculus
ctagtattccatcttccagactggg

SEQ ID NO: 369953 - DNA, 25 bp, Mus musculus
ctagtattccatgttccagactggg

SEQ ID NO: 369954 - DNA, 25 bp, Mus musculus
ctagtattgctaatgttttgaagta

SEQ ID NO: 369955 - DNA, 25 bp, Mus musculus
ctagtattgctattgttttgaagta

SEQ ID NO: 369956 - DNA, 25 bp, Mus musculus
ctagtatttctcaggacctccttaa

SEQ ID NO: 369957 - DNA, 25 bp, Mus musculus
ctagtatttctctggacctccttaa

SEQ ID NO: 369958 - DNA, 25 bp, Mus musculus
ctagtcaacctaccattcagtcagc

SEQ ID NO: 369959 - DNA, 25 bp, Mus musculus
ctagtcaacctagcattcagtcagc

SEQ ID NO: 369960 - DNA, 25 bp, Mus musculus
ctagtcaactgactcctgccaagat

SEQ ID NO: 369961 - DNA, 25 bp, Mus musculus
ctagtcaactgagtcctgccaagat

SEQ ID NO: 369962 - DNA, 25 bp, Mus musculus
ctagtcaagtgtacgggacaccacc

SEQ ID NO: 369963 - DNA, 25 bp, Mus musculus
ctagtcaagtgttcgggacaccacc

SEQ ID NO: 369964 - DNA, 25 bp, Mus musculus
ctagtcacagttccttgggcttaat

SEQ ID NO: 369965 - DNA, 25 bp, Mus musculus
ctagtcacagttgcttgggcttaat

SEQ ID NO: 369966 - DNA, 25 bp, Mus musculus
ctagtcacattactgttagatatca

SEQ ID NO: 369967 - DNA, 25 bp, Mus musculus
ctagtcacattagtgttagatatca

SEQ ID NO: 369968 - DNA, 25 bp, Mus musculus
ctagtcagcctgctgggtatcgagt

SEQ ID NO: 369969 - DNA, 25 bp, Mus musculus
ctagtcagcctggtgggtatcgagt

SEQ ID NO: 369970 - DNA, 25 bp, Mus musculus
ctagtcagcgttcccactgtgggca

SEQ ID NO: 369971 - DNA, 25 bp, Mus musculus
ctagtcagcgttgccactgtgggca

SEQ ID NO: 369972 - DNA, 25 bp, Mus musculus
ctagtcagggcaagatttatttaat

SEQ ID NO: 369973 - DNA, 25 bp, Mus musculus
ctagtcagggcatgatttatttaat

SEQ ID NO: 369974 - DNA, 25 bp, Mus musculus
ctagtcatacggcagcaactgctat

SEQ ID NO: 369975 - DNA, 25 bp, Mus musculus
ctagtcatacgggagcaactgctat

SEQ ID NO: 369976 - DNA, 25 bp, Mus musculus
ctagtcatcacacggctccactgaa

SEQ ID NO: 369977 - DNA, 25 bp, Mus musculus
ctagtcatcacagggctccactgaa

SEQ ID NO: 369978 - DNA, 25 bp, Mus musculus
ctagtcatctctcggtcagtaggtc

SEQ ID NO: 369979 - DNA, 25 bp, Mus musculus
ctagtcatctctgggtcagtaggtc

SEQ ID NO: 369980 - DNA, 25 bp, Mus musculus
ctagtcattagtctacaggttccaa

SEQ ID NO: 369981 - DNA, 25 bp, Mus musculus
ctagtcattagtgtacaggttccaa

SEQ ID NO: 369982 - DNA, 25 bp, Mus musculus
ctagtccaagacaagtgcccagtga

SEQ ID NO: 369983 - DNA, 25 bp, Mus musculus
ctagtccaagactagtgcccagtga

SEQ ID NO: 369984 - DNA, 25 bp, Mus musculus
ctagtccacagacggtcccaggata

SEQ ID NO: 369985 - DNA, 25 bp, Mus musculus
ctagtccacagagggtcccaggata

SEQ ID NO: 369986 - DNA, 25 bp, Mus musculus
ctagtccacggaattcagaatgagg

SEQ ID NO: 369987 - DNA, 25 bp, Mus musculus
ctagtccacggatttcagaatgagg

SEQ ID NO: 369988 - DNA, 25 bp, Mus musculus
ctagtccaggccattcagtatacag

SEQ ID NO: 369989 - DNA, 25 bp, Mus musculus
ctagtccaggcctttcagtatacag

SEQ ID NO: 369990 - DNA, 25 bp, Mus musculus
ctagtcccacgccattcaaacataa

SEQ ID NO: 369991 - DNA, 25 bp, Mus musculus
ctagtcccacgcgattcaaacataa

SEQ ID NO: 369992 - DNA, 25 bp, Mus musculus
ctagtccccaatagggtctcccagg

SEQ ID NO: 369993 - DNA, 25 bp, Mus musculus
ctagtccccaattgggtctcccagg

SEQ ID NO: 369994 - DNA, 25 bp, Mus musculus
ctagtccccagcatggtttgcttta

SEQ ID NO: 369995 - DNA, 25 bp, Mus musculus
ctagtccccagcttggtttgcttta

SEQ ID NO: 369996 - DNA, 25 bp, Mus musculus
ctagtccccaggctacagggaacat

SEQ ID NO: 369997 - DNA, 25 bp, Mus musculus
ctagtccccagggtacagggaacat

SEQ ID NO: 369998 - DNA, 25 bp, Mus musculus
ctagtccggcatctctctgtgacag

SEQ ID NO: 369999 - DNA, 25 bp, Mus musculus
ctagtccggcatgtctctgtgacag

SEQ ID NO: 370000 - DNA, 25 bp, Mus musculus
ctagtcgccagcattgtgtgtctgc

SEQ ID NO: 370001 - DNA, 25 bp, Mus musculus
ctagtcgccagctttgtgtgtctgc

SEQ ID NO: 370002 - DNA, 25 bp, Mus musculus
ctagtcgttgttctgaattctgtca

SEQ ID NO: 370003 - DNA, 25 bp, Mus musculus
ctagtcgttgttgtgaattctgtca

SEQ ID NO: 370004 - DNA, 25 bp, Mus musculus
ctagtctatagacttggatcccaga

SEQ ID NO: 370005 - DNA, 25 bp, Mus musculus
ctagtctatagagttggatcccaga

SEQ ID NO: 370006 - DNA, 25 bp, Mus musculus
ctagtctccttcagggtggactcaa

SEQ ID NO: 370007 - DNA, 25 bp, Mus musculus
ctagtctccttctgggtggactcaa

SEQ ID NO: 370008 - DNA, 25 bp, Mus musculus
ctagtctctctgagagatcaccaca

SEQ ID NO: 370009 - DNA, 25 bp, Mus musculus
ctagtctctctgtgagatcaccaca

SEQ ID NO: 370010 - DNA, 25 bp, Mus musculus
ctagtctctgaaccctttaaccaaa

SEQ ID NO: 370011 - DNA, 25 bp, Mus musculus
ctagtctctgaagcctttaaccaaa

SEQ ID NO: 370012 - DNA, 25 bp, Mus musculus
ctagtctgagtaaagcttaatggca

SEQ ID NO: 370013 - DNA, 25 bp, Mus musculus
ctagtctgagtatagcttaatggca

SEQ ID NO: 370014 - DNA, 25 bp, Mus musculus
ctagtctgcctacccgatcgatgag

SEQ ID NO: 370015 - DNA, 25 bp, Mus musculus
ctagtctgcctagccgatcgatgag

SEQ ID NO: 370016 - DNA, 25 bp, Mus musculus
ctagtctggtccctgatgggttaag

SEQ ID NO: 370017 - DNA, 25 bp, Mus musculus
ctagtctggtccgtgatgggttaag

SEQ ID NO: 370018 - DNA, 25 bp, Mus musculus
ctagtctgttttcccaattaacttg

SEQ ID NO: 370019 - DNA, 25 bp, Mus musculus
ctagtctgttttgccaattaacttg

SEQ ID NO: 370020 - DNA, 25 bp, Mus musculus
ctagtcttagcaaaatcttgttgtg

SEQ ID NO: 370021 - DNA, 25 bp, Mus musculus
ctagtcttagcataatcttgttgtg

SEQ ID NO: 370022 - DNA, 25 bp, Mus musculus
ctagtcttgttgacagaggcatctg

SEQ ID NO: 370023 - DNA, 25 bp, Mus musculus
ctagtcttgttgtcagaggcatctg

SEQ ID NO: 370024 - DNA, 25 bp, Mus musculus
ctagtctttactagtgtctgctctg

SEQ ID NO: 370025 - DNA, 25 bp, Mus musculus
ctagtctttactagttagatggaag

SEQ ID NO: 370026 - DNA, 25 bp, Mus musculus
ctagtctttacttgtgtctgctctg

SEQ ID NO: 370027 - DNA, 25 bp, Mus musculus
ctagtctttacttgttagatggaag

SEQ ID NO: 370028 - DNA, 25 bp, Mus musculus
ctagtcttttgcatcttgctgtttt

SEQ ID NO: 370029 - DNA, 25 bp, Mus musculus
ctagtcttttgcttcttgctgtttt

SEQ ID NO: 370030 - DNA, 25 bp, Mus musculus
ctagtgaaacttcgattctttcctg

SEQ ID NO: 370031 - DNA, 25 bp, Mus musculus
ctagtgaaacttggattctttcctg

SEQ ID NO: 370032 - DNA, 25 bp, Mus musculus
ctagtgaaccgtagcagcatgcgaa

SEQ ID NO: 370033 - DNA, 25 bp, Mus musculus
ctagtgaaccgttgcagcatgcgaa

SEQ ID NO: 370034 - DNA, 25 bp, Mus musculus
ctagtgacaatcaactctcctggta

SEQ ID NO: 370035 - DNA, 25 bp, Mus musculus
ctagtgacaatctactctcctggta

SEQ ID NO: 370036 - DNA, 25 bp, Mus musculus
ctagtgacaggcactgtgagacagg

SEQ ID NO: 370037 - DNA, 25 bp, Mus musculus
ctagtgacaggctctgtgagacagg

SEQ ID NO: 370038 - DNA, 25 bp, Mus musculus
ctagtgactcagctgggcttggtca

SEQ ID NO: 370039 - DNA, 25 bp, Mus musculus
ctagtgactcaggtgggcttggtca

SEQ ID NO: 370040 - DNA, 25 bp, Mus musculus
ctagtgactctcaagcttgcagaga

SEQ ID NO: 370041 - DNA, 25 bp, Mus musculus
ctagtgactctctagcttgcagaga

SEQ ID NO: 370042 - DNA, 25 bp, Mus musculus
ctagtgatgatgctgtgctctgcca

SEQ ID NO: 370043 - DNA, 25 bp, Mus musculus
ctagtgatgatgcttgttgggtttt

SEQ ID NO: 370044 - DNA, 25 bp, Mus musculus
ctagtgatgatggtgtgctctgcca

SEQ ID NO: 370045 - DNA, 25 bp, Mus musculus
ctagtgatgatggttgttgggtttt

SEQ ID NO: 370046 - DNA, 25 bp, Mus musculus
ctagtgatgcctcgccccttgttat

SEQ ID NO: 370047 - DNA, 25 bp, Mus musculus
ctagtgatgcctggccccttgttat

SEQ ID NO: 370048 - DNA, 25 bp, Mus musculus
ctagtgattttaaacgcggccagcg

SEQ ID NO: 370049 - DNA, 25 bp, Mus musculus
ctagtgattttatacgcggccagcg

SEQ ID NO: 370050 - DNA, 25 bp, Mus musculus
ctagtgcagcgtcctttaaggtggc

SEQ ID NO: 370051 - DNA, 25 bp, Mus musculus
ctagtgcagcgtgctttaaggtggc

SEQ ID NO: 370052 - DNA, 25 bp, Mus musculus
ctagtgccaattatgtctttccttc

SEQ ID NO: 370053 - DNA, 25 bp, Mus musculus
ctagtgccaattttgtctttccttc

SEQ ID NO: 370054 - DNA, 25 bp, Mus musculus
ctagtgcccatgatgtatggctcac

SEQ ID NO: 370055 - DNA, 25 bp, Mus musculus
ctagtgcccatgctgagatctcagc

SEQ ID NO: 370056 - DNA, 25 bp, Mus musculus
ctagtgcccatggtgagatctcagc

SEQ ID NO: 370057 - DNA, 25 bp, Mus musculus
ctagtgcccatgttgtatggctcac

SEQ ID NO: 370058 - DNA, 25 bp, Mus musculus
ctagtgcggtgcagtgagaagtatc

SEQ ID NO: 370059 - DNA, 25 bp, Mus musculus
ctagtgcggtgctgtgagaagtatc

SEQ ID NO: 370060 - DNA, 25 bp, Mus musculus
ctagtgctagtgacgtgtgggcctt

SEQ ID NO: 370061 - DNA, 25 bp, Mus musculus
ctagtgctagtgtcgtgtgggcctt

SEQ ID NO: 370062 - DNA, 25 bp, Mus musculus
ctagtgctgaagcttattaatgcta

SEQ ID NO: 370063 - DNA, 25 bp, Mus musculus
ctagtgctgaaggttattaatgcta

SEQ ID NO: 370064 - DNA, 25 bp, Mus musculus
ctagtgctgctgagtcttcctggac

SEQ ID NO: 370065 - DNA, 25 bp, Mus musculus
ctagtgctgctgcaagggccttgtt

SEQ ID NO: 370066 - DNA, 25 bp, Mus musculus
ctagtgctgctggaagggccttgtt

SEQ ID NO: 370067 - DNA, 25 bp, Mus musculus
ctagtgctgctgtgtcttcctggac

SEQ ID NO: 370068 - DNA, 25 bp, Mus musculus
ctagtgctggatccctgaggttatc

SEQ ID NO: 370069 - DNA, 25 bp, Mus musculus
ctagtgctggatgcctgaggttatc

SEQ ID NO: 370070 - DNA, 25 bp, Mus musculus
ctagtgctggtccattggatggtca

SEQ ID NO: 370071 - DNA, 25 bp, Mus musculus
ctagtgctggtcgattggatggtca

SEQ ID NO: 370072 - DNA, 25 bp, Mus musculus
ctagtgcttcaccacctggaaaatg

SEQ ID NO: 370073 - DNA, 25 bp, Mus musculus
ctagtgcttcacgacctggaaaatg

SEQ ID NO: 370074 - DNA, 25 bp, Mus musculus
ctagtggagtgtcaaagccttgtta

SEQ ID NO: 370075 - DNA, 25 bp, Mus musculus
ctagtggagtgtgaaagccttgtta

SEQ ID NO: 370076 - DNA, 25 bp, Mus musculus
ctagtggcaccacttgttcttacaa

SEQ ID NO: 370077 - DNA, 25 bp, Mus musculus
ctagtggcaccagttgttcttacaa

SEQ ID NO: 370078 - DNA, 25 bp, Mus musculus
ctagtggctcatcgtgctttcaata

SEQ ID NO: 370079 - DNA, 25 bp, Mus musculus
ctagtggctcatggtgctttcaata

SEQ ID NO: 370080 - DNA, 25 bp, Mus musculus
ctagtgggaaacaagctttgcttaa

SEQ ID NO: 370081 - DNA, 25 bp, Mus musculus
ctagtgggaaactagctttgcttaa

SEQ ID NO: 370082 - DNA, 25 bp, Mus musculus
ctagtgggatcacgcaccgagccga

SEQ ID NO: 370083 - DNA, 25 bp, Mus musculus
ctagtgggatcaggcaccgagccga

SEQ ID NO: 370084 - DNA, 25 bp, Mus musculus
ctagtgggtactactcagctgttgt

SEQ ID NO: 370085 - DNA, 25 bp, Mus musculus
ctagtgggtacttctcagctgttgt

SEQ ID NO: 370086 - DNA, 25 bp, Mus musculus
ctagtggtcactcaagtggccacca

SEQ ID NO: 370087 - DNA, 25 bp, Mus musculus
ctagtggtcactgaagtggccacca

SEQ ID NO: 370088 - DNA, 25 bp, Mus musculus
ctagtggtctagctcgggccatgaa

SEQ ID NO: 370089 - DNA, 25 bp, Mus musculus
ctagtggtctaggtcgggccatgaa

SEQ ID NO: 370090 - DNA, 25 bp, Mus musculus
ctagtggttagaatgaaaatgcccc

SEQ ID NO: 370091 - DNA, 25 bp, Mus musculus
ctagtggttagattgaaaatgcccc

SEQ ID NO: 370092 - DNA, 25 bp, Mus musculus
ctagtggtttttactgtgtcatgcc

SEQ ID NO: 370093 - DNA, 25 bp, Mus musculus
ctagtggttttttctgtgtcatgcc

SEQ ID NO: 370094 - DNA, 25 bp, Mus musculus
ctagtgtacaatcagtaaacagcct

SEQ ID NO: 370095 - DNA, 25 bp, Mus musculus
ctagtgtacaatgagtaaacagcct

SEQ ID NO: 370096 - DNA, 25 bp, Mus musculus
ctagtgtctcctcgtccaagggatg

SEQ ID NO: 370097 - DNA, 25 bp, Mus musculus
ctagtgtctcctggtccaagggatg

SEQ ID NO: 370098 - DNA, 25 bp, Mus musculus
ctagtgtgctgtccctcatgtgaac

SEQ ID NO: 370099 - DNA, 25 bp, Mus musculus
ctagtgtgctgtgcctcatgtgaac

SEQ ID NO: 370100 - DNA, 25 bp, Mus musculus
ctagtgtggcctatgggacagctgc

SEQ ID NO: 370101 - DNA, 25 bp, Mus musculus
ctagtgtggcctttgggacagctgc

SEQ ID NO: 370102 - DNA, 25 bp, Mus musculus
ctagtgtgtgaaagaccttgggtcc

SEQ ID NO: 370103 - DNA, 25 bp, Mus musculus
ctagtgtgtgaatgaccttgggtcc

SEQ ID NO: 370104 - DNA, 25 bp, Mus musculus
ctagtgtgttagaggtgttgttgct

SEQ ID NO: 370105 - DNA, 25 bp, Mus musculus
ctagtgtgttagtggtgttgttgct

SEQ ID NO: 370106 - DNA, 25 bp, Mus musculus
ctagtgttagctagtggctgctgga

SEQ ID NO: 370107 - DNA, 25 bp, Mus musculus
ctagtgttagcttgtggctgctgga

SEQ ID NO: 370108 - DNA, 25 bp, Mus musculus
ctagtgttcacacaactagtgttct

SEQ ID NO: 370109 - DNA, 25 bp, Mus musculus
ctagtgttcacagaactagtgttct

SEQ ID NO: 370110 - DNA, 25 bp, Mus musculus
ctagtgttctttatggtgtccctct

SEQ ID NO: 370111 - DNA, 25 bp, Mus musculus
ctagtgttctttttggtgtccctct

SEQ ID NO: 370112 - DNA, 25 bp, Mus musculus
ctagtgtttttgattgccaggctcg

SEQ ID NO: 370113 - DNA, 25 bp, Mus musculus
ctagtgtttttgtttgccaggctcg

SEQ ID NO: 370114 - DNA, 25 bp, Mus musculus
ctagttaaatcccacgttcatacct

SEQ ID NO: 370115 - DNA, 25 bp, Mus musculus
ctagttaaatccgacgttcatacct

SEQ ID NO: 370116 - DNA, 25 bp, Mus musculus
ctagttaaggtgagcgttcagcctt

SEQ ID NO: 370117 - DNA, 25 bp, Mus musculus
ctagttaaggtgtgcgttcagcctt

SEQ ID NO: 370118 - DNA, 25 bp, Mus musculus
ctagttactactatattcctggcaa

SEQ ID NO: 370119 - DNA, 25 bp, Mus musculus
ctagttactactttattcctggcaa

SEQ ID NO: 370120 - DNA, 25 bp, Mus musculus
ctagttactggcatatgtgtgtgtt

SEQ ID NO: 370121 - DNA, 25 bp, Mus musculus
ctagttactggcttatgtgtgtgtt

SEQ ID NO: 370122 - DNA, 25 bp, Mus musculus
ctagttacttatctggcagcggata

SEQ ID NO: 370123 - DNA, 25 bp, Mus musculus
ctagttacttatgtggcagcggata

SEQ ID NO: 370124 - DNA, 25 bp, Mus musculus
ctagttatgttaacttaccatctga

SEQ ID NO: 370125 - DNA, 25 bp, Mus musculus
ctagttatgttatcttaccatctga

SEQ ID NO: 370126 - DNA, 25 bp, Mus musculus
ctagttcagactcgcaagcaatcca

SEQ ID NO: 370127 - DNA, 25 bp, Mus musculus
ctagttcagactggcaagcaatcca

SEQ ID NO: 370128 - DNA, 25 bp, Mus musculus
ctagttcagccacagttgccaggga

SEQ ID NO: 370129 - DNA, 25 bp, Mus musculus
ctagttcagccagagttgccaggga

SEQ ID NO: 370130 - DNA, 25 bp, Mus musculus
ctagttcagtgaagggtaacaccca

SEQ ID NO: 370131 - DNA, 25 bp, Mus musculus
ctagttcagtgatgggtaacaccca

SEQ ID NO: 370132 - DNA, 25 bp, Mus musculus
ctagttcatagcatccattgtccca

SEQ ID NO: 370133 - DNA, 25 bp, Mus musculus
ctagttcatagcttccattgtccca

SEQ ID NO: 370134 - DNA, 25 bp, Mus musculus
ctagttcgcacacatgctctgcagg

SEQ ID NO: 370135 - DNA, 25 bp, Mus musculus
ctagttcgcacagatgctctgcagg

SEQ ID NO: 370136 - DNA, 25 bp, Mus musculus
ctagttctgcccacgaggataatat

SEQ ID NO: 370137 - DNA, 25 bp, Mus musculus
ctagttctgccctcgaggataatat

SEQ ID NO: 370138 - DNA, 25 bp, Mus musculus
ctagttcttaggctgcagtcttaaa

SEQ ID NO: 370139 - DNA, 25 bp, Mus musculus
ctagttcttagggtgcagtcttaaa

SEQ ID NO: 370140 - DNA, 25 bp, Mus musculus
ctagttgacgaccaatagccccagt

SEQ ID NO: 370141 - DNA, 25 bp, Mus musculus
ctagttgacgacgaatagccccagt

SEQ ID NO: 370142 - DNA, 25 bp, Mus musculus
ctagttgagtcaatgctattctgca

SEQ ID NO: 370143 - DNA, 25 bp, Mus musculus
ctagttgagtcattgctattctgca

SEQ ID NO: 370144 - DNA, 25 bp, Mus musculus
ctagttgccaatctactgtcctttt

SEQ ID NO: 370145 - DNA, 25 bp, Mus musculus
ctagttgccaatgtactgtcctttt

SEQ ID NO: 370146 - DNA, 25 bp, Mus musculus
ctagttgcccaactattggcacaga

SEQ ID NO: 370147 - DNA, 25 bp, Mus musculus
ctagttgcccaagtattggcacaga

SEQ ID NO: 370148 - DNA, 25 bp, Mus musculus
ctagttggacatatggcctggctca

SEQ ID NO: 370149 - DNA, 25 bp, Mus musculus
ctagttggacatttggcctggctca

SEQ ID NO: 370150 - DNA, 25 bp, Mus musculus
ctagttggtaggatgaaggcttctt

SEQ ID NO: 370151 - DNA, 25 bp, Mus musculus
ctagttggtaggttgaaggcttctt

SEQ ID NO: 370152 - DNA, 25 bp, Mus musculus
ctagttggtgagaaacctgtttctt

SEQ ID NO: 370153 - DNA, 25 bp, Mus musculus
ctagttggtgagtaacctgtttctt

SEQ ID NO: 370154 - DNA, 25 bp, Mus musculus
ctagttggtttgagataatccccta

SEQ ID NO: 370155 - DNA, 25 bp, Mus musculus
ctagttggtttgtgataatccccta

SEQ ID NO: 370156 - DNA, 25 bp, Mus musculus
ctagttgtgaacaggcttcgccgtt

SEQ ID NO: 370157 - DNA, 25 bp, Mus musculus
ctagttgtgaactggcttcgccgtt

SEQ ID NO: 370158 - DNA, 25 bp, Mus musculus
ctagttgttctaaattataaccata

SEQ ID NO: 370159 - DNA, 25 bp, Mus musculus
ctagttgttctatattataaccata

SEQ ID NO: 370160 - DNA, 25 bp, Mus musculus
ctagtttagtcgatctgtttatcaa

SEQ ID NO: 370161 - DNA, 25 bp, Mus musculus
ctagtttagtcgttctgtttatcaa

SEQ ID NO: 370162 - DNA, 25 bp, Mus musculus
ctagtttatgtgcactcttgatgaa

SEQ ID NO: 370163 - DNA, 25 bp, Mus musculus
ctagtttatgtggactcttgatgaa

SEQ ID NO: 370164 - DNA, 25 bp, Mus musculus
ctagtttattacctcactctgcctg

SEQ ID NO: 370165 - DNA, 25 bp, Mus musculus
ctagtttattacgtcactctgcctg

SEQ ID NO: 370166 - DNA, 25 bp, Mus musculus
ctagtttccacccaatgagataaaa

SEQ ID NO: 370167 - DNA, 25 bp, Mus musculus
ctagtttccaccgaatgagataaaa

SEQ ID NO: 370168 - DNA, 25 bp, Mus musculus
ctagtttccagacttctgtttgaaa

SEQ ID NO: 370169 - DNA, 25 bp, Mus musculus
ctagtttccagagttctgtttgaaa

SEQ ID NO: 370170 - DNA, 25 bp, Mus musculus
ctagtttccctacagtcagtgagta

SEQ ID NO: 370171 - DNA, 25 bp, Mus musculus
ctagtttccctagagtcagtgagta

SEQ ID NO: 370172 - DNA, 25 bp, Mus musculus
ctagtttctcccattcaagcgagga

SEQ ID NO: 370173 - DNA, 25 bp, Mus musculus
ctagtttctccctttcaagcgagga

SEQ ID NO: 370174 - DNA, 25 bp, Mus musculus
ctagtttctttgagctgaatcttaa

SEQ ID NO: 370175 - DNA, 25 bp, Mus musculus
ctagtttctttgtgctgaatcttaa

SEQ ID NO: 370176 - DNA, 25 bp, Mus musculus
ctagtttgaaggacggccttgtaga

SEQ ID NO: 370177 - DNA, 25 bp, Mus musculus
ctagtttgaaggtcggccttgtaga

SEQ ID NO: 370178 - DNA, 25 bp, Mus musculus
ctagtttgcaaacgtgagcacgctg

SEQ ID NO: 370179 - DNA, 25 bp, Mus musculus
ctagtttgcaaaggtgagcacgctg

SEQ ID NO: 370180 - DNA, 25 bp, Mus musculus
ctagtttgccacaagaacttaagtg

SEQ ID NO: 370181 - DNA, 25 bp, Mus musculus
ctagtttgccactagaacttaagtg

SEQ ID NO: 370182 - DNA, 25 bp, Mus musculus
ctagtttgctagctgagtttcattc

SEQ ID NO: 370183 - DNA, 25 bp, Mus musculus
ctagtttgctaggtgagtttcattc

SEQ ID NO: 370184 - DNA, 25 bp, Mus musculus
ctagtttgtagtccacatgtatgta

SEQ ID NO: 370185 - DNA, 25 bp, Mus musculus
ctagtttgtagtgcacatgtatgta

SEQ ID NO: 370186 - DNA, 25 bp, Mus musculus
ctagtttgtgttcgtcagtctttaa

SEQ ID NO: 370187 - DNA, 25 bp, Mus musculus
ctagtttgtgttggtcagtctttaa

SEQ ID NO: 370188 - DNA, 25 bp, Mus musculus
ctagttttcagacttttggacatga

SEQ ID NO: 370189 - DNA, 25 bp, Mus musculus
ctagttttcagagttttggacatga

SEQ ID NO: 370190 - DNA, 25 bp, Mus musculus
ctagttttctggattggtacctgaa

SEQ ID NO: 370191 - DNA, 25 bp, Mus musculus
ctagttttctggtttggtacctgaa

SEQ ID NO: 370192 - DNA, 25 bp, Mus musculus
ctagttttctgtaagtgataatgac

SEQ ID NO: 370193 - DNA, 25 bp, Mus musculus
ctagttttctgttagtgataatgac

SEQ ID NO: 370194 - DNA, 25 bp, Mus musculus
ctagttttgcccagaatgtgtgaaa

SEQ ID NO: 370195 - DNA, 25 bp, Mus musculus
ctagttttgccctgaatgtgtgaaa

SEQ ID NO: 370196 - DNA, 25 bp, Mus musculus
ctagtttttattccctgttaggcaa

SEQ ID NO: 370197 - DNA, 25 bp, Mus musculus
ctagtttttattgcctgttaggcaa

SEQ ID NO: 370198 - DNA, 25 bp, Mus musculus
ctagtttttgaaagtttctcatgat

SEQ ID NO: 370199 - DNA, 25 bp, Mus musculus
ctagtttttgaatgtttctcatgat

SEQ ID NO: 370200 - DNA, 25 bp, Mus musculus
ctataaaacagaactagccgggcag

SEQ ID NO: 370201 - DNA, 25 bp, Mus musculus
ctataaaacagatctagccgggcag

SEQ ID NO: 370202 - DNA, 25 bp, Mus musculus
ctataaaccctaagtctgaccgtgc

SEQ ID NO: 370203 - DNA, 25 bp, Mus musculus
ctataaaccctatgtctgaccgtgc

SEQ ID NO: 370204 - DNA, 25 bp, Mus musculus
ctataaagatgtagttactaaagac

SEQ ID NO: 370205 - DNA, 25 bp, Mus musculus
ctataaagatgttgttactaaagac

SEQ ID NO: 370206 - DNA, 25 bp, Mus musculus
ctataaagggtcagtattcccagtc

SEQ ID NO: 370207 - DNA, 25 bp, Mus musculus
ctataaagggtctgtattcccagtc

SEQ ID NO: 370208 - DNA, 25 bp, Mus musculus
ctataaaggtagcttcctgacttca

SEQ ID NO: 370209 - DNA, 25 bp, Mus musculus
ctataaaggtaggttcctgacttca

SEQ ID NO: 370210 - DNA, 25 bp, Mus musculus
ctataaatagttagtgtactgacat

SEQ ID NO: 370211 - DNA, 25 bp, Mus musculus
ctataaatagtttgtgtactgacat

SEQ ID NO: 370212 - DNA, 25 bp, Mus musculus
ctataacaatttacatttgcctttt

SEQ ID NO: 370213 - DNA, 25 bp, Mus musculus
ctataacaattttcatttgcctttt

SEQ ID NO: 370214 - DNA, 25 bp, Mus musculus
ctataacagcctacctgtgacttta

SEQ ID NO: 370215 - DNA, 25 bp, Mus musculus
ctataacagccttcctgtgacttta

SEQ ID NO: 370216 - DNA, 25 bp, Mus musculus
ctataacatcgtctggctgcagact

SEQ ID NO: 370217 - DNA, 25 bp, Mus musculus
ctataacatcgtgtggctgcagact

SEQ ID NO: 370218 - DNA, 25 bp, Mus musculus
ctataacccagtagcagcagacaat

SEQ ID NO: 370219 - DNA, 25 bp, Mus musculus
ctataacccagttgcagcagacaat

SEQ ID NO: 370220 - DNA, 25 bp, Mus musculus
ctataactggatattttcggcaaat

SEQ ID NO: 370221 - DNA, 25 bp, Mus musculus
ctataactggattttttcggcaaat

SEQ ID NO: 370222 - DNA, 25 bp, Mus musculus
ctataagatacgaaagcaatgccat

SEQ ID NO: 370223 - DNA, 25 bp, Mus musculus
ctataagatacgtaagcaatgccat

SEQ ID NO: 370224 - DNA, 25 bp, Mus musculus
ctataagcatgcatcctctgactga

SEQ ID NO: 370225 - DNA, 25 bp, Mus musculus
ctataagcatgcttcctctgactga

SEQ ID NO: 370226 - DNA, 25 bp, Mus musculus
ctataagttcaacgctaatctggtc

SEQ ID NO: 370227 - DNA, 25 bp, Mus musculus
ctataagttcaaggctaatctggtc

SEQ ID NO: 370228 - DNA, 25 bp, Mus musculus
ctataataacacctccactgtctga

SEQ ID NO: 370229 - DNA, 25 bp, Mus musculus
ctataataacacgtccactgtctga

SEQ ID NO: 370230 - DNA, 25 bp, Mus musculus
ctataataggctaactttgtgttct

SEQ ID NO: 370231 - DNA, 25 bp, Mus musculus
ctataataggcttactttgtgttct

SEQ ID NO: 370232 - DNA, 25 bp, Mus musculus
ctataatattgcagccttcactctg

SEQ ID NO: 370233 - DNA, 25 bp, Mus musculus
ctataatattgctgccttcactctg

SEQ ID NO: 370234 - DNA, 25 bp, Mus musculus
ctataatctcagaagtcagggaatt

SEQ ID NO: 370235 - DNA, 25 bp, Mus musculus
ctataatctcagtagtcagggaatt

SEQ ID NO: 370236 - DNA, 25 bp, Mus musculus
ctataatctctgatcctactatgat

SEQ ID NO: 370237 - DNA, 25 bp, Mus musculus
ctataatctctgttcctactatgat

SEQ ID NO: 370238 - DNA, 25 bp, Mus musculus
ctataatggcaacttgtgtgtgtgt

SEQ ID NO: 370239 - DNA, 25 bp, Mus musculus
ctataatggcaagttgtgtgtgtgt

SEQ ID NO: 370240 - DNA, 25 bp, Mus musculus
ctataatttgaaccccgtatctccg

SEQ ID NO: 370241 - DNA, 25 bp, Mus musculus
ctataatttgaagcccgtatctccg

SEQ ID NO: 370242 - DNA, 25 bp, Mus musculus
ctatacacaaccacgctttggcttt

SEQ ID NO: 370243 - DNA, 25 bp, Mus musculus
ctatacacaacctcgctttggcttt

SEQ ID NO: 370244 - DNA, 25 bp, Mus musculus
ctatacaccttcatctactctgtta

SEQ ID NO: 370245 - DNA, 25 bp, Mus musculus
ctatacaccttcttctactctgtta

SEQ ID NO: 370246 - DNA, 25 bp, Mus musculus
ctatacacgtctccgggactggcac

SEQ ID NO: 370247 - DNA, 25 bp, Mus musculus
ctatacacgtctgcgggactggcac

SEQ ID NO: 370248 - DNA, 25 bp, Mus musculus
ctatacactcctaggttgatgacct

SEQ ID NO: 370249 - DNA, 25 bp, Mus musculus
ctatacactccttggttgatgacct

SEQ ID NO: 370250 - DNA, 25 bp, Mus musculus
ctatacactgtacatattgactgcc

SEQ ID NO: 370251 - DNA, 25 bp, Mus musculus
ctatacactgtagatattgactgcc

SEQ ID NO: 370252 - DNA, 25 bp, Mus musculus
ctatacagaaaaaggtaccagtgct

SEQ ID NO: 370253 - DNA, 25 bp, Mus musculus
ctatacagaaaatggtaccagtgct

SEQ ID NO: 370254 - DNA, 25 bp, Mus musculus
ctatacagacagctttgtgcctcca

SEQ ID NO: 370255 - DNA, 25 bp, Mus musculus
ctatacagacaggtttgtgcctcca

SEQ ID NO: 370256 - DNA, 25 bp, Mus musculus
ctatacagagtaatccaaaagggac

SEQ ID NO: 370257 - DNA, 25 bp, Mus musculus
ctatacagagtattccaaaagggac

SEQ ID NO: 370258 - DNA, 25 bp, Mus musculus
ctataccacacgagatcccgcttta

SEQ ID NO: 370259 - DNA, 25 bp, Mus musculus
ctataccacacgtgatcccgcttta

SEQ ID NO: 370260 - DNA, 25 bp, Mus musculus
ctataccacgtgaccatcaggctaa

SEQ ID NO: 370261 - DNA, 25 bp, Mus musculus
ctataccacgtgtccatcaggctaa

SEQ ID NO: 370262 - DNA, 25 bp, Mus musculus
ctatacccagtaaacctgactcaaa

SEQ ID NO: 370263 - DNA, 25 bp, Mus musculus
ctatacccagtatacctgactcaaa

SEQ ID NO: 370264 - DNA, 25 bp, Mus musculus
ctatacccatatagtatgctcacaa

SEQ ID NO: 370265 - DNA, 25 bp, Mus musculus
ctatacccatattgtatgctcacaa

SEQ ID NO: 370266 - DNA, 25 bp, Mus musculus
ctatacccctatctcctaagtagat

SEQ ID NO: 370267 - DNA, 25 bp, Mus musculus
ctatacccctatgtcctaagtagat

SEQ ID NO: 370268 - DNA, 25 bp, Mus musculus
ctatacctccagctctaacataatt

SEQ ID NO: 370269 - DNA, 25 bp, Mus musculus
ctatacctccaggtctaacataatt

SEQ ID NO: 370270 - DNA, 25 bp, Mus musculus
ctatacggacccattggtgtctctg

SEQ ID NO: 370271 - DNA, 25 bp, Mus musculus
ctatacggaccctttggtgtctctg

SEQ ID NO: 370272 - DNA, 25 bp, Mus musculus
ctatactcgactatccttatggttt

SEQ ID NO: 370273 - DNA, 25 bp, Mus musculus
ctatactcgactttccttatggttt

SEQ ID NO: 370274 - DNA, 25 bp, Mus musculus
ctatactgacgcagatgtttggcca

SEQ ID NO: 370275 - DNA, 25 bp, Mus musculus
ctatactgacgctgatgtttggcca

SEQ ID NO: 370276 - DNA, 25 bp, Mus musculus
ctatactggaggcatatcatttttt

SEQ ID NO: 370277 - DNA, 25 bp, Mus musculus
ctatactggagggatatcatttttt

SEQ ID NO: 370278 - DNA, 25 bp, Mus musculus
ctatactgggccctattcagtggca

SEQ ID NO: 370279 - DNA, 25 bp, Mus musculus
ctatactgggccgtattcagtggca

SEQ ID NO: 370280 - DNA, 25 bp, Mus musculus
ctatactgtatgatggtgctttctt

SEQ ID NO: 370281 - DNA, 25 bp, Mus musculus
ctatactgtatgttggtgctttctt

SEQ ID NO: 370282 - DNA, 25 bp, Mus musculus
ctatacttctgtcgtctcatctttg

SEQ ID NO: 370283 - DNA, 25 bp, Mus musculus
ctatacttctgtggtctcatctttg

SEQ ID NO: 370284 - DNA, 25 bp, Mus musculus
ctatactttgccctgtaaccttata

SEQ ID NO: 370285 - DNA, 25 bp, Mus musculus
ctatactttgccgtgtaaccttata

SEQ ID NO: 370286 - DNA, 25 bp, Mus musculus
ctatactttgttatgcggcctgtac

SEQ ID NO: 370287 - DNA, 25 bp, Mus musculus
ctatactttgttttgcggcctgtac

SEQ ID NO: 370288 - DNA, 25 bp, Mus musculus
ctatacttttcaatggccacgcagc

SEQ ID NO: 370289 - DNA, 25 bp, Mus musculus
ctatacttttcattggccacgcagc

SEQ ID NO: 370290 - DNA, 25 bp, Mus musculus
ctatagaactgtagcactgtggaca

SEQ ID NO: 370291 - DNA, 25 bp, Mus musculus
ctatagaactgttgcactgtggaca

SEQ ID NO: 370292 - DNA, 25 bp, Mus musculus
ctatagaagaaacgcgcgctctggc

SEQ ID NO: 370293 - DNA, 25 bp, Mus musculus
ctatagaagaaaggcgcgctctggc

SEQ ID NO: 370294 - DNA, 25 bp, Mus musculus
ctatagaatattcttgtgtctggcc

SEQ ID NO: 370295 - DNA, 25 bp, Mus musculus
ctatagaatattgttgtgtctggcc

SEQ ID NO: 370296 - DNA, 25 bp, Mus musculus
ctatagaattgtactcttttgcttt

SEQ ID NO: 370297 - DNA, 25 bp, Mus musculus
ctatagaattgttctcttttgcttt

SEQ ID NO: 370298 - DNA, 25 bp, Mus musculus
ctatagacgtaaacacaaaggtgat

SEQ ID NO: 370299 - DNA, 25 bp, Mus musculus
ctatagacgtaatcacaaaggtgat

SEQ ID NO: 370300 - DNA, 25 bp, Mus musculus
ctatagactagtatggagatggaat

SEQ ID NO: 370301 - DNA, 25 bp, Mus musculus
ctatagactagtttggagatggaat

SEQ ID NO: 370302 - DNA, 25 bp, Mus musculus
ctatagagaccgatggaccagtgat

SEQ ID NO: 370303 - DNA, 25 bp, Mus musculus
ctatagagaccgttggaccagtgat

SEQ ID NO: 370304 - DNA, 25 bp, Mus musculus
ctatagagcaaaacgggcggcccaa

SEQ ID NO: 370305 - DNA, 25 bp, Mus musculus
ctatagagcaaacccctgtccatac

SEQ ID NO: 370306 - DNA, 25 bp, Mus musculus
ctatagagcaaagccctgtccatac

SEQ ID NO: 370307 - DNA, 25 bp, Mus musculus
ctatagagcaaatcgggcggcccaa

SEQ ID NO: 370308 - DNA, 25 bp, Mus musculus
ctatagaggctgagcgctgtctgct

SEQ ID NO: 370309 - DNA, 25 bp, Mus musculus
ctatagaggctgtgcgctgtctgct

SEQ ID NO: 370310 - DNA, 25 bp, Mus musculus
ctatagagtcaacttgtgctggcaa

SEQ ID NO: 370311 - DNA, 25 bp, Mus musculus
ctatagagtcaagttgtgctggcaa

SEQ ID NO: 370312 - DNA, 25 bp, Mus musculus
ctatagatcaggcaagtcttgaaca

SEQ ID NO: 370313 - DNA, 25 bp, Mus musculus
ctatagatcagggaagtcttgaaca

SEQ ID NO: 370314 - DNA, 25 bp, Mus musculus
ctatagcaacaaaaggcccctggag

SEQ ID NO: 370315 - DNA, 25 bp, Mus musculus
ctatagcaacaataggcccctggag

SEQ ID NO: 370316 - DNA, 25 bp, Mus musculus
ctatagcactttagggcatacaccc

SEQ ID NO: 370317 - DNA, 25 bp, Mus musculus
ctatagcacttttgggcatacaccc

SEQ ID NO: 370318 - DNA, 25 bp, Mus musculus
ctatagcattgacggagccgggtcc

SEQ ID NO: 370319 - DNA, 25 bp, Mus musculus
ctatagcattgagggagccgggtcc

SEQ ID NO: 370320 - DNA, 25 bp, Mus musculus
ctatagcccctaaaaatgctttaga

SEQ ID NO: 370321 - DNA, 25 bp, Mus musculus
ctatagcccctataaatgctttaga

SEQ ID NO: 370322 - DNA, 25 bp, Mus musculus
ctatagctctatagaagccgccgag

SEQ ID NO: 370323 - DNA, 25 bp, Mus musculus
ctatagctctattgaagccgccgag

SEQ ID NO: 370324 - DNA, 25 bp, Mus musculus
ctataggactttcacgccagctagt

SEQ ID NO: 370325 - DNA, 25 bp, Mus musculus
ctataggactttgacgccagctagt

SEQ ID NO: 370326 - DNA, 25 bp, Mus musculus
ctataggatcttagccattttttat

SEQ ID NO: 370327 - DNA, 25 bp, Mus musculus
ctataggatctttgccattttttat

SEQ ID NO: 370328 - DNA, 25 bp, Mus musculus
ctataggccaaaccgctgatgcaga

SEQ ID NO: 370329 - DNA, 25 bp, Mus musculus
ctataggccaaagcgctgatgcaga

SEQ ID NO: 370330 - DNA, 25 bp, Mus musculus
ctataggccgatagccccagctggg

SEQ ID NO: 370331 - DNA, 25 bp, Mus musculus
ctataggccgattgccccagctggg

SEQ ID NO: 370332 - DNA, 25 bp, Mus musculus
ctataggcctctatgtgttgcacaa

SEQ ID NO: 370333 - DNA, 25 bp, Mus musculus
ctataggcctctttgtgttgcacaa

SEQ ID NO: 370334 - DNA, 25 bp, Mus musculus
ctataggctctgctttcatgaaaaa

SEQ ID NO: 370335 - DNA, 25 bp, Mus musculus
ctataggctctggtttcatgaaaaa

SEQ ID NO: 370336 - DNA, 25 bp, Mus musculus
ctataggcttcgctgttcacaatat

SEQ ID NO: 370337 - DNA, 25 bp, Mus musculus
ctataggcttcggtgttcacaatat

SEQ ID NO: 370338 - DNA, 25 bp, Mus musculus
ctatagggttatcactgcagagcaa

SEQ ID NO: 370339 - DNA, 25 bp, Mus musculus
ctatagggttatgactgcagagcaa

SEQ ID NO: 370340 - DNA, 25 bp, Mus musculus
ctataggtctgacaggttatctgat

SEQ ID NO: 370341 - DNA, 25 bp, Mus musculus
ctataggtctgagaggttatctgat

SEQ ID NO: 370342 - DNA, 25 bp, Mus musculus
ctatagtcctttctgcatcatcttc

SEQ ID NO: 370343 - DNA, 25 bp, Mus musculus
ctatagtcctttgtgcatcatcttc

SEQ ID NO: 370344 - DNA, 25 bp, Mus musculus
ctatagtctgtgatacagcagtggt

SEQ ID NO: 370345 - DNA, 25 bp, Mus musculus
ctatagtctgtgttacagcagtggt

SEQ ID NO: 370346 - DNA, 25 bp, Mus musculus
ctatagtgggctctcaatgacaaca

SEQ ID NO: 370347 - DNA, 25 bp, Mus musculus
ctatagtgggctgtcaatgacaaca

SEQ ID NO: 370348 - DNA, 25 bp, Mus musculus
ctatagttagtgatggcgcttccct

SEQ ID NO: 370349 - DNA, 25 bp, Mus musculus
ctatagttagtgttggcgcttccct

SEQ ID NO: 370350 - DNA, 25 bp, Mus musculus
ctatagttccatcggcatctctgac

SEQ ID NO: 370351 - DNA, 25 bp, Mus musculus
ctatagttccatgggcatctctgac

SEQ ID NO: 370352 - DNA, 25 bp, Mus musculus
ctatagttggagacgaggtcaaacc

SEQ ID NO: 370353 - DNA, 25 bp, Mus musculus
ctatagttggagtcgaggtcaaacc

SEQ ID NO: 370354 - DNA, 25 bp, Mus musculus
ctatagttggtacttggtctctttt

SEQ ID NO: 370355 - DNA, 25 bp, Mus musculus
ctatagttggtagttggtctctttt

SEQ ID NO: 370356 - DNA, 25 bp, Mus musculus
ctatagtttcttcggcactcaccta

SEQ ID NO: 370357 - DNA, 25 bp, Mus musculus
ctatagtttcttgggcactcaccta

SEQ ID NO: 370358 - DNA, 25 bp, Mus musculus
ctatataaacctcttctattcctgg

SEQ ID NO: 370359 - DNA, 25 bp, Mus musculus
ctatataaacctgttctattcctgg

SEQ ID NO: 370360 - DNA, 25 bp, Mus musculus
ctatataatcctaactggcctgaaa

SEQ ID NO: 370361 - DNA, 25 bp, Mus musculus
ctatataatccttactggcctgaaa

SEQ ID NO: 370362 - DNA, 25 bp, Mus musculus
ctatataatgacctgagtctcagat

SEQ ID NO: 370363 - DNA, 25 bp, Mus musculus
ctatataatgacgtgagtctcagat

SEQ ID NO: 370364 - DNA, 25 bp, Mus musculus
ctatatacaagtcatccctgatgca

SEQ ID NO: 370365 - DNA, 25 bp, Mus musculus
ctatatacaagtgatccctgatgca

SEQ ID NO: 370366 - DNA, 25 bp, Mus musculus
ctatatacatatcatggcccaaggg

SEQ ID NO: 370367 - DNA, 25 bp, Mus musculus
ctatatacatatgatggcccaaggg

SEQ ID NO: 370368 - DNA, 25 bp, Mus musculus
ctatataccttgacttatcctgtct

SEQ ID NO: 370369 - DNA, 25 bp, Mus musculus
ctatataccttgtcttatcctgtct

SEQ ID NO: 370370 - DNA, 25 bp, Mus musculus
ctatatactcctcggcaaacctggc

SEQ ID NO: 370371 - DNA, 25 bp, Mus musculus
ctatatactcctgggcaaacctggc

SEQ ID NO: 370372 - DNA, 25 bp, Mus musculus
ctatatagacccatacaagctgctg

SEQ ID NO: 370373 - DNA, 25 bp, Mus musculus
ctatatagacccttacaagctgctg

SEQ ID NO: 370374 - DNA, 25 bp, Mus musculus
ctatatagtgcacgccggtcttact

SEQ ID NO: 370375 - DNA, 25 bp, Mus musculus
ctatatagtgcaggccggtcttact

SEQ ID NO: 370376 - DNA, 25 bp, Mus musculus
ctatatatactgagtggctatctgt

SEQ ID NO: 370377 - DNA, 25 bp, Mus musculus
ctatatatactgtgtggctatctgt

SEQ ID NO: 370378 - DNA, 25 bp, Mus musculus
ctatatatgattaagcactgtgcca

SEQ ID NO: 370379 - DNA, 25 bp, Mus musculus
ctatatatgatttagcactgtgcca

SEQ ID NO: 370380 - DNA, 25 bp, Mus musculus
ctatatatgttgctcgtggttcgtc

SEQ ID NO: 370381 - DNA, 25 bp, Mus musculus
ctatatatgttggtcgtggttcgtc

SEQ ID NO: 370382 - DNA, 25 bp, Mus musculus
ctatatccctttctttgtctgctaa

SEQ ID NO: 370383 - DNA, 25 bp, Mus musculus
ctatatccctttgtttgtctgctaa

SEQ ID NO: 370384 - DNA, 25 bp, Mus musculus
ctatatccgattcagctgtcctttg

SEQ ID NO: 370385 - DNA, 25 bp, Mus musculus
ctatatccgattgagctgtcctttg

SEQ ID NO: 370386 - DNA, 25 bp, Mus musculus
ctatatcctagacaagcactccatc

SEQ ID NO: 370387 - DNA, 25 bp, Mus musculus
ctatatcctagagaagcactccatc

SEQ ID NO: 370388 - DNA, 25 bp, Mus musculus
ctatatcggcgacctctgggttgga

SEQ ID NO: 370389 - DNA, 25 bp, Mus musculus
ctatatcggcgagctctgggttgga

SEQ ID NO: 370390 - DNA, 25 bp, Mus musculus
ctatatctccatccttgagtgtata

SEQ ID NO: 370391 - DNA, 25 bp, Mus musculus
ctatatctccatgcttgagtgtata

SEQ ID NO: 370392 - DNA, 25 bp, Mus musculus
ctatatctgtagaatttcttgtgtt

SEQ ID NO: 370393 - DNA, 25 bp, Mus musculus
ctatatctgtagtatttcttgtgtt

SEQ ID NO: 370394 - DNA, 25 bp, Mus musculus
ctatatgcatggaaggttctagaat

SEQ ID NO: 370395 - DNA, 25 bp, Mus musculus
ctatatgcatggtaggttctagaat

SEQ ID NO: 370396 - DNA, 25 bp, Mus musculus
ctatatgcgccgaggtggctaccgc

SEQ ID NO: 370397 - DNA, 25 bp, Mus musculus
ctatatgcgccgtggtggctaccgc

SEQ ID NO: 370398 - DNA, 25 bp, Mus musculus
ctatatgctggacacttgtttccca

SEQ ID NO: 370399 - DNA, 25 bp, Mus musculus
ctatatgctggagacttgtttccca

SEQ ID NO: 370400 - DNA, 25 bp, Mus musculus
ctatatggactaaaggctggcccgg

SEQ ID NO: 370401 - DNA, 25 bp, Mus musculus
ctatatggactaagtggttcaggct

SEQ ID NO: 370402 - DNA, 25 bp, Mus musculus
ctatatggactataggctggcccgg

SEQ ID NO: 370403 - DNA, 25 bp, Mus musculus
ctatatggactatgtggttcaggct

SEQ ID NO: 370404 - DNA, 25 bp, Mus musculus
ctatatggatcacgccagtggcaat

SEQ ID NO: 370405 - DNA, 25 bp, Mus musculus
ctatatggatcaggccagtggcaat

SEQ ID NO: 370406 - DNA, 25 bp, Mus musculus
ctatatggcataatcgaacgtgacc

SEQ ID NO: 370407 - DNA, 25 bp, Mus musculus
ctatatggcatattcgaacgtgacc

SEQ ID NO: 370408 - DNA, 25 bp, Mus musculus
ctatatgggcatattctctgaggaa

SEQ ID NO: 370409 - DNA, 25 bp, Mus musculus
ctatatgggcattttctctgaggaa

SEQ ID NO: 370410 - DNA, 25 bp, Mus musculus
ctatatggtaggaccttgtctcaag

SEQ ID NO: 370411 - DNA, 25 bp, Mus musculus
ctatatggtaggtccttgtctcaag

SEQ ID NO: 370412 - DNA, 25 bp, Mus musculus
ctatatggtgtgcagttcttggttt

SEQ ID NO: 370413 - DNA, 25 bp, Mus musculus
ctatatggtgtggagttcttggttt

SEQ ID NO: 370414 - DNA, 25 bp, Mus musculus
ctatatgtaaatagggccactggat

SEQ ID NO: 370415 - DNA, 25 bp, Mus musculus
ctatatgtaaattgggccactggat

SEQ ID NO: 370416 - DNA, 25 bp, Mus musculus
ctatatgtctgtcggcttgatgctg

SEQ ID NO: 370417 - DNA, 25 bp, Mus musculus
ctatatgtctgtgggcttgatgctg

SEQ ID NO: 370418 - DNA, 25 bp, Mus musculus
ctatatgttgtcatgtcacctatgg

SEQ ID NO: 370419 - DNA, 25 bp, Mus musculus
ctatatgttgtcttgtcacctatgg

SEQ ID NO: 370420 - DNA, 25 bp, Mus musculus
ctatattaagatattcctaaccagg

SEQ ID NO: 370421 - DNA, 25 bp, Mus musculus
ctatattaagattttcctaaccagg

SEQ ID NO: 370422 - DNA, 25 bp, Mus musculus
ctatattccaatccagttcactgtt

SEQ ID NO: 370423 - DNA, 25 bp, Mus musculus
ctatattccaatgcagttcactgtt

SEQ ID NO: 370424 - DNA, 25 bp, Mus musculus
ctatattctcacagcatatgcacct

SEQ ID NO: 370425 - DNA, 25 bp, Mus musculus
ctatattctcactgcatatgcacct

SEQ ID NO: 370426 - DNA, 25 bp, Mus musculus
ctatatttctttccttactgcacaa

SEQ ID NO: 370427 - DNA, 25 bp, Mus musculus
ctatatttctttgcttactgcacaa

SEQ ID NO: 370428 - DNA, 25 bp, Mus musculus
ctatatttgttcattttctgtgtga

SEQ ID NO: 370429 - DNA, 25 bp, Mus musculus
ctatatttgttctttttctgtgtga

SEQ ID NO: 370430 - DNA, 25 bp, Mus musculus
ctatcaacgttccttaagcaccaat

SEQ ID NO: 370431 - DNA, 25 bp, Mus musculus
ctatcaacgttcgttaagcaccaat

SEQ ID NO: 370432 - DNA, 25 bp, Mus musculus
ctatcaactcatatggtgtggctat

SEQ ID NO: 370433 - DNA, 25 bp, Mus musculus
ctatcaactcatttggtgtggctat

SEQ ID NO: 370434 - DNA, 25 bp, Mus musculus
ctatcaactggcctgctggagagat

SEQ ID NO: 370435 - DNA, 25 bp, Mus musculus
ctatcaactggcgtgctggagagat

SEQ ID NO: 370436 - DNA, 25 bp, Mus musculus
ctatcaactttccatggtagtcgcc

SEQ ID NO: 370437 - DNA, 25 bp, Mus musculus
ctatcaactttcgatggtagtcgcc

SEQ ID NO: 370438 - DNA, 25 bp, Mus musculus
ctatcaagacctatgtgattggaca

SEQ ID NO: 370439 - DNA, 25 bp, Mus musculus
ctatcaagacctttgtgattggaca

SEQ ID NO: 370440 - DNA, 25 bp, Mus musculus
ctatcaagtctgacctcaagaagta

SEQ ID NO: 370441 - DNA, 25 bp, Mus musculus
ctatcaagtctgtcctcaagaagta

SEQ ID NO: 370442 - DNA, 25 bp, Mus musculus
ctatcaatcacaccacaatttctca

SEQ ID NO: 370443 - DNA, 25 bp, Mus musculus
ctatcaatcacagcacaatttctca

SEQ ID NO: 370444 - DNA, 25 bp, Mus musculus
ctatcaatgcccctactgtgaaaaa

SEQ ID NO: 370445 - DNA, 25 bp, Mus musculus
ctatcaatgcccgtactgtgaaaaa

SEQ ID NO: 370446 - DNA, 25 bp, Mus musculus
ctatcacaacttcttgggagccgcc

SEQ ID NO: 370447 - DNA, 25 bp, Mus musculus
ctatcacaacttgttgggagccgcc

SEQ ID NO: 370448 - DNA, 25 bp, Mus musculus
ctatcacagatgctaattccccaga

SEQ ID NO: 370449 - DNA, 25 bp, Mus musculus
ctatcacagatggtaattccccaga

SEQ ID NO: 370450 - DNA, 25 bp, Mus musculus
ctatcacagtgaacggcagctcatg

SEQ ID NO: 370451 - DNA, 25 bp, Mus musculus
ctatcacagtgatcggcagctcatg

SEQ ID NO: 370452 - DNA, 25 bp, Mus musculus
ctatcaccacggaggctaaggtgga

SEQ ID NO: 370453 - DNA, 25 bp, Mus musculus
ctatcaccacggtggctaaggtgga

SEQ ID NO: 370454 - DNA, 25 bp, Mus musculus
ctatcaccctgtcatgtgcacagag

SEQ ID NO: 370455 - DNA, 25 bp, Mus musculus
ctatcaccctgtgatgtgcacagag

SEQ ID NO: 370456 - DNA, 25 bp, Mus musculus
ctatcacctagtctcatttcgtttg

SEQ ID NO: 370457 - DNA, 25 bp, Mus musculus
ctatcacctagtgtcatttcgtttg

SEQ ID NO: 370458 - DNA, 25 bp, Mus musculus
ctatcacctccaatgctgtatgatt

SEQ ID NO: 370459 - DNA, 25 bp, Mus musculus
ctatcacctccattgctgtatgatt

SEQ ID NO: 370460 - DNA, 25 bp, Mus musculus
ctatcacgtcttcccttggcctggg

SEQ ID NO: 370461 - DNA, 25 bp, Mus musculus
ctatcacgtcttgccttggcctggg

SEQ ID NO: 370462 - DNA, 25 bp, Mus musculus
ctatcacgttagacctgtgggttga

SEQ ID NO: 370463 - DNA, 25 bp, Mus musculus
ctatcacgttagtcctgtgggttga

SEQ ID NO: 370464 - DNA, 25 bp, Mus musculus
ctatcacttcctacgtgggcagagt

SEQ ID NO: 370465 - DNA, 25 bp, Mus musculus
ctatcacttccttcgtgggcagagt

SEQ ID NO: 370466 - DNA, 25 bp, Mus musculus
ctatcacttgtcatatcatgtggga

SEQ ID NO: 370467 - DNA, 25 bp, Mus musculus
ctatcacttgtcttatcatgtggga

SEQ ID NO: 370468 - DNA, 25 bp, Mus musculus
ctatcagacattattcatctagaaa

SEQ ID NO: 370469 - DNA, 25 bp, Mus musculus
ctatcagacatttttcatctagaaa

SEQ ID NO: 370470 - DNA, 25 bp, Mus musculus
ctatcagatcgcaagtacgagttag

SEQ ID NO: 370471 - DNA, 25 bp, Mus musculus
ctatcagatcgctagtacgagttag

SEQ ID NO: 370472 - DNA, 25 bp, Mus musculus
ctatcagatctgccactgtgcaggt

SEQ ID NO: 370473 - DNA, 25 bp, Mus musculus
ctatcagatctggcactgtgcaggt

SEQ ID NO: 370474 - DNA, 25 bp, Mus musculus
ctatcagatgtgacatgagactgtt

SEQ ID NO: 370475 - DNA, 25 bp, Mus musculus
ctatcagatgtgtcatgagactgtt

SEQ ID NO: 370476 - DNA, 25 bp, Mus musculus
ctatcagattagaggccgtggaggt

SEQ ID NO: 370477 - DNA, 25 bp, Mus musculus
ctatcagattagtggccgtggaggt

SEQ ID NO: 370478 - DNA, 25 bp, Mus musculus
ctatcagcaccaactctcagttcat

SEQ ID NO: 370479 - DNA, 25 bp, Mus musculus
ctatcagcaccatctctcagttcat

SEQ ID NO: 370480 - DNA, 25 bp, Mus musculus
ctatcagccaagcttcgacacatga

SEQ ID NO: 370481 - DNA, 25 bp, Mus musculus
ctatcagccaaggttcgacacatga

SEQ ID NO: 370482 - DNA, 25 bp, Mus musculus
ctatcagcgaagactggagaccaac

SEQ ID NO: 370483 - DNA, 25 bp, Mus musculus
ctatcagcgaagtctggagaccaac

SEQ ID NO: 370484 - DNA, 25 bp, Mus musculus
ctatcagcgaggagacaagcaacat

SEQ ID NO: 370485 - DNA, 25 bp, Mus musculus
ctatcagcgaggtgacaagcaacat

SEQ ID NO: 370486 - DNA, 25 bp, Mus musculus
ctatcagctgccagagtccagtcag

SEQ ID NO: 370487 - DNA, 25 bp, Mus musculus
ctatcagctgcctgagtccagtcag

SEQ ID NO: 370488 - DNA, 25 bp, Mus musculus
ctatcaggaggaactcttgtcttga

SEQ ID NO: 370489 - DNA, 25 bp, Mus musculus
ctatcaggaggatctcttgtcttga

SEQ ID NO: 370490 - DNA, 25 bp, Mus musculus
ctatcaggcaaaaggacgacgttta

SEQ ID NO: 370491 - DNA, 25 bp, Mus musculus
ctatcaggcaaatggacgacgttta

SEQ ID NO: 370492 - DNA, 25 bp, Mus musculus
ctatcagggcggaatggctacagac

SEQ ID NO: 370493 - DNA, 25 bp, Mus musculus
ctatcagggcggtatggctacagac

SEQ ID NO: 370494 - DNA, 25 bp, Mus musculus
ctatcagtcatcaatcaatcatcta

SEQ ID NO: 370495 - DNA, 25 bp, Mus musculus
ctatcagtcatctatcaatcatcta

SEQ ID NO: 370496 - DNA, 25 bp, Mus musculus
ctatcagtgactcccgggttcagcc

SEQ ID NO: 370497 - DNA, 25 bp, Mus musculus
ctatcagtgactgccgggttcagcc

SEQ ID NO: 370498 - DNA, 25 bp, Mus musculus
ctatcagttggtattggatgtgtaa

SEQ ID NO: 370499 - DNA, 25 bp, Mus musculus
ctatcagttggttttggatgtgtaa

SEQ ID NO: 370500 - DNA, 25 bp, Mus musculus
ctatcatagtttagtcatgtggtga

SEQ ID NO: 370501 - DNA, 25 bp, Mus musculus
ctatcatagttttgtcatgtggtga

SEQ ID NO: 370502 - DNA, 25 bp, Mus musculus
ctatcatcaattcccaattctgttc

SEQ ID NO: 370503 - DNA, 25 bp, Mus musculus
ctatcatcaattgccaattctgttc

SEQ ID NO: 370504 - DNA, 25 bp, Mus musculus
ctatcatccattccgatgtcatggc

SEQ ID NO: 370505 - DNA, 25 bp, Mus musculus
ctatcatccattgcgatgtcatggc

SEQ ID NO: 370506 - DNA, 25 bp, Mus musculus
ctatcatcctcaaaattcctttcta

SEQ ID NO: 370507 - DNA, 25 bp, Mus musculus
ctatcatcctcataattcctttcta

SEQ ID NO: 370508 - DNA, 25 bp, Mus musculus
ctatcatcctgtctctgtttaaaag

SEQ ID NO: 370509 - DNA, 25 bp, Mus musculus
ctatcatcctgtgtctgtttaaaag

SEQ ID NO: 370510 - DNA, 25 bp, Mus musculus
ctatcatcggaaacctagcctacag

SEQ ID NO: 370511 - DNA, 25 bp, Mus musculus
ctatcatcggaatcctagcctacag

SEQ ID NO: 370512 - DNA, 25 bp, Mus musculus
ctatcatctgtcaaaagcctttcga

SEQ ID NO: 370513 - DNA, 25 bp, Mus musculus
ctatcatctgtctaaagcctttcga

SEQ ID NO: 370514 - DNA, 25 bp, Mus musculus
ctatcatgtactcggtctattttgg

SEQ ID NO: 370515 - DNA, 25 bp, Mus musculus
ctatcatgtactgggtctattttgg

SEQ ID NO: 370516 - DNA, 25 bp, Mus musculus
ctatcatgttgtaagtgctgcaatc

SEQ ID NO: 370517 - DNA, 25 bp, Mus musculus
ctatcatgttgttagtgctgcaatc

SEQ ID NO: 370518 - DNA, 25 bp, Mus musculus
ctatcattcatgcattcctcaagga

SEQ ID NO: 370519 - DNA, 25 bp, Mus musculus
ctatcattcatggattcctcaagga

SEQ ID NO: 370520 - DNA, 25 bp, Mus musculus
ctatcatttactatggccctacggt

SEQ ID NO: 370521 - DNA, 25 bp, Mus musculus
ctatcatttactttggccctacggt

SEQ ID NO: 370522 - DNA, 25 bp, Mus musculus
ctatccaaagcacgcaaacccaatt

SEQ ID NO: 370523 - DNA, 25 bp, Mus musculus
ctatccaaagcaggcaaacccaatt

SEQ ID NO: 370524 - DNA, 25 bp, Mus musculus
ctatccaaaggtccatacccaggga

SEQ ID NO: 370525 - DNA, 25 bp, Mus musculus
ctatccaaaggtgcatacccaggga

SEQ ID NO: 370526 - DNA, 25 bp, Mus musculus
ctatccaaccaaaggtcggctgtac

SEQ ID NO: 370527 - DNA, 25 bp, Mus musculus
ctatccaaccaatggtcggctgtac

SEQ ID NO: 370528 - DNA, 25 bp, Mus musculus
ctatccaatgcacaacagctgtctg

SEQ ID NO: 370529 - DNA, 25 bp, Mus musculus
ctatccaatgcagaacagctgtctg

SEQ ID NO: 370530 - DNA, 25 bp, Mus musculus
ctatccaatttccaccccttaatgg

SEQ ID NO: 370531 - DNA, 25 bp, Mus musculus
ctatccaatttcgaccccttaatgg

SEQ ID NO: 370532 - DNA, 25 bp, Mus musculus
ctatccacgaggcacatgcagggtt

SEQ ID NO: 370533 - DNA, 25 bp, Mus musculus
ctatccacgagggacatgcagggtt

SEQ ID NO: 370534 - DNA, 25 bp, Mus musculus
ctatccagaattcgagctctctgtc

SEQ ID NO: 370535 - DNA, 25 bp, Mus musculus
ctatccagaattggagctctctgtc

SEQ ID NO: 370536 - DNA, 25 bp, Mus musculus
ctatccagccaaatacttttttcct

SEQ ID NO: 370537 - DNA, 25 bp, Mus musculus
ctatccagccaattacttttttcct

SEQ ID NO: 370538 - DNA, 25 bp, Mus musculus
ctatccaggcttatgggtcgggagt

SEQ ID NO: 370539 - DNA, 25 bp, Mus musculus
ctatccaggcttttgggtcgggagt

SEQ ID NO: 370540 - DNA, 25 bp, Mus musculus
ctatccagtagtaccggttcacttg

SEQ ID NO: 370541 - DNA, 25 bp, Mus musculus
ctatccagtagttccggttcacttg

SEQ ID NO: 370542 - DNA, 25 bp, Mus musculus
ctatccatcagaactctaccatggt

SEQ ID NO: 370543 - DNA, 25 bp, Mus musculus
ctatccatcagatctctaccatggt

SEQ ID NO: 370544 - DNA, 25 bp, Mus musculus
ctatccatcggactttccttttcac

SEQ ID NO: 370545 - DNA, 25 bp, Mus musculus
ctatccatcggagtttccttttcac

SEQ ID NO: 370546 - DNA, 25 bp, Mus musculus
ctatccatgtgtctattaattattg

SEQ ID NO: 370547 - DNA, 25 bp, Mus musculus
ctatccatgtgtgtattaattattg

SEQ ID NO: 370548 - DNA, 25 bp, Mus musculus
ctatccatgtttccttccaaggtgg

SEQ ID NO: 370549 - DNA, 25 bp, Mus musculus
ctatccatgtttgcttccaaggtgg

SEQ ID NO: 370550 - DNA, 25 bp, Mus musculus
ctatccattcgcacctctcatggtg

SEQ ID NO: 370551 - DNA, 25 bp, Mus musculus
ctatccattcgctcctctcatggtg

SEQ ID NO: 370552 - DNA, 25 bp, Mus musculus
ctatccattgacatgcattctcttg

SEQ ID NO: 370553 - DNA, 25 bp, Mus musculus
ctatccattgacttgcattctcttg

SEQ ID NO: 370554 - DNA, 25 bp, Mus musculus
ctatcccaaaaacgtcaaagtgctg

SEQ ID NO: 370555 - DNA, 25 bp, Mus musculus
ctatcccaaaaaggtcaaagtgctg

SEQ ID NO: 370556 - DNA, 25 bp, Mus musculus
ctatcccaccttctagcatattcta

SEQ ID NO: 370557 - DNA, 25 bp, Mus musculus
ctatcccaccttgtagcatattcta

SEQ ID NO: 370558 - DNA, 25 bp, Mus musculus
ctatcccactccattataaggttct

SEQ ID NO: 370559 - DNA, 25 bp, Mus musculus
ctatcccactcctttataaggttct

SEQ ID NO: 370560 - DNA, 25 bp, Mus musculus
ctatcccaggaaaatggtgaccaat

SEQ ID NO: 370561 - DNA, 25 bp, Mus musculus
ctatcccaggaatatggtgaccaat

SEQ ID NO: 370562 - DNA, 25 bp, Mus musculus
ctatcccatcatccaattccttatt

SEQ ID NO: 370563 - DNA, 25 bp, Mus musculus
ctatcccatcatgcaattccttatt

SEQ ID NO: 370564 - DNA, 25 bp, Mus musculus
ctatcccatcgtacaagtatgacag

SEQ ID NO: 370565 - DNA, 25 bp, Mus musculus
ctatcccatcgttcaagtatgacag

SEQ ID NO: 370566 - DNA, 25 bp, Mus musculus
ctatcccattacactctttgtggag

SEQ ID NO: 370567 - DNA, 25 bp, Mus musculus
ctatcccattactctctttgtggag

SEQ ID NO: 370568 - DNA, 25 bp, Mus musculus
ctatcccattccacttagtaaacca

SEQ ID NO: 370569 - DNA, 25 bp, Mus musculus
ctatcccattcctcttagtaaacca

SEQ ID NO: 370570 - DNA, 25 bp, Mus musculus
ctatccccactacaatgaccttgta

SEQ ID NO: 370571 - DNA, 25 bp, Mus musculus
ctatccccactagaatgaccttgta

SEQ ID NO: 370572 - DNA, 25 bp, Mus musculus
ctatcccctggaacttatgcattac

SEQ ID NO: 370573 - DNA, 25 bp, Mus musculus
ctatcccctggatcttatgcattac

SEQ ID NO: 370574 - DNA, 25 bp, Mus musculus
ctatcccgagataactttgaggcat

SEQ ID NO: 370575 - DNA, 25 bp, Mus musculus
ctatcccgagattactttgaggcat

SEQ ID NO: 370576 - DNA, 25 bp, Mus musculus
ctatcccgaggaagagttctgtgga

SEQ ID NO: 370577 - DNA, 25 bp, Mus musculus
ctatcccgaggatgagttctgtgga

SEQ ID NO: 370578 - DNA, 25 bp, Mus musculus
ctatccctagggagcatgagatttg

SEQ ID NO: 370579 - DNA, 25 bp, Mus musculus
ctatccctagggtgcatgagatttg

SEQ ID NO: 370580 - DNA, 25 bp, Mus musculus
ctatccctcgtccaaacatcagaat

SEQ ID NO: 370581 - DNA, 25 bp, Mus musculus
ctatccctcgtcgaaacatcagaat

SEQ ID NO: 370582 - DNA, 25 bp, Mus musculus
ctatccctgaacattgtagacccag

SEQ ID NO: 370583 - DNA, 25 bp, Mus musculus
ctatccctgaactttgtagacccag

SEQ ID NO: 370584 - DNA, 25 bp, Mus musculus
ctatcccttggcatgtttcttcttg

SEQ ID NO: 370585 - DNA, 25 bp, Mus musculus
ctatcccttggcttgtttcttcttg

SEQ ID NO: 370586 - DNA, 25 bp, Mus musculus
ctatccgagttcatcctttatgtct

SEQ ID NO: 370587 - DNA, 25 bp, Mus musculus
ctatccgagttcttcctttatgtct

SEQ ID NO: 370588 - DNA, 25 bp, Mus musculus
ctatccgcacgtaatttgccatgta

SEQ ID NO: 370589 - DNA, 25 bp, Mus musculus
ctatccgcacgttatttgccatgta

SEQ ID NO: 370590 - DNA, 25 bp, Mus musculus
ctatccggacagataaccgaggctt

SEQ ID NO: 370591 - DNA, 25 bp, Mus musculus
ctatccggacagttaaccgaggctt

SEQ ID NO: 370592 - DNA, 25 bp, Mus musculus
ctatccgggaatatgctaaaaagcc

SEQ ID NO: 370593 - DNA, 25 bp, Mus musculus
ctatccgggaatttgctaaaaagcc

SEQ ID NO: 370594 - DNA, 25 bp, Mus musculus
ctatccgtagagaattagtcctaag

SEQ ID NO: 370595 - DNA, 25 bp, Mus musculus
ctatccgtagagtattagtcctaag

SEQ ID NO: 370596 - DNA, 25 bp, Mus musculus
ctatccgtggcactgcgggaagctt

SEQ ID NO: 370597 - DNA, 25 bp, Mus musculus
ctatccgtggcagtgcgggaagctt

SEQ ID NO: 370598 - DNA, 25 bp, Mus musculus
ctatcctacctgacagttcattcaa

SEQ ID NO: 370599 - DNA, 25 bp, Mus musculus
ctatcctacctgtcagttcattcaa

SEQ ID NO: 370600 - DNA, 25 bp, Mus musculus
ctatcctattccagggagactaagg

SEQ ID NO: 370601 - DNA, 25 bp, Mus musculus
ctatcctattcctgggagactaagg

SEQ ID NO: 370602 - DNA, 25 bp, Mus musculus
ctatcctcagctactagatttcatt

SEQ ID NO: 370603 - DNA, 25 bp, Mus musculus
ctatcctcagctatgggaacaaaca

SEQ ID NO: 370604 - DNA, 25 bp, Mus musculus
ctatcctcagcttctagatttcatt

SEQ ID NO: 370605 - DNA, 25 bp, Mus musculus
ctatcctcagctttgggaacaaaca

SEQ ID NO: 370606 - DNA, 25 bp, Mus musculus
ctatcctccaggatataatcccgag

SEQ ID NO: 370607 - DNA, 25 bp, Mus musculus
ctatcctccaggttataatcccgag

SEQ ID NO: 370608 - DNA, 25 bp, Mus musculus
ctatcctcccgaagctgggttatag

SEQ ID NO: 370609 - DNA, 25 bp, Mus musculus
ctatcctcccgatgctgggttatag

SEQ ID NO: 370610 - DNA, 25 bp, Mus musculus
ctatcctccttaaatgaccagcaaa

SEQ ID NO: 370611 - DNA, 25 bp, Mus musculus
ctatcctccttatatgaccagcaaa

SEQ ID NO: 370612 - DNA, 25 bp, Mus musculus
ctatcctcctttcaataccattcga

SEQ ID NO: 370613 - DNA, 25 bp, Mus musculus
ctatcctcctttgaataccattcga

SEQ ID NO: 370614 - DNA, 25 bp, Mus musculus
ctatcctctggtaggctaacgaact

SEQ ID NO: 370615 - DNA, 25 bp, Mus musculus
ctatcctctggttggctaacgaact

SEQ ID NO: 370616 - DNA, 25 bp, Mus musculus
ctatcctgaaaaagcccacacgtga

SEQ ID NO: 370617 - DNA, 25 bp, Mus musculus
ctatcctgaaaatgcccacacgtga

SEQ ID NO: 370618 - DNA, 25 bp, Mus musculus
ctatcctgcatcatgtggcttcaaa

SEQ ID NO: 370619 - DNA, 25 bp, Mus musculus
ctatcctgcatcttgtggcttcaaa

SEQ ID NO: 370620 - DNA, 25 bp, Mus musculus
ctatcctgccagctatacttatgta

SEQ ID NO: 370621 - DNA, 25 bp, Mus musculus
ctatcctgccaggtatacttatgta

SEQ ID NO: 370622 - DNA, 25 bp, Mus musculus
ctatcctggagtataaccatagcga

SEQ ID NO: 370623 - DNA, 25 bp, Mus musculus
ctatcctggagtttaaccatagcga

SEQ ID NO: 370624 - DNA, 25 bp, Mus musculus
ctatccttaagtaaggtcctacctg

SEQ ID NO: 370625 - DNA, 25 bp, Mus musculus
ctatccttaagttaggtcctacctg

SEQ ID NO: 370626 - DNA, 25 bp, Mus musculus
ctatccttataaccactttctgtga

SEQ ID NO: 370627 - DNA, 25 bp, Mus musculus
ctatccttataagcactttctgtga

SEQ ID NO: 370628 - DNA, 25 bp, Mus musculus
ctatccttatgaaactcaggcttaa

SEQ ID NO: 370629 - DNA, 25 bp, Mus musculus
ctatccttatgatactcaggcttaa

SEQ ID NO: 370630 - DNA, 25 bp, Mus musculus
ctatccttgctcatttttcctaaat

SEQ ID NO: 370631 - DNA, 25 bp, Mus musculus
ctatccttgctcttttttcctaaat

SEQ ID NO: 370632 - DNA, 25 bp, Mus musculus
ctatccttggtgatcctagcgcaat

SEQ ID NO: 370633 - DNA, 25 bp, Mus musculus
ctatccttggtgttcctagcgcaat

SEQ ID NO: 370634 - DNA, 25 bp, Mus musculus
ctatcctttaacatccctttgaact

SEQ ID NO: 370635 - DNA, 25 bp, Mus musculus
ctatcctttaacttccctttgaact

SEQ ID NO: 370636 - DNA, 25 bp, Mus musculus
ctatcctttcagcattccgttttag

SEQ ID NO: 370637 - DNA, 25 bp, Mus musculus
ctatcctttcaggattccgttttag

SEQ ID NO: 370638 - DNA, 25 bp, Mus musculus
ctatccttttagatcatgggacaga

SEQ ID NO: 370639 - DNA, 25 bp, Mus musculus
ctatccttttagttcatgggacaga

SEQ ID NO: 370640 - DNA, 25 bp, Mus musculus
ctatcctttttactcttattcccag

SEQ ID NO: 370641 - DNA, 25 bp, Mus musculus
ctatcctttttagtcttattcccag

SEQ ID NO: 370642 - DNA, 25 bp, Mus musculus
ctatcgagatgcctcacgggtgaaa

SEQ ID NO: 370643 - DNA, 25 bp, Mus musculus
ctatcgagatgcgtcacgggtgaaa

SEQ ID NO: 370644 - DNA, 25 bp, Mus musculus
ctatcgatagaacccaggccctgag

SEQ ID NO: 370645 - DNA, 25 bp, Mus musculus
ctatcgatagaagccaggccctgag

SEQ ID NO: 370646 - DNA, 25 bp, Mus musculus
ctatcgcatgtaaagtaccatttat

SEQ ID NO: 370647 - DNA, 25 bp, Mus musculus
ctatcgcatgtatagtaccatttat

SEQ ID NO: 370648 - DNA, 25 bp, Mus musculus
ctatcgcctgctccagatgcgagca

SEQ ID NO: 370649 - DNA, 25 bp, Mus musculus
ctatcgcctgctgcagatgcgagca

SEQ ID NO: 370650 - DNA, 25 bp, Mus musculus
ctatcggccagtctgtggctatcta

SEQ ID NO: 370651 - DNA, 25 bp, Mus musculus
ctatcggccagtgtgtggctatcta

SEQ ID NO: 370652 - DNA, 25 bp, Mus musculus
ctatcggctttgctatactgtctgc

SEQ ID NO: 370653 - DNA, 25 bp, Mus musculus
ctatcggctttggtatactgtctgc

SEQ ID NO: 370654 - DNA, 25 bp, Mus musculus
ctatcggttagtcgtggtggcacac

SEQ ID NO: 370655 - DNA, 25 bp, Mus musculus
ctatcggttagtggtggtggcacac

SEQ ID NO: 370656 - DNA, 25 bp, Mus musculus
ctatcgtaagttccacctattgtta

SEQ ID NO: 370657 - DNA, 25 bp, Mus musculus
ctatcgtaagttgcacctattgtta

SEQ ID NO: 370658 - DNA, 25 bp, Mus musculus
ctatcgtattaaagtggaccttgca

SEQ ID NO: 370659 - DNA, 25 bp, Mus musculus
ctatcgtattaatgtggaccttgca

SEQ ID NO: 370660 - DNA, 25 bp, Mus musculus
ctatcgtggaggactgcagcggcat

SEQ ID NO: 370661 - DNA, 25 bp, Mus musculus
ctatcgtggaggtctgcagcggcat

SEQ ID NO: 370662 - DNA, 25 bp, Mus musculus
ctatcgttcttaccagacgtacttt

SEQ ID NO: 370663 - DNA, 25 bp, Mus musculus
ctatcgttcttagcagacgtacttt

SEQ ID NO: 370664 - DNA, 25 bp, Mus musculus
ctatcgttgagtccctgtggtccag

SEQ ID NO: 370665 - DNA, 25 bp, Mus musculus
ctatcgttgagtgcctgtggtccag

SEQ ID NO: 370666 - DNA, 25 bp, Mus musculus
ctatctaagactctgttgtacctga

SEQ ID NO: 370667 - DNA, 25 bp, Mus musculus
ctatctaagactgtgttgtacctga

SEQ ID NO: 370668 - DNA, 25 bp, Mus musculus
ctatctaatagacggctctgtgcct

SEQ ID NO: 370669 - DNA, 25 bp, Mus musculus
ctatctaatagagggctctgtgcct

SEQ ID NO: 370670 - DNA, 25 bp, Mus musculus
ctatctacacctatgatgattttgg

SEQ ID NO: 370671 - DNA, 25 bp, Mus musculus
ctatctacacctttgatgattttgg

SEQ ID NO: 370672 - DNA, 25 bp, Mus musculus
ctatctacctctccctcaatgaaaa

SEQ ID NO: 370673 - DNA, 25 bp, Mus musculus
ctatctacctctgcctcaatgaaaa

SEQ ID NO: 370674 - DNA, 25 bp, Mus musculus
ctatctacttatcccatctcattta

SEQ ID NO: 370675 - DNA, 25 bp, Mus musculus
ctatctacttatgccatctcattta

SEQ ID NO: 370676 - DNA, 25 bp, Mus musculus
ctatctactttcaacctgtcatcta

SEQ ID NO: 370677 - DNA, 25 bp, Mus musculus
ctatctactttctacctgtcatcta

SEQ ID NO: 370678 - DNA, 25 bp, Mus musculus
ctatctactttgaaggcttgccctg

SEQ ID NO: 370679 - DNA, 25 bp, Mus musculus
ctatctactttgtaggcttgccctg

SEQ ID NO: 370680 - DNA, 25 bp, Mus musculus
ctatctagaaatctacctgcctttt

SEQ ID NO: 370681 - DNA, 25 bp, Mus musculus
ctatctagaaatgtacctgcctttt

SEQ ID NO: 370682 - DNA, 25 bp, Mus musculus
ctatctaggctaatgcttttgcgga

SEQ ID NO: 370683 - DNA, 25 bp, Mus musculus
ctatctaggctattgcttttgcgga

SEQ ID NO: 370684 - DNA, 25 bp, Mus musculus
ctatctatcaaaccttgctgctgct

SEQ ID NO: 370685 - DNA, 25 bp, Mus musculus
ctatctatcaaagcttgctgctgct

SEQ ID NO: 370686 - DNA, 25 bp, Mus musculus
ctatctatctagcaccatgtctatc

SEQ ID NO: 370687 - DNA, 25 bp, Mus musculus
ctatctatctaggaccatgtctatc

SEQ ID NO: 370688 - DNA, 25 bp, Mus musculus
ctatctatgcacatacgacgggtcg

SEQ ID NO: 370689 - DNA, 25 bp, Mus musculus
ctatctatgcacttacgacgggtcg

SEQ ID NO: 370690 - DNA, 25 bp, Mus musculus
ctatctatggctatgttcctacacg

SEQ ID NO: 370691 - DNA, 25 bp, Mus musculus
ctatctatggctttgttcctacacg

SEQ ID NO: 370692 - DNA, 25 bp, Mus musculus
ctatctcagcaaagagcctcacttg

SEQ ID NO: 370693 - DNA, 25 bp, Mus musculus
ctatctcagcaatgagcctcacttg

SEQ ID NO: 370694 - DNA, 25 bp, Mus musculus
ctatctcatggtctcttctgttgtt

SEQ ID NO: 370695 - DNA, 25 bp, Mus musculus
ctatctcatggtgtcttctgttgtt

SEQ ID NO: 370696 - DNA, 25 bp, Mus musculus
ctatctcccagaatgactagcacat

SEQ ID NO: 370697 - DNA, 25 bp, Mus musculus
ctatctcccagattgactagcacat

SEQ ID NO: 370698 - DNA, 25 bp, Mus musculus
ctatctcccaggaagaatggcctaa

SEQ ID NO: 370699 - DNA, 25 bp, Mus musculus
ctatctcccaggtagaatggcctaa

SEQ ID NO: 370700 - DNA, 25 bp, Mus musculus
ctatctcccagtctctaggattgta

SEQ ID NO: 370701 - DNA, 25 bp, Mus musculus
ctatctcccagtgtctaggattgta

SEQ ID NO: 370702 - DNA, 25 bp, Mus musculus
ctatctcgcccactgaaatcacagg

SEQ ID NO: 370703 - DNA, 25 bp, Mus musculus
ctatctcgcccagtgaaatcacagg

SEQ ID NO: 370704 - DNA, 25 bp, Mus musculus
ctatctcgctgtattgcttataacg

SEQ ID NO: 370705 - DNA, 25 bp, Mus musculus
ctatctcgctgttttgcttataacg

SEQ ID NO: 370706 - DNA, 25 bp, Mus musculus
ctatctcgtatgaggttatgccagt

SEQ ID NO: 370707 - DNA, 25 bp, Mus musculus
ctatctcgtatgtggttatgccagt

SEQ ID NO: 370708 - DNA, 25 bp, Mus musculus
ctatctcgtgagagcttgtttctgt

SEQ ID NO: 370709 - DNA, 25 bp, Mus musculus
ctatctcgtgagtgcttgtttctgt

SEQ ID NO: 370710 - DNA, 25 bp, Mus musculus
ctatctctactcaggatggtatgaa

SEQ ID NO: 370711 - DNA, 25 bp, Mus musculus
ctatctctactctggatggtatgaa

SEQ ID NO: 370712 - DNA, 25 bp, Mus musculus
ctatctctatatatttgggcagctt

SEQ ID NO: 370713 - DNA, 25 bp, Mus musculus
ctatctctatatttttgggcagctt

SEQ ID NO: 370714 - DNA, 25 bp, Mus musculus
ctatctctccgtactatccatcgga

SEQ ID NO: 370715 - DNA, 25 bp, Mus musculus
ctatctctccgttctatccatcgga

SEQ ID NO: 370716 - DNA, 25 bp, Mus musculus
ctatctctcctcaaatgcttaagtc

SEQ ID NO: 370717 - DNA, 25 bp, Mus musculus
ctatctctcctctaatgcttaagtc

SEQ ID NO: 370718 - DNA, 25 bp, Mus musculus
ctatctctgcctaggaggtacagaa

SEQ ID NO: 370719 - DNA, 25 bp, Mus musculus
ctatctctgcctcaacattgccggg

SEQ ID NO: 370720 - DNA, 25 bp, Mus musculus
ctatctctgcctgaacattgccggg

SEQ ID NO: 370721 - DNA, 25 bp, Mus musculus
ctatctctgccttggaggtacagaa

SEQ ID NO: 370722 - DNA, 25 bp, Mus musculus
ctatctctttatctatctattgcta

SEQ ID NO: 370723 - DNA, 25 bp, Mus musculus
ctatctctttatgtatctattgcta

SEQ ID NO: 370724 - DNA, 25 bp, Mus musculus
ctatctgaagtactgggtccctgaa

SEQ ID NO: 370725 - DNA, 25 bp, Mus musculus
ctatctgaagtagtgggtccctgaa

SEQ ID NO: 370726 - DNA, 25 bp, Mus musculus
ctatctgaatccaagcctttagaat

SEQ ID NO: 370727 - DNA, 25 bp, Mus musculus
ctatctgaatcctagcctttagaat

SEQ ID NO: 370728 - DNA, 25 bp, Mus musculus
ctatctgactctagctgaacccaga

SEQ ID NO: 370729 - DNA, 25 bp, Mus musculus
ctatctgactcttgctgaacccaga

SEQ ID NO: 370730 - DNA, 25 bp, Mus musculus
ctatctgactgcatcactgaacaca

SEQ ID NO: 370731 - DNA, 25 bp, Mus musculus
ctatctgactgcttcactgaacaca

SEQ ID NO: 370732 - DNA, 25 bp, Mus musculus
ctatctgcactccaaactagacacg

SEQ ID NO: 370733 - DNA, 25 bp, Mus musculus
ctatctgcactcgaaactagacacg

SEQ ID NO: 370734 - DNA, 25 bp, Mus musculus
ctatctgccacactcatgtatacat

SEQ ID NO: 370735 - DNA, 25 bp, Mus musculus
ctatctgccacagtcatgtatacat

SEQ ID NO: 370736 - DNA, 25 bp, Mus musculus
ctatctgcgagtcggtagtggccat

SEQ ID NO: 370737 - DNA, 25 bp, Mus musculus
ctatctgcgagtgggtagtggccat

SEQ ID NO: 370738 - DNA, 25 bp, Mus musculus
ctatctgctacaacaactgcctgga

SEQ ID NO: 370739 - DNA, 25 bp, Mus musculus
ctatctgctacatcaactgcctgga

SEQ ID NO: 370740 - DNA, 25 bp, Mus musculus
ctatctgctagacttggacactgtg

SEQ ID NO: 370741 - DNA, 25 bp, Mus musculus
ctatctgctagagttggacactgtg

SEQ ID NO: 370742 - DNA, 25 bp, Mus musculus
ctatctgcttctatctattgaagag

SEQ ID NO: 370743 - DNA, 25 bp, Mus musculus
ctatctgcttctttctattgaagag

SEQ ID NO: 370744 - DNA, 25 bp, Mus musculus
ctatctggaaccagggctgctagaa

SEQ ID NO: 370745 - DNA, 25 bp, Mus musculus
ctatctggaacctgggctgctagaa

SEQ ID NO: 370746 - DNA, 25 bp, Mus musculus
ctatctggaggtatcttttggcgaa

SEQ ID NO: 370747 - DNA, 25 bp, Mus musculus
ctatctggaggtcttttgcttgtca

SEQ ID NO: 370748 - DNA, 25 bp, Mus musculus
ctatctggaggtgttttgcttgtca

SEQ ID NO: 370749 - DNA, 25 bp, Mus musculus
ctatctggaggtttcttttggcgaa

SEQ ID NO: 370750 - DNA, 25 bp, Mus musculus
ctatctggcagtagctatgtggacc

SEQ ID NO: 370751 - DNA, 25 bp, Mus musculus
ctatctggcagttgctatgtggacc

SEQ ID NO: 370752 - DNA, 25 bp, Mus musculus
ctatctggccctataaatgatcttt

SEQ ID NO: 370753 - DNA, 25 bp, Mus musculus
ctatctggccctttaaatgatcttt

SEQ ID NO: 370754 - DNA, 25 bp, Mus musculus
ctatctggtcttaataacaagggct

SEQ ID NO: 370755 - DNA, 25 bp, Mus musculus
ctatctggtctttataacaagggct

SEQ ID NO: 370756 - DNA, 25 bp, Mus musculus
ctatctgtaagaagctttatcaagt

SEQ ID NO: 370757 - DNA, 25 bp, Mus musculus
ctatctgtaagacagctaaagcctt

SEQ ID NO: 370758 - DNA, 25 bp, Mus musculus
ctatctgtaagagagctaaagcctt

SEQ ID NO: 370759 - DNA, 25 bp, Mus musculus
ctatctgtaagatgctttatcaagt

SEQ ID NO: 370760 - DNA, 25 bp, Mus musculus
ctatctgtaataagatcagactccc

SEQ ID NO: 370761 - DNA, 25 bp, Mus musculus
ctatctgtaatatgatcagactccc

SEQ ID NO: 370762 - DNA, 25 bp, Mus musculus
ctatctgtacagaagggactgggag

SEQ ID NO: 370763 - DNA, 25 bp, Mus musculus
ctatctgtacagtagggactgggag

SEQ ID NO: 370764 - DNA, 25 bp, Mus musculus
ctatctgtcagtagtcctattttat

SEQ ID NO: 370765 - DNA, 25 bp, Mus musculus
ctatctgtcagttgtcctattttat

SEQ ID NO: 370766 - DNA, 25 bp, Mus musculus
ctatctgttccgcagctcttatata

SEQ ID NO: 370767 - DNA, 25 bp, Mus musculus
ctatctgttccggagctcttatata

SEQ ID NO: 370768 - DNA, 25 bp, Mus musculus
ctatctgttggtatcaattctgcca

SEQ ID NO: 370769 - DNA, 25 bp, Mus musculus
ctatctgttggtttcaattctgcca

SEQ ID NO: 370770 - DNA, 25 bp, Mus musculus
ctatctgtttgtccgtctgtgtgtc

SEQ ID NO: 370771 - DNA, 25 bp, Mus musculus
ctatctgtttgtgcgtctgtgtgtc

SEQ ID NO: 370772 - DNA, 25 bp, Mus musculus
ctatcttaaaaaattctctctaggg

SEQ ID NO: 370773 - DNA, 25 bp, Mus musculus
ctatcttaaaaatttctctctaggg

SEQ ID NO: 370774 - DNA, 25 bp, Mus musculus
ctatcttacactcggagaaggagga

SEQ ID NO: 370775 - DNA, 25 bp, Mus musculus
ctatcttacactgggagaaggagga

SEQ ID NO: 370776 - DNA, 25 bp, Mus musculus
ctatcttagtgacggccctccctag

SEQ ID NO: 370777 - DNA, 25 bp, Mus musculus
ctatcttagtgagggccctccctag

SEQ ID NO: 370778 - DNA, 25 bp, Mus musculus
ctatcttcccttctaaggtcttgga

SEQ ID NO: 370779 - DNA, 25 bp, Mus musculus
ctatcttcccttgtaaggtcttgga

SEQ ID NO: 370780 - DNA, 25 bp, Mus musculus
ctatcttcctccatgagcaaagcga

SEQ ID NO: 370781 - DNA, 25 bp, Mus musculus
ctatcttcctccttgagcaaagcga

SEQ ID NO: 370782 - DNA, 25 bp, Mus musculus
ctatcttctacactgacatcatgct

SEQ ID NO: 370783 - DNA, 25 bp, Mus musculus
ctatcttctacagtgacatcatgct

SEQ ID NO: 370784 - DNA, 25 bp, Mus musculus
ctatcttcttagaacatgtccagct

SEQ ID NO: 370785 - DNA, 25 bp, Mus musculus
ctatcttcttagtacatgtccagct

SEQ ID NO: 370786 - DNA, 25 bp, Mus musculus
ctatcttgacggcaggaacaccaag

SEQ ID NO: 370787 - DNA, 25 bp, Mus musculus
ctatcttgacgggaggaacaccaag

SEQ ID NO: 370788 - DNA, 25 bp, Mus musculus
ctatctttcctaactttccaagtga

SEQ ID NO: 370789 - DNA, 25 bp, Mus musculus
ctatctttcctatctttccaagtga

SEQ ID NO: 370790 - DNA, 25 bp, Mus musculus
ctatctttgtatctgtctctctctg

SEQ ID NO: 370791 - DNA, 25 bp, Mus musculus
ctatctttgtatgtgtctctctctg

SEQ ID NO: 370792 - DNA, 25 bp, Mus musculus
ctatcttttactagttttctgttag

SEQ ID NO: 370793 - DNA, 25 bp, Mus musculus
ctatcttttacttgttttctgttag

SEQ ID NO: 370794 - DNA, 25 bp, Mus musculus
ctatcttttagtctaggtcccacct

SEQ ID NO: 370795 - DNA, 25 bp, Mus musculus
ctatcttttagtgtaggtcccacct

SEQ ID NO: 370796 - DNA, 25 bp, Mus musculus
ctatcttttcttctatgtttccatg

SEQ ID NO: 370797 - DNA, 25 bp, Mus musculus
ctatcttttcttgtatgtttccatg

SEQ ID NO: 370798 - DNA, 25 bp, Mus musculus
ctatcttttgtaagtgaattttttc

SEQ ID NO: 370799 - DNA, 25 bp, Mus musculus
ctatcttttgtatgtgaattttttc

SEQ ID NO: 370800 - DNA, 25 bp, Mus musculus
ctatctttttccaggtgggctgaaa

SEQ ID NO: 370801 - DNA, 25 bp, Mus musculus
ctatctttttcctggtgggctgaaa

SEQ ID NO: 370802 - DNA, 25 bp, Mus musculus
ctatgaaaacctaccctttgacagt

SEQ ID NO: 370803 - DNA, 25 bp, Mus musculus
ctatgaaaaccttccctttgacagt

SEQ ID NO: 370804 - DNA, 25 bp, Mus musculus
ctatgaaactttcaggtctacccct

SEQ ID NO: 370805 - DNA, 25 bp, Mus musculus
ctatgaaactttgaggtctacccct

SEQ ID NO: 370806 - DNA, 25 bp, Mus musculus
ctatgaaagtggacgggccattccg

SEQ ID NO: 370807 - DNA, 25 bp, Mus musculus
ctatgaaagtggtcgggccattccg

SEQ ID NO: 370808 - DNA, 25 bp, Mus musculus
ctatgaaatcgcccttcttgaagac

SEQ ID NO: 370809 - DNA, 25 bp, Mus musculus
ctatgaaatcgcgcttcttgaagac

SEQ ID NO: 370810 - DNA, 25 bp, Mus musculus
ctatgaaatgctagcccaggcccag

SEQ ID NO: 370811 - DNA, 25 bp, Mus musculus
ctatgaaatgcttgcccaggcccag

SEQ ID NO: 370812 - DNA, 25 bp, Mus musculus
ctatgaacacttatacaatgagctg

SEQ ID NO: 370813 - DNA, 25 bp, Mus musculus
ctatgaacacttttacaatgagctg

SEQ ID NO: 370814 - DNA, 25 bp, Mus musculus
ctatgaaccctacccagaacatgga

SEQ ID NO: 370815 - DNA, 25 bp, Mus musculus
ctatgaaccctagccagaacatgga

SEQ ID NO: 370816 - DNA, 25 bp, Mus musculus
ctatgaacctaaaaaatgagacaag

SEQ ID NO: 370817 - DNA, 25 bp, Mus musculus
ctatgaacctaataaatgagacaag

SEQ ID NO: 370818 - DNA, 25 bp, Mus musculus
ctatgaactagaagatacatgtgcc

SEQ ID NO: 370819 - DNA, 25 bp, Mus musculus
ctatgaactagatgatacatgtgcc

SEQ ID NO: 370820 - DNA, 25 bp, Mus musculus
ctatgaagccccaggacagagcagt

SEQ ID NO: 370821 - DNA, 25 bp, Mus musculus
ctatgaagcccctggacagagcagt

SEQ ID NO: 370822 - DNA, 25 bp, Mus musculus
ctatgaagctttagtgcctgagccc

SEQ ID NO: 370823 - DNA, 25 bp, Mus musculus
ctatgaagctttctgtctcagctcc

SEQ ID NO: 370824 - DNA, 25 bp, Mus musculus
ctatgaagctttgtgtctcagctcc

SEQ ID NO: 370825 - DNA, 25 bp, Mus musculus
ctatgaagcttttgtgcctgagccc

SEQ ID NO: 370826 - DNA, 25 bp, Mus musculus
ctatgaaggtttagctgaaggtacc

SEQ ID NO: 370827 - DNA, 25 bp, Mus musculus
ctatgaaggttttgctgaaggtacc

SEQ ID NO: 370828 - DNA, 25 bp, Mus musculus
ctatgaagtaagaagctctctaggg

SEQ ID NO: 370829 - DNA, 25 bp, Mus musculus
ctatgaagtaagtagctctctaggg

SEQ ID NO: 370830 - DNA, 25 bp, Mus musculus
ctatgaagtgtcataccgcatcggg

SEQ ID NO: 370831 - DNA, 25 bp, Mus musculus
ctatgaagtgtcttaccgcatcggg

SEQ ID NO: 370832 - DNA, 25 bp, Mus musculus
ctatgaataactatctctgtgtttt

SEQ ID NO: 370833 - DNA, 25 bp, Mus musculus
ctatgaataactttctctgtgtttt

SEQ ID NO: 370834 - DNA, 25 bp, Mus musculus
ctatgaatagtcctgtagccttggg

SEQ ID NO: 370835 - DNA, 25 bp, Mus musculus
ctatgaatagtcgtgtagccttggg

SEQ ID NO: 370836 - DNA, 25 bp, Mus musculus
ctatgaatcacgagaccagtaactg

SEQ ID NO: 370837 - DNA, 25 bp, Mus musculus
ctatgaatcacgtgaccagtaactg

SEQ ID NO: 370838 - DNA, 25 bp, Mus musculus
ctatgaatgaagcatcccatgggca

SEQ ID NO: 370839 - DNA, 25 bp, Mus musculus
ctatgaatgaaggatcccatgggca

SEQ ID NO: 370840 - DNA, 25 bp, Mus musculus
ctatgaatgttccatctgcctgact

SEQ ID NO: 370841 - DNA, 25 bp, Mus musculus
ctatgaatgttcgatctgcctgact

SEQ ID NO: 370842 - DNA, 25 bp, Mus musculus
ctatgaattctgcaaatgctgtctt

SEQ ID NO: 370843 - DNA, 25 bp, Mus musculus
ctatgaattctggaaatgctgtctt

SEQ ID NO: 370844 - DNA, 25 bp, Mus musculus
ctatgacaggatcccgtgccttttt

SEQ ID NO: 370845 - DNA, 25 bp, Mus musculus
ctatgacaggatgccgtgccttttt

SEQ ID NO: 370846 - DNA, 25 bp, Mus musculus
ctatgacagtgcagatctggtggca

SEQ ID NO: 370847 - DNA, 25 bp, Mus musculus
ctatgacagtgctgatctggtggca

SEQ ID NO: 370848 - DNA, 25 bp, Mus musculus
ctatgacatcgacatgaccaagtgt

SEQ ID NO: 370849 - DNA, 25 bp, Mus musculus
ctatgacatcgagatgaccaagtgt

SEQ ID NO: 370850 - DNA, 25 bp, Mus musculus
ctatgacattgcctgctgggaacat

SEQ ID NO: 370851 - DNA, 25 bp, Mus musculus
ctatgacattgcgtgctgggaacat

SEQ ID NO: 370852 - DNA, 25 bp, Mus musculus
ctatgacctggtacttgctgaagat

SEQ ID NO: 370853 - DNA, 25 bp, Mus musculus
ctatgacctggttcttgctgaagat

SEQ ID NO: 370854 - DNA, 25 bp, Mus musculus
ctatgacctgttatctacagttggt

SEQ ID NO: 370855 - DNA, 25 bp, Mus musculus
ctatgacctgttttctacagttggt

SEQ ID NO: 370856 - DNA, 25 bp, Mus musculus
ctatgaccttgaaatccgtatcctc

SEQ ID NO: 370857 - DNA, 25 bp, Mus musculus
ctatgaccttgatatccgtatcctc

SEQ ID NO: 370858 - DNA, 25 bp, Mus musculus
ctatgacggccaagtgtgggacaca

SEQ ID NO: 370859 - DNA, 25 bp, Mus musculus
ctatgacggccatgtgtgggacaca

SEQ ID NO: 370860 - DNA, 25 bp, Mus musculus
ctatgacggtgtaacgacagatccc

SEQ ID NO: 370861 - DNA, 25 bp, Mus musculus
ctatgacggtgttacgacagatccc

SEQ ID NO: 370862 - DNA, 25 bp, Mus musculus
ctatgacgtaagctgtgttctaaca

SEQ ID NO: 370863 - DNA, 25 bp, Mus musculus
ctatgacgtaaggtgtgttctaaca

SEQ ID NO: 370864 - DNA, 25 bp, Mus musculus
ctatgacgtcatactaacacctgta

SEQ ID NO: 370865 - DNA, 25 bp, Mus musculus
ctatgacgtcattctaacacctgta

SEQ ID NO: 370866 - DNA, 25 bp, Mus musculus
ctatgacgtctccagcttgaagcaa

SEQ ID NO: 370867 - DNA, 25 bp, Mus musculus
ctatgacgtctcgagcttgaagcaa

SEQ ID NO: 370868 - DNA, 25 bp, Mus musculus
ctatgactacctcaaccgatggaca

SEQ ID NO: 370869 - DNA, 25 bp, Mus musculus
ctatgactacctgaaccgatggaca

SEQ ID NO: 370870 - DNA, 25 bp, Mus musculus
ctatgactatttcctggcagccgaa

SEQ ID NO: 370871 - DNA, 25 bp, Mus musculus
ctatgactatttgctggcagccgaa

SEQ ID NO: 370872 - DNA, 25 bp, Mus musculus
ctatgactctggaaacaaagccttt

SEQ ID NO: 370873 - DNA, 25 bp, Mus musculus
ctatgactctggtaacaaagccttt

SEQ ID NO: 370874 - DNA, 25 bp, Mus musculus
ctatgactggatcgtaatgttgact

SEQ ID NO: 370875 - DNA, 25 bp, Mus musculus
ctatgactggatggtaatgttgact

SEQ ID NO: 370876 - DNA, 25 bp, Mus musculus
ctatgactgtgactgcctaggcggc

SEQ ID NO: 370877 - DNA, 25 bp, Mus musculus
ctatgactgtgagtgcctaggcggc

SEQ ID NO: 370878 - DNA, 25 bp, Mus musculus
ctatgactgtgtctcgtcttgctta

SEQ ID NO: 370879 - DNA, 25 bp, Mus musculus
ctatgactgtgtgtcgtcttgctta

SEQ ID NO: 370880 - DNA, 25 bp, Mus musculus
ctatgacttagtctgtttacgtgtg

SEQ ID NO: 370881 - DNA, 25 bp, Mus musculus
ctatgacttagtgtgtttacgtgtg

SEQ ID NO: 370882 - DNA, 25 bp, Mus musculus
ctatgagaaaatactccttcaggtc

SEQ ID NO: 370883 - DNA, 25 bp, Mus musculus
ctatgagaaaattctccttcaggtc

SEQ ID NO: 370884 - DNA, 25 bp, Mus musculus
ctatgagaacgacctggccttcctg

SEQ ID NO: 370885 - DNA, 25 bp, Mus musculus
ctatgagaacgagctggccttcctg

SEQ ID NO: 370886 - DNA, 25 bp, Mus musculus
ctatgagaatgcatacgggaggttc

SEQ ID NO: 370887 - DNA, 25 bp, Mus musculus
ctatgagaatgcttacgggaggttc

SEQ ID NO: 370888 - DNA, 25 bp, Mus musculus
ctatgagataacaggcgagcccctg

SEQ ID NO: 370889 - DNA, 25 bp, Mus musculus
ctatgagataactggcgagcccctg

SEQ ID NO: 370890 - DNA, 25 bp, Mus musculus
ctatgagatacaaagcggcggccgg

SEQ ID NO: 370891 - DNA, 25 bp, Mus musculus
ctatgagatacatagcggcggccgg

SEQ ID NO: 370892 - DNA, 25 bp, Mus musculus
ctatgagatctccttgcagcttgac

SEQ ID NO: 370893 - DNA, 25 bp, Mus musculus
ctatgagatctcgttgcagcttgac

SEQ ID NO: 370894 - DNA, 25 bp, Mus musculus
ctatgagatctgagcgtgtcctgat

SEQ ID NO: 370895 - DNA, 25 bp, Mus musculus
ctatgagatctgtgcgtgtcctgat

SEQ ID NO: 370896 - DNA, 25 bp, Mus musculus
ctatgagcagctcaaaagagcccta

SEQ ID NO: 370897 - DNA, 25 bp, Mus musculus
ctatgagcagctgaaaagagcccta

SEQ ID NO: 370898 - DNA, 25 bp, Mus musculus
ctatgagcaggccttggagctgttt

SEQ ID NO: 370899 - DNA, 25 bp, Mus musculus
ctatgagcaggcgttggagctgttt

SEQ ID NO: 370900 - DNA, 25 bp, Mus musculus
ctatgagccaccatgcttgtagttt

SEQ ID NO: 370901 - DNA, 25 bp, Mus musculus
ctatgagccaccttgcttgtagttt

SEQ ID NO: 370902 - DNA, 25 bp, Mus musculus
ctatgagccgagacgctcctgccaa

SEQ ID NO: 370903 - DNA, 25 bp, Mus musculus
ctatgagccgagtcgctcctgccaa

SEQ ID NO: 370904 - DNA, 25 bp, Mus musculus
ctatgagcgcgtaagcaagaggctg

SEQ ID NO: 370905 - DNA, 25 bp, Mus musculus
ctatgagcgcgttagcaagaggctg

SEQ ID NO: 370906 - DNA, 25 bp, Mus musculus
ctatgagctgtaaggcccggagcct

SEQ ID NO: 370907 - DNA, 25 bp, Mus musculus
ctatgagctgtatggcccggagcct

SEQ ID NO: 370908 - DNA, 25 bp, Mus musculus
ctatgagcttgcatccttgtgtgaa

SEQ ID NO: 370909 - DNA, 25 bp, Mus musculus
ctatgagcttgcttccttgtgtgaa

SEQ ID NO: 370910 - DNA, 25 bp, Mus musculus
ctatgaggatgtctccccaagcggg

SEQ ID NO: 370911 - DNA, 25 bp, Mus musculus
ctatgaggatgtgtccccaagcggg

SEQ ID NO: 370912 - DNA, 25 bp, Mus musculus
ctatgaggcaaacagagccagctgg

SEQ ID NO: 370913 - DNA, 25 bp, Mus musculus
ctatgaggcaaagagagccagctgg

SEQ ID NO: 370914 - DNA, 25 bp, Mus musculus
ctatgagtacctcacgagattgcca

SEQ ID NO: 370915 - DNA, 25 bp, Mus musculus
ctatgagtacctgacgagattgcca

SEQ ID NO: 370916 - DNA, 25 bp, Mus musculus
ctatgagtatgtctgtgagtcttac

SEQ ID NO: 370917 - DNA, 25 bp, Mus musculus
ctatgagtatgtgtgtgagtcttac

SEQ ID NO: 370918 - DNA, 25 bp, Mus musculus
ctatgagttcacctttcggaggttt

SEQ ID NO: 370919 - DNA, 25 bp, Mus musculus
ctatgagttcacgtttcggaggttt

SEQ ID NO: 370920 - DNA, 25 bp, Mus musculus
ctatgagttcccctatgagtactgg

SEQ ID NO: 370921 - DNA, 25 bp, Mus musculus
ctatgagttcccgtatgagtactgg

SEQ ID NO: 370922 - DNA, 25 bp, Mus musculus
ctatgagtttccacaccagcctgat

SEQ ID NO: 370923 - DNA, 25 bp, Mus musculus
ctatgagtttcctcaccagcctgat

SEQ ID NO: 370924 - DNA, 25 bp, Mus musculus
ctatgatacctgaatcttttctcta

SEQ ID NO: 370925 - DNA, 25 bp, Mus musculus
ctatgatacctgtatcttttctcta

SEQ ID NO: 370926 - DNA, 25 bp, Mus musculus
ctatgatacgaaccccggtctttcc

SEQ ID NO: 370927 - DNA, 25 bp, Mus musculus
ctatgatacgaagcccggtctttcc

SEQ ID NO: 370928 - DNA, 25 bp, Mus musculus
ctatgatacgtgattccctttgttg

SEQ ID NO: 370929 - DNA, 25 bp, Mus musculus
ctatgatacgtgtttccctttgttg

SEQ ID NO: 370930 - DNA, 25 bp, Mus musculus
ctatgatctacgcttgctgctggca

SEQ ID NO: 370931 - DNA, 25 bp, Mus musculus
ctatgatctacggttgctgctggca

SEQ ID NO: 370932 - DNA, 25 bp, Mus musculus
ctatgatctgatctgaggaacctga

SEQ ID NO: 370933 - DNA, 25 bp, Mus musculus
ctatgatctgatgtgaggaacctga

SEQ ID NO: 370934 - DNA, 25 bp, Mus musculus
ctatgatgaagcactctctccaaca

SEQ ID NO: 370935 - DNA, 25 bp, Mus musculus
ctatgatgaagctctctctccaaca

SEQ ID NO: 370936 - DNA, 25 bp, Mus musculus
ctatgatgactgagccaagattctg

SEQ ID NO: 370937 - DNA, 25 bp, Mus musculus
ctatgatgactgtgccaagattctg

SEQ ID NO: 370938 - DNA, 25 bp, Mus musculus
ctatgatgatgtccgaggccctgct

SEQ ID NO: 370939 - DNA, 25 bp, Mus musculus
ctatgatgatgtgcgaggccctgct

SEQ ID NO: 370940 - DNA, 25 bp, Mus musculus
ctatgatggaggaggtggctcacct

SEQ ID NO: 370941 - DNA, 25 bp, Mus musculus
ctatgatggaggtggtggctcacct

SEQ ID NO: 370942 - DNA, 25 bp, Mus musculus
ctatgatgtagaaaagcagccttca

SEQ ID NO: 370943 - DNA, 25 bp, Mus musculus
ctatgatgtagataagcagccttca

SEQ ID NO: 370944 - DNA, 25 bp, Mus musculus
ctatgattcttacgttgaggatgga

SEQ ID NO: 370945 - DNA, 25 bp, Mus musculus
ctatgattcttaggttgaggatgga

SEQ ID NO: 370946 - DNA, 25 bp, Mus musculus
ctatgattggccacctggcagaggc

SEQ ID NO: 370947 - DNA, 25 bp, Mus musculus
ctatgattggcctcctggcagaggc

SEQ ID NO: 370948 - DNA, 25 bp, Mus musculus
ctatgattgtatagtgcgttcttat

SEQ ID NO: 370949 - DNA, 25 bp, Mus musculus
ctatgattgtattgtgcgttcttat

SEQ ID NO: 370950 - DNA, 25 bp, Mus musculus
ctatgatttcaaatgcaggagacca

SEQ ID NO: 370951 - DNA, 25 bp, Mus musculus
ctatgatttcaattgcaggagacca

SEQ ID NO: 370952 - DNA, 25 bp, Mus musculus
ctatgcaaatccacaccatgactaa

SEQ ID NO: 370953 - DNA, 25 bp, Mus musculus
ctatgcaaatcctcaccatgactaa

SEQ ID NO: 370954 - DNA, 25 bp, Mus musculus
ctatgcaaatgacctgtcttaattc

SEQ ID NO: 370955 - DNA, 25 bp, Mus musculus
ctatgcaaatgagctgtcttaattc

SEQ ID NO: 370956 - DNA, 25 bp, Mus musculus
ctatgcaactctcccgggcagaggg

SEQ ID NO: 370957 - DNA, 25 bp, Mus musculus
ctatgcaactctgccgggcagaggg

SEQ ID NO: 370958 - DNA, 25 bp, Mus musculus
ctatgcaacttaatgtggctcttct

SEQ ID NO: 370959 - DNA, 25 bp, Mus musculus
ctatgcaacttattgtggctcttct

SEQ ID NO: 370960 - DNA, 25 bp, Mus musculus
ctatgcaagtttaatcagatgatca

SEQ ID NO: 370961 - DNA, 25 bp, Mus musculus
ctatgcaagttttatcagatgatca

SEQ ID NO: 370962 - DNA, 25 bp, Mus musculus
ctatgcaatagtatcagtatgtcac

SEQ ID NO: 370963 - DNA, 25 bp, Mus musculus
ctatgcaatagtttcagtatgtcac

SEQ ID NO: 370964 - DNA, 25 bp, Mus musculus
ctatgcactttcatgtggtgttcca

SEQ ID NO: 370965 - DNA, 25 bp, Mus musculus
ctatgcactttcttgtggtgttcca

SEQ ID NO: 370966 - DNA, 25 bp, Mus musculus
ctatgcatcgttaaggccagaccag

SEQ ID NO: 370967 - DNA, 25 bp, Mus musculus
ctatgcatcgtttaggccagaccag

SEQ ID NO: 370968 - DNA, 25 bp, Mus musculus
ctatgcatttacatcacttttgtgt

SEQ ID NO: 370969 - DNA, 25 bp, Mus musculus
ctatgcatttacttcacttttgtgt

SEQ ID NO: 370970 - DNA, 25 bp, Mus musculus
ctatgcatttagatccagtggtcca

SEQ ID NO: 370971 - DNA, 25 bp, Mus musculus
ctatgcatttagttccagtggtcca

SEQ ID NO: 370972 - DNA, 25 bp, Mus musculus
ctatgccaaatacctgactgactta

SEQ ID NO: 370973 - DNA, 25 bp, Mus musculus
ctatgccaaatagctgactgactta

SEQ ID NO: 370974 - DNA, 25 bp, Mus musculus
ctatgccaagatagcagcggacttc

SEQ ID NO: 370975 - DNA, 25 bp, Mus musculus
ctatgccaagattgcagcggacttc

SEQ ID NO: 370976 - DNA, 25 bp, Mus musculus
ctatgccaagtacccactactaatg

SEQ ID NO: 370977 - DNA, 25 bp, Mus musculus
ctatgccaagtagccactactaatg

SEQ ID NO: 370978 - DNA, 25 bp, Mus musculus
ctatgccacggcaaggttaaaacca

SEQ ID NO: 370979 - DNA, 25 bp, Mus musculus
ctatgccacggctaggttaaaacca

SEQ ID NO: 370980 - DNA, 25 bp, Mus musculus
ctatgccactcacccaacttatttg

SEQ ID NO: 370981 - DNA, 25 bp, Mus musculus
ctatgccactcagccaacttatttg

SEQ ID NO: 370982 - DNA, 25 bp, Mus musculus
ctatgccaggaacccttctctgaag

SEQ ID NO: 370983 - DNA, 25 bp, Mus musculus
ctatgccaggaagccttctctgaag

SEQ ID NO: 370984 - DNA, 25 bp, Mus musculus
ctatgccaggctacatgactttaca

SEQ ID NO: 370985 - DNA, 25 bp, Mus musculus
ctatgccaggcttcatgactttaca

SEQ ID NO: 370986 - DNA, 25 bp, Mus musculus
ctatgccctaaaccactatcaagag

SEQ ID NO: 370987 - DNA, 25 bp, Mus musculus
ctatgccctaaagcactatcaagag

SEQ ID NO: 370988 - DNA, 25 bp, Mus musculus
ctatgccctgatcagtgtgtgtgga

SEQ ID NO: 370989 - DNA, 25 bp, Mus musculus
ctatgccctgatgagtgtgtgtgga

SEQ ID NO: 370990 - DNA, 25 bp, Mus musculus
ctatgccctgtgacccaacaaaata

SEQ ID NO: 370991 - DNA, 25 bp, Mus musculus
ctatgccctgtgtcccaacaaaata

SEQ ID NO: 370992 - DNA, 25 bp, Mus musculus
ctatgccgatgcagcccactggaag

SEQ ID NO: 370993 - DNA, 25 bp, Mus musculus
ctatgccgatgctgcccactggaag

SEQ ID NO: 370994 - DNA, 25 bp, Mus musculus
ctatgccgctacaattgcttccaaa

SEQ ID NO: 370995 - DNA, 25 bp, Mus musculus
ctatgccgctactattgcttccaaa

SEQ ID NO: 370996 - DNA, 25 bp, Mus musculus
ctatgccggtgaccaggcttctgcc

SEQ ID NO: 370997 - DNA, 25 bp, Mus musculus
ctatgccggtgagcaggcttctgcc

SEQ ID NO: 370998 - DNA, 25 bp, Mus musculus
ctatgccgtggtcgtgattgcatct

SEQ ID NO: 370999 - DNA, 25 bp, Mus musculus
ctatgccgtggtggtgattgcatct

SEQ ID NO: 371000 - DNA, 25 bp, Mus musculus
ctatgcctaaagctcctataccatt

SEQ ID NO: 371001 - DNA, 25 bp, Mus musculus
ctatgcctaaaggtcctataccatt

SEQ ID NO: 371002 - DNA, 25 bp, Mus musculus
ctatgcctcctgcattttatacaaa

SEQ ID NO: 371003 - DNA, 25 bp, Mus musculus
ctatgcctcctggattttatacaaa

SEQ ID NO: 371004 - DNA, 25 bp, Mus musculus
ctatgcctctctaggagcaaatgat

SEQ ID NO: 371005 - DNA, 25 bp, Mus musculus
ctatgcctctcttggagcaaatgat

SEQ ID NO: 371006 - DNA, 25 bp, Mus musculus
ctatgcctgggaatgtggagaccga

SEQ ID NO: 371007 - DNA, 25 bp, Mus musculus
ctatgcctgggattgtggagaccga

SEQ ID NO: 371008 - DNA, 25 bp, Mus musculus
ctatgcctttttactggtgaactga

SEQ ID NO: 371009 - DNA, 25 bp, Mus musculus
ctatgccttttttctggtgaactga

SEQ ID NO: 371010 - DNA, 25 bp, Mus musculus
ctatgcgatcatagtgtatcaccac

SEQ ID NO: 371011 - DNA, 25 bp, Mus musculus
ctatgcgatcattgtgtatcaccac

SEQ ID NO: 371012 - DNA, 25 bp, Mus musculus
ctatgcgcagtacggcagctgtaac

SEQ ID NO: 371013 - DNA, 25 bp, Mus musculus
ctatgcgcagtagggcagctgtaac

SEQ ID NO: 371014 - DNA, 25 bp, Mus musculus
ctatgcgctgtactgtgtagcccgc

SEQ ID NO: 371015 - DNA, 25 bp, Mus musculus
ctatgcgctgtagtgtgtagcccgc

SEQ ID NO: 371016 - DNA, 25 bp, Mus musculus
ctatgcggctagatgatcagtgtga

SEQ ID NO: 371017 - DNA, 25 bp, Mus musculus
ctatgcggctagttgatcagtgtga

SEQ ID NO: 371018 - DNA, 25 bp, Mus musculus
ctatgctaatgtactctcaagccgg

SEQ ID NO: 371019 - DNA, 25 bp, Mus musculus
ctatgctaatgttctctcaagccgg

SEQ ID NO: 371020 - DNA, 25 bp, Mus musculus
ctatgctagctcatggtgccttgag

SEQ ID NO: 371021 - DNA, 25 bp, Mus musculus
ctatgctagctcttggtgccttgag

SEQ ID NO: 371022 - DNA, 25 bp, Mus musculus
ctatgctatcatcaaattcccactg

SEQ ID NO: 371023 - DNA, 25 bp, Mus musculus
ctatgctatcatgaaattcccactg

SEQ ID NO: 371024 - DNA, 25 bp, Mus musculus
ctatgctcaacaatcctcaactgaa

SEQ ID NO: 371025 - DNA, 25 bp, Mus musculus
ctatgctcaacattcctcaactgaa

SEQ ID NO: 371026 - DNA, 25 bp, Mus musculus
ctatgctcaataacctggactccat

SEQ ID NO: 371027 - DNA, 25 bp, Mus musculus
ctatgctcaatatcctggactccat

SEQ ID NO: 371028 - DNA, 25 bp, Mus musculus
ctatgctcatgcaaagaaccgactt

SEQ ID NO: 371029 - DNA, 25 bp, Mus musculus
ctatgctcatgctaagaaccgactt

SEQ ID NO: 371030 - DNA, 25 bp, Mus musculus
ctatgctcccttcttacttttatct

SEQ ID NO: 371031 - DNA, 25 bp, Mus musculus
ctatgctcccttgttacttttatct

SEQ ID NO: 371032 - DNA, 25 bp, Mus musculus
ctatgctcgtgccttcctgatggag

SEQ ID NO: 371033 - DNA, 25 bp, Mus musculus
ctatgctcgtgcgttcctgatggag

SEQ ID NO: 371034 - DNA, 25 bp, Mus musculus
ctatgctgacctcgacatggtccac

SEQ ID NO: 371035 - DNA, 25 bp, Mus musculus
ctatgctgacctggacatggtccac

SEQ ID NO: 371036 - DNA, 25 bp, Mus musculus
ctatgctgccaactaggattattga

SEQ ID NO: 371037 - DNA, 25 bp, Mus musculus
ctatgctgccaagtaggattattga

SEQ ID NO: 371038 - DNA, 25 bp, Mus musculus
ctatgctgctggagacatctgcact

SEQ ID NO: 371039 - DNA, 25 bp, Mus musculus
ctatgctgctggtgacatctgcact

SEQ ID NO: 371040 - DNA, 25 bp, Mus musculus
ctatgctgcttgaagctggctggca

SEQ ID NO: 371041 - DNA, 25 bp, Mus musculus
ctatgctgcttgtagctggctggca

SEQ ID NO: 371042 - DNA, 25 bp, Mus musculus
ctatgctggactccttgttgtaaaa

SEQ ID NO: 371043 - DNA, 25 bp, Mus musculus
ctatgctggactgcttgttgtaaaa

SEQ ID NO: 371044 - DNA, 25 bp, Mus musculus
ctatgctgtgccctcggagctcctg

SEQ ID NO: 371045 - DNA, 25 bp, Mus musculus
ctatgctgtgccgtcggagctcctg

SEQ ID NO: 371046 - DNA, 25 bp, Mus musculus
ctatgctgttggcatcgtcctacaa

SEQ ID NO: 371047 - DNA, 25 bp, Mus musculus
ctatgctgttgggatcgtcctacaa

SEQ ID NO: 371048 - DNA, 25 bp, Mus musculus
ctatgcttctttacctccttggaga

SEQ ID NO: 371049 - DNA, 25 bp, Mus musculus
ctatgcttcttttcctccttggaga

SEQ ID NO: 371050 - DNA, 25 bp, Mus musculus
ctatgcttgaagaggcatcccctct

SEQ ID NO: 371051 - DNA, 25 bp, Mus musculus
ctatgcttgaagtggcatcccctct

SEQ ID NO: 371052 - DNA, 25 bp, Mus musculus
ctatgcttgaatcgcacgcggtaca

SEQ ID NO: 371053 - DNA, 25 bp, Mus musculus
ctatgcttgaatggcacgcggtaca

SEQ ID NO: 371054 - DNA, 25 bp, Mus musculus
ctatgcttggatccagagaatggcc

SEQ ID NO: 371055 - DNA, 25 bp, Mus musculus
ctatgcttggatgcagagaatggcc

SEQ ID NO: 371056 - DNA, 25 bp, Mus musculus
ctatgctttgtaccttaggctacaa

SEQ ID NO: 371057 - DNA, 25 bp, Mus musculus
ctatgctttgtagcttaggctacaa

SEQ ID NO: 371058 - DNA, 25 bp, Mus musculus
ctatgcttttcaccccttaaattga

SEQ ID NO: 371059 - DNA, 25 bp, Mus musculus
ctatgcttttcagcccttaaattga

SEQ ID NO: 371060 - DNA, 25 bp, Mus musculus
ctatggaaactcactgaatagagga

SEQ ID NO: 371061 - DNA, 25 bp, Mus musculus
ctatggaaactctctgaatagagga

SEQ ID NO: 371062 - DNA, 25 bp, Mus musculus
ctatggaaataaaaccctacagatg

SEQ ID NO: 371063 - DNA, 25 bp, Mus musculus
ctatggaaataataccctacagatg

SEQ ID NO: 371064 - DNA, 25 bp, Mus musculus
ctatggaacactattgtgggaacag

SEQ ID NO: 371065 - DNA, 25 bp, Mus musculus
ctatggaacacttttgtgggaacag

SEQ ID NO: 371066 - DNA, 25 bp, Mus musculus
ctatggaacttgaactgcaggtggt

SEQ ID NO: 371067 - DNA, 25 bp, Mus musculus
ctatggaacttgtactgcaggtggt

SEQ ID NO: 371068 - DNA, 25 bp, Mus musculus
ctatggaagagtaaggcgatggctt

SEQ ID NO: 371069 - DNA, 25 bp, Mus musculus
ctatggaagagttaggcgatggctt

SEQ ID NO: 371070 - DNA, 25 bp, Mus musculus
ctatggactgggaatcggtaggcac

SEQ ID NO: 371071 - DNA, 25 bp, Mus musculus
ctatggactgggtatcggtaggcac

SEQ ID NO: 371072 - DNA, 25 bp, Mus musculus
ctatggactgtccaactacagagaa

SEQ ID NO: 371073 - DNA, 25 bp, Mus musculus
ctatggactgtcgaactacagagaa

SEQ ID NO: 371074 - DNA, 25 bp, Mus musculus
ctatggagaagacgtggcacaatca

SEQ ID NO: 371075 - DNA, 25 bp, Mus musculus
ctatggagaagaggtggcacaatca

SEQ ID NO: 371076 - DNA, 25 bp, Mus musculus
ctatggagaggtacatggcacagat

SEQ ID NO: 371077 - DNA, 25 bp, Mus musculus
ctatggagaggttcatggcacagat

SEQ ID NO: 371078 - DNA, 25 bp, Mus musculus
ctatggagatgacgcctcgttctca

SEQ ID NO: 371079 - DNA, 25 bp, Mus musculus
ctatggagatgaggcctcgttctca

SEQ ID NO: 371080 - DNA, 25 bp, Mus musculus
ctatggagcctcagttttacctaaa

SEQ ID NO: 371081 - DNA, 25 bp, Mus musculus
ctatggagcctctgttttacctaaa

SEQ ID NO: 371082 - DNA, 25 bp, Mus musculus
ctatggaggatgaaccagcggctgc

SEQ ID NO: 371083 - DNA, 25 bp, Mus musculus
ctatggaggatgtaccagcggctgc

SEQ ID NO: 371084 - DNA, 25 bp, Mus musculus
ctatggagtcatcagtttgggcccc

SEQ ID NO: 371085 - DNA, 25 bp, Mus musculus
ctatggagtcatgagtttgggcccc

SEQ ID NO: 371086 - DNA, 25 bp, Mus musculus
ctatggagtgttaacattacacaag

SEQ ID NO: 371087 - DNA, 25 bp, Mus musculus
ctatggagtgtttacattacacaag

SEQ ID NO: 371088 - DNA, 25 bp, Mus musculus
ctatggataaccctgagttgttaca

SEQ ID NO: 371089 - DNA, 25 bp, Mus musculus
ctatggataaccgtgagttgttaca

SEQ ID NO: 371090 - DNA, 25 bp, Mus musculus
ctatggatatggctgctgccgccca

SEQ ID NO: 371091 - DNA, 25 bp, Mus musculus
ctatggatatgggtgctgccgccca

SEQ ID NO: 371092 - DNA, 25 bp, Mus musculus
ctatggatctccacttacagcagtg

SEQ ID NO: 371093 - DNA, 25 bp, Mus musculus
ctatggatctcctcttacagcagtg

SEQ ID NO: 371094 - DNA, 25 bp, Mus musculus
ctatggatgcttatcaaaggcacac

SEQ ID NO: 371095 - DNA, 25 bp, Mus musculus
ctatggatgcttttcaaaggcacac

SEQ ID NO: 371096 - DNA, 25 bp, Mus musculus
ctatggattaagaagctgccgttac

SEQ ID NO: 371097 - DNA, 25 bp, Mus musculus
ctatggattaagtagctgccgttac

SEQ ID NO: 371098 - DNA, 25 bp, Mus musculus
ctatggattactcagttgctgatta

SEQ ID NO: 371099 - DNA, 25 bp, Mus musculus
ctatggattactgagttgctgatta

SEQ ID NO: 371100 - DNA, 25 bp, Mus musculus
ctatggattgaaccccatgttatca

SEQ ID NO: 371101 - DNA, 25 bp, Mus musculus
ctatggattgaagcccatgttatca

SEQ ID NO: 371102 - DNA, 25 bp, Mus musculus
ctatggcactatcactgcattaaaa

SEQ ID NO: 371103 - DNA, 25 bp, Mus musculus
ctatggcactatgactgcattaaaa

SEQ ID NO: 371104 - DNA, 25 bp, Mus musculus
ctatggcacttcacccaagcaaagt

SEQ ID NO: 371105 - DNA, 25 bp, Mus musculus
ctatggcacttctcccaagcaaagt

SEQ ID NO: 371106 - DNA, 25 bp, Mus musculus
ctatggcatccaagacagtgtcaca

SEQ ID NO: 371107 - DNA, 25 bp, Mus musculus
ctatggcatccatgacagtgtcaca

SEQ ID NO: 371108 - DNA, 25 bp, Mus musculus
ctatggcatctacaccaaagtggga

SEQ ID NO: 371109 - DNA, 25 bp, Mus musculus
ctatggcatctagaccaaagtggga

SEQ ID NO: 371110 - DNA, 25 bp, Mus musculus
ctatggcatgggaaagggctttatt

SEQ ID NO: 371111 - DNA, 25 bp, Mus musculus
ctatggcatgggtaagggctttatt

SEQ ID NO: 371112 - DNA, 25 bp, Mus musculus
ctatggcattgacgcactgagtgtc

SEQ ID NO: 371113 - DNA, 25 bp, Mus musculus
ctatggcattgaggcactgagtgtc

SEQ ID NO: 371114 - DNA, 25 bp, Mus musculus
ctatggccattaatggagctgtggt

SEQ ID NO: 371115 - DNA, 25 bp, Mus musculus
ctatggccattattggagctgtggt

SEQ ID NO: 371116 - DNA, 25 bp, Mus musculus
ctatggcccctacctaagtggccaa

SEQ ID NO: 371117 - DNA, 25 bp, Mus musculus
ctatggcccctagctaagtggccaa

SEQ ID NO: 371118 - DNA, 25 bp, Mus musculus
ctatggcccgctcctgggaggaaaa

SEQ ID NO: 371119 - DNA, 25 bp, Mus musculus
ctatggcccgctgctgggaggaaaa

SEQ ID NO: 371120 - DNA, 25 bp, Mus musculus
ctatggccggccactgttaacactg

SEQ ID NO: 371121 - DNA, 25 bp, Mus musculus
ctatggccggcctctgttaacactg

SEQ ID NO: 371122 - DNA, 25 bp, Mus musculus
ctatggcctggtccatccggtcaag

SEQ ID NO: 371123 - DNA, 25 bp, Mus musculus
ctatggcctggtgcatccggtcaag

SEQ ID NO: 371124 - DNA, 25 bp, Mus musculus
ctatggcctttaaagggcagtcagc

SEQ ID NO: 371125 - DNA, 25 bp, Mus musculus
ctatggcctttatagggcagtcagc

SEQ ID NO: 371126 - DNA, 25 bp, Mus musculus
ctatggctatgtagatgctacgtat

SEQ ID NO: 371127 - DNA, 25 bp, Mus musculus
ctatggctatgttgatgctacgtat

SEQ ID NO: 371128 - DNA, 25 bp, Mus musculus
ctatggctcccaaattcattttatt

SEQ ID NO: 371129 - DNA, 25 bp, Mus musculus
ctatggctcccatattcattttatt

SEQ ID NO: 371130 - DNA, 25 bp, Mus musculus
ctatggctctgcaagtgccttaaac

SEQ ID NO: 371131 - DNA, 25 bp, Mus musculus
ctatggctctgctagtgccttaaac

SEQ ID NO: 371132 - DNA, 25 bp, Mus musculus
ctatggctctggaacacacgaacat

SEQ ID NO: 371133 - DNA, 25 bp, Mus musculus
ctatggctctggtacacacgaacat

SEQ ID NO: 371134 - DNA, 25 bp, Mus musculus
ctatggctgattatgtttatatatt

SEQ ID NO: 371135 - DNA, 25 bp, Mus musculus
ctatggctgattttgtttatatatt

SEQ ID NO: 371136 - DNA, 25 bp, Mus musculus
ctatggctgcatatcccaagaagca

SEQ ID NO: 371137 - DNA, 25 bp, Mus musculus
ctatggctgcatttcccaagaagca

SEQ ID NO: 371138 - DNA, 25 bp, Mus musculus
ctatggctgccgcaaatgctttggg

SEQ ID NO: 371139 - DNA, 25 bp, Mus musculus
ctatggctgccggaaatgctttggg

SEQ ID NO: 371140 - DNA, 25 bp, Mus musculus
ctatggcttaagagcattccttggg

SEQ ID NO: 371141 - DNA, 25 bp, Mus musculus
ctatggcttaagtgcattccttggg

SEQ ID NO: 371142 - DNA, 25 bp, Mus musculus
ctatggctttctcaacatcaacttc

SEQ ID NO: 371143 - DNA, 25 bp, Mus musculus
ctatggctttctgaacatcaacttc

SEQ ID NO: 371144 - DNA, 25 bp, Mus musculus
ctatggctttgacgaagctgacctt

SEQ ID NO: 371145 - DNA, 25 bp, Mus musculus
ctatggctttgaggaagctgacctt

SEQ ID NO: 371146 - DNA, 25 bp, Mus musculus
ctatgggactagagagagctgactt

SEQ ID NO: 371147 - DNA, 25 bp, Mus musculus
ctatgggactagtgagagctgactt

SEQ ID NO: 371148 - DNA, 25 bp, Mus musculus
ctatgggactatcgagctgggaaaa

SEQ ID NO: 371149 - DNA, 25 bp, Mus musculus
ctatgggactatggagctgggaaaa

SEQ ID NO: 371150 - DNA, 25 bp, Mus musculus
ctatgggactcaaatgtgaagaact

SEQ ID NO: 371151 - DNA, 25 bp, Mus musculus
ctatgggactcatatgtgaagaact

SEQ ID NO: 371152 - DNA, 25 bp, Mus musculus
ctatgggactctcgctggtttggaa

SEQ ID NO: 371153 - DNA, 25 bp, Mus musculus
ctatgggactctggctggtttggaa

SEQ ID NO: 371154 - DNA, 25 bp, Mus musculus
ctatgggactgtagttctgaactga

SEQ ID NO: 371155 - DNA, 25 bp, Mus musculus
ctatgggactgttgttctgaactga

SEQ ID NO: 371156 - DNA, 25 bp, Mus musculus
ctatgggagccgcaagactctattt

SEQ ID NO: 371157 - DNA, 25 bp, Mus musculus
ctatgggagccggaagactctattt

SEQ ID NO: 371158 - DNA, 25 bp, Mus musculus
ctatgggatcatcgctatcctactt

SEQ ID NO: 371159 - DNA, 25 bp, Mus musculus
ctatgggatcatggctatcctactt

SEQ ID NO: 371160 - DNA, 25 bp, Mus musculus
ctatgggcacctagattgtttccgc

SEQ ID NO: 371161 - DNA, 25 bp, Mus musculus
ctatgggcaccttgattgtttccgc

SEQ ID NO: 371162 - DNA, 25 bp, Mus musculus
ctatgggccaggaggatcccctgga

SEQ ID NO: 371163 - DNA, 25 bp, Mus musculus
ctatgggccaggtggatcccctgga

SEQ ID NO: 371164 - DNA, 25 bp, Mus musculus
ctatgggcctggaacgtatagctag

SEQ ID NO: 371165 - DNA, 25 bp, Mus musculus
ctatgggcctggtacgtatagctag

SEQ ID NO: 371166 - DNA, 25 bp, Mus musculus
ctatgggtaaataatatgtgggact

SEQ ID NO: 371167 - DNA, 25 bp, Mus musculus
ctatgggtaaattatatgtgggact

SEQ ID NO: 371168 - DNA, 25 bp, Mus musculus
ctatgggtacacacctagtgggcta

SEQ ID NO: 371169 - DNA, 25 bp, Mus musculus
ctatgggtacactcctagtgggcta

SEQ ID NO: 371170 - DNA, 25 bp, Mus musculus
ctatgggtataactttgactttgtc

SEQ ID NO: 371171 - DNA, 25 bp, Mus musculus
ctatgggtataagtttgactttgtc

SEQ ID NO: 371172 - DNA, 25 bp, Mus musculus
ctatgggtgttaacacctagctgaa

SEQ ID NO: 371173 - DNA, 25 bp, Mus musculus
ctatgggtgttatcacctagctgaa

SEQ ID NO: 371174 - DNA, 25 bp, Mus musculus
ctatgggttcccagaggtggaccga

SEQ ID NO: 371175 - DNA, 25 bp, Mus musculus
ctatgggttccctgaggtggaccga

SEQ ID NO: 371176 - DNA, 25 bp, Mus musculus
ctatggtaaagtatttcagagtctc

SEQ ID NO: 371177 - DNA, 25 bp, Mus musculus
ctatggtaaagtttttcagagtctc

SEQ ID NO: 371178 - DNA, 25 bp, Mus musculus
ctatggtcacaaccggtaccggcag

SEQ ID NO: 371179 - DNA, 25 bp, Mus musculus
ctatggtcacaagcggtaccggcag

SEQ ID NO: 371180 - DNA, 25 bp, Mus musculus
ctatggtcaccactgtaactgcaac

SEQ ID NO: 371181 - DNA, 25 bp, Mus musculus
ctatggtcaccagtgtaactgcaac

SEQ ID NO: 371182 - DNA, 25 bp, Mus musculus
ctatggtcagctaactgaactgtga

SEQ ID NO: 371183 - DNA, 25 bp, Mus musculus
ctatggtcagcttactgaactgtga

SEQ ID NO: 371184 - DNA, 25 bp, Mus musculus
ctatggtctagaaccgtgctcagtg

SEQ ID NO: 371185 - DNA, 25 bp, Mus musculus
ctatggtctagatccgtgctcagtg

SEQ ID NO: 371186 - DNA, 25 bp, Mus musculus
ctatggtctgtgatgctgcttgaga

SEQ ID NO: 371187 - DNA, 25 bp, Mus musculus
ctatggtctgtgttgctgcttgaga

SEQ ID NO: 371188 - DNA, 25 bp, Mus musculus
ctatggtcttttcgcctggagttaa

SEQ ID NO: 371189 - DNA, 25 bp, Mus musculus
ctatggtcttttggcctggagttaa

SEQ ID NO: 371190 - DNA, 25 bp, Mus musculus
ctatggtgacttcgacgcctacagg

SEQ ID NO: 371191 - DNA, 25 bp, Mus musculus
ctatggtgacttggacgcctacagg

SEQ ID NO: 371192 - DNA, 25 bp, Mus musculus
ctatggtgagcacacgagcaggctt

SEQ ID NO: 371193 - DNA, 25 bp, Mus musculus
ctatggtgagcagacgagcaggctt

SEQ ID NO: 371194 - DNA, 25 bp, Mus musculus
ctatggtgagtcacatctgtgtgtc

SEQ ID NO: 371195 - DNA, 25 bp, Mus musculus
ctatggtgagtctcatctgtgtgtc

SEQ ID NO: 371196 - DNA, 25 bp, Mus musculus
ctatggtgcccaatctctgtcctac

SEQ ID NO: 371197 - DNA, 25 bp, Mus musculus
ctatggtgcccattctctgtcctac

SEQ ID NO: 371198 - DNA, 25 bp, Mus musculus
ctatggtgcgatcagtaaggattcc

SEQ ID NO: 371199 - DNA, 25 bp, Mus musculus
ctatggtgcgatgagtaaggattcc

SEQ ID NO: 371200 - DNA, 25 bp, Mus musculus
ctatggtggaacctcagcctgtctc

SEQ ID NO: 371201 - DNA, 25 bp, Mus musculus
ctatggtggaacgtcagcctgtctc

SEQ ID NO: 371202 - DNA, 25 bp, Mus musculus
ctatggtggtggctggagagcttcc

SEQ ID NO: 371203 - DNA, 25 bp, Mus musculus
ctatggtggtgggtggagagcttcc

SEQ ID NO: 371204 - DNA, 25 bp, Mus musculus
ctatggtgtcacaggcaatggcgat

SEQ ID NO: 371205 - DNA, 25 bp, Mus musculus
ctatggtgtcactggcaatggcgat

SEQ ID NO: 371206 - DNA, 25 bp, Mus musculus
ctatggtgtcatcaactggttggct

SEQ ID NO: 371207 - DNA, 25 bp, Mus musculus
ctatggtgtcatgaactggttggct

SEQ ID NO: 371208 - DNA, 25 bp, Mus musculus
ctatggtgtctgagaagctgaggct

SEQ ID NO: 371209 - DNA, 25 bp, Mus musculus
ctatggtgtctgtgaagctgaggct

SEQ ID NO: 371210 - DNA, 25 bp, Mus musculus
ctatggtgtttcagtgcctgtctac

SEQ ID NO: 371211 - DNA, 25 bp, Mus musculus
ctatggtgtttctgtgcctgtctac

SEQ ID NO: 371212 - DNA, 25 bp, Mus musculus
ctatggttacgaacccatgggtgga

SEQ ID NO: 371213 - DNA, 25 bp, Mus musculus
ctatggttacgatcccatgggtgga

SEQ ID NO: 371214 - DNA, 25 bp, Mus musculus
ctatggttccagctatggccttggg

SEQ ID NO: 371215 - DNA, 25 bp, Mus musculus
ctatggttccaggtatggccttggg

SEQ ID NO: 371216 - DNA, 25 bp, Mus musculus
ctatggttctatacaagctgtatgt

SEQ ID NO: 371217 - DNA, 25 bp, Mus musculus
ctatggttctattcaagctgtatgt

SEQ ID NO: 371218 - DNA, 25 bp, Mus musculus
ctatggttgggcaagaactcattat

SEQ ID NO: 371219 - DNA, 25 bp, Mus musculus
ctatggttgggctagaactcattat

SEQ ID NO: 371220 - DNA, 25 bp, Mus musculus
ctatggtttctcacttgttgcaaca

SEQ ID NO: 371221 - DNA, 25 bp, Mus musculus
ctatggtttctctcttgttgcaaca

SEQ ID NO: 371222 - DNA, 25 bp, Mus musculus
ctatggttttacatgctgcgggccg

SEQ ID NO: 371223 - DNA, 25 bp, Mus musculus
ctatggttttacttgctgcgggccg

SEQ ID NO: 371224 - DNA, 25 bp, Mus musculus
ctatggttttctaggctattgcagc

SEQ ID NO: 371225 - DNA, 25 bp, Mus musculus
ctatggttttcttggctattgcagc

SEQ ID NO: 371226 - DNA, 25 bp, Mus musculus
ctatgtaatctacctgaccagtgtt

SEQ ID NO: 371227 - DNA, 25 bp, Mus musculus
ctatgtaatctagctgaccagtgtt

SEQ ID NO: 371228 - DNA, 25 bp, Mus musculus
ctatgtacacatatctgctcttaaa

SEQ ID NO: 371229 - DNA, 25 bp, Mus musculus
ctatgtacacatttctgctcttaaa

SEQ ID NO: 371230 - DNA, 25 bp, Mus musculus
ctatgtacagacactgggccatcta

SEQ ID NO: 371231 - DNA, 25 bp, Mus musculus
ctatgtacagactctgggccatcta

SEQ ID NO: 371232 - DNA, 25 bp, Mus musculus
ctatgtagccttcgcatcattttct

SEQ ID NO: 371233 - DNA, 25 bp, Mus musculus
ctatgtagccttggcatcattttct

SEQ ID NO: 371234 - DNA, 25 bp, Mus musculus
ctatgtagctctctggtcgcagtaa

SEQ ID NO: 371235 - DNA, 25 bp, Mus musculus
ctatgtagctctgtggtcgcagtaa

SEQ ID NO: 371236 - DNA, 25 bp, Mus musculus
ctatgtagcttcaaggcatccttac

SEQ ID NO: 371237 - DNA, 25 bp, Mus musculus
ctatgtagcttctaggcatccttac

SEQ ID NO: 371238 - DNA, 25 bp, Mus musculus
ctatgtatacccaaagtcagccctc

SEQ ID NO: 371239 - DNA, 25 bp, Mus musculus
ctatgtataccctaagtcagccctc

SEQ ID NO: 371240 - DNA, 25 bp, Mus musculus
ctatgtatcatcagagacaatcaag

SEQ ID NO: 371241 - DNA, 25 bp, Mus musculus
ctatgtatcatctgagacaatcaag

SEQ ID NO: 371242 - DNA, 25 bp, Mus musculus
ctatgtatctccaagagagtctcct

SEQ ID NO: 371243 - DNA, 25 bp, Mus musculus
ctatgtatctcctagagagtctcct

SEQ ID NO: 371244 - DNA, 25 bp, Mus musculus
ctatgtatgtccaatgaagcgcttt

SEQ ID NO: 371245 - DNA, 25 bp, Mus musculus
ctatgtatgtcctatgaagcgcttt

SEQ ID NO: 371246 - DNA, 25 bp, Mus musculus
ctatgtattataaggcattcatttg

SEQ ID NO: 371247 - DNA, 25 bp, Mus musculus
ctatgtattatatggcattcatttg

SEQ ID NO: 371248 - DNA, 25 bp, Mus musculus
ctatgtattcctaccctcaaattca

SEQ ID NO: 371249 - DNA, 25 bp, Mus musculus
ctatgtattccttccctcaaattca

SEQ ID NO: 371250 - DNA, 25 bp, Mus musculus
ctatgtcagttccaccattgttaaa

SEQ ID NO: 371251 - DNA, 25 bp, Mus musculus
ctatgtcagttcgaccattgttaaa

SEQ ID NO: 371252 - DNA, 25 bp, Mus musculus
ctatgtccaggacgactcaaccctt

SEQ ID NO: 371253 - DNA, 25 bp, Mus musculus
ctatgtccaggaggactcaaccctt

SEQ ID NO: 371254 - DNA, 25 bp, Mus musculus
ctatgtccattgaggttttgtgtgt

SEQ ID NO: 371255 - DNA, 25 bp, Mus musculus
ctatgtccattgtggttttgtgtgt

SEQ ID NO: 371256 - DNA, 25 bp, Mus musculus
ctatgtccttatagctgacgtcaag

SEQ ID NO: 371257 - DNA, 25 bp, Mus musculus
ctatgtccttattgctgacgtcaag

SEQ ID NO: 371258 - DNA, 25 bp, Mus musculus
ctatgtccttcacagtcaatgggtc

SEQ ID NO: 371259 - DNA, 25 bp, Mus musculus
ctatgtccttcagagtcaatgggtc

SEQ ID NO: 371260 - DNA, 25 bp, Mus musculus
ctatgtctaatgacttcattcctgt

SEQ ID NO: 371261 - DNA, 25 bp, Mus musculus
ctatgtctaatgtcttcattcctgt

SEQ ID NO: 371262 - DNA, 25 bp, Mus musculus
ctatgtctacctcccaggtacctgg

SEQ ID NO: 371263 - DNA, 25 bp, Mus musculus
ctatgtctacctgccaggtacctgg

SEQ ID NO: 371264 - DNA, 25 bp, Mus musculus
ctatgtctcagaagctaatgtgtta

SEQ ID NO: 371265 - DNA, 25 bp, Mus musculus
ctatgtctcagaattcttaaaaatg

SEQ ID NO: 371266 - DNA, 25 bp, Mus musculus
ctatgtctcagatgctaatgtgtta

SEQ ID NO: 371267 - DNA, 25 bp, Mus musculus
ctatgtctcagatttcttaaaaatg

SEQ ID NO: 371268 - DNA, 25 bp, Mus musculus
ctatgtctcattactctgtcttgtt

SEQ ID NO: 371269 - DNA, 25 bp, Mus musculus
ctatgtctcatttctctgtcttgtt

SEQ ID NO: 371270 - DNA, 25 bp, Mus musculus
ctatgtctccatatctgtatctata

SEQ ID NO: 371271 - DNA, 25 bp, Mus musculus
ctatgtctccatttctgtatctata

SEQ ID NO: 371272 - DNA, 25 bp, Mus musculus
ctatgtcttctgacttaattgttca

SEQ ID NO: 371273 - DNA, 25 bp, Mus musculus
ctatgtcttctgtcttaattgttca

SEQ ID NO: 371274 - DNA, 25 bp, Mus musculus
ctatgtctttatcaaccggcagttt

SEQ ID NO: 371275 - DNA, 25 bp, Mus musculus
ctatgtctttatgaaccggcagttt

SEQ ID NO: 371276 - DNA, 25 bp, Mus musculus
ctatgtcttttaaggctacttcaga

SEQ ID NO: 371277 - DNA, 25 bp, Mus musculus
ctatgtcttttatggctacttcaga

SEQ ID NO: 371278 - DNA, 25 bp, Mus musculus
ctatgtgacatcaacctttattttc

SEQ ID NO: 371279 - DNA, 25 bp, Mus musculus
ctatgtgacatctacctttattttc

SEQ ID NO: 371280 - DNA, 25 bp, Mus musculus
ctatgtgcacataacatgtacatac

SEQ ID NO: 371281 - DNA, 25 bp, Mus musculus
ctatgtgcacattacatgtacatac

SEQ ID NO: 371282 - DNA, 25 bp, Mus musculus
ctatgtgcagcaacctgacccaaag

SEQ ID NO: 371283 - DNA, 25 bp, Mus musculus
ctatgtgcagcatcctgacccaaag

SEQ ID NO: 371284 - DNA, 25 bp, Mus musculus
ctatgtgcccagagttttttcagta

SEQ ID NO: 371285 - DNA, 25 bp, Mus musculus
ctatgtgcccagtgttttttcagta

SEQ ID NO: 371286 - DNA, 25 bp, Mus musculus
ctatgtgccgaacaccttctttgaa

SEQ ID NO: 371287 - DNA, 25 bp, Mus musculus
ctatgtgccgaagaccttctttgaa

SEQ ID NO: 371288 - DNA, 25 bp, Mus musculus
ctatgtgctcgaaggcaaggagctg

SEQ ID NO: 371289 - DNA, 25 bp, Mus musculus
ctatgtgctcgatggcaaggagctg

SEQ ID NO: 371290 - DNA, 25 bp, Mus musculus
ctatgtgctggccatttgtttatca

SEQ ID NO: 371291 - DNA, 25 bp, Mus musculus
ctatgtgctggcgatttgtttatca

SEQ ID NO: 371292 - DNA, 25 bp, Mus musculus
ctatgtgctgtcatgctacccttat

SEQ ID NO: 371293 - DNA, 25 bp, Mus musculus
ctatgtgctgtcttgctacccttat

SEQ ID NO: 371294 - DNA, 25 bp, Mus musculus
ctatgtggctagatcccaggccagc

SEQ ID NO: 371295 - DNA, 25 bp, Mus musculus
ctatgtggctagttcccaggccagc

SEQ ID NO: 371296 - DNA, 25 bp, Mus musculus
ctatgtgtctttactgtgtggcttc

SEQ ID NO: 371297 - DNA, 25 bp, Mus musculus
ctatgtgtcttttctgtgtggcttc

SEQ ID NO: 371298 - DNA, 25 bp, Mus musculus
ctatgtgtgcacagagcgaccagga

SEQ ID NO: 371299 - DNA, 25 bp, Mus musculus
ctatgtgtgcactgagcgaccagga

SEQ ID NO: 371300 - DNA, 25 bp, Mus musculus
ctatgtgtggcaatgactttgcaca

SEQ ID NO: 371301 - DNA, 25 bp, Mus musculus
ctatgtgtggcattgactttgcaca

SEQ ID NO: 371302 - DNA, 25 bp, Mus musculus
ctatgtgtgtatccaggtatgtaac

SEQ ID NO: 371303 - DNA, 25 bp, Mus musculus
ctatgtgtgtatgcaggtatgtaac

SEQ ID NO: 371304 - DNA, 25 bp, Mus musculus
ctatgtgtgtctcgctaccgagcag

SEQ ID NO: 371305 - DNA, 25 bp, Mus musculus
ctatgtgtgtctggctaccgagcag

SEQ ID NO: 371306 - DNA, 25 bp, Mus musculus
ctatgtgtttgcataccttcattcc

SEQ ID NO: 371307 - DNA, 25 bp, Mus musculus
ctatgtgtttgcttaccttcattcc

SEQ ID NO: 371308 - DNA, 25 bp, Mus musculus
ctatgttaacctcaagatggactga

SEQ ID NO: 371309 - DNA, 25 bp, Mus musculus
ctatgttaacctgaagatggactga

SEQ ID NO: 371310 - DNA, 25 bp, Mus musculus
ctatgttatgttaccagctgcctgg

SEQ ID NO: 371311 - DNA, 25 bp, Mus musculus
ctatgttatgtttccagctgcctgg

SEQ ID NO: 371312 - DNA, 25 bp, Mus musculus
ctatgttcacaacggcccaggttat

SEQ ID NO: 371313 - DNA, 25 bp, Mus musculus
ctatgttcacaagggcccaggttat

SEQ ID NO: 371314 - DNA, 25 bp, Mus musculus
ctatgttcctccatgctacggttgc

SEQ ID NO: 371315 - DNA, 25 bp, Mus musculus
ctatgttcctccttgctacggttgc

SEQ ID NO: 371316 - DNA, 25 bp, Mus musculus
ctatgttcgttgatgtttggctttg

SEQ ID NO: 371317 - DNA, 25 bp, Mus musculus
ctatgttcgttgttgtttggctttg

SEQ ID NO: 371318 - DNA, 25 bp, Mus musculus
ctatgttgagatctgtctcttttct

SEQ ID NO: 371319 - DNA, 25 bp, Mus musculus
ctatgttgagatgtgtctcttttct

SEQ ID NO: 371320 - DNA, 25 bp, Mus musculus
ctatgttgagtgatacctgtaataa

SEQ ID NO: 371321 - DNA, 25 bp, Mus musculus
ctatgttgagtgttacctgtaataa

SEQ ID NO: 371322 - DNA, 25 bp, Mus musculus
ctatgttggaacatgtgagcgtctc

SEQ ID NO: 371323 - DNA, 25 bp, Mus musculus
ctatgttggaacttgtgagcgtctc

SEQ ID NO: 371324 - DNA, 25 bp, Mus musculus
ctatgttgtcccatgctgtagtaca

SEQ ID NO: 371325 - DNA, 25 bp, Mus musculus
ctatgttgtcccttgctgtagtaca

SEQ ID NO: 371326 - DNA, 25 bp, Mus musculus
ctatgttgttaccattcccaaaaag

SEQ ID NO: 371327 - DNA, 25 bp, Mus musculus
ctatgttgttacgattcccaaaaag

SEQ ID NO: 371328 - DNA, 25 bp, Mus musculus
ctatgtttaggaattgtgtggttac

SEQ ID NO: 371329 - DNA, 25 bp, Mus musculus
ctatgtttaggatttgtgtggttac

SEQ ID NO: 371330 - DNA, 25 bp, Mus musculus
ctatgtttcaagcagtgagtatttt

SEQ ID NO: 371331 - DNA, 25 bp, Mus musculus
ctatgtttcaaggagtgagtatttt

SEQ ID NO: 371332 - DNA, 25 bp, Mus musculus
ctatgtttctgaaccactacgtgca

SEQ ID NO: 371333 - DNA, 25 bp, Mus musculus
ctatgtttctgatccactacgtgca

SEQ ID NO: 371334 - DNA, 25 bp, Mus musculus
ctatgtttgtttacctatcagtggg

SEQ ID NO: 371335 - DNA, 25 bp, Mus musculus
ctatgtttgttttcctatcagtggg

SEQ ID NO: 371336 - DNA, 25 bp, Mus musculus
ctatgttttcaaactatgacgttgt

SEQ ID NO: 371337 - DNA, 25 bp, Mus musculus
ctatgttttcaatctatgacgttgt

SEQ ID NO: 371338 - DNA, 25 bp, Mus musculus
ctatgttttggccttaaaattctgt

SEQ ID NO: 371339 - DNA, 25 bp, Mus musculus
ctatgttttggcgttaaaattctgt

SEQ ID NO: 371340 - DNA, 25 bp, Mus musculus
ctatgtttttcaccttctaagaaag

SEQ ID NO: 371341 - DNA, 25 bp, Mus musculus
ctatgtttttcagcttctaagaaag

SEQ ID NO: 371342 - DNA, 25 bp, Mus musculus
ctatgtttttggatagagtgtgtac

SEQ ID NO: 371343 - DNA, 25 bp, Mus musculus
ctatgtttttggttagagtgtgtac

SEQ ID NO: 371344 - DNA, 25 bp, Mus musculus
ctattacacataatttgacttacat

SEQ ID NO: 371345 - DNA, 25 bp, Mus musculus
ctattacacatattttgacttacat

SEQ ID NO: 371346 - DNA, 25 bp, Mus musculus
ctattacagcacacaaaagcagttg

SEQ ID NO: 371347 - DNA, 25 bp, Mus musculus
ctattacagcactcaaaagcagttg

SEQ ID NO: 371348 - DNA, 25 bp, Mus musculus
ctattacaggaaccggcctagcact

SEQ ID NO: 371349 - DNA, 25 bp, Mus musculus
ctattacaggaagcggcctagcact

SEQ ID NO: 371350 - DNA, 25 bp, Mus musculus
ctattacctgctatgtgaagtgttt

SEQ ID NO: 371351 - DNA, 25 bp, Mus musculus
ctattacctgctttgtgaagtgttt

SEQ ID NO: 371352 - DNA, 25 bp, Mus musculus
ctattactatgtctgtctggtccga

SEQ ID NO: 371353 - DNA, 25 bp, Mus musculus
ctattactatgtgtgtctggtccga

SEQ ID NO: 371354 - DNA, 25 bp, Mus musculus
ctattactgcccagtagtgtccctt

SEQ ID NO: 371355 - DNA, 25 bp, Mus musculus
ctattactgccctgtagtgtccctt

SEQ ID NO: 371356 - DNA, 25 bp, Mus musculus
ctattactgtagagcctatggtgac

SEQ ID NO: 371357 - DNA, 25 bp, Mus musculus
ctattactgtagtgcctatggtgac

SEQ ID NO: 371358 - DNA, 25 bp, Mus musculus
ctattactgtgcaagtctccggccc

SEQ ID NO: 371359 - DNA, 25 bp, Mus musculus
ctattactgtgctagtctccggccc

SEQ ID NO: 371360 - DNA, 25 bp, Mus musculus
ctattagactatatacactcagcaa

SEQ ID NO: 371361 - DNA, 25 bp, Mus musculus
ctattagactatttacactcagcaa

SEQ ID NO: 371362 - DNA, 25 bp, Mus musculus
ctattagcaagcctgtgagttattt

SEQ ID NO: 371363 - DNA, 25 bp, Mus musculus
ctattagcaagcgtgtgagttattt

SEQ ID NO: 371364 - DNA, 25 bp, Mus musculus
ctattagccaggatcatggtgtaat

SEQ ID NO: 371365 - DNA, 25 bp, Mus musculus
ctattagccaggttcatggtgtaat

SEQ ID NO: 371366 - DNA, 25 bp, Mus musculus
ctattagcttatctgaggtgctccc

SEQ ID NO: 371367 - DNA, 25 bp, Mus musculus
ctattagcttatgtgaggtgctccc

SEQ ID NO: 371368 - DNA, 25 bp, Mus musculus
ctattaggcccactatagctaagga

SEQ ID NO: 371369 - DNA, 25 bp, Mus musculus
ctattaggcccagtatagctaagga

SEQ ID NO: 371370 - DNA, 25 bp, Mus musculus
ctattagtttttctgacgccctaca

SEQ ID NO: 371371 - DNA, 25 bp, Mus musculus
ctattagtttttgtgacgccctaca

SEQ ID NO: 371372 - DNA, 25 bp, Mus musculus
ctattatcgcagagctgatccaggc

SEQ ID NO: 371373 - DNA, 25 bp, Mus musculus
ctattatcgcagtgctgatccaggc

SEQ ID NO: 371374 - DNA, 25 bp, Mus musculus
ctattatttataacccttggcccct

SEQ ID NO: 371375 - DNA, 25 bp, Mus musculus
ctattatttataacctcagacttgg

SEQ ID NO: 371376 - DNA, 25 bp, Mus musculus
ctattatttatatcccttggcccct

SEQ ID NO: 371377 - DNA, 25 bp, Mus musculus
ctattatttatatcctcagacttgg

SEQ ID NO: 371378 - DNA, 25 bp, Mus musculus
ctattatttctcaatttcccttctt

SEQ ID NO: 371379 - DNA, 25 bp, Mus musculus
ctattatttctctatttcccttctt

SEQ ID NO: 371380 - DNA, 25 bp, Mus musculus
ctattcacaggacccaatgtccata

SEQ ID NO: 371381 - DNA, 25 bp, Mus musculus
ctattcacaggagccaatgtccata

SEQ ID NO: 371382 - DNA, 25 bp, Mus musculus
ctattcacccagaggctaagcccag

SEQ ID NO: 371383 - DNA, 25 bp, Mus musculus
ctattcacccagtggctaagcccag

SEQ ID NO: 371384 - DNA, 25 bp, Mus musculus
ctattcacgtcaagtgtgtctttga

SEQ ID NO: 371385 - DNA, 25 bp, Mus musculus
ctattcacgtcatgtgtgtctttga

SEQ ID NO: 371386 - DNA, 25 bp, Mus musculus
ctattcagacctactttgcaaagag

SEQ ID NO: 371387 - DNA, 25 bp, Mus musculus
ctattcagaccttctttgcaaagag

SEQ ID NO: 371388 - DNA, 25 bp, Mus musculus
ctattcagatgaagtgcttcccact

SEQ ID NO: 371389 - DNA, 25 bp, Mus musculus
ctattcagatgatgtgcttcccact

SEQ ID NO: 371390 - DNA, 25 bp, Mus musculus
ctattcagatttcttgcacaagtat

SEQ ID NO: 371391 - DNA, 25 bp, Mus musculus
ctattcagatttgttgcacaagtat

SEQ ID NO: 371392 - DNA, 25 bp, Mus musculus
ctattcaggcctatggagcagcggg

SEQ ID NO: 371393 - DNA, 25 bp, Mus musculus
ctattcaggcctttggagcagcggg

SEQ ID NO: 371394 - DNA, 25 bp, Mus musculus
ctattcagtacccagcaaccaggag

SEQ ID NO: 371395 - DNA, 25 bp, Mus musculus
ctattcagtaccgagcaaccaggag

SEQ ID NO: 371396 - DNA, 25 bp, Mus musculus
ctattcagtgtgcagcagtggcaaa

SEQ ID NO: 371397 - DNA, 25 bp, Mus musculus
ctattcagtgtggagcagtggcaaa

SEQ ID NO: 371398 - DNA, 25 bp, Mus musculus
ctattcatgttaatttgctggctat

SEQ ID NO: 371399 - DNA, 25 bp, Mus musculus
ctattcatgttattttgctggctat

SEQ ID NO: 371400 - DNA, 25 bp, Mus musculus
ctattccaagaaacgggtgcccagc

SEQ ID NO: 371401 - DNA, 25 bp, Mus musculus
ctattccaagaatcgggtgcccagc

SEQ ID NO: 371402 - DNA, 25 bp, Mus musculus
ctattccaagaccacgcagatctgt

SEQ ID NO: 371403 - DNA, 25 bp, Mus musculus
ctattccaagacgacgcagatctgt

SEQ ID NO: 371404 - DNA, 25 bp, Mus musculus
ctattccactaacagccttcaaatg

SEQ ID NO: 371405 - DNA, 25 bp, Mus musculus
ctattccactaagagccttcaaatg

SEQ ID NO: 371406 - DNA, 25 bp, Mus musculus
ctattccagcaaagtaccacccact

SEQ ID NO: 371407 - DNA, 25 bp, Mus musculus
ctattccagcaatgtaccacccact

SEQ ID NO: 371408 - DNA, 25 bp, Mus musculus
ctattccagcttactagtgtctttg

SEQ ID NO: 371409 - DNA, 25 bp, Mus musculus
ctattccagctttctagtgtctttg

SEQ ID NO: 371410 - DNA, 25 bp, Mus musculus
ctattcccactcacactatgagtat

SEQ ID NO: 371411 - DNA, 25 bp, Mus musculus
ctattcccactctcactatgagtat

SEQ ID NO: 371412 - DNA, 25 bp, Mus musculus
ctattcccgtgaagccatttggagg

SEQ ID NO: 371413 - DNA, 25 bp, Mus musculus
ctattcccgtgatgccatttggagg

SEQ ID NO: 371414 - DNA, 25 bp, Mus musculus
ctattcccgttgactgacttcataa

SEQ ID NO: 371415 - DNA, 25 bp, Mus musculus
ctattcccgttgtctgacttcataa

SEQ ID NO: 371416 - DNA, 25 bp, Mus musculus
ctattccgtgtgctcacagacacct

SEQ ID NO: 371417 - DNA, 25 bp, Mus musculus
ctattccgtgtggtcacagacacct

SEQ ID NO: 371418 - DNA, 25 bp, Mus musculus
ctattcctcttcaagcattttcaga

SEQ ID NO: 371419 - DNA, 25 bp, Mus musculus
ctattcctcttctagcattttcaga

SEQ ID NO: 371420 - DNA, 25 bp, Mus musculus
ctattcctgaccattttcattcttg

SEQ ID NO: 371421 - DNA, 25 bp, Mus musculus
ctattcctgacctttttcattcttg

SEQ ID NO: 371422 - DNA, 25 bp, Mus musculus
ctattccttctacaacattcacaca

SEQ ID NO: 371423 - DNA, 25 bp, Mus musculus
ctattccttctagaacattcacaca

SEQ ID NO: 371424 - DNA, 25 bp, Mus musculus
ctattcgggcatacctacttactat

SEQ ID NO: 371425 - DNA, 25 bp, Mus musculus
ctattcgggcattcctacttactat

SEQ ID NO: 371426 - DNA, 25 bp, Mus musculus
ctattcgttcatcaaaccaacccaa

SEQ ID NO: 371427 - DNA, 25 bp, Mus musculus
ctattcgttcatgaaaccaacccaa

SEQ ID NO: 371428 - DNA, 25 bp, Mus musculus
ctattctaacttcgccttcctgatg

SEQ ID NO: 371429 - DNA, 25 bp, Mus musculus
ctattctaacttggccttcctgatg

SEQ ID NO: 371430 - DNA, 25 bp, Mus musculus
ctattctacacactggaactttgcc

SEQ ID NO: 371431 - DNA, 25 bp, Mus musculus
ctattctacacagtggaactttgcc

SEQ ID NO: 371432 - DNA, 25 bp, Mus musculus
ctattctagcttctgtttgactttt

SEQ ID NO: 371433 - DNA, 25 bp, Mus musculus
ctattctagcttgtgtttgactttt

SEQ ID NO: 371434 - DNA, 25 bp, Mus musculus
ctattctatgggaggccgggcttca

SEQ ID NO: 371435 - DNA, 25 bp, Mus musculus
ctattctatgggtggccgggcttca

SEQ ID NO: 371436 - DNA, 25 bp, Mus musculus
ctattctccactcgcttttcgcctc

SEQ ID NO: 371437 - DNA, 25 bp, Mus musculus
ctattctccactggcttttcgcctc

SEQ ID NO: 371438 - DNA, 25 bp, Mus musculus
ctattctcctttctcatttcaaaac

SEQ ID NO: 371439 - DNA, 25 bp, Mus musculus
ctattctcctttgtcatttcaaaac

SEQ ID NO: 371440 - DNA, 25 bp, Mus musculus
ctattctcgaccaccaggacaaaga

SEQ ID NO: 371441 - DNA, 25 bp, Mus musculus
ctattctcgacctccaggacaaaga

SEQ ID NO: 371442 - DNA, 25 bp, Mus musculus
ctattctctcacaatcagccgaatg

SEQ ID NO: 371443 - DNA, 25 bp, Mus musculus
ctattctctcactatcagccgaatg

SEQ ID NO: 371444 - DNA, 25 bp, Mus musculus
ctattctctgcacttctgttgatga

SEQ ID NO: 371445 - DNA, 25 bp, Mus musculus
ctattctctgcagttctgttgatga

SEQ ID NO: 371446 - DNA, 25 bp, Mus musculus
ctattctgaaagctcacggtggctt

SEQ ID NO: 371447 - DNA, 25 bp, Mus musculus
ctattctgaaaggtcacggtggctt

SEQ ID NO: 371448 - DNA, 25 bp, Mus musculus
ctattctgacctctacctttggagg

SEQ ID NO: 371449 - DNA, 25 bp, Mus musculus
ctattctgacctgtacctttggagg

SEQ ID NO: 371450 - DNA, 25 bp, Mus musculus
ctattctgctttcacttccaagtaa

SEQ ID NO: 371451 - DNA, 25 bp, Mus musculus
ctattctgctttgacttccaagtaa

SEQ ID NO: 371452 - DNA, 25 bp, Mus musculus
ctattcttacagatgcttcgtgcag

SEQ ID NO: 371453 - DNA, 25 bp, Mus musculus
ctattcttacagttgcttcgtgcag

SEQ ID NO: 371454 - DNA, 25 bp, Mus musculus
ctattcttactgaaggtttgatgtg

SEQ ID NO: 371455 - DNA, 25 bp, Mus musculus
ctattcttactgtaggtttgatgtg

SEQ ID NO: 371456 - DNA, 25 bp, Mus musculus
ctattcttatttctgcatacctgca

SEQ ID NO: 371457 - DNA, 25 bp, Mus musculus
ctattcttatttgtgcatacctgca

SEQ ID NO: 371458 - DNA, 25 bp, Mus musculus
ctattcttcagcatcctgtggagat

SEQ ID NO: 371459 - DNA, 25 bp, Mus musculus
ctattcttcagcttcctgtggagat

SEQ ID NO: 371460 - DNA, 25 bp, Mus musculus
ctattcttcaggatggtcatctgaa

SEQ ID NO: 371461 - DNA, 25 bp, Mus musculus
ctattcttcaggttggtcatctgaa

SEQ ID NO: 371462 - DNA, 25 bp, Mus musculus
ctattcttcctccatagacggtcat

SEQ ID NO: 371463 - DNA, 25 bp, Mus musculus
ctattcttcctccttcaactaagaa

SEQ ID NO: 371464 - DNA, 25 bp, Mus musculus
ctattcttcctcgatagacggtcat

SEQ ID NO: 371465 - DNA, 25 bp, Mus musculus
ctattcttcctcgttcaactaagaa

SEQ ID NO: 371466 - DNA, 25 bp, Mus musculus
ctattcttgattcggcttctcgcca

SEQ ID NO: 371467 - DNA, 25 bp, Mus musculus
ctattcttgattgggcttctcgcca

SEQ ID NO: 371468 - DNA, 25 bp, Mus musculus
ctattcttgttaacagccactctac

SEQ ID NO: 371469 - DNA, 25 bp, Mus musculus
ctattcttgttatcagccactctac

SEQ ID NO: 371470 - DNA, 25 bp, Mus musculus
ctattctttcttattatcagctggt

SEQ ID NO: 371471 - DNA, 25 bp, Mus musculus
ctattctttctttttatcagctggt

SEQ ID NO: 371472 - DNA, 25 bp, Mus musculus
ctattctttgctagtattccctggt

SEQ ID NO: 371473 - DNA, 25 bp, Mus musculus
ctattctttgcttgtattccctggt

SEQ ID NO: 371474 - DNA, 25 bp, Mus musculus
ctattcttttccacctcgtagaaag

SEQ ID NO: 371475 - DNA, 25 bp, Mus musculus
ctattcttttcctcctcgtagaaag

SEQ ID NO: 371476 - DNA, 25 bp, Mus musculus
ctattgaagcacacttatcccttac

SEQ ID NO: 371477 - DNA, 25 bp, Mus musculus
ctattgaagcactcttatcccttac

SEQ ID NO: 371478 - DNA, 25 bp, Mus musculus
ctattgacaaccagaaattccccat

SEQ ID NO: 371479 - DNA, 25 bp, Mus musculus
ctattgacaacctgaaattccccat

SEQ ID NO: 371480 - DNA, 25 bp, Mus musculus
ctattgacaatgagagctcctctga

SEQ ID NO: 371481 - DNA, 25 bp, Mus musculus
ctattgacaatgtgagctcctctga

SEQ ID NO: 371482 - DNA, 25 bp, Mus musculus
ctattgagattgcagtgtgtacccc

SEQ ID NO: 371483 - DNA, 25 bp, Mus musculus
ctattgagattggagtgtgtacccc

SEQ ID NO: 371484 - DNA, 25 bp, Mus musculus
ctattgatctagacattgcctcagc

SEQ ID NO: 371485 - DNA, 25 bp, Mus musculus
ctattgatctagtcattgcctcagc

SEQ ID NO: 371486 - DNA, 25 bp, Mus musculus
ctattgatctttccactttccgtgg

SEQ ID NO: 371487 - DNA, 25 bp, Mus musculus
ctattgatctttgcactttccgtgg

SEQ ID NO: 371488 - DNA, 25 bp, Mus musculus
ctattgatgcttcaagatgtctgaa

SEQ ID NO: 371489 - DNA, 25 bp, Mus musculus
ctattgatgcttgaagatgtctgaa

SEQ ID NO: 371490 - DNA, 25 bp, Mus musculus
ctattgattcaaacagtggtggctt

SEQ ID NO: 371491 - DNA, 25 bp, Mus musculus
ctattgattcaatcagtggtggctt

SEQ ID NO: 371492 - DNA, 25 bp, Mus musculus
ctattgcaacccaggtaaaccgagt

SEQ ID NO: 371493 - DNA, 25 bp, Mus musculus
ctattgcaaccctggtaaaccgagt

SEQ ID NO: 371494 - DNA, 25 bp, Mus musculus
ctattgcaactaccccgacatttga

SEQ ID NO: 371495 - DNA, 25 bp, Mus musculus
ctattgcaactagcccgacatttga

SEQ ID NO: 371496 - DNA, 25 bp, Mus musculus
ctattgcacgccaagctgaatgtga

SEQ ID NO: 371497 - DNA, 25 bp, Mus musculus
ctattgcacgcctagctgaatgtga

SEQ ID NO: 371498 - DNA, 25 bp, Mus musculus
ctattgccatgcagtagcgtgccca

SEQ ID NO: 371499 - DNA, 25 bp, Mus musculus
ctattgccatgctgtagcgtgccca

SEQ ID NO: 371500 - DNA, 25 bp, Mus musculus
ctattgcctcggctaaatgacaaat

SEQ ID NO: 371501 - DNA, 25 bp, Mus musculus
ctattgcctcgggtaaatgacaaat

SEQ ID NO: 371502 - DNA, 25 bp, Mus musculus
ctattgcctctgacccttagggtac

SEQ ID NO: 371503 - DNA, 25 bp, Mus musculus
ctattgcctctgtcccttagggtac

SEQ ID NO: 371504 - DNA, 25 bp, Mus musculus
ctattgctgcaaagtttacctgtgc

SEQ ID NO: 371505 - DNA, 25 bp, Mus musculus
ctattgctgcaacaacactgacatt

SEQ ID NO: 371506 - DNA, 25 bp, Mus musculus
ctattgctgcaagaacactgacatt

SEQ ID NO: 371507 - DNA, 25 bp, Mus musculus
ctattgctgcaatgtttacctgtgc

SEQ ID NO: 371508 - DNA, 25 bp, Mus musculus
ctattgctgggtatgtcttcttggg

SEQ ID NO: 371509 - DNA, 25 bp, Mus musculus
ctattgctgggtttgtcttcttggg

SEQ ID NO: 371510 - DNA, 25 bp, Mus musculus
ctattgctggtcactgtttcttaat

SEQ ID NO: 371511 - DNA, 25 bp, Mus musculus
ctattgctggtctctgtttcttaat

SEQ ID NO: 371512 - DNA, 25 bp, Mus musculus
ctattgcttcacatcagtgctgatt

SEQ ID NO: 371513 - DNA, 25 bp, Mus musculus
ctattgcttcacttcagtgctgatt

SEQ ID NO: 371514 - DNA, 25 bp, Mus musculus
ctattggaactcaatatatcaggct

SEQ ID NO: 371515 - DNA, 25 bp, Mus musculus
ctattggaactctatatatcaggct

SEQ ID NO: 371516 - DNA, 25 bp, Mus musculus
ctattggaatctcggctactggctg

SEQ ID NO: 371517 - DNA, 25 bp, Mus musculus
ctattggaatctgggctactggctg

SEQ ID NO: 371518 - DNA, 25 bp, Mus musculus
ctattggaccaaagagctgaatgaa

SEQ ID NO: 371519 - DNA, 25 bp, Mus musculus
ctattggaccaatgagctgaatgaa

SEQ ID NO: 371520 - DNA, 25 bp, Mus musculus
ctattggctggacagttagacccat

SEQ ID NO: 371521 - DNA, 25 bp, Mus musculus
ctattggctggagagttagacccat

SEQ ID NO: 371522 - DNA, 25 bp, Mus musculus
ctattggctggtattgttctgctat

SEQ ID NO: 371523 - DNA, 25 bp, Mus musculus
ctattggctggttttgttctgctat

SEQ ID NO: 371524 - DNA, 25 bp, Mus musculus
ctattgggcattatttccgtctctt

SEQ ID NO: 371525 - DNA, 25 bp, Mus musculus
ctattgggcattttttccgtctctt

SEQ ID NO: 371526 - DNA, 25 bp, Mus musculus
ctattggtaatgctctgagctgtgt

SEQ ID NO: 371527 - DNA, 25 bp, Mus musculus
ctattggtaatggtctgagctgtgt

SEQ ID NO: 371528 - DNA, 25 bp, Mus musculus
ctattggtcttgcttattttataaa

SEQ ID NO: 371529 - DNA, 25 bp, Mus musculus
ctattggtcttggttattttataaa

SEQ ID NO: 371530 - DNA, 25 bp, Mus musculus
ctattggtggacatctaggctggat

SEQ ID NO: 371531 - DNA, 25 bp, Mus musculus
ctattggtggacttctaggctggat

SEQ ID NO: 371532 - DNA, 25 bp, Mus musculus
ctattgtaagagatcttctgtttgt

SEQ ID NO: 371533 - DNA, 25 bp, Mus musculus
ctattgtaagagttcttctgtttgt

SEQ ID NO: 371534 - DNA, 25 bp, Mus musculus
ctattgtaaggaatcccgaagacct

SEQ ID NO: 371535 - DNA, 25 bp, Mus musculus
ctattgtaaggattcccgaagacct

SEQ ID NO: 371536 - DNA, 25 bp, Mus musculus
ctattgtaccttcccagttctctga

SEQ ID NO: 371537 - DNA, 25 bp, Mus musculus
ctattgtaccttgccagttctctga

SEQ ID NO: 371538 - DNA, 25 bp, Mus musculus
ctattgtccttaacccattctgatt

SEQ ID NO: 371539 - DNA, 25 bp, Mus musculus
ctattgtccttatcccattctgatt

SEQ ID NO: 371540 - DNA, 25 bp, Mus musculus
ctattgtcggccactagttcagtct

SEQ ID NO: 371541 - DNA, 25 bp, Mus musculus
ctattgtcggcctctagttcagtct

SEQ ID NO: 371542 - DNA, 25 bp, Mus musculus
ctattgtctattatggtgcactaaa

SEQ ID NO: 371543 - DNA, 25 bp, Mus musculus
ctattgtctattttggtgcactaaa

SEQ ID NO: 371544 - DNA, 25 bp, Mus musculus
ctattgtcttggcttttctttgggc

SEQ ID NO: 371545 - DNA, 25 bp, Mus musculus
ctattgtcttgggttttctttgggc

SEQ ID NO: 371546 - DNA, 25 bp, Mus musculus
ctattgtttagccagacaaggcccc

SEQ ID NO: 371547 - DNA, 25 bp, Mus musculus
ctattgtttagcgagacaaggcccc

SEQ ID NO: 371548 - DNA, 25 bp, Mus musculus
ctatttaaagacaccgcagactccg

SEQ ID NO: 371549 - DNA, 25 bp, Mus musculus
ctatttaaagactccgcagactccg

SEQ ID NO: 371550 - DNA, 25 bp, Mus musculus
ctatttaacatgctgctggcctagc

SEQ ID NO: 371551 - DNA, 25 bp, Mus musculus
ctatttaacatggtgctggcctagc

SEQ ID NO: 371552 - DNA, 25 bp, Mus musculus
ctatttaaccccagggattagagat

SEQ ID NO: 371553 - DNA, 25 bp, Mus musculus
ctatttaacccctgggattagagat

SEQ ID NO: 371554 - DNA, 25 bp, Mus musculus
ctatttaaccttagacaaacacttg

SEQ ID NO: 371555 - DNA, 25 bp, Mus musculus
ctatttaacctttgacaaacacttg

SEQ ID NO: 371556 - DNA, 25 bp, Mus musculus
ctatttaagcccagcgtttagagag

SEQ ID NO: 371557 - DNA, 25 bp, Mus musculus
ctatttaagccctgcgtttagagag

SEQ ID NO: 371558 - DNA, 25 bp, Mus musculus
ctatttaagttgcatatttctctac

SEQ ID NO: 371559 - DNA, 25 bp, Mus musculus
ctatttaagttggatatttctctac

SEQ ID NO: 371560 - DNA, 25 bp, Mus musculus
ctatttaatacaagaacagcctttg

SEQ ID NO: 371561 - DNA, 25 bp, Mus musculus
ctatttaatacatgaacagcctttg

SEQ ID NO: 371562 - DNA, 25 bp, Mus musculus
ctatttaccataccacatcatcagt

SEQ ID NO: 371563 - DNA, 25 bp, Mus musculus
ctatttaccatagcacatcatcagt

SEQ ID NO: 371564 - DNA, 25 bp, Mus musculus
ctatttactctgcaagtccgtgaca

SEQ ID NO: 371565 - DNA, 25 bp, Mus musculus
ctatttactctggaagtccgtgaca

SEQ ID NO: 371566 - DNA, 25 bp, Mus musculus
ctatttagcatgaaggagccccagg

SEQ ID NO: 371567 - DNA, 25 bp, Mus musculus
ctatttagcatgtaggagccccagg

SEQ ID NO: 371568 - DNA, 25 bp, Mus musculus
ctatttagccttaagagtcgggtct

SEQ ID NO: 371569 - DNA, 25 bp, Mus musculus
ctatttagcctttagagtcgggtct

SEQ ID NO: 371570 - DNA, 25 bp, Mus musculus
ctatttatagtgcaacagtgtcatt

SEQ ID NO: 371571 - DNA, 25 bp, Mus musculus
ctatttatagtggaacagtgtcatt

SEQ ID NO: 371572 - DNA, 25 bp, Mus musculus
ctatttatatcaccaagtagccaaa

SEQ ID NO: 371573 - DNA, 25 bp, Mus musculus
ctatttatatcagcaagtagccaaa

SEQ ID NO: 371574 - DNA, 25 bp, Mus musculus
ctatttatcacgcagccatgtaata

SEQ ID NO: 371575 - DNA, 25 bp, Mus musculus
ctatttatcacggagccatgtaata

SEQ ID NO: 371576 - DNA, 25 bp, Mus musculus
ctatttatctgccttttctttcaca

SEQ ID NO: 371577 - DNA, 25 bp, Mus musculus
ctatttatctgcgttttctttcaca

SEQ ID NO: 371578 - DNA, 25 bp, Mus musculus
ctatttatgtgcctcctggatatgc

SEQ ID NO: 371579 - DNA, 25 bp, Mus musculus
ctatttatgtgcgtcctggatatgc

SEQ ID NO: 371580 - DNA, 25 bp, Mus musculus
ctatttcaataactgctgtaccata

SEQ ID NO: 371581 - DNA, 25 bp, Mus musculus
ctatttcaataagtgctgtaccata

SEQ ID NO: 371582 - DNA, 25 bp, Mus musculus
ctatttcagcttagctagcactggg

SEQ ID NO: 371583 - DNA, 25 bp, Mus musculus
ctatttcagctttgctagcactggg

SEQ ID NO: 371584 - DNA, 25 bp, Mus musculus
ctatttccattgagcagtgttccag

SEQ ID NO: 371585 - DNA, 25 bp, Mus musculus
ctatttccattgtgcagtgttccag

SEQ ID NO: 371586 - DNA, 25 bp, Mus musculus
ctatttccctctcccaatgactttg

SEQ ID NO: 371587 - DNA, 25 bp, Mus musculus
ctatttccctctgccaatgactttg

SEQ ID NO: 371588 - DNA, 25 bp, Mus musculus
ctatttcctctgagcccagctatgc

SEQ ID NO: 371589 - DNA, 25 bp, Mus musculus
ctatttcctctgtgcccagctatgc

SEQ ID NO: 371590 - DNA, 25 bp, Mus musculus
ctatttccttccagtgttgtatata

SEQ ID NO: 371591 - DNA, 25 bp, Mus musculus
ctatttccttcctgtgttgtatata

SEQ ID NO: 371592 - DNA, 25 bp, Mus musculus
ctatttcggagcattcatggtctga

SEQ ID NO: 371593 - DNA, 25 bp, Mus musculus
ctatttcggagctttcatggtctga

SEQ ID NO: 371594 - DNA, 25 bp, Mus musculus
ctatttctaccaccggtctcctgga

SEQ ID NO: 371595 - DNA, 25 bp, Mus musculus
ctatttctaccagcggtctcctgga

SEQ ID NO: 371596 - DNA, 25 bp, Mus musculus
ctatttctactcaattccagccaat

SEQ ID NO: 371597 - DNA, 25 bp, Mus musculus
ctatttctactctattccagccaat

SEQ ID NO: 371598 - DNA, 25 bp, Mus musculus
ctatttctcagaagcttctggaatc

SEQ ID NO: 371599 - DNA, 25 bp, Mus musculus
ctatttctcagacggaggctcccct

SEQ ID NO: 371600 - DNA, 25 bp, Mus musculus
ctatttctcagagggaggctcccct

SEQ ID NO: 371601 - DNA, 25 bp, Mus musculus
ctatttctcagatgcttctggaatc

SEQ ID NO: 371602 - DNA, 25 bp, Mus musculus
ctatttctcattaactctccatggc

SEQ ID NO: 371603 - DNA, 25 bp, Mus musculus
ctatttctcatttactctccatggc

SEQ ID NO: 371604 - DNA, 25 bp, Mus musculus
ctatttctctgtacattggcagttt

SEQ ID NO: 371605 - DNA, 25 bp, Mus musculus
ctatttctctgttcattggcagttt

SEQ ID NO: 371606 - DNA, 25 bp, Mus musculus
ctatttctgtagctgcgactgggat

SEQ ID NO: 371607 - DNA, 25 bp, Mus musculus
ctatttctgtaggtgcgactgggat

SEQ ID NO: 371608 - DNA, 25 bp, Mus musculus
ctatttcttcctcattcttaatcac

SEQ ID NO: 371609 - DNA, 25 bp, Mus musculus
ctatttcttcctgattcttaatcac

SEQ ID NO: 371610 - DNA, 25 bp, Mus musculus
ctatttcttttgacacttctgtttc

SEQ ID NO: 371611 - DNA, 25 bp, Mus musculus
ctatttcttttgtcacttctgtttc

SEQ ID NO: 371612 - DNA, 25 bp, Mus musculus
ctatttctttttcgtaatgttgcct

SEQ ID NO: 371613 - DNA, 25 bp, Mus musculus
ctatttctttttggtaatgttgcct

SEQ ID NO: 371614 - DNA, 25 bp, Mus musculus
ctatttgaaccacagtaagctattg

SEQ ID NO: 371615 - DNA, 25 bp, Mus musculus
ctatttgaaccagagtaagctattg

SEQ ID NO: 371616 - DNA, 25 bp, Mus musculus
ctatttgagaagcacgggttagctt

SEQ ID NO: 371617 - DNA, 25 bp, Mus musculus
ctatttgagaaggacgggttagctt

SEQ ID NO: 371618 - DNA, 25 bp, Mus musculus
ctatttgctgggagagttcttatgg

SEQ ID NO: 371619 - DNA, 25 bp, Mus musculus
ctatttgctgggtgagttcttatgg

SEQ ID NO: 371620 - DNA, 25 bp, Mus musculus
ctatttgcttcccatggtcataggg

SEQ ID NO: 371621 - DNA, 25 bp, Mus musculus
ctatttgcttccgatggtcataggg

SEQ ID NO: 371622 - DNA, 25 bp, Mus musculus
ctatttggaggtcacacggttgagt

SEQ ID NO: 371623 - DNA, 25 bp, Mus musculus
ctatttggaggtgacacggttgagt

SEQ ID NO: 371624 - DNA, 25 bp, Mus musculus
ctatttggtgcacttcattctttct

SEQ ID NO: 371625 - DNA, 25 bp, Mus musculus
ctatttggtgcagttcattctttct

SEQ ID NO: 371626 - DNA, 25 bp, Mus musculus
ctatttgtaaataatggtgctcagt

SEQ ID NO: 371627 - DNA, 25 bp, Mus musculus
ctatttgtaaattatggtgctcagt

SEQ ID NO: 371628 - DNA, 25 bp, Mus musculus
ctatttgtgtttcagagaggcttaa

SEQ ID NO: 371629 - DNA, 25 bp, Mus musculus
ctatttgtgtttgagagaggcttaa

SEQ ID NO: 371630 - DNA, 25 bp, Mus musculus
ctatttgtttatctgtgcagcttga

SEQ ID NO: 371631 - DNA, 25 bp, Mus musculus
ctatttgtttatgtgtgcagcttga

SEQ ID NO: 371632 - DNA, 25 bp, Mus musculus
ctatttgtttggctactgatgtcta

SEQ ID NO: 371633 - DNA, 25 bp, Mus musculus
ctatttgtttgggtactgatgtcta

SEQ ID NO: 371634 - DNA, 25 bp, Mus musculus
ctattttaactaaggagcagaacat

SEQ ID NO: 371635 - DNA, 25 bp, Mus musculus
ctattttaactatggagcagaacat

SEQ ID NO: 371636 - DNA, 25 bp, Mus musculus
ctattttacatgagacactttgtat

SEQ ID NO: 371637 - DNA, 25 bp, Mus musculus
ctattttacatgtgacactttgtat

SEQ ID NO: 371638 - DNA, 25 bp, Mus musculus
ctattttagctcatattcttcccct

SEQ ID NO: 371639 - DNA, 25 bp, Mus musculus
ctattttagctcctctttatattat

SEQ ID NO: 371640 - DNA, 25 bp, Mus musculus
ctattttagctcgtctttatattat

SEQ ID NO: 371641 - DNA, 25 bp, Mus musculus
ctattttagctcttattcttcccct

SEQ ID NO: 371642 - DNA, 25 bp, Mus musculus
ctattttaggttacctcaatgacat

SEQ ID NO: 371643 - DNA, 25 bp, Mus musculus
ctattttaggtttcctcaatgacat

SEQ ID NO: 371644 - DNA, 25 bp, Mus musculus
ctattttataccaaagatgaagtga

SEQ ID NO: 371645 - DNA, 25 bp, Mus musculus
ctattttatacctaagatgaagtga

SEQ ID NO: 371646 - DNA, 25 bp, Mus musculus
ctattttatatcatgactgcttttt

SEQ ID NO: 371647 - DNA, 25 bp, Mus musculus
ctattttatatcttgactgcttttt

SEQ ID NO: 371648 - DNA, 25 bp, Mus musculus
ctattttatgacacccctccaataa

SEQ ID NO: 371649 - DNA, 25 bp, Mus musculus
ctattttatgactcccctccaataa

SEQ ID NO: 371650 - DNA, 25 bp, Mus musculus
ctattttatgttcttacttggccta

SEQ ID NO: 371651 - DNA, 25 bp, Mus musculus
ctattttatgttgttacttggccta

SEQ ID NO: 371652 - DNA, 25 bp, Mus musculus
ctattttcaattctctctcccagta

SEQ ID NO: 371653 - DNA, 25 bp, Mus musculus
ctattttcaattgtctctcccagta

SEQ ID NO: 371654 - DNA, 25 bp, Mus musculus
ctattttctaggatgagtggctgtc

SEQ ID NO: 371655 - DNA, 25 bp, Mus musculus
ctattttctaggttgagtggctgtc

SEQ ID NO: 371656 - DNA, 25 bp, Mus musculus
ctattttgtgaactttgttagtcat

SEQ ID NO: 371657 - DNA, 25 bp, Mus musculus
ctattttgtgaagtttgttagtcat

SEQ ID NO: 371658 - DNA, 25 bp, Mus musculus
ctatttttaataatgtgctgagcaa

SEQ ID NO: 371659 - DNA, 25 bp, Mus musculus
ctatttttaatattgtgctgagcaa

SEQ ID NO: 371660 - DNA, 25 bp, Mus musculus
ctatttttattcaggatggccactt

SEQ ID NO: 371661 - DNA, 25 bp, Mus musculus
ctatttttattctggatggccactt

SEQ ID NO: 371662 - DNA, 25 bp, Mus musculus
ctatttttcaaaactcctgttgtgt

SEQ ID NO: 371663 - DNA, 25 bp, Mus musculus
ctatttttcaaatctcctgttgtgt

SEQ ID NO: 371664 - DNA, 25 bp, Mus musculus
ctatttttgaaaccattcctcccat

SEQ ID NO: 371665 - DNA, 25 bp, Mus musculus
ctatttttgaaagcattcctcccat

SEQ ID NO: 371666 - DNA, 25 bp, Mus musculus
ctatttttgacgattggagccctta

SEQ ID NO: 371667 - DNA, 25 bp, Mus musculus
ctatttttgacgtttggagccctta

SEQ ID NO: 371668 - DNA, 25 bp, Mus musculus
ctatttttgcttacatcaacgtggg

SEQ ID NO: 371669 - DNA, 25 bp, Mus musculus
ctatttttgctttcatcaacgtggg

SEQ ID NO: 371670 - DNA, 25 bp, Mus musculus
ctatttttgtctatactgtgttggg

SEQ ID NO: 371671 - DNA, 25 bp, Mus musculus
ctatttttgtctttactgtgttggg

SEQ ID NO: 371672 - DNA, 25 bp, Mus musculus
ctattttttaatccctctctctgtc

SEQ ID NO: 371673 - DNA, 25 bp, Mus musculus
ctattttttaatgcctctctctgtc

SEQ ID NO: 371674 - DNA, 25 bp, Mus musculus
ctattttttaccagtagagacatga

SEQ ID NO: 371675 - DNA, 25 bp, Mus musculus
ctattttttacctgtagagacatga

SEQ ID NO: 371676 - DNA, 25 bp, Mus musculus
ctattttttagcagccctcataaat

SEQ ID NO: 371677 - DNA, 25 bp, Mus musculus
ctattttttagctgccctcataaat

SEQ ID NO: 371678 - DNA, 25 bp, Mus musculus
ctattttttcgcaaagcccacacca

SEQ ID NO: 371679 - DNA, 25 bp, Mus musculus
ctattttttcgctaagcccacacca

SEQ ID NO: 371680 - DNA, 25 bp, Mus musculus
ctattttttggcatttcagtgtctt

SEQ ID NO: 371681 - DNA, 25 bp, Mus musculus
ctattttttggcttttcagtgtctt

SEQ ID NO: 371682 - DNA, 25 bp, Mus musculus
ctattttttgttcctctggagagtg

SEQ ID NO: 371683 - DNA, 25 bp, Mus musculus
ctattttttgttgctctggagagtg

SEQ ID NO: 371684 - DNA, 25 bp, Mus musculus
ctatttttttgtcagtgcatcccaa

SEQ ID NO: 371685 - DNA, 25 bp, Mus musculus
ctatttttttgtgagtgcatcccaa

SEQ ID NO: 371686 - DNA, 25 bp, Mus musculus
ctcaaaacaatcctctttgcttggg

SEQ ID NO: 371687 - DNA, 25 bp, Mus musculus
ctcaaaacaatcgtctttgcttggg

SEQ ID NO: 371688 - DNA, 25 bp, Mus musculus
ctcaaaacctcaagatgtcaccatc

SEQ ID NO: 371689 - DNA, 25 bp, Mus musculus
ctcaaaacctcatgatgtcaccatc

SEQ ID NO: 371690 - DNA, 25 bp, Mus musculus
ctcaaaacgaggcaggtgtgtccgt

SEQ ID NO: 371691 - DNA, 25 bp, Mus musculus
ctcaaaacgagggaggtgtgtccgt

SEQ ID NO: 371692 - DNA, 25 bp, Mus musculus
ctcaaaacttgcctcatgctgaaag

SEQ ID NO: 371693 - DNA, 25 bp, Mus musculus
ctcaaaacttgcgtcatgctgaaag

SEQ ID NO: 371694 - DNA, 25 bp, Mus musculus
ctcaaaaggcttcggcggctctact

SEQ ID NO: 371695 - DNA, 25 bp, Mus musculus
ctcaaaaggcttgggcggctctact

SEQ ID NO: 371696 - DNA, 25 bp, Mus musculus
ctcaaaatagatatctgtgcttctt

SEQ ID NO: 371697 - DNA, 25 bp, Mus musculus
ctcaaaatagatttctgtgcttctt

SEQ ID NO: 371698 - DNA, 25 bp, Mus musculus
ctcaaaatcattctcacttggcatt

SEQ ID NO: 371699 - DNA, 25 bp, Mus musculus
ctcaaaatcattgtcacttggcatt

SEQ ID NO: 371700 - DNA, 25 bp, Mus musculus
ctcaaaatgattcccacactctggc

SEQ ID NO: 371701 - DNA, 25 bp, Mus musculus
ctcaaaatgattgccacactctggc

SEQ ID NO: 371702 - DNA, 25 bp, Mus musculus
ctcaaaatgttcatctctgctcaac

SEQ ID NO: 371703 - DNA, 25 bp, Mus musculus
ctcaaaatgttcttctctgctcaac

SEQ ID NO: 371704 - DNA, 25 bp, Mus musculus
ctcaaaattttgacactgcttcctt

SEQ ID NO: 371705 - DNA, 25 bp, Mus musculus
ctcaaaattttgtcactgcttcctt

SEQ ID NO: 371706 - DNA, 25 bp, Mus musculus
ctcaaacacctcactcatcaaggaa

SEQ ID NO: 371707 - DNA, 25 bp, Mus musculus
ctcaaacacctctctcatcaaggaa

SEQ ID NO: 371708 - DNA, 25 bp, Mus musculus
ctcaaacccatgattcccaatgtaa

SEQ ID NO: 371709 - DNA, 25 bp, Mus musculus
ctcaaacccatgtttcccaatgtaa

SEQ ID NO: 371710 - DNA, 25 bp, Mus musculus
ctcaaacccgacatcaggatgacaa

SEQ ID NO: 371711 - DNA, 25 bp, Mus musculus
ctcaaacccgacttcaggatgacaa

SEQ ID NO: 371712 - DNA, 25 bp, Mus musculus
ctcaaacgtttgctagactgctgta

SEQ ID NO: 371713 - DNA, 25 bp, Mus musculus
ctcaaacgtttggtagactgctgta

SEQ ID NO: 371714 - DNA, 25 bp, Mus musculus
ctcaaactatggagggccccgtgga

SEQ ID NO: 371715 - DNA, 25 bp, Mus musculus
ctcaaactatggtgggccccgtgga

SEQ ID NO: 371716 - DNA, 25 bp, Mus musculus
ctcaaactcggaaggaacgtactgg

SEQ ID NO: 371717 - DNA, 25 bp, Mus musculus
ctcaaactcggatggaacgtactgg

SEQ ID NO: 371718 - DNA, 25 bp, Mus musculus
ctcaaactgtgacgaactcttttcc

SEQ ID NO: 371719 - DNA, 25 bp, Mus musculus
ctcaaactgtgaggaactcttttcc

SEQ ID NO: 371720 - DNA, 25 bp, Mus musculus
ctcaaactgttgatcctcttttatt

SEQ ID NO: 371721 - DNA, 25 bp, Mus musculus
ctcaaactgttgttcctcttttatt

SEQ ID NO: 371722 - DNA, 25 bp, Mus musculus
ctcaaacttatcatttctcttctgt

SEQ ID NO: 371723 - DNA, 25 bp, Mus musculus
ctcaaacttatcttttctcttctgt

SEQ ID NO: 371724 - DNA, 25 bp, Mus musculus
ctcaaacttgctagccaggcaggga

SEQ ID NO: 371725 - DNA, 25 bp, Mus musculus
ctcaaacttgcttgccaggcaggga

SEQ ID NO: 371726 - DNA, 25 bp, Mus musculus
ctcaaagaacggcagagacgtctca

SEQ ID NO: 371727 - DNA, 25 bp, Mus musculus
ctcaaagaacgggagagacgtctca

SEQ ID NO: 371728 - DNA, 25 bp, Mus musculus
ctcaaagaggtccttaggacaagaa

SEQ ID NO: 371729 - DNA, 25 bp, Mus musculus
ctcaaagaggtccttctgagtgctg

SEQ ID NO: 371730 - DNA, 25 bp, Mus musculus
ctcaaagaggtcgttaggacaagaa

SEQ ID NO: 371731 - DNA, 25 bp, Mus musculus
ctcaaagaggtcgttctgagtgctg

SEQ ID NO: 371732 - DNA, 25 bp, Mus musculus
ctcaaagagtcaacaataacaatta

SEQ ID NO: 371733 - DNA, 25 bp, Mus musculus
ctcaaagagtcatcaataacaatta

SEQ ID NO: 371734 - DNA, 25 bp, Mus musculus
ctcaaagcatatactttttagacat

SEQ ID NO: 371735 - DNA, 25 bp, Mus musculus
ctcaaagcatattctttttagacat

SEQ ID NO: 371736 - DNA, 25 bp, Mus musculus
ctcaaagctatcatgacatgcagtt

SEQ ID NO: 371737 - DNA, 25 bp, Mus musculus
ctcaaagctatcttgacatgcagtt

SEQ ID NO: 371738 - DNA, 25 bp, Mus musculus
ctcaaagctgaaagacctgtgtcgt

SEQ ID NO: 371739 - DNA, 25 bp, Mus musculus
ctcaaagctgaatgacctgtgtcgt

SEQ ID NO: 371740 - DNA, 25 bp, Mus musculus
ctcaaaggaggcagtgtgatttcat

SEQ ID NO: 371741 - DNA, 25 bp, Mus musculus
ctcaaaggaggctgtgtgatttcat

SEQ ID NO: 371742 - DNA, 25 bp, Mus musculus
ctcaaaggcctgctaactgtgactc

SEQ ID NO: 371743 - DNA, 25 bp, Mus musculus
ctcaaaggcctggtaactgtgactc

SEQ ID NO: 371744 - DNA, 25 bp, Mus musculus
ctcaaagggtggcttgttgcgacaa

SEQ ID NO: 371745 - DNA, 25 bp, Mus musculus
ctcaaagggtgggttgttgcgacaa

SEQ ID NO: 371746 - DNA, 25 bp, Mus musculus
ctcaaagtggcacgctcttgggaca

SEQ ID NO: 371747 - DNA, 25 bp, Mus musculus
ctcaaagtggcaggctcttgggaca

SEQ ID NO: 371748 - DNA, 25 bp, Mus musculus
ctcaaatagtttactggccaaagtt

SEQ ID NO: 371749 - DNA, 25 bp, Mus musculus
ctcaaatagttttctggccaaagtt

SEQ ID NO: 371750 - DNA, 25 bp, Mus musculus
ctcaaatattgtcctatgcaccttc

SEQ ID NO: 371751 - DNA, 25 bp, Mus musculus
ctcaaatattgtgctatgcaccttc

SEQ ID NO: 371752 - DNA, 25 bp, Mus musculus
ctcaaatctcagcactccatagttt

SEQ ID NO: 371753 - DNA, 25 bp, Mus musculus
ctcaaatctcaggactccatagttt

SEQ ID NO: 371754 - DNA, 25 bp, Mus musculus
ctcaaatgtttaccattccttcctg

SEQ ID NO: 371755 - DNA, 25 bp, Mus musculus
ctcaaatgtttagcattccttcctg

SEQ ID NO: 371756 - DNA, 25 bp, Mus musculus
ctcaaatgttttccttgttgtgaac

SEQ ID NO: 371757 - DNA, 25 bp, Mus musculus
ctcaaatgttttgcttgttgtgaac

SEQ ID NO: 371758 - DNA, 25 bp, Mus musculus
ctcaaattctagcagatctgacatc

SEQ ID NO: 371759 - DNA, 25 bp, Mus musculus
ctcaaattctaggagatctgacatc

SEQ ID NO: 371760 - DNA, 25 bp, Mus musculus
ctcaaatttccacgttttccattat

SEQ ID NO: 371761 - DNA, 25 bp, Mus musculus
ctcaaatttccaggttttccattat

SEQ ID NO: 371762 - DNA, 25 bp, Mus musculus
ctcaaatttgacacaccagaagtaa

SEQ ID NO: 371763 - DNA, 25 bp, Mus musculus
ctcaaatttgactcaccagaagtaa

SEQ ID NO: 371764 - DNA, 25 bp, Mus musculus
ctcaacacatccaccgtagaaggga

SEQ ID NO: 371765 - DNA, 25 bp, Mus musculus
ctcaacacatcctccgtagaaggga

SEQ ID NO: 371766 - DNA, 25 bp, Mus musculus
ctcaacactgtgcttgtatctaaaa

SEQ ID NO: 371767 - DNA, 25 bp, Mus musculus
ctcaacactgtggttgtatctaaaa

SEQ ID NO: 371768 - DNA, 25 bp, Mus musculus
ctcaacagaaggctaagtgtggaat

SEQ ID NO: 371769 - DNA, 25 bp, Mus musculus
ctcaacagaagggtaagtgtggaat

SEQ ID NO: 371770 - DNA, 25 bp, Mus musculus
ctcaacagccagcataggagtgggt

SEQ ID NO: 371771 - DNA, 25 bp, Mus musculus
ctcaacagccaggataggagtgggt

SEQ ID NO: 371772 - DNA, 25 bp, Mus musculus
ctcaacatcttcacattacctacaa

SEQ ID NO: 371773 - DNA, 25 bp, Mus musculus
ctcaacatcttctcattacctacaa

SEQ ID NO: 371774 - DNA, 25 bp, Mus musculus
ctcaacattgttagtatcattatca

SEQ ID NO: 371775 - DNA, 25 bp, Mus musculus
ctcaacattgtttgtatcattatca

SEQ ID NO: 371776 - DNA, 25 bp, Mus musculus
ctcaacatttttctttcatcttctg

SEQ ID NO: 371777 - DNA, 25 bp, Mus musculus
ctcaacatttttgtttcatcttctg

SEQ ID NO: 371778 - DNA, 25 bp, Mus musculus
ctcaaccaatgtagattccttaaag

SEQ ID NO: 371779 - DNA, 25 bp, Mus musculus
ctcaaccaatgttgattccttaaag

SEQ ID NO: 371780 - DNA, 25 bp, Mus musculus
ctcaaccacactccagatgtctgta

SEQ ID NO: 371781 - DNA, 25 bp, Mus musculus
ctcaaccacactgcagatgtctgta

SEQ ID NO: 371782 - DNA, 25 bp, Mus musculus
ctcaacccataactgctgtcaaaca

SEQ ID NO: 371783 - DNA, 25 bp, Mus musculus
ctcaacccataagtgctgtcaaaca

SEQ ID NO: 371784 - DNA, 25 bp, Mus musculus
ctcaaccccaaaagcttataaccat

SEQ ID NO: 371785 - DNA, 25 bp, Mus musculus
ctcaaccccaaatgcttataaccat

SEQ ID NO: 371786 - DNA, 25 bp, Mus musculus
ctcaaccccattatttattcctgcc

SEQ ID NO: 371787 - DNA, 25 bp, Mus musculus
ctcaaccccattttttattcctgcc

SEQ ID NO: 371788 - DNA, 25 bp, Mus musculus
ctcaaccgcttccaagactagtttt

SEQ ID NO: 371789 - DNA, 25 bp, Mus musculus
ctcaaccgcttcgaagactagtttt

SEQ ID NO: 371790 - DNA, 25 bp, Mus musculus
ctcaacctagacaccttagctgtgt

SEQ ID NO: 371791 - DNA, 25 bp, Mus musculus
ctcaacctagactccttagctgtgt

SEQ ID NO: 371792 - DNA, 25 bp, Mus musculus
ctcaacctcccaactgttaagatga

SEQ ID NO: 371793 - DNA, 25 bp, Mus musculus
ctcaacctcccatctgttaagatga

SEQ ID NO: 371794 - DNA, 25 bp, Mus musculus
ctcaacctgtctacttgtgatcctt

SEQ ID NO: 371795 - DNA, 25 bp, Mus musculus
ctcaacctgtcttcttgtgatcctt

SEQ ID NO: 371796 - DNA, 25 bp, Mus musculus
ctcaaccttcataccatactatttt

SEQ ID NO: 371797 - DNA, 25 bp, Mus musculus
ctcaaccttcattccatactatttt

SEQ ID NO: 371798 - DNA, 25 bp, Mus musculus
ctcaaccttcccaatcttattgaat

SEQ ID NO: 371799 - DNA, 25 bp, Mus musculus
ctcaaccttccctatcttattgaat

SEQ ID NO: 371800 - DNA, 25 bp, Mus musculus
ctcaaccttgagcaccaaagctagt

SEQ ID NO: 371801 - DNA, 25 bp, Mus musculus
ctcaaccttgaggaccaaagctagt

SEQ ID NO: 371802 - DNA, 25 bp, Mus musculus
ctcaaccttgggagcctggataagt

SEQ ID NO: 371803 - DNA, 25 bp, Mus musculus
ctcaaccttgggtgcctggataagt

SEQ ID NO: 371804 - DNA, 25 bp, Mus musculus
ctcaaccttttgatatgaccctttt

SEQ ID NO: 371805 - DNA, 25 bp, Mus musculus
ctcaaccttttgttatgaccctttt

SEQ ID NO: 371806 - DNA, 25 bp, Mus musculus
ctcaacctttttctgacctttgtat

SEQ ID NO: 371807 - DNA, 25 bp, Mus musculus
ctcaacctttttgtgacctttgtat

SEQ ID NO: 371808 - DNA, 25 bp, Mus musculus
ctcaacgcgagcattccgaaagtct

SEQ ID NO: 371809 - DNA, 25 bp, Mus musculus
ctcaacgcgagctttccgaaagtct

SEQ ID NO: 371810 - DNA, 25 bp, Mus musculus
ctcaacgtcggtatcgccgaaaact

SEQ ID NO: 371811 - DNA, 25 bp, Mus musculus
ctcaacgtcggtttcgccgaaaact

SEQ ID NO: 371812 - DNA, 25 bp, Mus musculus
ctcaactaccacaaaacagcctatg

SEQ ID NO: 371813 - DNA, 25 bp, Mus musculus
ctcaactaccactaaacagcctatg

SEQ ID NO: 371814 - DNA, 25 bp, Mus musculus
ctcaactaggagaggctaactttag

SEQ ID NO: 371815 - DNA, 25 bp, Mus musculus
ctcaactaggagtggctaactttag

SEQ ID NO: 371816 - DNA, 25 bp, Mus musculus
ctcaactcttctcgcaggtgttgga

SEQ ID NO: 371817 - DNA, 25 bp, Mus musculus
ctcaactcttctggcaggtgttgga

SEQ ID NO: 371818 - DNA, 25 bp, Mus musculus
ctcaactgtgcaactgaatcccttc

SEQ ID NO: 371819 - DNA, 25 bp, Mus musculus
ctcaactgtgcatctgaatcccttc

SEQ ID NO: 371820 - DNA, 25 bp, Mus musculus
ctcaacttgactcttgtcagctgtt

SEQ ID NO: 371821 - DNA, 25 bp, Mus musculus
ctcaacttgactgttgtcagctgtt

SEQ ID NO: 371822 - DNA, 25 bp, Mus musculus
ctcaagaaatggaggcccggcaggc

SEQ ID NO: 371823 - DNA, 25 bp, Mus musculus
ctcaagaaatggtggcccggcaggc

SEQ ID NO: 371824 - DNA, 25 bp, Mus musculus
ctcaagaagagaccattcctaggtt

SEQ ID NO: 371825 - DNA, 25 bp, Mus musculus
ctcaagaagagagcattcctaggtt

SEQ ID NO: 371826 - DNA, 25 bp, Mus musculus
ctcaagaagctacactccagagaac

SEQ ID NO: 371827 - DNA, 25 bp, Mus musculus
ctcaagaagctagactccagagaac

SEQ ID NO: 371828 - DNA, 25 bp, Mus musculus
ctcaagaagtccaggatgcccttga

SEQ ID NO: 371829 - DNA, 25 bp, Mus musculus
ctcaagaagtcctggatgcccttga

SEQ ID NO: 371830 - DNA, 25 bp, Mus musculus
ctcaagagacttctttacataacat

SEQ ID NO: 371831 - DNA, 25 bp, Mus musculus
ctcaagagacttgtttacataacat

SEQ ID NO: 371832 - DNA, 25 bp, Mus musculus
ctcaagagggacaggacggctgaat

SEQ ID NO: 371833 - DNA, 25 bp, Mus musculus
ctcaagagggactggacggctgaat

SEQ ID NO: 371834 - DNA, 25 bp, Mus musculus
ctcaagagtcaaccacagtgtcacg

SEQ ID NO: 371835 - DNA, 25 bp, Mus musculus
ctcaagagtcaagcacagtgtcacg

SEQ ID NO: 371836 - DNA, 25 bp, Mus musculus
ctcaagatatccacttggtgtctgc

SEQ ID NO: 371837 - DNA, 25 bp, Mus musculus
ctcaagatatcctcttggtgtctgc

SEQ ID NO: 371838 - DNA, 25 bp, Mus musculus
ctcaagatcagacgtggctaggaga

SEQ ID NO: 371839 - DNA, 25 bp, Mus musculus
ctcaagatcagaggtggctaggaga

SEQ ID NO: 371840 - DNA, 25 bp, Mus musculus
ctcaagatttgcaaaggccttcctt

SEQ ID NO: 371841 - DNA, 25 bp, Mus musculus
ctcaagatttgctaaggccttcctt

SEQ ID NO: 371842 - DNA, 25 bp, Mus musculus
ctcaagcaaatcagctagtttcaga

SEQ ID NO: 371843 - DNA, 25 bp, Mus musculus
ctcaagcaaatctgctagtttcaga

SEQ ID NO: 371844 - DNA, 25 bp, Mus musculus
ctcaagcagaggcacaacgagatca

SEQ ID NO: 371845 - DNA, 25 bp, Mus musculus
ctcaagcagagggacaacgagatca

SEQ ID NO: 371846 - DNA, 25 bp, Mus musculus
ctcaagcaggatcgatgtgcacact

SEQ ID NO: 371847 - DNA, 25 bp, Mus musculus
ctcaagcaggatggatgtgcacact

SEQ ID NO: 371848 - DNA, 25 bp, Mus musculus
ctcaagcatcgaagcagccacagtg

SEQ ID NO: 371849 - DNA, 25 bp, Mus musculus
ctcaagcatcgatgcagccacagtg

SEQ ID NO: 371850 - DNA, 25 bp, Mus musculus
ctcaagccatccatcacatcgactt

SEQ ID NO: 371851 - DNA, 25 bp, Mus musculus
ctcaagccatccttcacatcgactt

SEQ ID NO: 371852 - DNA, 25 bp, Mus musculus
ctcaagcccgctcataagaataagg

SEQ ID NO: 371853 - DNA, 25 bp, Mus musculus
ctcaagcccgctgataagaataagg

SEQ ID NO: 371854 - DNA, 25 bp, Mus musculus
ctcaagcctgagaatagccgggtct

SEQ ID NO: 371855 - DNA, 25 bp, Mus musculus
ctcaagcctgagaggactcacacag

SEQ ID NO: 371856 - DNA, 25 bp, Mus musculus
ctcaagcctgagtatagccgggtct

SEQ ID NO: 371857 - DNA, 25 bp, Mus musculus
ctcaagcctgagtggactcacacag

SEQ ID NO: 371858 - DNA, 25 bp, Mus musculus
ctcaagcgactgagttccccaagtc

SEQ ID NO: 371859 - DNA, 25 bp, Mus musculus
ctcaagcgactgtgttccccaagtc

SEQ ID NO: 371860 - DNA, 25 bp, Mus musculus
ctcaagcgtggtcgctgccctgagt

SEQ ID NO: 371861 - DNA, 25 bp, Mus musculus
ctcaagcgtggtggctgccctgagt

SEQ ID NO: 371862 - DNA, 25 bp, Mus musculus
ctcaagctcatcaaagggacgacgt

SEQ ID NO: 371863 - DNA, 25 bp, Mus musculus
ctcaagctcatctaagggacgacgt

SEQ ID NO: 371864 - DNA, 25 bp, Mus musculus
ctcaagcttcttcgagggactgcaa

SEQ ID NO: 371865 - DNA, 25 bp, Mus musculus
ctcaagcttcttggagggactgcaa

SEQ ID NO: 371866 - DNA, 25 bp, Mus musculus
ctcaagcttggtcgtggaaagggca

SEQ ID NO: 371867 - DNA, 25 bp, Mus musculus
ctcaagcttggtggtggaaagggca

SEQ ID NO: 371868 - DNA, 25 bp, Mus musculus
ctcaaggaaaccctgtgactctcat

SEQ ID NO: 371869 - DNA, 25 bp, Mus musculus
ctcaaggaaaccgtgtgactctcat

SEQ ID NO: 371870 - DNA, 25 bp, Mus musculus
ctcaaggaaattactttgtgagctt

SEQ ID NO: 371871 - DNA, 25 bp, Mus musculus
ctcaaggaaatttctttgtgagctt

SEQ ID NO: 371872 - DNA, 25 bp, Mus musculus
ctcaaggaactcatgatggacaggt

SEQ ID NO: 371873 - DNA, 25 bp, Mus musculus
ctcaaggaactcttgatggacaggt

SEQ ID NO: 371874 - DNA, 25 bp, Mus musculus
ctcaaggactgtcgcctgcaactgg

SEQ ID NO: 371875 - DNA, 25 bp, Mus musculus
ctcaaggactgtggcctgcaactgg

SEQ ID NO: 371876 - DNA, 25 bp, Mus musculus
ctcaaggagcttagttacccacatc

SEQ ID NO: 371877 - DNA, 25 bp, Mus musculus
ctcaaggagctttgttacccacatc

SEQ ID NO: 371878 - DNA, 25 bp, Mus musculus
ctcaaggatgacacactacagtgtt

SEQ ID NO: 371879 - DNA, 25 bp, Mus musculus
ctcaaggatgactcactacagtgtt

SEQ ID NO: 371880 - DNA, 25 bp, Mus musculus
ctcaaggccatccaggcgctttcag

SEQ ID NO: 371881 - DNA, 25 bp, Mus musculus
ctcaaggccatcgaggcgctttcag

SEQ ID NO: 371882 - DNA, 25 bp, Mus musculus
ctcaaggccttaagactgcatgtct

SEQ ID NO: 371883 - DNA, 25 bp, Mus musculus
ctcaaggccttatgactgcatgtct

SEQ ID NO: 371884 - DNA, 25 bp, Mus musculus
ctcaaggcttgcatatcctgctctc

SEQ ID NO: 371885 - DNA, 25 bp, Mus musculus
ctcaaggcttgcttatcctgctctc

SEQ ID NO: 371886 - DNA, 25 bp, Mus musculus
ctcaagggaatcacacagctcggtg

SEQ ID NO: 371887 - DNA, 25 bp, Mus musculus
ctcaagggaatctcacagctcggtg

SEQ ID NO: 371888 - DNA, 25 bp, Mus musculus
ctcaagggttcaagttcaatgccag

SEQ ID NO: 371889 - DNA, 25 bp, Mus musculus
ctcaagggttcatgttcaatgccag

SEQ ID NO: 371890 - DNA, 25 bp, Mus musculus
ctcaaggtaggcaccgtggctgaac

SEQ ID NO: 371891 - DNA, 25 bp, Mus musculus
ctcaaggtaggctccgtggctgaac

SEQ ID NO: 371892 - DNA, 25 bp, Mus musculus
ctcaaggtcaccctctagtttatag

SEQ ID NO: 371893 - DNA, 25 bp, Mus musculus
ctcaaggtcaccgtctagtttatag

SEQ ID NO: 371894 - DNA, 25 bp, Mus musculus
ctcaaggttatactcagctatatat

SEQ ID NO: 371895 - DNA, 25 bp, Mus musculus
ctcaaggttatagtcagctatatat

SEQ ID NO: 371896 - DNA, 25 bp, Mus musculus
ctcaaggtttgccaagtgttatttt

SEQ ID NO: 371897 - DNA, 25 bp, Mus musculus
ctcaaggtttgcgaagtgttatttt

SEQ ID NO: 371898 - DNA, 25 bp, Mus musculus
ctcaaggtttggagtgtctctgcac

SEQ ID NO: 371899 - DNA, 25 bp, Mus musculus
ctcaaggtttggtgtgtctctgcac

SEQ ID NO: 371900 - DNA, 25 bp, Mus musculus
ctcaagtaaagcagtgtctgcctgt

SEQ ID NO: 371901 - DNA, 25 bp, Mus musculus
ctcaagtaaagctgtgtctgcctgt

SEQ ID NO: 371902 - DNA, 25 bp, Mus musculus
ctcaagtaccacatgcggatccata

SEQ ID NO: 371903 - DNA, 25 bp, Mus musculus
ctcaagtaccacttgcggatccata

SEQ ID NO: 371904 - DNA, 25 bp, Mus musculus
ctcaagtatgtcatgctgcctgtgg

SEQ ID NO: 371905 - DNA, 25 bp, Mus musculus
ctcaagtatgtcttgctgcctgtgg

SEQ ID NO: 371906 - DNA, 25 bp, Mus musculus
ctcaagtcaacactggctgcaatta

SEQ ID NO: 371907 - DNA, 25 bp, Mus musculus
ctcaagtcaacagtggctgcaatta

SEQ ID NO: 371908 - DNA, 25 bp, Mus musculus
ctcaagtcccgcctgaaggaggaag

SEQ ID NO: 371909 - DNA, 25 bp, Mus musculus
ctcaagtcccgcgtgaaggaggaag

SEQ ID NO: 371910 - DNA, 25 bp, Mus musculus
ctcaagtgctctctgacgatttttt

SEQ ID NO: 371911 - DNA, 25 bp, Mus musculus
ctcaagtgctctgtgacgatttttt

SEQ ID NO: 371912 - DNA, 25 bp, Mus musculus
ctcaagtgtgccattaagcctgact

SEQ ID NO: 371913 - DNA, 25 bp, Mus musculus
ctcaagtgtgcctttaagcctgact

SEQ ID NO: 371914 - DNA, 25 bp, Mus musculus
ctcaagttagtcatttagtgggaat

SEQ ID NO: 371915 - DNA, 25 bp, Mus musculus
ctcaagttagtcttttagtgggaat

SEQ ID NO: 371916 - DNA, 25 bp, Mus musculus
ctcaagtttgttcccaggagaaagc

SEQ ID NO: 371917 - DNA, 25 bp, Mus musculus
ctcaagtttgttgccaggagaaagc

SEQ ID NO: 371918 - DNA, 25 bp, Mus musculus
ctcaagttttggcacatgactcagc

SEQ ID NO: 371919 - DNA, 25 bp, Mus musculus
ctcaagttttgggacatgactcagc

SEQ ID NO: 371920 - DNA, 25 bp, Mus musculus
ctcaataacctaagcaagaggaagt

SEQ ID NO: 371921 - DNA, 25 bp, Mus musculus
ctcaataacctatgcaagaggaagt

SEQ ID NO: 371922 - DNA, 25 bp, Mus musculus
ctcaatactcttaggagacctcctg

SEQ ID NO: 371923 - DNA, 25 bp, Mus musculus
ctcaatactctttggagacctcctg

SEQ ID NO: 371924 - DNA, 25 bp, Mus musculus
ctcaatactttgatagctagacctt

SEQ ID NO: 371925 - DNA, 25 bp, Mus musculus
ctcaatactttgttagctagacctt

SEQ ID NO: 371926 - DNA, 25 bp, Mus musculus
ctcaatataatcctgccttagcctt

SEQ ID NO: 371927 - DNA, 25 bp, Mus musculus
ctcaatataatcgtgccttagcctt

SEQ ID NO: 371928 - DNA, 25 bp, Mus musculus
ctcaatatagttactgtgccatttg

SEQ ID NO: 371929 - DNA, 25 bp, Mus musculus
ctcaatatagtttctgtgccatttg

SEQ ID NO: 371930 - DNA, 25 bp, Mus musculus
ctcaatcatagtaggttaatttggg

SEQ ID NO: 371931 - DNA, 25 bp, Mus musculus
ctcaatcatagttggttaatttggg

SEQ ID NO: 371932 - DNA, 25 bp, Mus musculus
ctcaatcattgtcctcggaggtgca

SEQ ID NO: 371933 - DNA, 25 bp, Mus musculus
ctcaatcattgtgctcggaggtgca

SEQ ID NO: 371934 - DNA, 25 bp, Mus musculus
ctcaatccaacacttccttcatgat

SEQ ID NO: 371935 - DNA, 25 bp, Mus musculus
ctcaatccaacagttccttcatgat

SEQ ID NO: 371936 - DNA, 25 bp, Mus musculus
ctcaatcccatgatttcacactttt

SEQ ID NO: 371937 - DNA, 25 bp, Mus musculus
ctcaatcccatgttttcacactttt

SEQ ID NO: 371938 - DNA, 25 bp, Mus musculus
ctcaatccggacactacgaaagtga

SEQ ID NO: 371939 - DNA, 25 bp, Mus musculus
ctcaatccggactctacgaaagtga

SEQ ID NO: 371940 - DNA, 25 bp, Mus musculus
ctcaatcctgtaatcgaagccttcg

SEQ ID NO: 371941 - DNA, 25 bp, Mus musculus
ctcaatcctgtattcgaagccttcg

SEQ ID NO: 371942 - DNA, 25 bp, Mus musculus
ctcaatcgctcactggcaaactgaa

SEQ ID NO: 371943 - DNA, 25 bp, Mus musculus
ctcaatcgctcagtggcaaactgaa

SEQ ID NO: 371944 - DNA, 25 bp, Mus musculus
ctcaatctcctcatttcggaaatat

SEQ ID NO: 371945 - DNA, 25 bp, Mus musculus
ctcaatctcctcttttcggaaatat

SEQ ID NO: 371946 - DNA, 25 bp, Mus musculus
ctcaatctggccatgtgtcacctga

SEQ ID NO: 371947 - DNA, 25 bp, Mus musculus
ctcaatctggccttgtgtcacctga

SEQ ID NO: 371948 - DNA, 25 bp, Mus musculus
ctcaatctttagacatctgtatatg

SEQ ID NO: 371949 - DNA, 25 bp, Mus musculus
ctcaatctttagtcatctgtatatg

SEQ ID NO: 371950 - DNA, 25 bp, Mus musculus
ctcaatgaaatgaagtggcagcctt

SEQ ID NO: 371951 - DNA, 25 bp, Mus musculus
ctcaatgaaatgtagtggcagcctt

SEQ ID NO: 371952 - DNA, 25 bp, Mus musculus
ctcaatgagcagattcattctcccc

SEQ ID NO: 371953 - DNA, 25 bp, Mus musculus
ctcaatgagcagtttcattctcccc

SEQ ID NO: 371954 - DNA, 25 bp, Mus musculus
ctcaatgatagaccctgcccagcgt

SEQ ID NO: 371955 - DNA, 25 bp, Mus musculus
ctcaatgatagagcctgcccagcgt

SEQ ID NO: 371956 - DNA, 25 bp, Mus musculus
ctcaatgcccagaaaaatttcagga

SEQ ID NO: 371957 - DNA, 25 bp, Mus musculus
ctcaatgcccagtaaaatttcagga

SEQ ID NO: 371958 - DNA, 25 bp, Mus musculus
ctcaatgctaacacagacatcacct

SEQ ID NO: 371959 - DNA, 25 bp, Mus musculus
ctcaatgctaactcagacatcacct

SEQ ID NO: 371960 - DNA, 25 bp, Mus musculus
ctcaatgctggtacctggtactgaa

SEQ ID NO: 371961 - DNA, 25 bp, Mus musculus
ctcaatgctggttcctggtactgaa

SEQ ID NO: 371962 - DNA, 25 bp, Mus musculus
ctcaatggcatcaactattcagttc

SEQ ID NO: 371963 - DNA, 25 bp, Mus musculus
ctcaatggcatctactattcagttc

SEQ ID NO: 371964 - DNA, 25 bp, Mus musculus
ctcaatgggcttctcgaaggcacta

SEQ ID NO: 371965 - DNA, 25 bp, Mus musculus
ctcaatgggcttgtcgaaggcacta

SEQ ID NO: 371966 - DNA, 25 bp, Mus musculus
ctcaatgggtaaaggcacttatctc

SEQ ID NO: 371967 - DNA, 25 bp, Mus musculus
ctcaatgggtaatggcacttatctc

SEQ ID NO: 371968 - DNA, 25 bp, Mus musculus
ctcaatggtaaaagggtaaatggat

SEQ ID NO: 371969 - DNA, 25 bp, Mus musculus
ctcaatggtaaatgggtaaatggat

SEQ ID NO: 371970 - DNA, 25 bp, Mus musculus
ctcaatggtctcaagggttgatctt

SEQ ID NO: 371971 - DNA, 25 bp, Mus musculus
ctcaatggtctctagggttgatctt

SEQ ID NO: 371972 - DNA, 25 bp, Mus musculus
ctcaatgtctccacagggaaattgt

SEQ ID NO: 371973 - DNA, 25 bp, Mus musculus
ctcaatgtctcctcagggaaattgt

SEQ ID NO: 371974 - DNA, 25 bp, Mus musculus
ctcaattagaccattttgtgtgtag

SEQ ID NO: 371975 - DNA, 25 bp, Mus musculus
ctcaattagacctttttgtgtgtag

SEQ ID NO: 371976 - DNA, 25 bp, Mus musculus
ctcaattcagtcactcatctgcaat

SEQ ID NO: 371977 - DNA, 25 bp, Mus musculus
ctcaattcagtctctcatctgcaat

SEQ ID NO: 371978 - DNA, 25 bp, Mus musculus
ctcaattctctcaccaagaggcatc

SEQ ID NO: 371979 - DNA, 25 bp, Mus musculus
ctcaattctctctccaagaggcatc

SEQ ID NO: 371980 - DNA, 25 bp, Mus musculus
ctcaattctgcacccactaaataat

SEQ ID NO: 371981 - DNA, 25 bp, Mus musculus
ctcaattctgcagccactaaataat

SEQ ID NO: 371982 - DNA, 25 bp, Mus musculus
ctcaattggcttagcactttctcat

SEQ ID NO: 371983 - DNA, 25 bp, Mus musculus
ctcaattggctttgcactttctcat

SEQ ID NO: 371984 - DNA, 25 bp, Mus musculus
ctcaattttctaactgggtggccaa

SEQ ID NO: 371985 - DNA, 25 bp, Mus musculus
ctcaattttctatctgggtggccaa

SEQ ID NO: 371986 - DNA, 25 bp, Mus musculus
ctcacaacaaaaaacttcagccatc

SEQ ID NO: 371987 - DNA, 25 bp, Mus musculus
ctcacaacaaaatacttcagccatc

SEQ ID NO: 371988 - DNA, 25 bp, Mus musculus
ctcacaaccatgatagtacagctac

SEQ ID NO: 371989 - DNA, 25 bp, Mus musculus
ctcacaaccatgttagtacagctac

SEQ ID NO: 371990 - DNA, 25 bp, Mus musculus
ctcacaacgactccgttctttcggg

SEQ ID NO: 371991 - DNA, 25 bp, Mus musculus
ctcacaacgactgcgttctttcggg

SEQ ID NO: 371992 - DNA, 25 bp, Mus musculus
ctcacaactgccagtctctctgatt

SEQ ID NO: 371993 - DNA, 25 bp, Mus musculus
ctcacaactgcctgtctctctgatt

SEQ ID NO: 371994 - DNA, 25 bp, Mus musculus
ctcacaagaaacactcaggccaaac

SEQ ID NO: 371995 - DNA, 25 bp, Mus musculus
ctcacaagaaactctcaggccaaac

SEQ ID NO: 371996 - DNA, 25 bp, Mus musculus
ctcacaagaaccaacctgcaataaa

SEQ ID NO: 371997 - DNA, 25 bp, Mus musculus
ctcacaagaacctacctgcaataaa

SEQ ID NO: 371998 - DNA, 25 bp, Mus musculus
ctcacaagctgaagtggccggccca

SEQ ID NO: 371999 - DNA, 25 bp, Mus musculus
ctcacaagctgatgtggccggccca

SEQ ID NO: 372000 - DNA, 25 bp, Mus musculus
ctcacacaagccctaatctatggga

SEQ ID NO: 372001 - DNA, 25 bp, Mus musculus
ctcacacaagccgtaatctatggga

SEQ ID NO: 372002 - DNA, 25 bp, Mus musculus
ctcacacacataaaccctcagataa

SEQ ID NO: 372003 - DNA, 25 bp, Mus musculus
ctcacacacatataccctcagataa

SEQ ID NO: 372004 - DNA, 25 bp, Mus musculus
ctcacacaccatcttgaaatccaga

SEQ ID NO: 372005 - DNA, 25 bp, Mus musculus
ctcacacaccatgttgaaatccaga

SEQ ID NO: 372006 - DNA, 25 bp, Mus musculus
ctcacacactctaatagcagcttgg

SEQ ID NO: 372007 - DNA, 25 bp, Mus musculus
ctcacacactcttatagcagcttgg

SEQ ID NO: 372008 - DNA, 25 bp, Mus musculus
ctcacacaggccaaaatgcagcaga

SEQ ID NO: 372009 - DNA, 25 bp, Mus musculus
ctcacacaggcctaaatgcagcaga

SEQ ID NO: 372010 - DNA, 25 bp, Mus musculus
ctcacacagtgcctagactagattt

SEQ ID NO: 372011 - DNA, 25 bp, Mus musculus
ctcacacagtgcgtagactagattt

SEQ ID NO: 372012 - DNA, 25 bp, Mus musculus
ctcacacatgtgcttattaattttc

SEQ ID NO: 372013 - DNA, 25 bp, Mus musculus
ctcacacatgtggttattaattttc

SEQ ID NO: 372014 - DNA, 25 bp, Mus musculus
ctcacaccaactaactttgtactct

SEQ ID NO: 372015 - DNA, 25 bp, Mus musculus
ctcacaccaacttactttgtactct

SEQ ID NO: 372016 - DNA, 25 bp, Mus musculus
ctcacacccaggctcaaaggaaatg

SEQ ID NO: 372017 - DNA, 25 bp, Mus musculus
ctcacacccagggtcaaaggaaatg

SEQ ID NO: 372018 - DNA, 25 bp, Mus musculus
ctcacacccctcatgtgtttaaagc

SEQ ID NO: 372019 - DNA, 25 bp, Mus musculus
ctcacacccctcttgtgtttaaagc

SEQ ID NO: 372020 - DNA, 25 bp, Mus musculus
ctcacaccctgtattctaacttctt

SEQ ID NO: 372021 - DNA, 25 bp, Mus musculus
ctcacaccctgttttctaacttctt

SEQ ID NO: 372022 - DNA, 25 bp, Mus musculus
ctcacaccggaaactgacagtcatt

SEQ ID NO: 372023 - DNA, 25 bp, Mus musculus
ctcacaccggaatctgacagtcatt

SEQ ID NO: 372024 - DNA, 25 bp, Mus musculus
ctcacacctgtaatactaccacttg

SEQ ID NO: 372025 - DNA, 25 bp, Mus musculus
ctcacacctgtattactaccacttg

SEQ ID NO: 372026 - DNA, 25 bp, Mus musculus
ctcacacgagggagggcggatccct

SEQ ID NO: 372027 - DNA, 25 bp, Mus musculus
ctcacacgagggtgggcggatccct

SEQ ID NO: 372028 - DNA, 25 bp, Mus musculus
ctcacactacatatgttatgtggtt

SEQ ID NO: 372029 - DNA, 25 bp, Mus musculus
ctcacactacatttgttatgtggtt

SEQ ID NO: 372030 - DNA, 25 bp, Mus musculus
ctcacactcacaataacagctgcat

SEQ ID NO: 372031 - DNA, 25 bp, Mus musculus
ctcacactcacattaacagctgcat

SEQ ID NO: 372032 - DNA, 25 bp, Mus musculus
ctcacactcagtatctactttctta

SEQ ID NO: 372033 - DNA, 25 bp, Mus musculus
ctcacactcagtttctactttctta

SEQ ID NO: 372034 - DNA, 25 bp, Mus musculus
ctcacactcattaccgcatcagttt

SEQ ID NO: 372035 - DNA, 25 bp, Mus musculus
ctcacactcatttccgcatcagttt

SEQ ID NO: 372036 - DNA, 25 bp, Mus musculus
ctcacactctctcagctttagtgga

SEQ ID NO: 372037 - DNA, 25 bp, Mus musculus
ctcacactctctgagctttagtgga

SEQ ID NO: 372038 - DNA, 25 bp, Mus musculus
ctcacactggatactgcctgtaaag

SEQ ID NO: 372039 - DNA, 25 bp, Mus musculus
ctcacactggattctgcctgtaaag

SEQ ID NO: 372040 - DNA, 25 bp, Mus musculus
ctcacactggcaagctttagctttg

SEQ ID NO: 372041 - DNA, 25 bp, Mus musculus
ctcacactggcatgctttagctttg

SEQ ID NO: 372042 - DNA, 25 bp, Mus musculus
ctcacacttggcagttgcgacaggg

SEQ ID NO: 372043 - DNA, 25 bp, Mus musculus
ctcacacttggctgttgcgacaggg

SEQ ID NO: 372044 - DNA, 25 bp, Mus musculus
ctcacacttgtacctgaagcacgga

SEQ ID NO: 372045 - DNA, 25 bp, Mus musculus
ctcacacttgtagctgaagcacgga

SEQ ID NO: 372046 - DNA, 25 bp, Mus musculus
ctcacagaagagaagtcctcatgat

SEQ ID NO: 372047 - DNA, 25 bp, Mus musculus
ctcacagaagagtagtcctcatgat

SEQ ID NO: 372048 - DNA, 25 bp, Mus musculus
ctcacagaaggcctgggttttcttt

SEQ ID NO: 372049 - DNA, 25 bp, Mus musculus
ctcacagaaggcgtgggttttcttt

SEQ ID NO: 372050 - DNA, 25 bp, Mus musculus
ctcacagagctgagtcagcgcgtga

SEQ ID NO: 372051 - DNA, 25 bp, Mus musculus
ctcacagagctgtgtcagcgcgtga

SEQ ID NO: 372052 - DNA, 25 bp, Mus musculus
ctcacagagtccacaagaatgtctt

SEQ ID NO: 372053 - DNA, 25 bp, Mus musculus
ctcacagagtcccaaaccacaaata

SEQ ID NO: 372054 - DNA, 25 bp, Mus musculus
ctcacagagtccgaaaccacaaata

SEQ ID NO: 372055 - DNA, 25 bp, Mus musculus
ctcacagagtcctcaagaatgtctt

SEQ ID NO: 372056 - DNA, 25 bp, Mus musculus
ctcacagattggaaacgggttgact

SEQ ID NO: 372057 - DNA, 25 bp, Mus musculus
ctcacagattggtaacgggttgact

SEQ ID NO: 372058 - DNA, 25 bp, Mus musculus
ctcacagcaattatagtccagttcc

SEQ ID NO: 372059 - DNA, 25 bp, Mus musculus
ctcacagcaattttagtccagttcc

SEQ ID NO: 372060 - DNA, 25 bp, Mus musculus
ctcacagcagaccctttcagtcatt

SEQ ID NO: 372061 - DNA, 25 bp, Mus musculus
ctcacagcagacgctttcagtcatt

SEQ ID NO: 372062 - DNA, 25 bp, Mus musculus
ctcacagcagctagcctttaatatt

SEQ ID NO: 372063 - DNA, 25 bp, Mus musculus
ctcacagcagctaggtgggttttct

SEQ ID NO: 372064 - DNA, 25 bp, Mus musculus
ctcacagcagcttgcctttaatatt

SEQ ID NO: 372065 - DNA, 25 bp, Mus musculus
ctcacagcagcttggtgggttttct

SEQ ID NO: 372066 - DNA, 25 bp, Mus musculus
ctcacagcggccatgtccagacaga

SEQ ID NO: 372067 - DNA, 25 bp, Mus musculus
ctcacagcggccttgtccagacaga

SEQ ID NO: 372068 - DNA, 25 bp, Mus musculus
ctcacagctcacaaaggcttctgtt

SEQ ID NO: 372069 - DNA, 25 bp, Mus musculus
ctcacagctcactaaggcttctgtt

SEQ ID NO: 372070 - DNA, 25 bp, Mus musculus
ctcacaggatctagctatcactgta

SEQ ID NO: 372071 - DNA, 25 bp, Mus musculus
ctcacaggatcttgctatcactgta

SEQ ID NO: 372072 - DNA, 25 bp, Mus musculus
ctcacaggatggctgtctcagcatt

SEQ ID NO: 372073 - DNA, 25 bp, Mus musculus
ctcacaggatgggtgtctcagcatt

SEQ ID NO: 372074 - DNA, 25 bp, Mus musculus
ctcacaggccaaaaatgcttatatg

SEQ ID NO: 372075 - DNA, 25 bp, Mus musculus
ctcacaggccaataatgcttatatg

SEQ ID NO: 372076 - DNA, 25 bp, Mus musculus
ctcacaggccctaagatatttctaa

SEQ ID NO: 372077 - DNA, 25 bp, Mus musculus
ctcacaggcccttagatatttctaa

SEQ ID NO: 372078 - DNA, 25 bp, Mus musculus
ctcacaggcctacgacaaatccaaa

SEQ ID NO: 372079 - DNA, 25 bp, Mus musculus
ctcacaggcctaggacaaatccaaa

SEQ ID NO: 372080 - DNA, 25 bp, Mus musculus
ctcacaggctcaaacatctcatatc

SEQ ID NO: 372081 - DNA, 25 bp, Mus musculus
ctcacaggctcatacatctcatatc

SEQ ID NO: 372082 - DNA, 25 bp, Mus musculus
ctcacagggagacgcttgcagccga

SEQ ID NO: 372083 - DNA, 25 bp, Mus musculus
ctcacagggagaggcttgcagccga

SEQ ID NO: 372084 - DNA, 25 bp, Mus musculus
ctcacagggaggctcacactacagt

SEQ ID NO: 372085 - DNA, 25 bp, Mus musculus
ctcacagggagggtcacactacagt

SEQ ID NO: 372086 - DNA, 25 bp, Mus musculus
ctcacagggctacggatgcagctta

SEQ ID NO: 372087 - DNA, 25 bp, Mus musculus
ctcacagggctagggatgcagctta

SEQ ID NO: 372088 - DNA, 25 bp, Mus musculus
ctcacaggtggccaggagtcaaaaa

SEQ ID NO: 372089 - DNA, 25 bp, Mus musculus
ctcacaggtggcgaggagtcaaaaa

SEQ ID NO: 372090 - DNA, 25 bp, Mus musculus
ctcacaggtgtaccctttgaaagag

SEQ ID NO: 372091 - DNA, 25 bp, Mus musculus
ctcacaggtgtagcctttgaaagag

SEQ ID NO: 372092 - DNA, 25 bp, Mus musculus
ctcacagtactcatgtatctttctc

SEQ ID NO: 372093 - DNA, 25 bp, Mus musculus
ctcacagtactcttgtatctttctc

SEQ ID NO: 372094 - DNA, 25 bp, Mus musculus
ctcacagtcaaactcaaaggtttct

SEQ ID NO: 372095 - DNA, 25 bp, Mus musculus
ctcacagtcaaagtcaaaggtttct

SEQ ID NO: 372096 - DNA, 25 bp, Mus musculus
ctcacagtctcaccactcatttaaa

SEQ ID NO: 372097 - DNA, 25 bp, Mus musculus
ctcacagtctcagcactcatttaaa

SEQ ID NO: 372098 - DNA, 25 bp, Mus musculus
ctcacagtgactaagaaccgggtta

SEQ ID NO: 372099 - DNA, 25 bp, Mus musculus
ctcacagtgacttagaaccgggtta

SEQ ID NO: 372100 - DNA, 25 bp, Mus musculus
ctcacagtgaggaagcatgtacgtt

SEQ ID NO: 372101 - DNA, 25 bp, Mus musculus
ctcacagtgaggtagcatgtacgtt

SEQ ID NO: 372102 - DNA, 25 bp, Mus musculus
ctcacagtgggcaggtccatgaaca

SEQ ID NO: 372103 - DNA, 25 bp, Mus musculus
ctcacagtgggctggtccatgaaca

SEQ ID NO: 372104 - DNA, 25 bp, Mus musculus
ctcacagtgggtccagtgttagcca

SEQ ID NO: 372105 - DNA, 25 bp, Mus musculus
ctcacagtgggtgcagtgttagcca

SEQ ID NO: 372106 - DNA, 25 bp, Mus musculus
ctcacagtgtggatttgaatggtct

SEQ ID NO: 372107 - DNA, 25 bp, Mus musculus
ctcacagtgtggttttgaatggtct

SEQ ID NO: 372108 - DNA, 25 bp, Mus musculus
ctcacagttgtcagcatccagggaa

SEQ ID NO: 372109 - DNA, 25 bp, Mus musculus
ctcacagttgtctgcatccagggaa

SEQ ID NO: 372110 - DNA, 25 bp, Mus musculus
ctcacataggctctaagctctctga

SEQ ID NO: 372111 - DNA, 25 bp, Mus musculus
ctcacataggctgtaagctctctga

SEQ ID NO: 372112 - DNA, 25 bp, Mus musculus
ctcacatagtgcctaacaaccatct

SEQ ID NO: 372113 - DNA, 25 bp, Mus musculus
ctcacatagtgcgtaacaaccatct

SEQ ID NO: 372114 - DNA, 25 bp, Mus musculus
ctcacatatcaacactgctggcatt

SEQ ID NO: 372115 - DNA, 25 bp, Mus musculus
ctcacatatcaagactgctggcatt

SEQ ID NO: 372116 - DNA, 25 bp, Mus musculus
ctcacatattctattctggtctcag

SEQ ID NO: 372117 - DNA, 25 bp, Mus musculus
ctcacatattcttttctggtctcag

SEQ ID NO: 372118 - DNA, 25 bp, Mus musculus
ctcacatcaatgctgttggagccag

SEQ ID NO: 372119 - DNA, 25 bp, Mus musculus
ctcacatcaatggtgttggagccag

SEQ ID NO: 372120 - DNA, 25 bp, Mus musculus
ctcacatcaattacgttaatacaaa

SEQ ID NO: 372121 - DNA, 25 bp, Mus musculus
ctcacatcaatttcgttaatacaaa

SEQ ID NO: 372122 - DNA, 25 bp, Mus musculus
ctcacatcattcacagaaccacggg

SEQ ID NO: 372123 - DNA, 25 bp, Mus musculus
ctcacatcattctcagaaccacggg

SEQ ID NO: 372124 - DNA, 25 bp, Mus musculus
ctcacatccgtcctgcagaaatcag

SEQ ID NO: 372125 - DNA, 25 bp, Mus musculus
ctcacatccgtcgtgcagaaatcag

SEQ ID NO: 372126 - DNA, 25 bp, Mus musculus
ctcacatcctatctttggtagccaa

SEQ ID NO: 372127 - DNA, 25 bp, Mus musculus
ctcacatcctatgtttggtagccaa

SEQ ID NO: 372128 - DNA, 25 bp, Mus musculus
ctcacatgacctatattgtggcata

SEQ ID NO: 372129 - DNA, 25 bp, Mus musculus
ctcacatgacctttattgtggcata

SEQ ID NO: 372130 - DNA, 25 bp, Mus musculus
ctcacatgagttcctgtttgctggg

SEQ ID NO: 372131 - DNA, 25 bp, Mus musculus
ctcacatgagttgctgtttgctggg

SEQ ID NO: 372132 - DNA, 25 bp, Mus musculus
ctcacatgggctagactggcctgga

SEQ ID NO: 372133 - DNA, 25 bp, Mus musculus
ctcacatgggcttgactggcctgga

SEQ ID NO: 372134 - DNA, 25 bp, Mus musculus
ctcacatgggtgatcccgtatccct

SEQ ID NO: 372135 - DNA, 25 bp, Mus musculus
ctcacatgggtgcagtctataacta

SEQ ID NO: 372136 - DNA, 25 bp, Mus musculus
ctcacatgggtggagtctataacta

SEQ ID NO: 372137 - DNA, 25 bp, Mus musculus
ctcacatgggtgttcccgtatccct

SEQ ID NO: 372138 - DNA, 25 bp, Mus musculus
ctcacatggtaacctgtctgccaaa

SEQ ID NO: 372139 - DNA, 25 bp, Mus musculus
ctcacatggtaagctgtctgccaaa

SEQ ID NO: 372140 - DNA, 25 bp, Mus musculus
ctcacatggtcaaacggaacacggg

SEQ ID NO: 372141 - DNA, 25 bp, Mus musculus
ctcacatggtcatacggaacacggg

SEQ ID NO: 372142 - DNA, 25 bp, Mus musculus
ctcacatgtggacgtcttggcctat

SEQ ID NO: 372143 - DNA, 25 bp, Mus musculus
ctcacatgtggaggtcttggcctat

SEQ ID NO: 372144 - DNA, 25 bp, Mus musculus
ctcacattactccattttcagactg

SEQ ID NO: 372145 - DNA, 25 bp, Mus musculus
ctcacattactcgattttcagactg

SEQ ID NO: 372146 - DNA, 25 bp, Mus musculus
ctcacattccacaggcctgattttt

SEQ ID NO: 372147 - DNA, 25 bp, Mus musculus
ctcacattccactggcctgattttt

SEQ ID NO: 372148 - DNA, 25 bp, Mus musculus
ctcacattcctaacttggcatcaat

SEQ ID NO: 372149 - DNA, 25 bp, Mus musculus
ctcacattcctatcttggcatcaat

SEQ ID NO: 372150 - DNA, 25 bp, Mus musculus
ctcacattgaacatccaggccagac

SEQ ID NO: 372151 - DNA, 25 bp, Mus musculus
ctcacattgaacttccaggccagac

SEQ ID NO: 372152 - DNA, 25 bp, Mus musculus
ctcacatttcataggaccgctggtg

SEQ ID NO: 372153 - DNA, 25 bp, Mus musculus
ctcacatttcattggaccgctggtg

SEQ ID NO: 372154 - DNA, 25 bp, Mus musculus
ctcacatttgctccctcttagagtt

SEQ ID NO: 372155 - DNA, 25 bp, Mus musculus
ctcacatttgctgcctcttagagtt

SEQ ID NO: 372156 - DNA, 25 bp, Mus musculus
ctcaccaaatgcctttcggtgcctg

SEQ ID NO: 372157 - DNA, 25 bp, Mus musculus
ctcaccaaatgcgtttcggtgcctg

SEQ ID NO: 372158 - DNA, 25 bp, Mus musculus
ctcaccaaattaaaaaggcgttctg

SEQ ID NO: 372159 - DNA, 25 bp, Mus musculus
ctcaccaaattataaaggcgttctg

SEQ ID NO: 372160 - DNA, 25 bp, Mus musculus
ctcaccaagccacagtttagaaaat

SEQ ID NO: 372161 - DNA, 25 bp, Mus musculus
ctcaccaagccagagtttagaaaat

SEQ ID NO: 372162 - DNA, 25 bp, Mus musculus
ctcaccaaggacaccatgaatatca

SEQ ID NO: 372163 - DNA, 25 bp, Mus musculus
ctcaccaaggactccatgaatatca

SEQ ID NO: 372164 - DNA, 25 bp, Mus musculus
ctcaccaaggcaaaaatcacttttt

SEQ ID NO: 372165 - DNA, 25 bp, Mus musculus
ctcaccaaggcataaatcacttttt

SEQ ID NO: 372166 - DNA, 25 bp, Mus musculus
ctcaccaatattaccaccttacaaa

SEQ ID NO: 372167 - DNA, 25 bp, Mus musculus
ctcaccaatatttccaccttacaaa

SEQ ID NO: 372168 - DNA, 25 bp, Mus musculus
ctcaccaattggatgtccagtgcca

SEQ ID NO: 372169 - DNA, 25 bp, Mus musculus
ctcaccaattggttgtccagtgcca

SEQ ID NO: 372170 - DNA, 25 bp, Mus musculus
ctcaccacccttattaaagcactgt

SEQ ID NO: 372171 - DNA, 25 bp, Mus musculus
ctcaccaccctttttaaagcactgt

SEQ ID NO: 372172 - DNA, 25 bp, Mus musculus
ctcaccacggagcaaacgctatgca

SEQ ID NO: 372173 - DNA, 25 bp, Mus musculus
ctcaccacggaggaaacgctatgca

SEQ ID NO: 372174 - DNA, 25 bp, Mus musculus
ctcaccactatgagtgctgcacaca

SEQ ID NO: 372175 - DNA, 25 bp, Mus musculus
ctcaccactatgtgtgctgcacaca

SEQ ID NO: 372176 - DNA, 25 bp, Mus musculus
ctcaccagcccaacacttatagtgg

SEQ ID NO: 372177 - DNA, 25 bp, Mus musculus
ctcaccagcccatcacttatagtgg

SEQ ID NO: 372178 - DNA, 25 bp, Mus musculus
ctcaccagccctagatggtttataa

SEQ ID NO: 372179 - DNA, 25 bp, Mus musculus
ctcaccagcccttgatggtttataa

SEQ ID NO: 372180 - DNA, 25 bp, Mus musculus
ctcaccagctccatttagatatcat

SEQ ID NO: 372181 - DNA, 25 bp, Mus musculus
ctcaccagctccttttagatatcat

SEQ ID NO: 372182 - DNA, 25 bp, Mus musculus
ctcaccaggccaattgggagaggta

SEQ ID NO: 372183 - DNA, 25 bp, Mus musculus
ctcaccaggccatttgggagaggta

SEQ ID NO: 372184 - DNA, 25 bp, Mus musculus
ctcaccaggtatcgtagctcatgcc

SEQ ID NO: 372185 - DNA, 25 bp, Mus musculus
ctcaccaggtatggtagctcatgcc

SEQ ID NO: 372186 - DNA, 25 bp, Mus musculus
ctcaccaggtcaaggtgcgtggagt

SEQ ID NO: 372187 - DNA, 25 bp, Mus musculus
ctcaccaggtcatggtgcgtggagt

SEQ ID NO: 372188 - DNA, 25 bp, Mus musculus
ctcaccagtctcaagacttaattct

SEQ ID NO: 372189 - DNA, 25 bp, Mus musculus
ctcaccagtctctagacttaattct

SEQ ID NO: 372190 - DNA, 25 bp, Mus musculus
ctcaccagtgttaagggactcatgt

SEQ ID NO: 372191 - DNA, 25 bp, Mus musculus
ctcaccagtgttaattttggcctct

SEQ ID NO: 372192 - DNA, 25 bp, Mus musculus
ctcaccagtgtttagggactcatgt

SEQ ID NO: 372193 - DNA, 25 bp, Mus musculus
ctcaccagtgtttattttggcctct

SEQ ID NO: 372194 - DNA, 25 bp, Mus musculus
ctcaccatgggcatcaggtcactaa

SEQ ID NO: 372195 - DNA, 25 bp, Mus musculus
ctcaccatgggcttcaggtcactaa

SEQ ID NO: 372196 - DNA, 25 bp, Mus musculus
ctcacccaacacaatcttacaaaat

SEQ ID NO: 372197 - DNA, 25 bp, Mus musculus
ctcacccaacactatcttacaaaat

SEQ ID NO: 372198 - DNA, 25 bp, Mus musculus
ctcacccaatgcatggtgggcatta

SEQ ID NO: 372199 - DNA, 25 bp, Mus musculus
ctcacccaatgcttggtgggcatta

SEQ ID NO: 372200 - DNA, 25 bp, Mus musculus
ctcacccacatgctgaagatctttg

SEQ ID NO: 372201 - DNA, 25 bp, Mus musculus
ctcacccacatggtgaagatctttg

SEQ ID NO: 372202 - DNA, 25 bp, Mus musculus
ctcacccactgtcactttctaagaa

SEQ ID NO: 372203 - DNA, 25 bp, Mus musculus
ctcacccactgtgactttctaagaa

SEQ ID NO: 372204 - DNA, 25 bp, Mus musculus
ctcacccactttagctgtgtcagaa

SEQ ID NO: 372205 - DNA, 25 bp, Mus musculus
ctcacccactttctagactatacta

SEQ ID NO: 372206 - DNA, 25 bp, Mus musculus
ctcacccactttgtagactatacta

SEQ ID NO: 372207 - DNA, 25 bp, Mus musculus
ctcacccacttttgctgtgtcagaa

SEQ ID NO: 372208 - DNA, 25 bp, Mus musculus
ctcacccagcttataactggcttat

SEQ ID NO: 372209 - DNA, 25 bp, Mus musculus
ctcacccagcttttaactggcttat

SEQ ID NO: 372210 - DNA, 25 bp, Mus musculus
ctcacccaggtgctatcagatgacc

SEQ ID NO: 372211 - DNA, 25 bp, Mus musculus
ctcacccaggtggtatcagatgacc

SEQ ID NO: 372212 - DNA, 25 bp, Mus musculus
ctcacccataccaatgtactgttac

SEQ ID NO: 372213 - DNA, 25 bp, Mus musculus
ctcacccatacctatgtactgttac

SEQ ID NO: 372214 - DNA, 25 bp, Mus musculus
ctcacccatgccattcttgggaaaa

SEQ ID NO: 372215 - DNA, 25 bp, Mus musculus
ctcacccatgcctttcttgggaaaa

SEQ ID NO: 372216 - DNA, 25 bp, Mus musculus
ctcacccatgtgactctgttggagt

SEQ ID NO: 372217 - DNA, 25 bp, Mus musculus
ctcacccatgtgtctctgttggagt

SEQ ID NO: 372218 - DNA, 25 bp, Mus musculus
ctcacccattcaaaaaccctagaag

SEQ ID NO: 372219 - DNA, 25 bp, Mus musculus
ctcacccattcataaaccctagaag

SEQ ID NO: 372220 - DNA, 25 bp, Mus musculus
ctcaccccacatcaaagtaactttt

SEQ ID NO: 372221 - DNA, 25 bp, Mus musculus
ctcaccccacatgaaagtaactttt

SEQ ID NO: 372222 - DNA, 25 bp, Mus musculus
ctcaccccagttagttgatttcaca

SEQ ID NO: 372223 - DNA, 25 bp, Mus musculus
ctcaccccagtttgttgatttcaca

SEQ ID NO: 372224 - DNA, 25 bp, Mus musculus
ctcaccccatatctgtggtgggaaa

SEQ ID NO: 372225 - DNA, 25 bp, Mus musculus
ctcaccccatatgtgtggtgggaaa

SEQ ID NO: 372226 - DNA, 25 bp, Mus musculus
ctcaccccatccattgacttatttt

SEQ ID NO: 372227 - DNA, 25 bp, Mus musculus
ctcaccccatcctttgacttatttt

SEQ ID NO: 372228 - DNA, 25 bp, Mus musculus
ctcaccccatgaacctttctattat

SEQ ID NO: 372229 - DNA, 25 bp, Mus musculus
ctcaccccatgatcctttctattat

SEQ ID NO: 372230 - DNA, 25 bp, Mus musculus
ctcaccccgtttaactgtagtgttg

SEQ ID NO: 372231 - DNA, 25 bp, Mus musculus
ctcaccccgttttactgtagtgttg

SEQ ID NO: 372232 - DNA, 25 bp, Mus musculus
ctcacccctgtcctgttcagagtgg

SEQ ID NO: 372233 - DNA, 25 bp, Mus musculus
ctcacccctgtcgtgttcagagtgg

SEQ ID NO: 372234 - DNA, 25 bp, Mus musculus
ctcacccctttgcaattttgctcaa

SEQ ID NO: 372235 - DNA, 25 bp, Mus musculus
ctcacccctttggaattttgctcaa

SEQ ID NO: 372236 - DNA, 25 bp, Mus musculus
ctcacccgaactccgacagatttac

SEQ ID NO: 372237 - DNA, 25 bp, Mus musculus
ctcacccgaactgcgacagatttac

SEQ ID NO: 372238 - DNA, 25 bp, Mus musculus
ctcaccctaagtccctggcagatga

SEQ ID NO: 372239 - DNA, 25 bp, Mus musculus
ctcaccctaagtgcctggcagatga

SEQ ID NO: 372240 - DNA, 25 bp, Mus musculus
ctcaccctcaggctgttccaggtga

SEQ ID NO: 372241 - DNA, 25 bp, Mus musculus
ctcaccctcagggtgttccaggtga

SEQ ID NO: 372242 - DNA, 25 bp, Mus musculus
ctcaccctcatccatagctgggtgg

SEQ ID NO: 372243 - DNA, 25 bp, Mus musculus
ctcaccctcatcgatagctgggtgg

SEQ ID NO: 372244 - DNA, 25 bp, Mus musculus
ctcaccctctctagatagatggcta

SEQ ID NO: 372245 - DNA, 25 bp, Mus musculus
ctcaccctctcttgatagatggcta

SEQ ID NO: 372246 - DNA, 25 bp, Mus musculus
ctcaccctggtccacatcactgaga

SEQ ID NO: 372247 - DNA, 25 bp, Mus musculus
ctcaccctggtcgacatcactgaga

SEQ ID NO: 372248 - DNA, 25 bp, Mus musculus
ctcaccctgtaccaacagctatgat

SEQ ID NO: 372249 - DNA, 25 bp, Mus musculus
ctcaccctgtacgaacagctatgat

SEQ ID NO: 372250 - DNA, 25 bp, Mus musculus
ctcaccctgtagaagatggaatcat

SEQ ID NO: 372251 - DNA, 25 bp, Mus musculus
ctcaccctgtagtagatggaatcat

SEQ ID NO: 372252 - DNA, 25 bp, Mus musculus
ctcaccctgtggatccagaaatcta

SEQ ID NO: 372253 - DNA, 25 bp, Mus musculus
ctcaccctgtggttccagaaatcta

SEQ ID NO: 372254 - DNA, 25 bp, Mus musculus
ctcacccttctgcaagtaaacaact

SEQ ID NO: 372255 - DNA, 25 bp, Mus musculus
ctcacccttctggaagtaaacaact

SEQ ID NO: 372256 - DNA, 25 bp, Mus musculus
ctcaccctttgccagagtaacaagt

SEQ ID NO: 372257 - DNA, 25 bp, Mus musculus
ctcaccctttgcgagagtaacaagt

SEQ ID NO: 372258 - DNA, 25 bp, Mus musculus
ctcaccgagaaacctgcgtggccag

SEQ ID NO: 372259 - DNA, 25 bp, Mus musculus
ctcaccgagaaagctgcgtggccag

SEQ ID NO: 372260 - DNA, 25 bp, Mus musculus
ctcaccgaggccagtctagagctgg

SEQ ID NO: 372261 - DNA, 25 bp, Mus musculus
ctcaccgaggcctgtctagagctgg

SEQ ID NO: 372262 - DNA, 25 bp, Mus musculus
ctcaccgaggctcatgtgcttagga

SEQ ID NO: 372263 - DNA, 25 bp, Mus musculus
ctcaccgaggctgatgtgcttagga

SEQ ID NO: 372264 - DNA, 25 bp, Mus musculus
ctcaccgcagctactgtgaaaggca

SEQ ID NO: 372265 - DNA, 25 bp, Mus musculus
ctcaccgcagcttctgtgaaaggca

SEQ ID NO: 372266 - DNA, 25 bp, Mus musculus
ctcaccgcctctcaaagttctgaag

SEQ ID NO: 372267 - DNA, 25 bp, Mus musculus
ctcaccgcctctgaaagttctgaag

SEQ ID NO: 372268 - DNA, 25 bp, Mus musculus
ctcaccggacttctcaaatgttcaa

SEQ ID NO: 372269 - DNA, 25 bp, Mus musculus
ctcaccggacttgtcaaatgttcaa

SEQ ID NO: 372270 - DNA, 25 bp, Mus musculus
ctcaccggtcctaagggaattgaca

SEQ ID NO: 372271 - DNA, 25 bp, Mus musculus
ctcaccggtccttagggaattgaca

SEQ ID NO: 372272 - DNA, 25 bp, Mus musculus
ctcaccgtctgacaaggctttgaag

SEQ ID NO: 372273 - DNA, 25 bp, Mus musculus
ctcaccgtctgagaaggctttgaag

SEQ ID NO: 372274 - DNA, 25 bp, Mus musculus
ctcaccgttggtaatttgcttattt

SEQ ID NO: 372275 - DNA, 25 bp, Mus musculus
ctcaccgttggttatttgcttattt

SEQ ID NO: 372276 - DNA, 25 bp, Mus musculus
ctcacctacactcgagctcgtgaaa

SEQ ID NO: 372277 - DNA, 25 bp, Mus musculus
ctcacctacactggagctcgtgaaa

SEQ ID NO: 372278 - DNA, 25 bp, Mus musculus
ctcacctactagacagcttttgctg

SEQ ID NO: 372279 - DNA, 25 bp, Mus musculus
ctcacctactagtcagcttttgctg

SEQ ID NO: 372280 - DNA, 25 bp, Mus musculus
ctcacctcactgacttaataagaaa

SEQ ID NO: 372281 - DNA, 25 bp, Mus musculus
ctcacctcactgtcttaataagaaa

SEQ ID NO: 372282 - DNA, 25 bp, Mus musculus
ctcacctcagagatcttgtaaaaac

SEQ ID NO: 372283 - DNA, 25 bp, Mus musculus
ctcacctcagagttcttgtaaaaac

SEQ ID NO: 372284 - DNA, 25 bp, Mus musculus
ctcacctcctttagttttgacagtt

SEQ ID NO: 372285 - DNA, 25 bp, Mus musculus
ctcacctccttttgttttgacagtt

SEQ ID NO: 372286 - DNA, 25 bp, Mus musculus
ctcacctctgagatcattcatgaca

SEQ ID NO: 372287 - DNA, 25 bp, Mus musculus
ctcacctctgagttcattcatgaca

SEQ ID NO: 372288 - DNA, 25 bp, Mus musculus
ctcacctctggcacatcaatggaaa

SEQ ID NO: 372289 - DNA, 25 bp, Mus musculus
ctcacctctggccatctgatggaag

SEQ ID NO: 372290 - DNA, 25 bp, Mus musculus
ctcacctctggcgatctgatggaag

SEQ ID NO: 372291 - DNA, 25 bp, Mus musculus
ctcacctctggctcatcaatggaaa

SEQ ID NO: 372292 - DNA, 25 bp, Mus musculus
ctcacctctgtcaagttctatgaat

SEQ ID NO: 372293 - DNA, 25 bp, Mus musculus
ctcacctctgtctagttctatgaat

SEQ ID NO: 372294 - DNA, 25 bp, Mus musculus
ctcacctctgttcagttgctacata

SEQ ID NO: 372295 - DNA, 25 bp, Mus musculus
ctcacctctgttccattgtctataa

SEQ ID NO: 372296 - DNA, 25 bp, Mus musculus
ctcacctctgttgagttgctacata

SEQ ID NO: 372297 - DNA, 25 bp, Mus musculus
ctcacctctgttgcattgtctataa

SEQ ID NO: 372298 - DNA, 25 bp, Mus musculus
ctcacctctttaacttgacctaaca

SEQ ID NO: 372299 - DNA, 25 bp, Mus musculus
ctcacctctttatcttgacctaaca

SEQ ID NO: 372300 - DNA, 25 bp, Mus musculus
ctcacctctttgacaccaggtaaag

SEQ ID NO: 372301 - DNA, 25 bp, Mus musculus
ctcacctctttgtcaccaggtaaag

SEQ ID NO: 372302 - DNA, 25 bp, Mus musculus
ctcacctcttttcattcacacaagt

SEQ ID NO: 372303 - DNA, 25 bp, Mus musculus
ctcacctcttttgattcacacaagt

SEQ ID NO: 372304 - DNA, 25 bp, Mus musculus
ctcacctgcagactgagcagctgat

SEQ ID NO: 372305 - DNA, 25 bp, Mus musculus
ctcacctgcagagtgagcagctgat

SEQ ID NO: 372306 - DNA, 25 bp, Mus musculus
ctcacctgcctgacgaataacagac

SEQ ID NO: 372307 - DNA, 25 bp, Mus musculus
ctcacctgcctgtcgaataacagac

SEQ ID NO: 372308 - DNA, 25 bp, Mus musculus
ctcacctgcgcaacaggaccaagcc

SEQ ID NO: 372309 - DNA, 25 bp, Mus musculus
ctcacctgcgcatcaggaccaagcc

SEQ ID NO: 372310 - DNA, 25 bp, Mus musculus
ctcacctgcggacgcacatggagat

SEQ ID NO: 372311 - DNA, 25 bp, Mus musculus
ctcacctgcggaggcacatggagat

SEQ ID NO: 372312 - DNA, 25 bp, Mus musculus
ctcacctgctagaccaagtgggaag

SEQ ID NO: 372313 - DNA, 25 bp, Mus musculus
ctcacctgctagtccaagtgggaag

SEQ ID NO: 372314 - DNA, 25 bp, Mus musculus
ctcacctggaaaccttgggcttcta

SEQ ID NO: 372315 - DNA, 25 bp, Mus musculus
ctcacctggaaagcttgggcttcta

SEQ ID NO: 372316 - DNA, 25 bp, Mus musculus
ctcacctggattcccatgagcatca

SEQ ID NO: 372317 - DNA, 25 bp, Mus musculus
ctcacctggattgccatgagcatca

SEQ ID NO: 372318 - DNA, 25 bp, Mus musculus
ctcacctggcacaagagaatgtgga

SEQ ID NO: 372319 - DNA, 25 bp, Mus musculus
ctcacctggcactagagaatgtgga

SEQ ID NO: 372320 - DNA, 25 bp, Mus musculus
ctcacctggctgcacttttcaaaat

SEQ ID NO: 372321 - DNA, 25 bp, Mus musculus
ctcacctggctggacttttcaaaat

SEQ ID NO: 372322 - DNA, 25 bp, Mus musculus
ctcacctgggccagagacgcgtccc

SEQ ID NO: 372323 - DNA, 25 bp, Mus musculus
ctcacctgggcctgagacgcgtccc

SEQ ID NO: 372324 - DNA, 25 bp, Mus musculus
ctcacctggtggctgatctaatcat

SEQ ID NO: 372325 - DNA, 25 bp, Mus musculus
ctcacctggtgggtgatctaatcat

SEQ ID NO: 372326 - DNA, 25 bp, Mus musculus
ctcacctggtttctctgacagtcat

SEQ ID NO: 372327 - DNA, 25 bp, Mus musculus
ctcacctggtttgtctgacagtcat

SEQ ID NO: 372328 - DNA, 25 bp, Mus musculus
ctcacctgtatactcgttctgcgca

SEQ ID NO: 372329 - DNA, 25 bp, Mus musculus
ctcacctgtatagtcgttctgcgca

SEQ ID NO: 372330 - DNA, 25 bp, Mus musculus
ctcacctgtgagatggaaagtatgc

SEQ ID NO: 372331 - DNA, 25 bp, Mus musculus
ctcacctgtgagttggaaagtatgc

SEQ ID NO: 372332 - DNA, 25 bp, Mus musculus
ctcacctgtgttaattgtgcagaaa

SEQ ID NO: 372333 - DNA, 25 bp, Mus musculus
ctcacctgtgtttattgtgcagaaa

SEQ ID NO: 372334 - DNA, 25 bp, Mus musculus
ctcaccttaggtccccataattaat

SEQ ID NO: 372335 - DNA, 25 bp, Mus musculus
ctcaccttaggtctgcagcacagaa

SEQ ID NO: 372336 - DNA, 25 bp, Mus musculus
ctcaccttaggtgcccataattaat

SEQ ID NO: 372337 - DNA, 25 bp, Mus musculus
ctcaccttaggtgtgcagcacagaa

SEQ ID NO: 372338 - DNA, 25 bp, Mus musculus
ctcaccttagtaccggtgtcctggt

SEQ ID NO: 372339 - DNA, 25 bp, Mus musculus
ctcaccttagtagcggtgtcctggt

SEQ ID NO: 372340 - DNA, 25 bp, Mus musculus
ctcaccttcaaaatttacttgccca

SEQ ID NO: 372341 - DNA, 25 bp, Mus musculus
ctcaccttcaaattttacttgccca

SEQ ID NO: 372342 - DNA, 25 bp, Mus musculus
ctcaccttcatcatcttggaacaga

SEQ ID NO: 372343 - DNA, 25 bp, Mus musculus
ctcaccttcatcttcttggaacaga

SEQ ID NO: 372344 - DNA, 25 bp, Mus musculus
ctcaccttctccattgaacaaacta

SEQ ID NO: 372345 - DNA, 25 bp, Mus musculus
ctcaccttctcctttgaacaaacta

SEQ ID NO: 372346 - DNA, 25 bp, Mus musculus
ctcaccttgtaaacactggagtcaa

SEQ ID NO: 372347 - DNA, 25 bp, Mus musculus
ctcaccttgtaatcactggagtcaa

SEQ ID NO: 372348 - DNA, 25 bp, Mus musculus
ctcaccttgtagaggcacacaactg

SEQ ID NO: 372349 - DNA, 25 bp, Mus musculus
ctcaccttgtagtggcacacaactg

SEQ ID NO: 372350 - DNA, 25 bp, Mus musculus
ctcacctttcttcttcaagacgtag

SEQ ID NO: 372351 - DNA, 25 bp, Mus musculus
ctcacctttcttgttcaagacgtag

SEQ ID NO: 372352 - DNA, 25 bp, Mus musculus
ctcacgaaggatcactggagccagg

SEQ ID NO: 372353 - DNA, 25 bp, Mus musculus
ctcacgaaggatgactggagccagg

SEQ ID NO: 372354 - DNA, 25 bp, Mus musculus
ctcacgacagagcaccagctgctgg

SEQ ID NO: 372355 - DNA, 25 bp, Mus musculus
ctcacgacagaggaccagctgctgg

SEQ ID NO: 372356 - DNA, 25 bp, Mus musculus
ctcacgcagttccatgtatggaaaa

SEQ ID NO: 372357 - DNA, 25 bp, Mus musculus
ctcacgcagttcgatgtatggaaaa

SEQ ID NO: 372358 - DNA, 25 bp, Mus musculus
ctcacgccagggaagcctaatgttt

SEQ ID NO: 372359 - DNA, 25 bp, Mus musculus
ctcacgccagggtagcctaatgttt

SEQ ID NO: 372360 - DNA, 25 bp, Mus musculus
ctcacgctggacaggttacctgtgt

SEQ ID NO: 372361 - DNA, 25 bp, Mus musculus
ctcacgctggactggttacctgtgt

SEQ ID NO: 372362 - DNA, 25 bp, Mus musculus
ctcacgctggccaagaactatatca

SEQ ID NO: 372363 - DNA, 25 bp, Mus musculus
ctcacgctggcctagaactatatca

SEQ ID NO: 372364 - DNA, 25 bp, Mus musculus
ctcacgcttgagacagaagacatgt

SEQ ID NO: 372365 - DNA, 25 bp, Mus musculus
ctcacgcttgagtcagaagacatgt

SEQ ID NO: 372366 - DNA, 25 bp, Mus musculus
ctcacggactgtcctgtgcagcttt

SEQ ID NO: 372367 - DNA, 25 bp, Mus musculus
ctcacggactgtgctgtgcagcttt

SEQ ID NO: 372368 - DNA, 25 bp, Mus musculus
ctcacggcatatactcaattaggta

SEQ ID NO: 372369 - DNA, 25 bp, Mus musculus
ctcacggcatattctcaattaggta

SEQ ID NO: 372370 - DNA, 25 bp, Mus musculus
ctcacgggtctgctctttggaaaga

SEQ ID NO: 372371 - DNA, 25 bp, Mus musculus
ctcacgggtctggtctttggaaaga

SEQ ID NO: 372372 - DNA, 25 bp, Mus musculus
ctcacggtattgctctttgtttcac

SEQ ID NO: 372373 - DNA, 25 bp, Mus musculus
ctcacggtattggtctttgtttcac

SEQ ID NO: 372374 - DNA, 25 bp, Mus musculus
ctcacggtgtgtaggcatctttaaa

SEQ ID NO: 372375 - DNA, 25 bp, Mus musculus
ctcacggtgtgttggcatctttaaa

SEQ ID NO: 372376 - DNA, 25 bp, Mus musculus
ctcacgtagaacaggacagcttttg

SEQ ID NO: 372377 - DNA, 25 bp, Mus musculus
ctcacgtagaactggacagcttttg

SEQ ID NO: 372378 - DNA, 25 bp, Mus musculus
ctcacgtgcaagacagttgtgggat

SEQ ID NO: 372379 - DNA, 25 bp, Mus musculus
ctcacgtgcaagtcagttgtgggat

SEQ ID NO: 372380 - DNA, 25 bp, Mus musculus
ctcacgtggtgtcgtctctgtggaa

SEQ ID NO: 372381 - DNA, 25 bp, Mus musculus
ctcacgtggtgtggtctctgtggaa

SEQ ID NO: 372382 - DNA, 25 bp, Mus musculus
ctcacgttactactctgtcgattat

SEQ ID NO: 372383 - DNA, 25 bp, Mus musculus
ctcacgttactagtctgtcgattat

SEQ ID NO: 372384 - DNA, 25 bp, Mus musculus
ctcacgttgcagagacagctgggaa

SEQ ID NO: 372385 - DNA, 25 bp, Mus musculus
ctcacgttgcagtgacagctgggaa

SEQ ID NO: 372386 - DNA, 25 bp, Mus musculus
ctcactaactctccttctctgggaa

SEQ ID NO: 372387 - DNA, 25 bp, Mus musculus
ctcactaactctgcttctctgggaa

SEQ ID NO: 372388 - DNA, 25 bp, Mus musculus
ctcactaactgccactagggttttg

SEQ ID NO: 372389 - DNA, 25 bp, Mus musculus
ctcactaactgcgactagggttttg

SEQ ID NO: 372390 - DNA, 25 bp, Mus musculus
ctcactaaggagatccgtttttgag

SEQ ID NO: 372391 - DNA, 25 bp, Mus musculus
ctcactaaggagttccgtttttgag

SEQ ID NO: 372392 - DNA, 25 bp, Mus musculus
ctcactacactaacacgttacacta

SEQ ID NO: 372393 - DNA, 25 bp, Mus musculus
ctcactacactatcacgttacacta

SEQ ID NO: 372394 - DNA, 25 bp, Mus musculus
ctcactaccacaacaacttcaaggt

SEQ ID NO: 372395 - DNA, 25 bp, Mus musculus
ctcactaccacatcaacttcaaggt

SEQ ID NO: 372396 - DNA, 25 bp, Mus musculus
ctcactactcggcaagaaatgcttt

SEQ ID NO: 372397 - DNA, 25 bp, Mus musculus
ctcactactcgggaagaaatgcttt

SEQ ID NO: 372398 - DNA, 25 bp, Mus musculus
ctcactacttccaaagaccttacta

SEQ ID NO: 372399 - DNA, 25 bp, Mus musculus
ctcactacttcctaagaccttacta

SEQ ID NO: 372400 - DNA, 25 bp, Mus musculus
ctcactatctctattctgtacagac

SEQ ID NO: 372401 - DNA, 25 bp, Mus musculus
ctcactatctcttttctgtacagac

SEQ ID NO: 372402 - DNA, 25 bp, Mus musculus
ctcactatgtagaccgcagatgatt

SEQ ID NO: 372403 - DNA, 25 bp, Mus musculus
ctcactatgtagtccgcagatgatt

SEQ ID NO: 372404 - DNA, 25 bp, Mus musculus
ctcactatttctagaactttcctat

SEQ ID NO: 372405 - DNA, 25 bp, Mus musculus
ctcactatttcttgaactttcctat

SEQ ID NO: 372406 - DNA, 25 bp, Mus musculus
ctcactcaaattcctgtttgcatct

SEQ ID NO: 372407 - DNA, 25 bp, Mus musculus
ctcactcaaattgctgtttgcatct

SEQ ID NO: 372408 - DNA, 25 bp, Mus musculus
ctcactcaagatagtcagcaatgca

SEQ ID NO: 372409 - DNA, 25 bp, Mus musculus
ctcactcaagattgtcagcaatgca

SEQ ID NO: 372410 - DNA, 25 bp, Mus musculus
ctcactcacttgcaggacctgggaa

SEQ ID NO: 372411 - DNA, 25 bp, Mus musculus
ctcactcacttggaggacctgggaa

SEQ ID NO: 372412 - DNA, 25 bp, Mus musculus
ctcactcagtcacagggcctaagga

SEQ ID NO: 372413 - DNA, 25 bp, Mus musculus
ctcactcagtcagagggcctaagga

SEQ ID NO: 372414 - DNA, 25 bp, Mus musculus
ctcactcagtgaccacctcctggga

SEQ ID NO: 372415 - DNA, 25 bp, Mus musculus
ctcactcagtgagcacctcctggga

SEQ ID NO: 372416 - DNA, 25 bp, Mus musculus
ctcactcatcaacgcgcctgagttt

SEQ ID NO: 372417 - DNA, 25 bp, Mus musculus
ctcactcatcaaggcgcctgagttt

SEQ ID NO: 372418 - DNA, 25 bp, Mus musculus
ctcactcatctccactgtgttagta

SEQ ID NO: 372419 - DNA, 25 bp, Mus musculus
ctcactcatctcgactgtgttagta

SEQ ID NO: 372420 - DNA, 25 bp, Mus musculus
ctcactccatttctttcgtttgaag

SEQ ID NO: 372421 - DNA, 25 bp, Mus musculus
ctcactccatttgtttcgtttgaag

SEQ ID NO: 372422 - DNA, 25 bp, Mus musculus
ctcactccctgacatattttgtctc

SEQ ID NO: 372423 - DNA, 25 bp, Mus musculus
ctcactccctgagatattttgtctc

SEQ ID NO: 372424 - DNA, 25 bp, Mus musculus
ctcactccctggcacgaggtttttg

SEQ ID NO: 372425 - DNA, 25 bp, Mus musculus
ctcactccctgggacgaggtttttg

SEQ ID NO: 372426 - DNA, 25 bp, Mus musculus
ctcactccctttctgtcaagacatt

SEQ ID NO: 372427 - DNA, 25 bp, Mus musculus
ctcactccctttgtgtcaagacatt

SEQ ID NO: 372428 - DNA, 25 bp, Mus musculus
ctcactccgggaccgggcaggtact

SEQ ID NO: 372429 - DNA, 25 bp, Mus musculus
ctcactccgggagcgggcaggtact

SEQ ID NO: 372430 - DNA, 25 bp, Mus musculus
ctcactccttcaatgcaggttacaa

SEQ ID NO: 372431 - DNA, 25 bp, Mus musculus
ctcactccttcattgcaggttacaa

SEQ ID NO: 372432 - DNA, 25 bp, Mus musculus
ctcactcgtgaccacagcagttgtg

SEQ ID NO: 372433 - DNA, 25 bp, Mus musculus
ctcactcgtgacgacagcagttgtg

SEQ ID NO: 372434 - DNA, 25 bp, Mus musculus
ctcactctagggaaattgccctgtc

SEQ ID NO: 372435 - DNA, 25 bp, Mus musculus
ctcactctagggtaattgccctgtc

SEQ ID NO: 372436 - DNA, 25 bp, Mus musculus
ctcactctcacaattgacgggaaaa

SEQ ID NO: 372437 - DNA, 25 bp, Mus musculus
ctcactctcacatttgacgggaaaa

SEQ ID NO: 372438 - DNA, 25 bp, Mus musculus
ctcactctcatgctcaatctaaaat

SEQ ID NO: 372439 - DNA, 25 bp, Mus musculus
ctcactctcatggtcaatctaaaat

SEQ ID NO: 372440 - DNA, 25 bp, Mus musculus
ctcactctccaaagttgtcaacaac

SEQ ID NO: 372441 - DNA, 25 bp, Mus musculus
ctcactctccaatgttgtcaacaac

SEQ ID NO: 372442 - DNA, 25 bp, Mus musculus
ctcactctcctactgtttttaataa

SEQ ID NO: 372443 - DNA, 25 bp, Mus musculus
ctcactctcctagtgtttttaataa

SEQ ID NO: 372444 - DNA, 25 bp, Mus musculus
ctcactctgcctcagtactgaatgt

SEQ ID NO: 372445 - DNA, 25 bp, Mus musculus
ctcactctgcctgagtactgaatgt

SEQ ID NO: 372446 - DNA, 25 bp, Mus musculus
ctcactcttctgactaaaggtgcta

SEQ ID NO: 372447 - DNA, 25 bp, Mus musculus
ctcactcttctgtctaaaggtgcta

SEQ ID NO: 372448 - DNA, 25 bp, Mus musculus
ctcactctttcacgactggagggac

SEQ ID NO: 372449 - DNA, 25 bp, Mus musculus
ctcactctttcaggactggagggac

SEQ ID NO: 372450 - DNA, 25 bp, Mus musculus
ctcactgaatctcacaccaacatga

SEQ ID NO: 372451 - DNA, 25 bp, Mus musculus
ctcactgaatctgacaccaacatga

SEQ ID NO: 372452 - DNA, 25 bp, Mus musculus
ctcactgaccttacacactaagatg

SEQ ID NO: 372453 - DNA, 25 bp, Mus musculus
ctcactgacctttcacactaagatg

SEQ ID NO: 372454 - DNA, 25 bp, Mus musculus
ctcactgagagaaatgattggcccc

SEQ ID NO: 372455 - DNA, 25 bp, Mus musculus
ctcactgagagatatgattggcccc

SEQ ID NO: 372456 - DNA, 25 bp, Mus musculus
ctcactgagctcaagtctctactga

SEQ ID NO: 372457 - DNA, 25 bp, Mus musculus
ctcactgagctctagtctctactga

SEQ ID NO: 372458 - DNA, 25 bp, Mus musculus
ctcactgagtgacgttcctggaagt

SEQ ID NO: 372459 - DNA, 25 bp, Mus musculus
ctcactgagtgaggttcctggaagt

SEQ ID NO: 372460 - DNA, 25 bp, Mus musculus
ctcactgatagaatccgaagacagc

SEQ ID NO: 372461 - DNA, 25 bp, Mus musculus
ctcactgatagattccgaagacagc

SEQ ID NO: 372462 - DNA, 25 bp, Mus musculus
ctcactgatttgacagcactcctgg

SEQ ID NO: 372463 - DNA, 25 bp, Mus musculus
ctcactgatttgtcagcactcctgg

SEQ ID NO: 372464 - DNA, 25 bp, Mus musculus
ctcactgcaaagaggaccttaccct

SEQ ID NO: 372465 - DNA, 25 bp, Mus musculus
ctcactgcaaagtggaccttaccct

SEQ ID NO: 372466 - DNA, 25 bp, Mus musculus
ctcactgcaccacttgtactgactt

SEQ ID NO: 372467 - DNA, 25 bp, Mus musculus
ctcactgcaccagttgtactgactt

SEQ ID NO: 372468 - DNA, 25 bp, Mus musculus
ctcactgcagtcaatgctgtgggca

SEQ ID NO: 372469 - DNA, 25 bp, Mus musculus
ctcactgcagtctatgctgtgggca

SEQ ID NO: 372470 - DNA, 25 bp, Mus musculus
ctcactgcatacatatatccctgaa

SEQ ID NO: 372471 - DNA, 25 bp, Mus musculus
ctcactgcatacctctgtgtagtag

SEQ ID NO: 372472 - DNA, 25 bp, Mus musculus
ctcactgcatacgtctgtgtagtag

SEQ ID NO: 372473 - DNA, 25 bp, Mus musculus
ctcactgcatacttatatccctgaa

SEQ ID NO: 372474 - DNA, 25 bp, Mus musculus
ctcactgcatggagttggctattct

SEQ ID NO: 372475 - DNA, 25 bp, Mus musculus
ctcactgcatggtgttggctattct

SEQ ID NO: 372476 - DNA, 25 bp, Mus musculus
ctcactgcatgtaagctagcgctga

SEQ ID NO: 372477 - DNA, 25 bp, Mus musculus
ctcactgcatgttagctagcgctga

SEQ ID NO: 372478 - DNA, 25 bp, Mus musculus
ctcactgccaaaaacaaagacctat

SEQ ID NO: 372479 - DNA, 25 bp, Mus musculus
ctcactgccaaatacaaagacctat

SEQ ID NO: 372480 - DNA, 25 bp, Mus musculus
ctcactgcccagcagctacaaaaga

SEQ ID NO: 372481 - DNA, 25 bp, Mus musculus
ctcactgcccaggagctacaaaaga

SEQ ID NO: 372482 - DNA, 25 bp, Mus musculus
ctcactgcgcaaacgtttgtggtgt

SEQ ID NO: 372483 - DNA, 25 bp, Mus musculus
ctcactgcgcaatcgtttgtggtgt

SEQ ID NO: 372484 - DNA, 25 bp, Mus musculus
ctcactgcgcagattgggtttttat

SEQ ID NO: 372485 - DNA, 25 bp, Mus musculus
ctcactgcgcagtttgggtttttat

SEQ ID NO: 372486 - DNA, 25 bp, Mus musculus
ctcactgcttatatggaccttaacc

SEQ ID NO: 372487 - DNA, 25 bp, Mus musculus
ctcactgcttatttggaccttaacc

SEQ ID NO: 372488 - DNA, 25 bp, Mus musculus
ctcactgcttgactccatttcactg

SEQ ID NO: 372489 - DNA, 25 bp, Mus musculus
ctcactgcttgagtccatttcactg

SEQ ID NO: 372490 - DNA, 25 bp, Mus musculus
ctcactgctttaaatcctaccaaag

SEQ ID NO: 372491 - DNA, 25 bp, Mus musculus
ctcactgctttatatcctaccaaag

SEQ ID NO: 372492 - DNA, 25 bp, Mus musculus
ctcactggaagtctgcacttctcaa

SEQ ID NO: 372493 - DNA, 25 bp, Mus musculus
ctcactggaagtgtgcacttctcaa

SEQ ID NO: 372494 - DNA, 25 bp, Mus musculus
ctcactggagggatcctgagagaag

SEQ ID NO: 372495 - DNA, 25 bp, Mus musculus
ctcactggagggttcctgagagaag

SEQ ID NO: 372496 - DNA, 25 bp, Mus musculus
ctcactggagtactacatgggctta

SEQ ID NO: 372497 - DNA, 25 bp, Mus musculus
ctcactggagtagtacatgggctta

SEQ ID NO: 372498 - DNA, 25 bp, Mus musculus
ctcactggatctcgagaccccaaag

SEQ ID NO: 372499 - DNA, 25 bp, Mus musculus
ctcactggatctggagaccccaaag

SEQ ID NO: 372500 - DNA, 25 bp, Mus musculus
ctcactggccctagatactttggaa

SEQ ID NO: 372501 - DNA, 25 bp, Mus musculus
ctcactggcccttgatactttggaa

SEQ ID NO: 372502 - DNA, 25 bp, Mus musculus
ctcactgggttcaattagatattaa

SEQ ID NO: 372503 - DNA, 25 bp, Mus musculus
ctcactgggttctattagatattaa

SEQ ID NO: 372504 - DNA, 25 bp, Mus musculus
ctcactggtctgcaggacagtttga

SEQ ID NO: 372505 - DNA, 25 bp, Mus musculus
ctcactggtctggaggacagtttga

SEQ ID NO: 372506 - DNA, 25 bp, Mus musculus
ctcactggtggccaagacttgactt

SEQ ID NO: 372507 - DNA, 25 bp, Mus musculus
ctcactggtggcgaagacttgactt

SEQ ID NO: 372508 - DNA, 25 bp, Mus musculus
ctcactgtaagtagaagggagttcc

SEQ ID NO: 372509 - DNA, 25 bp, Mus musculus
ctcactgtaagttgaagggagttcc

SEQ ID NO: 372510 - DNA, 25 bp, Mus musculus
ctcactgtagtaaagcacaattgca

SEQ ID NO: 372511 - DNA, 25 bp, Mus musculus
ctcactgtagtatagcacaattgca

SEQ ID NO: 372512 - DNA, 25 bp, Mus musculus
ctcactgtatttattggctgtatca

SEQ ID NO: 372513 - DNA, 25 bp, Mus musculus
ctcactgtattttttggctgtatca

SEQ ID NO: 372514 - DNA, 25 bp, Mus musculus
ctcactgtccaaagcccagatgatt

SEQ ID NO: 372515 - DNA, 25 bp, Mus musculus
ctcactgtccaatgcccagatgatt

SEQ ID NO: 372516 - DNA, 25 bp, Mus musculus
ctcactgtctcccttagaatgcaca

SEQ ID NO: 372517 - DNA, 25 bp, Mus musculus
ctcactgtctccgttagaatgcaca

SEQ ID NO: 372518 - DNA, 25 bp, Mus musculus
ctcactgtgtaacccctagcatgat

SEQ ID NO: 372519 - DNA, 25 bp, Mus musculus
ctcactgtgtaagccctagcatgat

SEQ ID NO: 372520 - DNA, 25 bp, Mus musculus
ctcactgtgtagagttcctagattc

SEQ ID NO: 372521 - DNA, 25 bp, Mus musculus
ctcactgtgtagtgttcctagattc

SEQ ID NO: 372522 - DNA, 25 bp, Mus musculus
ctcactgtgtttatatttctcccag

SEQ ID NO: 372523 - DNA, 25 bp, Mus musculus
ctcactgtgtttttatttctcccag

SEQ ID NO: 372524 - DNA, 25 bp, Mus musculus
ctcactgttatcatggtgattgtac

SEQ ID NO: 372525 - DNA, 25 bp, Mus musculus
ctcactgttatcttggtgattgtac

SEQ ID NO: 372526 - DNA, 25 bp, Mus musculus
ctcactgttcaccataatgtggctc

SEQ ID NO: 372527 - DNA, 25 bp, Mus musculus
ctcactgttcacgataatgtggctc

SEQ ID NO: 372528 - DNA, 25 bp, Mus musculus
ctcactgttctgagggcatgaacaa

SEQ ID NO: 372529 - DNA, 25 bp, Mus musculus
ctcactgttctgtgggcatgaacaa

SEQ ID NO: 372530 - DNA, 25 bp, Mus musculus
ctcactgtttctagcgggtttgaat

SEQ ID NO: 372531 - DNA, 25 bp, Mus musculus
ctcactgtttcttgcgggtttgaat

SEQ ID NO: 372532 - DNA, 25 bp, Mus musculus
ctcacttaacatcctgctggtagat

SEQ ID NO: 372533 - DNA, 25 bp, Mus musculus
ctcacttaacatgctgctggtagat

SEQ ID NO: 372534 - DNA, 25 bp, Mus musculus
ctcacttacagacttggacagatac

SEQ ID NO: 372535 - DNA, 25 bp, Mus musculus
ctcacttacagagttggacagatac

SEQ ID NO: 372536 - DNA, 25 bp, Mus musculus
ctcacttagaccacctgcaacagaa

SEQ ID NO: 372537 - DNA, 25 bp, Mus musculus
ctcacttagacctcctgcaacagaa

SEQ ID NO: 372538 - DNA, 25 bp, Mus musculus
ctcacttagctgatccgcagaggta

SEQ ID NO: 372539 - DNA, 25 bp, Mus musculus
ctcacttagctgttccgcagaggta

SEQ ID NO: 372540 - DNA, 25 bp, Mus musculus
ctcacttatgaaacacagcgacgtt

SEQ ID NO: 372541 - DNA, 25 bp, Mus musculus
ctcacttatgaatcacagcgacgtt

SEQ ID NO: 372542 - DNA, 25 bp, Mus musculus
ctcacttatgagaatggtgcagtac

SEQ ID NO: 372543 - DNA, 25 bp, Mus musculus
ctcacttatgagtatggtgcagtac

SEQ ID NO: 372544 - DNA, 25 bp, Mus musculus
ctcacttcactgcattccagataag

SEQ ID NO: 372545 - DNA, 25 bp, Mus musculus
ctcacttcactggattccagataag

SEQ ID NO: 372546 - DNA, 25 bp, Mus musculus
ctcacttcagcacctcatattattt

SEQ ID NO: 372547 - DNA, 25 bp, Mus musculus
ctcacttcagcagctcatattattt

SEQ ID NO: 372548 - DNA, 25 bp, Mus musculus
ctcacttccatacaggaatgtcttt

SEQ ID NO: 372549 - DNA, 25 bp, Mus musculus
ctcacttccatagaggaatgtcttt

SEQ ID NO: 372550 - DNA, 25 bp, Mus musculus
ctcacttcgaaaagccatgtctagt

SEQ ID NO: 372551 - DNA, 25 bp, Mus musculus
ctcacttcgaaatgccatgtctagt

SEQ ID NO: 372552 - DNA, 25 bp, Mus musculus
ctcacttctaggagactgacttttt

SEQ ID NO: 372553 - DNA, 25 bp, Mus musculus
ctcacttctaggtgactgacttttt

SEQ ID NO: 372554 - DNA, 25 bp, Mus musculus
ctcacttctgagaagggatcgggta

SEQ ID NO: 372555 - DNA, 25 bp, Mus musculus
ctcacttctgagtagggatcgggta

SEQ ID NO: 372556 - DNA, 25 bp, Mus musculus
ctcacttcttccagagcgaggacat

SEQ ID NO: 372557 - DNA, 25 bp, Mus musculus
ctcacttcttcctgagcgaggacat

SEQ ID NO: 372558 - DNA, 25 bp, Mus musculus
ctcacttgagaaacactgcagagtt

SEQ ID NO: 372559 - DNA, 25 bp, Mus musculus
ctcacttgagaatcactgcagagtt

SEQ ID NO: 372560 - DNA, 25 bp, Mus musculus
ctcacttgagtgattggataattgg

SEQ ID NO: 372561 - DNA, 25 bp, Mus musculus
ctcacttgagtgtttggataattgg

SEQ ID NO: 372562 - DNA, 25 bp, Mus musculus
ctcacttgattgctgctgtttgcat

SEQ ID NO: 372563 - DNA, 25 bp, Mus musculus
ctcacttgattggtgctgtttgcat

SEQ ID NO: 372564 - DNA, 25 bp, Mus musculus
ctcacttgcagccagcctagttttt

SEQ ID NO: 372565 - DNA, 25 bp, Mus musculus
ctcacttgcagcgagcctagttttt

SEQ ID NO: 372566 - DNA, 25 bp, Mus musculus
ctcacttgctctccatgttttatgt

SEQ ID NO: 372567 - DNA, 25 bp, Mus musculus
ctcacttgctctgcatgttttatgt

SEQ ID NO: 372568 - DNA, 25 bp, Mus musculus
ctcacttggcccaaggtaactaaga

SEQ ID NO: 372569 - DNA, 25 bp, Mus musculus
ctcacttggccctaggtaactaaga

SEQ ID NO: 372570 - DNA, 25 bp, Mus musculus
ctcacttgggatcggcactgcggaa

SEQ ID NO: 372571 - DNA, 25 bp, Mus musculus
ctcacttgggatgggcactgcggaa

SEQ ID NO: 372572 - DNA, 25 bp, Mus musculus
ctcacttgtagcatccctatgatag

SEQ ID NO: 372573 - DNA, 25 bp, Mus musculus
ctcacttgtagcttccctatgatag

SEQ ID NO: 372574 - DNA, 25 bp, Mus musculus
ctcactttaaggactgtatcaggca

SEQ ID NO: 372575 - DNA, 25 bp, Mus musculus
ctcactttaaggtctgtatcaggca

SEQ ID NO: 372576 - DNA, 25 bp, Mus musculus
ctcactttagcccaaggattgattt

SEQ ID NO: 372577 - DNA, 25 bp, Mus musculus
ctcactttagccctgctatggaaag

SEQ ID NO: 372578 - DNA, 25 bp, Mus musculus
ctcactttagccgaaggattgattt

SEQ ID NO: 372579 - DNA, 25 bp, Mus musculus
ctcactttagccgtgctatggaaag

SEQ ID NO: 372580 - DNA, 25 bp, Mus musculus
ctcactttcagccacattcaattga

SEQ ID NO: 372581 - DNA, 25 bp, Mus musculus
ctcactttcagcgacattcaattga

SEQ ID NO: 372582 - DNA, 25 bp, Mus musculus
ctcactttccccatagaattcatgt

SEQ ID NO: 372583 - DNA, 25 bp, Mus musculus
ctcactttccccttagaattcatgt

SEQ ID NO: 372584 - DNA, 25 bp, Mus musculus
ctcactttctacatctaatactgaa

SEQ ID NO: 372585 - DNA, 25 bp, Mus musculus
ctcactttctacttctaatactgaa

SEQ ID NO: 372586 - DNA, 25 bp, Mus musculus
ctcactttctgccagcagacataaa

SEQ ID NO: 372587 - DNA, 25 bp, Mus musculus
ctcactttctgcgagcagacataaa

SEQ ID NO: 372588 - DNA, 25 bp, Mus musculus
ctcactttggagctgttactagaca

SEQ ID NO: 372589 - DNA, 25 bp, Mus musculus
ctcactttggaggtgttactagaca

SEQ ID NO: 372590 - DNA, 25 bp, Mus musculus
ctcacttttttacgttccatttcat

SEQ ID NO: 372591 - DNA, 25 bp, Mus musculus
ctcacttttttaggttccatttcat

SEQ ID NO: 372592 - DNA, 25 bp, Mus musculus
ctcagaaaacgtctgtgggagccca

SEQ ID NO: 372593 - DNA, 25 bp, Mus musculus
ctcagaaaacgtgtgtgggagccca

SEQ ID NO: 372594 - DNA, 25 bp, Mus musculus
ctcagaaaacttctgccctaaatta

SEQ ID NO: 372595 - DNA, 25 bp, Mus musculus
ctcagaaaacttgtgccctaaatta

SEQ ID NO: 372596 - DNA, 25 bp, Mus musculus
ctcagaaacctgcttcatgctttag

SEQ ID NO: 372597 - DNA, 25 bp, Mus musculus
ctcagaaacctggttcatgctttag

SEQ ID NO: 372598 - DNA, 25 bp, Mus musculus
ctcagaaactttaagaccaacttgg

SEQ ID NO: 372599 - DNA, 25 bp, Mus musculus
ctcagaaacttttagaccaacttgg

SEQ ID NO: 372600 - DNA, 25 bp, Mus musculus
ctcagaaatcctcccaccagaagat

SEQ ID NO: 372601 - DNA, 25 bp, Mus musculus
ctcagaaatcctgccaccagaagat

SEQ ID NO: 372602 - DNA, 25 bp, Mus musculus
ctcagaaccgccatcattacatttg

SEQ ID NO: 372603 - DNA, 25 bp, Mus musculus
ctcagaaccgccttcattacatttg

SEQ ID NO: 372604 - DNA, 25 bp, Mus musculus
ctcagaacgggacgtatgcaggccc

SEQ ID NO: 372605 - DNA, 25 bp, Mus musculus
ctcagaacgggaggtatgcaggccc

SEQ ID NO: 372606 - DNA, 25 bp, Mus musculus
ctcagaagatgaagtgaccagcccc

SEQ ID NO: 372607 - DNA, 25 bp, Mus musculus
ctcagaagatgatgtgaccagcccc

SEQ ID NO: 372608 - DNA, 25 bp, Mus musculus
ctcagaagccccattcggtttttat

SEQ ID NO: 372609 - DNA, 25 bp, Mus musculus
ctcagaagcccctttcggtttttat

SEQ ID NO: 372610 - DNA, 25 bp, Mus musculus
ctcagaagcctacggcaggccaagc

SEQ ID NO: 372611 - DNA, 25 bp, Mus musculus
ctcagaagcctagggcaggccaagc

SEQ ID NO: 372612 - DNA, 25 bp, Mus musculus
ctcagaagcgacaggaggtctattt

SEQ ID NO: 372613 - DNA, 25 bp, Mus musculus
ctcagaagcgactggaggtctattt

SEQ ID NO: 372614 - DNA, 25 bp, Mus musculus
ctcagaagctcccaagtttacccag

SEQ ID NO: 372615 - DNA, 25 bp, Mus musculus
ctcagaagctccgaagtttacccag

SEQ ID NO: 372616 - DNA, 25 bp, Mus musculus
ctcagaaggcaccaacaccagcggg

SEQ ID NO: 372617 - DNA, 25 bp, Mus musculus
ctcagaaggcacgaacaccagcggg

SEQ ID NO: 372618 - DNA, 25 bp, Mus musculus
ctcagaaggcttccctgtgtttgtt

SEQ ID NO: 372619 - DNA, 25 bp, Mus musculus
ctcagaaggcttgcctgtgtttgtt

SEQ ID NO: 372620 - DNA, 25 bp, Mus musculus
ctcagaagtccgaccctgtgggatc

SEQ ID NO: 372621 - DNA, 25 bp, Mus musculus
ctcagaagtccgtccctgtgggatc

SEQ ID NO: 372622 - DNA, 25 bp, Mus musculus
ctcagaagttctagtcacccaggac

SEQ ID NO: 372623 - DNA, 25 bp, Mus musculus
ctcagaagttcttgtcacccaggac

SEQ ID NO: 372624 - DNA, 25 bp, Mus musculus
ctcagaatgtggacagtcactggcc

SEQ ID NO: 372625 - DNA, 25 bp, Mus musculus
ctcagaatgtggtcagtcactggcc

SEQ ID NO: 372626 - DNA, 25 bp, Mus musculus
ctcagaatgttgatggccctcaggg

SEQ ID NO: 372627 - DNA, 25 bp, Mus musculus
ctcagaatgttgttggccctcaggg

SEQ ID NO: 372628 - DNA, 25 bp, Mus musculus
ctcagaattcttaggctggttctta

SEQ ID NO: 372629 - DNA, 25 bp, Mus musculus
ctcagaattctttggctggttctta

SEQ ID NO: 372630 - DNA, 25 bp, Mus musculus
ctcagaattgtcaaactctaccttc

SEQ ID NO: 372631 - DNA, 25 bp, Mus musculus
ctcagaattgtctaactctaccttc

SEQ ID NO: 372632 - DNA, 25 bp, Mus musculus
ctcagacaacacatgctctctttta

SEQ ID NO: 372633 - DNA, 25 bp, Mus musculus
ctcagacaacacttgctctctttta

SEQ ID NO: 372634 - DNA, 25 bp, Mus musculus
ctcagacaccagaaggtgaggtggc

SEQ ID NO: 372635 - DNA, 25 bp, Mus musculus
ctcagacaccagtaggtgaggtggc

SEQ ID NO: 372636 - DNA, 25 bp, Mus musculus
ctcagacatctgcaatggctttgaa

SEQ ID NO: 372637 - DNA, 25 bp, Mus musculus
ctcagacatctggaatggctttgaa

SEQ ID NO: 372638 - DNA, 25 bp, Mus musculus
ctcagacatcttatagaatacatga

SEQ ID NO: 372639 - DNA, 25 bp, Mus musculus
ctcagacatcttttagaatacatga

SEQ ID NO: 372640 - DNA, 25 bp, Mus musculus
ctcagacatgctcttgtcctctgta

SEQ ID NO: 372641 - DNA, 25 bp, Mus musculus
ctcagacatgctgttgtcctctgta

SEQ ID NO: 372642 - DNA, 25 bp, Mus musculus
ctcagaccaacaagtaaaccatgga

SEQ ID NO: 372643 - DNA, 25 bp, Mus musculus
ctcagaccaacatgtaaaccatgga

SEQ ID NO: 372644 - DNA, 25 bp, Mus musculus
ctcagaccggagatctacagttcag

SEQ ID NO: 372645 - DNA, 25 bp, Mus musculus
ctcagaccggagttctacagttcag

SEQ ID NO: 372646 - DNA, 25 bp, Mus musculus
ctcagacctaagatcataatttgta

SEQ ID NO: 372647 - DNA, 25 bp, Mus musculus
ctcagacctaagttcataatttgta

SEQ ID NO: 372648 - DNA, 25 bp, Mus musculus
ctcagacctgataatatgtaacatt

SEQ ID NO: 372649 - DNA, 25 bp, Mus musculus
ctcagacctgattatatgtaacatt

SEQ ID NO: 372650 - DNA, 25 bp, Mus musculus
ctcagacctgtaacttgctggttaa

SEQ ID NO: 372651 - DNA, 25 bp, Mus musculus
ctcagacctgtaccttatgctggaa

SEQ ID NO: 372652 - DNA, 25 bp, Mus musculus
ctcagacctgtagcttatgctggaa

SEQ ID NO: 372653 - DNA, 25 bp, Mus musculus
ctcagacctgtatcttgctggttaa

SEQ ID NO: 372654 - DNA, 25 bp, Mus musculus
ctcagaccttcaatctttcgacatc

SEQ ID NO: 372655 - DNA, 25 bp, Mus musculus
ctcagaccttcattctttcgacatc

SEQ ID NO: 372656 - DNA, 25 bp, Mus musculus
ctcagacggcccaatgggaggcatg

SEQ ID NO: 372657 - DNA, 25 bp, Mus musculus
ctcagacggccctatgggaggcatg

SEQ ID NO: 372658 - DNA, 25 bp, Mus musculus
ctcagactcagccactatgacaggg

SEQ ID NO: 372659 - DNA, 25 bp, Mus musculus
ctcagactcagcgactatgacaggg

SEQ ID NO: 372660 - DNA, 25 bp, Mus musculus
ctcagactcagtactctcttcttag

SEQ ID NO: 372661 - DNA, 25 bp, Mus musculus
ctcagactcagttctctcttcttag

SEQ ID NO: 372662 - DNA, 25 bp, Mus musculus
ctcagactcatactcagacctttaa

SEQ ID NO: 372663 - DNA, 25 bp, Mus musculus
ctcagactcatagtcagacctttaa

SEQ ID NO: 372664 - DNA, 25 bp, Mus musculus
ctcagactcggaagggatattcatt

SEQ ID NO: 372665 - DNA, 25 bp, Mus musculus
ctcagactcggatgggatattcatt

SEQ ID NO: 372666 - DNA, 25 bp, Mus musculus
ctcagactctgcatagtgtactcaa

SEQ ID NO: 372667 - DNA, 25 bp, Mus musculus
ctcagactctgcttagtgtactcaa

SEQ ID NO: 372668 - DNA, 25 bp, Mus musculus
ctcagacttcataccaaccttgata

SEQ ID NO: 372669 - DNA, 25 bp, Mus musculus
ctcagacttcattccaaccttgata

SEQ ID NO: 372670 - DNA, 25 bp, Mus musculus
ctcagacttctgatctccaagtttt

SEQ ID NO: 372671 - DNA, 25 bp, Mus musculus
ctcagacttctgttctccaagtttt

SEQ ID NO: 372672 - DNA, 25 bp, Mus musculus
ctcagagacattctttccatttgga

SEQ ID NO: 372673 - DNA, 25 bp, Mus musculus
ctcagagacattgtttccatttgga

SEQ ID NO: 372674 - DNA, 25 bp, Mus musculus
ctcagagactgacttcaggcaatgt

SEQ ID NO: 372675 - DNA, 25 bp, Mus musculus
ctcagagactgagttcaggcaatgt

SEQ ID NO: 372676 - DNA, 25 bp, Mus musculus
ctcagagatacacgtacacttacca

SEQ ID NO: 372677 - DNA, 25 bp, Mus musculus
ctcagagatacaggtacacttacca

SEQ ID NO: 372678 - DNA, 25 bp, Mus musculus
ctcagagcaaaaacatggccatggc

SEQ ID NO: 372679 - DNA, 25 bp, Mus musculus
ctcagagcaaaatcatggccatggc

SEQ ID NO: 372680 - DNA, 25 bp, Mus musculus
ctcagagcaactcggtcatactagt

SEQ ID NO: 372681 - DNA, 25 bp, Mus musculus
ctcagagcaactgggtcatactagt

SEQ ID NO: 372682 - DNA, 25 bp, Mus musculus
ctcagagcacgtccctggaggacgc

SEQ ID NO: 372683 - DNA, 25 bp, Mus musculus
ctcagagcacgtgcctggaggacgc

SEQ ID NO: 372684 - DNA, 25 bp, Mus musculus
ctcagagcctgaccatagttcattt

SEQ ID NO: 372685 - DNA, 25 bp, Mus musculus
ctcagagcctgagcatagttcattt

SEQ ID NO: 372686 - DNA, 25 bp, Mus musculus
ctcagagcctgcatgacggtggtta

SEQ ID NO: 372687 - DNA, 25 bp, Mus musculus
ctcagagcctgcttgacggtggtta

SEQ ID NO: 372688 - DNA, 25 bp, Mus musculus
ctcagagcgaccaaaccctgtgtga

SEQ ID NO: 372689 - DNA, 25 bp, Mus musculus
ctcagagcgacctaaccctgtgtga

SEQ ID NO: 372690 - DNA, 25 bp, Mus musculus
ctcagagcgctgaagaacggtccta

SEQ ID NO: 372691 - DNA, 25 bp, Mus musculus
ctcagagcgctgtagaacggtccta

SEQ ID NO: 372692 - DNA, 25 bp, Mus musculus
ctcagagctcaacaaggatattgat

SEQ ID NO: 372693 - DNA, 25 bp, Mus musculus
ctcagagctcaagaaggatattgat

SEQ ID NO: 372694 - DNA, 25 bp, Mus musculus
ctcagagctctaaacgtgggtcata

SEQ ID NO: 372695 - DNA, 25 bp, Mus musculus
ctcagagctctatacgtgggtcata

SEQ ID NO: 372696 - DNA, 25 bp, Mus musculus
ctcagaggaaatccaggcttgcctg

SEQ ID NO: 372697 - DNA, 25 bp, Mus musculus
ctcagaggaaatgcaggcttgcctg

SEQ ID NO: 372698 - DNA, 25 bp, Mus musculus
ctcagaggactcagcctcgggatct

SEQ ID NO: 372699 - DNA, 25 bp, Mus musculus
ctcagaggactctgcctcgggatct

SEQ ID NO: 372700 - DNA, 25 bp, Mus musculus
ctcagaggagttctattgtttccat

SEQ ID NO: 372701 - DNA, 25 bp, Mus musculus
ctcagaggagttgtattgtttccat

SEQ ID NO: 372702 - DNA, 25 bp, Mus musculus
ctcagaggcaaacgccagtgggtct

SEQ ID NO: 372703 - DNA, 25 bp, Mus musculus
ctcagaggcaaaggccagtgggtct

SEQ ID NO: 372704 - DNA, 25 bp, Mus musculus
ctcagaggcctacttttaagcagct

SEQ ID NO: 372705 - DNA, 25 bp, Mus musculus
ctcagaggcctagttttaagcagct

SEQ ID NO: 372706 - DNA, 25 bp, Mus musculus
ctcagaggcctccatagtgtgtcct

SEQ ID NO: 372707 - DNA, 25 bp, Mus musculus
ctcagaggcctcgatagtgtgtcct

SEQ ID NO: 372708 - DNA, 25 bp, Mus musculus
ctcagaggcggcatttgccttgaaa

SEQ ID NO: 372709 - DNA, 25 bp, Mus musculus
ctcagaggcggcttttgccttgaaa

SEQ ID NO: 372710 - DNA, 25 bp, Mus musculus
ctcagaggctcgctatcgtttttca

SEQ ID NO: 372711 - DNA, 25 bp, Mus musculus
ctcagaggctcggtatcgtttttca

SEQ ID NO: 372712 - DNA, 25 bp, Mus musculus
ctcagaggctggaatctggcccata

SEQ ID NO: 372713 - DNA, 25 bp, Mus musculus
ctcagaggctggtatctggcccata

SEQ ID NO: 372714 - DNA, 25 bp, Mus musculus
ctcagagggattaggctcttgctct

SEQ ID NO: 372715 - DNA, 25 bp, Mus musculus
ctcagagggatttggctcttgctct

SEQ ID NO: 372716 - DNA, 25 bp, Mus musculus
ctcagaggtgatatgaagactcaac

SEQ ID NO: 372717 - DNA, 25 bp, Mus musculus
ctcagaggtgatttgaagactcaac

SEQ ID NO: 372718 - DNA, 25 bp, Mus musculus
ctcagagtaatactgtttcgcgcca

SEQ ID NO: 372719 - DNA, 25 bp, Mus musculus
ctcagagtaatagtgtttcgcgcca

SEQ ID NO: 372720 - DNA, 25 bp, Mus musculus
ctcagagtatccactttatggccaa

SEQ ID NO: 372721 - DNA, 25 bp, Mus musculus
ctcagagtatcctctttatggccaa

SEQ ID NO: 372722 - DNA, 25 bp, Mus musculus
ctcagagtatttaatcaaccacagg

SEQ ID NO: 372723 - DNA, 25 bp, Mus musculus
ctcagagtattttatcaaccacagg

SEQ ID NO: 372724 - DNA, 25 bp, Mus musculus
ctcagagtcctgaagcgcagacatt

SEQ ID NO: 372725 - DNA, 25 bp, Mus musculus
ctcagagtcctgtagcgcagacatt

SEQ ID NO: 372726 - DNA, 25 bp, Mus musculus
ctcagagtcgtgacgccgccgggac

SEQ ID NO: 372727 - DNA, 25 bp, Mus musculus
ctcagagtcgtgtcgccgccgggac

SEQ ID NO: 372728 - DNA, 25 bp, Mus musculus
ctcagagtctctatcagacttaaaa

SEQ ID NO: 372729 - DNA, 25 bp, Mus musculus
ctcagagtctctttcagacttaaaa

SEQ ID NO: 372730 - DNA, 25 bp, Mus musculus
ctcagagtgcacagttccctttggg

SEQ ID NO: 372731 - DNA, 25 bp, Mus musculus
ctcagagtgcactgttccctttggg

SEQ ID NO: 372732 - DNA, 25 bp, Mus musculus
ctcagagttctgctacctcgaaggg

SEQ ID NO: 372733 - DNA, 25 bp, Mus musculus
ctcagagttctggtacctcgaaggg

SEQ ID NO: 372734 - DNA, 25 bp, Mus musculus
ctcagagtttaaagtcatgtcctac

SEQ ID NO: 372735 - DNA, 25 bp, Mus musculus
ctcagagtttaatgtcatgtcctac

SEQ ID NO: 372736 - DNA, 25 bp, Mus musculus
ctcagatatcagaccttgaagcatc

SEQ ID NO: 372737 - DNA, 25 bp, Mus musculus
ctcagatatcagtccttgaagcatc

SEQ ID NO: 372738 - DNA, 25 bp, Mus musculus
ctcagatcaagaacgtccattcctt

SEQ ID NO: 372739 - DNA, 25 bp, Mus musculus
ctcagatcaagatcgtccattcctt

SEQ ID NO: 372740 - DNA, 25 bp, Mus musculus
ctcagatccgacctgtgcagataca

SEQ ID NO: 372741 - DNA, 25 bp, Mus musculus
ctcagatccgacgtgtgcagataca

SEQ ID NO: 372742 - DNA, 25 bp, Mus musculus
ctcagatctcagcagtttgctgtta

SEQ ID NO: 372743 - DNA, 25 bp, Mus musculus
ctcagatctcaggagtttgctgtta

SEQ ID NO: 372744 - DNA, 25 bp, Mus musculus
ctcagatgccctagcggtatgggat

SEQ ID NO: 372745 - DNA, 25 bp, Mus musculus
ctcagatgcccttgcggtatgggat

SEQ ID NO: 372746 - DNA, 25 bp, Mus musculus
ctcagatggaccaaacttaccttct

SEQ ID NO: 372747 - DNA, 25 bp, Mus musculus
ctcagatggacctaacttaccttct

SEQ ID NO: 372748 - DNA, 25 bp, Mus musculus
ctcagatgggcaatgggcttggctc

SEQ ID NO: 372749 - DNA, 25 bp, Mus musculus
ctcagatgggcattgggcttggctc

SEQ ID NO: 372750 - DNA, 25 bp, Mus musculus
ctcagatgtcttctcacttcttaga

SEQ ID NO: 372751 - DNA, 25 bp, Mus musculus
ctcagatgtcttgtcacttcttaga

SEQ ID NO: 372752 - DNA, 25 bp, Mus musculus
ctcagatgttgcctttttctggtat

SEQ ID NO: 372753 - DNA, 25 bp, Mus musculus
ctcagatgttgcgtttttctggtat

SEQ ID NO: 372754 - DNA, 25 bp, Mus musculus
ctcagattctctacatggtggctac

SEQ ID NO: 372755 - DNA, 25 bp, Mus musculus
ctcagattctcttcatggtggctac

SEQ ID NO: 372756 - DNA, 25 bp, Mus musculus
ctcagattctgacttcctgggctgc

SEQ ID NO: 372757 - DNA, 25 bp, Mus musculus
ctcagattctgagttcctgggctgc

SEQ ID NO: 372758 - DNA, 25 bp, Mus musculus
ctcagattggctattaaaccctttg

SEQ ID NO: 372759 - DNA, 25 bp, Mus musculus
ctcagattggcttttaaaccctttg

SEQ ID NO: 372760 - DNA, 25 bp, Mus musculus
ctcagatttaacaggcgagccgggc

SEQ ID NO: 372761 - DNA, 25 bp, Mus musculus
ctcagatttaactggcgagccgggc

SEQ ID NO: 372762 - DNA, 25 bp, Mus musculus
ctcagatttcgacgccttagcaata

SEQ ID NO: 372763 - DNA, 25 bp, Mus musculus
ctcagatttcgaggccttagcaata

SEQ ID NO: 372764 - DNA, 25 bp, Mus musculus
ctcagattttgcaactaaagacgta

SEQ ID NO: 372765 - DNA, 25 bp, Mus musculus
ctcagattttgctactaaagacgta

SEQ ID NO: 372766 - DNA, 25 bp, Mus musculus
ctcagattttttcggactggcccag

SEQ ID NO: 372767 - DNA, 25 bp, Mus musculus
ctcagattttttgggactggcccag

SEQ ID NO: 372768 - DNA, 25 bp, Mus musculus
ctcagcaaacaacgcacttctcagg

SEQ ID NO: 372769 - DNA, 25 bp, Mus musculus
ctcagcaaacaaggcacttctcagg

SEQ ID NO: 372770 - DNA, 25 bp, Mus musculus
ctcagcaaacttacccaggcctggt

SEQ ID NO: 372771 - DNA, 25 bp, Mus musculus
ctcagcaaactttcccaggcctggt

SEQ ID NO: 372772 - DNA, 25 bp, Mus musculus
ctcagcaaccctaaggagcctttca

SEQ ID NO: 372773 - DNA, 25 bp, Mus musculus
ctcagcaacccttaggagcctttca

SEQ ID NO: 372774 - DNA, 25 bp, Mus musculus
ctcagcaaggtgaaagcttgtttgg

SEQ ID NO: 372775 - DNA, 25 bp, Mus musculus
ctcagcaaggtgtaagcttgtttgg

SEQ ID NO: 372776 - DNA, 25 bp, Mus musculus
ctcagcaatctgatccggaggaatt

SEQ ID NO: 372777 - DNA, 25 bp, Mus musculus
ctcagcaatctgttccggaggaatt

SEQ ID NO: 372778 - DNA, 25 bp, Mus musculus
ctcagcacacttctttgcttgggtt

SEQ ID NO: 372779 - DNA, 25 bp, Mus musculus
ctcagcacacttgtttgcttgggtt

SEQ ID NO: 372780 - DNA, 25 bp, Mus musculus
ctcagcaccaatctctggtggctca

SEQ ID NO: 372781 - DNA, 25 bp, Mus musculus
ctcagcaccaatgtctggtggctca

SEQ ID NO: 372782 - DNA, 25 bp, Mus musculus
ctcagcactcagagggtagacacca

SEQ ID NO: 372783 - DNA, 25 bp, Mus musculus
ctcagcactcagtgggtagacacca

SEQ ID NO: 372784 - DNA, 25 bp, Mus musculus
ctcagcactcggaagactgttgcaa

SEQ ID NO: 372785 - DNA, 25 bp, Mus musculus
ctcagcactcggtagactgttgcaa

SEQ ID NO: 372786 - DNA, 25 bp, Mus musculus
ctcagcactgtaccattttgtgtag

SEQ ID NO: 372787 - DNA, 25 bp, Mus musculus
ctcagcactgtagcattttgtgtag

SEQ ID NO: 372788 - DNA, 25 bp, Mus musculus
ctcagcactgttcacagtttgggca

SEQ ID NO: 372789 - DNA, 25 bp, Mus musculus
ctcagcactgttgacagtttgggca

SEQ ID NO: 372790 - DNA, 25 bp, Mus musculus
ctcagcacttttagctcacttcccc

SEQ ID NO: 372791 - DNA, 25 bp, Mus musculus
ctcagcactttttgctcacttcccc

SEQ ID NO: 372792 - DNA, 25 bp, Mus musculus
ctcagcagaattcactgcggctttg

SEQ ID NO: 372793 - DNA, 25 bp, Mus musculus
ctcagcagaattgactgcggctttg

SEQ ID NO: 372794 - DNA, 25 bp, Mus musculus
ctcagcagacacaagggccgtatgt

SEQ ID NO: 372795 - DNA, 25 bp, Mus musculus
ctcagcagacactagggccgtatgt

SEQ ID NO: 372796 - DNA, 25 bp, Mus musculus
ctcagcagaccaagcaggtttgcca

SEQ ID NO: 372797 - DNA, 25 bp, Mus musculus
ctcagcagaccatgcaggtttgcca

SEQ ID NO: 372798 - DNA, 25 bp, Mus musculus
ctcagcagagagcaagtactgttct

SEQ ID NO: 372799 - DNA, 25 bp, Mus musculus
ctcagcagagaggaagtactgttct

SEQ ID NO: 372800 - DNA, 25 bp, Mus musculus
ctcagcagattaatcctgtgaataa

SEQ ID NO: 372801 - DNA, 25 bp, Mus musculus
ctcagcagattattcctgtgaataa

SEQ ID NO: 372802 - DNA, 25 bp, Mus musculus
ctcagcagattccagagcttgcaca

SEQ ID NO: 372803 - DNA, 25 bp, Mus musculus
ctcagcagattcgagagcttgcaca

SEQ ID NO: 372804 - DNA, 25 bp, Mus musculus
ctcagcagcagtacatggctgcatt

SEQ ID NO: 372805 - DNA, 25 bp, Mus musculus
ctcagcagcagttcatggctgcatt

SEQ ID NO: 372806 - DNA, 25 bp, Mus musculus
ctcagcagcatacaaggaaccagga

SEQ ID NO: 372807 - DNA, 25 bp, Mus musculus
ctcagcagcatagaaggaaccagga

SEQ ID NO: 372808 - DNA, 25 bp, Mus musculus
ctcagcagccctaggatgttacagc

SEQ ID NO: 372809 - DNA, 25 bp, Mus musculus
ctcagcagcccttggatgttacagc

SEQ ID NO: 372810 - DNA, 25 bp, Mus musculus
ctcagcagctacagagcctggtggt

SEQ ID NO: 372811 - DNA, 25 bp, Mus musculus
ctcagcagctactgagcctggtggt

SEQ ID NO: 372812 - DNA, 25 bp, Mus musculus
ctcagcagctccagttaccaagttt

SEQ ID NO: 372813 - DNA, 25 bp, Mus musculus
ctcagcagctcctgttaccaagttt

SEQ ID NO: 372814 - DNA, 25 bp, Mus musculus
ctcagcagctcgaatcagacatctg

SEQ ID NO: 372815 - DNA, 25 bp, Mus musculus
ctcagcagctcgtatcagacatctg

SEQ ID NO: 372816 - DNA, 25 bp, Mus musculus
ctcagcagctggcatctttttattc

SEQ ID NO: 372817 - DNA, 25 bp, Mus musculus
ctcagcagctgggatctttttattc

SEQ ID NO: 372818 - DNA, 25 bp, Mus musculus
ctcagcaggcaaaggactccaggaa

SEQ ID NO: 372819 - DNA, 25 bp, Mus musculus
ctcagcaggcaatggactccaggaa

SEQ ID NO: 372820 - DNA, 25 bp, Mus musculus
ctcagcaggcctagttcacgatatg

SEQ ID NO: 372821 - DNA, 25 bp, Mus musculus
ctcagcaggccttgttcacgatatg

SEQ ID NO: 372822 - DNA, 25 bp, Mus musculus
ctcagcagtagactacacactgatc

SEQ ID NO: 372823 - DNA, 25 bp, Mus musculus
ctcagcagtagagtacacactgatc

SEQ ID NO: 372824 - DNA, 25 bp, Mus musculus
ctcagcagttaacgtctttagaaac

SEQ ID NO: 372825 - DNA, 25 bp, Mus musculus
ctcagcagttaaggtctttagaaac

SEQ ID NO: 372826 - DNA, 25 bp, Mus musculus
ctcagcataactacactttactttt

SEQ ID NO: 372827 - DNA, 25 bp, Mus musculus
ctcagcataacttcactttactttt

SEQ ID NO: 372828 - DNA, 25 bp, Mus musculus
ctcagcatagagattggtgcccgtg

SEQ ID NO: 372829 - DNA, 25 bp, Mus musculus
ctcagcatagagtttggtgcccgtg

SEQ ID NO: 372830 - DNA, 25 bp, Mus musculus
ctcagcatatgaaggtccttaccct

SEQ ID NO: 372831 - DNA, 25 bp, Mus musculus
ctcagcatatgatggtccttaccct

SEQ ID NO: 372832 - DNA, 25 bp, Mus musculus
ctcagcatcagaactaaacccttca

SEQ ID NO: 372833 - DNA, 25 bp, Mus musculus
ctcagcatcagatctaaacccttca

SEQ ID NO: 372834 - DNA, 25 bp, Mus musculus
ctcagcatccctaaaaacagtttct

SEQ ID NO: 372835 - DNA, 25 bp, Mus musculus
ctcagcatcccttaaaacagtttct

SEQ ID NO: 372836 - DNA, 25 bp, Mus musculus
ctcagcatgcgtatgtagaaataaa

SEQ ID NO: 372837 - DNA, 25 bp, Mus musculus
ctcagcatgcgtttgtagaaataaa

SEQ ID NO: 372838 - DNA, 25 bp, Mus musculus
ctcagcatgtaaagggactttccag

SEQ ID NO: 372839 - DNA, 25 bp, Mus musculus
ctcagcatgtaatgggactttccag

SEQ ID NO: 372840 - DNA, 25 bp, Mus musculus
ctcagcattgccaatggtcaatgag

SEQ ID NO: 372841 - DNA, 25 bp, Mus musculus
ctcagcattgcctatggtcaatgag

SEQ ID NO: 372842 - DNA, 25 bp, Mus musculus
ctcagccacccacaattttgttttc

SEQ ID NO: 372843 - DNA, 25 bp, Mus musculus
ctcagccacccagaattttgttttc

SEQ ID NO: 372844 - DNA, 25 bp, Mus musculus
ctcagccaccttcgaggagaacgca

SEQ ID NO: 372845 - DNA, 25 bp, Mus musculus
ctcagccaccttggaggagaacgca

SEQ ID NO: 372846 - DNA, 25 bp, Mus musculus
ctcagccagtatagctgggctttgt

SEQ ID NO: 372847 - DNA, 25 bp, Mus musculus
ctcagccagtattgctgggctttgt

SEQ ID NO: 372848 - DNA, 25 bp, Mus musculus
ctcagccatccaaaggtgggctcca

SEQ ID NO: 372849 - DNA, 25 bp, Mus musculus
ctcagccatccataggtgggctcca

SEQ ID NO: 372850 - DNA, 25 bp, Mus musculus
ctcagccatgcaatccatatcaaaa

SEQ ID NO: 372851 - DNA, 25 bp, Mus musculus
ctcagccatgcattccatatcaaaa

SEQ ID NO: 372852 - DNA, 25 bp, Mus musculus
ctcagcccagaacctcggagagaaa

SEQ ID NO: 372853 - DNA, 25 bp, Mus musculus
ctcagcccagaagctcggagagaaa

SEQ ID NO: 372854 - DNA, 25 bp, Mus musculus
ctcagcccagtcacgttgtattctt

SEQ ID NO: 372855 - DNA, 25 bp, Mus musculus
ctcagcccagtctcgttgtattctt

SEQ ID NO: 372856 - DNA, 25 bp, Mus musculus
ctcagcccattcagtctttccttgt

SEQ ID NO: 372857 - DNA, 25 bp, Mus musculus
ctcagcccattctgtctttccttgt

SEQ ID NO: 372858 - DNA, 25 bp, Mus musculus
ctcagccccagtatgacggatgaaa

SEQ ID NO: 372859 - DNA, 25 bp, Mus musculus
ctcagccccagtttgacggatgaaa

SEQ ID NO: 372860 - DNA, 25 bp, Mus musculus
ctcagcccgaggaaatcgcagataa

SEQ ID NO: 372861 - DNA, 25 bp, Mus musculus
ctcagcccgaggtaatcgcagataa

SEQ ID NO: 372862 - DNA, 25 bp, Mus musculus
ctcagcccgttgcaagcttggttta

SEQ ID NO: 372863 - DNA, 25 bp, Mus musculus
ctcagcccgttggaagcttggttta

SEQ ID NO: 372864 - DNA, 25 bp, Mus musculus
ctcagccctaagcagtggtggaaga

SEQ ID NO: 372865 - DNA, 25 bp, Mus musculus
ctcagccctaaggagtggtggaaga

SEQ ID NO: 372866 - DNA, 25 bp, Mus musculus
ctcagccctactagtgttagttcat

SEQ ID NO: 372867 - DNA, 25 bp, Mus musculus
ctcagccctacttgtgttagttcat

SEQ ID NO: 372868 - DNA, 25 bp, Mus musculus
ctcagccctagacttgttttgatct

SEQ ID NO: 372869 - DNA, 25 bp, Mus musculus
ctcagccctagagttgttttgatct

SEQ ID NO: 372870 - DNA, 25 bp, Mus musculus
ctcagccctgatcttagttttttgt

SEQ ID NO: 372871 - DNA, 25 bp, Mus musculus
ctcagccctgatgttagttttttgt

SEQ ID NO: 372872 - DNA, 25 bp, Mus musculus
ctcagccctgctccttggaaagaaa

SEQ ID NO: 372873 - DNA, 25 bp, Mus musculus
ctcagccctgctgcttggaaagaaa

SEQ ID NO: 372874 - DNA, 25 bp, Mus musculus
ctcagccctgtgacagtctgtatgt

SEQ ID NO: 372875 - DNA, 25 bp, Mus musculus
ctcagccctgtgatcttttaaggtg

SEQ ID NO: 372876 - DNA, 25 bp, Mus musculus
ctcagccctgtgattttctagttaa

SEQ ID NO: 372877 - DNA, 25 bp, Mus musculus
ctcagccctgtgtcagtctgtatgt

SEQ ID NO: 372878 - DNA, 25 bp, Mus musculus
ctcagccctgtgttcttttaaggtg

SEQ ID NO: 372879 - DNA, 25 bp, Mus musculus
ctcagccctgtgtttttctagttaa

SEQ ID NO: 372880 - DNA, 25 bp, Mus musculus
ctcagcccttggatgttttacgtag

SEQ ID NO: 372881 - DNA, 25 bp, Mus musculus
ctcagcccttggttgttttacgtag

SEQ ID NO: 372882 - DNA, 25 bp, Mus musculus
ctcagccgcccacgaagggtagcga

SEQ ID NO: 372883 - DNA, 25 bp, Mus musculus
ctcagccgcccaggaagggtagcga

SEQ ID NO: 372884 - DNA, 25 bp, Mus musculus
ctcagccgctttcatttcagagctg

SEQ ID NO: 372885 - DNA, 25 bp, Mus musculus
ctcagccgctttgatttcagagctg

SEQ ID NO: 372886 - DNA, 25 bp, Mus musculus
ctcagcctacctagcagacagatga

SEQ ID NO: 372887 - DNA, 25 bp, Mus musculus
ctcagcctaccttgcagacagatga

SEQ ID NO: 372888 - DNA, 25 bp, Mus musculus
ctcagcctaggaacagatggtccct

SEQ ID NO: 372889 - DNA, 25 bp, Mus musculus
ctcagcctaggatcagatggtccct

SEQ ID NO: 372890 - DNA, 25 bp, Mus musculus
ctcagcctcaggaaattgaatgtag

SEQ ID NO: 372891 - DNA, 25 bp, Mus musculus
ctcagcctcaggtaattgaatgtag

SEQ ID NO: 372892 - DNA, 25 bp, Mus musculus
ctcagcctctacagtagtagggaca

SEQ ID NO: 372893 - DNA, 25 bp, Mus musculus
ctcagcctctactgtagtagggaca

SEQ ID NO: 372894 - DNA, 25 bp, Mus musculus
ctcagcctctcgacgtaatttcatt

SEQ ID NO: 372895 - DNA, 25 bp, Mus musculus
ctcagcctctcgtcgtaatttcatt

SEQ ID NO: 372896 - DNA, 25 bp, Mus musculus
ctcagcctctgcaaacaaagcaggg

SEQ ID NO: 372897 - DNA, 25 bp, Mus musculus
ctcagcctctgctaacaaagcaggg

SEQ ID NO: 372898 - DNA, 25 bp, Mus musculus
ctcagcctctggctatgatgacgac

SEQ ID NO: 372899 - DNA, 25 bp, Mus musculus
ctcagcctctgggtatgatgacgac

SEQ ID NO: 372900 - DNA, 25 bp, Mus musculus
ctcagcctgaggactacattagtgc

SEQ ID NO: 372901 - DNA, 25 bp, Mus musculus
ctcagcctgaggtctacattagtgc

SEQ ID NO: 372902 - DNA, 25 bp, Mus musculus
ctcagcctgagtatccttctgcaag

SEQ ID NO: 372903 - DNA, 25 bp, Mus musculus
ctcagcctgagtttccttctgcaag

SEQ ID NO: 372904 - DNA, 25 bp, Mus musculus
ctcagcctgattacaaacacctttt

SEQ ID NO: 372905 - DNA, 25 bp, Mus musculus
ctcagcctgatttcaaacacctttt

SEQ ID NO: 372906 - DNA, 25 bp, Mus musculus
ctcagcctgggcaaggcctggagat

SEQ ID NO: 372907 - DNA, 25 bp, Mus musculus
ctcagcctgggctaggcctggagat

SEQ ID NO: 372908 - DNA, 25 bp, Mus musculus
ctcagcctgtgccacgaggcagata

SEQ ID NO: 372909 - DNA, 25 bp, Mus musculus
ctcagcctgtgcgacgaggcagata

SEQ ID NO: 372910 - DNA, 25 bp, Mus musculus
ctcagcctgtgtatctaagcactta

SEQ ID NO: 372911 - DNA, 25 bp, Mus musculus
ctcagcctgtgtttctaagcactta

SEQ ID NO: 372912 - DNA, 25 bp, Mus musculus
ctcagccttagtaccctgggacagc

SEQ ID NO: 372913 - DNA, 25 bp, Mus musculus
ctcagccttagttccctgggacagc

SEQ ID NO: 372914 - DNA, 25 bp, Mus musculus
ctcagccttcagacacatttagtca

SEQ ID NO: 372915 - DNA, 25 bp, Mus musculus
ctcagccttcagtcacatttagtca

SEQ ID NO: 372916 - DNA, 25 bp, Mus musculus
ctcagccttcatctgtgggtttgaa

SEQ ID NO: 372917 - DNA, 25 bp, Mus musculus
ctcagccttcatgtgtgggtttgaa

SEQ ID NO: 372918 - DNA, 25 bp, Mus musculus
ctcagccttgacagccagtgggcaa

SEQ ID NO: 372919 - DNA, 25 bp, Mus musculus
ctcagccttgactgccagtgggcaa

SEQ ID NO: 372920 - DNA, 25 bp, Mus musculus
ctcagccttgagaccattgccaaaa

SEQ ID NO: 372921 - DNA, 25 bp, Mus musculus
ctcagccttgagtccattgccaaaa

SEQ ID NO: 372922 - DNA, 25 bp, Mus musculus
ctcagccttgctactcagattcatc

SEQ ID NO: 372923 - DNA, 25 bp, Mus musculus
ctcagccttgcttctcagattcatc

SEQ ID NO: 372924 - DNA, 25 bp, Mus musculus
ctcagcctttagagctcggcaagat

SEQ ID NO: 372925 - DNA, 25 bp, Mus musculus
ctcagcctttagtgctcggcaagat

SEQ ID NO: 372926 - DNA, 25 bp, Mus musculus
ctcagcctttgaatgtccagggtga

SEQ ID NO: 372927 - DNA, 25 bp, Mus musculus
ctcagcctttgattgtccagggtga

SEQ ID NO: 372928 - DNA, 25 bp, Mus musculus
ctcagcgaggctagtgcggcactag

SEQ ID NO: 372929 - DNA, 25 bp, Mus musculus
ctcagcgaggcttgtgcggcactag

SEQ ID NO: 372930 - DNA, 25 bp, Mus musculus
ctcagcgcaaagacatcacctttaa

SEQ ID NO: 372931 - DNA, 25 bp, Mus musculus
ctcagcgcaaagtcatcacctttaa

SEQ ID NO: 372932 - DNA, 25 bp, Mus musculus
ctcagcgctgggaaagcattcggtt

SEQ ID NO: 372933 - DNA, 25 bp, Mus musculus
ctcagcgctgggtaagcattcggtt

SEQ ID NO: 372934 - DNA, 25 bp, Mus musculus
ctcagcggccgtacaggcggttaaa

SEQ ID NO: 372935 - DNA, 25 bp, Mus musculus
ctcagcggccgttcaggcggttaaa

SEQ ID NO: 372936 - DNA, 25 bp, Mus musculus
ctcagcggctgaacattcggcaggg

SEQ ID NO: 372937 - DNA, 25 bp, Mus musculus
ctcagcggctgatcattcggcaggg

SEQ ID NO: 372938 - DNA, 25 bp, Mus musculus
ctcagcggctgtcttccttgggaag

SEQ ID NO: 372939 - DNA, 25 bp, Mus musculus
ctcagcggctgtgttccttgggaag

SEQ ID NO: 372940 - DNA, 25 bp, Mus musculus
ctcagcggggaccaggaactgcata

SEQ ID NO: 372941 - DNA, 25 bp, Mus musculus
ctcagcggggacgaggaactgcata

SEQ ID NO: 372942 - DNA, 25 bp, Mus musculus
ctcagcgggtagagcacaggttgct

SEQ ID NO: 372943 - DNA, 25 bp, Mus musculus
ctcagcgggtagtgcacaggttgct

SEQ ID NO: 372944 - DNA, 25 bp, Mus musculus
ctcagcgtcgttcgaatcttctgta

SEQ ID NO: 372945 - DNA, 25 bp, Mus musculus
ctcagcgtcgttggaatcttctgta

SEQ ID NO: 372946 - DNA, 25 bp, Mus musculus
ctcagcgtgtttcgcgatggcagaa

SEQ ID NO: 372947 - DNA, 25 bp, Mus musculus
ctcagcgtgtttggcgatggcagaa

SEQ ID NO: 372948 - DNA, 25 bp, Mus musculus
ctcagctaaaatctcagagccatat

SEQ ID NO: 372949 - DNA, 25 bp, Mus musculus
ctcagctaaaatgtcagagccatat

SEQ ID NO: 372950 - DNA, 25 bp, Mus musculus
ctcagctaagtaatttctctgttaa

SEQ ID NO: 372951 - DNA, 25 bp, Mus musculus
ctcagctaagtattttctctgttaa

SEQ ID NO: 372952 - DNA, 25 bp, Mus musculus
ctcagctagctgagtgtacttcaaa

SEQ ID NO: 372953 - DNA, 25 bp, Mus musculus
ctcagctagctgtgtgtacttcaaa

SEQ ID NO: 372954 - DNA, 25 bp, Mus musculus
ctcagctagtgaccatcagcccaaa

SEQ ID NO: 372955 - DNA, 25 bp, Mus musculus
ctcagctagtgagcatcagcccaaa

SEQ ID NO: 372956 - DNA, 25 bp, Mus musculus
ctcagctatggtcgatgcaggtcaa

SEQ ID NO: 372957 - DNA, 25 bp, Mus musculus
ctcagctatggtggatgcaggtcaa

SEQ ID NO: 372958 - DNA, 25 bp, Mus musculus
ctcagctatgttcgcagttcaagac

SEQ ID NO: 372959 - DNA, 25 bp, Mus musculus
ctcagctatgttggcagttcaagac

SEQ ID NO: 372960 - DNA, 25 bp, Mus musculus
ctcagctattctcctcctggagcat

SEQ ID NO: 372961 - DNA, 25 bp, Mus musculus
ctcagctattctgctcctggagcat

SEQ ID NO: 372962 - DNA, 25 bp, Mus musculus
ctcagctcactgagccttggaggca

SEQ ID NO: 372963 - DNA, 25 bp, Mus musculus
ctcagctcactgtgccttggaggca

SEQ ID NO: 372964 - DNA, 25 bp, Mus musculus
ctcagctcacttagcatcagtttat

SEQ ID NO: 372965 - DNA, 25 bp, Mus musculus
ctcagctcactttgcatcagtttat

SEQ ID NO: 372966 - DNA, 25 bp, Mus musculus
ctcagctcagctcggtgggaagcag

SEQ ID NO: 372967 - DNA, 25 bp, Mus musculus
ctcagctcagctctgggaggtaaac

SEQ ID NO: 372968 - DNA, 25 bp, Mus musculus
ctcagctcagctgggtgggaagcag

SEQ ID NO: 372969 - DNA, 25 bp, Mus musculus
ctcagctcagctgtgggaggtaaac

SEQ ID NO: 372970 - DNA, 25 bp, Mus musculus
ctcagctcaggtctgcaagacacat

SEQ ID NO: 372971 - DNA, 25 bp, Mus musculus
ctcagctcaggtgtgcaagacacat

SEQ ID NO: 372972 - DNA, 25 bp, Mus musculus
ctcagctcccaccagtggtggcgga

SEQ ID NO: 372973 - DNA, 25 bp, Mus musculus
ctcagctcccacgagtggtggcgga

SEQ ID NO: 372974 - DNA, 25 bp, Mus musculus
ctcagctccccaaggaagaactggt

SEQ ID NO: 372975 - DNA, 25 bp, Mus musculus
ctcagctccccatggaagaactggt

SEQ ID NO: 372976 - DNA, 25 bp, Mus musculus
ctcagctcgaagatccttgttagct

SEQ ID NO: 372977 - DNA, 25 bp, Mus musculus
ctcagctcgaagttccttgttagct

SEQ ID NO: 372978 - DNA, 25 bp, Mus musculus
ctcagctcgttacgcaggaagagtt

SEQ ID NO: 372979 - DNA, 25 bp, Mus musculus
ctcagctcgttaggcaggaagagtt

SEQ ID NO: 372980 - DNA, 25 bp, Mus musculus
ctcagctctggtcggtactggattc

SEQ ID NO: 372981 - DNA, 25 bp, Mus musculus
ctcagctctggtgggtactggattc

SEQ ID NO: 372982 - DNA, 25 bp, Mus musculus
ctcagctcttacatgttttgacttg

SEQ ID NO: 372983 - DNA, 25 bp, Mus musculus
ctcagctcttacttgttttgacttg

SEQ ID NO: 372984 - DNA, 25 bp, Mus musculus
ctcagctgacacaggaatcttcatc

SEQ ID NO: 372985 - DNA, 25 bp, Mus musculus
ctcagctgacactggaatcttcatc

SEQ ID NO: 372986 - DNA, 25 bp, Mus musculus
ctcagctgagagactattcgtggtg

SEQ ID NO: 372987 - DNA, 25 bp, Mus musculus
ctcagctgagagtctattcgtggtg

SEQ ID NO: 372988 - DNA, 25 bp, Mus musculus
ctcagctgagcgagctccgaagtga

SEQ ID NO: 372989 - DNA, 25 bp, Mus musculus
ctcagctgagcgtgctccgaagtga

SEQ ID NO: 372990 - DNA, 25 bp, Mus musculus
ctcagctgccctcatgctgatttaa

SEQ ID NO: 372991 - DNA, 25 bp, Mus musculus
ctcagctgccctgatgctgatttaa

SEQ ID NO: 372992 - DNA, 25 bp, Mus musculus
ctcagctgctttccccaggaaaata

SEQ ID NO: 372993 - DNA, 25 bp, Mus musculus
ctcagctgctttgcccaggaaaata

SEQ ID NO: 372994 - DNA, 25 bp, Mus musculus
ctcagctgggaccggaacgcattcg

SEQ ID NO: 372995 - DNA, 25 bp, Mus musculus
ctcagctgggacgggaacgcattcg

SEQ ID NO: 372996 - DNA, 25 bp, Mus musculus
ctcagctggttcaacctgacatcaa

SEQ ID NO: 372997 - DNA, 25 bp, Mus musculus
ctcagctggttctacctgacatcaa

SEQ ID NO: 372998 - DNA, 25 bp, Mus musculus
ctcagctgtaacatctgatgatggt

SEQ ID NO: 372999 - DNA, 25 bp, Mus musculus
ctcagctgtaacttctgatgatggt

SEQ ID NO: 373000 - DNA, 25 bp, Mus musculus
ctcagctgtaccaggttttaaatgc

SEQ ID NO: 373001 - DNA, 25 bp, Mus musculus
ctcagctgtacctggttttaaatgc

SEQ ID NO: 373002 - DNA, 25 bp, Mus musculus
ctcagctgtcttcctgttttgcagt

SEQ ID NO: 373003 - DNA, 25 bp, Mus musculus
ctcagctgtcttgctgttttgcagt

SEQ ID NO: 373004 - DNA, 25 bp, Mus musculus
ctcagcttaaccatctcattgaaag

SEQ ID NO: 373005 - DNA, 25 bp, Mus musculus
ctcagcttaaccttctcattgaaag

SEQ ID NO: 373006 - DNA, 25 bp, Mus musculus
ctcagcttacacacggttactcaag

SEQ ID NO: 373007 - DNA, 25 bp, Mus musculus
ctcagcttacactcggttactcaag

SEQ ID NO: 373008 - DNA, 25 bp, Mus musculus
ctcagcttatggattaggcccactt

SEQ ID NO: 373009 - DNA, 25 bp, Mus musculus
ctcagcttatggtttaggcccactt

SEQ ID NO: 373010 - DNA, 25 bp, Mus musculus
ctcagcttccctctgtagatatata

SEQ ID NO: 373011 - DNA, 25 bp, Mus musculus
ctcagcttccctgtgtagatatata

SEQ ID NO: 373012 - DNA, 25 bp, Mus musculus
ctcagcttcctgatacagtataaga

SEQ ID NO: 373013 - DNA, 25 bp, Mus musculus
ctcagcttcctgttacagtataaga

SEQ ID NO: 373014 - DNA, 25 bp, Mus musculus
ctcagcttcttcaggcggtagctga

SEQ ID NO: 373015 - DNA, 25 bp, Mus musculus
ctcagcttcttctggcggtagctga

SEQ ID NO: 373016 - DNA, 25 bp, Mus musculus
ctcagcttgcagaaagctgattcca

SEQ ID NO: 373017 - DNA, 25 bp, Mus musculus
ctcagcttgcagtaagctgattcca

SEQ ID NO: 373018 - DNA, 25 bp, Mus musculus
ctcagcttgcccacaggagcaggaa

SEQ ID NO: 373019 - DNA, 25 bp, Mus musculus
ctcagcttgccctcaggagcaggaa

SEQ ID NO: 373020 - DNA, 25 bp, Mus musculus
ctcagcttggcgaagacggcaggat

SEQ ID NO: 373021 - DNA, 25 bp, Mus musculus
ctcagcttggcgtagacggcaggat

SEQ ID NO: 373022 - DNA, 25 bp, Mus musculus
ctcagctttaccctctgcaaagaga

SEQ ID NO: 373023 - DNA, 25 bp, Mus musculus
ctcagctttaccgtctgcaaagaga

SEQ ID NO: 373024 - DNA, 25 bp, Mus musculus
ctcagctttcacaagtgggttatat

SEQ ID NO: 373025 - DNA, 25 bp, Mus musculus
ctcagctttcactagtgggttatat

SEQ ID NO: 373026 - DNA, 25 bp, Mus musculus
ctcagctttcctacagtgacaagaa

SEQ ID NO: 373027 - DNA, 25 bp, Mus musculus
ctcagctttcctctcatgtggcaaa

SEQ ID NO: 373028 - DNA, 25 bp, Mus musculus
ctcagctttcctgtcatgtggcaaa

SEQ ID NO: 373029 - DNA, 25 bp, Mus musculus
ctcagctttccttcagtgacaagaa

SEQ ID NO: 373030 - DNA, 25 bp, Mus musculus
ctcagctttgaaaatgttgcctaga

SEQ ID NO: 373031 - DNA, 25 bp, Mus musculus
ctcagctttgaatatgttgcctaga

SEQ ID NO: 373032 - DNA, 25 bp, Mus musculus
ctcaggaaagccatacttatgtgtg

SEQ ID NO: 373033 - DNA, 25 bp, Mus musculus
ctcaggaaagccttacttatgtgtg

SEQ ID NO: 373034 - DNA, 25 bp, Mus musculus
ctcaggaacaggagtgtgtgccctt

SEQ ID NO: 373035 - DNA, 25 bp, Mus musculus
ctcaggaacaggtgtgtgtgccctt

SEQ ID NO: 373036 - DNA, 25 bp, Mus musculus
ctcaggaaccttccagtttagacaa

SEQ ID NO: 373037 - DNA, 25 bp, Mus musculus
ctcaggaaccttgcagtttagacaa

SEQ ID NO: 373038 - DNA, 25 bp, Mus musculus
ctcaggaactcacgcgcccaggaag

SEQ ID NO: 373039 - DNA, 25 bp, Mus musculus
ctcaggaactcaggcgcccaggaag

SEQ ID NO: 373040 - DNA, 25 bp, Mus musculus
ctcaggaagctgagctggccaagga

SEQ ID NO: 373041 - DNA, 25 bp, Mus musculus
ctcaggaagctgtgctggccaagga

SEQ ID NO: 373042 - DNA, 25 bp, Mus musculus
ctcaggaaggcaacccactttggag

SEQ ID NO: 373043 - DNA, 25 bp, Mus musculus
ctcaggaaggcatcccactttggag

SEQ ID NO: 373044 - DNA, 25 bp, Mus musculus
ctcaggaatgaacatgcttgctgcc

SEQ ID NO: 373045 - DNA, 25 bp, Mus musculus
ctcaggaatgaagatgcttgctgcc

SEQ ID NO: 373046 - DNA, 25 bp, Mus musculus
ctcaggacactgaacagcgatgccg

SEQ ID NO: 373047 - DNA, 25 bp, Mus musculus
ctcaggacactgtacagcgatgccg

SEQ ID NO: 373048 - DNA, 25 bp, Mus musculus
ctcaggactgagacacatgatgact

SEQ ID NO: 373049 - DNA, 25 bp, Mus musculus
ctcaggactgagtcacatgatgact

SEQ ID NO: 373050 - DNA, 25 bp, Mus musculus
ctcaggagaaccacgtgggactgct

SEQ ID NO: 373051 - DNA, 25 bp, Mus musculus
ctcaggagaacctcgtgggactgct

SEQ ID NO: 373052 - DNA, 25 bp, Mus musculus
ctcaggagagtgaattcaggctggt

SEQ ID NO: 373053 - DNA, 25 bp, Mus musculus
ctcaggagagtgtattcaggctggt

SEQ ID NO: 373054 - DNA, 25 bp, Mus musculus
ctcaggagctctctgttgtgtggta

SEQ ID NO: 373055 - DNA, 25 bp, Mus musculus
ctcaggagctctgtgttgtgtggta

SEQ ID NO: 373056 - DNA, 25 bp, Mus musculus
ctcaggaggaaactcgcctatgata

SEQ ID NO: 373057 - DNA, 25 bp, Mus musculus
ctcaggaggaaagtcgcctatgata

SEQ ID NO: 373058 - DNA, 25 bp, Mus musculus
ctcaggagggcgactctggccgtca

SEQ ID NO: 373059 - DNA, 25 bp, Mus musculus
ctcaggagggcgtctctggccgtca

SEQ ID NO: 373060 - DNA, 25 bp, Mus musculus
ctcaggagggctaggtttctaccta

SEQ ID NO: 373061 - DNA, 25 bp, Mus musculus
ctcaggagggcttggtttctaccta

SEQ ID NO: 373062 - DNA, 25 bp, Mus musculus
ctcaggagtttgatctctttcaaga

SEQ ID NO: 373063 - DNA, 25 bp, Mus musculus
ctcaggagtttgttctctttcaaga

SEQ ID NO: 373064 - DNA, 25 bp, Mus musculus
ctcaggatattacgccagttcagat

SEQ ID NO: 373065 - DNA, 25 bp, Mus musculus
ctcaggatattaggccagttcagat

SEQ ID NO: 373066 - DNA, 25 bp, Mus musculus
ctcaggatctggctccgaatccaaa

SEQ ID NO: 373067 - DNA, 25 bp, Mus musculus
ctcaggatctgggtccgaatccaaa

SEQ ID NO: 373068 - DNA, 25 bp, Mus musculus
ctcaggatcttcaggaaacccaaga

SEQ ID NO: 373069 - DNA, 25 bp, Mus musculus
ctcaggatcttctggaaacccaaga

SEQ ID NO: 373070 - DNA, 25 bp, Mus musculus
ctcaggattagaactcaggtgatat

SEQ ID NO: 373071 - DNA, 25 bp, Mus musculus
ctcaggattagatctcaggtgatat

SEQ ID NO: 373072 - DNA, 25 bp, Mus musculus
ctcaggattccaacttgcaggtaat

SEQ ID NO: 373073 - DNA, 25 bp, Mus musculus
ctcaggattccacagccttggatga

SEQ ID NO: 373074 - DNA, 25 bp, Mus musculus
ctcaggattccagagccttggatga

SEQ ID NO: 373075 - DNA, 25 bp, Mus musculus
ctcaggattccatcttgcaggtaat

SEQ ID NO: 373076 - DNA, 25 bp, Mus musculus
ctcaggattcctctaacacatttgg

SEQ ID NO: 373077 - DNA, 25 bp, Mus musculus
ctcaggattcctgtaacacatttgg

SEQ ID NO: 373078 - DNA, 25 bp, Mus musculus
ctcaggcaacagactccttggaaga

SEQ ID NO: 373079 - DNA, 25 bp, Mus musculus
ctcaggcaacagtctccttggaaga

SEQ ID NO: 373080 - DNA, 25 bp, Mus musculus
ctcaggcaacatctgctgttctgca

SEQ ID NO: 373081 - DNA, 25 bp, Mus musculus
ctcaggcaacatgtgctgttctgca

SEQ ID NO: 373082 - DNA, 25 bp, Mus musculus
ctcaggcaaggcagttactgctatt

SEQ ID NO: 373083 - DNA, 25 bp, Mus musculus
ctcaggcaaggctgttactgctatt

SEQ ID NO: 373084 - DNA, 25 bp, Mus musculus
ctcaggcaatggaagtggacggact

SEQ ID NO: 373085 - DNA, 25 bp, Mus musculus
ctcaggcaatggtagtggacggact

SEQ ID NO: 373086 - DNA, 25 bp, Mus musculus
ctcaggcaccataaattcagcgagc

SEQ ID NO: 373087 - DNA, 25 bp, Mus musculus
ctcaggcaccattaattcagcgagc

SEQ ID NO: 373088 - DNA, 25 bp, Mus musculus
ctcaggcactggcaccaatgggatc

SEQ ID NO: 373089 - DNA, 25 bp, Mus musculus
ctcaggcactgggaccaatgggatc

SEQ ID NO: 373090 - DNA, 25 bp, Mus musculus
ctcaggcaggttcatctttctagat

SEQ ID NO: 373091 - DNA, 25 bp, Mus musculus
ctcaggcaggttgatctttctagat

SEQ ID NO: 373092 - DNA, 25 bp, Mus musculus
ctcaggcatctcctcgaatttatga

SEQ ID NO: 373093 - DNA, 25 bp, Mus musculus
ctcaggcatctcgtcgaatttatga

SEQ ID NO: 373094 - DNA, 25 bp, Mus musculus
ctcaggcatggcagctttcggaaag

SEQ ID NO: 373095 - DNA, 25 bp, Mus musculus
ctcaggcatggctgctttcggaaag

SEQ ID NO: 373096 - DNA, 25 bp, Mus musculus
ctcaggcatgtaaggtttcggttct

SEQ ID NO: 373097 - DNA, 25 bp, Mus musculus
ctcaggcatgtatggtttcggttct

SEQ ID NO: 373098 - DNA, 25 bp, Mus musculus
ctcaggccagttcacaagcccggag

SEQ ID NO: 373099 - DNA, 25 bp, Mus musculus
ctcaggccagttgacaagcccggag

SEQ ID NO: 373100 - DNA, 25 bp, Mus musculus
ctcaggccattccagctctgaaaaa

SEQ ID NO: 373101 - DNA, 25 bp, Mus musculus
ctcaggccattcgagctctgaaaaa

SEQ ID NO: 373102 - DNA, 25 bp, Mus musculus
ctcaggcctcagaaagttgcaatca

SEQ ID NO: 373103 - DNA, 25 bp, Mus musculus
ctcaggcctcagtaagttgcaatca

SEQ ID NO: 373104 - DNA, 25 bp, Mus musculus
ctcaggcctccaagatctttgtgag

SEQ ID NO: 373105 - DNA, 25 bp, Mus musculus
ctcaggcctccatgatctttgtgag

SEQ ID NO: 373106 - DNA, 25 bp, Mus musculus
ctcaggcctcgaaagatgttgcatt

SEQ ID NO: 373107 - DNA, 25 bp, Mus musculus
ctcaggcctcgatagatgttgcatt

SEQ ID NO: 373108 - DNA, 25 bp, Mus musculus
ctcaggcctcttctataggagcact

SEQ ID NO: 373109 - DNA, 25 bp, Mus musculus
ctcaggcctcttgtataggagcact

SEQ ID NO: 373110 - DNA, 25 bp, Mus musculus
ctcaggctacgcattggtgctccag

SEQ ID NO: 373111 - DNA, 25 bp, Mus musculus
ctcaggctacgctttggtgctccag

SEQ ID NO: 373112 - DNA, 25 bp, Mus musculus
ctcaggctagcactatatactcagg

SEQ ID NO: 373113 - DNA, 25 bp, Mus musculus
ctcaggctagcagtatatactcagg

SEQ ID NO: 373114 - DNA, 25 bp, Mus musculus
ctcaggctagctatcttgtgttttt

SEQ ID NO: 373115 - DNA, 25 bp, Mus musculus
ctcaggctagctttcttgtgttttt

SEQ ID NO: 373116 - DNA, 25 bp, Mus musculus
ctcaggctatctagtgctgttcaca

SEQ ID NO: 373117 - DNA, 25 bp, Mus musculus
ctcaggctatcttgtgctgttcaca

SEQ ID NO: 373118 - DNA, 25 bp, Mus musculus
ctcaggctcagactcaactgctggg

SEQ ID NO: 373119 - DNA, 25 bp, Mus musculus
ctcaggctcagagtcaactgctggg

SEQ ID NO: 373120 - DNA, 25 bp, Mus musculus
ctcaggctctgcaagtggtctgaca

SEQ ID NO: 373121 - DNA, 25 bp, Mus musculus
ctcaggctctgcagtccaaggattg

SEQ ID NO: 373122 - DNA, 25 bp, Mus musculus
ctcaggctctgctagtggtctgaca

SEQ ID NO: 373123 - DNA, 25 bp, Mus musculus
ctcaggctctgctgtccaaggattg

SEQ ID NO: 373124 - DNA, 25 bp, Mus musculus
ctcaggctctggaattaaacacgga

SEQ ID NO: 373125 - DNA, 25 bp, Mus musculus
ctcaggctctggtattaaacacgga

SEQ ID NO: 373126 - DNA, 25 bp, Mus musculus
ctcaggctgaaaaagagtgcggagc

SEQ ID NO: 373127 - DNA, 25 bp, Mus musculus
ctcaggctgaaatagagtgcggagc

SEQ ID NO: 373128 - DNA, 25 bp, Mus musculus
ctcaggctggaaccagagcatagct

SEQ ID NO: 373129 - DNA, 25 bp, Mus musculus
ctcaggctggaagcagagcatagct

SEQ ID NO: 373130 - DNA, 25 bp, Mus musculus
ctcaggctggatctagggttgcact

SEQ ID NO: 373131 - DNA, 25 bp, Mus musculus
ctcaggctggatgtagggttgcact

SEQ ID NO: 373132 - DNA, 25 bp, Mus musculus
ctcaggctggcacgaacttcttggg

SEQ ID NO: 373133 - DNA, 25 bp, Mus musculus
ctcaggctggcaggaacttcttggg

SEQ ID NO: 373134 - DNA, 25 bp, Mus musculus
ctcaggctgtgacttgcaggatccc

SEQ ID NO: 373135 - DNA, 25 bp, Mus musculus
ctcaggctgtgagttgcaggatccc

SEQ ID NO: 373136 - DNA, 25 bp, Mus musculus
ctcaggcttaagaatgaaggttgtc

SEQ ID NO: 373137 - DNA, 25 bp, Mus musculus
ctcaggcttaagtatgaaggttgtc

SEQ ID NO: 373138 - DNA, 25 bp, Mus musculus
ctcaggcttgagacttcaggcaaca

SEQ ID NO: 373139 - DNA, 25 bp, Mus musculus
ctcaggcttgagtcttcaggcaaca

SEQ ID NO: 373140 - DNA, 25 bp, Mus musculus
ctcaggctttagatggactgggtgc

SEQ ID NO: 373141 - DNA, 25 bp, Mus musculus
ctcaggctttagttggactgggtgc

SEQ ID NO: 373142 - DNA, 25 bp, Mus musculus
ctcaggctttcactatcaagacctt

SEQ ID NO: 373143 - DNA, 25 bp, Mus musculus
ctcaggctttcagtatcaagacctt

SEQ ID NO: 373144 - DNA, 25 bp, Mus musculus
ctcaggctttttaggtttatattgt

SEQ ID NO: 373145 - DNA, 25 bp, Mus musculus
ctcaggcttttttggtttatattgt

SEQ ID NO: 373146 - DNA, 25 bp, Mus musculus
ctcagggaacctatgcgggaatttt

SEQ ID NO: 373147 - DNA, 25 bp, Mus musculus
ctcagggaacctttgcgggaatttt

SEQ ID NO: 373148 - DNA, 25 bp, Mus musculus
ctcagggaactgactttcgggcgtg

SEQ ID NO: 373149 - DNA, 25 bp, Mus musculus
ctcagggaactgtctttcgggcgtg

SEQ ID NO: 373150 - DNA, 25 bp, Mus musculus
ctcagggaatggcactcgctcatgt

SEQ ID NO: 373151 - DNA, 25 bp, Mus musculus
ctcagggaatgggactcgctcatgt

SEQ ID NO: 373152 - DNA, 25 bp, Mus musculus
ctcagggaatgtagtgtcttggtct

SEQ ID NO: 373153 - DNA, 25 bp, Mus musculus
ctcagggaatgttgtgtcttggtct

SEQ ID NO: 373154 - DNA, 25 bp, Mus musculus
ctcagggacaaactaataaagtgct

SEQ ID NO: 373155 - DNA, 25 bp, Mus musculus
ctcagggacaaagtaataaagtgct

SEQ ID NO: 373156 - DNA, 25 bp, Mus musculus
ctcagggacacacgcagctcaggta

SEQ ID NO: 373157 - DNA, 25 bp, Mus musculus
ctcagggacacaggcagctcaggta

SEQ ID NO: 373158 - DNA, 25 bp, Mus musculus
ctcagggacattacacttggatgat

SEQ ID NO: 373159 - DNA, 25 bp, Mus musculus
ctcagggacatttcacttggatgat

SEQ ID NO: 373160 - DNA, 25 bp, Mus musculus
ctcagggacccactactgttagtag

SEQ ID NO: 373161 - DNA, 25 bp, Mus musculus
ctcagggacccagtactgttagtag

SEQ ID NO: 373162 - DNA, 25 bp, Mus musculus
ctcagggagctgagtgagcacttgt

SEQ ID NO: 373163 - DNA, 25 bp, Mus musculus
ctcagggagctgtgtgagcacttgt

SEQ ID NO: 373164 - DNA, 25 bp, Mus musculus
ctcagggaggaacatccttcccggg

SEQ ID NO: 373165 - DNA, 25 bp, Mus musculus
ctcagggaggaagatccttcccggg

SEQ ID NO: 373166 - DNA, 25 bp, Mus musculus
ctcagggccacaaagcagattacat

SEQ ID NO: 373167 - DNA, 25 bp, Mus musculus
ctcagggccacatagcagattacat

SEQ ID NO: 373168 - DNA, 25 bp, Mus musculus
ctcagggccactagatgaccctggg

SEQ ID NO: 373169 - DNA, 25 bp, Mus musculus
ctcagggccacttgatgaccctggg

SEQ ID NO: 373170 - DNA, 25 bp, Mus musculus
ctcagggcctaaatcaagttctgta

SEQ ID NO: 373171 - DNA, 25 bp, Mus musculus
ctcagggcctaattcaagttctgta

SEQ ID NO: 373172 - DNA, 25 bp, Mus musculus
ctcagggcctccagggtgacaagga

SEQ ID NO: 373173 - DNA, 25 bp, Mus musculus
ctcagggcctcctgggtgacaagga

SEQ ID NO: 373174 - DNA, 25 bp, Mus musculus
ctcagggccttccagacatttcctg

SEQ ID NO: 373175 - DNA, 25 bp, Mus musculus
ctcagggccttcgagacatttcctg

SEQ ID NO: 373176 - DNA, 25 bp, Mus musculus
ctcagggcggtcaccaaggaagcta

SEQ ID NO: 373177 - DNA, 25 bp, Mus musculus
ctcagggcggtctccaaggaagcta

SEQ ID NO: 373178 - DNA, 25 bp, Mus musculus
ctcagggcgtggacagccgagggca

SEQ ID NO: 373179 - DNA, 25 bp, Mus musculus
ctcagggcgtggtcagccgagggca

SEQ ID NO: 373180 - DNA, 25 bp, Mus musculus
ctcagggctcagatggaggtgtact

SEQ ID NO: 373181 - DNA, 25 bp, Mus musculus
ctcagggctcagttggaggtgtact

SEQ ID NO: 373182 - DNA, 25 bp, Mus musculus
ctcagggctctgaagcatggcaaaa

SEQ ID NO: 373183 - DNA, 25 bp, Mus musculus
ctcagggctctgtagcatggcaaaa

SEQ ID NO: 373184 - DNA, 25 bp, Mus musculus
ctcagggctgagcaggctctgcacc

SEQ ID NO: 373185 - DNA, 25 bp, Mus musculus
ctcagggctgaggaggctctgcacc

SEQ ID NO: 373186 - DNA, 25 bp, Mus musculus
ctcagggctgttataatgctgctta

SEQ ID NO: 373187 - DNA, 25 bp, Mus musculus
ctcagggctgttttaatgctgctta

SEQ ID NO: 373188 - DNA, 25 bp, Mus musculus
ctcagggcttaacaacactgaagtc

SEQ ID NO: 373189 - DNA, 25 bp, Mus musculus
ctcagggcttaagaacactgaagtc

SEQ ID NO: 373190 - DNA, 25 bp, Mus musculus
ctcagggggactctctattcctgga

SEQ ID NO: 373191 - DNA, 25 bp, Mus musculus
ctcagggggactgtctattcctgga

SEQ ID NO: 373192 - DNA, 25 bp, Mus musculus
ctcagggtagggacacttggtactc

SEQ ID NO: 373193 - DNA, 25 bp, Mus musculus
ctcagggtagggtcacttggtactc

SEQ ID NO: 373194 - DNA, 25 bp, Mus musculus
ctcagggtatgcagggattggcatt

SEQ ID NO: 373195 - DNA, 25 bp, Mus musculus
ctcagggtatgctgggattggcatt

SEQ ID NO: 373196 - DNA, 25 bp, Mus musculus
ctcagggtcagcagagcctttgact

SEQ ID NO: 373197 - DNA, 25 bp, Mus musculus
ctcagggtcagctgagcctttgact

SEQ ID NO: 373198 - DNA, 25 bp, Mus musculus
ctcagggtcctaaaggtggtggcaa

SEQ ID NO: 373199 - DNA, 25 bp, Mus musculus
ctcagggtcctataggtggtggcaa

SEQ ID NO: 373200 - DNA, 25 bp, Mus musculus
ctcagggtctcacatttccatgaaa

SEQ ID NO: 373201 - DNA, 25 bp, Mus musculus
ctcagggtctcagatttccatgaaa

SEQ ID NO: 373202 - DNA, 25 bp, Mus musculus
ctcagggtctgaagtctccaaatct

SEQ ID NO: 373203 - DNA, 25 bp, Mus musculus
ctcagggtctgatgtctccaaatct

SEQ ID NO: 373204 - DNA, 25 bp, Mus musculus
ctcagggtcttcacgcatagactaa

SEQ ID NO: 373205 - DNA, 25 bp, Mus musculus
ctcagggtcttctcgcatagactaa

SEQ ID NO: 373206 - DNA, 25 bp, Mus musculus
ctcagggtgagtaggtgttagaatt

SEQ ID NO: 373207 - DNA, 25 bp, Mus musculus
ctcagggtgagttggtgttagaatt

SEQ ID NO: 373208 - DNA, 25 bp, Mus musculus
ctcagggtgcagacctggtgaacat

SEQ ID NO: 373209 - DNA, 25 bp, Mus musculus
ctcagggtgcagtcctggtgaacat

SEQ ID NO: 373210 - DNA, 25 bp, Mus musculus
ctcagggtgcccaccagagtacagg

SEQ ID NO: 373211 - DNA, 25 bp, Mus musculus
ctcagggtgccctccagagtacagg

SEQ ID NO: 373212 - DNA, 25 bp, Mus musculus
ctcagggtggccagtattttgactt

SEQ ID NO: 373213 - DNA, 25 bp, Mus musculus
ctcagggtggcctgtattttgactt

SEQ ID NO: 373214 - DNA, 25 bp, Mus musculus
ctcagggtggctcgcatccacaaga

SEQ ID NO: 373215 - DNA, 25 bp, Mus musculus
ctcagggtggctggcatccacaaga

SEQ ID NO: 373216 - DNA, 25 bp, Mus musculus
ctcagggttagaatggcgcacctga

SEQ ID NO: 373217 - DNA, 25 bp, Mus musculus
ctcagggttagattggcgcacctga

SEQ ID NO: 373218 - DNA, 25 bp, Mus musculus
ctcaggtacaggcagaggtgccttt

SEQ ID NO: 373219 - DNA, 25 bp, Mus musculus
ctcaggtacagggagaggtgccttt

SEQ ID NO: 373220 - DNA, 25 bp, Mus musculus
ctcaggtacccacctctgtggtcag

SEQ ID NO: 373221 - DNA, 25 bp, Mus musculus
ctcaggtacccagctctgtggtcag

SEQ ID NO: 373222 - DNA, 25 bp, Mus musculus
ctcaggtagctgacgcggtccgaga

SEQ ID NO: 373223 - DNA, 25 bp, Mus musculus
ctcaggtagctgtcgcggtccgaga

SEQ ID NO: 373224 - DNA, 25 bp, Mus musculus
ctcaggtatcctatggtttgcagat

SEQ ID NO: 373225 - DNA, 25 bp, Mus musculus
ctcaggtatcctttggtttgcagat

SEQ ID NO: 373226 - DNA, 25 bp, Mus musculus
ctcaggtcaaaaaggcgggccgatc

SEQ ID NO: 373227 - DNA, 25 bp, Mus musculus
ctcaggtcaaaatggcgggccgatc

SEQ ID NO: 373228 - DNA, 25 bp, Mus musculus
ctcaggtcacaaatgtgcactcacg

SEQ ID NO: 373229 - DNA, 25 bp, Mus musculus
ctcaggtcacaattgtgcactcacg

SEQ ID NO: 373230 - DNA, 25 bp, Mus musculus
ctcaggtcctaacagacactggcac

SEQ ID NO: 373231 - DNA, 25 bp, Mus musculus
ctcaggtcctaagagacactggcac

SEQ ID NO: 373232 - DNA, 25 bp, Mus musculus
ctcaggtcctatctgagcctgggat

SEQ ID NO: 373233 - DNA, 25 bp, Mus musculus
ctcaggtcctatgtgagcctgggat

SEQ ID NO: 373234 - DNA, 25 bp, Mus musculus
ctcaggtctccacggattgcttcag

SEQ ID NO: 373235 - DNA, 25 bp, Mus musculus
ctcaggtctccagggattgcttcag

SEQ ID NO: 373236 - DNA, 25 bp, Mus musculus
ctcaggtctgatagggagcaccgat

SEQ ID NO: 373237 - DNA, 25 bp, Mus musculus
ctcaggtctgattgggagcaccgat

SEQ ID NO: 373238 - DNA, 25 bp, Mus musculus
ctcaggtgaccccaggttatgtcaa

SEQ ID NO: 373239 - DNA, 25 bp, Mus musculus
ctcaggtgacccgaggttatgtcaa

SEQ ID NO: 373240 - DNA, 25 bp, Mus musculus
ctcaggtgctgcaggactttgtgca

SEQ ID NO: 373241 - DNA, 25 bp, Mus musculus
ctcaggtgctgctggactttgtgca

SEQ ID NO: 373242 - DNA, 25 bp, Mus musculus
ctcaggtggtccctgatgcctatga

SEQ ID NO: 373243 - DNA, 25 bp, Mus musculus
ctcaggtggtccgtgatgcctatga

SEQ ID NO: 373244 - DNA, 25 bp, Mus musculus
ctcaggtgtctgctatttatcttga

SEQ ID NO: 373245 - DNA, 25 bp, Mus musculus
ctcaggtgtctggtatttatcttga

SEQ ID NO: 373246 - DNA, 25 bp, Mus musculus
ctcaggttaattccttgatcgccgt

SEQ ID NO: 373247 - DNA, 25 bp, Mus musculus
ctcaggttaattgcttgatcgccgt

SEQ ID NO: 373248 - DNA, 25 bp, Mus musculus
ctcaggttcattcattctgtgtaat

SEQ ID NO: 373249 - DNA, 25 bp, Mus musculus
ctcaggttcattgattctgtgtaat

SEQ ID NO: 373250 - DNA, 25 bp, Mus musculus
ctcaggttgaggcttgcccattgtg

SEQ ID NO: 373251 - DNA, 25 bp, Mus musculus
ctcaggttgagggttgcccattgtg

SEQ ID NO: 373252 - DNA, 25 bp, Mus musculus
ctcaggttgcatcagcccatgacaa

SEQ ID NO: 373253 - DNA, 25 bp, Mus musculus
ctcaggttgcatgagcccatgacaa

SEQ ID NO: 373254 - DNA, 25 bp, Mus musculus
ctcaggttgcctacacttgtgttta

SEQ ID NO: 373255 - DNA, 25 bp, Mus musculus
ctcaggttgccttcacttgtgttta

SEQ ID NO: 373256 - DNA, 25 bp, Mus musculus
ctcaggttggcacgtttcactccat

SEQ ID NO: 373257 - DNA, 25 bp, Mus musculus
ctcaggttggcaggtttcactccat

SEQ ID NO: 373258 - DNA, 25 bp, Mus musculus
ctcaggtttatcacagggttggact

SEQ ID NO: 373259 - DNA, 25 bp, Mus musculus
ctcaggtttatctcagggttggact

SEQ ID NO: 373260 - DNA, 25 bp, Mus musculus
ctcagtaaacttacccttgcctagg

SEQ ID NO: 373261 - DNA, 25 bp, Mus musculus
ctcagtaaactttcccttgcctagg

SEQ ID NO: 373262 - DNA, 25 bp, Mus musculus
ctcagtaaaggacacttcccattgt

SEQ ID NO: 373263 - DNA, 25 bp, Mus musculus
ctcagtaaaggagacttcccattgt

SEQ ID NO: 373264 - DNA, 25 bp, Mus musculus
ctcagtaactttattggcagctcaa

SEQ ID NO: 373265 - DNA, 25 bp, Mus musculus
ctcagtaacttttttggcagctcaa

SEQ ID NO: 373266 - DNA, 25 bp, Mus musculus
ctcagtaagatccttcccattggtc

SEQ ID NO: 373267 - DNA, 25 bp, Mus musculus
ctcagtaagatcgttcccattggtc

SEQ ID NO: 373268 - DNA, 25 bp, Mus musculus
ctcagtacagagcacctgctgcggg

SEQ ID NO: 373269 - DNA, 25 bp, Mus musculus
ctcagtacagaggacctgctgcggg

SEQ ID NO: 373270 - DNA, 25 bp, Mus musculus
ctcagtaccctcatcttatgtggag

SEQ ID NO: 373271 - DNA, 25 bp, Mus musculus
ctcagtaccctcttcttatgtggag

SEQ ID NO: 373272 - DNA, 25 bp, Mus musculus
ctcagtaccgttcgttgtattccat

SEQ ID NO: 373273 - DNA, 25 bp, Mus musculus
ctcagtaccgttggttgtattccat

SEQ ID NO: 373274 - DNA, 25 bp, Mus musculus
ctcagtagcaatcacagaggcttag

SEQ ID NO: 373275 - DNA, 25 bp, Mus musculus
ctcagtagcaatgacagaggcttag

SEQ ID NO: 373276 - DNA, 25 bp, Mus musculus
ctcagtaggaaactgcttttgcttt

SEQ ID NO: 373277 - DNA, 25 bp, Mus musculus
ctcagtaggaaagtgcttttgcttt

SEQ ID NO: 373278 - DNA, 25 bp, Mus musculus
ctcagtaggcgtacggagcagaaac

SEQ ID NO: 373279 - DNA, 25 bp, Mus musculus
ctcagtaggcgttcggagcagaaac

SEQ ID NO: 373280 - DNA, 25 bp, Mus musculus
ctcagtatatggatctagttggcct

SEQ ID NO: 373281 - DNA, 25 bp, Mus musculus
ctcagtatatggttctagttggcct

SEQ ID NO: 373282 - DNA, 25 bp, Mus musculus
ctcagtatcaacagtgtggagcctg

SEQ ID NO: 373283 - DNA, 25 bp, Mus musculus
ctcagtatcaactgtgtggagcctg

SEQ ID NO: 373284 - DNA, 25 bp, Mus musculus
ctcagtatgttcactttcttttaca

SEQ ID NO: 373285 - DNA, 25 bp, Mus musculus
ctcagtatgttctctttcttttaca

SEQ ID NO: 373286 - DNA, 25 bp, Mus musculus
ctcagtcaagagataacgcggtggg

SEQ ID NO: 373287 - DNA, 25 bp, Mus musculus
ctcagtcaagagttaacgcggtggg

SEQ ID NO: 373288 - DNA, 25 bp, Mus musculus
ctcagtcagctcagggccgaaggga

SEQ ID NO: 373289 - DNA, 25 bp, Mus musculus
ctcagtcagctctgggccgaaggga

SEQ ID NO: 373290 - DNA, 25 bp, Mus musculus
ctcagtcaggtgatgggtctccaag

SEQ ID NO: 373291 - DNA, 25 bp, Mus musculus
ctcagtcaggtgttgggtctccaag

SEQ ID NO: 373292 - DNA, 25 bp, Mus musculus
ctcagtcataccactgtgtgcagtg

SEQ ID NO: 373293 - DNA, 25 bp, Mus musculus
ctcagtcatacctctgtgtgcagtg

SEQ ID NO: 373294 - DNA, 25 bp, Mus musculus
ctcagtccaggtagcgtttaatcaa

SEQ ID NO: 373295 - DNA, 25 bp, Mus musculus
ctcagtccaggttgcgtttaatcaa

SEQ ID NO: 373296 - DNA, 25 bp, Mus musculus
ctcagtccccatcttagtcttggtt

SEQ ID NO: 373297 - DNA, 25 bp, Mus musculus
ctcagtccccatgttagtcttggtt

SEQ ID NO: 373298 - DNA, 25 bp, Mus musculus
ctcagtcccctgaggtggactggag

SEQ ID NO: 373299 - DNA, 25 bp, Mus musculus
ctcagtcccctgtggtggactggag

SEQ ID NO: 373300 - DNA, 25 bp, Mus musculus
ctcagtcctctgaacagtcatcttg

SEQ ID NO: 373301 - DNA, 25 bp, Mus musculus
ctcagtcctctgtacagtcatcttg

SEQ ID NO: 373302 - DNA, 25 bp, Mus musculus
ctcagtcgagacacactgtgcagaa

SEQ ID NO: 373303 - DNA, 25 bp, Mus musculus
ctcagtcgagactcactgtgcagaa

SEQ ID NO: 373304 - DNA, 25 bp, Mus musculus
ctcagtctagctatacccagaaatc

SEQ ID NO: 373305 - DNA, 25 bp, Mus musculus
ctcagtctagctttacccagaaatc

SEQ ID NO: 373306 - DNA, 25 bp, Mus musculus
ctcagtctatatcaaaacctttcta

SEQ ID NO: 373307 - DNA, 25 bp, Mus musculus
ctcagtctatatgaaaacctttcta

SEQ ID NO: 373308 - DNA, 25 bp, Mus musculus
ctcagtctccagagctgtatgtggc

SEQ ID NO: 373309 - DNA, 25 bp, Mus musculus
ctcagtctccagtgctgtatgtggc

SEQ ID NO: 373310 - DNA, 25 bp, Mus musculus
ctcagtctgtgcaggctgcagaaga

SEQ ID NO: 373311 - DNA, 25 bp, Mus musculus
ctcagtctgtgctggctgcagaaga

SEQ ID NO: 373312 - DNA, 25 bp, Mus musculus
ctcagtctgtttcgaaagtgaatac

SEQ ID NO: 373313 - DNA, 25 bp, Mus musculus
ctcagtctgtttggaaagtgaatac

SEQ ID NO: 373314 - DNA, 25 bp, Mus musculus
ctcagtcttccacaccaatatgaca

SEQ ID NO: 373315 - DNA, 25 bp, Mus musculus
ctcagtcttccagaccaatatgaca

SEQ ID NO: 373316 - DNA, 25 bp, Mus musculus
ctcagtctttctatcatggtcagtg

SEQ ID NO: 373317 - DNA, 25 bp, Mus musculus
ctcagtctttctttcatggtcagtg

SEQ ID NO: 373318 - DNA, 25 bp, Mus musculus
ctcagtgaaaaacagcactagctgc

SEQ ID NO: 373319 - DNA, 25 bp, Mus musculus
ctcagtgaaaaagagcactagctgc

SEQ ID NO: 373320 - DNA, 25 bp, Mus musculus
ctcagtgaagccagaatccaggtct

SEQ ID NO: 373321 - DNA, 25 bp, Mus musculus
ctcagtgaagcctgaatccaggtct

SEQ ID NO: 373322 - DNA, 25 bp, Mus musculus
ctcagtgaatgtcgctctcttgtgt

SEQ ID NO: 373323 - DNA, 25 bp, Mus musculus
ctcagtgaatgtggctctcttgtgt

SEQ ID NO: 373324 - DNA, 25 bp, Mus musculus
ctcagtgacaagcactttggttttt

SEQ ID NO: 373325 - DNA, 25 bp, Mus musculus
ctcagtgacaaggactttggttttt

SEQ ID NO: 373326 - DNA, 25 bp, Mus musculus
ctcagtgactggacagcctctaggg

SEQ ID NO: 373327 - DNA, 25 bp, Mus musculus
ctcagtgactggtcagcctctaggg

SEQ ID NO: 373328 - DNA, 25 bp, Mus musculus
ctcagtgagcctacctatcgtaagg

SEQ ID NO: 373329 - DNA, 25 bp, Mus musculus
ctcagtgagccttcctatcgtaagg

SEQ ID NO: 373330 - DNA, 25 bp, Mus musculus
ctcagtgagctgagagtaaactctt

SEQ ID NO: 373331 - DNA, 25 bp, Mus musculus
ctcagtgagctgtgagtaaactctt

SEQ ID NO: 373332 - DNA, 25 bp, Mus musculus
ctcagtgaggacagccccgagcagg

SEQ ID NO: 373333 - DNA, 25 bp, Mus musculus
ctcagtgaggactgccccgagcagg

SEQ ID NO: 373334 - DNA, 25 bp, Mus musculus
ctcagtgaggtgctgaatctccaga

SEQ ID NO: 373335 - DNA, 25 bp, Mus musculus
ctcagtgaggtggtgaatctccaga

SEQ ID NO: 373336 - DNA, 25 bp, Mus musculus
ctcagtgatgacatgtgttggactc

SEQ ID NO: 373337 - DNA, 25 bp, Mus musculus
ctcagtgatgacttgtgttggactc

SEQ ID NO: 373338 - DNA, 25 bp, Mus musculus
ctcagtgatgctcccacctgctgga

SEQ ID NO: 373339 - DNA, 25 bp, Mus musculus
ctcagtgatgctgccacctgctgga

SEQ ID NO: 373340 - DNA, 25 bp, Mus musculus
ctcagtgatttacggcgcattcctc

SEQ ID NO: 373341 - DNA, 25 bp, Mus musculus
ctcagtgatttagggcgcattcctc

SEQ ID NO: 373342 - DNA, 25 bp, Mus musculus
ctcagtgcacggatgggaccgcccc

SEQ ID NO: 373343 - DNA, 25 bp, Mus musculus
ctcagtgcacggttgggaccgcccc

SEQ ID NO: 373344 - DNA, 25 bp, Mus musculus
ctcagtgcatgacgaagcagcccaa

SEQ ID NO: 373345 - DNA, 25 bp, Mus musculus
ctcagtgcatgaggaagcagcccaa

SEQ ID NO: 373346 - DNA, 25 bp, Mus musculus
ctcagtgccatgcgttcgctgaaag

SEQ ID NO: 373347 - DNA, 25 bp, Mus musculus
ctcagtgccatgggttcgctgaaag

SEQ ID NO: 373348 - DNA, 25 bp, Mus musculus
ctcagtgcccaaattcagaagtcat

SEQ ID NO: 373349 - DNA, 25 bp, Mus musculus
ctcagtgcccaatttcagaagtcat

SEQ ID NO: 373350 - DNA, 25 bp, Mus musculus
ctcagtgcctccagggtctgtggga

SEQ ID NO: 373351 - DNA, 25 bp, Mus musculus
ctcagtgcctcctgggtctgtggga

SEQ ID NO: 373352 - DNA, 25 bp, Mus musculus
ctcagtgccttgagatttctgctct

SEQ ID NO: 373353 - DNA, 25 bp, Mus musculus
ctcagtgccttgtgatttctgctct

SEQ ID NO: 373354 - DNA, 25 bp, Mus musculus
ctcagtgcgcgtagaaggcttgcta

SEQ ID NO: 373355 - DNA, 25 bp, Mus musculus
ctcagtgcgcgttgaaggcttgcta

SEQ ID NO: 373356 - DNA, 25 bp, Mus musculus
ctcagtgcggacatttgggcgctga

SEQ ID NO: 373357 - DNA, 25 bp, Mus musculus
ctcagtgcggacttttgggcgctga

SEQ ID NO: 373358 - DNA, 25 bp, Mus musculus
ctcagtgcgggactttgtgaatctc

SEQ ID NO: 373359 - DNA, 25 bp, Mus musculus
ctcagtgcgggagtttgtgaatctc

SEQ ID NO: 373360 - DNA, 25 bp, Mus musculus
ctcagtgctcctagttcaaagtggg

SEQ ID NO: 373361 - DNA, 25 bp, Mus musculus
ctcagtgctccttgttcaaagtggg

SEQ ID NO: 373362 - DNA, 25 bp, Mus musculus
ctcagtgctcggattcagtattcaa

SEQ ID NO: 373363 - DNA, 25 bp, Mus musculus
ctcagtgctcggtttcagtattcaa

SEQ ID NO: 373364 - DNA, 25 bp, Mus musculus
ctcagtgcttccatgggaggtactt

SEQ ID NO: 373365 - DNA, 25 bp, Mus musculus
ctcagtgcttccttgggaggtactt

SEQ ID NO: 373366 - DNA, 25 bp, Mus musculus
ctcagtgcttctattgaccagacaa

SEQ ID NO: 373367 - DNA, 25 bp, Mus musculus
ctcagtgcttcttttgaccagacaa

SEQ ID NO: 373368 - DNA, 25 bp, Mus musculus
ctcagtgctttcctagccctactgt

SEQ ID NO: 373369 - DNA, 25 bp, Mus musculus
ctcagtgctttcgtagccctactgt

SEQ ID NO: 373370 - DNA, 25 bp, Mus musculus
ctcagtgcttttcgaccacggttaa

SEQ ID NO: 373371 - DNA, 25 bp, Mus musculus
ctcagtgcttttggaccacggttaa

SEQ ID NO: 373372 - DNA, 25 bp, Mus musculus
ctcagtggactgaggctcctggatg

SEQ ID NO: 373373 - DNA, 25 bp, Mus musculus
ctcagtggactgtggctcctggatg

SEQ ID NO: 373374 - DNA, 25 bp, Mus musculus
ctcagtggaggaagttcatgacgat

SEQ ID NO: 373375 - DNA, 25 bp, Mus musculus
ctcagtggaggatgttcatgacgat

SEQ ID NO: 373376 - DNA, 25 bp, Mus musculus
ctcagtggagggattcctcctcata

SEQ ID NO: 373377 - DNA, 25 bp, Mus musculus
ctcagtggagggtttcctcctcata

SEQ ID NO: 373378 - DNA, 25 bp, Mus musculus
ctcagtggcccgaatttatgtgtga

SEQ ID NO: 373379 - DNA, 25 bp, Mus musculus
ctcagtggcccgtatttatgtgtga

SEQ ID NO: 373380 - DNA, 25 bp, Mus musculus
ctcagtgggactagttttaaagcct

SEQ ID NO: 373381 - DNA, 25 bp, Mus musculus
ctcagtgggacttgttttaaagcct

SEQ ID NO: 373382 - DNA, 25 bp, Mus musculus
ctcagtgggaggatctttctgtact

SEQ ID NO: 373383 - DNA, 25 bp, Mus musculus
ctcagtgggaggttctttctgtact

SEQ ID NO: 373384 - DNA, 25 bp, Mus musculus
ctcagtgggtaacgtcttatcactt

SEQ ID NO: 373385 - DNA, 25 bp, Mus musculus
ctcagtgggtaaggtcttatcactt

SEQ ID NO: 373386 - DNA, 25 bp, Mus musculus
ctcagtggtagaccgcttgcctagc

SEQ ID NO: 373387 - DNA, 25 bp, Mus musculus
ctcagtggtagagcgcttgcctagc

SEQ ID NO: 373388 - DNA, 25 bp, Mus musculus
ctcagtggtgatagtgggttctgta

SEQ ID NO: 373389 - DNA, 25 bp, Mus musculus
ctcagtggtgattgtgggttctgta

SEQ ID NO: 373390 - DNA, 25 bp, Mus musculus
ctcagtgtcatcagtaggtggcttt

SEQ ID NO: 373391 - DNA, 25 bp, Mus musculus
ctcagtgtcatctgtaggtggcttt

SEQ ID NO: 373392 - DNA, 25 bp, Mus musculus
ctcagtgtccaacccagcaaagaag

SEQ ID NO: 373393 - DNA, 25 bp, Mus musculus
ctcagtgtccaagccagcaaagaag

SEQ ID NO: 373394 - DNA, 25 bp, Mus musculus
ctcagtgtcctcaaatcttgttcaa

SEQ ID NO: 373395 - DNA, 25 bp, Mus musculus
ctcagtgtcctctaatcttgttcaa

SEQ ID NO: 373396 - DNA, 25 bp, Mus musculus
ctcagtgtcctgaaagctgccacaa

SEQ ID NO: 373397 - DNA, 25 bp, Mus musculus
ctcagtgtcctgtaagctgccacaa

SEQ ID NO: 373398 - DNA, 25 bp, Mus musculus
ctcagtgtctcacagcaggaggtat

SEQ ID NO: 373399 - DNA, 25 bp, Mus musculus
ctcagtgtctcagagcaggaggtat

SEQ ID NO: 373400 - DNA, 25 bp, Mus musculus
ctcagtgtctgtccaagttaacata

SEQ ID NO: 373401 - DNA, 25 bp, Mus musculus
ctcagtgtctgtgcaagttaacata

SEQ ID NO: 373402 - DNA, 25 bp, Mus musculus
ctcagtgtcttcatttcagcagaag

SEQ ID NO: 373403 - DNA, 25 bp, Mus musculus
ctcagtgtcttcttttcagcagaag

SEQ ID NO: 373404 - DNA, 25 bp, Mus musculus
ctcagtgtggatactcaggttggta

SEQ ID NO: 373405 - DNA, 25 bp, Mus musculus
ctcagtgtggattctcaggttggta

SEQ ID NO: 373406 - DNA, 25 bp, Mus musculus
ctcagtgtgggcaatagacaggcat

SEQ ID NO: 373407 - DNA, 25 bp, Mus musculus
ctcagtgtgggctatagacaggcat

SEQ ID NO: 373408 - DNA, 25 bp, Mus musculus
ctcagtgtgtagcttcggtatgtgt

SEQ ID NO: 373409 - DNA, 25 bp, Mus musculus
ctcagtgtgtaggttcggtatgtgt

SEQ ID NO: 373410 - DNA, 25 bp, Mus musculus
ctcagtgtgtctagatattgcccta

SEQ ID NO: 373411 - DNA, 25 bp, Mus musculus
ctcagtgtgtcttgatattgcccta

SEQ ID NO: 373412 - DNA, 25 bp, Mus musculus
ctcagtgtgtgtcgtcttcctcatc

SEQ ID NO: 373413 - DNA, 25 bp, Mus musculus
ctcagtgtgtgtggtcttcctcatc

SEQ ID NO: 373414 - DNA, 25 bp, Mus musculus
ctcagtgtgtttacatttcccggaa

SEQ ID NO: 373415 - DNA, 25 bp, Mus musculus
ctcagtgtgttttcatttcccggaa

SEQ ID NO: 373416 - DNA, 25 bp, Mus musculus
ctcagtgtttccctttatcacaata

SEQ ID NO: 373417 - DNA, 25 bp, Mus musculus
ctcagtgtttccgtttatcacaata

SEQ ID NO: 373418 - DNA, 25 bp, Mus musculus
ctcagttcaatccacgtcgtattct

SEQ ID NO: 373419 - DNA, 25 bp, Mus musculus
ctcagttcaatcgacgtcgtattct

SEQ ID NO: 373420 - DNA, 25 bp, Mus musculus
ctcagttcgctcaggaagccgaggg

SEQ ID NO: 373421 - DNA, 25 bp, Mus musculus
ctcagttcgctctggaagccgaggg

SEQ ID NO: 373422 - DNA, 25 bp, Mus musculus
ctcagttctcttacccgtgagggaa

SEQ ID NO: 373423 - DNA, 25 bp, Mus musculus
ctcagttctctttcccgtgagggaa

SEQ ID NO: 373424 - DNA, 25 bp, Mus musculus
ctcagttctgcgatcacgcgaggaa

SEQ ID NO: 373425 - DNA, 25 bp, Mus musculus
ctcagttctgcgttcacgcgaggaa

SEQ ID NO: 373426 - DNA, 25 bp, Mus musculus
ctcagttcttcaagctaggatgaca

SEQ ID NO: 373427 - DNA, 25 bp, Mus musculus
ctcagttcttcatgctaggatgaca

SEQ ID NO: 373428 - DNA, 25 bp, Mus musculus
ctcagttcttggatcccaaattcta

SEQ ID NO: 373429 - DNA, 25 bp, Mus musculus
ctcagttcttggttcccaaattcta

SEQ ID NO: 373430 - DNA, 25 bp, Mus musculus
ctcagttctttccacgctaaagtta

SEQ ID NO: 373431 - DNA, 25 bp, Mus musculus
ctcagttctttcgacgctaaagtta

SEQ ID NO: 373432 - DNA, 25 bp, Mus musculus
ctcagttgaggcacactgtcaaacc

SEQ ID NO: 373433 - DNA, 25 bp, Mus musculus
ctcagttgaggctcactgtcaaacc

SEQ ID NO: 373434 - DNA, 25 bp, Mus musculus
ctcagttgcaaacactgcctggttc

SEQ ID NO: 373435 - DNA, 25 bp, Mus musculus
ctcagttgcaaagactgcctggttc

SEQ ID NO: 373436 - DNA, 25 bp, Mus musculus
ctcagttggaccacctgtgtatgtg

SEQ ID NO: 373437 - DNA, 25 bp, Mus musculus
ctcagttggacctcctgtgtatgtg

SEQ ID NO: 373438 - DNA, 25 bp, Mus musculus
ctcagttggcagaggcttgctagca

SEQ ID NO: 373439 - DNA, 25 bp, Mus musculus
ctcagttggcagtggcttgctagca

SEQ ID NO: 373440 - DNA, 25 bp, Mus musculus
ctcagttgggagattaatcttgcca

SEQ ID NO: 373441 - DNA, 25 bp, Mus musculus
ctcagttgggagtttaatcttgcca

SEQ ID NO: 373442 - DNA, 25 bp, Mus musculus
ctcagttgtatcaggttttgtgcac

SEQ ID NO: 373443 - DNA, 25 bp, Mus musculus
ctcagttgtatctggttttgtgcac

SEQ ID NO: 373444 - DNA, 25 bp, Mus musculus
ctcagttgtattacctgttcaagaa

SEQ ID NO: 373445 - DNA, 25 bp, Mus musculus
ctcagttgtatttcctgttcaagaa

SEQ ID NO: 373446 - DNA, 25 bp, Mus musculus
ctcagtttacccctatcacaggaag

SEQ ID NO: 373447 - DNA, 25 bp, Mus musculus
ctcagtttacccgtatcacaggaag

SEQ ID NO: 373448 - DNA, 25 bp, Mus musculus
ctcagtttactaattggcccattat

SEQ ID NO: 373449 - DNA, 25 bp, Mus musculus
ctcagtttactatttggcccattat

SEQ ID NO: 373450 - DNA, 25 bp, Mus musculus
ctcagtttagccatcagagtcagaa

SEQ ID NO: 373451 - DNA, 25 bp, Mus musculus
ctcagtttagccttcagagtcagaa

SEQ ID NO: 373452 - DNA, 25 bp, Mus musculus
ctcagtttccctcaaatgccctggg

SEQ ID NO: 373453 - DNA, 25 bp, Mus musculus
ctcagtttccctgaaatgccctggg

SEQ ID NO: 373454 - DNA, 25 bp, Mus musculus
ctcagtttccttatcaccagggata

SEQ ID NO: 373455 - DNA, 25 bp, Mus musculus
ctcagtttccttttcaccagggata

SEQ ID NO: 373456 - DNA, 25 bp, Mus musculus
ctcagtttctagaccacacttgtta

SEQ ID NO: 373457 - DNA, 25 bp, Mus musculus
ctcagtttctagtccacacttgtta

SEQ ID NO: 373458 - DNA, 25 bp, Mus musculus
ctcagtttggacacgtggtagatat

SEQ ID NO: 373459 - DNA, 25 bp, Mus musculus
ctcagtttggactcgtggtagatat

SEQ ID NO: 373460 - DNA, 25 bp, Mus musculus
ctcagtttgttcactagtggctgta

SEQ ID NO: 373461 - DNA, 25 bp, Mus musculus
ctcagtttgttctctagtggctgta

SEQ ID NO: 373462 - DNA, 25 bp, Mus musculus
ctcagttttcacacaagactccaaa

SEQ ID NO: 373463 - DNA, 25 bp, Mus musculus
ctcagttttcactcaagactccaaa

SEQ ID NO: 373464 - DNA, 25 bp, Mus musculus
ctcagttttgagagcagtgtatgct

SEQ ID NO: 373465 - DNA, 25 bp, Mus musculus
ctcagttttgagtgcagtgtatgct

SEQ ID NO: 373466 - DNA, 25 bp, Mus musculus
ctcagttttggcatgcaggatctat

SEQ ID NO: 373467 - DNA, 25 bp, Mus musculus
ctcagttttggcttgcaggatctat

SEQ ID NO: 373468 - DNA, 25 bp, Mus musculus
ctcagtttttggaggcagtcaattt

SEQ ID NO: 373469 - DNA, 25 bp, Mus musculus
ctcagtttttggtggcagtcaattt

SEQ ID NO: 373470 - DNA, 25 bp, Mus musculus
ctcataaaccttcctgtcagtactt

SEQ ID NO: 373471 - DNA, 25 bp, Mus musculus
ctcataaaccttgctgtcagtactt

SEQ ID NO: 373472 - DNA, 25 bp, Mus musculus
ctcataagcaagatcagcaaggttg

SEQ ID NO: 373473 - DNA, 25 bp, Mus musculus
ctcataagcaagttcagcaaggttg

SEQ ID NO: 373474 - DNA, 25 bp, Mus musculus
ctcataagctctcccatactgaata

SEQ ID NO: 373475 - DNA, 25 bp, Mus musculus
ctcataagctctgccatactgaata

SEQ ID NO: 373476 - DNA, 25 bp, Mus musculus
ctcatacacttgagagcatgactca

SEQ ID NO: 373477 - DNA, 25 bp, Mus musculus
ctcatacacttgtgagcatgactca

SEQ ID NO: 373478 - DNA, 25 bp, Mus musculus
ctcatacatagcactgacaaaggat

SEQ ID NO: 373479 - DNA, 25 bp, Mus musculus
ctcatacatagctctgacaaaggat

SEQ ID NO: 373480 - DNA, 25 bp, Mus musculus
ctcatacatatgacgggcacgtgga

SEQ ID NO: 373481 - DNA, 25 bp, Mus musculus
ctcatacatatgtcgggcacgtgga

SEQ ID NO: 373482 - DNA, 25 bp, Mus musculus
ctcataccagatcctgtgccatcaa

SEQ ID NO: 373483 - DNA, 25 bp, Mus musculus
ctcataccagatgctgtgccatcaa

SEQ ID NO: 373484 - DNA, 25 bp, Mus musculus
ctcatacctgtgaacccagacggtc

SEQ ID NO: 373485 - DNA, 25 bp, Mus musculus
ctcatacctgtgtacccagacggtc

SEQ ID NO: 373486 - DNA, 25 bp, Mus musculus
ctcatacgcaatctctattcctgaa

SEQ ID NO: 373487 - DNA, 25 bp, Mus musculus
ctcatacgcaatgtctattcctgaa

SEQ ID NO: 373488 - DNA, 25 bp, Mus musculus
ctcatacgcatacctcatcaggcag

SEQ ID NO: 373489 - DNA, 25 bp, Mus musculus
ctcatacgcatagctcatcaggcag

SEQ ID NO: 373490 - DNA, 25 bp, Mus musculus
ctcatactatagcagggcagaggca

SEQ ID NO: 373491 - DNA, 25 bp, Mus musculus
ctcatactataggagggcagaggca

SEQ ID NO: 373492 - DNA, 25 bp, Mus musculus
ctcatactatcccaaggtgggaggt

SEQ ID NO: 373493 - DNA, 25 bp, Mus musculus
ctcatactatccgaaggtgggaggt

SEQ ID NO: 373494 - DNA, 25 bp, Mus musculus
ctcatactcttcaatggtccagatg

SEQ ID NO: 373495 - DNA, 25 bp, Mus musculus
ctcatactcttctatggtccagatg

SEQ ID NO: 373496 - DNA, 25 bp, Mus musculus
ctcatactgagacaaagctagcctg

SEQ ID NO: 373497 - DNA, 25 bp, Mus musculus
ctcatactgagagaaagctagcctg

SEQ ID NO: 373498 - DNA, 25 bp, Mus musculus
ctcatactgtacatcacttaggagt

SEQ ID NO: 373499 - DNA, 25 bp, Mus musculus
ctcatactgtacttcacttaggagt

SEQ ID NO: 373500 - DNA, 25 bp, Mus musculus
ctcatacttatgagtgcttctcagg

SEQ ID NO: 373501 - DNA, 25 bp, Mus musculus
ctcatacttatgtgtgcttctcagg

SEQ ID NO: 373502 - DNA, 25 bp, Mus musculus
ctcatacttcaacgattttggtagc

SEQ ID NO: 373503 - DNA, 25 bp, Mus musculus
ctcatacttcaaggattttggtagc

SEQ ID NO: 373504 - DNA, 25 bp, Mus musculus
ctcatacttcatatcagcattgtga

SEQ ID NO: 373505 - DNA, 25 bp, Mus musculus
ctcatacttcatttcagcattgtga

SEQ ID NO: 373506 - DNA, 25 bp, Mus musculus
ctcatagatgccacctcgctgaggg

SEQ ID NO: 373507 - DNA, 25 bp, Mus musculus
ctcatagatgcctcctcgctgaggg

SEQ ID NO: 373508 - DNA, 25 bp, Mus musculus
ctcatagatggacacgagggctctt

SEQ ID NO: 373509 - DNA, 25 bp, Mus musculus
ctcatagatggagacgagggctctt

SEQ ID NO: 373510 - DNA, 25 bp, Mus musculus
ctcataggcagaactcgtctgacat

SEQ ID NO: 373511 - DNA, 25 bp, Mus musculus
ctcataggcagatctcgtctgacat

SEQ ID NO: 373512 - DNA, 25 bp, Mus musculus
ctcataggcctcactgcttaaaact

SEQ ID NO: 373513 - DNA, 25 bp, Mus musculus
ctcataggcctctctgcttaaaact

SEQ ID NO: 373514 - DNA, 25 bp, Mus musculus
ctcataggctgaacgttttcagcac

SEQ ID NO: 373515 - DNA, 25 bp, Mus musculus
ctcataggctgatcgttttcagcac

SEQ ID NO: 373516 - DNA, 25 bp, Mus musculus
ctcatagggatcactcaagtgcttg

SEQ ID NO: 373517 - DNA, 25 bp, Mus musculus
ctcatagggatctctcaagtgcttg

SEQ ID NO: 373518 - DNA, 25 bp, Mus musculus
ctcataggtcaacatgaatcctggg

SEQ ID NO: 373519 - DNA, 25 bp, Mus musculus
ctcataggtcaagatgaatcctggg

SEQ ID NO: 373520 - DNA, 25 bp, Mus musculus
ctcatagttcccattacagttccat

SEQ ID NO: 373521 - DNA, 25 bp, Mus musculus
ctcatagttccctttacagttccat

SEQ ID NO: 373522 - DNA, 25 bp, Mus musculus
ctcatatctatcattaattggtgga

SEQ ID NO: 373523 - DNA, 25 bp, Mus musculus
ctcatatctatctttaattggtgga

SEQ ID NO: 373524 - DNA, 25 bp, Mus musculus
ctcatatctctcatcatcaatggac

SEQ ID NO: 373525 - DNA, 25 bp, Mus musculus
ctcatatctctcttcatcaatggac

SEQ ID NO: 373526 - DNA, 25 bp, Mus musculus
ctcatatgatttactcatctgtgta

SEQ ID NO: 373527 - DNA, 25 bp, Mus musculus
ctcatatgattttctcatctgtgta

SEQ ID NO: 373528 - DNA, 25 bp, Mus musculus
ctcatatgtgtgataggtagactct

SEQ ID NO: 373529 - DNA, 25 bp, Mus musculus
ctcatatgtgtgttaggtagactct

SEQ ID NO: 373530 - DNA, 25 bp, Mus musculus
ctcatattctttcgccccactgtat

SEQ ID NO: 373531 - DNA, 25 bp, Mus musculus
ctcatattctttggccccactgtat

SEQ ID NO: 373532 - DNA, 25 bp, Mus musculus
ctcatattggccaaggtctccttgt

SEQ ID NO: 373533 - DNA, 25 bp, Mus musculus
ctcatattggcctaggtctccttgt

SEQ ID NO: 373534 - DNA, 25 bp, Mus musculus
ctcatcaacattatctttgctctgt

SEQ ID NO: 373535 - DNA, 25 bp, Mus musculus
ctcatcaacattttctttgctctgt

SEQ ID NO: 373536 - DNA, 25 bp, Mus musculus
ctcatcaaccctcaactaaggactt

SEQ ID NO: 373537 - DNA, 25 bp, Mus musculus
ctcatcaaccctgaactaaggactt

SEQ ID NO: 373538 - DNA, 25 bp, Mus musculus
ctcatcaaggcgcctgagttttgtt

SEQ ID NO: 373539 - DNA, 25 bp, Mus musculus
ctcatcaaggcggctgagttttgtt

SEQ ID NO: 373540 - DNA, 25 bp, Mus musculus
ctcatcaattacaacaagggccagt

SEQ ID NO: 373541 - DNA, 25 bp, Mus musculus
ctcatcaattactacaagggccagt

SEQ ID NO: 373542 - DNA, 25 bp, Mus musculus
ctcatcacaaggactactaagcatt

SEQ ID NO: 373543 - DNA, 25 bp, Mus musculus
ctcatcacaaggtctactaagcatt

SEQ ID NO: 373544 - DNA, 25 bp, Mus musculus
ctcatcacatcccttgggtttgtat

SEQ ID NO: 373545 - DNA, 25 bp, Mus musculus
ctcatcacatccgttgggtttgtat

SEQ ID NO: 373546 - DNA, 25 bp, Mus musculus
ctcatcaccgctaatgtgggccctg

SEQ ID NO: 373547 - DNA, 25 bp, Mus musculus
ctcatcaccgcttatgtgggccctg

SEQ ID NO: 373548 - DNA, 25 bp, Mus musculus
ctcatcaggctaccctctgggaaag

SEQ ID NO: 373549 - DNA, 25 bp, Mus musculus
ctcatcaggctagcctctgggaaag

SEQ ID NO: 373550 - DNA, 25 bp, Mus musculus
ctcatcatagatcggctgctgtcga

SEQ ID NO: 373551 - DNA, 25 bp, Mus musculus
ctcatcatagatgggctgctgtcga

SEQ ID NO: 373552 - DNA, 25 bp, Mus musculus
ctcatcatcccgaccttgaaagaga

SEQ ID NO: 373553 - DNA, 25 bp, Mus musculus
ctcatcatcccgtccttgaaagaga

SEQ ID NO: 373554 - DNA, 25 bp, Mus musculus
ctcatcatcctccacgtgcagtgat

SEQ ID NO: 373555 - DNA, 25 bp, Mus musculus
ctcatcatcctcgacgtgcagtgat

SEQ ID NO: 373556 - DNA, 25 bp, Mus musculus
ctcatccacaggacagggcttaggt

SEQ ID NO: 373557 - DNA, 25 bp, Mus musculus
ctcatccacaggtcagggcttaggt

SEQ ID NO: 373558 - DNA, 25 bp, Mus musculus
ctcatccagatcataggttatttat

SEQ ID NO: 373559 - DNA, 25 bp, Mus musculus
ctcatccagatcttaggttatttat

SEQ ID NO: 373560 - DNA, 25 bp, Mus musculus
ctcatccagtcactgtctagggcaa

SEQ ID NO: 373561 - DNA, 25 bp, Mus musculus
ctcatccagtcagtgtctagggcaa

SEQ ID NO: 373562 - DNA, 25 bp, Mus musculus
ctcatccagtggctcacaagtgtgt

SEQ ID NO: 373563 - DNA, 25 bp, Mus musculus
ctcatccagtgggtcacaagtgtgt

SEQ ID NO: 373564 - DNA, 25 bp, Mus musculus
ctcatcccaggtcgatcccatgtgt

SEQ ID NO: 373565 - DNA, 25 bp, Mus musculus
ctcatcccaggtggatcccatgtgt

SEQ ID NO: 373566 - DNA, 25 bp, Mus musculus
ctcatccccagcagggcttagaaaa

SEQ ID NO: 373567 - DNA, 25 bp, Mus musculus
ctcatccccagctgggcttagaaaa

SEQ ID NO: 373568 - DNA, 25 bp, Mus musculus
ctcatccccggaattctgaatgtga

SEQ ID NO: 373569 - DNA, 25 bp, Mus musculus
ctcatccccggatttctgaatgtga

SEQ ID NO: 373570 - DNA, 25 bp, Mus musculus
ctcatcccggttagagcatgcagga

SEQ ID NO: 373571 - DNA, 25 bp, Mus musculus
ctcatcccggtttgagcatgcagga

SEQ ID NO: 373572 - DNA, 25 bp, Mus musculus
ctcatcccttacaccatatcagaaa

SEQ ID NO: 373573 - DNA, 25 bp, Mus musculus
ctcatcccttactccatatcagaaa

SEQ ID NO: 373574 - DNA, 25 bp, Mus musculus
ctcatcccttgactggtgaggaaaa

SEQ ID NO: 373575 - DNA, 25 bp, Mus musculus
ctcatcccttgagtggtgaggaaaa

SEQ ID NO: 373576 - DNA, 25 bp, Mus musculus
ctcatccgatgaacagtagcttcca

SEQ ID NO: 373577 - DNA, 25 bp, Mus musculus
ctcatccgatgatcagtagcttcca

SEQ ID NO: 373578 - DNA, 25 bp, Mus musculus
ctcatccgggctattagactcaaga

SEQ ID NO: 373579 - DNA, 25 bp, Mus musculus
ctcatccgggcttttagactcaaga

SEQ ID NO: 373580 - DNA, 25 bp, Mus musculus
ctcatcctaaccaatcttttctaaa

SEQ ID NO: 373581 - DNA, 25 bp, Mus musculus
ctcatcctaacctatcttttctaaa

SEQ ID NO: 373582 - DNA, 25 bp, Mus musculus
ctcatcctattcactggttgactta

SEQ ID NO: 373583 - DNA, 25 bp, Mus musculus
ctcatcctattctctggttgactta

SEQ ID NO: 373584 - DNA, 25 bp, Mus musculus
ctcatcctcatgctttgtacaacat

SEQ ID NO: 373585 - DNA, 25 bp, Mus musculus
ctcatcctcatggtttgtacaacat

SEQ ID NO: 373586 - DNA, 25 bp, Mus musculus
ctcatcctcgatatttcagcagtgt

SEQ ID NO: 373587 - DNA, 25 bp, Mus musculus
ctcatcctcgatttttcagcagtgt

SEQ ID NO: 373588 - DNA, 25 bp, Mus musculus
ctcatcctcgccagtgaagcagaga

SEQ ID NO: 373589 - DNA, 25 bp, Mus musculus
ctcatcctcgcctgtgaagcagaga

SEQ ID NO: 373590 - DNA, 25 bp, Mus musculus
ctcatcctctatcccggtgtaaatt

SEQ ID NO: 373591 - DNA, 25 bp, Mus musculus
ctcatcctctatgccggtgtaaatt

SEQ ID NO: 373592 - DNA, 25 bp, Mus musculus
ctcatcctgatgagtgccagttaga

SEQ ID NO: 373593 - DNA, 25 bp, Mus musculus
ctcatcctgatgtgtgccagttaga

SEQ ID NO: 373594 - DNA, 25 bp, Mus musculus
ctcatcctgcaccacgacgaggtga

SEQ ID NO: 373595 - DNA, 25 bp, Mus musculus
ctcatcctgcacgacgacgaggtga

SEQ ID NO: 373596 - DNA, 25 bp, Mus musculus
ctcatcctgtggctagtcttgcaga

SEQ ID NO: 373597 - DNA, 25 bp, Mus musculus
ctcatcctgtgggtagtcttgcaga

SEQ ID NO: 373598 - DNA, 25 bp, Mus musculus
ctcatccttcaaccttttcttacag

SEQ ID NO: 373599 - DNA, 25 bp, Mus musculus
ctcatccttcaagcttttcttacag

SEQ ID NO: 373600 - DNA, 25 bp, Mus musculus
ctcatccttttacgctccaagagtc

SEQ ID NO: 373601 - DNA, 25 bp, Mus musculus
ctcatccttttaggctccaagagtc

SEQ ID NO: 373602 - DNA, 25 bp, Mus musculus
ctcatccttttgacatttggtgata

SEQ ID NO: 373603 - DNA, 25 bp, Mus musculus
ctcatccttttgtcatttggtgata

SEQ ID NO: 373604 - DNA, 25 bp, Mus musculus
ctcatcgtccatagctcacatggta

SEQ ID NO: 373605 - DNA, 25 bp, Mus musculus
ctcatcgtccattgctcacatggta

SEQ ID NO: 373606 - DNA, 25 bp, Mus musculus
ctcatcgtttttccagtggtggctt

SEQ ID NO: 373607 - DNA, 25 bp, Mus musculus
ctcatcgtttttgcagtggtggctt

SEQ ID NO: 373608 - DNA, 25 bp, Mus musculus
ctcatctactgaagctgcggagcga

SEQ ID NO: 373609 - DNA, 25 bp, Mus musculus
ctcatctactgatgctgcggagcga

SEQ ID NO: 373610 - DNA, 25 bp, Mus musculus
ctcatctactgtctctgttgcagaa

SEQ ID NO: 373611 - DNA, 25 bp, Mus musculus
ctcatctactgtgtctgttgcagaa

SEQ ID NO: 373612 - DNA, 25 bp, Mus musculus
ctcatctcaagtaaagccagtcatt

SEQ ID NO: 373613 - DNA, 25 bp, Mus musculus
ctcatctcaagttaagccagtcatt

SEQ ID NO: 373614 - DNA, 25 bp, Mus musculus
ctcatctcacttagttaccctaaga

SEQ ID NO: 373615 - DNA, 25 bp, Mus musculus
ctcatctcactttgttaccctaaga

SEQ ID NO: 373616 - DNA, 25 bp, Mus musculus
ctcatctcatgtattctgcctaagc

SEQ ID NO: 373617 - DNA, 25 bp, Mus musculus
ctcatctcatgttttctgcctaagc

SEQ ID NO: 373618 - DNA, 25 bp, Mus musculus
ctcatctccataaagcactcagaaa

SEQ ID NO: 373619 - DNA, 25 bp, Mus musculus
ctcatctccatatagcactcagaaa

SEQ ID NO: 373620 - DNA, 25 bp, Mus musculus
ctcatctcctttcttagtgctcttc

SEQ ID NO: 373621 - DNA, 25 bp, Mus musculus
ctcatctcctttgttagtgctcttc

SEQ ID NO: 373622 - DNA, 25 bp, Mus musculus
ctcatctctacaatgtcagacacct

SEQ ID NO: 373623 - DNA, 25 bp, Mus musculus
ctcatctctacattgtcagacacct

SEQ ID NO: 373624 - DNA, 25 bp, Mus musculus
ctcatctctgcaatcttagctacta

SEQ ID NO: 373625 - DNA, 25 bp, Mus musculus
ctcatctctgcattcttagctacta

SEQ ID NO: 373626 - DNA, 25 bp, Mus musculus
ctcatctctggaacaaggtcgctga

SEQ ID NO: 373627 - DNA, 25 bp, Mus musculus
ctcatctctggatcaaggtcgctga

SEQ ID NO: 373628 - DNA, 25 bp, Mus musculus
ctcatctctgtgattgtgactcgca

SEQ ID NO: 373629 - DNA, 25 bp, Mus musculus
ctcatctctgtgtttgtgactcgca

SEQ ID NO: 373630 - DNA, 25 bp, Mus musculus
ctcatctgattcaatattgacctga

SEQ ID NO: 373631 - DNA, 25 bp, Mus musculus
ctcatctgattctatattgacctga

SEQ ID NO: 373632 - DNA, 25 bp, Mus musculus
ctcatctggagtcacctggtagctt

SEQ ID NO: 373633 - DNA, 25 bp, Mus musculus
ctcatctggagtgacctggtagctt

SEQ ID NO: 373634 - DNA, 25 bp, Mus musculus
ctcatctggtacattaggtttgcca

SEQ ID NO: 373635 - DNA, 25 bp, Mus musculus
ctcatctggtactttaggtttgcca

SEQ ID NO: 373636 - DNA, 25 bp, Mus musculus
ctcatctgtggtcattaagtgcatt

SEQ ID NO: 373637 - DNA, 25 bp, Mus musculus
ctcatctgtggtgattaagtgcatt

SEQ ID NO: 373638 - DNA, 25 bp, Mus musculus
ctcatctgttccacctgtgtaagag

SEQ ID NO: 373639 - DNA, 25 bp, Mus musculus
ctcatctgttcctcctgtgtaagag

SEQ ID NO: 373640 - DNA, 25 bp, Mus musculus
ctcatcttcaacatgttctactgga

SEQ ID NO: 373641 - DNA, 25 bp, Mus musculus
ctcatcttcaacttgttctactgga

SEQ ID NO: 373642 - DNA, 25 bp, Mus musculus
ctcatcttcaccctggactttgaaa

SEQ ID NO: 373643 - DNA, 25 bp, Mus musculus
ctcatcttcaccgtggactttgaaa

SEQ ID NO: 373644 - DNA, 25 bp, Mus musculus
ctcatcttcagtccttggttccaaa

SEQ ID NO: 373645 - DNA, 25 bp, Mus musculus
ctcatcttcagtgcttggttccaaa

SEQ ID NO: 373646 - DNA, 25 bp, Mus musculus
ctcatcttcataccagagacttaat

SEQ ID NO: 373647 - DNA, 25 bp, Mus musculus
ctcatcttcatagcagagacttaat

SEQ ID NO: 373648 - DNA, 25 bp, Mus musculus
ctcatcttctccatcattatgatga

SEQ ID NO: 373649 - DNA, 25 bp, Mus musculus
ctcatcttctccttcattatgatga

SEQ ID NO: 373650 - DNA, 25 bp, Mus musculus
ctcatcttggttagctcatatgtca

SEQ ID NO: 373651 - DNA, 25 bp, Mus musculus
ctcatcttggtttgctcatatgtca

SEQ ID NO: 373652 - DNA, 25 bp, Mus musculus
ctcatctttggtccctggagaatca

SEQ ID NO: 373653 - DNA, 25 bp, Mus musculus
ctcatctttggtgcctggagaatca

SEQ ID NO: 373654 - DNA, 25 bp, Mus musculus
ctcatctttgtgacccatggagctg

SEQ ID NO: 373655 - DNA, 25 bp, Mus musculus
ctcatctttgtgtcccatggagctg

SEQ ID NO: 373656 - DNA, 25 bp, Mus musculus
ctcatctttgttcttgcagcttgcc

SEQ ID NO: 373657 - DNA, 25 bp, Mus musculus
ctcatctttgttgttgcagcttgcc

SEQ ID NO: 373658 - DNA, 25 bp, Mus musculus
ctcatgaactgcaaccgctccttca

SEQ ID NO: 373659 - DNA, 25 bp, Mus musculus
ctcatgaactgctaccgctccttca

SEQ ID NO: 373660 - DNA, 25 bp, Mus musculus
ctcatgaagcagagccgctgggaca

SEQ ID NO: 373661 - DNA, 25 bp, Mus musculus
ctcatgaagcagtgccgctgggaca

SEQ ID NO: 373662 - DNA, 25 bp, Mus musculus
ctcatgaaggagatgcgcgcacaca

SEQ ID NO: 373663 - DNA, 25 bp, Mus musculus
ctcatgaaggagttgcgcgcacaca

SEQ ID NO: 373664 - DNA, 25 bp, Mus musculus
ctcatgacccatactttattctctg

SEQ ID NO: 373665 - DNA, 25 bp, Mus musculus
ctcatgacccattctttattctctg

SEQ ID NO: 373666 - DNA, 25 bp, Mus musculus
ctcatgacctgaactttttagccaa

SEQ ID NO: 373667 - DNA, 25 bp, Mus musculus
ctcatgacctgatctttttagccaa

SEQ ID NO: 373668 - DNA, 25 bp, Mus musculus
ctcatgacggagctgcagcttgtag

SEQ ID NO: 373669 - DNA, 25 bp, Mus musculus
ctcatgacggaggtgcagcttgtag

SEQ ID NO: 373670 - DNA, 25 bp, Mus musculus
ctcatgactctaagtttgttgtatt

SEQ ID NO: 373671 - DNA, 25 bp, Mus musculus
ctcatgactctatgtttgttgtatt

SEQ ID NO: 373672 - DNA, 25 bp, Mus musculus
ctcatgactgcaacttctcacaaag

SEQ ID NO: 373673 - DNA, 25 bp, Mus musculus
ctcatgactgcactggtggtctgga

SEQ ID NO: 373674 - DNA, 25 bp, Mus musculus
ctcatgactgcagtggtggtctgga

SEQ ID NO: 373675 - DNA, 25 bp, Mus musculus
ctcatgactgcatcttctcacaaag

SEQ ID NO: 373676 - DNA, 25 bp, Mus musculus
ctcatgactgtcatttccagcttac

SEQ ID NO: 373677 - DNA, 25 bp, Mus musculus
ctcatgactgtcttttccagcttac

SEQ ID NO: 373678 - DNA, 25 bp, Mus musculus
ctcatgagagcactaatacaagtgt

SEQ ID NO: 373679 - DNA, 25 bp, Mus musculus
ctcatgagagcagtaatacaagtgt

SEQ ID NO: 373680 - DNA, 25 bp, Mus musculus
ctcatgagtcagaccatctccaagg

SEQ ID NO: 373681 - DNA, 25 bp, Mus musculus
ctcatgagtcagtccatctccaagg

SEQ ID NO: 373682 - DNA, 25 bp, Mus musculus
ctcatgatctctccttgtttgtgat

SEQ ID NO: 373683 - DNA, 25 bp, Mus musculus
ctcatgatctctgcttgtttgtgat

SEQ ID NO: 373684 - DNA, 25 bp, Mus musculus
ctcatgatgcctagactccaactat

SEQ ID NO: 373685 - DNA, 25 bp, Mus musculus
ctcatgatgccttgactccaactat

SEQ ID NO: 373686 - DNA, 25 bp, Mus musculus
ctcatgattcatacactcaccagtg

SEQ ID NO: 373687 - DNA, 25 bp, Mus musculus
ctcatgattcattcactcaccagtg

SEQ ID NO: 373688 - DNA, 25 bp, Mus musculus
ctcatgatttgcatctttcaggtca

SEQ ID NO: 373689 - DNA, 25 bp, Mus musculus
ctcatgatttgcttctttcaggtca

SEQ ID NO: 373690 - DNA, 25 bp, Mus musculus
ctcatgcaacacaaagggtcctctg

SEQ ID NO: 373691 - DNA, 25 bp, Mus musculus
ctcatgcaacactaagggtcctctg

SEQ ID NO: 373692 - DNA, 25 bp, Mus musculus
ctcatgcactgtcttgacattccat

SEQ ID NO: 373693 - DNA, 25 bp, Mus musculus
ctcatgcactgtgttgacattccat

SEQ ID NO: 373694 - DNA, 25 bp, Mus musculus
ctcatgcagataaagcactcaatgt

SEQ ID NO: 373695 - DNA, 25 bp, Mus musculus
ctcatgcagatatagcactcaatgt

SEQ ID NO: 373696 - DNA, 25 bp, Mus musculus
ctcatgccacccaaagggcgtagaa

SEQ ID NO: 373697 - DNA, 25 bp, Mus musculus
ctcatgccaccctaagggcgtagaa

SEQ ID NO: 373698 - DNA, 25 bp, Mus musculus
ctcatgccccatcaatacacataag

SEQ ID NO: 373699 - DNA, 25 bp, Mus musculus
ctcatgccccatgaatacacataag

SEQ ID NO: 373700 - DNA, 25 bp, Mus musculus
ctcatgccctaactctcttaagtaa

SEQ ID NO: 373701 - DNA, 25 bp, Mus musculus
ctcatgccctaagtctcttaagtaa

SEQ ID NO: 373702 - DNA, 25 bp, Mus musculus
ctcatgccctaccattttagagcac

SEQ ID NO: 373703 - DNA, 25 bp, Mus musculus
ctcatgccctacgattttagagcac

SEQ ID NO: 373704 - DNA, 25 bp, Mus musculus
ctcatgcctctcactttgtaggtaa

SEQ ID NO: 373705 - DNA, 25 bp, Mus musculus
ctcatgcctctctctttgtaggtaa

SEQ ID NO: 373706 - DNA, 25 bp, Mus musculus
ctcatgccttacaaatctgcatatt

SEQ ID NO: 373707 - DNA, 25 bp, Mus musculus
ctcatgccttactaatctgcatatt

SEQ ID NO: 373708 - DNA, 25 bp, Mus musculus
ctcatgctacataacccaccaaagg

SEQ ID NO: 373709 - DNA, 25 bp, Mus musculus
ctcatgctacattacccaccaaagg

SEQ ID NO: 373710 - DNA, 25 bp, Mus musculus
ctcatgctagccaaggcttttggct

SEQ ID NO: 373711 - DNA, 25 bp, Mus musculus
ctcatgctagcctaggcttttggct

SEQ ID NO: 373712 - DNA, 25 bp, Mus musculus
ctcatgctatgccttcgttttacaa

SEQ ID NO: 373713 - DNA, 25 bp, Mus musculus
ctcatgctatgcgttcgttttacaa

SEQ ID NO: 373714 - DNA, 25 bp, Mus musculus
ctcatgctgtaccacaggaggcaga

SEQ ID NO: 373715 - DNA, 25 bp, Mus musculus
ctcatgctgtacgacaggaggcaga

SEQ ID NO: 373716 - DNA, 25 bp, Mus musculus
ctcatgcttgtacaggaaatctcta

SEQ ID NO: 373717 - DNA, 25 bp, Mus musculus
ctcatgcttgtactttcaacgcttg

SEQ ID NO: 373718 - DNA, 25 bp, Mus musculus
ctcatgcttgtagaggaaatctcta

SEQ ID NO: 373719 - DNA, 25 bp, Mus musculus
ctcatgcttgtagtttcaacgcttg

SEQ ID NO: 373720 - DNA, 25 bp, Mus musculus
ctcatgctttagaaagtactaggag

SEQ ID NO: 373721 - DNA, 25 bp, Mus musculus
ctcatgctttagtaagtactaggag

SEQ ID NO: 373722 - DNA, 25 bp, Mus musculus
ctcatggaacatccggccaggtgag

SEQ ID NO: 373723 - DNA, 25 bp, Mus musculus
ctcatggaacatgcggccaggtgag

SEQ ID NO: 373724 - DNA, 25 bp, Mus musculus
ctcatggaatataagtaaactcact

SEQ ID NO: 373725 - DNA, 25 bp, Mus musculus
ctcatggaatattagtaaactcact

SEQ ID NO: 373726 - DNA, 25 bp, Mus musculus
ctcatggacagtcctttgcctcctg

SEQ ID NO: 373727 - DNA, 25 bp, Mus musculus
ctcatggacagtgctttgcctcctg

SEQ ID NO: 373728 - DNA, 25 bp, Mus musculus
ctcatggagataataccttagtgtt

SEQ ID NO: 373729 - DNA, 25 bp, Mus musculus
ctcatggagatattaccttagtgtt

SEQ ID NO: 373730 - DNA, 25 bp, Mus musculus
ctcatggagccaccgtttgaacctt

SEQ ID NO: 373731 - DNA, 25 bp, Mus musculus
ctcatggagccagcgtttgaacctt

SEQ ID NO: 373732 - DNA, 25 bp, Mus musculus
ctcatggatatgctggtcaacaccc

SEQ ID NO: 373733 - DNA, 25 bp, Mus musculus
ctcatggatatggtggtcaacaccc

SEQ ID NO: 373734 - DNA, 25 bp, Mus musculus
ctcatggatcgtcccaagtgccaag

SEQ ID NO: 373735 - DNA, 25 bp, Mus musculus
ctcatggatcgtgccaagtgccaag

SEQ ID NO: 373736 - DNA, 25 bp, Mus musculus
ctcatggattgaccaggcggcagca

SEQ ID NO: 373737 - DNA, 25 bp, Mus musculus
ctcatggattgagcaggcggcagca

SEQ ID NO: 373738 - DNA, 25 bp, Mus musculus
ctcatggatttgctagctgttttaa

SEQ ID NO: 373739 - DNA, 25 bp, Mus musculus
ctcatggatttggtagctgttttaa

SEQ ID NO: 373740 - DNA, 25 bp, Mus musculus
ctcatggcattcatgttagctgatt

SEQ ID NO: 373741 - DNA, 25 bp, Mus musculus
ctcatggcattcttgttagctgatt

SEQ ID NO: 373742 - DNA, 25 bp, Mus musculus
ctcatggcattgcaggctcagccgt

SEQ ID NO: 373743 - DNA, 25 bp, Mus musculus
ctcatggcattggaggctcagccgt

SEQ ID NO: 373744 - DNA, 25 bp, Mus musculus
ctcatggcgactcggcctgtcactt

SEQ ID NO: 373745 - DNA, 25 bp, Mus musculus
ctcatggcgactgggcctgtcactt

SEQ ID NO: 373746 - DNA, 25 bp, Mus musculus
ctcatggctgccattgtgtattgga

SEQ ID NO: 373747 - DNA, 25 bp, Mus musculus
ctcatggctgcctttgtgtattgga

SEQ ID NO: 373748 - DNA, 25 bp, Mus musculus
ctcatgggatatcaggttcttgttc

SEQ ID NO: 373749 - DNA, 25 bp, Mus musculus
ctcatgggatatgaggttcttgttc

SEQ ID NO: 373750 - DNA, 25 bp, Mus musculus
ctcatgggcatgagactgggagcca

SEQ ID NO: 373751 - DNA, 25 bp, Mus musculus
ctcatgggcatgtgactgggagcca

SEQ ID NO: 373752 - DNA, 25 bp, Mus musculus
ctcatgggtgtgactattagtgttc

SEQ ID NO: 373753 - DNA, 25 bp, Mus musculus
ctcatgggtgtgtctattagtgttc

SEQ ID NO: 373754 - DNA, 25 bp, Mus musculus
ctcatgggtttgcttcatttggcaa

SEQ ID NO: 373755 - DNA, 25 bp, Mus musculus
ctcatgggtttggttcatttggcaa

SEQ ID NO: 373756 - DNA, 25 bp, Mus musculus
ctcatggtgactctggcatggtgac

SEQ ID NO: 373757 - DNA, 25 bp, Mus musculus
ctcatggtgactgtggcatggtgac

SEQ ID NO: 373758 - DNA, 25 bp, Mus musculus
ctcatggtgcgcattggcgtcttct

SEQ ID NO: 373759 - DNA, 25 bp, Mus musculus
ctcatggtgcgctttggcgtcttct

SEQ ID NO: 373760 - DNA, 25 bp, Mus musculus
ctcatggtgcggctggccaagagca

SEQ ID NO: 373761 - DNA, 25 bp, Mus musculus
ctcatggtgcgggtggccaagagca

SEQ ID NO: 373762 - DNA, 25 bp, Mus musculus
ctcatggtgcttacaataaatttct

SEQ ID NO: 373763 - DNA, 25 bp, Mus musculus
ctcatggtgctttcaataaatttct

SEQ ID NO: 373764 - DNA, 25 bp, Mus musculus
ctcatggtggacaggttccggctta

SEQ ID NO: 373765 - DNA, 25 bp, Mus musculus
ctcatggtggacatctagatgaaca

SEQ ID NO: 373766 - DNA, 25 bp, Mus musculus
ctcatggtggactggttccggctta

SEQ ID NO: 373767 - DNA, 25 bp, Mus musculus
ctcatggtggacttctagatgaaca

SEQ ID NO: 373768 - DNA, 25 bp, Mus musculus
ctcatgtagggaagtggtgctgaca

SEQ ID NO: 373769 - DNA, 25 bp, Mus musculus
ctcatgtagggatgtggtgctgaca

SEQ ID NO: 373770 - DNA, 25 bp, Mus musculus
ctcatgtcaatgcttggcgtgggaa

SEQ ID NO: 373771 - DNA, 25 bp, Mus musculus
ctcatgtcaatggttggcgtgggaa

SEQ ID NO: 373772 - DNA, 25 bp, Mus musculus
ctcatgtcatgtatcacgtgtgcaa

SEQ ID NO: 373773 - DNA, 25 bp, Mus musculus
ctcatgtcatgtttcacgtgtgcaa

SEQ ID NO: 373774 - DNA, 25 bp, Mus musculus
ctcatgtcttatagaagggcttccc

SEQ ID NO: 373775 - DNA, 25 bp, Mus musculus
ctcatgtcttattgaagggcttccc

SEQ ID NO: 373776 - DNA, 25 bp, Mus musculus
ctcatgtgagctattctttccttct

SEQ ID NO: 373777 - DNA, 25 bp, Mus musculus
ctcatgtgagcttttctttccttct

SEQ ID NO: 373778 - DNA, 25 bp, Mus musculus
ctcatgtgcccaacagttagtaaat

SEQ ID NO: 373779 - DNA, 25 bp, Mus musculus
ctcatgtgcccatcagttagtaaat

SEQ ID NO: 373780 - DNA, 25 bp, Mus musculus
ctcatgttcattccagctagctggc

SEQ ID NO: 373781 - DNA, 25 bp, Mus musculus
ctcatgttcattgcagctagctggc

SEQ ID NO: 373782 - DNA, 25 bp, Mus musculus
ctcatgttccccaatggctataaat

SEQ ID NO: 373783 - DNA, 25 bp, Mus musculus
ctcatgttcccctatggctataaat

SEQ ID NO: 373784 - DNA, 25 bp, Mus musculus
ctcatgttgtctatgtatatgccac

SEQ ID NO: 373785 - DNA, 25 bp, Mus musculus
ctcatgttgtctttgtatatgccac

SEQ ID NO: 373786 - DNA, 25 bp, Mus musculus
ctcatgtttaacaaacttgcacaag

SEQ ID NO: 373787 - DNA, 25 bp, Mus musculus
ctcatgtttaactaacttgcacaag

SEQ ID NO: 373788 - DNA, 25 bp, Mus musculus
ctcatgtttatacctgcatatgtat

SEQ ID NO: 373789 - DNA, 25 bp, Mus musculus
ctcatgtttatagctgcatatgtat

SEQ ID NO: 373790 - DNA, 25 bp, Mus musculus
ctcatgtttcatcaagtgcaccaaa

SEQ ID NO: 373791 - DNA, 25 bp, Mus musculus
ctcatgtttcatgaagtgcaccaaa

SEQ ID NO: 373792 - DNA, 25 bp, Mus musculus
ctcatgtttgctcggacactgctga

SEQ ID NO: 373793 - DNA, 25 bp, Mus musculus
ctcatgtttgctgggacactgctga

SEQ ID NO: 373794 - DNA, 25 bp, Mus musculus
ctcattaataccatgctctgcagtt

SEQ ID NO: 373795 - DNA, 25 bp, Mus musculus
ctcattaataccttgctctgcagtt

SEQ ID NO: 373796 - DNA, 25 bp, Mus musculus
ctcattaatataccgaaacttaggg

SEQ ID NO: 373797 - DNA, 25 bp, Mus musculus
ctcattaatatagcgaaacttaggg

SEQ ID NO: 373798 - DNA, 25 bp, Mus musculus
ctcattacagtgctgtggaccccat

SEQ ID NO: 373799 - DNA, 25 bp, Mus musculus
ctcattacagtggtgtggaccccat

SEQ ID NO: 373800 - DNA, 25 bp, Mus musculus
ctcattactcggctttcatactttg

SEQ ID NO: 373801 - DNA, 25 bp, Mus musculus
ctcattactcgggtttcatactttg

SEQ ID NO: 373802 - DNA, 25 bp, Mus musculus
ctcattagaaacatcagtgggtctg

SEQ ID NO: 373803 - DNA, 25 bp, Mus musculus
ctcattagaaacttcagtgggtctg

SEQ ID NO: 373804 - DNA, 25 bp, Mus musculus
ctcattagagccctgctggtggtgt

SEQ ID NO: 373805 - DNA, 25 bp, Mus musculus
ctcattagagccgtgctggtggtgt

SEQ ID NO: 373806 - DNA, 25 bp, Mus musculus
ctcattaggattcaactgtcagctt

SEQ ID NO: 373807 - DNA, 25 bp, Mus musculus
ctcattaggattgaactgtcagctt

SEQ ID NO: 373808 - DNA, 25 bp, Mus musculus
ctcattatcacaatagcctgctctt

SEQ ID NO: 373809 - DNA, 25 bp, Mus musculus
ctcattatcacattagcctgctctt

SEQ ID NO: 373810 - DNA, 25 bp, Mus musculus
ctcattatggccattccatctactt

SEQ ID NO: 373811 - DNA, 25 bp, Mus musculus
ctcattatggcctttccatctactt

SEQ ID NO: 373812 - DNA, 25 bp, Mus musculus
ctcattattgggattactctacttg

SEQ ID NO: 373813 - DNA, 25 bp, Mus musculus
ctcattattgggtttactctacttg

SEQ ID NO: 373814 - DNA, 25 bp, Mus musculus
ctcattatttatagcccctgggacg

SEQ ID NO: 373815 - DNA, 25 bp, Mus musculus
ctcattatttattgcccctgggacg

SEQ ID NO: 373816 - DNA, 25 bp, Mus musculus
ctcattcagaacactacctcttttt

SEQ ID NO: 373817 - DNA, 25 bp, Mus musculus
ctcattcagaactctacctcttttt

SEQ ID NO: 373818 - DNA, 25 bp, Mus musculus
ctcattcagctacagcttcattttt

SEQ ID NO: 373819 - DNA, 25 bp, Mus musculus
ctcattcagctagagcttcattttt

SEQ ID NO: 373820 - DNA, 25 bp, Mus musculus
ctcattcaggatactcagcagtcat

SEQ ID NO: 373821 - DNA, 25 bp, Mus musculus
ctcattcaggattctcagcagtcat

SEQ ID NO: 373822 - DNA, 25 bp, Mus musculus
ctcattcagtgcaaagccatggctt

SEQ ID NO: 373823 - DNA, 25 bp, Mus musculus
ctcattcagtgctaagccatggctt

SEQ ID NO: 373824 - DNA, 25 bp, Mus musculus
ctcattcattgacctacctttggga

SEQ ID NO: 373825 - DNA, 25 bp, Mus musculus
ctcattcattgagctacctttggga

SEQ ID NO: 373826 - DNA, 25 bp, Mus musculus
ctcattccgtggctgatggatgaat

SEQ ID NO: 373827 - DNA, 25 bp, Mus musculus
ctcattccgtgggtgatggatgaat

SEQ ID NO: 373828 - DNA, 25 bp, Mus musculus
ctcattcctggaaacaaacttctgt

SEQ ID NO: 373829 - DNA, 25 bp, Mus musculus
ctcattcctggatacaaacttctgt

SEQ ID NO: 373830 - DNA, 25 bp, Mus musculus
ctcattccttttcatgttcaaattt

SEQ ID NO: 373831 - DNA, 25 bp, Mus musculus
ctcattccttttgatgttcaaattt

SEQ ID NO: 373832 - DNA, 25 bp, Mus musculus
ctcattcgatttctcaggattccac

SEQ ID NO: 373833 - DNA, 25 bp, Mus musculus
ctcattcgatttgtcaggattccac

SEQ ID NO: 373834 - DNA, 25 bp, Mus musculus
ctcattctctgcagcaaacttggca

SEQ ID NO: 373835 - DNA, 25 bp, Mus musculus
ctcattctctgctgcaaacttggca

SEQ ID NO: 373836 - DNA, 25 bp, Mus musculus
ctcattctcttcacgttcaccttgg

SEQ ID NO: 373837 - DNA, 25 bp, Mus musculus
ctcattctcttctcgttcaccttgg

SEQ ID NO: 373838 - DNA, 25 bp, Mus musculus
ctcattctgtccagagggacttgaa

SEQ ID NO: 373839 - DNA, 25 bp, Mus musculus
ctcattctgtcctgagggacttgaa

SEQ ID NO: 373840 - DNA, 25 bp, Mus musculus
ctcattcttcgtaagctcactttat

SEQ ID NO: 373841 - DNA, 25 bp, Mus musculus
ctcattcttcgttagctcactttat

SEQ ID NO: 373842 - DNA, 25 bp, Mus musculus
ctcattcttgagaagcattagggta

SEQ ID NO: 373843 - DNA, 25 bp, Mus musculus
ctcattcttgagtagcattagggta

SEQ ID NO: 373844 - DNA, 25 bp, Mus musculus
ctcattcttgtaaccctagtatcac

SEQ ID NO: 373845 - DNA, 25 bp, Mus musculus
ctcattcttgtatccctagtatcac

SEQ ID NO: 373846 - DNA, 25 bp, Mus musculus
ctcattgaccctattgacctggatg

SEQ ID NO: 373847 - DNA, 25 bp, Mus musculus
ctcattgacccttttgacctggatg

SEQ ID NO: 373848 - DNA, 25 bp, Mus musculus
ctcattgactcgctagtgaatgtta

SEQ ID NO: 373849 - DNA, 25 bp, Mus musculus
ctcattgactcggtagtgaatgtta

SEQ ID NO: 373850 - DNA, 25 bp, Mus musculus
ctcattgactctctgacaagtgtta

SEQ ID NO: 373851 - DNA, 25 bp, Mus musculus
ctcattgactctgtgacaagtgtta

SEQ ID NO: 373852 - DNA, 25 bp, Mus musculus
ctcattgcagtgctttccctttggg

SEQ ID NO: 373853 - DNA, 25 bp, Mus musculus
ctcattgcagtggtttccctttggg

SEQ ID NO: 373854 - DNA, 25 bp, Mus musculus
ctcattgctcggaatgtcagacaca

SEQ ID NO: 373855 - DNA, 25 bp, Mus musculus
ctcattgctcggtatgtcagacaca

SEQ ID NO: 373856 - DNA, 25 bp, Mus musculus
ctcattgctcttagagtggctcaca

SEQ ID NO: 373857 - DNA, 25 bp, Mus musculus
ctcattgctctttgagtggctcaca

SEQ ID NO: 373858 - DNA, 25 bp, Mus musculus
ctcattgcttctcagggtgcagtta

SEQ ID NO: 373859 - DNA, 25 bp, Mus musculus
ctcattgcttctgagggtgcagtta

SEQ ID NO: 373860 - DNA, 25 bp, Mus musculus
ctcattggacacatctgttatcatg

SEQ ID NO: 373861 - DNA, 25 bp, Mus musculus
ctcattggacacttctgttatcatg

SEQ ID NO: 373862 - DNA, 25 bp, Mus musculus
ctcattggatggctccctccatgca

SEQ ID NO: 373863 - DNA, 25 bp, Mus musculus
ctcattggatgggtccctccatgca

SEQ ID NO: 373864 - DNA, 25 bp, Mus musculus
ctcattggcagcaagaactggttga

SEQ ID NO: 373865 - DNA, 25 bp, Mus musculus
ctcattggcagctagaactggttga

SEQ ID NO: 373866 - DNA, 25 bp, Mus musculus
ctcattggccacctagcggtggtaa

SEQ ID NO: 373867 - DNA, 25 bp, Mus musculus
ctcattggccacgtagcggtggtaa

SEQ ID NO: 373868 - DNA, 25 bp, Mus musculus
ctcattggtagacaacttttcttgt

SEQ ID NO: 373869 - DNA, 25 bp, Mus musculus
ctcattggtagagaacttttcttgt

SEQ ID NO: 373870 - DNA, 25 bp, Mus musculus
ctcattggttgaaggtggtggcatt

SEQ ID NO: 373871 - DNA, 25 bp, Mus musculus
ctcattggttgatggtggtggcatt

SEQ ID NO: 373872 - DNA, 25 bp, Mus musculus
ctcattgtaacaagccgactgtgga

SEQ ID NO: 373873 - DNA, 25 bp, Mus musculus
ctcattgtaacatgccgactgtgga

SEQ ID NO: 373874 - DNA, 25 bp, Mus musculus
ctcattgtccttcgctggactgaca

SEQ ID NO: 373875 - DNA, 25 bp, Mus musculus
ctcattgtccttggctggactgaca

SEQ ID NO: 373876 - DNA, 25 bp, Mus musculus
ctcattgtggacagagtgtgtatgt

SEQ ID NO: 373877 - DNA, 25 bp, Mus musculus
ctcattgtggactgagtgtgtatgt

SEQ ID NO: 373878 - DNA, 25 bp, Mus musculus
ctcattgtgtcccaggtgtgtgaag

SEQ ID NO: 373879 - DNA, 25 bp, Mus musculus
ctcattgtgtccgaggtgtgtgaag

SEQ ID NO: 373880 - DNA, 25 bp, Mus musculus
ctcattgttaagctacaggacccaa

SEQ ID NO: 373881 - DNA, 25 bp, Mus musculus
ctcattgttaaggtacaggacccaa

SEQ ID NO: 373882 - DNA, 25 bp, Mus musculus
ctcatttaacaccaaggccctttag

SEQ ID NO: 373883 - DNA, 25 bp, Mus musculus
ctcatttaacacgaaggccctttag

SEQ ID NO: 373884 - DNA, 25 bp, Mus musculus
ctcatttaatgtaagcttctctgtt

SEQ ID NO: 373885 - DNA, 25 bp, Mus musculus
ctcatttaatgttagcttctctgtt

SEQ ID NO: 373886 - DNA, 25 bp, Mus musculus
ctcatttactatcctggcaagatta

SEQ ID NO: 373887 - DNA, 25 bp, Mus musculus
ctcatttactatgctggcaagatta

SEQ ID NO: 373888 - DNA, 25 bp, Mus musculus
ctcatttatatcctgggtcaagaaa

SEQ ID NO: 373889 - DNA, 25 bp, Mus musculus
ctcatttatatcgtgggtcaagaaa

SEQ ID NO: 373890 - DNA, 25 bp, Mus musculus
ctcatttatcccagagcttgctggg

SEQ ID NO: 373891 - DNA, 25 bp, Mus musculus
ctcatttatccctgagcttgctggg

SEQ ID NO: 373892 - DNA, 25 bp, Mus musculus
ctcatttcattcatctcacgttatt

SEQ ID NO: 373893 - DNA, 25 bp, Mus musculus
ctcatttcattcatgggctgccata

SEQ ID NO: 373894 - DNA, 25 bp, Mus musculus
ctcatttcattcttctcacgttatt

SEQ ID NO: 373895 - DNA, 25 bp, Mus musculus
ctcatttcattcttgggctgccata

SEQ ID NO: 373896 - DNA, 25 bp, Mus musculus
ctcatttcccaaaatctagcttatt

SEQ ID NO: 373897 - DNA, 25 bp, Mus musculus
ctcatttcccaatatctagcttatt

SEQ ID NO: 373898 - DNA, 25 bp, Mus musculus
ctcatttcccagatcttgtttctaa

SEQ ID NO: 373899 - DNA, 25 bp, Mus musculus
ctcatttcccagttcttgtttctaa

SEQ ID NO: 373900 - DNA, 25 bp, Mus musculus
ctcatttccgagacacctatatcaa

SEQ ID NO: 373901 - DNA, 25 bp, Mus musculus
ctcatttccgagtcacctatatcaa

SEQ ID NO: 373902 - DNA, 25 bp, Mus musculus
ctcatttctattactacaaggacta

SEQ ID NO: 373903 - DNA, 25 bp, Mus musculus
ctcatttctatttctacaaggacta

SEQ ID NO: 373904 - DNA, 25 bp, Mus musculus
ctcatttctctcaagtttggtagtc

SEQ ID NO: 373905 - DNA, 25 bp, Mus musculus
ctcatttctctctagtttggtagtc

SEQ ID NO: 373906 - DNA, 25 bp, Mus musculus
ctcatttctgaaccctctttgtaca

SEQ ID NO: 373907 - DNA, 25 bp, Mus musculus
ctcatttctgaagcctctttgtaca

SEQ ID NO: 373908 - DNA, 25 bp, Mus musculus
ctcatttgaaagcttggcacttgct

SEQ ID NO: 373909 - DNA, 25 bp, Mus musculus
ctcatttgaaaggttggcacttgct

SEQ ID NO: 373910 - DNA, 25 bp, Mus musculus
ctcatttgacagatttccatgtttg

SEQ ID NO: 373911 - DNA, 25 bp, Mus musculus
ctcatttgacagttttccatgtttg

SEQ ID NO: 373912 - DNA, 25 bp, Mus musculus
ctcatttggcggattggtgggataa

SEQ ID NO: 373913 - DNA, 25 bp, Mus musculus
ctcatttggcggtttggtgggataa

SEQ ID NO: 373914 - DNA, 25 bp, Mus musculus
ctcatttgtcccacggagagttata

SEQ ID NO: 373915 - DNA, 25 bp, Mus musculus
ctcatttgtcccagtattttctctc

SEQ ID NO: 373916 - DNA, 25 bp, Mus musculus
ctcatttgtccctcggagagttata

SEQ ID NO: 373917 - DNA, 25 bp, Mus musculus
ctcatttgtccctgtattttctctc

SEQ ID NO: 373918 - DNA, 25 bp, Mus musculus
ctcatttgttaacattgtagtcctt

SEQ ID NO: 373919 - DNA, 25 bp, Mus musculus
ctcatttgttaagattgtagtcctt

SEQ ID NO: 373920 - DNA, 25 bp, Mus musculus
ctcattttagctcgttatctgcaaa

SEQ ID NO: 373921 - DNA, 25 bp, Mus musculus
ctcattttagctggttatctgcaaa

SEQ ID NO: 373922 - DNA, 25 bp, Mus musculus
ctcattttatcaatccctattcttg

SEQ ID NO: 373923 - DNA, 25 bp, Mus musculus
ctcattttatcattccctattcttg

SEQ ID NO: 373924 - DNA, 25 bp, Mus musculus
ctcattttatgcagtggaccccatg

SEQ ID NO: 373925 - DNA, 25 bp, Mus musculus
ctcattttatgctgtggaccccatg

SEQ ID NO: 373926 - DNA, 25 bp, Mus musculus
ctcattttattcatcaaggaatgca

SEQ ID NO: 373927 - DNA, 25 bp, Mus musculus
ctcattttattcttcaaggaatgca

SEQ ID NO: 373928 - DNA, 25 bp, Mus musculus
ctcattttccaacaagcattacaag

SEQ ID NO: 373929 - DNA, 25 bp, Mus musculus
ctcattttccaaccatcctttttat

SEQ ID NO: 373930 - DNA, 25 bp, Mus musculus
ctcattttccaagaagcattacaag

SEQ ID NO: 373931 - DNA, 25 bp, Mus musculus
ctcattttccaagcatcctttttat

SEQ ID NO: 373932 - DNA, 25 bp, Mus musculus
ctcattttgatactgcacatttcag

SEQ ID NO: 373933 - DNA, 25 bp, Mus musculus
ctcattttgatagtgcacatttcag

SEQ ID NO: 373934 - DNA, 25 bp, Mus musculus
ctcattttgggcactgttacctaca

SEQ ID NO: 373935 - DNA, 25 bp, Mus musculus
ctcattttgggctctgttacctaca

SEQ ID NO: 373936 - DNA, 25 bp, Mus musculus
ctcatttttgagacgtttatagaat

SEQ ID NO: 373937 - DNA, 25 bp, Mus musculus
ctcatttttgagtcgtttatagaat

SEQ ID NO: 373938 - DNA, 25 bp, Mus musculus
ctccaaaaagttccccgtagatgtt

SEQ ID NO: 373939 - DNA, 25 bp, Mus musculus
ctccaaaaagttgcccgtagatgtt

SEQ ID NO: 373940 - DNA, 25 bp, Mus musculus
ctccaaaactgtccgacctgaagta

SEQ ID NO: 373941 - DNA, 25 bp, Mus musculus
ctccaaaactgtgcgacctgaagta

SEQ ID NO: 373942 - DNA, 25 bp, Mus musculus
ctccaaaccactagacttcatcaat

SEQ ID NO: 373943 - DNA, 25 bp, Mus musculus
ctccaaaccacttgacttcatcaat

SEQ ID NO: 373944 - DNA, 25 bp, Mus musculus
ctccaaaccttgcagcaggatgctt

SEQ ID NO: 373945 - DNA, 25 bp, Mus musculus
ctccaaaccttggagcaggatgctt

SEQ ID NO: 373946 - DNA, 25 bp, Mus musculus
ctccaaagaagtacattgctgacct

SEQ ID NO: 373947 - DNA, 25 bp, Mus musculus
ctccaaagaagttcattgctgacct

SEQ ID NO: 373948 - DNA, 25 bp, Mus musculus
ctccaaatgcccaaggtctagctct

SEQ ID NO: 373949 - DNA, 25 bp, Mus musculus
ctccaaatgccctaggtctagctct

SEQ ID NO: 373950 - DNA, 25 bp, Mus musculus
ctccaaatggaacgaaacatgctct

SEQ ID NO: 373951 - DNA, 25 bp, Mus musculus
ctccaaatggaaggaaacatgctct

SEQ ID NO: 373952 - DNA, 25 bp, Mus musculus
ctccaacaatatatcagtgcttctg

SEQ ID NO: 373953 - DNA, 25 bp, Mus musculus
ctccaacaatatttcagtgcttctg

SEQ ID NO: 373954 - DNA, 25 bp, Mus musculus
ctccaacacataactgggcacttga

SEQ ID NO: 373955 - DNA, 25 bp, Mus musculus
ctccaacacatatctgggcacttga

SEQ ID NO: 373956 - DNA, 25 bp, Mus musculus
ctccaacagggccactccttgtagt

SEQ ID NO: 373957 - DNA, 25 bp, Mus musculus
ctccaacagggcgactccttgtagt

SEQ ID NO: 373958 - DNA, 25 bp, Mus musculus
ctccaacaggttcagctcatatata

SEQ ID NO: 373959 - DNA, 25 bp, Mus musculus
ctccaacaggttgagctcatatata

SEQ ID NO: 373960 - DNA, 25 bp, Mus musculus
ctccaacagtctcatctcactttgg

SEQ ID NO: 373961 - DNA, 25 bp, Mus musculus
ctccaacagtctgatctcactttgg

SEQ ID NO: 373962 - DNA, 25 bp, Mus musculus
ctccaaccaggaaagaaaaccatgg

SEQ ID NO: 373963 - DNA, 25 bp, Mus musculus
ctccaaccaggatagaaaaccatgg

SEQ ID NO: 373964 - DNA, 25 bp, Mus musculus
ctccaacctcttatactctttgagt

SEQ ID NO: 373965 - DNA, 25 bp, Mus musculus
ctccaacctcttttactctttgagt

SEQ ID NO: 373966 - DNA, 25 bp, Mus musculus
ctccaacgtaacagcaatttaatgt

SEQ ID NO: 373967 - DNA, 25 bp, Mus musculus
ctccaacgtaactgcaatttaatgt

SEQ ID NO: 373968 - DNA, 25 bp, Mus musculus
ctccaacgtggacttgatgccctaa

SEQ ID NO: 373969 - DNA, 25 bp, Mus musculus
ctccaacgtggagttgatgccctaa

SEQ ID NO: 373970 - DNA, 25 bp, Mus musculus
ctccaactggttctttatgcacaag

SEQ ID NO: 373971 - DNA, 25 bp, Mus musculus
ctccaactggttgtttatgcacaag

SEQ ID NO: 373972 - DNA, 25 bp, Mus musculus
ctccaactttccacctgagactgga

SEQ ID NO: 373973 - DNA, 25 bp, Mus musculus
ctccaactttcctcctgagactgga

SEQ ID NO: 373974 - DNA, 25 bp, Mus musculus
ctccaagatctgaggctcgccaagt

SEQ ID NO: 373975 - DNA, 25 bp, Mus musculus
ctccaagatctgtggctcgccaagt

SEQ ID NO: 373976 - DNA, 25 bp, Mus musculus
ctccaagcaccccattcagaagatg

SEQ ID NO: 373977 - DNA, 25 bp, Mus musculus
ctccaagcacccgattcagaagatg

SEQ ID NO: 373978 - DNA, 25 bp, Mus musculus
ctccaagccaggatgagctagaagt

SEQ ID NO: 373979 - DNA, 25 bp, Mus musculus
ctccaagccaggttgagctagaagt

SEQ ID NO: 373980 - DNA, 25 bp, Mus musculus
ctccaagccctgacggaaggtccga

SEQ ID NO: 373981 - DNA, 25 bp, Mus musculus
ctccaagccctgtcggaaggtccga

SEQ ID NO: 373982 - DNA, 25 bp, Mus musculus
ctccaagctgacacgtcctcattaa

SEQ ID NO: 373983 - DNA, 25 bp, Mus musculus
ctccaagctgactcgtcctcattaa

SEQ ID NO: 373984 - DNA, 25 bp, Mus musculus
ctccaagcttagagacctcagtttg

SEQ ID NO: 373985 - DNA, 25 bp, Mus musculus
ctccaagcttagtgacctcagtttg

SEQ ID NO: 373986 - DNA, 25 bp, Mus musculus
ctccaagcttttcatcctactataa

SEQ ID NO: 373987 - DNA, 25 bp, Mus musculus
ctccaagcttttgatcctactataa

SEQ ID NO: 373988 - DNA, 25 bp, Mus musculus
ctccaaggaaccacatcatatggcc

SEQ ID NO: 373989 - DNA, 25 bp, Mus musculus
ctccaaggaacctcatcatatggcc

SEQ ID NO: 373990 - DNA, 25 bp, Mus musculus
ctccaaggacaccaggcttgtatat

SEQ ID NO: 373991 - DNA, 25 bp, Mus musculus
ctccaaggacacgaggcttgtatat

SEQ ID NO: 373992 - DNA, 25 bp, Mus musculus
ctccaaggacgcagaggcagcagac

SEQ ID NO: 373993 - DNA, 25 bp, Mus musculus
ctccaaggacgctgaggcagcagac

SEQ ID NO: 373994 - DNA, 25 bp, Mus musculus
ctccaaggaggtcgacagctgtcct

SEQ ID NO: 373995 - DNA, 25 bp, Mus musculus
ctccaaggaggtggacagctgtcct

SEQ ID NO: 373996 - DNA, 25 bp, Mus musculus
ctccaaggatgccaggtaaacatgt

SEQ ID NO: 373997 - DNA, 25 bp, Mus musculus
ctccaaggatgcgaggtaaacatgt

SEQ ID NO: 373998 - DNA, 25 bp, Mus musculus
ctccaaggcagcatctagcaggaca

SEQ ID NO: 373999 - DNA, 25 bp, Mus musculus
ctccaaggcagcttctagcaggaca

SEQ ID NO: 374000 - DNA, 25 bp, Mus musculus
ctccaaggtcctatgtctatatcaa

SEQ ID NO: 374001 - DNA, 25 bp, Mus musculus
ctccaaggtcctttgtctatatcaa

SEQ ID NO: 374002 - DNA, 25 bp, Mus musculus
ctccaaggtgaccaggcttaaatcg

SEQ ID NO: 374003 - DNA, 25 bp, Mus musculus
ctccaaggtgacgaggcttaaatcg

SEQ ID NO: 374004 - DNA, 25 bp, Mus musculus
ctccaaggtttgaaggtaatttgtg

SEQ ID NO: 374005 - DNA, 25 bp, Mus musculus
ctccaaggtttgtaggtaatttgtg

SEQ ID NO: 374006 - DNA, 25 bp, Mus musculus
ctccaagttctacactagcctggtc

SEQ ID NO: 374007 - DNA, 25 bp, Mus musculus
ctccaagttctagactagcctggtc

SEQ ID NO: 374008 - DNA, 25 bp, Mus musculus
ctccaatagaatcgtgtcacccgat

SEQ ID NO: 374009 - DNA, 25 bp, Mus musculus
ctccaatagaatggtgtcacccgat

SEQ ID NO: 374010 - DNA, 25 bp, Mus musculus
ctccaatattctaacttagttccat

SEQ ID NO: 374011 - DNA, 25 bp, Mus musculus
ctccaatattcttacttagttccat

SEQ ID NO: 374012 - DNA, 25 bp, Mus musculus
ctccaatccctcaacattatttttt

SEQ ID NO: 374013 - DNA, 25 bp, Mus musculus
ctccaatccctctacattatttttt

SEQ ID NO: 374014 - DNA, 25 bp, Mus musculus
ctccaatccgttcaagaatttatac

SEQ ID NO: 374015 - DNA, 25 bp, Mus musculus
ctccaatccgttgaagaatttatac

SEQ ID NO: 374016 - DNA, 25 bp, Mus musculus
ctccaatccttcagttcatcaggag

SEQ ID NO: 374017 - DNA, 25 bp, Mus musculus
ctccaatccttctgttcatcaggag

SEQ ID NO: 374018 - DNA, 25 bp, Mus musculus
ctccaatgatgcctgaatccacgta

SEQ ID NO: 374019 - DNA, 25 bp, Mus musculus
ctccaatgatgcgtgaatccacgta

SEQ ID NO: 374020 - DNA, 25 bp, Mus musculus
ctccaatggccgagtttctgtaaag

SEQ ID NO: 374021 - DNA, 25 bp, Mus musculus
ctccaatggccgtgtttctgtaaag

SEQ ID NO: 374022 - DNA, 25 bp, Mus musculus
ctccaatggcctagaagtctctgct

SEQ ID NO: 374023 - DNA, 25 bp, Mus musculus
ctccaatggccttgaagtctctgct

SEQ ID NO: 374024 - DNA, 25 bp, Mus musculus
ctccaatgtgccagctgtttcagaa

SEQ ID NO: 374025 - DNA, 25 bp, Mus musculus
ctccaatgtgcctgctgtttcagaa

SEQ ID NO: 374026 - DNA, 25 bp, Mus musculus
ctccaatgtggtcctagcctaggtg

SEQ ID NO: 374027 - DNA, 25 bp, Mus musculus
ctccaatgtggtgctagcctaggtg

SEQ ID NO: 374028 - DNA, 25 bp, Mus musculus
ctccaatttctcagaccattctagt

SEQ ID NO: 374029 - DNA, 25 bp, Mus musculus
ctccaatttctctgaccattctagt

SEQ ID NO: 374030 - DNA, 25 bp, Mus musculus
ctccaatttttacaggtcatgctaa

SEQ ID NO: 374031 - DNA, 25 bp, Mus musculus
ctccaatttttagaggtcatgctaa

SEQ ID NO: 374032 - DNA, 25 bp, Mus musculus
ctccacaaaagtccaagctcttttt

SEQ ID NO: 374033 - DNA, 25 bp, Mus musculus
ctccacaaaagtgcaagctcttttt

SEQ ID NO: 374034 - DNA, 25 bp, Mus musculus
ctccacaacaatacctatgcctaaa

SEQ ID NO: 374035 - DNA, 25 bp, Mus musculus
ctccacaacaattcctatgcctaaa

SEQ ID NO: 374036 - DNA, 25 bp, Mus musculus
ctccacaagtccatctggcatgaat

SEQ ID NO: 374037 - DNA, 25 bp, Mus musculus
ctccacaagtccttctggcatgaat

SEQ ID NO: 374038 - DNA, 25 bp, Mus musculus
ctccacacacggctgaggttttcaa

SEQ ID NO: 374039 - DNA, 25 bp, Mus musculus
ctccacacacgggtgaggttttcaa

SEQ ID NO: 374040 - DNA, 25 bp, Mus musculus
ctccacacagacatcatggccaaga

SEQ ID NO: 374041 - DNA, 25 bp, Mus musculus
ctccacacagacttcatggccaaga

SEQ ID NO: 374042 - DNA, 25 bp, Mus musculus
ctccacaccagtatcgaattcacag

SEQ ID NO: 374043 - DNA, 25 bp, Mus musculus
ctccacaccagtttcgaattcacag

SEQ ID NO: 374044 - DNA, 25 bp, Mus musculus
ctccacacccctaataagcaggaaa

SEQ ID NO: 374045 - DNA, 25 bp, Mus musculus
ctccacaccccttataagcaggaaa

SEQ ID NO: 374046 - DNA, 25 bp, Mus musculus
ctccacacttctcgaattttctttc

SEQ ID NO: 374047 - DNA, 25 bp, Mus musculus
ctccacacttctggaattttctttc

SEQ ID NO: 374048 - DNA, 25 bp, Mus musculus
ctccacacttgtcctttggcaggca

SEQ ID NO: 374049 - DNA, 25 bp, Mus musculus
ctccacacttgtcgtttgtgctaaa

SEQ ID NO: 374050 - DNA, 25 bp, Mus musculus
ctccacacttgtgctttggcaggca

SEQ ID NO: 374051 - DNA, 25 bp, Mus musculus
ctccacacttgtggtttgtgctaaa

SEQ ID NO: 374052 - DNA, 25 bp, Mus musculus
ctccacagatctcacgatgagctat

SEQ ID NO: 374053 - DNA, 25 bp, Mus musculus
ctccacagatctgacgatgagctat

SEQ ID NO: 374054 - DNA, 25 bp, Mus musculus
ctccacagctccataattgttaatg

SEQ ID NO: 374055 - DNA, 25 bp, Mus musculus
ctccacagctccttaattgttaatg

SEQ ID NO: 374056 - DNA, 25 bp, Mus musculus
ctccacaggtatctgcagcattttc

SEQ ID NO: 374057 - DNA, 25 bp, Mus musculus
ctccacaggtatgtgcagcattttc

SEQ ID NO: 374058 - DNA, 25 bp, Mus musculus
ctccacagtcaaagctttcaggtgt

SEQ ID NO: 374059 - DNA, 25 bp, Mus musculus
ctccacagtcaatgctttcaggtgt

SEQ ID NO: 374060 - DNA, 25 bp, Mus musculus
ctccacatgcgtcggcagttatgaa

SEQ ID NO: 374061 - DNA, 25 bp, Mus musculus
ctccacatgcgtgggcagttatgaa

SEQ ID NO: 374062 - DNA, 25 bp, Mus musculus
ctccacatgcttacacaacgtaaaa

SEQ ID NO: 374063 - DNA, 25 bp, Mus musculus
ctccacatgctttcacaacgtaaaa

SEQ ID NO: 374064 - DNA, 25 bp, Mus musculus
ctccacatggaaccatgagcttcgg

SEQ ID NO: 374065 - DNA, 25 bp, Mus musculus
ctccacatggaagcatgagcttcgg

SEQ ID NO: 374066 - DNA, 25 bp, Mus musculus
ctccacatgtgtctagcatatagta

SEQ ID NO: 374067 - DNA, 25 bp, Mus musculus
ctccacatgtgtgtagcatatagta

SEQ ID NO: 374068 - DNA, 25 bp, Mus musculus
ctccacatgtttctagttaatagtg

SEQ ID NO: 374069 - DNA, 25 bp, Mus musculus
ctccacatgtttgtagttaatagtg

SEQ ID NO: 374070 - DNA, 25 bp, Mus musculus
ctccacattcttcttgaagcctttt

SEQ ID NO: 374071 - DNA, 25 bp, Mus musculus
ctccacattcttgttgaagcctttt

SEQ ID NO: 374072 - DNA, 25 bp, Mus musculus
ctccaccacgtaagagtccactgaa

SEQ ID NO: 374073 - DNA, 25 bp, Mus musculus
ctccaccacgtatgagtccactgaa

SEQ ID NO: 374074 - DNA, 25 bp, Mus musculus
ctccaccaggagaatactactttga

SEQ ID NO: 374075 - DNA, 25 bp, Mus musculus
ctccaccaggagtatactactttga

SEQ ID NO: 374076 - DNA, 25 bp, Mus musculus
ctccacccacagcatgttacttagg

SEQ ID NO: 374077 - DNA, 25 bp, Mus musculus
ctccacccacaggatgttacttagg

SEQ ID NO: 374078 - DNA, 25 bp, Mus musculus
ctccacccacatagcactttaaagt

SEQ ID NO: 374079 - DNA, 25 bp, Mus musculus
ctccacccacattgcactttaaagt

SEQ ID NO: 374080 - DNA, 25 bp, Mus musculus
ctccacccatacagaattctacttt

SEQ ID NO: 374081 - DNA, 25 bp, Mus musculus
ctccacccatactgaattctacttt

SEQ ID NO: 374082 - DNA, 25 bp, Mus musculus
ctccacccgcttatatattcattta

SEQ ID NO: 374083 - DNA, 25 bp, Mus musculus
ctccacccgcttttatattcattta

SEQ ID NO: 374084 - DNA, 25 bp, Mus musculus
ctccaccctagaactcgcatggttg

SEQ ID NO: 374085 - DNA, 25 bp, Mus musculus
ctccaccctagatctcgcatggttg

SEQ ID NO: 374086 - DNA, 25 bp, Mus musculus
ctccacccttccaggtcaaaagaag

SEQ ID NO: 374087 - DNA, 25 bp, Mus musculus
ctccacccttcctggtcaaaagaag

SEQ ID NO: 374088 - DNA, 25 bp, Mus musculus
ctccaccgggtgataccaaggcaaa

SEQ ID NO: 374089 - DNA, 25 bp, Mus musculus
ctccaccgggtgttaccaaggcaaa

SEQ ID NO: 374090 - DNA, 25 bp, Mus musculus
ctccacctaggccaggacgaatgag

SEQ ID NO: 374091 - DNA, 25 bp, Mus musculus
ctccacctaggcgaggacgaatgag

SEQ ID NO: 374092 - DNA, 25 bp, Mus musculus
ctccacctcaaacgaattcagatct

SEQ ID NO: 374093 - DNA, 25 bp, Mus musculus
ctccacctcaaaggaattcagatct

SEQ ID NO: 374094 - DNA, 25 bp, Mus musculus
ctccacctccagctgagagtgttaa

SEQ ID NO: 374095 - DNA, 25 bp, Mus musculus
ctccacctccaggtgagagtgttaa

SEQ ID NO: 374096 - DNA, 25 bp, Mus musculus
ctccacctctacaacctaatttatt

SEQ ID NO: 374097 - DNA, 25 bp, Mus musculus
ctccacctctactacctaatttatt

SEQ ID NO: 374098 - DNA, 25 bp, Mus musculus
ctccacctgagtctccaagattagg

SEQ ID NO: 374099 - DNA, 25 bp, Mus musculus
ctccacctgagtgtccaagattagg

SEQ ID NO: 374100 - DNA, 25 bp, Mus musculus
ctccacctgctgataaagatattaa

SEQ ID NO: 374101 - DNA, 25 bp, Mus musculus
ctccacctgctgttaaagatattaa

SEQ ID NO: 374102 - DNA, 25 bp, Mus musculus
ctccacctggcaccgtagggtaagg

SEQ ID NO: 374103 - DNA, 25 bp, Mus musculus
ctccacctggcagcgtagggtaagg

SEQ ID NO: 374104 - DNA, 25 bp, Mus musculus
ctccacctggctagcagacaaactg

SEQ ID NO: 374105 - DNA, 25 bp, Mus musculus
ctccacctggcttgcagacaaactg

SEQ ID NO: 374106 - DNA, 25 bp, Mus musculus
ctccaccttctgaatgttagttagg

SEQ ID NO: 374107 - DNA, 25 bp, Mus musculus
ctccaccttctgtatgttagttagg

SEQ ID NO: 374108 - DNA, 25 bp, Mus musculus
ctccaccttttcacgtcttataaag

SEQ ID NO: 374109 - DNA, 25 bp, Mus musculus
ctccaccttttctcgtcttataaag

SEQ ID NO: 374110 - DNA, 25 bp, Mus musculus
ctccacgaggagatcgagcacctga

SEQ ID NO: 374111 - DNA, 25 bp, Mus musculus
ctccacgaggagttcgagcacctga

SEQ ID NO: 374112 - DNA, 25 bp, Mus musculus
ctccacggatgtagctgaccaaagc

SEQ ID NO: 374113 - DNA, 25 bp, Mus musculus
ctccacggatgttgctgaccaaagc

SEQ ID NO: 374114 - DNA, 25 bp, Mus musculus
ctccacgggaagcttctcttttata

SEQ ID NO: 374115 - DNA, 25 bp, Mus musculus
ctccacgggaaggttctcttttata

SEQ ID NO: 374116 - DNA, 25 bp, Mus musculus
ctccacggtgcgcatgcgcagagag

SEQ ID NO: 374117 - DNA, 25 bp, Mus musculus
ctccacggtgcggatgcgcagagag

SEQ ID NO: 374118 - DNA, 25 bp, Mus musculus
ctccacgtccctctgaatggaagat

SEQ ID NO: 374119 - DNA, 25 bp, Mus musculus
ctccacgtccctgtgaatggaagat

SEQ ID NO: 374120 - DNA, 25 bp, Mus musculus
ctccacgtgcacagacatttgttca

SEQ ID NO: 374121 - DNA, 25 bp, Mus musculus
ctccacgtgcactgacatttgttca

SEQ ID NO: 374122 - DNA, 25 bp, Mus musculus
ctccacgtggctctagaaggcgtgc

SEQ ID NO: 374123 - DNA, 25 bp, Mus musculus
ctccacgtggctgtagaaggcgtgc

SEQ ID NO: 374124 - DNA, 25 bp, Mus musculus
ctccactacggacacccttgttggg

SEQ ID NO: 374125 - DNA, 25 bp, Mus musculus
ctccactacggagacccttgttggg

SEQ ID NO: 374126 - DNA, 25 bp, Mus musculus
ctccactcacggcaaattcaacggc

SEQ ID NO: 374127 - DNA, 25 bp, Mus musculus
ctccactcacgggaaattcaacggc

SEQ ID NO: 374128 - DNA, 25 bp, Mus musculus
ctccactcccacatagaggactgtg

SEQ ID NO: 374129 - DNA, 25 bp, Mus musculus
ctccactcccacttagaggactgtg

SEQ ID NO: 374130 - DNA, 25 bp, Mus musculus
ctccactgccctatttagtcatgag

SEQ ID NO: 374131 - DNA, 25 bp, Mus musculus
ctccactgccctttttagtcatgag

SEQ ID NO: 374132 - DNA, 25 bp, Mus musculus
ctccactggcaccaaacatacaggt

SEQ ID NO: 374133 - DNA, 25 bp, Mus musculus
ctccactggcacgaaacatacaggt

SEQ ID NO: 374134 - DNA, 25 bp, Mus musculus
ctccactgtgttatgcagactaact

SEQ ID NO: 374135 - DNA, 25 bp, Mus musculus
ctccactgtgttttgcagactaact

SEQ ID NO: 374136 - DNA, 25 bp, Mus musculus
ctccactgtttaccttagcactaaa

SEQ ID NO: 374137 - DNA, 25 bp, Mus musculus
ctccactgtttagcttagcactaaa

SEQ ID NO: 374138 - DNA, 25 bp, Mus musculus
ctccacttctaccaacttgacctac

SEQ ID NO: 374139 - DNA, 25 bp, Mus musculus
ctccacttctacgaacttgacctac

SEQ ID NO: 374140 - DNA, 25 bp, Mus musculus
ctccacttctatatgccaggaacaa

SEQ ID NO: 374141 - DNA, 25 bp, Mus musculus
ctccacttctatcagggcacagaaa

SEQ ID NO: 374142 - DNA, 25 bp, Mus musculus
ctccacttctatgagggcacagaaa

SEQ ID NO: 374143 - DNA, 25 bp, Mus musculus
ctccacttctatttgccaggaacaa

SEQ ID NO: 374144 - DNA, 25 bp, Mus musculus
ctccacttcttcagcaattgcattt

SEQ ID NO: 374145 - DNA, 25 bp, Mus musculus
ctccacttcttctgcaattgcattt

SEQ ID NO: 374146 - DNA, 25 bp, Mus musculus
ctccacttgaggatagacccagcag

SEQ ID NO: 374147 - DNA, 25 bp, Mus musculus
ctccacttgaggttagacccagcag

SEQ ID NO: 374148 - DNA, 25 bp, Mus musculus
ctccacttttgtatacttgatgctt

SEQ ID NO: 374149 - DNA, 25 bp, Mus musculus
ctccacttttgtttacttgatgctt

SEQ ID NO: 374150 - DNA, 25 bp, Mus musculus
ctccagaaaattacgtgctgtggtt

SEQ ID NO: 374151 - DNA, 25 bp, Mus musculus
ctccagaaaatttcgtgctgtggtt

SEQ ID NO: 374152 - DNA, 25 bp, Mus musculus
ctccagaagacgactggcctcgaga

SEQ ID NO: 374153 - DNA, 25 bp, Mus musculus
ctccagaagacgtctggcctcgaga

SEQ ID NO: 374154 - DNA, 25 bp, Mus musculus
ctccagaaggtgctgatgacagcct

SEQ ID NO: 374155 - DNA, 25 bp, Mus musculus
ctccagaaggtggtgatgacagcct

SEQ ID NO: 374156 - DNA, 25 bp, Mus musculus
ctccagacagaacctcagggtgtgt

SEQ ID NO: 374157 - DNA, 25 bp, Mus musculus
ctccagacagaagctcagggtgtgt

SEQ ID NO: 374158 - DNA, 25 bp, Mus musculus
ctccagaccagcaccttaaagtgat

SEQ ID NO: 374159 - DNA, 25 bp, Mus musculus
ctccagaccagctccttaaagtgat

SEQ ID NO: 374160 - DNA, 25 bp, Mus musculus
ctccagaccttgctgtgggctattc

SEQ ID NO: 374161 - DNA, 25 bp, Mus musculus
ctccagaccttggtgtgggctattc

SEQ ID NO: 374162 - DNA, 25 bp, Mus musculus
ctccagacgaggcaccagatttgta

SEQ ID NO: 374163 - DNA, 25 bp, Mus musculus
ctccagacgagggaccagatttgta

SEQ ID NO: 374164 - DNA, 25 bp, Mus musculus
ctccagactaaacggacaggtccca

SEQ ID NO: 374165 - DNA, 25 bp, Mus musculus
ctccagactaaagggacaggtccca

SEQ ID NO: 374166 - DNA, 25 bp, Mus musculus
ctccagacttggctgctgctagaaa

SEQ ID NO: 374167 - DNA, 25 bp, Mus musculus
ctccagacttgggtgctgctagaaa

SEQ ID NO: 374168 - DNA, 25 bp, Mus musculus
ctccagagatcaacgtcagtgacgt

SEQ ID NO: 374169 - DNA, 25 bp, Mus musculus
ctccagagatcatcgtcagtgacgt

SEQ ID NO: 374170 - DNA, 25 bp, Mus musculus
ctccagagcaccacagggacactgt

SEQ ID NO: 374171 - DNA, 25 bp, Mus musculus
ctccagagcacctcagggacactgt

SEQ ID NO: 374172 - DNA, 25 bp, Mus musculus
ctccagagctttagctgggtgtgtt

SEQ ID NO: 374173 - DNA, 25 bp, Mus musculus
ctccagagcttttgctgggtgtgtt

SEQ ID NO: 374174 - DNA, 25 bp, Mus musculus
ctccagagtcagcatcatgtgctcc

SEQ ID NO: 374175 - DNA, 25 bp, Mus musculus
ctccagagtcaggatcatgtgctcc

SEQ ID NO: 374176 - DNA, 25 bp, Mus musculus
ctccagatcctgaggtgggccgtga

SEQ ID NO: 374177 - DNA, 25 bp, Mus musculus
ctccagatcctgtggtgggccgtga

SEQ ID NO: 374178 - DNA, 25 bp, Mus musculus
ctccagatttagacagacagcacat

SEQ ID NO: 374179 - DNA, 25 bp, Mus musculus
ctccagatttagtcagacagcacat

SEQ ID NO: 374180 - DNA, 25 bp, Mus musculus
ctccagcaaactcaccaagcagttt

SEQ ID NO: 374181 - DNA, 25 bp, Mus musculus
ctccagcaaactgaccaagcagttt

SEQ ID NO: 374182 - DNA, 25 bp, Mus musculus
ctccagcacagcaccaggcaggttg

SEQ ID NO: 374183 - DNA, 25 bp, Mus musculus
ctccagcacagctccaggcaggttg

SEQ ID NO: 374184 - DNA, 25 bp, Mus musculus
ctccagcacctgagtaagtgcagaa

SEQ ID NO: 374185 - DNA, 25 bp, Mus musculus
ctccagcacctgtgtaagtgcagaa

SEQ ID NO: 374186 - DNA, 25 bp, Mus musculus
ctccagcagaggcataatccagata

SEQ ID NO: 374187 - DNA, 25 bp, Mus musculus
ctccagcagagggataatccagata

SEQ ID NO: 374188 - DNA, 25 bp, Mus musculus
ctccagcaggaactacctttctgaa

SEQ ID NO: 374189 - DNA, 25 bp, Mus musculus
ctccagcaggaagtacctttctgaa

SEQ ID NO: 374190 - DNA, 25 bp, Mus musculus
ctccagcatcctaattttttcctta

SEQ ID NO: 374191 - DNA, 25 bp, Mus musculus
ctccagcatccttattttttcctta

SEQ ID NO: 374192 - DNA, 25 bp, Mus musculus
ctccagccacctacagatagacaag

SEQ ID NO: 374193 - DNA, 25 bp, Mus musculus
ctccagccaccttcagatagacaag

SEQ ID NO: 374194 - DNA, 25 bp, Mus musculus
ctccagcccatgacagattatttaa

SEQ ID NO: 374195 - DNA, 25 bp, Mus musculus
ctccagcccatgtcagattatttaa

SEQ ID NO: 374196 - DNA, 25 bp, Mus musculus
ctccagcccctactgaaggtattat

SEQ ID NO: 374197 - DNA, 25 bp, Mus musculus
ctccagcccctagtgaaggtattat

SEQ ID NO: 374198 - DNA, 25 bp, Mus musculus
ctccagccctatctagaggaataat

SEQ ID NO: 374199 - DNA, 25 bp, Mus musculus
ctccagccctatgtagaggaataat

SEQ ID NO: 374200 - DNA, 25 bp, Mus musculus
ctccagccgtctctaggctctggga

SEQ ID NO: 374201 - DNA, 25 bp, Mus musculus
ctccagccgtctgtaggctctggga

SEQ ID NO: 374202 - DNA, 25 bp, Mus musculus
ctccagcctagtcaaatacccttaa

SEQ ID NO: 374203 - DNA, 25 bp, Mus musculus
ctccagcctagtgaaatacccttaa

SEQ ID NO: 374204 - DNA, 25 bp, Mus musculus
ctccagcctcctaacaagatgtatt

SEQ ID NO: 374205 - DNA, 25 bp, Mus musculus
ctccagcctccttacaagatgtatt

SEQ ID NO: 374206 - DNA, 25 bp, Mus musculus
ctccagcctcttataatcttcattt

SEQ ID NO: 374207 - DNA, 25 bp, Mus musculus
ctccagcctcttttaatcttcattt

SEQ ID NO: 374208 - DNA, 25 bp, Mus musculus
ctccagcctggactccgaggtatga

SEQ ID NO: 374209 - DNA, 25 bp, Mus musculus
ctccagcctggagtccgaggtatga

SEQ ID NO: 374210 - DNA, 25 bp, Mus musculus
ctccagcctgtcagtacttaatggc

SEQ ID NO: 374211 - DNA, 25 bp, Mus musculus
ctccagcctgtctgtacttaatggc

SEQ ID NO: 374212 - DNA, 25 bp, Mus musculus
ctccagcctgttctgggaggcacag

SEQ ID NO: 374213 - DNA, 25 bp, Mus musculus
ctccagcctgttgtgggaggcacag

SEQ ID NO: 374214 - DNA, 25 bp, Mus musculus
ctccagccttcaagggactacttac

SEQ ID NO: 374215 - DNA, 25 bp, Mus musculus
ctccagccttcatgggactacttac

SEQ ID NO: 374216 - DNA, 25 bp, Mus musculus
ctccagctaggcctgtcaatttttt

SEQ ID NO: 374217 - DNA, 25 bp, Mus musculus
ctccagctaggcgtgtcaatttttt

SEQ ID NO: 374218 - DNA, 25 bp, Mus musculus
ctccagctagtcatgtgcacaatgt

SEQ ID NO: 374219 - DNA, 25 bp, Mus musculus
ctccagctagtcttgtgcacaatgt

SEQ ID NO: 374220 - DNA, 25 bp, Mus musculus
ctccagctatacagcagaatgaggt

SEQ ID NO: 374221 - DNA, 25 bp, Mus musculus
ctccagctatactgcagaatgaggt

SEQ ID NO: 374222 - DNA, 25 bp, Mus musculus
ctccagctccacatgtttctagtta

SEQ ID NO: 374223 - DNA, 25 bp, Mus musculus
ctccagctccacttgtttctagtta

SEQ ID NO: 374224 - DNA, 25 bp, Mus musculus
ctccagctccagaaaagctactcat

SEQ ID NO: 374225 - DNA, 25 bp, Mus musculus
ctccagctccagtaaagctactcat

SEQ ID NO: 374226 - DNA, 25 bp, Mus musculus
ctccagctcctcagtatgagagatt

SEQ ID NO: 374227 - DNA, 25 bp, Mus musculus
ctccagctcctctgtatgagagatt

SEQ ID NO: 374228 - DNA, 25 bp, Mus musculus
ctccagctctggctaacactaaggg

SEQ ID NO: 374229 - DNA, 25 bp, Mus musculus
ctccagctctgggtaacactaaggg

SEQ ID NO: 374230 - DNA, 25 bp, Mus musculus
ctccagctgcaccaacaagtagaaa

SEQ ID NO: 374231 - DNA, 25 bp, Mus musculus
ctccagctgcacgaacaagtagaaa

SEQ ID NO: 374232 - DNA, 25 bp, Mus musculus
ctccagctggctatatggctagaat

SEQ ID NO: 374233 - DNA, 25 bp, Mus musculus
ctccagctggctttatggctagaat

SEQ ID NO: 374234 - DNA, 25 bp, Mus musculus
ctccagctgggactcctaatgcaga

SEQ ID NO: 374235 - DNA, 25 bp, Mus musculus
ctccagctgggagtcctaatgcaga

SEQ ID NO: 374236 - DNA, 25 bp, Mus musculus
ctccagctttccacgatgattaaat

SEQ ID NO: 374237 - DNA, 25 bp, Mus musculus
ctccagctttcctcgatgattaaat

SEQ ID NO: 374238 - DNA, 25 bp, Mus musculus
ctccagctttgacatagcggcacaa

SEQ ID NO: 374239 - DNA, 25 bp, Mus musculus
ctccagctttgagatagcggcacaa

SEQ ID NO: 374240 - DNA, 25 bp, Mus musculus
ctccagctttgtccctttttggaaa

SEQ ID NO: 374241 - DNA, 25 bp, Mus musculus
ctccagctttgtgcctttttggaaa

SEQ ID NO: 374242 - DNA, 25 bp, Mus musculus
ctccaggaagtcaatagctcaggct

SEQ ID NO: 374243 - DNA, 25 bp, Mus musculus
ctccaggaagtctatagctcaggct

SEQ ID NO: 374244 - DNA, 25 bp, Mus musculus
ctccaggacatgacctagctcaggg

SEQ ID NO: 374245 - DNA, 25 bp, Mus musculus
ctccaggacatgtcctagctcaggg

SEQ ID NO: 374246 - DNA, 25 bp, Mus musculus
ctccaggagaaacagctagtgctca

SEQ ID NO: 374247 - DNA, 25 bp, Mus musculus
ctccaggagaaagagctagtgctca

SEQ ID NO: 374248 - DNA, 25 bp, Mus musculus
ctccaggagcatctggaacccgtta

SEQ ID NO: 374249 - DNA, 25 bp, Mus musculus
ctccaggagcatgtggaacccgtta

SEQ ID NO: 374250 - DNA, 25 bp, Mus musculus
ctccaggaggctatggcgaaagcga

SEQ ID NO: 374251 - DNA, 25 bp, Mus musculus
ctccaggaggctttggcgaaagcga

SEQ ID NO: 374252 - DNA, 25 bp, Mus musculus
ctccaggatttcactgacttgattt

SEQ ID NO: 374253 - DNA, 25 bp, Mus musculus
ctccaggatttctctgacttgattt

SEQ ID NO: 374254 - DNA, 25 bp, Mus musculus
ctccaggcaggaatctttgtttctt

SEQ ID NO: 374255 - DNA, 25 bp, Mus musculus
ctccaggcaggattctttgtttctt

SEQ ID NO: 374256 - DNA, 25 bp, Mus musculus
ctccaggccagtcagatctatgtag

SEQ ID NO: 374257 - DNA, 25 bp, Mus musculus
ctccaggccagtgagatctatgtag

SEQ ID NO: 374258 - DNA, 25 bp, Mus musculus
ctccaggccatgcataagaggctgt

SEQ ID NO: 374259 - DNA, 25 bp, Mus musculus
ctccaggccatggataagaggctgt

SEQ ID NO: 374260 - DNA, 25 bp, Mus musculus
ctccaggcccctaggagaaagggct

SEQ ID NO: 374261 - DNA, 25 bp, Mus musculus
ctccaggccccttggagaaagggct

SEQ ID NO: 374262 - DNA, 25 bp, Mus musculus
ctccaggccctcattgctacagagg

SEQ ID NO: 374263 - DNA, 25 bp, Mus musculus
ctccaggccctctttgctacagagg

SEQ ID NO: 374264 - DNA, 25 bp, Mus musculus
ctccaggcctaaacacggttttcag

SEQ ID NO: 374265 - DNA, 25 bp, Mus musculus
ctccaggcctaatcacggttttcag

SEQ ID NO: 374266 - DNA, 25 bp, Mus musculus
ctccaggctaaaaaacacttacatt

SEQ ID NO: 374267 - DNA, 25 bp, Mus musculus
ctccaggctaaataacacttacatt

SEQ ID NO: 374268 - DNA, 25 bp, Mus musculus
ctccaggctgcaacatatatcataa

SEQ ID NO: 374269 - DNA, 25 bp, Mus musculus
ctccaggctgcatcatatatcataa

SEQ ID NO: 374270 - DNA, 25 bp, Mus musculus
ctccaggctgctagttacttgggca

SEQ ID NO: 374271 - DNA, 25 bp, Mus musculus
ctccaggctgcttgttacttgggca

SEQ ID NO: 374272 - DNA, 25 bp, Mus musculus
ctccagggactgctattctgcagag

SEQ ID NO: 374273 - DNA, 25 bp, Mus musculus
ctccagggactggtattctgcagag

SEQ ID NO: 374274 - DNA, 25 bp, Mus musculus
ctccagggagatagtgcagcagctg

SEQ ID NO: 374275 - DNA, 25 bp, Mus musculus
ctccagggagattgtgcagcagctg

SEQ ID NO: 374276 - DNA, 25 bp, Mus musculus
ctccagggaggtcacgccaggcaaa

SEQ ID NO: 374277 - DNA, 25 bp, Mus musculus
ctccagggaggtgacgccaggcaaa

SEQ ID NO: 374278 - DNA, 25 bp, Mus musculus
ctccagggctggaattgcagtgcgt

SEQ ID NO: 374279 - DNA, 25 bp, Mus musculus
ctccagggctggtattgcagtgcgt

SEQ ID NO: 374280 - DNA, 25 bp, Mus musculus
ctccaggtctctacctaactcttgt

SEQ ID NO: 374281 - DNA, 25 bp, Mus musculus
ctccaggtctcttcctaactcttgt

SEQ ID NO: 374282 - DNA, 25 bp, Mus musculus
ctccaggtcttgctctctagaggtg

SEQ ID NO: 374283 - DNA, 25 bp, Mus musculus
ctccaggtcttggtctctagaggtg

SEQ ID NO: 374284 - DNA, 25 bp, Mus musculus
ctccaggtggaacggctcagtgatc

SEQ ID NO: 374285 - DNA, 25 bp, Mus musculus
ctccaggtggaagggctcagtgatc

SEQ ID NO: 374286 - DNA, 25 bp, Mus musculus
ctccaggtgggcaatatccaaagag

SEQ ID NO: 374287 - DNA, 25 bp, Mus musculus
ctccaggtgggcatgagggtcatca

SEQ ID NO: 374288 - DNA, 25 bp, Mus musculus
ctccaggtgggctatatccaaagag

SEQ ID NO: 374289 - DNA, 25 bp, Mus musculus
ctccaggtgggcttgagggtcatca

SEQ ID NO: 374290 - DNA, 25 bp, Mus musculus
ctccaggttcctcatctgttaagag

SEQ ID NO: 374291 - DNA, 25 bp, Mus musculus
ctccaggttcctgatctgttaagag

SEQ ID NO: 374292 - DNA, 25 bp, Mus musculus
ctccaggttgtcctgccacagctgt

SEQ ID NO: 374293 - DNA, 25 bp, Mus musculus
ctccaggttgtcgtgccacagctgt

SEQ ID NO: 374294 - DNA, 25 bp, Mus musculus
ctccaggtttctaccaagatggcta

SEQ ID NO: 374295 - DNA, 25 bp, Mus musculus
ctccaggtttcttccaagatggcta

SEQ ID NO: 374296 - DNA, 25 bp, Mus musculus
ctccaggttttgctctgaactttgt

SEQ ID NO: 374297 - DNA, 25 bp, Mus musculus
ctccaggttttggtctgaactttgt

SEQ ID NO: 374298 - DNA, 25 bp, Mus musculus
ctccagtaaatgacaccacaccgtg

SEQ ID NO: 374299 - DNA, 25 bp, Mus musculus
ctccagtaaatgtcaccacaccgtg

SEQ ID NO: 374300 - DNA, 25 bp, Mus musculus
ctccagtaacaactggatactgtta

SEQ ID NO: 374301 - DNA, 25 bp, Mus musculus
ctccagtaacaagtggatactgtta

SEQ ID NO: 374302 - DNA, 25 bp, Mus musculus
ctccagtaccacattcctttaatta

SEQ ID NO: 374303 - DNA, 25 bp, Mus musculus
ctccagtaccactttcctttaatta

SEQ ID NO: 374304 - DNA, 25 bp, Mus musculus
ctccagtagcccacagacaccagtg

SEQ ID NO: 374305 - DNA, 25 bp, Mus musculus
ctccagtagccctcagacaccagtg

SEQ ID NO: 374306 - DNA, 25 bp, Mus musculus
ctccagtcagagaaagtgtttttgt

SEQ ID NO: 374307 - DNA, 25 bp, Mus musculus
ctccagtcagagtaagtgtttttgt

SEQ ID NO: 374308 - DNA, 25 bp, Mus musculus
ctccagtcagctcaatgttcctact

SEQ ID NO: 374309 - DNA, 25 bp, Mus musculus
ctccagtcagctgaatgttcctact

SEQ ID NO: 374310 - DNA, 25 bp, Mus musculus
ctccagtcccatattttagctcata

SEQ ID NO: 374311 - DNA, 25 bp, Mus musculus
ctccagtcccattttttagctcata

SEQ ID NO: 374312 - DNA, 25 bp, Mus musculus
ctccagtcgggaaatcagtcggtga

SEQ ID NO: 374313 - DNA, 25 bp, Mus musculus
ctccagtcgggatatcagtcggtga

SEQ ID NO: 374314 - DNA, 25 bp, Mus musculus
ctccagtctaaaacctcccaaatag

SEQ ID NO: 374315 - DNA, 25 bp, Mus musculus
ctccagtctaaatcctcccaaatag

SEQ ID NO: 374316 - DNA, 25 bp, Mus musculus
ctccagtctccccagtagagaaatg

SEQ ID NO: 374317 - DNA, 25 bp, Mus musculus
ctccagtctcccgagtagagaaatg

SEQ ID NO: 374318 - DNA, 25 bp, Mus musculus
ctccagtggaatacagctctttgtg

SEQ ID NO: 374319 - DNA, 25 bp, Mus musculus
ctccagtggaattcagctctttgtg

SEQ ID NO: 374320 - DNA, 25 bp, Mus musculus
ctccagtgtaaaattaatatgttca

SEQ ID NO: 374321 - DNA, 25 bp, Mus musculus
ctccagtgtaaatttaatatgttca

SEQ ID NO: 374322 - DNA, 25 bp, Mus musculus
ctccagtgtcatactttgagtttgt

SEQ ID NO: 374323 - DNA, 25 bp, Mus musculus
ctccagtgtcattctttgagtttgt

SEQ ID NO: 374324 - DNA, 25 bp, Mus musculus
ctccagtgtgtcagactttgaggca

SEQ ID NO: 374325 - DNA, 25 bp, Mus musculus
ctccagtgtgtctgactttgaggca

SEQ ID NO: 374326 - DNA, 25 bp, Mus musculus
ctccagtgttagacattcttcattg

SEQ ID NO: 374327 - DNA, 25 bp, Mus musculus
ctccagtgttagtcattcttcattg

SEQ ID NO: 374328 - DNA, 25 bp, Mus musculus
ctccagttaattctttacccagtca

SEQ ID NO: 374329 - DNA, 25 bp, Mus musculus
ctccagttaattgtttacccagtca

SEQ ID NO: 374330 - DNA, 25 bp, Mus musculus
ctccagttcaaacgcacccaataaa

SEQ ID NO: 374331 - DNA, 25 bp, Mus musculus
ctccagttcaaaggcacccaataaa

SEQ ID NO: 374332 - DNA, 25 bp, Mus musculus
ctccagttcaggattgccagtagaa

SEQ ID NO: 374333 - DNA, 25 bp, Mus musculus
ctccagttcaggtttgccagtagaa

SEQ ID NO: 374334 - DNA, 25 bp, Mus musculus
ctccagttccctctgaagagtaact

SEQ ID NO: 374335 - DNA, 25 bp, Mus musculus
ctccagttccctgtgaagagtaact

SEQ ID NO: 374336 - DNA, 25 bp, Mus musculus
ctccagttctagagacctcatctaa

SEQ ID NO: 374337 - DNA, 25 bp, Mus musculus
ctccagttctagtgacctcatctaa

SEQ ID NO: 374338 - DNA, 25 bp, Mus musculus
ctccagttctccatgaggtgaccct

SEQ ID NO: 374339 - DNA, 25 bp, Mus musculus
ctccagttctccttgaggtgaccct

SEQ ID NO: 374340 - DNA, 25 bp, Mus musculus
ctccagttgactaccctggtgaaga

SEQ ID NO: 374341 - DNA, 25 bp, Mus musculus
ctccagttgacttccctggtgaaga

SEQ ID NO: 374342 - DNA, 25 bp, Mus musculus
ctccagttgcttccttctgccgtgg

SEQ ID NO: 374343 - DNA, 25 bp, Mus musculus
ctccagttgcttgcttctgccgtgg

SEQ ID NO: 374344 - DNA, 25 bp, Mus musculus
ctccagtttcttactgctgcctctg

SEQ ID NO: 374345 - DNA, 25 bp, Mus musculus
ctccagtttcttcacctctaaaata

SEQ ID NO: 374346 - DNA, 25 bp, Mus musculus
ctccagtttcttgacctctaaaata

SEQ ID NO: 374347 - DNA, 25 bp, Mus musculus
ctccagtttctttctgctgcctctg

SEQ ID NO: 374348 - DNA, 25 bp, Mus musculus
ctccagtttgacaacgaggcacttg

SEQ ID NO: 374349 - DNA, 25 bp, Mus musculus
ctccagtttgactacgaggcacttg

SEQ ID NO: 374350 - DNA, 25 bp, Mus musculus
ctccagtttgccaggtgatctattt

SEQ ID NO: 374351 - DNA, 25 bp, Mus musculus
ctccagtttgcctggtgatctattt

SEQ ID NO: 374352 - DNA, 25 bp, Mus musculus
ctccagtttgtgataaaggcccctg

SEQ ID NO: 374353 - DNA, 25 bp, Mus musculus
ctccagtttgtgttaaaggcccctg

SEQ ID NO: 374354 - DNA, 25 bp, Mus musculus
ctccataagctgattaaggtactgc

SEQ ID NO: 374355 - DNA, 25 bp, Mus musculus
ctccataagctgtttaaggtactgc

SEQ ID NO: 374356 - DNA, 25 bp, Mus musculus
ctccataaggtgagcaaaacagtat

SEQ ID NO: 374357 - DNA, 25 bp, Mus musculus
ctccataaggtgtgcaaaacagtat

SEQ ID NO: 374358 - DNA, 25 bp, Mus musculus
ctccatacattacagtggtgcccag

SEQ ID NO: 374359 - DNA, 25 bp, Mus musculus
ctccatacattagagtggtgcccag

SEQ ID NO: 374360 - DNA, 25 bp, Mus musculus
ctccatactctgagattccaggctc

SEQ ID NO: 374361 - DNA, 25 bp, Mus musculus
ctccatactctgtgattccaggctc

SEQ ID NO: 374362 - DNA, 25 bp, Mus musculus
ctccataggagcagacttgtgtgtt

SEQ ID NO: 374363 - DNA, 25 bp, Mus musculus
ctccataggagctgacttgtgtgtt

SEQ ID NO: 374364 - DNA, 25 bp, Mus musculus
ctccatatactcaccacacatgtgg

SEQ ID NO: 374365 - DNA, 25 bp, Mus musculus
ctccatatactctccacacatgtgg

SEQ ID NO: 374366 - DNA, 25 bp, Mus musculus
ctccatatatccaagatttgtgcgg

SEQ ID NO: 374367 - DNA, 25 bp, Mus musculus
ctccatatatcctagatttgtgcgg

SEQ ID NO: 374368 - DNA, 25 bp, Mus musculus
ctccatatccaaatgtctcctggtg

SEQ ID NO: 374369 - DNA, 25 bp, Mus musculus
ctccatatccaattgtctcctggtg

SEQ ID NO: 374370 - DNA, 25 bp, Mus musculus
ctccatatctgtaccaaccgaatga

SEQ ID NO: 374371 - DNA, 25 bp, Mus musculus
ctccatatctgttccaaccgaatga

SEQ ID NO: 374372 - DNA, 25 bp, Mus musculus
ctccatatggccaagaagtctttgt

SEQ ID NO: 374373 - DNA, 25 bp, Mus musculus
ctccatatggcctagaagtctttgt

SEQ ID NO: 374374 - DNA, 25 bp, Mus musculus
ctccatatgttcacctcatttacca

SEQ ID NO: 374375 - DNA, 25 bp, Mus musculus
ctccatatgttctcctcatttacca

SEQ ID NO: 374376 - DNA, 25 bp, Mus musculus
ctccatattacaatttatcttgtgc

SEQ ID NO: 374377 - DNA, 25 bp, Mus musculus
ctccatattacattttatcttgtgc

SEQ ID NO: 374378 - DNA, 25 bp, Mus musculus
ctccatcaactgagtcccgggaaaa

SEQ ID NO: 374379 - DNA, 25 bp, Mus musculus
ctccatcaactgtgtcccgggaaaa

SEQ ID NO: 374380 - DNA, 25 bp, Mus musculus
ctccatcatggtctcagggaagctg

SEQ ID NO: 374381 - DNA, 25 bp, Mus musculus
ctccatcatggtgtcagggaagctg

SEQ ID NO: 374382 - DNA, 25 bp, Mus musculus
ctccatcatgttagggtcccagaga

SEQ ID NO: 374383 - DNA, 25 bp, Mus musculus
ctccatcatgtttgggtcccagaga

SEQ ID NO: 374384 - DNA, 25 bp, Mus musculus
ctccatcatttccacctgacaaatg

SEQ ID NO: 374385 - DNA, 25 bp, Mus musculus
ctccatcatttcgacctgacaaatg

SEQ ID NO: 374386 - DNA, 25 bp, Mus musculus
ctccatcccttcatgtaataccaat

SEQ ID NO: 374387 - DNA, 25 bp, Mus musculus
ctccatcccttcttgtaataccaat

SEQ ID NO: 374388 - DNA, 25 bp, Mus musculus
ctccatctaggactgtagcttgtat

SEQ ID NO: 374389 - DNA, 25 bp, Mus musculus
ctccatctaggagtgtagcttgtat

SEQ ID NO: 374390 - DNA, 25 bp, Mus musculus
ctccatctatcgattgctgaagttc

SEQ ID NO: 374391 - DNA, 25 bp, Mus musculus
ctccatctatcgtttgctgaagttc

SEQ ID NO: 374392 - DNA, 25 bp, Mus musculus
ctccatctctataagcagtttttat

SEQ ID NO: 374393 - DNA, 25 bp, Mus musculus
ctccatctctattagcagtttttat

SEQ ID NO: 374394 - DNA, 25 bp, Mus musculus
ctccatctcttgcagatctagtcag

SEQ ID NO: 374395 - DNA, 25 bp, Mus musculus
ctccatctcttggagatctagtcag

SEQ ID NO: 374396 - DNA, 25 bp, Mus musculus
ctccatctgactcgcctgcaggaag

SEQ ID NO: 374397 - DNA, 25 bp, Mus musculus
ctccatctgactggcctgcaggaag

SEQ ID NO: 374398 - DNA, 25 bp, Mus musculus
ctccatctgtcacctatacgaatta

SEQ ID NO: 374399 - DNA, 25 bp, Mus musculus
ctccatctgtcagctatacgaatta

SEQ ID NO: 374400 - DNA, 25 bp, Mus musculus
ctccatcttactatgcaggcagact

SEQ ID NO: 374401 - DNA, 25 bp, Mus musculus
ctccatcttactttgcaggcagact

SEQ ID NO: 374402 - DNA, 25 bp, Mus musculus
ctccatcttgtcaagccatattcta

SEQ ID NO: 374403 - DNA, 25 bp, Mus musculus
ctccatcttgtctagccatattcta

SEQ ID NO: 374404 - DNA, 25 bp, Mus musculus
ctccatgaagatcacctgctctaat

SEQ ID NO: 374405 - DNA, 25 bp, Mus musculus
ctccatgaagatgacctgctctaat

SEQ ID NO: 374406 - DNA, 25 bp, Mus musculus
ctccatgaatgtccttgtcgtctat

SEQ ID NO: 374407 - DNA, 25 bp, Mus musculus
ctccatgaatgtgcttgtcgtctat

SEQ ID NO: 374408 - DNA, 25 bp, Mus musculus
ctccatgacattcagacccaagtgt

SEQ ID NO: 374409 - DNA, 25 bp, Mus musculus
ctccatgacattgagacccaagtgt

SEQ ID NO: 374410 - DNA, 25 bp, Mus musculus
ctccatgataagagcagttgcctac

SEQ ID NO: 374411 - DNA, 25 bp, Mus musculus
ctccatgataagtgcagttgcctac

SEQ ID NO: 374412 - DNA, 25 bp, Mus musculus
ctccatgcaagtcctgttttgggca

SEQ ID NO: 374413 - DNA, 25 bp, Mus musculus
ctccatgcaagtgctgttttgggca

SEQ ID NO: 374414 - DNA, 25 bp, Mus musculus
ctccatgcccttaatttcagaacca

SEQ ID NO: 374415 - DNA, 25 bp, Mus musculus
ctccatgccctttatttcagaacca

SEQ ID NO: 374416 - DNA, 25 bp, Mus musculus
ctccatggagacctctggtctggaa

SEQ ID NO: 374417 - DNA, 25 bp, Mus musculus
ctccatggagacgtctggtctggaa

SEQ ID NO: 374418 - DNA, 25 bp, Mus musculus
ctccatggaggcattaaggtcggct

SEQ ID NO: 374419 - DNA, 25 bp, Mus musculus
ctccatggaggctttaaggtcggct

SEQ ID NO: 374420 - DNA, 25 bp, Mus musculus
ctccatggagtacataggcagggtc

SEQ ID NO: 374421 - DNA, 25 bp, Mus musculus
ctccatggagtagataggcagggtc

SEQ ID NO: 374422 - DNA, 25 bp, Mus musculus
ctccatggcttcagctttagttcct

SEQ ID NO: 374423 - DNA, 25 bp, Mus musculus
ctccatggcttctgctttagttcct

SEQ ID NO: 374424 - DNA, 25 bp, Mus musculus
ctccatggcttgacctatgtagcaa

SEQ ID NO: 374425 - DNA, 25 bp, Mus musculus
ctccatggcttgtcctatgtagcaa

SEQ ID NO: 374426 - DNA, 25 bp, Mus musculus
ctccatgggatcagcacacacactc

SEQ ID NO: 374427 - DNA, 25 bp, Mus musculus
ctccatgggatctgcacacacactc

SEQ ID NO: 374428 - DNA, 25 bp, Mus musculus
ctccatgggttgctgggactcacat

SEQ ID NO: 374429 - DNA, 25 bp, Mus musculus
ctccatgggttggtgggactcacat

SEQ ID NO: 374430 - DNA, 25 bp, Mus musculus
ctccatgtacccatgccctttgaga

SEQ ID NO: 374431 - DNA, 25 bp, Mus musculus
ctccatgtacccttgccctttgaga

SEQ ID NO: 374432 - DNA, 25 bp, Mus musculus
ctccatgtacctagcaacctattgg

SEQ ID NO: 374433 - DNA, 25 bp, Mus musculus
ctccatgtaccttgcaacctattgg

SEQ ID NO: 374434 - DNA, 25 bp, Mus musculus
ctccatgtaggacccctgtagcttc

SEQ ID NO: 374435 - DNA, 25 bp, Mus musculus
ctccatgtaggagccctgtagcttc

SEQ ID NO: 374436 - DNA, 25 bp, Mus musculus
ctccatgtatgtcttttcccctgac

SEQ ID NO: 374437 - DNA, 25 bp, Mus musculus
ctccatgtatgtgttttcccctgac

SEQ ID NO: 374438 - DNA, 25 bp, Mus musculus
ctccatgtcacccaaacttgagggt

SEQ ID NO: 374439 - DNA, 25 bp, Mus musculus
ctccatgtcaccgaaacttgagggt

SEQ ID NO: 374440 - DNA, 25 bp, Mus musculus
ctccatgtccagcatgtagccctaa

SEQ ID NO: 374441 - DNA, 25 bp, Mus musculus
ctccatgtccaggatgtagccctaa

SEQ ID NO: 374442 - DNA, 25 bp, Mus musculus
ctccatgtctggcatgacctcacag

SEQ ID NO: 374443 - DNA, 25 bp, Mus musculus
ctccatgtctgggatgacctcacag

SEQ ID NO: 374444 - DNA, 25 bp, Mus musculus
ctccatgtggttctctggactgaca

SEQ ID NO: 374445 - DNA, 25 bp, Mus musculus
ctccatgtggttgtctggactgaca

SEQ ID NO: 374446 - DNA, 25 bp, Mus musculus
ctccatgtgtacaattcagaacttg

SEQ ID NO: 374447 - DNA, 25 bp, Mus musculus
ctccatgtgtactattcagaacttg

SEQ ID NO: 374448 - DNA, 25 bp, Mus musculus
ctccatgtgtgtcatttagtcacag

SEQ ID NO: 374449 - DNA, 25 bp, Mus musculus
ctccatgtgtgtgatttagtcacag

SEQ ID NO: 374450 - DNA, 25 bp, Mus musculus
ctccatgtttccacgcgagtcggtg

SEQ ID NO: 374451 - DNA, 25 bp, Mus musculus
ctccatgtttcctcgcgagtcggtg

SEQ ID NO: 374452 - DNA, 25 bp, Mus musculus
ctccattagagacgccacactgaat

SEQ ID NO: 374453 - DNA, 25 bp, Mus musculus
ctccattagagaggccacactgaat

SEQ ID NO: 374454 - DNA, 25 bp, Mus musculus
ctccattcaagtcacggcagaactg

SEQ ID NO: 374455 - DNA, 25 bp, Mus musculus
ctccattcaagtgacggcagaactg

SEQ ID NO: 374456 - DNA, 25 bp, Mus musculus
ctccattcacatattgttcccaaac

SEQ ID NO: 374457 - DNA, 25 bp, Mus musculus
ctccattcacattttgttcccaaac

SEQ ID NO: 374458 - DNA, 25 bp, Mus musculus
ctccattcacgtcacttcttgatgt

SEQ ID NO: 374459 - DNA, 25 bp, Mus musculus
ctccattcacgtgacttcttgatgt

SEQ ID NO: 374460 - DNA, 25 bp, Mus musculus
ctccattccatactcttgtgggatg

SEQ ID NO: 374461 - DNA, 25 bp, Mus musculus
ctccattccatagtcttgtgggatg

SEQ ID NO: 374462 - DNA, 25 bp, Mus musculus
ctccattcgtaccagaaacggcttt

SEQ ID NO: 374463 - DNA, 25 bp, Mus musculus
ctccattcgtacgagaaacggcttt

SEQ ID NO: 374464 - DNA, 25 bp, Mus musculus
ctccattctgttagcggtgcttatg

SEQ ID NO: 374465 - DNA, 25 bp, Mus musculus
ctccattctgtttgcggtgcttatg

SEQ ID NO: 374466 - DNA, 25 bp, Mus musculus
ctccattcttaacagaggtcagagt

SEQ ID NO: 374467 - DNA, 25 bp, Mus musculus
ctccattcttaagagaggtcagagt

SEQ ID NO: 374468 - DNA, 25 bp, Mus musculus
ctccattgccttatcaagtcttcaa

SEQ ID NO: 374469 - DNA, 25 bp, Mus musculus
ctccattgccttttcaagtcttcaa

SEQ ID NO: 374470 - DNA, 25 bp, Mus musculus
ctccattgtgaaatcagaaccatgt

SEQ ID NO: 374471 - DNA, 25 bp, Mus musculus
ctccattgtgaattcagaaccatgt

SEQ ID NO: 374472 - DNA, 25 bp, Mus musculus
ctccatttagttacctgttggcaag

SEQ ID NO: 374473 - DNA, 25 bp, Mus musculus
ctccatttagtttcctgttggcaag

SEQ ID NO: 374474 - DNA, 25 bp, Mus musculus
ctccatttcagtcatcgagcaggaa

SEQ ID NO: 374475 - DNA, 25 bp, Mus musculus
ctccatttcagtgatcgagcaggaa

SEQ ID NO: 374476 - DNA, 25 bp, Mus musculus
ctccatttccagactgaaggttgtg

SEQ ID NO: 374477 - DNA, 25 bp, Mus musculus
ctccatttccagtctgaaggttgtg

SEQ ID NO: 374478 - DNA, 25 bp, Mus musculus
ctccatttccctcttgatattcaaa

SEQ ID NO: 374479 - DNA, 25 bp, Mus musculus
ctccatttccctgttgatattcaaa

SEQ ID NO: 374480 - DNA, 25 bp, Mus musculus
ctccatttctttccctagattctaa

SEQ ID NO: 374481 - DNA, 25 bp, Mus musculus
ctccatttctttgcctagattctaa

SEQ ID NO: 374482 - DNA, 25 bp, Mus musculus
ctccatttgggacatcatgatgtca

SEQ ID NO: 374483 - DNA, 25 bp, Mus musculus
ctccatttgggagatcatgatgtca

SEQ ID NO: 374484 - DNA, 25 bp, Mus musculus
ctccatttggtgctgatggtttcaa

SEQ ID NO: 374485 - DNA, 25 bp, Mus musculus
ctccatttggtggtgatggtttcaa

SEQ ID NO: 374486 - DNA, 25 bp, Mus musculus
ctccattttatgatggctgctataa

SEQ ID NO: 374487 - DNA, 25 bp, Mus musculus
ctccattttatgttggctgctataa

SEQ ID NO: 374488 - DNA, 25 bp, Mus musculus
ctccatttttgtcccagtttcgata

SEQ ID NO: 374489 - DNA, 25 bp, Mus musculus
ctccatttttgtgccagtttcgata

SEQ ID NO: 374490 - DNA, 25 bp, Mus musculus
ctccattttttacttggctattaat

SEQ ID NO: 374491 - DNA, 25 bp, Mus musculus
ctccattttttagttggctattaat

SEQ ID NO: 374492 - DNA, 25 bp, Mus musculus
ctcccaaaagcaccgagacttcgtg

SEQ ID NO: 374493 - DNA, 25 bp, Mus musculus
ctcccaaaagcagcgagacttcgtg

SEQ ID NO: 374494 - DNA, 25 bp, Mus musculus
ctcccaaactctcgatttataggac

SEQ ID NO: 374495 - DNA, 25 bp, Mus musculus
ctcccaaactctggatttataggac

SEQ ID NO: 374496 - DNA, 25 bp, Mus musculus
ctcccaacgaatcaggtgatcggct

SEQ ID NO: 374497 - DNA, 25 bp, Mus musculus
ctcccaacgaatgaggtgatcggct

SEQ ID NO: 374498 - DNA, 25 bp, Mus musculus
ctcccaacgcacagacttgtgtaat

SEQ ID NO: 374499 - DNA, 25 bp, Mus musculus
ctcccaacgcactgacttgtgtaat

SEQ ID NO: 374500 - DNA, 25 bp, Mus musculus
ctcccaacgcctctgatttgaaagg

SEQ ID NO: 374501 - DNA, 25 bp, Mus musculus
ctcccaacgcctgtgatttgaaagg

SEQ ID NO: 374502 - DNA, 25 bp, Mus musculus
ctcccaactttcaatctgaatccaa

SEQ ID NO: 374503 - DNA, 25 bp, Mus musculus
ctcccaactttctatctgaatccaa

SEQ ID NO: 374504 - DNA, 25 bp, Mus musculus
ctcccaaggaacattgttcgtagct

SEQ ID NO: 374505 - DNA, 25 bp, Mus musculus
ctcccaaggaactttgttcgtagct

SEQ ID NO: 374506 - DNA, 25 bp, Mus musculus
ctcccaagggcaaccagaagtccaa

SEQ ID NO: 374507 - DNA, 25 bp, Mus musculus
ctcccaagggcatccagaagtccaa

SEQ ID NO: 374508 - DNA, 25 bp, Mus musculus
ctcccaaggtgaaatgcttgactaa

SEQ ID NO: 374509 - DNA, 25 bp, Mus musculus
ctcccaaggtgatatgcttgactaa

SEQ ID NO: 374510 - DNA, 25 bp, Mus musculus
ctcccaatagagcacatatgtaacc

SEQ ID NO: 374511 - DNA, 25 bp, Mus musculus
ctcccaatagaggacatatgtaacc

SEQ ID NO: 374512 - DNA, 25 bp, Mus musculus
ctcccacactgcctcttagagattt

SEQ ID NO: 374513 - DNA, 25 bp, Mus musculus
ctcccacactgcgtcttagagattt

SEQ ID NO: 374514 - DNA, 25 bp, Mus musculus
ctcccacagcgcatttaattttacc

SEQ ID NO: 374515 - DNA, 25 bp, Mus musculus
ctcccacagcgcttttaattttacc

SEQ ID NO: 374516 - DNA, 25 bp, Mus musculus
ctcccacaggaccaagatgcttaat

SEQ ID NO: 374517 - DNA, 25 bp, Mus musculus
ctcccacaggacgaagatgcttaat

SEQ ID NO: 374518 - DNA, 25 bp, Mus musculus
ctcccacaggagatcacattctttc

SEQ ID NO: 374519 - DNA, 25 bp, Mus musculus
ctcccacaggagttcacattctttc

SEQ ID NO: 374520 - DNA, 25 bp, Mus musculus
ctcccacagtggcaggcgagagcca

SEQ ID NO: 374521 - DNA, 25 bp, Mus musculus
ctcccacagtgggaggcgagagcca

SEQ ID NO: 374522 - DNA, 25 bp, Mus musculus
ctcccacatgctcggttctggaatg

SEQ ID NO: 374523 - DNA, 25 bp, Mus musculus
ctcccacatgctgggttctggaatg

SEQ ID NO: 374524 - DNA, 25 bp, Mus musculus
ctcccaccctttcatcggaatatgt

SEQ ID NO: 374525 - DNA, 25 bp, Mus musculus
ctcccaccctttgatcggaatatgt

SEQ ID NO: 374526 - DNA, 25 bp, Mus musculus
ctcccaccgaagcaagtgtctgtct

SEQ ID NO: 374527 - DNA, 25 bp, Mus musculus
ctcccaccgaaggaagtgtctgtct

SEQ ID NO: 374528 - DNA, 25 bp, Mus musculus
ctcccaccgataagggttgggcgtt

SEQ ID NO: 374529 - DNA, 25 bp, Mus musculus
ctcccaccgatatgggttgggcgtt

SEQ ID NO: 374530 - DNA, 25 bp, Mus musculus
ctcccacctgttatcctagaaatga

SEQ ID NO: 374531 - DNA, 25 bp, Mus musculus
ctcccacctgttttcctagaaatga

SEQ ID NO: 374532 - DNA, 25 bp, Mus musculus
ctcccaccttggcaatgtcagaaag

SEQ ID NO: 374533 - DNA, 25 bp, Mus musculus
ctcccaccttgggaatgtcagaaag

SEQ ID NO: 374534 - DNA, 25 bp, Mus musculus
ctcccacctttcagaatctggtgta

SEQ ID NO: 374535 - DNA, 25 bp, Mus musculus
ctcccacctttctgaatctggtgta

SEQ ID NO: 374536 - DNA, 25 bp, Mus musculus
ctcccacggcacacaacagtattga

SEQ ID NO: 374537 - DNA, 25 bp, Mus musculus
ctcccacggcactcaacagtattga

SEQ ID NO: 374538 - DNA, 25 bp, Mus musculus
ctcccacggcatcacagtaagtgtt

SEQ ID NO: 374539 - DNA, 25 bp, Mus musculus
ctcccacggcatgacagtaagtgtt

SEQ ID NO: 374540 - DNA, 25 bp, Mus musculus
ctcccacgtggtagggatgtgttca

SEQ ID NO: 374541 - DNA, 25 bp, Mus musculus
ctcccacgtggttgggatgtgttca

SEQ ID NO: 374542 - DNA, 25 bp, Mus musculus
ctcccactacatctcaagtgttaca

SEQ ID NO: 374543 - DNA, 25 bp, Mus musculus
ctcccactacatgtcaagtgttaca

SEQ ID NO: 374544 - DNA, 25 bp, Mus musculus
ctcccactccagactagatgacatt

SEQ ID NO: 374545 - DNA, 25 bp, Mus musculus
ctcccactccagtctagatgacatt

SEQ ID NO: 374546 - DNA, 25 bp, Mus musculus
ctcccactcccaatatgaaagacat

SEQ ID NO: 374547 - DNA, 25 bp, Mus musculus
ctcccactcccattatgaaagacat

SEQ ID NO: 374548 - DNA, 25 bp, Mus musculus
ctcccactggtgcataccaattagg

SEQ ID NO: 374549 - DNA, 25 bp, Mus musculus
ctcccactggtggataccaattagg

SEQ ID NO: 374550 - DNA, 25 bp, Mus musculus
ctcccactgtgaattaggcttctat

SEQ ID NO: 374551 - DNA, 25 bp, Mus musculus
ctcccactgtgatttaggcttctat

SEQ ID NO: 374552 - DNA, 25 bp, Mus musculus
ctcccacttactcaccaagaaaggt

SEQ ID NO: 374553 - DNA, 25 bp, Mus musculus
ctcccacttactgaccaagaaaggt

SEQ ID NO: 374554 - DNA, 25 bp, Mus musculus
ctcccacttgacctgtttggaggga

SEQ ID NO: 374555 - DNA, 25 bp, Mus musculus
ctcccacttgacgtgtttggaggga

SEQ ID NO: 374556 - DNA, 25 bp, Mus musculus
ctcccagaaaccagctacaaacatt

SEQ ID NO: 374557 - DNA, 25 bp, Mus musculus
ctcccagaaacctgctacaaacatt

SEQ ID NO: 374558 - DNA, 25 bp, Mus musculus
ctcccagaactgcagcatcatgtaa

SEQ ID NO: 374559 - DNA, 25 bp, Mus musculus
ctcccagaactggagcatcatgtaa

SEQ ID NO: 374560 - DNA, 25 bp, Mus musculus
ctcccagaagctcccaatgcaataa

SEQ ID NO: 374561 - DNA, 25 bp, Mus musculus
ctcccagaagctgccaatgcaataa

SEQ ID NO: 374562 - DNA, 25 bp, Mus musculus
ctcccagagaggactacagagccta

SEQ ID NO: 374563 - DNA, 25 bp, Mus musculus
ctcccagagaggtctacagagccta

SEQ ID NO: 374564 - DNA, 25 bp, Mus musculus
ctcccagagtaaattctggtttgga

SEQ ID NO: 374565 - DNA, 25 bp, Mus musculus
ctcccagagtaatttctggtttgga

SEQ ID NO: 374566 - DNA, 25 bp, Mus musculus
ctcccagagtcacggtcatgtgctc

SEQ ID NO: 374567 - DNA, 25 bp, Mus musculus
ctcccagagtcagggtcatgtgctc

SEQ ID NO: 374568 - DNA, 25 bp, Mus musculus
ctcccagagttcctgtgctagatgg

SEQ ID NO: 374569 - DNA, 25 bp, Mus musculus
ctcccagagttcgtgtgctagatgg

SEQ ID NO: 374570 - DNA, 25 bp, Mus musculus
ctcccagcacggctgttacagttgt

SEQ ID NO: 374571 - DNA, 25 bp, Mus musculus
ctcccagcacgggtgttacagttgt

SEQ ID NO: 374572 - DNA, 25 bp, Mus musculus
ctcccagcagttagatgacctatac

SEQ ID NO: 374573 - DNA, 25 bp, Mus musculus
ctcccagcagtttgatgacctatac

SEQ ID NO: 374574 - DNA, 25 bp, Mus musculus
ctcccagcattgaaaagcttttatt

SEQ ID NO: 374575 - DNA, 25 bp, Mus musculus
ctcccagcattgtaaagcttttatt

SEQ ID NO: 374576 - DNA, 25 bp, Mus musculus
ctcccagcctctactttattagaat

SEQ ID NO: 374577 - DNA, 25 bp, Mus musculus
ctcccagcctcttctttattagaat

SEQ ID NO: 374578 - DNA, 25 bp, Mus musculus
ctcccagcgggtcacgaagagacta

SEQ ID NO: 374579 - DNA, 25 bp, Mus musculus
ctcccagcgggtgacgaagagacta

SEQ ID NO: 374580 - DNA, 25 bp, Mus musculus
ctcccagcgttccttaatattttag

SEQ ID NO: 374581 - DNA, 25 bp, Mus musculus
ctcccagcgttcgttaatattttag

SEQ ID NO: 374582 - DNA, 25 bp, Mus musculus
ctcccagctatgattcagtctttga

SEQ ID NO: 374583 - DNA, 25 bp, Mus musculus
ctcccagctatgtttcagtctttga

SEQ ID NO: 374584 - DNA, 25 bp, Mus musculus
ctcccagctcagcgtagatagagct

SEQ ID NO: 374585 - DNA, 25 bp, Mus musculus
ctcccagctcagggtagatagagct

SEQ ID NO: 374586 - DNA, 25 bp, Mus musculus
ctcccagctctgatttatgtttgcc

SEQ ID NO: 374587 - DNA, 25 bp, Mus musculus
ctcccagctctgttttatgtttgcc

SEQ ID NO: 374588 - DNA, 25 bp, Mus musculus
ctcccagctgttccagagcgatgat

SEQ ID NO: 374589 - DNA, 25 bp, Mus musculus
ctcccagctgttgcagagcgatgat

SEQ ID NO: 374590 - DNA, 25 bp, Mus musculus
ctcccaggaaatacacatgcttcca

SEQ ID NO: 374591 - DNA, 25 bp, Mus musculus
ctcccaggaaattcacatgcttcca

SEQ ID NO: 374592 - DNA, 25 bp, Mus musculus
ctcccaggaatgcctgtacatgttt

SEQ ID NO: 374593 - DNA, 25 bp, Mus musculus
ctcccaggaatggctgtacatgttt

SEQ ID NO: 374594 - DNA, 25 bp, Mus musculus
ctcccaggatgactgcaggttttcc

SEQ ID NO: 374595 - DNA, 25 bp, Mus musculus
ctcccaggatgagtgcaggttttcc

SEQ ID NO: 374596 - DNA, 25 bp, Mus musculus
ctcccaggcatgatagcttcctctc

SEQ ID NO: 374597 - DNA, 25 bp, Mus musculus
ctcccaggcatgttagcttcctctc

SEQ ID NO: 374598 - DNA, 25 bp, Mus musculus
ctcccaggcctaactcatgagaagg

SEQ ID NO: 374599 - DNA, 25 bp, Mus musculus
ctcccaggcctatctcatgagaagg

SEQ ID NO: 374600 - DNA, 25 bp, Mus musculus
ctcccagggccgaaggagccagaga

SEQ ID NO: 374601 - DNA, 25 bp, Mus musculus
ctcccagggccgtaggagccagaga

SEQ ID NO: 374602 - DNA, 25 bp, Mus musculus
ctcccaggtagcaagaactccgtat

SEQ ID NO: 374603 - DNA, 25 bp, Mus musculus
ctcccaggtagctagaactccgtat

SEQ ID NO: 374604 - DNA, 25 bp, Mus musculus
ctcccaggtctcataacacagttta

SEQ ID NO: 374605 - DNA, 25 bp, Mus musculus
ctcccaggtctcttaacacagttta

SEQ ID NO: 374606 - DNA, 25 bp, Mus musculus
ctcccaggtggcattgtaccaaaga

SEQ ID NO: 374607 - DNA, 25 bp, Mus musculus
ctcccaggtggctttgtaccaaaga

SEQ ID NO: 374608 - DNA, 25 bp, Mus musculus
ctcccagtacagatttcttttccat

SEQ ID NO: 374609 - DNA, 25 bp, Mus musculus
ctcccagtacagttttcttttccat

SEQ ID NO: 374610 - DNA, 25 bp, Mus musculus
ctcccagtagagcttggcttgctgt

SEQ ID NO: 374611 - DNA, 25 bp, Mus musculus
ctcccagtagaggttggcttgctgt

SEQ ID NO: 374612 - DNA, 25 bp, Mus musculus
ctcccagtcgctcaggtgacagtgt

SEQ ID NO: 374613 - DNA, 25 bp, Mus musculus
ctcccagtcgctgaggtgacagtgt

SEQ ID NO: 374614 - DNA, 25 bp, Mus musculus
ctcccagtgctgagaactgggtgct

SEQ ID NO: 374615 - DNA, 25 bp, Mus musculus
ctcccagtgctgtgaactgggtgct

SEQ ID NO: 374616 - DNA, 25 bp, Mus musculus
ctcccagttaccaggtgtttcttca

SEQ ID NO: 374617 - DNA, 25 bp, Mus musculus
ctcccagttacctggtgtttcttca

SEQ ID NO: 374618 - DNA, 25 bp, Mus musculus
ctcccagttttcactgcttgtggta

SEQ ID NO: 374619 - DNA, 25 bp, Mus musculus
ctcccagttttctctgcttgtggta

SEQ ID NO: 374620 - DNA, 25 bp, Mus musculus
ctcccatactccaatagaggcctat

SEQ ID NO: 374621 - DNA, 25 bp, Mus musculus
ctcccatactcctatagaggcctat

SEQ ID NO: 374622 - DNA, 25 bp, Mus musculus
ctcccatacttgctgagctagctag

SEQ ID NO: 374623 - DNA, 25 bp, Mus musculus
ctcccatacttggtgagctagctag

SEQ ID NO: 374624 - DNA, 25 bp, Mus musculus
ctcccatagcttctgtttactgtat

SEQ ID NO: 374625 - DNA, 25 bp, Mus musculus
ctcccatagcttgtgtttactgtat

SEQ ID NO: 374626 - DNA, 25 bp, Mus musculus
ctcccatataaaacattaatagaga

SEQ ID NO: 374627 - DNA, 25 bp, Mus musculus
ctcccatataaatcattaatagaga

SEQ ID NO: 374628 - DNA, 25 bp, Mus musculus
ctcccatcagctcatctgattctgt

SEQ ID NO: 374629 - DNA, 25 bp, Mus musculus
ctcccatcagctgatctgattctgt

SEQ ID NO: 374630 - DNA, 25 bp, Mus musculus
ctcccatcaggtaagccatgtgttt

SEQ ID NO: 374631 - DNA, 25 bp, Mus musculus
ctcccatcaggttagccatgtgttt

SEQ ID NO: 374632 - DNA, 25 bp, Mus musculus
ctcccatccaaactgtgctcattag

SEQ ID NO: 374633 - DNA, 25 bp, Mus musculus
ctcccatccaaagtgtgctcattag

SEQ ID NO: 374634 - DNA, 25 bp, Mus musculus
ctcccatccacaatggctctctgaa

SEQ ID NO: 374635 - DNA, 25 bp, Mus musculus
ctcccatccacattggctctctgaa

SEQ ID NO: 374636 - DNA, 25 bp, Mus musculus
ctcccatccatacaagcaaactttt

SEQ ID NO: 374637 - DNA, 25 bp, Mus musculus
ctcccatccatactgcatggtgtgt

SEQ ID NO: 374638 - DNA, 25 bp, Mus musculus
ctcccatccatagaagcaaactttt

SEQ ID NO: 374639 - DNA, 25 bp, Mus musculus
ctcccatccatagtgcatggtgtgt

SEQ ID NO: 374640 - DNA, 25 bp, Mus musculus
ctcccatcccagatgatctcaagat

SEQ ID NO: 374641 - DNA, 25 bp, Mus musculus
ctcccatcccagttgatctcaagat

SEQ ID NO: 374642 - DNA, 25 bp, Mus musculus
ctcccatcctgcatatgtgcatata

SEQ ID NO: 374643 - DNA, 25 bp, Mus musculus
ctcccatcctgcttatgtgcatata

SEQ ID NO: 374644 - DNA, 25 bp, Mus musculus
ctcccatctaatcaactctctgaga

SEQ ID NO: 374645 - DNA, 25 bp, Mus musculus
ctcccatctaatgaactctctgaga

SEQ ID NO: 374646 - DNA, 25 bp, Mus musculus
ctcccatctgttacagaggctgctg

SEQ ID NO: 374647 - DNA, 25 bp, Mus musculus
ctcccatctgtttcagaggctgctg

SEQ ID NO: 374648 - DNA, 25 bp, Mus musculus
ctcccatctttcacttgcacataaa

SEQ ID NO: 374649 - DNA, 25 bp, Mus musculus
ctcccatctttctcttgcacataaa

SEQ ID NO: 374650 - DNA, 25 bp, Mus musculus
ctcccatgatggctacatagtgtgt

SEQ ID NO: 374651 - DNA, 25 bp, Mus musculus
ctcccatgatgggtacatagtgtgt

SEQ ID NO: 374652 - DNA, 25 bp, Mus musculus
ctcccatgcccactttagtcagtag

SEQ ID NO: 374653 - DNA, 25 bp, Mus musculus
ctcccatgcccagtttagtcagtag

SEQ ID NO: 374654 - DNA, 25 bp, Mus musculus
ctcccatgctctaacttgtttggta

SEQ ID NO: 374655 - DNA, 25 bp, Mus musculus
ctcccatgctcttacttgtttggta

SEQ ID NO: 374656 - DNA, 25 bp, Mus musculus
ctcccatgcttgatacctggttttc

SEQ ID NO: 374657 - DNA, 25 bp, Mus musculus
ctcccatgcttgttacctggttttc

SEQ ID NO: 374658 - DNA, 25 bp, Mus musculus
ctcccatggaccctggcagtgatgg

SEQ ID NO: 374659 - DNA, 25 bp, Mus musculus
ctcccatggaccgtggcagtgatgg

SEQ ID NO: 374660 - DNA, 25 bp, Mus musculus
ctcccatgtctgatctcagcagaga

SEQ ID NO: 374661 - DNA, 25 bp, Mus musculus
ctcccatgtctgttctcagcagaga

SEQ ID NO: 374662 - DNA, 25 bp, Mus musculus
ctcccattaaacagagcacagaggt

SEQ ID NO: 374663 - DNA, 25 bp, Mus musculus
ctcccattaaactgagcacagaggt

SEQ ID NO: 374664 - DNA, 25 bp, Mus musculus
ctcccattgatgagccacgtggtat

SEQ ID NO: 374665 - DNA, 25 bp, Mus musculus
ctcccattgatgtgccacgtggtat

SEQ ID NO: 374666 - DNA, 25 bp, Mus musculus
ctccccaaaaagctgccttctgaaa

SEQ ID NO: 374667 - DNA, 25 bp, Mus musculus
ctccccaaaaaggtgccttctgaaa

SEQ ID NO: 374668 - DNA, 25 bp, Mus musculus
ctccccaaacatcgcttttataggt

SEQ ID NO: 374669 - DNA, 25 bp, Mus musculus
ctccccaaacatggcttttataggt

SEQ ID NO: 374670 - DNA, 25 bp, Mus musculus
ctccccaacgatcaagcagacgaat

SEQ ID NO: 374671 - DNA, 25 bp, Mus musculus
ctccccaacgatgaagcagacgaat

SEQ ID NO: 374672 - DNA, 25 bp, Mus musculus
ctccccaactcactaactgtatttt

SEQ ID NO: 374673 - DNA, 25 bp, Mus musculus
ctccccaactcagtaactgtatttt

SEQ ID NO: 374674 - DNA, 25 bp, Mus musculus
ctccccaagctgattttcatggtgt

SEQ ID NO: 374675 - DNA, 25 bp, Mus musculus
ctccccaagctgtttttcatggtgt

SEQ ID NO: 374676 - DNA, 25 bp, Mus musculus
ctccccaaggagctgcaggtatact

SEQ ID NO: 374677 - DNA, 25 bp, Mus musculus
ctccccaaggaggtgcaggtatact

SEQ ID NO: 374678 - DNA, 25 bp, Mus musculus
ctccccacaatgctttttacaagtg

SEQ ID NO: 374679 - DNA, 25 bp, Mus musculus
ctccccacaatggtttttacaagtg

SEQ ID NO: 374680 - DNA, 25 bp, Mus musculus
ctccccacatgtctctaattttatt

SEQ ID NO: 374681 - DNA, 25 bp, Mus musculus
ctccccacatgtgtctaattttatt

SEQ ID NO: 374682 - DNA, 25 bp, Mus musculus
ctccccaccatgctgaggtaattaa

SEQ ID NO: 374683 - DNA, 25 bp, Mus musculus
ctccccaccatggtgaggtaattaa

SEQ ID NO: 374684 - DNA, 25 bp, Mus musculus
ctccccaccgtaaaatcatttcatt

SEQ ID NO: 374685 - DNA, 25 bp, Mus musculus
ctccccaccgtataatcatttcatt

SEQ ID NO: 374686 - DNA, 25 bp, Mus musculus
ctccccacgtaaatcactgtgagaa

SEQ ID NO: 374687 - DNA, 25 bp, Mus musculus
ctccccacgtaattcactgtgagaa

SEQ ID NO: 374688 - DNA, 25 bp, Mus musculus
ctccccactgacactgtgactgtga

SEQ ID NO: 374689 - DNA, 25 bp, Mus musculus
ctccccactgactctgtgactgtga

SEQ ID NO: 374690 - DNA, 25 bp, Mus musculus
ctccccactgtgataatatttattt

SEQ ID NO: 374691 - DNA, 25 bp, Mus musculus
ctccccactgtgttaatatttattt

SEQ ID NO: 374692 - DNA, 25 bp, Mus musculus
ctccccacttatcttatgatatcga

SEQ ID NO: 374693 - DNA, 25 bp, Mus musculus
ctccccacttatgttatgatatcga

SEQ ID NO: 374694 - DNA, 25 bp, Mus musculus
ctccccagaactatgctttactgtt

SEQ ID NO: 374695 - DNA, 25 bp, Mus musculus
ctccccagaactttgctttactgtt

SEQ ID NO: 374696 - DNA, 25 bp, Mus musculus
ctccccagaagaccctgatttgatt

SEQ ID NO: 374697 - DNA, 25 bp, Mus musculus
ctccccagaagacgcttggacactt

SEQ ID NO: 374698 - DNA, 25 bp, Mus musculus
ctccccagaagagcctgatttgatt

SEQ ID NO: 374699 - DNA, 25 bp, Mus musculus
ctccccagaagaggcttggacactt

SEQ ID NO: 374700 - DNA, 25 bp, Mus musculus
ctccccagagatagggtcttcacca

SEQ ID NO: 374701 - DNA, 25 bp, Mus musculus
ctccccagagattgggtcttcacca

SEQ ID NO: 374702 - DNA, 25 bp, Mus musculus
ctccccaggaatcagcatgcatgta

SEQ ID NO: 374703 - DNA, 25 bp, Mus musculus
ctccccaggaatgagcatgcatgta

SEQ ID NO: 374704 - DNA, 25 bp, Mus musculus
ctccccaggatgagtagtaccactg

SEQ ID NO: 374705 - DNA, 25 bp, Mus musculus
ctccccaggatgtgtagtaccactg

SEQ ID NO: 374706 - DNA, 25 bp, Mus musculus
ctccccagggagctcttacaagtag

SEQ ID NO: 374707 - DNA, 25 bp, Mus musculus
ctccccagggaggtcttacaagtag

SEQ ID NO: 374708 - DNA, 25 bp, Mus musculus
ctccccagggcacgtgctgacttgg

SEQ ID NO: 374709 - DNA, 25 bp, Mus musculus
ctccccagggcaggtgctgacttgg

SEQ ID NO: 374710 - DNA, 25 bp, Mus musculus
ctccccagtgataagtgtgttacat

SEQ ID NO: 374711 - DNA, 25 bp, Mus musculus
ctccccagtgattagtgtgttacat

SEQ ID NO: 374712 - DNA, 25 bp, Mus musculus
ctccccagtgcaaaatggcaaatat

SEQ ID NO: 374713 - DNA, 25 bp, Mus musculus
ctccccagtgcataatggcaaatat

SEQ ID NO: 374714 - DNA, 25 bp, Mus musculus
ctccccagtggcatgggtgtttaaa

SEQ ID NO: 374715 - DNA, 25 bp, Mus musculus
ctccccagtggcttgggtgtttaaa

SEQ ID NO: 374716 - DNA, 25 bp, Mus musculus
ctccccagtgggaacccagtatagt

SEQ ID NO: 374717 - DNA, 25 bp, Mus musculus
ctccccagtgggtacccagtatagt

SEQ ID NO: 374718 - DNA, 25 bp, Mus musculus
ctccccagttatctctgattgataa

SEQ ID NO: 374719 - DNA, 25 bp, Mus musculus
ctccccagttatgtctgattgataa

SEQ ID NO: 374720 - DNA, 25 bp, Mus musculus
ctccccatgctcagtattaattacc

SEQ ID NO: 374721 - DNA, 25 bp, Mus musculus
ctccccatgctctgtattaattacc

SEQ ID NO: 374722 - DNA, 25 bp, Mus musculus
ctccccatgggacggctgtttttgg

SEQ ID NO: 374723 - DNA, 25 bp, Mus musculus
ctccccatgggacttattgttacaa

SEQ ID NO: 374724 - DNA, 25 bp, Mus musculus
ctccccatgggagggctgtttttgg

SEQ ID NO: 374725 - DNA, 25 bp, Mus musculus
ctccccatgggagttattgttacaa

SEQ ID NO: 374726 - DNA, 25 bp, Mus musculus
ctccccattcagacatctttttaag

SEQ ID NO: 374727 - DNA, 25 bp, Mus musculus
ctccccattcagtcatctttttaag

SEQ ID NO: 374728 - DNA, 25 bp, Mus musculus
ctccccgaacaaagtatcagcaaca

SEQ ID NO: 374729 - DNA, 25 bp, Mus musculus
ctccccgaacaatgtatcagcaaca

SEQ ID NO: 374730 - DNA, 25 bp, Mus musculus
ctccccgaggatctctaccatttga

SEQ ID NO: 374731 - DNA, 25 bp, Mus musculus
ctccccgaggatgtctaccatttga

SEQ ID NO: 374732 - DNA, 25 bp, Mus musculus
ctccccgagtctcatctgaaaggtg

SEQ ID NO: 374733 - DNA, 25 bp, Mus musculus
ctccccgagtctgatctgaaaggtg

SEQ ID NO: 374734 - DNA, 25 bp, Mus musculus
ctccccgcacctaagaatgattttg

SEQ ID NO: 374735 - DNA, 25 bp, Mus musculus
ctccccgcaccttagaatgattttg

SEQ ID NO: 374736 - DNA, 25 bp, Mus musculus
ctccccgcagagcgcttgttttcca

SEQ ID NO: 374737 - DNA, 25 bp, Mus musculus
ctccccgcagagggcttgttttcca

SEQ ID NO: 374738 - DNA, 25 bp, Mus musculus
ctccccgctctaagatgtaaacctt

SEQ ID NO: 374739 - DNA, 25 bp, Mus musculus
ctccccgctctatgatgtaaacctt

SEQ ID NO: 374740 - DNA, 25 bp, Mus musculus
ctccccgcttctatagagggtgata

SEQ ID NO: 374741 - DNA, 25 bp, Mus musculus
ctccccgcttctttagagggtgata

SEQ ID NO: 374742 - DNA, 25 bp, Mus musculus
ctccccgtatgaagaaaggtccatt

SEQ ID NO: 374743 - DNA, 25 bp, Mus musculus
ctccccgtatgatgaaaggtccatt

SEQ ID NO: 374744 - DNA, 25 bp, Mus musculus
ctccccgtcagtagttttctccaga

SEQ ID NO: 374745 - DNA, 25 bp, Mus musculus
ctccccgtcagttgttttctccaga

SEQ ID NO: 374746 - DNA, 25 bp, Mus musculus
ctccccgtggccatgcggctgatgg

SEQ ID NO: 374747 - DNA, 25 bp, Mus musculus
ctccccgtggccttgcggctgatgg

SEQ ID NO: 374748 - DNA, 25 bp, Mus musculus
ctcccctaaagaagaggtagcctgt

SEQ ID NO: 374749 - DNA, 25 bp, Mus musculus
ctcccctaaagatgaggtagcctgt

SEQ ID NO: 374750 - DNA, 25 bp, Mus musculus
ctcccctaagcgctgattatgtctt

SEQ ID NO: 374751 - DNA, 25 bp, Mus musculus
ctcccctaagcggtgattatgtctt

SEQ ID NO: 374752 - DNA, 25 bp, Mus musculus
ctcccctagtagaagcaggtttttg

SEQ ID NO: 374753 - DNA, 25 bp, Mus musculus
ctcccctagtagtagcaggtttttg

SEQ ID NO: 374754 - DNA, 25 bp, Mus musculus
ctcccctatactctgacttacttaa

SEQ ID NO: 374755 - DNA, 25 bp, Mus musculus
ctcccctatactgtgacttacttaa

SEQ ID NO: 374756 - DNA, 25 bp, Mus musculus
ctcccctatcagacactcattaaga

SEQ ID NO: 374757 - DNA, 25 bp, Mus musculus
ctcccctatcagtcactcattaaga

SEQ ID NO: 374758 - DNA, 25 bp, Mus musculus
ctcccctatgtgaaagctctgttga

SEQ ID NO: 374759 - DNA, 25 bp, Mus musculus
ctcccctatgtgtaagctctgttga

SEQ ID NO: 374760 - DNA, 25 bp, Mus musculus
ctcccctcactcacattttattaga

SEQ ID NO: 374761 - DNA, 25 bp, Mus musculus
ctcccctcactctcattttattaga

SEQ ID NO: 374762 - DNA, 25 bp, Mus musculus
ctcccctcagaaaaatgtcagccat

SEQ ID NO: 374763 - DNA, 25 bp, Mus musculus
ctcccctcagaataatgtcagccat

SEQ ID NO: 374764 - DNA, 25 bp, Mus musculus
ctcccctcatatatttggcagcaaa

SEQ ID NO: 374765 - DNA, 25 bp, Mus musculus
ctcccctcatatttttggcagcaaa

SEQ ID NO: 374766 - DNA, 25 bp, Mus musculus
ctcccctcatgtatatctttcaaag

SEQ ID NO: 374767 - DNA, 25 bp, Mus musculus
ctcccctcatgtttatctttcaaag

SEQ ID NO: 374768 - DNA, 25 bp, Mus musculus
ctcccctccgagataacatctgaag

SEQ ID NO: 374769 - DNA, 25 bp, Mus musculus
ctcccctccgagttaacatctgaag

SEQ ID NO: 374770 - DNA, 25 bp, Mus musculus
ctcccctcctaaagcaaacattgaa

SEQ ID NO: 374771 - DNA, 25 bp, Mus musculus
ctcccctcctaatgcaaacattgaa

SEQ ID NO: 374772 - DNA, 25 bp, Mus musculus
ctcccctcctgtctgacaatgacct

SEQ ID NO: 374773 - DNA, 25 bp, Mus musculus
ctcccctcctgtgtgacaatgacct

SEQ ID NO: 374774 - DNA, 25 bp, Mus musculus
ctcccctctattacttttcagattt

SEQ ID NO: 374775 - DNA, 25 bp, Mus musculus
ctcccctctatttcttttcagattt

SEQ ID NO: 374776 - DNA, 25 bp, Mus musculus
ctcccctctgctagaagatgttatt

SEQ ID NO: 374777 - DNA, 25 bp, Mus musculus
ctcccctctgcttgaagatgttatt

SEQ ID NO: 374778 - DNA, 25 bp, Mus musculus
ctcccctcttagactaagtatcata

SEQ ID NO: 374779 - DNA, 25 bp, Mus musculus
ctcccctcttagtctaagtatcata

SEQ ID NO: 374780 - DNA, 25 bp, Mus musculus
ctcccctgactaaccttgagtagga

SEQ ID NO: 374781 - DNA, 25 bp, Mus musculus
ctcccctgactatccttgagtagga

SEQ ID NO: 374782 - DNA, 25 bp, Mus musculus
ctcccctgagctctcttttggtctt

SEQ ID NO: 374783 - DNA, 25 bp, Mus musculus
ctcccctgagctgtcttttggtctt

SEQ ID NO: 374784 - DNA, 25 bp, Mus musculus
ctcccctgattcctatgcctgtggg

SEQ ID NO: 374785 - DNA, 25 bp, Mus musculus
ctcccctgattcgtatgcctgtggg

SEQ ID NO: 374786 - DNA, 25 bp, Mus musculus
ctcccctggactacagttcgagaga

SEQ ID NO: 374787 - DNA, 25 bp, Mus musculus
ctcccctggacttcagttcgagaga

SEQ ID NO: 374788 - DNA, 25 bp, Mus musculus
ctcccctggccacttagggatggga

SEQ ID NO: 374789 - DNA, 25 bp, Mus musculus
ctcccctggccagttagggatggga

SEQ ID NO: 374790 - DNA, 25 bp, Mus musculus
ctcccctggtgaaggacttgtaaca

SEQ ID NO: 374791 - DNA, 25 bp, Mus musculus
ctcccctggtgatggacttgtaaca

SEQ ID NO: 374792 - DNA, 25 bp, Mus musculus
ctcccctggttaccagtggtcaaga

SEQ ID NO: 374793 - DNA, 25 bp, Mus musculus
ctcccctggttagcagtggtcaaga

SEQ ID NO: 374794 - DNA, 25 bp, Mus musculus
ctcccctgttgcaatctgatgtgtt

SEQ ID NO: 374795 - DNA, 25 bp, Mus musculus
ctcccctgttgctatctgatgtgtt

SEQ ID NO: 374796 - DNA, 25 bp, Mus musculus
ctcccctgttttctcagattaattc

SEQ ID NO: 374797 - DNA, 25 bp, Mus musculus
ctcccctgttttgtcagattaattc

SEQ ID NO: 374798 - DNA, 25 bp, Mus musculus
ctccccttagctatgacttaggaag

SEQ ID NO: 374799 - DNA, 25 bp, Mus musculus
ctccccttagctttgacttaggaag

SEQ ID NO: 374800 - DNA, 25 bp, Mus musculus
ctccccttctagactattattgtca

SEQ ID NO: 374801 - DNA, 25 bp, Mus musculus
ctccccttctagtctattattgtca

SEQ ID NO: 374802 - DNA, 25 bp, Mus musculus
ctccccttgagcaagattccaattt

SEQ ID NO: 374803 - DNA, 25 bp, Mus musculus
ctccccttgagctagattccaattt

SEQ ID NO: 374804 - DNA, 25 bp, Mus musculus
ctccccttggaacgaccacctctgt

SEQ ID NO: 374805 - DNA, 25 bp, Mus musculus
ctccccttggaaggaccacctctgt

SEQ ID NO: 374806 - DNA, 25 bp, Mus musculus
ctcccctttggtagtatgattttct

SEQ ID NO: 374807 - DNA, 25 bp, Mus musculus
ctcccctttggttgtatgattttct

SEQ ID NO: 374808 - DNA, 25 bp, Mus musculus
ctcccctttgtgatggactgcaaat

SEQ ID NO: 374809 - DNA, 25 bp, Mus musculus
ctcccctttgtgttggactgcaaat

SEQ ID NO: 374810 - DNA, 25 bp, Mus musculus
ctccccttttctccacagaagagga

SEQ ID NO: 374811 - DNA, 25 bp, Mus musculus
ctccccttttctgcacagaagagga

SEQ ID NO: 374812 - DNA, 25 bp, Mus musculus
ctcccgaaacttcgccaatgagttc

SEQ ID NO: 374813 - DNA, 25 bp, Mus musculus
ctcccgaaacttggccaatgagttc

SEQ ID NO: 374814 - DNA, 25 bp, Mus musculus
ctcccgaagatgaagcagacccttt

SEQ ID NO: 374815 - DNA, 25 bp, Mus musculus
ctcccgaagatgtagcagacccttt

SEQ ID NO: 374816 - DNA, 25 bp, Mus musculus
ctcccgacatagcatctcagagtgg

SEQ ID NO: 374817 - DNA, 25 bp, Mus musculus
ctcccgacataggatctcagagtgg

SEQ ID NO: 374818 - DNA, 25 bp, Mus musculus
ctcccgagaactctgtgtggatact

SEQ ID NO: 374819 - DNA, 25 bp, Mus musculus
ctcccgagaactgtgtgtggatact

SEQ ID NO: 374820 - DNA, 25 bp, Mus musculus
ctcccgagaggaagcaactgcgttt

SEQ ID NO: 374821 - DNA, 25 bp, Mus musculus
ctcccgagaggatgcaactgcgttt

SEQ ID NO: 374822 - DNA, 25 bp, Mus musculus
ctcccgagtactcgattacagacat

SEQ ID NO: 374823 - DNA, 25 bp, Mus musculus
ctcccgagtactggattacagacat

SEQ ID NO: 374824 - DNA, 25 bp, Mus musculus
ctcccgatcacaaccattatcaagg

SEQ ID NO: 374825 - DNA, 25 bp, Mus musculus
ctcccgatcacatccattatcaagg

SEQ ID NO: 374826 - DNA, 25 bp, Mus musculus
ctcccgctcgctcgctgggaaagag

SEQ ID NO: 374827 - DNA, 25 bp, Mus musculus
ctcccgctcgctggctgggaaagag

SEQ ID NO: 374828 - DNA, 25 bp, Mus musculus
ctcccggaacgcagccgacaaggag

SEQ ID NO: 374829 - DNA, 25 bp, Mus musculus
ctcccggaacgctgccgacaaggag

SEQ ID NO: 374830 - DNA, 25 bp, Mus musculus
ctcccggaacttcaatttctcatta

SEQ ID NO: 374831 - DNA, 25 bp, Mus musculus
ctcccggaacttgaatttctcatta

SEQ ID NO: 374832 - DNA, 25 bp, Mus musculus
ctcccggacatcaattttctcataa

SEQ ID NO: 374833 - DNA, 25 bp, Mus musculus
ctcccggacatctattttctcataa

SEQ ID NO: 374834 - DNA, 25 bp, Mus musculus
ctcccggaccgcagagagatcatct

SEQ ID NO: 374835 - DNA, 25 bp, Mus musculus
ctcccggaccgctgagagatcatct

SEQ ID NO: 374836 - DNA, 25 bp, Mus musculus
ctcccggagagcagggttgctgtaa

SEQ ID NO: 374837 - DNA, 25 bp, Mus musculus
ctcccggagagctgggttgctgtaa

SEQ ID NO: 374838 - DNA, 25 bp, Mus musculus
ctcccggaggacaagtgctgtgcat

SEQ ID NO: 374839 - DNA, 25 bp, Mus musculus
ctcccggaggactagtgctgtgcat

SEQ ID NO: 374840 - DNA, 25 bp, Mus musculus
ctcccggaggtacctatggtagtta

SEQ ID NO: 374841 - DNA, 25 bp, Mus musculus
ctcccggaggtagctatggtagtta

SEQ ID NO: 374842 - DNA, 25 bp, Mus musculus
ctcccggatgacaacaaggcagatg

SEQ ID NO: 374843 - DNA, 25 bp, Mus musculus
ctcccggatgactacaaggcagatg

SEQ ID NO: 374844 - DNA, 25 bp, Mus musculus
ctcccggatgatcgtgtggaactca

SEQ ID NO: 374845 - DNA, 25 bp, Mus musculus
ctcccggatgatggtgtggaactca

SEQ ID NO: 374846 - DNA, 25 bp, Mus musculus
ctcccggcctttagttaagcaatat

SEQ ID NO: 374847 - DNA, 25 bp, Mus musculus
ctcccggccttttgttaagcaatat

SEQ ID NO: 374848 - DNA, 25 bp, Mus musculus
ctcccgggccagatgcaggtagaat

SEQ ID NO: 374849 - DNA, 25 bp, Mus musculus
ctcccgggccagttgcaggtagaat

SEQ ID NO: 374850 - DNA, 25 bp, Mus musculus
ctcccggtgaagatgcgcagtgcaa

SEQ ID NO: 374851 - DNA, 25 bp, Mus musculus
ctcccggtgaagttgcgcagtgcaa

SEQ ID NO: 374852 - DNA, 25 bp, Mus musculus
ctcccggttcctcgaagtatgatga

SEQ ID NO: 374853 - DNA, 25 bp, Mus musculus
ctcccggttcctggaagtatgatga

SEQ ID NO: 374854 - DNA, 25 bp, Mus musculus
ctcccgtagcctcatggactgtttt

SEQ ID NO: 374855 - DNA, 25 bp, Mus musculus
ctcccgtagcctgatggactgtttt

SEQ ID NO: 374856 - DNA, 25 bp, Mus musculus
ctcccgtcagagagactcgcgggat

SEQ ID NO: 374857 - DNA, 25 bp, Mus musculus
ctcccgtcagagtgactcgcgggat

SEQ ID NO: 374858 - DNA, 25 bp, Mus musculus
ctcccgtctcttcattcaaaacaaa

SEQ ID NO: 374859 - DNA, 25 bp, Mus musculus
ctcccgtctcttgattcaaaacaaa

SEQ ID NO: 374860 - DNA, 25 bp, Mus musculus
ctcccgtgtggtcattttcagcagg

SEQ ID NO: 374861 - DNA, 25 bp, Mus musculus
ctcccgtgtggtgattttcagcagg

SEQ ID NO: 374862 - DNA, 25 bp, Mus musculus
ctcccgttaggaactgaggtgctat

SEQ ID NO: 374863 - DNA, 25 bp, Mus musculus
ctcccgttaggatctgaggtgctat

SEQ ID NO: 374864 - DNA, 25 bp, Mus musculus
ctcccgttccttcgtagatgtgtca

SEQ ID NO: 374865 - DNA, 25 bp, Mus musculus
ctcccgttccttggtagatgtgtca

SEQ ID NO: 374866 - DNA, 25 bp, Mus musculus
ctccctaagagccagtggcttagaa

SEQ ID NO: 374867 - DNA, 25 bp, Mus musculus
ctccctaagagcgagtggcttagaa

SEQ ID NO: 374868 - DNA, 25 bp, Mus musculus
ctccctacaggtacaccgtagtagt

SEQ ID NO: 374869 - DNA, 25 bp, Mus musculus
ctccctacaggttcaccgtagtagt

SEQ ID NO: 374870 - DNA, 25 bp, Mus musculus
ctccctacagtgacagcaataccag

SEQ ID NO: 374871 - DNA, 25 bp, Mus musculus
ctccctacagtgtcagcaataccag

SEQ ID NO: 374872 - DNA, 25 bp, Mus musculus
ctccctacctctatttaactgatat

SEQ ID NO: 374873 - DNA, 25 bp, Mus musculus
ctccctacctctttttaactgatat

SEQ ID NO: 374874 - DNA, 25 bp, Mus musculus
ctccctacgggacgacatgctcagg

SEQ ID NO: 374875 - DNA, 25 bp, Mus musculus
ctccctacgggaggacatgctcagg

SEQ ID NO: 374876 - DNA, 25 bp, Mus musculus
ctccctacgtgtctattcttgggat

SEQ ID NO: 374877 - DNA, 25 bp, Mus musculus
ctccctacgtgtgtattcttgggat

SEQ ID NO: 374878 - DNA, 25 bp, Mus musculus
ctccctacgttgctggtgtacaaag

SEQ ID NO: 374879 - DNA, 25 bp, Mus musculus
ctccctacgttggtggtgtacaaag

SEQ ID NO: 374880 - DNA, 25 bp, Mus musculus
ctccctactgtaaggcagttcatct

SEQ ID NO: 374881 - DNA, 25 bp, Mus musculus
ctccctactgtatggcagttcatct

SEQ ID NO: 374882 - DNA, 25 bp, Mus musculus
ctccctagaggaatcggactggcta

SEQ ID NO: 374883 - DNA, 25 bp, Mus musculus
ctccctagaggattcggactggcta

SEQ ID NO: 374884 - DNA, 25 bp, Mus musculus
ctccctagcgtcagggcagaggttt

SEQ ID NO: 374885 - DNA, 25 bp, Mus musculus
ctccctagcgtctgggcagaggttt

SEQ ID NO: 374886 - DNA, 25 bp, Mus musculus
ctccctaggtggacagggtcacaga

SEQ ID NO: 374887 - DNA, 25 bp, Mus musculus
ctccctaggtggtcagggtcacaga

SEQ ID NO: 374888 - DNA, 25 bp, Mus musculus
ctccctagtgctcgtgttacagagc

SEQ ID NO: 374889 - DNA, 25 bp, Mus musculus
ctccctagtgctggtgttacagagc

SEQ ID NO: 374890 - DNA, 25 bp, Mus musculus
ctccctatcgttcttagcagacgta

SEQ ID NO: 374891 - DNA, 25 bp, Mus musculus
ctccctatcgttgttagcagacgta

SEQ ID NO: 374892 - DNA, 25 bp, Mus musculus
ctccctattcgaaaaagatggtgac

SEQ ID NO: 374893 - DNA, 25 bp, Mus musculus
ctccctattcgataaagatggtgac

SEQ ID NO: 374894 - DNA, 25 bp, Mus musculus
ctccctattgacagatatgagaatc

SEQ ID NO: 374895 - DNA, 25 bp, Mus musculus
ctccctattgactgatatgagaatc

SEQ ID NO: 374896 - DNA, 25 bp, Mus musculus
ctccctatttttatgaataccatca

SEQ ID NO: 374897 - DNA, 25 bp, Mus musculus
ctccctatttttttgaataccatca

SEQ ID NO: 374898 - DNA, 25 bp, Mus musculus
ctccctcactcaagttagagcttgt

SEQ ID NO: 374899 - DNA, 25 bp, Mus musculus
ctccctcactcatgttagagcttgt

SEQ ID NO: 374900 - DNA, 25 bp, Mus musculus
ctccctcagcttatgtgaacacttt

SEQ ID NO: 374901 - DNA, 25 bp, Mus musculus
ctccctcagcttttgtgaacacttt

SEQ ID NO: 374902 - DNA, 25 bp, Mus musculus
ctccctcagtatagccacagcaaga

SEQ ID NO: 374903 - DNA, 25 bp, Mus musculus
ctccctcagtattgccacagcaaga

SEQ ID NO: 374904 - DNA, 25 bp, Mus musculus
ctccctcagtgtaccttaaaaggct

SEQ ID NO: 374905 - DNA, 25 bp, Mus musculus
ctccctcagtgttccttaaaaggct

SEQ ID NO: 374906 - DNA, 25 bp, Mus musculus
ctccctcatacaaaccacattgaaa

SEQ ID NO: 374907 - DNA, 25 bp, Mus musculus
ctccctcatacataccacattgaaa

SEQ ID NO: 374908 - DNA, 25 bp, Mus musculus
ctccctcatgataactctagctttg

SEQ ID NO: 374909 - DNA, 25 bp, Mus musculus
ctccctcatgattactctagctttg

SEQ ID NO: 374910 - DNA, 25 bp, Mus musculus
ctccctccagagacttactttattt

SEQ ID NO: 374911 - DNA, 25 bp, Mus musculus
ctccctccagagtcttactttattt

SEQ ID NO: 374912 - DNA, 25 bp, Mus musculus
ctccctcccatcatataaatctaaa

SEQ ID NO: 374913 - DNA, 25 bp, Mus musculus
ctccctcccatcttataaatctaaa

SEQ ID NO: 374914 - DNA, 25 bp, Mus musculus
ctccctcccattctatttgtaacag

SEQ ID NO: 374915 - DNA, 25 bp, Mus musculus
ctccctcccattgtatttgtaacag

SEQ ID NO: 374916 - DNA, 25 bp, Mus musculus
ctccctccgaaactctagtttgcaa

SEQ ID NO: 374917 - DNA, 25 bp, Mus musculus
ctccctccgaaagtctagtttgcaa

SEQ ID NO: 374918 - DNA, 25 bp, Mus musculus
ctccctccggagaagactagaaact

SEQ ID NO: 374919 - DNA, 25 bp, Mus musculus
ctccctccggagtagactagaaact

SEQ ID NO: 374920 - DNA, 25 bp, Mus musculus
ctccctcctataactggtgtggcag

SEQ ID NO: 374921 - DNA, 25 bp, Mus musculus
ctccctcctatatctggtgtggcag

SEQ ID NO: 374922 - DNA, 25 bp, Mus musculus
ctccctcctctaatacatttcttaa

SEQ ID NO: 374923 - DNA, 25 bp, Mus musculus
ctccctcctctattacatttcttaa

SEQ ID NO: 374924 - DNA, 25 bp, Mus musculus
ctccctcctttcatcgagggaaatg

SEQ ID NO: 374925 - DNA, 25 bp, Mus musculus
ctccctcctttcttcgagggaaatg

SEQ ID NO: 374926 - DNA, 25 bp, Mus musculus
ctccctcgaagcatgtactcaagtt

SEQ ID NO: 374927 - DNA, 25 bp, Mus musculus
ctccctcgaagcttgtactcaagtt

SEQ ID NO: 374928 - DNA, 25 bp, Mus musculus
ctccctcgataaaccgaggctgtgg

SEQ ID NO: 374929 - DNA, 25 bp, Mus musculus
ctccctcgataatccgaggctgtgg

SEQ ID NO: 374930 - DNA, 25 bp, Mus musculus
ctccctcgctttcaacagtgataca

SEQ ID NO: 374931 - DNA, 25 bp, Mus musculus
ctccctcgctttgaacagtgataca

SEQ ID NO: 374932 - DNA, 25 bp, Mus musculus
ctccctcgggtactgaaacattcat

SEQ ID NO: 374933 - DNA, 25 bp, Mus musculus
ctccctcgggtagtgaaacattcat

SEQ ID NO: 374934 - DNA, 25 bp, Mus musculus
ctccctcgggtcatataaacccttg

SEQ ID NO: 374935 - DNA, 25 bp, Mus musculus
ctccctcgggtcttataaacccttg

SEQ ID NO: 374936 - DNA, 25 bp, Mus musculus
ctccctctacctatggcaagtgata

SEQ ID NO: 374937 - DNA, 25 bp, Mus musculus
ctccctctacctttggcaagtgata

SEQ ID NO: 374938 - DNA, 25 bp, Mus musculus
ctccctctagctctacgtgaagtga

SEQ ID NO: 374939 - DNA, 25 bp, Mus musculus
ctccctctagctgtacgtgaagtga

SEQ ID NO: 374940 - DNA, 25 bp, Mus musculus
ctccctctcaagcagttgatttttt

SEQ ID NO: 374941 - DNA, 25 bp, Mus musculus
ctccctctcaaggagttgatttttt

SEQ ID NO: 374942 - DNA, 25 bp, Mus musculus
ctccctctccttctatgtaatatct

SEQ ID NO: 374943 - DNA, 25 bp, Mus musculus
ctccctctccttgtatgtaatatct

SEQ ID NO: 374944 - DNA, 25 bp, Mus musculus
ctccctctctaaataaatgtgctat

SEQ ID NO: 374945 - DNA, 25 bp, Mus musculus
ctccctctctaattaaatgtgctat

SEQ ID NO: 374946 - DNA, 25 bp, Mus musculus
ctccctctctgtaatactcttaaca

SEQ ID NO: 374947 - DNA, 25 bp, Mus musculus
ctccctctctgtagaaatgttgaag

SEQ ID NO: 374948 - DNA, 25 bp, Mus musculus
ctccctctctgttatactcttaaca

SEQ ID NO: 374949 - DNA, 25 bp, Mus musculus
ctccctctctgttgaaatgttgaag

SEQ ID NO: 374950 - DNA, 25 bp, Mus musculus
ctccctctgctgagcgaagacaaga

SEQ ID NO: 374951 - DNA, 25 bp, Mus musculus
ctccctctgctgtgcgaagacaaga

SEQ ID NO: 374952 - DNA, 25 bp, Mus musculus
ctccctctggagagcagctgtctgt

SEQ ID NO: 374953 - DNA, 25 bp, Mus musculus
ctccctctggagtgcagctgtctgt

SEQ ID NO: 374954 - DNA, 25 bp, Mus musculus
ctccctcttccactaacttgaagga

SEQ ID NO: 374955 - DNA, 25 bp, Mus musculus
ctccctcttccagtaacttgaagga

SEQ ID NO: 374956 - DNA, 25 bp, Mus musculus
ctccctcttgacctatgcatcttta

SEQ ID NO: 374957 - DNA, 25 bp, Mus musculus
ctccctcttgacgtatgcatcttta

SEQ ID NO: 374958 - DNA, 25 bp, Mus musculus
ctccctcttgagagcgttataatct

SEQ ID NO: 374959 - DNA, 25 bp, Mus musculus
ctccctcttgagtgcgttataatct

SEQ ID NO: 374960 - DNA, 25 bp, Mus musculus
ctccctctttgtcgcaagctagaac

SEQ ID NO: 374961 - DNA, 25 bp, Mus musculus
ctccctctttgtggcaagctagaac

SEQ ID NO: 374962 - DNA, 25 bp, Mus musculus
ctccctgaacatactaagcactcta

SEQ ID NO: 374963 - DNA, 25 bp, Mus musculus
ctccctgaacattctaagcactcta

SEQ ID NO: 374964 - DNA, 25 bp, Mus musculus
ctccctgaagacagattgtcctttt

SEQ ID NO: 374965 - DNA, 25 bp, Mus musculus
ctccctgaagactgattgtcctttt

SEQ ID NO: 374966 - DNA, 25 bp, Mus musculus
ctccctgacagaagcttagactaca

SEQ ID NO: 374967 - DNA, 25 bp, Mus musculus
ctccctgacagatgcttagactaca

SEQ ID NO: 374968 - DNA, 25 bp, Mus musculus
ctccctgacatccacagagcagaga

SEQ ID NO: 374969 - DNA, 25 bp, Mus musculus
ctccctgacatcgacagagcagaga

SEQ ID NO: 374970 - DNA, 25 bp, Mus musculus
ctccctgactgactggtgctgttca

SEQ ID NO: 374971 - DNA, 25 bp, Mus musculus
ctccctgactgagtggtgctgttca

SEQ ID NO: 374972 - DNA, 25 bp, Mus musculus
ctccctgagacaagacaccctgata

SEQ ID NO: 374973 - DNA, 25 bp, Mus musculus
ctccctgagacatgacaccctgata

SEQ ID NO: 374974 - DNA, 25 bp, Mus musculus
ctccctgagggcaaggggctgtcat

SEQ ID NO: 374975 - DNA, 25 bp, Mus musculus
ctccctgagggctaggggctgtcat

SEQ ID NO: 374976 - DNA, 25 bp, Mus musculus
ctccctgagtatcatgtgctgttta

SEQ ID NO: 374977 - DNA, 25 bp, Mus musculus
ctccctgagtatgatgtgctgttta

SEQ ID NO: 374978 - DNA, 25 bp, Mus musculus
ctccctgatgcacgttctttaaggt

SEQ ID NO: 374979 - DNA, 25 bp, Mus musculus
ctccctgatgcaggttctttaaggt

SEQ ID NO: 374980 - DNA, 25 bp, Mus musculus
ctccctgattatattagaggactga

SEQ ID NO: 374981 - DNA, 25 bp, Mus musculus
ctccctgattattttagaggactga

SEQ ID NO: 374982 - DNA, 25 bp, Mus musculus
ctccctgcaaagaagataaggttct

SEQ ID NO: 374983 - DNA, 25 bp, Mus musculus
ctccctgcaaagtagataaggttct

SEQ ID NO: 374984 - DNA, 25 bp, Mus musculus
ctccctgcaagcaattcaactggta

SEQ ID NO: 374985 - DNA, 25 bp, Mus musculus
ctccctgcaagctattcaactggta

SEQ ID NO: 374986 - DNA, 25 bp, Mus musculus
ctccctgcaagtagttcctgagcaa

SEQ ID NO: 374987 - DNA, 25 bp, Mus musculus
ctccctgcaagttgttcctgagcaa

SEQ ID NO: 374988 - DNA, 25 bp, Mus musculus
ctccctgcatttcctattagtggtg

SEQ ID NO: 374989 - DNA, 25 bp, Mus musculus
ctccctgcatttgctattagtggtg

SEQ ID NO: 374990 - DNA, 25 bp, Mus musculus
ctccctgccatcaacaaaacatgtt

SEQ ID NO: 374991 - DNA, 25 bp, Mus musculus
ctccctgccatctacaaaacatgtt

SEQ ID NO: 374992 - DNA, 25 bp, Mus musculus
ctccctgcggcaaagtgaggttcag

SEQ ID NO: 374993 - DNA, 25 bp, Mus musculus
ctccctgcggcatagtgaggttcag

SEQ ID NO: 374994 - DNA, 25 bp, Mus musculus
ctccctgcgtttacttaacatcttg

SEQ ID NO: 374995 - DNA, 25 bp, Mus musculus
ctccctgcgtttcaaccattataaa

SEQ ID NO: 374996 - DNA, 25 bp, Mus musculus
ctccctgcgtttgaaccattataaa

SEQ ID NO: 374997 - DNA, 25 bp, Mus musculus
ctccctgcgttttcttaacatcttg

SEQ ID NO: 374998 - DNA, 25 bp, Mus musculus
ctccctgctggaaataagtcacttc

SEQ ID NO: 374999 - DNA, 25 bp, Mus musculus
ctccctgctggatataagtcacttc

SEQ ID NO: 375000 - DNA, 25 bp, Mus musculus
ctccctgctgtaatggtcatagcag

SEQ ID NO: 375001 - DNA, 25 bp, Mus musculus
ctccctgctgtattggtcatagcag

SEQ ID NO: 375002 - DNA, 25 bp, Mus musculus
ctccctgctgtgcatgtacaaccag

SEQ ID NO: 375003 - DNA, 25 bp, Mus musculus
ctccctgctgtggatgtacaaccag

SEQ ID NO: 375004 - DNA, 25 bp, Mus musculus
ctccctgctttgagagaggatccaa

SEQ ID NO: 375005 - DNA, 25 bp, Mus musculus
ctccctgctttgtgagaggatccaa

SEQ ID NO: 375006 - DNA, 25 bp, Mus musculus
ctccctgcttttcactgtaaaccag

SEQ ID NO: 375007 - DNA, 25 bp, Mus musculus
ctccctgcttttgactgtaaaccag

SEQ ID NO: 375008 - DNA, 25 bp, Mus musculus
ctccctggaaataactgagcacttt

SEQ ID NO: 375009 - DNA, 25 bp, Mus musculus
ctccctggaaattactgagcacttt

SEQ ID NO: 375010 - DNA, 25 bp, Mus musculus
ctccctggacatctttgctgaggaa

SEQ ID NO: 375011 - DNA, 25 bp, Mus musculus
ctccctggacatgtttgctgaggaa

SEQ ID NO: 375012 - DNA, 25 bp, Mus musculus
ctccctggacgtctgattgatgctg

SEQ ID NO: 375013 - DNA, 25 bp, Mus musculus
ctccctggacgtgtgattgatgctg

SEQ ID NO: 375014 - DNA, 25 bp, Mus musculus
ctccctggagacaagctttcatagt

SEQ ID NO: 375015 - DNA, 25 bp, Mus musculus
ctccctggagactagctttcatagt

SEQ ID NO: 375016 - DNA, 25 bp, Mus musculus
ctccctggaggaatagtcaagcatc

SEQ ID NO: 375017 - DNA, 25 bp, Mus musculus
ctccctggaggattagtcaagcatc

SEQ ID NO: 375018 - DNA, 25 bp, Mus musculus
ctccctggcattcagagacgagaga

SEQ ID NO: 375019 - DNA, 25 bp, Mus musculus
ctccctggcattgagagacgagaga

SEQ ID NO: 375020 - DNA, 25 bp, Mus musculus
ctccctggccctcagatactgagat

SEQ ID NO: 375021 - DNA, 25 bp, Mus musculus
ctccctggccctgagatactgagat

SEQ ID NO: 375022 - DNA, 25 bp, Mus musculus
ctccctggcctcagtttagatagga

SEQ ID NO: 375023 - DNA, 25 bp, Mus musculus
ctccctggcctctgtttagatagga

SEQ ID NO: 375024 - DNA, 25 bp, Mus musculus
ctccctggcttccttgaatgagtta

SEQ ID NO: 375025 - DNA, 25 bp, Mus musculus
ctccctggcttcgttgaatgagtta

SEQ ID NO: 375026 - DNA, 25 bp, Mus musculus
ctccctgggaaaagtgccctccaag

SEQ ID NO: 375027 - DNA, 25 bp, Mus musculus
ctccctgggaaatgtgccctccaag

SEQ ID NO: 375028 - DNA, 25 bp, Mus musculus
ctccctgggaagcaaccgaagaatg

SEQ ID NO: 375029 - DNA, 25 bp, Mus musculus
ctccctgggaaggaaccgaagaatg

SEQ ID NO: 375030 - DNA, 25 bp, Mus musculus
ctccctgggtgactctgaatttggt

SEQ ID NO: 375031 - DNA, 25 bp, Mus musculus
ctccctgggtgagtctgaatttggt

SEQ ID NO: 375032 - DNA, 25 bp, Mus musculus
ctccctgggtttccagagttcctgt

SEQ ID NO: 375033 - DNA, 25 bp, Mus musculus
ctccctgggtttgcagagttcctgt

SEQ ID NO: 375034 - DNA, 25 bp, Mus musculus
ctccctggtaagcagagactcaaga

SEQ ID NO: 375035 - DNA, 25 bp, Mus musculus
ctccctggtaaggagagactcaaga

SEQ ID NO: 375036 - DNA, 25 bp, Mus musculus
ctccctggtcctcatatagtactga

SEQ ID NO: 375037 - DNA, 25 bp, Mus musculus
ctccctggtcctgatatagtactga

SEQ ID NO: 375038 - DNA, 25 bp, Mus musculus
ctccctgtatgtccctttctttcag

SEQ ID NO: 375039 - DNA, 25 bp, Mus musculus
ctccctgtatgtgcctttctttcag

SEQ ID NO: 375040 - DNA, 25 bp, Mus musculus
ctccctgtcacaagcatattcaaac

SEQ ID NO: 375041 - DNA, 25 bp, Mus musculus
ctccctgtcacatgcatattcaaac

SEQ ID NO: 375042 - DNA, 25 bp, Mus musculus
ctccctgtcagaccgctgttttaaa

SEQ ID NO: 375043 - DNA, 25 bp, Mus musculus
ctccctgtcagagcgctgttttaaa

SEQ ID NO: 375044 - DNA, 25 bp, Mus musculus
ctccctgtccttatgtgatgcatta

SEQ ID NO: 375045 - DNA, 25 bp, Mus musculus
ctccctgtccttttgtgatgcatta

SEQ ID NO: 375046 - DNA, 25 bp, Mus musculus
ctccctgtgacacgcaagtacagtg

SEQ ID NO: 375047 - DNA, 25 bp, Mus musculus
ctccctgtgacaggcaagtacagtg

SEQ ID NO: 375048 - DNA, 25 bp, Mus musculus
ctccctgtgatgatgatagccatgt

SEQ ID NO: 375049 - DNA, 25 bp, Mus musculus
ctccctgtgatgttgatagccatgt

SEQ ID NO: 375050 - DNA, 25 bp, Mus musculus
ctccctgtgctcaaatatgtgtgta

SEQ ID NO: 375051 - DNA, 25 bp, Mus musculus
ctccctgtgctctaatatgtgtgta

SEQ ID NO: 375052 - DNA, 25 bp, Mus musculus
ctccctgtgctgatggtgatgctga

SEQ ID NO: 375053 - DNA, 25 bp, Mus musculus
ctccctgtgctgttggtgatgctga

SEQ ID NO: 375054 - DNA, 25 bp, Mus musculus
ctccctgtggagcacgacattgacc

SEQ ID NO: 375055 - DNA, 25 bp, Mus musculus
ctccctgtggaggacgacattgacc

SEQ ID NO: 375056 - DNA, 25 bp, Mus musculus
ctccctgtggcaattgagctttatg

SEQ ID NO: 375057 - DNA, 25 bp, Mus musculus
ctccctgtggcactacatcatggta

SEQ ID NO: 375058 - DNA, 25 bp, Mus musculus
ctccctgtggcagtacatcatggta

SEQ ID NO: 375059 - DNA, 25 bp, Mus musculus
ctccctgtggcatttgagctttatg

SEQ ID NO: 375060 - DNA, 25 bp, Mus musculus
ctccctgtggtactccagattcaac

SEQ ID NO: 375061 - DNA, 25 bp, Mus musculus
ctccctgtggtagtccagattcaac

SEQ ID NO: 375062 - DNA, 25 bp, Mus musculus
ctccctgtggttccctaaagacttg

SEQ ID NO: 375063 - DNA, 25 bp, Mus musculus
ctccctgtggttgcctaaagacttg

SEQ ID NO: 375064 - DNA, 25 bp, Mus musculus
ctccctgttagtacttcatgtggtt

SEQ ID NO: 375065 - DNA, 25 bp, Mus musculus
ctccctgttagttcttcatgtggtt

SEQ ID NO: 375066 - DNA, 25 bp, Mus musculus
ctccctgttcctctgttggttgtga

SEQ ID NO: 375067 - DNA, 25 bp, Mus musculus
ctccctgttcctgtgttggttgtga

SEQ ID NO: 375068 - DNA, 25 bp, Mus musculus
ctcccttaagagaatcactgttctg

SEQ ID NO: 375069 - DNA, 25 bp, Mus musculus
ctcccttaagagtatcactgttctg

SEQ ID NO: 375070 - DNA, 25 bp, Mus musculus
ctcccttagtgtagttatgtccctc

SEQ ID NO: 375071 - DNA, 25 bp, Mus musculus
ctcccttagtgttgttatgtccctc

SEQ ID NO: 375072 - DNA, 25 bp, Mus musculus
ctcccttcacaaatagaaacggaag

SEQ ID NO: 375073 - DNA, 25 bp, Mus musculus
ctcccttcacaattagaaacggaag

SEQ ID NO: 375074 - DNA, 25 bp, Mus musculus
ctcccttcactcatgcagagattag

SEQ ID NO: 375075 - DNA, 25 bp, Mus musculus
ctcccttcactcttgcagagattag

SEQ ID NO: 375076 - DNA, 25 bp, Mus musculus
ctcccttcagcgctgcacctggaca

SEQ ID NO: 375077 - DNA, 25 bp, Mus musculus
ctcccttcagcggtgcacctggaca

SEQ ID NO: 375078 - DNA, 25 bp, Mus musculus
ctcccttcagtgagtccagatcaag

SEQ ID NO: 375079 - DNA, 25 bp, Mus musculus
ctcccttcagtgtgtccagatcaag

SEQ ID NO: 375080 - DNA, 25 bp, Mus musculus
ctcccttcatggatgtgtttggtgt

SEQ ID NO: 375081 - DNA, 25 bp, Mus musculus
ctcccttcatggttgtgtttggtgt

SEQ ID NO: 375082 - DNA, 25 bp, Mus musculus
ctcccttcccagcacaaagattata

SEQ ID NO: 375083 - DNA, 25 bp, Mus musculus
ctcccttcccaggacaaagattata

SEQ ID NO: 375084 - DNA, 25 bp, Mus musculus
ctcccttcccatagtggcagtgaaa

SEQ ID NO: 375085 - DNA, 25 bp, Mus musculus
ctcccttcccattgtggcagtgaaa

SEQ ID NO: 375086 - DNA, 25 bp, Mus musculus
ctcccttccctcaagtaaactgatt

SEQ ID NO: 375087 - DNA, 25 bp, Mus musculus
ctcccttccctctagtaaactgatt

SEQ ID NO: 375088 - DNA, 25 bp, Mus musculus
ctcccttcccttattgacatgaatt

SEQ ID NO: 375089 - DNA, 25 bp, Mus musculus
ctcccttccctttttgacatgaatt

SEQ ID NO: 375090 - DNA, 25 bp, Mus musculus
ctcccttccggtatgtgcttagcat

SEQ ID NO: 375091 - DNA, 25 bp, Mus musculus
ctcccttccggtttgtgcttagcat

SEQ ID NO: 375092 - DNA, 25 bp, Mus musculus
ctcccttcctttcgcatatgtatgt

SEQ ID NO: 375093 - DNA, 25 bp, Mus musculus
ctcccttcctttctcaatgaaaata

SEQ ID NO: 375094 - DNA, 25 bp, Mus musculus
ctcccttcctttggcatatgtatgt

SEQ ID NO: 375095 - DNA, 25 bp, Mus musculus
ctcccttcctttgtcaatgaaaata

SEQ ID NO: 375096 - DNA, 25 bp, Mus musculus
ctcccttcggctaatattttggcac

SEQ ID NO: 375097 - DNA, 25 bp, Mus musculus
ctcccttcggcttatattttggcac

SEQ ID NO: 375098 - DNA, 25 bp, Mus musculus
ctcccttctagtatccaatggcctg

SEQ ID NO: 375099 - DNA, 25 bp, Mus musculus
ctcccttctagtttccaatggcctg

SEQ ID NO: 375100 - DNA, 25 bp, Mus musculus
ctcccttctcagcataagcaactgg

SEQ ID NO: 375101 - DNA, 25 bp, Mus musculus
ctcccttctcaggataagcaactgg

SEQ ID NO: 375102 - DNA, 25 bp, Mus musculus
ctcccttcttctatactgaaactga

SEQ ID NO: 375103 - DNA, 25 bp, Mus musculus
ctcccttcttctttactgaaactga

SEQ ID NO: 375104 - DNA, 25 bp, Mus musculus
ctcccttgagctccttttgggaaga

SEQ ID NO: 375105 - DNA, 25 bp, Mus musculus
ctcccttgagctgcttttgggaaga

SEQ ID NO: 375106 - DNA, 25 bp, Mus musculus
ctcccttgcactcgttggaggcaga

SEQ ID NO: 375107 - DNA, 25 bp, Mus musculus
ctcccttgcactggttggaggcaga

SEQ ID NO: 375108 - DNA, 25 bp, Mus musculus
ctcccttgcattatttctttgtttc

SEQ ID NO: 375109 - DNA, 25 bp, Mus musculus
ctcccttgcattttttctttgtttc

SEQ ID NO: 375110 - DNA, 25 bp, Mus musculus
ctcccttgccttatatggtgaactc

SEQ ID NO: 375111 - DNA, 25 bp, Mus musculus
ctcccttgccttttatggtgaactc

SEQ ID NO: 375112 - DNA, 25 bp, Mus musculus
ctcccttgcttgcatctgtatatag

SEQ ID NO: 375113 - DNA, 25 bp, Mus musculus
ctcccttgcttggatctgtatatag

SEQ ID NO: 375114 - DNA, 25 bp, Mus musculus
ctcccttggacgcagagactggctt

SEQ ID NO: 375115 - DNA, 25 bp, Mus musculus
ctcccttggacggagagactggctt

SEQ ID NO: 375116 - DNA, 25 bp, Mus musculus
ctcccttggataagattcttcatgg

SEQ ID NO: 375117 - DNA, 25 bp, Mus musculus
ctcccttggatatgattcttcatgg

SEQ ID NO: 375118 - DNA, 25 bp, Mus musculus
ctcccttggctcattgcaaataccg

SEQ ID NO: 375119 - DNA, 25 bp, Mus musculus
ctcccttggctctttgcaaataccg

SEQ ID NO: 375120 - DNA, 25 bp, Mus musculus
ctcccttgggctcttttctataaag

SEQ ID NO: 375121 - DNA, 25 bp, Mus musculus
ctcccttgggctgttttctataaag

SEQ ID NO: 375122 - DNA, 25 bp, Mus musculus
ctcccttgtaatctcccaataaaca

SEQ ID NO: 375123 - DNA, 25 bp, Mus musculus
ctcccttgtaatgtcccaataaaca

SEQ ID NO: 375124 - DNA, 25 bp, Mus musculus
ctcccttgtgttacaaccaatcaga

SEQ ID NO: 375125 - DNA, 25 bp, Mus musculus
ctcccttgtgtttcaaccaatcaga

SEQ ID NO: 375126 - DNA, 25 bp, Mus musculus
ctcccttgttgaattcgttgtgaca

SEQ ID NO: 375127 - DNA, 25 bp, Mus musculus
ctcccttgttgatttcgttgtgaca

SEQ ID NO: 375128 - DNA, 25 bp, Mus musculus
ctccctttagcgctgcacctggaca

SEQ ID NO: 375129 - DNA, 25 bp, Mus musculus
ctccctttagcggtgcacctggaca

SEQ ID NO: 375130 - DNA, 25 bp, Mus musculus
ctccctttatgtaacagaccttgtc

SEQ ID NO: 375131 - DNA, 25 bp, Mus musculus
ctccctttatgttacagaccttgtc

SEQ ID NO: 375132 - DNA, 25 bp, Mus musculus
ctccctttcgtacggctaaggagca

SEQ ID NO: 375133 - DNA, 25 bp, Mus musculus
ctccctttcgtagggctaaggagca

SEQ ID NO: 375134 - DNA, 25 bp, Mus musculus
ctccctttctgtcgcttatcaaaaa

SEQ ID NO: 375135 - DNA, 25 bp, Mus musculus
ctccctttctgtggcttatcaaaaa

SEQ ID NO: 375136 - DNA, 25 bp, Mus musculus
ctccctttgaagatctgtccatatt

SEQ ID NO: 375137 - DNA, 25 bp, Mus musculus
ctccctttgaagttctgtccatatt

SEQ ID NO: 375138 - DNA, 25 bp, Mus musculus
ctccctttgagaaacaccacactga

SEQ ID NO: 375139 - DNA, 25 bp, Mus musculus
ctccctttgagatacaccacactga

SEQ ID NO: 375140 - DNA, 25 bp, Mus musculus
ctccctttgctgatacaccagtgac

SEQ ID NO: 375141 - DNA, 25 bp, Mus musculus
ctccctttgctgttacaccagtgac

SEQ ID NO: 375142 - DNA, 25 bp, Mus musculus
ctccctttggatagagttcccaaat

SEQ ID NO: 375143 - DNA, 25 bp, Mus musculus
ctccctttggattgagttcccaaat

SEQ ID NO: 375144 - DNA, 25 bp, Mus musculus
ctccctttgggtaatatgtagtgaa

SEQ ID NO: 375145 - DNA, 25 bp, Mus musculus
ctccctttgggttatatgtagtgaa

SEQ ID NO: 375146 - DNA, 25 bp, Mus musculus
ctccctttgttcctgctatgaaatg

SEQ ID NO: 375147 - DNA, 25 bp, Mus musculus
ctccctttgttcgtgctatgaaatg

SEQ ID NO: 375148 - DNA, 25 bp, Mus musculus
ctccctttttctacctatgattcaa

SEQ ID NO: 375149 - DNA, 25 bp, Mus musculus
ctccctttttcttcctatgattcaa

SEQ ID NO: 375150 - DNA, 25 bp, Mus musculus
ctccgaactactcctaagctgaaag

SEQ ID NO: 375151 - DNA, 25 bp, Mus musculus
ctccgaactactgctaagctgaaag

SEQ ID NO: 375152 - DNA, 25 bp, Mus musculus
ctccgaagaataaatgaatccaccc

SEQ ID NO: 375153 - DNA, 25 bp, Mus musculus
ctccgaagaatatatgaatccaccc

SEQ ID NO: 375154 - DNA, 25 bp, Mus musculus
ctccgactccttccattagcatatt

SEQ ID NO: 375155 - DNA, 25 bp, Mus musculus
ctccgactccttgcattagcatatt

SEQ ID NO: 375156 - DNA, 25 bp, Mus musculus
ctccgactgagcaaggccagaacct

SEQ ID NO: 375157 - DNA, 25 bp, Mus musculus
ctccgactgagctaggccagaacct

SEQ ID NO: 375158 - DNA, 25 bp, Mus musculus
ctccgactgtagaccagcctttaaa

SEQ ID NO: 375159 - DNA, 25 bp, Mus musculus
ctccgactgtagtccagcctttaaa

SEQ ID NO: 375160 - DNA, 25 bp, Mus musculus
ctccgagactgtaggccatgcatca

SEQ ID NO: 375161 - DNA, 25 bp, Mus musculus
ctccgagactgttggccatgcatca

SEQ ID NO: 375162 - DNA, 25 bp, Mus musculus
ctccgagattgtaaagcgtgaagac

SEQ ID NO: 375163 - DNA, 25 bp, Mus musculus
ctccgagattgttaagcgtgaagac

SEQ ID NO: 375164 - DNA, 25 bp, Mus musculus
ctccgagccatgactcaagaagaaa

SEQ ID NO: 375165 - DNA, 25 bp, Mus musculus
ctccgagccatgtctcaagaagaaa

SEQ ID NO: 375166 - DNA, 25 bp, Mus musculus
ctccgagcccttcgcatttctatga

SEQ ID NO: 375167 - DNA, 25 bp, Mus musculus
ctccgagcccttggcatttctatga

SEQ ID NO: 375168 - DNA, 25 bp, Mus musculus
ctccgaggcggacgctagccttgaa

SEQ ID NO: 375169 - DNA, 25 bp, Mus musculus
ctccgaggcggaggctagccttgaa

SEQ ID NO: 375170 - DNA, 25 bp, Mus musculus
ctccgagtccttctggatgtagcca

SEQ ID NO: 375171 - DNA, 25 bp, Mus musculus
ctccgagtccttgtggatgtagcca

SEQ ID NO: 375172 - DNA, 25 bp, Mus musculus
ctccgagtcggcactcagaggaatt

SEQ ID NO: 375173 - DNA, 25 bp, Mus musculus
ctccgagtcggctctcagaggaatt

SEQ ID NO: 375174 - DNA, 25 bp, Mus musculus
ctccgagtgccactgttaaaggcct

SEQ ID NO: 375175 - DNA, 25 bp, Mus musculus
ctccgagtgccagtgttaaaggcct

SEQ ID NO: 375176 - DNA, 25 bp, Mus musculus
ctccgagtgggtacaagcaaataac

SEQ ID NO: 375177 - DNA, 25 bp, Mus musculus
ctccgagtgggttcaagcaaataac

SEQ ID NO: 375178 - DNA, 25 bp, Mus musculus
ctccgagttctgctgtcacacacaa

SEQ ID NO: 375179 - DNA, 25 bp, Mus musculus
ctccgagttctggtgtcacacacaa

SEQ ID NO: 375180 - DNA, 25 bp, Mus musculus
ctccgatccaacagcaacattgttt

SEQ ID NO: 375181 - DNA, 25 bp, Mus musculus
ctccgatccaactgcaacattgttt

SEQ ID NO: 375182 - DNA, 25 bp, Mus musculus
ctccgatcccacaagcagtttaaat

SEQ ID NO: 375183 - DNA, 25 bp, Mus musculus
ctccgatcccactagcagtttaaat

SEQ ID NO: 375184 - DNA, 25 bp, Mus musculus
ctccgatgacagaaacgtgctttta

SEQ ID NO: 375185 - DNA, 25 bp, Mus musculus
ctccgatgacagtaacgtgctttta

SEQ ID NO: 375186 - DNA, 25 bp, Mus musculus
ctccgatggcggaggtttcttaaga

SEQ ID NO: 375187 - DNA, 25 bp, Mus musculus
ctccgatggcggtggtttcttaaga

SEQ ID NO: 375188 - DNA, 25 bp, Mus musculus
ctccgattgcttctttcagtttgga

SEQ ID NO: 375189 - DNA, 25 bp, Mus musculus
ctccgattgcttgtttcagtttgga

SEQ ID NO: 375190 - DNA, 25 bp, Mus musculus
ctccgatttgcactgtgacctacat

SEQ ID NO: 375191 - DNA, 25 bp, Mus musculus
ctccgatttgcagtgtgacctacat

SEQ ID NO: 375192 - DNA, 25 bp, Mus musculus
ctccgcaataatacaccagaccaga

SEQ ID NO: 375193 - DNA, 25 bp, Mus musculus
ctccgcaataattcaccagaccaga

SEQ ID NO: 375194 - DNA, 25 bp, Mus musculus
ctccgcaatcggcatttcaacattt

SEQ ID NO: 375195 - DNA, 25 bp, Mus musculus
ctccgcaatcgggatttcaacattt

SEQ ID NO: 375196 - DNA, 25 bp, Mus musculus
ctccgcaggacactttcttgtgtgt

SEQ ID NO: 375197 - DNA, 25 bp, Mus musculus
ctccgcaggacagtttcttgtgtgt

SEQ ID NO: 375198 - DNA, 25 bp, Mus musculus
ctccgcatctgtaacttctttttcc

SEQ ID NO: 375199 - DNA, 25 bp, Mus musculus
ctccgcatctgttacttctttttcc

SEQ ID NO: 375200 - DNA, 25 bp, Mus musculus
ctccgccaggtgctacaattgtaca

SEQ ID NO: 375201 - DNA, 25 bp, Mus musculus
ctccgccaggtggtacaattgtaca

SEQ ID NO: 375202 - DNA, 25 bp, Mus musculus
ctccgccatggacaaattttcgcac

SEQ ID NO: 375203 - DNA, 25 bp, Mus musculus
ctccgccatggagaaattttcgcac

SEQ ID NO: 375204 - DNA, 25 bp, Mus musculus
ctccgcctccggcagaagcaggctc

SEQ ID NO: 375205 - DNA, 25 bp, Mus musculus
ctccgcctccgggagaagcaggctc

SEQ ID NO: 375206 - DNA, 25 bp, Mus musculus
ctccgcctgaggacactgagctcca

SEQ ID NO: 375207 - DNA, 25 bp, Mus musculus
ctccgcctgaggtcactgagctcca

SEQ ID NO: 375208 - DNA, 25 bp, Mus musculus
ctccgcctggagaagattcacaaac

SEQ ID NO: 375209 - DNA, 25 bp, Mus musculus
ctccgcctggagtagattcacaaac

SEQ ID NO: 375210 - DNA, 25 bp, Mus musculus
ctccgcgaagcacgtttaactcaca

SEQ ID NO: 375211 - DNA, 25 bp, Mus musculus
ctccgcgaagcaggtttaactcaca

SEQ ID NO: 375212 - DNA, 25 bp, Mus musculus
ctccgctacattaattacccaaggt

SEQ ID NO: 375213 - DNA, 25 bp, Mus musculus
ctccgctacatttattacccaaggt

SEQ ID NO: 375214 - DNA, 25 bp, Mus musculus
ctccgctccaggacaacactaagga

SEQ ID NO: 375215 - DNA, 25 bp, Mus musculus
ctccgctccaggtcaacactaagga

SEQ ID NO: 375216 - DNA, 25 bp, Mus musculus
ctccgctgatgaatatccctgatgg

SEQ ID NO: 375217 - DNA, 25 bp, Mus musculus
ctccgctgatgattatccctgatgg

SEQ ID NO: 375218 - DNA, 25 bp, Mus musculus
ctccgctggtcccaatgatcagtta

SEQ ID NO: 375219 - DNA, 25 bp, Mus musculus
ctccgctggtccgaatgatcagtta

SEQ ID NO: 375220 - DNA, 25 bp, Mus musculus
ctccgctgtgttctcttctgaccaa

SEQ ID NO: 375221 - DNA, 25 bp, Mus musculus
ctccgctgtgttgtcttctgaccaa

SEQ ID NO: 375222 - DNA, 25 bp, Mus musculus
ctccgctttgtccaaaacaacgaca

SEQ ID NO: 375223 - DNA, 25 bp, Mus musculus
ctccgctttgtcgaaaacaacgaca

SEQ ID NO: 375224 - DNA, 25 bp, Mus musculus
ctccggaactatctcccagaggatg

SEQ ID NO: 375225 - DNA, 25 bp, Mus musculus
ctccggaactatgtcccagaggatg

SEQ ID NO: 375226 - DNA, 25 bp, Mus musculus
ctccggaagcaacaggctccaggac

SEQ ID NO: 375227 - DNA, 25 bp, Mus musculus
ctccggaagcaagaggctccaggac

SEQ ID NO: 375228 - DNA, 25 bp, Mus musculus
ctccggacagctctttaccatgaga

SEQ ID NO: 375229 - DNA, 25 bp, Mus musculus
ctccggacagctgtttaccatgaga

SEQ ID NO: 375230 - DNA, 25 bp, Mus musculus
ctccggagactcatcagattgatga

SEQ ID NO: 375231 - DNA, 25 bp, Mus musculus
ctccggagactcttcagattgatga

SEQ ID NO: 375232 - DNA, 25 bp, Mus musculus
ctccggagagcgctgtactatatga

SEQ ID NO: 375233 - DNA, 25 bp, Mus musculus
ctccggagagcggtgtactatatga

SEQ ID NO: 375234 - DNA, 25 bp, Mus musculus
ctccggagccctaagagtagggctt

SEQ ID NO: 375235 - DNA, 25 bp, Mus musculus
ctccggagcccttagagtagggctt

SEQ ID NO: 375236 - DNA, 25 bp, Mus musculus
ctccggaggatcaaggttcagtttc

SEQ ID NO: 375237 - DNA, 25 bp, Mus musculus
ctccggaggatctaggttcagtttc

SEQ ID NO: 375238 - DNA, 25 bp, Mus musculus
ctccggatacatcctaggcctaagt

SEQ ID NO: 375239 - DNA, 25 bp, Mus musculus
ctccggatacatgctaggcctaagt

SEQ ID NO: 375240 - DNA, 25 bp, Mus musculus
ctccggcaaggaccctaggaagcga

SEQ ID NO: 375241 - DNA, 25 bp, Mus musculus
ctccggcaaggagcctaggaagcga

SEQ ID NO: 375242 - DNA, 25 bp, Mus musculus
ctccggcagtcaacccagggaaagg

SEQ ID NO: 375243 - DNA, 25 bp, Mus musculus
ctccggcagtcatcccagggaaagg

SEQ ID NO: 375244 - DNA, 25 bp, Mus musculus
ctccggcatcgtcagttccgtaatg

SEQ ID NO: 375245 - DNA, 25 bp, Mus musculus
ctccggcatcgtgagttccgtaatg

SEQ ID NO: 375246 - DNA, 25 bp, Mus musculus
ctccggccaccaatggaagctaatg

SEQ ID NO: 375247 - DNA, 25 bp, Mus musculus
ctccggccaccattggaagctaatg

SEQ ID NO: 375248 - DNA, 25 bp, Mus musculus
ctccggcccttgaaattattgttgt

SEQ ID NO: 375249 - DNA, 25 bp, Mus musculus
ctccggcccttgtaattattgttgt

SEQ ID NO: 375250 - DNA, 25 bp, Mus musculus
ctccggcctctgatacgtaaagaca

SEQ ID NO: 375251 - DNA, 25 bp, Mus musculus
ctccggcctctgttacgtaaagaca

SEQ ID NO: 375252 - DNA, 25 bp, Mus musculus
ctccggcgtctcagtctttgtaaag

SEQ ID NO: 375253 - DNA, 25 bp, Mus musculus
ctccggcgtctctgtctttgtaaag

SEQ ID NO: 375254 - DNA, 25 bp, Mus musculus
ctccggctgaagcaccaaagttgga

SEQ ID NO: 375255 - DNA, 25 bp, Mus musculus
ctccggctgaaggaccaaagttgga

SEQ ID NO: 375256 - DNA, 25 bp, Mus musculus
ctccgggaatccatcaggcgaggaa

SEQ ID NO: 375257 - DNA, 25 bp, Mus musculus
ctccgggaatccttcaggcgaggaa

SEQ ID NO: 375258 - DNA, 25 bp, Mus musculus
ctccgggaccttatcattcagatat

SEQ ID NO: 375259 - DNA, 25 bp, Mus musculus
ctccgggaccttttcattcagatat

SEQ ID NO: 375260 - DNA, 25 bp, Mus musculus
ctccgggaggttatctgtaagactg

SEQ ID NO: 375261 - DNA, 25 bp, Mus musculus
ctccgggaggttttctgtaagactg

SEQ ID NO: 375262 - DNA, 25 bp, Mus musculus
ctccgggatgtaaaggtagttgtat

SEQ ID NO: 375263 - DNA, 25 bp, Mus musculus
ctccgggatgtataggtagttgtat

SEQ ID NO: 375264 - DNA, 25 bp, Mus musculus
ctccgggattccaagcatgactgta

SEQ ID NO: 375265 - DNA, 25 bp, Mus musculus
ctccgggattcctagcatgactgta

SEQ ID NO: 375266 - DNA, 25 bp, Mus musculus
ctccgggccatgatttccccaagaa

SEQ ID NO: 375267 - DNA, 25 bp, Mus musculus
ctccgggccatgttttccccaagaa

SEQ ID NO: 375268 - DNA, 25 bp, Mus musculus
ctccgggcccataacaaactatata

SEQ ID NO: 375269 - DNA, 25 bp, Mus musculus
ctccgggcccattacaaactatata

SEQ ID NO: 375270 - DNA, 25 bp, Mus musculus
ctccgggtggtgatcgtggacgagg

SEQ ID NO: 375271 - DNA, 25 bp, Mus musculus
ctccgggtggtgttcgtggacgagg

SEQ ID NO: 375272 - DNA, 25 bp, Mus musculus
ctccggtcacagatctgggaaacag

SEQ ID NO: 375273 - DNA, 25 bp, Mus musculus
ctccggtcacagttctgggaaacag

SEQ ID NO: 375274 - DNA, 25 bp, Mus musculus
ctccggtggcgtcctaacctagtat

SEQ ID NO: 375275 - DNA, 25 bp, Mus musculus
ctccggtggcgtgctaacctagtat

SEQ ID NO: 375276 - DNA, 25 bp, Mus musculus
ctccggtgtgagaagtgtaacgctg

SEQ ID NO: 375277 - DNA, 25 bp, Mus musculus
ctccggtgtgagtagtgtaacgctg

SEQ ID NO: 375278 - DNA, 25 bp, Mus musculus
ctccggttaactctgctccatattt

SEQ ID NO: 375279 - DNA, 25 bp, Mus musculus
ctccggttaactgtgctccatattt

SEQ ID NO: 375280 - DNA, 25 bp, Mus musculus
ctccggttcaaacgcgcataataaa

SEQ ID NO: 375281 - DNA, 25 bp, Mus musculus
ctccggttcaaaggcgcataataaa

SEQ ID NO: 375282 - DNA, 25 bp, Mus musculus
ctccggttctgtcagacaggagagc

SEQ ID NO: 375283 - DNA, 25 bp, Mus musculus
ctccggttctgtgagacaggagagc

SEQ ID NO: 375284 - DNA, 25 bp, Mus musculus
ctccgtaagtttcccagttcttgag

SEQ ID NO: 375285 - DNA, 25 bp, Mus musculus
ctccgtaagtttgccagttcttgag

SEQ ID NO: 375286 - DNA, 25 bp, Mus musculus
ctccgtatggaaattagttttatat

SEQ ID NO: 375287 - DNA, 25 bp, Mus musculus
ctccgtatggaatttagttttatat

SEQ ID NO: 375288 - DNA, 25 bp, Mus musculus
ctccgtcactatactcagcagaatt

SEQ ID NO: 375289 - DNA, 25 bp, Mus musculus
ctccgtcactattctcagcagaatt

SEQ ID NO: 375290 - DNA, 25 bp, Mus musculus
ctccgtcatctccatacatttattg

SEQ ID NO: 375291 - DNA, 25 bp, Mus musculus
ctccgtcatctcgatacatttattg

SEQ ID NO: 375292 - DNA, 25 bp, Mus musculus
ctccgtccaacaattaatcagtgta

SEQ ID NO: 375293 - DNA, 25 bp, Mus musculus
ctccgtccaacatttaatcagtgta

SEQ ID NO: 375294 - DNA, 25 bp, Mus musculus
ctccgtcctagtccactgtagaatt

SEQ ID NO: 375295 - DNA, 25 bp, Mus musculus
ctccgtcctagtgcactgtagaatt

SEQ ID NO: 375296 - DNA, 25 bp, Mus musculus
ctccgtcctttcatttcaacatata

SEQ ID NO: 375297 - DNA, 25 bp, Mus musculus
ctccgtcctttcttttcaacatata

SEQ ID NO: 375298 - DNA, 25 bp, Mus musculus
ctccgtctacttcatcattacattg

SEQ ID NO: 375299 - DNA, 25 bp, Mus musculus
ctccgtctacttgatcattacattg

SEQ ID NO: 375300 - DNA, 25 bp, Mus musculus
ctccgtcttccaatttctggtactc

SEQ ID NO: 375301 - DNA, 25 bp, Mus musculus
ctccgtcttccattttctggtactc

SEQ ID NO: 375302 - DNA, 25 bp, Mus musculus
ctccgtcttgataccggtctataaa

SEQ ID NO: 375303 - DNA, 25 bp, Mus musculus
ctccgtcttgattccggtctataaa

SEQ ID NO: 375304 - DNA, 25 bp, Mus musculus
ctccgtgaggttctccaggctgtgt

SEQ ID NO: 375305 - DNA, 25 bp, Mus musculus
ctccgtgaggttgtccaggctgtgt

SEQ ID NO: 375306 - DNA, 25 bp, Mus musculus
ctccgtgctctcagattattgcatg

SEQ ID NO: 375307 - DNA, 25 bp, Mus musculus
ctccgtgctctctgattattgcatg

SEQ ID NO: 375308 - DNA, 25 bp, Mus musculus
ctccgtgctctgcacatgcaagaag

SEQ ID NO: 375309 - DNA, 25 bp, Mus musculus
ctccgtgctctggacatgcaagaag

SEQ ID NO: 375310 - DNA, 25 bp, Mus musculus
ctccgtggcatcagctattcaaaga

SEQ ID NO: 375311 - DNA, 25 bp, Mus musculus
ctccgtggcatctgctattcaaaga

SEQ ID NO: 375312 - DNA, 25 bp, Mus musculus
ctccgtgggcaccaagcatatatgt

SEQ ID NO: 375313 - DNA, 25 bp, Mus musculus
ctccgtgggcacgaagcatatatgt

SEQ ID NO: 375314 - DNA, 25 bp, Mus musculus
ctccgtgggcatattcagacagaca

SEQ ID NO: 375315 - DNA, 25 bp, Mus musculus
ctccgtgggcattttcagacagaca

SEQ ID NO: 375316 - DNA, 25 bp, Mus musculus
ctccgtggtgacatggcatcgcttt

SEQ ID NO: 375317 - DNA, 25 bp, Mus musculus
ctccgtggtgacttggcatcgcttt

SEQ ID NO: 375318 - DNA, 25 bp, Mus musculus
ctccgtgtttccataaggtggctat

SEQ ID NO: 375319 - DNA, 25 bp, Mus musculus
ctccgtgtttccttaaggtggctat

SEQ ID NO: 375320 - DNA, 25 bp, Mus musculus
ctccgttagttcctttttcagcaat

SEQ ID NO: 375321 - DNA, 25 bp, Mus musculus
ctccgttagttcgtttttcagcaat

SEQ ID NO: 375322 - DNA, 25 bp, Mus musculus
ctccgtttacgtatgacccaacaat

SEQ ID NO: 375323 - DNA, 25 bp, Mus musculus
ctccgtttacgtttgacccaacaat

SEQ ID NO: 375324 - DNA, 25 bp, Mus musculus
ctcctaaacctactcctgatttatc

SEQ ID NO: 375325 - DNA, 25 bp, Mus musculus
ctcctaaacctagtcctgatttatc

SEQ ID NO: 375326 - DNA, 25 bp, Mus musculus
ctcctaaactacagatttcctgggc

SEQ ID NO: 375327 - DNA, 25 bp, Mus musculus
ctcctaaactactgatttcctgggc

SEQ ID NO: 375328 - DNA, 25 bp, Mus musculus
ctcctaaataccctgcttaactaca

SEQ ID NO: 375329 - DNA, 25 bp, Mus musculus
ctcctaaataccgtgcttaactaca

SEQ ID NO: 375330 - DNA, 25 bp, Mus musculus
ctcctaaatcctatctccagtgaca

SEQ ID NO: 375331 - DNA, 25 bp, Mus musculus
ctcctaaatcctttctccagtgaca

SEQ ID NO: 375332 - DNA, 25 bp, Mus musculus
ctcctaacgatgcatccggacttgt

SEQ ID NO: 375333 - DNA, 25 bp, Mus musculus
ctcctaacgatggatccggacttgt

SEQ ID NO: 375334 - DNA, 25 bp, Mus musculus
ctcctaactccaacttgaaaactgc

SEQ ID NO: 375335 - DNA, 25 bp, Mus musculus
ctcctaactccatcttgaaaactgc

SEQ ID NO: 375336 - DNA, 25 bp, Mus musculus
ctcctaaggcttacagtgtgtttat

SEQ ID NO: 375337 - DNA, 25 bp, Mus musculus
ctcctaaggctttcagtgtgtttat

SEQ ID NO: 375338 - DNA, 25 bp, Mus musculus
ctcctaatcctaaacagtccaactg

SEQ ID NO: 375339 - DNA, 25 bp, Mus musculus
ctcctaatcctatacagtccaactg

SEQ ID NO: 375340 - DNA, 25 bp, Mus musculus
ctcctaatgtgcatcatccaatgga

SEQ ID NO: 375341 - DNA, 25 bp, Mus musculus
ctcctaatgtgcttcatccaatgga

SEQ ID NO: 375342 - DNA, 25 bp, Mus musculus
ctcctaattgagacttgcctaagat

SEQ ID NO: 375343 - DNA, 25 bp, Mus musculus
ctcctaattgagtcttgcctaagat

SEQ ID NO: 375344 - DNA, 25 bp, Mus musculus
ctcctacatttgacccaatgagctt

SEQ ID NO: 375345 - DNA, 25 bp, Mus musculus
ctcctacatttgtcccaatgagctt

SEQ ID NO: 375346 - DNA, 25 bp, Mus musculus
ctcctacccatcattatttatacag

SEQ ID NO: 375347 - DNA, 25 bp, Mus musculus
ctcctacccatctttatttatacag

SEQ ID NO: 375348 - DNA, 25 bp, Mus musculus
ctcctaccgaccattgcttttggat

SEQ ID NO: 375349 - DNA, 25 bp, Mus musculus
ctcctaccgacctttgcttttggat

SEQ ID NO: 375350 - DNA, 25 bp, Mus musculus
ctcctacgggcaagcgggtagctga

SEQ ID NO: 375351 - DNA, 25 bp, Mus musculus
ctcctacgggcatgcgggtagctga

SEQ ID NO: 375352 - DNA, 25 bp, Mus musculus
ctcctagacgttaccaattcacaat

SEQ ID NO: 375353 - DNA, 25 bp, Mus musculus
ctcctagacgtttccaattcacaat

SEQ ID NO: 375354 - DNA, 25 bp, Mus musculus
ctcctagcgcacctcaaaaaacggg

SEQ ID NO: 375355 - DNA, 25 bp, Mus musculus
ctcctagcgcacgtcaaaaaacggg

SEQ ID NO: 375356 - DNA, 25 bp, Mus musculus
ctcctaggccctatgggaattattg

SEQ ID NO: 375357 - DNA, 25 bp, Mus musculus
ctcctaggccctttgggaattattg

SEQ ID NO: 375358 - DNA, 25 bp, Mus musculus
ctcctaggcttaatcttgacacaga

SEQ ID NO: 375359 - DNA, 25 bp, Mus musculus
ctcctaggcttattcttgacacaga

SEQ ID NO: 375360 - DNA, 25 bp, Mus musculus
ctcctagggcacaaccatgacatca

SEQ ID NO: 375361 - DNA, 25 bp, Mus musculus
ctcctagggcactaccatgacatca

SEQ ID NO: 375362 - DNA, 25 bp, Mus musculus
ctcctaggtgagattttattgtgtt

SEQ ID NO: 375363 - DNA, 25 bp, Mus musculus
ctcctaggtgagtttttattgtgtt

SEQ ID NO: 375364 - DNA, 25 bp, Mus musculus
ctcctagtggaccacaaagtgctgt

SEQ ID NO: 375365 - DNA, 25 bp, Mus musculus
ctcctagtggacgacaaagtgctgt

SEQ ID NO: 375366 - DNA, 25 bp, Mus musculus
ctcctagtgtgtctttgaaacagtt

SEQ ID NO: 375367 - DNA, 25 bp, Mus musculus
ctcctagtgtgtgtttgaaacagtt

SEQ ID NO: 375368 - DNA, 25 bp, Mus musculus
ctcctagttctcctcattttattaa

SEQ ID NO: 375369 - DNA, 25 bp, Mus musculus
ctcctagttctcgtcattttattaa

SEQ ID NO: 375370 - DNA, 25 bp, Mus musculus
ctcctagttggaactgtcttcagct

SEQ ID NO: 375371 - DNA, 25 bp, Mus musculus
ctcctagttggatctgtcttcagct

SEQ ID NO: 375372 - DNA, 25 bp, Mus musculus
ctcctatacgcaagctccaagagat

SEQ ID NO: 375373 - DNA, 25 bp, Mus musculus
ctcctatacgcatgctccaagagat

SEQ ID NO: 375374 - DNA, 25 bp, Mus musculus
ctcctatatacccttgtttcctcag

SEQ ID NO: 375375 - DNA, 25 bp, Mus musculus
ctcctatataccgttgtttcctcag

SEQ ID NO: 375376 - DNA, 25 bp, Mus musculus
ctcctatccagtctctttaagctac

SEQ ID NO: 375377 - DNA, 25 bp, Mus musculus
ctcctatccagtgtctttaagctac

SEQ ID NO: 375378 - DNA, 25 bp, Mus musculus
ctcctatcccttatacgttgagtga

SEQ ID NO: 375379 - DNA, 25 bp, Mus musculus
ctcctatcccttttacgttgagtga

SEQ ID NO: 375380 - DNA, 25 bp, Mus musculus
ctcctatctgtcatttcaggagcca

SEQ ID NO: 375381 - DNA, 25 bp, Mus musculus
ctcctatctgtcttttcaggagcca

SEQ ID NO: 375382 - DNA, 25 bp, Mus musculus
ctcctatgactcagactttccaaaa

SEQ ID NO: 375383 - DNA, 25 bp, Mus musculus
ctcctatgactctgactttccaaaa

SEQ ID NO: 375384 - DNA, 25 bp, Mus musculus
ctcctatggaggatgtaccagcggc

SEQ ID NO: 375385 - DNA, 25 bp, Mus musculus
ctcctatggaggttgtaccagcggc

SEQ ID NO: 375386 - DNA, 25 bp, Mus musculus
ctcctatggagtattgctgaggtac

SEQ ID NO: 375387 - DNA, 25 bp, Mus musculus
ctcctatggagttttgctgaggtac

SEQ ID NO: 375388 - DNA, 25 bp, Mus musculus
ctcctatgggttctgccacagcatg

SEQ ID NO: 375389 - DNA, 25 bp, Mus musculus
ctcctatgggttgtgccacagcatg

SEQ ID NO: 375390 - DNA, 25 bp, Mus musculus
ctcctatgttacctagcatggttga

SEQ ID NO: 375391 - DNA, 25 bp, Mus musculus
ctcctatgttacgtagcatggttga

SEQ ID NO: 375392 - DNA, 25 bp, Mus musculus
ctcctattagctcagtaggttgtgc

SEQ ID NO: 375393 - DNA, 25 bp, Mus musculus
ctcctattagctgagtaggttgtgc

SEQ ID NO: 375394 - DNA, 25 bp, Mus musculus
ctcctattatggatcttttaaaaat

SEQ ID NO: 375395 - DNA, 25 bp, Mus musculus
ctcctattatggttcttttaaaaat

SEQ ID NO: 375396 - DNA, 25 bp, Mus musculus
ctcctattctctcgagcattcttaa

SEQ ID NO: 375397 - DNA, 25 bp, Mus musculus
ctcctattctctggagcattcttaa

SEQ ID NO: 375398 - DNA, 25 bp, Mus musculus
ctcctatttcctagttgccattaga

SEQ ID NO: 375399 - DNA, 25 bp, Mus musculus
ctcctatttccttgttgccattaga

SEQ ID NO: 375400 - DNA, 25 bp, Mus musculus
ctcctattttccagaagtgaacatt

SEQ ID NO: 375401 - DNA, 25 bp, Mus musculus
ctcctattttcctgaagtgaacatt

SEQ ID NO: 375402 - DNA, 25 bp, Mus musculus
ctcctattttgcactgacacacaga

SEQ ID NO: 375403 - DNA, 25 bp, Mus musculus
ctcctattttgctctgacacacaga

SEQ ID NO: 375404 - DNA, 25 bp, Mus musculus
ctcctcaactctcgaaagcacttgg

SEQ ID NO: 375405 - DNA, 25 bp, Mus musculus
ctcctcaactctggaaagcacttgg

SEQ ID NO: 375406 - DNA, 25 bp, Mus musculus
ctcctcaagcacagtatttccatgt

SEQ ID NO: 375407 - DNA, 25 bp, Mus musculus
ctcctcaagcactgtatttccatgt

SEQ ID NO: 375408 - DNA, 25 bp, Mus musculus
ctcctcaatagcactgggtttttgg

SEQ ID NO: 375409 - DNA, 25 bp, Mus musculus
ctcctcaatagctctgggtttttgg

SEQ ID NO: 375410 - DNA, 25 bp, Mus musculus
ctcctcacaaggaagggcctcaatt

SEQ ID NO: 375411 - DNA, 25 bp, Mus musculus
ctcctcacaaggtagggcctcaatt

SEQ ID NO: 375412 - DNA, 25 bp, Mus musculus
ctcctcacacatattcatgcagtta

SEQ ID NO: 375413 - DNA, 25 bp, Mus musculus
ctcctcacacattttcatgcagtta

SEQ ID NO: 375414 - DNA, 25 bp, Mus musculus
ctcctcacactactctatataacaa

SEQ ID NO: 375415 - DNA, 25 bp, Mus musculus
ctcctcacactagtctatataacaa

SEQ ID NO: 375416 - DNA, 25 bp, Mus musculus
ctcctcacagtcctccagtaagaag

SEQ ID NO: 375417 - DNA, 25 bp, Mus musculus
ctcctcacagtcgtccagtaagaag

SEQ ID NO: 375418 - DNA, 25 bp, Mus musculus
ctcctcactgcaatctgagactgtc

SEQ ID NO: 375419 - DNA, 25 bp, Mus musculus
ctcctcactgcattctgagactgtc

SEQ ID NO: 375420 - DNA, 25 bp, Mus musculus
ctcctcactgctcgatagacaagtt

SEQ ID NO: 375421 - DNA, 25 bp, Mus musculus
ctcctcactgctggatagacaagtt

SEQ ID NO: 375422 - DNA, 25 bp, Mus musculus
ctcctcagcatcataactccagaag

SEQ ID NO: 375423 - DNA, 25 bp, Mus musculus
ctcctcagcatcttaactccagaag

SEQ ID NO: 375424 - DNA, 25 bp, Mus musculus
ctcctcagcgagcagcaagatttca

SEQ ID NO: 375425 - DNA, 25 bp, Mus musculus
ctcctcagcgaggagcaagatttca

SEQ ID NO: 375426 - DNA, 25 bp, Mus musculus
ctcctcagctcaattgttactttgt

SEQ ID NO: 375427 - DNA, 25 bp, Mus musculus
ctcctcagctcatttgttactttgt

SEQ ID NO: 375428 - DNA, 25 bp, Mus musculus
ctcctcatgaatcctgtatctaatc

SEQ ID NO: 375429 - DNA, 25 bp, Mus musculus
ctcctcatgaatgctgtatctaatc

SEQ ID NO: 375430 - DNA, 25 bp, Mus musculus
ctcctcatgctgatcagtgatggca

SEQ ID NO: 375431 - DNA, 25 bp, Mus musculus
ctcctcatgctgttcagtgatggca

SEQ ID NO: 375432 - DNA, 25 bp, Mus musculus
ctcctccaaaccatactagtaacag

SEQ ID NO: 375433 - DNA, 25 bp, Mus musculus
ctcctccaaaccttactagtaacag

SEQ ID NO: 375434 - DNA, 25 bp, Mus musculus
ctcctccacatcatcttgatgcaaa

SEQ ID NO: 375435 - DNA, 25 bp, Mus musculus
ctcctccacatcttcttgatgcaaa

SEQ ID NO: 375436 - DNA, 25 bp, Mus musculus
ctcctccactggagactgcgggcgg

SEQ ID NO: 375437 - DNA, 25 bp, Mus musculus
ctcctccactggtgactgcgggcgg

SEQ ID NO: 375438 - DNA, 25 bp, Mus musculus
ctcctccagagacgtctgttattta

SEQ ID NO: 375439 - DNA, 25 bp, Mus musculus
ctcctccagagaggtctgttattta

SEQ ID NO: 375440 - DNA, 25 bp, Mus musculus
ctcctccaggaacctctttgagaaa

SEQ ID NO: 375441 - DNA, 25 bp, Mus musculus
ctcctccaggaagctctttgagaaa

SEQ ID NO: 375442 - DNA, 25 bp, Mus musculus
ctcctccaggtaagaatactcttgg

SEQ ID NO: 375443 - DNA, 25 bp, Mus musculus
ctcctccaggtatgaatactcttgg

SEQ ID NO: 375444 - DNA, 25 bp, Mus musculus
ctcctccataaaaaccaactctatt

SEQ ID NO: 375445 - DNA, 25 bp, Mus musculus
ctcctccataaataccaactctatt

SEQ ID NO: 375446 - DNA, 25 bp, Mus musculus
ctcctccatcagagtcattaccaaa

SEQ ID NO: 375447 - DNA, 25 bp, Mus musculus
ctcctccatcagtgtcattaccaaa

SEQ ID NO: 375448 - DNA, 25 bp, Mus musculus
ctcctccatttgattactgctggca

SEQ ID NO: 375449 - DNA, 25 bp, Mus musculus
ctcctccatttgtttactgctggca

SEQ ID NO: 375450 - DNA, 25 bp, Mus musculus
ctcctcccacggatatctaacaagg

SEQ ID NO: 375451 - DNA, 25 bp, Mus musculus
ctcctcccacggttatctaacaagg

SEQ ID NO: 375452 - DNA, 25 bp, Mus musculus
ctcctcccagagatttggtttagct

SEQ ID NO: 375453 - DNA, 25 bp, Mus musculus
ctcctcccagagttttggtttagct

SEQ ID NO: 375454 - DNA, 25 bp, Mus musculus
ctcctcccggagagtgtatatttat

SEQ ID NO: 375455 - DNA, 25 bp, Mus musculus
ctcctcccggagtgtgtatatttat

SEQ ID NO: 375456 - DNA, 25 bp, Mus musculus
ctcctccctggtaccataattaagt

SEQ ID NO: 375457 - DNA, 25 bp, Mus musculus
ctcctccctggttccataattaagt

SEQ ID NO: 375458 - DNA, 25 bp, Mus musculus
ctcctccctgttcaagtcttaggca

SEQ ID NO: 375459 - DNA, 25 bp, Mus musculus
ctcctccctgttgaagtcttaggca

SEQ ID NO: 375460 - DNA, 25 bp, Mus musculus
ctcctcccttcacaaatagaaacgg

SEQ ID NO: 375461 - DNA, 25 bp, Mus musculus
ctcctcccttcagaaatagaaacgg

SEQ ID NO: 375462 - DNA, 25 bp, Mus musculus
ctcctccgtcgtagtattcatgtat

SEQ ID NO: 375463 - DNA, 25 bp, Mus musculus
ctcctccgtcgttgtattcatgtat

SEQ ID NO: 375464 - DNA, 25 bp, Mus musculus
ctcctcctaactagtgttacgtgac

SEQ ID NO: 375465 - DNA, 25 bp, Mus musculus
ctcctcctaacttgtgttacgtgac

SEQ ID NO: 375466 - DNA, 25 bp, Mus musculus
ctcctcctagctcccctgaagacag

SEQ ID NO: 375467 - DNA, 25 bp, Mus musculus
ctcctcctagctgccctgaagacag

SEQ ID NO: 375468 - DNA, 25 bp, Mus musculus
ctcctcctatttaccagaagtgaac

SEQ ID NO: 375469 - DNA, 25 bp, Mus musculus
ctcctcctattttccagaagtgaac

SEQ ID NO: 375470 - DNA, 25 bp, Mus musculus
ctcctcctcaatcctctataaagtg

SEQ ID NO: 375471 - DNA, 25 bp, Mus musculus
ctcctcctcaatgctctataaagtg

SEQ ID NO: 375472 - DNA, 25 bp, Mus musculus
ctcctcctcagaacaagtcaacgtt

SEQ ID NO: 375473 - DNA, 25 bp, Mus musculus
ctcctcctcagatcaagtcaacgtt

SEQ ID NO: 375474 - DNA, 25 bp, Mus musculus
ctcctcctcggcagttatagattca

SEQ ID NO: 375475 - DNA, 25 bp, Mus musculus
ctcctcctcggctgttatagattca

SEQ ID NO: 375476 - DNA, 25 bp, Mus musculus
ctcctcctctatcggtatgtatcat

SEQ ID NO: 375477 - DNA, 25 bp, Mus musculus
ctcctcctctatgggtatgtatcat

SEQ ID NO: 375478 - DNA, 25 bp, Mus musculus
ctcctcctggatcctattgtattac

SEQ ID NO: 375479 - DNA, 25 bp, Mus musculus
ctcctcctggatgctattgtattac

SEQ ID NO: 375480 - DNA, 25 bp, Mus musculus
ctcctcctgggcaggtgaagacaag

SEQ ID NO: 375481 - DNA, 25 bp, Mus musculus
ctcctcctgggctggtgaagacaag

SEQ ID NO: 375482 - DNA, 25 bp, Mus musculus
ctcctcctgggtatgaagcctatga

SEQ ID NO: 375483 - DNA, 25 bp, Mus musculus
ctcctcctgggtttgaagcctatga

SEQ ID NO: 375484 - DNA, 25 bp, Mus musculus
ctcctcctggtaccatggttcaaga

SEQ ID NO: 375485 - DNA, 25 bp, Mus musculus
ctcctcctggtagcatggttcaaga

SEQ ID NO: 375486 - DNA, 25 bp, Mus musculus
ctcctcctgtatcccaaaatcattt

SEQ ID NO: 375487 - DNA, 25 bp, Mus musculus
ctcctcctgtatgccaaaatcattt

SEQ ID NO: 375488 - DNA, 25 bp, Mus musculus
ctcctcctttcaatattctcagatg

SEQ ID NO: 375489 - DNA, 25 bp, Mus musculus
ctcctcctttcattattctcagatg

SEQ ID NO: 375490 - DNA, 25 bp, Mus musculus
ctcctccttttcactaatatttcaa

SEQ ID NO: 375491 - DNA, 25 bp, Mus musculus
ctcctccttttctctaatatttcaa

SEQ ID NO: 375492 - DNA, 25 bp, Mus musculus
ctcctcgaaagtctggtatctctaa

SEQ ID NO: 375493 - DNA, 25 bp, Mus musculus
ctcctcgaaagtgtggtatctctaa

SEQ ID NO: 375494 - DNA, 25 bp, Mus musculus
ctcctcgacctccaatgggaatgag

SEQ ID NO: 375495 - DNA, 25 bp, Mus musculus
ctcctcgacctcgaatgggaatgag

SEQ ID NO: 375496 - DNA, 25 bp, Mus musculus
ctcctcgagtttcagaacgatcgcg

SEQ ID NO: 375497 - DNA, 25 bp, Mus musculus
ctcctcgagtttgagaacgatcgcg

SEQ ID NO: 375498 - DNA, 25 bp, Mus musculus
ctcctcgatttgatgtgatcgacaa

SEQ ID NO: 375499 - DNA, 25 bp, Mus musculus
ctcctcgatttgttgtgatcgacaa

SEQ ID NO: 375500 - DNA, 25 bp, Mus musculus
ctcctcggaccacatgatgtctagg

SEQ ID NO: 375501 - DNA, 25 bp, Mus musculus
ctcctcggaccagatgatgtctagg

SEQ ID NO: 375502 - DNA, 25 bp, Mus musculus
ctcctcggctgtcgtctgagatgct

SEQ ID NO: 375503 - DNA, 25 bp, Mus musculus
ctcctcggctgtggtctgagatgct

SEQ ID NO: 375504 - DNA, 25 bp, Mus musculus
ctcctcgggccaataaactgatgtt

SEQ ID NO: 375505 - DNA, 25 bp, Mus musculus
ctcctcgggccattaaactgatgtt

SEQ ID NO: 375506 - DNA, 25 bp, Mus musculus
ctcctcgtcatcatgagatctcagg

SEQ ID NO: 375507 - DNA, 25 bp, Mus musculus
ctcctcgtcatcttgagatctcagg

SEQ ID NO: 375508 - DNA, 25 bp, Mus musculus
ctcctctatctccaacgaaacatgg

SEQ ID NO: 375509 - DNA, 25 bp, Mus musculus
ctcctctatctcgaacgaaacatgg

SEQ ID NO: 375510 - DNA, 25 bp, Mus musculus
ctcctctcacggagcattctaagga

SEQ ID NO: 375511 - DNA, 25 bp, Mus musculus
ctcctctcacggtgcattctaagga

SEQ ID NO: 375512 - DNA, 25 bp, Mus musculus
ctcctctcatgcaatatcagggtgg

SEQ ID NO: 375513 - DNA, 25 bp, Mus musculus
ctcctctcatgctatatcagggtgg

SEQ ID NO: 375514 - DNA, 25 bp, Mus musculus
ctcctctccattctagtagcatcag

SEQ ID NO: 375515 - DNA, 25 bp, Mus musculus
ctcctctccattgtagtagcatcag

SEQ ID NO: 375516 - DNA, 25 bp, Mus musculus
ctcctctcccagaaagaactctaga

SEQ ID NO: 375517 - DNA, 25 bp, Mus musculus
ctcctctcccagtaagaactctaga

SEQ ID NO: 375518 - DNA, 25 bp, Mus musculus
ctcctctccttgaagcagaatggga

SEQ ID NO: 375519 - DNA, 25 bp, Mus musculus
ctcctctccttgtagcagaatggga

SEQ ID NO: 375520 - DNA, 25 bp, Mus musculus
ctcctctcgcacatggaaggtatca

SEQ ID NO: 375521 - DNA, 25 bp, Mus musculus
ctcctctcgcacttggaaggtatca

SEQ ID NO: 375522 - DNA, 25 bp, Mus musculus
ctcctctctcccagaagtccccatt

SEQ ID NO: 375523 - DNA, 25 bp, Mus musculus
ctcctctctccctgaagtccccatt

SEQ ID NO: 375524 - DNA, 25 bp, Mus musculus
ctcctctctcgtattacacaatata

SEQ ID NO: 375525 - DNA, 25 bp, Mus musculus
ctcctctctcgttttacacaatata

SEQ ID NO: 375526 - DNA, 25 bp, Mus musculus
ctcctctctgacatgcttataacta

SEQ ID NO: 375527 - DNA, 25 bp, Mus musculus
ctcctctctgacttgcttataacta

SEQ ID NO: 375528 - DNA, 25 bp, Mus musculus
ctcctctctgctcataggtcacaga

SEQ ID NO: 375529 - DNA, 25 bp, Mus musculus
ctcctctctgctgataggtcacaga

SEQ ID NO: 375530 - DNA, 25 bp, Mus musculus
ctcctctctgttagctctgaagtga

SEQ ID NO: 375531 - DNA, 25 bp, Mus musculus
ctcctctctgtttgctctgaagtga

SEQ ID NO: 375532 - DNA, 25 bp, Mus musculus
ctcctctcttagaccaaacagcaag

SEQ ID NO: 375533 - DNA, 25 bp, Mus musculus
ctcctctcttagtccaaacagcaag

SEQ ID NO: 375534 - DNA, 25 bp, Mus musculus
ctcctctcttcactaggcacaattt

SEQ ID NO: 375535 - DNA, 25 bp, Mus musculus
ctcctctcttcagtaggcacaattt

SEQ ID NO: 375536 - DNA, 25 bp, Mus musculus
ctcctctgagacattgttctccaaa

SEQ ID NO: 375537 - DNA, 25 bp, Mus musculus
ctcctctgagactttgttctccaaa

SEQ ID NO: 375538 - DNA, 25 bp, Mus musculus
ctcctctgagatcacttcagcgtgt

SEQ ID NO: 375539 - DNA, 25 bp, Mus musculus
ctcctctgagatgacttcagcgtgt

SEQ ID NO: 375540 - DNA, 25 bp, Mus musculus
ctcctctgaggacggctgataagca

SEQ ID NO: 375541 - DNA, 25 bp, Mus musculus
ctcctctgaggagggctgataagca

SEQ ID NO: 375542 - DNA, 25 bp, Mus musculus
ctcctctgatttatggcagcctctg

SEQ ID NO: 375543 - DNA, 25 bp, Mus musculus
ctcctctgatttttggcagcctctg

SEQ ID NO: 375544 - DNA, 25 bp, Mus musculus
ctcctctgcaaaatctcaagtccaa

SEQ ID NO: 375545 - DNA, 25 bp, Mus musculus
ctcctctgcaaattctcaagtccaa

SEQ ID NO: 375546 - DNA, 25 bp, Mus musculus
ctcctctgcaggacagcttatgaag

SEQ ID NO: 375547 - DNA, 25 bp, Mus musculus
ctcctctgcaggtcagcttatgaag

SEQ ID NO: 375548 - DNA, 25 bp, Mus musculus
ctcctctgctgacccaaggaggtct

SEQ ID NO: 375549 - DNA, 25 bp, Mus musculus
ctcctctgctgagccaaggaggtct

SEQ ID NO: 375550 - DNA, 25 bp, Mus musculus
ctcctctggctgagagggtcattgg

SEQ ID NO: 375551 - DNA, 25 bp, Mus musculus
ctcctctggctgtgagggtcattgg

SEQ ID NO: 375552 - DNA, 25 bp, Mus musculus
ctcctctggtctatgacttgatcaa

SEQ ID NO: 375553 - DNA, 25 bp, Mus musculus
ctcctctggtctttgacttgatcaa

SEQ ID NO: 375554 - DNA, 25 bp, Mus musculus
ctcctctggttcaagcttatgtttg

SEQ ID NO: 375555 - DNA, 25 bp, Mus musculus
ctcctctggttctagcttatgtttg

SEQ ID NO: 375556 - DNA, 25 bp, Mus musculus
ctcctctgtacgagcagcaggtatt

SEQ ID NO: 375557 - DNA, 25 bp, Mus musculus
ctcctctgtacgtgcagcaggtatt

SEQ ID NO: 375558 - DNA, 25 bp, Mus musculus
ctcctctgtcgtcgctagcattgaa

SEQ ID NO: 375559 - DNA, 25 bp, Mus musculus
ctcctctgtcgtggctagcattgaa

SEQ ID NO: 375560 - DNA, 25 bp, Mus musculus
ctcctcttacagatcaatcacagat

SEQ ID NO: 375561 - DNA, 25 bp, Mus musculus
ctcctcttacagttcaatcacagat

SEQ ID NO: 375562 - DNA, 25 bp, Mus musculus
ctcctcttacttatttcatcttcta

SEQ ID NO: 375563 - DNA, 25 bp, Mus musculus
ctcctcttacttttttcatcttcta

SEQ ID NO: 375564 - DNA, 25 bp, Mus musculus
ctcctcttatgcctttgcttggaag

SEQ ID NO: 375565 - DNA, 25 bp, Mus musculus
ctcctcttatgcgtttgcttggaag

SEQ ID NO: 375566 - DNA, 25 bp, Mus musculus
ctcctcttcataattcctacagggt

SEQ ID NO: 375567 - DNA, 25 bp, Mus musculus
ctcctcttcatatttcctacagggt

SEQ ID NO: 375568 - DNA, 25 bp, Mus musculus
ctcctcttcatcatggcacagaaat

SEQ ID NO: 375569 - DNA, 25 bp, Mus musculus
ctcctcttcatcttggcacagaaat

SEQ ID NO: 375570 - DNA, 25 bp, Mus musculus
ctcctcttcattcccgagagtggat

SEQ ID NO: 375571 - DNA, 25 bp, Mus musculus
ctcctcttcattgccgagagtggat

SEQ ID NO: 375572 - DNA, 25 bp, Mus musculus
ctcctcttctcaatgttaagtctca

SEQ ID NO: 375573 - DNA, 25 bp, Mus musculus
ctcctcttctcattgttaagtctca

SEQ ID NO: 375574 - DNA, 25 bp, Mus musculus
ctcctcttctgccattcattttaat

SEQ ID NO: 375575 - DNA, 25 bp, Mus musculus
ctcctcttctgcgattcattttaat

SEQ ID NO: 375576 - DNA, 25 bp, Mus musculus
ctcctcttgactatgctttggttat

SEQ ID NO: 375577 - DNA, 25 bp, Mus musculus
ctcctcttgactttgctttggttat

SEQ ID NO: 375578 - DNA, 25 bp, Mus musculus
ctcctcttggttctggcagcggtga

SEQ ID NO: 375579 - DNA, 25 bp, Mus musculus
ctcctcttggttgtggcagcggtga

SEQ ID NO: 375580 - DNA, 25 bp, Mus musculus
ctcctctttgctaaccagacagaag

SEQ ID NO: 375581 - DNA, 25 bp, Mus musculus
ctcctctttgcttaccagacagaag

SEQ ID NO: 375582 - DNA, 25 bp, Mus musculus
ctcctcttttccagcagcatagatt

SEQ ID NO: 375583 - DNA, 25 bp, Mus musculus
ctcctcttttcctgcagcatagatt

SEQ ID NO: 375584 - DNA, 25 bp, Mus musculus
ctcctcttttttctagggcaactgg

SEQ ID NO: 375585 - DNA, 25 bp, Mus musculus
ctcctcttttttgtagggcaactgg

SEQ ID NO: 375586 - DNA, 25 bp, Mus musculus
ctcctgaaactaaaggcgtagtgtg

SEQ ID NO: 375587 - DNA, 25 bp, Mus musculus
ctcctgaaactataggcgtagtgtg

SEQ ID NO: 375588 - DNA, 25 bp, Mus musculus
ctcctgaaactcagagggtcgctca

SEQ ID NO: 375589 - DNA, 25 bp, Mus musculus
ctcctgaaactctgagggtcgctca

SEQ ID NO: 375590 - DNA, 25 bp, Mus musculus
ctcctgaaatgcctcgggtcatcag

SEQ ID NO: 375591 - DNA, 25 bp, Mus musculus
ctcctgaaatgcgtcgggtcatcag

SEQ ID NO: 375592 - DNA, 25 bp, Mus musculus
ctcctgaagactatctgacagacca

SEQ ID NO: 375593 - DNA, 25 bp, Mus musculus
ctcctgaagactttctgacagacca

SEQ ID NO: 375594 - DNA, 25 bp, Mus musculus
ctcctgaagttcagaggctcatcct

SEQ ID NO: 375595 - DNA, 25 bp, Mus musculus
ctcctgaagttctgaggctcatcct

SEQ ID NO: 375596 - DNA, 25 bp, Mus musculus
ctcctgaatgctaagatggctgtta

SEQ ID NO: 375597 - DNA, 25 bp, Mus musculus
ctcctgaatgcttagatggctgtta

SEQ ID NO: 375598 - DNA, 25 bp, Mus musculus
ctcctgacactgccaataaactcaa

SEQ ID NO: 375599 - DNA, 25 bp, Mus musculus
ctcctgacactggcaataaactcaa

SEQ ID NO: 375600 - DNA, 25 bp, Mus musculus
ctcctgacctgacctcttcaaagga

SEQ ID NO: 375601 - DNA, 25 bp, Mus musculus
ctcctgacctgagctcttcaaagga

SEQ ID NO: 375602 - DNA, 25 bp, Mus musculus
ctcctgacctggcttatattaaaga

SEQ ID NO: 375603 - DNA, 25 bp, Mus musculus
ctcctgacctgggttatattaaaga

SEQ ID NO: 375604 - DNA, 25 bp, Mus musculus
ctcctgactcacactagagctttaa

SEQ ID NO: 375605 - DNA, 25 bp, Mus musculus
ctcctgactcactctagagctttaa

SEQ ID NO: 375606 - DNA, 25 bp, Mus musculus
ctcctgactcttaagcactgagatt

SEQ ID NO: 375607 - DNA, 25 bp, Mus musculus
ctcctgactctttagcactgagatt

SEQ ID NO: 375608 - DNA, 25 bp, Mus musculus
ctcctgagaactcgctctttataaa

SEQ ID NO: 375609 - DNA, 25 bp, Mus musculus
ctcctgagaactggctctttataaa

SEQ ID NO: 375610 - DNA, 25 bp, Mus musculus
ctcctgagaatcaatggtgtcccct

SEQ ID NO: 375611 - DNA, 25 bp, Mus musculus
ctcctgagaatctatggtgtcccct

SEQ ID NO: 375612 - DNA, 25 bp, Mus musculus
ctcctgagacttattgcctgttgaa

SEQ ID NO: 375613 - DNA, 25 bp, Mus musculus
ctcctgagactttttgcctgttgaa

SEQ ID NO: 375614 - DNA, 25 bp, Mus musculus
ctcctgaggagtaccttaatgcccc

SEQ ID NO: 375615 - DNA, 25 bp, Mus musculus
ctcctgaggagttccttaatgcccc

SEQ ID NO: 375616 - DNA, 25 bp, Mus musculus
ctcctgaggctgagttgtaattata

SEQ ID NO: 375617 - DNA, 25 bp, Mus musculus
ctcctgaggctgtgttgtaattata

SEQ ID NO: 375618 - DNA, 25 bp, Mus musculus
ctcctgagggacaagggactcgacc

SEQ ID NO: 375619 - DNA, 25 bp, Mus musculus
ctcctgagggactagggactcgacc

SEQ ID NO: 375620 - DNA, 25 bp, Mus musculus
ctcctgagtttaacattgatattgt

SEQ ID NO: 375621 - DNA, 25 bp, Mus musculus
ctcctgagtttatcattgatattgt

SEQ ID NO: 375622 - DNA, 25 bp, Mus musculus
ctcctgataggcagggagtggatca

SEQ ID NO: 375623 - DNA, 25 bp, Mus musculus
ctcctgataggctgggagtggatca

SEQ ID NO: 375624 - DNA, 25 bp, Mus musculus
ctcctgatcatgacctacggtgtga

SEQ ID NO: 375625 - DNA, 25 bp, Mus musculus
ctcctgatcatgtcctacggtgtga

SEQ ID NO: 375626 - DNA, 25 bp, Mus musculus
ctcctgatcggacacaagaagttta

SEQ ID NO: 375627 - DNA, 25 bp, Mus musculus
ctcctgatcggagacaagaagttta

SEQ ID NO: 375628 - DNA, 25 bp, Mus musculus
ctcctgatctacaaagtttccaacc

SEQ ID NO: 375629 - DNA, 25 bp, Mus musculus
ctcctgatctactaagtttccaacc

SEQ ID NO: 375630 - DNA, 25 bp, Mus musculus
ctcctgatctggaagaagctgccaa

SEQ ID NO: 375631 - DNA, 25 bp, Mus musculus
ctcctgatctggtagaagctgccaa

SEQ ID NO: 375632 - DNA, 25 bp, Mus musculus
ctcctgattgtcattgtgggtgaac

SEQ ID NO: 375633 - DNA, 25 bp, Mus musculus
ctcctgattgtctttgtgggtgaac

SEQ ID NO: 375634 - DNA, 25 bp, Mus musculus
ctcctgattgttataccgttttgtg

SEQ ID NO: 375635 - DNA, 25 bp, Mus musculus
ctcctgattgttttaccgttttgtg

SEQ ID NO: 375636 - DNA, 25 bp, Mus musculus
ctcctgatttgcctgaatatgaaga

SEQ ID NO: 375637 - DNA, 25 bp, Mus musculus
ctcctgatttgcgtgaatatgaaga

SEQ ID NO: 375638 - DNA, 25 bp, Mus musculus
ctcctgcaacctaccttatttgaat

SEQ ID NO: 375639 - DNA, 25 bp, Mus musculus
ctcctgcaaccttccttatttgaat

SEQ ID NO: 375640 - DNA, 25 bp, Mus musculus
ctcctgcaatccaatgtatttatta

SEQ ID NO: 375641 - DNA, 25 bp, Mus musculus
ctcctgcaatcctatgtatttatta

SEQ ID NO: 375642 - DNA, 25 bp, Mus musculus
ctcctgcactgtcaatgctctgtga

SEQ ID NO: 375643 - DNA, 25 bp, Mus musculus
ctcctgcactgtgaatgctctgtga

SEQ ID NO: 375644 - DNA, 25 bp, Mus musculus
ctcctgcagctcaggttgaccttga

SEQ ID NO: 375645 - DNA, 25 bp, Mus musculus
ctcctgcagctctggttgaccttga

SEQ ID NO: 375646 - DNA, 25 bp, Mus musculus
ctcctgcatctgctatggactttca

SEQ ID NO: 375647 - DNA, 25 bp, Mus musculus
ctcctgcatctggtatggactttca

SEQ ID NO: 375648 - DNA, 25 bp, Mus musculus
ctcctgccaactctggctcagagga

SEQ ID NO: 375649 - DNA, 25 bp, Mus musculus
ctcctgccaactgtggctcagagga

SEQ ID NO: 375650 - DNA, 25 bp, Mus musculus
ctcctgccacataggacacatcatt

SEQ ID NO: 375651 - DNA, 25 bp, Mus musculus
ctcctgccacattggacacatcatt

SEQ ID NO: 375652 - DNA, 25 bp, Mus musculus
ctcctgccctggaaatggaagctgt

SEQ ID NO: 375653 - DNA, 25 bp, Mus musculus
ctcctgccctggtaatggaagctgt

SEQ ID NO: 375654 - DNA, 25 bp, Mus musculus
ctcctgcccttactgtttgattaca

SEQ ID NO: 375655 - DNA, 25 bp, Mus musculus
ctcctgcccttagtgtttgattaca

SEQ ID NO: 375656 - DNA, 25 bp, Mus musculus
ctcctgcctacaagtgatcaagcac

SEQ ID NO: 375657 - DNA, 25 bp, Mus musculus
ctcctgcctacatgtgatcaagcac

SEQ ID NO: 375658 - DNA, 25 bp, Mus musculus
ctcctgcctggacgtggaagactta

SEQ ID NO: 375659 - DNA, 25 bp, Mus musculus
ctcctgcctggaggtggaagactta

SEQ ID NO: 375660 - DNA, 25 bp, Mus musculus
ctcctgccttcgaagctctggtatt

SEQ ID NO: 375661 - DNA, 25 bp, Mus musculus
ctcctgccttcgtagctctggtatt

SEQ ID NO: 375662 - DNA, 25 bp, Mus musculus
ctcctgccttgtagttcggtaataa

SEQ ID NO: 375663 - DNA, 25 bp, Mus musculus
ctcctgccttgttgttcggtaataa

SEQ ID NO: 375664 - DNA, 25 bp, Mus musculus
ctcctgcctttgagattggattcct

SEQ ID NO: 375665 - DNA, 25 bp, Mus musculus
ctcctgcctttgtgattggattcct

SEQ ID NO: 375666 - DNA, 25 bp, Mus musculus
ctcctgcgatgtcgcgagacttaaa

SEQ ID NO: 375667 - DNA, 25 bp, Mus musculus
ctcctgcgatgtggcgagacttaaa

SEQ ID NO: 375668 - DNA, 25 bp, Mus musculus
ctcctgcggaccatgctctactggg

SEQ ID NO: 375669 - DNA, 25 bp, Mus musculus
ctcctgcggaccttgctctactggg

SEQ ID NO: 375670 - DNA, 25 bp, Mus musculus
ctcctgctacctagtagtcttggaa

SEQ ID NO: 375671 - DNA, 25 bp, Mus musculus
ctcctgctaccttgtagtcttggaa

SEQ ID NO: 375672 - DNA, 25 bp, Mus musculus
ctcctgctcaggattagaggttcat

SEQ ID NO: 375673 - DNA, 25 bp, Mus musculus
ctcctgctcaggtttagaggttcat

SEQ ID NO: 375674 - DNA, 25 bp, Mus musculus
ctcctgctgactcggtttgtagcat

SEQ ID NO: 375675 - DNA, 25 bp, Mus musculus
ctcctgctgactgggtttgtagcat

SEQ ID NO: 375676 - DNA, 25 bp, Mus musculus
ctcctgctgatgacttcctttattg

SEQ ID NO: 375677 - DNA, 25 bp, Mus musculus
ctcctgctgatgattgtgtcaggac

SEQ ID NO: 375678 - DNA, 25 bp, Mus musculus
ctcctgctgatgtcttcctttattg

SEQ ID NO: 375679 - DNA, 25 bp, Mus musculus
ctcctgctgatgtttgtgtcaggac

SEQ ID NO: 375680 - DNA, 25 bp, Mus musculus
ctcctgctgcagatttcttgtcttg

SEQ ID NO: 375681 - DNA, 25 bp, Mus musculus
ctcctgctgcagttttcttgtcttg

SEQ ID NO: 375682 - DNA, 25 bp, Mus musculus
ctcctgctggtgaaatcctacccaa

SEQ ID NO: 375683 - DNA, 25 bp, Mus musculus
ctcctgctggtgtaatcctacccaa

SEQ ID NO: 375684 - DNA, 25 bp, Mus musculus
ctcctgctggttactttgtgattta

SEQ ID NO: 375685 - DNA, 25 bp, Mus musculus
ctcctgctggtttctttgtgattta

SEQ ID NO: 375686 - DNA, 25 bp, Mus musculus
ctcctgcttacaactcaagttctga

SEQ ID NO: 375687 - DNA, 25 bp, Mus musculus
ctcctgcttacatctcaagttctga

SEQ ID NO: 375688 - DNA, 25 bp, Mus musculus
ctcctgcttggaccttctcgtgaag

SEQ ID NO: 375689 - DNA, 25 bp, Mus musculus
ctcctgcttggagcttctcgtgaag

SEQ ID NO: 375690 - DNA, 25 bp, Mus musculus
ctcctggaaagtctgtgctgatcat

SEQ ID NO: 375691 - DNA, 25 bp, Mus musculus
ctcctggaaagtgtgtgctgatcat

SEQ ID NO: 375692 - DNA, 25 bp, Mus musculus
ctcctggaacaacaccaaccaagaa

SEQ ID NO: 375693 - DNA, 25 bp, Mus musculus
ctcctggaacaagaccaaccaagaa

SEQ ID NO: 375694 - DNA, 25 bp, Mus musculus
ctcctggaacctccatgtgaacagt

SEQ ID NO: 375695 - DNA, 25 bp, Mus musculus
ctcctggaacctgcatgtgaacagt

SEQ ID NO: 375696 - DNA, 25 bp, Mus musculus
ctcctggaagccctgaggtttctgt

SEQ ID NO: 375697 - DNA, 25 bp, Mus musculus
ctcctggaagccgtgaggtttctgt

SEQ ID NO: 375698 - DNA, 25 bp, Mus musculus
ctcctggaatcccaatgagccttgg

SEQ ID NO: 375699 - DNA, 25 bp, Mus musculus
ctcctggaatccgaatgagccttgg

SEQ ID NO: 375700 - DNA, 25 bp, Mus musculus
ctcctggagctcagggtagtttgtc

SEQ ID NO: 375701 - DNA, 25 bp, Mus musculus
ctcctggagctctgggtagtttgtc

SEQ ID NO: 375702 - DNA, 25 bp, Mus musculus
ctcctggaggagaatggctgctgca

SEQ ID NO: 375703 - DNA, 25 bp, Mus musculus
ctcctggaggagtatggctgctgca

SEQ ID NO: 375704 - DNA, 25 bp, Mus musculus
ctcctggaggtgcttcatgtggaca

SEQ ID NO: 375705 - DNA, 25 bp, Mus musculus
ctcctggaggtggttcatgtggaca

SEQ ID NO: 375706 - DNA, 25 bp, Mus musculus
ctcctggatggtctgagaaccgtcc

SEQ ID NO: 375707 - DNA, 25 bp, Mus musculus
ctcctggatggtgtgagaaccgtcc

SEQ ID NO: 375708 - DNA, 25 bp, Mus musculus
ctcctggcaccaagggacaaggaca

SEQ ID NO: 375709 - DNA, 25 bp, Mus musculus
ctcctggcaccatgggacaaggaca

SEQ ID NO: 375710 - DNA, 25 bp, Mus musculus
ctcctggcatagagacgagaaggcg

SEQ ID NO: 375711 - DNA, 25 bp, Mus musculus
ctcctggcatagtgacgagaaggcg

SEQ ID NO: 375712 - DNA, 25 bp, Mus musculus
ctcctggccaacattgatctatttt

SEQ ID NO: 375713 - DNA, 25 bp, Mus musculus
ctcctggccaactttgatctatttt

SEQ ID NO: 375714 - DNA, 25 bp, Mus musculus
ctcctggcccatcctggagaataca

SEQ ID NO: 375715 - DNA, 25 bp, Mus musculus
ctcctggcccatgctggagaataca

SEQ ID NO: 375716 - DNA, 25 bp, Mus musculus
ctcctggccttacactttagtgcaa

SEQ ID NO: 375717 - DNA, 25 bp, Mus musculus
ctcctggccttagactttagtgcaa

SEQ ID NO: 375718 - DNA, 25 bp, Mus musculus
ctcctggcgatgcttttgacattat

SEQ ID NO: 375719 - DNA, 25 bp, Mus musculus
ctcctggcgatggttttgacattat

SEQ ID NO: 375720 - DNA, 25 bp, Mus musculus
ctcctggcgggtctatagctagttt

SEQ ID NO: 375721 - DNA, 25 bp, Mus musculus
ctcctggcgggtgtatagctagttt

SEQ ID NO: 375722 - DNA, 25 bp, Mus musculus
ctcctggcgtttaatggaagtgtta

SEQ ID NO: 375723 - DNA, 25 bp, Mus musculus
ctcctggcgttttatggaagtgtta

SEQ ID NO: 375724 - DNA, 25 bp, Mus musculus
ctcctggctggtcgcctgaaagcag

SEQ ID NO: 375725 - DNA, 25 bp, Mus musculus
ctcctggctggtggcctgaaagcag

SEQ ID NO: 375726 - DNA, 25 bp, Mus musculus
ctcctgggaatcagagagctgctca

SEQ ID NO: 375727 - DNA, 25 bp, Mus musculus
ctcctgggaatctgagagctgctca

SEQ ID NO: 375728 - DNA, 25 bp, Mus musculus
ctcctgggacctattgcagatgtgc

SEQ ID NO: 375729 - DNA, 25 bp, Mus musculus
ctcctgggaccttttgcagatgtgc

SEQ ID NO: 375730 - DNA, 25 bp, Mus musculus
ctcctgggactgagacctccgtgct

SEQ ID NO: 375731 - DNA, 25 bp, Mus musculus
ctcctgggactgagcttcaaagtta

SEQ ID NO: 375732 - DNA, 25 bp, Mus musculus
ctcctgggactgtgacctccgtgct

SEQ ID NO: 375733 - DNA, 25 bp, Mus musculus
ctcctgggactgtgcttcaaagtta

SEQ ID NO: 375734 - DNA, 25 bp, Mus musculus
ctcctgggagctagacggaggctaa

SEQ ID NO: 375735 - DNA, 25 bp, Mus musculus
ctcctgggagcttgacggaggctaa

SEQ ID NO: 375736 - DNA, 25 bp, Mus musculus
ctcctgggatcaccagcatgcttta

SEQ ID NO: 375737 - DNA, 25 bp, Mus musculus
ctcctgggatcagcagcatgcttta

SEQ ID NO: 375738 - DNA, 25 bp, Mus musculus
ctcctgggtagaagtgttcatcaca

SEQ ID NO: 375739 - DNA, 25 bp, Mus musculus
ctcctgggtagactggtacatgcgt

SEQ ID NO: 375740 - DNA, 25 bp, Mus musculus
ctcctgggtagagtggtacatgcgt

SEQ ID NO: 375741 - DNA, 25 bp, Mus musculus
ctcctgggtagatgtgttcatcaca

SEQ ID NO: 375742 - DNA, 25 bp, Mus musculus
ctcctgggtccacaatgttctagat

SEQ ID NO: 375743 - DNA, 25 bp, Mus musculus
ctcctgggtccagaatgttctagat

SEQ ID NO: 375744 - DNA, 25 bp, Mus musculus
ctcctgggtgacatagcgggttgta

SEQ ID NO: 375745 - DNA, 25 bp, Mus musculus
ctcctgggtgacttagcgggttgta

SEQ ID NO: 375746 - DNA, 25 bp, Mus musculus
ctcctgggttataagccctataaat

SEQ ID NO: 375747 - DNA, 25 bp, Mus musculus
ctcctgggttatatgtcctttgtgt

SEQ ID NO: 375748 - DNA, 25 bp, Mus musculus
ctcctgggttattagccctataaat

SEQ ID NO: 375749 - DNA, 25 bp, Mus musculus
ctcctgggttatttgtcctttgtgt

SEQ ID NO: 375750 - DNA, 25 bp, Mus musculus
ctcctgggttcaagctgtaataaag

SEQ ID NO: 375751 - DNA, 25 bp, Mus musculus
ctcctgggttcatgctgtaataaag

SEQ ID NO: 375752 - DNA, 25 bp, Mus musculus
ctcctgggttggatacatctgacgg

SEQ ID NO: 375753 - DNA, 25 bp, Mus musculus
ctcctgggttggttacatctgacgg

SEQ ID NO: 375754 - DNA, 25 bp, Mus musculus
ctcctgggttgtatccaaacaacag

SEQ ID NO: 375755 - DNA, 25 bp, Mus musculus
ctcctgggttgtttccaaacaacag

SEQ ID NO: 375756 - DNA, 25 bp, Mus musculus
ctcctggtaacactctactgcagat

SEQ ID NO: 375757 - DNA, 25 bp, Mus musculus
ctcctggtaacagtctactgcagat

SEQ ID NO: 375758 - DNA, 25 bp, Mus musculus
ctcctggtacatattggttcgcatt

SEQ ID NO: 375759 - DNA, 25 bp, Mus musculus
ctcctggtacattttggttcgcatt

SEQ ID NO: 375760 - DNA, 25 bp, Mus musculus
ctcctggtcacacctgttgtctgaa

SEQ ID NO: 375761 - DNA, 25 bp, Mus musculus
ctcctggtcacagctgttgtctgaa

SEQ ID NO: 375762 - DNA, 25 bp, Mus musculus
ctcctggtcccgcataaataattgt

SEQ ID NO: 375763 - DNA, 25 bp, Mus musculus
ctcctggtcccggataaataattgt

SEQ ID NO: 375764 - DNA, 25 bp, Mus musculus
ctcctggtcgtgacagcagcattgt

SEQ ID NO: 375765 - DNA, 25 bp, Mus musculus
ctcctggtcgtgtcagcagcattgt

SEQ ID NO: 375766 - DNA, 25 bp, Mus musculus
ctcctggtctctcaaggacttgaaa

SEQ ID NO: 375767 - DNA, 25 bp, Mus musculus
ctcctggtctctgaaggacttgaaa

SEQ ID NO: 375768 - DNA, 25 bp, Mus musculus
ctcctggtgctgcactttgatgtgg

SEQ ID NO: 375769 - DNA, 25 bp, Mus musculus
ctcctggtgctggactttgatgtgg

SEQ ID NO: 375770 - DNA, 25 bp, Mus musculus
ctcctggttccaacattgctattta

SEQ ID NO: 375771 - DNA, 25 bp, Mus musculus
ctcctggttccatcattgctattta

SEQ ID NO: 375772 - DNA, 25 bp, Mus musculus
ctcctgtaactgatggttcaggcca

SEQ ID NO: 375773 - DNA, 25 bp, Mus musculus
ctcctgtaactgttggttcaggcca

SEQ ID NO: 375774 - DNA, 25 bp, Mus musculus
ctcctgtaccagagtccaggtgtaa

SEQ ID NO: 375775 - DNA, 25 bp, Mus musculus
ctcctgtaccagtgtccaggtgtaa

SEQ ID NO: 375776 - DNA, 25 bp, Mus musculus
ctcctgtacgagaggctgcagaaca

SEQ ID NO: 375777 - DNA, 25 bp, Mus musculus
ctcctgtacgagtggctgcagaaca

SEQ ID NO: 375778 - DNA, 25 bp, Mus musculus
ctcctgtactgcacctgagtagtta

SEQ ID NO: 375779 - DNA, 25 bp, Mus musculus
ctcctgtactgctcctgagtagtta

SEQ ID NO: 375780 - DNA, 25 bp, Mus musculus
ctcctgtactttagacctcaactta

SEQ ID NO: 375781 - DNA, 25 bp, Mus musculus
ctcctgtacttttgacctcaactta

SEQ ID NO: 375782 - DNA, 25 bp, Mus musculus
ctcctgtaggagcttagtgggtcat

SEQ ID NO: 375783 - DNA, 25 bp, Mus musculus
ctcctgtaggaggttagtgggtcat

SEQ ID NO: 375784 - DNA, 25 bp, Mus musculus
ctcctgtataaaaccgacctctgga

SEQ ID NO: 375785 - DNA, 25 bp, Mus musculus
ctcctgtataaatccgacctctgga

SEQ ID NO: 375786 - DNA, 25 bp, Mus musculus
ctcctgtataccaaccactgataag

SEQ ID NO: 375787 - DNA, 25 bp, Mus musculus
ctcctgtatacctaccactgataag

SEQ ID NO: 375788 - DNA, 25 bp, Mus musculus
ctcctgtcaggcagagcagacctga

SEQ ID NO: 375789 - DNA, 25 bp, Mus musculus
ctcctgtcaggctgagcagacctga

SEQ ID NO: 375790 - DNA, 25 bp, Mus musculus
ctcctgtccatgagaaggtgtggag

SEQ ID NO: 375791 - DNA, 25 bp, Mus musculus
ctcctgtccatgtgaaggtgtggag

SEQ ID NO: 375792 - DNA, 25 bp, Mus musculus
ctcctgtcccaacgttaatctgaaa

SEQ ID NO: 375793 - DNA, 25 bp, Mus musculus
ctcctgtcccaaggttaatctgaaa

SEQ ID NO: 375794 - DNA, 25 bp, Mus musculus
ctcctgtcctaacctggttggagga

SEQ ID NO: 375795 - DNA, 25 bp, Mus musculus
ctcctgtcctaagctggttggagga

SEQ ID NO: 375796 - DNA, 25 bp, Mus musculus
ctcctgtcgcctcgaaatttccaaa

SEQ ID NO: 375797 - DNA, 25 bp, Mus musculus
ctcctgtcgcctggaaatttccaaa

SEQ ID NO: 375798 - DNA, 25 bp, Mus musculus
ctcctgtctcacactgtattgtaaa

SEQ ID NO: 375799 - DNA, 25 bp, Mus musculus
ctcctgtctcactctgtattgtaaa

SEQ ID NO: 375800 - DNA, 25 bp, Mus musculus
ctcctgtctctgaattcttgatcaa

SEQ ID NO: 375801 - DNA, 25 bp, Mus musculus
ctcctgtctctgcttactagtacta

SEQ ID NO: 375802 - DNA, 25 bp, Mus musculus
ctcctgtctctggttactagtacta

SEQ ID NO: 375803 - DNA, 25 bp, Mus musculus
ctcctgtctctgtattcttgatcaa

SEQ ID NO: 375804 - DNA, 25 bp, Mus musculus
ctcctgtctgagctgtctacttcct

SEQ ID NO: 375805 - DNA, 25 bp, Mus musculus
ctcctgtctgaggtgtctacttcct

SEQ ID NO: 375806 - DNA, 25 bp, Mus musculus
ctcctgtgaaatcttctgcattctg

SEQ ID NO: 375807 - DNA, 25 bp, Mus musculus
ctcctgtgaaatgttctgcattctg

SEQ ID NO: 375808 - DNA, 25 bp, Mus musculus
ctcctgtgccttaataaggaaattc

SEQ ID NO: 375809 - DNA, 25 bp, Mus musculus
ctcctgtgcctttataaggaaattc

SEQ ID NO: 375810 - DNA, 25 bp, Mus musculus
ctcctgtgctgtcggcctaagctgg

SEQ ID NO: 375811 - DNA, 25 bp, Mus musculus
ctcctgtgctgtgggcctaagctgg

SEQ ID NO: 375812 - DNA, 25 bp, Mus musculus
ctcctgtggaatctgtagctacgaa

SEQ ID NO: 375813 - DNA, 25 bp, Mus musculus
ctcctgtggaatgtgtagctacgaa

SEQ ID NO: 375814 - DNA, 25 bp, Mus musculus
ctcctgtgggctcatttgtgtaaga

SEQ ID NO: 375815 - DNA, 25 bp, Mus musculus
ctcctgtgggctgatttgtgtaaga

SEQ ID NO: 375816 - DNA, 25 bp, Mus musculus
ctcctgtgtacactattgtagcatg

SEQ ID NO: 375817 - DNA, 25 bp, Mus musculus
ctcctgtgtacagtattgtagcatg

SEQ ID NO: 375818 - DNA, 25 bp, Mus musculus
ctcctgtgtggcaagcagcgggtaa

SEQ ID NO: 375819 - DNA, 25 bp, Mus musculus
ctcctgtgtggctagcagcgggtaa

SEQ ID NO: 375820 - DNA, 25 bp, Mus musculus
ctcctgtgttagagcctccatccat

SEQ ID NO: 375821 - DNA, 25 bp, Mus musculus
ctcctgtgttagtgcctccatccat

SEQ ID NO: 375822 - DNA, 25 bp, Mus musculus
ctcctgtgttcaagtaggttcagga

SEQ ID NO: 375823 - DNA, 25 bp, Mus musculus
ctcctgtgttcatgtaggttcagga

SEQ ID NO: 375824 - DNA, 25 bp, Mus musculus
ctcctgttgagaacaacagctttct

SEQ ID NO: 375825 - DNA, 25 bp, Mus musculus
ctcctgttgagatcaacagctttct

SEQ ID NO: 375826 - DNA, 25 bp, Mus musculus
ctcctgttgctacattacatccgaa

SEQ ID NO: 375827 - DNA, 25 bp, Mus musculus
ctcctgttgctagattacatccgaa

SEQ ID NO: 375828 - DNA, 25 bp, Mus musculus
ctcctgttggttcacgatccaggaa

SEQ ID NO: 375829 - DNA, 25 bp, Mus musculus
ctcctgttggttgacgatccaggaa

SEQ ID NO: 375830 - DNA, 25 bp, Mus musculus
ctcctgttgttccttgtgactatca

SEQ ID NO: 375831 - DNA, 25 bp, Mus musculus
ctcctgttgttcgttgtgactatca

SEQ ID NO: 375832 - DNA, 25 bp, Mus musculus
ctcctgtttattatgccatatgtgt

SEQ ID NO: 375833 - DNA, 25 bp, Mus musculus
ctcctgtttattttgccatatgtgt

SEQ ID NO: 375834 - DNA, 25 bp, Mus musculus
ctcctgttttcaagccttttcaaat

SEQ ID NO: 375835 - DNA, 25 bp, Mus musculus
ctcctgttttcatgccttttcaaat

SEQ ID NO: 375836 - DNA, 25 bp, Mus musculus
ctcctgttttgcctcttaagtcata

SEQ ID NO: 375837 - DNA, 25 bp, Mus musculus
ctcctgttttgcgtcttaagtcata

SEQ ID NO: 375838 - DNA, 25 bp, Mus musculus
ctccttaagaagctgtagtccctcg

SEQ ID NO: 375839 - DNA, 25 bp, Mus musculus
ctccttaagaaggtgtagtccctcg

SEQ ID NO: 375840 - DNA, 25 bp, Mus musculus
ctccttaaggatactcagacctgga

SEQ ID NO: 375841 - DNA, 25 bp, Mus musculus
ctccttaaggattctcagacctgga

SEQ ID NO: 375842 - DNA, 25 bp, Mus musculus
ctccttaatgatatccttccttcaa

SEQ ID NO: 375843 - DNA, 25 bp, Mus musculus
ctccttaatgatttccttccttcaa

SEQ ID NO: 375844 - DNA, 25 bp, Mus musculus
ctccttacccacacaactttatgtt

SEQ ID NO: 375845 - DNA, 25 bp, Mus musculus
ctccttacccactcaactttatgtt

SEQ ID NO: 375846 - DNA, 25 bp, Mus musculus
ctccttacctagacaagacgctgtg

SEQ ID NO: 375847 - DNA, 25 bp, Mus musculus
ctccttacctagtcaagacgctgtg

SEQ ID NO: 375848 - DNA, 25 bp, Mus musculus
ctccttacctccactatgaattgta

SEQ ID NO: 375849 - DNA, 25 bp, Mus musculus
ctccttacctcctctatgaattgta

SEQ ID NO: 375850 - DNA, 25 bp, Mus musculus
ctccttactgtaccatctgtgaggt

SEQ ID NO: 375851 - DNA, 25 bp, Mus musculus
ctccttactgtagcatctgtgaggt

SEQ ID NO: 375852 - DNA, 25 bp, Mus musculus
ctccttacttctagactccagttca

SEQ ID NO: 375853 - DNA, 25 bp, Mus musculus
ctccttacttcttgactccagttca

SEQ ID NO: 375854 - DNA, 25 bp, Mus musculus
ctccttagaagcattgcctctagag

SEQ ID NO: 375855 - DNA, 25 bp, Mus musculus
ctccttagaagctttgcctctagag

SEQ ID NO: 375856 - DNA, 25 bp, Mus musculus
ctccttagaggccttcacaagaagc

SEQ ID NO: 375857 - DNA, 25 bp, Mus musculus
ctccttagaggcgttcacaagaagc

SEQ ID NO: 375858 - DNA, 25 bp, Mus musculus
ctccttagccctagttgctagtaat

SEQ ID NO: 375859 - DNA, 25 bp, Mus musculus
ctccttagcccttgttgctagtaat

SEQ ID NO: 375860 - DNA, 25 bp, Mus musculus
ctccttagttccctgtggttggttg

SEQ ID NO: 375861 - DNA, 25 bp, Mus musculus
ctccttagttccgtgtggttggttg

SEQ ID NO: 375862 - DNA, 25 bp, Mus musculus
ctccttagttgcatttcccaggaat

SEQ ID NO: 375863 - DNA, 25 bp, Mus musculus
ctccttagttgcttttcccaggaat

SEQ ID NO: 375864 - DNA, 25 bp, Mus musculus
ctccttataaagacatggcattaca

SEQ ID NO: 375865 - DNA, 25 bp, Mus musculus
ctccttataaagtcatggcattaca

SEQ ID NO: 375866 - DNA, 25 bp, Mus musculus
ctccttatactaacaggcaagtagg

SEQ ID NO: 375867 - DNA, 25 bp, Mus musculus
ctccttatactatcaggcaagtagg

SEQ ID NO: 375868 - DNA, 25 bp, Mus musculus
ctccttatctcactctgggtcagag

SEQ ID NO: 375869 - DNA, 25 bp, Mus musculus
ctccttatctcagtctgggtcagag

SEQ ID NO: 375870 - DNA, 25 bp, Mus musculus
ctccttattcttaactcatgggccg

SEQ ID NO: 375871 - DNA, 25 bp, Mus musculus
ctccttattctttactcatgggccg

SEQ ID NO: 375872 - DNA, 25 bp, Mus musculus
ctccttattgtcactgtaaatggaa

SEQ ID NO: 375873 - DNA, 25 bp, Mus musculus
ctccttattgtctctgtaaatggaa

SEQ ID NO: 375874 - DNA, 25 bp, Mus musculus
ctccttcaaagaaaaccactacctg

SEQ ID NO: 375875 - DNA, 25 bp, Mus musculus
ctccttcaaagataaccactacctg

SEQ ID NO: 375876 - DNA, 25 bp, Mus musculus
ctccttcagaagcatatgacctggg

SEQ ID NO: 375877 - DNA, 25 bp, Mus musculus
ctccttcagaaggatatgacctggg

SEQ ID NO: 375878 - DNA, 25 bp, Mus musculus
ctccttcagattacctagatatctt

SEQ ID NO: 375879 - DNA, 25 bp, Mus musculus
ctccttcagatttcctagatatctt

SEQ ID NO: 375880 - DNA, 25 bp, Mus musculus
ctccttcaggatatcggtcttttat

SEQ ID NO: 375881 - DNA, 25 bp, Mus musculus
ctccttcaggatcaggtacttcttt

SEQ ID NO: 375882 - DNA, 25 bp, Mus musculus
ctccttcaggatgaggtacttcttt

SEQ ID NO: 375883 - DNA, 25 bp, Mus musculus
ctccttcaggatttcggtcttttat

SEQ ID NO: 375884 - DNA, 25 bp, Mus musculus
ctccttcagtccatgagttgtgtgg

SEQ ID NO: 375885 - DNA, 25 bp, Mus musculus
ctccttcagtccttgagttgtgtgg

SEQ ID NO: 375886 - DNA, 25 bp, Mus musculus
ctccttcagtgtaagtgcattccca

SEQ ID NO: 375887 - DNA, 25 bp, Mus musculus
ctccttcagtgttagtgcattccca

SEQ ID NO: 375888 - DNA, 25 bp, Mus musculus
ctccttcatagtcctttcactgaat

SEQ ID NO: 375889 - DNA, 25 bp, Mus musculus
ctccttcatagtgctttcactgaat

SEQ ID NO: 375890 - DNA, 25 bp, Mus musculus
ctccttcattctagcattccagaag

SEQ ID NO: 375891 - DNA, 25 bp, Mus musculus
ctccttcattcttgcattccagaag

SEQ ID NO: 375892 - DNA, 25 bp, Mus musculus
ctccttccaatgaggatcccataga

SEQ ID NO: 375893 - DNA, 25 bp, Mus musculus
ctccttccaatgtggatcccataga

SEQ ID NO: 375894 - DNA, 25 bp, Mus musculus
ctccttccagaaacacttatctcta

SEQ ID NO: 375895 - DNA, 25 bp, Mus musculus
ctccttccagaatcacttatctcta

SEQ ID NO: 375896 - DNA, 25 bp, Mus musculus
ctccttccccctcttttgaatcagg

SEQ ID NO: 375897 - DNA, 25 bp, Mus musculus
ctccttccccctgttttgaatcagg

SEQ ID NO: 375898 - DNA, 25 bp, Mus musculus
ctccttcccgaacaggtgatggctg

SEQ ID NO: 375899 - DNA, 25 bp, Mus musculus
ctccttcccgaagaggtgatggctg

SEQ ID NO: 375900 - DNA, 25 bp, Mus musculus
ctccttccgccaaatcaaatcggta

SEQ ID NO: 375901 - DNA, 25 bp, Mus musculus
ctccttccgccatatcaaatcggta

SEQ ID NO: 375902 - DNA, 25 bp, Mus musculus
ctccttccggtaattgtacataatg

SEQ ID NO: 375903 - DNA, 25 bp, Mus musculus
ctccttccggtatttgtacataatg

SEQ ID NO: 375904 - DNA, 25 bp, Mus musculus
ctccttcctcgtctttttatggatc

SEQ ID NO: 375905 - DNA, 25 bp, Mus musculus
ctccttcctcgtgtttttatggatc

SEQ ID NO: 375906 - DNA, 25 bp, Mus musculus
ctccttcctgatacttggttgtatt

SEQ ID NO: 375907 - DNA, 25 bp, Mus musculus
ctccttcctgattcttggttgtatt

SEQ ID NO: 375908 - DNA, 25 bp, Mus musculus
ctccttcctggcattgggtagacat

SEQ ID NO: 375909 - DNA, 25 bp, Mus musculus
ctccttcctggctttgggtagacat

SEQ ID NO: 375910 - DNA, 25 bp, Mus musculus
ctccttcctgtgagctggataggga

SEQ ID NO: 375911 - DNA, 25 bp, Mus musculus
ctccttcctgtgtgctggataggga

SEQ ID NO: 375912 - DNA, 25 bp, Mus musculus
ctccttccttatagcgtggtataga

SEQ ID NO: 375913 - DNA, 25 bp, Mus musculus
ctccttccttatcttttctctatta

SEQ ID NO: 375914 - DNA, 25 bp, Mus musculus
ctccttccttatgttttctctatta

SEQ ID NO: 375915 - DNA, 25 bp, Mus musculus
ctccttccttattgcgtggtataga

SEQ ID NO: 375916 - DNA, 25 bp, Mus musculus
ctccttccttccactactggaggaa

SEQ ID NO: 375917 - DNA, 25 bp, Mus musculus
ctccttccttcctctactggaggaa

SEQ ID NO: 375918 - DNA, 25 bp, Mus musculus
ctccttcgcaggcagggacctaagg

SEQ ID NO: 375919 - DNA, 25 bp, Mus musculus
ctccttcgcagggagggacctaagg

SEQ ID NO: 375920 - DNA, 25 bp, Mus musculus
ctccttcgcatgagtgatggttaga

SEQ ID NO: 375921 - DNA, 25 bp, Mus musculus
ctccttcgcatgtgtgatggttaga

SEQ ID NO: 375922 - DNA, 25 bp, Mus musculus
ctccttcgctcaatactgtttcaaa

SEQ ID NO: 375923 - DNA, 25 bp, Mus musculus
ctccttcgctcattactgtttcaaa

SEQ ID NO: 375924 - DNA, 25 bp, Mus musculus
ctccttcgggctagggaaagtgctt

SEQ ID NO: 375925 - DNA, 25 bp, Mus musculus
ctccttcgggcttgggaaagtgctt

SEQ ID NO: 375926 - DNA, 25 bp, Mus musculus
ctccttctaccacgacacggaggaa

SEQ ID NO: 375927 - DNA, 25 bp, Mus musculus
ctccttctaccaggacacggaggaa

SEQ ID NO: 375928 - DNA, 25 bp, Mus musculus
ctccttctattcactgggctggaaa

SEQ ID NO: 375929 - DNA, 25 bp, Mus musculus
ctccttctattctctgggctggaaa

SEQ ID NO: 375930 - DNA, 25 bp, Mus musculus
ctccttctcaagctctaagactcaa

SEQ ID NO: 375931 - DNA, 25 bp, Mus musculus
ctccttctcaaggtctaagactcaa

SEQ ID NO: 375932 - DNA, 25 bp, Mus musculus
ctccttctctatctgggtgcttaat

SEQ ID NO: 375933 - DNA, 25 bp, Mus musculus
ctccttctctatgtgggtgcttaat

SEQ ID NO: 375934 - DNA, 25 bp, Mus musculus
ctccttctggttatgtggctggaca

SEQ ID NO: 375935 - DNA, 25 bp, Mus musculus
ctccttctggttttgtggctggaca

SEQ ID NO: 375936 - DNA, 25 bp, Mus musculus
ctccttcttcttcgcctagggcaga

SEQ ID NO: 375937 - DNA, 25 bp, Mus musculus
ctccttcttcttggcctagggcaga

SEQ ID NO: 375938 - DNA, 25 bp, Mus musculus
ctccttgaattaatgtctctctctc

SEQ ID NO: 375939 - DNA, 25 bp, Mus musculus
ctccttgaattattgtctctctctc

SEQ ID NO: 375940 - DNA, 25 bp, Mus musculus
ctccttgacggaagaagtgccatgt

SEQ ID NO: 375941 - DNA, 25 bp, Mus musculus
ctccttgacggatgaagtgccatgt

SEQ ID NO: 375942 - DNA, 25 bp, Mus musculus
ctccttgcaactcgctaatgactac

SEQ ID NO: 375943 - DNA, 25 bp, Mus musculus
ctccttgcaactggctaatgactac

SEQ ID NO: 375944 - DNA, 25 bp, Mus musculus
ctccttgcacatatggaacagatat

SEQ ID NO: 375945 - DNA, 25 bp, Mus musculus
ctccttgcacatttggaacagatat

SEQ ID NO: 375946 - DNA, 25 bp, Mus musculus
ctccttgcattgagatgatctagtg

SEQ ID NO: 375947 - DNA, 25 bp, Mus musculus
ctccttgcattgtgatgatctagtg

SEQ ID NO: 375948 - DNA, 25 bp, Mus musculus
ctccttgcctcacggttgtgcgtgg

SEQ ID NO: 375949 - DNA, 25 bp, Mus musculus
ctccttgcctcagggttgtgcgtgg

SEQ ID NO: 375950 - DNA, 25 bp, Mus musculus
ctccttgctatcagtcacaactcag

SEQ ID NO: 375951 - DNA, 25 bp, Mus musculus
ctccttgctatctgtcacaactcag

SEQ ID NO: 375952 - DNA, 25 bp, Mus musculus
ctccttgctctcatttaaatccata

SEQ ID NO: 375953 - DNA, 25 bp, Mus musculus
ctccttgctctcttttaaatccata

SEQ ID NO: 375954 - DNA, 25 bp, Mus musculus
ctccttgctgtcatgatttggtggt

SEQ ID NO: 375955 - DNA, 25 bp, Mus musculus
ctccttgctgtcttgatttggtggt

SEQ ID NO: 375956 - DNA, 25 bp, Mus musculus
ctccttgctgttctgtgtcatagaa

SEQ ID NO: 375957 - DNA, 25 bp, Mus musculus
ctccttgctgttgtgtgtcatagaa

SEQ ID NO: 375958 - DNA, 25 bp, Mus musculus
ctccttgcttagcttcctgaagaca

SEQ ID NO: 375959 - DNA, 25 bp, Mus musculus
ctccttgcttaggttcctgaagaca

SEQ ID NO: 375960 - DNA, 25 bp, Mus musculus
ctccttggaaacaattctcttggtt

SEQ ID NO: 375961 - DNA, 25 bp, Mus musculus
ctccttggaaactattctcttggtt

SEQ ID NO: 375962 - DNA, 25 bp, Mus musculus
ctccttggaattccttctgctacat

SEQ ID NO: 375963 - DNA, 25 bp, Mus musculus
ctccttggaattgcttctgctacat

SEQ ID NO: 375964 - DNA, 25 bp, Mus musculus
ctccttggagtactatcccttcaaa

SEQ ID NO: 375965 - DNA, 25 bp, Mus musculus
ctccttggagtagtatcccttcaaa

SEQ ID NO: 375966 - DNA, 25 bp, Mus musculus
ctccttggccaacttgctctgtatg

SEQ ID NO: 375967 - DNA, 25 bp, Mus musculus
ctccttggccaagttgctctgtatg

SEQ ID NO: 375968 - DNA, 25 bp, Mus musculus
ctccttggccttagggcattcagat

SEQ ID NO: 375969 - DNA, 25 bp, Mus musculus
ctccttggcctttgggcattcagat

SEQ ID NO: 375970 - DNA, 25 bp, Mus musculus
ctccttggttgaccagttgcatggt

SEQ ID NO: 375971 - DNA, 25 bp, Mus musculus
ctccttggttgagcagttgcatggt

SEQ ID NO: 375972 - DNA, 25 bp, Mus musculus
ctccttgtcaagaggtgtgggcata

SEQ ID NO: 375973 - DNA, 25 bp, Mus musculus
ctccttgtcaagtggtgtgggcata

SEQ ID NO: 375974 - DNA, 25 bp, Mus musculus
ctccttgtcattagggtctttggtg

SEQ ID NO: 375975 - DNA, 25 bp, Mus musculus
ctccttgtcatttgggtctttggtg

SEQ ID NO: 375976 - DNA, 25 bp, Mus musculus
ctccttgtcgagacggtctctggaa

SEQ ID NO: 375977 - DNA, 25 bp, Mus musculus
ctccttgtcgagtcggtctctggaa

SEQ ID NO: 375978 - DNA, 25 bp, Mus musculus
ctccttgtgagcaccgtggctatca

SEQ ID NO: 375979 - DNA, 25 bp, Mus musculus
ctccttgtgagctccgtggctatca

SEQ ID NO: 375980 - DNA, 25 bp, Mus musculus
ctccttgtgcttcatctgagggtaa

SEQ ID NO: 375981 - DNA, 25 bp, Mus musculus
ctccttgtgcttgatctgagggtaa

SEQ ID NO: 375982 - DNA, 25 bp, Mus musculus
ctccttgtgtagcagtgggtgtcca

SEQ ID NO: 375983 - DNA, 25 bp, Mus musculus
ctccttgtgtaggagtgggtgtcca

SEQ ID NO: 375984 - DNA, 25 bp, Mus musculus
ctccttgtgtgaaagagacatgact

SEQ ID NO: 375985 - DNA, 25 bp, Mus musculus
ctccttgtgtgatagagacatgact

SEQ ID NO: 375986 - DNA, 25 bp, Mus musculus
ctccttgtgtgtattggtctttggg

SEQ ID NO: 375987 - DNA, 25 bp, Mus musculus
ctccttgtgtgttttggtctttggg

SEQ ID NO: 375988 - DNA, 25 bp, Mus musculus
ctccttgttcacaagcacaggtaga

SEQ ID NO: 375989 - DNA, 25 bp, Mus musculus
ctccttgttcactagcacaggtaga

SEQ ID NO: 375990 - DNA, 25 bp, Mus musculus
ctccttgtttcccttgataatcttg

SEQ ID NO: 375991 - DNA, 25 bp, Mus musculus
ctccttgtttccgttgataatcttg

SEQ ID NO: 375992 - DNA, 25 bp, Mus musculus
ctccttgtttctctcttatgaagtg

SEQ ID NO: 375993 - DNA, 25 bp, Mus musculus
ctccttgtttctgtcttatgaagtg

SEQ ID NO: 375994 - DNA, 25 bp, Mus musculus
ctcctttaatgtagcatgtttgcaa

SEQ ID NO: 375995 - DNA, 25 bp, Mus musculus
ctcctttaatgttgcatgtttgcaa

SEQ ID NO: 375996 - DNA, 25 bp, Mus musculus
ctcctttactgaagggcactgacca

SEQ ID NO: 375997 - DNA, 25 bp, Mus musculus
ctcctttactgatgggcactgacca

SEQ ID NO: 375998 - DNA, 25 bp, Mus musculus
ctcctttatcccactcattatataa

SEQ ID NO: 375999 - DNA, 25 bp, Mus musculus
ctcctttatccctctcattatataa

SEQ ID NO: 376000 - DNA, 25 bp, Mus musculus
ctcctttatcgcataggccgtgaaa

SEQ ID NO: 376001 - DNA, 25 bp, Mus musculus
ctcctttatcgcttaggccgtgaaa

SEQ ID NO: 376002 - DNA, 25 bp, Mus musculus
ctcctttatcttattctagctattt

SEQ ID NO: 376003 - DNA, 25 bp, Mus musculus
ctcctttatctttttctagctattt

SEQ ID NO: 376004 - DNA, 25 bp, Mus musculus
ctcctttcacctactgaggtagaat

SEQ ID NO: 376005 - DNA, 25 bp, Mus musculus
ctcctttcaccttctgaggtagaat

SEQ ID NO: 376006 - DNA, 25 bp, Mus musculus
ctcctttcaggaagatcgctttgtt

SEQ ID NO: 376007 - DNA, 25 bp, Mus musculus
ctcctttcaggatgatcgctttgtt

SEQ ID NO: 376008 - DNA, 25 bp, Mus musculus
ctcctttcagggatgtggtacctgt

SEQ ID NO: 376009 - DNA, 25 bp, Mus musculus
ctcctttcagggttgtggtacctgt

SEQ ID NO: 376010 - DNA, 25 bp, Mus musculus
ctcctttcatttcctgagtgttaag

SEQ ID NO: 376011 - DNA, 25 bp, Mus musculus
ctcctttcatttgctgagtgttaag

SEQ ID NO: 376012 - DNA, 25 bp, Mus musculus
ctcctttccctacgctcatgaatat

SEQ ID NO: 376013 - DNA, 25 bp, Mus musculus
ctcctttccctaggctcatgaatat

SEQ ID NO: 376014 - DNA, 25 bp, Mus musculus
ctcctttcctagactcatggcaatc

SEQ ID NO: 376015 - DNA, 25 bp, Mus musculus
ctcctttcctagtctcatggcaatc

SEQ ID NO: 376016 - DNA, 25 bp, Mus musculus
ctcctttcctctcgagtcagtgaaa

SEQ ID NO: 376017 - DNA, 25 bp, Mus musculus
ctcctttcctctggagtcagtgaaa

SEQ ID NO: 376018 - DNA, 25 bp, Mus musculus
ctcctttctcttccagtatgtattc

SEQ ID NO: 376019 - DNA, 25 bp, Mus musculus
ctcctttctcttccgctgggtacaa

SEQ ID NO: 376020 - DNA, 25 bp, Mus musculus
ctcctttctcttgcagtatgtattc

SEQ ID NO: 376021 - DNA, 25 bp, Mus musculus
ctcctttctcttgcgctgggtacaa

SEQ ID NO: 376022 - DNA, 25 bp, Mus musculus
ctcctttctgttattgcaccagata

SEQ ID NO: 376023 - DNA, 25 bp, Mus musculus
ctcctttctgtttttgcaccagata

SEQ ID NO: 376024 - DNA, 25 bp, Mus musculus
ctcctttgatggatcctgatgctta

SEQ ID NO: 376025 - DNA, 25 bp, Mus musculus
ctcctttgatggttcctgatgctta

SEQ ID NO: 376026 - DNA, 25 bp, Mus musculus
ctcctttgcgatcgatggcatgtgt

SEQ ID NO: 376027 - DNA, 25 bp, Mus musculus
ctcctttgcgatggatggcatgtgt

SEQ ID NO: 376028 - DNA, 25 bp, Mus musculus
ctcctttggatcacccagggttcac

SEQ ID NO: 376029 - DNA, 25 bp, Mus musculus
ctcctttggatctcccagggttcac

SEQ ID NO: 376030 - DNA, 25 bp, Mus musculus
ctcctttgtcccctaattggaaatg

SEQ ID NO: 376031 - DNA, 25 bp, Mus musculus
ctcctttgtcccgtaattggaaatg

SEQ ID NO: 376032 - DNA, 25 bp, Mus musculus
ctcctttgtctgaacttttggtgtt

SEQ ID NO: 376033 - DNA, 25 bp, Mus musculus
ctcctttgtctgtacttttggtgtt

SEQ ID NO: 376034 - DNA, 25 bp, Mus musculus
ctcctttgtcttcgttggcttctaa

SEQ ID NO: 376035 - DNA, 25 bp, Mus musculus
ctcctttgtcttggttggcttctaa

SEQ ID NO: 376036 - DNA, 25 bp, Mus musculus
ctcctttgtgagacaggtgtttctc

SEQ ID NO: 376037 - DNA, 25 bp, Mus musculus
ctcctttgtgagctatccattctct

SEQ ID NO: 376038 - DNA, 25 bp, Mus musculus
ctcctttgtgaggtatccattctct

SEQ ID NO: 376039 - DNA, 25 bp, Mus musculus
ctcctttgtgagtcaggtgtttctc

SEQ ID NO: 376040 - DNA, 25 bp, Mus musculus
ctcctttgtgatcagtgtttctcat

SEQ ID NO: 376041 - DNA, 25 bp, Mus musculus
ctcctttgtgatgagtgtttctcat

SEQ ID NO: 376042 - DNA, 25 bp, Mus musculus
ctcctttgttgactgcatataataa

SEQ ID NO: 376043 - DNA, 25 bp, Mus musculus
ctcctttgttgagtgcatataataa

SEQ ID NO: 376044 - DNA, 25 bp, Mus musculus
ctccttttagacagtgcgtgcgtga

SEQ ID NO: 376045 - DNA, 25 bp, Mus musculus
ctccttttagactgtgcgtgcgtga

SEQ ID NO: 376046 - DNA, 25 bp, Mus musculus
ctccttttagttccagcatgtgctc

SEQ ID NO: 376047 - DNA, 25 bp, Mus musculus
ctccttttagttgcagcatgtgctc

SEQ ID NO: 376048 - DNA, 25 bp, Mus musculus
ctccttttcagtcgttgtgtctgga

SEQ ID NO: 376049 - DNA, 25 bp, Mus musculus
ctccttttcagtggttgtgtctgga

SEQ ID NO: 376050 - DNA, 25 bp, Mus musculus
ctccttttccttctgaggtcagtgt

SEQ ID NO: 376051 - DNA, 25 bp, Mus musculus
ctccttttccttgtgaggtcagtgt

SEQ ID NO: 376052 - DNA, 25 bp, Mus musculus
ctccttttcttgaggccccaaggat

SEQ ID NO: 376053 - DNA, 25 bp, Mus musculus
ctccttttcttgtggccccaaggat

SEQ ID NO: 376054 - DNA, 25 bp, Mus musculus
ctccttttgtacagtgttgtgcttg

SEQ ID NO: 376055 - DNA, 25 bp, Mus musculus
ctccttttgtactgtgttgtgcttg

SEQ ID NO: 376056 - DNA, 25 bp, Mus musculus
ctccttttgttaactggtctttgtt

SEQ ID NO: 376057 - DNA, 25 bp, Mus musculus
ctccttttgttatctggtctttgtt

SEQ ID NO: 376058 - DNA, 25 bp, Mus musculus
ctcctttttggaccctcatgagaca

SEQ ID NO: 376059 - DNA, 25 bp, Mus musculus
ctcctttttggagcctcatgagaca

SEQ ID NO: 376060 - DNA, 25 bp, Mus musculus
ctccttttttgccttgtactgaatg

SEQ ID NO: 376061 - DNA, 25 bp, Mus musculus
ctccttttttgcgttgtactgaatg

SEQ ID NO: 376062 - DNA, 25 bp, Mus musculus
ctcgaaaggttaaccttcccagaat

SEQ ID NO: 376063 - DNA, 25 bp, Mus musculus
ctcgaaaggttatccttcccagaat

SEQ ID NO: 376064 - DNA, 25 bp, Mus musculus
ctcgaaagttgtaataatgctccat

SEQ ID NO: 376065 - DNA, 25 bp, Mus musculus
ctcgaaagttgttataatgctccat

SEQ ID NO: 376066 - DNA, 25 bp, Mus musculus
ctcgaacaacctccatcatttattt

SEQ ID NO: 376067 - DNA, 25 bp, Mus musculus
ctcgaacaacctgcatcatttattt

SEQ ID NO: 376068 - DNA, 25 bp, Mus musculus
ctcgaacatgccatatgggctaaga

SEQ ID NO: 376069 - DNA, 25 bp, Mus musculus
ctcgaacatgccttatgggctaaga

SEQ ID NO: 376070 - DNA, 25 bp, Mus musculus
ctcgaacatttgattcatacaagca

SEQ ID NO: 376071 - DNA, 25 bp, Mus musculus
ctcgaacatttgtttcatacaagca

SEQ ID NO: 376072 - DNA, 25 bp, Mus musculus
ctcgaacccagtcggcagcaggtga

SEQ ID NO: 376073 - DNA, 25 bp, Mus musculus
ctcgaacccagtgggcagcaggtga

SEQ ID NO: 376074 - DNA, 25 bp, Mus musculus
ctcgaacctcggaactggattgcga

SEQ ID NO: 376075 - DNA, 25 bp, Mus musculus
ctcgaacctcggtactggattgcga

SEQ ID NO: 376076 - DNA, 25 bp, Mus musculus
ctcgaactcaggagtagatcaggct

SEQ ID NO: 376077 - DNA, 25 bp, Mus musculus
ctcgaactcaggtgtagatcaggct

SEQ ID NO: 376078 - DNA, 25 bp, Mus musculus
ctcgaactgccacgagggagcttct

SEQ ID NO: 376079 - DNA, 25 bp, Mus musculus
ctcgaactgccaggagggagcttct

SEQ ID NO: 376080 - DNA, 25 bp, Mus musculus
ctcgaacttctgagggacactttca

SEQ ID NO: 376081 - DNA, 25 bp, Mus musculus
ctcgaacttctgtgggacactttca

SEQ ID NO: 376082 - DNA, 25 bp, Mus musculus
ctcgaataacttactcacgtgtgtt

SEQ ID NO: 376083 - DNA, 25 bp, Mus musculus
ctcgaataactttctcacgtgtgtt

SEQ ID NO: 376084 - DNA, 25 bp, Mus musculus
ctcgaatcagttacattcaccgaca

SEQ ID NO: 376085 - DNA, 25 bp, Mus musculus
ctcgaatcagtttcattcaccgaca

SEQ ID NO: 376086 - DNA, 25 bp, Mus musculus
ctcgaatctagaaatgcccacttgg

SEQ ID NO: 376087 - DNA, 25 bp, Mus musculus
ctcgaatctagatatgcccacttgg

SEQ ID NO: 376088 - DNA, 25 bp, Mus musculus
ctcgacacagcaccttttctaaaga

SEQ ID NO: 376089 - DNA, 25 bp, Mus musculus
ctcgacacagcagcttttctaaaga

SEQ ID NO: 376090 - DNA, 25 bp, Mus musculus
ctcgacccaggacggaaagggcatt

SEQ ID NO: 376091 - DNA, 25 bp, Mus musculus
ctcgacccaggagggaaagggcatt

SEQ ID NO: 376092 - DNA, 25 bp, Mus musculus
ctcgaccttaggcaccactgtggat

SEQ ID NO: 376093 - DNA, 25 bp, Mus musculus
ctcgaccttagggaccactgtggat

SEQ ID NO: 376094 - DNA, 25 bp, Mus musculus
ctcgacggtccacggctgaggcctt

SEQ ID NO: 376095 - DNA, 25 bp, Mus musculus
ctcgacggtccagggctgaggcctt

SEQ ID NO: 376096 - DNA, 25 bp, Mus musculus
ctcgacgtcattcagcttcacggtg

SEQ ID NO: 376097 - DNA, 25 bp, Mus musculus
ctcgacgtcattgagcttcacggtg

SEQ ID NO: 376098 - DNA, 25 bp, Mus musculus
ctcgacgttcttagcacactataac

SEQ ID NO: 376099 - DNA, 25 bp, Mus musculus
ctcgacgttctttgcacactataac

SEQ ID NO: 376100 - DNA, 25 bp, Mus musculus
ctcgactctgagacactgatcgagc

SEQ ID NO: 376101 - DNA, 25 bp, Mus musculus
ctcgactctgagtcactgatcgagc

SEQ ID NO: 376102 - DNA, 25 bp, Mus musculus
ctcgacttggtgactgggtttcaaa

SEQ ID NO: 376103 - DNA, 25 bp, Mus musculus
ctcgacttggtgtctgggtttcaaa

SEQ ID NO: 376104 - DNA, 25 bp, Mus musculus
ctcgagaaacagaatgtgctactga

SEQ ID NO: 376105 - DNA, 25 bp, Mus musculus
ctcgagaaacagtatgtgctactga

SEQ ID NO: 376106 - DNA, 25 bp, Mus musculus
ctcgagaagagcaacaagtgtcctg

SEQ ID NO: 376107 - DNA, 25 bp, Mus musculus
ctcgagaagagctacaagtgtcctg

SEQ ID NO: 376108 - DNA, 25 bp, Mus musculus
ctcgagagataccaccagaagaact

SEQ ID NO: 376109 - DNA, 25 bp, Mus musculus
ctcgagagatacgaccagaagaact

SEQ ID NO: 376110 - DNA, 25 bp, Mus musculus
ctcgagaggataaggctgccctgga

SEQ ID NO: 376111 - DNA, 25 bp, Mus musculus
ctcgagaggatatggctgccctgga

SEQ ID NO: 376112 - DNA, 25 bp, Mus musculus
ctcgagaggcctaccaggagcagaa

SEQ ID NO: 376113 - DNA, 25 bp, Mus musculus
ctcgagaggccttccaggagcagaa

SEQ ID NO: 376114 - DNA, 25 bp, Mus musculus
ctcgagattattccgactttaattg

SEQ ID NO: 376115 - DNA, 25 bp, Mus musculus
ctcgagattattgcgactttaattg

SEQ ID NO: 376116 - DNA, 25 bp, Mus musculus
ctcgagctcactattcagcagtgta

SEQ ID NO: 376117 - DNA, 25 bp, Mus musculus
ctcgagctcacttttcagcagtgta

SEQ ID NO: 376118 - DNA, 25 bp, Mus musculus
ctcgagctgttactgcctgtacgga

SEQ ID NO: 376119 - DNA, 25 bp, Mus musculus
ctcgagctgttagtgcctgtacgga

SEQ ID NO: 376120 - DNA, 25 bp, Mus musculus
ctcgagcttgatcctgttttgaatt

SEQ ID NO: 376121 - DNA, 25 bp, Mus musculus
ctcgagcttgatgctgttttgaatt

SEQ ID NO: 376122 - DNA, 25 bp, Mus musculus
ctcgaggacacaagggaaaccggct

SEQ ID NO: 376123 - DNA, 25 bp, Mus musculus
ctcgaggacacatgggaaaccggct

SEQ ID NO: 376124 - DNA, 25 bp, Mus musculus
ctcgaggcagctacccgggatgaga

SEQ ID NO: 376125 - DNA, 25 bp, Mus musculus
ctcgaggcagcttcccgggatgaga

SEQ ID NO: 376126 - DNA, 25 bp, Mus musculus
ctcgaggctacgagaaggaacagtt

SEQ ID NO: 376127 - DNA, 25 bp, Mus musculus
ctcgaggctacgtgaaggaacagtt

SEQ ID NO: 376128 - DNA, 25 bp, Mus musculus
ctcgaggtggcaagtttatccagaa

SEQ ID NO: 376129 - DNA, 25 bp, Mus musculus
ctcgaggtggcatgtttatccagaa

SEQ ID NO: 376130 - DNA, 25 bp, Mus musculus
ctcgagtcagtgcaatgggaatcca

SEQ ID NO: 376131 - DNA, 25 bp, Mus musculus
ctcgagtcagtggaatgggaatcca

SEQ ID NO: 376132 - DNA, 25 bp, Mus musculus
ctcgagtgtctgcattattctgaac

SEQ ID NO: 376133 - DNA, 25 bp, Mus musculus
ctcgagtgtctggattattctgaac

SEQ ID NO: 376134 - DNA, 25 bp, Mus musculus
ctcgagttattaaaaatctgaccct

SEQ ID NO: 376135 - DNA, 25 bp, Mus musculus
ctcgagttattataaatctgaccct

SEQ ID NO: 376136 - DNA, 25 bp, Mus musculus
ctcgagtttcttcccattctgtaga

SEQ ID NO: 376137 - DNA, 25 bp, Mus musculus
ctcgagtttcttgccattctgtaga

SEQ ID NO: 376138 - DNA, 25 bp, Mus musculus
ctcgatacaatgctcaaggaacaga

SEQ ID NO: 376139 - DNA, 25 bp, Mus musculus
ctcgatacaatggtcaaggaacaga

SEQ ID NO: 376140 - DNA, 25 bp, Mus musculus
ctcgatacggagatttgtgcattat

SEQ ID NO: 376141 - DNA, 25 bp, Mus musculus
ctcgatacggagttttgtgcattat

SEQ ID NO: 376142 - DNA, 25 bp, Mus musculus
ctcgatagtgcgccgaatgtgtctg

SEQ ID NO: 376143 - DNA, 25 bp, Mus musculus
ctcgatagtgcggcgaatgtgtctg

SEQ ID NO: 376144 - DNA, 25 bp, Mus musculus
ctcgatattttgcttcatttactta

SEQ ID NO: 376145 - DNA, 25 bp, Mus musculus
ctcgatattttggttcatttactta

SEQ ID NO: 376146 - DNA, 25 bp, Mus musculus
ctcgatcatatcatgaaatggccat

SEQ ID NO: 376147 - DNA, 25 bp, Mus musculus
ctcgatcatatcttgaaatggccat

SEQ ID NO: 376148 - DNA, 25 bp, Mus musculus
ctcgatgacgtcatcagcaaggtgt

SEQ ID NO: 376149 - DNA, 25 bp, Mus musculus
ctcgatgacgtcttcagcaaggtgt

SEQ ID NO: 376150 - DNA, 25 bp, Mus musculus
ctcgatgccaatactcggaagcaag

SEQ ID NO: 376151 - DNA, 25 bp, Mus musculus
ctcgatgccaattctcggaagcaag

SEQ ID NO: 376152 - DNA, 25 bp, Mus musculus
ctcgatgcctttcccatatatttat

SEQ ID NO: 376153 - DNA, 25 bp, Mus musculus
ctcgatgcctttgccatatatttat

SEQ ID NO: 376154 - DNA, 25 bp, Mus musculus
ctcgatgctgggaagcattccacga

SEQ ID NO: 376155 - DNA, 25 bp, Mus musculus
ctcgatgctgggtagcattccacga

SEQ ID NO: 376156 - DNA, 25 bp, Mus musculus
ctcgatggtccaataaacctgagga

SEQ ID NO: 376157 - DNA, 25 bp, Mus musculus
ctcgatggtccattaaacctgagga

SEQ ID NO: 376158 - DNA, 25 bp, Mus musculus
ctcgatgtgcctcctggtgaggaaa

SEQ ID NO: 376159 - DNA, 25 bp, Mus musculus
ctcgatgtgcctgctggtgaggaaa

SEQ ID NO: 376160 - DNA, 25 bp, Mus musculus
ctcgatgtgcttcggagagtctcct

SEQ ID NO: 376161 - DNA, 25 bp, Mus musculus
ctcgatgtgcttgggagagtctcct

SEQ ID NO: 376162 - DNA, 25 bp, Mus musculus
ctcgatttagctccgtgtacatttg

SEQ ID NO: 376163 - DNA, 25 bp, Mus musculus
ctcgatttagctgcgtgtacatttg

SEQ ID NO: 376164 - DNA, 25 bp, Mus musculus
ctcgcaagctatcttccagatcata

SEQ ID NO: 376165 - DNA, 25 bp, Mus musculus
ctcgcaagctatgttccagatcata

SEQ ID NO: 376166 - DNA, 25 bp, Mus musculus
ctcgcaatccaaccaacaaacaaat

SEQ ID NO: 376167 - DNA, 25 bp, Mus musculus
ctcgcaatccaagcaacaaacaaat

SEQ ID NO: 376168 - DNA, 25 bp, Mus musculus
ctcgcaccaggaaccgttgaattta

SEQ ID NO: 376169 - DNA, 25 bp, Mus musculus
ctcgcaccaggatccgttgaattta

SEQ ID NO: 376170 - DNA, 25 bp, Mus musculus
ctcgcacgatggcaaacagtttagt

SEQ ID NO: 376171 - DNA, 25 bp, Mus musculus
ctcgcacgatgggaaacagtttagt

SEQ ID NO: 376172 - DNA, 25 bp, Mus musculus
ctcgcagcagaaccggtatgtacct

SEQ ID NO: 376173 - DNA, 25 bp, Mus musculus
ctcgcagcagaagcggtatgtacct

SEQ ID NO: 376174 - DNA, 25 bp, Mus musculus
ctcgcagctatgaggcattctctta

SEQ ID NO: 376175 - DNA, 25 bp, Mus musculus
ctcgcagctatgtggcattctctta

SEQ ID NO: 376176 - DNA, 25 bp, Mus musculus
ctcgcaggactcaggcagggcagct

SEQ ID NO: 376177 - DNA, 25 bp, Mus musculus
ctcgcaggactctggcagggcagct

SEQ ID NO: 376178 - DNA, 25 bp, Mus musculus
ctcgcaggattaatcttcagccagg

SEQ ID NO: 376179 - DNA, 25 bp, Mus musculus
ctcgcaggattattcttcagccagg

SEQ ID NO: 376180 - DNA, 25 bp, Mus musculus
ctcgcagttgccagtgtacacagag

SEQ ID NO: 376181 - DNA, 25 bp, Mus musculus
ctcgcagttgcctgtgtacacagag

SEQ ID NO: 376182 - DNA, 25 bp, Mus musculus
ctcgcatatttacttcctgtattca

SEQ ID NO: 376183 - DNA, 25 bp, Mus musculus
ctcgcatatttagttcctgtattca

SEQ ID NO: 376184 - DNA, 25 bp, Mus musculus
ctcgcatccccgctaattaatgaaa

SEQ ID NO: 376185 - DNA, 25 bp, Mus musculus
ctcgcatccccggtaattaatgaaa

SEQ ID NO: 376186 - DNA, 25 bp, Mus musculus
ctcgcattatgtctgtaggtgcata

SEQ ID NO: 376187 - DNA, 25 bp, Mus musculus
ctcgcattatgtgtgtaggtgcata

SEQ ID NO: 376188 - DNA, 25 bp, Mus musculus
ctcgccacataaaaggccttgtata

SEQ ID NO: 376189 - DNA, 25 bp, Mus musculus
ctcgccacataataggccttgtata

SEQ ID NO: 376190 - DNA, 25 bp, Mus musculus
ctcgccacatctagaaaaatgccac

SEQ ID NO: 376191 - DNA, 25 bp, Mus musculus
ctcgccacatcttgaaaaatgccac

SEQ ID NO: 376192 - DNA, 25 bp, Mus musculus
ctcgccagagtgatcagtttaaata

SEQ ID NO: 376193 - DNA, 25 bp, Mus musculus
ctcgccagagtgttcagtttaaata

SEQ ID NO: 376194 - DNA, 25 bp, Mus musculus
ctcgccagccacaaggaagtgactc

SEQ ID NO: 376195 - DNA, 25 bp, Mus musculus
ctcgccagccactaggaagtgactc

SEQ ID NO: 376196 - DNA, 25 bp, Mus musculus
ctcgccatattgagcggcggcgccg

SEQ ID NO: 376197 - DNA, 25 bp, Mus musculus
ctcgccatattgtgcggcggcgccg

SEQ ID NO: 376198 - DNA, 25 bp, Mus musculus
ctcgccatccagagggttgtttggt

SEQ ID NO: 376199 - DNA, 25 bp, Mus musculus
ctcgccatccagtgggttgtttggt

SEQ ID NO: 376200 - DNA, 25 bp, Mus musculus
ctcgccatctttagctaaacatcta

SEQ ID NO: 376201 - DNA, 25 bp, Mus musculus
ctcgccatcttttgctaaacatcta

SEQ ID NO: 376202 - DNA, 25 bp, Mus musculus
ctcgccattgaaatttatgttctct

SEQ ID NO: 376203 - DNA, 25 bp, Mus musculus
ctcgccattgaattttatgttctct

SEQ ID NO: 376204 - DNA, 25 bp, Mus musculus
ctcgcccataggaggagtggtttcc

SEQ ID NO: 376205 - DNA, 25 bp, Mus musculus
ctcgcccataggtggagtggtttcc

SEQ ID NO: 376206 - DNA, 25 bp, Mus musculus
ctcgccccgtatcatacgggtcata

SEQ ID NO: 376207 - DNA, 25 bp, Mus musculus
ctcgccccgtatgatacgggtcata

SEQ ID NO: 376208 - DNA, 25 bp, Mus musculus
ctcgcccgccagaagaacatgaaga

SEQ ID NO: 376209 - DNA, 25 bp, Mus musculus
ctcgcccgccagtagaacatgaaga

SEQ ID NO: 376210 - DNA, 25 bp, Mus musculus
ctcgcccggcttataactcattatg

SEQ ID NO: 376211 - DNA, 25 bp, Mus musculus
ctcgcccggcttttaactcattatg

SEQ ID NO: 376212 - DNA, 25 bp, Mus musculus
ctcgcccgggaacccatctgatggg

SEQ ID NO: 376213 - DNA, 25 bp, Mus musculus
ctcgcccgggaagccatctgatggg

SEQ ID NO: 376214 - DNA, 25 bp, Mus musculus
ctcgccctaccaccaagtgattgaa

SEQ ID NO: 376215 - DNA, 25 bp, Mus musculus
ctcgccctaccagcaagtgattgaa

SEQ ID NO: 376216 - DNA, 25 bp, Mus musculus
ctcgccctcagaaaggaccttgtgg

SEQ ID NO: 376217 - DNA, 25 bp, Mus musculus
ctcgccctcagataggaccttgtgg

SEQ ID NO: 376218 - DNA, 25 bp, Mus musculus
ctcgccctgcccatgttttgtgtgt

SEQ ID NO: 376219 - DNA, 25 bp, Mus musculus
ctcgccctgcccttgttttgtgtgt

SEQ ID NO: 376220 - DNA, 25 bp, Mus musculus
ctcgccgatggcagtggtaattaaa

SEQ ID NO: 376221 - DNA, 25 bp, Mus musculus
ctcgccgatggctgtggtaattaaa

SEQ ID NO: 376222 - DNA, 25 bp, Mus musculus
ctcgcctagcccatcagttcatgtg

SEQ ID NO: 376223 - DNA, 25 bp, Mus musculus
ctcgcctagcccttcagttcatgtg

SEQ ID NO: 376224 - DNA, 25 bp, Mus musculus
ctcgcctagtctcgaagcagttcca

SEQ ID NO: 376225 - DNA, 25 bp, Mus musculus
ctcgcctagtctggaagcagttcca

SEQ ID NO: 376226 - DNA, 25 bp, Mus musculus
ctcgcctctaacactgaaatgaaat

SEQ ID NO: 376227 - DNA, 25 bp, Mus musculus
ctcgcctctaactctgaaatgaaat

SEQ ID NO: 376228 - DNA, 25 bp, Mus musculus
ctcgcctgcagcatggtattcagaa

SEQ ID NO: 376229 - DNA, 25 bp, Mus musculus
ctcgcctgcagcttggtattcagaa

SEQ ID NO: 376230 - DNA, 25 bp, Mus musculus
ctcgcctttctacccaggttggaaa

SEQ ID NO: 376231 - DNA, 25 bp, Mus musculus
ctcgcctttctagccaggttggaaa

SEQ ID NO: 376232 - DNA, 25 bp, Mus musculus
ctcgcgcagtacatggtagttcagc

SEQ ID NO: 376233 - DNA, 25 bp, Mus musculus
ctcgcgcagtacttggtagttcagc

SEQ ID NO: 376234 - DNA, 25 bp, Mus musculus
ctcgcgcttaacagactttcttata

SEQ ID NO: 376235 - DNA, 25 bp, Mus musculus
ctcgcgcttaactgactttcttata

SEQ ID NO: 376236 - DNA, 25 bp, Mus musculus
ctcgcggacagcatacagctggaga

SEQ ID NO: 376237 - DNA, 25 bp, Mus musculus
ctcgcggacagcttacagctggaga

SEQ ID NO: 376238 - DNA, 25 bp, Mus musculus
ctcgcgtaatgacgctgcatcgctc

SEQ ID NO: 376239 - DNA, 25 bp, Mus musculus
ctcgcgtaatgaggctgcatcgctc

SEQ ID NO: 376240 - DNA, 25 bp, Mus musculus
ctcgcgtgcctaaagcactcgggag

SEQ ID NO: 376241 - DNA, 25 bp, Mus musculus
ctcgcgtgcctatagcactcgggag

SEQ ID NO: 376242 - DNA, 25 bp, Mus musculus
ctcgcgtgggcaatctttcagtgaa

SEQ ID NO: 376243 - DNA, 25 bp, Mus musculus
ctcgcgtgggcattctttcagtgaa

SEQ ID NO: 376244 - DNA, 25 bp, Mus musculus
ctcgctaaaactcacgtccgtgtaa

SEQ ID NO: 376245 - DNA, 25 bp, Mus musculus
ctcgctaaaactgacgtccgtgtaa

SEQ ID NO: 376246 - DNA, 25 bp, Mus musculus
ctcgctagacctaaactcagactgt

SEQ ID NO: 376247 - DNA, 25 bp, Mus musculus
ctcgctagaccttaactcagactgt

SEQ ID NO: 376248 - DNA, 25 bp, Mus musculus
ctcgctataattatgcccatgatta

SEQ ID NO: 376249 - DNA, 25 bp, Mus musculus
ctcgctataattttgcccatgatta

SEQ ID NO: 376250 - DNA, 25 bp, Mus musculus
ctcgctatagctatctgttggcaaa

SEQ ID NO: 376251 - DNA, 25 bp, Mus musculus
ctcgctatagctttctgttggcaaa

SEQ ID NO: 376252 - DNA, 25 bp, Mus musculus
ctcgctatcactcccaatacattaa

SEQ ID NO: 376253 - DNA, 25 bp, Mus musculus
ctcgctatcactgccaatacattaa

SEQ ID NO: 376254 - DNA, 25 bp, Mus musculus
ctcgctatcaggcttaggcaggcaa

SEQ ID NO: 376255 - DNA, 25 bp, Mus musculus
ctcgctatcagggttaggcaggcaa

SEQ ID NO: 376256 - DNA, 25 bp, Mus musculus
ctcgctcacaatcgcaaggcctgtg

SEQ ID NO: 376257 - DNA, 25 bp, Mus musculus
ctcgctcacaatggcaaggcctgtg

SEQ ID NO: 376258 - DNA, 25 bp, Mus musculus
ctcgctcaccaactgcttgcaagaa

SEQ ID NO: 376259 - DNA, 25 bp, Mus musculus
ctcgctcaccaagtgcttgcaagaa

SEQ ID NO: 376260 - DNA, 25 bp, Mus musculus
ctcgctcagcggcagtttgacagga

SEQ ID NO: 376261 - DNA, 25 bp, Mus musculus
ctcgctcagcgggagtttgacagga

SEQ ID NO: 376262 - DNA, 25 bp, Mus musculus
ctcgctcccacacaaaatattgctt

SEQ ID NO: 376263 - DNA, 25 bp, Mus musculus
ctcgctcccacagaaaatattgctt

SEQ ID NO: 376264 - DNA, 25 bp, Mus musculus
ctcgctcgccatcattaacggaaga

SEQ ID NO: 376265 - DNA, 25 bp, Mus musculus
ctcgctcgccatgattaacggaaga

SEQ ID NO: 376266 - DNA, 25 bp, Mus musculus
ctcgctcgctggcaaagaggagcca

SEQ ID NO: 376267 - DNA, 25 bp, Mus musculus
ctcgctcgctgggaaagaggagcca

SEQ ID NO: 376268 - DNA, 25 bp, Mus musculus
ctcgctcgggacagagacgttcaaa

SEQ ID NO: 376269 - DNA, 25 bp, Mus musculus
ctcgctcgggactgagacgttcaaa

SEQ ID NO: 376270 - DNA, 25 bp, Mus musculus
ctcgctctagagatgagaacaggca

SEQ ID NO: 376271 - DNA, 25 bp, Mus musculus
ctcgctctagagttgagaacaggca

SEQ ID NO: 376272 - DNA, 25 bp, Mus musculus
ctcgctctcccacattttaattttt

SEQ ID NO: 376273 - DNA, 25 bp, Mus musculus
ctcgctctcccagattttaattttt

SEQ ID NO: 376274 - DNA, 25 bp, Mus musculus
ctcgctctcggcacggtgtccgggt

SEQ ID NO: 376275 - DNA, 25 bp, Mus musculus
ctcgctctcggctcggtgtccgggt

SEQ ID NO: 376276 - DNA, 25 bp, Mus musculus
ctcgctctgagcacctattaaaagt

SEQ ID NO: 376277 - DNA, 25 bp, Mus musculus
ctcgctctgagctcctattaaaagt

SEQ ID NO: 376278 - DNA, 25 bp, Mus musculus
ctcgctgaagctctgtaatgtggat

SEQ ID NO: 376279 - DNA, 25 bp, Mus musculus
ctcgctgaagctgtgtaatgtggat

SEQ ID NO: 376280 - DNA, 25 bp, Mus musculus
ctcgctgaaggactttgtgcagttt

SEQ ID NO: 376281 - DNA, 25 bp, Mus musculus
ctcgctgaaggagtttgtgcagttt

SEQ ID NO: 376282 - DNA, 25 bp, Mus musculus
ctcgctgagtgcatgctgtgagcat

SEQ ID NO: 376283 - DNA, 25 bp, Mus musculus
ctcgctgagtgcttgctgtgagcat

SEQ ID NO: 376284 - DNA, 25 bp, Mus musculus
ctcgctgagttcacggcctggaggc

SEQ ID NO: 376285 - DNA, 25 bp, Mus musculus
ctcgctgagttctcggcctggaggc

SEQ ID NO: 376286 - DNA, 25 bp, Mus musculus
ctcgctgcatccattaatctgctta

SEQ ID NO: 376287 - DNA, 25 bp, Mus musculus
ctcgctgcatcctttaatctgctta

SEQ ID NO: 376288 - DNA, 25 bp, Mus musculus
ctcgctgcccagctatgtatctaga

SEQ ID NO: 376289 - DNA, 25 bp, Mus musculus
ctcgctgcccaggtatgtatctaga

SEQ ID NO: 376290 - DNA, 25 bp, Mus musculus
ctcgctgcccggagtcgcgcagagt

SEQ ID NO: 376291 - DNA, 25 bp, Mus musculus
ctcgctgcccggtgtcgcgcagagt

SEQ ID NO: 376292 - DNA, 25 bp, Mus musculus
ctcgctgctgtcaggcactgagaag

SEQ ID NO: 376293 - DNA, 25 bp, Mus musculus
ctcgctgctgtctggcactgagaag

SEQ ID NO: 376294 - DNA, 25 bp, Mus musculus
ctcgctggccatcataaccgtgtga

SEQ ID NO: 376295 - DNA, 25 bp, Mus musculus
ctcgctggccatgataaccgtgtga

SEQ ID NO: 376296 - DNA, 25 bp, Mus musculus
ctcgctgggtttagttgaccttgta

SEQ ID NO: 376297 - DNA, 25 bp, Mus musculus
ctcgctgggttttgttgaccttgta

SEQ ID NO: 376298 - DNA, 25 bp, Mus musculus
ctcgctggtgtgctgaatggacttc

SEQ ID NO: 376299 - DNA, 25 bp, Mus musculus
ctcgctggtgtggtgaatggacttc

SEQ ID NO: 376300 - DNA, 25 bp, Mus musculus
ctcgctgtaaaaatggtgtgtgtac

SEQ ID NO: 376301 - DNA, 25 bp, Mus musculus
ctcgctgtaaaattggtgtgtgtac

SEQ ID NO: 376302 - DNA, 25 bp, Mus musculus
ctcgctgtaatccaccgctgtcggg

SEQ ID NO: 376303 - DNA, 25 bp, Mus musculus
ctcgctgtaatcgaccgctgtcggg

SEQ ID NO: 376304 - DNA, 25 bp, Mus musculus
ctcgctgtatctaaacatctctgac

SEQ ID NO: 376305 - DNA, 25 bp, Mus musculus
ctcgctgtatcttaacatctctgac

SEQ ID NO: 376306 - DNA, 25 bp, Mus musculus
ctcgctgtattgcttataacgatac

SEQ ID NO: 376307 - DNA, 25 bp, Mus musculus
ctcgctgtattggttataacgatac

SEQ ID NO: 376308 - DNA, 25 bp, Mus musculus
ctcgctgtcccacgacgagaggttg

SEQ ID NO: 376309 - DNA, 25 bp, Mus musculus
ctcgctgtcccaggacgagaggttg

SEQ ID NO: 376310 - DNA, 25 bp, Mus musculus
ctcgctgtctagaacttgtttctta

SEQ ID NO: 376311 - DNA, 25 bp, Mus musculus
ctcgctgtctagtacttgtttctta

SEQ ID NO: 376312 - DNA, 25 bp, Mus musculus
ctcgctgtctttaagctacatgctg

SEQ ID NO: 376313 - DNA, 25 bp, Mus musculus
ctcgctgtcttttagctacatgctg

SEQ ID NO: 376314 - DNA, 25 bp, Mus musculus
ctcgctgtgcagattgtttgtccta

SEQ ID NO: 376315 - DNA, 25 bp, Mus musculus
ctcgctgtgcagtttgtttgtccta

SEQ ID NO: 376316 - DNA, 25 bp, Mus musculus
ctcgctgtggcaacatccatcaaaa

SEQ ID NO: 376317 - DNA, 25 bp, Mus musculus
ctcgctgtggcatcatccatcaaaa

SEQ ID NO: 376318 - DNA, 25 bp, Mus musculus
ctcgctgttgccacgatcaaagaaa

SEQ ID NO: 376319 - DNA, 25 bp, Mus musculus
ctcgctgttgcctcgatcaaagaaa

SEQ ID NO: 376320 - DNA, 25 bp, Mus musculus
ctcgctgttgttcttcatctagtat

SEQ ID NO: 376321 - DNA, 25 bp, Mus musculus
ctcgctgttgttgttcatctagtat

SEQ ID NO: 376322 - DNA, 25 bp, Mus musculus
ctcgcttccatgagcatcttaaaag

SEQ ID NO: 376323 - DNA, 25 bp, Mus musculus
ctcgcttccatgtgcatcttaaaag

SEQ ID NO: 376324 - DNA, 25 bp, Mus musculus
ctcgcttccgcacggagcatgacaa

SEQ ID NO: 376325 - DNA, 25 bp, Mus musculus
ctcgcttccgcagggagcatgacaa

SEQ ID NO: 376326 - DNA, 25 bp, Mus musculus
ctcgcttgcctgatcctgaaacggg

SEQ ID NO: 376327 - DNA, 25 bp, Mus musculus
ctcgcttgcctgttcctgaaacggg

SEQ ID NO: 376328 - DNA, 25 bp, Mus musculus
ctcgcttgttctccggaaaggtttg

SEQ ID NO: 376329 - DNA, 25 bp, Mus musculus
ctcgcttgttctgcggaaaggtttg

SEQ ID NO: 376330 - DNA, 25 bp, Mus musculus
ctcgctttgaggacagagattccat

SEQ ID NO: 376331 - DNA, 25 bp, Mus musculus
ctcgctttgaggtcagagattccat

SEQ ID NO: 376332 - DNA, 25 bp, Mus musculus
ctcgctttttgaaagttcctgccag

SEQ ID NO: 376333 - DNA, 25 bp, Mus musculus
ctcgctttttgatagttcctgccag

SEQ ID NO: 376334 - DNA, 25 bp, Mus musculus
ctcggaaacaccactcgtctgaggg

SEQ ID NO: 376335 - DNA, 25 bp, Mus musculus
ctcggaaacacctctcgtctgaggg

SEQ ID NO: 376336 - DNA, 25 bp, Mus musculus
ctcggaacctgcagaggtgagccaa

SEQ ID NO: 376337 - DNA, 25 bp, Mus musculus
ctcggaacctgctgaggtgagccaa

SEQ ID NO: 376338 - DNA, 25 bp, Mus musculus
ctcggaactcatagttggctgggaa

SEQ ID NO: 376339 - DNA, 25 bp, Mus musculus
ctcggaactcattgttggctgggaa

SEQ ID NO: 376340 - DNA, 25 bp, Mus musculus
ctcggaaggaaacacctctgtgcta

SEQ ID NO: 376341 - DNA, 25 bp, Mus musculus
ctcggaaggaaagacctctgtgcta

SEQ ID NO: 376342 - DNA, 25 bp, Mus musculus
ctcggaatcacaccaggagtcttct

SEQ ID NO: 376343 - DNA, 25 bp, Mus musculus
ctcggaatcacagcaggagtcttct

SEQ ID NO: 376344 - DNA, 25 bp, Mus musculus
ctcggacagcgactgaccacggatt

SEQ ID NO: 376345 - DNA, 25 bp, Mus musculus
ctcggacagcgagtgaccacggatt

SEQ ID NO: 376346 - DNA, 25 bp, Mus musculus
ctcggacgaagcagtgtttctcact

SEQ ID NO: 376347 - DNA, 25 bp, Mus musculus
ctcggacgaagctgtgtttctcact

SEQ ID NO: 376348 - DNA, 25 bp, Mus musculus
ctcggactgtagaggacggcgtaat

SEQ ID NO: 376349 - DNA, 25 bp, Mus musculus
ctcggactgtagtggacggcgtaat

SEQ ID NO: 376350 - DNA, 25 bp, Mus musculus
ctcggagacactcgcatctctgcac

SEQ ID NO: 376351 - DNA, 25 bp, Mus musculus
ctcggagacactggcatctctgcac

SEQ ID NO: 376352 - DNA, 25 bp, Mus musculus
ctcggagaggccatttgctttcaga

SEQ ID NO: 376353 - DNA, 25 bp, Mus musculus
ctcggagaggccttttgctttcaga

SEQ ID NO: 376354 - DNA, 25 bp, Mus musculus
ctcggagatcctccatatccacaag

SEQ ID NO: 376355 - DNA, 25 bp, Mus musculus
ctcggagatcctgcatatccacaag

SEQ ID NO: 376356 - DNA, 25 bp, Mus musculus
ctcggagcatgcaaagacctgactt

SEQ ID NO: 376357 - DNA, 25 bp, Mus musculus
ctcggagcatgctaagacctgactt

SEQ ID NO: 376358 - DNA, 25 bp, Mus musculus
ctcggagccacacagatcctttttt

SEQ ID NO: 376359 - DNA, 25 bp, Mus musculus
ctcggagccacagagatcctttttt

SEQ ID NO: 376360 - DNA, 25 bp, Mus musculus
ctcggagcctctcggaataccacat

SEQ ID NO: 376361 - DNA, 25 bp, Mus musculus
ctcggagcctctgggaataccacat

SEQ ID NO: 376362 - DNA, 25 bp, Mus musculus
ctcggagcgatgcttgaaatcagta

SEQ ID NO: 376363 - DNA, 25 bp, Mus musculus
ctcggagcgatggttgaaatcagta

SEQ ID NO: 376364 - DNA, 25 bp, Mus musculus
ctcggagcgctgagcccactttctg

SEQ ID NO: 376365 - DNA, 25 bp, Mus musculus
ctcggagcgctgtgcccactttctg

SEQ ID NO: 376366 - DNA, 25 bp, Mus musculus
ctcggagctgctcaggacgcaaaat

SEQ ID NO: 376367 - DNA, 25 bp, Mus musculus
ctcggagctgctgaggacgcaaaat

SEQ ID NO: 376368 - DNA, 25 bp, Mus musculus
ctcggagggagtatctgctacttta

SEQ ID NO: 376369 - DNA, 25 bp, Mus musculus
ctcggagggagtttctgctacttta

SEQ ID NO: 376370 - DNA, 25 bp, Mus musculus
ctcggagtaggaccccacacaaacg

SEQ ID NO: 376371 - DNA, 25 bp, Mus musculus
ctcggagtaggagcccacacaaacg

SEQ ID NO: 376372 - DNA, 25 bp, Mus musculus
ctcggagtattaccagttccacctc

SEQ ID NO: 376373 - DNA, 25 bp, Mus musculus
ctcggagtattagcagttccacctc

SEQ ID NO: 376374 - DNA, 25 bp, Mus musculus
ctcggagtctttatgctggtgtgtc

SEQ ID NO: 376375 - DNA, 25 bp, Mus musculus
ctcggagtctttttgctggtgtgtc

SEQ ID NO: 376376 - DNA, 25 bp, Mus musculus
ctcggataaacacctagaaaccctt

SEQ ID NO: 376377 - DNA, 25 bp, Mus musculus
ctcggataaacagctagaaaccctt

SEQ ID NO: 376378 - DNA, 25 bp, Mus musculus
ctcggatatactcggtgctaccaca

SEQ ID NO: 376379 - DNA, 25 bp, Mus musculus
ctcggatatactgggtgctaccaca

SEQ ID NO: 376380 - DNA, 25 bp, Mus musculus
ctcggatcatccaagtgtttgagca

SEQ ID NO: 376381 - DNA, 25 bp, Mus musculus
ctcggatcatcctagtgtttgagca

SEQ ID NO: 376382 - DNA, 25 bp, Mus musculus
ctcggatcccataggctacattttt

SEQ ID NO: 376383 - DNA, 25 bp, Mus musculus
ctcggatcccattggctacattttt

SEQ ID NO: 376384 - DNA, 25 bp, Mus musculus
ctcggatccgccaagttattcagga

SEQ ID NO: 376385 - DNA, 25 bp, Mus musculus
ctcggatccgcctagttattcagga

SEQ ID NO: 376386 - DNA, 25 bp, Mus musculus
ctcggatcttcaagttcttcagtaa

SEQ ID NO: 376387 - DNA, 25 bp, Mus musculus
ctcggatcttcatgttcttcagtaa

SEQ ID NO: 376388 - DNA, 25 bp, Mus musculus
ctcggatcttttccacacagttgca

SEQ ID NO: 376389 - DNA, 25 bp, Mus musculus
ctcggatcttttgcacacagttgca

SEQ ID NO: 376390 - DNA, 25 bp, Mus musculus
ctcggatgaaggactctctagtagg

SEQ ID NO: 376391 - DNA, 25 bp, Mus musculus
ctcggatgaaggtctctctagtagg

SEQ ID NO: 376392 - DNA, 25 bp, Mus musculus
ctcggatttggaaagcgttaagtgc

SEQ ID NO: 376393 - DNA, 25 bp, Mus musculus
ctcggatttggatagcgttaagtgc

SEQ ID NO: 376394 - DNA, 25 bp, Mus musculus
ctcggatttggtattctgctggtaa

SEQ ID NO: 376395 - DNA, 25 bp, Mus musculus
ctcggatttggttttctgctggtaa

SEQ ID NO: 376396 - DNA, 25 bp, Mus musculus
ctcggcaattgtagcctcggcagct

SEQ ID NO: 376397 - DNA, 25 bp, Mus musculus
ctcggcaattgttgcctcggcagct

SEQ ID NO: 376398 - DNA, 25 bp, Mus musculus
ctcggcaccaaacagatttatttgc

SEQ ID NO: 376399 - DNA, 25 bp, Mus musculus
ctcggcaccaaagagatttatttgc

SEQ ID NO: 376400 - DNA, 25 bp, Mus musculus
ctcggcaccattctctccggatggg

SEQ ID NO: 376401 - DNA, 25 bp, Mus musculus
ctcggcaccattgtctccggatggg

SEQ ID NO: 376402 - DNA, 25 bp, Mus musculus
ctcggcactgcacaataaattacat

SEQ ID NO: 376403 - DNA, 25 bp, Mus musculus
ctcggcactgcagaataaattacat

SEQ ID NO: 376404 - DNA, 25 bp, Mus musculus
ctcggcagagtgacccagtgacgat

SEQ ID NO: 376405 - DNA, 25 bp, Mus musculus
ctcggcagagtgtcccagtgacgat

SEQ ID NO: 376406 - DNA, 25 bp, Mus musculus
ctcggcagcaggaagagccaccagt

SEQ ID NO: 376407 - DNA, 25 bp, Mus musculus
ctcggcagcaggtagagccaccagt

SEQ ID NO: 376408 - DNA, 25 bp, Mus musculus
ctcggcatcagcagagtccatggaa

SEQ ID NO: 376409 - DNA, 25 bp, Mus musculus
ctcggcatcagctgagtccatggaa

SEQ ID NO: 376410 - DNA, 25 bp, Mus musculus
ctcggcattcctacttggctggagg

SEQ ID NO: 376411 - DNA, 25 bp, Mus musculus
ctcggcattccttcttggctggagg

SEQ ID NO: 376412 - DNA, 25 bp, Mus musculus
ctcggccaagtcatacaatcgtgaa

SEQ ID NO: 376413 - DNA, 25 bp, Mus musculus
ctcggccaagtcttacaatcgtgaa

SEQ ID NO: 376414 - DNA, 25 bp, Mus musculus
ctcggccagtgaagctctaggtttt

SEQ ID NO: 376415 - DNA, 25 bp, Mus musculus
ctcggccagtgatgctctaggtttt

SEQ ID NO: 376416 - DNA, 25 bp, Mus musculus
ctcggccctatgctgccattaaagg

SEQ ID NO: 376417 - DNA, 25 bp, Mus musculus
ctcggccctatggtgccattaaagg

SEQ ID NO: 376418 - DNA, 25 bp, Mus musculus
ctcggccctcctacagtaataaata

SEQ ID NO: 376419 - DNA, 25 bp, Mus musculus
ctcggccctccttcagtaataaata

SEQ ID NO: 376420 - DNA, 25 bp, Mus musculus
ctcggccgtcggatgccgtctggat

SEQ ID NO: 376421 - DNA, 25 bp, Mus musculus
ctcggccgtcggttgccgtctggat

SEQ ID NO: 376422 - DNA, 25 bp, Mus musculus
ctcggcctatgcatttgtgcttgaa

SEQ ID NO: 376423 - DNA, 25 bp, Mus musculus
ctcggcctatgcttttgtgcttgaa

SEQ ID NO: 376424 - DNA, 25 bp, Mus musculus
ctcggcctattacagttgactttta

SEQ ID NO: 376425 - DNA, 25 bp, Mus musculus
ctcggcctattagagttgactttta

SEQ ID NO: 376426 - DNA, 25 bp, Mus musculus
ctcggcctgaaaactggctgatcag

SEQ ID NO: 376427 - DNA, 25 bp, Mus musculus
ctcggcctgaaatctggctgatcag

SEQ ID NO: 376428 - DNA, 25 bp, Mus musculus
ctcggcctgggtcacatcacagcat

SEQ ID NO: 376429 - DNA, 25 bp, Mus musculus
ctcggcctgggtgacatcacagcat

SEQ ID NO: 376430 - DNA, 25 bp, Mus musculus
ctcggcctttcacactttggatgga

SEQ ID NO: 376431 - DNA, 25 bp, Mus musculus
ctcggcctttcagactttggatgga

SEQ ID NO: 376432 - DNA, 25 bp, Mus musculus
ctcggcgcactgaagttgaacactt

SEQ ID NO: 376433 - DNA, 25 bp, Mus musculus
ctcggcgcactgtagttgaacactt

SEQ ID NO: 376434 - DNA, 25 bp, Mus musculus
ctcggcgcaggaaatcaccaacttg

SEQ ID NO: 376435 - DNA, 25 bp, Mus musculus
ctcggcgcaggatatcaccaacttg

SEQ ID NO: 376436 - DNA, 25 bp, Mus musculus
ctcggcgctgtaaacctctgaagga

SEQ ID NO: 376437 - DNA, 25 bp, Mus musculus
ctcggcgctgtatacctctgaagga

SEQ ID NO: 376438 - DNA, 25 bp, Mus musculus
ctcggcgcttatatctgtagtttta

SEQ ID NO: 376439 - DNA, 25 bp, Mus musculus
ctcggcgcttatttctgtagtttta

SEQ ID NO: 376440 - DNA, 25 bp, Mus musculus
ctcggcggcgaaccctggagttttc

SEQ ID NO: 376441 - DNA, 25 bp, Mus musculus
ctcggcggcgaagcctggagttttc

SEQ ID NO: 376442 - DNA, 25 bp, Mus musculus
ctcggcggttaacaatactgattga

SEQ ID NO: 376443 - DNA, 25 bp, Mus musculus
ctcggcggttaagaatactgattga

SEQ ID NO: 376444 - DNA, 25 bp, Mus musculus
ctcggctaatagcaaccagaggtta

SEQ ID NO: 376445 - DNA, 25 bp, Mus musculus
ctcggctaataggaaccagaggtta

SEQ ID NO: 376446 - DNA, 25 bp, Mus musculus
ctcggctattgtacaggcttactgt

SEQ ID NO: 376447 - DNA, 25 bp, Mus musculus
ctcggctattgttcaggcttactgt

SEQ ID NO: 376448 - DNA, 25 bp, Mus musculus
ctcggctcagctagtatcagacatg

SEQ ID NO: 376449 - DNA, 25 bp, Mus musculus
ctcggctcagcttgtatcagacatg

SEQ ID NO: 376450 - DNA, 25 bp, Mus musculus
ctcggctccactcttatttcttatg

SEQ ID NO: 376451 - DNA, 25 bp, Mus musculus
ctcggctccactgttatttcttatg

SEQ ID NO: 376452 - DNA, 25 bp, Mus musculus
ctcggctgcgccagattttattaga

SEQ ID NO: 376453 - DNA, 25 bp, Mus musculus
ctcggctgcgcctgattttattaga

SEQ ID NO: 376454 - DNA, 25 bp, Mus musculus
ctcggctgggacagaagtttgccat

SEQ ID NO: 376455 - DNA, 25 bp, Mus musculus
ctcggctgggactgaagtttgccat

SEQ ID NO: 376456 - DNA, 25 bp, Mus musculus
ctcggcttctcacactggacaatta

SEQ ID NO: 376457 - DNA, 25 bp, Mus musculus
ctcggcttctcagactggacaatta

SEQ ID NO: 376458 - DNA, 25 bp, Mus musculus
ctcggctttgtgcaccatgcagtgt

SEQ ID NO: 376459 - DNA, 25 bp, Mus musculus
ctcggctttgtggaccatgcagtgt

SEQ ID NO: 376460 - DNA, 25 bp, Mus musculus
ctcgggaacacgcaatccagctgga

SEQ ID NO: 376461 - DNA, 25 bp, Mus musculus
ctcgggaacacggaatccagctgga

SEQ ID NO: 376462 - DNA, 25 bp, Mus musculus
ctcgggaagcttcttgtgtctggaa

SEQ ID NO: 376463 - DNA, 25 bp, Mus musculus
ctcgggaagcttgttgtgtctggaa

SEQ ID NO: 376464 - DNA, 25 bp, Mus musculus
ctcgggaatgctattccagcaggga

SEQ ID NO: 376465 - DNA, 25 bp, Mus musculus
ctcgggaatgcttttccagcaggga

SEQ ID NO: 376466 - DNA, 25 bp, Mus musculus
ctcgggacagagacgttcaaaggac

SEQ ID NO: 376467 - DNA, 25 bp, Mus musculus
ctcgggacagagtcgttcaaaggac

SEQ ID NO: 376468 - DNA, 25 bp, Mus musculus
ctcgggacctgcactatttcaggga

SEQ ID NO: 376469 - DNA, 25 bp, Mus musculus
ctcgggacctgctctatttcaggga

SEQ ID NO: 376470 - DNA, 25 bp, Mus musculus
ctcgggacgattactgtcttgatga

SEQ ID NO: 376471 - DNA, 25 bp, Mus musculus
ctcgggacgatttctgtcttgatga

SEQ ID NO: 376472 - DNA, 25 bp, Mus musculus
ctcgggacgctgcacttttacatgg

SEQ ID NO: 376473 - DNA, 25 bp, Mus musculus
ctcgggacgctggacttttacatgg

SEQ ID NO: 376474 - DNA, 25 bp, Mus musculus
ctcgggagcaatcaggttgaaaatg

SEQ ID NO: 376475 - DNA, 25 bp, Mus musculus
ctcgggagcaatgaggttgaaaatg

SEQ ID NO: 376476 - DNA, 25 bp, Mus musculus
ctcgggagggttaaagacgatcgct

SEQ ID NO: 376477 - DNA, 25 bp, Mus musculus
ctcgggagggtttaagacgatcgct

SEQ ID NO: 376478 - DNA, 25 bp, Mus musculus
ctcgggagtgtgactgcctatcaat

SEQ ID NO: 376479 - DNA, 25 bp, Mus musculus
ctcgggagtgtgatcttaaatatga

SEQ ID NO: 376480 - DNA, 25 bp, Mus musculus
ctcgggagtgtgtctgcctatcaat

SEQ ID NO: 376481 - DNA, 25 bp, Mus musculus
ctcgggagtgtgttcttaaatatga

SEQ ID NO: 376482 - DNA, 25 bp, Mus musculus
ctcgggatcaccatagcggtggcat

SEQ ID NO: 376483 - DNA, 25 bp, Mus musculus
ctcgggatcaccttagcggtggcat

SEQ ID NO: 376484 - DNA, 25 bp, Mus musculus
ctcgggattaaacctatggtcatgt

SEQ ID NO: 376485 - DNA, 25 bp, Mus musculus
ctcgggattaaagctatggtcatgt

SEQ ID NO: 376486 - DNA, 25 bp, Mus musculus
ctcgggattcgtactctaaggtagg

SEQ ID NO: 376487 - DNA, 25 bp, Mus musculus
ctcgggattcgttctctaaggtagg

SEQ ID NO: 376488 - DNA, 25 bp, Mus musculus
ctcgggattggaccctgaacaatct

SEQ ID NO: 376489 - DNA, 25 bp, Mus musculus
ctcgggattggagcctgaacaatct

SEQ ID NO: 376490 - DNA, 25 bp, Mus musculus
ctcgggcagcgaacagaaggcgcac

SEQ ID NO: 376491 - DNA, 25 bp, Mus musculus
ctcgggcagcgatcagaaggcgcac

SEQ ID NO: 376492 - DNA, 25 bp, Mus musculus
ctcgggccatccagaagaaaattga

SEQ ID NO: 376493 - DNA, 25 bp, Mus musculus
ctcgggccatcctgaagaaaattga

SEQ ID NO: 376494 - DNA, 25 bp, Mus musculus
ctcgggccccacagccaggtgggat

SEQ ID NO: 376495 - DNA, 25 bp, Mus musculus
ctcgggccccactgccaggtgggat

SEQ ID NO: 376496 - DNA, 25 bp, Mus musculus
ctcgggcggctgaatgcagatctaa

SEQ ID NO: 376497 - DNA, 25 bp, Mus musculus
ctcgggcggctgtatgcagatctaa

SEQ ID NO: 376498 - DNA, 25 bp, Mus musculus
ctcgggctcggtcggaactaccagt

SEQ ID NO: 376499 - DNA, 25 bp, Mus musculus
ctcgggctcggtgggaactaccagt

SEQ ID NO: 376500 - DNA, 25 bp, Mus musculus
ctcggggctctgctggtaatagaca

SEQ ID NO: 376501 - DNA, 25 bp, Mus musculus
ctcggggctctggtggtaatagaca

SEQ ID NO: 376502 - DNA, 25 bp, Mus musculus
ctcgggtgacttaaagcttgtgatc

SEQ ID NO: 376503 - DNA, 25 bp, Mus musculus
ctcgggtgactttaagcttgtgatc

SEQ ID NO: 376504 - DNA, 25 bp, Mus musculus
ctcgggtgataaaggacctgcctgg

SEQ ID NO: 376505 - DNA, 25 bp, Mus musculus
ctcgggtgataatggacctgcctgg

SEQ ID NO: 376506 - DNA, 25 bp, Mus musculus
ctcgggtgctgcaaggtgctaccat

SEQ ID NO: 376507 - DNA, 25 bp, Mus musculus
ctcgggtgctgctaggtgctaccat

SEQ ID NO: 376508 - DNA, 25 bp, Mus musculus
ctcgggtgctgtaagagctggaacc

SEQ ID NO: 376509 - DNA, 25 bp, Mus musculus
ctcgggtgctgttagagctggaacc

SEQ ID NO: 376510 - DNA, 25 bp, Mus musculus
ctcgggtgtgccaggatctaggaac

SEQ ID NO: 376511 - DNA, 25 bp, Mus musculus
ctcgggtgtgcctggatctaggaac

SEQ ID NO: 376512 - DNA, 25 bp, Mus musculus
ctcgggtttcatactttgctgtgtt

SEQ ID NO: 376513 - DNA, 25 bp, Mus musculus
ctcgggtttcattctttgctgtgtt

SEQ ID NO: 376514 - DNA, 25 bp, Mus musculus
ctcggtactgcgcttgcacagagta

SEQ ID NO: 376515 - DNA, 25 bp, Mus musculus
ctcggtactgcggttgcacagagta

SEQ ID NO: 376516 - DNA, 25 bp, Mus musculus
ctcggtagcactcaccctgagaata

SEQ ID NO: 376517 - DNA, 25 bp, Mus musculus
ctcggtagcactgaccctgagaata

SEQ ID NO: 376518 - DNA, 25 bp, Mus musculus
ctcggtagctacagtcctcgtggta

SEQ ID NO: 376519 - DNA, 25 bp, Mus musculus
ctcggtagctactgtcctcgtggta

SEQ ID NO: 376520 - DNA, 25 bp, Mus musculus
ctcggtatcacgatttttgtcatat

SEQ ID NO: 376521 - DNA, 25 bp, Mus musculus
ctcggtatcacgttttttgtcatat

SEQ ID NO: 376522 - DNA, 25 bp, Mus musculus
ctcggtatggatcttaagtcttgca

SEQ ID NO: 376523 - DNA, 25 bp, Mus musculus
ctcggtatggatgttaagtcttgca

SEQ ID NO: 376524 - DNA, 25 bp, Mus musculus
ctcggtattgccagtttcttgtgca

SEQ ID NO: 376525 - DNA, 25 bp, Mus musculus
ctcggtattgcctgtttcttgtgca

SEQ ID NO: 376526 - DNA, 25 bp, Mus musculus
ctcggtcaacaacccatttatcaac

SEQ ID NO: 376527 - DNA, 25 bp, Mus musculus
ctcggtcaacaagccatttatcaac

SEQ ID NO: 376528 - DNA, 25 bp, Mus musculus
ctcggtcaagcccaccaagaatttg

SEQ ID NO: 376529 - DNA, 25 bp, Mus musculus
ctcggtcaagccgaccaagaatttg

SEQ ID NO: 376530 - DNA, 25 bp, Mus musculus
ctcggtcaccttataatcttgttca

SEQ ID NO: 376531 - DNA, 25 bp, Mus musculus
ctcggtcaccttttaatcttgttca

SEQ ID NO: 376532 - DNA, 25 bp, Mus musculus
ctcggtcacggcctttggagtcgtt

SEQ ID NO: 376533 - DNA, 25 bp, Mus musculus
ctcggtcacggcgtttggagtcgtt

SEQ ID NO: 376534 - DNA, 25 bp, Mus musculus
ctcggtcagagccagtgcccagagt

SEQ ID NO: 376535 - DNA, 25 bp, Mus musculus
ctcggtcagagcgagtgcccagagt

SEQ ID NO: 376536 - DNA, 25 bp, Mus musculus
ctcggtcagtcacctatgttgtgga

SEQ ID NO: 376537 - DNA, 25 bp, Mus musculus
ctcggtcagtcagctatgttgtgga

SEQ ID NO: 376538 - DNA, 25 bp, Mus musculus
ctcggtccatgaagctcaggtttta

SEQ ID NO: 376539 - DNA, 25 bp, Mus musculus
ctcggtccatgatgctcaggtttta

SEQ ID NO: 376540 - DNA, 25 bp, Mus musculus
ctcggtcctgagctctgagcatctc

SEQ ID NO: 376541 - DNA, 25 bp, Mus musculus
ctcggtcctgaggtctgagcatctc

SEQ ID NO: 376542 - DNA, 25 bp, Mus musculus
ctcggtccttacagcatttgagaac

SEQ ID NO: 376543 - DNA, 25 bp, Mus musculus
ctcggtccttactgcatttgagaac

SEQ ID NO: 376544 - DNA, 25 bp, Mus musculus
ctcggtctaagcactcatgatttta

SEQ ID NO: 376545 - DNA, 25 bp, Mus musculus
ctcggtctaagctctcatgatttta

SEQ ID NO: 376546 - DNA, 25 bp, Mus musculus
ctcggtctttgtaacttcaccagaa

SEQ ID NO: 376547 - DNA, 25 bp, Mus musculus
ctcggtctttgttacttcaccagaa

SEQ ID NO: 376548 - DNA, 25 bp, Mus musculus
ctcggtgatcaaatccagtggacag

SEQ ID NO: 376549 - DNA, 25 bp, Mus musculus
ctcggtgatcaattccagtggacag

SEQ ID NO: 376550 - DNA, 25 bp, Mus musculus
ctcggtgcatccctgtgttgatagc

SEQ ID NO: 376551 - DNA, 25 bp, Mus musculus
ctcggtgcatccgtgtgttgatagc

SEQ ID NO: 376552 - DNA, 25 bp, Mus musculus
ctcggtgccatcagttttcttttga

SEQ ID NO: 376553 - DNA, 25 bp, Mus musculus
ctcggtgccatctgttttcttttga

SEQ ID NO: 376554 - DNA, 25 bp, Mus musculus
ctcggtgcgatactgatgatgaaat

SEQ ID NO: 376555 - DNA, 25 bp, Mus musculus
ctcggtgcgatagtgatgatgaaat

SEQ ID NO: 376556 - DNA, 25 bp, Mus musculus
ctcggtgctataccctttcatcttt

SEQ ID NO: 376557 - DNA, 25 bp, Mus musculus
ctcggtgctatagcctttcatcttt

SEQ ID NO: 376558 - DNA, 25 bp, Mus musculus
ctcggtgctgagacttattaaatat

SEQ ID NO: 376559 - DNA, 25 bp, Mus musculus
ctcggtgctgagtcttattaaatat

SEQ ID NO: 376560 - DNA, 25 bp, Mus musculus
ctcggtgcttcacccggaaatacac

SEQ ID NO: 376561 - DNA, 25 bp, Mus musculus
ctcggtgcttcagccggaaatacac

SEQ ID NO: 376562 - DNA, 25 bp, Mus musculus
ctcggtggaggcaagtatgtgtcct

SEQ ID NO: 376563 - DNA, 25 bp, Mus musculus
ctcggtggaggctagtatgtgtcct

SEQ ID NO: 376564 - DNA, 25 bp, Mus musculus
ctcggtggcactcagaacaaaggtt

SEQ ID NO: 376565 - DNA, 25 bp, Mus musculus
ctcggtggcactgagaacaaaggtt

SEQ ID NO: 376566 - DNA, 25 bp, Mus musculus
ctcggtgtgcctaatttgtgtactg

SEQ ID NO: 376567 - DNA, 25 bp, Mus musculus
ctcggtgtgccttatttgtgtactg

SEQ ID NO: 376568 - DNA, 25 bp, Mus musculus
ctcggtgtggctcacattcgcgcag

SEQ ID NO: 376569 - DNA, 25 bp, Mus musculus
ctcggtgtggctgacattcgcgcag

SEQ ID NO: 376570 - DNA, 25 bp, Mus musculus
ctcggtgttattcgttttgctggtt

SEQ ID NO: 376571 - DNA, 25 bp, Mus musculus
ctcggtgttattggttttgctggtt

SEQ ID NO: 376572 - DNA, 25 bp, Mus musculus
ctcggtgtttcaatctgcatgcata

SEQ ID NO: 376573 - DNA, 25 bp, Mus musculus
ctcggtgtttcattctgcatgcata

SEQ ID NO: 376574 - DNA, 25 bp, Mus musculus
ctcggttaattgatctgcagcacgt

SEQ ID NO: 376575 - DNA, 25 bp, Mus musculus
ctcggttaattgttctgcagcacgt

SEQ ID NO: 376576 - DNA, 25 bp, Mus musculus
ctcggttccatgagtgaaggcccaa

SEQ ID NO: 376577 - DNA, 25 bp, Mus musculus
ctcggttccatgtgtgaaggcccaa

SEQ ID NO: 376578 - DNA, 25 bp, Mus musculus
ctcggttcctcacacaaatctggaa

SEQ ID NO: 376579 - DNA, 25 bp, Mus musculus
ctcggttcctcagacaaatctggaa

SEQ ID NO: 376580 - DNA, 25 bp, Mus musculus
ctcggttctggtcgccattttgaat

SEQ ID NO: 376581 - DNA, 25 bp, Mus musculus
ctcggttctggtggccattttgaat

SEQ ID NO: 376582 - DNA, 25 bp, Mus musculus
ctcggttggtagagtcctcgtgaga

SEQ ID NO: 376583 - DNA, 25 bp, Mus musculus
ctcggttggtagtgtcctcgtgaga

SEQ ID NO: 376584 - DNA, 25 bp, Mus musculus
ctcggtttgactctccagggaatag

SEQ ID NO: 376585 - DNA, 25 bp, Mus musculus
ctcggtttgactgtccagggaatag

SEQ ID NO: 376586 - DNA, 25 bp, Mus musculus
ctcggtttttctatttgctgtttct

SEQ ID NO: 376587 - DNA, 25 bp, Mus musculus
ctcggtttttctttttgctgtttct

SEQ ID NO: 376588 - DNA, 25 bp, Mus musculus
ctcgtaagtgaccatggcaaccagg

SEQ ID NO: 376589 - DNA, 25 bp, Mus musculus
ctcgtaagtgacgatggcaaccagg

SEQ ID NO: 376590 - DNA, 25 bp, Mus musculus
ctcgtagaacttctatctctcttcc

SEQ ID NO: 376591 - DNA, 25 bp, Mus musculus
ctcgtagaacttgtatctctcttcc

SEQ ID NO: 376592 - DNA, 25 bp, Mus musculus
ctcgtagcatgtagtggtcaggtat

SEQ ID NO: 376593 - DNA, 25 bp, Mus musculus
ctcgtagcatgttgtggtcaggtat

SEQ ID NO: 376594 - DNA, 25 bp, Mus musculus
ctcgtagctgtgatcgtaggtggcg

SEQ ID NO: 376595 - DNA, 25 bp, Mus musculus
ctcgtagctgtgttcgtaggtggcg

SEQ ID NO: 376596 - DNA, 25 bp, Mus musculus
ctcgtagtaaatctgcgcaggcgtc

SEQ ID NO: 376597 - DNA, 25 bp, Mus musculus
ctcgtagtaaatgtgcgcaggcgtc

SEQ ID NO: 376598 - DNA, 25 bp, Mus musculus
ctcgtatcctgtcatttagcagttg

SEQ ID NO: 376599 - DNA, 25 bp, Mus musculus
ctcgtatcctgtgatttagcagttg

SEQ ID NO: 376600 - DNA, 25 bp, Mus musculus
ctcgtatctgccactctaataaata

SEQ ID NO: 376601 - DNA, 25 bp, Mus musculus
ctcgtatctgcctctctaataaata

SEQ ID NO: 376602 - DNA, 25 bp, Mus musculus
ctcgtatgctcgctagtcttgtaat

SEQ ID NO: 376603 - DNA, 25 bp, Mus musculus
ctcgtatgctcggtagtcttgtaat

SEQ ID NO: 376604 - DNA, 25 bp, Mus musculus
ctcgtcaccatcctgtttgcaaagg

SEQ ID NO: 376605 - DNA, 25 bp, Mus musculus
ctcgtcaccatcgtgtttgcaaagg

SEQ ID NO: 376606 - DNA, 25 bp, Mus musculus
ctcgtcacctacagtatctgttaat

SEQ ID NO: 376607 - DNA, 25 bp, Mus musculus
ctcgtcacctactgtatctgttaat

SEQ ID NO: 376608 - DNA, 25 bp, Mus musculus
ctcgtcatcagccacgaaatcgatg

SEQ ID NO: 376609 - DNA, 25 bp, Mus musculus
ctcgtcatcagcgacgaaatcgatg

SEQ ID NO: 376610 - DNA, 25 bp, Mus musculus
ctcgtccactatcatcactgttttt

SEQ ID NO: 376611 - DNA, 25 bp, Mus musculus
ctcgtccactatgatcactgttttt

SEQ ID NO: 376612 - DNA, 25 bp, Mus musculus
ctcgtccccaataccaattattagg

SEQ ID NO: 376613 - DNA, 25 bp, Mus musculus
ctcgtccccaattccaattattagg

SEQ ID NO: 376614 - DNA, 25 bp, Mus musculus
ctcgtccctgtccacttgaatatta

SEQ ID NO: 376615 - DNA, 25 bp, Mus musculus
ctcgtccctgtcgacttgaatatta

SEQ ID NO: 376616 - DNA, 25 bp, Mus musculus
ctcgtcctcattaactgtcaacatt

SEQ ID NO: 376617 - DNA, 25 bp, Mus musculus
ctcgtcctcatttactgtcaacatt

SEQ ID NO: 376618 - DNA, 25 bp, Mus musculus
ctcgtcctgcaacgtcgcagggata

SEQ ID NO: 376619 - DNA, 25 bp, Mus musculus
ctcgtcctgcaaggtcgcagggata

SEQ ID NO: 376620 - DNA, 25 bp, Mus musculus
ctcgtccttttgcatgatctacaga

SEQ ID NO: 376621 - DNA, 25 bp, Mus musculus
ctcgtccttttggatgatctacaga

SEQ ID NO: 376622 - DNA, 25 bp, Mus musculus
ctcgtcggcttgacaggtcatgtgg

SEQ ID NO: 376623 - DNA, 25 bp, Mus musculus
ctcgtcggcttgtcaggtcatgtgg

SEQ ID NO: 376624 - DNA, 25 bp, Mus musculus
ctcgtcggtattatcagggcaaaca

SEQ ID NO: 376625 - DNA, 25 bp, Mus musculus
ctcgtcggtattttcagggcaaaca

SEQ ID NO: 376626 - DNA, 25 bp, Mus musculus
ctcgtgacaccgagggagagtccct

SEQ ID NO: 376627 - DNA, 25 bp, Mus musculus
ctcgtgacaccgtgggagagtccct

SEQ ID NO: 376628 - DNA, 25 bp, Mus musculus
ctcgtgactcctagacgcaaggatt

SEQ ID NO: 376629 - DNA, 25 bp, Mus musculus
ctcgtgactccttgacgcaaggatt

SEQ ID NO: 376630 - DNA, 25 bp, Mus musculus
ctcgtgactggactgcacagttcat

SEQ ID NO: 376631 - DNA, 25 bp, Mus musculus
ctcgtgactggagtgcacagttcat

SEQ ID NO: 376632 - DNA, 25 bp, Mus musculus
ctcgtgagcctgaacagccttgaat

SEQ ID NO: 376633 - DNA, 25 bp, Mus musculus
ctcgtgagcctgtacagccttgaat

SEQ ID NO: 376634 - DNA, 25 bp, Mus musculus
ctcgtgaggtggagggcattcccac

SEQ ID NO: 376635 - DNA, 25 bp, Mus musculus
ctcgtgaggtggtgggcattcccac

SEQ ID NO: 376636 - DNA, 25 bp, Mus musculus
ctcgtgatttggcaccagcacctgg

SEQ ID NO: 376637 - DNA, 25 bp, Mus musculus
ctcgtgatttgggaccagcacctgg

SEQ ID NO: 376638 - DNA, 25 bp, Mus musculus
ctcgtgcagtcaactgccgcaagaa

SEQ ID NO: 376639 - DNA, 25 bp, Mus musculus
ctcgtgcagtcatctgccgcaagaa

SEQ ID NO: 376640 - DNA, 25 bp, Mus musculus
ctcgtgcagtggctgaatcagtgtt

SEQ ID NO: 376641 - DNA, 25 bp, Mus musculus
ctcgtgcagtgggtgaatcagtgtt

SEQ ID NO: 376642 - DNA, 25 bp, Mus musculus
ctcgtgcgtcatatagattcttaca

SEQ ID NO: 376643 - DNA, 25 bp, Mus musculus
ctcgtgcgtcatttagattcttaca

SEQ ID NO: 376644 - DNA, 25 bp, Mus musculus
ctcgtgctaggccattcgtgttact

SEQ ID NO: 376645 - DNA, 25 bp, Mus musculus
ctcgtgctaggcgattcgtgttact

SEQ ID NO: 376646 - DNA, 25 bp, Mus musculus
ctcgtgctctacatcgacgacgagg

SEQ ID NO: 376647 - DNA, 25 bp, Mus musculus
ctcgtgctctacttcgacgacgagg

SEQ ID NO: 376648 - DNA, 25 bp, Mus musculus
ctcgtgctctgcctgtttggtgtga

SEQ ID NO: 376649 - DNA, 25 bp, Mus musculus
ctcgtgctctgcgtgtttggtgtga

SEQ ID NO: 376650 - DNA, 25 bp, Mus musculus
ctcgtgctcttaaggacctcgatga

SEQ ID NO: 376651 - DNA, 25 bp, Mus musculus
ctcgtgctcttatggacctcgatga

SEQ ID NO: 376652 - DNA, 25 bp, Mus musculus
ctcgtgctgccaatgttaaaatgcc

SEQ ID NO: 376653 - DNA, 25 bp, Mus musculus
ctcgtgctgccattgttaaaatgcc

SEQ ID NO: 376654 - DNA, 25 bp, Mus musculus
ctcgtggattcgaacggtggatttg

SEQ ID NO: 376655 - DNA, 25 bp, Mus musculus
ctcgtggattcgtacggtggatttg

SEQ ID NO: 376656 - DNA, 25 bp, Mus musculus
ctcgtggattctacgcaccaatggg

SEQ ID NO: 376657 - DNA, 25 bp, Mus musculus
ctcgtggattcttcgcaccaatggg

SEQ ID NO: 376658 - DNA, 25 bp, Mus musculus
ctcgtggctgacaaggacctcctgg

SEQ ID NO: 376659 - DNA, 25 bp, Mus musculus
ctcgtggctgactaggacctcctgg

SEQ ID NO: 376660 - DNA, 25 bp, Mus musculus
ctcgtggctgcccattctgttaaac

SEQ ID NO: 376661 - DNA, 25 bp, Mus musculus
ctcgtggctgccgattctgttaaac

SEQ ID NO: 376662 - DNA, 25 bp, Mus musculus
ctcgtggcttaacggtgactctcct

SEQ ID NO: 376663 - DNA, 25 bp, Mus musculus
ctcgtggcttaagggtgactctcct

SEQ ID NO: 376664 - DNA, 25 bp, Mus musculus
ctcgtggtgttcatgatcggattaa

SEQ ID NO: 376665 - DNA, 25 bp, Mus musculus
ctcgtggtgttcttgatcggattaa

SEQ ID NO: 376666 - DNA, 25 bp, Mus musculus
ctcgtggtttatcctggcaatgata

SEQ ID NO: 376667 - DNA, 25 bp, Mus musculus
ctcgtggtttatgctggcaatgata

SEQ ID NO: 376668 - DNA, 25 bp, Mus musculus
ctcgtggttttgataatagattccc

SEQ ID NO: 376669 - DNA, 25 bp, Mus musculus
ctcgtggttttgttaatagattccc

SEQ ID NO: 376670 - DNA, 25 bp, Mus musculus
ctcgtgtactgacccatcaagatga

SEQ ID NO: 376671 - DNA, 25 bp, Mus musculus
ctcgtgtactgagccatcaagatga

SEQ ID NO: 376672 - DNA, 25 bp, Mus musculus
ctcgtgtccgagaagaagtacccct

SEQ ID NO: 376673 - DNA, 25 bp, Mus musculus
ctcgtgtccgagtagaagtacccct

SEQ ID NO: 376674 - DNA, 25 bp, Mus musculus
ctcgtgtggctgaataactcggttc

SEQ ID NO: 376675 - DNA, 25 bp, Mus musculus
ctcgtgtggctgtataactcggttc

SEQ ID NO: 376676 - DNA, 25 bp, Mus musculus
ctcgtgtgggcaaagtgggacctat

SEQ ID NO: 376677 - DNA, 25 bp, Mus musculus
ctcgtgtgggcatagtgggacctat

SEQ ID NO: 376678 - DNA, 25 bp, Mus musculus
ctcgtgtgtcgaatttccggtggcg

SEQ ID NO: 376679 - DNA, 25 bp, Mus musculus
ctcgtgtgtcgattttccggtggcg

SEQ ID NO: 376680 - DNA, 25 bp, Mus musculus
ctcgtgttagaaaaagagtctgcca

SEQ ID NO: 376681 - DNA, 25 bp, Mus musculus
ctcgtgttagaataagagtctgcca

SEQ ID NO: 376682 - DNA, 25 bp, Mus musculus
ctcgtgttgtatctttgcccttgta

SEQ ID NO: 376683 - DNA, 25 bp, Mus musculus
ctcgtgttgtatgtttgcccttgta

SEQ ID NO: 376684 - DNA, 25 bp, Mus musculus
ctcgttaactccacagataatctgt

SEQ ID NO: 376685 - DNA, 25 bp, Mus musculus
ctcgttaactcctcagataatctgt

SEQ ID NO: 376686 - DNA, 25 bp, Mus musculus
ctcgttagactgattatttgatccc

SEQ ID NO: 376687 - DNA, 25 bp, Mus musculus
ctcgttagactgtttatttgatccc

SEQ ID NO: 376688 - DNA, 25 bp, Mus musculus
ctcgttcactacattcttggacaga

SEQ ID NO: 376689 - DNA, 25 bp, Mus musculus
ctcgttcactactttcttggacaga

SEQ ID NO: 376690 - DNA, 25 bp, Mus musculus
ctcgttcatcccagagcttggataa

SEQ ID NO: 376691 - DNA, 25 bp, Mus musculus
ctcgttcatccctgagcttggataa

SEQ ID NO: 376692 - DNA, 25 bp, Mus musculus
ctcgttcattggactcctgtgagga

SEQ ID NO: 376693 - DNA, 25 bp, Mus musculus
ctcgttcattggtctcctgtgagga

SEQ ID NO: 376694 - DNA, 25 bp, Mus musculus
ctcgttcccgacagctaattgtctg

SEQ ID NO: 376695 - DNA, 25 bp, Mus musculus
ctcgttcccgactgctaattgtctg

SEQ ID NO: 376696 - DNA, 25 bp, Mus musculus
ctcgttcctcagcaaatgcaaggtg

SEQ ID NO: 376697 - DNA, 25 bp, Mus musculus
ctcgttcctcaggaaatgcaaggtg

SEQ ID NO: 376698 - DNA, 25 bp, Mus musculus
ctcgttcctctcaccctgagttttt

SEQ ID NO: 376699 - DNA, 25 bp, Mus musculus
ctcgttcctctctccctgagttttt

SEQ ID NO: 376700 - DNA, 25 bp, Mus musculus
ctcgttccttagaccaacatttcta

SEQ ID NO: 376701 - DNA, 25 bp, Mus musculus
ctcgttccttagtccaacatttcta

SEQ ID NO: 376702 - DNA, 25 bp, Mus musculus
ctcgttctcataagtgttgtctgct

SEQ ID NO: 376703 - DNA, 25 bp, Mus musculus
ctcgttctcatatgtgttgtctgct

SEQ ID NO: 376704 - DNA, 25 bp, Mus musculus
ctcgttctctggagggcatgatttt

SEQ ID NO: 376705 - DNA, 25 bp, Mus musculus
ctcgttctctggtgggcatgatttt

SEQ ID NO: 376706 - DNA, 25 bp, Mus musculus
ctcgttctgataattgtgtctttgt

SEQ ID NO: 376707 - DNA, 25 bp, Mus musculus
ctcgttctgatatttgtgtctttgt

SEQ ID NO: 376708 - DNA, 25 bp, Mus musculus
ctcgttctgccgcttatgggaaaga

SEQ ID NO: 376709 - DNA, 25 bp, Mus musculus
ctcgttctgccggttatgggaaaga

SEQ ID NO: 376710 - DNA, 25 bp, Mus musculus
ctcgttctgtagattaagctggcat

SEQ ID NO: 376711 - DNA, 25 bp, Mus musculus
ctcgttctgtagtttaagctggcat

SEQ ID NO: 376712 - DNA, 25 bp, Mus musculus
ctcgttgccctaattcatcttttaa

SEQ ID NO: 376713 - DNA, 25 bp, Mus musculus
ctcgttgccctatttcatcttttaa

SEQ ID NO: 376714 - DNA, 25 bp, Mus musculus
ctcgttgctgtgctttaagtgtaca

SEQ ID NO: 376715 - DNA, 25 bp, Mus musculus
ctcgttgctgtggtttaagtgtaca

SEQ ID NO: 376716 - DNA, 25 bp, Mus musculus
ctcgttgcttagctgctttttcctt

SEQ ID NO: 376717 - DNA, 25 bp, Mus musculus
ctcgttgcttaggtgctttttcctt

SEQ ID NO: 376718 - DNA, 25 bp, Mus musculus
ctcgttggaaataatagcaccttca

SEQ ID NO: 376719 - DNA, 25 bp, Mus musculus
ctcgttggaaattatagcaccttca

SEQ ID NO: 376720 - DNA, 25 bp, Mus musculus
ctcgttgtattcatctagagaagca

SEQ ID NO: 376721 - DNA, 25 bp, Mus musculus
ctcgttgtattcttctagagaagca

SEQ ID NO: 376722 - DNA, 25 bp, Mus musculus
ctcgttgtcattagttccaagctgc

SEQ ID NO: 376723 - DNA, 25 bp, Mus musculus
ctcgttgtcatttgttccaagctgc

SEQ ID NO: 376724 - DNA, 25 bp, Mus musculus
ctcgtttacctgagcttagtttgtg

SEQ ID NO: 376725 - DNA, 25 bp, Mus musculus
ctcgtttacctgtgcttagtttgtg

SEQ ID NO: 376726 - DNA, 25 bp, Mus musculus
ctcgtttcattacgccttgtacaaa

SEQ ID NO: 376727 - DNA, 25 bp, Mus musculus
ctcgtttcattaggccttgtacaaa

SEQ ID NO: 376728 - DNA, 25 bp, Mus musculus
ctcgttttcaagagcccggaggagg

SEQ ID NO: 376729 - DNA, 25 bp, Mus musculus
ctcgttttcaagtgcccggaggagg

SEQ ID NO: 376730 - DNA, 25 bp, Mus musculus
ctcgttttgggcaattgggaagcct

SEQ ID NO: 376731 - DNA, 25 bp, Mus musculus
ctcgttttgggctattgggaagcct

SEQ ID NO: 376732 - DNA, 25 bp, Mus musculus
ctcgttttgtccaggattccgataa

SEQ ID NO: 376733 - DNA, 25 bp, Mus musculus
ctcgttttgtcctggattccgataa

SEQ ID NO: 376734 - DNA, 25 bp, Mus musculus
ctcgtttttcttcactttgtccatt

SEQ ID NO: 376735 - DNA, 25 bp, Mus musculus
ctcgtttttcttgactttgtccatt

SEQ ID NO: 376736 - DNA, 25 bp, Mus musculus
ctctaaactggcattgggtgagctt

SEQ ID NO: 376737 - DNA, 25 bp, Mus musculus
ctctaaactggctttgggtgagctt

SEQ ID NO: 376738 - DNA, 25 bp, Mus musculus
ctctaaagacgaatgtcccttccac

SEQ ID NO: 376739 - DNA, 25 bp, Mus musculus
ctctaaagacgattgtcccttccac

SEQ ID NO: 376740 - DNA, 25 bp, Mus musculus
ctctaaagaggtacatctcatctca

SEQ ID NO: 376741 - DNA, 25 bp, Mus musculus
ctctaaagaggttcatctcatctca

SEQ ID NO: 376742 - DNA, 25 bp, Mus musculus
ctctaaatcatcatgcgacagtctc

SEQ ID NO: 376743 - DNA, 25 bp, Mus musculus
ctctaaatcatcttgcgacagtctc

SEQ ID NO: 376744 - DNA, 25 bp, Mus musculus
ctctaaatgacacctggaccttcca

SEQ ID NO: 376745 - DNA, 25 bp, Mus musculus
ctctaaatgacagctggaccttcca

SEQ ID NO: 376746 - DNA, 25 bp, Mus musculus
ctctaaatgacccaaaaaagctatt

SEQ ID NO: 376747 - DNA, 25 bp, Mus musculus
ctctaaatgaccgaaaaaagctatt

SEQ ID NO: 376748 - DNA, 25 bp, Mus musculus
ctctaaatttggagactctggaaac

SEQ ID NO: 376749 - DNA, 25 bp, Mus musculus
ctctaaatttggtgactctggaaac

SEQ ID NO: 376750 - DNA, 25 bp, Mus musculus
ctctaacaaaacaaggctgtctcga

SEQ ID NO: 376751 - DNA, 25 bp, Mus musculus
ctctaacaaaactaggctgtctcga

SEQ ID NO: 376752 - DNA, 25 bp, Mus musculus
ctctaacactagcttcaggacatct

SEQ ID NO: 376753 - DNA, 25 bp, Mus musculus
ctctaacactaggttcaggacatct

SEQ ID NO: 376754 - DNA, 25 bp, Mus musculus
ctctaacacttgaggctgttgttac

SEQ ID NO: 376755 - DNA, 25 bp, Mus musculus
ctctaacacttgtggctgttgttac

SEQ ID NO: 376756 - DNA, 25 bp, Mus musculus
ctctaaccctgaattttctgggcca

SEQ ID NO: 376757 - DNA, 25 bp, Mus musculus
ctctaaccctgatttttctgggcca

SEQ ID NO: 376758 - DNA, 25 bp, Mus musculus
ctctaacctcagatattggctggtg

SEQ ID NO: 376759 - DNA, 25 bp, Mus musculus
ctctaacctcagttattggctggtg

SEQ ID NO: 376760 - DNA, 25 bp, Mus musculus
ctctaacctgccattggatacgcat

SEQ ID NO: 376761 - DNA, 25 bp, Mus musculus
ctctaacctgcctttggatacgcat

SEQ ID NO: 376762 - DNA, 25 bp, Mus musculus
ctctaacttcctaaccgaaagcaca

SEQ ID NO: 376763 - DNA, 25 bp, Mus musculus
ctctaacttccttaccgaaagcaca

SEQ ID NO: 376764 - DNA, 25 bp, Mus musculus
ctctaagaactactggcccatgaaa

SEQ ID NO: 376765 - DNA, 25 bp, Mus musculus
ctctaagaactagtggcccatgaaa

SEQ ID NO: 376766 - DNA, 25 bp, Mus musculus
ctctaagaagagcttgtgccggcaa

SEQ ID NO: 376767 - DNA, 25 bp, Mus musculus
ctctaagaagaggttgtgccggcaa

SEQ ID NO: 376768 - DNA, 25 bp, Mus musculus
ctctaagatagaagtacctggctcc

SEQ ID NO: 376769 - DNA, 25 bp, Mus musculus
ctctaagatagatgtacctggctcc

SEQ ID NO: 376770 - DNA, 25 bp, Mus musculus
ctctaagcaattctttagccgggcc

SEQ ID NO: 376771 - DNA, 25 bp, Mus musculus
ctctaagcaattgtttagccgggcc

SEQ ID NO: 376772 - DNA, 25 bp, Mus musculus
ctctaagcacggcaaattgggaaga

SEQ ID NO: 376773 - DNA, 25 bp, Mus musculus
ctctaagcacgggaaattgggaaga

SEQ ID NO: 376774 - DNA, 25 bp, Mus musculus
ctctaagggtcacccttggctatca

SEQ ID NO: 376775 - DNA, 25 bp, Mus musculus
ctctaagggtcagccttggctatca

SEQ ID NO: 376776 - DNA, 25 bp, Mus musculus
ctctaagtccccagagtctagttga

SEQ ID NO: 376777 - DNA, 25 bp, Mus musculus
ctctaagtcccctgagtctagttga

SEQ ID NO: 376778 - DNA, 25 bp, Mus musculus
ctctaagtctgacttacctgtacct

SEQ ID NO: 376779 - DNA, 25 bp, Mus musculus
ctctaagtctgagttacctgtacct

SEQ ID NO: 376780 - DNA, 25 bp, Mus musculus
ctctaagtgtaccagtttcctcaat

SEQ ID NO: 376781 - DNA, 25 bp, Mus musculus
ctctaagtgtacgagtttcctcaat

SEQ ID NO: 376782 - DNA, 25 bp, Mus musculus
ctctaatccctgcaccagtttataa

SEQ ID NO: 376783 - DNA, 25 bp, Mus musculus
ctctaatccctggaccagtttataa

SEQ ID NO: 376784 - DNA, 25 bp, Mus musculus
ctctaatgccaacggagcggctctg

SEQ ID NO: 376785 - DNA, 25 bp, Mus musculus
ctctaatgccaagggagcggctctg

SEQ ID NO: 376786 - DNA, 25 bp, Mus musculus
ctctaatgtttaaggcatgctgtga

SEQ ID NO: 376787 - DNA, 25 bp, Mus musculus
ctctaatgtttatggcatgctgtga

SEQ ID NO: 376788 - DNA, 25 bp, Mus musculus
ctctaattatccatgtttttacttg

SEQ ID NO: 376789 - DNA, 25 bp, Mus musculus
ctctaattatccttgtttttacttg

SEQ ID NO: 376790 - DNA, 25 bp, Mus musculus
ctctaattccctaggttagatacca

SEQ ID NO: 376791 - DNA, 25 bp, Mus musculus
ctctaattcccttggttagatacca

SEQ ID NO: 376792 - DNA, 25 bp, Mus musculus
ctctaattttgacgctggacagtta

SEQ ID NO: 376793 - DNA, 25 bp, Mus musculus
ctctaattttgaggctggacagtta

SEQ ID NO: 376794 - DNA, 25 bp, Mus musculus
ctctacacactgacaggagcttgtc

SEQ ID NO: 376795 - DNA, 25 bp, Mus musculus
ctctacacactgtcaggagcttgtc

SEQ ID NO: 376796 - DNA, 25 bp, Mus musculus
ctctacacagaaagtatgacacggg

SEQ ID NO: 376797 - DNA, 25 bp, Mus musculus
ctctacacagaatgtatgacacggg

SEQ ID NO: 376798 - DNA, 25 bp, Mus musculus
ctctacacagctctttctgtcctgg

SEQ ID NO: 376799 - DNA, 25 bp, Mus musculus
ctctacacagctgtttctgtcctgg

SEQ ID NO: 376800 - DNA, 25 bp, Mus musculus
ctctacacccatcgattctctgaaa

SEQ ID NO: 376801 - DNA, 25 bp, Mus musculus
ctctacacccatggattctctgaaa

SEQ ID NO: 376802 - DNA, 25 bp, Mus musculus
ctctacagcagcatccaataaaggg

SEQ ID NO: 376803 - DNA, 25 bp, Mus musculus
ctctacagcagcttccaataaaggg

SEQ ID NO: 376804 - DNA, 25 bp, Mus musculus
ctctacaggcaaaattaggcacccc

SEQ ID NO: 376805 - DNA, 25 bp, Mus musculus
ctctacaggcaatattaggcacccc

SEQ ID NO: 376806 - DNA, 25 bp, Mus musculus
ctctacagtgctccacaggaatctt

SEQ ID NO: 376807 - DNA, 25 bp, Mus musculus
ctctacagtgctgcacaggaatctt

SEQ ID NO: 376808 - DNA, 25 bp, Mus musculus
ctctacagtgttcaagctggtcgaa

SEQ ID NO: 376809 - DNA, 25 bp, Mus musculus
ctctacagtgttgaagctggtcgaa

SEQ ID NO: 376810 - DNA, 25 bp, Mus musculus
ctctacatcgaactctacccaggga

SEQ ID NO: 376811 - DNA, 25 bp, Mus musculus
ctctacatcgaagtctacccaggga

SEQ ID NO: 376812 - DNA, 25 bp, Mus musculus
ctctaccacgttacttatcatgact

SEQ ID NO: 376813 - DNA, 25 bp, Mus musculus
ctctaccacgtttcttatcatgact

SEQ ID NO: 376814 - DNA, 25 bp, Mus musculus
ctctaccactatatcttctttatca

SEQ ID NO: 376815 - DNA, 25 bp, Mus musculus
ctctaccactatttcttctttatca

SEQ ID NO: 376816 - DNA, 25 bp, Mus musculus
ctctaccatttaattatctcagctg

SEQ ID NO: 376817 - DNA, 25 bp, Mus musculus
ctctaccatttatttatctcagctg

SEQ ID NO: 376818 - DNA, 25 bp, Mus musculus
ctctacccaattcccatggataagg

SEQ ID NO: 376819 - DNA, 25 bp, Mus musculus
ctctacccaattgccatggataagg

SEQ ID NO: 376820 - DNA, 25 bp, Mus musculus
ctctacccagaacgatgccatcttg

SEQ ID NO: 376821 - DNA, 25 bp, Mus musculus
ctctacccagaaggatgccatcttg

SEQ ID NO: 376822 - DNA, 25 bp, Mus musculus
ctctacccagcaccatattgagatg

SEQ ID NO: 376823 - DNA, 25 bp, Mus musculus
ctctacccagcagcatattgagatg

SEQ ID NO: 376824 - DNA, 25 bp, Mus musculus
ctctacccggtgatgtagtactgtt

SEQ ID NO: 376825 - DNA, 25 bp, Mus musculus
ctctacccggtgttgtagtactgtt

SEQ ID NO: 376826 - DNA, 25 bp, Mus musculus
ctctacctcgacatgggtggttcaa

SEQ ID NO: 376827 - DNA, 25 bp, Mus musculus
ctctacctcgacttgggtggttcaa

SEQ ID NO: 376828 - DNA, 25 bp, Mus musculus
ctctacctgaatcgcttttgtagtc

SEQ ID NO: 376829 - DNA, 25 bp, Mus musculus
ctctacctgaatggcttttgtagtc

SEQ ID NO: 376830 - DNA, 25 bp, Mus musculus
ctctacctggtaccatatctgtgga

SEQ ID NO: 376831 - DNA, 25 bp, Mus musculus
ctctacctggtagcatatctgtgga

SEQ ID NO: 376832 - DNA, 25 bp, Mus musculus
ctctacctggtcagtgttggtgtaa

SEQ ID NO: 376833 - DNA, 25 bp, Mus musculus
ctctacctggtctgtgttggtgtaa

SEQ ID NO: 376834 - DNA, 25 bp, Mus musculus
ctctacctgtgacactgcagaatct

SEQ ID NO: 376835 - DNA, 25 bp, Mus musculus
ctctacctgtgagactgcagaatct

SEQ ID NO: 376836 - DNA, 25 bp, Mus musculus
ctctacctgttcactgaacttctaa

SEQ ID NO: 376837 - DNA, 25 bp, Mus musculus
ctctacctgttctctgaacttctaa

SEQ ID NO: 376838 - DNA, 25 bp, Mus musculus
ctctacctttaactgaggcaacaaa

SEQ ID NO: 376839 - DNA, 25 bp, Mus musculus
ctctacctttaagtgaggcaacaaa

SEQ ID NO: 376840 - DNA, 25 bp, Mus musculus
ctctacgagtcacggctgccgtgta

SEQ ID NO: 376841 - DNA, 25 bp, Mus musculus
ctctacgagtcagggctgccgtgta

SEQ ID NO: 376842 - DNA, 25 bp, Mus musculus
ctctacgattcaagtgtccctgtgg

SEQ ID NO: 376843 - DNA, 25 bp, Mus musculus
ctctacgattcatgtgtccctgtgg

SEQ ID NO: 376844 - DNA, 25 bp, Mus musculus
ctctacgccggaagttctaccacta

SEQ ID NO: 376845 - DNA, 25 bp, Mus musculus
ctctacgccggatgttctaccacta

SEQ ID NO: 376846 - DNA, 25 bp, Mus musculus
ctctacgccgtaagactgcaggaga

SEQ ID NO: 376847 - DNA, 25 bp, Mus musculus
ctctacgccgtatgactgcaggaga

SEQ ID NO: 376848 - DNA, 25 bp, Mus musculus
ctctacgcttaaaagtggtgacttc

SEQ ID NO: 376849 - DNA, 25 bp, Mus musculus
ctctacgcttaatagtggtgacttc

SEQ ID NO: 376850 - DNA, 25 bp, Mus musculus
ctctactacgtgagactctgggata

SEQ ID NO: 376851 - DNA, 25 bp, Mus musculus
ctctactacgtgtgactctgggata

SEQ ID NO: 376852 - DNA, 25 bp, Mus musculus
ctctactagagtcgtctgtgagaaa

SEQ ID NO: 376853 - DNA, 25 bp, Mus musculus
ctctactagagtggtctgtgagaaa

SEQ ID NO: 376854 - DNA, 25 bp, Mus musculus
ctctactaggatctggtttctttaa

SEQ ID NO: 376855 - DNA, 25 bp, Mus musculus
ctctactaggatgtggtttctttaa

SEQ ID NO: 376856 - DNA, 25 bp, Mus musculus
ctctactatgccacatgttgcctac

SEQ ID NO: 376857 - DNA, 25 bp, Mus musculus
ctctactatgcctcatgttgcctac

SEQ ID NO: 376858 - DNA, 25 bp, Mus musculus
ctctactcctaacctctgatgttct

SEQ ID NO: 376859 - DNA, 25 bp, Mus musculus
ctctactcctaagctctgatgttct

SEQ ID NO: 376860 - DNA, 25 bp, Mus musculus
ctctactctctgaattgtcttaatt

SEQ ID NO: 376861 - DNA, 25 bp, Mus musculus
ctctactctctgtattgtcttaatt

SEQ ID NO: 376862 - DNA, 25 bp, Mus musculus
ctctactctttcagctggaggaata

SEQ ID NO: 376863 - DNA, 25 bp, Mus musculus
ctctactctttctgctggaggaata

SEQ ID NO: 376864 - DNA, 25 bp, Mus musculus
ctctactgaaatctgtgtggcatta

SEQ ID NO: 376865 - DNA, 25 bp, Mus musculus
ctctactgaaatgtgtgtggcatta

SEQ ID NO: 376866 - DNA, 25 bp, Mus musculus
ctctactgaatgactaccgagttcc

SEQ ID NO: 376867 - DNA, 25 bp, Mus musculus
ctctactgaatgtctaccgagttcc

SEQ ID NO: 376868 - DNA, 25 bp, Mus musculus
ctctactgccacctcgggtacaggg

SEQ ID NO: 376869 - DNA, 25 bp, Mus musculus
ctctactgccacgtcgggtacaggg

SEQ ID NO: 376870 - DNA, 25 bp, Mus musculus
ctctactgccatcgaaccggatgat

SEQ ID NO: 376871 - DNA, 25 bp, Mus musculus
ctctactgccatggaaccggatgat

SEQ ID NO: 376872 - DNA, 25 bp, Mus musculus
ctctactggtatctgtctcaagaca

SEQ ID NO: 376873 - DNA, 25 bp, Mus musculus
ctctactggtatgtgtctcaagaca

SEQ ID NO: 376874 - DNA, 25 bp, Mus musculus
ctctactgtgtactccatttttcag

SEQ ID NO: 376875 - DNA, 25 bp, Mus musculus
ctctactgtgtagtccatttttcag

SEQ ID NO: 376876 - DNA, 25 bp, Mus musculus
ctctactgtttgagtgccagtggaa

SEQ ID NO: 376877 - DNA, 25 bp, Mus musculus
ctctactgtttgtgtgccagtggaa

SEQ ID NO: 376878 - DNA, 25 bp, Mus musculus
ctctacttagtgcttaccttcaaca

SEQ ID NO: 376879 - DNA, 25 bp, Mus musculus
ctctacttagtggttaccttcaaca

SEQ ID NO: 376880 - DNA, 25 bp, Mus musculus
ctctacttcttcaacgaaatcatcg

SEQ ID NO: 376881 - DNA, 25 bp, Mus musculus
ctctacttcttctacgaaatcatcg

SEQ ID NO: 376882 - DNA, 25 bp, Mus musculus
ctctacttgctaacgggacatcagg

SEQ ID NO: 376883 - DNA, 25 bp, Mus musculus
ctctacttgctatcgggacatcagg

SEQ ID NO: 376884 - DNA, 25 bp, Mus musculus
ctctactttggtcaaggctcaaagc

SEQ ID NO: 376885 - DNA, 25 bp, Mus musculus
ctctactttggtgaaggctcaaagc

SEQ ID NO: 376886 - DNA, 25 bp, Mus musculus
ctctacttttgtaatggcggcacat

SEQ ID NO: 376887 - DNA, 25 bp, Mus musculus
ctctacttttgttatggcggcacat

SEQ ID NO: 376888 - DNA, 25 bp, Mus musculus
ctctactttttgcaacagcttgaaa

SEQ ID NO: 376889 - DNA, 25 bp, Mus musculus
ctctactttttggaacagcttgaaa

SEQ ID NO: 376890 - DNA, 25 bp, Mus musculus
ctctagaattggctgagctcactaa

SEQ ID NO: 376891 - DNA, 25 bp, Mus musculus
ctctagaattgggtgagctcactaa

SEQ ID NO: 376892 - DNA, 25 bp, Mus musculus
ctctagaccctgaaccagcaagtgg

SEQ ID NO: 376893 - DNA, 25 bp, Mus musculus
ctctagaccctgtaccagcaagtgg

SEQ ID NO: 376894 - DNA, 25 bp, Mus musculus
ctctagacttcgagcaggagatggc

SEQ ID NO: 376895 - DNA, 25 bp, Mus musculus
ctctagacttcgtgcaggagatggc

SEQ ID NO: 376896 - DNA, 25 bp, Mus musculus
ctctagaggccgcatgtgcaaagta

SEQ ID NO: 376897 - DNA, 25 bp, Mus musculus
ctctagaggccggatgtgcaaagta

SEQ ID NO: 376898 - DNA, 25 bp, Mus musculus
ctctagatggcgaacttgatgaaaa

SEQ ID NO: 376899 - DNA, 25 bp, Mus musculus
ctctagatggcgtacttgatgaaaa

SEQ ID NO: 376900 - DNA, 25 bp, Mus musculus
ctctagcaggatagttcgcaggctg

SEQ ID NO: 376901 - DNA, 25 bp, Mus musculus
ctctagcaggattgttcgcaggctg

SEQ ID NO: 376902 - DNA, 25 bp, Mus musculus
ctctagcaggttcagattgtatatc

SEQ ID NO: 376903 - DNA, 25 bp, Mus musculus
ctctagcaggttgagattgtatatc

SEQ ID NO: 376904 - DNA, 25 bp, Mus musculus
ctctagcatatgagtattgactctc

SEQ ID NO: 376905 - DNA, 25 bp, Mus musculus
ctctagcatatgtgtattgactctc

SEQ ID NO: 376906 - DNA, 25 bp, Mus musculus
ctctagccaggaccatctcaagtgg

SEQ ID NO: 376907 - DNA, 25 bp, Mus musculus
ctctagccaggagcatctcaagtgg

SEQ ID NO: 376908 - DNA, 25 bp, Mus musculus
ctctagccccgtaggatactttgaa

SEQ ID NO: 376909 - DNA, 25 bp, Mus musculus
ctctagccccgttggatactttgaa

SEQ ID NO: 376910 - DNA, 25 bp, Mus musculus
ctctagcctccgagatgggtcatca

SEQ ID NO: 376911 - DNA, 25 bp, Mus musculus
ctctagcctccgtgatgggtcatca

SEQ ID NO: 376912 - DNA, 25 bp, Mus musculus
ctctagcctctcagacttggttgtc

SEQ ID NO: 376913 - DNA, 25 bp, Mus musculus
ctctagcctctctgacttggttgtc

SEQ ID NO: 376914 - DNA, 25 bp, Mus musculus
ctctagcctgcaacttttgttttaa

SEQ ID NO: 376915 - DNA, 25 bp, Mus musculus
ctctagcctgcatcttttgttttaa

SEQ ID NO: 376916 - DNA, 25 bp, Mus musculus
ctctagcgcgggaccagaagatgaa

SEQ ID NO: 376917 - DNA, 25 bp, Mus musculus
ctctagcgcgggtccagaagatgaa

SEQ ID NO: 376918 - DNA, 25 bp, Mus musculus
ctctagcgttcgaacgcactgattt

SEQ ID NO: 376919 - DNA, 25 bp, Mus musculus
ctctagcgttcgtacgcactgattt

SEQ ID NO: 376920 - DNA, 25 bp, Mus musculus
ctctagctaggcagggtcggagtct

SEQ ID NO: 376921 - DNA, 25 bp, Mus musculus
ctctagctaggctgggtcggagtct

SEQ ID NO: 376922 - DNA, 25 bp, Mus musculus
ctctagctcctaaccatttcaaata

SEQ ID NO: 376923 - DNA, 25 bp, Mus musculus
ctctagctcctatccatttcaaata

SEQ ID NO: 376924 - DNA, 25 bp, Mus musculus
ctctagcttgctcggtttgttgttt

SEQ ID NO: 376925 - DNA, 25 bp, Mus musculus
ctctagcttgctgggtttgttgttt

SEQ ID NO: 376926 - DNA, 25 bp, Mus musculus
ctctagcttttactatttttgtgga

SEQ ID NO: 376927 - DNA, 25 bp, Mus musculus
ctctagcttttagtatttttgtgga

SEQ ID NO: 376928 - DNA, 25 bp, Mus musculus
ctctaggagaggattgtctgcaaat

SEQ ID NO: 376929 - DNA, 25 bp, Mus musculus
ctctaggagaggtttgtctgcaaat

SEQ ID NO: 376930 - DNA, 25 bp, Mus musculus
ctctaggccgtaatgcatgtgctta

SEQ ID NO: 376931 - DNA, 25 bp, Mus musculus
ctctaggccgtattgcatgtgctta

SEQ ID NO: 376932 - DNA, 25 bp, Mus musculus
ctctaggctacccagcgtgttatgg

SEQ ID NO: 376933 - DNA, 25 bp, Mus musculus
ctctaggctaccgagcgtgttatgg

SEQ ID NO: 376934 - DNA, 25 bp, Mus musculus
ctctaggctatgagtgtaagtcaat

SEQ ID NO: 376935 - DNA, 25 bp, Mus musculus
ctctaggctatgtgtgtaagtcaat

SEQ ID NO: 376936 - DNA, 25 bp, Mus musculus
ctctaggctctccttgtgacaatag

SEQ ID NO: 376937 - DNA, 25 bp, Mus musculus
ctctaggctctcgttgtgacaatag

SEQ ID NO: 376938 - DNA, 25 bp, Mus musculus
ctctaggcttacccgcatgagctct

SEQ ID NO: 376939 - DNA, 25 bp, Mus musculus
ctctaggcttacgcgcatgagctct

SEQ ID NO: 376940 - DNA, 25 bp, Mus musculus
ctctagggcagtcaatctgggatct

SEQ ID NO: 376941 - DNA, 25 bp, Mus musculus
ctctagggcagtgaatctgggatct

SEQ ID NO: 376942 - DNA, 25 bp, Mus musculus
ctctagggccatcgattgaacatca

SEQ ID NO: 376943 - DNA, 25 bp, Mus musculus
ctctagggccatggattgaacatca

SEQ ID NO: 376944 - DNA, 25 bp, Mus musculus
ctctagggccctaatgatataatcc

SEQ ID NO: 376945 - DNA, 25 bp, Mus musculus
ctctagggcccttatgatataatcc

SEQ ID NO: 376946 - DNA, 25 bp, Mus musculus
ctctaggggcttctgacctgagtga

SEQ ID NO: 376947 - DNA, 25 bp, Mus musculus
ctctaggggcttgtgacctgagtga

SEQ ID NO: 376948 - DNA, 25 bp, Mus musculus
ctctaggttggtctcagccttgtga

SEQ ID NO: 376949 - DNA, 25 bp, Mus musculus
ctctaggttggtgtcagccttgtga

SEQ ID NO: 376950 - DNA, 25 bp, Mus musculus
ctctagtaagttcctggcacagcac

SEQ ID NO: 376951 - DNA, 25 bp, Mus musculus
ctctagtaagttgctggcacagcac

SEQ ID NO: 376952 - DNA, 25 bp, Mus musculus
ctctagtaccaaagtgttcctaaca

SEQ ID NO: 376953 - DNA, 25 bp, Mus musculus
ctctagtaccaatgtgttcctaaca

SEQ ID NO: 376954 - DNA, 25 bp, Mus musculus
ctctagtccgaaaattcccttttgg

SEQ ID NO: 376955 - DNA, 25 bp, Mus musculus
ctctagtccgaatattcccttttgg

SEQ ID NO: 376956 - DNA, 25 bp, Mus musculus
ctctagtccggccagcccgtggtgt

SEQ ID NO: 376957 - DNA, 25 bp, Mus musculus
ctctagtccggcgagcccgtggtgt

SEQ ID NO: 376958 - DNA, 25 bp, Mus musculus
ctctagtctgtgaaactgtgctact

SEQ ID NO: 376959 - DNA, 25 bp, Mus musculus
ctctagtctgtgtaactgtgctact

SEQ ID NO: 376960 - DNA, 25 bp, Mus musculus
ctctagtgccctatggactctgtgg

SEQ ID NO: 376961 - DNA, 25 bp, Mus musculus
ctctagtgccctttggactctgtgg

SEQ ID NO: 376962 - DNA, 25 bp, Mus musculus
ctctagtgggcaacgggacagagac

SEQ ID NO: 376963 - DNA, 25 bp, Mus musculus
ctctagtgggcatcgggacagagac

SEQ ID NO: 376964 - DNA, 25 bp, Mus musculus
ctctagtgtctaaatgccagtgtac

SEQ ID NO: 376965 - DNA, 25 bp, Mus musculus
ctctagtgtctatatgccagtgtac

SEQ ID NO: 376966 - DNA, 25 bp, Mus musculus
ctctagtttttgagaggtttgactt

SEQ ID NO: 376967 - DNA, 25 bp, Mus musculus
ctctagtttttgtgaggtttgactt

SEQ ID NO: 376968 - DNA, 25 bp, Mus musculus
ctctataaaatcctgtttgctttca

SEQ ID NO: 376969 - DNA, 25 bp, Mus musculus
ctctataaaatcgtgtttgctttca

SEQ ID NO: 376970 - DNA, 25 bp, Mus musculus
ctctataatcaacggcttcgttctt

SEQ ID NO: 376971 - DNA, 25 bp, Mus musculus
ctctataatcaagggcttcgttctt

SEQ ID NO: 376972 - DNA, 25 bp, Mus musculus
ctctataatttaactgctgtcgtaa

SEQ ID NO: 376973 - DNA, 25 bp, Mus musculus
ctctataatttatctgctgtcgtaa

SEQ ID NO: 376974 - DNA, 25 bp, Mus musculus
ctctatatttttcggcagctttccc

SEQ ID NO: 376975 - DNA, 25 bp, Mus musculus
ctctatatttttgggcagctttccc

SEQ ID NO: 376976 - DNA, 25 bp, Mus musculus
ctctatcaacggcaaggaagctgtt

SEQ ID NO: 376977 - DNA, 25 bp, Mus musculus
ctctatcaacgggaaggaagctgtt

SEQ ID NO: 376978 - DNA, 25 bp, Mus musculus
ctctatccttgccttagcaaagaat

SEQ ID NO: 376979 - DNA, 25 bp, Mus musculus
ctctatccttgcgttagcaaagaat

SEQ ID NO: 376980 - DNA, 25 bp, Mus musculus
ctctatctctgcacgtgtgtttggg

SEQ ID NO: 376981 - DNA, 25 bp, Mus musculus
ctctatctctgctcgtgtgtttggg

SEQ ID NO: 376982 - DNA, 25 bp, Mus musculus
ctctatctctgtcttaacttgtact

SEQ ID NO: 376983 - DNA, 25 bp, Mus musculus
ctctatctctgtgttaacttgtact

SEQ ID NO: 376984 - DNA, 25 bp, Mus musculus
ctctatctgatgagtcttactgctg

SEQ ID NO: 376985 - DNA, 25 bp, Mus musculus
ctctatctgatgtgtcttactgctg

SEQ ID NO: 376986 - DNA, 25 bp, Mus musculus
ctctatgagaggacacggccgtgga

SEQ ID NO: 376987 - DNA, 25 bp, Mus musculus
ctctatgagaggtcacggccgtgga

SEQ ID NO: 376988 - DNA, 25 bp, Mus musculus
ctctatgaggaaaaaagtcacgtgt

SEQ ID NO: 376989 - DNA, 25 bp, Mus musculus
ctctatgaggaataaagtcacgtgt

SEQ ID NO: 376990 - DNA, 25 bp, Mus musculus
ctctatgagtttctcgacagttttc

SEQ ID NO: 376991 - DNA, 25 bp, Mus musculus
ctctatgagtttgtcgacagttttc

SEQ ID NO: 376992 - DNA, 25 bp, Mus musculus
ctctatgcagcccacagatgtgttt

SEQ ID NO: 376993 - DNA, 25 bp, Mus musculus
ctctatgcagccgacagatgtgttt

SEQ ID NO: 376994 - DNA, 25 bp, Mus musculus
ctctatgccctaaattcgaaattga

SEQ ID NO: 376995 - DNA, 25 bp, Mus musculus
ctctatgccctatattcgaaattga

SEQ ID NO: 376996 - DNA, 25 bp, Mus musculus
ctctatgccctgactgtgagcttta

SEQ ID NO: 376997 - DNA, 25 bp, Mus musculus
ctctatgccctgtctgtgagcttta

SEQ ID NO: 376998 - DNA, 25 bp, Mus musculus
ctctatgccgtgagctgtggtttaa

SEQ ID NO: 376999 - DNA, 25 bp, Mus musculus
ctctatgccgtgtgctgtggtttaa

SEQ ID NO: 377000 - DNA, 25 bp, Mus musculus
ctctatgcctagcagaaattctgtg

SEQ ID NO: 377001 - DNA, 25 bp, Mus musculus
ctctatgcctaggagaaattctgtg

SEQ ID NO: 377002 - DNA, 25 bp, Mus musculus
ctctatgcctctcttggagcaaatg

SEQ ID NO: 377003 - DNA, 25 bp, Mus musculus
ctctatgcctctgttggagcaaatg

SEQ ID NO: 377004 - DNA, 25 bp, Mus musculus
ctctatgggatcaactaccggtgtc

SEQ ID NO: 377005 - DNA, 25 bp, Mus musculus
ctctatgggatctactaccggtgtc

SEQ ID NO: 377006 - DNA, 25 bp, Mus musculus
ctctatgtactcaggtgtgtgagaa

SEQ ID NO: 377007 - DNA, 25 bp, Mus musculus
ctctatgtactctggtgtgtgagaa

SEQ ID NO: 377008 - DNA, 25 bp, Mus musculus
ctctatgtcaaacgctcccgcaaaa

SEQ ID NO: 377009 - DNA, 25 bp, Mus musculus
ctctatgtcaaaggctcccgcaaaa

SEQ ID NO: 377010 - DNA, 25 bp, Mus musculus
ctctatgtctgtctgttccaattgt

SEQ ID NO: 377011 - DNA, 25 bp, Mus musculus
ctctatgtctgtgtgttccaattgt

SEQ ID NO: 377012 - DNA, 25 bp, Mus musculus
ctctattacgcaatgttccgaagtt

SEQ ID NO: 377013 - DNA, 25 bp, Mus musculus
ctctattacgcattgttccgaagtt

SEQ ID NO: 377014 - DNA, 25 bp, Mus musculus
ctctattacttacccacatgcctag

SEQ ID NO: 377015 - DNA, 25 bp, Mus musculus
ctctattacttagccacatgcctag

SEQ ID NO: 377016 - DNA, 25 bp, Mus musculus
ctctattcagagcttatccggagac

SEQ ID NO: 377017 - DNA, 25 bp, Mus musculus
ctctattcagaggttatccggagac

SEQ ID NO: 377018 - DNA, 25 bp, Mus musculus
ctctattcagccatttcttacatgg

SEQ ID NO: 377019 - DNA, 25 bp, Mus musculus
ctctattcagccttttcttacatgg

SEQ ID NO: 377020 - DNA, 25 bp, Mus musculus
ctctattccataatacaagctccac

SEQ ID NO: 377021 - DNA, 25 bp, Mus musculus
ctctattccatattacaagctccac

SEQ ID NO: 377022 - DNA, 25 bp, Mus musculus
ctctattcctacacagcagtcagaa

SEQ ID NO: 377023 - DNA, 25 bp, Mus musculus
ctctattcctactcagcagtcagaa

SEQ ID NO: 377024 - DNA, 25 bp, Mus musculus
ctctattccttgatcgccgattaca

SEQ ID NO: 377025 - DNA, 25 bp, Mus musculus
ctctattccttgttcgccgattaca

SEQ ID NO: 377026 - DNA, 25 bp, Mus musculus
ctctattctaggcaggaatttccat

SEQ ID NO: 377027 - DNA, 25 bp, Mus musculus
ctctattctagggaggaatttccat

SEQ ID NO: 377028 - DNA, 25 bp, Mus musculus
ctctattctcacagttaatgtttgt

SEQ ID NO: 377029 - DNA, 25 bp, Mus musculus
ctctattctcactgttaatgtttgt

SEQ ID NO: 377030 - DNA, 25 bp, Mus musculus
ctctattctcttagtaaatacaggt

SEQ ID NO: 377031 - DNA, 25 bp, Mus musculus
ctctattctctttgtaaatacaggt

SEQ ID NO: 377032 - DNA, 25 bp, Mus musculus
ctctattctgccagtaacccagtat

SEQ ID NO: 377033 - DNA, 25 bp, Mus musculus
ctctattctgcctgtaacccagtat

SEQ ID NO: 377034 - DNA, 25 bp, Mus musculus
ctctattctttcatcatgccagctg

SEQ ID NO: 377035 - DNA, 25 bp, Mus musculus
ctctattctttcttcatgccagctg

SEQ ID NO: 377036 - DNA, 25 bp, Mus musculus
ctctattgttctcctactgggctgc

SEQ ID NO: 377037 - DNA, 25 bp, Mus musculus
ctctattgttctgctactgggctgc

SEQ ID NO: 377038 - DNA, 25 bp, Mus musculus
ctctatttccatccccaaatgcaaa

SEQ ID NO: 377039 - DNA, 25 bp, Mus musculus
ctctatttccatgcccaaatgcaaa

SEQ ID NO: 377040 - DNA, 25 bp, Mus musculus
ctctatttgctcagggactacccct

SEQ ID NO: 377041 - DNA, 25 bp, Mus musculus
ctctatttgctctgggactacccct

SEQ ID NO: 377042 - DNA, 25 bp, Mus musculus
ctctatttggttcgagatctctctc

SEQ ID NO: 377043 - DNA, 25 bp, Mus musculus
ctctatttggttggagatctctctc

SEQ ID NO: 377044 - DNA, 25 bp, Mus musculus
ctctatttttttctcagtgcatccc

SEQ ID NO: 377045 - DNA, 25 bp, Mus musculus
ctctatttttttgtcagtgcatccc

SEQ ID NO: 377046 - DNA, 25 bp, Mus musculus
ctctcaaacaccatctcatgacagt

SEQ ID NO: 377047 - DNA, 25 bp, Mus musculus
ctctcaaacaccttctcatgacagt

SEQ ID NO: 377048 - DNA, 25 bp, Mus musculus
ctctcaaacagaccagatgtgggaa

SEQ ID NO: 377049 - DNA, 25 bp, Mus musculus
ctctcaaacagagcagatgtgggaa

SEQ ID NO: 377050 - DNA, 25 bp, Mus musculus
ctctcaaagttgaccaagtgtgtgt

SEQ ID NO: 377051 - DNA, 25 bp, Mus musculus
ctctcaaagttgtccaagtgtgtgt

SEQ ID NO: 377052 - DNA, 25 bp, Mus musculus
ctctcaaattcaccccggaggaata

SEQ ID NO: 377053 - DNA, 25 bp, Mus musculus
ctctcaaattcagcccggaggaata

SEQ ID NO: 377054 - DNA, 25 bp, Mus musculus
ctctcaacacgcatgtctctagaaa

SEQ ID NO: 377055 - DNA, 25 bp, Mus musculus
ctctcaacacgcttgtctctagaaa

SEQ ID NO: 377056 - DNA, 25 bp, Mus musculus
ctctcaacatcccaggtgcagatga

SEQ ID NO: 377057 - DNA, 25 bp, Mus musculus
ctctcaacatccgaggtgcagatga

SEQ ID NO: 377058 - DNA, 25 bp, Mus musculus
ctctcaaccaaactcatcttatcag

SEQ ID NO: 377059 - DNA, 25 bp, Mus musculus
ctctcaaccaaagtcatcttatcag

SEQ ID NO: 377060 - DNA, 25 bp, Mus musculus
ctctcaaccccgagtaactaaatca

SEQ ID NO: 377061 - DNA, 25 bp, Mus musculus
ctctcaaccccgtgtaactaaatca

SEQ ID NO: 377062 - DNA, 25 bp, Mus musculus
ctctcaacttgtacccacattgtta

SEQ ID NO: 377063 - DNA, 25 bp, Mus musculus
ctctcaacttgttcccacattgtta

SEQ ID NO: 377064 - DNA, 25 bp, Mus musculus
ctctcaactttaagcctactttctt

SEQ ID NO: 377065 - DNA, 25 bp, Mus musculus
ctctcaactttatgcctactttctt

SEQ ID NO: 377066 - DNA, 25 bp, Mus musculus
ctctcaagacccagatttgaccctg

SEQ ID NO: 377067 - DNA, 25 bp, Mus musculus
ctctcaagaccctgatttgaccctg

SEQ ID NO: 377068 - DNA, 25 bp, Mus musculus
ctctcaaggagtacccgctgtaggg

SEQ ID NO: 377069 - DNA, 25 bp, Mus musculus
ctctcaaggagttcccgctgtaggg

SEQ ID NO: 377070 - DNA, 25 bp, Mus musculus
ctctcaagggctatgcgttcgtagc

SEQ ID NO: 377071 - DNA, 25 bp, Mus musculus
ctctcaagggctttgcgttcgtagc

SEQ ID NO: 377072 - DNA, 25 bp, Mus musculus
ctctcaagtgagaattgtttgtggt

SEQ ID NO: 377073 - DNA, 25 bp, Mus musculus
ctctcaagtgagtattgtttgtggt

SEQ ID NO: 377074 - DNA, 25 bp, Mus musculus
ctctcaagtggcatcctgtagtgga

SEQ ID NO: 377075 - DNA, 25 bp, Mus musculus
ctctcaagtggcttcctgtagtgga

SEQ ID NO: 377076 - DNA, 25 bp, Mus musculus
ctctcaagttggcagcccagcctga

SEQ ID NO: 377077 - DNA, 25 bp, Mus musculus
ctctcaagttgggagcccagcctga

SEQ ID NO: 377078 - DNA, 25 bp, Mus musculus
ctctcaatagacctcgtccaggaaa

SEQ ID NO: 377079 - DNA, 25 bp, Mus musculus
ctctcaatagacgtcgtccaggaaa

SEQ ID NO: 377080 - DNA, 25 bp, Mus musculus
ctctcaatgccaccttcgttaggat

SEQ ID NO: 377081 - DNA, 25 bp, Mus musculus
ctctcaatgccagcttcgttaggat

SEQ ID NO: 377082 - DNA, 25 bp, Mus musculus
ctctcaattcaaagtgcccatgctc

SEQ ID NO: 377083 - DNA, 25 bp, Mus musculus
ctctcaattcaatgtgcccatgctc

SEQ ID NO: 377084 - DNA, 25 bp, Mus musculus
ctctcacaattgacgggaaaacagc

SEQ ID NO: 377085 - DNA, 25 bp, Mus musculus
ctctcacaattgtcgggaaaacagc

SEQ ID NO: 377086 - DNA, 25 bp, Mus musculus
ctctcacacacaccgtcataaaaag

SEQ ID NO: 377087 - DNA, 25 bp, Mus musculus
ctctcacacacagcgtcataaaaag

SEQ ID NO: 377088 - DNA, 25 bp, Mus musculus
ctctcacacacgcttaaacgctttt

SEQ ID NO: 377089 - DNA, 25 bp, Mus musculus
ctctcacacacggttaaacgctttt

SEQ ID NO: 377090 - DNA, 25 bp, Mus musculus
ctctcacacgtcatcactactatgt

SEQ ID NO: 377091 - DNA, 25 bp, Mus musculus
ctctcacacgtcttcactactatgt

SEQ ID NO: 377092 - DNA, 25 bp, Mus musculus
ctctcacatagtccttggattctgt

SEQ ID NO: 377093 - DNA, 25 bp, Mus musculus
ctctcacatagtgcttggattctgt

SEQ ID NO: 377094 - DNA, 25 bp, Mus musculus
ctctcacccgaactgcgacagattt

SEQ ID NO: 377095 - DNA, 25 bp, Mus musculus
ctctcacccgaagtgcgacagattt

SEQ ID NO: 377096 - DNA, 25 bp, Mus musculus
ctctcaccctaactcaggcagaatg

SEQ ID NO: 377097 - DNA, 25 bp, Mus musculus
ctctcaccctaagtcaggcagaatg

SEQ ID NO: 377098 - DNA, 25 bp, Mus musculus
ctctcacctgctctcaaagaaaact

SEQ ID NO: 377099 - DNA, 25 bp, Mus musculus
ctctcacctgctgtcaaagaaaact

SEQ ID NO: 377100 - DNA, 25 bp, Mus musculus
ctctcacctgggagtctcaagtcaa

SEQ ID NO: 377101 - DNA, 25 bp, Mus musculus
ctctcacctgggtgtctcaagtcaa

SEQ ID NO: 377102 - DNA, 25 bp, Mus musculus
ctctcacgcgtgattgccaagctgg

SEQ ID NO: 377103 - DNA, 25 bp, Mus musculus
ctctcacgcgtgtttgccaagctgg

SEQ ID NO: 377104 - DNA, 25 bp, Mus musculus
ctctcacggcgcaacagtgaaagga

SEQ ID NO: 377105 - DNA, 25 bp, Mus musculus
ctctcacggcgctacagtgaaagga

SEQ ID NO: 377106 - DNA, 25 bp, Mus musculus
ctctcacgtgtgctttgcattttag

SEQ ID NO: 377107 - DNA, 25 bp, Mus musculus
ctctcacgtgtggtttgcattttag

SEQ ID NO: 377108 - DNA, 25 bp, Mus musculus
ctctcacgttaccgctgattctcta

SEQ ID NO: 377109 - DNA, 25 bp, Mus musculus
ctctcacgttacggctgattctcta

SEQ ID NO: 377110 - DNA, 25 bp, Mus musculus
ctctcactatttctctagttccttg

SEQ ID NO: 377111 - DNA, 25 bp, Mus musculus
ctctcactatttgtctagttccttg

SEQ ID NO: 377112 - DNA, 25 bp, Mus musculus
ctctcactctccacgtttctaaatg

SEQ ID NO: 377113 - DNA, 25 bp, Mus musculus
ctctcactctcctcgtttctaaatg

SEQ ID NO: 377114 - DNA, 25 bp, Mus musculus
ctctcactttataccatttcctatt

SEQ ID NO: 377115 - DNA, 25 bp, Mus musculus
ctctcactttattccatttcctatt

SEQ ID NO: 377116 - DNA, 25 bp, Mus musculus
ctctcagaagccaagggcaggccaa

SEQ ID NO: 377117 - DNA, 25 bp, Mus musculus
ctctcagaagcctagggcaggccaa

SEQ ID NO: 377118 - DNA, 25 bp, Mus musculus
ctctcagaccaaccggtggcggcgt

SEQ ID NO: 377119 - DNA, 25 bp, Mus musculus
ctctcagaccaagcggtggcggcgt

SEQ ID NO: 377120 - DNA, 25 bp, Mus musculus
ctctcagaccatcatttccttgtag

SEQ ID NO: 377121 - DNA, 25 bp, Mus musculus
ctctcagaccatgatttccttgtag

SEQ ID NO: 377122 - DNA, 25 bp, Mus musculus
ctctcagagcgaccagactttgccc

SEQ ID NO: 377123 - DNA, 25 bp, Mus musculus
ctctcagagcgagcagactttgccc

SEQ ID NO: 377124 - DNA, 25 bp, Mus musculus
ctctcagaggcacgtcacatggttt

SEQ ID NO: 377125 - DNA, 25 bp, Mus musculus
ctctcagaggcaggtcacatggttt

SEQ ID NO: 377126 - DNA, 25 bp, Mus musculus
ctctcagagtacattgtcctgggaa

SEQ ID NO: 377127 - DNA, 25 bp, Mus musculus
ctctcagagtactttgtcctgggaa

SEQ ID NO: 377128 - DNA, 25 bp, Mus musculus
ctctcagagtcacagtgtctttttt

SEQ ID NO: 377129 - DNA, 25 bp, Mus musculus
ctctcagagtcagagtgtctttttt

SEQ ID NO: 377130 - DNA, 25 bp, Mus musculus
ctctcagatattcagggtccaggga

SEQ ID NO: 377131 - DNA, 25 bp, Mus musculus
ctctcagatattgagggtccaggga

SEQ ID NO: 377132 - DNA, 25 bp, Mus musculus
ctctcagatttgagaatcactcagt

SEQ ID NO: 377133 - DNA, 25 bp, Mus musculus
ctctcagatttgtgaatcactcagt

SEQ ID NO: 377134 - DNA, 25 bp, Mus musculus
ctctcagcacatacccatgagtatg

SEQ ID NO: 377135 - DNA, 25 bp, Mus musculus
ctctcagcacattcccatgagtatg

SEQ ID NO: 377136 - DNA, 25 bp, Mus musculus
ctctcagctcaacttcaatggtcta

SEQ ID NO: 377137 - DNA, 25 bp, Mus musculus
ctctcagctcaagttcaatggtcta

SEQ ID NO: 377138 - DNA, 25 bp, Mus musculus
ctctcagctctgatgattgcgaaat

SEQ ID NO: 377139 - DNA, 25 bp, Mus musculus
ctctcagctctgttgattgcgaaat

SEQ ID NO: 377140 - DNA, 25 bp, Mus musculus
ctctcaggaaccattgctttttgtc

SEQ ID NO: 377141 - DNA, 25 bp, Mus musculus
ctctcaggaacctttgctttttgtc

SEQ ID NO: 377142 - DNA, 25 bp, Mus musculus
ctctcaggaacgcttggaacactat

SEQ ID NO: 377143 - DNA, 25 bp, Mus musculus
ctctcaggaacggttggaacactat

SEQ ID NO: 377144 - DNA, 25 bp, Mus musculus
ctctcaggagtcagacagcgccgat

SEQ ID NO: 377145 - DNA, 25 bp, Mus musculus
ctctcaggagtctgacagcgccgat

SEQ ID NO: 377146 - DNA, 25 bp, Mus musculus
ctctcaggatgcctctctcaggatg

SEQ ID NO: 377147 - DNA, 25 bp, Mus musculus
ctctcaggatgcgtctctcaggatg

SEQ ID NO: 377148 - DNA, 25 bp, Mus musculus
ctctcagggagacagacaaccttct

SEQ ID NO: 377149 - DNA, 25 bp, Mus musculus
ctctcagggagagagacaaccttct

SEQ ID NO: 377150 - DNA, 25 bp, Mus musculus
ctctcaggtcctagacgagtccaac

SEQ ID NO: 377151 - DNA, 25 bp, Mus musculus
ctctcaggtccttgacgagtccaac

SEQ ID NO: 377152 - DNA, 25 bp, Mus musculus
ctctcaggtgccctgaatgctgata

SEQ ID NO: 377153 - DNA, 25 bp, Mus musculus
ctctcaggtgccgtgaatgctgata

SEQ ID NO: 377154 - DNA, 25 bp, Mus musculus
ctctcaggttggcttcaaatactgc

SEQ ID NO: 377155 - DNA, 25 bp, Mus musculus
ctctcaggttgggttcaaatactgc

SEQ ID NO: 377156 - DNA, 25 bp, Mus musculus
ctctcagtaagaaccttcccattgg

SEQ ID NO: 377157 - DNA, 25 bp, Mus musculus
ctctcagtaagatccttcccattgg

SEQ ID NO: 377158 - DNA, 25 bp, Mus musculus
ctctcagtagtgcttgcttttgcgt

SEQ ID NO: 377159 - DNA, 25 bp, Mus musculus
ctctcagtagtggttgcttttgcgt

SEQ ID NO: 377160 - DNA, 25 bp, Mus musculus
ctctcagtcatactcttcagtgttt

SEQ ID NO: 377161 - DNA, 25 bp, Mus musculus
ctctcagtcatagtcttcagtgttt

SEQ ID NO: 377162 - DNA, 25 bp, Mus musculus
ctctcagtgctgctaaaggtcgtgc

SEQ ID NO: 377163 - DNA, 25 bp, Mus musculus
ctctcagtgctggtaaaggtcgtgc

SEQ ID NO: 377164 - DNA, 25 bp, Mus musculus
ctctcagtgtccatgtgcatcaact

SEQ ID NO: 377165 - DNA, 25 bp, Mus musculus
ctctcagtgtccttgtgcatcaact

SEQ ID NO: 377166 - DNA, 25 bp, Mus musculus
ctctcagttggcagcggcttagaga

SEQ ID NO: 377167 - DNA, 25 bp, Mus musculus
ctctcagttggctgcggcttagaga

SEQ ID NO: 377168 - DNA, 25 bp, Mus musculus
ctctcagtttcacccaataacacta

SEQ ID NO: 377169 - DNA, 25 bp, Mus musculus
ctctcagtttcagccaataacacta

SEQ ID NO: 377170 - DNA, 25 bp, Mus musculus
ctctcagtttctcctacagtgatga

SEQ ID NO: 377171 - DNA, 25 bp, Mus musculus
ctctcagtttctgctacagtgatga

SEQ ID NO: 377172 - DNA, 25 bp, Mus musculus
ctctcatactatagcagggcagagg

SEQ ID NO: 377173 - DNA, 25 bp, Mus musculus
ctctcatactattgcagggcagagg

SEQ ID NO: 377174 - DNA, 25 bp, Mus musculus
ctctcatatgccacctattgtattg

SEQ ID NO: 377175 - DNA, 25 bp, Mus musculus
ctctcatatgcctcctattgtattg

SEQ ID NO: 377176 - DNA, 25 bp, Mus musculus
ctctcatcaagactccttcggaaaa

SEQ ID NO: 377177 - DNA, 25 bp, Mus musculus
ctctcatcaagagtccttcggaaaa

SEQ ID NO: 377178 - DNA, 25 bp, Mus musculus
ctctcatcagctacagtgtctgctg

SEQ ID NO: 377179 - DNA, 25 bp, Mus musculus
ctctcatcagcttcagtgtctgctg

SEQ ID NO: 377180 - DNA, 25 bp, Mus musculus
ctctcatcaggaaacaagcaggcat

SEQ ID NO: 377181 - DNA, 25 bp, Mus musculus
ctctcatcaggatacaagcaggcat

SEQ ID NO: 377182 - DNA, 25 bp, Mus musculus
ctctcatccatcactgtaaacgtta

SEQ ID NO: 377183 - DNA, 25 bp, Mus musculus
ctctcatccatctctgtaaacgtta

SEQ ID NO: 377184 - DNA, 25 bp, Mus musculus
ctctcatccgttctgcttactaaca

SEQ ID NO: 377185 - DNA, 25 bp, Mus musculus
ctctcatccgttgtgcttactaaca

SEQ ID NO: 377186 - DNA, 25 bp, Mus musculus
ctctcatctcagaaattccatccag

SEQ ID NO: 377187 - DNA, 25 bp, Mus musculus
ctctcatctcagtaattccatccag

SEQ ID NO: 377188 - DNA, 25 bp, Mus musculus
ctctcatctctaactctctcgggaa

SEQ ID NO: 377189 - DNA, 25 bp, Mus musculus
ctctcatctctatctctctcgggaa

SEQ ID NO: 377190 - DNA, 25 bp, Mus musculus
ctctcatctgatagtccaccagaga

SEQ ID NO: 377191 - DNA, 25 bp, Mus musculus
ctctcatctgattgtccaccagaga

SEQ ID NO: 377192 - DNA, 25 bp, Mus musculus
ctctcatgagaacacagacctgaca

SEQ ID NO: 377193 - DNA, 25 bp, Mus musculus
ctctcatgagaagacagacctgaca

SEQ ID NO: 377194 - DNA, 25 bp, Mus musculus
ctctcatgagacacagggcaaggct

SEQ ID NO: 377195 - DNA, 25 bp, Mus musculus
ctctcatgagactcagggcaaggct

SEQ ID NO: 377196 - DNA, 25 bp, Mus musculus
ctctcatgccctcctttttatatga

SEQ ID NO: 377197 - DNA, 25 bp, Mus musculus
ctctcatgccctgctttttatatga

SEQ ID NO: 377198 - DNA, 25 bp, Mus musculus
ctctcatggattcaacagggtcccc

SEQ ID NO: 377199 - DNA, 25 bp, Mus musculus
ctctcatggattgaacagggtcccc

SEQ ID NO: 377200 - DNA, 25 bp, Mus musculus
ctctcatggcccagtttagtgtgga

SEQ ID NO: 377201 - DNA, 25 bp, Mus musculus
ctctcatggccctgtttagtgtgga

SEQ ID NO: 377202 - DNA, 25 bp, Mus musculus
ctctcatggtcgctgtcttaaataa

SEQ ID NO: 377203 - DNA, 25 bp, Mus musculus
ctctcatggtcggtgtcttaaataa

SEQ ID NO: 377204 - DNA, 25 bp, Mus musculus
ctctcatgtggtccaataagcaata

SEQ ID NO: 377205 - DNA, 25 bp, Mus musculus
ctctcatgtggtgcaataagcaata

SEQ ID NO: 377206 - DNA, 25 bp, Mus musculus
ctctcatgtgtgaatcccacaaggg

SEQ ID NO: 377207 - DNA, 25 bp, Mus musculus
ctctcatgtgtgtatcccacaaggg

SEQ ID NO: 377208 - DNA, 25 bp, Mus musculus
ctctcatgttccctaaatctctgaa

SEQ ID NO: 377209 - DNA, 25 bp, Mus musculus
ctctcatgttccgtaaatctctgaa

SEQ ID NO: 377210 - DNA, 25 bp, Mus musculus
ctctcattaccaaggcacggaggct

SEQ ID NO: 377211 - DNA, 25 bp, Mus musculus
ctctcattaccatggcacggaggct

SEQ ID NO: 377212 - DNA, 25 bp, Mus musculus
ctctcattatctacttgtctggtga

SEQ ID NO: 377213 - DNA, 25 bp, Mus musculus
ctctcattatcttcttgtctggtga

SEQ ID NO: 377214 - DNA, 25 bp, Mus musculus
ctctcattatttacgcccatttcaa

SEQ ID NO: 377215 - DNA, 25 bp, Mus musculus
ctctcattattttcgcccatttcaa

SEQ ID NO: 377216 - DNA, 25 bp, Mus musculus
ctctcatttcaaaggcacttatggc

SEQ ID NO: 377217 - DNA, 25 bp, Mus musculus
ctctcatttcaatggcacttatggc

SEQ ID NO: 377218 - DNA, 25 bp, Mus musculus
ctctcattttagctttctacctatc

SEQ ID NO: 377219 - DNA, 25 bp, Mus musculus
ctctcattttaggtttctacctatc

SEQ ID NO: 377220 - DNA, 25 bp, Mus musculus
ctctcattttcacggcaggcagcag

SEQ ID NO: 377221 - DNA, 25 bp, Mus musculus
ctctcattttcagggcaggcagcag

SEQ ID NO: 377222 - DNA, 25 bp, Mus musculus
ctctccaaagaaacattttccttgt

SEQ ID NO: 377223 - DNA, 25 bp, Mus musculus
ctctccaaagaatcattttccttgt

SEQ ID NO: 377224 - DNA, 25 bp, Mus musculus
ctctccaaccctcattacaaaaatg

SEQ ID NO: 377225 - DNA, 25 bp, Mus musculus
ctctccaaccctgattacaaaaatg

SEQ ID NO: 377226 - DNA, 25 bp, Mus musculus
ctctccaaccgcattatttttaatg

SEQ ID NO: 377227 - DNA, 25 bp, Mus musculus
ctctccaaccgctttatttttaatg

SEQ ID NO: 377228 - DNA, 25 bp, Mus musculus
ctctccaactgtaagctttctacat

SEQ ID NO: 377229 - DNA, 25 bp, Mus musculus
ctctccaactgttagctttctacat

SEQ ID NO: 377230 - DNA, 25 bp, Mus musculus
ctctccaagcagaagtagacctcct

SEQ ID NO: 377231 - DNA, 25 bp, Mus musculus
ctctccaagcagtagtagacctcct

SEQ ID NO: 377232 - DNA, 25 bp, Mus musculus
ctctccaagctcaccaaagaggatg

SEQ ID NO: 377233 - DNA, 25 bp, Mus musculus
ctctccaagctctccaaagaggatg

SEQ ID NO: 377234 - DNA, 25 bp, Mus musculus
ctctccacccttcagtatttatgct

SEQ ID NO: 377235 - DNA, 25 bp, Mus musculus
ctctccacccttgagtatttatgct

SEQ ID NO: 377236 - DNA, 25 bp, Mus musculus
ctctccacgtagagttctgtgttta

SEQ ID NO: 377237 - DNA, 25 bp, Mus musculus
ctctccacgtagtgttctgtgttta

SEQ ID NO: 377238 - DNA, 25 bp, Mus musculus
ctctccacttctcgtcagagatggt

SEQ ID NO: 377239 - DNA, 25 bp, Mus musculus
ctctccacttctggtcagagatggt

SEQ ID NO: 377240 - DNA, 25 bp, Mus musculus
ctctccagaccaattctaagcgtat

SEQ ID NO: 377241 - DNA, 25 bp, Mus musculus
ctctccagaccatttctaagcgtat

SEQ ID NO: 377242 - DNA, 25 bp, Mus musculus
ctctccagacccacttaagaaaagt

SEQ ID NO: 377243 - DNA, 25 bp, Mus musculus
ctctccagaccctcttaagaaaagt

SEQ ID NO: 377244 - DNA, 25 bp, Mus musculus
ctctccagagacagttgtgaccttc

SEQ ID NO: 377245 - DNA, 25 bp, Mus musculus
ctctccagagactgttgtgaccttc

SEQ ID NO: 377246 - DNA, 25 bp, Mus musculus
ctctccagagatcatcgtcagtgac

SEQ ID NO: 377247 - DNA, 25 bp, Mus musculus
ctctccagagatgatcgtcagtgac

SEQ ID NO: 377248 - DNA, 25 bp, Mus musculus
ctctccagcaagattctgggtagca

SEQ ID NO: 377249 - DNA, 25 bp, Mus musculus
ctctccagcaagtttctgggtagca

SEQ ID NO: 377250 - DNA, 25 bp, Mus musculus
ctctccagcaccatcattttcaatt

SEQ ID NO: 377251 - DNA, 25 bp, Mus musculus
ctctccagcaccttcattttcaatt

SEQ ID NO: 377252 - DNA, 25 bp, Mus musculus
ctctccagccaccagaattatgttt

SEQ ID NO: 377253 - DNA, 25 bp, Mus musculus
ctctccagccacgagaattatgttt

SEQ ID NO: 377254 - DNA, 25 bp, Mus musculus
ctctccagcccaagacagattattt

SEQ ID NO: 377255 - DNA, 25 bp, Mus musculus
ctctccagcccatgacagattattt

SEQ ID NO: 377256 - DNA, 25 bp, Mus musculus
ctctccagcctcataatgaagaaca

SEQ ID NO: 377257 - DNA, 25 bp, Mus musculus
ctctccagcctcttaatgaagaaca

SEQ ID NO: 377258 - DNA, 25 bp, Mus musculus
ctctccagccttcttgaataacttt

SEQ ID NO: 377259 - DNA, 25 bp, Mus musculus
ctctccagccttgttgaataacttt

SEQ ID NO: 377260 - DNA, 25 bp, Mus musculus
ctctccagctccataatcattattt

SEQ ID NO: 377261 - DNA, 25 bp, Mus musculus
ctctccagctccttaatcattattt

SEQ ID NO: 377262 - DNA, 25 bp, Mus musculus
ctctccagctgtcagttttgttggg

SEQ ID NO: 377263 - DNA, 25 bp, Mus musculus
ctctccagctgtgagttttgttggg

SEQ ID NO: 377264 - DNA, 25 bp, Mus musculus
ctctccagtacacacaagtcagggt

SEQ ID NO: 377265 - DNA, 25 bp, Mus musculus
ctctccagtacagacaagtcagggt

SEQ ID NO: 377266 - DNA, 25 bp, Mus musculus
ctctccagtgagacttaaaagtaaa

SEQ ID NO: 377267 - DNA, 25 bp, Mus musculus
ctctccagtgagtcttaaaagtaaa

SEQ ID NO: 377268 - DNA, 25 bp, Mus musculus
ctctccagtgctcaaggttagcctg

SEQ ID NO: 377269 - DNA, 25 bp, Mus musculus
ctctccagtgctgaaggttagcctg

SEQ ID NO: 377270 - DNA, 25 bp, Mus musculus
ctctccatatatccctgggctggag

SEQ ID NO: 377271 - DNA, 25 bp, Mus musculus
ctctccatatatgcctgggctggag

SEQ ID NO: 377272 - DNA, 25 bp, Mus musculus
ctctccatatgcagccatgttggct

SEQ ID NO: 377273 - DNA, 25 bp, Mus musculus
ctctccatatgctgccatgttggct

SEQ ID NO: 377274 - DNA, 25 bp, Mus musculus
ctctccatattcaatataatacttg

SEQ ID NO: 377275 - DNA, 25 bp, Mus musculus
ctctccatattctatataatacttg

SEQ ID NO: 377276 - DNA, 25 bp, Mus musculus
ctctccatcacccatactgtaaata

SEQ ID NO: 377277 - DNA, 25 bp, Mus musculus
ctctccatcaccgatactgtaaata

SEQ ID NO: 377278 - DNA, 25 bp, Mus musculus
ctctccatcctgctttgacaataga

SEQ ID NO: 377279 - DNA, 25 bp, Mus musculus
ctctccatcctggtttgacaataga

SEQ ID NO: 377280 - DNA, 25 bp, Mus musculus
ctctccatccttagctttagatgac

SEQ ID NO: 377281 - DNA, 25 bp, Mus musculus
ctctccatcctttgctttagatgac

SEQ ID NO: 377282 - DNA, 25 bp, Mus musculus
ctctccatctctcacacaaagtgta

SEQ ID NO: 377283 - DNA, 25 bp, Mus musculus
ctctccatctctgacacaaagtgta

SEQ ID NO: 377284 - DNA, 25 bp, Mus musculus
ctctccatgcccaggattggatgtg

SEQ ID NO: 377285 - DNA, 25 bp, Mus musculus
ctctccatgccctggattggatgtg

SEQ ID NO: 377286 - DNA, 25 bp, Mus musculus
ctctccatggtgctttttgaatcac

SEQ ID NO: 377287 - DNA, 25 bp, Mus musculus
ctctccatggtggtttttgaatcac

SEQ ID NO: 377288 - DNA, 25 bp, Mus musculus
ctctccatggttaccgtgggacaat

SEQ ID NO: 377289 - DNA, 25 bp, Mus musculus
ctctccatggtttccgtgggacaat

SEQ ID NO: 377290 - DNA, 25 bp, Mus musculus
ctctccatgtctatttacactctgt

SEQ ID NO: 377291 - DNA, 25 bp, Mus musculus
ctctccatgtctttttacactctgt

SEQ ID NO: 377292 - DNA, 25 bp, Mus musculus
ctctcccaaaggaccagaacctggt

SEQ ID NO: 377293 - DNA, 25 bp, Mus musculus
ctctcccaaaggtccagaacctggt

SEQ ID NO: 377294 - DNA, 25 bp, Mus musculus
ctctcccaagagaaaggccatattc

SEQ ID NO: 377295 - DNA, 25 bp, Mus musculus
ctctcccaagagtaaggccatattc

SEQ ID NO: 377296 - DNA, 25 bp, Mus musculus
ctctcccaagtcaaccattgttttt

SEQ ID NO: 377297 - DNA, 25 bp, Mus musculus
ctctcccaagtctaccattgttttt

SEQ ID NO: 377298 - DNA, 25 bp, Mus musculus
ctctcccacgtgctatagctagtga

SEQ ID NO: 377299 - DNA, 25 bp, Mus musculus
ctctcccacgtggtatagctagtga

SEQ ID NO: 377300 - DNA, 25 bp, Mus musculus
ctctcccagcgaaggttttaggatc

SEQ ID NO: 377301 - DNA, 25 bp, Mus musculus
ctctcccagcgatggttttaggatc

SEQ ID NO: 377302 - DNA, 25 bp, Mus musculus
ctctcccaggctctagctacagagg

SEQ ID NO: 377303 - DNA, 25 bp, Mus musculus
ctctcccaggctgtagctacagagg

SEQ ID NO: 377304 - DNA, 25 bp, Mus musculus
ctctcccatttcactctgaggctgg

SEQ ID NO: 377305 - DNA, 25 bp, Mus musculus
ctctcccatttctctctgaggctgg

SEQ ID NO: 377306 - DNA, 25 bp, Mus musculus
ctctccccactcactgaaattttaa

SEQ ID NO: 377307 - DNA, 25 bp, Mus musculus
ctctccccactctctgaaattttaa

SEQ ID NO: 377308 - DNA, 25 bp, Mus musculus
ctctcccctagcatgggttgaagga

SEQ ID NO: 377309 - DNA, 25 bp, Mus musculus
ctctcccctagcttgggttgaagga

SEQ ID NO: 377310 - DNA, 25 bp, Mus musculus
ctctcccctctaaaagttgctgaaa

SEQ ID NO: 377311 - DNA, 25 bp, Mus musculus
ctctcccctctataagttgctgaaa

SEQ ID NO: 377312 - DNA, 25 bp, Mus musculus
ctctccccttccatctaaaatgaaa

SEQ ID NO: 377313 - DNA, 25 bp, Mus musculus
ctctccccttccttctaaaatgaaa

SEQ ID NO: 377314 - DNA, 25 bp, Mus musculus
ctctccctactgaaacagttttgtt

SEQ ID NO: 377315 - DNA, 25 bp, Mus musculus
ctctccctactgtaacagttttgtt

SEQ ID NO: 377316 - DNA, 25 bp, Mus musculus
ctctccctatggatacgactgtgta

SEQ ID NO: 377317 - DNA, 25 bp, Mus musculus
ctctccctatggttacgactgtgta

SEQ ID NO: 377318 - DNA, 25 bp, Mus musculus
ctctccctcagaatcatcttgatta

SEQ ID NO: 377319 - DNA, 25 bp, Mus musculus
ctctccctcagattcatcttgatta

SEQ ID NO: 377320 - DNA, 25 bp, Mus musculus
ctctccctctcaatactctttggag

SEQ ID NO: 377321 - DNA, 25 bp, Mus musculus
ctctccctctcattactctttggag

SEQ ID NO: 377322 - DNA, 25 bp, Mus musculus
ctctccctcttaagtagacacacgt

SEQ ID NO: 377323 - DNA, 25 bp, Mus musculus
ctctccctcttatgtagacacacgt

SEQ ID NO: 377324 - DNA, 25 bp, Mus musculus
ctctccctcttcaagttttcttaag

SEQ ID NO: 377325 - DNA, 25 bp, Mus musculus
ctctccctcttctagttttcttaag

SEQ ID NO: 377326 - DNA, 25 bp, Mus musculus
ctctccctgatcacctaaggaatta

SEQ ID NO: 377327 - DNA, 25 bp, Mus musculus
ctctccctgatctcctaaggaatta

SEQ ID NO: 377328 - DNA, 25 bp, Mus musculus
ctctccctgtctcgaggtattgtta

SEQ ID NO: 377329 - DNA, 25 bp, Mus musculus
ctctccctgtctggaggtattgtta

SEQ ID NO: 377330 - DNA, 25 bp, Mus musculus
ctctccctgtgcatgggccacattt

SEQ ID NO: 377331 - DNA, 25 bp, Mus musculus
ctctccctgtgcttgggccacattt

SEQ ID NO: 377332 - DNA, 25 bp, Mus musculus
ctctcccttacaacgcataaaactt

SEQ ID NO: 377333 - DNA, 25 bp, Mus musculus
ctctcccttacatcgcataaaactt

SEQ ID NO: 377334 - DNA, 25 bp, Mus musculus
ctctccctttaactaggtgcttagc

SEQ ID NO: 377335 - DNA, 25 bp, Mus musculus
ctctccctttaagtaggtgcttagc

SEQ ID NO: 377336 - DNA, 25 bp, Mus musculus
ctctccgcacgtaaacctgaggaag

SEQ ID NO: 377337 - DNA, 25 bp, Mus musculus
ctctccgcacgttaacctgaggaag

SEQ ID NO: 377338 - DNA, 25 bp, Mus musculus
ctctccggaactcatgcgctgcaaa

SEQ ID NO: 377339 - DNA, 25 bp, Mus musculus
ctctccggaactgatgcgctgcaaa

SEQ ID NO: 377340 - DNA, 25 bp, Mus musculus
ctctccggagacacccacaaaaagg

SEQ ID NO: 377341 - DNA, 25 bp, Mus musculus
ctctccggagactcccacaaaaagg

SEQ ID NO: 377342 - DNA, 25 bp, Mus musculus
ctctccgtgttgcagagtcaccctg

SEQ ID NO: 377343 - DNA, 25 bp, Mus musculus
ctctccgtgttggagagtcaccctg

SEQ ID NO: 377344 - DNA, 25 bp, Mus musculus
ctctcctaacataacatgttttcaa

SEQ ID NO: 377345 - DNA, 25 bp, Mus musculus
ctctcctaacattacatgttttcaa

SEQ ID NO: 377346 - DNA, 25 bp, Mus musculus
ctctcctaatctccaaagcattcaa

SEQ ID NO: 377347 - DNA, 25 bp, Mus musculus
ctctcctaatctgcaaagcattcaa

SEQ ID NO: 377348 - DNA, 25 bp, Mus musculus
ctctcctactggacacttgtatatg

SEQ ID NO: 377349 - DNA, 25 bp, Mus musculus
ctctcctactggtcacttgtatatg

SEQ ID NO: 377350 - DNA, 25 bp, Mus musculus
ctctcctagcacagtgcgaggatca

SEQ ID NO: 377351 - DNA, 25 bp, Mus musculus
ctctcctagcactgtgcgaggatca

SEQ ID NO: 377352 - DNA, 25 bp, Mus musculus
ctctcctagcgccaaagacatcaag

SEQ ID NO: 377353 - DNA, 25 bp, Mus musculus
ctctcctagcgcgaaagacatcaag

SEQ ID NO: 377354 - DNA, 25 bp, Mus musculus
ctctcctatcccatttacgttgagt

SEQ ID NO: 377355 - DNA, 25 bp, Mus musculus
ctctcctatcccttttacgttgagt

SEQ ID NO: 377356 - DNA, 25 bp, Mus musculus
ctctcctcaagcctgagtggactca

SEQ ID NO: 377357 - DNA, 25 bp, Mus musculus
ctctcctcaagcgtgagtggactca

SEQ ID NO: 377358 - DNA, 25 bp, Mus musculus
ctctcctcactacgcttttgactaa

SEQ ID NO: 377359 - DNA, 25 bp, Mus musculus
ctctcctcactaggcttttgactaa

SEQ ID NO: 377360 - DNA, 25 bp, Mus musculus
ctctcctcatagctgagatctaaat

SEQ ID NO: 377361 - DNA, 25 bp, Mus musculus
ctctcctcataggtgagatctaaat

SEQ ID NO: 377362 - DNA, 25 bp, Mus musculus
ctctcctccaacacatgtgacttta

SEQ ID NO: 377363 - DNA, 25 bp, Mus musculus
ctctcctccaactcatgtgacttta

SEQ ID NO: 377364 - DNA, 25 bp, Mus musculus
ctctcctccagtcgtattttagaga

SEQ ID NO: 377365 - DNA, 25 bp, Mus musculus
ctctcctccagtggtattttagaga

SEQ ID NO: 377366 - DNA, 25 bp, Mus musculus
ctctcctccatgcaaatccaggtgg

SEQ ID NO: 377367 - DNA, 25 bp, Mus musculus
ctctcctccatggaaatccaggtgg

SEQ ID NO: 377368 - DNA, 25 bp, Mus musculus
ctctcctcccatacaaaaacaagtt

SEQ ID NO: 377369 - DNA, 25 bp, Mus musculus
ctctcctcccattcaaaaacaagtt

SEQ ID NO: 377370 - DNA, 25 bp, Mus musculus
ctctcctccgtaatatgtttgtttg

SEQ ID NO: 377371 - DNA, 25 bp, Mus musculus
ctctcctccgtattatgtttgtttg

SEQ ID NO: 377372 - DNA, 25 bp, Mus musculus
ctctcctcggagcttatacatcact

SEQ ID NO: 377373 - DNA, 25 bp, Mus musculus
ctctcctcggaggttatacatcact

SEQ ID NO: 377374 - DNA, 25 bp, Mus musculus
ctctcctctcctctactcaataaac

SEQ ID NO: 377375 - DNA, 25 bp, Mus musculus
ctctcctctcctgtactcaataaac

SEQ ID NO: 377376 - DNA, 25 bp, Mus musculus
ctctcctctgagcatgtattccaga

SEQ ID NO: 377377 - DNA, 25 bp, Mus musculus
ctctcctctgaggatgtattccaga

SEQ ID NO: 377378 - DNA, 25 bp, Mus musculus
ctctcctctggactggctcagtgtg

SEQ ID NO: 377379 - DNA, 25 bp, Mus musculus
ctctcctctggagtggctcagtgtg

SEQ ID NO: 377380 - DNA, 25 bp, Mus musculus
ctctcctgacctagcatcaacagaa

SEQ ID NO: 377381 - DNA, 25 bp, Mus musculus
ctctcctgaccttgcatcaacagaa

SEQ ID NO: 377382 - DNA, 25 bp, Mus musculus
ctctcctgacttctcagagacttaa

SEQ ID NO: 377383 - DNA, 25 bp, Mus musculus
ctctcctgacttgtcagagacttaa

SEQ ID NO: 377384 - DNA, 25 bp, Mus musculus
ctctcctgatacctagcttcatagg

SEQ ID NO: 377385 - DNA, 25 bp, Mus musculus
ctctcctgatacgtagcttcatagg

SEQ ID NO: 377386 - DNA, 25 bp, Mus musculus
ctctcctgcctgacattatggcaaa

SEQ ID NO: 377387 - DNA, 25 bp, Mus musculus
ctctcctgcctgtcattatggcaaa

SEQ ID NO: 377388 - DNA, 25 bp, Mus musculus
ctctcctgctacagctttcagaaga

SEQ ID NO: 377389 - DNA, 25 bp, Mus musculus
ctctcctgctactgctttcagaaga

SEQ ID NO: 377390 - DNA, 25 bp, Mus musculus
ctctcctggagaaacgcgggcggct

SEQ ID NO: 377391 - DNA, 25 bp, Mus musculus
ctctcctggagatacgcgggcggct

SEQ ID NO: 377392 - DNA, 25 bp, Mus musculus
ctctcctggatcaccggataaataa

SEQ ID NO: 377393 - DNA, 25 bp, Mus musculus
ctctcctggatctccggataaataa

SEQ ID NO: 377394 - DNA, 25 bp, Mus musculus
ctctcctggcagcatgaggcgtgca

SEQ ID NO: 377395 - DNA, 25 bp, Mus musculus
ctctcctggcaggatgaggcgtgca

SEQ ID NO: 377396 - DNA, 25 bp, Mus musculus
ctctcctggcctaggcgggatcggc

SEQ ID NO: 377397 - DNA, 25 bp, Mus musculus
ctctcctggccttggcgggatcggc

SEQ ID NO: 377398 - DNA, 25 bp, Mus musculus
ctctcctggttaccctctgaagtca

SEQ ID NO: 377399 - DNA, 25 bp, Mus musculus
ctctcctggttagcctctgaagtca

SEQ ID NO: 377400 - DNA, 25 bp, Mus musculus
ctctcctggttgaatgacttgctca

SEQ ID NO: 377401 - DNA, 25 bp, Mus musculus
ctctcctggttgcaggtcatttcaa

SEQ ID NO: 377402 - DNA, 25 bp, Mus musculus
ctctcctggttggaggtcatttcaa

SEQ ID NO: 377403 - DNA, 25 bp, Mus musculus
ctctcctggttgtatgacttgctca

SEQ ID NO: 377404 - DNA, 25 bp, Mus musculus
ctctcctgtcatacagaagtgaagg

SEQ ID NO: 377405 - DNA, 25 bp, Mus musculus
ctctcctgtcatcctgtgatgctga

SEQ ID NO: 377406 - DNA, 25 bp, Mus musculus
ctctcctgtcatgctgtgatgctga

SEQ ID NO: 377407 - DNA, 25 bp, Mus musculus
ctctcctgtcattcagaagtgaagg

SEQ ID NO: 377408 - DNA, 25 bp, Mus musculus
ctctcctgtcttataggccctaaaa

SEQ ID NO: 377409 - DNA, 25 bp, Mus musculus
ctctcctgtcttttaggccctaaaa

SEQ ID NO: 377410 - DNA, 25 bp, Mus musculus
ctctcctgtgtacatattgccttca

SEQ ID NO: 377411 - DNA, 25 bp, Mus musculus
ctctcctgtgtagatattgccttca

SEQ ID NO: 377412 - DNA, 25 bp, Mus musculus
ctctcctgttaaatgcttgttcctg

SEQ ID NO: 377413 - DNA, 25 bp, Mus musculus
ctctcctgttaattgcttgttcctg

SEQ ID NO: 377414 - DNA, 25 bp, Mus musculus
ctctcctgtttccttgaatgatctg

SEQ ID NO: 377415 - DNA, 25 bp, Mus musculus
ctctcctgtttcgttgaatgatctg

SEQ ID NO: 377416 - DNA, 25 bp, Mus musculus
ctctccttacacattccagatgaaa

SEQ ID NO: 377417 - DNA, 25 bp, Mus musculus
ctctccttacactttccagatgaaa

SEQ ID NO: 377418 - DNA, 25 bp, Mus musculus
ctctccttatccatcttgtaagaca

SEQ ID NO: 377419 - DNA, 25 bp, Mus musculus
ctctccttatccttcttgtaagaca

SEQ ID NO: 377420 - DNA, 25 bp, Mus musculus
ctctccttcatcagcagctaatgta

SEQ ID NO: 377421 - DNA, 25 bp, Mus musculus
ctctccttcatctgcagctaatgta

SEQ ID NO: 377422 - DNA, 25 bp, Mus musculus
ctctccttgattcgtaaccttgtac

SEQ ID NO: 377423 - DNA, 25 bp, Mus musculus
ctctccttgattggtaaccttgtac

SEQ ID NO: 377424 - DNA, 25 bp, Mus musculus
ctctccttgttgagaccttggccaa

SEQ ID NO: 377425 - DNA, 25 bp, Mus musculus
ctctccttgttgtgaccttggccaa

SEQ ID NO: 377426 - DNA, 25 bp, Mus musculus
ctctcctttaagctgtgtccagtga

SEQ ID NO: 377427 - DNA, 25 bp, Mus musculus
ctctcctttaaggtgtgtccagtga

SEQ ID NO: 377428 - DNA, 25 bp, Mus musculus
ctctcctttaatattggcagttaca

SEQ ID NO: 377429 - DNA, 25 bp, Mus musculus
ctctcctttaattttggcagttaca

SEQ ID NO: 377430 - DNA, 25 bp, Mus musculus
ctctcctttcatacagtttccatgg

SEQ ID NO: 377431 - DNA, 25 bp, Mus musculus
ctctcctttcattcagtttccatgg

SEQ ID NO: 377432 - DNA, 25 bp, Mus musculus
ctctcctttggcattctgtgcagaa

SEQ ID NO: 377433 - DNA, 25 bp, Mus musculus
ctctcctttggctttctgtgcagaa

SEQ ID NO: 377434 - DNA, 25 bp, Mus musculus
ctctcctttgtgagtcaggtgtttc

SEQ ID NO: 377435 - DNA, 25 bp, Mus musculus
ctctcctttgtgtgtcaggtgtttc

SEQ ID NO: 377436 - DNA, 25 bp, Mus musculus
ctctcctttttgatggttatttgag

SEQ ID NO: 377437 - DNA, 25 bp, Mus musculus
ctctcctttttgttggttatttgag

SEQ ID NO: 377438 - DNA, 25 bp, Mus musculus
ctctcgaatagtatacctcatccat

SEQ ID NO: 377439 - DNA, 25 bp, Mus musculus
ctctcgaatagtttacctcatccat

SEQ ID NO: 377440 - DNA, 25 bp, Mus musculus
ctctcgagcttgatcctgttttgaa

SEQ ID NO: 377441 - DNA, 25 bp, Mus musculus
ctctcgagcttgttcctgttttgaa

SEQ ID NO: 377442 - DNA, 25 bp, Mus musculus
ctctcgatcactctgggtcttggga

SEQ ID NO: 377443 - DNA, 25 bp, Mus musculus
ctctcgatcactgtgggtcttggga

SEQ ID NO: 377444 - DNA, 25 bp, Mus musculus
ctctcgcacctgagttgaccaaaga

SEQ ID NO: 377445 - DNA, 25 bp, Mus musculus
ctctcgcacctgtgttgaccaaaga

SEQ ID NO: 377446 - DNA, 25 bp, Mus musculus
ctctcgcagactaggaatccacgta

SEQ ID NO: 377447 - DNA, 25 bp, Mus musculus
ctctcgcagacttggaatccacgta

SEQ ID NO: 377448 - DNA, 25 bp, Mus musculus
ctctcgcagcttccccataggattg

SEQ ID NO: 377449 - DNA, 25 bp, Mus musculus
ctctcgcagcttgcccataggattg

SEQ ID NO: 377450 - DNA, 25 bp, Mus musculus
ctctcgccagttattcacgtttaaa

SEQ ID NO: 377451 - DNA, 25 bp, Mus musculus
ctctcgccagtttttcacgtttaaa

SEQ ID NO: 377452 - DNA, 25 bp, Mus musculus
ctctcgcctcggattatttattgac

SEQ ID NO: 377453 - DNA, 25 bp, Mus musculus
ctctcgcctcggtttatttattgac

SEQ ID NO: 377454 - DNA, 25 bp, Mus musculus
ctctcgcgcgacaaaattccaaatt

SEQ ID NO: 377455 - DNA, 25 bp, Mus musculus
ctctcgcgcgactaaattccaaatt

SEQ ID NO: 377456 - DNA, 25 bp, Mus musculus
ctctcggactctacacaattacttt

SEQ ID NO: 377457 - DNA, 25 bp, Mus musculus
ctctcggactcttcacaattacttt

SEQ ID NO: 377458 - DNA, 25 bp, Mus musculus
ctctcggcgtcacgctgatggaaca

SEQ ID NO: 377459 - DNA, 25 bp, Mus musculus
ctctcggcgtcaggctgatggaaca

SEQ ID NO: 377460 - DNA, 25 bp, Mus musculus
ctctcggctcagaatatagaagaaa

SEQ ID NO: 377461 - DNA, 25 bp, Mus musculus
ctctcggctcagtatatagaagaaa

SEQ ID NO: 377462 - DNA, 25 bp, Mus musculus
ctctcgggacctagctggtgagcgt

SEQ ID NO: 377463 - DNA, 25 bp, Mus musculus
ctctcgggaccttgctggtgagcgt

SEQ ID NO: 377464 - DNA, 25 bp, Mus musculus
ctctcgggccatcagtaggatgctt

SEQ ID NO: 377465 - DNA, 25 bp, Mus musculus
ctctcgggccatgagtaggatgctt

SEQ ID NO: 377466 - DNA, 25 bp, Mus musculus
ctctcgggcctcattgtatgaggat

SEQ ID NO: 377467 - DNA, 25 bp, Mus musculus
ctctcgggcctctttgtatgaggat

SEQ ID NO: 377468 - DNA, 25 bp, Mus musculus
ctctcgggggatcgagatttctaaa

SEQ ID NO: 377469 - DNA, 25 bp, Mus musculus
ctctcgggggatggagatttctaaa

SEQ ID NO: 377470 - DNA, 25 bp, Mus musculus
ctctcgggtgcactctgttttgagg

SEQ ID NO: 377471 - DNA, 25 bp, Mus musculus
ctctcgggtgcagtctgttttgagg

SEQ ID NO: 377472 - DNA, 25 bp, Mus musculus
ctctcggtacaaacaggcagtcggt

SEQ ID NO: 377473 - DNA, 25 bp, Mus musculus
ctctcggtacaatcaggcagtcggt

SEQ ID NO: 377474 - DNA, 25 bp, Mus musculus
ctctcggtcttcattgattctgtac

SEQ ID NO: 377475 - DNA, 25 bp, Mus musculus
ctctcggtcttctttgattctgtac

SEQ ID NO: 377476 - DNA, 25 bp, Mus musculus
ctctcggttcatacaaaggaccttc

SEQ ID NO: 377477 - DNA, 25 bp, Mus musculus
ctctcggttcattcaaaggaccttc

SEQ ID NO: 377478 - DNA, 25 bp, Mus musculus
ctctcggttctgctcgttcatgtga

SEQ ID NO: 377479 - DNA, 25 bp, Mus musculus
ctctcggttctggtcgttcatgtga

SEQ ID NO: 377480 - DNA, 25 bp, Mus musculus
ctctcgtcttcaacaactgttctga

SEQ ID NO: 377481 - DNA, 25 bp, Mus musculus
ctctcgtcttcatcaactgttctga

SEQ ID NO: 377482 - DNA, 25 bp, Mus musculus
ctctcgtcttccagaaacactatta

SEQ ID NO: 377483 - DNA, 25 bp, Mus musculus
ctctcgtcttcctgaaacactatta

SEQ ID NO: 377484 - DNA, 25 bp, Mus musculus
ctctcgtggattcgtacggtggatt

SEQ ID NO: 377485 - DNA, 25 bp, Mus musculus
ctctcgtggattggtacggtggatt

SEQ ID NO: 377486 - DNA, 25 bp, Mus musculus
ctctcgtggtggattttcaggcaac

SEQ ID NO: 377487 - DNA, 25 bp, Mus musculus
ctctcgtggtggtttttcaggcaac

SEQ ID NO: 377488 - DNA, 25 bp, Mus musculus
ctctcgtggttgattcctggaggaa

SEQ ID NO: 377489 - DNA, 25 bp, Mus musculus
ctctcgtggttgtttcctggaggaa

SEQ ID NO: 377490 - DNA, 25 bp, Mus musculus
ctctcgtgtcatataggtcctgaaa

SEQ ID NO: 377491 - DNA, 25 bp, Mus musculus
ctctcgtgtcatttaggtcctgaaa

SEQ ID NO: 377492 - DNA, 25 bp, Mus musculus
ctctctaaagtgatctctctgtctg

SEQ ID NO: 377493 - DNA, 25 bp, Mus musculus
ctctctaaagtgttctctctgtctg

SEQ ID NO: 377494 - DNA, 25 bp, Mus musculus
ctctctaacatcatacttacgcgga

SEQ ID NO: 377495 - DNA, 25 bp, Mus musculus
ctctctaacatcttacttacgcgga

SEQ ID NO: 377496 - DNA, 25 bp, Mus musculus
ctctctaactgcaccttcagagata

SEQ ID NO: 377497 - DNA, 25 bp, Mus musculus
ctctctaactgctccttcagagata

SEQ ID NO: 377498 - DNA, 25 bp, Mus musculus
ctctctaatcttaagcccacaaaac

SEQ ID NO: 377499 - DNA, 25 bp, Mus musculus
ctctctaatctttagcccacaaaac

SEQ ID NO: 377500 - DNA, 25 bp, Mus musculus
ctctctaattatccttgtttttact

SEQ ID NO: 377501 - DNA, 25 bp, Mus musculus
ctctctaattatgcttgtttttact

SEQ ID NO: 377502 - DNA, 25 bp, Mus musculus
ctctctaatttcaaaggacatgtct

SEQ ID NO: 377503 - DNA, 25 bp, Mus musculus
ctctctaatttctaaggacatgtct

SEQ ID NO: 377504 - DNA, 25 bp, Mus musculus
ctctctacagaaactcttccttgtt

SEQ ID NO: 377505 - DNA, 25 bp, Mus musculus
ctctctacagaatctcttccttgtt

SEQ ID NO: 377506 - DNA, 25 bp, Mus musculus
ctctctaccactatttcttctttat

SEQ ID NO: 377507 - DNA, 25 bp, Mus musculus
ctctctaccactttttcttctttat

SEQ ID NO: 377508 - DNA, 25 bp, Mus musculus
ctctctacccgtcagtcttggaaga

SEQ ID NO: 377509 - DNA, 25 bp, Mus musculus
ctctctacccgtgagtcttggaaga

SEQ ID NO: 377510 - DNA, 25 bp, Mus musculus
ctctctacctcacaagttacacttt

SEQ ID NO: 377511 - DNA, 25 bp, Mus musculus
ctctctacctcagaagttacacttt

SEQ ID NO: 377512 - DNA, 25 bp, Mus musculus
ctctctacctccagcaggcaaagga

SEQ ID NO: 377513 - DNA, 25 bp, Mus musculus
ctctctacctcctgcaggcaaagga

SEQ ID NO: 377514 - DNA, 25 bp, Mus musculus
ctctctacctggagccacagataat

SEQ ID NO: 377515 - DNA, 25 bp, Mus musculus
ctctctacctggtgccacagataat

SEQ ID NO: 377516 - DNA, 25 bp, Mus musculus
ctctctactcagatggatttagcag

SEQ ID NO: 377517 - DNA, 25 bp, Mus musculus
ctctctactcagttggatttagcag

SEQ ID NO: 377518 - DNA, 25 bp, Mus musculus
ctctctactggcctgttaatcaaaa

SEQ ID NO: 377519 - DNA, 25 bp, Mus musculus
ctctctactggcgtgttaatcaaaa

SEQ ID NO: 377520 - DNA, 25 bp, Mus musculus
ctctctagaatgaggcttctctgat

SEQ ID NO: 377521 - DNA, 25 bp, Mus musculus
ctctctagaatgtggcttctctgat

SEQ ID NO: 377522 - DNA, 25 bp, Mus musculus
ctctctagacggaaggtctgtgctt

SEQ ID NO: 377523 - DNA, 25 bp, Mus musculus
ctctctagacggtaggtctgtgctt

SEQ ID NO: 377524 - DNA, 25 bp, Mus musculus
ctctctagcagactagttcccacag

SEQ ID NO: 377525 - DNA, 25 bp, Mus musculus
ctctctagcagagtagttcccacag

SEQ ID NO: 377526 - DNA, 25 bp, Mus musculus
ctctctagcccaattatagcatact

SEQ ID NO: 377527 - DNA, 25 bp, Mus musculus
ctctctagcccatttatagcatact

SEQ ID NO: 377528 - DNA, 25 bp, Mus musculus
ctctctagcgtcaactctatcaaaa

SEQ ID NO: 377529 - DNA, 25 bp, Mus musculus
ctctctagcgtctactctatcaaaa

SEQ ID NO: 377530 - DNA, 25 bp, Mus musculus
ctctctagctgtcggaacagttaac

SEQ ID NO: 377531 - DNA, 25 bp, Mus musculus
ctctctagctgtcggcctgtaaaag

SEQ ID NO: 377532 - DNA, 25 bp, Mus musculus
ctctctagctgtgggaacagttaac

SEQ ID NO: 377533 - DNA, 25 bp, Mus musculus
ctctctagctgtgggcctgtaaaag

SEQ ID NO: 377534 - DNA, 25 bp, Mus musculus
ctctctaggtctacaagccagggaa

SEQ ID NO: 377535 - DNA, 25 bp, Mus musculus
ctctctaggtcttcaagccagggaa

SEQ ID NO: 377536 - DNA, 25 bp, Mus musculus
ctctctataaaaaggtgctgtgcgg

SEQ ID NO: 377537 - DNA, 25 bp, Mus musculus
ctctctataaaatggtgctgtgcgg

SEQ ID NO: 377538 - DNA, 25 bp, Mus musculus
ctctctatacccagcaaattgactg

SEQ ID NO: 377539 - DNA, 25 bp, Mus musculus
ctctctataccctgcaaattgactg

SEQ ID NO: 377540 - DNA, 25 bp, Mus musculus
ctctctatcacaaagttacgtacta

SEQ ID NO: 377541 - DNA, 25 bp, Mus musculus
ctctctatcacaccgttcattgtca

SEQ ID NO: 377542 - DNA, 25 bp, Mus musculus
ctctctatcacagcgttcattgtca

SEQ ID NO: 377543 - DNA, 25 bp, Mus musculus
ctctctatcacatagttacgtacta

SEQ ID NO: 377544 - DNA, 25 bp, Mus musculus
ctctctatcagacaactcacagagg

SEQ ID NO: 377545 - DNA, 25 bp, Mus musculus
ctctctatcagagaactcacagagg

SEQ ID NO: 377546 - DNA, 25 bp, Mus musculus
ctctctatcattatcatccctgttg

SEQ ID NO: 377547 - DNA, 25 bp, Mus musculus
ctctctatcattttcatccctgttg

SEQ ID NO: 377548 - DNA, 25 bp, Mus musculus
ctctctatctacagttttgattttc

SEQ ID NO: 377549 - DNA, 25 bp, Mus musculus
ctctctatctactgttttgattttc

SEQ ID NO: 377550 - DNA, 25 bp, Mus musculus
ctctctatttctctaaggactcaat

SEQ ID NO: 377551 - DNA, 25 bp, Mus musculus
ctctctatttctgtaaggactcaat

SEQ ID NO: 377552 - DNA, 25 bp, Mus musculus
ctctctatttttacctaactctctg

SEQ ID NO: 377553 - DNA, 25 bp, Mus musculus
ctctctattttttcctaactctctg

SEQ ID NO: 377554 - DNA, 25 bp, Mus musculus
ctctctcaaggcaacatacgcagct

SEQ ID NO: 377555 - DNA, 25 bp, Mus musculus
ctctctcaaggctacatacgcagct

SEQ ID NO: 377556 - DNA, 25 bp, Mus musculus
ctctctcaccagccttcaattgtgg

SEQ ID NO: 377557 - DNA, 25 bp, Mus musculus
ctctctcaccaggcttcaattgtgg

SEQ ID NO: 377558 - DNA, 25 bp, Mus musculus
ctctctcactatactagctgaataa

SEQ ID NO: 377559 - DNA, 25 bp, Mus musculus
ctctctcactattctagctgaataa

SEQ ID NO: 377560 - DNA, 25 bp, Mus musculus
ctctctcagggccttccagacattt

SEQ ID NO: 377561 - DNA, 25 bp, Mus musculus
ctctctcagggcgttccagacattt

SEQ ID NO: 377562 - DNA, 25 bp, Mus musculus
ctctctcagggtcgcaggacctgga

SEQ ID NO: 377563 - DNA, 25 bp, Mus musculus
ctctctcagggtggcaggacctgga

SEQ ID NO: 377564 - DNA, 25 bp, Mus musculus
ctctctcagtatctgtctcttaaga

SEQ ID NO: 377565 - DNA, 25 bp, Mus musculus
ctctctcagtatgtgtctcttaaga

SEQ ID NO: 377566 - DNA, 25 bp, Mus musculus
ctctctcagtggatcaaggtatcct

SEQ ID NO: 377567 - DNA, 25 bp, Mus musculus
ctctctcagtggttcaaggtatcct

SEQ ID NO: 377568 - DNA, 25 bp, Mus musculus
ctctctcagttcactagcttgtaaa

SEQ ID NO: 377569 - DNA, 25 bp, Mus musculus
ctctctcagttctctagcttgtaaa

SEQ ID NO: 377570 - DNA, 25 bp, Mus musculus
ctctctcataggaggtctcactgta

SEQ ID NO: 377571 - DNA, 25 bp, Mus musculus
ctctctcataggtggtctcactgta

SEQ ID NO: 377572 - DNA, 25 bp, Mus musculus
ctctctcatctaaaccttgcagaat

SEQ ID NO: 377573 - DNA, 25 bp, Mus musculus
ctctctcatctataccttgcagaat

SEQ ID NO: 377574 - DNA, 25 bp, Mus musculus
ctctctcattatccccttgaactgt

SEQ ID NO: 377575 - DNA, 25 bp, Mus musculus
ctctctcattatgcccttgaactgt

SEQ ID NO: 377576 - DNA, 25 bp, Mus musculus
ctctctccacaaacaagttctctag

SEQ ID NO: 377577 - DNA, 25 bp, Mus musculus
ctctctccacaatcaagttctctag

SEQ ID NO: 377578 - DNA, 25 bp, Mus musculus
ctctctccacatcccaagaaagaaa

SEQ ID NO: 377579 - DNA, 25 bp, Mus musculus
ctctctccacatgccaagaaagaaa

SEQ ID NO: 377580 - DNA, 25 bp, Mus musculus
ctctctccagctcgaaggtgaagtt

SEQ ID NO: 377581 - DNA, 25 bp, Mus musculus
ctctctccagctggaaggtgaagtt

SEQ ID NO: 377582 - DNA, 25 bp, Mus musculus
ctctctccatgtcgttgatagagtg

SEQ ID NO: 377583 - DNA, 25 bp, Mus musculus
ctctctccatgtggttgatagagtg

SEQ ID NO: 377584 - DNA, 25 bp, Mus musculus
ctctctccatttcttaatttctgtg

SEQ ID NO: 377585 - DNA, 25 bp, Mus musculus
ctctctccatttgttaatttctgtg

SEQ ID NO: 377586 - DNA, 25 bp, Mus musculus
ctctctcccagtcgtgatttgttaa

SEQ ID NO: 377587 - DNA, 25 bp, Mus musculus
ctctctcccagtggtgatttgttaa

SEQ ID NO: 377588 - DNA, 25 bp, Mus musculus
ctctctccccacatgtatagaatta

SEQ ID NO: 377589 - DNA, 25 bp, Mus musculus
ctctctccccacttgtatagaatta

SEQ ID NO: 377590 - DNA, 25 bp, Mus musculus
ctctctccgaagattacatcctaaa

SEQ ID NO: 377591 - DNA, 25 bp, Mus musculus
ctctctccgaagtttacatcctaaa

SEQ ID NO: 377592 - DNA, 25 bp, Mus musculus
ctctctccgagcaaatgttgacaga

SEQ ID NO: 377593 - DNA, 25 bp, Mus musculus
ctctctccgagctaatgttgacaga

SEQ ID NO: 377594 - DNA, 25 bp, Mus musculus
ctctctcctctacttatttactagt

SEQ ID NO: 377595 - DNA, 25 bp, Mus musculus
ctctctcctctagttatttactagt

SEQ ID NO: 377596 - DNA, 25 bp, Mus musculus
ctctctcctgttcggtaaatacaag

SEQ ID NO: 377597 - DNA, 25 bp, Mus musculus
ctctctcctgttgggtaaatacaag

SEQ ID NO: 377598 - DNA, 25 bp, Mus musculus
ctctctcgatggatgctaggtagta

SEQ ID NO: 377599 - DNA, 25 bp, Mus musculus
ctctctcgatggttgctaggtagta

SEQ ID NO: 377600 - DNA, 25 bp, Mus musculus
ctctctcgctgcatctctgtggagg

SEQ ID NO: 377601 - DNA, 25 bp, Mus musculus
ctctctcgctgcttctctgtggagg

SEQ ID NO: 377602 - DNA, 25 bp, Mus musculus
ctctctcgggaactgtaaatgatag

SEQ ID NO: 377603 - DNA, 25 bp, Mus musculus
ctctctcgggaagtgtaaatgatag

SEQ ID NO: 377604 - DNA, 25 bp, Mus musculus
ctctctcgtgctattcatttggtaa

SEQ ID NO: 377605 - DNA, 25 bp, Mus musculus
ctctctcgtgcttttcatttggtaa

SEQ ID NO: 377606 - DNA, 25 bp, Mus musculus
ctctctcgtgttagctgatccacaa

SEQ ID NO: 377607 - DNA, 25 bp, Mus musculus
ctctctcgtgtttgctgatccacaa

SEQ ID NO: 377608 - DNA, 25 bp, Mus musculus
ctctctctacaacgtggacgtgttt

SEQ ID NO: 377609 - DNA, 25 bp, Mus musculus
ctctctctacaaggtggacgtgttt

SEQ ID NO: 377610 - DNA, 25 bp, Mus musculus
ctctctctattaaacaccagtgtgt

SEQ ID NO: 377611 - DNA, 25 bp, Mus musculus
ctctctctattatacaccagtgtgt

SEQ ID NO: 377612 - DNA, 25 bp, Mus musculus
ctctctctcaaaaatgcaggtaatg

SEQ ID NO: 377613 - DNA, 25 bp, Mus musculus
ctctctctcaaatatgcaggtaatg

SEQ ID NO: 377614 - DNA, 25 bp, Mus musculus
ctctctctcccaccatggaggaaga

SEQ ID NO: 377615 - DNA, 25 bp, Mus musculus
ctctctctcccagcatggaggaaga

SEQ ID NO: 377616 - DNA, 25 bp, Mus musculus
ctctctctccttcggcttatttgga

SEQ ID NO: 377617 - DNA, 25 bp, Mus musculus
ctctctctccttgggcttatttgga

SEQ ID NO: 377618 - DNA, 25 bp, Mus musculus
ctctctctgcctaaaatcttctaaa

SEQ ID NO: 377619 - DNA, 25 bp, Mus musculus
ctctctctgccttaaatcttctaaa

SEQ ID NO: 377620 - DNA, 25 bp, Mus musculus
ctctctctgctgaatggtgggagga

SEQ ID NO: 377621 - DNA, 25 bp, Mus musculus
ctctctctgctgtatggtgggagga

SEQ ID NO: 377622 - DNA, 25 bp, Mus musculus
ctctctctgggcatactaatgcatt

SEQ ID NO: 377623 - DNA, 25 bp, Mus musculus
ctctctctgggcatttcagaaacca

SEQ ID NO: 377624 - DNA, 25 bp, Mus musculus
ctctctctgggcttactaatgcatt

SEQ ID NO: 377625 - DNA, 25 bp, Mus musculus
ctctctctgggcttttcagaaacca

SEQ ID NO: 377626 - DNA, 25 bp, Mus musculus
ctctctctggtcatgtcactcaggg

SEQ ID NO: 377627 - DNA, 25 bp, Mus musculus
ctctctctggtcttgtcactcaggg

SEQ ID NO: 377628 - DNA, 25 bp, Mus musculus
ctctctctgtccaagagcataggat

SEQ ID NO: 377629 - DNA, 25 bp, Mus musculus
ctctctctgtcctagagcataggat

SEQ ID NO: 377630 - DNA, 25 bp, Mus musculus
ctctctcttaccagtgtatccattg

SEQ ID NO: 377631 - DNA, 25 bp, Mus musculus
ctctctcttacctgtgtatccattg

SEQ ID NO: 377632 - DNA, 25 bp, Mus musculus
ctctctcttcagcttattggtcttg

SEQ ID NO: 377633 - DNA, 25 bp, Mus musculus
ctctctcttcaggttattggtcttg

SEQ ID NO: 377634 - DNA, 25 bp, Mus musculus
ctctctcttctccaataaactgcag

SEQ ID NO: 377635 - DNA, 25 bp, Mus musculus
ctctctcttctcgaataaactgcag

SEQ ID NO: 377636 - DNA, 25 bp, Mus musculus
ctctctcttcttatgggacagcaac

SEQ ID NO: 377637 - DNA, 25 bp, Mus musculus
ctctctcttcttttgggacagcaac

SEQ ID NO: 377638 - DNA, 25 bp, Mus musculus
ctctctcttgccagatgctggaaga

SEQ ID NO: 377639 - DNA, 25 bp, Mus musculus
ctctctcttgcctgatgctggaaga

SEQ ID NO: 377640 - DNA, 25 bp, Mus musculus
ctctctcttggaatcttattacctg

SEQ ID NO: 377641 - DNA, 25 bp, Mus musculus
ctctctcttggattcttattacctg

SEQ ID NO: 377642 - DNA, 25 bp, Mus musculus
ctctctctttcaacagtacttcatg

SEQ ID NO: 377643 - DNA, 25 bp, Mus musculus
ctctctctttcatcagtacttcatg

SEQ ID NO: 377644 - DNA, 25 bp, Mus musculus
ctctctctttgcagagacagaggaa

SEQ ID NO: 377645 - DNA, 25 bp, Mus musculus
ctctctctttgctgagacagaggaa

SEQ ID NO: 377646 - DNA, 25 bp, Mus musculus
ctctctcttttcaataagccttcat

SEQ ID NO: 377647 - DNA, 25 bp, Mus musculus
ctctctcttttctataagccttcat

SEQ ID NO: 377648 - DNA, 25 bp, Mus musculus
ctctctgaaaacagaagctaacttg

SEQ ID NO: 377649 - DNA, 25 bp, Mus musculus
ctctctgaaaactgaagctaacttg

SEQ ID NO: 377650 - DNA, 25 bp, Mus musculus
ctctctgaactaccgtataacacca

SEQ ID NO: 377651 - DNA, 25 bp, Mus musculus
ctctctgaactagcgtataacacca

SEQ ID NO: 377652 - DNA, 25 bp, Mus musculus
ctctctgaactgaagcttggacaca

SEQ ID NO: 377653 - DNA, 25 bp, Mus musculus
ctctctgaactgtagcttggacaca

SEQ ID NO: 377654 - DNA, 25 bp, Mus musculus
ctctctgacaagagttaaaggtaaa

SEQ ID NO: 377655 - DNA, 25 bp, Mus musculus
ctctctgacaagtgttaaaggtaaa

SEQ ID NO: 377656 - DNA, 25 bp, Mus musculus
ctctctgacaccatcaataaccata

SEQ ID NO: 377657 - DNA, 25 bp, Mus musculus
ctctctgacaccttcaataaccata

SEQ ID NO: 377658 - DNA, 25 bp, Mus musculus
ctctctgacagtacttgcacaagtt

SEQ ID NO: 377659 - DNA, 25 bp, Mus musculus
ctctctgacagttcttgcacaagtt

SEQ ID NO: 377660 - DNA, 25 bp, Mus musculus
ctctctgaccctagtgcaagaccat

SEQ ID NO: 377661 - DNA, 25 bp, Mus musculus
ctctctgaccctctagaactattta

SEQ ID NO: 377662 - DNA, 25 bp, Mus musculus
ctctctgaccctgtagaactattta

SEQ ID NO: 377663 - DNA, 25 bp, Mus musculus
ctctctgacccttgtgcaagaccat

SEQ ID NO: 377664 - DNA, 25 bp, Mus musculus
ctctctgacttgcttgtctgtgtct

SEQ ID NO: 377665 - DNA, 25 bp, Mus musculus
ctctctgacttggttgtctgtgtct

SEQ ID NO: 377666 - DNA, 25 bp, Mus musculus
ctctctgaggagaatcatggatttc

SEQ ID NO: 377667 - DNA, 25 bp, Mus musculus
ctctctgaggagcaggctttccatg

SEQ ID NO: 377668 - DNA, 25 bp, Mus musculus
ctctctgaggaggaggctttccatg

SEQ ID NO: 377669 - DNA, 25 bp, Mus musculus
ctctctgaggagtatcatggatttc

SEQ ID NO: 377670 - DNA, 25 bp, Mus musculus
ctctctgaggtgactctcccatggg

SEQ ID NO: 377671 - DNA, 25 bp, Mus musculus
ctctctgaggtgtctctcccatggg

SEQ ID NO: 377672 - DNA, 25 bp, Mus musculus
ctctctgagtgcagtggagtaagat

SEQ ID NO: 377673 - DNA, 25 bp, Mus musculus
ctctctgagtgctgtggagtaagat

SEQ ID NO: 377674 - DNA, 25 bp, Mus musculus
ctctctgagttccagctcatttgag

SEQ ID NO: 377675 - DNA, 25 bp, Mus musculus
ctctctgagttcgagctcatttgag

SEQ ID NO: 377676 - DNA, 25 bp, Mus musculus
ctctctgatagaaatggctgttggc

SEQ ID NO: 377677 - DNA, 25 bp, Mus musculus
ctctctgatagatatggctgttggc

SEQ ID NO: 377678 - DNA, 25 bp, Mus musculus
ctctctgatctaaaaaacaattgtt

SEQ ID NO: 377679 - DNA, 25 bp, Mus musculus
ctctctgatctataaaacaattgtt

SEQ ID NO: 377680 - DNA, 25 bp, Mus musculus
ctctctgatgagactgtgtctaggg

SEQ ID NO: 377681 - DNA, 25 bp, Mus musculus
ctctctgatgagtctgtgtctaggg

SEQ ID NO: 377682 - DNA, 25 bp, Mus musculus
ctctctgatttccatttgcacagga

SEQ ID NO: 377683 - DNA, 25 bp, Mus musculus
ctctctgatttcgatttgcacagga

SEQ ID NO: 377684 - DNA, 25 bp, Mus musculus
ctctctgcatggaaattgtagcatt

SEQ ID NO: 377685 - DNA, 25 bp, Mus musculus
ctctctgcatggtaattgtagcatt

SEQ ID NO: 377686 - DNA, 25 bp, Mus musculus
ctctctgccacaatgtttacttttt

SEQ ID NO: 377687 - DNA, 25 bp, Mus musculus
ctctctgccacattgtttacttttt

SEQ ID NO: 377688 - DNA, 25 bp, Mus musculus
ctctctgccaggagaatttgggttt

SEQ ID NO: 377689 - DNA, 25 bp, Mus musculus
ctctctgccaggtgaatttgggttt

SEQ ID NO: 377690 - DNA, 25 bp, Mus musculus
ctctctgcccttcgattgggaattg

SEQ ID NO: 377691 - DNA, 25 bp, Mus musculus
ctctctgcccttggattgggaattg

SEQ ID NO: 377692 - DNA, 25 bp, Mus musculus
ctctctgcctatacttggcgaggga

SEQ ID NO: 377693 - DNA, 25 bp, Mus musculus
ctctctgcctattcttggcgaggga

SEQ ID NO: 377694 - DNA, 25 bp, Mus musculus
ctctctgcctgacatactgcggcgt

SEQ ID NO: 377695 - DNA, 25 bp, Mus musculus
ctctctgcctgagatactgcggcgt

SEQ ID NO: 377696 - DNA, 25 bp, Mus musculus
ctctctgcctggaggtgtggatatg

SEQ ID NO: 377697 - DNA, 25 bp, Mus musculus
ctctctgcctggtggtgtggatatg

SEQ ID NO: 377698 - DNA, 25 bp, Mus musculus
ctctctgctaacaccaactcaaaaa

SEQ ID NO: 377699 - DNA, 25 bp, Mus musculus
ctctctgctaactccaactcaaaaa

SEQ ID NO: 377700 - DNA, 25 bp, Mus musculus
ctctctgctcgtcaaggtcattgca

SEQ ID NO: 377701 - DNA, 25 bp, Mus musculus
ctctctgctcgtgaaggtcattgca

SEQ ID NO: 377702 - DNA, 25 bp, Mus musculus
ctctctgctgagagatgttttcttc

SEQ ID NO: 377703 - DNA, 25 bp, Mus musculus
ctctctgctgagtgatgttttcttc

SEQ ID NO: 377704 - DNA, 25 bp, Mus musculus
ctctctggaaatacttgctgtgctg

SEQ ID NO: 377705 - DNA, 25 bp, Mus musculus
ctctctggaaattcttgctgtgctg

SEQ ID NO: 377706 - DNA, 25 bp, Mus musculus
ctctctggacagcagactgcacagc

SEQ ID NO: 377707 - DNA, 25 bp, Mus musculus
ctctctggacaggagactgcacagc

SEQ ID NO: 377708 - DNA, 25 bp, Mus musculus
ctctctggagtcatctgtattccga

SEQ ID NO: 377709 - DNA, 25 bp, Mus musculus
ctctctggagtcttctgtattccga

SEQ ID NO: 377710 - DNA, 25 bp, Mus musculus
ctctctggatatcactggtgcctta

SEQ ID NO: 377711 - DNA, 25 bp, Mus musculus
ctctctggatatgactggtgcctta

SEQ ID NO: 377712 - DNA, 25 bp, Mus musculus
ctctctggcaaactcaatcactcag

SEQ ID NO: 377713 - DNA, 25 bp, Mus musculus
ctctctggcaaagtcaatcactcag

SEQ ID NO: 377714 - DNA, 25 bp, Mus musculus
ctctctggcagaccttgggaggcac

SEQ ID NO: 377715 - DNA, 25 bp, Mus musculus
ctctctggcagagcttgggaggcac

SEQ ID NO: 377716 - DNA, 25 bp, Mus musculus
ctctctggcatcacagactgatcat

SEQ ID NO: 377717 - DNA, 25 bp, Mus musculus
ctctctggcatctcagactgatcat

SEQ ID NO: 377718 - DNA, 25 bp, Mus musculus
ctctctggccagcagtttaatctct

SEQ ID NO: 377719 - DNA, 25 bp, Mus musculus
ctctctggccaggagtttaatctct

SEQ ID NO: 377720 - DNA, 25 bp, Mus musculus
ctctctggcccaagatgtaaactat

SEQ ID NO: 377721 - DNA, 25 bp, Mus musculus
ctctctggcccatgatgtaaactat

SEQ ID NO: 377722 - DNA, 25 bp, Mus musculus
ctctctggctaaagatcaaggtctc

SEQ ID NO: 377723 - DNA, 25 bp, Mus musculus
ctctctggctaatgatcaaggtctc

SEQ ID NO: 377724 - DNA, 25 bp, Mus musculus
ctctctggctctcctcaaaatataa

SEQ ID NO: 377725 - DNA, 25 bp, Mus musculus
ctctctggctctgctcaaaatataa

SEQ ID NO: 377726 - DNA, 25 bp, Mus musculus
ctctctgggcctatttgaatgttta

SEQ ID NO: 377727 - DNA, 25 bp, Mus musculus
ctctctgggcctttttgaatgttta

SEQ ID NO: 377728 - DNA, 25 bp, Mus musculus
ctctctgggtgaagctgttgggatc

SEQ ID NO: 377729 - DNA, 25 bp, Mus musculus
ctctctgggtgatgctgttgggatc

SEQ ID NO: 377730 - DNA, 25 bp, Mus musculus
ctctctgggtgtacaggttctgtat

SEQ ID NO: 377731 - DNA, 25 bp, Mus musculus
ctctctgggtgtagcatgctcattt

SEQ ID NO: 377732 - DNA, 25 bp, Mus musculus
ctctctgggtgttcaggttctgtat

SEQ ID NO: 377733 - DNA, 25 bp, Mus musculus
ctctctgggtgttgcatgctcattt

SEQ ID NO: 377734 - DNA, 25 bp, Mus musculus
ctctctggtgtcagtttggtgtcac

SEQ ID NO: 377735 - DNA, 25 bp, Mus musculus
ctctctggtgtctgtttggtgtcac

SEQ ID NO: 377736 - DNA, 25 bp, Mus musculus
ctctctgtactgagcgtgtgtatac

SEQ ID NO: 377737 - DNA, 25 bp, Mus musculus
ctctctgtactgtgcgtgtgtatac

SEQ ID NO: 377738 - DNA, 25 bp, Mus musculus
ctctctgtaggcagagcagtgcagt

SEQ ID NO: 377739 - DNA, 25 bp, Mus musculus
ctctctgtaggctgagcagtgcagt

SEQ ID NO: 377740 - DNA, 25 bp, Mus musculus
ctctctgtcactcacctaactttag

SEQ ID NO: 377741 - DNA, 25 bp, Mus musculus
ctctctgtcactgacctaactttag

SEQ ID NO: 377742 - DNA, 25 bp, Mus musculus
ctctctgtctctctagctttatcta

SEQ ID NO: 377743 - DNA, 25 bp, Mus musculus
ctctctgtctctgtagctttatcta

SEQ ID NO: 377744 - DNA, 25 bp, Mus musculus
ctctctgtgaccctcagagtacact

SEQ ID NO: 377745 - DNA, 25 bp, Mus musculus
ctctctgtgaccgtcagagtacact

SEQ ID NO: 377746 - DNA, 25 bp, Mus musculus
ctctctgtggcactgaaccacttga

SEQ ID NO: 377747 - DNA, 25 bp, Mus musculus
ctctctgtggcagtgaaccacttga

SEQ ID NO: 377748 - DNA, 25 bp, Mus musculus
ctctctgttcagagcttgctaatca

SEQ ID NO: 377749 - DNA, 25 bp, Mus musculus
ctctctgttcagagtagacccacag

SEQ ID NO: 377750 - DNA, 25 bp, Mus musculus
ctctctgttcagtgcttgctaatca

SEQ ID NO: 377751 - DNA, 25 bp, Mus musculus
ctctctgttcagtgtagacccacag

SEQ ID NO: 377752 - DNA, 25 bp, Mus musculus
ctctctgttccaatattcatctttc

SEQ ID NO: 377753 - DNA, 25 bp, Mus musculus
ctctctgttccattattcatctttc

SEQ ID NO: 377754 - DNA, 25 bp, Mus musculus
ctctctgttgagagcgtcttcagtt

SEQ ID NO: 377755 - DNA, 25 bp, Mus musculus
ctctctgttgagtgcgtcttcagtt

SEQ ID NO: 377756 - DNA, 25 bp, Mus musculus
ctctctgtttctccatacacagtag

SEQ ID NO: 377757 - DNA, 25 bp, Mus musculus
ctctctgtttctgcatacacagtag

SEQ ID NO: 377758 - DNA, 25 bp, Mus musculus
ctctcttaattccttttggttcctg

SEQ ID NO: 377759 - DNA, 25 bp, Mus musculus
ctctcttaattcgttttggttcctg

SEQ ID NO: 377760 - DNA, 25 bp, Mus musculus
ctctcttacatactcagcacattta

SEQ ID NO: 377761 - DNA, 25 bp, Mus musculus
ctctcttacatagtcagcacattta

SEQ ID NO: 377762 - DNA, 25 bp, Mus musculus
ctctcttactggctacctgtaatgt

SEQ ID NO: 377763 - DNA, 25 bp, Mus musculus
ctctcttactgggtacctgtaatgt

SEQ ID NO: 377764 - DNA, 25 bp, Mus musculus
ctctcttagcccatgcttaagtgag

SEQ ID NO: 377765 - DNA, 25 bp, Mus musculus
ctctcttagcccttgcttaagtgag

SEQ ID NO: 377766 - DNA, 25 bp, Mus musculus
ctctcttagtcaacattttgcccac

SEQ ID NO: 377767 - DNA, 25 bp, Mus musculus
ctctcttagtcatcattttgcccac

SEQ ID NO: 377768 - DNA, 25 bp, Mus musculus
ctctcttattgaactccagccagag

SEQ ID NO: 377769 - DNA, 25 bp, Mus musculus
ctctcttattgatctccagccagag

SEQ ID NO: 377770 - DNA, 25 bp, Mus musculus
ctctcttatttgaacttgtgtgtgt

SEQ ID NO: 377771 - DNA, 25 bp, Mus musculus
ctctcttatttgtacttgtgtgtgt

SEQ ID NO: 377772 - DNA, 25 bp, Mus musculus
ctctcttcacaaccctgggtttctt

SEQ ID NO: 377773 - DNA, 25 bp, Mus musculus
ctctcttcacaagcctgggtttctt

SEQ ID NO: 377774 - DNA, 25 bp, Mus musculus
ctctcttcatgtactgggagctgta

SEQ ID NO: 377775 - DNA, 25 bp, Mus musculus
ctctcttcatgttctgggagctgta

SEQ ID NO: 377776 - DNA, 25 bp, Mus musculus
ctctcttccacccatgaatatcatt

SEQ ID NO: 377777 - DNA, 25 bp, Mus musculus
ctctcttccaccgatgaatatcatt

SEQ ID NO: 377778 - DNA, 25 bp, Mus musculus
ctctcttcccatagtttacagtgaa

SEQ ID NO: 377779 - DNA, 25 bp, Mus musculus
ctctcttcccattgtttacagtgaa

SEQ ID NO: 377780 - DNA, 25 bp, Mus musculus
ctctcttccgatcgatacagcattg

SEQ ID NO: 377781 - DNA, 25 bp, Mus musculus
ctctcttccgatggatacagcattg

SEQ ID NO: 377782 - DNA, 25 bp, Mus musculus
ctctcttcctctcttactattttaa

SEQ ID NO: 377783 - DNA, 25 bp, Mus musculus
ctctcttcctctgttactattttaa

SEQ ID NO: 377784 - DNA, 25 bp, Mus musculus
ctctcttctatgcattgctgctttt

SEQ ID NO: 377785 - DNA, 25 bp, Mus musculus
ctctcttctatggattgctgctttt

SEQ ID NO: 377786 - DNA, 25 bp, Mus musculus
ctctcttctcttcggcctctaagaa

SEQ ID NO: 377787 - DNA, 25 bp, Mus musculus
ctctcttctcttgggcctctaagaa

SEQ ID NO: 377788 - DNA, 25 bp, Mus musculus
ctctcttcttcacgttttgtgtttc

SEQ ID NO: 377789 - DNA, 25 bp, Mus musculus
ctctcttcttcaggttttgtgtttc

SEQ ID NO: 377790 - DNA, 25 bp, Mus musculus
ctctcttgaaggaaacacataggct

SEQ ID NO: 377791 - DNA, 25 bp, Mus musculus
ctctcttgaaggatgatgtagtgtg

SEQ ID NO: 377792 - DNA, 25 bp, Mus musculus
ctctcttgaaggtaacacataggct

SEQ ID NO: 377793 - DNA, 25 bp, Mus musculus
ctctcttgaaggttgatgtagtgtg

SEQ ID NO: 377794 - DNA, 25 bp, Mus musculus
ctctcttgagagcatgtaaatgtta

SEQ ID NO: 377795 - DNA, 25 bp, Mus musculus
ctctcttgagaggatgtaaatgtta

SEQ ID NO: 377796 - DNA, 25 bp, Mus musculus
ctctcttgatctatatctgtctctg

SEQ ID NO: 377797 - DNA, 25 bp, Mus musculus
ctctcttgatctttatctgtctctg

SEQ ID NO: 377798 - DNA, 25 bp, Mus musculus
ctctcttgccagagactgaaggaaa

SEQ ID NO: 377799 - DNA, 25 bp, Mus musculus
ctctcttgccagtgactgaaggaaa

SEQ ID NO: 377800 - DNA, 25 bp, Mus musculus
ctctcttgctgaagacaatccatat

SEQ ID NO: 377801 - DNA, 25 bp, Mus musculus
ctctcttgctgatgacaatccatat

SEQ ID NO: 377802 - DNA, 25 bp, Mus musculus
ctctcttggcaactgatagttcagc

SEQ ID NO: 377803 - DNA, 25 bp, Mus musculus
ctctcttggcaagtgatagttcagc

SEQ ID NO: 377804 - DNA, 25 bp, Mus musculus
ctctcttgtacgagtgagctgctaa

SEQ ID NO: 377805 - DNA, 25 bp, Mus musculus
ctctcttgtacgtgtgagctgctaa

SEQ ID NO: 377806 - DNA, 25 bp, Mus musculus
ctctcttgtatgcattcaccagaca

SEQ ID NO: 377807 - DNA, 25 bp, Mus musculus
ctctcttgtatggattcaccagaca

SEQ ID NO: 377808 - DNA, 25 bp, Mus musculus
ctctcttgtgaaattgtgccggtta

SEQ ID NO: 377809 - DNA, 25 bp, Mus musculus
ctctcttgtgaatttgtgccggtta

SEQ ID NO: 377810 - DNA, 25 bp, Mus musculus
ctctcttgtgtgagagcatcctaag

SEQ ID NO: 377811 - DNA, 25 bp, Mus musculus
ctctcttgtgtgtgagcatcctaag

SEQ ID NO: 377812 - DNA, 25 bp, Mus musculus
ctctctttctaaaatgcacactggc

SEQ ID NO: 377813 - DNA, 25 bp, Mus musculus
ctctctttctaatatgcacactggc

SEQ ID NO: 377814 - DNA, 25 bp, Mus musculus
ctctctttctacatccaggaggaac

SEQ ID NO: 377815 - DNA, 25 bp, Mus musculus
ctctctttctacttccaggaggaac

SEQ ID NO: 377816 - DNA, 25 bp, Mus musculus
ctctctttgattatgaagtggcgga

SEQ ID NO: 377817 - DNA, 25 bp, Mus musculus
ctctctttgattttgaagtggcgga

SEQ ID NO: 377818 - DNA, 25 bp, Mus musculus
ctctctttgcaacctttaatcccag

SEQ ID NO: 377819 - DNA, 25 bp, Mus musculus
ctctctttgcaagctttaatcccag

SEQ ID NO: 377820 - DNA, 25 bp, Mus musculus
ctctctttgcctaaaacctctttat

SEQ ID NO: 377821 - DNA, 25 bp, Mus musculus
ctctctttgccttaaacctctttat

SEQ ID NO: 377822 - DNA, 25 bp, Mus musculus
ctctctttgcggaaaccatactccg

SEQ ID NO: 377823 - DNA, 25 bp, Mus musculus
ctctctttgcggtaaccatactccg

SEQ ID NO: 377824 - DNA, 25 bp, Mus musculus
ctctctttggatctcagtgttgtgt

SEQ ID NO: 377825 - DNA, 25 bp, Mus musculus
ctctctttggatgtcagtgttgtgt

SEQ ID NO: 377826 - DNA, 25 bp, Mus musculus
ctctctttggtgatgggactgcagt

SEQ ID NO: 377827 - DNA, 25 bp, Mus musculus
ctctctttggtgttgggactgcagt

SEQ ID NO: 377828 - DNA, 25 bp, Mus musculus
ctctctttgtgtatctgaactttgc

SEQ ID NO: 377829 - DNA, 25 bp, Mus musculus
ctctctttgtgtttctgaactttgc

SEQ ID NO: 377830 - DNA, 25 bp, Mus musculus
ctctcttttagcctcaagtgaaact

SEQ ID NO: 377831 - DNA, 25 bp, Mus musculus
ctctcttttagcgtcaagtgaaact

SEQ ID NO: 377832 - DNA, 25 bp, Mus musculus
ctctcttttcttctgaggctaaaga

SEQ ID NO: 377833 - DNA, 25 bp, Mus musculus
ctctcttttcttgtgaggctaaaga

SEQ ID NO: 377834 - DNA, 25 bp, Mus musculus
ctctgaaaccctcgttggcctggaa

SEQ ID NO: 377835 - DNA, 25 bp, Mus musculus
ctctgaaaccctggttggcctggaa

SEQ ID NO: 377836 - DNA, 25 bp, Mus musculus
ctctgaaactctagccttgtgggac

SEQ ID NO: 377837 - DNA, 25 bp, Mus musculus
ctctgaaactcttgccttgtgggac

SEQ ID NO: 377838 - DNA, 25 bp, Mus musculus
ctctgaaactgtctttcccctgcag

SEQ ID NO: 377839 - DNA, 25 bp, Mus musculus
ctctgaaactgtgtttcccctgcag

SEQ ID NO: 377840 - DNA, 25 bp, Mus musculus
ctctgaaactttcggcttttccact

SEQ ID NO: 377841 - DNA, 25 bp, Mus musculus
ctctgaaactttgggcttttccact

SEQ ID NO: 377842 - DNA, 25 bp, Mus musculus
ctctgaaagctgcaactgaagtgtc

SEQ ID NO: 377843 - DNA, 25 bp, Mus musculus
ctctgaaagctggaactgaagtgtc

SEQ ID NO: 377844 - DNA, 25 bp, Mus musculus
ctctgaaagtttagcagtgatgctt

SEQ ID NO: 377845 - DNA, 25 bp, Mus musculus
ctctgaaagttttgcagtgatgctt

SEQ ID NO: 377846 - DNA, 25 bp, Mus musculus
ctctgaaattccagtactgtatctg

SEQ ID NO: 377847 - DNA, 25 bp, Mus musculus
ctctgaaattcctgtactgtatctg

SEQ ID NO: 377848 - DNA, 25 bp, Mus musculus
ctctgaacattgcttccttcttcat

SEQ ID NO: 377849 - DNA, 25 bp, Mus musculus
ctctgaacattggttccttcttcat

SEQ ID NO: 377850 - DNA, 25 bp, Mus musculus
ctctgaagacccatgatagtaagct

SEQ ID NO: 377851 - DNA, 25 bp, Mus musculus
ctctgaagacccttgatagtaagct

SEQ ID NO: 377852 - DNA, 25 bp, Mus musculus
ctctgaaggaggactggaggaccct

SEQ ID NO: 377853 - DNA, 25 bp, Mus musculus
ctctgaaggaggtctggaggaccct

SEQ ID NO: 377854 - DNA, 25 bp, Mus musculus
ctctgaaggatcacagctcgtggat

SEQ ID NO: 377855 - DNA, 25 bp, Mus musculus
ctctgaaggatctcagctcgtggat

SEQ ID NO: 377856 - DNA, 25 bp, Mus musculus
ctctgaagggaaatgggccccagaa

SEQ ID NO: 377857 - DNA, 25 bp, Mus musculus
ctctgaagggaattgggccccagaa

SEQ ID NO: 377858 - DNA, 25 bp, Mus musculus
ctctgaatccaacgctcactgtttg

SEQ ID NO: 377859 - DNA, 25 bp, Mus musculus
ctctgaatccaaggctcactgtttg

SEQ ID NO: 377860 - DNA, 25 bp, Mus musculus
ctctgaatgacaattgggtatcata

SEQ ID NO: 377861 - DNA, 25 bp, Mus musculus
ctctgaatgacatttgggtatcata

SEQ ID NO: 377862 - DNA, 25 bp, Mus musculus
ctctgaatttagctcggttccctgt

SEQ ID NO: 377863 - DNA, 25 bp, Mus musculus
ctctgaatttaggtcggttccctgt

SEQ ID NO: 377864 - DNA, 25 bp, Mus musculus
ctctgaatttgtctgcaggtgtaat

SEQ ID NO: 377865 - DNA, 25 bp, Mus musculus
ctctgaatttgtgtgcaggtgtaat

SEQ ID NO: 377866 - DNA, 25 bp, Mus musculus
ctctgacagccaaatctcttgttat

SEQ ID NO: 377867 - DNA, 25 bp, Mus musculus
ctctgacagccatatctcttgttat

SEQ ID NO: 377868 - DNA, 25 bp, Mus musculus
ctctgacatcttaattttctatact

SEQ ID NO: 377869 - DNA, 25 bp, Mus musculus
ctctgacatctttattttctatact

SEQ ID NO: 377870 - DNA, 25 bp, Mus musculus
ctctgacatgaaagatatttgcaaa

SEQ ID NO: 377871 - DNA, 25 bp, Mus musculus
ctctgacatgaatgatatttgcaaa

SEQ ID NO: 377872 - DNA, 25 bp, Mus musculus
ctctgacatggacgtcccaggaatt

SEQ ID NO: 377873 - DNA, 25 bp, Mus musculus
ctctgacatggaggtcccaggaatt

SEQ ID NO: 377874 - DNA, 25 bp, Mus musculus
ctctgacatggtaagattttgctac

SEQ ID NO: 377875 - DNA, 25 bp, Mus musculus
ctctgacatggttagattttgctac

SEQ ID NO: 377876 - DNA, 25 bp, Mus musculus
ctctgacattagcagctctgcttgc

SEQ ID NO: 377877 - DNA, 25 bp, Mus musculus
ctctgacattaggagctctgcttgc

SEQ ID NO: 377878 - DNA, 25 bp, Mus musculus
ctctgaccactgaacttaaccttgg

SEQ ID NO: 377879 - DNA, 25 bp, Mus musculus
ctctgaccactgtacttaaccttgg

SEQ ID NO: 377880 - DNA, 25 bp, Mus musculus
ctctgaccattcaagtgtactgcca

SEQ ID NO: 377881 - DNA, 25 bp, Mus musculus
ctctgaccattctagtgtactgcca

SEQ ID NO: 377882 - DNA, 25 bp, Mus musculus
ctctgacccactagggttttgtgtt

SEQ ID NO: 377883 - DNA, 25 bp, Mus musculus
ctctgacccacttgggttttgtgtt

SEQ ID NO: 377884 - DNA, 25 bp, Mus musculus
ctctgacccgcaaggaaatgggact

SEQ ID NO: 377885 - DNA, 25 bp, Mus musculus
ctctgacccgcatggaaatgggact

SEQ ID NO: 377886 - DNA, 25 bp, Mus musculus
ctctgaccgatgcttgtgaattgtg

SEQ ID NO: 377887 - DNA, 25 bp, Mus musculus
ctctgaccgatggttgtgaattgtg

SEQ ID NO: 377888 - DNA, 25 bp, Mus musculus
ctctgacctccaagttagtactgtg

SEQ ID NO: 377889 - DNA, 25 bp, Mus musculus
ctctgacctccatgttagtactgtg

SEQ ID NO: 377890 - DNA, 25 bp, Mus musculus
ctctgacctctgagtgatatgatgt

SEQ ID NO: 377891 - DNA, 25 bp, Mus musculus
ctctgacctctgatggtgactgaac

SEQ ID NO: 377892 - DNA, 25 bp, Mus musculus
ctctgacctctgcattcatattgtg

SEQ ID NO: 377893 - DNA, 25 bp, Mus musculus
ctctgacctctggattcatattgtg

SEQ ID NO: 377894 - DNA, 25 bp, Mus musculus
ctctgacctctgtgtgatatgatgt

SEQ ID NO: 377895 - DNA, 25 bp, Mus musculus
ctctgacctctgttggtgactgaac

SEQ ID NO: 377896 - DNA, 25 bp, Mus musculus
ctctgacctgtaattgtgtgtggac

SEQ ID NO: 377897 - DNA, 25 bp, Mus musculus
ctctgacctgtatttgtgtgtggac

SEQ ID NO: 377898 - DNA, 25 bp, Mus musculus
ctctgactccagagcaaggattctg

SEQ ID NO: 377899 - DNA, 25 bp, Mus musculus
ctctgactccagtgcaaggattctg

SEQ ID NO: 377900 - DNA, 25 bp, Mus musculus
ctctgactctgccaaagatttcata

SEQ ID NO: 377901 - DNA, 25 bp, Mus musculus
ctctgactctgcgaaagatttcata

SEQ ID NO: 377902 - DNA, 25 bp, Mus musculus
ctctgactgactatgctatctctaa

SEQ ID NO: 377903 - DNA, 25 bp, Mus musculus
ctctgactgactttgctatctctaa

SEQ ID NO: 377904 - DNA, 25 bp, Mus musculus
ctctgactggagctacctcccagga

SEQ ID NO: 377905 - DNA, 25 bp, Mus musculus
ctctgactggaggtacctcccagga

SEQ ID NO: 377906 - DNA, 25 bp, Mus musculus
ctctgactggccacagaaggcatga

SEQ ID NO: 377907 - DNA, 25 bp, Mus musculus
ctctgactggcctcagaaggcatga

SEQ ID NO: 377908 - DNA, 25 bp, Mus musculus
ctctgactgggacatgagacttgta

SEQ ID NO: 377909 - DNA, 25 bp, Mus musculus
ctctgactgggagatgagacttgta

SEQ ID NO: 377910 - DNA, 25 bp, Mus musculus
ctctgactggtacagcattatgctt

SEQ ID NO: 377911 - DNA, 25 bp, Mus musculus
ctctgactggtagagcattatgctt

SEQ ID NO: 377912 - DNA, 25 bp, Mus musculus
ctctgactgtttaatccactgactg

SEQ ID NO: 377913 - DNA, 25 bp, Mus musculus
ctctgactgttttatccactgactg

SEQ ID NO: 377914 - DNA, 25 bp, Mus musculus
ctctgacttaccattctagtatggc

SEQ ID NO: 377915 - DNA, 25 bp, Mus musculus
ctctgacttacctttctagtatggc

SEQ ID NO: 377916 - DNA, 25 bp, Mus musculus
ctctgacttctgaatttgcataggc

SEQ ID NO: 377917 - DNA, 25 bp, Mus musculus
ctctgacttctgtatttgcataggc

SEQ ID NO: 377918 - DNA, 25 bp, Mus musculus
ctctgacttgtgcttgtgcactgaa

SEQ ID NO: 377919 - DNA, 25 bp, Mus musculus
ctctgacttgtggttgtgcactgaa

SEQ ID NO: 377920 - DNA, 25 bp, Mus musculus
ctctgacttgttccacctgatttta

SEQ ID NO: 377921 - DNA, 25 bp, Mus musculus
ctctgacttgttgcacctgatttta

SEQ ID NO: 377922 - DNA, 25 bp, Mus musculus
ctctgacttttcatcacttcttaga

SEQ ID NO: 377923 - DNA, 25 bp, Mus musculus
ctctgacttttcttcacttcttaga

SEQ ID NO: 377924 - DNA, 25 bp, Mus musculus
ctctgacttttgatttgaatgtggt

SEQ ID NO: 377925 - DNA, 25 bp, Mus musculus
ctctgacttttgttttgaatgtggt

SEQ ID NO: 377926 - DNA, 25 bp, Mus musculus
ctctgagacagcatatcttacatta

SEQ ID NO: 377927 - DNA, 25 bp, Mus musculus
ctctgagacagcttatcttacatta

SEQ ID NO: 377928 - DNA, 25 bp, Mus musculus
ctctgagagaagaaactcctcctcc

SEQ ID NO: 377929 - DNA, 25 bp, Mus musculus
ctctgagagaagtaactcctcctcc

SEQ ID NO: 377930 - DNA, 25 bp, Mus musculus
ctctgagagagactggattggccca

SEQ ID NO: 377931 - DNA, 25 bp, Mus musculus
ctctgagagagagtggattggccca

SEQ ID NO: 377932 - DNA, 25 bp, Mus musculus
ctctgagagctacttctgtgtttct

SEQ ID NO: 377933 - DNA, 25 bp, Mus musculus
ctctgagagctagttctgtgtttct

SEQ ID NO: 377934 - DNA, 25 bp, Mus musculus
ctctgagaggcaagctttcatacga

SEQ ID NO: 377935 - DNA, 25 bp, Mus musculus
ctctgagaggcatgctttcatacga

SEQ ID NO: 377936 - DNA, 25 bp, Mus musculus
ctctgagatgagagcctaggtgtca

SEQ ID NO: 377937 - DNA, 25 bp, Mus musculus
ctctgagatgagtgcctaggtgtca

SEQ ID NO: 377938 - DNA, 25 bp, Mus musculus
ctctgagcaccactctgagaagagt

SEQ ID NO: 377939 - DNA, 25 bp, Mus musculus
ctctgagcaccagtctgagaagagt

SEQ ID NO: 377940 - DNA, 25 bp, Mus musculus
ctctgagcactgaattgtaacttct

SEQ ID NO: 377941 - DNA, 25 bp, Mus musculus
ctctgagcactgtattgtaacttct

SEQ ID NO: 377942 - DNA, 25 bp, Mus musculus
ctctgagcagatcgccctctcttga

SEQ ID NO: 377943 - DNA, 25 bp, Mus musculus
ctctgagcagatggccctctcttga

SEQ ID NO: 377944 - DNA, 25 bp, Mus musculus
ctctgagccggtcactgtctcattg

SEQ ID NO: 377945 - DNA, 25 bp, Mus musculus
ctctgagccggtgactgtctcattg

SEQ ID NO: 377946 - DNA, 25 bp, Mus musculus
ctctgagcggcgcagtagtctacta

SEQ ID NO: 377947 - DNA, 25 bp, Mus musculus
ctctgagcggcggagtagtctacta

SEQ ID NO: 377948 - DNA, 25 bp, Mus musculus
ctctgagctatcaagaccctgttaa

SEQ ID NO: 377949 - DNA, 25 bp, Mus musculus
ctctgagctatctagaccctgttaa

SEQ ID NO: 377950 - DNA, 25 bp, Mus musculus
ctctgagctctgagggcacttgcat

SEQ ID NO: 377951 - DNA, 25 bp, Mus musculus
ctctgagctctgtgggcacttgcat

SEQ ID NO: 377952 - DNA, 25 bp, Mus musculus
ctctgagcttgaagtgtctgcctag

SEQ ID NO: 377953 - DNA, 25 bp, Mus musculus
ctctgagcttgatgtgtctgcctag

SEQ ID NO: 377954 - DNA, 25 bp, Mus musculus
ctctgaggacctacacatgttcata

SEQ ID NO: 377955 - DNA, 25 bp, Mus musculus
ctctgaggaccttcacatgttcata

SEQ ID NO: 377956 - DNA, 25 bp, Mus musculus
ctctgaggactaccttacagctgac

SEQ ID NO: 377957 - DNA, 25 bp, Mus musculus
ctctgaggactagcttacagctgac

SEQ ID NO: 377958 - DNA, 25 bp, Mus musculus
ctctgaggactcatgctaatgtcag

SEQ ID NO: 377959 - DNA, 25 bp, Mus musculus
ctctgaggactcttgctaatgtcag

SEQ ID NO: 377960 - DNA, 25 bp, Mus musculus
ctctgaggcactaaacacaattacc

SEQ ID NO: 377961 - DNA, 25 bp, Mus musculus
ctctgaggcacttaacacaattacc

SEQ ID NO: 377962 - DNA, 25 bp, Mus musculus
ctctgaggcagtattgaccctgtat

SEQ ID NO: 377963 - DNA, 25 bp, Mus musculus
ctctgaggcagttttgaccctgtat

SEQ ID NO: 377964 - DNA, 25 bp, Mus musculus
ctctgaggcggtaagggttcctgca

SEQ ID NO: 377965 - DNA, 25 bp, Mus musculus
ctctgaggcggttagggttcctgca

SEQ ID NO: 377966 - DNA, 25 bp, Mus musculus
ctctgaggcttccatggctactgtg

SEQ ID NO: 377967 - DNA, 25 bp, Mus musculus
ctctgaggcttcgatggctactgtg

SEQ ID NO: 377968 - DNA, 25 bp, Mus musculus
ctctgaggcttgagttgatacttta

SEQ ID NO: 377969 - DNA, 25 bp, Mus musculus
ctctgaggcttgtgttgatacttta

SEQ ID NO: 377970 - DNA, 25 bp, Mus musculus
ctctgagggaaccagtcacacaaca

SEQ ID NO: 377971 - DNA, 25 bp, Mus musculus
ctctgagggaacgagtcacacaaca

SEQ ID NO: 377972 - DNA, 25 bp, Mus musculus
ctctgagggcacctatacttttgtg

SEQ ID NO: 377973 - DNA, 25 bp, Mus musculus
ctctgagggcacgtatacttttgtg

SEQ ID NO: 377974 - DNA, 25 bp, Mus musculus
ctctgagggcggctacacataatct

SEQ ID NO: 377975 - DNA, 25 bp, Mus musculus
ctctgagggcgggtacacataatct

SEQ ID NO: 377976 - DNA, 25 bp, Mus musculus
ctctgagggctccttaatcttttac

SEQ ID NO: 377977 - DNA, 25 bp, Mus musculus
ctctgagggctcgttaatcttttac

SEQ ID NO: 377978 - DNA, 25 bp, Mus musculus
ctctgaggtactctgctagggtgct

SEQ ID NO: 377979 - DNA, 25 bp, Mus musculus
ctctgaggtactgtgctagggtgct

SEQ ID NO: 377980 - DNA, 25 bp, Mus musculus
ctctgaggtatcaaccatgggttct

SEQ ID NO: 377981 - DNA, 25 bp, Mus musculus
ctctgaggtatctaccatgggttct

SEQ ID NO: 377982 - DNA, 25 bp, Mus musculus
ctctgaggtctaaggctttcactgt

SEQ ID NO: 377983 - DNA, 25 bp, Mus musculus
ctctgaggtctatggctttcactgt

SEQ ID NO: 377984 - DNA, 25 bp, Mus musculus
ctctgagtatctcctgtgcacagga

SEQ ID NO: 377985 - DNA, 25 bp, Mus musculus
ctctgagtatctgctgtgcacagga

SEQ ID NO: 377986 - DNA, 25 bp, Mus musculus
ctctgagtctctagaggtcaccaag

SEQ ID NO: 377987 - DNA, 25 bp, Mus musculus
ctctgagtctcttgaggtcaccaag

SEQ ID NO: 377988 - DNA, 25 bp, Mus musculus
ctctgagtgacaaagctttatatac

SEQ ID NO: 377989 - DNA, 25 bp, Mus musculus
ctctgagtgacatagctttatatac

SEQ ID NO: 377990 - DNA, 25 bp, Mus musculus
ctctgagtgatcaaagccaaatatt

SEQ ID NO: 377991 - DNA, 25 bp, Mus musculus
ctctgagtgatctaagccaaatatt

SEQ ID NO: 377992 - DNA, 25 bp, Mus musculus
ctctgagtgcctcgatttcattttt

SEQ ID NO: 377993 - DNA, 25 bp, Mus musculus
ctctgagtgcctggatttcattttt

SEQ ID NO: 377994 - DNA, 25 bp, Mus musculus
ctctgagtgtgacgctagctgagtt

SEQ ID NO: 377995 - DNA, 25 bp, Mus musculus
ctctgagtgtgaggctagctgagtt

SEQ ID NO: 377996 - DNA, 25 bp, Mus musculus
ctctgagttatccagtttgggctac

SEQ ID NO: 377997 - DNA, 25 bp, Mus musculus
ctctgagttatcgagtttgggctac

SEQ ID NO: 377998 - DNA, 25 bp, Mus musculus
ctctgagttccaagcgcagagcctg

SEQ ID NO: 377999 - DNA, 25 bp, Mus musculus
ctctgagttccatgcgcagagcctg

SEQ ID NO: 378000 - DNA, 25 bp, Mus musculus
ctctgagttctacgaggctgcctaa

SEQ ID NO: 378001 - DNA, 25 bp, Mus musculus
ctctgagttctaggaggctgcctaa

SEQ ID NO: 378002 - DNA, 25 bp, Mus musculus
ctctgagttgctcaaatctcctggg

SEQ ID NO: 378003 - DNA, 25 bp, Mus musculus
ctctgagttgctgaaatctcctggg

SEQ ID NO: 378004 - DNA, 25 bp, Mus musculus
ctctgagttggtctgtgtccagcaa

SEQ ID NO: 378005 - DNA, 25 bp, Mus musculus
ctctgagttggtgtgtgtccagcaa

SEQ ID NO: 378006 - DNA, 25 bp, Mus musculus
ctctgatagataaggctgttggctg

SEQ ID NO: 378007 - DNA, 25 bp, Mus musculus
ctctgatagatatggctgttggctg

SEQ ID NO: 378008 - DNA, 25 bp, Mus musculus
ctctgatatacccaccgatgtactt

SEQ ID NO: 378009 - DNA, 25 bp, Mus musculus
ctctgatataccgaccgatgtactt

SEQ ID NO: 378010 - DNA, 25 bp, Mus musculus
ctctgatatcagataccagtgtagt

SEQ ID NO: 378011 - DNA, 25 bp, Mus musculus
ctctgatatcagttaccagtgtagt

SEQ ID NO: 378012 - DNA, 25 bp, Mus musculus
ctctgatccaagcaacgatgctatc

SEQ ID NO: 378013 - DNA, 25 bp, Mus musculus
ctctgatccaaggaacgatgctatc

SEQ ID NO: 378014 - DNA, 25 bp, Mus musculus
ctctgatccaataccaggaggaacg

SEQ ID NO: 378015 - DNA, 25 bp, Mus musculus
ctctgatccaattccaggaggaacg

SEQ ID NO: 378016 - DNA, 25 bp, Mus musculus
ctctgatccagaccaccaaaaatac

SEQ ID NO: 378017 - DNA, 25 bp, Mus musculus
ctctgatccagagcaccaaaaatac

SEQ ID NO: 378018 - DNA, 25 bp, Mus musculus
ctctgatcccagcaccatggaaaag

SEQ ID NO: 378019 - DNA, 25 bp, Mus musculus
ctctgatcccaggaccatggaaaag

SEQ ID NO: 378020 - DNA, 25 bp, Mus musculus
ctctgatccttcattaggctattgg

SEQ ID NO: 378021 - DNA, 25 bp, Mus musculus
ctctgatccttctttaggctattgg

SEQ ID NO: 378022 - DNA, 25 bp, Mus musculus
ctctgatctatgatcttgcagaaat

SEQ ID NO: 378023 - DNA, 25 bp, Mus musculus
ctctgatctatgttcttgcagaaat

SEQ ID NO: 378024 - DNA, 25 bp, Mus musculus
ctctgatctgtacaaatatgaccta

SEQ ID NO: 378025 - DNA, 25 bp, Mus musculus
ctctgatctgtagaaatatgaccta

SEQ ID NO: 378026 - DNA, 25 bp, Mus musculus
ctctgatgccatatatgtgtgtaca

SEQ ID NO: 378027 - DNA, 25 bp, Mus musculus
ctctgatgccatttatgtgtgtaca

SEQ ID NO: 378028 - DNA, 25 bp, Mus musculus
ctctgatgcggccttcttagaaggt

SEQ ID NO: 378029 - DNA, 25 bp, Mus musculus
ctctgatgcggcgttcttagaaggt

SEQ ID NO: 378030 - DNA, 25 bp, Mus musculus
ctctgatggaagagtccgcggagca

SEQ ID NO: 378031 - DNA, 25 bp, Mus musculus
ctctgatggaagtgtccgcggagca

SEQ ID NO: 378032 - DNA, 25 bp, Mus musculus
ctctgatgttggaattcatatgctc

SEQ ID NO: 378033 - DNA, 25 bp, Mus musculus
ctctgatgttggtattcatatgctc

SEQ ID NO: 378034 - DNA, 25 bp, Mus musculus
ctctgattcactagaagagccccag

SEQ ID NO: 378035 - DNA, 25 bp, Mus musculus
ctctgattcacttgaagagccccag

SEQ ID NO: 378036 - DNA, 25 bp, Mus musculus
ctctgattgtgtatgctatgctggg

SEQ ID NO: 378037 - DNA, 25 bp, Mus musculus
ctctgattgtgtttgctatgctggg

SEQ ID NO: 378038 - DNA, 25 bp, Mus musculus
ctctgatttattacctggcgctttt

SEQ ID NO: 378039 - DNA, 25 bp, Mus musculus
ctctgatttatttcctggcgctttt

SEQ ID NO: 378040 - DNA, 25 bp, Mus musculus
ctctgatttcttagtacctcacttt

SEQ ID NO: 378041 - DNA, 25 bp, Mus musculus
ctctgatttctttgtacctcacttt

SEQ ID NO: 378042 - DNA, 25 bp, Mus musculus
ctctgatttggaagaatgtgcccaa

SEQ ID NO: 378043 - DNA, 25 bp, Mus musculus
ctctgatttggatgaatgtgcccaa

SEQ ID NO: 378044 - DNA, 25 bp, Mus musculus
ctctgatttttaaatgctgctaaat

SEQ ID NO: 378045 - DNA, 25 bp, Mus musculus
ctctgatttttatatgctgctaaat

SEQ ID NO: 378046 - DNA, 25 bp, Mus musculus
ctctgatttttgactcagcctggtc

SEQ ID NO: 378047 - DNA, 25 bp, Mus musculus
ctctgatttttgtctcagcctggtc

SEQ ID NO: 378048 - DNA, 25 bp, Mus musculus
ctctgcaaaagtaacaagtgctcta

SEQ ID NO: 378049 - DNA, 25 bp, Mus musculus
ctctgcaaaagttacaagtgctcta

SEQ ID NO: 378050 - DNA, 25 bp, Mus musculus
ctctgcaaacttccttgtcttttta

SEQ ID NO: 378051 - DNA, 25 bp, Mus musculus
ctctgcaaacttgcttgtcttttta

SEQ ID NO: 378052 - DNA, 25 bp, Mus musculus
ctctgcaactctaatacttatccac

SEQ ID NO: 378053 - DNA, 25 bp, Mus musculus
ctctgcaactcttatacttatccac

SEQ ID NO: 378054 - DNA, 25 bp, Mus musculus
ctctgcacaagcatcccaagttgga

SEQ ID NO: 378055 - DNA, 25 bp, Mus musculus
ctctgcacaagcttcccaagttgga

SEQ ID NO: 378056 - DNA, 25 bp, Mus musculus
ctctgcacagaaagggacgcttcgt

SEQ ID NO: 378057 - DNA, 25 bp, Mus musculus
ctctgcacagaatgggacgcttcgt

SEQ ID NO: 378058 - DNA, 25 bp, Mus musculus
ctctgcaccacgagtcttagaatta

SEQ ID NO: 378059 - DNA, 25 bp, Mus musculus
ctctgcaccacgtgtcttagaatta

SEQ ID NO: 378060 - DNA, 25 bp, Mus musculus
ctctgcaccgagaattgctttctgt

SEQ ID NO: 378061 - DNA, 25 bp, Mus musculus
ctctgcaccgagtattgctttctgt

SEQ ID NO: 378062 - DNA, 25 bp, Mus musculus
ctctgcaccgtgctcagggaaatgg

SEQ ID NO: 378063 - DNA, 25 bp, Mus musculus
ctctgcaccgtggtcagggaaatgg

SEQ ID NO: 378064 - DNA, 25 bp, Mus musculus
ctctgcacgccaacgggatagctaa

SEQ ID NO: 378065 - DNA, 25 bp, Mus musculus
ctctgcacgccatcgggatagctaa

SEQ ID NO: 378066 - DNA, 25 bp, Mus musculus
ctctgcagaaacacacaaactaaac

SEQ ID NO: 378067 - DNA, 25 bp, Mus musculus
ctctgcagaaactcacaaactaaac

SEQ ID NO: 378068 - DNA, 25 bp, Mus musculus
ctctgcagaagacccacgaaggtgt

SEQ ID NO: 378069 - DNA, 25 bp, Mus musculus
ctctgcagaagagccacgaaggtgt

SEQ ID NO: 378070 - DNA, 25 bp, Mus musculus
ctctgcagccctacgattcggtatt

SEQ ID NO: 378071 - DNA, 25 bp, Mus musculus
ctctgcagcccttcgattcggtatt

SEQ ID NO: 378072 - DNA, 25 bp, Mus musculus
ctctgcagcgttctttttatgggaa

SEQ ID NO: 378073 - DNA, 25 bp, Mus musculus
ctctgcagcgttgtttttatgggaa

SEQ ID NO: 378074 - DNA, 25 bp, Mus musculus
ctctgcagctatcttgcttcaggca

SEQ ID NO: 378075 - DNA, 25 bp, Mus musculus
ctctgcagctatgttgcttcaggca

SEQ ID NO: 378076 - DNA, 25 bp, Mus musculus
ctctgcagctctcgaatgggagttt

SEQ ID NO: 378077 - DNA, 25 bp, Mus musculus
ctctgcagctctggaatgggagttt

SEQ ID NO: 378078 - DNA, 25 bp, Mus musculus
ctctgcagcttcacaagatgggcac

SEQ ID NO: 378079 - DNA, 25 bp, Mus musculus
ctctgcagcttctcaagatgggcac

SEQ ID NO: 378080 - DNA, 25 bp, Mus musculus
ctctgcaggaaacctcaagtctgtg

SEQ ID NO: 378081 - DNA, 25 bp, Mus musculus
ctctgcaggaaagctcaagtctgtg

SEQ ID NO: 378082 - DNA, 25 bp, Mus musculus
ctctgcagggaacgctgtgtcatgt

SEQ ID NO: 378083 - DNA, 25 bp, Mus musculus
ctctgcagggaaggctgtgtcatgt

SEQ ID NO: 378084 - DNA, 25 bp, Mus musculus
ctctgcaggtgcaatctaaacttgg

SEQ ID NO: 378085 - DNA, 25 bp, Mus musculus
ctctgcaggtgcaggtccagggaaa

SEQ ID NO: 378086 - DNA, 25 bp, Mus musculus
ctctgcaggtgctatctaaacttgg

SEQ ID NO: 378087 - DNA, 25 bp, Mus musculus
ctctgcaggtgctggtccagggaaa

SEQ ID NO: 378088 - DNA, 25 bp, Mus musculus
ctctgcagtcagaagctgcctagag

SEQ ID NO: 378089 - DNA, 25 bp, Mus musculus
ctctgcagtcagtagctgcctagag

SEQ ID NO: 378090 - DNA, 25 bp, Mus musculus
ctctgcatatctatcacacattttg

SEQ ID NO: 378091 - DNA, 25 bp, Mus musculus
ctctgcatatctcaccacaattgta

SEQ ID NO: 378092 - DNA, 25 bp, Mus musculus
ctctgcatatctgaccacaattgta

SEQ ID NO: 378093 - DNA, 25 bp, Mus musculus
ctctgcatatctttcacacattttg

SEQ ID NO: 378094 - DNA, 25 bp, Mus musculus
ctctgcatattgctggaatagccta

SEQ ID NO: 378095 - DNA, 25 bp, Mus musculus
ctctgcatattggtggaatagccta

SEQ ID NO: 378096 - DNA, 25 bp, Mus musculus
ctctgcatcattaatcctgtggtgt

SEQ ID NO: 378097 - DNA, 25 bp, Mus musculus
ctctgcatcatttatcctgtggtgt

SEQ ID NO: 378098 - DNA, 25 bp, Mus musculus
ctctgcatccgaaactacataggaa

SEQ ID NO: 378099 - DNA, 25 bp, Mus musculus
ctctgcatccgatactacataggaa

SEQ ID NO: 378100 - DNA, 25 bp, Mus musculus
ctctgcatctgtcaaacttcagctt

SEQ ID NO: 378101 - DNA, 25 bp, Mus musculus
ctctgcatctgtgaaacttcagctt

SEQ ID NO: 378102 - DNA, 25 bp, Mus musculus
ctctgcatggaaccactgcctgagg

SEQ ID NO: 378103 - DNA, 25 bp, Mus musculus
ctctgcatggaagcactgcctgagg

SEQ ID NO: 378104 - DNA, 25 bp, Mus musculus
ctctgcatggtcctatccatgagta

SEQ ID NO: 378105 - DNA, 25 bp, Mus musculus
ctctgcatggtcgtatccatgagta

SEQ ID NO: 378106 - DNA, 25 bp, Mus musculus
ctctgcatttagatcccctaaggta

SEQ ID NO: 378107 - DNA, 25 bp, Mus musculus
ctctgcatttagttcccctaaggta

SEQ ID NO: 378108 - DNA, 25 bp, Mus musculus
ctctgccaaaggacctaataagttc

SEQ ID NO: 378109 - DNA, 25 bp, Mus musculus
ctctgccaaaggtcctaataagttc

SEQ ID NO: 378110 - DNA, 25 bp, Mus musculus
ctctgccaagtgcttaggactgctt

SEQ ID NO: 378111 - DNA, 25 bp, Mus musculus
ctctgccaagtggttaggactgctt

SEQ ID NO: 378112 - DNA, 25 bp, Mus musculus
ctctgccaatgtcctgggaagactg

SEQ ID NO: 378113 - DNA, 25 bp, Mus musculus
ctctgccaatgtgctgggaagactg

SEQ ID NO: 378114 - DNA, 25 bp, Mus musculus
ctctgccactggatattgtagctta

SEQ ID NO: 378115 - DNA, 25 bp, Mus musculus
ctctgccactggttattgtagctta

SEQ ID NO: 378116 - DNA, 25 bp, Mus musculus
ctctgccagagtctgtactcaacag

SEQ ID NO: 378117 - DNA, 25 bp, Mus musculus
ctctgccagagtgtgtactcaacag

SEQ ID NO: 378118 - DNA, 25 bp, Mus musculus
ctctgccaggagatccaggcagcat

SEQ ID NO: 378119 - DNA, 25 bp, Mus musculus
ctctgccaggagttccaggcagcat

SEQ ID NO: 378120 - DNA, 25 bp, Mus musculus
ctctgccagggacaacgttcagctt

SEQ ID NO: 378121 - DNA, 25 bp, Mus musculus
ctctgccagggagaacgttcagctt

SEQ ID NO: 378122 - DNA, 25 bp, Mus musculus
ctctgccatattacactggacccag

SEQ ID NO: 378123 - DNA, 25 bp, Mus musculus
ctctgccatatttcactggacccag

SEQ ID NO: 378124 - DNA, 25 bp, Mus musculus
ctctgccatgacatcttgtgtagta

SEQ ID NO: 378125 - DNA, 25 bp, Mus musculus
ctctgccatgacttcttgtgtagta

SEQ ID NO: 378126 - DNA, 25 bp, Mus musculus
ctctgccatgtcaacctttactaaa

SEQ ID NO: 378127 - DNA, 25 bp, Mus musculus
ctctgccatgtctacctttactaaa

SEQ ID NO: 378128 - DNA, 25 bp, Mus musculus
ctctgccccgggacgcctaggagcc

SEQ ID NO: 378129 - DNA, 25 bp, Mus musculus
ctctgccccgggtcgcctaggagcc

SEQ ID NO: 378130 - DNA, 25 bp, Mus musculus
ctctgcccggatactgaagccctga

SEQ ID NO: 378131 - DNA, 25 bp, Mus musculus
ctctgcccggattctgaagccctga

SEQ ID NO: 378132 - DNA, 25 bp, Mus musculus
ctctgcccggcaaaagtacttattg

SEQ ID NO: 378133 - DNA, 25 bp, Mus musculus
ctctgcccggcataagtacttattg

SEQ ID NO: 378134 - DNA, 25 bp, Mus musculus
ctctgcccgtatctactgggtcata

SEQ ID NO: 378135 - DNA, 25 bp, Mus musculus
ctctgcccgtatgtactgggtcata

SEQ ID NO: 378136 - DNA, 25 bp, Mus musculus
ctctgcccgttaatagttgactctg

SEQ ID NO: 378137 - DNA, 25 bp, Mus musculus
ctctgcccgttattagttgactctg

SEQ ID NO: 378138 - DNA, 25 bp, Mus musculus
ctctgccctaaactggatagccatg

SEQ ID NO: 378139 - DNA, 25 bp, Mus musculus
ctctgccctaaagtggatagccatg

SEQ ID NO: 378140 - DNA, 25 bp, Mus musculus
ctctgccctggtaggtctgggagta

SEQ ID NO: 378141 - DNA, 25 bp, Mus musculus
ctctgccctggttggtctgggagta

SEQ ID NO: 378142 - DNA, 25 bp, Mus musculus
ctctgcccttatagtgccagaagga

SEQ ID NO: 378143 - DNA, 25 bp, Mus musculus
ctctgcccttattgtgccagaagga

SEQ ID NO: 378144 - DNA, 25 bp, Mus musculus
ctctgccgcgtgagtgaagggtaat

SEQ ID NO: 378145 - DNA, 25 bp, Mus musculus
ctctgccgcgtgtgtgaagggtaat

SEQ ID NO: 378146 - DNA, 25 bp, Mus musculus
ctctgccggcagacgagatctgagt

SEQ ID NO: 378147 - DNA, 25 bp, Mus musculus
ctctgccggcagtcgagatctgagt

SEQ ID NO: 378148 - DNA, 25 bp, Mus musculus
ctctgcctactaaattcccaattga

SEQ ID NO: 378149 - DNA, 25 bp, Mus musculus
ctctgcctactatattcccaattga

SEQ ID NO: 378150 - DNA, 25 bp, Mus musculus
ctctgcctagagctccttcaaaaag

SEQ ID NO: 378151 - DNA, 25 bp, Mus musculus
ctctgcctagaggtccttcaaaaag

SEQ ID NO: 378152 - DNA, 25 bp, Mus musculus
ctctgcctatctacatctacaatgg

SEQ ID NO: 378153 - DNA, 25 bp, Mus musculus
ctctgcctatcttcatctacaatgg

SEQ ID NO: 378154 - DNA, 25 bp, Mus musculus
ctctgcctccataatcttcagaagt

SEQ ID NO: 378155 - DNA, 25 bp, Mus musculus
ctctgcctccattatcttcagaagt

SEQ ID NO: 378156 - DNA, 25 bp, Mus musculus
ctctgcctccttaattccaaattaa

SEQ ID NO: 378157 - DNA, 25 bp, Mus musculus
ctctgcctcctttattccaaattaa

SEQ ID NO: 378158 - DNA, 25 bp, Mus musculus
ctctgcctctaccagcaagagggtg

SEQ ID NO: 378159 - DNA, 25 bp, Mus musculus
ctctgcctctacgagcaagagggtg

SEQ ID NO: 378160 - DNA, 25 bp, Mus musculus
ctctgcctctccagagctctgagag

SEQ ID NO: 378161 - DNA, 25 bp, Mus musculus
ctctgcctctcctgagctctgagag

SEQ ID NO: 378162 - DNA, 25 bp, Mus musculus
ctctgcctctctagtattagaatga

SEQ ID NO: 378163 - DNA, 25 bp, Mus musculus
ctctgcctctcttgtattagaatga

SEQ ID NO: 378164 - DNA, 25 bp, Mus musculus
ctctgcctctgaaggagctcatgga

SEQ ID NO: 378165 - DNA, 25 bp, Mus musculus
ctctgcctctgatggagctcatgga

SEQ ID NO: 378166 - DNA, 25 bp, Mus musculus
ctctgcctctgcaatcatgggtaat

SEQ ID NO: 378167 - DNA, 25 bp, Mus musculus
ctctgcctctgctatcatgggtaat

SEQ ID NO: 378168 - DNA, 25 bp, Mus musculus
ctctgcctctgtactgaatcaggag

SEQ ID NO: 378169 - DNA, 25 bp, Mus musculus
ctctgcctctgttctgaatcaggag

SEQ ID NO: 378170 - DNA, 25 bp, Mus musculus
ctctgcctcttactagggcttagga

SEQ ID NO: 378171 - DNA, 25 bp, Mus musculus
ctctgcctcttagtagggcttagga

SEQ ID NO: 378172 - DNA, 25 bp, Mus musculus
ctctgcctgcatagcaaactgctta

SEQ ID NO: 378173 - DNA, 25 bp, Mus musculus
ctctgcctgcattgcaaactgctta

SEQ ID NO: 378174 - DNA, 25 bp, Mus musculus
ctctgcctgtgaatttcttttctaa

SEQ ID NO: 378175 - DNA, 25 bp, Mus musculus
ctctgcctgtgattttcttttctaa

SEQ ID NO: 378176 - DNA, 25 bp, Mus musculus
ctctgcctgtggctactgttgagaa

SEQ ID NO: 378177 - DNA, 25 bp, Mus musculus
ctctgcctgtgggtactgttgagaa

SEQ ID NO: 378178 - DNA, 25 bp, Mus musculus
ctctgcctgttacgtcacataccaa

SEQ ID NO: 378179 - DNA, 25 bp, Mus musculus
ctctgcctgttaggtcacataccaa

SEQ ID NO: 378180 - DNA, 25 bp, Mus musculus
ctctgccttaatattgtctgttagc

SEQ ID NO: 378181 - DNA, 25 bp, Mus musculus
ctctgccttaattttgtctgttagc

SEQ ID NO: 378182 - DNA, 25 bp, Mus musculus
ctctgccttagcaccagttaatgga

SEQ ID NO: 378183 - DNA, 25 bp, Mus musculus
ctctgccttagctccagttaatgga

SEQ ID NO: 378184 - DNA, 25 bp, Mus musculus
ctctgccttcacagtagatttcaat

SEQ ID NO: 378185 - DNA, 25 bp, Mus musculus
ctctgccttcactgtagatttcaat

SEQ ID NO: 378186 - DNA, 25 bp, Mus musculus
ctctgccttggcaactgcatggaag

SEQ ID NO: 378187 - DNA, 25 bp, Mus musculus
ctctgccttggctactgcatggaag

SEQ ID NO: 378188 - DNA, 25 bp, Mus musculus
ctctgccttgggatcttgcaggaaa

SEQ ID NO: 378189 - DNA, 25 bp, Mus musculus
ctctgccttgggttcttgcaggaaa

SEQ ID NO: 378190 - DNA, 25 bp, Mus musculus
ctctgcctttacattgaagaccaga

SEQ ID NO: 378191 - DNA, 25 bp, Mus musculus
ctctgcctttactttgaagaccaga

SEQ ID NO: 378192 - DNA, 25 bp, Mus musculus
ctctgcctttataaaccacaccagg

SEQ ID NO: 378193 - DNA, 25 bp, Mus musculus
ctctgcctttattaaccacaccagg

SEQ ID NO: 378194 - DNA, 25 bp, Mus musculus
ctctgcgaaagccaagcgtgtttct

SEQ ID NO: 378195 - DNA, 25 bp, Mus musculus
ctctgcgaaagcgaagcgtgtttct

SEQ ID NO: 378196 - DNA, 25 bp, Mus musculus
ctctgcgatgagctgtgtcctgaca

SEQ ID NO: 378197 - DNA, 25 bp, Mus musculus
ctctgcgatgaggtgtgtcctgaca

SEQ ID NO: 378198 - DNA, 25 bp, Mus musculus
ctctgcgatgctatgtgacacacgt

SEQ ID NO: 378199 - DNA, 25 bp, Mus musculus
ctctgcgatgctttgtgacacacgt

SEQ ID NO: 378200 - DNA, 25 bp, Mus musculus
ctctgcgcaaacacgggctactgaa

SEQ ID NO: 378201 - DNA, 25 bp, Mus musculus
ctctgcgcaaactcgggctactgaa

SEQ ID NO: 378202 - DNA, 25 bp, Mus musculus
ctctgcgcacggacagccggctggt

SEQ ID NO: 378203 - DNA, 25 bp, Mus musculus
ctctgcgcacggtcagccggctggt

SEQ ID NO: 378204 - DNA, 25 bp, Mus musculus
ctctgcgcgtacaacagtactaact

SEQ ID NO: 378205 - DNA, 25 bp, Mus musculus
ctctgcgcgtactacagtactaact

SEQ ID NO: 378206 - DNA, 25 bp, Mus musculus
ctctgcgctggcacgtgtgggcaaa

SEQ ID NO: 378207 - DNA, 25 bp, Mus musculus
ctctgcgctggctcgtgtgggcaaa

SEQ ID NO: 378208 - DNA, 25 bp, Mus musculus
ctctgcggaagcctggtcatttgga

SEQ ID NO: 378209 - DNA, 25 bp, Mus musculus
ctctgcggaagcgtggtcatttgga

SEQ ID NO: 378210 - DNA, 25 bp, Mus musculus
ctctgcgggaacatggctggtacat

SEQ ID NO: 378211 - DNA, 25 bp, Mus musculus
ctctgcgggaacttggctggtacat

SEQ ID NO: 378212 - DNA, 25 bp, Mus musculus
ctctgcgtctgcattggatttattt

SEQ ID NO: 378213 - DNA, 25 bp, Mus musculus
ctctgcgtctgctttggatttattt

SEQ ID NO: 378214 - DNA, 25 bp, Mus musculus
ctctgcgttggtacggtaggcctcg

SEQ ID NO: 378215 - DNA, 25 bp, Mus musculus
ctctgcgttggttcggtaggcctcg

SEQ ID NO: 378216 - DNA, 25 bp, Mus musculus
ctctgctacttgagatagtgtggga

SEQ ID NO: 378217 - DNA, 25 bp, Mus musculus
ctctgctacttgtgatagtgtggga

SEQ ID NO: 378218 - DNA, 25 bp, Mus musculus
ctctgctagaataaaagaatgtcac

SEQ ID NO: 378219 - DNA, 25 bp, Mus musculus
ctctgctagaattaaagaatgtcac

SEQ ID NO: 378220 - DNA, 25 bp, Mus musculus
ctctgctagagacagggagtaccta

SEQ ID NO: 378221 - DNA, 25 bp, Mus musculus
ctctgctagagagagggagtaccta

SEQ ID NO: 378222 - DNA, 25 bp, Mus musculus
ctctgctcaagaagccccttaaata

SEQ ID NO: 378223 - DNA, 25 bp, Mus musculus
ctctgctcaagatgccccttaaata

SEQ ID NO: 378224 - DNA, 25 bp, Mus musculus
ctctgctcaggcacaaatgaccata

SEQ ID NO: 378225 - DNA, 25 bp, Mus musculus
ctctgctcaggctcaaatgaccata

SEQ ID NO: 378226 - DNA, 25 bp, Mus musculus
ctctgctccaccactgtaagacgag

SEQ ID NO: 378227 - DNA, 25 bp, Mus musculus
ctctgctccacctctgtaagacgag

SEQ ID NO: 378228 - DNA, 25 bp, Mus musculus
ctctgctcctacaccagtgacccta

SEQ ID NO: 378229 - DNA, 25 bp, Mus musculus
ctctgctcctactccagtgacccta

SEQ ID NO: 378230 - DNA, 25 bp, Mus musculus
ctctgctctcttctgactgtgttca

SEQ ID NO: 378231 - DNA, 25 bp, Mus musculus
ctctgctctcttgtgactgtgttca

SEQ ID NO: 378232 - DNA, 25 bp, Mus musculus
ctctgctcttctcgacaatgtggat

SEQ ID NO: 378233 - DNA, 25 bp, Mus musculus
ctctgctcttctggacaatgtggat

SEQ ID NO: 378234 - DNA, 25 bp, Mus musculus
ctctgctcttggactctagggcaaa

SEQ ID NO: 378235 - DNA, 25 bp, Mus musculus
ctctgctcttggtctctagggcaaa

SEQ ID NO: 378236 - DNA, 25 bp, Mus musculus
ctctgctgaagtcttgctgaaaagc

SEQ ID NO: 378237 - DNA, 25 bp, Mus musculus
ctctgctgaagtgttgctgaaaagc

SEQ ID NO: 378238 - DNA, 25 bp, Mus musculus
ctctgctgagcaaaagtaccatgaa

SEQ ID NO: 378239 - DNA, 25 bp, Mus musculus
ctctgctgagcataagtaccatgaa

SEQ ID NO: 378240 - DNA, 25 bp, Mus musculus
ctctgctgagctacattgctgactc

SEQ ID NO: 378241 - DNA, 25 bp, Mus musculus
ctctgctgagcttcattgctgactc

SEQ ID NO: 378242 - DNA, 25 bp, Mus musculus
ctctgctgccagagacatagactac

SEQ ID NO: 378243 - DNA, 25 bp, Mus musculus
ctctgctgccagtgacatagactac

SEQ ID NO: 378244 - DNA, 25 bp, Mus musculus
ctctgctgctacctgttaattttag

SEQ ID NO: 378245 - DNA, 25 bp, Mus musculus
ctctgctgctacgtgttaattttag

SEQ ID NO: 378246 - DNA, 25 bp, Mus musculus
ctctgctgctttccactgaggaagc

SEQ ID NO: 378247 - DNA, 25 bp, Mus musculus
ctctgctgctttgcactgaggaagc

SEQ ID NO: 378248 - DNA, 25 bp, Mus musculus
ctctgctggcgtacaagttgtattt

SEQ ID NO: 378249 - DNA, 25 bp, Mus musculus
ctctgctggcgttcaagttgtattt

SEQ ID NO: 378250 - DNA, 25 bp, Mus musculus
ctctgctggcttcccagcagagaca

SEQ ID NO: 378251 - DNA, 25 bp, Mus musculus
ctctgctggcttgccagcagagaca

SEQ ID NO: 378252 - DNA, 25 bp, Mus musculus
ctctgctgggaacgtactggctgtc

SEQ ID NO: 378253 - DNA, 25 bp, Mus musculus
ctctgctgggaaggtactggctgtc

SEQ ID NO: 378254 - DNA, 25 bp, Mus musculus
ctctgctgtattacctatggagcat

SEQ ID NO: 378255 - DNA, 25 bp, Mus musculus
ctctgctgtatttcctatggagcat

SEQ ID NO: 378256 - DNA, 25 bp, Mus musculus
ctctgctgtcaaaggcttctggaag

SEQ ID NO: 378257 - DNA, 25 bp, Mus musculus
ctctgctgtcaatggcttctggaag

SEQ ID NO: 378258 - DNA, 25 bp, Mus musculus
ctctgctgtcctctgggatgtgact

SEQ ID NO: 378259 - DNA, 25 bp, Mus musculus
ctctgctgtcctgtgggatgtgact

SEQ ID NO: 378260 - DNA, 25 bp, Mus musculus
ctctgctgtgctcacatgtgtaaat

SEQ ID NO: 378261 - DNA, 25 bp, Mus musculus
ctctgctgtgctgacatgtgtaaat

SEQ ID NO: 378262 - DNA, 25 bp, Mus musculus
ctctgctgtgggagtcctgctggac

SEQ ID NO: 378263 - DNA, 25 bp, Mus musculus
ctctgctgtgggtgtcctgctggac

SEQ ID NO: 378264 - DNA, 25 bp, Mus musculus
ctctgcttaaatattgctccttcac

SEQ ID NO: 378265 - DNA, 25 bp, Mus musculus
ctctgcttaaattttgctccttcac

SEQ ID NO: 378266 - DNA, 25 bp, Mus musculus
ctctgcttagagatgctgcaataaa

SEQ ID NO: 378267 - DNA, 25 bp, Mus musculus
ctctgcttagagttgctgcaataaa

SEQ ID NO: 378268 - DNA, 25 bp, Mus musculus
ctctgcttaggccaagctgttcaaa

SEQ ID NO: 378269 - DNA, 25 bp, Mus musculus
ctctgcttaggcgaagctgttcaaa

SEQ ID NO: 378270 - DNA, 25 bp, Mus musculus
ctctgcttccagctgtgggtagaaa

SEQ ID NO: 378271 - DNA, 25 bp, Mus musculus
ctctgcttccaggtgtgggtagaaa

SEQ ID NO: 378272 - DNA, 25 bp, Mus musculus
ctctgcttcccaattagctgtgatt

SEQ ID NO: 378273 - DNA, 25 bp, Mus musculus
ctctgcttcccatttagctgtgatt

SEQ ID NO: 378274 - DNA, 25 bp, Mus musculus
ctctgcttccgcctaagaatattaa

SEQ ID NO: 378275 - DNA, 25 bp, Mus musculus
ctctgcttccgcgtaagaatattaa

SEQ ID NO: 378276 - DNA, 25 bp, Mus musculus
ctctgcttcctaaattcttagattt

SEQ ID NO: 378277 - DNA, 25 bp, Mus musculus
ctctgcttcctatattcttagattt

SEQ ID NO: 378278 - DNA, 25 bp, Mus musculus
ctctgcttcttcacaaaaagagatt

SEQ ID NO: 378279 - DNA, 25 bp, Mus musculus
ctctgcttcttctcaaaaagagatt

SEQ ID NO: 378280 - DNA, 25 bp, Mus musculus
ctctgcttctttagagactggatga

SEQ ID NO: 378281 - DNA, 25 bp, Mus musculus
ctctgcttcttttgagactggatga

SEQ ID NO: 378282 - DNA, 25 bp, Mus musculus
ctctgcttgaacaccagtgtttcag

SEQ ID NO: 378283 - DNA, 25 bp, Mus musculus
ctctgcttgaactccagtgtttcag

SEQ ID NO: 378284 - DNA, 25 bp, Mus musculus
ctctgcttgcctctgtggagtaggt

SEQ ID NO: 378285 - DNA, 25 bp, Mus musculus
ctctgcttgcctgtgtggagtaggt

SEQ ID NO: 378286 - DNA, 25 bp, Mus musculus
ctctgcttgtctcttcagtagggat

SEQ ID NO: 378287 - DNA, 25 bp, Mus musculus
ctctgcttgtctgttcagtagggat

SEQ ID NO: 378288 - DNA, 25 bp, Mus musculus
ctctgcttgttcatatctgtatctt

SEQ ID NO: 378289 - DNA, 25 bp, Mus musculus
ctctgcttgttcttatctgtatctt

SEQ ID NO: 378290 - DNA, 25 bp, Mus musculus
ctctgctttaagatccttttcttga

SEQ ID NO: 378291 - DNA, 25 bp, Mus musculus
ctctgctttaagttccttttcttga

SEQ ID NO: 378292 - DNA, 25 bp, Mus musculus
ctctgctttcctctgggatatggaa

SEQ ID NO: 378293 - DNA, 25 bp, Mus musculus
ctctgctttcctgtgggatatggaa

SEQ ID NO: 378294 - DNA, 25 bp, Mus musculus
ctctgctttggtactacaatctgtt

SEQ ID NO: 378295 - DNA, 25 bp, Mus musculus
ctctgctttggttctacaatctgtt

SEQ ID NO: 378296 - DNA, 25 bp, Mus musculus
ctctgctttgtacgcacaggctgat

SEQ ID NO: 378297 - DNA, 25 bp, Mus musculus
ctctgctttgtaggcacaggctgat

SEQ ID NO: 378298 - DNA, 25 bp, Mus musculus
ctctgctttgttacttgatgtcttg

SEQ ID NO: 378299 - DNA, 25 bp, Mus musculus
ctctgctttgtttcttgatgtcttg

SEQ ID NO: 378300 - DNA, 25 bp, Mus musculus
ctctggaaagggagcggaaggtagg

SEQ ID NO: 378301 - DNA, 25 bp, Mus musculus
ctctggaaagggtgcggaaggtagg

SEQ ID NO: 378302 - DNA, 25 bp, Mus musculus
ctctggaactccagcctaccaaagg

SEQ ID NO: 378303 - DNA, 25 bp, Mus musculus
ctctggaactcctgcctaccaaagg

SEQ ID NO: 378304 - DNA, 25 bp, Mus musculus
ctctggaactgcagggtctgaggct

SEQ ID NO: 378305 - DNA, 25 bp, Mus musculus
ctctggaactgctgggtctgaggct

SEQ ID NO: 378306 - DNA, 25 bp, Mus musculus
ctctggaagagccttgtgttttaac

SEQ ID NO: 378307 - DNA, 25 bp, Mus musculus
ctctggaagagcgttgtgttttaac

SEQ ID NO: 378308 - DNA, 25 bp, Mus musculus
ctctggaagcacagttgcttgtgcc

SEQ ID NO: 378309 - DNA, 25 bp, Mus musculus
ctctggaagcactgttgcttgtgcc

SEQ ID NO: 378310 - DNA, 25 bp, Mus musculus
ctctggaaggccatgattgtccggg

SEQ ID NO: 378311 - DNA, 25 bp, Mus musculus
ctctggaaggccttgattgtccggg

SEQ ID NO: 378312 - DNA, 25 bp, Mus musculus
ctctggaaggtccagtgtgagctcc

SEQ ID NO: 378313 - DNA, 25 bp, Mus musculus
ctctggaaggtcgagtgtgagctcc

SEQ ID NO: 378314 - DNA, 25 bp, Mus musculus
ctctggaagtgacacacctttgttt

SEQ ID NO: 378315 - DNA, 25 bp, Mus musculus
ctctggaagtgacagtgaccgagaa

SEQ ID NO: 378316 - DNA, 25 bp, Mus musculus
ctctggaagtgagacacctttgttt

SEQ ID NO: 378317 - DNA, 25 bp, Mus musculus
ctctggaagtgagagtgaccgagaa

SEQ ID NO: 378318 - DNA, 25 bp, Mus musculus
ctctggaagttcacaggcctgggtt

SEQ ID NO: 378319 - DNA, 25 bp, Mus musculus
ctctggaagttctcaggcctgggtt

SEQ ID NO: 378320 - DNA, 25 bp, Mus musculus
ctctggaatccactatggtaccatg

SEQ ID NO: 378321 - DNA, 25 bp, Mus musculus
ctctggaatccagtatggtaccatg

SEQ ID NO: 378322 - DNA, 25 bp, Mus musculus
ctctggaatttcagggctagtcttt

SEQ ID NO: 378323 - DNA, 25 bp, Mus musculus
ctctggaatttctgggctagtcttt

SEQ ID NO: 378324 - DNA, 25 bp, Mus musculus
ctctggacaaagcatgctaagctat

SEQ ID NO: 378325 - DNA, 25 bp, Mus musculus
ctctggacaaaggatgctaagctat

SEQ ID NO: 378326 - DNA, 25 bp, Mus musculus
ctctggacacaactactccctgaaa

SEQ ID NO: 378327 - DNA, 25 bp, Mus musculus
ctctggacacaagtactccctgaaa

SEQ ID NO: 378328 - DNA, 25 bp, Mus musculus
ctctggacatttctcctgctcacaa

SEQ ID NO: 378329 - DNA, 25 bp, Mus musculus
ctctggacatttgtcctgctcacaa

SEQ ID NO: 378330 - DNA, 25 bp, Mus musculus
ctctggacctacacaacctgtgaat

SEQ ID NO: 378331 - DNA, 25 bp, Mus musculus
ctctggacctactcaacctgtgaat

SEQ ID NO: 378332 - DNA, 25 bp, Mus musculus
ctctggactctgaggtatgcctcta

SEQ ID NO: 378333 - DNA, 25 bp, Mus musculus
ctctggactctgctaggctgcgaac

SEQ ID NO: 378334 - DNA, 25 bp, Mus musculus
ctctggactctggtaggctgcgaac

SEQ ID NO: 378335 - DNA, 25 bp, Mus musculus
ctctggactctgtggtatgcctcta

SEQ ID NO: 378336 - DNA, 25 bp, Mus musculus
ctctggactgctcgtgttaaggcat

SEQ ID NO: 378337 - DNA, 25 bp, Mus musculus
ctctggactgctggtgttaaggcat

SEQ ID NO: 378338 - DNA, 25 bp, Mus musculus
ctctggacttgcagaaatgattcca

SEQ ID NO: 378339 - DNA, 25 bp, Mus musculus
ctctggacttgctgaaatgattcca

SEQ ID NO: 378340 - DNA, 25 bp, Mus musculus
ctctggagaaggctgctccaatgaa

SEQ ID NO: 378341 - DNA, 25 bp, Mus musculus
ctctggagaagggtgctccaatgaa

SEQ ID NO: 378342 - DNA, 25 bp, Mus musculus
ctctggagaattccctattttcagt

SEQ ID NO: 378343 - DNA, 25 bp, Mus musculus
ctctggagaattgcctattttcagt

SEQ ID NO: 378344 - DNA, 25 bp, Mus musculus
ctctggagacgcacgggctacatct

SEQ ID NO: 378345 - DNA, 25 bp, Mus musculus
ctctggagacgctcgggctacatct

SEQ ID NO: 378346 - DNA, 25 bp, Mus musculus
ctctggagactgaagaccacaggag

SEQ ID NO: 378347 - DNA, 25 bp, Mus musculus
ctctggagactgtagaccacaggag

SEQ ID NO: 378348 - DNA, 25 bp, Mus musculus
ctctggagaggtactctctgcgtgg

SEQ ID NO: 378349 - DNA, 25 bp, Mus musculus
ctctggagaggttctctctgcgtgg

SEQ ID NO: 378350 - DNA, 25 bp, Mus musculus
ctctggagatctaagctctctgctc

SEQ ID NO: 378351 - DNA, 25 bp, Mus musculus
ctctggagatcttagctctctgctc

SEQ ID NO: 378352 - DNA, 25 bp, Mus musculus
ctctggagcaaaaagaagccttact

SEQ ID NO: 378353 - DNA, 25 bp, Mus musculus
ctctggagcaaatagaagccttact

SEQ ID NO: 378354 - DNA, 25 bp, Mus musculus
ctctggagccaccttataatcttac

SEQ ID NO: 378355 - DNA, 25 bp, Mus musculus
ctctggagccacgttataatcttac

SEQ ID NO: 378356 - DNA, 25 bp, Mus musculus
ctctggagctgtccctatggactaa

SEQ ID NO: 378357 - DNA, 25 bp, Mus musculus
ctctggagctgtgcctatggactaa

SEQ ID NO: 378358 - DNA, 25 bp, Mus musculus
ctctggagtcaaaggcctgggcgca

SEQ ID NO: 378359 - DNA, 25 bp, Mus musculus
ctctggagtcaatggcctgggcgca

SEQ ID NO: 378360 - DNA, 25 bp, Mus musculus
ctctggagtcagatggtggctaaac

SEQ ID NO: 378361 - DNA, 25 bp, Mus musculus
ctctggagtcagctgctttaacaat

SEQ ID NO: 378362 - DNA, 25 bp, Mus musculus
ctctggagtcaggtgctttaacaat

SEQ ID NO: 378363 - DNA, 25 bp, Mus musculus
ctctggagtcagttggtggctaaac

SEQ ID NO: 378364 - DNA, 25 bp, Mus musculus
ctctggagtctaagtgtgtgaagga

SEQ ID NO: 378365 - DNA, 25 bp, Mus musculus
ctctggagtctatgtgtgtgaagga

SEQ ID NO: 378366 - DNA, 25 bp, Mus musculus
ctctggagttacagttctacagttt

SEQ ID NO: 378367 - DNA, 25 bp, Mus musculus
ctctggagttactgttctacagttt

SEQ ID NO: 378368 - DNA, 25 bp, Mus musculus
ctctggatagcacctggacctgagc

SEQ ID NO: 378369 - DNA, 25 bp, Mus musculus
ctctggatagcagctggacctgagc

SEQ ID NO: 378370 - DNA, 25 bp, Mus musculus
ctctggataggtataagcggttcaa

SEQ ID NO: 378371 - DNA, 25 bp, Mus musculus
ctctggataggtttaagcggttcaa

SEQ ID NO: 378372 - DNA, 25 bp, Mus musculus
ctctggatagtcagacaggagctat

SEQ ID NO: 378373 - DNA, 25 bp, Mus musculus
ctctggatagtctgacaggagctat

SEQ ID NO: 378374 - DNA, 25 bp, Mus musculus
ctctggatagtgactcatggcatat

SEQ ID NO: 378375 - DNA, 25 bp, Mus musculus
ctctggatagtgtctcatggcatat

SEQ ID NO: 378376 - DNA, 25 bp, Mus musculus
ctctggatatggatagctaggcttg

SEQ ID NO: 378377 - DNA, 25 bp, Mus musculus
ctctggatatggttagctaggcttg

SEQ ID NO: 378378 - DNA, 25 bp, Mus musculus
ctctggatcaagaaaggaaccgtct

SEQ ID NO: 378379 - DNA, 25 bp, Mus musculus
ctctggatcaagtaaggaaccgtct

SEQ ID NO: 378380 - DNA, 25 bp, Mus musculus
ctctggatcacaccaatgacatcat

SEQ ID NO: 378381 - DNA, 25 bp, Mus musculus
ctctggatcacagcaatgacatcat

SEQ ID NO: 378382 - DNA, 25 bp, Mus musculus
ctctggatcatgactcctgtggagt

SEQ ID NO: 378383 - DNA, 25 bp, Mus musculus
ctctggatcatgtctcctgtggagt

SEQ ID NO: 378384 - DNA, 25 bp, Mus musculus
ctctggatcctacacagggctcaat

SEQ ID NO: 378385 - DNA, 25 bp, Mus musculus
ctctggatcctagacagggctcaat

SEQ ID NO: 378386 - DNA, 25 bp, Mus musculus
ctctggatcgggaaacctggtgaca

SEQ ID NO: 378387 - DNA, 25 bp, Mus musculus
ctctggatcgggtaacctggtgaca

SEQ ID NO: 378388 - DNA, 25 bp, Mus musculus
ctctggatgtaaatgggtttctgct

SEQ ID NO: 378389 - DNA, 25 bp, Mus musculus
ctctggatgtaattgggtttctgct

SEQ ID NO: 378390 - DNA, 25 bp, Mus musculus
ctctggattgtgagctgttcttata

SEQ ID NO: 378391 - DNA, 25 bp, Mus musculus
ctctggattgtgtgctgttcttata

SEQ ID NO: 378392 - DNA, 25 bp, Mus musculus
ctctggatttgtcacaaggagcatt

SEQ ID NO: 378393 - DNA, 25 bp, Mus musculus
ctctggatttgtgacaaggagcatt

SEQ ID NO: 378394 - DNA, 25 bp, Mus musculus
ctctggcaacatactttatctggga

SEQ ID NO: 378395 - DNA, 25 bp, Mus musculus
ctctggcaacattctttatctggga

SEQ ID NO: 378396 - DNA, 25 bp, Mus musculus
ctctggcaaggcatgtagggttctg

SEQ ID NO: 378397 - DNA, 25 bp, Mus musculus
ctctggcaaggcttgtagggttctg

SEQ ID NO: 378398 - DNA, 25 bp, Mus musculus
ctctggcaatctacttcataatggg

SEQ ID NO: 378399 - DNA, 25 bp, Mus musculus
ctctggcaatcttcttcataatggg

SEQ ID NO: 378400 - DNA, 25 bp, Mus musculus
ctctggcactcgactttggatgaaa

SEQ ID NO: 378401 - DNA, 25 bp, Mus musculus
ctctggcactcgtctttggatgaaa

SEQ ID NO: 378402 - DNA, 25 bp, Mus musculus
ctctggcagaagacatccatgtcag

SEQ ID NO: 378403 - DNA, 25 bp, Mus musculus
ctctggcagaagtcatccatgtcag

SEQ ID NO: 378404 - DNA, 25 bp, Mus musculus
ctctggcagccaacattcagggtga

SEQ ID NO: 378405 - DNA, 25 bp, Mus musculus
ctctggcagccatcattcagggtga

SEQ ID NO: 378406 - DNA, 25 bp, Mus musculus
ctctggcatccacggtcttcagttt

SEQ ID NO: 378407 - DNA, 25 bp, Mus musculus
ctctggcatccagggtcttcagttt

SEQ ID NO: 378408 - DNA, 25 bp, Mus musculus
ctctggcatgggaggagcgtctcca

SEQ ID NO: 378409 - DNA, 25 bp, Mus musculus
ctctggcatgggtggagcgtctcca

SEQ ID NO: 378410 - DNA, 25 bp, Mus musculus
ctctggccacccacggtgatggagg

SEQ ID NO: 378411 - DNA, 25 bp, Mus musculus
ctctggccaccctcggtgatggagg

SEQ ID NO: 378412 - DNA, 25 bp, Mus musculus
ctctggccactgaacttgttaattt

SEQ ID NO: 378413 - DNA, 25 bp, Mus musculus
ctctggccactgtacttgttaattt

SEQ ID NO: 378414 - DNA, 25 bp, Mus musculus
ctctggccagcacctgggagagaca

SEQ ID NO: 378415 - DNA, 25 bp, Mus musculus
ctctggccagcagctgggagagaca

SEQ ID NO: 378416 - DNA, 25 bp, Mus musculus
ctctggccaggacctttgtttgcaa

SEQ ID NO: 378417 - DNA, 25 bp, Mus musculus
ctctggccaggagctttgtttgcaa

SEQ ID NO: 378418 - DNA, 25 bp, Mus musculus
ctctggcccaagatgtaaactatca

SEQ ID NO: 378419 - DNA, 25 bp, Mus musculus
ctctggcccaagttgtaaactatca

SEQ ID NO: 378420 - DNA, 25 bp, Mus musculus
ctctggcccagcagatggacagtga

SEQ ID NO: 378421 - DNA, 25 bp, Mus musculus
ctctggcccagctgatggacagtga

SEQ ID NO: 378422 - DNA, 25 bp, Mus musculus
ctctggccctacacactattttata

SEQ ID NO: 378423 - DNA, 25 bp, Mus musculus
ctctggccctactcactattttata

SEQ ID NO: 378424 - DNA, 25 bp, Mus musculus
ctctggccgaggaagagctccggca

SEQ ID NO: 378425 - DNA, 25 bp, Mus musculus
ctctggccgaggtagagctccggca

SEQ ID NO: 378426 - DNA, 25 bp, Mus musculus
ctctggcctctgctttccatgtcaa

SEQ ID NO: 378427 - DNA, 25 bp, Mus musculus
ctctggcctctggtttccatgtcaa

SEQ ID NO: 378428 - DNA, 25 bp, Mus musculus
ctctggcctgaacaacccacagatg

SEQ ID NO: 378429 - DNA, 25 bp, Mus musculus
ctctggcctgaagaacccacagatg

SEQ ID NO: 378430 - DNA, 25 bp, Mus musculus
ctctggcctggaactgttaggtact

SEQ ID NO: 378431 - DNA, 25 bp, Mus musculus
ctctggcctggatctgttaggtact

SEQ ID NO: 378432 - DNA, 25 bp, Mus musculus
ctctggcctgtaactctttgttttc

SEQ ID NO: 378433 - DNA, 25 bp, Mus musculus
ctctggcctgtatctctttgttttc

SEQ ID NO: 378434 - DNA, 25 bp, Mus musculus
ctctggcgaccaccctgagagagag

SEQ ID NO: 378435 - DNA, 25 bp, Mus musculus
ctctggcgaccagcctgagagagag

SEQ ID NO: 378436 - DNA, 25 bp, Mus musculus
ctctggcgatttccctggacaagtg

SEQ ID NO: 378437 - DNA, 25 bp, Mus musculus
ctctggcgatttgcctggacaagtg

SEQ ID NO: 378438 - DNA, 25 bp, Mus musculus
ctctggcgcggacgctcttgaatct

SEQ ID NO: 378439 - DNA, 25 bp, Mus musculus
ctctggcgcggaggctcttgaatct

SEQ ID NO: 378440 - DNA, 25 bp, Mus musculus
ctctggctagccagtgtacacgtag

SEQ ID NO: 378441 - DNA, 25 bp, Mus musculus
ctctggctagcctgtgtacacgtag

SEQ ID NO: 378442 - DNA, 25 bp, Mus musculus
ctctggctatccatagcctgggaaa

SEQ ID NO: 378443 - DNA, 25 bp, Mus musculus
ctctggctatccttagcctgggaaa

SEQ ID NO: 378444 - DNA, 25 bp, Mus musculus
ctctggctatgaacgaaggctacct

SEQ ID NO: 378445 - DNA, 25 bp, Mus musculus
ctctggctatgatcgaaggctacct

SEQ ID NO: 378446 - DNA, 25 bp, Mus musculus
ctctggctcattaaggaagtgacat

SEQ ID NO: 378447 - DNA, 25 bp, Mus musculus
ctctggctcatttaggaagtgacat

SEQ ID NO: 378448 - DNA, 25 bp, Mus musculus
ctctggctccctacagagcaatatt

SEQ ID NO: 378449 - DNA, 25 bp, Mus musculus
ctctggctcccttcagagcaatatt

SEQ ID NO: 378450 - DNA, 25 bp, Mus musculus
ctctggctccggatggtattttata

SEQ ID NO: 378451 - DNA, 25 bp, Mus musculus
ctctggctccggttggtattttata

SEQ ID NO: 378452 - DNA, 25 bp, Mus musculus
ctctggctcgacatcggatggtaga

SEQ ID NO: 378453 - DNA, 25 bp, Mus musculus
ctctggctcgacttcggatggtaga

SEQ ID NO: 378454 - DNA, 25 bp, Mus musculus
ctctggctcttgaggtgtggactca

SEQ ID NO: 378455 - DNA, 25 bp, Mus musculus
ctctggctcttgtggtgtggactca

SEQ ID NO: 378456 - DNA, 25 bp, Mus musculus
ctctggctgctcagtgagaggaatt

SEQ ID NO: 378457 - DNA, 25 bp, Mus musculus
ctctggctgctctgtgagaggaatt

SEQ ID NO: 378458 - DNA, 25 bp, Mus musculus
ctctggctgctgaagctacagaaaa

SEQ ID NO: 378459 - DNA, 25 bp, Mus musculus
ctctggctgctgctgaacaccgggc

SEQ ID NO: 378460 - DNA, 25 bp, Mus musculus
ctctggctgctggtgaacaccgggc

SEQ ID NO: 378461 - DNA, 25 bp, Mus musculus
ctctggctgctgtagctacagaaaa

SEQ ID NO: 378462 - DNA, 25 bp, Mus musculus
ctctggctgcttctaaacatcaact

SEQ ID NO: 378463 - DNA, 25 bp, Mus musculus
ctctggctgcttgtaaacatcaact

SEQ ID NO: 378464 - DNA, 25 bp, Mus musculus
ctctggctgtacagtcctctaaagg

SEQ ID NO: 378465 - DNA, 25 bp, Mus musculus
ctctggctgtactgtcctctaaagg

SEQ ID NO: 378466 - DNA, 25 bp, Mus musculus
ctctggcttcacaatttacctggaa

SEQ ID NO: 378467 - DNA, 25 bp, Mus musculus
ctctggcttcactatttacctggaa

SEQ ID NO: 378468 - DNA, 25 bp, Mus musculus
ctctggcttcagcacacacgtgtac

SEQ ID NO: 378469 - DNA, 25 bp, Mus musculus
ctctggcttcaggacacacgtgtac

SEQ ID NO: 378470 - DNA, 25 bp, Mus musculus
ctctggcttctgaccatgttgagta

SEQ ID NO: 378471 - DNA, 25 bp, Mus musculus
ctctggcttctgtccatgttgagta

SEQ ID NO: 378472 - DNA, 25 bp, Mus musculus
ctctggcttcttaagggctcaagat

SEQ ID NO: 378473 - DNA, 25 bp, Mus musculus
ctctggcttctttagggctcaagat

SEQ ID NO: 378474 - DNA, 25 bp, Mus musculus
ctctggcttgagattcttgtgcatt

SEQ ID NO: 378475 - DNA, 25 bp, Mus musculus
ctctggcttgagtttcttgtgcatt

SEQ ID NO: 378476 - DNA, 25 bp, Mus musculus
ctctggcttggaaaacagtacccat

SEQ ID NO: 378477 - DNA, 25 bp, Mus musculus
ctctggcttggataacagtacccat

SEQ ID NO: 378478 - DNA, 25 bp, Mus musculus
ctctggctttgcattgaatctaagg

SEQ ID NO: 378479 - DNA, 25 bp, Mus musculus
ctctggctttgctttgaatctaagg

SEQ ID NO: 378480 - DNA, 25 bp, Mus musculus
ctctggcttttcacctggtctcagc

SEQ ID NO: 378481 - DNA, 25 bp, Mus musculus
ctctggcttttctcctggtctcagc

SEQ ID NO: 378482 - DNA, 25 bp, Mus musculus
ctctggcttttgaatgtgacacctt

SEQ ID NO: 378483 - DNA, 25 bp, Mus musculus
ctctggcttttgtatgtgacacctt

SEQ ID NO: 378484 - DNA, 25 bp, Mus musculus
ctctggctttttcgttctgttacta

SEQ ID NO: 378485 - DNA, 25 bp, Mus musculus
ctctggctttttggttctgttacta

SEQ ID NO: 378486 - DNA, 25 bp, Mus musculus
ctctgggaaaggaatactgtgggtt

SEQ ID NO: 378487 - DNA, 25 bp, Mus musculus
ctctgggaaaggtatactgtgggtt

SEQ ID NO: 378488 - DNA, 25 bp, Mus musculus
ctctgggaactacgcaacatggaat

SEQ ID NO: 378489 - DNA, 25 bp, Mus musculus
ctctgggaactaggcaacatggaat

SEQ ID NO: 378490 - DNA, 25 bp, Mus musculus
ctctgggaaggcaggctccctgaaa

SEQ ID NO: 378491 - DNA, 25 bp, Mus musculus
ctctgggaaggcatcggagccacag

SEQ ID NO: 378492 - DNA, 25 bp, Mus musculus
ctctgggaaggctggctccctgaaa

SEQ ID NO: 378493 - DNA, 25 bp, Mus musculus
ctctgggaaggcttcggagccacag

SEQ ID NO: 378494 - DNA, 25 bp, Mus musculus
ctctgggacatcaaggtggcggcta

SEQ ID NO: 378495 - DNA, 25 bp, Mus musculus
ctctgggacatctaggtggcggcta

SEQ ID NO: 378496 - DNA, 25 bp, Mus musculus
ctctgggagcggaacctgcggatac

SEQ ID NO: 378497 - DNA, 25 bp, Mus musculus
ctctgggagcggtacctgcggatac

SEQ ID NO: 378498 - DNA, 25 bp, Mus musculus
ctctgggagggcagaatctgcttgt

SEQ ID NO: 378499 - DNA, 25 bp, Mus musculus
ctctgggagggctgaatctgcttgt

SEQ ID NO: 378500 - DNA, 25 bp, Mus musculus
ctctgggaggtcagatgctgtcttc

SEQ ID NO: 378501 - DNA, 25 bp, Mus musculus
ctctgggaggtctgatgctgtcttc

SEQ ID NO: 378502 - DNA, 25 bp, Mus musculus
ctctgggaggttccggcaagatcta

SEQ ID NO: 378503 - DNA, 25 bp, Mus musculus
ctctgggaggttgcggcaagatcta

SEQ ID NO: 378504 - DNA, 25 bp, Mus musculus
ctctgggagtgcatactcacagttt

SEQ ID NO: 378505 - DNA, 25 bp, Mus musculus
ctctgggagtgcttactcacagttt

SEQ ID NO: 378506 - DNA, 25 bp, Mus musculus
ctctgggagtttcacggaggctcta

SEQ ID NO: 378507 - DNA, 25 bp, Mus musculus
ctctgggagtttgacggaggctcta

SEQ ID NO: 378508 - DNA, 25 bp, Mus musculus
ctctgggattgcagaattctggctg

SEQ ID NO: 378509 - DNA, 25 bp, Mus musculus
ctctgggattgctgaattctggctg

SEQ ID NO: 378510 - DNA, 25 bp, Mus musculus
ctctgggatttgataatccaggagt

SEQ ID NO: 378511 - DNA, 25 bp, Mus musculus
ctctgggatttgttaatccaggagt

SEQ ID NO: 378512 - DNA, 25 bp, Mus musculus
ctctgggcaagtatagggaaggttc

SEQ ID NO: 378513 - DNA, 25 bp, Mus musculus
ctctgggcaagtttagggaaggttc

SEQ ID NO: 378514 - DNA, 25 bp, Mus musculus
ctctgggcactcctaacaacgaagt

SEQ ID NO: 378515 - DNA, 25 bp, Mus musculus
ctctgggcactcgtaacaacgaagt

SEQ ID NO: 378516 - DNA, 25 bp, Mus musculus
ctctgggcagctctataggatcatc

SEQ ID NO: 378517 - DNA, 25 bp, Mus musculus
ctctgggcagctgtataggatcatc

SEQ ID NO: 378518 - DNA, 25 bp, Mus musculus
ctctgggcatcgatcctggtgggaa

SEQ ID NO: 378519 - DNA, 25 bp, Mus musculus
ctctgggcatcgttcctggtgggaa

SEQ ID NO: 378520 - DNA, 25 bp, Mus musculus
ctctgggccatcaacaggactatta

SEQ ID NO: 378521 - DNA, 25 bp, Mus musculus
ctctgggccatctacaggactatta

SEQ ID NO: 378522 - DNA, 25 bp, Mus musculus
ctctgggcctacagtgacacaggaa

SEQ ID NO: 378523 - DNA, 25 bp, Mus musculus
ctctgggcctactgtgacacaggaa

SEQ ID NO: 378524 - DNA, 25 bp, Mus musculus
ctctgggcgtcaaggcagcctgtta

SEQ ID NO: 378525 - DNA, 25 bp, Mus musculus
ctctgggcgtcatggcagcctgtta

SEQ ID NO: 378526 - DNA, 25 bp, Mus musculus
ctctgggctctcctgtcagtcaaag

SEQ ID NO: 378527 - DNA, 25 bp, Mus musculus
ctctgggctctcgtgtcagtcaaag

SEQ ID NO: 378528 - DNA, 25 bp, Mus musculus
ctctgggctgcactacgggaaagca

SEQ ID NO: 378529 - DNA, 25 bp, Mus musculus
ctctgggctgcagtacgggaaagca

SEQ ID NO: 378530 - DNA, 25 bp, Mus musculus
ctctgggctggcagcaggaactgac

SEQ ID NO: 378531 - DNA, 25 bp, Mus musculus
ctctgggctggctgcaggaactgac

SEQ ID NO: 378532 - DNA, 25 bp, Mus musculus
ctctgggctgtacgaatctgggcac

SEQ ID NO: 378533 - DNA, 25 bp, Mus musculus
ctctgggctgtaggaatctgggcac

SEQ ID NO: 378534 - DNA, 25 bp, Mus musculus
ctctgggcttctattttgatcggga

SEQ ID NO: 378535 - DNA, 25 bp, Mus musculus
ctctgggcttctcctgtaggtaact

SEQ ID NO: 378536 - DNA, 25 bp, Mus musculus
ctctgggcttctgctgtaggtaact

SEQ ID NO: 378537 - DNA, 25 bp, Mus musculus
ctctgggcttcttttttgatcggga

SEQ ID NO: 378538 - DNA, 25 bp, Mus musculus
ctctgggcttgacactcaacgtaaa

SEQ ID NO: 378539 - DNA, 25 bp, Mus musculus
ctctgggcttgagactcaacgtaaa

SEQ ID NO: 378540 - DNA, 25 bp, Mus musculus
ctctgggcttggaagggactgttta

SEQ ID NO: 378541 - DNA, 25 bp, Mus musculus
ctctgggcttggtagggactgttta

SEQ ID NO: 378542 - DNA, 25 bp, Mus musculus
ctctgggctttcctatgtatgctat

SEQ ID NO: 378543 - DNA, 25 bp, Mus musculus
ctctgggctttcgtatgtatgctat

SEQ ID NO: 378544 - DNA, 25 bp, Mus musculus
ctctgggcttttatgtggtgttcat

SEQ ID NO: 378545 - DNA, 25 bp, Mus musculus
ctctgggcttttttgtggtgttcat

SEQ ID NO: 378546 - DNA, 25 bp, Mus musculus
ctctgggtaaccctgctcctgaaag

SEQ ID NO: 378547 - DNA, 25 bp, Mus musculus
ctctgggtaaccgtgctcctgaaag

SEQ ID NO: 378548 - DNA, 25 bp, Mus musculus
ctctgggtcctcacaggtagagaca

SEQ ID NO: 378549 - DNA, 25 bp, Mus musculus
ctctgggtcctctcaggtagagaca

SEQ ID NO: 378550 - DNA, 25 bp, Mus musculus
ctctgggtctataggaaggcgctat

SEQ ID NO: 378551 - DNA, 25 bp, Mus musculus
ctctgggtctattggaaggcgctat

SEQ ID NO: 378552 - DNA, 25 bp, Mus musculus
ctctgggtctgcagttctgagagac

SEQ ID NO: 378553 - DNA, 25 bp, Mus musculus
ctctgggtctgctgttctgagagac

SEQ ID NO: 378554 - DNA, 25 bp, Mus musculus
ctctgggtgccaatattactgcttg

SEQ ID NO: 378555 - DNA, 25 bp, Mus musculus
ctctgggtgccattattactgcttg

SEQ ID NO: 378556 - DNA, 25 bp, Mus musculus
ctctgggtggttctattctgagcac

SEQ ID NO: 378557 - DNA, 25 bp, Mus musculus
ctctgggtggttgtattctgagcac

SEQ ID NO: 378558 - DNA, 25 bp, Mus musculus
ctctgggttaagatgttagctcctt

SEQ ID NO: 378559 - DNA, 25 bp, Mus musculus
ctctgggttaagttgttagctcctt

SEQ ID NO: 378560 - DNA, 25 bp, Mus musculus
ctctgggttactcaacgctttttat

SEQ ID NO: 378561 - DNA, 25 bp, Mus musculus
ctctgggttactgaacgctttttat

SEQ ID NO: 378562 - DNA, 25 bp, Mus musculus
ctctggtaatttcagaagatctgac

SEQ ID NO: 378563 - DNA, 25 bp, Mus musculus
ctctggtaatttgagaagatctgac

SEQ ID NO: 378564 - DNA, 25 bp, Mus musculus
ctctggtattaacagctctgctctg

SEQ ID NO: 378565 - DNA, 25 bp, Mus musculus
ctctggtattaagagctctgctctg

SEQ ID NO: 378566 - DNA, 25 bp, Mus musculus
ctctggtattcactttaccttgtga

SEQ ID NO: 378567 - DNA, 25 bp, Mus musculus
ctctggtattcagtttaccttgtga

SEQ ID NO: 378568 - DNA, 25 bp, Mus musculus
ctctggtcaaatcagtctggactgt

SEQ ID NO: 378569 - DNA, 25 bp, Mus musculus
ctctggtcaaatgagtctggactgt

SEQ ID NO: 378570 - DNA, 25 bp, Mus musculus
ctctggtcacacatacctttcaaaa

SEQ ID NO: 378571 - DNA, 25 bp, Mus musculus
ctctggtcacacttacctttcaaaa

SEQ ID NO: 378572 - DNA, 25 bp, Mus musculus
ctctggtcatgaacatatgctgtgt

SEQ ID NO: 378573 - DNA, 25 bp, Mus musculus
ctctggtcatgatcatatgctgtgt

SEQ ID NO: 378574 - DNA, 25 bp, Mus musculus
ctctggtcattgagaacctgtgtga

SEQ ID NO: 378575 - DNA, 25 bp, Mus musculus
ctctggtcattgtgaacctgtgtga

SEQ ID NO: 378576 - DNA, 25 bp, Mus musculus
ctctggtccccaaatgtgagacatg

SEQ ID NO: 378577 - DNA, 25 bp, Mus musculus
ctctggtccccatatgtgagacatg

SEQ ID NO: 378578 - DNA, 25 bp, Mus musculus
ctctggtcccgcaaaacttgaatga

SEQ ID NO: 378579 - DNA, 25 bp, Mus musculus
ctctggtcccgctaaacttgaatga

SEQ ID NO: 378580 - DNA, 25 bp, Mus musculus
ctctggtcctacaggactctgacac

SEQ ID NO: 378581 - DNA, 25 bp, Mus musculus
ctctggtcctactggactctgacac

SEQ ID NO: 378582 - DNA, 25 bp, Mus musculus
ctctggtctctacctagttgtctta

SEQ ID NO: 378583 - DNA, 25 bp, Mus musculus
ctctggtctctagctagttgtctta

SEQ ID NO: 378584 - DNA, 25 bp, Mus musculus
ctctggtctctgaattttcacccca

SEQ ID NO: 378585 - DNA, 25 bp, Mus musculus
ctctggtctctgtattttcacccca

SEQ ID NO: 378586 - DNA, 25 bp, Mus musculus
ctctggtctgaactgtttagctgtt

SEQ ID NO: 378587 - DNA, 25 bp, Mus musculus
ctctggtctgaagtgtttagctgtt

SEQ ID NO: 378588 - DNA, 25 bp, Mus musculus
ctctggtctgttagtaattagcact

SEQ ID NO: 378589 - DNA, 25 bp, Mus musculus
ctctggtctgtttgtaattagcact

SEQ ID NO: 378590 - DNA, 25 bp, Mus musculus
ctctggtgcctcacctaggactggg

SEQ ID NO: 378591 - DNA, 25 bp, Mus musculus
ctctggtgcctctcctaggactggg

SEQ ID NO: 378592 - DNA, 25 bp, Mus musculus
ctctggtgctagctccggagacggc

SEQ ID NO: 378593 - DNA, 25 bp, Mus musculus
ctctggtgctaggtccggagacggc

SEQ ID NO: 378594 - DNA, 25 bp, Mus musculus
ctctggtgctccaagtcatttttaa

SEQ ID NO: 378595 - DNA, 25 bp, Mus musculus
ctctggtgctcctagtcatttttaa

SEQ ID NO: 378596 - DNA, 25 bp, Mus musculus
ctctggtgtcctacgagtgcgagaa

SEQ ID NO: 378597 - DNA, 25 bp, Mus musculus
ctctggtgtccttcgagtgcgagaa

SEQ ID NO: 378598 - DNA, 25 bp, Mus musculus
ctctggtgttagatactgcctgtaa

SEQ ID NO: 378599 - DNA, 25 bp, Mus musculus
ctctggtgttagttactgcctgtaa

SEQ ID NO: 378600 - DNA, 25 bp, Mus musculus
ctctggttcaccactgggatggaga

SEQ ID NO: 378601 - DNA, 25 bp, Mus musculus
ctctggttcacctctgggatggaga

SEQ ID NO: 378602 - DNA, 25 bp, Mus musculus
ctctggttcagacactcgaagactc

SEQ ID NO: 378603 - DNA, 25 bp, Mus musculus
ctctggttcagagactcgaagactc

SEQ ID NO: 378604 - DNA, 25 bp, Mus musculus
ctctggttcattaagctgtttggca

SEQ ID NO: 378605 - DNA, 25 bp, Mus musculus
ctctggttcatttagctgtttggca

SEQ ID NO: 378606 - DNA, 25 bp, Mus musculus
ctctggttcccaatctataggatgt

SEQ ID NO: 378607 - DNA, 25 bp, Mus musculus
ctctggttcccattctataggatgt

SEQ ID NO: 378608 - DNA, 25 bp, Mus musculus
ctctggttccttctttcagtaacaa

SEQ ID NO: 378609 - DNA, 25 bp, Mus musculus
ctctggttccttgtttcagtaacaa

SEQ ID NO: 378610 - DNA, 25 bp, Mus musculus
ctctggttctggagccacagcttgg

SEQ ID NO: 378611 - DNA, 25 bp, Mus musculus
ctctggttctggtgccacagcttgg

SEQ ID NO: 378612 - DNA, 25 bp, Mus musculus
ctctggttgacacccactcaaaaag

SEQ ID NO: 378613 - DNA, 25 bp, Mus musculus
ctctggttgacagccactcaaaaag

SEQ ID NO: 378614 - DNA, 25 bp, Mus musculus
ctctggttgtcgcaaagcatctgaa

SEQ ID NO: 378615 - DNA, 25 bp, Mus musculus
ctctggttgtcggaaagcatctgaa

SEQ ID NO: 378616 - DNA, 25 bp, Mus musculus
ctctggttgtggagcccgggccctc

SEQ ID NO: 378617 - DNA, 25 bp, Mus musculus
ctctggttgtggtgcccgggccctc

SEQ ID NO: 378618 - DNA, 25 bp, Mus musculus
ctctggtttattattctctgttgaa

SEQ ID NO: 378619 - DNA, 25 bp, Mus musculus
ctctggtttatttttctctgttgaa

SEQ ID NO: 378620 - DNA, 25 bp, Mus musculus
ctctggtttgaacccgattgctctg

SEQ ID NO: 378621 - DNA, 25 bp, Mus musculus
ctctggtttgaagccgattgctctg

SEQ ID NO: 378622 - DNA, 25 bp, Mus musculus
ctctgtaaaccaagacaagtcaagg

SEQ ID NO: 378623 - DNA, 25 bp, Mus musculus
ctctgtaaaccatgacaagtcaagg

SEQ ID NO: 378624 - DNA, 25 bp, Mus musculus
ctctgtaaagcccaaacaattgtta

SEQ ID NO: 378625 - DNA, 25 bp, Mus musculus
ctctgtaaagccctgtatgcagtga

SEQ ID NO: 378626 - DNA, 25 bp, Mus musculus
ctctgtaaagccgaaacaattgtta

SEQ ID NO: 378627 - DNA, 25 bp, Mus musculus
ctctgtaaagccgtgtatgcagtga

SEQ ID NO: 378628 - DNA, 25 bp, Mus musculus
ctctgtaattttcaagctctctgta

SEQ ID NO: 378629 - DNA, 25 bp, Mus musculus
ctctgtaattttgaagctctctgta

SEQ ID NO: 378630 - DNA, 25 bp, Mus musculus
ctctgtacacttagggctttttctt

SEQ ID NO: 378631 - DNA, 25 bp, Mus musculus
ctctgtacactttgggctttttctt

SEQ ID NO: 378632 - DNA, 25 bp, Mus musculus
ctctgtacaggccaaggctgcgtag

SEQ ID NO: 378633 - DNA, 25 bp, Mus musculus
ctctgtacaggcgaaggctgcgtag

SEQ ID NO: 378634 - DNA, 25 bp, Mus musculus
ctctgtacattaacactggtcaccc

SEQ ID NO: 378635 - DNA, 25 bp, Mus musculus
ctctgtacattatcactggtcaccc

SEQ ID NO: 378636 - DNA, 25 bp, Mus musculus
ctctgtaccattccggctctgaggg

SEQ ID NO: 378637 - DNA, 25 bp, Mus musculus
ctctgtaccattgcggctctgaggg

SEQ ID NO: 378638 - DNA, 25 bp, Mus musculus
ctctgtaccgtgatgtgatgctgga

SEQ ID NO: 378639 - DNA, 25 bp, Mus musculus
ctctgtaccgtgttgtgatgctgga

SEQ ID NO: 378640 - DNA, 25 bp, Mus musculus
ctctgtacggttctcgccatgtcac

SEQ ID NO: 378641 - DNA, 25 bp, Mus musculus
ctctgtacggttgtcgccatgtcac

SEQ ID NO: 378642 - DNA, 25 bp, Mus musculus
ctctgtacttggattgccattggca

SEQ ID NO: 378643 - DNA, 25 bp, Mus musculus
ctctgtacttggtttgccattggca

SEQ ID NO: 378644 - DNA, 25 bp, Mus musculus
ctctgtagacccactatctgtgagt

SEQ ID NO: 378645 - DNA, 25 bp, Mus musculus
ctctgtagaccctctatctgtgagt

SEQ ID NO: 378646 - DNA, 25 bp, Mus musculus
ctctgtagcgtcctgcggcaatatt

SEQ ID NO: 378647 - DNA, 25 bp, Mus musculus
ctctgtagcgtcgtgcggcaatatt

SEQ ID NO: 378648 - DNA, 25 bp, Mus musculus
ctctgtagctggagacagtaccctg

SEQ ID NO: 378649 - DNA, 25 bp, Mus musculus
ctctgtagctggtgacagtaccctg

SEQ ID NO: 378650 - DNA, 25 bp, Mus musculus
ctctgtatcactcttctaggactgg

SEQ ID NO: 378651 - DNA, 25 bp, Mus musculus
ctctgtatcactgttctaggactgg

SEQ ID NO: 378652 - DNA, 25 bp, Mus musculus
ctctgtatctgtatctttgctgtgt

SEQ ID NO: 378653 - DNA, 25 bp, Mus musculus
ctctgtatctgtttctttgctgtgt

SEQ ID NO: 378654 - DNA, 25 bp, Mus musculus
ctctgtattactaatcattctggcc

SEQ ID NO: 378655 - DNA, 25 bp, Mus musculus
ctctgtattacttatcattctggcc

SEQ ID NO: 378656 - DNA, 25 bp, Mus musculus
ctctgtattatccttctgatgccaa

SEQ ID NO: 378657 - DNA, 25 bp, Mus musculus
ctctgtattatcgttctgatgccaa

SEQ ID NO: 378658 - DNA, 25 bp, Mus musculus
ctctgtattatgcttcctctgggaa

SEQ ID NO: 378659 - DNA, 25 bp, Mus musculus
ctctgtattatggttcctctgggaa

SEQ ID NO: 378660 - DNA, 25 bp, Mus musculus
ctctgtattcacctgctgtttatga

SEQ ID NO: 378661 - DNA, 25 bp, Mus musculus
ctctgtattcacgtgctgtttatga

SEQ ID NO: 378662 - DNA, 25 bp, Mus musculus
ctctgtattcttagtaaattctaga

SEQ ID NO: 378663 - DNA, 25 bp, Mus musculus
ctctgtattctttgtaaattctaga

SEQ ID NO: 378664 - DNA, 25 bp, Mus musculus
ctctgtattttcaagcaaatttcct

SEQ ID NO: 378665 - DNA, 25 bp, Mus musculus
ctctgtattttctagcaaatttcct

SEQ ID NO: 378666 - DNA, 25 bp, Mus musculus
ctctgtatttttaggtcactgtgga

SEQ ID NO: 378667 - DNA, 25 bp, Mus musculus
ctctgtattttttggtcactgtgga

SEQ ID NO: 378668 - DNA, 25 bp, Mus musculus
ctctgtcaatgacaggtccactcgt

SEQ ID NO: 378669 - DNA, 25 bp, Mus musculus
ctctgtcaatgagaggtccactcgt

SEQ ID NO: 378670 - DNA, 25 bp, Mus musculus
ctctgtcaccctctgacatttagaa

SEQ ID NO: 378671 - DNA, 25 bp, Mus musculus
ctctgtcaccctgtgacatttagaa

SEQ ID NO: 378672 - DNA, 25 bp, Mus musculus
ctctgtcacctcagtgcagggaaac

SEQ ID NO: 378673 - DNA, 25 bp, Mus musculus
ctctgtcacctctgtgcagggaaac

SEQ ID NO: 378674 - DNA, 25 bp, Mus musculus
ctctgtcacgcacgccatgtttgag

SEQ ID NO: 378675 - DNA, 25 bp, Mus musculus
ctctgtcacgcaggccatgtttgag

SEQ ID NO: 378676 - DNA, 25 bp, Mus musculus
ctctgtcagctaagaatctctttta

SEQ ID NO: 378677 - DNA, 25 bp, Mus musculus
ctctgtcagctatgaatctctttta

SEQ ID NO: 378678 - DNA, 25 bp, Mus musculus
ctctgtcaggctcttattcagaagt

SEQ ID NO: 378679 - DNA, 25 bp, Mus musculus
ctctgtcaggctgttattcagaagt

SEQ ID NO: 378680 - DNA, 25 bp, Mus musculus
ctctgtcagtgtatgccccaggaga

SEQ ID NO: 378681 - DNA, 25 bp, Mus musculus
ctctgtcagtgtttgccccaggaga

SEQ ID NO: 378682 - DNA, 25 bp, Mus musculus
ctctgtcatcctagtaaaatttcca

SEQ ID NO: 378683 - DNA, 25 bp, Mus musculus
ctctgtcatccttgtaaaatttcca

SEQ ID NO: 378684 - DNA, 25 bp, Mus musculus
ctctgtcatctaaaacctttggaga

SEQ ID NO: 378685 - DNA, 25 bp, Mus musculus
ctctgtcatctataacctttggaga

SEQ ID NO: 378686 - DNA, 25 bp, Mus musculus
ctctgtcattgacttttgagattta

SEQ ID NO: 378687 - DNA, 25 bp, Mus musculus
ctctgtcattgagttttgagattta

SEQ ID NO: 378688 - DNA, 25 bp, Mus musculus
ctctgtcatttcaggtgtcatttca

SEQ ID NO: 378689 - DNA, 25 bp, Mus musculus
ctctgtcatttctggtgtcatttca

SEQ ID NO: 378690 - DNA, 25 bp, Mus musculus
ctctgtccaaggcttgagaatctca

SEQ ID NO: 378691 - DNA, 25 bp, Mus musculus
ctctgtccaagggttgagaatctca

SEQ ID NO: 378692 - DNA, 25 bp, Mus musculus
ctctgtccacccatgaagtagaact

SEQ ID NO: 378693 - DNA, 25 bp, Mus musculus
ctctgtccacccttgaagtagaact

SEQ ID NO: 378694 - DNA, 25 bp, Mus musculus
ctctgtccagccaccatgataagcg

SEQ ID NO: 378695 - DNA, 25 bp, Mus musculus
ctctgtccagcctccatgataagcg

SEQ ID NO: 378696 - DNA, 25 bp, Mus musculus
ctctgtccatctcccaatttctttg

SEQ ID NO: 378697 - DNA, 25 bp, Mus musculus
ctctgtccatctgccaatttctttg

SEQ ID NO: 378698 - DNA, 25 bp, Mus musculus
ctctgtccattgatcctgctaataa

SEQ ID NO: 378699 - DNA, 25 bp, Mus musculus
ctctgtccattgttcctgctaataa

SEQ ID NO: 378700 - DNA, 25 bp, Mus musculus
ctctgtcccaggatctttgaatcct

SEQ ID NO: 378701 - DNA, 25 bp, Mus musculus
ctctgtcccaggttctttgaatcct

SEQ ID NO: 378702 - DNA, 25 bp, Mus musculus
ctctgtcccattctgtctttcagtt

SEQ ID NO: 378703 - DNA, 25 bp, Mus musculus
ctctgtcccattgtgtctttcagtt

SEQ ID NO: 378704 - DNA, 25 bp, Mus musculus
ctctgtccccttcatttagaatttg

SEQ ID NO: 378705 - DNA, 25 bp, Mus musculus
ctctgtccccttgatttagaatttg

SEQ ID NO: 378706 - DNA, 25 bp, Mus musculus
ctctgtcccttcagtatgcatatgt

SEQ ID NO: 378707 - DNA, 25 bp, Mus musculus
ctctgtcccttctgtatgcatatgt

SEQ ID NO: 378708 - DNA, 25 bp, Mus musculus
ctctgtcctcaaccgggacaggcag

SEQ ID NO: 378709 - DNA, 25 bp, Mus musculus
ctctgtcctcaagcgggacaggcag

SEQ ID NO: 378710 - DNA, 25 bp, Mus musculus
ctctgtccttacactgcaatcaaga

SEQ ID NO: 378711 - DNA, 25 bp, Mus musculus
ctctgtccttactctgcaatcaaga

SEQ ID NO: 378712 - DNA, 25 bp, Mus musculus
ctctgtcctttcatgtgggatgttg

SEQ ID NO: 378713 - DNA, 25 bp, Mus musculus
ctctgtcctttcttgtgggatgttg

SEQ ID NO: 378714 - DNA, 25 bp, Mus musculus
ctctgtcgctagcaagcaggcaacc

SEQ ID NO: 378715 - DNA, 25 bp, Mus musculus
ctctgtcgctaggaagcaggcaacc

SEQ ID NO: 378716 - DNA, 25 bp, Mus musculus
ctctgtcggtctcttcattacatca

SEQ ID NO: 378717 - DNA, 25 bp, Mus musculus
ctctgtcggtctgttcattacatca

SEQ ID NO: 378718 - DNA, 25 bp, Mus musculus
ctctgtcgtattcaccttcagtttt

SEQ ID NO: 378719 - DNA, 25 bp, Mus musculus
ctctgtcgtattgaccttcagtttt

SEQ ID NO: 378720 - DNA, 25 bp, Mus musculus
ctctgtctatgcagcggccccaaag

SEQ ID NO: 378721 - DNA, 25 bp, Mus musculus
ctctgtctatgctgcggccccaaag

SEQ ID NO: 378722 - DNA, 25 bp, Mus musculus
ctctgtctcaccagtattactggaa

SEQ ID NO: 378723 - DNA, 25 bp, Mus musculus
ctctgtctcacctgtattactggaa

SEQ ID NO: 378724 - DNA, 25 bp, Mus musculus
ctctgtctccctagatcggtcagca

SEQ ID NO: 378725 - DNA, 25 bp, Mus musculus
ctctgtctcccttgatcggtcagca

SEQ ID NO: 378726 - DNA, 25 bp, Mus musculus
ctctgtctccggcacttgaaggaaa

SEQ ID NO: 378727 - DNA, 25 bp, Mus musculus
ctctgtctccgggacttgaaggaaa

SEQ ID NO: 378728 - DNA, 25 bp, Mus musculus
ctctgtctcgcgcaaacctggaaat

SEQ ID NO: 378729 - DNA, 25 bp, Mus musculus
ctctgtctcgcgctggagagaagca

SEQ ID NO: 378730 - DNA, 25 bp, Mus musculus
ctctgtctcgcggaaacctggaaat

SEQ ID NO: 378731 - DNA, 25 bp, Mus musculus
ctctgtctcgcggtggagagaagca

SEQ ID NO: 378732 - DNA, 25 bp, Mus musculus
ctctgtctctccactaaaagggttg

SEQ ID NO: 378733 - DNA, 25 bp, Mus musculus
ctctgtctctcctctaaaagggttg

SEQ ID NO: 378734 - DNA, 25 bp, Mus musculus
ctctgtctctctattacaaaggagt

SEQ ID NO: 378735 - DNA, 25 bp, Mus musculus
ctctgtctctctccacattgggcgt

SEQ ID NO: 378736 - DNA, 25 bp, Mus musculus
ctctgtctctctgcacattgggcgt

SEQ ID NO: 378737 - DNA, 25 bp, Mus musculus
ctctgtctctcttttacaaaggagt

SEQ ID NO: 378738 - DNA, 25 bp, Mus musculus
ctctgtctctgtatatgtcttgctc

SEQ ID NO: 378739 - DNA, 25 bp, Mus musculus
ctctgtctctgtttatgtcttgctc

SEQ ID NO: 378740 - DNA, 25 bp, Mus musculus
ctctgtctcttcaggctaggataga

SEQ ID NO: 378741 - DNA, 25 bp, Mus musculus
ctctgtctcttcctaaaattcaaat

SEQ ID NO: 378742 - DNA, 25 bp, Mus musculus
ctctgtctcttcgtaaaattcaaat

SEQ ID NO: 378743 - DNA, 25 bp, Mus musculus
ctctgtctcttctggctaggataga

SEQ ID NO: 378744 - DNA, 25 bp, Mus musculus
ctctgtctggatctggaccactgac

SEQ ID NO: 378745 - DNA, 25 bp, Mus musculus
ctctgtctggatgtggaccactgac

SEQ ID NO: 378746 - DNA, 25 bp, Mus musculus
ctctgtctgtatctgcttctgaggg

SEQ ID NO: 378747 - DNA, 25 bp, Mus musculus
ctctgtctgtatgtgcttctgaggg

SEQ ID NO: 378748 - DNA, 25 bp, Mus musculus
ctctgtctgtctaagatcatgaatc

SEQ ID NO: 378749 - DNA, 25 bp, Mus musculus
ctctgtctgtcttagatcatgaatc

SEQ ID NO: 378750 - DNA, 25 bp, Mus musculus
ctctgtctgtgtaagggcctggaaa

SEQ ID NO: 378751 - DNA, 25 bp, Mus musculus
ctctgtctgtgttagggcctggaaa

SEQ ID NO: 378752 - DNA, 25 bp, Mus musculus
ctctgtcttactacacaactgcagt

SEQ ID NO: 378753 - DNA, 25 bp, Mus musculus
ctctgtcttacttcacaactgcagt

SEQ ID NO: 378754 - DNA, 25 bp, Mus musculus
ctctgtcttccaaccagatgtgtgg

SEQ ID NO: 378755 - DNA, 25 bp, Mus musculus
ctctgtcttccatccagatgtgtgg

SEQ ID NO: 378756 - DNA, 25 bp, Mus musculus
ctctgtcttcggagctccaatttta

SEQ ID NO: 378757 - DNA, 25 bp, Mus musculus
ctctgtcttcggtgctccaatttta

SEQ ID NO: 378758 - DNA, 25 bp, Mus musculus
ctctgtgaaaataatccgcctggtc

SEQ ID NO: 378759 - DNA, 25 bp, Mus musculus
ctctgtgaaaattatccgcctggtc

SEQ ID NO: 378760 - DNA, 25 bp, Mus musculus
ctctgtgaacccctatattttctgg

SEQ ID NO: 378761 - DNA, 25 bp, Mus musculus
ctctgtgaacccgtatattttctgg

SEQ ID NO: 378762 - DNA, 25 bp, Mus musculus
ctctgtgaagacctcatctggaaca

SEQ ID NO: 378763 - DNA, 25 bp, Mus musculus
ctctgtgaagacgtcatctggaaca

SEQ ID NO: 378764 - DNA, 25 bp, Mus musculus
ctctgtgaagttagacccgtacacc

SEQ ID NO: 378765 - DNA, 25 bp, Mus musculus
ctctgtgaagtttgacccgtacacc

SEQ ID NO: 378766 - DNA, 25 bp, Mus musculus
ctctgtgaatgaaacttatctgtta

SEQ ID NO: 378767 - DNA, 25 bp, Mus musculus
ctctgtgaatgatacttatctgtta

SEQ ID NO: 378768 - DNA, 25 bp, Mus musculus
ctctgtgaattaatgttccctccta

SEQ ID NO: 378769 - DNA, 25 bp, Mus musculus
ctctgtgaattattgttccctccta

SEQ ID NO: 378770 - DNA, 25 bp, Mus musculus
ctctgtgacagacctcaaggttggt

SEQ ID NO: 378771 - DNA, 25 bp, Mus musculus
ctctgtgacagagctcaaggttggt

SEQ ID NO: 378772 - DNA, 25 bp, Mus musculus
ctctgtgactttactctgttcagca

SEQ ID NO: 378773 - DNA, 25 bp, Mus musculus
ctctgtgacttttctctgttcagca

SEQ ID NO: 378774 - DNA, 25 bp, Mus musculus
ctctgtgagcaccactgagtgatct

SEQ ID NO: 378775 - DNA, 25 bp, Mus musculus
ctctgtgagcacgactgagtgatct

SEQ ID NO: 378776 - DNA, 25 bp, Mus musculus
ctctgtgagtttatcatcactaagt

SEQ ID NO: 378777 - DNA, 25 bp, Mus musculus
ctctgtgagtttttcatcactaagt

SEQ ID NO: 378778 - DNA, 25 bp, Mus musculus
ctctgtgatctgacggctgaatgat

SEQ ID NO: 378779 - DNA, 25 bp, Mus musculus
ctctgtgatctgtcggctgaatgat

SEQ ID NO: 378780 - DNA, 25 bp, Mus musculus
ctctgtgatggaagccaacacggtt

SEQ ID NO: 378781 - DNA, 25 bp, Mus musculus
ctctgtgatggatgccaacacggtt

SEQ ID NO: 378782 - DNA, 25 bp, Mus musculus
ctctgtgcatatacatcatataata

SEQ ID NO: 378783 - DNA, 25 bp, Mus musculus
ctctgtgcatattcatcatataata

SEQ ID NO: 378784 - DNA, 25 bp, Mus musculus
ctctgtgcatttagctgggaatgtt

SEQ ID NO: 378785 - DNA, 25 bp, Mus musculus
ctctgtgcattttgctgggaatgtt

SEQ ID NO: 378786 - DNA, 25 bp, Mus musculus
ctctgtgccagaaactcatattagt

SEQ ID NO: 378787 - DNA, 25 bp, Mus musculus
ctctgtgccagatactcatattagt

SEQ ID NO: 378788 - DNA, 25 bp, Mus musculus
ctctgtgccattagcgttactgagg

SEQ ID NO: 378789 - DNA, 25 bp, Mus musculus
ctctgtgccatttgcgttactgagg

SEQ ID NO: 378790 - DNA, 25 bp, Mus musculus
ctctgtgcctgtaggaagagccaca

SEQ ID NO: 378791 - DNA, 25 bp, Mus musculus
ctctgtgcctgttggaagagccaca

SEQ ID NO: 378792 - DNA, 25 bp, Mus musculus
ctctgtgctacaactgtccatgtgt

SEQ ID NO: 378793 - DNA, 25 bp, Mus musculus
ctctgtgctacatctgtccatgtgt

SEQ ID NO: 378794 - DNA, 25 bp, Mus musculus
ctctgtgctcagcatttgttgggtt

SEQ ID NO: 378795 - DNA, 25 bp, Mus musculus
ctctgtgctcaggatttgttgggtt

SEQ ID NO: 378796 - DNA, 25 bp, Mus musculus
ctctgtgctctcagtaggagtcaga

SEQ ID NO: 378797 - DNA, 25 bp, Mus musculus
ctctgtgctctctgtaggagtcaga

SEQ ID NO: 378798 - DNA, 25 bp, Mus musculus
ctctgtgctctgagaagctgtggag

SEQ ID NO: 378799 - DNA, 25 bp, Mus musculus
ctctgtgctctgtgaagctgtggag

SEQ ID NO: 378800 - DNA, 25 bp, Mus musculus
ctctgtgctgctccgtagagctctc

SEQ ID NO: 378801 - DNA, 25 bp, Mus musculus
ctctgtgctgctgcgtagagctctc

SEQ ID NO: 378802 - DNA, 25 bp, Mus musculus
ctctgtgctggaaggcagcagataa

SEQ ID NO: 378803 - DNA, 25 bp, Mus musculus
ctctgtgctggactaaaagggaact

SEQ ID NO: 378804 - DNA, 25 bp, Mus musculus
ctctgtgctggagtaaaagggaact

SEQ ID NO: 378805 - DNA, 25 bp, Mus musculus
ctctgtgctggatggcagcagataa

SEQ ID NO: 378806 - DNA, 25 bp, Mus musculus
ctctgtgcttccaactatcactgaa

SEQ ID NO: 378807 - DNA, 25 bp, Mus musculus
ctctgtgcttcctactatcactgaa

SEQ ID NO: 378808 - DNA, 25 bp, Mus musculus
ctctgtgcttgcacttgaggtagaa

SEQ ID NO: 378809 - DNA, 25 bp, Mus musculus
ctctgtgcttgctcttgaggtagaa

SEQ ID NO: 378810 - DNA, 25 bp, Mus musculus
ctctgtggagggacggccgtttgca

SEQ ID NO: 378811 - DNA, 25 bp, Mus musculus
ctctgtggagggtcggccgtttgca

SEQ ID NO: 378812 - DNA, 25 bp, Mus musculus
ctctgtggccaaactgtatgctttt

SEQ ID NO: 378813 - DNA, 25 bp, Mus musculus
ctctgtggccaatctgtatgctttt

SEQ ID NO: 378814 - DNA, 25 bp, Mus musculus
ctctgtggctaacaattgctccagt

SEQ ID NO: 378815 - DNA, 25 bp, Mus musculus
ctctgtggctaagaattgctccagt

SEQ ID NO: 378816 - DNA, 25 bp, Mus musculus
ctctgtgggatcacctgcaacagtt

SEQ ID NO: 378817 - DNA, 25 bp, Mus musculus
ctctgtgggatctcctgcaacagtt

SEQ ID NO: 378818 - DNA, 25 bp, Mus musculus
ctctgtgggcacatgcattcatgtg

SEQ ID NO: 378819 - DNA, 25 bp, Mus musculus
ctctgtgggcacatggatgcgtgta

SEQ ID NO: 378820 - DNA, 25 bp, Mus musculus
ctctgtgggcacttgcattcatgtg

SEQ ID NO: 378821 - DNA, 25 bp, Mus musculus
ctctgtgggcacttggatgcgtgta

SEQ ID NO: 378822 - DNA, 25 bp, Mus musculus
ctctgtggtagaactgagtccagac

SEQ ID NO: 378823 - DNA, 25 bp, Mus musculus
ctctgtggtagatctgagtccagac

SEQ ID NO: 378824 - DNA, 25 bp, Mus musculus
ctctgtggtctcagtgctgaataaa

SEQ ID NO: 378825 - DNA, 25 bp, Mus musculus
ctctgtggtctctgtgctgaataaa

SEQ ID NO: 378826 - DNA, 25 bp, Mus musculus
ctctgtggttaaagttctaagtgcc

SEQ ID NO: 378827 - DNA, 25 bp, Mus musculus
ctctgtggttaatgttctaagtgcc

SEQ ID NO: 378828 - DNA, 25 bp, Mus musculus
ctctgtggtttgagggaggcttctc

SEQ ID NO: 378829 - DNA, 25 bp, Mus musculus
ctctgtggtttgtgggaggcttctc

SEQ ID NO: 378830 - DNA, 25 bp, Mus musculus
ctctgtgtaaacaccctgggcgttg

SEQ ID NO: 378831 - DNA, 25 bp, Mus musculus
ctctgtgtaaactccctgggcgttg

SEQ ID NO: 378832 - DNA, 25 bp, Mus musculus
ctctgtgtaatgatgctagtctgta

SEQ ID NO: 378833 - DNA, 25 bp, Mus musculus
ctctgtgtaatgttgctagtctgta

SEQ ID NO: 378834 - DNA, 25 bp, Mus musculus
ctctgtgtacagacttctggtaggg

SEQ ID NO: 378835 - DNA, 25 bp, Mus musculus
ctctgtgtacagtcttctggtaggg

SEQ ID NO: 378836 - DNA, 25 bp, Mus musculus
ctctgtgtagtgctagctttcctgg

SEQ ID NO: 378837 - DNA, 25 bp, Mus musculus
ctctgtgtagtggtagctttcctgg

SEQ ID NO: 378838 - DNA, 25 bp, Mus musculus
ctctgtgtatatcatgttctagtaa

SEQ ID NO: 378839 - DNA, 25 bp, Mus musculus
ctctgtgtatatgatgttctagtaa

SEQ ID NO: 378840 - DNA, 25 bp, Mus musculus
ctctgtgtatttaagtgtttctcaa

SEQ ID NO: 378841 - DNA, 25 bp, Mus musculus
ctctgtgtattttagtgtttctcaa

SEQ ID NO: 378842 - DNA, 25 bp, Mus musculus
ctctgtgtcaaaatgccaatggctg

SEQ ID NO: 378843 - DNA, 25 bp, Mus musculus
ctctgtgtcaaattgccaatggctg

SEQ ID NO: 378844 - DNA, 25 bp, Mus musculus
ctctgtgtcacaatctctgttgttt

SEQ ID NO: 378845 - DNA, 25 bp, Mus musculus
ctctgtgtcacattctctgttgttt

SEQ ID NO: 378846 - DNA, 25 bp, Mus musculus
ctctgtgtcatcctaaatgtaaagt

SEQ ID NO: 378847 - DNA, 25 bp, Mus musculus
ctctgtgtcatcgtaaatgtaaagt

SEQ ID NO: 378848 - DNA, 25 bp, Mus musculus
ctctgtgtcctcacgggaaaatttt

SEQ ID NO: 378849 - DNA, 25 bp, Mus musculus
ctctgtgtcctctcgggaaaatttt

SEQ ID NO: 378850 - DNA, 25 bp, Mus musculus
ctctgtgtcggcatagccagagtgg

SEQ ID NO: 378851 - DNA, 25 bp, Mus musculus
ctctgtgtcggcttagccagagtgg

SEQ ID NO: 378852 - DNA, 25 bp, Mus musculus
ctctgtgtctctagagatgatcatc

SEQ ID NO: 378853 - DNA, 25 bp, Mus musculus
ctctgtgtctctcttacattgctga

SEQ ID NO: 378854 - DNA, 25 bp, Mus musculus
ctctgtgtctctgttacattgctga

SEQ ID NO: 378855 - DNA, 25 bp, Mus musculus
ctctgtgtctcttgagatgatcatc

SEQ ID NO: 378856 - DNA, 25 bp, Mus musculus
ctctgtgtctgccatttattagcca

SEQ ID NO: 378857 - DNA, 25 bp, Mus musculus
ctctgtgtctgcgatttattagcca

SEQ ID NO: 378858 - DNA, 25 bp, Mus musculus
ctctgtgtctggaattggaggacaa

SEQ ID NO: 378859 - DNA, 25 bp, Mus musculus
ctctgtgtctggtattggaggacaa

SEQ ID NO: 378860 - DNA, 25 bp, Mus musculus
ctctgtgtcttgaaaatgtgtcatt

SEQ ID NO: 378861 - DNA, 25 bp, Mus musculus
ctctgtgtcttgtaaatgtgtcatt

SEQ ID NO: 378862 - DNA, 25 bp, Mus musculus
ctctgtgtgagtagttctggtgctg

SEQ ID NO: 378863 - DNA, 25 bp, Mus musculus
ctctgtgtgagttgttctggtgctg

SEQ ID NO: 378864 - DNA, 25 bp, Mus musculus
ctctgtgtgcagctagcttgggttt

SEQ ID NO: 378865 - DNA, 25 bp, Mus musculus
ctctgtgtgcaggtagcttgggttt

SEQ ID NO: 378866 - DNA, 25 bp, Mus musculus
ctctgtgtgccaaggtgcttgataa

SEQ ID NO: 378867 - DNA, 25 bp, Mus musculus
ctctgtgtgccatggtgcttgataa

SEQ ID NO: 378868 - DNA, 25 bp, Mus musculus
ctctgtgtgcttaccacactgggaa

SEQ ID NO: 378869 - DNA, 25 bp, Mus musculus
ctctgtgtgctttccacactgggaa

SEQ ID NO: 378870 - DNA, 25 bp, Mus musculus
ctctgtgtggagaggctgcattcat

SEQ ID NO: 378871 - DNA, 25 bp, Mus musculus
ctctgtgtggagattatcatagcat

SEQ ID NO: 378872 - DNA, 25 bp, Mus musculus
ctctgtgtggagtggctgcattcat

SEQ ID NO: 378873 - DNA, 25 bp, Mus musculus
ctctgtgtggagtttatcatagcat

SEQ ID NO: 378874 - DNA, 25 bp, Mus musculus
ctctgtgtggctcggatgacctgta

SEQ ID NO: 378875 - DNA, 25 bp, Mus musculus
ctctgtgtggctgggatgacctgta

SEQ ID NO: 378876 - DNA, 25 bp, Mus musculus
ctctgtgtgtagacttagctatcct

SEQ ID NO: 378877 - DNA, 25 bp, Mus musculus
ctctgtgtgtagtcttagctatcct

SEQ ID NO: 378878 - DNA, 25 bp, Mus musculus
ctctgtgtgttacaggagctctgga

SEQ ID NO: 378879 - DNA, 25 bp, Mus musculus
ctctgtgtgttagaggagctctgga

SEQ ID NO: 378880 - DNA, 25 bp, Mus musculus
ctctgtgttacaagagggcctgcac

SEQ ID NO: 378881 - DNA, 25 bp, Mus musculus
ctctgtgttacatgagggcctgcac

SEQ ID NO: 378882 - DNA, 25 bp, Mus musculus
ctctgtgttcaacccgggctgtgaa

SEQ ID NO: 378883 - DNA, 25 bp, Mus musculus
ctctgtgttcaagccgggctgtgaa

SEQ ID NO: 378884 - DNA, 25 bp, Mus musculus
ctctgtgttgtgcagcttgttttgc

SEQ ID NO: 378885 - DNA, 25 bp, Mus musculus
ctctgtgttgtggagcttgttttgc

SEQ ID NO: 378886 - DNA, 25 bp, Mus musculus
ctctgtgtttcaagttttgatgtaa

SEQ ID NO: 378887 - DNA, 25 bp, Mus musculus
ctctgtgtttcatgttttgatgtaa

SEQ ID NO: 378888 - DNA, 25 bp, Mus musculus
ctctgtgttttacttagtcccaatt

SEQ ID NO: 378889 - DNA, 25 bp, Mus musculus
ctctgtgttttagttagtcccaatt

SEQ ID NO: 378890 - DNA, 25 bp, Mus musculus
ctctgttaacgtaccctaagatgct

SEQ ID NO: 378891 - DNA, 25 bp, Mus musculus
ctctgttaacgttccctaagatgct

SEQ ID NO: 378892 - DNA, 25 bp, Mus musculus
ctctgttacttacctggctgggaca

SEQ ID NO: 378893 - DNA, 25 bp, Mus musculus
ctctgttacttagctggctgggaca

SEQ ID NO: 378894 - DNA, 25 bp, Mus musculus
ctctgttatcacaaggtcacctcta

SEQ ID NO: 378895 - DNA, 25 bp, Mus musculus
ctctgttatcactaggtcacctcta

SEQ ID NO: 378896 - DNA, 25 bp, Mus musculus
ctctgttatgatcccttgccttcca

SEQ ID NO: 378897 - DNA, 25 bp, Mus musculus
ctctgttatgatgccttgccttcca

SEQ ID NO: 378898 - DNA, 25 bp, Mus musculus
ctctgttattgcctgagctcaaata

SEQ ID NO: 378899 - DNA, 25 bp, Mus musculus
ctctgttattgcgtgagctcaaata

SEQ ID NO: 378900 - DNA, 25 bp, Mus musculus
ctctgttcaccaaatcccaggagaa

SEQ ID NO: 378901 - DNA, 25 bp, Mus musculus
ctctgttcaccatatcccaggagaa

SEQ ID NO: 378902 - DNA, 25 bp, Mus musculus
ctctgttccactcatacactgggac

SEQ ID NO: 378903 - DNA, 25 bp, Mus musculus
ctctgttccactgatacactgggac

SEQ ID NO: 378904 - DNA, 25 bp, Mus musculus
ctctgttccttgaggctcatgggcc

SEQ ID NO: 378905 - DNA, 25 bp, Mus musculus
ctctgttccttgtggctcatgggcc

SEQ ID NO: 378906 - DNA, 25 bp, Mus musculus
ctctgttctaagacgtcagtgacac

SEQ ID NO: 378907 - DNA, 25 bp, Mus musculus
ctctgttctaagtcgtcagtgacac

SEQ ID NO: 378908 - DNA, 25 bp, Mus musculus
ctctgttctttgagagctctgtggc

SEQ ID NO: 378909 - DNA, 25 bp, Mus musculus
ctctgttctttgtgagctctgtggc

SEQ ID NO: 378910 - DNA, 25 bp, Mus musculus
ctctgttgatttcttttattaactc

SEQ ID NO: 378911 - DNA, 25 bp, Mus musculus
ctctgttgatttgttttattaactc

SEQ ID NO: 378912 - DNA, 25 bp, Mus musculus
ctctgttgcacacataccactggtg

SEQ ID NO: 378913 - DNA, 25 bp, Mus musculus
ctctgttgcacagataccactggtg

SEQ ID NO: 378914 - DNA, 25 bp, Mus musculus
ctctgttgcgcacactgtggtctta

SEQ ID NO: 378915 - DNA, 25 bp, Mus musculus
ctctgttgcgcagactgtggtctta

SEQ ID NO: 378916 - DNA, 25 bp, Mus musculus
ctctgttgctatactctgacattca

SEQ ID NO: 378917 - DNA, 25 bp, Mus musculus
ctctgttgctattctctgacattca

SEQ ID NO: 378918 - DNA, 25 bp, Mus musculus
ctctgttgctgacttgctcttgtat

SEQ ID NO: 378919 - DNA, 25 bp, Mus musculus
ctctgttgctgagttgctcttgtat

SEQ ID NO: 378920 - DNA, 25 bp, Mus musculus
ctctgttggatgcaactttaagtta

SEQ ID NO: 378921 - DNA, 25 bp, Mus musculus
ctctgttggatggaactttaagtta

SEQ ID NO: 378922 - DNA, 25 bp, Mus musculus
ctctgttggcttcgtagggtggaga

SEQ ID NO: 378923 - DNA, 25 bp, Mus musculus
ctctgttggcttggtagggtggaga

SEQ ID NO: 378924 - DNA, 25 bp, Mus musculus
ctctgttgggagagcggctgatccc

SEQ ID NO: 378925 - DNA, 25 bp, Mus musculus
ctctgttgggagtgcggctgatccc

SEQ ID NO: 378926 - DNA, 25 bp, Mus musculus
ctctgttggtgtcagtcagtgcttt

SEQ ID NO: 378927 - DNA, 25 bp, Mus musculus
ctctgttggtgtgagtcagtgcttt

SEQ ID NO: 378928 - DNA, 25 bp, Mus musculus
ctctgttgttccaggatcgtggtat

SEQ ID NO: 378929 - DNA, 25 bp, Mus musculus
ctctgttgttccaggtggctgggcc

SEQ ID NO: 378930 - DNA, 25 bp, Mus musculus
ctctgttgttcctggatcgtggtat

SEQ ID NO: 378931 - DNA, 25 bp, Mus musculus
ctctgttgttcctggtggctgggcc

SEQ ID NO: 378932 - DNA, 25 bp, Mus musculus
ctctgtttacaacctcacttggagg

SEQ ID NO: 378933 - DNA, 25 bp, Mus musculus
ctctgtttacaagctcacttggagg

SEQ ID NO: 378934 - DNA, 25 bp, Mus musculus
ctctgtttaccaatctctttagcat

SEQ ID NO: 378935 - DNA, 25 bp, Mus musculus
ctctgtttaccattctctttagcat

SEQ ID NO: 378936 - DNA, 25 bp, Mus musculus
ctctgtttccagacaactcctgagg

SEQ ID NO: 378937 - DNA, 25 bp, Mus musculus
ctctgtttccagtcaactcctgagg

SEQ ID NO: 378938 - DNA, 25 bp, Mus musculus
ctctgtttccccagtacttgaaata

SEQ ID NO: 378939 - DNA, 25 bp, Mus musculus
ctctgtttcccctgtacttgaaata

SEQ ID NO: 378940 - DNA, 25 bp, Mus musculus
ctctgtttccctcagcaaaggtgat

SEQ ID NO: 378941 - DNA, 25 bp, Mus musculus
ctctgtttccctgagcaaaggtgat

SEQ ID NO: 378942 - DNA, 25 bp, Mus musculus
ctctgtttgataatcctgcttgtat

SEQ ID NO: 378943 - DNA, 25 bp, Mus musculus
ctctgtttgatattcctgcttgtat

SEQ ID NO: 378944 - DNA, 25 bp, Mus musculus
ctctgtttgggaaggttgacaccgt

SEQ ID NO: 378945 - DNA, 25 bp, Mus musculus
ctctgtttgggatggttgacaccgt

SEQ ID NO: 378946 - DNA, 25 bp, Mus musculus
ctctgtttgtatctgagcaagggaa

SEQ ID NO: 378947 - DNA, 25 bp, Mus musculus
ctctgtttgtatgtgagcaagggaa

SEQ ID NO: 378948 - DNA, 25 bp, Mus musculus
ctctgttttatgattgcccttggtc

SEQ ID NO: 378949 - DNA, 25 bp, Mus musculus
ctctgttttatgtttgcccttggtc

SEQ ID NO: 378950 - DNA, 25 bp, Mus musculus
ctctgttttctaatgatgctttcta

SEQ ID NO: 378951 - DNA, 25 bp, Mus musculus
ctctgttttctattgatgctttcta

SEQ ID NO: 378952 - DNA, 25 bp, Mus musculus
ctctgttttgagctgttgtttaata

SEQ ID NO: 378953 - DNA, 25 bp, Mus musculus
ctctgttttgaggtgttgtttaata

SEQ ID NO: 378954 - DNA, 25 bp, Mus musculus
ctctgttttttcagaggccttgaaa

SEQ ID NO: 378955 - DNA, 25 bp, Mus musculus
ctctgttttttctgaggccttgaaa

SEQ ID NO: 378956 - DNA, 25 bp, Mus musculus
ctcttaaagtcactcgggcgtcttt

SEQ ID NO: 378957 - DNA, 25 bp, Mus musculus
ctcttaaagtcagtcgggcgtcttt

SEQ ID NO: 378958 - DNA, 25 bp, Mus musculus
ctcttaaattgtcttaaccactgag

SEQ ID NO: 378959 - DNA, 25 bp, Mus musculus
ctcttaaattgtgttaaccactgag

SEQ ID NO: 378960 - DNA, 25 bp, Mus musculus
ctcttaacagtgcatgggcccagtt

SEQ ID NO: 378961 - DNA, 25 bp, Mus musculus
ctcttaacagtggatgggcccagtt

SEQ ID NO: 378962 - DNA, 25 bp, Mus musculus
ctcttaacccctaacctgagaatga

SEQ ID NO: 378963 - DNA, 25 bp, Mus musculus
ctcttaaccccttacctgagaatga

SEQ ID NO: 378964 - DNA, 25 bp, Mus musculus
ctcttaacgagtcccaaatccacaa

SEQ ID NO: 378965 - DNA, 25 bp, Mus musculus
ctcttaacgagtgccaaatccacaa

SEQ ID NO: 378966 - DNA, 25 bp, Mus musculus
ctcttaacgttccctttctgtcaca

SEQ ID NO: 378967 - DNA, 25 bp, Mus musculus
ctcttaacgttcgctttctgtcaca

SEQ ID NO: 378968 - DNA, 25 bp, Mus musculus
ctcttaagcatgagctcgcctttaa

SEQ ID NO: 378969 - DNA, 25 bp, Mus musculus
ctcttaagcatgtgctcgcctttaa

SEQ ID NO: 378970 - DNA, 25 bp, Mus musculus
ctcttaagtataccttagtatgtga

SEQ ID NO: 378971 - DNA, 25 bp, Mus musculus
ctcttaagtatagcttagtatgtga

SEQ ID NO: 378972 - DNA, 25 bp, Mus musculus
ctcttaataatgactggtgtttgtc

SEQ ID NO: 378973 - DNA, 25 bp, Mus musculus
ctcttaataatgtctggtgtttgtc

SEQ ID NO: 378974 - DNA, 25 bp, Mus musculus
ctcttaatcttcatgttggcagtga

SEQ ID NO: 378975 - DNA, 25 bp, Mus musculus
ctcttaatcttcttgttggcagtga

SEQ ID NO: 378976 - DNA, 25 bp, Mus musculus
ctcttacaacttaatgctaatcggg

SEQ ID NO: 378977 - DNA, 25 bp, Mus musculus
ctcttacaactttatgctaatcggg

SEQ ID NO: 378978 - DNA, 25 bp, Mus musculus
ctcttacagagtcatttggttatag

SEQ ID NO: 378979 - DNA, 25 bp, Mus musculus
ctcttacagagtgatttggttatag

SEQ ID NO: 378980 - DNA, 25 bp, Mus musculus
ctcttacattgtagactcatgaggg

SEQ ID NO: 378981 - DNA, 25 bp, Mus musculus
ctcttacattgttgactcatgaggg

SEQ ID NO: 378982 - DNA, 25 bp, Mus musculus
ctcttaccaacaaacctacacatgt

SEQ ID NO: 378983 - DNA, 25 bp, Mus musculus
ctcttaccaacatacctacacatgt

SEQ ID NO: 378984 - DNA, 25 bp, Mus musculus
ctcttaccctgcataaaaatccact

SEQ ID NO: 378985 - DNA, 25 bp, Mus musculus
ctcttaccctgcttaaaaatccact

SEQ ID NO: 378986 - DNA, 25 bp, Mus musculus
ctcttacgggtgattgtcatactta

SEQ ID NO: 378987 - DNA, 25 bp, Mus musculus
ctcttacgggtgtttgtcatactta

SEQ ID NO: 378988 - DNA, 25 bp, Mus musculus
ctcttactagggacacctttgacta

SEQ ID NO: 378989 - DNA, 25 bp, Mus musculus
ctcttactagggtcacctttgacta

SEQ ID NO: 378990 - DNA, 25 bp, Mus musculus
ctcttactcccacttttgtgtaggt

SEQ ID NO: 378991 - DNA, 25 bp, Mus musculus
ctcttactcccagttttgtgtaggt

SEQ ID NO: 378992 - DNA, 25 bp, Mus musculus
ctcttactgccaccaaggattcagc

SEQ ID NO: 378993 - DNA, 25 bp, Mus musculus
ctcttactgccagcaaggattcagc

SEQ ID NO: 378994 - DNA, 25 bp, Mus musculus
ctcttactggcaagaggtgctccaa

SEQ ID NO: 378995 - DNA, 25 bp, Mus musculus
ctcttactggcatgaggtgctccaa

SEQ ID NO: 378996 - DNA, 25 bp, Mus musculus
ctcttactgggcattctgaaatatt

SEQ ID NO: 378997 - DNA, 25 bp, Mus musculus
ctcttactgggctttctgaaatatt

SEQ ID NO: 378998 - DNA, 25 bp, Mus musculus
ctcttacttggaactcttgtggaat

SEQ ID NO: 378999 - DNA, 25 bp, Mus musculus
ctcttacttggatctcttgtggaat

SEQ ID NO: 379000 - DNA, 25 bp, Mus musculus
ctcttacttgttatgacttgaattt

SEQ ID NO: 379001 - DNA, 25 bp, Mus musculus
ctcttacttgttttgacttgaattt

SEQ ID NO: 379002 - DNA, 25 bp, Mus musculus
ctcttagatgatcgcccagggtcca

SEQ ID NO: 379003 - DNA, 25 bp, Mus musculus
ctcttagatgatggcccagggtcca

SEQ ID NO: 379004 - DNA, 25 bp, Mus musculus
ctcttagcagccaatgattccgtat

SEQ ID NO: 379005 - DNA, 25 bp, Mus musculus
ctcttagcagcctatgattccgtat

SEQ ID NO: 379006 - DNA, 25 bp, Mus musculus
ctcttagcagctatcatatcctttt

SEQ ID NO: 379007 - DNA, 25 bp, Mus musculus
ctcttagcagctttcatatcctttt

SEQ ID NO: 379008 - DNA, 25 bp, Mus musculus
ctcttagcccctcttgctatggcaa

SEQ ID NO: 379009 - DNA, 25 bp, Mus musculus
ctcttagcccctgttgctatggcaa

SEQ ID NO: 379010 - DNA, 25 bp, Mus musculus
ctcttagctttcagactgctgggat

SEQ ID NO: 379011 - DNA, 25 bp, Mus musculus
ctcttagctttctgactgctgggat

SEQ ID NO: 379012 - DNA, 25 bp, Mus musculus
ctcttaggtcccacattggtgagtt

SEQ ID NO: 379013 - DNA, 25 bp, Mus musculus
ctcttaggtccctcattggtgagtt

SEQ ID NO: 379014 - DNA, 25 bp, Mus musculus
ctcttagtctgcattgtgaaactta

SEQ ID NO: 379015 - DNA, 25 bp, Mus musculus
ctcttagtctgctttgtgaaactta

SEQ ID NO: 379016 - DNA, 25 bp, Mus musculus
ctcttagtgagcagcgaagggactt

SEQ ID NO: 379017 - DNA, 25 bp, Mus musculus
ctcttagtgagctgcgaagggactt

SEQ ID NO: 379018 - DNA, 25 bp, Mus musculus
ctcttagttcagatatcttaatcat

SEQ ID NO: 379019 - DNA, 25 bp, Mus musculus
ctcttagttcagttatcttaatcat

SEQ ID NO: 379020 - DNA, 25 bp, Mus musculus
ctcttatacgtaaagccaggtggtc

SEQ ID NO: 379021 - DNA, 25 bp, Mus musculus
ctcttatacgtatagccaggtggtc

SEQ ID NO: 379022 - DNA, 25 bp, Mus musculus
ctcttatagagcaggccatagactt

SEQ ID NO: 379023 - DNA, 25 bp, Mus musculus
ctcttatagagctggccatagactt

SEQ ID NO: 379024 - DNA, 25 bp, Mus musculus
ctcttatcccggagaagagctcagg

SEQ ID NO: 379025 - DNA, 25 bp, Mus musculus
ctcttatcccggtgaagagctcagg

SEQ ID NO: 379026 - DNA, 25 bp, Mus musculus
ctcttatcctctcgaattgcagcca

SEQ ID NO: 379027 - DNA, 25 bp, Mus musculus
ctcttatcctctggaattgcagcca

SEQ ID NO: 379028 - DNA, 25 bp, Mus musculus
ctcttatctccccaaggtattgttt

SEQ ID NO: 379029 - DNA, 25 bp, Mus musculus
ctcttatctcccgaaggtattgttt

SEQ ID NO: 379030 - DNA, 25 bp, Mus musculus
ctcttatcttctaagaaccgggaat

SEQ ID NO: 379031 - DNA, 25 bp, Mus musculus
ctcttatcttcttagaaccgggaat

SEQ ID NO: 379032 - DNA, 25 bp, Mus musculus
ctcttatgttttctcctttggtatc

SEQ ID NO: 379033 - DNA, 25 bp, Mus musculus
ctcttatgttttgtcctttggtatc

SEQ ID NO: 379034 - DNA, 25 bp, Mus musculus
ctcttattccaacgttcattgtgaa

SEQ ID NO: 379035 - DNA, 25 bp, Mus musculus
ctcttattccaaggttcattgtgaa

SEQ ID NO: 379036 - DNA, 25 bp, Mus musculus
ctcttattgcccaaaccaactgata

SEQ ID NO: 379037 - DNA, 25 bp, Mus musculus
ctcttattgccctaaccaactgata

SEQ ID NO: 379038 - DNA, 25 bp, Mus musculus
ctcttcaaactcatcgtccagcaaa

SEQ ID NO: 379039 - DNA, 25 bp, Mus musculus
ctcttcaaactcttcgtccagcaaa

SEQ ID NO: 379040 - DNA, 25 bp, Mus musculus
ctcttcaaagggctcacttggggct

SEQ ID NO: 379041 - DNA, 25 bp, Mus musculus
ctcttcaaaggggtcacttggggct

SEQ ID NO: 379042 - DNA, 25 bp, Mus musculus
ctcttcaacacactgggactcattt

SEQ ID NO: 379043 - DNA, 25 bp, Mus musculus
ctcttcaacacagtgggactcattt

SEQ ID NO: 379044 - DNA, 25 bp, Mus musculus
ctcttcaaccctactatcttcaaag

SEQ ID NO: 379045 - DNA, 25 bp, Mus musculus
ctcttcaacccttctatcttcaaag

SEQ ID NO: 379046 - DNA, 25 bp, Mus musculus
ctcttcaagacacaactgtgtaatt

SEQ ID NO: 379047 - DNA, 25 bp, Mus musculus
ctcttcaagacagaactgtgtaatt

SEQ ID NO: 379048 - DNA, 25 bp, Mus musculus
ctcttcaagggcctacaggtctatt

SEQ ID NO: 379049 - DNA, 25 bp, Mus musculus
ctcttcaagggcgtacaggtctatt

SEQ ID NO: 379050 - DNA, 25 bp, Mus musculus
ctcttcaagtccacactcatattag

SEQ ID NO: 379051 - DNA, 25 bp, Mus musculus
ctcttcaagtcctcactcatattag

SEQ ID NO: 379052 - DNA, 25 bp, Mus musculus
ctcttcaatgagagttttcaccaac

SEQ ID NO: 379053 - DNA, 25 bp, Mus musculus
ctcttcaatgagtgttttcaccaac

SEQ ID NO: 379054 - DNA, 25 bp, Mus musculus
ctcttcaccaaaccaacggcaaatg

SEQ ID NO: 379055 - DNA, 25 bp, Mus musculus
ctcttcaccaaagcaacggcaaatg

SEQ ID NO: 379056 - DNA, 25 bp, Mus musculus
ctcttcacctctaacttgaaagcag

SEQ ID NO: 379057 - DNA, 25 bp, Mus musculus
ctcttcacctcttacttgaaagcag

SEQ ID NO: 379058 - DNA, 25 bp, Mus musculus
ctcttcacttatcctgcttgttgaa

SEQ ID NO: 379059 - DNA, 25 bp, Mus musculus
ctcttcacttatgctgcttgttgaa

SEQ ID NO: 379060 - DNA, 25 bp, Mus musculus
ctcttcagacaacgactcttggtag

SEQ ID NO: 379061 - DNA, 25 bp, Mus musculus
ctcttcagacaaggactcttggtag

SEQ ID NO: 379062 - DNA, 25 bp, Mus musculus
ctcttcagagtaaatttaccatgtg

SEQ ID NO: 379063 - DNA, 25 bp, Mus musculus
ctcttcagagtatatttaccatgtg

SEQ ID NO: 379064 - DNA, 25 bp, Mus musculus
ctcttcagccaaaacaacggttggg

SEQ ID NO: 379065 - DNA, 25 bp, Mus musculus
ctcttcagccaatacaacggttggg

SEQ ID NO: 379066 - DNA, 25 bp, Mus musculus
ctcttcagctggcacatagatggat

SEQ ID NO: 379067 - DNA, 25 bp, Mus musculus
ctcttcagctgggacatagatggat

SEQ ID NO: 379068 - DNA, 25 bp, Mus musculus
ctcttcagtgccagtcatttgggaa

SEQ ID NO: 379069 - DNA, 25 bp, Mus musculus
ctcttcagtgcctgtcatttgggaa

SEQ ID NO: 379070 - DNA, 25 bp, Mus musculus
ctcttcagtggcaagaaagtgaacc

SEQ ID NO: 379071 - DNA, 25 bp, Mus musculus
ctcttcagtggctagaaagtgaacc

SEQ ID NO: 379072 - DNA, 25 bp, Mus musculus
ctcttcatagttctgaggagttgat

SEQ ID NO: 379073 - DNA, 25 bp, Mus musculus
ctcttcatagttgtgaggagttgat

SEQ ID NO: 379074 - DNA, 25 bp, Mus musculus
ctcttcatgcataggcctcttaaca

SEQ ID NO: 379075 - DNA, 25 bp, Mus musculus
ctcttcatgcattggcctcttaaca

SEQ ID NO: 379076 - DNA, 25 bp, Mus musculus
ctcttcatgggcaataatcgtcctg

SEQ ID NO: 379077 - DNA, 25 bp, Mus musculus
ctcttcatgggctataatcgtcctg

SEQ ID NO: 379078 - DNA, 25 bp, Mus musculus
ctcttcatgtacagggagctgtaat

SEQ ID NO: 379079 - DNA, 25 bp, Mus musculus
ctcttcatgtactgggagctgtaat

SEQ ID NO: 379080 - DNA, 25 bp, Mus musculus
ctcttcatgtgcagccttgagctca

SEQ ID NO: 379081 - DNA, 25 bp, Mus musculus
ctcttcatgtgctgccttgagctca

SEQ ID NO: 379082 - DNA, 25 bp, Mus musculus
ctcttcattccaccaatggccaaat

SEQ ID NO: 379083 - DNA, 25 bp, Mus musculus
ctcttcattccagcaatggccaaat

SEQ ID NO: 379084 - DNA, 25 bp, Mus musculus
ctcttcattgcaccgctgttgggtt

SEQ ID NO: 379085 - DNA, 25 bp, Mus musculus
ctcttcattgcagcgctgttgggtt

SEQ ID NO: 379086 - DNA, 25 bp, Mus musculus
ctcttccaagcaccatggtgtgaat

SEQ ID NO: 379087 - DNA, 25 bp, Mus musculus
ctcttccaagcagcatggtgtgaat

SEQ ID NO: 379088 - DNA, 25 bp, Mus musculus
ctcttccaaggccacataggtgtgg

SEQ ID NO: 379089 - DNA, 25 bp, Mus musculus
ctcttccaaggcgacataggtgtgg

SEQ ID NO: 379090 - DNA, 25 bp, Mus musculus
ctcttccactgtctttgcagcagtc

SEQ ID NO: 379091 - DNA, 25 bp, Mus musculus
ctcttccactgtgtttgcagcagtc

SEQ ID NO: 379092 - DNA, 25 bp, Mus musculus
ctcttccagagaatcggagtttggt

SEQ ID NO: 379093 - DNA, 25 bp, Mus musculus
ctcttccagagattcggagtttggt

SEQ ID NO: 379094 - DNA, 25 bp, Mus musculus
ctcttccaggcacagaaggaccgga

SEQ ID NO: 379095 - DNA, 25 bp, Mus musculus
ctcttccaggcagagaaggaccgga

SEQ ID NO: 379096 - DNA, 25 bp, Mus musculus
ctcttccatctcaagaaagtctgag

SEQ ID NO: 379097 - DNA, 25 bp, Mus musculus
ctcttccatctctagaaagtctgag

SEQ ID NO: 379098 - DNA, 25 bp, Mus musculus
ctcttccatgtgctggcatgtggat

SEQ ID NO: 379099 - DNA, 25 bp, Mus musculus
ctcttccatgtggtggcatgtggat

SEQ ID NO: 379100 - DNA, 25 bp, Mus musculus
ctcttcccactacacaattggtttt

SEQ ID NO: 379101 - DNA, 25 bp, Mus musculus
ctcttcccactagacaattggtttt

SEQ ID NO: 379102 - DNA, 25 bp, Mus musculus
ctcttcccttacacactaattttgg

SEQ ID NO: 379103 - DNA, 25 bp, Mus musculus
ctcttcccttactcactaattttgg

SEQ ID NO: 379104 - DNA, 25 bp, Mus musculus
ctcttccgccagatggttgaggcta

SEQ ID NO: 379105 - DNA, 25 bp, Mus musculus
ctcttccgccagttggttgaggcta

SEQ ID NO: 379106 - DNA, 25 bp, Mus musculus
ctcttccgctaccttgagcatatga

SEQ ID NO: 379107 - DNA, 25 bp, Mus musculus
ctcttccgctacgttgagcatatga

SEQ ID NO: 379108 - DNA, 25 bp, Mus musculus
ctcttcctacacagggtcctttgta

SEQ ID NO: 379109 - DNA, 25 bp, Mus musculus
ctcttcctacactgggtcctttgta

SEQ ID NO: 379110 - DNA, 25 bp, Mus musculus
ctcttcctactcctatcatttgaat

SEQ ID NO: 379111 - DNA, 25 bp, Mus musculus
ctcttcctactcgtatcatttgaat

SEQ ID NO: 379112 - DNA, 25 bp, Mus musculus
ctcttcctagatctgctgtgtcagg

SEQ ID NO: 379113 - DNA, 25 bp, Mus musculus
ctcttcctagatgtgctgtgtcagg

SEQ ID NO: 379114 - DNA, 25 bp, Mus musculus
ctcttcctatatcagatgggtgggt

SEQ ID NO: 379115 - DNA, 25 bp, Mus musculus
ctcttcctatatgagatgggtgggt

SEQ ID NO: 379116 - DNA, 25 bp, Mus musculus
ctcttcctatccagtaccttaatta

SEQ ID NO: 379117 - DNA, 25 bp, Mus musculus
ctcttcctatcctgtaccttaatta

SEQ ID NO: 379118 - DNA, 25 bp, Mus musculus
ctcttcctcagtatttgatttttcc

SEQ ID NO: 379119 - DNA, 25 bp, Mus musculus
ctcttcctcagtttttgatttttcc

SEQ ID NO: 379120 - DNA, 25 bp, Mus musculus
ctcttcctcgacaatcacaaattac

SEQ ID NO: 379121 - DNA, 25 bp, Mus musculus
ctcttcctcgactatcacaaattac

SEQ ID NO: 379122 - DNA, 25 bp, Mus musculus
ctcttcctcgagatcttcctttgat

SEQ ID NO: 379123 - DNA, 25 bp, Mus musculus
ctcttcctcgagttcttcctttgat

SEQ ID NO: 379124 - DNA, 25 bp, Mus musculus
ctcttcctctgtagagtcattgcat

SEQ ID NO: 379125 - DNA, 25 bp, Mus musculus
ctcttcctctgttgagtcattgcat

SEQ ID NO: 379126 - DNA, 25 bp, Mus musculus
ctcttcctggaactactgatttact

SEQ ID NO: 379127 - DNA, 25 bp, Mus musculus
ctcttcctggaagtactgatttact

SEQ ID NO: 379128 - DNA, 25 bp, Mus musculus
ctcttcctggatcacgtcatgtata

SEQ ID NO: 379129 - DNA, 25 bp, Mus musculus
ctcttcctggatgacgtcatgtata

SEQ ID NO: 379130 - DNA, 25 bp, Mus musculus
ctcttcctgggcactaacgacatag

SEQ ID NO: 379131 - DNA, 25 bp, Mus musculus
ctcttcctgggctctaacgacatag

SEQ ID NO: 379132 - DNA, 25 bp, Mus musculus
ctcttcctgtcactatttgtctgtg

SEQ ID NO: 379133 - DNA, 25 bp, Mus musculus
ctcttcctgtcagtatttgtctgtg

SEQ ID NO: 379134 - DNA, 25 bp, Mus musculus
ctcttccttgctaaatttgctctga

SEQ ID NO: 379135 - DNA, 25 bp, Mus musculus
ctcttccttgctatggcatgggtac

SEQ ID NO: 379136 - DNA, 25 bp, Mus musculus
ctcttccttgcttaatttgctctga

SEQ ID NO: 379137 - DNA, 25 bp, Mus musculus
ctcttccttgctttggcatgggtac

SEQ ID NO: 379138 - DNA, 25 bp, Mus musculus
ctcttccttgtaaggcgagggtcag

SEQ ID NO: 379139 - DNA, 25 bp, Mus musculus
ctcttccttgtatggcgagggtcag

SEQ ID NO: 379140 - DNA, 25 bp, Mus musculus
ctcttccttgttatattgctattcc

SEQ ID NO: 379141 - DNA, 25 bp, Mus musculus
ctcttccttgttttattgctattcc

SEQ ID NO: 379142 - DNA, 25 bp, Mus musculus
ctcttcgccatcactcaggaaaggt

SEQ ID NO: 379143 - DNA, 25 bp, Mus musculus
ctcttcgccatctctcaggaaaggt

SEQ ID NO: 379144 - DNA, 25 bp, Mus musculus
ctcttcgcttgtctgtggcagagag

SEQ ID NO: 379145 - DNA, 25 bp, Mus musculus
ctcttcgcttgtgtgtggcagagag

SEQ ID NO: 379146 - DNA, 25 bp, Mus musculus
ctcttcggtcttatgcaggtaccaa

SEQ ID NO: 379147 - DNA, 25 bp, Mus musculus
ctcttcggtcttttgcaggtaccaa

SEQ ID NO: 379148 - DNA, 25 bp, Mus musculus
ctcttcgtgcgaaacaggcgactga

SEQ ID NO: 379149 - DNA, 25 bp, Mus musculus
ctcttcgtgcgatacaggcgactga

SEQ ID NO: 379150 - DNA, 25 bp, Mus musculus
ctcttcgtgtacagagacatgccaa

SEQ ID NO: 379151 - DNA, 25 bp, Mus musculus
ctcttcgtgtactgagacatgccaa

SEQ ID NO: 379152 - DNA, 25 bp, Mus musculus
ctcttctaagagagctgggtaccaa

SEQ ID NO: 379153 - DNA, 25 bp, Mus musculus
ctcttctaagagtgctgggtaccaa

SEQ ID NO: 379154 - DNA, 25 bp, Mus musculus
ctcttctaccctattacaggaggag

SEQ ID NO: 379155 - DNA, 25 bp, Mus musculus
ctcttctacccttttacaggaggag

SEQ ID NO: 379156 - DNA, 25 bp, Mus musculus
ctcttctacctcaaagcagttctga

SEQ ID NO: 379157 - DNA, 25 bp, Mus musculus
ctcttctacctctaagcagttctga

SEQ ID NO: 379158 - DNA, 25 bp, Mus musculus
ctcttctaccttaatctctctttaa

SEQ ID NO: 379159 - DNA, 25 bp, Mus musculus
ctcttctacctttatctctctttaa

SEQ ID NO: 379160 - DNA, 25 bp, Mus musculus
ctcttctactccattttcaagtctc

SEQ ID NO: 379161 - DNA, 25 bp, Mus musculus
ctcttctactcctttttcaagtctc

SEQ ID NO: 379162 - DNA, 25 bp, Mus musculus
ctcttctacttaccagtctggtcga

SEQ ID NO: 379163 - DNA, 25 bp, Mus musculus
ctcttctacttagcagtctggtcga

SEQ ID NO: 379164 - DNA, 25 bp, Mus musculus
ctcttctagaggcttcaggttggat

SEQ ID NO: 379165 - DNA, 25 bp, Mus musculus
ctcttctagagggttcaggttggat

SEQ ID NO: 379166 - DNA, 25 bp, Mus musculus
ctcttctagcacatgggtttttagt

SEQ ID NO: 379167 - DNA, 25 bp, Mus musculus
ctcttctagcacttgggtttttagt

SEQ ID NO: 379168 - DNA, 25 bp, Mus musculus
ctcttctagggtcgctctgtcctga

SEQ ID NO: 379169 - DNA, 25 bp, Mus musculus
ctcttctagggtggctctgtcctga

SEQ ID NO: 379170 - DNA, 25 bp, Mus musculus
ctcttctatactcgacttctccaaa

SEQ ID NO: 379171 - DNA, 25 bp, Mus musculus
ctcttctatactggacttctccaaa

SEQ ID NO: 379172 - DNA, 25 bp, Mus musculus
ctcttctatctcatgtttccctgta

SEQ ID NO: 379173 - DNA, 25 bp, Mus musculus
ctcttctatctcttgtttccctgta

SEQ ID NO: 379174 - DNA, 25 bp, Mus musculus
ctcttctcaggcatcctaagggata

SEQ ID NO: 379175 - DNA, 25 bp, Mus musculus
ctcttctcaggcttcctaagggata

SEQ ID NO: 379176 - DNA, 25 bp, Mus musculus
ctcttctcatctctcatgctttaaa

SEQ ID NO: 379177 - DNA, 25 bp, Mus musculus
ctcttctcatctgtcatgctttaaa

SEQ ID NO: 379178 - DNA, 25 bp, Mus musculus
ctcttctccctgagtgatgatggct

SEQ ID NO: 379179 - DNA, 25 bp, Mus musculus
ctcttctccctgtgtgatgatggct

SEQ ID NO: 379180 - DNA, 25 bp, Mus musculus
ctcttctccgcccaaggtggatgtt

SEQ ID NO: 379181 - DNA, 25 bp, Mus musculus
ctcttctccgccgaaggtggatgtt

SEQ ID NO: 379182 - DNA, 25 bp, Mus musculus
ctcttctcctgtcagctgagtagaa

SEQ ID NO: 379183 - DNA, 25 bp, Mus musculus
ctcttctcctgtgagctgagtagaa

SEQ ID NO: 379184 - DNA, 25 bp, Mus musculus
ctcttctccttcagagaggtaaaca

SEQ ID NO: 379185 - DNA, 25 bp, Mus musculus
ctcttctccttctgagaggtaaaca

SEQ ID NO: 379186 - DNA, 25 bp, Mus musculus
ctcttctctcttcaatgtttaccat

SEQ ID NO: 379187 - DNA, 25 bp, Mus musculus
ctcttctctcttgaatgtttaccat

SEQ ID NO: 379188 - DNA, 25 bp, Mus musculus
ctcttctctgcacttggtgatgcaa

SEQ ID NO: 379189 - DNA, 25 bp, Mus musculus
ctcttctctgcagttggtgatgcaa

SEQ ID NO: 379190 - DNA, 25 bp, Mus musculus
ctcttctctgtactatcacttttga

SEQ ID NO: 379191 - DNA, 25 bp, Mus musculus
ctcttctctgtagtatcacttttga

SEQ ID NO: 379192 - DNA, 25 bp, Mus musculus
ctcttctcttaaagaaccagattat

SEQ ID NO: 379193 - DNA, 25 bp, Mus musculus
ctcttctcttaatgaaccagattat

SEQ ID NO: 379194 - DNA, 25 bp, Mus musculus
ctcttctgaaggcttggagttgacc

SEQ ID NO: 379195 - DNA, 25 bp, Mus musculus
ctcttctgaagggttggagttgacc

SEQ ID NO: 379196 - DNA, 25 bp, Mus musculus
ctcttctgacgacttctgaagtcag

SEQ ID NO: 379197 - DNA, 25 bp, Mus musculus
ctcttctgacgagttctgaagtcag

SEQ ID NO: 379198 - DNA, 25 bp, Mus musculus
ctcttctgattcatgcatagagaaa

SEQ ID NO: 379199 - DNA, 25 bp, Mus musculus
ctcttctgattcttgcatagagaaa

SEQ ID NO: 379200 - DNA, 25 bp, Mus musculus
ctcttctgctctcctaagtacagtt

SEQ ID NO: 379201 - DNA, 25 bp, Mus musculus
ctcttctgctctgctaagtacagtt

SEQ ID NO: 379202 - DNA, 25 bp, Mus musculus
ctcttctggactctctgtggttaaa

SEQ ID NO: 379203 - DNA, 25 bp, Mus musculus
ctcttctggactgtctgtggttaaa

SEQ ID NO: 379204 - DNA, 25 bp, Mus musculus
ctcttctggcacctgggtgtacaag

SEQ ID NO: 379205 - DNA, 25 bp, Mus musculus
ctcttctggcacgtgggtgtacaag

SEQ ID NO: 379206 - DNA, 25 bp, Mus musculus
ctcttctggctgagaactgcgtaga

SEQ ID NO: 379207 - DNA, 25 bp, Mus musculus
ctcttctggctgtgaactgcgtaga

SEQ ID NO: 379208 - DNA, 25 bp, Mus musculus
ctcttctgggatactcgttttattt

SEQ ID NO: 379209 - DNA, 25 bp, Mus musculus
ctcttctgggattctcgttttattt

SEQ ID NO: 379210 - DNA, 25 bp, Mus musculus
ctcttctggtgtctctgaagacagc

SEQ ID NO: 379211 - DNA, 25 bp, Mus musculus
ctcttctggtgtgtctgaagacagc

SEQ ID NO: 379212 - DNA, 25 bp, Mus musculus
ctcttctgtcagctttcaaagggct

SEQ ID NO: 379213 - DNA, 25 bp, Mus musculus
ctcttctgtcaggtttcaaagggct

SEQ ID NO: 379214 - DNA, 25 bp, Mus musculus
ctcttctgtgtgactgagcttatga

SEQ ID NO: 379215 - DNA, 25 bp, Mus musculus
ctcttctgtgtgtctgagcttatga

SEQ ID NO: 379216 - DNA, 25 bp, Mus musculus
ctcttctgttccaacgcacagggtt

SEQ ID NO: 379217 - DNA, 25 bp, Mus musculus
ctcttctgttcctacgcacagggtt

SEQ ID NO: 379218 - DNA, 25 bp, Mus musculus
ctcttcttataaacgcccttctaat

SEQ ID NO: 379219 - DNA, 25 bp, Mus musculus
ctcttcttataatcgcccttctaat

SEQ ID NO: 379220 - DNA, 25 bp, Mus musculus
ctcttcttcctgagttttaggatta

SEQ ID NO: 379221 - DNA, 25 bp, Mus musculus
ctcttcttcctgatatcagtagttc

SEQ ID NO: 379222 - DNA, 25 bp, Mus musculus
ctcttcttcctgtgttttaggatta

SEQ ID NO: 379223 - DNA, 25 bp, Mus musculus
ctcttcttcctgttatcagtagttc

SEQ ID NO: 379224 - DNA, 25 bp, Mus musculus
ctcttcttgaatattacccctagtg

SEQ ID NO: 379225 - DNA, 25 bp, Mus musculus
ctcttcttgaattttacccctagtg

SEQ ID NO: 379226 - DNA, 25 bp, Mus musculus
ctcttcttgatgctctactgtttga

SEQ ID NO: 379227 - DNA, 25 bp, Mus musculus
ctcttcttgatggtctactgtttga

SEQ ID NO: 379228 - DNA, 25 bp, Mus musculus
ctcttcttgcagagccatggcagga

SEQ ID NO: 379229 - DNA, 25 bp, Mus musculus
ctcttcttgcagtgccatggcagga

SEQ ID NO: 379230 - DNA, 25 bp, Mus musculus
ctcttcttgccgcttgggaatgaca

SEQ ID NO: 379231 - DNA, 25 bp, Mus musculus
ctcttcttgccggttgggaatgaca

SEQ ID NO: 379232 - DNA, 25 bp, Mus musculus
ctcttgaaacctagggttctgacta

SEQ ID NO: 379233 - DNA, 25 bp, Mus musculus
ctcttgaaaccttgggttctgacta

SEQ ID NO: 379234 - DNA, 25 bp, Mus musculus
ctcttgacagagaactgaggcgact

SEQ ID NO: 379235 - DNA, 25 bp, Mus musculus
ctcttgacagagtactgaggcgact

SEQ ID NO: 379236 - DNA, 25 bp, Mus musculus
ctcttgaccagcatatgggacaaag

SEQ ID NO: 379237 - DNA, 25 bp, Mus musculus
ctcttgaccagcttatgggacaaag

SEQ ID NO: 379238 - DNA, 25 bp, Mus musculus
ctcttgacccccagacttattgctt

SEQ ID NO: 379239 - DNA, 25 bp, Mus musculus
ctcttgaccccctgacttattgctt

SEQ ID NO: 379240 - DNA, 25 bp, Mus musculus
ctcttgacctatccatctttagctc

SEQ ID NO: 379241 - DNA, 25 bp, Mus musculus
ctcttgacctatgcatctttagctc

SEQ ID NO: 379242 - DNA, 25 bp, Mus musculus
ctcttgacgctgctaggtcttattt

SEQ ID NO: 379243 - DNA, 25 bp, Mus musculus
ctcttgacgctggtaggtcttattt

SEQ ID NO: 379244 - DNA, 25 bp, Mus musculus
ctcttgactgttatcctctgatcaa

SEQ ID NO: 379245 - DNA, 25 bp, Mus musculus
ctcttgactgttttcctctgatcaa

SEQ ID NO: 379246 - DNA, 25 bp, Mus musculus
ctcttgaggacactgtgcttgttca

SEQ ID NO: 379247 - DNA, 25 bp, Mus musculus
ctcttgaggacagtgtgcttgttca

SEQ ID NO: 379248 - DNA, 25 bp, Mus musculus
ctcttgagtattcctccctttgaaa

SEQ ID NO: 379249 - DNA, 25 bp, Mus musculus
ctcttgagtattgctccctttgaaa

SEQ ID NO: 379250 - DNA, 25 bp, Mus musculus
ctcttgagtcgtcgtgtgcgtctga

SEQ ID NO: 379251 - DNA, 25 bp, Mus musculus
ctcttgagtcgtggtgtgcgtctga

SEQ ID NO: 379252 - DNA, 25 bp, Mus musculus
ctcttgagtgctcacctgttgtata

SEQ ID NO: 379253 - DNA, 25 bp, Mus musculus
ctcttgagtgctgacctgttgtata

SEQ ID NO: 379254 - DNA, 25 bp, Mus musculus
ctcttgatcctcattgtggtgggcg

SEQ ID NO: 379255 - DNA, 25 bp, Mus musculus
ctcttgatcctctttgtggtgggcg

SEQ ID NO: 379256 - DNA, 25 bp, Mus musculus
ctcttgatgcgacgtaattaccgag

SEQ ID NO: 379257 - DNA, 25 bp, Mus musculus
ctcttgatgcgaggtaattaccgag

SEQ ID NO: 379258 - DNA, 25 bp, Mus musculus
ctcttgcacaccatcatagtactat

SEQ ID NO: 379259 - DNA, 25 bp, Mus musculus
ctcttgcacaccttcatagtactat

SEQ ID NO: 379260 - DNA, 25 bp, Mus musculus
ctcttgcactctagtacagtctggg

SEQ ID NO: 379261 - DNA, 25 bp, Mus musculus
ctcttgcactcttgtacagtctggg

SEQ ID NO: 379262 - DNA, 25 bp, Mus musculus
ctcttgcatcctcggagggtctaca

SEQ ID NO: 379263 - DNA, 25 bp, Mus musculus
ctcttgcatcctgggagggtctaca

SEQ ID NO: 379264 - DNA, 25 bp, Mus musculus
ctcttgcatgcacctgctaaatggt

SEQ ID NO: 379265 - DNA, 25 bp, Mus musculus
ctcttgcatgcagctgctaaatggt

SEQ ID NO: 379266 - DNA, 25 bp, Mus musculus
ctcttgccatctcttctctggaaaa

SEQ ID NO: 379267 - DNA, 25 bp, Mus musculus
ctcttgccatctgttctctggaaaa

SEQ ID NO: 379268 - DNA, 25 bp, Mus musculus
ctcttgccattacctctcaaatatt

SEQ ID NO: 379269 - DNA, 25 bp, Mus musculus
ctcttgccattagctctcaaatatt

SEQ ID NO: 379270 - DNA, 25 bp, Mus musculus
ctcttgccccatcaatatctatttt

SEQ ID NO: 379271 - DNA, 25 bp, Mus musculus
ctcttgccccatgaatatctatttt

SEQ ID NO: 379272 - DNA, 25 bp, Mus musculus
ctcttgccctctcctgactgaggat

SEQ ID NO: 379273 - DNA, 25 bp, Mus musculus
ctcttgccctctgctgactgaggat

SEQ ID NO: 379274 - DNA, 25 bp, Mus musculus
ctcttgccgaagctcactcatcaag

SEQ ID NO: 379275 - DNA, 25 bp, Mus musculus
ctcttgccgaaggtcactcatcaag

SEQ ID NO: 379276 - DNA, 25 bp, Mus musculus
ctcttgccgctgatgtcggagaaaa

SEQ ID NO: 379277 - DNA, 25 bp, Mus musculus
ctcttgccgctgttgtcggagaaaa

SEQ ID NO: 379278 - DNA, 25 bp, Mus musculus
ctcttgcctgctcggccaaattgaa

SEQ ID NO: 379279 - DNA, 25 bp, Mus musculus
ctcttgcctgctctcaaatgctggg

SEQ ID NO: 379280 - DNA, 25 bp, Mus musculus
ctcttgcctgctgggccaaattgaa

SEQ ID NO: 379281 - DNA, 25 bp, Mus musculus
ctcttgcctgctgtcaaatgctggg

SEQ ID NO: 379282 - DNA, 25 bp, Mus musculus
ctcttgcgatagactcaggtttgtg

SEQ ID NO: 379283 - DNA, 25 bp, Mus musculus
ctcttgcgatagtctcaggtttgtg

SEQ ID NO: 379284 - DNA, 25 bp, Mus musculus
ctcttgctctggctctttgttaaat

SEQ ID NO: 379285 - DNA, 25 bp, Mus musculus
ctcttgctctgggtctttgttaaat

SEQ ID NO: 379286 - DNA, 25 bp, Mus musculus
ctcttgctgcctccttagtaggcaa

SEQ ID NO: 379287 - DNA, 25 bp, Mus musculus
ctcttgctgcctgcttagtaggcaa

SEQ ID NO: 379288 - DNA, 25 bp, Mus musculus
ctcttgctgttcacatcggatttgt

SEQ ID NO: 379289 - DNA, 25 bp, Mus musculus
ctcttgctgttctcatcggatttgt

SEQ ID NO: 379290 - DNA, 25 bp, Mus musculus
ctcttgcttcctctgttgagagtta

SEQ ID NO: 379291 - DNA, 25 bp, Mus musculus
ctcttgcttcctgtgttgagagtta

SEQ ID NO: 379292 - DNA, 25 bp, Mus musculus
ctcttggaacttaatcttgcacata

SEQ ID NO: 379293 - DNA, 25 bp, Mus musculus
ctcttggaactttatcttgcacata

SEQ ID NO: 379294 - DNA, 25 bp, Mus musculus
ctcttggacaagaggctgagctcct

SEQ ID NO: 379295 - DNA, 25 bp, Mus musculus
ctcttggacaagtggctgagctcct

SEQ ID NO: 379296 - DNA, 25 bp, Mus musculus
ctcttggacttcatttctttacttg

SEQ ID NO: 379297 - DNA, 25 bp, Mus musculus
ctcttggacttcttttctttacttg

SEQ ID NO: 379298 - DNA, 25 bp, Mus musculus
ctcttggagaagaaacctgttgttt

SEQ ID NO: 379299 - DNA, 25 bp, Mus musculus
ctcttggagaagtaacctgttgttt

SEQ ID NO: 379300 - DNA, 25 bp, Mus musculus
ctcttggagcaaatgatgaagacat

SEQ ID NO: 379301 - DNA, 25 bp, Mus musculus
ctcttggagcaattgatgaagacat

SEQ ID NO: 379302 - DNA, 25 bp, Mus musculus
ctcttggaggagagcggttagcccc

SEQ ID NO: 379303 - DNA, 25 bp, Mus musculus
ctcttggaggagtgcggttagcccc

SEQ ID NO: 379304 - DNA, 25 bp, Mus musculus
ctcttggcaagtactcaggtggaca

SEQ ID NO: 379305 - DNA, 25 bp, Mus musculus
ctcttggcaagttctcaggtggaca

SEQ ID NO: 379306 - DNA, 25 bp, Mus musculus
ctcttggcacagcactcacatctgg

SEQ ID NO: 379307 - DNA, 25 bp, Mus musculus
ctcttggcacaggactcacatctgg

SEQ ID NO: 379308 - DNA, 25 bp, Mus musculus
ctcttggccaaaatggcctccaagg

SEQ ID NO: 379309 - DNA, 25 bp, Mus musculus
ctcttggccaaattggcctccaagg

SEQ ID NO: 379310 - DNA, 25 bp, Mus musculus
ctcttggctagtatgttcacttcta

SEQ ID NO: 379311 - DNA, 25 bp, Mus musculus
ctcttggctagtttgttcacttcta

SEQ ID NO: 379312 - DNA, 25 bp, Mus musculus
ctcttggctcaacctaacagcaagc

SEQ ID NO: 379313 - DNA, 25 bp, Mus musculus
ctcttggctcaagctaacagcaagc

SEQ ID NO: 379314 - DNA, 25 bp, Mus musculus
ctcttggcttctactacatagttct

SEQ ID NO: 379315 - DNA, 25 bp, Mus musculus
ctcttggcttcttctacatagttct

SEQ ID NO: 379316 - DNA, 25 bp, Mus musculus
ctcttgggacacatttgggagcaca

SEQ ID NO: 379317 - DNA, 25 bp, Mus musculus
ctcttgggacacttttgggagcaca

SEQ ID NO: 379318 - DNA, 25 bp, Mus musculus
ctcttgggagatatataggcctcag

SEQ ID NO: 379319 - DNA, 25 bp, Mus musculus
ctcttgggagatttataggcctcag

SEQ ID NO: 379320 - DNA, 25 bp, Mus musculus
ctcttgggtagtagccgatgcgagc

SEQ ID NO: 379321 - DNA, 25 bp, Mus musculus
ctcttgggtagttgccgatgcgagc

SEQ ID NO: 379322 - DNA, 25 bp, Mus musculus
ctcttgggtccacataatagcatga

SEQ ID NO: 379323 - DNA, 25 bp, Mus musculus
ctcttgggtccagataatagcatga

SEQ ID NO: 379324 - DNA, 25 bp, Mus musculus
ctcttgggtgttctagacctttcca

SEQ ID NO: 379325 - DNA, 25 bp, Mus musculus
ctcttgggtgttgtagacctttcca

SEQ ID NO: 379326 - DNA, 25 bp, Mus musculus
ctcttgggtttacgccaggtcataa

SEQ ID NO: 379327 - DNA, 25 bp, Mus musculus
ctcttgggtttaggccaggtcataa

SEQ ID NO: 379328 - DNA, 25 bp, Mus musculus
ctcttgggtttcactctgaatggtt

SEQ ID NO: 379329 - DNA, 25 bp, Mus musculus
ctcttgggtttctctctgaatggtt

SEQ ID NO: 379330 - DNA, 25 bp, Mus musculus
ctcttggtagagaactgaggcggct

SEQ ID NO: 379331 - DNA, 25 bp, Mus musculus
ctcttggtagagtactgaggcggct

SEQ ID NO: 379332 - DNA, 25 bp, Mus musculus
ctcttggtcattagtacagcttgta

SEQ ID NO: 379333 - DNA, 25 bp, Mus musculus
ctcttggtcatttgtacagcttgta

SEQ ID NO: 379334 - DNA, 25 bp, Mus musculus
ctcttggtggcaatgactcctatca

SEQ ID NO: 379335 - DNA, 25 bp, Mus musculus
ctcttggtggcattgactcctatca

SEQ ID NO: 379336 - DNA, 25 bp, Mus musculus
ctcttggtggtcattcaagcttgca

SEQ ID NO: 379337 - DNA, 25 bp, Mus musculus
ctcttggtggtctttcaagcttgca

SEQ ID NO: 379338 - DNA, 25 bp, Mus musculus
ctcttggtgtatcctggagctttca

SEQ ID NO: 379339 - DNA, 25 bp, Mus musculus
ctcttggtgtatgctggagctttca

SEQ ID NO: 379340 - DNA, 25 bp, Mus musculus
ctcttggttggccaatgtctggcat

SEQ ID NO: 379341 - DNA, 25 bp, Mus musculus
ctcttggttggcgaatgtctggcat

SEQ ID NO: 379342 - DNA, 25 bp, Mus musculus
ctcttggttggtctaactcagctgt

SEQ ID NO: 379343 - DNA, 25 bp, Mus musculus
ctcttggttggtgtaactcagctgt

SEQ ID NO: 379344 - DNA, 25 bp, Mus musculus
ctcttggtttagactcctgagtgct

SEQ ID NO: 379345 - DNA, 25 bp, Mus musculus
ctcttggtttagtctcctgagtgct

SEQ ID NO: 379346 - DNA, 25 bp, Mus musculus
ctcttggtttttcagccaaagctgg

SEQ ID NO: 379347 - DNA, 25 bp, Mus musculus
ctcttggtttttgagccaaagctgg

SEQ ID NO: 379348 - DNA, 25 bp, Mus musculus
ctcttgtactctactcgtgcttaaa

SEQ ID NO: 379349 - DNA, 25 bp, Mus musculus
ctcttgtactcttctcgtgcttaaa

SEQ ID NO: 379350 - DNA, 25 bp, Mus musculus
ctcttgtattttatcatccatctgg

SEQ ID NO: 379351 - DNA, 25 bp, Mus musculus
ctcttgtattttttcatccatctgg

SEQ ID NO: 379352 - DNA, 25 bp, Mus musculus
ctcttgtcagttatgcgatcttgca

SEQ ID NO: 379353 - DNA, 25 bp, Mus musculus
ctcttgtcagttttgcgatcttgca

SEQ ID NO: 379354 - DNA, 25 bp, Mus musculus
ctcttgtccattctccgttaggatt

SEQ ID NO: 379355 - DNA, 25 bp, Mus musculus
ctcttgtccattgtccgttaggatt

SEQ ID NO: 379356 - DNA, 25 bp, Mus musculus
ctcttgtccccaatagaaccataaa

SEQ ID NO: 379357 - DNA, 25 bp, Mus musculus
ctcttgtccccattagaaccataaa

SEQ ID NO: 379358 - DNA, 25 bp, Mus musculus
ctcttgtccggacgttagctttcca

SEQ ID NO: 379359 - DNA, 25 bp, Mus musculus
ctcttgtccggaggttagctttcca

SEQ ID NO: 379360 - DNA, 25 bp, Mus musculus
ctcttgtcctctatgacggatacac

SEQ ID NO: 379361 - DNA, 25 bp, Mus musculus
ctcttgtcctctttgacggatacac

SEQ ID NO: 379362 - DNA, 25 bp, Mus musculus
ctcttgtctctgatcttgggaagca

SEQ ID NO: 379363 - DNA, 25 bp, Mus musculus
ctcttgtctctgttcttgggaagca

SEQ ID NO: 379364 - DNA, 25 bp, Mus musculus
ctcttgtctgagattggctttatat

SEQ ID NO: 379365 - DNA, 25 bp, Mus musculus
ctcttgtctgagtttggctttatat

SEQ ID NO: 379366 - DNA, 25 bp, Mus musculus
ctcttgtctgtccttatgtttgtgg

SEQ ID NO: 379367 - DNA, 25 bp, Mus musculus
ctcttgtctgtcgttatgtttgtgg

SEQ ID NO: 379368 - DNA, 25 bp, Mus musculus
ctcttgtgaaccctgtgggcaccag

SEQ ID NO: 379369 - DNA, 25 bp, Mus musculus
ctcttgtgaaccgtgtgggcaccag

SEQ ID NO: 379370 - DNA, 25 bp, Mus musculus
ctcttgtgaattaagcctggtttac

SEQ ID NO: 379371 - DNA, 25 bp, Mus musculus
ctcttgtgaatttagcctggtttac

SEQ ID NO: 379372 - DNA, 25 bp, Mus musculus
ctcttgtgagccctgtcttaggtgg

SEQ ID NO: 379373 - DNA, 25 bp, Mus musculus
ctcttgtgagccgtgtcttaggtgg

SEQ ID NO: 379374 - DNA, 25 bp, Mus musculus
ctcttgtgcaggatgtggaggactc

SEQ ID NO: 379375 - DNA, 25 bp, Mus musculus
ctcttgtgcaggttgtggaggactc

SEQ ID NO: 379376 - DNA, 25 bp, Mus musculus
ctcttgtgctgaataaggcttgtta

SEQ ID NO: 379377 - DNA, 25 bp, Mus musculus
ctcttgtgctgacccagactttttt

SEQ ID NO: 379378 - DNA, 25 bp, Mus musculus
ctcttgtgctgagccagactttttt

SEQ ID NO: 379379 - DNA, 25 bp, Mus musculus
ctcttgtgctgattaaggcttgtta

SEQ ID NO: 379380 - DNA, 25 bp, Mus musculus
ctcttgtggaagacttgagttcaat

SEQ ID NO: 379381 - DNA, 25 bp, Mus musculus
ctcttgtggaagtcttgagttcaat

SEQ ID NO: 379382 - DNA, 25 bp, Mus musculus
ctcttgtttaaacggaagtgccgtg

SEQ ID NO: 379383 - DNA, 25 bp, Mus musculus
ctcttgtttaaagggaagtgccgtg

SEQ ID NO: 379384 - DNA, 25 bp, Mus musculus
ctcttgtttcctcttatttctatca

SEQ ID NO: 379385 - DNA, 25 bp, Mus musculus
ctcttgtttcctgttatttctatca

SEQ ID NO: 379386 - DNA, 25 bp, Mus musculus
ctcttgttttgtatgggtatgcttc

SEQ ID NO: 379387 - DNA, 25 bp, Mus musculus
ctcttgttttgtttgggtatgcttc

SEQ ID NO: 379388 - DNA, 25 bp, Mus musculus
ctcttgtttttgctgttggttctca

SEQ ID NO: 379389 - DNA, 25 bp, Mus musculus
ctcttgtttttggtgttggttctca

SEQ ID NO: 379390 - DNA, 25 bp, Mus musculus
ctctttaattaaacagctctgcatc

SEQ ID NO: 379391 - DNA, 25 bp, Mus musculus
ctctttaattaatcagctctgcatc

SEQ ID NO: 379392 - DNA, 25 bp, Mus musculus
ctctttacataaactggaaccacac

SEQ ID NO: 379393 - DNA, 25 bp, Mus musculus
ctctttacataatctggaaccacac

SEQ ID NO: 379394 - DNA, 25 bp, Mus musculus
ctctttacgggacgcctcattggag

SEQ ID NO: 379395 - DNA, 25 bp, Mus musculus
ctctttacgggaggcctcattggag

SEQ ID NO: 379396 - DNA, 25 bp, Mus musculus
ctctttactcctagccattattaga

SEQ ID NO: 379397 - DNA, 25 bp, Mus musculus
ctctttactccttgccattattaga

SEQ ID NO: 379398 - DNA, 25 bp, Mus musculus
ctctttagacaacaggatgtccggg

SEQ ID NO: 379399 - DNA, 25 bp, Mus musculus
ctctttagacaagaggatgtccggg

SEQ ID NO: 379400 - DNA, 25 bp, Mus musculus
ctctttagaggaagcagggagccct

SEQ ID NO: 379401 - DNA, 25 bp, Mus musculus
ctctttagaggatgcagggagccct

SEQ ID NO: 379402 - DNA, 25 bp, Mus musculus
ctctttagatagaacctgtgccctc

SEQ ID NO: 379403 - DNA, 25 bp, Mus musculus
ctctttagatagtacctgtgccctc

SEQ ID NO: 379404 - DNA, 25 bp, Mus musculus
ctctttagatcaatccagaagctgc

SEQ ID NO: 379405 - DNA, 25 bp, Mus musculus
ctctttagatcattccagaagctgc

SEQ ID NO: 379406 - DNA, 25 bp, Mus musculus
ctctttagcactctccactttgaat

SEQ ID NO: 379407 - DNA, 25 bp, Mus musculus
ctctttagcactgtccactttgaat

SEQ ID NO: 379408 - DNA, 25 bp, Mus musculus
ctctttagtcccctggttcaggcct

SEQ ID NO: 379409 - DNA, 25 bp, Mus musculus
ctctttagtcccgtggttcaggcct

SEQ ID NO: 379410 - DNA, 25 bp, Mus musculus
ctctttatctccaaatgttgcagga

SEQ ID NO: 379411 - DNA, 25 bp, Mus musculus
ctctttatctcctaatgttgcagga

SEQ ID NO: 379412 - DNA, 25 bp, Mus musculus
ctctttatctttagtccataccatc

SEQ ID NO: 379413 - DNA, 25 bp, Mus musculus
ctctttatcttttgtccataccatc

SEQ ID NO: 379414 - DNA, 25 bp, Mus musculus
ctctttatgccgacgttagtggaaa

SEQ ID NO: 379415 - DNA, 25 bp, Mus musculus
ctctttatgccgtcgttagtggaaa

SEQ ID NO: 379416 - DNA, 25 bp, Mus musculus
ctctttattgttagtaccagtaggt

SEQ ID NO: 379417 - DNA, 25 bp, Mus musculus
ctctttattgtttgtaccagtaggt

SEQ ID NO: 379418 - DNA, 25 bp, Mus musculus
ctctttcaacctagtgggcacatgt

SEQ ID NO: 379419 - DNA, 25 bp, Mus musculus
ctctttcaaccttgtgggcacatgt

SEQ ID NO: 379420 - DNA, 25 bp, Mus musculus
ctctttcaatgccatcatggaagag

SEQ ID NO: 379421 - DNA, 25 bp, Mus musculus
ctctttcaatgcgatcatggaagag

SEQ ID NO: 379422 - DNA, 25 bp, Mus musculus
ctctttcactaaaatatcttttgga

SEQ ID NO: 379423 - DNA, 25 bp, Mus musculus
ctctttcactaatatatcttttgga

SEQ ID NO: 379424 - DNA, 25 bp, Mus musculus
ctctttcactggcatctggccagaa

SEQ ID NO: 379425 - DNA, 25 bp, Mus musculus
ctctttcactgggatctggccagaa

SEQ ID NO: 379426 - DNA, 25 bp, Mus musculus
ctctttcatgcccatctaccaatga

SEQ ID NO: 379427 - DNA, 25 bp, Mus musculus
ctctttcatgccgatctaccaatga

SEQ ID NO: 379428 - DNA, 25 bp, Mus musculus
ctctttccaataacctgctcccaaa

SEQ ID NO: 379429 - DNA, 25 bp, Mus musculus
ctctttccaatatcctgctcccaaa

SEQ ID NO: 379430 - DNA, 25 bp, Mus musculus
ctctttccagaaatatagggctcct

SEQ ID NO: 379431 - DNA, 25 bp, Mus musculus
ctctttccagaattatagggctcct

SEQ ID NO: 379432 - DNA, 25 bp, Mus musculus
ctctttcccactcagatagtttgta

SEQ ID NO: 379433 - DNA, 25 bp, Mus musculus
ctctttcccactgagatagtttgta

SEQ ID NO: 379434 - DNA, 25 bp, Mus musculus
ctctttcccattaccaaatatctca

SEQ ID NO: 379435 - DNA, 25 bp, Mus musculus
ctctttcccatttccaaatatctca

SEQ ID NO: 379436 - DNA, 25 bp, Mus musculus
ctctttccctgaagcattatgatcc

SEQ ID NO: 379437 - DNA, 25 bp, Mus musculus
ctctttccctgacactcaaattatt

SEQ ID NO: 379438 - DNA, 25 bp, Mus musculus
ctctttccctgagactcaaattatt

SEQ ID NO: 379439 - DNA, 25 bp, Mus musculus
ctctttccctgatgcattatgatcc

SEQ ID NO: 379440 - DNA, 25 bp, Mus musculus
ctctttcccttcacatatttcattt

SEQ ID NO: 379441 - DNA, 25 bp, Mus musculus
ctctttcccttctcatatttcattt

SEQ ID NO: 379442 - DNA, 25 bp, Mus musculus
ctctttcccttgctataaccagata

SEQ ID NO: 379443 - DNA, 25 bp, Mus musculus
ctctttcccttggtataaccagata

SEQ ID NO: 379444 - DNA, 25 bp, Mus musculus
ctctttcctaacaggtgtgggctta

SEQ ID NO: 379445 - DNA, 25 bp, Mus musculus
ctctttcctaactggtgtgggctta

SEQ ID NO: 379446 - DNA, 25 bp, Mus musculus
ctctttcctcttagtcatgtatgta

SEQ ID NO: 379447 - DNA, 25 bp, Mus musculus
ctctttcctctttgtcatgtatgta

SEQ ID NO: 379448 - DNA, 25 bp, Mus musculus
ctctttcctgctctcagatggattt

SEQ ID NO: 379449 - DNA, 25 bp, Mus musculus
ctctttcctgctgtcagatggattt

SEQ ID NO: 379450 - DNA, 25 bp, Mus musculus
ctctttcctgggagacgtaattgca

SEQ ID NO: 379451 - DNA, 25 bp, Mus musculus
ctctttcctgggtgacgtaattgca

SEQ ID NO: 379452 - DNA, 25 bp, Mus musculus
ctctttcctgtcacatgggctttaa

SEQ ID NO: 379453 - DNA, 25 bp, Mus musculus
ctctttcctgtctcatgggctttaa

SEQ ID NO: 379454 - DNA, 25 bp, Mus musculus
ctctttccttatacttggcaactac

SEQ ID NO: 379455 - DNA, 25 bp, Mus musculus
ctctttccttattcttggcaactac

SEQ ID NO: 379456 - DNA, 25 bp, Mus musculus
ctctttccttttcagcaatactgga

SEQ ID NO: 379457 - DNA, 25 bp, Mus musculus
ctctttccttttgagcaatactgga

SEQ ID NO: 379458 - DNA, 25 bp, Mus musculus
ctctttcgcactcgctacaaacaaa

SEQ ID NO: 379459 - DNA, 25 bp, Mus musculus
ctctttcgcactggctacaaacaaa

SEQ ID NO: 379460 - DNA, 25 bp, Mus musculus
ctctttctaatcaggtgtgactctt

SEQ ID NO: 379461 - DNA, 25 bp, Mus musculus
ctctttctaatctggtgtgactctt

SEQ ID NO: 379462 - DNA, 25 bp, Mus musculus
ctctttctacctagtgccgggcagc

SEQ ID NO: 379463 - DNA, 25 bp, Mus musculus
ctctttctaccttgtgccgggcagc

SEQ ID NO: 379464 - DNA, 25 bp, Mus musculus
ctctttctatcaagtgggtcctaag

SEQ ID NO: 379465 - DNA, 25 bp, Mus musculus
ctctttctatcatgtgggtcctaag

SEQ ID NO: 379466 - DNA, 25 bp, Mus musculus
ctctttctccacaccgttatttgaa

SEQ ID NO: 379467 - DNA, 25 bp, Mus musculus
ctctttctccactccgttatttgaa

SEQ ID NO: 379468 - DNA, 25 bp, Mus musculus
ctctttctccttagttttctcatag

SEQ ID NO: 379469 - DNA, 25 bp, Mus musculus
ctctttctcctttgttttctcatag

SEQ ID NO: 379470 - DNA, 25 bp, Mus musculus
ctctttctctgcacgaactttacaa

SEQ ID NO: 379471 - DNA, 25 bp, Mus musculus
ctctttctctgctcgaactttacaa

SEQ ID NO: 379472 - DNA, 25 bp, Mus musculus
ctctttctctgtcttcactatatgt

SEQ ID NO: 379473 - DNA, 25 bp, Mus musculus
ctctttctctgtgttcactatatgt

SEQ ID NO: 379474 - DNA, 25 bp, Mus musculus
ctctttctgcgtcctgggttgcctg

SEQ ID NO: 379475 - DNA, 25 bp, Mus musculus
ctctttctgcgtgctgggttgcctg

SEQ ID NO: 379476 - DNA, 25 bp, Mus musculus
ctctttctgggcactctcatgggtg

SEQ ID NO: 379477 - DNA, 25 bp, Mus musculus
ctctttctgggctctctcatgggtg

SEQ ID NO: 379478 - DNA, 25 bp, Mus musculus
ctctttcttagtaagttcccttatg

SEQ ID NO: 379479 - DNA, 25 bp, Mus musculus
ctctttcttagttagttcccttatg

SEQ ID NO: 379480 - DNA, 25 bp, Mus musculus
ctctttcttcccagagtgtaaatgt

SEQ ID NO: 379481 - DNA, 25 bp, Mus musculus
ctctttcttccctgagtgtaaatgt

SEQ ID NO: 379482 - DNA, 25 bp, Mus musculus
ctctttcttcttctggtgataatct

SEQ ID NO: 379483 - DNA, 25 bp, Mus musculus
ctctttcttcttgtggtgataatct

SEQ ID NO: 379484 - DNA, 25 bp, Mus musculus
ctctttcttgggactggtaaaccag

SEQ ID NO: 379485 - DNA, 25 bp, Mus musculus
ctctttcttgggtctggtaaaccag

SEQ ID NO: 379486 - DNA, 25 bp, Mus musculus
ctctttcttgtgaagacagattgga

SEQ ID NO: 379487 - DNA, 25 bp, Mus musculus
ctctttcttgtgtagacagattgga

SEQ ID NO: 379488 - DNA, 25 bp, Mus musculus
ctctttcttttgactgtgctgatgt

SEQ ID NO: 379489 - DNA, 25 bp, Mus musculus
ctctttcttttgtctgtgctgatgt

SEQ ID NO: 379490 - DNA, 25 bp, Mus musculus
ctctttgaagctccatgtgggcctg

SEQ ID NO: 379491 - DNA, 25 bp, Mus musculus
ctctttgaagctgcatgtgggcctg

SEQ ID NO: 379492 - DNA, 25 bp, Mus musculus
ctctttgacagtattcctggacaaa

SEQ ID NO: 379493 - DNA, 25 bp, Mus musculus
ctctttgacagttttcctggacaaa

SEQ ID NO: 379494 - DNA, 25 bp, Mus musculus
ctctttgactaccatcctaaggaag

SEQ ID NO: 379495 - DNA, 25 bp, Mus musculus
ctctttgactacgatcctaaggaag

SEQ ID NO: 379496 - DNA, 25 bp, Mus musculus
ctctttgagaacctggcactgggaa

SEQ ID NO: 379497 - DNA, 25 bp, Mus musculus
ctctttgagaacgtggcactgggaa

SEQ ID NO: 379498 - DNA, 25 bp, Mus musculus
ctctttgattccacgtactccagac

SEQ ID NO: 379499 - DNA, 25 bp, Mus musculus
ctctttgattcctcgtactccagac

SEQ ID NO: 379500 - DNA, 25 bp, Mus musculus
ctctttgccattcgttcccagctat

SEQ ID NO: 379501 - DNA, 25 bp, Mus musculus
ctctttgccattggttcccagctat

SEQ ID NO: 379502 - DNA, 25 bp, Mus musculus
ctctttgcctacagaccacattgct

SEQ ID NO: 379503 - DNA, 25 bp, Mus musculus
ctctttgcctactgaccacattgct

SEQ ID NO: 379504 - DNA, 25 bp, Mus musculus
ctctttgcggctaggaagttccgtg

SEQ ID NO: 379505 - DNA, 25 bp, Mus musculus
ctctttgcggcttggaagttccgtg

SEQ ID NO: 379506 - DNA, 25 bp, Mus musculus
ctctttgctctgaggtgatccgtcc

SEQ ID NO: 379507 - DNA, 25 bp, Mus musculus
ctctttgctctgtggtgatccgtcc

SEQ ID NO: 379508 - DNA, 25 bp, Mus musculus
ctctttgctgtgcttctaggtggta

SEQ ID NO: 379509 - DNA, 25 bp, Mus musculus
ctctttgctgtgcttttagccatca

SEQ ID NO: 379510 - DNA, 25 bp, Mus musculus
ctctttgctgtggttctaggtggta

SEQ ID NO: 379511 - DNA, 25 bp, Mus musculus
ctctttgctgtggttttagccatca

SEQ ID NO: 379512 - DNA, 25 bp, Mus musculus
ctctttggacatcttggctggctgc

SEQ ID NO: 379513 - DNA, 25 bp, Mus musculus
ctctttggacatgttggctggctgc

SEQ ID NO: 379514 - DNA, 25 bp, Mus musculus
ctctttggagagaggctggaactga

SEQ ID NO: 379515 - DNA, 25 bp, Mus musculus
ctctttggagagtggctggaactga

SEQ ID NO: 379516 - DNA, 25 bp, Mus musculus
ctctttggatttaacactttcactg

SEQ ID NO: 379517 - DNA, 25 bp, Mus musculus
ctctttggattttacactttcactg

SEQ ID NO: 379518 - DNA, 25 bp, Mus musculus
ctctttggcctgagaatatgtgctc

SEQ ID NO: 379519 - DNA, 25 bp, Mus musculus
ctctttggcctgtgaatatgtgctc

SEQ ID NO: 379520 - DNA, 25 bp, Mus musculus
ctctttgggtacacgattcaggcat

SEQ ID NO: 379521 - DNA, 25 bp, Mus musculus
ctctttgggtactcgattcaggcat

SEQ ID NO: 379522 - DNA, 25 bp, Mus musculus
ctctttgggtctagtgttagggtca

SEQ ID NO: 379523 - DNA, 25 bp, Mus musculus
ctctttgggtcttgtgttagggtca

SEQ ID NO: 379524 - DNA, 25 bp, Mus musculus
ctctttggtggaagccctcgctgaa

SEQ ID NO: 379525 - DNA, 25 bp, Mus musculus
ctctttggtggatgccctcgctgaa

SEQ ID NO: 379526 - DNA, 25 bp, Mus musculus
ctctttggtttcagagactgtagca

SEQ ID NO: 379527 - DNA, 25 bp, Mus musculus
ctctttggtttctgagactgtagca

SEQ ID NO: 379528 - DNA, 25 bp, Mus musculus
ctctttgtaaaaattctcatcgtgg

SEQ ID NO: 379529 - DNA, 25 bp, Mus musculus
ctctttgtaaaatttctcatcgtgg

SEQ ID NO: 379530 - DNA, 25 bp, Mus musculus
ctctttgtacatcaaatcgtggcta

SEQ ID NO: 379531 - DNA, 25 bp, Mus musculus
ctctttgtacatgaaatcgtggcta

SEQ ID NO: 379532 - DNA, 25 bp, Mus musculus
ctctttgtcaaaccagggctgtcag

SEQ ID NO: 379533 - DNA, 25 bp, Mus musculus
ctctttgtcaaagcagggctgtcag

SEQ ID NO: 379534 - DNA, 25 bp, Mus musculus
ctctttgtcagacccctggtgattc

SEQ ID NO: 379535 - DNA, 25 bp, Mus musculus
ctctttgtcagagccctggtgattc

SEQ ID NO: 379536 - DNA, 25 bp, Mus musculus
ctctttgtcatcacaaaacccgatg

SEQ ID NO: 379537 - DNA, 25 bp, Mus musculus
ctctttgtcatctcaaaacccgatg

SEQ ID NO: 379538 - DNA, 25 bp, Mus musculus
ctctttgtccaaaggaatggatctt

SEQ ID NO: 379539 - DNA, 25 bp, Mus musculus
ctctttgtccaatggaatggatctt

SEQ ID NO: 379540 - DNA, 25 bp, Mus musculus
ctctttgtcttcacaatgtggttct

SEQ ID NO: 379541 - DNA, 25 bp, Mus musculus
ctctttgtcttctcaatgtggttct

SEQ ID NO: 379542 - DNA, 25 bp, Mus musculus
ctctttgtctttcggcctggtgaga

SEQ ID NO: 379543 - DNA, 25 bp, Mus musculus
ctctttgtctttgggcctggtgaga

SEQ ID NO: 379544 - DNA, 25 bp, Mus musculus
ctctttgtgacaaacctttgcggaa

SEQ ID NO: 379545 - DNA, 25 bp, Mus musculus
ctctttgtgacatacctttgcggaa

SEQ ID NO: 379546 - DNA, 25 bp, Mus musculus
ctctttgtgatgaggtttgggctaa

SEQ ID NO: 379547 - DNA, 25 bp, Mus musculus
ctctttgtgatgtggtttgggctaa

SEQ ID NO: 379548 - DNA, 25 bp, Mus musculus
ctctttgtggagagtttattttgct

SEQ ID NO: 379549 - DNA, 25 bp, Mus musculus
ctctttgtggagtgtttattttgct

SEQ ID NO: 379550 - DNA, 25 bp, Mus musculus
ctctttgtgtatctgaactttgcct

SEQ ID NO: 379551 - DNA, 25 bp, Mus musculus
ctctttgtgtatgtgaactttgcct

SEQ ID NO: 379552 - DNA, 25 bp, Mus musculus
ctctttgttctgagataggctaaaa

SEQ ID NO: 379553 - DNA, 25 bp, Mus musculus
ctctttgttctgtgataggctaaaa

SEQ ID NO: 379554 - DNA, 25 bp, Mus musculus
ctctttgttgtaagctcatagccga

SEQ ID NO: 379555 - DNA, 25 bp, Mus musculus
ctctttgttgtatgctcatagccga

SEQ ID NO: 379556 - DNA, 25 bp, Mus musculus
ctctttgttttcattatgcccttct

SEQ ID NO: 379557 - DNA, 25 bp, Mus musculus
ctctttgttttctttatgcccttct

SEQ ID NO: 379558 - DNA, 25 bp, Mus musculus
ctcttttaaatcattgggctcactg

SEQ ID NO: 379559 - DNA, 25 bp, Mus musculus
ctcttttaaatctttgggctcactg

SEQ ID NO: 379560 - DNA, 25 bp, Mus musculus
ctcttttactacacaaacctgcttg

SEQ ID NO: 379561 - DNA, 25 bp, Mus musculus
ctcttttactactcaaacctgcttg

SEQ ID NO: 379562 - DNA, 25 bp, Mus musculus
ctcttttatgtcatcaggtgtcagg

SEQ ID NO: 379563 - DNA, 25 bp, Mus musculus
ctcttttatgtcttcaggtgtcagg

SEQ ID NO: 379564 - DNA, 25 bp, Mus musculus
ctcttttcagttccgcgtgcgtgcg

SEQ ID NO: 379565 - DNA, 25 bp, Mus musculus
ctcttttcagttgcgcgtgcgtgcg

SEQ ID NO: 379566 - DNA, 25 bp, Mus musculus
ctcttttccaagagtgacctggctt

SEQ ID NO: 379567 - DNA, 25 bp, Mus musculus
ctcttttccaagtgtgacctggctt

SEQ ID NO: 379568 - DNA, 25 bp, Mus musculus
ctcttttccgacagttagccaaatg

SEQ ID NO: 379569 - DNA, 25 bp, Mus musculus
ctcttttccgactgttagccaaatg

SEQ ID NO: 379570 - DNA, 25 bp, Mus musculus
ctcttttctaatcctgtaccaggct

SEQ ID NO: 379571 - DNA, 25 bp, Mus musculus
ctcttttctaatgctgtaccaggct

SEQ ID NO: 379572 - DNA, 25 bp, Mus musculus
ctcttttctccaagcagacaacatt

SEQ ID NO: 379573 - DNA, 25 bp, Mus musculus
ctcttttctccatgcagacaacatt

SEQ ID NO: 379574 - DNA, 25 bp, Mus musculus
ctcttttctctgagcggtaggctaa

SEQ ID NO: 379575 - DNA, 25 bp, Mus musculus
ctcttttctctgtgcggtaggctaa

SEQ ID NO: 379576 - DNA, 25 bp, Mus musculus
ctcttttgaagtctgtgttttggaa

SEQ ID NO: 379577 - DNA, 25 bp, Mus musculus
ctcttttgaagtgtgtgttttggaa

SEQ ID NO: 379578 - DNA, 25 bp, Mus musculus
ctcttttgccggcatggtgggtttc

SEQ ID NO: 379579 - DNA, 25 bp, Mus musculus
ctcttttgccgggatggtgggtttc

SEQ ID NO: 379580 - DNA, 25 bp, Mus musculus
ctcttttgcttcagactctacacaa

SEQ ID NO: 379581 - DNA, 25 bp, Mus musculus
ctcttttgcttctgactctacacaa

SEQ ID NO: 379582 - DNA, 25 bp, Mus musculus
ctcttttggcctacaaagcctgtaa

SEQ ID NO: 379583 - DNA, 25 bp, Mus musculus
ctcttttggccttcaaagcctgtaa

SEQ ID NO: 379584 - DNA, 25 bp, Mus musculus
ctctttttatgaattcagtcctcct

SEQ ID NO: 379585 - DNA, 25 bp, Mus musculus
ctctttttatgatttcagtcctcct

SEQ ID NO: 379586 - DNA, 25 bp, Mus musculus
ctctttttcattatctgtccttttg

SEQ ID NO: 379587 - DNA, 25 bp, Mus musculus
ctctttttcattttctgtccttttg

SEQ ID NO: 379588 - DNA, 25 bp, Mus musculus
ctctttttctctaccacatggagat

SEQ ID NO: 379589 - DNA, 25 bp, Mus musculus
ctctttttctcttccacatggagat

SEQ ID NO: 379590 - DNA, 25 bp, Mus musculus
ctctttttgcaacgtttccattcct

SEQ ID NO: 379591 - DNA, 25 bp, Mus musculus
ctctttttgcaaggtttccattcct

SEQ ID NO: 379592 - DNA, 25 bp, Mus musculus
ctctttttgtctaaagtgggctgca

SEQ ID NO: 379593 - DNA, 25 bp, Mus musculus
ctctttttgtcttaagtgggctgca

SEQ ID NO: 379594 - DNA, 25 bp, Mus musculus
ctcttttttagaatgctttgcccct

SEQ ID NO: 379595 - DNA, 25 bp, Mus musculus
ctcttttttagattgctttgcccct

SEQ ID NO: 379596 - DNA, 25 bp, Mus musculus
ctgaaaaatggactacacagtagag

SEQ ID NO: 379597 - DNA, 25 bp, Mus musculus
ctgaaaaatggagtacacagtagag

SEQ ID NO: 379598 - DNA, 25 bp, Mus musculus
ctgaaaacctgtctagaaatgctga

SEQ ID NO: 379599 - DNA, 25 bp, Mus musculus
ctgaaaacctgtgtagaaatgctga

SEQ ID NO: 379600 - DNA, 25 bp, Mus musculus
ctgaaaagaagcacaacaatttaat

SEQ ID NO: 379601 - DNA, 25 bp, Mus musculus
ctgaaaagaagctcaacaatttaat

SEQ ID NO: 379602 - DNA, 25 bp, Mus musculus
ctgaaaagcgcacccgccaggtcat

SEQ ID NO: 379603 - DNA, 25 bp, Mus musculus
ctgaaaagcgcagccgccaggtcat

SEQ ID NO: 379604 - DNA, 25 bp, Mus musculus
ctgaaaagggaacctggagaagtct

SEQ ID NO: 379605 - DNA, 25 bp, Mus musculus
ctgaaaagggaagctggagaagtct

SEQ ID NO: 379606 - DNA, 25 bp, Mus musculus
ctgaaaatcgagaacgctcagtttt

SEQ ID NO: 379607 - DNA, 25 bp, Mus musculus
ctgaaaatcgagtacgctcagtttt

SEQ ID NO: 379608 - DNA, 25 bp, Mus musculus
ctgaaaatgtggctctctgcggttt

SEQ ID NO: 379609 - DNA, 25 bp, Mus musculus
ctgaaaatgtgggtctctgcggttt

SEQ ID NO: 379610 - DNA, 25 bp, Mus musculus
ctgaaacacactccagaagttctgt

SEQ ID NO: 379611 - DNA, 25 bp, Mus musculus
ctgaaacacactgcagaagttctgt

SEQ ID NO: 379612 - DNA, 25 bp, Mus musculus
ctgaaacacgctcagcattttcggg

SEQ ID NO: 379613 - DNA, 25 bp, Mus musculus
ctgaaacacgctgagcattttcggg

SEQ ID NO: 379614 - DNA, 25 bp, Mus musculus
ctgaaaccactcctggatggccagt

SEQ ID NO: 379615 - DNA, 25 bp, Mus musculus
ctgaaaccactcgtggatggccagt

SEQ ID NO: 379616 - DNA, 25 bp, Mus musculus
ctgaaaccagagcaacagcctatgt

SEQ ID NO: 379617 - DNA, 25 bp, Mus musculus
ctgaaaccagaggaacagcctatgt

SEQ ID NO: 379618 - DNA, 25 bp, Mus musculus
ctgaaaccagatcccttccaggacg

SEQ ID NO: 379619 - DNA, 25 bp, Mus musculus
ctgaaaccagatgccttccaggacg

SEQ ID NO: 379620 - DNA, 25 bp, Mus musculus
ctgaaacccaagactatagccccaa

SEQ ID NO: 379621 - DNA, 25 bp, Mus musculus
ctgaaacccaagtctatagccccaa

SEQ ID NO: 379622 - DNA, 25 bp, Mus musculus
ctgaaacctggtaaacaagctccca

SEQ ID NO: 379623 - DNA, 25 bp, Mus musculus
ctgaaacctggttaacaagctccca

SEQ ID NO: 379624 - DNA, 25 bp, Mus musculus
ctgaaacctttgagacaaccgggag

SEQ ID NO: 379625 - DNA, 25 bp, Mus musculus
ctgaaacctttgtgacaaccgggag

SEQ ID NO: 379626 - DNA, 25 bp, Mus musculus
ctgaaacgaggtcccctctatctat

SEQ ID NO: 379627 - DNA, 25 bp, Mus musculus
ctgaaacgaggtgccctctatctat

SEQ ID NO: 379628 - DNA, 25 bp, Mus musculus
ctgaaacgctcacaaactagtctat

SEQ ID NO: 379629 - DNA, 25 bp, Mus musculus
ctgaaacgctcagaaactagtctat

SEQ ID NO: 379630 - DNA, 25 bp, Mus musculus
ctgaaacgctgcattcgcacagcag

SEQ ID NO: 379631 - DNA, 25 bp, Mus musculus
ctgaaacgctgctttcgcacagcag

SEQ ID NO: 379632 - DNA, 25 bp, Mus musculus
ctgaaacgtgtgcttctggaacctt

SEQ ID NO: 379633 - DNA, 25 bp, Mus musculus
ctgaaacgtgtggttctggaacctt

SEQ ID NO: 379634 - DNA, 25 bp, Mus musculus
ctgaaactagttctccttttctagt

SEQ ID NO: 379635 - DNA, 25 bp, Mus musculus
ctgaaactagttgtccttttctagt

SEQ ID NO: 379636 - DNA, 25 bp, Mus musculus
ctgaaactatggagagctcttcctc

SEQ ID NO: 379637 - DNA, 25 bp, Mus musculus
ctgaaactatggtgagctcttcctc

SEQ ID NO: 379638 - DNA, 25 bp, Mus musculus
ctgaaactcattacaaaaggccaat

SEQ ID NO: 379639 - DNA, 25 bp, Mus musculus
ctgaaactcatttcaaaaggccaat

SEQ ID NO: 379640 - DNA, 25 bp, Mus musculus
ctgaaactgacacctgtggcatatg

SEQ ID NO: 379641 - DNA, 25 bp, Mus musculus
ctgaaactgacagctgtggcatatg

SEQ ID NO: 379642 - DNA, 25 bp, Mus musculus
ctgaaactggagatcaagactgacc

SEQ ID NO: 379643 - DNA, 25 bp, Mus musculus
ctgaaactggagttcaagactgacc

SEQ ID NO: 379644 - DNA, 25 bp, Mus musculus
ctgaaacttaccacctctgagtggg

SEQ ID NO: 379645 - DNA, 25 bp, Mus musculus
ctgaaacttacctcctctgagtggg

SEQ ID NO: 379646 - DNA, 25 bp, Mus musculus
ctgaaacttgccctaagctctgaag

SEQ ID NO: 379647 - DNA, 25 bp, Mus musculus
ctgaaacttgccgtaagctctgaag

SEQ ID NO: 379648 - DNA, 25 bp, Mus musculus
ctgaaacttgttattggctggcctt

SEQ ID NO: 379649 - DNA, 25 bp, Mus musculus
ctgaaacttgtttttggctggcctt

SEQ ID NO: 379650 - DNA, 25 bp, Mus musculus
ctgaaagatctgaggcaaagttgga

SEQ ID NO: 379651 - DNA, 25 bp, Mus musculus
ctgaaagatctgtggcaaagttgga

SEQ ID NO: 379652 - DNA, 25 bp, Mus musculus
ctgaaagatggaattctagctctct

SEQ ID NO: 379653 - DNA, 25 bp, Mus musculus
ctgaaagatggatttctagctctct

SEQ ID NO: 379654 - DNA, 25 bp, Mus musculus
ctgaaagccactctgtaggaccaag

SEQ ID NO: 379655 - DNA, 25 bp, Mus musculus
ctgaaagccactgtgtaggaccaag

SEQ ID NO: 379656 - DNA, 25 bp, Mus musculus
ctgaaagccatgcatggcgtcttcc

SEQ ID NO: 379657 - DNA, 25 bp, Mus musculus
ctgaaagccatggatggcgtcttcc

SEQ ID NO: 379658 - DNA, 25 bp, Mus musculus
ctgaaagcccctacctatgaaaatt

SEQ ID NO: 379659 - DNA, 25 bp, Mus musculus
ctgaaagccccttcctatgaaaatt

SEQ ID NO: 379660 - DNA, 25 bp, Mus musculus
ctgaaagctgtgagatgtttttgac

SEQ ID NO: 379661 - DNA, 25 bp, Mus musculus
ctgaaagctgtgtgatgtttttgac

SEQ ID NO: 379662 - DNA, 25 bp, Mus musculus
ctgaaaggcaggagttatagacaat

SEQ ID NO: 379663 - DNA, 25 bp, Mus musculus
ctgaaaggcaggtgttatagacaat

SEQ ID NO: 379664 - DNA, 25 bp, Mus musculus
ctgaaaggcatccgtgccacgcatc

SEQ ID NO: 379665 - DNA, 25 bp, Mus musculus
ctgaaaggcatcggtgccacgcatc

SEQ ID NO: 379666 - DNA, 25 bp, Mus musculus
ctgaaaggcttgcacgcatctttat

SEQ ID NO: 379667 - DNA, 25 bp, Mus musculus
ctgaaaggcttggacgcatctttat

SEQ ID NO: 379668 - DNA, 25 bp, Mus musculus
ctgaaaggttgaccgggaaatccat

SEQ ID NO: 379669 - DNA, 25 bp, Mus musculus
ctgaaaggttgagcgggaaatccat

SEQ ID NO: 379670 - DNA, 25 bp, Mus musculus
ctgaaagtagttctggccttccttc

SEQ ID NO: 379671 - DNA, 25 bp, Mus musculus
ctgaaagtagttgtggccttccttc

SEQ ID NO: 379672 - DNA, 25 bp, Mus musculus
ctgaaagtggacagtggcttttttg

SEQ ID NO: 379673 - DNA, 25 bp, Mus musculus
ctgaaagtggactgtggcttttttg

SEQ ID NO: 379674 - DNA, 25 bp, Mus musculus
ctgaaagtgtttcctagcctctgag

SEQ ID NO: 379675 - DNA, 25 bp, Mus musculus
ctgaaagtgtttgctagcctctgag

SEQ ID NO: 379676 - DNA, 25 bp, Mus musculus
ctgaaagttgaaacaaatcccactt

SEQ ID NO: 379677 - DNA, 25 bp, Mus musculus
ctgaaagttgaatcaaatcccactt

SEQ ID NO: 379678 - DNA, 25 bp, Mus musculus
ctgaaataaacacccaccgcctctg

SEQ ID NO: 379679 - DNA, 25 bp, Mus musculus
ctgaaataaacagccaccgcctctg

SEQ ID NO: 379680 - DNA, 25 bp, Mus musculus
ctgaaatcaatgcaacacactggat

SEQ ID NO: 379681 - DNA, 25 bp, Mus musculus
ctgaaatcaatggaacacactggat

SEQ ID NO: 379682 - DNA, 25 bp, Mus musculus
ctgaaatcacatatgcttatcacag

SEQ ID NO: 379683 - DNA, 25 bp, Mus musculus
ctgaaatcacatttgcttatcacag

SEQ ID NO: 379684 - DNA, 25 bp, Mus musculus
ctgaaatcactacataaaagcccga

SEQ ID NO: 379685 - DNA, 25 bp, Mus musculus
ctgaaatcactagataaaagcccga

SEQ ID NO: 379686 - DNA, 25 bp, Mus musculus
ctgaaatcaggaaagcagggaccct

SEQ ID NO: 379687 - DNA, 25 bp, Mus musculus
ctgaaatcaggatagcagggaccct

SEQ ID NO: 379688 - DNA, 25 bp, Mus musculus
ctgaaatcatacctttattgtttat

SEQ ID NO: 379689 - DNA, 25 bp, Mus musculus
ctgaaatcatacgtttattgtttat

SEQ ID NO: 379690 - DNA, 25 bp, Mus musculus
ctgaaatccactctcatcacagatg

SEQ ID NO: 379691 - DNA, 25 bp, Mus musculus
ctgaaatccactgtcatcacagatg

SEQ ID NO: 379692 - DNA, 25 bp, Mus musculus
ctgaaatccataccattgcctgaac

SEQ ID NO: 379693 - DNA, 25 bp, Mus musculus
ctgaaatccatagcattgcctgaac

SEQ ID NO: 379694 - DNA, 25 bp, Mus musculus
ctgaaatcccagaaccaggtaggca

SEQ ID NO: 379695 - DNA, 25 bp, Mus musculus
ctgaaatcccagtaccaggtaggca

SEQ ID NO: 379696 - DNA, 25 bp, Mus musculus
ctgaaatccttactccttggtggaa

SEQ ID NO: 379697 - DNA, 25 bp, Mus musculus
ctgaaatccttagtccttggtggaa

SEQ ID NO: 379698 - DNA, 25 bp, Mus musculus
ctgaaatctagcaggagcctctcac

SEQ ID NO: 379699 - DNA, 25 bp, Mus musculus
ctgaaatctagctggagcctctcac

SEQ ID NO: 379700 - DNA, 25 bp, Mus musculus
ctgaaatcttgtacactggagtgta

SEQ ID NO: 379701 - DNA, 25 bp, Mus musculus
ctgaaatcttgttcactggagtgta

SEQ ID NO: 379702 - DNA, 25 bp, Mus musculus
ctgaaatgagagaagtcccctgtgg

SEQ ID NO: 379703 - DNA, 25 bp, Mus musculus
ctgaaatgagagtagtcccctgtgg

SEQ ID NO: 379704 - DNA, 25 bp, Mus musculus
ctgaaatgataaaccaccgatcccc

SEQ ID NO: 379705 - DNA, 25 bp, Mus musculus
ctgaaatgataatccaccgatcccc

SEQ ID NO: 379706 - DNA, 25 bp, Mus musculus
ctgaaatgctgaaatctcctgtgaa

SEQ ID NO: 379707 - DNA, 25 bp, Mus musculus
ctgaaatgctgatatctcctgtgaa

SEQ ID NO: 379708 - DNA, 25 bp, Mus musculus
ctgaaatgcttcaaagtggtctgga

SEQ ID NO: 379709 - DNA, 25 bp, Mus musculus
ctgaaatgcttctaagtggtctgga

SEQ ID NO: 379710 - DNA, 25 bp, Mus musculus
ctgaaatgcttgctgcccagatctg

SEQ ID NO: 379711 - DNA, 25 bp, Mus musculus
ctgaaatgcttggtgcccagatctg

SEQ ID NO: 379712 - DNA, 25 bp, Mus musculus
ctgaaatggagtccgagctcgagac

SEQ ID NO: 379713 - DNA, 25 bp, Mus musculus
ctgaaatggagtgcgagctcgagac

SEQ ID NO: 379714 - DNA, 25 bp, Mus musculus
ctgaaattcctacatttaagctctg

SEQ ID NO: 379715 - DNA, 25 bp, Mus musculus
ctgaaattcctagatttaagctctg

SEQ ID NO: 379716 - DNA, 25 bp, Mus musculus
ctgaaattttgtatagtatgtgaat

SEQ ID NO: 379717 - DNA, 25 bp, Mus musculus
ctgaaattttgtttagtatgtgaat

SEQ ID NO: 379718 - DNA, 25 bp, Mus musculus
ctgaacaactgcagtcggcttggaa

SEQ ID NO: 379719 - DNA, 25 bp, Mus musculus
ctgaacaactgctgtcggcttggaa

SEQ ID NO: 379720 - DNA, 25 bp, Mus musculus
ctgaacaatctgactccaaaagttt

SEQ ID NO: 379721 - DNA, 25 bp, Mus musculus
ctgaacaatctgtctccaaaagttt

SEQ ID NO: 379722 - DNA, 25 bp, Mus musculus
ctgaacacagtgcacccatctatga

SEQ ID NO: 379723 - DNA, 25 bp, Mus musculus
ctgaacacagtggacccatctatga

SEQ ID NO: 379724 - DNA, 25 bp, Mus musculus
ctgaacacgcttcgcctagacgagg

SEQ ID NO: 379725 - DNA, 25 bp, Mus musculus
ctgaacacgcttggcctagacgagg

SEQ ID NO: 379726 - DNA, 25 bp, Mus musculus
ctgaacacgtcaaattttacagttt

SEQ ID NO: 379727 - DNA, 25 bp, Mus musculus
ctgaacacgtcatattttacagttt

SEQ ID NO: 379728 - DNA, 25 bp, Mus musculus
ctgaacactgccatatggccaggat

SEQ ID NO: 379729 - DNA, 25 bp, Mus musculus
ctgaacactgccttatggccaggat

SEQ ID NO: 379730 - DNA, 25 bp, Mus musculus
ctgaacagaatcctcaccacggatg

SEQ ID NO: 379731 - DNA, 25 bp, Mus musculus
ctgaacagaatcgtcaccacggatg

SEQ ID NO: 379732 - DNA, 25 bp, Mus musculus
ctgaacagacatcacttttaaagct

SEQ ID NO: 379733 - DNA, 25 bp, Mus musculus
ctgaacagacatgacttttaaagct

SEQ ID NO: 379734 - DNA, 25 bp, Mus musculus
ctgaacatgggcacctgcagggatg

SEQ ID NO: 379735 - DNA, 25 bp, Mus musculus
ctgaacatgggcagttgatcccagc

SEQ ID NO: 379736 - DNA, 25 bp, Mus musculus
ctgaacatgggctcctgcagggatg

SEQ ID NO: 379737 - DNA, 25 bp, Mus musculus
ctgaacatgggctgttgatcccagc

SEQ ID NO: 379738 - DNA, 25 bp, Mus musculus
ctgaacattcttagttaaactggga

SEQ ID NO: 379739 - DNA, 25 bp, Mus musculus
ctgaacattctttgttaaactggga

SEQ ID NO: 379740 - DNA, 25 bp, Mus musculus
ctgaacattgacatttctttgcctt

SEQ ID NO: 379741 - DNA, 25 bp, Mus musculus
ctgaacattgacttttctttgcctt

SEQ ID NO: 379742 - DNA, 25 bp, Mus musculus
ctgaacattgctctgtcaccgacag

SEQ ID NO: 379743 - DNA, 25 bp, Mus musculus
ctgaacattgctgtgtcaccgacag

SEQ ID NO: 379744 - DNA, 25 bp, Mus musculus
ctgaaccacaacaccagggactttg

SEQ ID NO: 379745 - DNA, 25 bp, Mus musculus
ctgaaccacaactccagggactttg

SEQ ID NO: 379746 - DNA, 25 bp, Mus musculus
ctgaaccacctaacagcttgggcat

SEQ ID NO: 379747 - DNA, 25 bp, Mus musculus
ctgaaccacctatcagcttgggcat

SEQ ID NO: 379748 - DNA, 25 bp, Mus musculus
ctgaaccatgtgctgctgctgtctc

SEQ ID NO: 379749 - DNA, 25 bp, Mus musculus
ctgaaccatgtggtgctgctgtctc

SEQ ID NO: 379750 - DNA, 25 bp, Mus musculus
ctgaacccacccatacctggaggag

SEQ ID NO: 379751 - DNA, 25 bp, Mus musculus
ctgaacccacccttacctggaggag

SEQ ID NO: 379752 - DNA, 25 bp, Mus musculus
ctgaaccccagcacaaactttgaga

SEQ ID NO: 379753 - DNA, 25 bp, Mus musculus
ctgaaccccagctcaaactttgaga

SEQ ID NO: 379754 - DNA, 25 bp, Mus musculus
ctgaacccgcagcagcgatggctgc

SEQ ID NO: 379755 - DNA, 25 bp, Mus musculus
ctgaacccgcaggagcgatggctgc

SEQ ID NO: 379756 - DNA, 25 bp, Mus musculus
ctgaacccggagaacccagagctga

SEQ ID NO: 379757 - DNA, 25 bp, Mus musculus
ctgaacccggagtacccagagctga

SEQ ID NO: 379758 - DNA, 25 bp, Mus musculus
ctgaaccctgtgcaccaggaagcga

SEQ ID NO: 379759 - DNA, 25 bp, Mus musculus
ctgaaccctgtggaccaggaagcga

SEQ ID NO: 379760 - DNA, 25 bp, Mus musculus
ctgaaccctttcatctacagcttga

SEQ ID NO: 379761 - DNA, 25 bp, Mus musculus
ctgaaccctttcttctacagcttga

SEQ ID NO: 379762 - DNA, 25 bp, Mus musculus
ctgaaccggcccagcgcgaggacag

SEQ ID NO: 379763 - DNA, 25 bp, Mus musculus
ctgaaccggccctgcgcgaggacag

SEQ ID NO: 379764 - DNA, 25 bp, Mus musculus
ctgaacctagtgaaaagttttctct

SEQ ID NO: 379765 - DNA, 25 bp, Mus musculus
ctgaacctagtgtaaagttttctct

SEQ ID NO: 379766 - DNA, 25 bp, Mus musculus
ctgaacctctttaccatgacttgga

SEQ ID NO: 379767 - DNA, 25 bp, Mus musculus
ctgaacctcttttccatgacttgga

SEQ ID NO: 379768 - DNA, 25 bp, Mus musculus
ctgaacctgataccccatgcaaata

SEQ ID NO: 379769 - DNA, 25 bp, Mus musculus
ctgaacctgatagcccatgcaaata

SEQ ID NO: 379770 - DNA, 25 bp, Mus musculus
ctgaacctgcttatcctcattgaag

SEQ ID NO: 379771 - DNA, 25 bp, Mus musculus
ctgaacctgcttttcctcattgaag

SEQ ID NO: 379772 - DNA, 25 bp, Mus musculus
ctgaacctggagctctctaatttga

SEQ ID NO: 379773 - DNA, 25 bp, Mus musculus
ctgaacctggaggtctctaatttga

SEQ ID NO: 379774 - DNA, 25 bp, Mus musculus
ctgaaccttggtctacagtgaagta

SEQ ID NO: 379775 - DNA, 25 bp, Mus musculus
ctgaaccttggtgtacagtgaagta

SEQ ID NO: 379776 - DNA, 25 bp, Mus musculus
ctgaacgattacaatgccttcccag

SEQ ID NO: 379777 - DNA, 25 bp, Mus musculus
ctgaacgattactatgccttcccag

SEQ ID NO: 379778 - DNA, 25 bp, Mus musculus
ctgaacgcccgtccttgttgccaaa

SEQ ID NO: 379779 - DNA, 25 bp, Mus musculus
ctgaacgcccgtgcttgttgccaaa

SEQ ID NO: 379780 - DNA, 25 bp, Mus musculus
ctgaacgggccaatgaacaagtatt

SEQ ID NO: 379781 - DNA, 25 bp, Mus musculus
ctgaacgggccattgaacaagtatt

SEQ ID NO: 379782 - DNA, 20 bp, Mus musculus
ctgaacggtagcatcttgac

SEQ ID NO: 379783 - DNA, 25 bp, Mus musculus
ctgaacggtgtgagctactgcggtt

SEQ ID NO: 379784 - DNA, 25 bp, Mus musculus
ctgaacggtgtgtgctactgcggtt

SEQ ID NO: 379785 - DNA, 25 bp, Mus musculus
ctgaactaaggcagctccatcaaca

SEQ ID NO: 379786 - DNA, 25 bp, Mus musculus
ctgaactaaggctgctccatcaaca

SEQ ID NO: 379787 - DNA, 25 bp, Mus musculus
ctgaactagaggcatgtggctcaat

SEQ ID NO: 379788 - DNA, 25 bp, Mus musculus
ctgaactagagggatgtggctcaat

SEQ ID NO: 379789 - DNA, 25 bp, Mus musculus
ctgaactagtgcatcctagaattac

SEQ ID NO: 379790 - DNA, 25 bp, Mus musculus
ctgaactagtgcttcctagaattac

SEQ ID NO: 379791 - DNA, 25 bp, Mus musculus
ctgaactcaatacagtcactccttt

SEQ ID NO: 379792 - DNA, 25 bp, Mus musculus
ctgaactcaatagagtcactccttt

SEQ ID NO: 379793 - DNA, 25 bp, Mus musculus
ctgaactcacgcatcctagaattac

SEQ ID NO: 379794 - DNA, 25 bp, Mus musculus
ctgaactcacgcttcctagaattac

SEQ ID NO: 379795 - DNA, 25 bp, Mus musculus
ctgaactcacggcttttctacacaa

SEQ ID NO: 379796 - DNA, 25 bp, Mus musculus
ctgaactcacgggttttctacacaa

SEQ ID NO: 379797 - DNA, 25 bp, Mus musculus
ctgaactcactcaacctgtaagact

SEQ ID NO: 379798 - DNA, 25 bp, Mus musculus
ctgaactcactctacctgtaagact

SEQ ID NO: 379799 - DNA, 25 bp, Mus musculus
ctgaactcagatcctgtccaagagc

SEQ ID NO: 379800 - DNA, 25 bp, Mus musculus
ctgaactcagatgctgtccaagagc

SEQ ID NO: 379801 - DNA, 25 bp, Mus musculus
ctgaactcatccacacaacgagaac

SEQ ID NO: 379802 - DNA, 25 bp, Mus musculus
ctgaactcatcctcacaacgagaac

SEQ ID NO: 379803 - DNA, 25 bp, Mus musculus
ctgaactccgctagcatacacgatg

SEQ ID NO: 379804 - DNA, 25 bp, Mus musculus
ctgaactccgcttgcatacacgatg

SEQ ID NO: 379805 - DNA, 25 bp, Mus musculus
ctgaactcctgcacaacaagatgga

SEQ ID NO: 379806 - DNA, 25 bp, Mus musculus
ctgaactcctgctcaacaagatgga

SEQ ID NO: 379807 - DNA, 25 bp, Mus musculus
ctgaactcctgtagtaatggctaaa

SEQ ID NO: 379808 - DNA, 25 bp, Mus musculus
ctgaactcctgttgtaatggctaaa

SEQ ID NO: 379809 - DNA, 25 bp, Mus musculus
ctgaactcttcaccccagaatgcat

SEQ ID NO: 379810 - DNA, 25 bp, Mus musculus
ctgaactcttcagcccagaatgcat

SEQ ID NO: 379811 - DNA, 25 bp, Mus musculus
ctgaactcttccacaaacatttctg

SEQ ID NO: 379812 - DNA, 25 bp, Mus musculus
ctgaactcttcctcaaacatttctg

SEQ ID NO: 379813 - DNA, 25 bp, Mus musculus
ctgaactgctatacaatgacatctg

SEQ ID NO: 379814 - DNA, 25 bp, Mus musculus
ctgaactgctattcaatgacatctg

SEQ ID NO: 379815 - DNA, 25 bp, Mus musculus
ctgaacttagttctgagcagtggac

SEQ ID NO: 379816 - DNA, 25 bp, Mus musculus
ctgaacttagttgtgagcagtggac

SEQ ID NO: 379817 - DNA, 25 bp, Mus musculus
ctgaacttatgaacaaactcatgga

SEQ ID NO: 379818 - DNA, 25 bp, Mus musculus
ctgaacttatgatcaaactcatgga

SEQ ID NO: 379819 - DNA, 25 bp, Mus musculus
ctgaacttcagcattgaagaactga

SEQ ID NO: 379820 - DNA, 25 bp, Mus musculus
ctgaacttcagctttgaagaactga

SEQ ID NO: 379821 - DNA, 25 bp, Mus musculus
ctgaacttcccacctgggatctgtg

SEQ ID NO: 379822 - DNA, 25 bp, Mus musculus
ctgaacttcccagctgggatctgtg

SEQ ID NO: 379823 - DNA, 25 bp, Mus musculus
ctgaacttctcacttttgtctgtct

SEQ ID NO: 379824 - DNA, 25 bp, Mus musculus
ctgaacttctcagttttgtctgtct

SEQ ID NO: 379825 - DNA, 25 bp, Mus musculus
ctgaacttctggacccttagaaatg

SEQ ID NO: 379826 - DNA, 25 bp, Mus musculus
ctgaacttctggtcccttagaaatg

SEQ ID NO: 379827 - DNA, 25 bp, Mus musculus
ctgaacttcttcagctgtcgagaga

SEQ ID NO: 379828 - DNA, 25 bp, Mus musculus
ctgaacttcttctgctgtcgagaga

SEQ ID NO: 379829 - DNA, 25 bp, Mus musculus
ctgaacttgagtcccacgcgctgtg

SEQ ID NO: 379830 - DNA, 25 bp, Mus musculus
ctgaacttgagtgccacgcgctgtg

SEQ ID NO: 379831 - DNA, 25 bp, Mus musculus
ctgaacttgctcaccttcaatgtgg

SEQ ID NO: 379832 - DNA, 25 bp, Mus musculus
ctgaacttgctctccttcaatgtgg

SEQ ID NO: 379833 - DNA, 25 bp, Mus musculus
ctgaacttttgtctgcaatttctgc

SEQ ID NO: 379834 - DNA, 25 bp, Mus musculus
ctgaacttttgtgtgcaatttctgc

SEQ ID NO: 379835 - DNA, 25 bp, Mus musculus
ctgaagaaacatctccatccatggc

SEQ ID NO: 379836 - DNA, 25 bp, Mus musculus
ctgaagaaacatgtccatccatggc

SEQ ID NO: 379837 - DNA, 25 bp, Mus musculus
ctgaagaaatttcaccctatgggac

SEQ ID NO: 379838 - DNA, 25 bp, Mus musculus
ctgaagaaatttgaccctatgggac

SEQ ID NO: 379839 - DNA, 25 bp, Mus musculus
ctgaagaactgtcgcctgggctcct

SEQ ID NO: 379840 - DNA, 25 bp, Mus musculus
ctgaagaactgtggcctgggctcct

SEQ ID NO: 379841 - DNA, 25 bp, Mus musculus
ctgaagaagaccaccagtgccatgc

SEQ ID NO: 379842 - DNA, 25 bp, Mus musculus
ctgaagaagacctccagtgccatgc

SEQ ID NO: 379843 - DNA, 25 bp, Mus musculus
ctgaagaagcccatcgggtttctga

SEQ ID NO: 379844 - DNA, 25 bp, Mus musculus
ctgaagaagcccttcgggtttctga

SEQ ID NO: 379845 - DNA, 25 bp, Mus musculus
ctgaagaaggtacccggagcccagt

SEQ ID NO: 379846 - DNA, 25 bp, Mus musculus
ctgaagaaggtagccggagcccagt

SEQ ID NO: 379847 - DNA, 25 bp, Mus musculus
ctgaagaattccaatctagtgtgca

SEQ ID NO: 379848 - DNA, 25 bp, Mus musculus
ctgaagaattcctatctagtgtgca

SEQ ID NO: 379849 - DNA, 25 bp, Mus musculus
ctgaagacaaaaacgcctaaccgct

SEQ ID NO: 379850 - DNA, 25 bp, Mus musculus
ctgaagacaaaatcgcctaaccgct

SEQ ID NO: 379851 - DNA, 25 bp, Mus musculus
ctgaagacagagacctttccagact

SEQ ID NO: 379852 - DNA, 25 bp, Mus musculus
ctgaagacagagtcctttccagact

SEQ ID NO: 379853 - DNA, 25 bp, Mus musculus
ctgaagaccacaccccaggttttga

SEQ ID NO: 379854 - DNA, 25 bp, Mus musculus
ctgaagaccacagcccaggttttga

SEQ ID NO: 379855 - DNA, 25 bp, Mus musculus
ctgaagaccactcgaagccgggact

SEQ ID NO: 379856 - DNA, 25 bp, Mus musculus
ctgaagaccactggaagccgggact

SEQ ID NO: 379857 - DNA, 25 bp, Mus musculus
ctgaagacccatcatagtaagcttt

SEQ ID NO: 379858 - DNA, 25 bp, Mus musculus
ctgaagacccatgatagtaagcttt

SEQ ID NO: 379859 - DNA, 25 bp, Mus musculus
ctgaagactgataggctggaaggtt

SEQ ID NO: 379860 - DNA, 25 bp, Mus musculus
ctgaagactgattggctggaaggtt

SEQ ID NO: 379861 - DNA, 25 bp, Mus musculus
ctgaagagacctaacattgtaccta

SEQ ID NO: 379862 - DNA, 25 bp, Mus musculus
ctgaagagaccttacattgtaccta

SEQ ID NO: 379863 - DNA, 25 bp, Mus musculus
ctgaagagatgcacataggaatctc

SEQ ID NO: 379864 - DNA, 25 bp, Mus musculus
ctgaagagatgctcataggaatctc

SEQ ID NO: 379865 - DNA, 25 bp, Mus musculus
ctgaagagccatctgcgcatccaca

SEQ ID NO: 379866 - DNA, 25 bp, Mus musculus
ctgaagagccatgtgcgcatccaca

SEQ ID NO: 379867 - DNA, 25 bp, Mus musculus
ctgaagagctttctctgaagcctga

SEQ ID NO: 379868 - DNA, 25 bp, Mus musculus
ctgaagagctttgtctgaagcctga

SEQ ID NO: 379869 - DNA, 25 bp, Mus musculus
ctgaagaggaggctcgggtagaggc

SEQ ID NO: 379870 - DNA, 25 bp, Mus musculus
ctgaagaggagggtcgggtagaggc

SEQ ID NO: 379871 - DNA, 25 bp, Mus musculus
ctgaagaggtgcctgccatcttgga

SEQ ID NO: 379872 - DNA, 25 bp, Mus musculus
ctgaagaggtgcgtgccatcttgga

SEQ ID NO: 379873 - DNA, 25 bp, Mus musculus
ctgaagatacccatgaacttccggt

SEQ ID NO: 379874 - DNA, 25 bp, Mus musculus
ctgaagatacccttgaacttccggt

SEQ ID NO: 379875 - DNA, 25 bp, Mus musculus
ctgaagatctgccagtccgaggttc

SEQ ID NO: 379876 - DNA, 25 bp, Mus musculus
ctgaagatctgcgagtccgaggttc

SEQ ID NO: 379877 - DNA, 25 bp, Mus musculus
ctgaagatctggaaccgcaggtaga

SEQ ID NO: 379878 - DNA, 25 bp, Mus musculus
ctgaagatctggcagggcatcgaca

SEQ ID NO: 379879 - DNA, 25 bp, Mus musculus
ctgaagatctgggagggcatcgaca

SEQ ID NO: 379880 - DNA, 25 bp, Mus musculus
ctgaagatctggtaccgcaggtaga

SEQ ID NO: 379881 - DNA, 25 bp, Mus musculus
ctgaagatggaaccctgcatggaca

SEQ ID NO: 379882 - DNA, 25 bp, Mus musculus
ctgaagatggaactggcacccagct

SEQ ID NO: 379883 - DNA, 25 bp, Mus musculus
ctgaagatggaagcctgcatggaca

SEQ ID NO: 379884 - DNA, 25 bp, Mus musculus
ctgaagatggaagtggcacccagct

SEQ ID NO: 379885 - DNA, 25 bp, Mus musculus
ctgaagcacttacgagctactgctc

SEQ ID NO: 379886 - DNA, 25 bp, Mus musculus
ctgaagcacttaggagctactgctc

SEQ ID NO: 379887 - DNA, 25 bp, Mus musculus
ctgaagcacttgcagctgaaactat

SEQ ID NO: 379888 - DNA, 25 bp, Mus musculus
ctgaagcacttggagctgaaactat

SEQ ID NO: 379889 - DNA, 25 bp, Mus musculus
ctgaagcagggacgctgtcacacct

SEQ ID NO: 379890 - DNA, 25 bp, Mus musculus
ctgaagcagggaggctgtcacacct

SEQ ID NO: 379891 - DNA, 25 bp, Mus musculus
ctgaagcatggaccccaagtgacag

SEQ ID NO: 379892 - DNA, 25 bp, Mus musculus
ctgaagcatggagcccaagtgacag

SEQ ID NO: 379893 - DNA, 25 bp, Mus musculus
ctgaagcatgttaccgaagactgtg

SEQ ID NO: 379894 - DNA, 25 bp, Mus musculus
ctgaagcatgtttccgaagactgtg

SEQ ID NO: 379895 - DNA, 25 bp, Mus musculus
ctgaagcatttaaactgtctttatt

SEQ ID NO: 379896 - DNA, 25 bp, Mus musculus
ctgaagcatttatactgtctttatt

SEQ ID NO: 379897 - DNA, 25 bp, Mus musculus
ctgaagcccactccggaaactaaag

SEQ ID NO: 379898 - DNA, 25 bp, Mus musculus
ctgaagcccactgcggaaactaaag

SEQ ID NO: 379899 - DNA, 25 bp, Mus musculus
ctgaagcccatgctgttcgtgggaa

SEQ ID NO: 379900 - DNA, 25 bp, Mus musculus
ctgaagcccatggtgttcgtgggaa

SEQ ID NO: 379901 - DNA, 25 bp, Mus musculus
ctgaagcccattagcttttccttgg

SEQ ID NO: 379902 - DNA, 25 bp, Mus musculus
ctgaagcccatttgcttttccttgg

SEQ ID NO: 379903 - DNA, 25 bp, Mus musculus
ctgaagccccttcttttggaggtgc

SEQ ID NO: 379904 - DNA, 25 bp, Mus musculus
ctgaagccccttgttttggaggtgc

SEQ ID NO: 379905 - DNA, 25 bp, Mus musculus
ctgaagcccgagaatgacataatgt

SEQ ID NO: 379906 - DNA, 25 bp, Mus musculus
ctgaagcccgagtatgacataatgt

SEQ ID NO: 379907 - DNA, 25 bp, Mus musculus
ctgaagcctaaaccaggtttctttt

SEQ ID NO: 379908 - DNA, 25 bp, Mus musculus
ctgaagcctaaagcaggtttctttt

SEQ ID NO: 379909 - DNA, 25 bp, Mus musculus
ctgaagcctgaacagcaggtgtgct

SEQ ID NO: 379910 - DNA, 25 bp, Mus musculus
ctgaagcctgaagagcaggtgtgct

SEQ ID NO: 379911 - DNA, 25 bp, Mus musculus
ctgaagcctttaaccaaatgggaat

SEQ ID NO: 379912 - DNA, 25 bp, Mus musculus
ctgaagcctttatccaaatgggaat

SEQ ID NO: 379913 - DNA, 25 bp, Mus musculus
ctgaagccttttcagaccctgctgt

SEQ ID NO: 379914 - DNA, 25 bp, Mus musculus
ctgaagccttttgagaccctgctgt

SEQ ID NO: 379915 - DNA, 25 bp, Mus musculus
ctgaagcgcagtaggatgctgaact

SEQ ID NO: 379916 - DNA, 25 bp, Mus musculus
ctgaagcgcagttggatgctgaact

SEQ ID NO: 379917 - DNA, 25 bp, Mus musculus
ctgaagcggcccaggaactggaaga

SEQ ID NO: 379918 - DNA, 25 bp, Mus musculus
ctgaagcggccctggaactggaaga

SEQ ID NO: 379919 - DNA, 25 bp, Mus musculus
ctgaagcgtctgaccagtttggtat

SEQ ID NO: 379920 - DNA, 25 bp, Mus musculus
ctgaagcgtctgtccagtttggtat

SEQ ID NO: 379921 - DNA, 25 bp, Mus musculus
ctgaagcgtgccaaacgacagctgt

SEQ ID NO: 379922 - DNA, 25 bp, Mus musculus
ctgaagcgtgcctaacgacagctgt

SEQ ID NO: 379923 - DNA, 25 bp, Mus musculus
ctgaagctagggatagttgtgagcc

SEQ ID NO: 379924 - DNA, 25 bp, Mus musculus
ctgaagctagggttagttgtgagcc

SEQ ID NO: 379925 - DNA, 25 bp, Mus musculus
ctgaagctccagacgtcatggtagc

SEQ ID NO: 379926 - DNA, 25 bp, Mus musculus
ctgaagctccagtcgtcatggtagc

SEQ ID NO: 379927 - DNA, 25 bp, Mus musculus
ctgaagctcctcacatcaaaggtaa

SEQ ID NO: 379928 - DNA, 25 bp, Mus musculus
ctgaagctcctctcatcaaaggtaa

SEQ ID NO: 379929 - DNA, 25 bp, Mus musculus
ctgaagctccttcatcagagtccaa

SEQ ID NO: 379930 - DNA, 25 bp, Mus musculus
ctgaagctccttgatcagagtccaa

SEQ ID NO: 379931 - DNA, 25 bp, Mus musculus
ctgaagctgagaccagtggaatcct

SEQ ID NO: 379932 - DNA, 25 bp, Mus musculus
ctgaagctgagagcagtggaatcct

SEQ ID NO: 379933 - DNA, 25 bp, Mus musculus
ctgaagctgaggaccctgtttggat

SEQ ID NO: 379934 - DNA, 25 bp, Mus musculus
ctgaagctgaggtccctgtttggat

SEQ ID NO: 379935 - DNA, 25 bp, Mus musculus
ctgaagctgatgctgaactggagaa

SEQ ID NO: 379936 - DNA, 25 bp, Mus musculus
ctgaagctgatggtgaactggagaa

SEQ ID NO: 379937 - DNA, 25 bp, Mus musculus
ctgaagctgcagcactggcgtaagt

SEQ ID NO: 379938 - DNA, 25 bp, Mus musculus
ctgaagctgcaggactggcgtaagt

SEQ ID NO: 379939 - DNA, 25 bp, Mus musculus
ctgaagctgcttctgatgcctctga

SEQ ID NO: 379940 - DNA, 25 bp, Mus musculus
ctgaagctgcttgtgatgcctctga

SEQ ID NO: 379941 - DNA, 25 bp, Mus musculus
ctgaagcttaagagaggatttcctt

SEQ ID NO: 379942 - DNA, 25 bp, Mus musculus
ctgaagcttaagtgaggatttcctt

SEQ ID NO: 379943 - DNA, 25 bp, Mus musculus
ctgaagcttttaagattgctataaa

SEQ ID NO: 379944 - DNA, 25 bp, Mus musculus
ctgaagcttttatgattgctataaa

SEQ ID NO: 379945 - DNA, 25 bp, Mus musculus
ctgaaggaaagcagccagccttgcc

SEQ ID NO: 379946 - DNA, 25 bp, Mus musculus
ctgaaggaaagctgccagccttgcc

SEQ ID NO: 379947 - DNA, 25 bp, Mus musculus
ctgaaggaagttcgctttctccaaa

SEQ ID NO: 379948 - DNA, 25 bp, Mus musculus
ctgaaggaagttggctttctccaaa

SEQ ID NO: 379949 - DNA, 25 bp, Mus musculus
ctgaaggaccctcctggttttggaa

SEQ ID NO: 379950 - DNA, 25 bp, Mus musculus
ctgaaggaccctgctggttttggaa

SEQ ID NO: 379951 - DNA, 25 bp, Mus musculus
ctgaaggacgatcaggtcgctcagc

SEQ ID NO: 379952 - DNA, 25 bp, Mus musculus
ctgaaggacgatgaggtcgctcagc

SEQ ID NO: 379953 - DNA, 25 bp, Mus musculus
ctgaaggactccatgggacgtgaag

SEQ ID NO: 379954 - DNA, 25 bp, Mus musculus
ctgaaggactccttgggacgtgaag

SEQ ID NO: 379955 - DNA, 25 bp, Mus musculus
ctgaaggactgtcgcaatatttctt

SEQ ID NO: 379956 - DNA, 25 bp, Mus musculus
ctgaaggactgtggcaatatttctt

SEQ ID NO: 379957 - DNA, 25 bp, Mus musculus
ctgaaggagaacatgtgagggccat

SEQ ID NO: 379958 - DNA, 25 bp, Mus musculus
ctgaaggagaacttgtgagggccat

SEQ ID NO: 379959 - DNA, 25 bp, Mus musculus
ctgaaggagagcaccgtgtggacca

SEQ ID NO: 379960 - DNA, 25 bp, Mus musculus
ctgaaggagagctccgtgtggacca

SEQ ID NO: 379961 - DNA, 25 bp, Mus musculus
ctgaaggagagtctccagactttga

SEQ ID NO: 379962 - DNA, 25 bp, Mus musculus
ctgaaggagagtgtccagactttga

SEQ ID NO: 379963 - DNA, 25 bp, Mus musculus
ctgaaggatctgctctcttagaaga

SEQ ID NO: 379964 - DNA, 25 bp, Mus musculus
ctgaaggatctggtctcttagaaga

SEQ ID NO: 379965 - DNA, 25 bp, Mus musculus
ctgaaggcaactctcgcaggagctg

SEQ ID NO: 379966 - DNA, 25 bp, Mus musculus
ctgaaggcaactgtcgcaggagctg

SEQ ID NO: 379967 - DNA, 25 bp, Mus musculus
ctgaaggccttcaggattggaacaa

SEQ ID NO: 379968 - DNA, 25 bp, Mus musculus
ctgaaggccttctggattggaacaa

SEQ ID NO: 379969 - DNA, 25 bp, Mus musculus
ctgaaggctaaaagtttttacgcat

SEQ ID NO: 379970 - DNA, 25 bp, Mus musculus
ctgaaggctaaatgtttttacgcat

SEQ ID NO: 379971 - DNA, 25 bp, Mus musculus
ctgaaggcttctaataaaatatcaa

SEQ ID NO: 379972 - DNA, 25 bp, Mus musculus
ctgaaggcttcttataaaatatcaa

SEQ ID NO: 379973 - DNA, 25 bp, Mus musculus
ctgaagggcggacatgacacaacat

SEQ ID NO: 379974 - DNA, 25 bp, Mus musculus
ctgaagggcggagatgacacaacat

SEQ ID NO: 379975 - DNA, 25 bp, Mus musculus
ctgaagggtaacacaggttctggca

SEQ ID NO: 379976 - DNA, 25 bp, Mus musculus
ctgaagggtaactcaggttctggca

SEQ ID NO: 379977 - DNA, 25 bp, Mus musculus
ctgaagggtggtcttttctcagatt

SEQ ID NO: 379978 - DNA, 25 bp, Mus musculus
ctgaagggtggtgttttctcagatt

SEQ ID NO: 379979 - DNA, 25 bp, Mus musculus
ctgaaggtaccccttcctatggcat

SEQ ID NO: 379980 - DNA, 25 bp, Mus musculus
ctgaaggtacccgttcctatggcat

SEQ ID NO: 379981 - DNA, 25 bp, Mus musculus
ctgaaggtattccagttatggcctg

SEQ ID NO: 379982 - DNA, 25 bp, Mus musculus
ctgaaggtattcgagttatggcctg

SEQ ID NO: 379983 - DNA, 25 bp, Mus musculus
ctgaaggtccaacaatctgcattga

SEQ ID NO: 379984 - DNA, 25 bp, Mus musculus
ctgaaggtccaagaatctgcattga

SEQ ID NO: 379985 - DNA, 25 bp, Mus musculus
ctgaaggtcggtaccagcaagaact

SEQ ID NO: 379986 - DNA, 25 bp, Mus musculus
ctgaaggtcggttccagcaagaact

SEQ ID NO: 379987 - DNA, 25 bp, Mus musculus
ctgaaggtctagacatcttccaaga

SEQ ID NO: 379988 - DNA, 25 bp, Mus musculus
ctgaaggtctagtcatcttccaaga

SEQ ID NO: 379989 - DNA, 25 bp, Mus musculus
ctgaaggtgacaaagctgccaaaca

SEQ ID NO: 379990 - DNA, 25 bp, Mus musculus
ctgaaggtgacatagctgccaaaca

SEQ ID NO: 379991 - DNA, 25 bp, Mus musculus
ctgaaggtgcagctatacgcgaaat

SEQ ID NO: 379992 - DNA, 25 bp, Mus musculus
ctgaaggtgcaggtatacgcgaaat

SEQ ID NO: 379993 - DNA, 25 bp, Mus musculus
ctgaaggtgctaattaacaagggag

SEQ ID NO: 379994 - DNA, 25 bp, Mus musculus
ctgaaggtgctatttaacaagggag

SEQ ID NO: 379995 - DNA, 25 bp, Mus musculus
ctgaaggtggccatgagagcacttg

SEQ ID NO: 379996 - DNA, 25 bp, Mus musculus
ctgaaggtggccttgagagcacttg

SEQ ID NO: 379997 - DNA, 25 bp, Mus musculus
ctgaaggtgttcatgatgcggtccg

SEQ ID NO: 379998 - DNA, 25 bp, Mus musculus
ctgaaggtgttcttgatgcggtccg

SEQ ID NO: 379999 - DNA, 25 bp, Mus musculus
ctgaaggtgttgctgttgctcctgc

SEQ ID NO: 380000 - DNA, 25 bp, Mus musculus
ctgaaggtgttggtgttgctcctgc

SEQ ID NO: 380001 - DNA, 25 bp, Mus musculus
ctgaaggttagcacttggaaatgac

SEQ ID NO: 380002 - DNA, 25 bp, Mus musculus
ctgaaggttagctcttggaaatgac

SEQ ID NO: 380003 - DNA, 25 bp, Mus musculus
ctgaaggttcatcgcaccctgtgca

SEQ ID NO: 380004 - DNA, 25 bp, Mus musculus
ctgaaggttcatggcaccctgtgca

SEQ ID NO: 380005 - DNA, 25 bp, Mus musculus
ctgaagtcaaaccgtcttccaatgg

SEQ ID NO: 380006 - DNA, 25 bp, Mus musculus
ctgaagtcaaacggtcttccaatgg

SEQ ID NO: 380007 - DNA, 25 bp, Mus musculus
ctgaagtcacgacctcaattcccag

SEQ ID NO: 380008 - DNA, 25 bp, Mus musculus
ctgaagtcacgagctcaattcccag

SEQ ID NO: 380009 - DNA, 25 bp, Mus musculus
ctgaagtcacgcagcattgagagct

SEQ ID NO: 380010 - DNA, 25 bp, Mus musculus
ctgaagtcacgctgcattgagagct

SEQ ID NO: 380011 - DNA, 25 bp, Mus musculus
ctgaagtcagcaattgtgtgtttgt

SEQ ID NO: 380012 - DNA, 25 bp, Mus musculus
ctgaagtcagcatttgtgtgtttgt

SEQ ID NO: 380013 - DNA, 25 bp, Mus musculus
ctgaagtcagtgatgcagcctggat

SEQ ID NO: 380014 - DNA, 25 bp, Mus musculus
ctgaagtcagtgttgcagcctggat

SEQ ID NO: 380015 - DNA, 25 bp, Mus musculus
ctgaagtccatgagtgctgggcagc

SEQ ID NO: 380016 - DNA, 25 bp, Mus musculus
ctgaagtccatgctggaggccatca

SEQ ID NO: 380017 - DNA, 25 bp, Mus musculus
ctgaagtccatggtggaggccatca

SEQ ID NO: 380018 - DNA, 25 bp, Mus musculus
ctgaagtccatgtgtgctgggcagc

SEQ ID NO: 380019 - DNA, 25 bp, Mus musculus
ctgaagtcccgtcccttgctacagg

SEQ ID NO: 380020 - DNA, 25 bp, Mus musculus
ctgaagtcccgtgccttgctacagg

SEQ ID NO: 380021 - DNA, 25 bp, Mus musculus
ctgaagtccttgaatattgtgtttg

SEQ ID NO: 380022 - DNA, 25 bp, Mus musculus
ctgaagtccttgagccatgtatcta

SEQ ID NO: 380023 - DNA, 25 bp, Mus musculus
ctgaagtccttgtatattgtgtttg

SEQ ID NO: 380024 - DNA, 25 bp, Mus musculus
ctgaagtccttgtgccatgtatcta

SEQ ID NO: 380025 - DNA, 25 bp, Mus musculus
ctgaagtcgtaaccataatatgtaa

SEQ ID NO: 380026 - DNA, 25 bp, Mus musculus
ctgaagtcgtaagcataatatgtaa

SEQ ID NO: 380027 - DNA, 25 bp, Mus musculus
ctgaagtctcttcaatgcctgcctg

SEQ ID NO: 380028 - DNA, 25 bp, Mus musculus
ctgaagtctcttgaatgcctgcctg

SEQ ID NO: 380029 - DNA, 25 bp, Mus musculus
ctgaagtcttgtcgccaggagtcaa

SEQ ID NO: 380030 - DNA, 25 bp, Mus musculus
ctgaagtcttgtggccaggagtcaa

SEQ ID NO: 380031 - DNA, 25 bp, Mus musculus
ctgaagtgacagcacctcaggattt

SEQ ID NO: 380032 - DNA, 25 bp, Mus musculus
ctgaagtgacaggacctcaggattt

SEQ ID NO: 380033 - DNA, 25 bp, Mus musculus
ctgaagtgctccctgatgtgtgtat

SEQ ID NO: 380034 - DNA, 25 bp, Mus musculus
ctgaagtgctccgtgatgtgtgtat

SEQ ID NO: 380035 - DNA, 25 bp, Mus musculus
ctgaagtggcacatttcactttaac

SEQ ID NO: 380036 - DNA, 25 bp, Mus musculus
ctgaagtggcacttttcactttaac

SEQ ID NO: 380037 - DNA, 25 bp, Mus musculus
ctgaagtgggttatgctttctctca

SEQ ID NO: 380038 - DNA, 25 bp, Mus musculus
ctgaagtgggttttgctttctctca

SEQ ID NO: 380039 - DNA, 25 bp, Mus musculus
ctgaagtggtctctgtcaggtactt

SEQ ID NO: 380040 - DNA, 25 bp, Mus musculus
ctgaagtggtctgtgtcaggtactt

SEQ ID NO: 380041 - DNA, 25 bp, Mus musculus
ctgaagtgtaaacagtggacatact

SEQ ID NO: 380042 - DNA, 25 bp, Mus musculus
ctgaagtgtaaagagtggacatact

SEQ ID NO: 380043 - DNA, 25 bp, Mus musculus
ctgaagtgtcacaccctgaagatga

SEQ ID NO: 380044 - DNA, 25 bp, Mus musculus
ctgaagtgtcactccctgaagatga

SEQ ID NO: 380045 - DNA, 25 bp, Mus musculus
ctgaagtgttccctgagtactgatc

SEQ ID NO: 380046 - DNA, 25 bp, Mus musculus
ctgaagtgttccgtgagtactgatc

SEQ ID NO: 380047 - DNA, 25 bp, Mus musculus
ctgaagtgttgtccctatattgcat

SEQ ID NO: 380048 - DNA, 25 bp, Mus musculus
ctgaagtgttgtgcctatattgcat

SEQ ID NO: 380049 - DNA, 25 bp, Mus musculus
ctgaagttacatctttctgcttaat

SEQ ID NO: 380050 - DNA, 25 bp, Mus musculus
ctgaagttacatgtttctgcttaat

SEQ ID NO: 380051 - DNA, 25 bp, Mus musculus
ctgaagttcaagaccacagcaccac

SEQ ID NO: 380052 - DNA, 25 bp, Mus musculus
ctgaagttcaagtccacagcaccac

SEQ ID NO: 380053 - DNA, 25 bp, Mus musculus
ctgaagttcagtctccggtggtcga

SEQ ID NO: 380054 - DNA, 25 bp, Mus musculus
ctgaagttcagtgtccggtggtcga

SEQ ID NO: 380055 - DNA, 25 bp, Mus musculus
ctgaagttccttcttgatctatata

SEQ ID NO: 380056 - DNA, 25 bp, Mus musculus
ctgaagttccttgttgatctatata

SEQ ID NO: 380057 - DNA, 25 bp, Mus musculus
ctgaagttgatcatgcaagccctgg

SEQ ID NO: 380058 - DNA, 25 bp, Mus musculus
ctgaagttgatcttgcaagccctgg

SEQ ID NO: 380059 - DNA, 25 bp, Mus musculus
ctgaagttggttatcatatcttttt

SEQ ID NO: 380060 - DNA, 25 bp, Mus musculus
ctgaagttggttttcatatcttttt

SEQ ID NO: 380061 - DNA, 25 bp, Mus musculus
ctgaagttgtatctgccctgcaggc

SEQ ID NO: 380062 - DNA, 25 bp, Mus musculus
ctgaagttgtatgtgccctgcaggc

SEQ ID NO: 380063 - DNA, 25 bp, Mus musculus
ctgaagtttaataacaactgggcag

SEQ ID NO: 380064 - DNA, 25 bp, Mus musculus
ctgaagtttaattacaactgggcag

SEQ ID NO: 380065 - DNA, 25 bp, Mus musculus
ctgaagtttcaaaatccctactaaa

SEQ ID NO: 380066 - DNA, 25 bp, Mus musculus
ctgaagtttcaatatccctactaaa

SEQ ID NO: 380067 - DNA, 25 bp, Mus musculus
ctgaagtttcagaagcgcccataaa

SEQ ID NO: 380068 - DNA, 25 bp, Mus musculus
ctgaagtttcagtagcgcccataaa

SEQ ID NO: 380069 - DNA, 25 bp, Mus musculus
ctgaagtttgtgctatggatgcccc

SEQ ID NO: 380070 - DNA, 25 bp, Mus musculus
ctgaagtttgtggtatggatgcccc

SEQ ID NO: 380071 - DNA, 25 bp, Mus musculus
ctgaagttttatccagccttctcga

SEQ ID NO: 380072 - DNA, 25 bp, Mus musculus
ctgaagttttatgcagccttctcga

SEQ ID NO: 380073 - DNA, 25 bp, Mus musculus
ctgaagtttttgaatctttaaagag

SEQ ID NO: 380074 - DNA, 25 bp, Mus musculus
ctgaagtttttgtatctttaaagag

SEQ ID NO: 380075 - DNA, 25 bp, Mus musculus
ctgaataaagtcagaaggagtctga

SEQ ID NO: 380076 - DNA, 25 bp, Mus musculus
ctgaataaagtctgaaggagtctga

SEQ ID NO: 380077 - DNA, 25 bp, Mus musculus
ctgaataccgaaacaccccaaggaa

SEQ ID NO: 380078 - DNA, 25 bp, Mus musculus
ctgaataccgaatcaccccaaggaa

SEQ ID NO: 380079 - DNA, 25 bp, Mus musculus
ctgaatacgttgctgcatgccttta

SEQ ID NO: 380080 - DNA, 25 bp, Mus musculus
ctgaatacgttggtgcatgccttta

SEQ ID NO: 380081 - DNA, 25 bp, Mus musculus
ctgaatacttggatgctaattataa

SEQ ID NO: 380082 - DNA, 25 bp, Mus musculus
ctgaatacttggttgctaattataa

SEQ ID NO: 380083 - DNA, 25 bp, Mus musculus
ctgaatacttttacttctgtacaag

SEQ ID NO: 380084 - DNA, 25 bp, Mus musculus
ctgaatactttttcttctgtacaag

SEQ ID NO: 380085 - DNA, 25 bp, Mus musculus
ctgaatagcttcaggtacgtggtag

SEQ ID NO: 380086 - DNA, 25 bp, Mus musculus
ctgaatagcttctggtacgtggtag

SEQ ID NO: 380087 - DNA, 25 bp, Mus musculus
ctgaataggcgaacacaacgtgcat

SEQ ID NO: 380088 - DNA, 25 bp, Mus musculus
ctgaataggcgatcacaacgtgcat

SEQ ID NO: 380089 - DNA, 25 bp, Mus musculus
ctgaatatatgaccacgctcacccg

SEQ ID NO: 380090 - DNA, 25 bp, Mus musculus
ctgaatatatgagcacgctcacccg

SEQ ID NO: 380091 - DNA, 25 bp, Mus musculus
ctgaatcaactacgaaggccattat

SEQ ID NO: 380092 - DNA, 25 bp, Mus musculus
ctgaatcaactaggaaggccattat

SEQ ID NO: 380093 - DNA, 25 bp, Mus musculus
ctgaatcagagcaagcatgccattt

SEQ ID NO: 380094 - DNA, 25 bp, Mus musculus
ctgaatcagagctagcatgccattt

SEQ ID NO: 380095 - DNA, 25 bp, Mus musculus
ctgaatccatggagctgtggagccc

SEQ ID NO: 380096 - DNA, 25 bp, Mus musculus
ctgaatccatggtgctgtggagccc

SEQ ID NO: 380097 - DNA, 25 bp, Mus musculus
ctgaatccccataggagtttccatg

SEQ ID NO: 380098 - DNA, 25 bp, Mus musculus
ctgaatccccattggagtttccatg

SEQ ID NO: 380099 - DNA, 25 bp, Mus musculus
ctgaatcctaacactggactccatt

SEQ ID NO: 380100 - DNA, 25 bp, Mus musculus
ctgaatcctaactctggactccatt

SEQ ID NO: 380101 - DNA, 25 bp, Mus musculus
ctgaatccttagaatcctttggttt

SEQ ID NO: 380102 - DNA, 25 bp, Mus musculus
ctgaatccttagtatcctttggttt

SEQ ID NO: 380103 - DNA, 25 bp, Mus musculus
ctgaatcgcacgaaggtggtaccta

SEQ ID NO: 380104 - DNA, 25 bp, Mus musculus
ctgaatcgcacgtaggtggtaccta

SEQ ID NO: 380105 - DNA, 25 bp, Mus musculus
ctgaatctcatcacactagagatgt

SEQ ID NO: 380106 - DNA, 25 bp, Mus musculus
ctgaatctcatctcactagagatgt

SEQ ID NO: 380107 - DNA, 25 bp, Mus musculus
ctgaatctgaacaggcttcacaaaa

SEQ ID NO: 380108 - DNA, 25 bp, Mus musculus
ctgaatctgaactggcttcacaaaa

SEQ ID NO: 380109 - DNA, 25 bp, Mus musculus
ctgaatctgcctcctgaattctgga

SEQ ID NO: 380110 - DNA, 25 bp, Mus musculus
ctgaatctgcctgctgaattctgga

SEQ ID NO: 380111 - DNA, 25 bp, Mus musculus
ctgaatctggatatcgggcaaggac

SEQ ID NO: 380112 - DNA, 25 bp, Mus musculus
ctgaatctggatttcgggcaaggac

SEQ ID NO: 380113 - DNA, 25 bp, Mus musculus
ctgaatctgttcatgccggtaatat

SEQ ID NO: 380114 - DNA, 25 bp, Mus musculus
ctgaatctgttcttgccggtaatat

SEQ ID NO: 380115 - DNA, 25 bp, Mus musculus
ctgaatgaaactacactttggtggt

SEQ ID NO: 380116 - DNA, 25 bp, Mus musculus
ctgaatgaaacttcactttggtggt

SEQ ID NO: 380117 - DNA, 25 bp, Mus musculus
ctgaatgaacctaagtgagacgtgt

SEQ ID NO: 380118 - DNA, 25 bp, Mus musculus
ctgaatgaaccttagtgagacgtgt

SEQ ID NO: 380119 - DNA, 25 bp, Mus musculus
ctgaatgaaggtattgccagctcag

SEQ ID NO: 380120 - DNA, 25 bp, Mus musculus
ctgaatgaaggttttgccagctcag

SEQ ID NO: 380121 - DNA, 25 bp, Mus musculus
ctgaatgaccacctcccaattctag

SEQ ID NO: 380122 - DNA, 25 bp, Mus musculus
ctgaatgaccacgtcccaattctag

SEQ ID NO: 380123 - DNA, 25 bp, Mus musculus
ctgaatgcattgaagctctgagcca

SEQ ID NO: 380124 - DNA, 25 bp, Mus musculus
ctgaatgcattgtagctctgagcca

SEQ ID NO: 380125 - DNA, 25 bp, Mus musculus
ctgaatgcctgtcatactatggtct

SEQ ID NO: 380126 - DNA, 25 bp, Mus musculus
ctgaatgcctgtgatactatggtct

SEQ ID NO: 380127 - DNA, 25 bp, Mus musculus
ctgaatgctactcccttccaagtgc

SEQ ID NO: 380128 - DNA, 25 bp, Mus musculus
ctgaatgctactgccttccaagtgc

SEQ ID NO: 380129 - DNA, 25 bp, Mus musculus
ctgaatgctggcacccagggtaata

SEQ ID NO: 380130 - DNA, 25 bp, Mus musculus
ctgaatgctggctcccagggtaata

SEQ ID NO: 380131 - DNA, 25 bp, Mus musculus
ctgaatggctgtaatctctcagccc

SEQ ID NO: 380132 - DNA, 25 bp, Mus musculus
ctgaatggctgttatctctcagccc

SEQ ID NO: 380133 - DNA, 25 bp, Mus musculus
ctgaatgggatgactggcatgagtc

SEQ ID NO: 380134 - DNA, 25 bp, Mus musculus
ctgaatgggatgtctggcatgagtc

SEQ ID NO: 380135 - DNA, 25 bp, Mus musculus
ctgaatggtttacggcacgtgctgt

SEQ ID NO: 380136 - DNA, 25 bp, Mus musculus
ctgaatggtttagggcacgtgctgt

SEQ ID NO: 380137 - DNA, 25 bp, Mus musculus
ctgaatgtaattagagccctttgtg

SEQ ID NO: 380138 - DNA, 25 bp, Mus musculus
ctgaatgtaatttgagccctttgtg

SEQ ID NO: 380139 - DNA, 25 bp, Mus musculus
ctgaatgtatgtcccttcttttaag

SEQ ID NO: 380140 - DNA, 25 bp, Mus musculus
ctgaatgtatgtgccttcttttaag

SEQ ID NO: 380141 - DNA, 25 bp, Mus musculus
ctgaatgtccctatgctaagctttg

SEQ ID NO: 380142 - DNA, 25 bp, Mus musculus
ctgaatgtccctttgctaagctttg

SEQ ID NO: 380143 - DNA, 25 bp, Mus musculus
ctgaatgtgaacatgattgctcaaa

SEQ ID NO: 380144 - DNA, 25 bp, Mus musculus
ctgaatgtgaacttgattgctcaaa

SEQ ID NO: 380145 - DNA, 25 bp, Mus musculus
ctgaatgtgactctttagaggtggt

SEQ ID NO: 380146 - DNA, 25 bp, Mus musculus
ctgaatgtgactgtttagaggtggt

SEQ ID NO: 380147 - DNA, 25 bp, Mus musculus
ctgaatgttcatccgtttgggcgtt

SEQ ID NO: 380148 - DNA, 25 bp, Mus musculus
ctgaatgttcatgcgtttgggcgtt

SEQ ID NO: 380149 - DNA, 25 bp, Mus musculus
ctgaattacaggaccgtttccagcc

SEQ ID NO: 380150 - DNA, 25 bp, Mus musculus
ctgaattacaggtccgtttccagcc

SEQ ID NO: 380151 - DNA, 25 bp, Mus musculus
ctgaattatgccagtcttgctcaca

SEQ ID NO: 380152 - DNA, 25 bp, Mus musculus
ctgaattatgcctgtcttgctcaca

SEQ ID NO: 380153 - DNA, 25 bp, Mus musculus
ctgaattccagactatcattttaca

SEQ ID NO: 380154 - DNA, 25 bp, Mus musculus
ctgaattccagagtatcattttaca

SEQ ID NO: 380155 - DNA, 25 bp, Mus musculus
ctgaattccatgagagatcatctcc

SEQ ID NO: 380156 - DNA, 25 bp, Mus musculus
ctgaattccatgtgagatcatctcc

SEQ ID NO: 380157 - DNA, 25 bp, Mus musculus
ctgaattcctccagggctcctgaac

SEQ ID NO: 380158 - DNA, 25 bp, Mus musculus
ctgaattcctcctgggctcctgaac

SEQ ID NO: 380159 - DNA, 25 bp, Mus musculus
ctgaattccttgcagatggtagcat

SEQ ID NO: 380160 - DNA, 25 bp, Mus musculus
ctgaattccttggagatggtagcat

SEQ ID NO: 380161 - DNA, 25 bp, Mus musculus
ctgaattcgaagatactgctccagc

SEQ ID NO: 380162 - DNA, 25 bp, Mus musculus
ctgaattcgaagttactgctccagc

SEQ ID NO: 380163 - DNA, 25 bp, Mus musculus
ctgaattcgttcctcctggcctctc

SEQ ID NO: 380164 - DNA, 25 bp, Mus musculus
ctgaattcgttcgtcctggcctctc

SEQ ID NO: 380165 - DNA, 25 bp, Mus musculus
ctgaattcttttccaccattaaaga

SEQ ID NO: 380166 - DNA, 25 bp, Mus musculus
ctgaattcttttgcaccattaaaga

SEQ ID NO: 380167 - DNA, 25 bp, Mus musculus
ctgaattgagagaaaggtgtgctaa

SEQ ID NO: 380168 - DNA, 25 bp, Mus musculus
ctgaattgagagtaaggtgtgctaa

SEQ ID NO: 380169 - DNA, 25 bp, Mus musculus
ctgaattgcagtcgcttgacctttt

SEQ ID NO: 380170 - DNA, 25 bp, Mus musculus
ctgaattgcagtggcttgacctttt

SEQ ID NO: 380171 - DNA, 25 bp, Mus musculus
ctgaattggtcaaggcacagagccc

SEQ ID NO: 380172 - DNA, 25 bp, Mus musculus
ctgaattggtcatggcacagagccc

SEQ ID NO: 380173 - DNA, 25 bp, Mus musculus
ctgaattgtcatacacaggtggcaa

SEQ ID NO: 380174 - DNA, 25 bp, Mus musculus
ctgaattgtcattcacaggtggcaa

SEQ ID NO: 380175 - DNA, 25 bp, Mus musculus
ctgaatttaatcatcttcgccttca

SEQ ID NO: 380176 - DNA, 25 bp, Mus musculus
ctgaatttaatcttcttcgccttca

SEQ ID NO: 380177 - DNA, 25 bp, Mus musculus
ctgaatttacctcgcgtctacactt

SEQ ID NO: 380178 - DNA, 25 bp, Mus musculus
ctgaatttacctggcgtctacactt

SEQ ID NO: 380179 - DNA, 25 bp, Mus musculus
ctgaatttataaaactccccttaat

SEQ ID NO: 380180 - DNA, 25 bp, Mus musculus
ctgaatttataatactccccttaat

SEQ ID NO: 380181 - DNA, 25 bp, Mus musculus
ctgaatttcaagctgttaggaccac

SEQ ID NO: 380182 - DNA, 25 bp, Mus musculus
ctgaatttcaaggtgttaggaccac

SEQ ID NO: 380183 - DNA, 25 bp, Mus musculus
ctgaatttccccaggcagagtaatt

SEQ ID NO: 380184 - DNA, 25 bp, Mus musculus
ctgaatttcccctggcagagtaatt

SEQ ID NO: 380185 - DNA, 25 bp, Mus musculus
ctgaatttctcaacttctcacagta

SEQ ID NO: 380186 - DNA, 25 bp, Mus musculus
ctgaatttctcatcttctcacagta

SEQ ID NO: 380187 - DNA, 25 bp, Mus musculus
ctgaatttctttctggttcactttt

SEQ ID NO: 380188 - DNA, 25 bp, Mus musculus
ctgaatttctttgtggttcactttt

SEQ ID NO: 380189 - DNA, 25 bp, Mus musculus
ctgaatttgtgtactagaatagact

SEQ ID NO: 380190 - DNA, 25 bp, Mus musculus
ctgaatttgtgttctagaatagact

SEQ ID NO: 380191 - DNA, 25 bp, Mus musculus
ctgaattttcgtatattttaactga

SEQ ID NO: 380192 - DNA, 25 bp, Mus musculus
ctgaattttcgtttattttaactga

SEQ ID NO: 380193 - DNA, 25 bp, Mus musculus
ctgaattttctgacacttaaccaaa

SEQ ID NO: 380194 - DNA, 25 bp, Mus musculus
ctgaattttctgtcacttaaccaaa

SEQ ID NO: 380195 - DNA, 25 bp, Mus musculus
ctgacaaagaccataaaccaccctg

SEQ ID NO: 380196 - DNA, 25 bp, Mus musculus
ctgacaaagaccttaaaccaccctg

SEQ ID NO: 380197 - DNA, 25 bp, Mus musculus
ctgacaaatgagatgcatagctaca

SEQ ID NO: 380198 - DNA, 25 bp, Mus musculus
ctgacaaatgagttgcatagctaca

SEQ ID NO: 380199 - DNA, 25 bp, Mus musculus
ctgacaacacagcaatgatcccaca

SEQ ID NO: 380200 - DNA, 25 bp, Mus musculus
ctgacaacacaggaatgatcccaca

SEQ ID NO: 380201 - DNA, 25 bp, Mus musculus
ctgacaacccctaggactttgagaa

SEQ ID NO: 380202 - DNA, 25 bp, Mus musculus
ctgacaaccccttggactttgagaa

SEQ ID NO: 380203 - DNA, 25 bp, Mus musculus
ctgacaactgccatatcccagtagt

SEQ ID NO: 380204 - DNA, 25 bp, Mus musculus
ctgacaactgccttatcccagtagt

SEQ ID NO: 380205 - DNA, 25 bp, Mus musculus
ctgacaacttggctggtggcactct

SEQ ID NO: 380206 - DNA, 25 bp, Mus musculus
ctgacaacttgggtggtggcactct

SEQ ID NO: 380207 - DNA, 25 bp, Mus musculus
ctgacaagaactcgaagcaaattta

SEQ ID NO: 380208 - DNA, 25 bp, Mus musculus
ctgacaagaactggaagcaaattta

SEQ ID NO: 380209 - DNA, 25 bp, Mus musculus
ctgacaagatgaagtgcagccccat

SEQ ID NO: 380210 - DNA, 25 bp, Mus musculus
ctgacaagatgatgtgcagccccat

SEQ ID NO: 380211 - DNA, 25 bp, Mus musculus
ctgacaaggccgacagtgtgactcg

SEQ ID NO: 380212 - DNA, 25 bp, Mus musculus
ctgacaaggccgtcagtgtgactcg

SEQ ID NO: 380213 - DNA, 25 bp, Mus musculus
ctgacaatgccaactcctcacagaa

SEQ ID NO: 380214 - DNA, 25 bp, Mus musculus
ctgacaatgccatctcctcacagaa

SEQ ID NO: 380215 - DNA, 25 bp, Mus musculus
ctgacaattcttccccaagctaaag

SEQ ID NO: 380216 - DNA, 25 bp, Mus musculus
ctgacaattcttgcccaagctaaag

SEQ ID NO: 380217 - DNA, 25 bp, Mus musculus
ctgacaatttctcatccctttggga

SEQ ID NO: 380218 - DNA, 25 bp, Mus musculus
ctgacaatttctgatccctttggga

SEQ ID NO: 380219 - DNA, 25 bp, Mus musculus
ctgacaattttcagatagcagcccc

SEQ ID NO: 380220 - DNA, 25 bp, Mus musculus
ctgacaattttctgatagcagcccc

SEQ ID NO: 380221 - DNA, 25 bp, Mus musculus
ctgacacaactaattgagaatgaga

SEQ ID NO: 380222 - DNA, 25 bp, Mus musculus
ctgacacaactatttgagaatgaga

SEQ ID NO: 380223 - DNA, 25 bp, Mus musculus
ctgacacaccatccaccatatatat

SEQ ID NO: 380224 - DNA, 25 bp, Mus musculus
ctgacacaccatgcaccatatatat

SEQ ID NO: 380225 - DNA, 25 bp, Mus musculus
ctgacacacctaaagtccaagtata

SEQ ID NO: 380226 - DNA, 25 bp, Mus musculus
ctgacacacctatagtccaagtata

SEQ ID NO: 380227 - DNA, 25 bp, Mus musculus
ctgacacagagcatatgaaatggac

SEQ ID NO: 380228 - DNA, 25 bp, Mus musculus
ctgacacagagcttatgaaatggac

SEQ ID NO: 380229 - DNA, 25 bp, Mus musculus
ctgacacatagcacgtaccacatat

SEQ ID NO: 380230 - DNA, 25 bp, Mus musculus
ctgacacatagctcgtaccacatat

SEQ ID NO: 380231 - DNA, 25 bp, Mus musculus
ctgacacatctgaccttcgggaagg

SEQ ID NO: 380232 - DNA, 25 bp, Mus musculus
ctgacacatctgtccttcgggaagg

SEQ ID NO: 380233 - DNA, 25 bp, Mus musculus
ctgacacatcttagagcttttccca

SEQ ID NO: 380234 - DNA, 25 bp, Mus musculus
ctgacacatctttgagcttttccca

SEQ ID NO: 380235 - DNA, 25 bp, Mus musculus
ctgacaccagaccctgagccctcag

SEQ ID NO: 380236 - DNA, 25 bp, Mus musculus
ctgacaccagacgctgagccctcag

SEQ ID NO: 380237 - DNA, 25 bp, Mus musculus
ctgacaccctctagtggtcttcaag

SEQ ID NO: 380238 - DNA, 25 bp, Mus musculus
ctgacaccctcttgtggtcttcaag

SEQ ID NO: 380239 - DNA, 25 bp, Mus musculus
ctgacacctgttctattggatacat

SEQ ID NO: 380240 - DNA, 25 bp, Mus musculus
ctgacacctgttgtattggatacat

SEQ ID NO: 380241 - DNA, 25 bp, Mus musculus
ctgacacgggacaaggaataaagtt

SEQ ID NO: 380242 - DNA, 25 bp, Mus musculus
ctgacacgggactaggaataaagtt

SEQ ID NO: 380243 - DNA, 25 bp, Mus musculus
ctgacacgtttgacagtgaagacaa

SEQ ID NO: 380244 - DNA, 25 bp, Mus musculus
ctgacacgtttgtcagtgaagacaa

SEQ ID NO: 380245 - DNA, 25 bp, Mus musculus
ctgacactctcaccacagttgggaa

SEQ ID NO: 380246 - DNA, 25 bp, Mus musculus
ctgacactctcagcacagttgggaa

SEQ ID NO: 380247 - DNA, 25 bp, Mus musculus
ctgacactcttcaactttagctatg

SEQ ID NO: 380248 - DNA, 25 bp, Mus musculus
ctgacactcttctactttagctatg

SEQ ID NO: 380249 - DNA, 25 bp, Mus musculus
ctgacactgatcagatccggtggtt

SEQ ID NO: 380250 - DNA, 25 bp, Mus musculus
ctgacactgatctgatccggtggtt

SEQ ID NO: 380251 - DNA, 25 bp, Mus musculus
ctgacactggcaagatcctgtgtgc

SEQ ID NO: 380252 - DNA, 25 bp, Mus musculus
ctgacactggcatgatcctgtgtgc

SEQ ID NO: 380253 - DNA, 25 bp, Mus musculus
ctgacactgtggcatggtttagaat

SEQ ID NO: 380254 - DNA, 25 bp, Mus musculus
ctgacactgtgggatggtttagaat

SEQ ID NO: 380255 - DNA, 25 bp, Mus musculus
ctgacactgttgagaccatggcttt

SEQ ID NO: 380256 - DNA, 25 bp, Mus musculus
ctgacactgttgtgaccatggcttt

SEQ ID NO: 380257 - DNA, 25 bp, Mus musculus
ctgacagaatggcccagagggcaaa

SEQ ID NO: 380258 - DNA, 25 bp, Mus musculus
ctgacagaatggctcgtcaccgaga

SEQ ID NO: 380259 - DNA, 25 bp, Mus musculus
ctgacagaatgggccagagggcaaa

SEQ ID NO: 380260 - DNA, 25 bp, Mus musculus
ctgacagaatgggtcgtcaccgaga

SEQ ID NO: 380261 - DNA, 25 bp, Mus musculus
ctgacagacaacaagctttcccaag

SEQ ID NO: 380262 - DNA, 25 bp, Mus musculus
ctgacagacaactagctttcccaag

SEQ ID NO: 380263 - DNA, 25 bp, Mus musculus
ctgacagaccgaacctgccgggtaa

SEQ ID NO: 380264 - DNA, 25 bp, Mus musculus
ctgacagaccgatcctgccgggtaa

SEQ ID NO: 380265 - DNA, 25 bp, Mus musculus
ctgacagaccttacattgctcatgg

SEQ ID NO: 380266 - DNA, 25 bp, Mus musculus
ctgacagacctttcattgctcatgg

SEQ ID NO: 380267 - DNA, 25 bp, Mus musculus
ctgacagactctcgaacatttgtgt

SEQ ID NO: 380268 - DNA, 25 bp, Mus musculus
ctgacagactctggaacatttgtgt

SEQ ID NO: 380269 - DNA, 25 bp, Mus musculus
ctgacagagagtcaacctaagtaaa

SEQ ID NO: 380270 - DNA, 25 bp, Mus musculus
ctgacagagagtgaacctaagtaaa

SEQ ID NO: 380271 - DNA, 25 bp, Mus musculus
ctgacagagctaagtgaagaacaac

SEQ ID NO: 380272 - DNA, 25 bp, Mus musculus
ctgacagagctatgtgaagaacaac

SEQ ID NO: 380273 - DNA, 25 bp, Mus musculus
ctgacagcagaaccagttcacatat

SEQ ID NO: 380274 - DNA, 25 bp, Mus musculus
ctgacagcagaagcagttcacatat

SEQ ID NO: 380275 - DNA, 25 bp, Mus musculus
ctgacagccctgctttgacaaagag

SEQ ID NO: 380276 - DNA, 25 bp, Mus musculus
ctgacagccctggtttgacaaagag

SEQ ID NO: 380277 - DNA, 25 bp, Mus musculus
ctgacagccttgctccagtctagga

SEQ ID NO: 380278 - DNA, 25 bp, Mus musculus
ctgacagccttggtccagtctagga

SEQ ID NO: 380279 - DNA, 25 bp, Mus musculus
ctgacagcggctatgttcaacttgt

SEQ ID NO: 380280 - DNA, 25 bp, Mus musculus
ctgacagcggctttgttcaacttgt

SEQ ID NO: 380281 - DNA, 25 bp, Mus musculus
ctgacagctgtccttttaagtagtt

SEQ ID NO: 380282 - DNA, 25 bp, Mus musculus
ctgacagctgtcgttttaagtagtt

SEQ ID NO: 380283 - DNA, 25 bp, Mus musculus
ctgacaggaaataaaagccacattt

SEQ ID NO: 380284 - DNA, 25 bp, Mus musculus
ctgacaggaaattaaagccacattt

SEQ ID NO: 380285 - DNA, 25 bp, Mus musculus
ctgacaggaggcatacatgaaacct

SEQ ID NO: 380286 - DNA, 25 bp, Mus musculus
ctgacaggaggcttacatgaaacct

SEQ ID NO: 380287 - DNA, 25 bp, Mus musculus
ctgacaggtgtgagcgccttcattg

SEQ ID NO: 380288 - DNA, 25 bp, Mus musculus
ctgacaggtgtgtgcgccttcattg

SEQ ID NO: 380289 - DNA, 25 bp, Mus musculus
ctgacagtccatagcatcgtcccaa

SEQ ID NO: 380290 - DNA, 25 bp, Mus musculus
ctgacagtccattgcatcgtcccaa

SEQ ID NO: 380291 - DNA, 25 bp, Mus musculus
ctgacagtgatgctgaccattcaga

SEQ ID NO: 380292 - DNA, 25 bp, Mus musculus
ctgacagtgatggtgaccattcaga

SEQ ID NO: 380293 - DNA, 25 bp, Mus musculus
ctgacagtttctaatttggcatatt

SEQ ID NO: 380294 - DNA, 25 bp, Mus musculus
ctgacagtttcttatttggcatatt

SEQ ID NO: 380295 - DNA, 25 bp, Mus musculus
ctgacagttttgagcggcagcaaga

SEQ ID NO: 380296 - DNA, 25 bp, Mus musculus
ctgacagttttgtgcggcagcaaga

SEQ ID NO: 380297 - DNA, 25 bp, Mus musculus
ctgacataccagagttttaaatggg

SEQ ID NO: 380298 - DNA, 25 bp, Mus musculus
ctgacataccagtgttttaaatggg

SEQ ID NO: 380299 - DNA, 25 bp, Mus musculus
ctgacatagactaggcaggttcttg

SEQ ID NO: 380300 - DNA, 25 bp, Mus musculus
ctgacatagacttggcaggttcttg

SEQ ID NO: 380301 - DNA, 25 bp, Mus musculus
ctgacatccattcctcgtagtaaat

SEQ ID NO: 380302 - DNA, 25 bp, Mus musculus
ctgacatccattgctcgtagtaaat

SEQ ID NO: 380303 - DNA, 25 bp, Mus musculus
ctgacatcctgtagtgtgagctcag

SEQ ID NO: 380304 - DNA, 25 bp, Mus musculus
ctgacatcctgttgtgtgagctcag

SEQ ID NO: 380305 - DNA, 25 bp, Mus musculus
ctgacatcctttcctcatagtaaaa

SEQ ID NO: 380306 - DNA, 25 bp, Mus musculus
ctgacatcctttgctcatagtaaaa

SEQ ID NO: 380307 - DNA, 25 bp, Mus musculus
ctgacatgaatgatatttgcaaata

SEQ ID NO: 380308 - DNA, 25 bp, Mus musculus
ctgacatgaatgctactaagagtaa

SEQ ID NO: 380309 - DNA, 25 bp, Mus musculus
ctgacatgaatggtactaagagtaa

SEQ ID NO: 380310 - DNA, 25 bp, Mus musculus
ctgacatgaatgttatttgcaaata

SEQ ID NO: 380311 - DNA, 25 bp, Mus musculus
ctgacatgagcgcaggtcttctgaa

SEQ ID NO: 380312 - DNA, 25 bp, Mus musculus
ctgacatgagcggaggtcttctgaa

SEQ ID NO: 380313 - DNA, 25 bp, Mus musculus
ctgacatgaggcaactggacggaga

SEQ ID NO: 380314 - DNA, 25 bp, Mus musculus
ctgacatgaggctactggacggaga

SEQ ID NO: 380315 - DNA, 25 bp, Mus musculus
ctgacatgccatacattctgataga

SEQ ID NO: 380316 - DNA, 25 bp, Mus musculus
ctgacatgccattcattctgataga

SEQ ID NO: 380317 - DNA, 25 bp, Mus musculus
ctgacatgcccacatatttctctag

SEQ ID NO: 380318 - DNA, 25 bp, Mus musculus
ctgacatgcccagatatttctctag

SEQ ID NO: 380319 - DNA, 25 bp, Mus musculus
ctgacatgcctacactcctaataaa

SEQ ID NO: 380320 - DNA, 25 bp, Mus musculus
ctgacatgcctagactcctaataaa

SEQ ID NO: 380321 - DNA, 25 bp, Mus musculus
ctgacatgcctgctgcgagctttca

SEQ ID NO: 380322 - DNA, 25 bp, Mus musculus
ctgacatgcctggtgcgagctttca

SEQ ID NO: 380323 - DNA, 25 bp, Mus musculus
ctgacatgcttgctccagaggctat

SEQ ID NO: 380324 - DNA, 25 bp, Mus musculus
ctgacatgcttggtccagaggctat

SEQ ID NO: 380325 - DNA, 25 bp, Mus musculus
ctgacatgggtcatgcggattgcaa

SEQ ID NO: 380326 - DNA, 25 bp, Mus musculus
ctgacatgggtcttgcggattgcaa

SEQ ID NO: 380327 - DNA, 25 bp, Mus musculus
ctgacatgtagtactgttataaact

SEQ ID NO: 380328 - DNA, 25 bp, Mus musculus
ctgacatgtagttctgttataaact

SEQ ID NO: 380329 - DNA, 25 bp, Mus musculus
ctgacatgtcatccacaatagtttt

SEQ ID NO: 380330 - DNA, 25 bp, Mus musculus
ctgacatgtcatgcacaatagtttt

SEQ ID NO: 380331 - DNA, 25 bp, Mus musculus
ctgacattcagaatgggagacacat

SEQ ID NO: 380332 - DNA, 25 bp, Mus musculus
ctgacattcagattgggagacacat

SEQ ID NO: 380333 - DNA, 25 bp, Mus musculus
ctgacattcatgagatttgcctaca

SEQ ID NO: 380334 - DNA, 25 bp, Mus musculus
ctgacattcatgtgatttgcctaca

SEQ ID NO: 380335 - DNA, 25 bp, Mus musculus
ctgacattccacactaacataacac

SEQ ID NO: 380336 - DNA, 25 bp, Mus musculus
ctgacattccactctaacataacac

SEQ ID NO: 380337 - DNA, 25 bp, Mus musculus
ctgacattccagctggtggctagaa

SEQ ID NO: 380338 - DNA, 25 bp, Mus musculus
ctgacattccaggtggtggctagaa

SEQ ID NO: 380339 - DNA, 25 bp, Mus musculus
ctgacattcctgagtgtgcgggtga

SEQ ID NO: 380340 - DNA, 25 bp, Mus musculus
ctgacattcctgtgtgtgcgggtga

SEQ ID NO: 380341 - DNA, 25 bp, Mus musculus
ctgacattctgtatgcctgcttgag

SEQ ID NO: 380342 - DNA, 25 bp, Mus musculus
ctgacattctgtttgcctgcttgag

SEQ ID NO: 380343 - DNA, 25 bp, Mus musculus
ctgacattgggacatcacctggaat

SEQ ID NO: 380344 - DNA, 25 bp, Mus musculus
ctgacattgggagatcacctggaat

SEQ ID NO: 380345 - DNA, 25 bp, Mus musculus
ctgacatttaccaaatacttctatt

SEQ ID NO: 380346 - DNA, 25 bp, Mus musculus
ctgacatttacctaatacttctatt

SEQ ID NO: 380347 - DNA, 25 bp, Mus musculus
ctgacatttcctatgcttctatttg

SEQ ID NO: 380348 - DNA, 25 bp, Mus musculus
ctgacatttcctttgcttctatttg

SEQ ID NO: 380349 - DNA, 25 bp, Mus musculus
ctgacatttgatagaatcaccctat

SEQ ID NO: 380350 - DNA, 25 bp, Mus musculus
ctgacatttgattgaatcaccctat

SEQ ID NO: 380351 - DNA, 25 bp, Mus musculus
ctgacattttctagttcagagacag

SEQ ID NO: 380352 - DNA, 25 bp, Mus musculus
ctgacattttcttgttcagagacag

SEQ ID NO: 380353 - DNA, 25 bp, Mus musculus
ctgaccaagcttactcttgaggaag

SEQ ID NO: 380354 - DNA, 25 bp, Mus musculus
ctgaccaagctttctcttgaggaag

SEQ ID NO: 380355 - DNA, 25 bp, Mus musculus
ctgaccaagtgtcgctcatggcact

SEQ ID NO: 380356 - DNA, 25 bp, Mus musculus
ctgaccaagtgtggctcatggcact

SEQ ID NO: 380357 - DNA, 25 bp, Mus musculus
ctgaccaatcagattctccaagtgt

SEQ ID NO: 380358 - DNA, 25 bp, Mus musculus
ctgaccaatcagtttctccaagtgt

SEQ ID NO: 380359 - DNA, 25 bp, Mus musculus
ctgaccaatggacgcagcgtgtaca

SEQ ID NO: 380360 - DNA, 25 bp, Mus musculus
ctgaccaatggaggcagcgtgtaca

SEQ ID NO: 380361 - DNA, 25 bp, Mus musculus
ctgaccaccataccctgagaaagat

SEQ ID NO: 380362 - DNA, 25 bp, Mus musculus
ctgaccaccatagcctgagaaagat

SEQ ID NO: 380363 - DNA, 25 bp, Mus musculus
ctgaccactactctactggaggagg

SEQ ID NO: 380364 - DNA, 25 bp, Mus musculus
ctgaccactactctgataaaatgtt

SEQ ID NO: 380365 - DNA, 25 bp, Mus musculus
ctgaccactactgtactggaggagg

SEQ ID NO: 380366 - DNA, 25 bp, Mus musculus
ctgaccactactgtgataaaatgtt

SEQ ID NO: 380367 - DNA, 25 bp, Mus musculus
ctgaccacttggctgcgctgaagag

SEQ ID NO: 380368 - DNA, 25 bp, Mus musculus
ctgaccacttgggtgcgctgaagag

SEQ ID NO: 380369 - DNA, 25 bp, Mus musculus
ctgaccagagtcctggagggaaata

SEQ ID NO: 380370 - DNA, 25 bp, Mus musculus
ctgaccagagtcgtggagggaaata

SEQ ID NO: 380371 - DNA, 25 bp, Mus musculus
ctgaccagctagaatcacatattta

SEQ ID NO: 380372 - DNA, 25 bp, Mus musculus
ctgaccagctagtatcacatattta

SEQ ID NO: 380373 - DNA, 25 bp, Mus musculus
ctgaccaggtggatataattctaat

SEQ ID NO: 380374 - DNA, 25 bp, Mus musculus
ctgaccaggtggttataattctaat

SEQ ID NO: 380375 - DNA, 25 bp, Mus musculus
ctgaccagtgctctcaatgggcact

SEQ ID NO: 380376 - DNA, 25 bp, Mus musculus
ctgaccagtgctgtcaatgggcact

SEQ ID NO: 380377 - DNA, 25 bp, Mus musculus
ctgaccagtgttagttaggatatac

SEQ ID NO: 380378 - DNA, 25 bp, Mus musculus
ctgaccagtgttcgcacccagacag

SEQ ID NO: 380379 - DNA, 25 bp, Mus musculus
ctgaccagtgttggcacccagacag

SEQ ID NO: 380380 - DNA, 25 bp, Mus musculus
ctgaccagtgtttgttaggatatac

SEQ ID NO: 380381 - DNA, 25 bp, Mus musculus
ctgaccagttatccaatagtaaatg

SEQ ID NO: 380382 - DNA, 25 bp, Mus musculus
ctgaccagttatgcaatagtaaatg

SEQ ID NO: 380383 - DNA, 25 bp, Mus musculus
ctgaccataagactaaaacccacca

SEQ ID NO: 380384 - DNA, 25 bp, Mus musculus
ctgaccataagagtaaaacccacca

SEQ ID NO: 380385 - DNA, 25 bp, Mus musculus
ctgaccataagcacattcaccatta

SEQ ID NO: 380386 - DNA, 25 bp, Mus musculus
ctgaccataagctcattcaccatta

SEQ ID NO: 380387 - DNA, 25 bp, Mus musculus
ctgaccatagtcactgctgaccact

SEQ ID NO: 380388 - DNA, 25 bp, Mus musculus
ctgaccatagtctctgctgaccact

SEQ ID NO: 380389 - DNA, 25 bp, Mus musculus
ctgaccatctgcctcttgagagaaa

SEQ ID NO: 380390 - DNA, 25 bp, Mus musculus
ctgaccatctgcgtcttgagagaaa

SEQ ID NO: 380391 - DNA, 25 bp, Mus musculus
ctgaccatctgtcccaagagcctgg

SEQ ID NO: 380392 - DNA, 25 bp, Mus musculus
ctgaccatctgtgccaagagcctgg

SEQ ID NO: 380393 - DNA, 25 bp, Mus musculus
ctgaccatgaagactgacctgcctg

SEQ ID NO: 380394 - DNA, 25 bp, Mus musculus
ctgaccatgaagtctgacctgcctg

SEQ ID NO: 380395 - DNA, 25 bp, Mus musculus
ctgaccatggcactggatgttcctg

SEQ ID NO: 380396 - DNA, 25 bp, Mus musculus
ctgaccatggcagtggatgttcctg

SEQ ID NO: 380397 - DNA, 25 bp, Mus musculus
ctgaccatggtcaccgagatgcggt

SEQ ID NO: 380398 - DNA, 25 bp, Mus musculus
ctgaccatggtctccgagatgcggt

SEQ ID NO: 380399 - DNA, 25 bp, Mus musculus
ctgaccatgtatccacttgttgatt

SEQ ID NO: 380400 - DNA, 25 bp, Mus musculus
ctgaccatgtatgcacttgttgatt

SEQ ID NO: 380401 - DNA, 25 bp, Mus musculus
ctgaccattctactgtactgccatt

SEQ ID NO: 380402 - DNA, 25 bp, Mus musculus
ctgaccattctagtgtactgccatt

SEQ ID NO: 380403 - DNA, 25 bp, Mus musculus
ctgaccattgctacttggcctggta

SEQ ID NO: 380404 - DNA, 25 bp, Mus musculus
ctgaccattgcttcttggcctggta

SEQ ID NO: 380405 - DNA, 25 bp, Mus musculus
ctgaccatttgtatattagccattg

SEQ ID NO: 380406 - DNA, 25 bp, Mus musculus
ctgaccatttgtttattagccattg

SEQ ID NO: 380407 - DNA, 25 bp, Mus musculus
ctgaccattttgacccatgaataaa

SEQ ID NO: 380408 - DNA, 25 bp, Mus musculus
ctgaccattttgtcccatgaataaa

SEQ ID NO: 380409 - DNA, 25 bp, Mus musculus
ctgacccacactctctgtaaggtgt

SEQ ID NO: 380410 - DNA, 25 bp, Mus musculus
ctgacccacactgtctgtaaggtgt

SEQ ID NO: 380411 - DNA, 25 bp, Mus musculus
ctgacccacagactcatgttgcttg

SEQ ID NO: 380412 - DNA, 25 bp, Mus musculus
ctgacccacagagtcatgttgcttg

SEQ ID NO: 380413 - DNA, 25 bp, Mus musculus
ctgacccacattcggaatccagata

SEQ ID NO: 380414 - DNA, 25 bp, Mus musculus
ctgacccacattgggaatccagata

SEQ ID NO: 380415 - DNA, 25 bp, Mus musculus
ctgacccaccacacattttgatgaa

SEQ ID NO: 380416 - DNA, 25 bp, Mus musculus
ctgacccaccactcattttgatgaa

SEQ ID NO: 380417 - DNA, 25 bp, Mus musculus
ctgacccactgcatttcaacagttt

SEQ ID NO: 380418 - DNA, 25 bp, Mus musculus
ctgacccactgcttttcaacagttt

SEQ ID NO: 380419 - DNA, 25 bp, Mus musculus
ctgacccaggatactactgcagaga

SEQ ID NO: 380420 - DNA, 25 bp, Mus musculus
ctgacccaggattctactgcagaga

SEQ ID NO: 380421 - DNA, 25 bp, Mus musculus
ctgacccaggtgactccttcttaag

SEQ ID NO: 380422 - DNA, 25 bp, Mus musculus
ctgacccaggtgtctccttcttaag

SEQ ID NO: 380423 - DNA, 25 bp, Mus musculus
ctgacccagtgacattaataagtgt

SEQ ID NO: 380424 - DNA, 25 bp, Mus musculus
ctgacccagtgagattaataagtgt

SEQ ID NO: 380425 - DNA, 25 bp, Mus musculus
ctgacccattggaactgctgtaaaa

SEQ ID NO: 380426 - DNA, 25 bp, Mus musculus
ctgacccattggtactgctgtaaaa

SEQ ID NO: 380427 - DNA, 25 bp, Mus musculus
ctgaccccaagaagatggccgcata

SEQ ID NO: 380428 - DNA, 25 bp, Mus musculus
ctgaccccaagatgatggccgcata

SEQ ID NO: 380429 - DNA, 25 bp, Mus musculus
ctgaccccacaacacattctatttg

SEQ ID NO: 380430 - DNA, 25 bp, Mus musculus
ctgaccccacaagacattctatttg

SEQ ID NO: 380431 - DNA, 25 bp, Mus musculus
ctgaccccactcctgactacttcag

SEQ ID NO: 380432 - DNA, 25 bp, Mus musculus
ctgaccccactcgtgactacttcag

SEQ ID NO: 380433 - DNA, 25 bp, Mus musculus
ctgaccccactgcagcctttgggaa

SEQ ID NO: 380434 - DNA, 25 bp, Mus musculus
ctgaccccactggagcctttgggaa

SEQ ID NO: 380435 - DNA, 25 bp, Mus musculus
ctgaccccatttctacagtttcttt

SEQ ID NO: 380436 - DNA, 25 bp, Mus musculus
ctgaccccatttgtacagtttcttt

SEQ ID NO: 380437 - DNA, 25 bp, Mus musculus
ctgaccccgagaagatacccagctt

SEQ ID NO: 380438 - DNA, 25 bp, Mus musculus
ctgaccccgagatgatacccagctt

SEQ ID NO: 380439 - DNA, 25 bp, Mus musculus
ctgaccccgtgtctagactaagcta

SEQ ID NO: 380440 - DNA, 25 bp, Mus musculus
ctgaccccgtgtgtagactaagcta

SEQ ID NO: 380441 - DNA, 25 bp, Mus musculus
ctgacccctgccatttgtgctgaga

SEQ ID NO: 380442 - DNA, 25 bp, Mus musculus
ctgacccctgccttttgtgctgaga

SEQ ID NO: 380443 - DNA, 25 bp, Mus musculus
ctgacccctgctaatgccaagaaag

SEQ ID NO: 380444 - DNA, 25 bp, Mus musculus
ctgacccctgcttatgccaagaaag

SEQ ID NO: 380445 - DNA, 25 bp, Mus musculus
ctgaccccttggatcaacaatggat

SEQ ID NO: 380446 - DNA, 25 bp, Mus musculus
ctgaccccttggttcaacaatggat

SEQ ID NO: 380447 - DNA, 25 bp, Mus musculus
ctgacccgagagctacatttgtttt

SEQ ID NO: 380448 - DNA, 25 bp, Mus musculus
ctgacccgagaggtacatttgtttt

SEQ ID NO: 380449 - DNA, 25 bp, Mus musculus
ctgacccggaaaccacaggaggtga

SEQ ID NO: 380450 - DNA, 25 bp, Mus musculus
ctgacccggaaagcacaggaggtga

SEQ ID NO: 380451 - DNA, 25 bp, Mus musculus
ctgacccggaggccgggcctgatcg

SEQ ID NO: 380452 - DNA, 25 bp, Mus musculus
ctgacccggagggcgggcctgatcg

SEQ ID NO: 380453 - DNA, 25 bp, Mus musculus
ctgacccgggaacaagctgactatt

SEQ ID NO: 380454 - DNA, 25 bp, Mus musculus
ctgacccgggaagaagctgactatt

SEQ ID NO: 380455 - DNA, 25 bp, Mus musculus
ctgacccgggtcatcagtgtgtgtg

SEQ ID NO: 380456 - DNA, 25 bp, Mus musculus
ctgacccgggtcttcagtgtgtgtg

SEQ ID NO: 380457 - DNA, 25 bp, Mus musculus
ctgacccgtgtgagagtggcaactt

SEQ ID NO: 380458 - DNA, 25 bp, Mus musculus
ctgacccgtgtgtgagtggcaactt

SEQ ID NO: 380459 - DNA, 25 bp, Mus musculus
ctgaccctatcaccagagttctggg

SEQ ID NO: 380460 - DNA, 25 bp, Mus musculus
ctgaccctatcagcagagttctggg

SEQ ID NO: 380461 - DNA, 25 bp, Mus musculus
ctgaccctctggctggaccgtgaag

SEQ ID NO: 380462 - DNA, 25 bp, Mus musculus
ctgaccctctgggtggaccgtgaag

SEQ ID NO: 380463 - DNA, 25 bp, Mus musculus
ctgaccctgaccctttgctatattc

SEQ ID NO: 380464 - DNA, 25 bp, Mus musculus
ctgaccctgaccgtttgctatattc

SEQ ID NO: 380465 - DNA, 25 bp, Mus musculus
ctgaccctgaggctattatgtaacc

SEQ ID NO: 380466 - DNA, 25 bp, Mus musculus
ctgaccctgagggtattatgtaacc

SEQ ID NO: 380467 - DNA, 25 bp, Mus musculus
ctgaccctggctacagattgacttg

SEQ ID NO: 380468 - DNA, 25 bp, Mus musculus
ctgaccctggcttcagattgacttg

SEQ ID NO: 380469 - DNA, 25 bp, Mus musculus
ctgaccctggggatcagcactctca

SEQ ID NO: 380470 - DNA, 25 bp, Mus musculus
ctgaccctggggttcagcactctca

SEQ ID NO: 380471 - DNA, 25 bp, Mus musculus
ctgaccctgtgcatggagagaggct

SEQ ID NO: 380472 - DNA, 25 bp, Mus musculus
ctgaccctgtgcttggagagaggct

SEQ ID NO: 380473 - DNA, 25 bp, Mus musculus
ctgacccttctgagttcttgccctg

SEQ ID NO: 380474 - DNA, 25 bp, Mus musculus
ctgacccttctgtgttcttgccctg

SEQ ID NO: 380475 - DNA, 25 bp, Mus musculus
ctgacccttgtgacaccactagtga

SEQ ID NO: 380476 - DNA, 25 bp, Mus musculus
ctgacccttgtgtcaccactagtga

SEQ ID NO: 380477 - DNA, 25 bp, Mus musculus
ctgacccttgttactgccaaagctg

SEQ ID NO: 380478 - DNA, 25 bp, Mus musculus
ctgacccttgttcttcaggtgggta

SEQ ID NO: 380479 - DNA, 25 bp, Mus musculus
ctgacccttgttgttcaggtgggta

SEQ ID NO: 380480 - DNA, 25 bp, Mus musculus
ctgacccttgtttctgccaaagctg

SEQ ID NO: 380481 - DNA, 25 bp, Mus musculus
ctgacccttttaccaatgttgcaca

SEQ ID NO: 380482 - DNA, 25 bp, Mus musculus
ctgacccttttagcaatgttgcaca

SEQ ID NO: 380483 - DNA, 25 bp, Mus musculus
ctgaccgagagaaacttggcctggc

SEQ ID NO: 380484 - DNA, 25 bp, Mus musculus
ctgaccgagagatacttggcctggc

SEQ ID NO: 380485 - DNA, 25 bp, Mus musculus
ctgaccgagcgtcgctacagcttca

SEQ ID NO: 380486 - DNA, 25 bp, Mus musculus
ctgaccgagcgtggctacagcttca

SEQ ID NO: 380487 - DNA, 25 bp, Mus musculus
ctgaccgagctgagggaagaacttt

SEQ ID NO: 380488 - DNA, 25 bp, Mus musculus
ctgaccgagctgtgggaagaacttt

SEQ ID NO: 380489 - DNA, 25 bp, Mus musculus
ctgaccgaggaaaaggagaccgctt

SEQ ID NO: 380490 - DNA, 25 bp, Mus musculus
ctgaccgaggaataggagaccgctt

SEQ ID NO: 380491 - DNA, 25 bp, Mus musculus
ctgaccgcacttcttgagatgctga

SEQ ID NO: 380492 - DNA, 25 bp, Mus musculus
ctgaccgcacttgttgagatgctga

SEQ ID NO: 380493 - DNA, 25 bp, Mus musculus
ctgaccgcatgaagtggatcgcctg

SEQ ID NO: 380494 - DNA, 25 bp, Mus musculus
ctgaccgcatgatgtggatcgcctg

SEQ ID NO: 380495 - DNA, 25 bp, Mus musculus
ctgaccgctccgcaaaagttgcgtg

SEQ ID NO: 380496 - DNA, 25 bp, Mus musculus
ctgaccgctccggaaaagttgcgtg

SEQ ID NO: 380497 - DNA, 25 bp, Mus musculus
ctgaccggccttcttgcaagtgaag

SEQ ID NO: 380498 - DNA, 25 bp, Mus musculus
ctgaccggccttgttgcaagtgaag

SEQ ID NO: 380499 - DNA, 25 bp, Mus musculus
ctgaccgtacagaagcctcaatggg

SEQ ID NO: 380500 - DNA, 25 bp, Mus musculus
ctgaccgtacagtagcctcaatggg

SEQ ID NO: 380501 - DNA, 25 bp, Mus musculus
ctgaccgtggcacgatgcatctata

SEQ ID NO: 380502 - DNA, 25 bp, Mus musculus
ctgaccgtggcaggatgcatctata

SEQ ID NO: 380503 - DNA, 25 bp, Mus musculus
ctgacctaatgacgctctccgttaa

SEQ ID NO: 380504 - DNA, 25 bp, Mus musculus
ctgacctaatgaggctctccgttaa

SEQ ID NO: 380505 - DNA, 25 bp, Mus musculus
ctgacctacaacagctgcctgacat

SEQ ID NO: 380506 - DNA, 25 bp, Mus musculus
ctgacctacaactgctgcctgacat

SEQ ID NO: 380507 - DNA, 25 bp, Mus musculus
ctgacctaggttctatagatgagga

SEQ ID NO: 380508 - DNA, 25 bp, Mus musculus
ctgacctaggttgtatagatgagga

SEQ ID NO: 380509 - DNA, 25 bp, Mus musculus
ctgacctagtgtctgcttttcggct

SEQ ID NO: 380510 - DNA, 25 bp, Mus musculus
ctgacctagtgtgtgcttttcggct

SEQ ID NO: 380511 - DNA, 25 bp, Mus musculus
ctgacctatactagccagctccagg

SEQ ID NO: 380512 - DNA, 25 bp, Mus musculus
ctgacctatacttgccagctccagg

SEQ ID NO: 380513 - DNA, 25 bp, Mus musculus
ctgacctcaagtccatatatggtga

SEQ ID NO: 380514 - DNA, 25 bp, Mus musculus
ctgacctcaagtgcatatatggtga

SEQ ID NO: 380515 - DNA, 25 bp, Mus musculus
ctgacctcacacacatggcaatcct

SEQ ID NO: 380516 - DNA, 25 bp, Mus musculus
ctgacctcacactcatggcaatcct

SEQ ID NO: 380517 - DNA, 25 bp, Mus musculus
ctgacctcacctccctgtagcgagt

SEQ ID NO: 380518 - DNA, 25 bp, Mus musculus
ctgacctcacctgcctgtagcgagt

SEQ ID NO: 380519 - DNA, 25 bp, Mus musculus
ctgacctcagtccaatttacatgat

SEQ ID NO: 380520 - DNA, 25 bp, Mus musculus
ctgacctcagtcgaatttacatgat

SEQ ID NO: 380521 - DNA, 25 bp, Mus musculus
ctgacctccagaccaaagactgcag

SEQ ID NO: 380522 - DNA, 25 bp, Mus musculus
ctgacctccagagcaaagactgcag

SEQ ID NO: 380523 - DNA, 25 bp, Mus musculus
ctgacctccgacatacatagtttgt

SEQ ID NO: 380524 - DNA, 25 bp, Mus musculus
ctgacctccgacttacatagtttgt

SEQ ID NO: 380525 - DNA, 25 bp, Mus musculus
ctgacctctaccagcagatggatat

SEQ ID NO: 380526 - DNA, 25 bp, Mus musculus
ctgacctctacctgcagatggatat

SEQ ID NO: 380527 - DNA, 25 bp, Mus musculus
ctgacctctctcaaggatagactat

SEQ ID NO: 380528 - DNA, 25 bp, Mus musculus
ctgacctctctctaggatagactat

SEQ ID NO: 380529 - DNA, 25 bp, Mus musculus
ctgacctctctgacaattgcatttt

SEQ ID NO: 380530 - DNA, 25 bp, Mus musculus
ctgacctctctgtcaattgcatttt

SEQ ID NO: 380531 - DNA, 25 bp, Mus musculus
ctgacctctgagacgggtgtcttga

SEQ ID NO: 380532 - DNA, 25 bp, Mus musculus
ctgacctctgagtcgggtgtcttga

SEQ ID NO: 380533 - DNA, 25 bp, Mus musculus
ctgacctcttgcatggacttcaaag

SEQ ID NO: 380534 - DNA, 25 bp, Mus musculus
ctgacctcttgcttggacttcaaag

SEQ ID NO: 380535 - DNA, 25 bp, Mus musculus
ctgacctgactacggcgatgtgcgt

SEQ ID NO: 380536 - DNA, 25 bp, Mus musculus
ctgacctgactagggcgatgtgcgt

SEQ ID NO: 380537 - DNA, 25 bp, Mus musculus
ctgacctgcaatcgagtgctccgct

SEQ ID NO: 380538 - DNA, 25 bp, Mus musculus
ctgacctgcaatggagtgctccgct

SEQ ID NO: 380539 - DNA, 25 bp, Mus musculus
ctgacctgccagaaatttatttgta

SEQ ID NO: 380540 - DNA, 25 bp, Mus musculus
ctgacctgccagtaatttatttgta

SEQ ID NO: 380541 - DNA, 25 bp, Mus musculus
ctgacctgctacatataacctacta

SEQ ID NO: 380542 - DNA, 25 bp, Mus musculus
ctgacctgctacttataacctacta

SEQ ID NO: 380543 - DNA, 25 bp, Mus musculus
ctgacctggctacgctttatcttct

SEQ ID NO: 380544 - DNA, 25 bp, Mus musculus
ctgacctggctaggctttatcttct

SEQ ID NO: 380545 - DNA, 25 bp, Mus musculus
ctgacctgggaaaggctagaacgga

SEQ ID NO: 380546 - DNA, 25 bp, Mus musculus
ctgacctgggaatggctagaacgga

SEQ ID NO: 380547 - DNA, 25 bp, Mus musculus
ctgacctgggacatggcctgtcgag

SEQ ID NO: 380548 - DNA, 25 bp, Mus musculus
ctgacctgggacttggcctgtcgag

SEQ ID NO: 380549 - DNA, 25 bp, Mus musculus
ctgacctgtgccaccaagtgatgtt

SEQ ID NO: 380550 - DNA, 25 bp, Mus musculus
ctgacctgtgcctccaagtgatgtt

SEQ ID NO: 380551 - DNA, 25 bp, Mus musculus
ctgacctgtgtgctttgaccttata

SEQ ID NO: 380552 - DNA, 25 bp, Mus musculus
ctgacctgtgtggtttgaccttata

SEQ ID NO: 380553 - DNA, 25 bp, Mus musculus
ctgaccttaatcatgagctccggac

SEQ ID NO: 380554 - DNA, 25 bp, Mus musculus
ctgaccttaatcttgagctccggac

SEQ ID NO: 380555 - DNA, 25 bp, Mus musculus
ctgaccttcagcatttctctacaac

SEQ ID NO: 380556 - DNA, 25 bp, Mus musculus
ctgaccttcagcttttctctacaac

SEQ ID NO: 380557 - DNA, 25 bp, Mus musculus
ctgaccttgcagagtcttgacattc

SEQ ID NO: 380558 - DNA, 25 bp, Mus musculus
ctgaccttgcagtgtcttgacattc

SEQ ID NO: 380559 - DNA, 25 bp, Mus musculus
ctgaccttggagcttgtaaacgaga

SEQ ID NO: 380560 - DNA, 25 bp, Mus musculus
ctgaccttggaggttgtaaacgaga

SEQ ID NO: 380561 - DNA, 25 bp, Mus musculus
ctgacctttgtgcagtcaaaattga

SEQ ID NO: 380562 - DNA, 25 bp, Mus musculus
ctgacctttgtggagtcaaaattga

SEQ ID NO: 380563 - DNA, 25 bp, Mus musculus
ctgaccttttttctctgagaccagg

SEQ ID NO: 380564 - DNA, 25 bp, Mus musculus
ctgaccttttttgtctgagaccagg

SEQ ID NO: 380565 - DNA, 25 bp, Mus musculus
ctgacgactctgaggtctattattg

SEQ ID NO: 380566 - DNA, 25 bp, Mus musculus
ctgacgactctgtggtctattattg

SEQ ID NO: 380567 - DNA, 25 bp, Mus musculus
ctgacgagtcgtcttcagggagtca

SEQ ID NO: 380568 - DNA, 25 bp, Mus musculus
ctgacgagtcgtgttcagggagtca

SEQ ID NO: 380569 - DNA, 25 bp, Mus musculus
ctgacgccgtcaagcattggtgctt

SEQ ID NO: 380570 - DNA, 25 bp, Mus musculus
ctgacgccgtcatgcattggtgctt

SEQ ID NO: 380571 - DNA, 25 bp, Mus musculus
ctgacgctcctgaggtggtgagcat

SEQ ID NO: 380572 - DNA, 25 bp, Mus musculus
ctgacgctcctgtggtggtgagcat

SEQ ID NO: 380573 - DNA, 25 bp, Mus musculus
ctgacgctgtggacagccgacagtg

SEQ ID NO: 380574 - DNA, 25 bp, Mus musculus
ctgacgctgtggaccctgagatgca

SEQ ID NO: 380575 - DNA, 25 bp, Mus musculus
ctgacgctgtggtcagccgacagtg

SEQ ID NO: 380576 - DNA, 25 bp, Mus musculus
ctgacgctgtggtccctgagatgca

SEQ ID NO: 380577 - DNA, 25 bp, Mus musculus
ctgacggactacctcatgaagatcc

SEQ ID NO: 380578 - DNA, 25 bp, Mus musculus
ctgacggactacgtcatgaagatcc

SEQ ID NO: 380579 - DNA, 25 bp, Mus musculus
ctgacggctctacggggcttatatt

SEQ ID NO: 380580 - DNA, 25 bp, Mus musculus
ctgacggctctagggggcttatatt

SEQ ID NO: 380581 - DNA, 25 bp, Mus musculus
ctgacggctctcctgaacattaaga

SEQ ID NO: 380582 - DNA, 25 bp, Mus musculus
ctgacggctctcgtgaacattaaga

SEQ ID NO: 380583 - DNA, 25 bp, Mus musculus
ctgacggtcgttcgtgtaactgcac

SEQ ID NO: 380584 - DNA, 25 bp, Mus musculus
ctgacggtcgttggtgtaactgcac

SEQ ID NO: 380585 - DNA, 25 bp, Mus musculus
ctgacgtactgcagatactcaagat

SEQ ID NO: 380586 - DNA, 25 bp, Mus musculus
ctgacgtactgctgatactcaagat

SEQ ID NO: 380587 - DNA, 25 bp, Mus musculus
ctgacgtcagatcctgtatgccgaa

SEQ ID NO: 380588 - DNA, 25 bp, Mus musculus
ctgacgtcagatgctgtatgccgaa

SEQ ID NO: 380589 - DNA, 25 bp, Mus musculus
ctgacgtcatgaccttgctgtcctt

SEQ ID NO: 380590 - DNA, 25 bp, Mus musculus
ctgacgtcatgagcttgctgtcctt

SEQ ID NO: 380591 - DNA, 25 bp, Mus musculus
ctgacgtccagtctacagtgaatct

SEQ ID NO: 380592 - DNA, 25 bp, Mus musculus
ctgacgtccagtgtacagtgaatct

SEQ ID NO: 380593 - DNA, 25 bp, Mus musculus
ctgacgtccgcactttgttctgaaa

SEQ ID NO: 380594 - DNA, 25 bp, Mus musculus
ctgacgtccgcagtttgttctgaaa

SEQ ID NO: 380595 - DNA, 25 bp, Mus musculus
ctgacgtctcggatgtgtgaatcta

SEQ ID NO: 380596 - DNA, 25 bp, Mus musculus
ctgacgtctcggttgtgtgaatcta

SEQ ID NO: 380597 - DNA, 25 bp, Mus musculus
ctgacgtctggtcctctcgaaaggt

SEQ ID NO: 380598 - DNA, 25 bp, Mus musculus
ctgacgtctggtgctctcgaaaggt

SEQ ID NO: 380599 - DNA, 25 bp, Mus musculus
ctgacgttcaagatcgcagggacgt

SEQ ID NO: 380600 - DNA, 25 bp, Mus musculus
ctgacgttcaagttcgcagggacgt

SEQ ID NO: 380601 - DNA, 25 bp, Mus musculus
ctgactaaaatcatccacccaaatg

SEQ ID NO: 380602 - DNA, 25 bp, Mus musculus
ctgactaaaatcttccacccaaatg

SEQ ID NO: 380603 - DNA, 25 bp, Mus musculus
ctgactaatgccatcctagtgcagc

SEQ ID NO: 380604 - DNA, 25 bp, Mus musculus
ctgactaatgccttcctagtgcagc

SEQ ID NO: 380605 - DNA, 25 bp, Mus musculus
ctgactacatcaatagtcttcccaa

SEQ ID NO: 380606 - DNA, 25 bp, Mus musculus
ctgactacatcaccgcagcatatgt

SEQ ID NO: 380607 - DNA, 25 bp, Mus musculus
ctgactacatcagcgcagcatatgt

SEQ ID NO: 380608 - DNA, 25 bp, Mus musculus
ctgactacatcattagtcttcccaa

SEQ ID NO: 380609 - DNA, 25 bp, Mus musculus
ctgactacctgtaccggtgaccaga

SEQ ID NO: 380610 - DNA, 25 bp, Mus musculus
ctgactacctgttccggtgaccaga

SEQ ID NO: 380611 - DNA, 25 bp, Mus musculus
ctgactactaccaagtggaaccgat

SEQ ID NO: 380612 - DNA, 25 bp, Mus musculus
ctgactactacctagtggaaccgat

SEQ ID NO: 380613 - DNA, 25 bp, Mus musculus
ctgactagcaatccctacagccttt

SEQ ID NO: 380614 - DNA, 25 bp, Mus musculus
ctgactagcaatgcctacagccttt

SEQ ID NO: 380615 - DNA, 25 bp, Mus musculus
ctgactaggcccagtctgatcacag

SEQ ID NO: 380616 - DNA, 25 bp, Mus musculus
ctgactaggccctgtctgatcacag

SEQ ID NO: 380617 - DNA, 25 bp, Mus musculus
ctgactagttgacggtttagctgca

SEQ ID NO: 380618 - DNA, 25 bp, Mus musculus
ctgactagttgagggtttagctgca

SEQ ID NO: 380619 - DNA, 25 bp, Mus musculus
ctgactatatccctattctgctgta

SEQ ID NO: 380620 - DNA, 25 bp, Mus musculus
ctgactatatccgtattctgctgta

SEQ ID NO: 380621 - DNA, 25 bp, Mus musculus
ctgactatcagacctttgccatcct

SEQ ID NO: 380622 - DNA, 25 bp, Mus musculus
ctgactatcagagctttgccatcct

SEQ ID NO: 380623 - DNA, 25 bp, Mus musculus
ctgactatcctcaaaggcagcagtt

SEQ ID NO: 380624 - DNA, 25 bp, Mus musculus
ctgactatcctctaaggcagcagtt

SEQ ID NO: 380625 - DNA, 25 bp, Mus musculus
ctgactatcttacctgggaggtttt

SEQ ID NO: 380626 - DNA, 25 bp, Mus musculus
ctgactatcttagctgggaggtttt

SEQ ID NO: 380627 - DNA, 25 bp, Mus musculus
ctgactatcttcacaatctctctct

SEQ ID NO: 380628 - DNA, 25 bp, Mus musculus
ctgactatcttctcaatctctctct

SEQ ID NO: 380629 - DNA, 25 bp, Mus musculus
ctgactatgagtcccttatgctctg

SEQ ID NO: 380630 - DNA, 25 bp, Mus musculus
ctgactatgagtgccttatgctctg

SEQ ID NO: 380631 - DNA, 25 bp, Mus musculus
ctgactatgtctataagcgcattaa

SEQ ID NO: 380632 - DNA, 25 bp, Mus musculus
ctgactatgtctttaagcgcattaa

SEQ ID NO: 380633 - DNA, 25 bp, Mus musculus
ctgactcaattcctctcatacaaag

SEQ ID NO: 380634 - DNA, 25 bp, Mus musculus
ctgactcaattcgtctcatacaaag

SEQ ID NO: 380635 - DNA, 25 bp, Mus musculus
ctgactcacggtaggcgcagcgcag

SEQ ID NO: 380636 - DNA, 25 bp, Mus musculus
ctgactcacggttggcgcagcgcag

SEQ ID NO: 380637 - DNA, 25 bp, Mus musculus
ctgactcatcctatgggtgttccaa

SEQ ID NO: 380638 - DNA, 25 bp, Mus musculus
ctgactcatcctttgggtgttccaa

SEQ ID NO: 380639 - DNA, 25 bp, Mus musculus
ctgactcattccatactggtaggat

SEQ ID NO: 380640 - DNA, 25 bp, Mus musculus
ctgactcattccttactggtaggat

SEQ ID NO: 380641 - DNA, 25 bp, Mus musculus
ctgactccaaaactgacgaaccaca

SEQ ID NO: 380642 - DNA, 25 bp, Mus musculus
ctgactccaaaactttatcaaacca

SEQ ID NO: 380643 - DNA, 25 bp, Mus musculus
ctgactccaaaagtgacgaaccaca

SEQ ID NO: 380644 - DNA, 25 bp, Mus musculus
ctgactccaaaagtttatcaaacca

SEQ ID NO: 380645 - DNA, 25 bp, Mus musculus
ctgactccagctagcgggcacagga

SEQ ID NO: 380646 - DNA, 25 bp, Mus musculus
ctgactccagcttgcgggcacagga

SEQ ID NO: 380647 - DNA, 25 bp, Mus musculus
ctgactcccaaacgttttcctctga

SEQ ID NO: 380648 - DNA, 25 bp, Mus musculus
ctgactcccaaaggttttcctctga

SEQ ID NO: 380649 - DNA, 25 bp, Mus musculus
ctgactccctaccttttaatcagta

SEQ ID NO: 380650 - DNA, 25 bp, Mus musculus
ctgactccctacgttttaatcagta

SEQ ID NO: 380651 - DNA, 25 bp, Mus musculus
ctgactccctccatgatggctgtgc

SEQ ID NO: 380652 - DNA, 25 bp, Mus musculus
ctgactccctccttgatggctgtgc

SEQ ID NO: 380653 - DNA, 25 bp, Mus musculus
ctgactccgctcacagaagatgcag

SEQ ID NO: 380654 - DNA, 25 bp, Mus musculus
ctgactccgctctcagaagatgcag

SEQ ID NO: 380655 - DNA, 25 bp, Mus musculus
ctgactcctataagactggcattgt

SEQ ID NO: 380656 - DNA, 25 bp, Mus musculus
ctgactcctatatgactggcattgt

SEQ ID NO: 380657 - DNA, 25 bp, Mus musculus
ctgactccttatattcgtaacttat

SEQ ID NO: 380658 - DNA, 25 bp, Mus musculus
ctgactccttatcggcatccattat

SEQ ID NO: 380659 - DNA, 25 bp, Mus musculus
ctgactccttatgggcatccattat

SEQ ID NO: 380660 - DNA, 25 bp, Mus musculus
ctgactccttattttcgtaacttat

SEQ ID NO: 380661 - DNA, 25 bp, Mus musculus
ctgactcgactgcaaggctaaaaac

SEQ ID NO: 380662 - DNA, 25 bp, Mus musculus
ctgactcgactggaaggctaaaaac

SEQ ID NO: 380663 - DNA, 25 bp, Mus musculus
ctgactcgcaggacgccaagtgtgg

SEQ ID NO: 380664 - DNA, 25 bp, Mus musculus
ctgactcgcaggtcgccaagtgtgg

SEQ ID NO: 380665 - DNA, 25 bp, Mus musculus
ctgactcggtgtatggatctgtggt

SEQ ID NO: 380666 - DNA, 25 bp, Mus musculus
ctgactcggtgtttggatctgtggt

SEQ ID NO: 380667 - DNA, 25 bp, Mus musculus
ctgactcgtcctcattaactgtcaa

SEQ ID NO: 380668 - DNA, 25 bp, Mus musculus
ctgactcgtcctgattaactgtcaa

SEQ ID NO: 380669 - DNA, 25 bp, Mus musculus
ctgactctacctatctctcataaat

SEQ ID NO: 380670 - DNA, 25 bp, Mus musculus
ctgactctacctttctctcataaat

SEQ ID NO: 380671 - DNA, 25 bp, Mus musculus
ctgactctcagtcaagttttattta

SEQ ID NO: 380672 - DNA, 25 bp, Mus musculus
ctgactctcagtgaagttttattta

SEQ ID NO: 380673 - DNA, 25 bp, Mus musculus
ctgactctccaaaaaccatcacaga

SEQ ID NO: 380674 - DNA, 25 bp, Mus musculus
ctgactctccaataaccatcacaga

SEQ ID NO: 380675 - DNA, 25 bp, Mus musculus
ctgactctctcgagtagccgaggat

SEQ ID NO: 380676 - DNA, 25 bp, Mus musculus
ctgactctctcgtgtagccgaggat

SEQ ID NO: 380677 - DNA, 25 bp, Mus musculus
ctgactctcttgagggtgctgtgga

SEQ ID NO: 380678 - DNA, 25 bp, Mus musculus
ctgactctcttgtgggtgctgtgga

SEQ ID NO: 380679 - DNA, 25 bp, Mus musculus
ctgactctgaccagtggatctgaac

SEQ ID NO: 380680 - DNA, 25 bp, Mus musculus
ctgactctgacctgtggatctgaac

SEQ ID NO: 380681 - DNA, 25 bp, Mus musculus
ctgactctgagtaaaaggccctttg

SEQ ID NO: 380682 - DNA, 25 bp, Mus musculus
ctgactctgagttaaaggccctttg

SEQ ID NO: 380683 - DNA, 25 bp, Mus musculus
ctgactctggagagctagggtgaca

SEQ ID NO: 380684 - DNA, 25 bp, Mus musculus
ctgactctggagtgctagggtgaca

SEQ ID NO: 380685 - DNA, 25 bp, Mus musculus
ctgactctggatccccgggcagctg

SEQ ID NO: 380686 - DNA, 25 bp, Mus musculus
ctgactctggatgcccgggcagctg

SEQ ID NO: 380687 - DNA, 25 bp, Mus musculus
ctgactcttcccctttgtttgtgaa

SEQ ID NO: 380688 - DNA, 25 bp, Mus musculus
ctgactcttcccgtttgtttgtgaa

SEQ ID NO: 380689 - DNA, 25 bp, Mus musculus
ctgactcttcctacgtcggagaaag

SEQ ID NO: 380690 - DNA, 25 bp, Mus musculus
ctgactcttccttcgtcggagaaag

SEQ ID NO: 380691 - DNA, 25 bp, Mus musculus
ctgactcttgaaaactgcttgctaa

SEQ ID NO: 380692 - DNA, 25 bp, Mus musculus
ctgactcttgaatactgcttgctaa

SEQ ID NO: 380693 - DNA, 25 bp, Mus musculus
ctgactcttttccttgatcagtggg

SEQ ID NO: 380694 - DNA, 25 bp, Mus musculus
ctgactcttttcgttgatcagtggg

SEQ ID NO: 380695 - DNA, 25 bp, Mus musculus
ctgactgaattacaatccacctctt

SEQ ID NO: 380696 - DNA, 25 bp, Mus musculus
ctgactgaattagaatccacctctt

SEQ ID NO: 380697 - DNA, 25 bp, Mus musculus
ctgactgacagtctcagcctgggaa

SEQ ID NO: 380698 - DNA, 25 bp, Mus musculus
ctgactgacagtgtcagcctgggaa

SEQ ID NO: 380699 - DNA, 25 bp, Mus musculus
ctgactgagagcaagcccactggct

SEQ ID NO: 380700 - DNA, 25 bp, Mus musculus
ctgactgagagctagcccactggct

SEQ ID NO: 380701 - DNA, 25 bp, Mus musculus
ctgactgatccacagcagttatgct

SEQ ID NO: 380702 - DNA, 25 bp, Mus musculus
ctgactgatccagagcagttatgct

SEQ ID NO: 380703 - DNA, 25 bp, Mus musculus
ctgactgcaccaccaagaacagggt

SEQ ID NO: 380704 - DNA, 25 bp, Mus musculus
ctgactgcaccagcaagaacagggt

SEQ ID NO: 380705 - DNA, 25 bp, Mus musculus
ctgactgcagataaacagacctcaa

SEQ ID NO: 380706 - DNA, 25 bp, Mus musculus
ctgactgcagattaacagacctcaa

SEQ ID NO: 380707 - DNA, 25 bp, Mus musculus
ctgactgcaggactgtattggcttt

SEQ ID NO: 380708 - DNA, 25 bp, Mus musculus
ctgactgcaggagtgtattggcttt

SEQ ID NO: 380709 - DNA, 25 bp, Mus musculus
ctgactgcagttagagagccttctt

SEQ ID NO: 380710 - DNA, 25 bp, Mus musculus
ctgactgcagtttgagagccttctt

SEQ ID NO: 380711 - DNA, 25 bp, Mus musculus
ctgactgcatggagaactttcatat

SEQ ID NO: 380712 - DNA, 25 bp, Mus musculus
ctgactgcatggtgaactttcatat

SEQ ID NO: 380713 - DNA, 25 bp, Mus musculus
ctgactgcattgcagattttcgttc

SEQ ID NO: 380714 - DNA, 25 bp, Mus musculus
ctgactgcattggagattttcgttc

SEQ ID NO: 380715 - DNA, 25 bp, Mus musculus
ctgactgcccatctagcaatgctga

SEQ ID NO: 380716 - DNA, 25 bp, Mus musculus
ctgactgcccatctgacattatgta

SEQ ID NO: 380717 - DNA, 25 bp, Mus musculus
ctgactgcccatgtagcaatgctga

SEQ ID NO: 380718 - DNA, 25 bp, Mus musculus
ctgactgcccatgtgacattatgta

SEQ ID NO: 380719 - DNA, 25 bp, Mus musculus
ctgactgctcacaagccctgaaatt

SEQ ID NO: 380720 - DNA, 25 bp, Mus musculus
ctgactgctcactagccctgaaatt

SEQ ID NO: 380721 - DNA, 25 bp, Mus musculus
ctgactgctcttctgaagggtgtga

SEQ ID NO: 380722 - DNA, 25 bp, Mus musculus
ctgactgctcttgtgaagggtgtga

SEQ ID NO: 380723 - DNA, 25 bp, Mus musculus
ctgactgctgtcatcatagcagcca

SEQ ID NO: 380724 - DNA, 25 bp, Mus musculus
ctgactgctgtcatgttgggaggca

SEQ ID NO: 380725 - DNA, 25 bp, Mus musculus
ctgactgctgtcttcatagcagcca

SEQ ID NO: 380726 - DNA, 25 bp, Mus musculus
ctgactgctgtcttgttgggaggca

SEQ ID NO: 380727 - DNA, 25 bp, Mus musculus
ctgactggaggaccccgaactgcaa

SEQ ID NO: 380728 - DNA, 25 bp, Mus musculus
ctgactggaggagcccgaactgcaa

SEQ ID NO: 380729 - DNA, 25 bp, Mus musculus
ctgactggccacaggcaactgagta

SEQ ID NO: 380730 - DNA, 25 bp, Mus musculus
ctgactggccactggcaactgagta

SEQ ID NO: 380731 - DNA, 25 bp, Mus musculus
ctgactggcttgagggccatggcat

SEQ ID NO: 380732 - DNA, 25 bp, Mus musculus
ctgactggcttgcttatattccttt

SEQ ID NO: 380733 - DNA, 25 bp, Mus musculus
ctgactggcttggttatattccttt

SEQ ID NO: 380734 - DNA, 25 bp, Mus musculus
ctgactggcttgtgggccatggcat

SEQ ID NO: 380735 - DNA, 25 bp, Mus musculus
ctgactggtgagatgaaagcctaca

SEQ ID NO: 380736 - DNA, 25 bp, Mus musculus
ctgactggtgagttgaaagcctaca

SEQ ID NO: 380737 - DNA, 25 bp, Mus musculus
ctgactggttgacctgcgaaaaggt

SEQ ID NO: 380738 - DNA, 25 bp, Mus musculus
ctgactggttgagctgcgaaaaggt

SEQ ID NO: 380739 - DNA, 25 bp, Mus musculus
ctgactgtacaaacatctctctcac

SEQ ID NO: 380740 - DNA, 25 bp, Mus musculus
ctgactgtacaacattgtcctctga

SEQ ID NO: 380741 - DNA, 25 bp, Mus musculus
ctgactgtacaagattgtcctctga

SEQ ID NO: 380742 - DNA, 25 bp, Mus musculus
ctgactgtacaatcatctctctcac

SEQ ID NO: 380743 - DNA, 25 bp, Mus musculus
ctgactgtacttaccctgagttgac

SEQ ID NO: 380744 - DNA, 25 bp, Mus musculus
ctgactgtactttccctgagttgac

SEQ ID NO: 380745 - DNA, 25 bp, Mus musculus
ctgactgtagctcattttggtagcc

SEQ ID NO: 380746 - DNA, 25 bp, Mus musculus
ctgactgtagctgattttggtagcc

SEQ ID NO: 380747 - DNA, 25 bp, Mus musculus
ctgactgtatgcatggtaaaccttg

SEQ ID NO: 380748 - DNA, 25 bp, Mus musculus
ctgactgtatgcttggtaaaccttg

SEQ ID NO: 380749 - DNA, 25 bp, Mus musculus
ctgactgtattcatcctgcctaata

SEQ ID NO: 380750 - DNA, 25 bp, Mus musculus
ctgactgtattcttcctgcctaata

SEQ ID NO: 380751 - DNA, 25 bp, Mus musculus
ctgactgtcaccagttgctactgaa

SEQ ID NO: 380752 - DNA, 25 bp, Mus musculus
ctgactgtcacctgttgctactgaa

SEQ ID NO: 380753 - DNA, 25 bp, Mus musculus
ctgactgtcccacaattcacaatgt

SEQ ID NO: 380754 - DNA, 25 bp, Mus musculus
ctgactgtcccagaattcacaatgt

SEQ ID NO: 380755 - DNA, 25 bp, Mus musculus
ctgactgtcctaaaacttaaactag

SEQ ID NO: 380756 - DNA, 25 bp, Mus musculus
ctgactgtcctataacttaaactag

SEQ ID NO: 380757 - DNA, 25 bp, Mus musculus
ctgactgtccttaatgaagaactca

SEQ ID NO: 380758 - DNA, 25 bp, Mus musculus
ctgactgtcctttatgaagaactca

SEQ ID NO: 380759 - DNA, 25 bp, Mus musculus
ctgactgtgactcaaatcaatgcaa

SEQ ID NO: 380760 - DNA, 25 bp, Mus musculus
ctgactgtgactgaaatcaatgcaa

SEQ ID NO: 380761 - DNA, 25 bp, Mus musculus
ctgactgtgattcccggtagccgtg

SEQ ID NO: 380762 - DNA, 25 bp, Mus musculus
ctgactgtgattgccggtagccgtg

SEQ ID NO: 380763 - DNA, 25 bp, Mus musculus
ctgactgtgctcaccatataagtaa

SEQ ID NO: 380764 - DNA, 25 bp, Mus musculus
ctgactgtgctctccatataagtaa

SEQ ID NO: 380765 - DNA, 25 bp, Mus musculus
ctgactgtgtccagccaaggcgggc

SEQ ID NO: 380766 - DNA, 25 bp, Mus musculus
ctgactgtgtcctgccaaggcgggc

SEQ ID NO: 380767 - DNA, 25 bp, Mus musculus
ctgactgtgtggctgcattgagaac

SEQ ID NO: 380768 - DNA, 25 bp, Mus musculus
ctgactgtgtgggtgcattgagaac

SEQ ID NO: 380769 - DNA, 25 bp, Mus musculus
ctgactgttagacagggacctggca

SEQ ID NO: 380770 - DNA, 25 bp, Mus musculus
ctgactgttagagagggacctggca

SEQ ID NO: 380771 - DNA, 25 bp, Mus musculus
ctgactgttctcaccatactttgta

SEQ ID NO: 380772 - DNA, 25 bp, Mus musculus
ctgactgttctctccatactttgta

SEQ ID NO: 380773 - DNA, 25 bp, Mus musculus
ctgactgttgccattggtcttacaa

SEQ ID NO: 380774 - DNA, 25 bp, Mus musculus
ctgactgttgccctttatttatgca

SEQ ID NO: 380775 - DNA, 25 bp, Mus musculus
ctgactgttgccgtttatttatgca

SEQ ID NO: 380776 - DNA, 25 bp, Mus musculus
ctgactgttgcctttggtcttacaa

SEQ ID NO: 380777 - DNA, 25 bp, Mus musculus
ctgactgttgctcccctttcatgac

SEQ ID NO: 380778 - DNA, 25 bp, Mus musculus
ctgactgttgctgccctttcatgac

SEQ ID NO: 380779 - DNA, 25 bp, Mus musculus
ctgactgttggcaggtctgtgatcc

SEQ ID NO: 380780 - DNA, 25 bp, Mus musculus
ctgactgttggctggtctgtgatcc

SEQ ID NO: 380781 - DNA, 25 bp, Mus musculus
ctgacttaatctccatgtgactacc

SEQ ID NO: 380782 - DNA, 25 bp, Mus musculus
ctgacttaatctgcatgtgactacc

SEQ ID NO: 380783 - DNA, 25 bp, Mus musculus
ctgacttacgtcaccattacaaaca

SEQ ID NO: 380784 - DNA, 25 bp, Mus musculus
ctgacttacgtctccattacaaaca

SEQ ID NO: 380785 - DNA, 25 bp, Mus musculus
ctgacttagtttcccctgtgataga

SEQ ID NO: 380786 - DNA, 25 bp, Mus musculus
ctgacttagtttgccctgtgataga

SEQ ID NO: 380787 - DNA, 25 bp, Mus musculus
ctgacttattccagaatttctgtta

SEQ ID NO: 380788 - DNA, 25 bp, Mus musculus
ctgacttattcctgaatttctgtta

SEQ ID NO: 380789 - DNA, 25 bp, Mus musculus
ctgacttcacagaggcttctttcca

SEQ ID NO: 380790 - DNA, 25 bp, Mus musculus
ctgacttcacagtggcttctttcca

SEQ ID NO: 380791 - DNA, 25 bp, Mus musculus
ctgacttcagagagtcctacatgaa

SEQ ID NO: 380792 - DNA, 25 bp, Mus musculus
ctgacttcagagtgtcctacatgaa

SEQ ID NO: 380793 - DNA, 25 bp, Mus musculus
ctgacttccatacgcgctgtagcct

SEQ ID NO: 380794 - DNA, 25 bp, Mus musculus
ctgacttccataggcgctgtagcct

SEQ ID NO: 380795 - DNA, 25 bp, Mus musculus
ctgacttccatgaggttccttcgat

SEQ ID NO: 380796 - DNA, 25 bp, Mus musculus
ctgacttccatgtggttccttcgat

SEQ ID NO: 380797 - DNA, 25 bp, Mus musculus
ctgacttcccctccaggtctaattc

SEQ ID NO: 380798 - DNA, 25 bp, Mus musculus
ctgacttcccctgcaggtctaattc

SEQ ID NO: 380799 - DNA, 25 bp, Mus musculus
ctgacttccgacctcaaatttaaga

SEQ ID NO: 380800 - DNA, 25 bp, Mus musculus
ctgacttccgacgtcaaatttaaga

SEQ ID NO: 380801 - DNA, 25 bp, Mus musculus
ctgacttcctatcccttagtgtgga

SEQ ID NO: 380802 - DNA, 25 bp, Mus musculus
ctgacttcctatctattccattgtg

SEQ ID NO: 380803 - DNA, 25 bp, Mus musculus
ctgacttcctatgccttagtgtgga

SEQ ID NO: 380804 - DNA, 25 bp, Mus musculus
ctgacttcctatgtattccattgtg

SEQ ID NO: 380805 - DNA, 25 bp, Mus musculus
ctgacttcctgcatgacagaggtta

SEQ ID NO: 380806 - DNA, 25 bp, Mus musculus
ctgacttcctgcttgacagaggtta

SEQ ID NO: 380807 - DNA, 25 bp, Mus musculus
ctgacttcctttcgcactaggcatg

SEQ ID NO: 380808 - DNA, 25 bp, Mus musculus
ctgacttcctttggcactaggcatg

SEQ ID NO: 380809 - DNA, 25 bp, Mus musculus
ctgacttctaaaacagtaggtgctg

SEQ ID NO: 380810 - DNA, 25 bp, Mus musculus
ctgacttctaaatcagtaggtgctg

SEQ ID NO: 380811 - DNA, 25 bp, Mus musculus
ctgacttctaagagctggacctaaa

SEQ ID NO: 380812 - DNA, 25 bp, Mus musculus
ctgacttctaagtgctggacctaaa

SEQ ID NO: 380813 - DNA, 25 bp, Mus musculus
ctgacttctgagaaggaccctgggt

SEQ ID NO: 380814 - DNA, 25 bp, Mus musculus
ctgacttctgagtaggaccctgggt

SEQ ID NO: 380815 - DNA, 25 bp, Mus musculus
ctgacttctgggacaattgccattt

SEQ ID NO: 380816 - DNA, 25 bp, Mus musculus
ctgacttctgggtcaattgccattt

SEQ ID NO: 380817 - DNA, 25 bp, Mus musculus
ctgacttctgttattaatgcccatt

SEQ ID NO: 380818 - DNA, 25 bp, Mus musculus
ctgacttctgtttttaatgcccatt

SEQ ID NO: 380819 - DNA, 25 bp, Mus musculus
ctgacttcttacagaggctttccag

SEQ ID NO: 380820 - DNA, 25 bp, Mus musculus
ctgacttcttactgaggctttccag

SEQ ID NO: 380821 - DNA, 25 bp, Mus musculus
ctgacttgaattaccataaaccttg

SEQ ID NO: 380822 - DNA, 25 bp, Mus musculus
ctgacttgaatttccataaaccttg

SEQ ID NO: 380823 - DNA, 25 bp, Mus musculus
ctgacttgacagaatgaccacggct

SEQ ID NO: 380824 - DNA, 25 bp, Mus musculus
ctgacttgacagtatgaccacggct

SEQ ID NO: 380825 - DNA, 25 bp, Mus musculus
ctgacttgaggtattgttctctttc

SEQ ID NO: 380826 - DNA, 25 bp, Mus musculus
ctgacttgaggttttgttctctttc

SEQ ID NO: 380827 - DNA, 25 bp, Mus musculus
ctgacttgcccaaaactgtgtatat

SEQ ID NO: 380828 - DNA, 25 bp, Mus musculus
ctgacttgcccataactgtgtatat

SEQ ID NO: 380829 - DNA, 25 bp, Mus musculus
ctgacttggcctcacatgaaccaaa

SEQ ID NO: 380830 - DNA, 25 bp, Mus musculus
ctgacttggcctgacatgaaccaaa

SEQ ID NO: 380831 - DNA, 25 bp, Mus musculus
ctgacttggtgtagtgtcctgtaaa

SEQ ID NO: 380832 - DNA, 25 bp, Mus musculus
ctgacttggtgttgtgtcctgtaaa

SEQ ID NO: 380833 - DNA, 25 bp, Mus musculus
ctgacttgtatacctctggagctga

SEQ ID NO: 380834 - DNA, 25 bp, Mus musculus
ctgacttgtatagctctggagctga

SEQ ID NO: 380835 - DNA, 25 bp, Mus musculus
ctgacttgtattctggcagtcggaa

SEQ ID NO: 380836 - DNA, 25 bp, Mus musculus
ctgacttgtattgtggcagtcggaa

SEQ ID NO: 380837 - DNA, 25 bp, Mus musculus
ctgacttgtgtcacttaatttctgt

SEQ ID NO: 380838 - DNA, 25 bp, Mus musculus
ctgacttgtgtctcttaatttctgt

SEQ ID NO: 380839 - DNA, 25 bp, Mus musculus
ctgactttatcacagaagggcggca

SEQ ID NO: 380840 - DNA, 25 bp, Mus musculus
ctgactttatcagagaagggcggca

SEQ ID NO: 380841 - DNA, 25 bp, Mus musculus
ctgactttcactatattggtaagac

SEQ ID NO: 380842 - DNA, 25 bp, Mus musculus
ctgactttcactttattggtaagac

SEQ ID NO: 380843 - DNA, 25 bp, Mus musculus
ctgactttccagctgttgatataat

SEQ ID NO: 380844 - DNA, 25 bp, Mus musculus
ctgactttccaggtgttgatataat

SEQ ID NO: 380845 - DNA, 25 bp, Mus musculus
ctgactttcccgaggttcaaggaca

SEQ ID NO: 380846 - DNA, 25 bp, Mus musculus
ctgactttcccgtggttcaaggaca

SEQ ID NO: 380847 - DNA, 25 bp, Mus musculus
ctgactttgaccactatcgatgagt

SEQ ID NO: 380848 - DNA, 25 bp, Mus musculus
ctgactttgacctctatcgatgagt

SEQ ID NO: 380849 - DNA, 25 bp, Mus musculus
ctgactttgacgatcaggcaaacag

SEQ ID NO: 380850 - DNA, 25 bp, Mus musculus
ctgactttgacgttcaggcaaacag

SEQ ID NO: 380851 - DNA, 25 bp, Mus musculus
ctgactttgatacacatcttagaaa

SEQ ID NO: 380852 - DNA, 25 bp, Mus musculus
ctgactttgatagacatcttagaaa

SEQ ID NO: 380853 - DNA, 25 bp, Mus musculus
ctgactttggatactgtgcacagat

SEQ ID NO: 380854 - DNA, 25 bp, Mus musculus
ctgactttggatccctcagtggtcc

SEQ ID NO: 380855 - DNA, 25 bp, Mus musculus
ctgactttggatgcctcagtggtcc

SEQ ID NO: 380856 - DNA, 25 bp, Mus musculus
ctgactttggattctgtgcacagat

SEQ ID NO: 380857 - DNA, 25 bp, Mus musculus
ctgactttgtagctacactgttctt

SEQ ID NO: 380858 - DNA, 25 bp, Mus musculus
ctgactttgtaggtacactgttctt

SEQ ID NO: 380859 - DNA, 25 bp, Mus musculus
ctgacttttaccagacaggtctcca

SEQ ID NO: 380860 - DNA, 25 bp, Mus musculus
ctgacttttacctgacaggtctcca

SEQ ID NO: 380861 - DNA, 25 bp, Mus musculus
ctgacttttatccagttcttttgcc

SEQ ID NO: 380862 - DNA, 25 bp, Mus musculus
ctgacttttatcgagttcttttgcc

SEQ ID NO: 380863 - DNA, 25 bp, Mus musculus
ctgacttttcatccacagctatgat

SEQ ID NO: 380864 - DNA, 25 bp, Mus musculus
ctgacttttcatgcacagctatgat

SEQ ID NO: 380865 - DNA, 25 bp, Mus musculus
ctgagaaacattcagggtgacccca

SEQ ID NO: 380866 - DNA, 25 bp, Mus musculus
ctgagaaacattgagggtgacccca

SEQ ID NO: 380867 - DNA, 25 bp, Mus musculus
ctgagaaattcccagtggtcacata

SEQ ID NO: 380868 - DNA, 25 bp, Mus musculus
ctgagaaattccgagtggtcacata

SEQ ID NO: 380869 - DNA, 25 bp, Mus musculus
ctgagaacaaagcagccgtaccagg

SEQ ID NO: 380870 - DNA, 25 bp, Mus musculus
ctgagaacaaaggagccgtaccagg

SEQ ID NO: 380871 - DNA, 25 bp, Mus musculus
ctgagaacaaccataaaatcattga

SEQ ID NO: 380872 - DNA, 25 bp, Mus musculus
ctgagaacaaccttaaaatcattga

SEQ ID NO: 380873 - DNA, 25 bp, Mus musculus
ctgagaacagggatcctctggatga

SEQ ID NO: 380874 - DNA, 25 bp, Mus musculus
ctgagaacagggttcctctggatga

SEQ ID NO: 380875 - DNA, 25 bp, Mus musculus
ctgagaacatgcaagctccttcaac

SEQ ID NO: 380876 - DNA, 25 bp, Mus musculus
ctgagaacatgctagctccttcaac

SEQ ID NO: 380877 - DNA, 25 bp, Mus musculus
ctgagaaccaaacttttagactgta

SEQ ID NO: 380878 - DNA, 25 bp, Mus musculus
ctgagaaccaaagttttagactgta

SEQ ID NO: 380879 - DNA, 25 bp, Mus musculus
ctgagaaccggaccctggactgtac

SEQ ID NO: 380880 - DNA, 25 bp, Mus musculus
ctgagaaccggagcctggactgtac

SEQ ID NO: 380881 - DNA, 25 bp, Mus musculus
ctgagaacgacaagcaccgggtggt

SEQ ID NO: 380882 - DNA, 25 bp, Mus musculus
ctgagaacgacatgcaccgggtggt

SEQ ID NO: 380883 - DNA, 25 bp, Mus musculus
ctgagaacgcacactggcgggttta

SEQ ID NO: 380884 - DNA, 25 bp, Mus musculus
ctgagaacgcactctggcgggttta

SEQ ID NO: 380885 - DNA, 25 bp, Mus musculus
ctgagaacgcggactccagcctgct

SEQ ID NO: 380886 - DNA, 25 bp, Mus musculus
ctgagaacgcggtctccagcctgct

SEQ ID NO: 380887 - DNA, 25 bp, Mus musculus
ctgagaacttgccaggagtcgctcc

SEQ ID NO: 380888 - DNA, 25 bp, Mus musculus
ctgagaacttgcgaggagtcgctcc

SEQ ID NO: 380889 - DNA, 25 bp, Mus musculus
ctgagaagaactcaggtgaccgcag

SEQ ID NO: 380890 - DNA, 25 bp, Mus musculus
ctgagaagaactgaggtgaccgcag

SEQ ID NO: 380891 - DNA, 25 bp, Mus musculus
ctgagaagacaaacaactacgcatg

SEQ ID NO: 380892 - DNA, 25 bp, Mus musculus
ctgagaagacaatcaactacgcatg

SEQ ID NO: 380893 - DNA, 25 bp, Mus musculus
ctgagaagacttagctgagtcacct

SEQ ID NO: 380894 - DNA, 25 bp, Mus musculus
ctgagaagactttgctgagtcacct

SEQ ID NO: 380895 - DNA, 25 bp, Mus musculus
ctgagaagagtgatcccagcctctg

SEQ ID NO: 380896 - DNA, 25 bp, Mus musculus
ctgagaagagtgttcccagcctctg

SEQ ID NO: 380897 - DNA, 25 bp, Mus musculus
ctgagaagccataagcccagcactt

SEQ ID NO: 380898 - DNA, 25 bp, Mus musculus
ctgagaagccattagcccagcactt

SEQ ID NO: 380899 - DNA, 25 bp, Mus musculus
ctgagaagcccaaagctagcatgat

SEQ ID NO: 380900 - DNA, 25 bp, Mus musculus
ctgagaagcccatagctagcatgat

SEQ ID NO: 380901 - DNA, 25 bp, Mus musculus
ctgagaagctctcagttctgttaga

SEQ ID NO: 380902 - DNA, 25 bp, Mus musculus
ctgagaagctctgagttctgttaga

SEQ ID NO: 380903 - DNA, 25 bp, Mus musculus
ctgagaagcttgaaacccctggaat

SEQ ID NO: 380904 - DNA, 25 bp, Mus musculus
ctgagaagcttgtaacccctggaat

SEQ ID NO: 380905 - DNA, 25 bp, Mus musculus
ctgagaaggcaacggacttgacccc

SEQ ID NO: 380906 - DNA, 25 bp, Mus musculus
ctgagaaggcaagggacttgacccc

SEQ ID NO: 380907 - DNA, 25 bp, Mus musculus
ctgagaagggttcgccctgctcact

SEQ ID NO: 380908 - DNA, 25 bp, Mus musculus
ctgagaagggttggccctgctcact

SEQ ID NO: 380909 - DNA, 25 bp, Mus musculus
ctgagaagtcgtcgacctgggacct

SEQ ID NO: 380910 - DNA, 25 bp, Mus musculus
ctgagaagtcgtggacctgggacct

SEQ ID NO: 380911 - DNA, 25 bp, Mus musculus
ctgagaagtgtcacaggcgcaccgt

SEQ ID NO: 380912 - DNA, 25 bp, Mus musculus
ctgagaagtgtctcaggcgcaccgt

SEQ ID NO: 380913 - DNA, 25 bp, Mus musculus
ctgagaatactgaaccatgactata

SEQ ID NO: 380914 - DNA, 25 bp, Mus musculus
ctgagaatactgtaccatgactata

SEQ ID NO: 380915 - DNA, 25 bp, Mus musculus
ctgagaatctgcctgttttgtactt

SEQ ID NO: 380916 - DNA, 25 bp, Mus musculus
ctgagaatctgcgtgttttgtactt

SEQ ID NO: 380917 - DNA, 25 bp, Mus musculus
ctgagaatctggagatgtgtggcct

SEQ ID NO: 380918 - DNA, 25 bp, Mus musculus
ctgagaatctggtgatgtgtggcct

SEQ ID NO: 380919 - DNA, 25 bp, Mus musculus
ctgagacaacttctaagggatcgtt

SEQ ID NO: 380920 - DNA, 25 bp, Mus musculus
ctgagacaacttgtaagggatcgtt

SEQ ID NO: 380921 - DNA, 25 bp, Mus musculus
ctgagacaattcactctggctgttt

SEQ ID NO: 380922 - DNA, 25 bp, Mus musculus
ctgagacaattctctctggctgttt

SEQ ID NO: 380923 - DNA, 25 bp, Mus musculus
ctgagacaccgaccatgcgcattaa

SEQ ID NO: 380924 - DNA, 25 bp, Mus musculus
ctgagacaccgagcatgcgcattaa

SEQ ID NO: 380925 - DNA, 25 bp, Mus musculus
ctgagacactgaaagaaaacaatgt

SEQ ID NO: 380926 - DNA, 25 bp, Mus musculus
ctgagacactgaccatgtgcccagt

SEQ ID NO: 380927 - DNA, 25 bp, Mus musculus
ctgagacactgagcatgtgcccagt

SEQ ID NO: 380928 - DNA, 25 bp, Mus musculus
ctgagacactgatagaaaacaatgt

SEQ ID NO: 380929 - DNA, 25 bp, Mus musculus
ctgagacagcttcaacccaacgaac

SEQ ID NO: 380930 - DNA, 25 bp, Mus musculus
ctgagacagcttgaacccaacgaac

SEQ ID NO: 380931 - DNA, 25 bp, Mus musculus
ctgagacagttgaagggcccatagt

SEQ ID NO: 380932 - DNA, 25 bp, Mus musculus
ctgagacagttgtagggcccatagt

SEQ ID NO: 380933 - DNA, 25 bp, Mus musculus
ctgagacatttcaccagacctatgt

SEQ ID NO: 380934 - DNA, 25 bp, Mus musculus
ctgagacatttctccagacctatgt

SEQ ID NO: 380935 - DNA, 25 bp, Mus musculus
ctgagaccactgacttagagccaat

SEQ ID NO: 380936 - DNA, 25 bp, Mus musculus
ctgagaccactgtcttagagccaat

SEQ ID NO: 380937 - DNA, 25 bp, Mus musculus
ctgagaccagctatccggtggcgga

SEQ ID NO: 380938 - DNA, 25 bp, Mus musculus
ctgagaccagctttccggtggcgga

SEQ ID NO: 380939 - DNA, 25 bp, Mus musculus
ctgagacccatcagttggcagaact

SEQ ID NO: 380940 - DNA, 25 bp, Mus musculus
ctgagacccatctgttggcagaact

SEQ ID NO: 380941 - DNA, 25 bp, Mus musculus
ctgagacccctgatcattcttaaaa

SEQ ID NO: 380942 - DNA, 25 bp, Mus musculus
ctgagacccctgttcattcttaaaa

SEQ ID NO: 380943 - DNA, 25 bp, Mus musculus
ctgagaccctcaacaatctcattgt

SEQ ID NO: 380944 - DNA, 25 bp, Mus musculus
ctgagaccctcatcaatctcattgt

SEQ ID NO: 380945 - DNA, 25 bp, Mus musculus
ctgagaccggtgacgtgcccggctc

SEQ ID NO: 380946 - DNA, 25 bp, Mus musculus
ctgagaccggtgtcgtgcccggctc

SEQ ID NO: 380947 - DNA, 25 bp, Mus musculus
ctgagacctcagcttagattgtaga

SEQ ID NO: 380948 - DNA, 25 bp, Mus musculus
ctgagacctcaggttagattgtaga

SEQ ID NO: 380949 - DNA, 25 bp, Mus musculus
ctgagacctggtcgtgtatgctgca

SEQ ID NO: 380950 - DNA, 25 bp, Mus musculus
ctgagacctggtggtgtatgctgca

SEQ ID NO: 380951 - DNA, 25 bp, Mus musculus
ctgagacgtggacagtaccctgact

SEQ ID NO: 380952 - DNA, 25 bp, Mus musculus
ctgagacgtggagagtaccctgact

SEQ ID NO: 380953 - DNA, 25 bp, Mus musculus
ctgagactaaacacacccacctatt

SEQ ID NO: 380954 - DNA, 25 bp, Mus musculus
ctgagactaaactcacccacctatt

SEQ ID NO: 380955 - DNA, 25 bp, Mus musculus
ctgagactataccttgccagggagt

SEQ ID NO: 380956 - DNA, 25 bp, Mus musculus
ctgagactatacgttgccagggagt

SEQ ID NO: 380957 - DNA, 25 bp, Mus musculus
ctgagactcctgagcttacaatgaa

SEQ ID NO: 380958 - DNA, 25 bp, Mus musculus
ctgagactcctgtgcttacaatgaa

SEQ ID NO: 380959 - DNA, 25 bp, Mus musculus
ctgagactgggtcttgcttgccaaa

SEQ ID NO: 380960 - DNA, 25 bp, Mus musculus
ctgagactgggtgttgcttgccaaa

SEQ ID NO: 380961 - DNA, 25 bp, Mus musculus
ctgagacttgttcccagttcctggg

SEQ ID NO: 380962 - DNA, 25 bp, Mus musculus
ctgagacttgttgccagttcctggg

SEQ ID NO: 380963 - DNA, 25 bp, Mus musculus
ctgagagacagacttacttagacaa

SEQ ID NO: 380964 - DNA, 25 bp, Mus musculus
ctgagagacagagttacttagacaa

SEQ ID NO: 380965 - DNA, 25 bp, Mus musculus
ctgagagactctatagggactacct

SEQ ID NO: 380966 - DNA, 25 bp, Mus musculus
ctgagagactctttagggactacct

SEQ ID NO: 380967 - DNA, 25 bp, Mus musculus
ctgagagactgtagcccctgtgaac

SEQ ID NO: 380968 - DNA, 25 bp, Mus musculus
ctgagagactgttgcccctgtgaac

SEQ ID NO: 380969 - DNA, 25 bp, Mus musculus
ctgagagagcctcccggatgatgaa

SEQ ID NO: 380970 - DNA, 25 bp, Mus musculus
ctgagagagcctgccggatgatgaa

SEQ ID NO: 380971 - DNA, 25 bp, Mus musculus
ctgagagagggccacacagtgacca

SEQ ID NO: 380972 - DNA, 25 bp, Mus musculus
ctgagagagggcgacacagtgacca

SEQ ID NO: 380973 - DNA, 25 bp, Mus musculus
ctgagagataccatgagattctgta

SEQ ID NO: 380974 - DNA, 25 bp, Mus musculus
ctgagagataccttgagattctgta

SEQ ID NO: 380975 - DNA, 25 bp, Mus musculus
ctgagagcaactccctgctgaaact

SEQ ID NO: 380976 - DNA, 25 bp, Mus musculus
ctgagagcaactgcctgctgaaact

SEQ ID NO: 380977 - DNA, 25 bp, Mus musculus
ctgagagcagtacagccagccttgc

SEQ ID NO: 380978 - DNA, 25 bp, Mus musculus
ctgagagcagtagagccagccttgc

SEQ ID NO: 380979 - DNA, 25 bp, Mus musculus
ctgagagccagacagtggatcttag

SEQ ID NO: 380980 - DNA, 25 bp, Mus musculus
ctgagagccagagagtggatcttag

SEQ ID NO: 380981 - DNA, 25 bp, Mus musculus
ctgagagccctgcagactgtgtgtc

SEQ ID NO: 380982 - DNA, 25 bp, Mus musculus
ctgagagccctggagactgtgtgtc

SEQ ID NO: 380983 - DNA, 25 bp, Mus musculus
ctgagagccgttcagactggcagat

SEQ ID NO: 380984 - DNA, 25 bp, Mus musculus
ctgagagccgttgagactggcagat

SEQ ID NO: 380985 - DNA, 25 bp, Mus musculus
ctgagagctctcacggcatggcagg

SEQ ID NO: 380986 - DNA, 25 bp, Mus musculus
ctgagagctctctcggcatggcagg

SEQ ID NO: 380987 - DNA, 25 bp, Mus musculus
ctgagagcttccctcgggagggcag

SEQ ID NO: 380988 - DNA, 25 bp, Mus musculus
ctgagagcttccgtcgggagggcag

SEQ ID NO: 380989 - DNA, 25 bp, Mus musculus
ctgagagcttgtaatttggtcctat

SEQ ID NO: 380990 - DNA, 25 bp, Mus musculus
ctgagagcttgttatttggtcctat

SEQ ID NO: 380991 - DNA, 25 bp, Mus musculus
ctgagaggacttaatgggccacaaa

SEQ ID NO: 380992 - DNA, 25 bp, Mus musculus
ctgagaggactttatgggccacaaa

SEQ ID NO: 380993 - DNA, 25 bp, Mus musculus
ctgagaggcctgcactttgctttgc

SEQ ID NO: 380994 - DNA, 25 bp, Mus musculus
ctgagaggcctggactttgctttgc

SEQ ID NO: 380995 - DNA, 25 bp, Mus musculus
ctgagaggctacagtccttttttac

SEQ ID NO: 380996 - DNA, 25 bp, Mus musculus
ctgagaggctactgtccttttttac

SEQ ID NO: 380997 - DNA, 25 bp, Mus musculus
ctgagagggtgtccagtgccctccc

SEQ ID NO: 380998 - DNA, 25 bp, Mus musculus
ctgagagggtgtgcagtgccctccc

SEQ ID NO: 380999 - DNA, 25 bp, Mus musculus
ctgagaggtctgaagattctgaaac

SEQ ID NO: 381000 - DNA, 25 bp, Mus musculus
ctgagaggtctgtagattctgaaac

SEQ ID NO: 381001 - DNA, 25 bp, Mus musculus
ctgagaggtgtgaccaagcagagtt

SEQ ID NO: 381002 - DNA, 25 bp, Mus musculus
ctgagaggtgtgtccaagcagagtt

SEQ ID NO: 381003 - DNA, 25 bp, Mus musculus
ctgagaggttttctttccatgtaca

SEQ ID NO: 381004 - DNA, 25 bp, Mus musculus
ctgagaggttttgtttccatgtaca

SEQ ID NO: 381005 - DNA, 25 bp, Mus musculus
ctgagagtcttaaacaggccatata

SEQ ID NO: 381006 - DNA, 25 bp, Mus musculus
ctgagagtcttatacaggccatata

SEQ ID NO: 381007 - DNA, 25 bp, Mus musculus
ctgagagtgcagaatcgatgttatt

SEQ ID NO: 381008 - DNA, 25 bp, Mus musculus
ctgagagtgcagatccatgcaaact

SEQ ID NO: 381009 - DNA, 25 bp, Mus musculus
ctgagagtgcagtatcgatgttatt

SEQ ID NO: 381010 - DNA, 25 bp, Mus musculus
ctgagagtgcagttccatgcaaact

SEQ ID NO: 381011 - DNA, 25 bp, Mus musculus
ctgagagttcctacctaggcctgga

SEQ ID NO: 381012 - DNA, 25 bp, Mus musculus
ctgagagttccttcctaggcctgga

SEQ ID NO: 381013 - DNA, 25 bp, Mus musculus
ctgagataaacacctgggtgtaggc

SEQ ID NO: 381014 - DNA, 25 bp, Mus musculus
ctgagataaacagctgggtgtaggc

SEQ ID NO: 381015 - DNA, 25 bp, Mus musculus
ctgagatacagtcaaaacatgacaa

SEQ ID NO: 381016 - DNA, 25 bp, Mus musculus
ctgagatacagtgaaaacatgacaa

SEQ ID NO: 381017 - DNA, 25 bp, Mus musculus
ctgagatatcagaccccactgtgta

SEQ ID NO: 381018 - DNA, 25 bp, Mus musculus
ctgagatatcagtccccactgtgta

SEQ ID NO: 381019 - DNA, 25 bp, Mus musculus
ctgagatcagcacgagttgccccat

SEQ ID NO: 381020 - DNA, 25 bp, Mus musculus
ctgagatcagcaggagttgccccat

SEQ ID NO: 381021 - DNA, 25 bp, Mus musculus
ctgagatccgaaagtgaagctgaga

SEQ ID NO: 381022 - DNA, 25 bp, Mus musculus
ctgagatccgaatgtgaagctgaga

SEQ ID NO: 381023 - DNA, 25 bp, Mus musculus
ctgagatccgccagcttgaggagaa

SEQ ID NO: 381024 - DNA, 25 bp, Mus musculus
ctgagatccgcctgcttgaggagaa

SEQ ID NO: 381025 - DNA, 25 bp, Mus musculus
ctgagatccggcacatggtgggcct

SEQ ID NO: 381026 - DNA, 25 bp, Mus musculus
ctgagatccggctcatggtgggcct

SEQ ID NO: 381027 - DNA, 25 bp, Mus musculus
ctgagatcctacatggtgcttcgaa

SEQ ID NO: 381028 - DNA, 25 bp, Mus musculus
ctgagatcctacttggtgcttcgaa

SEQ ID NO: 381029 - DNA, 25 bp, Mus musculus
ctgagatcctgtatcacttactggg

SEQ ID NO: 381030 - DNA, 25 bp, Mus musculus
ctgagatcctgtcggacagtcagtt

SEQ ID NO: 381031 - DNA, 25 bp, Mus musculus
ctgagatcctgtgggacagtcagtt

SEQ ID NO: 381032 - DNA, 25 bp, Mus musculus
ctgagatcctgtttcacttactggg

SEQ ID NO: 381033 - DNA, 25 bp, Mus musculus
ctgagatctgtaatcctagcgagta

SEQ ID NO: 381034 - DNA, 25 bp, Mus musculus
ctgagatctgtattcctagcgagta

SEQ ID NO: 381035 - DNA, 25 bp, Mus musculus
ctgagatgattcaaggccccaagcc

SEQ ID NO: 381036 - DNA, 25 bp, Mus musculus
ctgagatgattctaggccccaagcc

SEQ ID NO: 381037 - DNA, 25 bp, Mus musculus
ctgagatgcccaatgtgcaaatgca

SEQ ID NO: 381038 - DNA, 25 bp, Mus musculus
ctgagatgcccattgtgcaaatgca

SEQ ID NO: 381039 - DNA, 25 bp, Mus musculus
ctgagatgcgccatgcagtgcatga

SEQ ID NO: 381040 - DNA, 25 bp, Mus musculus
ctgagatgcgccttgcagtgcatga

SEQ ID NO: 381041 - DNA, 25 bp, Mus musculus
ctgagatgctggatgtgaaacactg

SEQ ID NO: 381042 - DNA, 25 bp, Mus musculus
ctgagatgctggttgtgaaacactg

SEQ ID NO: 381043 - DNA, 25 bp, Mus musculus
ctgagatggattctcttgtcctgcc

SEQ ID NO: 381044 - DNA, 25 bp, Mus musculus
ctgagatggattgtcttgtcctgcc

SEQ ID NO: 381045 - DNA, 25 bp, Mus musculus
ctgagatgtaccaaaattatgacca

SEQ ID NO: 381046 - DNA, 25 bp, Mus musculus
ctgagatgtacctaaattatgacca

SEQ ID NO: 381047 - DNA, 25 bp, Mus musculus
ctgagatgtctcatgtcctctagta

SEQ ID NO: 381048 - DNA, 25 bp, Mus musculus
ctgagatgtctcttgtcctctagta

SEQ ID NO: 381049 - DNA, 25 bp, Mus musculus
ctgagattccttctaggtccacatt

SEQ ID NO: 381050 - DNA, 25 bp, Mus musculus
ctgagattccttgtaggtccacatt

SEQ ID NO: 381051 - DNA, 25 bp, Mus musculus
ctgagattgccaaccggcagagtgt

SEQ ID NO: 381052 - DNA, 25 bp, Mus musculus
ctgagattgccatccggcagagtgt

SEQ ID NO: 381053 - DNA, 25 bp, Mus musculus
ctgagattgtccaagtgatccgcaa

SEQ ID NO: 381054 - DNA, 25 bp, Mus musculus
ctgagattgtcctagtgatccgcaa

SEQ ID NO: 381055 - DNA, 25 bp, Mus musculus
ctgagatttcaacttgtttacttgc

SEQ ID NO: 381056 - DNA, 25 bp, Mus musculus
ctgagatttcaagttgtttacttgc

SEQ ID NO: 381057 - DNA, 25 bp, Mus musculus
ctgagatttcagcttcccatcaaaa

SEQ ID NO: 381058 - DNA, 25 bp, Mus musculus
ctgagatttcaggttcccatcaaaa

SEQ ID NO: 381059 - DNA, 25 bp, Mus musculus
ctgagatttctccactgtgctgtaa

SEQ ID NO: 381060 - DNA, 25 bp, Mus musculus
ctgagatttctcgactgtgctgtaa

SEQ ID NO: 381061 - DNA, 25 bp, Mus musculus
ctgagatttggtaagctttgagagc

SEQ ID NO: 381062 - DNA, 25 bp, Mus musculus
ctgagatttggttagctttgagagc

SEQ ID NO: 381063 - DNA, 25 bp, Mus musculus
ctgagattttttctggcccaccgac

SEQ ID NO: 381064 - DNA, 25 bp, Mus musculus
ctgagattttttgtggcccaccgac

SEQ ID NO: 381065 - DNA, 25 bp, Mus musculus
ctgagcaacgtgctggcagccatga

SEQ ID NO: 381066 - DNA, 25 bp, Mus musculus
ctgagcaacgtggtggcagccatga

SEQ ID NO: 381067 - DNA, 25 bp, Mus musculus
ctgagcaaggctcaactgtctgaca

SEQ ID NO: 381068 - DNA, 25 bp, Mus musculus
ctgagcaaggctgaactgtctgaca

SEQ ID NO: 381069 - DNA, 25 bp, Mus musculus
ctgagcaagtgcagtgtacgacaca

SEQ ID NO: 381070 - DNA, 25 bp, Mus musculus
ctgagcaagtgctgtgtacgacaca

SEQ ID NO: 381071 - DNA, 25 bp, Mus musculus
ctgagcaatagcaatctccaggatg

SEQ ID NO: 381072 - DNA, 25 bp, Mus musculus
ctgagcaatagctatctccaggatg

SEQ ID NO: 381073 - DNA, 25 bp, Mus musculus
ctgagcaatcttcccagctctggaa

SEQ ID NO: 381074 - DNA, 25 bp, Mus musculus
ctgagcaatcttgccagctctggaa

SEQ ID NO: 381075 - DNA, 25 bp, Mus musculus
ctgagcacaaagaggccagcatttt

SEQ ID NO: 381076 - DNA, 25 bp, Mus musculus
ctgagcacaaagtggccagcatttt

SEQ ID NO: 381077 - DNA, 25 bp, Mus musculus
ctgagcacacacagttgtctcttca

SEQ ID NO: 381078 - DNA, 25 bp, Mus musculus
ctgagcacacactgttgtctcttca

SEQ ID NO: 381079 - DNA, 25 bp, Mus musculus
ctgagcacagacacaagaagggact

SEQ ID NO: 381080 - DNA, 25 bp, Mus musculus
ctgagcacagactcaagaagggact

SEQ ID NO: 381081 - DNA, 25 bp, Mus musculus
ctgagcaccaaaacaacctgataaa

SEQ ID NO: 381082 - DNA, 25 bp, Mus musculus
ctgagcaccaaatcaacctgataaa

SEQ ID NO: 381083 - DNA, 25 bp, Mus musculus
ctgagcaccaggacagttaaggctg

SEQ ID NO: 381084 - DNA, 25 bp, Mus musculus
ctgagcaccaggtcagttaaggctg

SEQ ID NO: 381085 - DNA, 25 bp, Mus musculus
ctgagcaccatgcttatcaccaggt

SEQ ID NO: 381086 - DNA, 25 bp, Mus musculus
ctgagcaccatggttatcaccaggt

SEQ ID NO: 381087 - DNA, 25 bp, Mus musculus
ctgagcacccctcgtgtgcctggga

SEQ ID NO: 381088 - DNA, 25 bp, Mus musculus
ctgagcacccctggtgtgcctggga

SEQ ID NO: 381089 - DNA, 25 bp, Mus musculus
ctgagcactgccaaaagaacttggt

SEQ ID NO: 381090 - DNA, 25 bp, Mus musculus
ctgagcactgcctaaagaacttggt

SEQ ID NO: 381091 - DNA, 25 bp, Mus musculus
ctgagcactggcactcaatacagat

SEQ ID NO: 381092 - DNA, 25 bp, Mus musculus
ctgagcactggctctcaatacagat

SEQ ID NO: 381093 - DNA, 25 bp, Mus musculus
ctgagcacttagaccctgaagttta

SEQ ID NO: 381094 - DNA, 25 bp, Mus musculus
ctgagcacttagtccctgaagttta

SEQ ID NO: 381095 - DNA, 25 bp, Mus musculus
ctgagcagagtccaaacctgggctg

SEQ ID NO: 381096 - DNA, 25 bp, Mus musculus
ctgagcagagtcgaaacctgggctg

SEQ ID NO: 381097 - DNA, 25 bp, Mus musculus
ctgagcagatacagcgtgcttacct

SEQ ID NO: 381098 - DNA, 25 bp, Mus musculus
ctgagcagatactgcgtgcttacct

SEQ ID NO: 381099 - DNA, 25 bp, Mus musculus
ctgagcagctgcaattcttttgttt

SEQ ID NO: 381100 - DNA, 25 bp, Mus musculus
ctgagcagctgctattcttttgttt

SEQ ID NO: 381101 - DNA, 25 bp, Mus musculus
ctgagcagctttctatatgtattaa

SEQ ID NO: 381102 - DNA, 25 bp, Mus musculus
ctgagcagctttgtatatgtattaa

SEQ ID NO: 381103 - DNA, 25 bp, Mus musculus
ctgagcaggactccacttcagccat

SEQ ID NO: 381104 - DNA, 25 bp, Mus musculus
ctgagcaggactgcacttcagccat

SEQ ID NO: 381105 - DNA, 25 bp, Mus musculus
ctgagcaggcacagggctgtcatca

SEQ ID NO: 381106 - DNA, 25 bp, Mus musculus
ctgagcaggcactgggctgtcatca

SEQ ID NO: 381107 - DNA, 25 bp, Mus musculus
ctgagcaggcgtctagatcatcact

SEQ ID NO: 381108 - DNA, 25 bp, Mus musculus
ctgagcaggcgtgtagatcatcact

SEQ ID NO: 381109 - DNA, 25 bp, Mus musculus
ctgagcaggctgatttgtatgtatc

SEQ ID NO: 381110 - DNA, 25 bp, Mus musculus
ctgagcaggctgttttgtatgtatc

SEQ ID NO: 381111 - DNA, 25 bp, Mus musculus
ctgagcaggtggaggacactcttga

SEQ ID NO: 381112 - DNA, 25 bp, Mus musculus
ctgagcaggtggtggacactcttga

SEQ ID NO: 381113 - DNA, 25 bp, Mus musculus
ctgagcagtcagacgatggtggttc

SEQ ID NO: 381114 - DNA, 25 bp, Mus musculus
ctgagcagtcagtcgatggtggttc

SEQ ID NO: 381115 - DNA, 25 bp, Mus musculus
ctgagcagtgggaactctccaggct

SEQ ID NO: 381116 - DNA, 25 bp, Mus musculus
ctgagcagtgggtactctccaggct

SEQ ID NO: 381117 - DNA, 25 bp, Mus musculus
ctgagcagttctccggctttctggc

SEQ ID NO: 381118 - DNA, 25 bp, Mus musculus
ctgagcagttctgcggctttctggc

SEQ ID NO: 381119 - DNA, 25 bp, Mus musculus
ctgagcatagcacccttgtggacag

SEQ ID NO: 381120 - DNA, 25 bp, Mus musculus
ctgagcatagcagccttgtggacag

SEQ ID NO: 381121 - DNA, 25 bp, Mus musculus
ctgagcatctacagactctgtggat

SEQ ID NO: 381122 - DNA, 25 bp, Mus musculus
ctgagcatctactgactctgtggat

SEQ ID NO: 381123 - DNA, 25 bp, Mus musculus
ctgagcatgaatcccatcctctgat

SEQ ID NO: 381124 - DNA, 25 bp, Mus musculus
ctgagcatgaatgccatcctctgat

SEQ ID NO: 381125 - DNA, 25 bp, Mus musculus
ctgagcatgctgaagcggccagtat

SEQ ID NO: 381126 - DNA, 25 bp, Mus musculus
ctgagcatgctgtagcggccagtat

SEQ ID NO: 381127 - DNA, 25 bp, Mus musculus
ctgagcattcttacgccctaaaaaa

SEQ ID NO: 381128 - DNA, 25 bp, Mus musculus
ctgagcattctttcgccctaaaaaa

SEQ ID NO: 381129 - DNA, 25 bp, Mus musculus
ctgagcatttggaactagttaccta

SEQ ID NO: 381130 - DNA, 25 bp, Mus musculus
ctgagcatttggtactagttaccta

SEQ ID NO: 381131 - DNA, 25 bp, Mus musculus
ctgagccaagtaactcgtaccaggg

SEQ ID NO: 381132 - DNA, 25 bp, Mus musculus
ctgagccaagtacggagacgttgct

SEQ ID NO: 381133 - DNA, 25 bp, Mus musculus
ctgagccaagtagggagacgttgct

SEQ ID NO: 381134 - DNA, 25 bp, Mus musculus
ctgagccaagtatctcgtaccaggg

SEQ ID NO: 381135 - DNA, 25 bp, Mus musculus
ctgagccaagttcggctcatcttcc

SEQ ID NO: 381136 - DNA, 25 bp, Mus musculus
ctgagccaagttgggctcatcttcc

SEQ ID NO: 381137 - DNA, 25 bp, Mus musculus
ctgagccaatgtagggccttctgaa

SEQ ID NO: 381138 - DNA, 25 bp, Mus musculus
ctgagccaatgttgggccttctgaa

SEQ ID NO: 381139 - DNA, 25 bp, Mus musculus
ctgagccactgtactgggagcagaa

SEQ ID NO: 381140 - DNA, 25 bp, Mus musculus
ctgagccactgttctgggagcagaa

SEQ ID NO: 381141 - DNA, 25 bp, Mus musculus
ctgagccagagaatttccatgagat

SEQ ID NO: 381142 - DNA, 25 bp, Mus musculus
ctgagccagagattttccatgagat

SEQ ID NO: 381143 - DNA, 25 bp, Mus musculus
ctgagccagagcagtgcctctccaa

SEQ ID NO: 381144 - DNA, 25 bp, Mus musculus
ctgagccagagctgtgcctctccaa

SEQ ID NO: 381145 - DNA, 25 bp, Mus musculus
ctgagccaggcccagtaccatgtgg

SEQ ID NO: 381146 - DNA, 25 bp, Mus musculus
ctgagccaggccgagtaccatgtgg

SEQ ID NO: 381147 - DNA, 25 bp, Mus musculus
ctgagccagggcacatagaacattg

SEQ ID NO: 381148 - DNA, 25 bp, Mus musculus
ctgagccagggctcatagaacattg

SEQ ID NO: 381149 - DNA, 25 bp, Mus musculus
ctgagccaggtgctacacaccctta

SEQ ID NO: 381150 - DNA, 25 bp, Mus musculus
ctgagccaggtggtacacaccctta

SEQ ID NO: 381151 - DNA, 25 bp, Mus musculus
ctgagccagtagagggacaagccct

SEQ ID NO: 381152 - DNA, 25 bp, Mus musculus
ctgagccagtagtgggacaagccct

SEQ ID NO: 381153 - DNA, 25 bp, Mus musculus
ctgagccagttgatactaaactctt

SEQ ID NO: 381154 - DNA, 25 bp, Mus musculus
ctgagccagttgttactaaactctt

SEQ ID NO: 381155 - DNA, 25 bp, Mus musculus
ctgagccatatcactagccatctgg

SEQ ID NO: 381156 - DNA, 25 bp, Mus musculus
ctgagccatatctctagccatctgg

SEQ ID NO: 381157 - DNA, 25 bp, Mus musculus
ctgagccatcttcatatctttctga

SEQ ID NO: 381158 - DNA, 25 bp, Mus musculus
ctgagccatcttgatatctttctga

SEQ ID NO: 381159 - DNA, 25 bp, Mus musculus
ctgagccatgggactctttatgtta

SEQ ID NO: 381160 - DNA, 25 bp, Mus musculus
ctgagccatgggtctctttatgtta

SEQ ID NO: 381161 - DNA, 25 bp, Mus musculus
ctgagcccacagatatcttctaaga

SEQ ID NO: 381162 - DNA, 25 bp, Mus musculus
ctgagcccacagttatcttctaaga

SEQ ID NO: 381163 - DNA, 25 bp, Mus musculus
ctgagcccagagattctctgaagct

SEQ ID NO: 381164 - DNA, 25 bp, Mus musculus
ctgagcccagagtttctctgaagct

SEQ ID NO: 381165 - DNA, 25 bp, Mus musculus
ctgagcccaggtaaggagtgttctt

SEQ ID NO: 381166 - DNA, 25 bp, Mus musculus
ctgagcccaggttaggagtgttctt

SEQ ID NO: 381167 - DNA, 25 bp, Mus musculus
ctgagccccattaccctggcaggtt

SEQ ID NO: 381168 - DNA, 25 bp, Mus musculus
ctgagccccatttccctggcaggtt

SEQ ID NO: 381169 - DNA, 25 bp, Mus musculus
ctgagcccctaaccacattcttgtg

SEQ ID NO: 381170 - DNA, 25 bp, Mus musculus
ctgagcccctaagcacattcttgtg

SEQ ID NO: 381171 - DNA, 25 bp, Mus musculus
ctgagccctgtgacggccgggctta

SEQ ID NO: 381172 - DNA, 25 bp, Mus musculus
ctgagccctgtgtcggccgggctta

SEQ ID NO: 381173 - DNA, 25 bp, Mus musculus
ctgagcccttcaatctgagctgtag

SEQ ID NO: 381174 - DNA, 25 bp, Mus musculus
ctgagcccttcattctgagctgtag

SEQ ID NO: 381175 - DNA, 25 bp, Mus musculus
ctgagcccttgcatgtgtttgggcc

SEQ ID NO: 381176 - DNA, 25 bp, Mus musculus
ctgagcccttgcttgtgtttgggcc

SEQ ID NO: 381177 - DNA, 25 bp, Mus musculus
ctgagccggtccaccagttttttat

SEQ ID NO: 381178 - DNA, 25 bp, Mus musculus
ctgagccggtcctccagttttttat

SEQ ID NO: 381179 - DNA, 25 bp, Mus musculus
ctgagccggtttcgtcacccagaag

SEQ ID NO: 381180 - DNA, 25 bp, Mus musculus
ctgagccggtttggtcacccagaag

SEQ ID NO: 381181 - DNA, 25 bp, Mus musculus
ctgagcctacacaagccagtgtggg

SEQ ID NO: 381182 - DNA, 25 bp, Mus musculus
ctgagcctacactagccagtgtggg

SEQ ID NO: 381183 - DNA, 25 bp, Mus musculus
ctgagcctatcactgcggttagtgt

SEQ ID NO: 381184 - DNA, 25 bp, Mus musculus
ctgagcctatcagtgcggttagtgt

SEQ ID NO: 381185 - DNA, 25 bp, Mus musculus
ctgagcctatgaagtcgttgatgtt

SEQ ID NO: 381186 - DNA, 25 bp, Mus musculus
ctgagcctatgatgtcgttgatgtt

SEQ ID NO: 381187 - DNA, 25 bp, Mus musculus
ctgagcctcagtctatgtatctggt

SEQ ID NO: 381188 - DNA, 25 bp, Mus musculus
ctgagcctcagtgtatgtatctggt

SEQ ID NO: 381189 - DNA, 25 bp, Mus musculus
ctgagcctccagctgggcaatatac

SEQ ID NO: 381190 - DNA, 25 bp, Mus musculus
ctgagcctccagctgggcaatatcc

SEQ ID NO: 381191 - DNA, 25 bp, Mus musculus
ctgagcctccaggtgggcaatatac

SEQ ID NO: 381192 - DNA, 25 bp, Mus musculus
ctgagcctccaggtgggcaatatcc

SEQ ID NO: 381193 - DNA, 25 bp, Mus musculus
ctgagcctccttaggatcgtgaaaa

SEQ ID NO: 381194 - DNA, 25 bp, Mus musculus
ctgagcctcctttggatcgtgaaaa

SEQ ID NO: 381195 - DNA, 25 bp, Mus musculus
ctgagcctctcactatcttatgaag

SEQ ID NO: 381196 - DNA, 25 bp, Mus musculus
ctgagcctctcagtatcttatgaag

SEQ ID NO: 381197 - DNA, 25 bp, Mus musculus
ctgagcctgagacaaactggtgact

SEQ ID NO: 381198 - DNA, 25 bp, Mus musculus
ctgagcctgagagaaactggtgact

SEQ ID NO: 381199 - DNA, 25 bp, Mus musculus
ctgagcctgagtccctagccaggtt

SEQ ID NO: 381200 - DNA, 25 bp, Mus musculus
ctgagcctgagtgcctagccaggtt

SEQ ID NO: 381201 - DNA, 25 bp, Mus musculus
ctgagcctggagaacggacctttgg

SEQ ID NO: 381202 - DNA, 25 bp, Mus musculus
ctgagcctggagtacggacctttgg

SEQ ID NO: 381203 - DNA, 25 bp, Mus musculus
ctgagcctggctatgagtaagtgac

SEQ ID NO: 381204 - DNA, 25 bp, Mus musculus
ctgagcctggctttgagtaagtgac

SEQ ID NO: 381205 - DNA, 25 bp, Mus musculus
ctgagccttagcctactctaaagat

SEQ ID NO: 381206 - DNA, 25 bp, Mus musculus
ctgagccttagcgtactctaaagat

SEQ ID NO: 381207 - DNA, 25 bp, Mus musculus
ctgagccttcttagtctacctcaat

SEQ ID NO: 381208 - DNA, 25 bp, Mus musculus
ctgagccttctttgtctacctcaat

SEQ ID NO: 381209 - DNA, 25 bp, Mus musculus
ctgagccttgtaccctgtagtgaca

SEQ ID NO: 381210 - DNA, 25 bp, Mus musculus
ctgagccttgtagcctgtagtgaca

SEQ ID NO: 381211 - DNA, 25 bp, Mus musculus
ctgagcgaaactcgctgcgcctagt

SEQ ID NO: 381212 - DNA, 25 bp, Mus musculus
ctgagcgaaactggctgcgcctagt

SEQ ID NO: 381213 - DNA, 25 bp, Mus musculus
ctgagcgatggactggatgccacaa

SEQ ID NO: 381214 - DNA, 25 bp, Mus musculus
ctgagcgatggagtggatgccacaa

SEQ ID NO: 381215 - DNA, 25 bp, Mus musculus
ctgagcgcaaatcgccctgggattt

SEQ ID NO: 381216 - DNA, 25 bp, Mus musculus
ctgagcgcaaatggccctgggattt

SEQ ID NO: 381217 - DNA, 25 bp, Mus musculus
ctgagcgctcttaatactttctaac

SEQ ID NO: 381218 - DNA, 25 bp, Mus musculus
ctgagcgctctttatactttctaac

SEQ ID NO: 381219 - DNA, 25 bp, Mus musculus
ctgagcgctggaacagtggcgcatc

SEQ ID NO: 381220 - DNA, 25 bp, Mus musculus
ctgagcgctggatcagtggcgcatc

SEQ ID NO: 381221 - DNA, 25 bp, Mus musculus
ctgagcggcactacatcgatgatgt

SEQ ID NO: 381222 - DNA, 25 bp, Mus musculus
ctgagcggcacttcatcgatgatgt

SEQ ID NO: 381223 - DNA, 25 bp, Mus musculus
ctgagcggccgtccgtacatcgtca

SEQ ID NO: 381224 - DNA, 25 bp, Mus musculus
ctgagcggccgtgcgtacatcgtca

SEQ ID NO: 381225 - DNA, 25 bp, Mus musculus
ctgagcggcgagatcgaccagctgc

SEQ ID NO: 381226 - DNA, 25 bp, Mus musculus
ctgagcggcgagttcgaccagctgc

SEQ ID NO: 381227 - DNA, 25 bp, Mus musculus
ctgagcggcgcactagtctactact

SEQ ID NO: 381228 - DNA, 25 bp, Mus musculus
ctgagcggcgcagtagtctactact

SEQ ID NO: 381229 - DNA, 25 bp, Mus musculus
ctgagcgtagcaacggactggtcgt

SEQ ID NO: 381230 - DNA, 25 bp, Mus musculus
ctgagcgtagcatcggactggtcgt

SEQ ID NO: 381231 - DNA, 25 bp, Mus musculus
ctgagcgtagctcgtttactcttta

SEQ ID NO: 381232 - DNA, 25 bp, Mus musculus
ctgagcgtagctggtttactcttta

SEQ ID NO: 381233 - DNA, 25 bp, Mus musculus
ctgagcgtcaggcagaatcttcaca

SEQ ID NO: 381234 - DNA, 25 bp, Mus musculus
ctgagcgtcagggagaatcttcaca

SEQ ID NO: 381235 - DNA, 25 bp, Mus musculus
ctgagcgttaggactgcccacgtga

SEQ ID NO: 381236 - DNA, 25 bp, Mus musculus
ctgagcgttaggtctgcccacgtga

SEQ ID NO: 381237 - DNA, 25 bp, Mus musculus
ctgagcgttgctcccgactctgctt

SEQ ID NO: 381238 - DNA, 25 bp, Mus musculus
ctgagcgttgctgccgactctgctt

SEQ ID NO: 381239 - DNA, 25 bp, Mus musculus
ctgagctaagatacaagccttctgt

SEQ ID NO: 381240 - DNA, 25 bp, Mus musculus
ctgagctaagattcaagccttctgt

SEQ ID NO: 381241 - DNA, 25 bp, Mus musculus
ctgagctacatacggacacccctgt

SEQ ID NO: 381242 - DNA, 25 bp, Mus musculus
ctgagctacatagggacacccctgt

SEQ ID NO: 381243 - DNA, 25 bp, Mus musculus
ctgagctactttactagacatttga

SEQ ID NO: 381244 - DNA, 25 bp, Mus musculus
ctgagctactttcccaggtcaataa

SEQ ID NO: 381245 - DNA, 25 bp, Mus musculus
ctgagctactttgccaggtcaataa

SEQ ID NO: 381246 - DNA, 25 bp, Mus musculus
ctgagctacttttctagacatttga

SEQ ID NO: 381247 - DNA, 25 bp, Mus musculus
ctgagctagcttatcttacgggcaa

SEQ ID NO: 381248 - DNA, 25 bp, Mus musculus
ctgagctagcttttcttacgggcaa

SEQ ID NO: 381249 - DNA, 25 bp, Mus musculus
ctgagctcagacatacccagtaaga

SEQ ID NO: 381250 - DNA, 25 bp, Mus musculus
ctgagctcagacttacccagtaaga

SEQ ID NO: 381251 - DNA, 25 bp, Mus musculus
ctgagctcagagagggtatcaggtc

SEQ ID NO: 381252 - DNA, 25 bp, Mus musculus
ctgagctcagagtgggtatcaggtc

SEQ ID NO: 381253 - DNA, 25 bp, Mus musculus
ctgagctcagatcgcttctattcca

SEQ ID NO: 381254 - DNA, 25 bp, Mus musculus
ctgagctcagatggcttctattcca

SEQ ID NO: 381255 - DNA, 25 bp, Mus musculus
ctgagctcagctagcctcgggccag

SEQ ID NO: 381256 - DNA, 25 bp, Mus musculus
ctgagctcagcttgcctcgggccag

SEQ ID NO: 381257 - DNA, 25 bp, Mus musculus
ctgagctcagtaactggaacccacg

SEQ ID NO: 381258 - DNA, 25 bp, Mus musculus
ctgagctcagtatctggaacccacg

SEQ ID NO: 381259 - DNA, 25 bp, Mus musculus
ctgagctcccgtatgttgtttgttg

SEQ ID NO: 381260 - DNA, 25 bp, Mus musculus
ctgagctcccgtttgttgtttgttg

SEQ ID NO: 381261 - DNA, 25 bp, Mus musculus
ctgagctcgtcaaggtctatgtcaa

SEQ ID NO: 381262 - DNA, 25 bp, Mus musculus
ctgagctcgtcatggtctatgtcaa

SEQ ID NO: 381263 - DNA, 25 bp, Mus musculus
ctgagctctatgagactgtgtcctc

SEQ ID NO: 381264 - DNA, 25 bp, Mus musculus
ctgagctctatgtgactgtgtcctc

SEQ ID NO: 381265 - DNA, 25 bp, Mus musculus
ctgagctctattaacaacttggtgt

SEQ ID NO: 381266 - DNA, 25 bp, Mus musculus
ctgagctctatttacaacttggtgt

SEQ ID NO: 381267 - DNA, 25 bp, Mus musculus
ctgagctctcgcattcaagaaacat

SEQ ID NO: 381268 - DNA, 25 bp, Mus musculus
ctgagctctcgctttcaagaaacat

SEQ ID NO: 381269 - DNA, 25 bp, Mus musculus
ctgagctctgtgatccttgttaaac

SEQ ID NO: 381270 - DNA, 25 bp, Mus musculus
ctgagctctgtgttccttgttaaac

SEQ ID NO: 381271 - DNA, 25 bp, Mus musculus
ctgagctctttcagaggctggtaaa

SEQ ID NO: 381272 - DNA, 25 bp, Mus musculus
ctgagctctttctgaggctggtaaa

SEQ ID NO: 381273 - DNA, 25 bp, Mus musculus
ctgagctgagtaatataatcaacct

SEQ ID NO: 381274 - DNA, 25 bp, Mus musculus
ctgagctgagtattataatcaacct

SEQ ID NO: 381275 - DNA, 25 bp, Mus musculus
ctgagctgagttagggttttgaacc

SEQ ID NO: 381276 - DNA, 25 bp, Mus musculus
ctgagctgagtttgggttttgaacc

SEQ ID NO: 381277 - DNA, 25 bp, Mus musculus
ctgagctgatgtaagagtatttaat

SEQ ID NO: 381278 - DNA, 25 bp, Mus musculus
ctgagctgatgttagagtatttaat

SEQ ID NO: 381279 - DNA, 25 bp, Mus musculus
ctgagctgcagcagaatccgctggt

SEQ ID NO: 381280 - DNA, 25 bp, Mus musculus
ctgagctgcagctgaatccgctggt

SEQ ID NO: 381281 - DNA, 25 bp, Mus musculus
ctgagctgccaacgagccacgagat

SEQ ID NO: 381282 - DNA, 25 bp, Mus musculus
ctgagctgccaaggagccacgagat

SEQ ID NO: 381283 - DNA, 25 bp, Mus musculus
ctgagctgccgtcacaggtggcatt

SEQ ID NO: 381284 - DNA, 25 bp, Mus musculus
ctgagctgccgtgacaggtggcatt

SEQ ID NO: 381285 - DNA, 25 bp, Mus musculus
ctgagctgcctacggagacattgtc

SEQ ID NO: 381286 - DNA, 25 bp, Mus musculus
ctgagctgcctagggagacattgtc

SEQ ID NO: 381287 - DNA, 25 bp, Mus musculus
ctgagctggaatccaatgacgtggt

SEQ ID NO: 381288 - DNA, 25 bp, Mus musculus
ctgagctggaatgcaatgacgtggt

SEQ ID NO: 381289 - DNA, 25 bp, Mus musculus
ctgagctggcccaggaaagcagaga

SEQ ID NO: 381290 - DNA, 25 bp, Mus musculus
ctgagctggccctggaaagcagaga

SEQ ID NO: 381291 - DNA, 25 bp, Mus musculus
ctgagctggcttctggtgtacacag

SEQ ID NO: 381292 - DNA, 25 bp, Mus musculus
ctgagctggcttgtggtgtacacag

SEQ ID NO: 381293 - DNA, 25 bp, Mus musculus
ctgagctgtaccatatggaaagtgg

SEQ ID NO: 381294 - DNA, 25 bp, Mus musculus
ctgagctgtaccttatggaaagtgg

SEQ ID NO: 381295 - DNA, 25 bp, Mus musculus
ctgagctgtatcatctgcctcttta

SEQ ID NO: 381296 - DNA, 25 bp, Mus musculus
ctgagctgtatcttctgcctcttta

SEQ ID NO: 381297 - DNA, 25 bp, Mus musculus
ctgagctgtgaaaccagttgccttg

SEQ ID NO: 381298 - DNA, 25 bp, Mus musculus
ctgagctgtgaatccagttgccttg

SEQ ID NO: 381299 - DNA, 25 bp, Mus musculus
ctgagcttagccagctagccaaggg

SEQ ID NO: 381300 - DNA, 25 bp, Mus musculus
ctgagcttagcctgctagccaaggg

SEQ ID NO: 381301 - DNA, 25 bp, Mus musculus
ctgagcttccatcagcgatgagact

SEQ ID NO: 381302 - DNA, 25 bp, Mus musculus
ctgagcttccatgagcgatgagact

SEQ ID NO: 381303 - DNA, 25 bp, Mus musculus
ctgagcttctgtccacgtattttct

SEQ ID NO: 381304 - DNA, 25 bp, Mus musculus
ctgagcttctgtgcacgtattttct

SEQ ID NO: 381305 - DNA, 25 bp, Mus musculus
ctgagcttcttgaaagatttctctg

SEQ ID NO: 381306 - DNA, 25 bp, Mus musculus
ctgagcttcttgtaagatttctctg

SEQ ID NO: 381307 - DNA, 25 bp, Mus musculus
ctgagctttggacgatgggtttcaa

SEQ ID NO: 381308 - DNA, 25 bp, Mus musculus
ctgagctttggaggatgggtttcaa

SEQ ID NO: 381309 - DNA, 25 bp, Mus musculus
ctgagctttgttacttgcctataaa

SEQ ID NO: 381310 - DNA, 25 bp, Mus musculus
ctgagctttgtttcttgcctataaa

SEQ ID NO: 381311 - DNA, 25 bp, Mus musculus
ctgagctttttcataagatcatgtc

SEQ ID NO: 381312 - DNA, 25 bp, Mus musculus
ctgagctttttcttaagatcatgtc

SEQ ID NO: 381313 - DNA, 25 bp, Mus musculus
ctgaggaacaggctgctcttgactt

SEQ ID NO: 381314 - DNA, 25 bp, Mus musculus
ctgaggaacagggtgctcttgactt

SEQ ID NO: 381315 - DNA, 25 bp, Mus musculus
ctgaggaaccacattctgtctctat

SEQ ID NO: 381316 - DNA, 25 bp, Mus musculus
ctgaggaaccactttctgtctctat

SEQ ID NO: 381317 - DNA, 25 bp, Mus musculus
ctgaggaactggacccaagcttgac

SEQ ID NO: 381318 - DNA, 25 bp, Mus musculus
ctgaggaactggtcccaagcttgac

SEQ ID NO: 381319 - DNA, 25 bp, Mus musculus
ctgaggaagacactggtcatcagtt

SEQ ID NO: 381320 - DNA, 25 bp, Mus musculus
ctgaggaagacagtggtcatcagtt

SEQ ID NO: 381321 - DNA, 25 bp, Mus musculus
ctgaggaagccaagtcctacccctc

SEQ ID NO: 381322 - DNA, 25 bp, Mus musculus
ctgaggaagccatgtcctacccctc

SEQ ID NO: 381323 - DNA, 25 bp, Mus musculus
ctgaggaagctgaccggcatcctga

SEQ ID NO: 381324 - DNA, 25 bp, Mus musculus
ctgaggaagctgtccggcatcctga

SEQ ID NO: 381325 - DNA, 25 bp, Mus musculus
ctgaggaatgtacgcagggcctcct

SEQ ID NO: 381326 - DNA, 25 bp, Mus musculus
ctgaggaatgtaggcagggcctcct

SEQ ID NO: 381327 - DNA, 25 bp, Mus musculus
ctgaggacacagcaattggcactgt

SEQ ID NO: 381328 - DNA, 25 bp, Mus musculus
ctgaggacacaggaattggcactgt

SEQ ID NO: 381329 - DNA, 25 bp, Mus musculus
ctgaggacagggaagccagattgcc

SEQ ID NO: 381330 - DNA, 25 bp, Mus musculus
ctgaggacagggtagccagattgcc

SEQ ID NO: 381331 - DNA, 25 bp, Mus musculus
ctgaggacccctaggatgatgctta

SEQ ID NO: 381332 - DNA, 25 bp, Mus musculus
ctgaggaccccttggatgatgctta

SEQ ID NO: 381333 - DNA, 25 bp, Mus musculus
ctgaggaccctcaatttaagaagat

SEQ ID NO: 381334 - DNA, 25 bp, Mus musculus
ctgaggaccctcaggattaatcgaa

SEQ ID NO: 381335 - DNA, 25 bp, Mus musculus
ctgaggaccctctatttaagaagat

SEQ ID NO: 381336 - DNA, 25 bp, Mus musculus
ctgaggaccctctggattaatcgaa

SEQ ID NO: 381337 - DNA, 25 bp, Mus musculus
ctgaggaccgaccactgcagaaagt

SEQ ID NO: 381338 - DNA, 25 bp, Mus musculus
ctgaggaccgacgactgcagaaagt

SEQ ID NO: 381339 - DNA, 25 bp, Mus musculus
ctgaggacctctcacagcagttgtc

SEQ ID NO: 381340 - DNA, 25 bp, Mus musculus
ctgaggacctctgacagcagttgtc

SEQ ID NO: 381341 - DNA, 25 bp, Mus musculus
ctgaggacggcgcacactcatgcca

SEQ ID NO: 381342 - DNA, 25 bp, Mus musculus
ctgaggacggcggacactcatgcca

SEQ ID NO: 381343 - DNA, 25 bp, Mus musculus
ctgaggactcaaatgttgccttgga

SEQ ID NO: 381344 - DNA, 25 bp, Mus musculus
ctgaggactcaattgttgccttgga

SEQ ID NO: 381345 - DNA, 25 bp, Mus musculus
ctgaggactcagaccgcaaatatga

SEQ ID NO: 381346 - DNA, 25 bp, Mus musculus
ctgaggactcagtccgcaaatatga

SEQ ID NO: 381347 - DNA, 25 bp, Mus musculus
ctgaggactgcacatggacctgttg

SEQ ID NO: 381348 - DNA, 25 bp, Mus musculus
ctgaggactgcagatggacctgttg

SEQ ID NO: 381349 - DNA, 25 bp, Mus musculus
ctgaggacttccaattgccctggag

SEQ ID NO: 381350 - DNA, 25 bp, Mus musculus
ctgaggacttcctattgccctggag

SEQ ID NO: 381351 - DNA, 25 bp, Mus musculus
ctgaggactttcatcagttgcttca

SEQ ID NO: 381352 - DNA, 25 bp, Mus musculus
ctgaggactttcttcagttgcttca

SEQ ID NO: 381353 - DNA, 25 bp, Mus musculus
ctgaggagaacactgcccctgatgc

SEQ ID NO: 381354 - DNA, 25 bp, Mus musculus
ctgaggagaacagtgcccctgatgc

SEQ ID NO: 381355 - DNA, 25 bp, Mus musculus
ctgaggagacaaatgccctcttcct

SEQ ID NO: 381356 - DNA, 25 bp, Mus musculus
ctgaggagacaattgccctcttcct

SEQ ID NO: 381357 - DNA, 25 bp, Mus musculus
ctgaggagacctaccttatcctgaa

SEQ ID NO: 381358 - DNA, 25 bp, Mus musculus
ctgaggagaccttccttatcctgaa

SEQ ID NO: 381359 - DNA, 25 bp, Mus musculus
ctgaggagactgaacagcccgtttt

SEQ ID NO: 381360 - DNA, 25 bp, Mus musculus
ctgaggagactgtacagcccgtttt

SEQ ID NO: 381361 - DNA, 25 bp, Mus musculus
ctgaggagccaaccagggtgctaaa

SEQ ID NO: 381362 - DNA, 25 bp, Mus musculus
ctgaggagccaagcagggtgctaaa

SEQ ID NO: 381363 - DNA, 25 bp, Mus musculus
ctgaggagccacaaactccactgat

SEQ ID NO: 381364 - DNA, 25 bp, Mus musculus
ctgaggagccactaactccactgat

SEQ ID NO: 381365 - DNA, 25 bp, Mus musculus
ctgaggagctgacccagtgtttctc

SEQ ID NO: 381366 - DNA, 25 bp, Mus musculus
ctgaggagctgagccagtgtttctc

SEQ ID NO: 381367 - DNA, 25 bp, Mus musculus
ctgaggaggaagagattttaaacaa

SEQ ID NO: 381368 - DNA, 25 bp, Mus musculus
ctgaggaggaagtgattttaaacaa

SEQ ID NO: 381369 - DNA, 25 bp, Mus musculus
ctgaggaggcaaccaggttcagctc

SEQ ID NO: 381370 - DNA, 25 bp, Mus musculus
ctgaggaggcaagcaggttcagctc

SEQ ID NO: 381371 - DNA, 25 bp, Mus musculus
ctgaggagtcccaataccaactcgg

SEQ ID NO: 381372 - DNA, 25 bp, Mus musculus
ctgaggagtccctataccaactcgg

SEQ ID NO: 381373 - DNA, 25 bp, Mus musculus
ctgaggagtgatatgcaacgcaatg

SEQ ID NO: 381374 - DNA, 25 bp, Mus musculus
ctgaggagtgatttgcaacgcaatg

SEQ ID NO: 381375 - DNA, 25 bp, Mus musculus
ctgaggagtggcatcttagagacat

SEQ ID NO: 381376 - DNA, 25 bp, Mus musculus
ctgaggagtggcttcttagagacat

SEQ ID NO: 381377 - DNA, 25 bp, Mus musculus
ctgaggataagtacctcagcccggg

SEQ ID NO: 381378 - DNA, 25 bp, Mus musculus
ctgaggataagttcctcagcccggg

SEQ ID NO: 381379 - DNA, 25 bp, Mus musculus
ctgaggatacagaagtggacaatat

SEQ ID NO: 381380 - DNA, 25 bp, Mus musculus
ctgaggatacagtagtggacaatat

SEQ ID NO: 381381 - DNA, 25 bp, Mus musculus
ctgaggatcacccttccagagtcat

SEQ ID NO: 381382 - DNA, 25 bp, Mus musculus
ctgaggatcaccgttccagagtcat

SEQ ID NO: 381383 - DNA, 25 bp, Mus musculus
ctgaggatcaggagcccatggagtt

SEQ ID NO: 381384 - DNA, 25 bp, Mus musculus
ctgaggatcaggtgcccatggagtt

SEQ ID NO: 381385 - DNA, 25 bp, Mus musculus
ctgaggatgctcaactggttgtttc

SEQ ID NO: 381386 - DNA, 25 bp, Mus musculus
ctgaggatgctctactggttgtttc

SEQ ID NO: 381387 - DNA, 25 bp, Mus musculus
ctgaggatgcttcacttctgtctgg

SEQ ID NO: 381388 - DNA, 25 bp, Mus musculus
ctgaggatgcttgacttctgtctgg

SEQ ID NO: 381389 - DNA, 25 bp, Mus musculus
ctgaggcaatcaccagctggcctgg

SEQ ID NO: 381390 - DNA, 25 bp, Mus musculus
ctgaggcaatcagcagctggcctgg

SEQ ID NO: 381391 - DNA, 25 bp, Mus musculus
ctgaggcaccatcgcaggtccaaat

SEQ ID NO: 381392 - DNA, 25 bp, Mus musculus
ctgaggcaccatggcaggtccaaat

SEQ ID NO: 381393 - DNA, 25 bp, Mus musculus
ctgaggcagagcaccagcgaacaat

SEQ ID NO: 381394 - DNA, 25 bp, Mus musculus
ctgaggcagagctccagcgaacaat

SEQ ID NO: 381395 - DNA, 25 bp, Mus musculus
ctgaggcaggccctgttgctgtatc

SEQ ID NO: 381396 - DNA, 25 bp, Mus musculus
ctgaggcaggccgtgttgctgtatc

SEQ ID NO: 381397 - DNA, 25 bp, Mus musculus
ctgaggccactgatctggaggctga

SEQ ID NO: 381398 - DNA, 25 bp, Mus musculus
ctgaggccactgttctggaggctga

SEQ ID NO: 381399 - DNA, 25 bp, Mus musculus
ctgaggccacttattccaatgtggg

SEQ ID NO: 381400 - DNA, 25 bp, Mus musculus
ctgaggccactttttccaatgtggg

SEQ ID NO: 381401 - DNA, 25 bp, Mus musculus
ctgaggccaggacctattgtgctgc

SEQ ID NO: 381402 - DNA, 25 bp, Mus musculus
ctgaggccaggagctattgtgctgc

SEQ ID NO: 381403 - DNA, 25 bp, Mus musculus
ctgaggcccgcaagaccgtggagca

SEQ ID NO: 381404 - DNA, 25 bp, Mus musculus
ctgaggcccgcatgaccgtggagca

SEQ ID NO: 381405 - DNA, 25 bp, Mus musculus
ctgaggcccggacgctggattggac

SEQ ID NO: 381406 - DNA, 25 bp, Mus musculus
ctgaggcccggaggctggattggac

SEQ ID NO: 381407 - DNA, 25 bp, Mus musculus
ctgaggcccgtgacggctggcacta

SEQ ID NO: 381408 - DNA, 25 bp, Mus musculus
ctgaggcccgtgtcggctggcacta

SEQ ID NO: 381409 - DNA, 25 bp, Mus musculus
ctgaggccgccaccaaagctgagca

SEQ ID NO: 381410 - DNA, 25 bp, Mus musculus
ctgaggccgccagcaaagctgagca

SEQ ID NO: 381411 - DNA, 25 bp, Mus musculus
ctgaggccgtacctcatccacgatg

SEQ ID NO: 381412 - DNA, 25 bp, Mus musculus
ctgaggccgtacgtcatccacgatg

SEQ ID NO: 381413 - DNA, 25 bp, Mus musculus
ctgaggcctcatcaactttagcttt

SEQ ID NO: 381414 - DNA, 25 bp, Mus musculus
ctgaggcctcatgaactttagcttt

SEQ ID NO: 381415 - DNA, 25 bp, Mus musculus
ctgaggcctcggcttatggcaagtg

SEQ ID NO: 381416 - DNA, 25 bp, Mus musculus
ctgaggcctcgggttatggcaagtg

SEQ ID NO: 381417 - DNA, 25 bp, Mus musculus
ctgaggcctgtgcttgggctttaac

SEQ ID NO: 381418 - DNA, 25 bp, Mus musculus
ctgaggcctgtggttgggctttaac

SEQ ID NO: 381419 - DNA, 25 bp, Mus musculus
ctgaggccttgtaccagaaggagca

SEQ ID NO: 381420 - DNA, 25 bp, Mus musculus
ctgaggccttgttccagaaggagca

SEQ ID NO: 381421 - DNA, 25 bp, Mus musculus
ctgaggcgaacactgaggcaatcca

SEQ ID NO: 381422 - DNA, 25 bp, Mus musculus
ctgaggcgaacagtgaggcaatcca

SEQ ID NO: 381423 - DNA, 25 bp, Mus musculus
ctgaggcgggagatctgcatccaaa

SEQ ID NO: 381424 - DNA, 25 bp, Mus musculus
ctgaggcgggagttctgcatccaaa

SEQ ID NO: 381425 - DNA, 25 bp, Mus musculus
ctgaggctatttatatggctgtgat

SEQ ID NO: 381426 - DNA, 25 bp, Mus musculus
ctgaggctatttttatggctgtgat

SEQ ID NO: 381427 - DNA, 25 bp, Mus musculus
ctgaggctcccactgctgtgaactg

SEQ ID NO: 381428 - DNA, 25 bp, Mus musculus
ctgaggctcccagtgctgtgaactg

SEQ ID NO: 381429 - DNA, 25 bp, Mus musculus
ctgaggctcgcacgtctaagaccaa

SEQ ID NO: 381430 - DNA, 25 bp, Mus musculus
ctgaggctcgcaggtctaagaccaa

SEQ ID NO: 381431 - DNA, 25 bp, Mus musculus
ctgaggctctgaaatgacggcatgc

SEQ ID NO: 381432 - DNA, 25 bp, Mus musculus
ctgaggctctgatatgacggcatgc

SEQ ID NO: 381433 - DNA, 25 bp, Mus musculus
ctgaggctctggaaaccaagcggtt

SEQ ID NO: 381434 - DNA, 25 bp, Mus musculus
ctgaggctctggtaaccaagcggtt

SEQ ID NO: 381435 - DNA, 25 bp, Mus musculus
ctgaggctgacaaagttcgcaccat

SEQ ID NO: 381436 - DNA, 25 bp, Mus musculus
ctgaggctgacatagttcgcaccat

SEQ ID NO: 381437 - DNA, 25 bp, Mus musculus
ctgaggctgaccaaacaggaagggc

SEQ ID NO: 381438 - DNA, 25 bp, Mus musculus
ctgaggctgacctaacaggaagggc

SEQ ID NO: 381439 - DNA, 25 bp, Mus musculus
ctgaggctgcctatctactttcaaa

SEQ ID NO: 381440 - DNA, 25 bp, Mus musculus
ctgaggctgcctttctactttcaaa

SEQ ID NO: 381441 - DNA, 25 bp, Mus musculus
ctgaggctgtggagtgcttacagac

SEQ ID NO: 381442 - DNA, 25 bp, Mus musculus
ctgaggctgtggtgtgcttacagac

SEQ ID NO: 381443 - DNA, 25 bp, Mus musculus
ctgaggctgttccacgcattgttga

SEQ ID NO: 381444 - DNA, 25 bp, Mus musculus
ctgaggctgttcgacgcattgttga

SEQ ID NO: 381445 - DNA, 25 bp, Mus musculus
ctgaggctgttgaacattccacatt

SEQ ID NO: 381446 - DNA, 25 bp, Mus musculus
ctgaggctgttgtacattccacatt

SEQ ID NO: 381447 - DNA, 25 bp, Mus musculus
ctgaggcttactaacagtttttgtt

SEQ ID NO: 381448 - DNA, 25 bp, Mus musculus
ctgaggcttacttacagtttttgtt

SEQ ID NO: 381449 - DNA, 25 bp, Mus musculus
ctgaggcttcaacccctgcttggat

SEQ ID NO: 381450 - DNA, 25 bp, Mus musculus
ctgaggcttcaagccctgcttggat

SEQ ID NO: 381451 - DNA, 25 bp, Mus musculus
ctgaggcttctactccaggaggttg

SEQ ID NO: 381452 - DNA, 25 bp, Mus musculus
ctgaggcttctagtccaggaggttg

SEQ ID NO: 381453 - DNA, 25 bp, Mus musculus
ctgaggcttctgcactcttttataa

SEQ ID NO: 381454 - DNA, 25 bp, Mus musculus
ctgaggcttctggactcttttataa

SEQ ID NO: 381455 - DNA, 25 bp, Mus musculus
ctgaggcttgacactactgtgtacc

SEQ ID NO: 381456 - DNA, 25 bp, Mus musculus
ctgaggcttgactctactgtgtacc

SEQ ID NO: 381457 - DNA, 25 bp, Mus musculus
ctgaggcttgagctcacagcaggcc

SEQ ID NO: 381458 - DNA, 25 bp, Mus musculus
ctgaggcttgaggtcacagcaggcc

SEQ ID NO: 381459 - DNA, 25 bp, Mus musculus
ctgaggcttgtgcagctacgttctc

SEQ ID NO: 381460 - DNA, 25 bp, Mus musculus
ctgaggcttgtggagctacgttctc

SEQ ID NO: 381461 - DNA, 25 bp, Mus musculus
ctgaggctttgcaggctgtggtaat

SEQ ID NO: 381462 - DNA, 25 bp, Mus musculus
ctgaggctttgctggctgtggtaat

SEQ ID NO: 381463 - DNA, 25 bp, Mus musculus
ctgaggctttttcccacacctttat

SEQ ID NO: 381464 - DNA, 25 bp, Mus musculus
ctgaggctttttgccacacctttat

SEQ ID NO: 381465 - DNA, 25 bp, Mus musculus
ctgagggaaccactcacacaacaca

SEQ ID NO: 381466 - DNA, 25 bp, Mus musculus
ctgagggaaccagtcacacaacaca

SEQ ID NO: 381467 - DNA, 25 bp, Mus musculus
ctgagggaagccaagggaccatcct

SEQ ID NO: 381468 - DNA, 25 bp, Mus musculus
ctgagggaagcctagggaccatcct

SEQ ID NO: 381469 - DNA, 25 bp, Mus musculus
ctgagggactacacagggcgcagca

SEQ ID NO: 381470 - DNA, 25 bp, Mus musculus
ctgagggactactcagggcgcagca

SEQ ID NO: 381471 - DNA, 25 bp, Mus musculus
ctgagggacttgaccgcccatcgtg

SEQ ID NO: 381472 - DNA, 25 bp, Mus musculus
ctgagggacttgtccgcccatcgtg

SEQ ID NO: 381473 - DNA, 25 bp, Mus musculus
ctgagggagaagcacctggctctct

SEQ ID NO: 381474 - DNA, 25 bp, Mus musculus
ctgagggagaaggacctggctctct

SEQ ID NO: 381475 - DNA, 25 bp, Mus musculus
ctgagggagcaaatacttaaccaaa

SEQ ID NO: 381476 - DNA, 25 bp, Mus musculus
ctgagggagcaattacttaaccaaa

SEQ ID NO: 381477 - DNA, 25 bp, Mus musculus
ctgagggagcatatacttccttaat

SEQ ID NO: 381478 - DNA, 25 bp, Mus musculus
ctgagggagcatttacttccttaat

SEQ ID NO: 381479 - DNA, 25 bp, Mus musculus
ctgagggattcaaagcatgcatgta

SEQ ID NO: 381480 - DNA, 25 bp, Mus musculus
ctgagggattcatagcatgcatgta

SEQ ID NO: 381481 - DNA, 25 bp, Mus musculus
ctgagggcaagcatccgtgttgata

SEQ ID NO: 381482 - DNA, 25 bp, Mus musculus
ctgagggcaagcttccgtgttgata

SEQ ID NO: 381483 - DNA, 25 bp, Mus musculus
ctgagggcagatcattgttcttgta

SEQ ID NO: 381484 - DNA, 25 bp, Mus musculus
ctgagggcagatctacataccgtgt

SEQ ID NO: 381485 - DNA, 25 bp, Mus musculus
ctgagggcagatgattgttcttgta

SEQ ID NO: 381486 - DNA, 25 bp, Mus musculus
ctgagggcagatgtacataccgtgt

SEQ ID NO: 381487 - DNA, 25 bp, Mus musculus
ctgagggcagggaccagcacagcca

SEQ ID NO: 381488 - DNA, 25 bp, Mus musculus
ctgagggcagggtccagcacagcca

SEQ ID NO: 381489 - DNA, 25 bp, Mus musculus
ctgagggcatttaaacacatggatt

SEQ ID NO: 381490 - DNA, 25 bp, Mus musculus
ctgagggcattttaacacatggatt

SEQ ID NO: 381491 - DNA, 25 bp, Mus musculus
ctgagggcccagacatattataaaa

SEQ ID NO: 381492 - DNA, 25 bp, Mus musculus
ctgagggcccagtcatattataaaa

SEQ ID NO: 381493 - DNA, 25 bp, Mus musculus
ctgagggcggccaggtgatctacat

SEQ ID NO: 381494 - DNA, 25 bp, Mus musculus
ctgagggcggcctggtgatctacat

SEQ ID NO: 381495 - DNA, 25 bp, Mus musculus
ctgagggcttttacaccaagtggtg

SEQ ID NO: 381496 - DNA, 25 bp, Mus musculus
ctgagggctttttcaccaagtggtg

SEQ ID NO: 381497 - DNA, 25 bp, Mus musculus
ctgaggggacatcatatgatcctgg

SEQ ID NO: 381498 - DNA, 25 bp, Mus musculus
ctgaggggacatgatatgatcctgg

SEQ ID NO: 381499 - DNA, 25 bp, Mus musculus
ctgagggtacgcccttttccagcgg

SEQ ID NO: 381500 - DNA, 25 bp, Mus musculus
ctgagggtacgcgcttttccagcgg

SEQ ID NO: 381501 - DNA, 25 bp, Mus musculus
ctgagggtcagtacattgatagcaa

SEQ ID NO: 381502 - DNA, 25 bp, Mus musculus
ctgagggtcagttcattgatagcaa

SEQ ID NO: 381503 - DNA, 25 bp, Mus musculus
ctgagggtcgcaactctgaccggga

SEQ ID NO: 381504 - DNA, 25 bp, Mus musculus
ctgagggtcgcatctctgaccggga

SEQ ID NO: 381505 - DNA, 25 bp, Mus musculus
ctgagggtcggtctattggactcac

SEQ ID NO: 381506 - DNA, 25 bp, Mus musculus
ctgagggtcggtgtattggactcac

SEQ ID NO: 381507 - DNA, 25 bp, Mus musculus
ctgagggtctgtaggttcaaactat

SEQ ID NO: 381508 - DNA, 25 bp, Mus musculus
ctgagggtctgttggttcaaactat

SEQ ID NO: 381509 - DNA, 25 bp, Mus musculus
ctgagggtgagccactcctgtactg

SEQ ID NO: 381510 - DNA, 25 bp, Mus musculus
ctgagggtgagcgactcctgtactg

SEQ ID NO: 381511 - DNA, 25 bp, Mus musculus
ctgagggtgctgaactagattaggt

SEQ ID NO: 381512 - DNA, 25 bp, Mus musculus
ctgagggtgctgtactagattaggt

SEQ ID NO: 381513 - DNA, 25 bp, Mus musculus
ctgagggtggggactgggcttcttc

SEQ ID NO: 381514 - DNA, 25 bp, Mus musculus
ctgagggtggggtctgggcttcttc

SEQ ID NO: 381515 - DNA, 25 bp, Mus musculus
ctgagggttctcactcctgctagca

SEQ ID NO: 381516 - DNA, 25 bp, Mus musculus
ctgagggttctctctcctgctagca

SEQ ID NO: 381517 - DNA, 25 bp, Mus musculus
ctgagggttggcacttccaggaaaa

SEQ ID NO: 381518 - DNA, 25 bp, Mus musculus
ctgagggttggctcttccaggaaaa

SEQ ID NO: 381519 - DNA, 25 bp, Mus musculus
ctgagggtttgcagatctgggtaat

SEQ ID NO: 381520 - DNA, 25 bp, Mus musculus
ctgagggtttgctgatctgggtaat

SEQ ID NO: 381521 - DNA, 25 bp, Mus musculus
ctgaggtaccgcagtgtttgtatca

SEQ ID NO: 381522 - DNA, 25 bp, Mus musculus
ctgaggtaccgctgtgtttgtatca

SEQ ID NO: 381523 - DNA, 25 bp, Mus musculus
ctgaggtagcatatggcattggaaa

SEQ ID NO: 381524 - DNA, 25 bp, Mus musculus
ctgaggtagcatttggcattggaaa

SEQ ID NO: 381525 - DNA, 25 bp, Mus musculus
ctgaggtagctgatgttactcctgt

SEQ ID NO: 381526 - DNA, 25 bp, Mus musculus
ctgaggtagctgttgttactcctgt

SEQ ID NO: 381527 - DNA, 25 bp, Mus musculus
ctgaggtaggttagatggcccctgc

SEQ ID NO: 381528 - DNA, 25 bp, Mus musculus
ctgaggtaggtttgatggcccctgc

SEQ ID NO: 381529 - DNA, 25 bp, Mus musculus
ctgaggtatgagctgtgaaccacaa

SEQ ID NO: 381530 - DNA, 25 bp, Mus musculus
ctgaggtatgaggtgtgaaccacaa

SEQ ID NO: 381531 - DNA, 25 bp, Mus musculus
ctgaggtcacagcatcagaagttca

SEQ ID NO: 381532 - DNA, 25 bp, Mus musculus
ctgaggtcacaggatcagaagttca

SEQ ID NO: 381533 - DNA, 25 bp, Mus musculus
ctgaggtcagcaagccagtggttct

SEQ ID NO: 381534 - DNA, 25 bp, Mus musculus
ctgaggtcagcatgccagtggttct

SEQ ID NO: 381535 - DNA, 25 bp, Mus musculus
ctgaggtcctttcatgtttatctat

SEQ ID NO: 381536 - DNA, 25 bp, Mus musculus
ctgaggtcctttgatgtttatctat

SEQ ID NO: 381537 - DNA, 25 bp, Mus musculus
ctgaggtctcttactaggtgcacag

SEQ ID NO: 381538 - DNA, 25 bp, Mus musculus
ctgaggtctctttctaggtgcacag

SEQ ID NO: 381539 - DNA, 25 bp, Mus musculus
ctgaggtgatccagcagggcacagt

SEQ ID NO: 381540 - DNA, 25 bp, Mus musculus
ctgaggtgatcctgcagggcacagt

SEQ ID NO: 381541 - DNA, 25 bp, Mus musculus
ctgaggtggcccagtagggattacc

SEQ ID NO: 381542 - DNA, 25 bp, Mus musculus
ctgaggtggccctgtagggattacc

SEQ ID NO: 381543 - DNA, 25 bp, Mus musculus
ctgaggtgggtcctaggtactccat

SEQ ID NO: 381544 - DNA, 25 bp, Mus musculus
ctgaggtgggtcgtaggtactccat

SEQ ID NO: 381545 - DNA, 25 bp, Mus musculus
ctgaggtgtgctccccattctagtg

SEQ ID NO: 381546 - DNA, 25 bp, Mus musculus
ctgaggtgtgctgcccattctagtg

SEQ ID NO: 381547 - DNA, 25 bp, Mus musculus
ctgaggtgtggcacagaggacactt

SEQ ID NO: 381548 - DNA, 25 bp, Mus musculus
ctgaggtgtggctcagaggacactt

SEQ ID NO: 381549 - DNA, 25 bp, Mus musculus
ctgaggtgtgggatccagtgcaatt

SEQ ID NO: 381550 - DNA, 25 bp, Mus musculus
ctgaggtgtgggttccagtgcaatt

SEQ ID NO: 381551 - DNA, 25 bp, Mus musculus
ctgaggttaaagcagccgcacgtta

SEQ ID NO: 381552 - DNA, 25 bp, Mus musculus
ctgaggttaaaggagccgcacgtta

SEQ ID NO: 381553 - DNA, 25 bp, Mus musculus
ctgaggttacttccattgttgctac

SEQ ID NO: 381554 - DNA, 25 bp, Mus musculus
ctgaggttacttgcattgttgctac

SEQ ID NO: 381555 - DNA, 25 bp, Mus musculus
ctgaggttatagacttactcctttt

SEQ ID NO: 381556 - DNA, 25 bp, Mus musculus
ctgaggttatagtcttactcctttt

SEQ ID NO: 381557 - DNA, 25 bp, Mus musculus
ctgaggttattgagaatgaccataa

SEQ ID NO: 381558 - DNA, 25 bp, Mus musculus
ctgaggttattgcactgccaccaag

SEQ ID NO: 381559 - DNA, 25 bp, Mus musculus
ctgaggttattggactgccaccaag

SEQ ID NO: 381560 - DNA, 25 bp, Mus musculus
ctgaggttattgtgaatgaccataa

SEQ ID NO: 381561 - DNA, 25 bp, Mus musculus
ctgaggttcctaaggccagaggcat

SEQ ID NO: 381562 - DNA, 25 bp, Mus musculus
ctgaggttcctatggccagaggcat

SEQ ID NO: 381563 - DNA, 25 bp, Mus musculus
ctgaggttcctgaggagggctcaaa

SEQ ID NO: 381564 - DNA, 25 bp, Mus musculus
ctgaggttcctgtggagggctcaaa

SEQ ID NO: 381565 - DNA, 25 bp, Mus musculus
ctgaggttggtacattgctgtcgcc

SEQ ID NO: 381566 - DNA, 25 bp, Mus musculus
ctgaggttggtagattgctgtcgcc

SEQ ID NO: 381567 - DNA, 25 bp, Mus musculus
ctgaggttggtgacattggttatct

SEQ ID NO: 381568 - DNA, 25 bp, Mus musculus
ctgaggttggtgtcattggttatct

SEQ ID NO: 381569 - DNA, 25 bp, Mus musculus
ctgaggtttaggctgttgtgaccac

SEQ ID NO: 381570 - DNA, 25 bp, Mus musculus
ctgaggtttagggtgttgtgaccac

SEQ ID NO: 381571 - DNA, 25 bp, Mus musculus
ctgaggtttataatgagaatccttt

SEQ ID NO: 381572 - DNA, 25 bp, Mus musculus
ctgaggtttatattgagaatccttt

SEQ ID NO: 381573 - DNA, 25 bp, Mus musculus
ctgagtaatgctctcccagtggtgt

SEQ ID NO: 381574 - DNA, 25 bp, Mus musculus
ctgagtaatgctgtcccagtggtgt

SEQ ID NO: 381575 - DNA, 25 bp, Mus musculus
ctgagtacacaaagcaccccgcttt

SEQ ID NO: 381576 - DNA, 25 bp, Mus musculus
ctgagtacacaatgcaccccgcttt

SEQ ID NO: 381577 - DNA, 25 bp, Mus musculus
ctgagtaccaagactcagcagcaag

SEQ ID NO: 381578 - DNA, 25 bp, Mus musculus
ctgagtaccaagtctcagcagcaag

SEQ ID NO: 381579 - DNA, 25 bp, Mus musculus
ctgagtaccaccagtttgcaactta

SEQ ID NO: 381580 - DNA, 25 bp, Mus musculus
ctgagtaccacctgtttgcaactta

SEQ ID NO: 381581 - DNA, 25 bp, Mus musculus
ctgagtacgccacgtggaaccgaga

SEQ ID NO: 381582 - DNA, 25 bp, Mus musculus
ctgagtacgccaggtggaaccgaga

SEQ ID NO: 381583 - DNA, 25 bp, Mus musculus
ctgagtactcataacctagctaaga

SEQ ID NO: 381584 - DNA, 25 bp, Mus musculus
ctgagtactcattacctagctaaga

SEQ ID NO: 381585 - DNA, 25 bp, Mus musculus
ctgagtactgttacaggctggcttc

SEQ ID NO: 381586 - DNA, 25 bp, Mus musculus
ctgagtactgtttcaggctggcttc

SEQ ID NO: 381587 - DNA, 25 bp, Mus musculus
ctgagtagcgcacatctgtcatctc

SEQ ID NO: 381588 - DNA, 25 bp, Mus musculus
ctgagtagcgcagatctgtcatctc

SEQ ID NO: 381589 - DNA, 25 bp, Mus musculus
ctgagtagctacaggtgatcaccct

SEQ ID NO: 381590 - DNA, 25 bp, Mus musculus
ctgagtagctactggtgatcaccct

SEQ ID NO: 381591 - DNA, 25 bp, Mus musculus
ctgagtagctcactgactatcacta

SEQ ID NO: 381592 - DNA, 25 bp, Mus musculus
ctgagtagctcagtgactatcacta

SEQ ID NO: 381593 - DNA, 25 bp, Mus musculus
ctgagtaggcagattgtgtaacccc

SEQ ID NO: 381594 - DNA, 25 bp, Mus musculus
ctgagtaggcagtttgtgtaacccc

SEQ ID NO: 381595 - DNA, 25 bp, Mus musculus
ctgagtagtcagctgcatttttaag

SEQ ID NO: 381596 - DNA, 25 bp, Mus musculus
ctgagtagtcaggtgcatttttaag

SEQ ID NO: 381597 - DNA, 25 bp, Mus musculus
ctgagtataacaacttctgggtgga

SEQ ID NO: 381598 - DNA, 25 bp, Mus musculus
ctgagtataacatcttctgggtgga

SEQ ID NO: 381599 - DNA, 25 bp, Mus musculus
ctgagtatagcaacgaaggtcaagg

SEQ ID NO: 381600 - DNA, 25 bp, Mus musculus
ctgagtatagcatcgaaggtcaagg

SEQ ID NO: 381601 - DNA, 25 bp, Mus musculus
ctgagtatgtcgaggagtctactgg

SEQ ID NO: 381602 - DNA, 25 bp, Mus musculus
ctgagtatgtcgtggagtctactgg

SEQ ID NO: 381603 - DNA, 25 bp, Mus musculus
ctgagtatttggcacatgatggctt

SEQ ID NO: 381604 - DNA, 25 bp, Mus musculus
ctgagtatttgggacatgatggctt

SEQ ID NO: 381605 - DNA, 25 bp, Mus musculus
ctgagtatttttaagagagttcata

SEQ ID NO: 381606 - DNA, 25 bp, Mus musculus
ctgagtattttttagagagttcata

SEQ ID NO: 381607 - DNA, 25 bp, Mus musculus
ctgagtcaacacaggactcttgttg

SEQ ID NO: 381608 - DNA, 25 bp, Mus musculus
ctgagtcaacactggactcttgttg

SEQ ID NO: 381609 - DNA, 25 bp, Mus musculus
ctgagtcacaaaaccttggagccac

SEQ ID NO: 381610 - DNA, 25 bp, Mus musculus
ctgagtcacaaatccttggagccac

SEQ ID NO: 381611 - DNA, 25 bp, Mus musculus
ctgagtcaccctccagtggacaaaa

SEQ ID NO: 381612 - DNA, 25 bp, Mus musculus
ctgagtcaccctgcagtggacaaaa

SEQ ID NO: 381613 - DNA, 25 bp, Mus musculus
ctgagtcactagcagctccaggaag

SEQ ID NO: 381614 - DNA, 25 bp, Mus musculus
ctgagtcactaggagctccaggaag

SEQ ID NO: 381615 - DNA, 25 bp, Mus musculus
ctgagtcactggagccctattacac

SEQ ID NO: 381616 - DNA, 25 bp, Mus musculus
ctgagtcactggtgccctattacac

SEQ ID NO: 381617 - DNA, 25 bp, Mus musculus
ctgagtcagaccataggaaataccc

SEQ ID NO: 381618 - DNA, 25 bp, Mus musculus
ctgagtcagaccttaggaaataccc

SEQ ID NO: 381619 - DNA, 25 bp, Mus musculus
ctgagtcaggttaccagtactgcct

SEQ ID NO: 381620 - DNA, 25 bp, Mus musculus
ctgagtcaggtttccagtactgcct

SEQ ID NO: 381621 - DNA, 25 bp, Mus musculus
ctgagtccagggagagttgtgcacc

SEQ ID NO: 381622 - DNA, 25 bp, Mus musculus
ctgagtccagggtgagttgtgcacc

SEQ ID NO: 381623 - DNA, 25 bp, Mus musculus
ctgagtccagtgatagtcgagtcct

SEQ ID NO: 381624 - DNA, 25 bp, Mus musculus
ctgagtccagtgttagtcgagtcct

SEQ ID NO: 381625 - DNA, 25 bp, Mus musculus
ctgagtccccagaagaactgagggt

SEQ ID NO: 381626 - DNA, 25 bp, Mus musculus
ctgagtccccagtagaactgagggt

SEQ ID NO: 381627 - DNA, 25 bp, Mus musculus
ctgagtcccctgaccagtggtccag

SEQ ID NO: 381628 - DNA, 25 bp, Mus musculus
ctgagtcccctgtccagtggtccag

SEQ ID NO: 381629 - DNA, 25 bp, Mus musculus
ctgagtccgggcctaataagaagtg

SEQ ID NO: 381630 - DNA, 25 bp, Mus musculus
ctgagtccgggcgtaataagaagtg

SEQ ID NO: 381631 - DNA, 25 bp, Mus musculus
ctgagtcctaaaacatcccatgaaa

SEQ ID NO: 381632 - DNA, 25 bp, Mus musculus
ctgagtcctaaatcatcccatgaaa

SEQ ID NO: 381633 - DNA, 25 bp, Mus musculus
ctgagtcctatgattgacggcggat

SEQ ID NO: 381634 - DNA, 25 bp, Mus musculus
ctgagtcctatgtttgacggcggat

SEQ ID NO: 381635 - DNA, 25 bp, Mus musculus
ctgagtcctgccctgagagtaagga

SEQ ID NO: 381636 - DNA, 25 bp, Mus musculus
ctgagtcctgccgtgagagtaagga

SEQ ID NO: 381637 - DNA, 25 bp, Mus musculus
ctgagtcctgttataatgtggtgct

SEQ ID NO: 381638 - DNA, 25 bp, Mus musculus
ctgagtcctgttttaatgtggtgct

SEQ ID NO: 381639 - DNA, 25 bp, Mus musculus
ctgagtccttggatgccgagaagca

SEQ ID NO: 381640 - DNA, 25 bp, Mus musculus
ctgagtccttggttgccgagaagca

SEQ ID NO: 381641 - DNA, 25 bp, Mus musculus
ctgagtccttttacactggctcttt

SEQ ID NO: 381642 - DNA, 25 bp, Mus musculus
ctgagtcctttttcactggctcttt

SEQ ID NO: 381643 - DNA, 25 bp, Mus musculus
ctgagtcggaggctagcttgtacta

SEQ ID NO: 381644 - DNA, 25 bp, Mus musculus
ctgagtcggagggtagcttgtacta

SEQ ID NO: 381645 - DNA, 25 bp, Mus musculus
ctgagtctcaggatgctacaagtat

SEQ ID NO: 381646 - DNA, 25 bp, Mus musculus
ctgagtctcaggttgctacaagtat

SEQ ID NO: 381647 - DNA, 25 bp, Mus musculus
ctgagtctctgcctgtgaagggctt

SEQ ID NO: 381648 - DNA, 25 bp, Mus musculus
ctgagtctctgcgtgtgaagggctt

SEQ ID NO: 381649 - DNA, 25 bp, Mus musculus
ctgagtctgattccgtactcctgcc

SEQ ID NO: 381650 - DNA, 25 bp, Mus musculus
ctgagtctgattgcgtactcctgcc

SEQ ID NO: 381651 - DNA, 25 bp, Mus musculus
ctgagtctgcctaattttggttaat

SEQ ID NO: 381652 - DNA, 25 bp, Mus musculus
ctgagtctgccttattttggttaat

SEQ ID NO: 381653 - DNA, 25 bp, Mus musculus
ctgagtcttctgataccaaggtaat

SEQ ID NO: 381654 - DNA, 25 bp, Mus musculus
ctgagtcttctgttaccaaggtaat

SEQ ID NO: 381655 - DNA, 25 bp, Mus musculus
ctgagtgacaggaagaacttgaccc

SEQ ID NO: 381656 - DNA, 25 bp, Mus musculus
ctgagtgacaggtagaacttgaccc

SEQ ID NO: 381657 - DNA, 25 bp, Mus musculus
ctgagtgaccctatcctagaaacaa

SEQ ID NO: 381658 - DNA, 25 bp, Mus musculus
ctgagtgaccctttcctagaaacaa

SEQ ID NO: 381659 - DNA, 25 bp, Mus musculus
ctgagtgactgaaagtgatccttac

SEQ ID NO: 381660 - DNA, 25 bp, Mus musculus
ctgagtgactgatagtgatccttac

SEQ ID NO: 381661 - DNA, 25 bp, Mus musculus
ctgagtgagctgcactttctgggaa

SEQ ID NO: 381662 - DNA, 25 bp, Mus musculus
ctgagtgagctggactttctgggaa

SEQ ID NO: 381663 - DNA, 25 bp, Mus musculus
ctgagtgagtcaagcatgatgcagt

SEQ ID NO: 381664 - DNA, 25 bp, Mus musculus
ctgagtgagtcatgcatgatgcagt

SEQ ID NO: 381665 - DNA, 25 bp, Mus musculus
ctgagtgagtgtcttaggcgtttcc

SEQ ID NO: 381666 - DNA, 25 bp, Mus musculus
ctgagtgagtgtgttaggcgtttcc

SEQ ID NO: 381667 - DNA, 25 bp, Mus musculus
ctgagtgatctgactgtaacatagt

SEQ ID NO: 381668 - DNA, 25 bp, Mus musculus
ctgagtgatctgtctgtaacatagt

SEQ ID NO: 381669 - DNA, 25 bp, Mus musculus
ctgagtgatggcctgtcttgaacaa

SEQ ID NO: 381670 - DNA, 25 bp, Mus musculus
ctgagtgatggcgtgtcttgaacaa

SEQ ID NO: 381671 - DNA, 25 bp, Mus musculus
ctgagtgccagtagctttcagcatc

SEQ ID NO: 381672 - DNA, 25 bp, Mus musculus
ctgagtgccagttgctttcagcatc

SEQ ID NO: 381673 - DNA, 25 bp, Mus musculus
ctgagtgcccggatctttggtgaag

SEQ ID NO: 381674 - DNA, 25 bp, Mus musculus
ctgagtgcccggttctttggtgaag

SEQ ID NO: 381675 - DNA, 25 bp, Mus musculus
ctgagtgccgacaagctttactgaa

SEQ ID NO: 381676 - DNA, 25 bp, Mus musculus
ctgagtgccgactagctttactgaa

SEQ ID NO: 381677 - DNA, 25 bp, Mus musculus
ctgagtgctaagcaagggtgtaacc

SEQ ID NO: 381678 - DNA, 25 bp, Mus musculus
ctgagtgctaaggaagggtgtaacc

SEQ ID NO: 381679 - DNA, 25 bp, Mus musculus
ctgagtgctagacctatttaccgct

SEQ ID NO: 381680 - DNA, 25 bp, Mus musculus
ctgagtgctagagctatttaccgct

SEQ ID NO: 381681 - DNA, 25 bp, Mus musculus
ctgagtgctcccagctggataatgg

SEQ ID NO: 381682 - DNA, 25 bp, Mus musculus
ctgagtgctccctgctggataatgg

SEQ ID NO: 381683 - DNA, 25 bp, Mus musculus
ctgagtgctgggatacccagtgtgc

SEQ ID NO: 381684 - DNA, 25 bp, Mus musculus
ctgagtgctgggattctctgcagat

SEQ ID NO: 381685 - DNA, 25 bp, Mus musculus
ctgagtgctgggttacccagtgtgc

SEQ ID NO: 381686 - DNA, 25 bp, Mus musculus
ctgagtgctgggtttctctgcagat

SEQ ID NO: 381687 - DNA, 25 bp, Mus musculus
ctgagtgctgtgcttctctgtgcag

SEQ ID NO: 381688 - DNA, 25 bp, Mus musculus
ctgagtgctgtggttctctgtgcag

SEQ ID NO: 381689 - DNA, 25 bp, Mus musculus
ctgagtgcttctcgcaaaccatcaa

SEQ ID NO: 381690 - DNA, 25 bp, Mus musculus
ctgagtgcttctggcaaaccatcaa

SEQ ID NO: 381691 - DNA, 25 bp, Mus musculus
ctgagtggagcaccggtcatcatct

SEQ ID NO: 381692 - DNA, 25 bp, Mus musculus
ctgagtggagcagcggtcatcatct

SEQ ID NO: 381693 - DNA, 25 bp, Mus musculus
ctgagtggcattaattcagtgtatt

SEQ ID NO: 381694 - DNA, 25 bp, Mus musculus
ctgagtggcattatgtgcttcctga

SEQ ID NO: 381695 - DNA, 25 bp, Mus musculus
ctgagtggcatttattcagtgtatt

SEQ ID NO: 381696 - DNA, 25 bp, Mus musculus
ctgagtggcattttgtgcttcctga

SEQ ID NO: 381697 - DNA, 25 bp, Mus musculus
ctgagtggctggcactttatctgaa

SEQ ID NO: 381698 - DNA, 25 bp, Mus musculus
ctgagtggctgggactttatctgaa

SEQ ID NO: 381699 - DNA, 25 bp, Mus musculus
ctgagtggtcacaaactggtaacaa

SEQ ID NO: 381700 - DNA, 25 bp, Mus musculus
ctgagtggtcactaactggtaacaa

SEQ ID NO: 381701 - DNA, 25 bp, Mus musculus
ctgagtggtcctcagctgctgtgca

SEQ ID NO: 381702 - DNA, 25 bp, Mus musculus
ctgagtggtcctgagctgctgtgca

SEQ ID NO: 381703 - DNA, 25 bp, Mus musculus
ctgagtggttcacctgcgtctggtc

SEQ ID NO: 381704 - DNA, 25 bp, Mus musculus
ctgagtggttcagctgcgtctggtc

SEQ ID NO: 381705 - DNA, 25 bp, Mus musculus
ctgagtggtttactgagctctgcca

SEQ ID NO: 381706 - DNA, 25 bp, Mus musculus
ctgagtggtttagtgagctctgcca

SEQ ID NO: 381707 - DNA, 25 bp, Mus musculus
ctgagtggttttcaatggcatggct

SEQ ID NO: 381708 - DNA, 25 bp, Mus musculus
ctgagtggttttgaatggcatggct

SEQ ID NO: 381709 - DNA, 25 bp, Mus musculus
ctgagtgtcatgaccagtcctgagt

SEQ ID NO: 381710 - DNA, 25 bp, Mus musculus
ctgagtgtcatgtccagtcctgagt

SEQ ID NO: 381711 - DNA, 25 bp, Mus musculus
ctgagtgtggccatactatggaagt

SEQ ID NO: 381712 - DNA, 25 bp, Mus musculus
ctgagtgtggccttactatggaagt

SEQ ID NO: 381713 - DNA, 25 bp, Mus musculus
ctgagtgttcagacaatgcaagcaa

SEQ ID NO: 381714 - DNA, 25 bp, Mus musculus
ctgagtgttcagtcaatgcaagcaa

SEQ ID NO: 381715 - DNA, 25 bp, Mus musculus
ctgagtgttcggagaacccctgtat

SEQ ID NO: 381716 - DNA, 25 bp, Mus musculus
ctgagtgttcggtgaacccctgtat

SEQ ID NO: 381717 - DNA, 25 bp, Mus musculus
ctgagtgttcttctgagctttaggc

SEQ ID NO: 381718 - DNA, 25 bp, Mus musculus
ctgagtgttcttgtgagctttaggc

SEQ ID NO: 381719 - DNA, 25 bp, Mus musculus
ctgagtgttgaacccgtgcatccct

SEQ ID NO: 381720 - DNA, 25 bp, Mus musculus
ctgagtgttgaagccgtgcatccct

SEQ ID NO: 381721 - DNA, 25 bp, Mus musculus
ctgagtgttgtactcgcaaaacaag

SEQ ID NO: 381722 - DNA, 25 bp, Mus musculus
ctgagtgttgtacttctcatgtgaa

SEQ ID NO: 381723 - DNA, 25 bp, Mus musculus
ctgagtgttgtagtcgcaaaacaag

SEQ ID NO: 381724 - DNA, 25 bp, Mus musculus
ctgagtgttgtagttctcatgtgaa

SEQ ID NO: 381725 - DNA, 25 bp, Mus musculus
ctgagtgtttatcttcttgcctgaa

SEQ ID NO: 381726 - DNA, 25 bp, Mus musculus
ctgagtgtttatgttcttgcctgaa

SEQ ID NO: 381727 - DNA, 25 bp, Mus musculus
ctgagttaagaccacatccctgata

SEQ ID NO: 381728 - DNA, 25 bp, Mus musculus
ctgagttaagacgacatccctgata

SEQ ID NO: 381729 - DNA, 25 bp, Mus musculus
ctgagttacaacattagagctattt

SEQ ID NO: 381730 - DNA, 25 bp, Mus musculus
ctgagttacaactttagagctattt

SEQ ID NO: 381731 - DNA, 25 bp, Mus musculus
ctgagttacagcagaaccctttagt

SEQ ID NO: 381732 - DNA, 25 bp, Mus musculus
ctgagttacagctgaaccctttagt

SEQ ID NO: 381733 - DNA, 25 bp, Mus musculus
ctgagttacggtaaaaggagcagga

SEQ ID NO: 381734 - DNA, 25 bp, Mus musculus
ctgagttacggttaaaggagcagga

SEQ ID NO: 381735 - DNA, 25 bp, Mus musculus
ctgagttagcttcggcaattacgtt

SEQ ID NO: 381736 - DNA, 25 bp, Mus musculus
ctgagttagcttgggcaattacgtt

SEQ ID NO: 381737 - DNA, 25 bp, Mus musculus
ctgagttagggtcctagcacacatg

SEQ ID NO: 381738 - DNA, 25 bp, Mus musculus
ctgagttagggtgctagcacacatg

SEQ ID NO: 381739 - DNA, 25 bp, Mus musculus
ctgagttagtggagcttctgtccaa

SEQ ID NO: 381740 - DNA, 25 bp, Mus musculus
ctgagttagtggtgcttctgtccaa

SEQ ID NO: 381741 - DNA, 25 bp, Mus musculus
ctgagttagttcacctaaggacact

SEQ ID NO: 381742 - DNA, 25 bp, Mus musculus
ctgagttagttctcctaaggacact

SEQ ID NO: 381743 - DNA, 25 bp, Mus musculus
ctgagttcaacgctaacctgtgcta

SEQ ID NO: 381744 - DNA, 25 bp, Mus musculus
ctgagttcaacggtaacctgtgcta

SEQ ID NO: 381745 - DNA, 25 bp, Mus musculus
ctgagttcaataactgatgttgcaa

SEQ ID NO: 381746 - DNA, 25 bp, Mus musculus
ctgagttcaatatctgatgttgcaa

SEQ ID NO: 381747 - DNA, 25 bp, Mus musculus
ctgagttcatcacggctctgacctc

SEQ ID NO: 381748 - DNA, 25 bp, Mus musculus
ctgagttcatcagggctctgacctc

SEQ ID NO: 381749 - DNA, 25 bp, Mus musculus
ctgagttcattcatggaaccaacat

SEQ ID NO: 381750 - DNA, 25 bp, Mus musculus
ctgagttcattcttggaaccaacat

SEQ ID NO: 381751 - DNA, 25 bp, Mus musculus
ctgagttccactcagttcctaagca

SEQ ID NO: 381752 - DNA, 25 bp, Mus musculus
ctgagttccactgagttcctaagca

SEQ ID NO: 381753 - DNA, 25 bp, Mus musculus
ctgagttcctgcctaagggagagaa

SEQ ID NO: 381754 - DNA, 25 bp, Mus musculus
ctgagttcctgcgtaagggagagaa

SEQ ID NO: 381755 - DNA, 25 bp, Mus musculus
ctgagttgaactaggactggcacat

SEQ ID NO: 381756 - DNA, 25 bp, Mus musculus
ctgagttgaacttggactggcacat

SEQ ID NO: 381757 - DNA, 25 bp, Mus musculus
ctgagttgcccacgttatccttgaa

SEQ ID NO: 381758 - DNA, 25 bp, Mus musculus
ctgagttgcccaggttatccttgaa

SEQ ID NO: 381759 - DNA, 25 bp, Mus musculus
ctgagttgctaccatcaaattggaa

SEQ ID NO: 381760 - DNA, 25 bp, Mus musculus
ctgagttgctacgatcaaattggaa

SEQ ID NO: 381761 - DNA, 25 bp, Mus musculus
ctgagttggtgcacacacttgttta

SEQ ID NO: 381762 - DNA, 25 bp, Mus musculus
ctgagttggtgctcacacttgttta

SEQ ID NO: 381763 - DNA, 25 bp, Mus musculus
ctgagttgtttcaatttaggccaag

SEQ ID NO: 381764 - DNA, 25 bp, Mus musculus
ctgagttgtttctatttaggccaag

SEQ ID NO: 381765 - DNA, 25 bp, Mus musculus
ctgagtttagaacacctattacaaa

SEQ ID NO: 381766 - DNA, 25 bp, Mus musculus
ctgagtttagaagacctattacaaa

SEQ ID NO: 381767 - DNA, 25 bp, Mus musculus
ctgagtttagacagctccgaagcct

SEQ ID NO: 381768 - DNA, 25 bp, Mus musculus
ctgagtttagactgctccgaagcct

SEQ ID NO: 381769 - DNA, 25 bp, Mus musculus
ctgagtttatctaggcctgagggca

SEQ ID NO: 381770 - DNA, 25 bp, Mus musculus
ctgagtttatcttggcctgagggca

SEQ ID NO: 381771 - DNA, 25 bp, Mus musculus
ctgagtttcttaattagtgtcctag

SEQ ID NO: 381772 - DNA, 25 bp, Mus musculus
ctgagtttcttatttagtgtcctag

SEQ ID NO: 381773 - DNA, 25 bp, Mus musculus
ctgagtttgactactgaccttgata

SEQ ID NO: 381774 - DNA, 25 bp, Mus musculus
ctgagtttgacttctgaccttgata

SEQ ID NO: 381775 - DNA, 25 bp, Mus musculus
ctgagtttgagtcagcctccaggct

SEQ ID NO: 381776 - DNA, 25 bp, Mus musculus
ctgagtttgagtgagcctccaggct

SEQ ID NO: 381777 - DNA, 25 bp, Mus musculus
ctgagtttgcagcacattggccata

SEQ ID NO: 381778 - DNA, 25 bp, Mus musculus
ctgagtttgcaggacattggccata

SEQ ID NO: 381779 - DNA, 25 bp, Mus musculus
ctgagtttgcatatatgacttgtaa

SEQ ID NO: 381780 - DNA, 25 bp, Mus musculus
ctgagtttgcatttatgacttgtaa

SEQ ID NO: 381781 - DNA, 25 bp, Mus musculus
ctgagtttgctcatgggtgtaattt

SEQ ID NO: 381782 - DNA, 25 bp, Mus musculus
ctgagtttgctcttgggtgtaattt

SEQ ID NO: 381783 - DNA, 25 bp, Mus musculus
ctgagtttggcaaggcctgcaatgt

SEQ ID NO: 381784 - DNA, 25 bp, Mus musculus
ctgagtttggcatggcctgcaatgt

SEQ ID NO: 381785 - DNA, 25 bp, Mus musculus
ctgagtttgttgcagacctttgcct

SEQ ID NO: 381786 - DNA, 25 bp, Mus musculus
ctgagtttgttggagacctttgcct

SEQ ID NO: 381787 - DNA, 25 bp, Mus musculus
ctgagttttggtccagttgggctga

SEQ ID NO: 381788 - DNA, 25 bp, Mus musculus
ctgagttttggtgcagttgggctga

SEQ ID NO: 381789 - DNA, 25 bp, Mus musculus
ctgagtttttagaatactgcctata

SEQ ID NO: 381790 - DNA, 25 bp, Mus musculus
ctgagtttttagtatactgcctata

SEQ ID NO: 381791 - DNA, 25 bp, Mus musculus
ctgataaaatacactagcttgggcc

SEQ ID NO: 381792 - DNA, 25 bp, Mus musculus
ctgataaaatactctagcttgggcc

SEQ ID NO: 381793 - DNA, 25 bp, Mus musculus
ctgataacctgaatagtgcactaaa

SEQ ID NO: 381794 - DNA, 25 bp, Mus musculus
ctgataacctgattagtgcactaaa

SEQ ID NO: 381795 - DNA, 25 bp, Mus musculus
ctgataacttgtctactttgtcctt

SEQ ID NO: 381796 - DNA, 25 bp, Mus musculus
ctgataacttgtgtactttgtcctt

SEQ ID NO: 381797 - DNA, 25 bp, Mus musculus
ctgataagatgccaggtgttctcct

SEQ ID NO: 381798 - DNA, 25 bp, Mus musculus
ctgataagatgcgaggtgttctcct

SEQ ID NO: 381799 - DNA, 25 bp, Mus musculus
ctgataaggccccacggagagaaga

SEQ ID NO: 381800 - DNA, 25 bp, Mus musculus
ctgataaggcccgacggagagaaga

SEQ ID NO: 381801 - DNA, 25 bp, Mus musculus
ctgataagttgtatggccgttggtt

SEQ ID NO: 381802 - DNA, 25 bp, Mus musculus
ctgataagttgtttggccgttggtt

SEQ ID NO: 381803 - DNA, 25 bp, Mus musculus
ctgataatgtcactgctgtaattta

SEQ ID NO: 381804 - DNA, 25 bp, Mus musculus
ctgataatgtcagtgctgtaattta

SEQ ID NO: 381805 - DNA, 25 bp, Mus musculus
ctgataattatcaggcttgcacaca

SEQ ID NO: 381806 - DNA, 25 bp, Mus musculus
ctgataattatctggcttgcacaca

SEQ ID NO: 381807 - DNA, 25 bp, Mus musculus
ctgataatttgcatgttctgggaca

SEQ ID NO: 381808 - DNA, 25 bp, Mus musculus
ctgataatttgcttgttctgggaca

SEQ ID NO: 381809 - DNA, 25 bp, Mus musculus
ctgataccagccattaagacaccat

SEQ ID NO: 381810 - DNA, 25 bp, Mus musculus
ctgataccagcctttaagacaccat

SEQ ID NO: 381811 - DNA, 25 bp, Mus musculus
ctgatacctcagagttgcaacatat

SEQ ID NO: 381812 - DNA, 25 bp, Mus musculus
ctgatacctcagatacccttgttac

SEQ ID NO: 381813 - DNA, 25 bp, Mus musculus
ctgatacctcagtgttgcaacatat

SEQ ID NO: 381814 - DNA, 25 bp, Mus musculus
ctgatacctcagttacccttgttac

SEQ ID NO: 381815 - DNA, 25 bp, Mus musculus
ctgatactctcacgcctgatgggag

SEQ ID NO: 381816 - DNA, 25 bp, Mus musculus
ctgatactctcaggcctgatgggag

SEQ ID NO: 381817 - DNA, 25 bp, Mus musculus
ctgatacttatacgctccgactttg

SEQ ID NO: 381818 - DNA, 25 bp, Mus musculus
ctgatacttataggctccgactttg

SEQ ID NO: 381819 - DNA, 25 bp, Mus musculus
ctgatacttggtagtatttcctaca

SEQ ID NO: 381820 - DNA, 25 bp, Mus musculus
ctgatacttggttgtatttcctaca

SEQ ID NO: 381821 - DNA, 25 bp, Mus musculus
ctgatacttgtgcatgtttttcttc

SEQ ID NO: 381822 - DNA, 25 bp, Mus musculus
ctgatacttgtggatgtttttcttc

SEQ ID NO: 381823 - DNA, 25 bp, Mus musculus
ctgatagagcaaatcctggaatata

SEQ ID NO: 381824 - DNA, 25 bp, Mus musculus
ctgatagagcaattcctggaatata

SEQ ID NO: 381825 - DNA, 25 bp, Mus musculus
ctgatagattcccaagacagctcat

SEQ ID NO: 381826 - DNA, 25 bp, Mus musculus
ctgatagattccgaagacagctcat

SEQ ID NO: 381827 - DNA, 25 bp, Mus musculus
ctgatagctcttagactaggactct

SEQ ID NO: 381828 - DNA, 25 bp, Mus musculus
ctgatagctctttgactaggactct

SEQ ID NO: 381829 - DNA, 25 bp, Mus musculus
ctgataggacaaatggctttagaca

SEQ ID NO: 381830 - DNA, 25 bp, Mus musculus
ctgataggacaattggctttagaca

SEQ ID NO: 381831 - DNA, 25 bp, Mus musculus
ctgataggatgacaagacacgcccc

SEQ ID NO: 381832 - DNA, 25 bp, Mus musculus
ctgataggatgagaagacacgcccc

SEQ ID NO: 381833 - DNA, 25 bp, Mus musculus
ctgataggtggacctgttagtctga

SEQ ID NO: 381834 - DNA, 25 bp, Mus musculus
ctgataggtggagctgttagtctga

SEQ ID NO: 381835 - DNA, 25 bp, Mus musculus
ctgataggtgggagggtctctttat

SEQ ID NO: 381836 - DNA, 25 bp, Mus musculus
ctgataggtgggtgggtctctttat

SEQ ID NO: 381837 - DNA, 25 bp, Mus musculus
ctgatagtagccattgtaacccaaa

SEQ ID NO: 381838 - DNA, 25 bp, Mus musculus
ctgatagtagcctttgtaacccaaa

SEQ ID NO: 381839 - DNA, 25 bp, Mus musculus
ctgatagtgatccttacacagtgat

SEQ ID NO: 381840 - DNA, 25 bp, Mus musculus
ctgatagtgatcgttacacagtgat

SEQ ID NO: 381841 - DNA, 25 bp, Mus musculus
ctgatagttactaggccttggatta

SEQ ID NO: 381842 - DNA, 25 bp, Mus musculus
ctgatagttacttggccttggatta

SEQ ID NO: 381843 - DNA, 25 bp, Mus musculus
ctgatatagcgacaaagcctgggca

SEQ ID NO: 381844 - DNA, 25 bp, Mus musculus
ctgatatagcgagaaagcctgggca

SEQ ID NO: 381845 - DNA, 25 bp, Mus musculus
ctgatatcactgagaacagcaggat

SEQ ID NO: 381846 - DNA, 25 bp, Mus musculus
ctgatatcactgtgaacagcaggat

SEQ ID NO: 381847 - DNA, 25 bp, Mus musculus
ctgatatcagagcataacttctgga

SEQ ID NO: 381848 - DNA, 25 bp, Mus musculus
ctgatatcagaggataacttctgga

SEQ ID NO: 381849 - DNA, 25 bp, Mus musculus
ctgatatcagttcctgaagcctctc

SEQ ID NO: 381850 - DNA, 25 bp, Mus musculus
ctgatatcagttgctgaagcctctc

SEQ ID NO: 381851 - DNA, 25 bp, Mus musculus
ctgatatctgaccagtggatgcctc

SEQ ID NO: 381852 - DNA, 25 bp, Mus musculus
ctgatatctgacgagtggatgcctc

SEQ ID NO: 381853 - DNA, 25 bp, Mus musculus
ctgatatggataaagtcttaggcga

SEQ ID NO: 381854 - DNA, 25 bp, Mus musculus
ctgatatggatatagtcttaggcga

SEQ ID NO: 381855 - DNA, 25 bp, Mus musculus
ctgatattctttactgatcctgctc

SEQ ID NO: 381856 - DNA, 25 bp, Mus musculus
ctgatattcttttctgatcctgctc

SEQ ID NO: 381857 - DNA, 25 bp, Mus musculus
ctgatatttccaccaagagccctgt

SEQ ID NO: 381858 - DNA, 25 bp, Mus musculus
ctgatatttccagcaagagccctgt

SEQ ID NO: 381859 - DNA, 25 bp, Mus musculus
ctgatatttgatatggttgtcccca

SEQ ID NO: 381860 - DNA, 25 bp, Mus musculus
ctgatatttgatttggttgtcccca

SEQ ID NO: 381861 - DNA, 25 bp, Mus musculus
ctgatcacacttctttttaatgagg

SEQ ID NO: 381862 - DNA, 25 bp, Mus musculus
ctgatcacacttgtttttaatgagg

SEQ ID NO: 381863 - DNA, 25 bp, Mus musculus
ctgatcaccagaagctgaggctgct

SEQ ID NO: 381864 - DNA, 25 bp, Mus musculus
ctgatcaccagatgctgaggctgct

SEQ ID NO: 381865 - DNA, 25 bp, Mus musculus
ctgatcactgataagctttagaact

SEQ ID NO: 381866 - DNA, 25 bp, Mus musculus
ctgatcactgattagctttagaact

SEQ ID NO: 381867 - DNA, 25 bp, Mus musculus
ctgatcactgttctgtgccaagact

SEQ ID NO: 381868 - DNA, 25 bp, Mus musculus
ctgatcactgttgtgtgccaagact

SEQ ID NO: 381869 - DNA, 25 bp, Mus musculus
ctgatcagaatacggtgaccactct

SEQ ID NO: 381870 - DNA, 25 bp, Mus musculus
ctgatcagaatagggtgaccactct

SEQ ID NO: 381871 - DNA, 25 bp, Mus musculus
ctgatcaggacaattgagacccggg

SEQ ID NO: 381872 - DNA, 25 bp, Mus musculus
ctgatcaggacatttgagacccggg

SEQ ID NO: 381873 - DNA, 25 bp, Mus musculus
ctgatcatcaagaacgtgcgtctgg

SEQ ID NO: 381874 - DNA, 25 bp, Mus musculus
ctgatcatcaagtacgtgcgtctgg

SEQ ID NO: 381875 - DNA, 25 bp, Mus musculus
ctgatcattttgcttctttgggtaa

SEQ ID NO: 381876 - DNA, 25 bp, Mus musculus
ctgatcattttggttctttgggtaa

SEQ ID NO: 381877 - DNA, 25 bp, Mus musculus
ctgatccaattccaggaggaacgga

SEQ ID NO: 381878 - DNA, 25 bp, Mus musculus
ctgatccaattcgaggaggaacgga

SEQ ID NO: 381879 - DNA, 25 bp, Mus musculus
ctgatccagagaatgaaccttttga

SEQ ID NO: 381880 - DNA, 25 bp, Mus musculus
ctgatccagagattgaaccttttga

SEQ ID NO: 381881 - DNA, 25 bp, Mus musculus
ctgatcccacagatacacatttcct

SEQ ID NO: 381882 - DNA, 25 bp, Mus musculus
ctgatcccacagttacacatttcct

SEQ ID NO: 381883 - DNA, 25 bp, Mus musculus
ctgatccccaggctatttattgcaa

SEQ ID NO: 381884 - DNA, 25 bp, Mus musculus
ctgatccccagggtatttattgcaa

SEQ ID NO: 381885 - DNA, 25 bp, Mus musculus
ctgatccctagacacacatatggga

SEQ ID NO: 381886 - DNA, 25 bp, Mus musculus
ctgatccctagagacacatatggga

SEQ ID NO: 381887 - DNA, 25 bp, Mus musculus
ctgatccctgggattctagaacatt

SEQ ID NO: 381888 - DNA, 25 bp, Mus musculus
ctgatccctgggtttctagaacatt

SEQ ID NO: 381889 - DNA, 25 bp, Mus musculus
ctgatccctttaacagttgccacag

SEQ ID NO: 381890 - DNA, 25 bp, Mus musculus
ctgatccctttatcagttgccacag

SEQ ID NO: 381891 - DNA, 25 bp, Mus musculus
ctgatcctcagtagaatgtgggctt

SEQ ID NO: 381892 - DNA, 25 bp, Mus musculus
ctgatcctcagttgaatgtgggctt

SEQ ID NO: 381893 - DNA, 25 bp, Mus musculus
ctgatcctcatcacatgtaagattt

SEQ ID NO: 381894 - DNA, 25 bp, Mus musculus
ctgatcctcatctcatgtaagattt

SEQ ID NO: 381895 - DNA, 25 bp, Mus musculus
ctgatcctccttaccaaatgctgag

SEQ ID NO: 381896 - DNA, 25 bp, Mus musculus
ctgatcctcctttccaaatgctgag

SEQ ID NO: 381897 - DNA, 25 bp, Mus musculus
ctgatcctggagaagatgacttagg

SEQ ID NO: 381898 - DNA, 25 bp, Mus musculus
ctgatcctggagtagatgacttagg

SEQ ID NO: 381899 - DNA, 25 bp, Mus musculus
ctgatccttcttcactttgtttagt

SEQ ID NO: 381900 - DNA, 25 bp, Mus musculus
ctgatccttcttgactttgtttagt

SEQ ID NO: 381901 - DNA, 25 bp, Mus musculus
ctgatcgatcacatccagaaggagc

SEQ ID NO: 381902 - DNA, 25 bp, Mus musculus
ctgatcgatcacttccagaaggagc

SEQ ID NO: 381903 - DNA, 25 bp, Mus musculus
ctgatcgattttaattggtccactg

SEQ ID NO: 381904 - DNA, 25 bp, Mus musculus
ctgatcgatttttattggtccactg

SEQ ID NO: 381905 - DNA, 25 bp, Mus musculus
ctgatcggcttaagacgtatgtgac

SEQ ID NO: 381906 - DNA, 25 bp, Mus musculus
ctgatcggcttatgacgtatgtgac

SEQ ID NO: 381907 - DNA, 25 bp, Mus musculus
ctgatcgtgattctgggcaccagcc

SEQ ID NO: 381908 - DNA, 25 bp, Mus musculus
ctgatcgtgattgtgggcaccagcc

SEQ ID NO: 381909 - DNA, 25 bp, Mus musculus
ctgatcgtggtgacagctgctcaaa

SEQ ID NO: 381910 - DNA, 25 bp, Mus musculus
ctgatcgtggtgtcagctgctcaaa

SEQ ID NO: 381911 - DNA, 25 bp, Mus musculus
ctgatcgttattctatcctgggtct

SEQ ID NO: 381912 - DNA, 25 bp, Mus musculus
ctgatcgttattgtatcctgggtct

SEQ ID NO: 381913 - DNA, 25 bp, Mus musculus
ctgatctattccagcagcttgtgga

SEQ ID NO: 381914 - DNA, 25 bp, Mus musculus
ctgatctattcctgcagcttgtgga

SEQ ID NO: 381915 - DNA, 25 bp, Mus musculus
ctgatctcatatagttagagataat

SEQ ID NO: 381916 - DNA, 25 bp, Mus musculus
ctgatctcatattgttagagataat

SEQ ID NO: 381917 - DNA, 25 bp, Mus musculus
ctgatctcattcagggatcaattga

SEQ ID NO: 381918 - DNA, 25 bp, Mus musculus
ctgatctcattctgggatcaattga

SEQ ID NO: 381919 - DNA, 25 bp, Mus musculus
ctgatctctgatccctgttcataca

SEQ ID NO: 381920 - DNA, 25 bp, Mus musculus
ctgatctctgatgcctgttcataca

SEQ ID NO: 381921 - DNA, 25 bp, Mus musculus
ctgatctctttcagtggttctctct

SEQ ID NO: 381922 - DNA, 25 bp, Mus musculus
ctgatctctttctgtggttctctct

SEQ ID NO: 381923 - DNA, 25 bp, Mus musculus
ctgatctgataacagctgctagcca

SEQ ID NO: 381924 - DNA, 25 bp, Mus musculus
ctgatctgataagagctgctagcca

SEQ ID NO: 381925 - DNA, 25 bp, Mus musculus
ctgatctgcaaccaggggccagaac

SEQ ID NO: 381926 - DNA, 25 bp, Mus musculus
ctgatctgcaacgaggggccagaac

SEQ ID NO: 381927 - DNA, 25 bp, Mus musculus
ctgatctgccacaagttaccgaaat

SEQ ID NO: 381928 - DNA, 25 bp, Mus musculus
ctgatctgccactagttaccgaaat

SEQ ID NO: 381929 - DNA, 25 bp, Mus musculus
ctgatctgtgttcgtgctcatttga

SEQ ID NO: 381930 - DNA, 25 bp, Mus musculus
ctgatctgtgttggtgctcatttga

SEQ ID NO: 381931 - DNA, 25 bp, Mus musculus
ctgatcttacccaaattaaccctga

SEQ ID NO: 381932 - DNA, 25 bp, Mus musculus
ctgatcttaccctaattaaccctga

SEQ ID NO: 381933 - DNA, 25 bp, Mus musculus
ctgatcttctgcagctgtgttttat

SEQ ID NO: 381934 - DNA, 25 bp, Mus musculus
ctgatcttctgctgctgtgttttat

SEQ ID NO: 381935 - DNA, 25 bp, Mus musculus
ctgatcttgcttcccagagtactaa

SEQ ID NO: 381936 - DNA, 25 bp, Mus musculus
ctgatcttgcttgccagagtactaa

SEQ ID NO: 381937 - DNA, 25 bp, Mus musculus
ctgatcttggctcctgattctgaag

SEQ ID NO: 381938 - DNA, 25 bp, Mus musculus
ctgatcttggctgctgattctgaag

SEQ ID NO: 381939 - DNA, 25 bp, Mus musculus
ctgatctttcacagcagagtaggaa

SEQ ID NO: 381940 - DNA, 25 bp, Mus musculus
ctgatctttcactgcagagtaggaa

SEQ ID NO: 381941 - DNA, 25 bp, Mus musculus
ctgatctttcttatgtccacttaga

SEQ ID NO: 381942 - DNA, 25 bp, Mus musculus
ctgatctttcttttgtccacttaga

SEQ ID NO: 381943 - DNA, 25 bp, Mus musculus
ctgatgaaaaagcttgccctcccaa

SEQ ID NO: 381944 - DNA, 25 bp, Mus musculus
ctgatgaaaaaggttgccctcccaa

SEQ ID NO: 381945 - DNA, 25 bp, Mus musculus
ctgatgaaaatcaccgacctccggg

SEQ ID NO: 381946 - DNA, 25 bp, Mus musculus
ctgatgaaaatctccgacctccggg

SEQ ID NO: 381947 - DNA, 25 bp, Mus musculus
ctgatgaaatcaccagcactttgta

SEQ ID NO: 381948 - DNA, 25 bp, Mus musculus
ctgatgaaatcagcagcactttgta

SEQ ID NO: 381949 - DNA, 25 bp, Mus musculus
ctgatgaacagaattctacaattgt

SEQ ID NO: 381950 - DNA, 25 bp, Mus musculus
ctgatgaacagatttctacaattgt

SEQ ID NO: 381951 - DNA, 25 bp, Mus musculus
ctgatgaacaggcatttaacacaac

SEQ ID NO: 381952 - DNA, 25 bp, Mus musculus
ctgatgaacagggatttaacacaac

SEQ ID NO: 381953 - DNA, 25 bp, Mus musculus
ctgatgaagcctaccttattggccg

SEQ ID NO: 381954 - DNA, 25 bp, Mus musculus
ctgatgaagccttccttattggccg

SEQ ID NO: 381955 - DNA, 25 bp, Mus musculus
ctgatgaagggcacctggatagatg

SEQ ID NO: 381956 - DNA, 25 bp, Mus musculus
ctgatgaagggctcctggatagatg

SEQ ID NO: 381957 - DNA, 25 bp, Mus musculus
ctgatgaccgatcccgtgagactgc

SEQ ID NO: 381958 - DNA, 25 bp, Mus musculus
ctgatgaccgatgccgtgagactgc

SEQ ID NO: 381959 - DNA, 25 bp, Mus musculus
ctgatgacgacacgctgaaccacct

SEQ ID NO: 381960 - DNA, 25 bp, Mus musculus
ctgatgacgacaggctgaaccacct

SEQ ID NO: 381961 - DNA, 25 bp, Mus musculus
ctgatgagcatccaccggaggaaaa

SEQ ID NO: 381962 - DNA, 25 bp, Mus musculus
ctgatgagcatcgaccggaggaaaa

SEQ ID NO: 381963 - DNA, 25 bp, Mus musculus
ctgatgaggctcatgaccaccaaaa

SEQ ID NO: 381964 - DNA, 25 bp, Mus musculus
ctgatgaggctcttgaccaccaaaa

SEQ ID NO: 381965 - DNA, 25 bp, Mus musculus
ctgatgaggtctctgggtgtccact

SEQ ID NO: 381966 - DNA, 25 bp, Mus musculus
ctgatgaggtctgtgggtgtccact

SEQ ID NO: 381967 - DNA, 25 bp, Mus musculus
ctgatgagtcagacacagttccact

SEQ ID NO: 381968 - DNA, 25 bp, Mus musculus
ctgatgagtcagtcacagttccact

SEQ ID NO: 381969 - DNA, 25 bp, Mus musculus
ctgatgatcgcccttttttgtatcc

SEQ ID NO: 381970 - DNA, 25 bp, Mus musculus
ctgatgatcgccgttttttgtatcc

SEQ ID NO: 381971 - DNA, 25 bp, Mus musculus
ctgatgatgaaaatcaccaaggctg

SEQ ID NO: 381972 - DNA, 25 bp, Mus musculus
ctgatgatgaaattcaccaaggctg

SEQ ID NO: 381973 - DNA, 25 bp, Mus musculus
ctgatgattcatatgtctgtccaag

SEQ ID NO: 381974 - DNA, 25 bp, Mus musculus
ctgatgattcatttgtctgtccaag

SEQ ID NO: 381975 - DNA, 25 bp, Mus musculus
ctgatgattctgattgctctgatga

SEQ ID NO: 381976 - DNA, 25 bp, Mus musculus
ctgatgattctgtttgctctgatga

SEQ ID NO: 381977 - DNA, 25 bp, Mus musculus
ctgatgcaactccaaagctgacttt

SEQ ID NO: 381978 - DNA, 25 bp, Mus musculus
ctgatgcaactcgaaagctgacttt

SEQ ID NO: 381979 - DNA, 25 bp, Mus musculus
ctgatgcacccgagttagtacctca

SEQ ID NO: 381980 - DNA, 25 bp, Mus musculus
ctgatgcacccgtgttagtacctca

SEQ ID NO: 381981 - DNA, 25 bp, Mus musculus
ctgatgcacctgaattccagctggg

SEQ ID NO: 381982 - DNA, 25 bp, Mus musculus
ctgatgcacctgtattccagctggg

SEQ ID NO: 381983 - DNA, 25 bp, Mus musculus
ctgatgcactacacgtcttttgaag

SEQ ID NO: 381984 - DNA, 25 bp, Mus musculus
ctgatgcactactcgtcttttgaag

SEQ ID NO: 381985 - DNA, 25 bp, Mus musculus
ctgatgcagaccctgtgggaacact

SEQ ID NO: 381986 - DNA, 25 bp, Mus musculus
ctgatgcagaccgtgtgggaacact

SEQ ID NO: 381987 - DNA, 25 bp, Mus musculus
ctgatgcagcttatacgaagataat

SEQ ID NO: 381988 - DNA, 25 bp, Mus musculus
ctgatgcagcttttacgaagataat

SEQ ID NO: 381989 - DNA, 25 bp, Mus musculus
ctgatgccacccaaagtttgaaggt

SEQ ID NO: 381990 - DNA, 25 bp, Mus musculus
ctgatgccaccctaagtttgaaggt

SEQ ID NO: 381991 - DNA, 25 bp, Mus musculus
ctgatgccactgaacagatggatat

SEQ ID NO: 381992 - DNA, 25 bp, Mus musculus
ctgatgccactgtacagatggatat

SEQ ID NO: 381993 - DNA, 25 bp, Mus musculus
ctgatgccagcaccggaaggcctga

SEQ ID NO: 381994 - DNA, 25 bp, Mus musculus
ctgatgccagcagcggaaggcctga

SEQ ID NO: 381995 - DNA, 25 bp, Mus musculus
ctgatgccagtgctaagtgctcatt

SEQ ID NO: 381996 - DNA, 25 bp, Mus musculus
ctgatgccagtggtaagtgctcatt

SEQ ID NO: 381997 - DNA, 25 bp, Mus musculus
ctgatgccatctcacgtctgctgga

SEQ ID NO: 381998 - DNA, 25 bp, Mus musculus
ctgatgccatctgacgtctgctgga

SEQ ID NO: 381999 - DNA, 25 bp, Mus musculus
ctgatgccctggactggagtgtctg

SEQ ID NO: 382000 - DNA, 25 bp, Mus musculus
ctgatgccctggtctggagtgtctg

SEQ ID NO: 382001 - DNA, 25 bp, Mus musculus
ctgatgcgtggcatttgcttcttta

SEQ ID NO: 382002 - DNA, 25 bp, Mus musculus
ctgatgcgtggcttttgcttcttta

SEQ ID NO: 382003 - DNA, 25 bp, Mus musculus
ctgatgctctagacacctctgaggg

SEQ ID NO: 382004 - DNA, 25 bp, Mus musculus
ctgatgctctagtcacctctgaggg

SEQ ID NO: 382005 - DNA, 25 bp, Mus musculus
ctgatgctggatattaattagactt

SEQ ID NO: 382006 - DNA, 25 bp, Mus musculus
ctgatgctggattttaattagactt

SEQ ID NO: 382007 - DNA, 25 bp, Mus musculus
ctgatgctgtgcactgggacaggca

SEQ ID NO: 382008 - DNA, 25 bp, Mus musculus
ctgatgctgtgctctgggacaggca

SEQ ID NO: 382009 - DNA, 25 bp, Mus musculus
ctgatgcttaaaacagaacactgtt

SEQ ID NO: 382010 - DNA, 25 bp, Mus musculus
ctgatgcttaaatcagaacactgtt

SEQ ID NO: 382011 - DNA, 25 bp, Mus musculus
ctgatgcttcaaacaacacctcctg

SEQ ID NO: 382012 - DNA, 25 bp, Mus musculus
ctgatgcttcaatcaacacctcctg

SEQ ID NO: 382013 - DNA, 25 bp, Mus musculus
ctgatgcttccccttacatgtgaag

SEQ ID NO: 382014 - DNA, 25 bp, Mus musculus
ctgatgcttcccgttacatgtgaag

SEQ ID NO: 382015 - DNA, 25 bp, Mus musculus
ctgatgcttctgacatacattggta

SEQ ID NO: 382016 - DNA, 25 bp, Mus musculus
ctgatgcttctgtcatacattggta

SEQ ID NO: 382017 - DNA, 25 bp, Mus musculus
ctgatgcttttgaaaggctttgacc

SEQ ID NO: 382018 - DNA, 25 bp, Mus musculus
ctgatgcttttgtaaggctttgacc

SEQ ID NO: 382019 - DNA, 25 bp, Mus musculus
ctgatggaaaacctgcttctagccc

SEQ ID NO: 382020 - DNA, 25 bp, Mus musculus
ctgatggaaaacgtgcttctagccc

SEQ ID NO: 382021 - DNA, 25 bp, Mus musculus
ctgatggaagacactttcacactca

SEQ ID NO: 382022 - DNA, 25 bp, Mus musculus
ctgatggaagactctttcacactca

SEQ ID NO: 382023 - DNA, 25 bp, Mus musculus
ctgatggaagccacacacttggcat

SEQ ID NO: 382024 - DNA, 25 bp, Mus musculus
ctgatggaagcctcacacttggcat

SEQ ID NO: 382025 - DNA, 25 bp, Mus musculus
ctgatggacatcctcgaggaccgac

SEQ ID NO: 382026 - DNA, 25 bp, Mus musculus
ctgatggacatcgtcgaggaccgac

SEQ ID NO: 382027 - DNA, 25 bp, Mus musculus
ctgatggagctcagtgtgtacctat

SEQ ID NO: 382028 - DNA, 25 bp, Mus musculus
ctgatggagctctgtgtgtacctat

SEQ ID NO: 382029 - DNA, 25 bp, Mus musculus
ctgatggagttcattttagccacaa

SEQ ID NO: 382030 - DNA, 25 bp, Mus musculus
ctgatggagttctttttagccacaa

SEQ ID NO: 382031 - DNA, 25 bp, Mus musculus
ctgatggccaccaggcgcttgggtt

SEQ ID NO: 382032 - DNA, 25 bp, Mus musculus
ctgatggccacctggcgcttgggtt

SEQ ID NO: 382033 - DNA, 25 bp, Mus musculus
ctgatggcctgaactactgtagcca

SEQ ID NO: 382034 - DNA, 25 bp, Mus musculus
ctgatggcctgatctactgtagcca

SEQ ID NO: 382035 - DNA, 25 bp, Mus musculus
ctgatggctctaagcagcactgtat

SEQ ID NO: 382036 - DNA, 25 bp, Mus musculus
ctgatggctctatgcagcactgtat

SEQ ID NO: 382037 - DNA, 25 bp, Mus musculus
ctgatggctctgaaggcagtactct

SEQ ID NO: 382038 - DNA, 25 bp, Mus musculus
ctgatggctctgtaggcagtactct

SEQ ID NO: 382039 - DNA, 25 bp, Mus musculus
ctgatggctttcaaccagctggaga

SEQ ID NO: 382040 - DNA, 25 bp, Mus musculus
ctgatggctttctaccagctggaga

SEQ ID NO: 382041 - DNA, 25 bp, Mus musculus
ctgatgggaagcagtacctgtctat

SEQ ID NO: 382042 - DNA, 25 bp, Mus musculus
ctgatgggaagctgtacctgtctat

SEQ ID NO: 382043 - DNA, 25 bp, Mus musculus
ctgatgggacctaagttgttggtga

SEQ ID NO: 382044 - DNA, 25 bp, Mus musculus
ctgatgggaccttagttgttggtga

SEQ ID NO: 382045 - DNA, 25 bp, Mus musculus
ctgatgggcgagcagacggcgtgct

SEQ ID NO: 382046 - DNA, 25 bp, Mus musculus
ctgatgggcgaggagacggcgtgct

SEQ ID NO: 382047 - DNA, 25 bp, Mus musculus
ctgatgggttcactatttgtacagc

SEQ ID NO: 382048 - DNA, 25 bp, Mus musculus
ctgatgggttcagtatttgtacagc

SEQ ID NO: 382049 - DNA, 25 bp, Mus musculus
ctgatggtaatcaagctgcaagttt

SEQ ID NO: 382050 - DNA, 25 bp, Mus musculus
ctgatggtaatctagctgcaagttt

SEQ ID NO: 382051 - DNA, 25 bp, Mus musculus
ctgatggtattaatagagcgtgaaa

SEQ ID NO: 382052 - DNA, 25 bp, Mus musculus
ctgatggtattattagagcgtgaaa

SEQ ID NO: 382053 - DNA, 25 bp, Mus musculus
ctgatggtatttaattgctggtaaa

SEQ ID NO: 382054 - DNA, 25 bp, Mus musculus
ctgatggtattttattgctggtaaa

SEQ ID NO: 382055 - DNA, 25 bp, Mus musculus
ctgatggtgagcagccaatcagggc

SEQ ID NO: 382056 - DNA, 25 bp, Mus musculus
ctgatggtgagctgccaatcagggc

SEQ ID NO: 382057 - DNA, 25 bp, Mus musculus
ctgatggtgcaacataaagatgcat

SEQ ID NO: 382058 - DNA, 25 bp, Mus musculus
ctgatggtgcaagataaagatgcat

SEQ ID NO: 382059 - DNA, 25 bp, Mus musculus
ctgatggttattctccgttctcctc

SEQ ID NO: 382060 - DNA, 25 bp, Mus musculus
ctgatggttattgtccgttctcctc

SEQ ID NO: 382061 - DNA, 25 bp, Mus musculus
ctgatggttgttcttgtgggtttac

SEQ ID NO: 382062 - DNA, 25 bp, Mus musculus
ctgatggttgttgttgtgggtttac

SEQ ID NO: 382063 - DNA, 25 bp, Mus musculus
ctgatgtaacagatgtttgccatta

SEQ ID NO: 382064 - DNA, 25 bp, Mus musculus
ctgatgtaacagttgtttgccatta

SEQ ID NO: 382065 - DNA, 25 bp, Mus musculus
ctgatgtaccttcgctggagactgg

SEQ ID NO: 382066 - DNA, 25 bp, Mus musculus
ctgatgtaccttggctggagactgg

SEQ ID NO: 382067 - DNA, 25 bp, Mus musculus
ctgatgtagtgaccagcccagcagt

SEQ ID NO: 382068 - DNA, 25 bp, Mus musculus
ctgatgtagtgagcagcccagcagt

SEQ ID NO: 382069 - DNA, 25 bp, Mus musculus
ctgatgtataagattgagtccagcc

SEQ ID NO: 382070 - DNA, 25 bp, Mus musculus
ctgatgtataagtttgagtccagcc

SEQ ID NO: 382071 - DNA, 25 bp, Mus musculus
ctgatgtattttagttcactatttt

SEQ ID NO: 382072 - DNA, 25 bp, Mus musculus
ctgatgtatttttgttcactatttt

SEQ ID NO: 382073 - DNA, 25 bp, Mus musculus
ctgatgtcacagctcacttagttga

SEQ ID NO: 382074 - DNA, 25 bp, Mus musculus
ctgatgtcacaggtcacttagttga

SEQ ID NO: 382075 - DNA, 25 bp, Mus musculus
ctgatgtcacttataattagagaac

SEQ ID NO: 382076 - DNA, 25 bp, Mus musculus
ctgatgtcacttttaattagagaac

SEQ ID NO: 382077 - DNA, 25 bp, Mus musculus
ctgatgtccagtccagtctggctgt

SEQ ID NO: 382078 - DNA, 25 bp, Mus musculus
ctgatgtccagtgcagtctggctgt

SEQ ID NO: 382079 - DNA, 25 bp, Mus musculus
ctgatgtcctgtagtcttggttcta

SEQ ID NO: 382080 - DNA, 25 bp, Mus musculus
ctgatgtcctgttgtcttggttcta

SEQ ID NO: 382081 - DNA, 25 bp, Mus musculus
ctgatgtctggcacacaggagagtc

SEQ ID NO: 382082 - DNA, 25 bp, Mus musculus
ctgatgtctggctcacaggagagtc

SEQ ID NO: 382083 - DNA, 25 bp, Mus musculus
ctgatgtgagtgatctggcctagtc

SEQ ID NO: 382084 - DNA, 25 bp, Mus musculus
ctgatgtgagtgttctggcctagtc

SEQ ID NO: 382085 - DNA, 25 bp, Mus musculus
ctgatgtgccagctggatgaccact

SEQ ID NO: 382086 - DNA, 25 bp, Mus musculus
ctgatgtgccaggtggatgaccact

SEQ ID NO: 382087 - DNA, 25 bp, Mus musculus
ctgatgtggcctatggagctaccgg

SEQ ID NO: 382088 - DNA, 25 bp, Mus musculus
ctgatgtggcctttggagctaccgg

SEQ ID NO: 382089 - DNA, 25 bp, Mus musculus
ctgatgtgggagagcgtcgttcatt

SEQ ID NO: 382090 - DNA, 25 bp, Mus musculus
ctgatgtgggagtgcgtcgttcatt

SEQ ID NO: 382091 - DNA, 25 bp, Mus musculus
ctgatgtgtccaagtgtaactgctg

SEQ ID NO: 382092 - DNA, 25 bp, Mus musculus
ctgatgtgtccatgtgtaactgctg

SEQ ID NO: 382093 - DNA, 25 bp, Mus musculus
ctgatgttacacagcagtctgaaaa

SEQ ID NO: 382094 - DNA, 25 bp, Mus musculus
ctgatgttacactgcagtctgaaaa

SEQ ID NO: 382095 - DNA, 25 bp, Mus musculus
ctgatgttcagtagtgttaactcaa

SEQ ID NO: 382096 - DNA, 25 bp, Mus musculus
ctgatgttcagttgtgttaactcaa

SEQ ID NO: 382097 - DNA, 25 bp, Mus musculus
ctgatgttccagcaaccagaatttc

SEQ ID NO: 382098 - DNA, 25 bp, Mus musculus
ctgatgttccaggaaccagaatttc

SEQ ID NO: 382099 - DNA, 25 bp, Mus musculus
ctgatgttggccaagttagtgctta

SEQ ID NO: 382100 - DNA, 25 bp, Mus musculus
ctgatgttggcctagttagtgctta

SEQ ID NO: 382101 - DNA, 25 bp, Mus musculus
ctgatgttggttattaaagtagatt

SEQ ID NO: 382102 - DNA, 25 bp, Mus musculus
ctgatgttggtttttaaagtagatt

SEQ ID NO: 382103 - DNA, 25 bp, Mus musculus
ctgatgtttctaccaaactgtagtg

SEQ ID NO: 382104 - DNA, 25 bp, Mus musculus
ctgatgtttctagcaaactgtagtg

SEQ ID NO: 382105 - DNA, 25 bp, Mus musculus
ctgattaaagacaagggcctcccta

SEQ ID NO: 382106 - DNA, 25 bp, Mus musculus
ctgattaaagactagggcctcccta

SEQ ID NO: 382107 - DNA, 25 bp, Mus musculus
ctgattaagtcacgtccactgggtg

SEQ ID NO: 382108 - DNA, 25 bp, Mus musculus
ctgattaagtcaggtccactgggtg

SEQ ID NO: 382109 - DNA, 25 bp, Mus musculus
ctgattaatcagctttggcactttt

SEQ ID NO: 382110 - DNA, 25 bp, Mus musculus
ctgattaatcaggtttggcactttt

SEQ ID NO: 382111 - DNA, 25 bp, Mus musculus
ctgattacctttaacgtgccactaa

SEQ ID NO: 382112 - DNA, 25 bp, Mus musculus
ctgattaccttttacgtgccactaa

SEQ ID NO: 382113 - DNA, 25 bp, Mus musculus
ctgattactagaagctgacctctgc

SEQ ID NO: 382114 - DNA, 25 bp, Mus musculus
ctgattactagatgctgacctctgc

SEQ ID NO: 382115 - DNA, 25 bp, Mus musculus
ctgattactttaccatccgcaccag

SEQ ID NO: 382116 - DNA, 25 bp, Mus musculus
ctgattactttagcatccgcaccag

SEQ ID NO: 382117 - DNA, 25 bp, Mus musculus
ctgattagcccaactatccaattgg

SEQ ID NO: 382118 - DNA, 25 bp, Mus musculus
ctgattagcccatctatccaattgg

SEQ ID NO: 382119 - DNA, 25 bp, Mus musculus
ctgattagccggaacctgggcaatg

SEQ ID NO: 382120 - DNA, 25 bp, Mus musculus
ctgattagccggtacctgggcaatg

SEQ ID NO: 382121 - DNA, 25 bp, Mus musculus
ctgattaggcaaagagagcttctct

SEQ ID NO: 382122 - DNA, 25 bp, Mus musculus
ctgattaggcaatgagagcttctct

SEQ ID NO: 382123 - DNA, 25 bp, Mus musculus
ctgattagtacacttgacttggaac

SEQ ID NO: 382124 - DNA, 25 bp, Mus musculus
ctgattagtacagttgacttggaac

SEQ ID NO: 382125 - DNA, 25 bp, Mus musculus
ctgattataatcatcccattttctt

SEQ ID NO: 382126 - DNA, 25 bp, Mus musculus
ctgattataatcttcccattttctt

SEQ ID NO: 382127 - DNA, 25 bp, Mus musculus
ctgattatagcaagggctgtcccca

SEQ ID NO: 382128 - DNA, 25 bp, Mus musculus
ctgattatagcatgggctgtcccca

SEQ ID NO: 382129 - DNA, 25 bp, Mus musculus
ctgattatgtgcaacccctcatttt

SEQ ID NO: 382130 - DNA, 25 bp, Mus musculus
ctgattatgtgctacccctcatttt

SEQ ID NO: 382131 - DNA, 25 bp, Mus musculus
ctgattattttcatggcgctagcca

SEQ ID NO: 382132 - DNA, 25 bp, Mus musculus
ctgattattttcttggcgctagcca

SEQ ID NO: 382133 - DNA, 25 bp, Mus musculus
ctgattcaaattaaccagtaggaag

SEQ ID NO: 382134 - DNA, 25 bp, Mus musculus
ctgattcaaatttaccagtaggaag

SEQ ID NO: 382135 - DNA, 25 bp, Mus musculus
ctgattcacaatcccacctggatct

SEQ ID NO: 382136 - DNA, 25 bp, Mus musculus
ctgattcacaatgccacctggatct

SEQ ID NO: 382137 - DNA, 25 bp, Mus musculus
ctgattcacagaccgacagtgacca

SEQ ID NO: 382138 - DNA, 25 bp, Mus musculus
ctgattcacagagcgacagtgacca

SEQ ID NO: 382139 - DNA, 25 bp, Mus musculus
ctgattcagcccagagggttagtta

SEQ ID NO: 382140 - DNA, 25 bp, Mus musculus
ctgattcagccctgagggttagtta

SEQ ID NO: 382141 - DNA, 25 bp, Mus musculus
ctgattcaggcaagctggagtcctt

SEQ ID NO: 382142 - DNA, 25 bp, Mus musculus
ctgattcaggcatgctggagtcctt

SEQ ID NO: 382143 - DNA, 25 bp, Mus musculus
ctgattcccggaacctgagttatgg

SEQ ID NO: 382144 - DNA, 25 bp, Mus musculus
ctgattcccggatcctgagttatgg

SEQ ID NO: 382145 - DNA, 25 bp, Mus musculus
ctgattcctttaactctgtttcctt

SEQ ID NO: 382146 - DNA, 25 bp, Mus musculus
ctgattcctttatctctgtttcctt

SEQ ID NO: 382147 - DNA, 25 bp, Mus musculus
ctgattcggttccatgtccaaagga

SEQ ID NO: 382148 - DNA, 25 bp, Mus musculus
ctgattcggttcgatgtccaaagga

SEQ ID NO: 382149 - DNA, 25 bp, Mus musculus
ctgattctacctacagttccaggaa

SEQ ID NO: 382150 - DNA, 25 bp, Mus musculus
ctgattctaccttcagttccaggaa

SEQ ID NO: 382151 - DNA, 25 bp, Mus musculus
ctgattctgagaatcttgcttctga

SEQ ID NO: 382152 - DNA, 25 bp, Mus musculus
ctgattctgagattcttgcttctga

SEQ ID NO: 382153 - DNA, 25 bp, Mus musculus
ctgattctgaggagcactagtgact

SEQ ID NO: 382154 - DNA, 25 bp, Mus musculus
ctgattctgaggtgcactagtgact

SEQ ID NO: 382155 - DNA, 25 bp, Mus musculus
ctgattctggaaccaacgttctttc

SEQ ID NO: 382156 - DNA, 25 bp, Mus musculus
ctgattctggaagcaacgttctttc

SEQ ID NO: 382157 - DNA, 25 bp, Mus musculus
ctgattctggtgattggagccctca

SEQ ID NO: 382158 - DNA, 25 bp, Mus musculus
ctgattctggtgtttggagccctca

SEQ ID NO: 382159 - DNA, 25 bp, Mus musculus
ctgattctgtaaatctttgttggga

SEQ ID NO: 382160 - DNA, 25 bp, Mus musculus
ctgattctgtaattctttgttggga

SEQ ID NO: 382161 - DNA, 25 bp, Mus musculus
ctgattcttaagactctccagagga

SEQ ID NO: 382162 - DNA, 25 bp, Mus musculus
ctgattcttaagtctctccagagga

SEQ ID NO: 382163 - DNA, 25 bp, Mus musculus
ctgattcttgttaggtgtttgccga

SEQ ID NO: 382164 - DNA, 25 bp, Mus musculus
ctgattcttgtttggtgtttgccga

SEQ ID NO: 382165 - DNA, 25 bp, Mus musculus
ctgattctttaacacctggttgccc

SEQ ID NO: 382166 - DNA, 25 bp, Mus musculus
ctgattctttaagacctggttgccc

SEQ ID NO: 382167 - DNA, 25 bp, Mus musculus
ctgattgactgtagatggattgtgg

SEQ ID NO: 382168 - DNA, 25 bp, Mus musculus
ctgattgactgttgatggattgtgg

SEQ ID NO: 382169 - DNA, 25 bp, Mus musculus
ctgattgagaacactgtgggctggc

SEQ ID NO: 382170 - DNA, 25 bp, Mus musculus
ctgattgagaactctgtgggctggc

SEQ ID NO: 382171 - DNA, 25 bp, Mus musculus
ctgattgatggtcgcgagcactact

SEQ ID NO: 382172 - DNA, 25 bp, Mus musculus
ctgattgatggtggcgagcactact

SEQ ID NO: 382173 - DNA, 25 bp, Mus musculus
ctgattgatgtgagagagcctggct

SEQ ID NO: 382174 - DNA, 25 bp, Mus musculus
ctgattgatgtgtgagagcctggct

SEQ ID NO: 382175 - DNA, 25 bp, Mus musculus
ctgattgccctacccagaacttgac

SEQ ID NO: 382176 - DNA, 25 bp, Mus musculus
ctgattgccctagccagaacttgac

SEQ ID NO: 382177 - DNA, 25 bp, Mus musculus
ctgattgccgctacttgactatata

SEQ ID NO: 382178 - DNA, 25 bp, Mus musculus
ctgattgccgcttcttgactatata

SEQ ID NO: 382179 - DNA, 25 bp, Mus musculus
ctgattggatgcctgtgacctgtct

SEQ ID NO: 382180 - DNA, 25 bp, Mus musculus
ctgattggatgcgtgtgacctgtct

SEQ ID NO: 382181 - DNA, 25 bp, Mus musculus
ctgattggcaggacaagccctcgga

SEQ ID NO: 382182 - DNA, 25 bp, Mus musculus
ctgattggcaggtcaagccctcgga

SEQ ID NO: 382183 - DNA, 25 bp, Mus musculus
ctgattggctgacttgtgtctctta

SEQ ID NO: 382184 - DNA, 25 bp, Mus musculus
ctgattggctgagttgtgtctctta

SEQ ID NO: 382185 - DNA, 25 bp, Mus musculus
ctgattgggtataaacattttctgg

SEQ ID NO: 382186 - DNA, 25 bp, Mus musculus
ctgattgggtattaacattttctgg

SEQ ID NO: 382187 - DNA, 25 bp, Mus musculus
ctgattggtcaaaatgcctaaagga

SEQ ID NO: 382188 - DNA, 25 bp, Mus musculus
ctgattggtcaatatgcctaaagga

SEQ ID NO: 382189 - DNA, 25 bp, Mus musculus
ctgattggtggtaaatcttccatct

SEQ ID NO: 382190 - DNA, 25 bp, Mus musculus
ctgattggtggttaatcttccatct

SEQ ID NO: 382191 - DNA, 25 bp, Mus musculus
ctgattgtgacccaggagtgtccct

SEQ ID NO: 382192 - DNA, 25 bp, Mus musculus
ctgattgtgaccgaggagtgtccct

SEQ ID NO: 382193 - DNA, 25 bp, Mus musculus
ctgattgtgtgtcttctctttgtag

SEQ ID NO: 382194 - DNA, 25 bp, Mus musculus
ctgattgtgtgtgttctctttgtag

SEQ ID NO: 382195 - DNA, 25 bp, Mus musculus
ctgattgttagtacaaaattgtgac

SEQ ID NO: 382196 - DNA, 25 bp, Mus musculus
ctgattgttagttcaaaattgtgac

SEQ ID NO: 382197 - DNA, 25 bp, Mus musculus
ctgattgtttgaagacctgcacttt

SEQ ID NO: 382198 - DNA, 25 bp, Mus musculus
ctgattgtttgatgacctgcacttt

SEQ ID NO: 382199 - DNA, 25 bp, Mus musculus
ctgatttagattcccctttcactgt

SEQ ID NO: 382200 - DNA, 25 bp, Mus musculus
ctgatttagattgccctttcactgt

SEQ ID NO: 382201 - DNA, 25 bp, Mus musculus
ctgatttatccacagcccagcatgg

SEQ ID NO: 382202 - DNA, 25 bp, Mus musculus
ctgatttatccagagcccagcatgg

SEQ ID NO: 382203 - DNA, 25 bp, Mus musculus
ctgatttatctgacactcagctgtc

SEQ ID NO: 382204 - DNA, 25 bp, Mus musculus
ctgatttatctgtcactcagctgtc

SEQ ID NO: 382205 - DNA, 25 bp, Mus musculus
ctgatttcaccacatcttttttctt

SEQ ID NO: 382206 - DNA, 25 bp, Mus musculus
ctgatttcaccagatcttttttctt

SEQ ID NO: 382207 - DNA, 25 bp, Mus musculus
ctgatttcacctcatcgttggttat

SEQ ID NO: 382208 - DNA, 25 bp, Mus musculus
ctgatttcacctgatcgttggttat

SEQ ID NO: 382209 - DNA, 25 bp, Mus musculus
ctgatttcagaaaacactggacctg

SEQ ID NO: 382210 - DNA, 25 bp, Mus musculus
ctgatttcagaatacactggacctg

SEQ ID NO: 382211 - DNA, 25 bp, Mus musculus
ctgatttcagttcacctgtggtcct

SEQ ID NO: 382212 - DNA, 25 bp, Mus musculus
ctgatttcagttccatccttacaaa

SEQ ID NO: 382213 - DNA, 25 bp, Mus musculus
ctgatttcagttgacctgtggtcct

SEQ ID NO: 382214 - DNA, 25 bp, Mus musculus
ctgatttcagttgcatccttacaaa

SEQ ID NO: 382215 - DNA, 25 bp, Mus musculus
ctgatttccagcagctttttgtgaa

SEQ ID NO: 382216 - DNA, 25 bp, Mus musculus
ctgatttccagctgctttttgtgaa

SEQ ID NO: 382217 - DNA, 25 bp, Mus musculus
ctgatttgcctgcccatcccatcca

SEQ ID NO: 382218 - DNA, 25 bp, Mus musculus
ctgatttgcctggccatcccatcca

SEQ ID NO: 382219 - DNA, 25 bp, Mus musculus
ctgatttgggctctcaactgatttg

SEQ ID NO: 382220 - DNA, 25 bp, Mus musculus
ctgatttgggctgtcaactgatttg

SEQ ID NO: 382221 - DNA, 25 bp, Mus musculus
ctgatttgttggctccctctgcttt

SEQ ID NO: 382222 - DNA, 25 bp, Mus musculus
ctgatttgttgggtccctctgcttt

SEQ ID NO: 382223 - DNA, 25 bp, Mus musculus
ctgattttaatccttgagtctgtgt

SEQ ID NO: 382224 - DNA, 25 bp, Mus musculus
ctgattttaatcgttgagtctgtgt

SEQ ID NO: 382225 - DNA, 25 bp, Mus musculus
ctgattttatttaatgcaagctgct

SEQ ID NO: 382226 - DNA, 25 bp, Mus musculus
ctgattttattttatgcaagctgct

SEQ ID NO: 382227 - DNA, 25 bp, Mus musculus
ctgattttcaacatatctgaccata

SEQ ID NO: 382228 - DNA, 25 bp, Mus musculus
ctgattttcaacttatctgaccata

SEQ ID NO: 382229 - DNA, 25 bp, Mus musculus
ctgattttcaagacaactaggttag

SEQ ID NO: 382230 - DNA, 25 bp, Mus musculus
ctgattttcaagtcaactaggttag

SEQ ID NO: 382231 - DNA, 25 bp, Mus musculus
ctgattttctccagacctttctaag

SEQ ID NO: 382232 - DNA, 25 bp, Mus musculus
ctgattttctcctgacctttctaag

SEQ ID NO: 382233 - DNA, 25 bp, Mus musculus
ctgattttgccccaatggtaggaaa

SEQ ID NO: 382234 - DNA, 25 bp, Mus musculus
ctgattttgcccgaatggtaggaaa

SEQ ID NO: 382235 - DNA, 25 bp, Mus musculus
ctgattttgttaacatgggtactat

SEQ ID NO: 382236 - DNA, 25 bp, Mus musculus
ctgattttgttatcatgggtactat

SEQ ID NO: 382237 - DNA, 25 bp, Mus musculus
ctgattttgttgactgtttgcctaa

SEQ ID NO: 382238 - DNA, 25 bp, Mus musculus
ctgattttgttgtctgtttgcctaa

SEQ ID NO: 382239 - DNA, 25 bp, Mus musculus
ctgatttttccaacttttgtaatta

SEQ ID NO: 382240 - DNA, 25 bp, Mus musculus
ctgatttttccatcttttgtaatta

SEQ ID NO: 382241 - DNA, 25 bp, Mus musculus
ctgcaaaaaatcctggctcaaaaaa

SEQ ID NO: 382242 - DNA, 25 bp, Mus musculus
ctgcaaaaaatcgtggctcaaaaaa

SEQ ID NO: 382243 - DNA, 25 bp, Mus musculus
ctgcaaaagaggagaacgagttcgt

SEQ ID NO: 382244 - DNA, 25 bp, Mus musculus
ctgcaaaagaggtgaacgagttcgt

SEQ ID NO: 382245 - DNA, 25 bp, Mus musculus
ctgcaaaatttaccgaaccatcacg

SEQ ID NO: 382246 - DNA, 25 bp, Mus musculus
ctgcaaaatttagcgaaccatcacg

SEQ ID NO: 382247 - DNA, 25 bp, Mus musculus
ctgcaaacagaaactcaccttcact

SEQ ID NO: 382248 - DNA, 25 bp, Mus musculus
ctgcaaacagaatctcaccttcact

SEQ ID NO: 382249 - DNA, 25 bp, Mus musculus
ctgcaaacagggacttccagaatag

SEQ ID NO: 382250 - DNA, 25 bp, Mus musculus
ctgcaaacagggtcttccagaatag

SEQ ID NO: 382251 - DNA, 25 bp, Mus musculus
ctgcaaaccgatctatcctttctgt

SEQ ID NO: 382252 - DNA, 25 bp, Mus musculus
ctgcaaaccgatgtatcctttctgt

SEQ ID NO: 382253 - DNA, 25 bp, Mus musculus
ctgcaaacttccctgggtgagtgtg

SEQ ID NO: 382254 - DNA, 25 bp, Mus musculus
ctgcaaacttccgtgggtgagtgtg

SEQ ID NO: 382255 - DNA, 25 bp, Mus musculus
ctgcaaagagcaccatagagtcatg

SEQ ID NO: 382256 - DNA, 25 bp, Mus musculus
ctgcaaagagcactggatcgggcct

SEQ ID NO: 382257 - DNA, 25 bp, Mus musculus
ctgcaaagagcagcatagagtcatg

SEQ ID NO: 382258 - DNA, 25 bp, Mus musculus
ctgcaaagagcagtggatcgggcct

SEQ ID NO: 382259 - DNA, 25 bp, Mus musculus
ctgcaaagcaggcactgtggatttt

SEQ ID NO: 382260 - DNA, 25 bp, Mus musculus
ctgcaaagcagggactgtggatttt

SEQ ID NO: 382261 - DNA, 25 bp, Mus musculus
ctgcaaaggctgagctgggccagct

SEQ ID NO: 382262 - DNA, 25 bp, Mus musculus
ctgcaaaggctgtgctgggccagct

SEQ ID NO: 382263 - DNA, 25 bp, Mus musculus
ctgcaaagggcacgtttagagaaca

SEQ ID NO: 382264 - DNA, 25 bp, Mus musculus
ctgcaaagggcaggtttagagaaca

SEQ ID NO: 382265 - DNA, 25 bp, Mus musculus
ctgcaaatcagtcttgactgtagcc

SEQ ID NO: 382266 - DNA, 25 bp, Mus musculus
ctgcaaatcagtgttgactgtagcc

SEQ ID NO: 382267 - DNA, 25 bp, Mus musculus
ctgcaaatgatgagacgctttaaga

SEQ ID NO: 382268 - DNA, 25 bp, Mus musculus
ctgcaaatgatgtgacgctttaaga

SEQ ID NO: 382269 - DNA, 25 bp, Mus musculus
ctgcaacaccagcagagggctctca

SEQ ID NO: 382270 - DNA, 25 bp, Mus musculus
ctgcaacaccaggagagggctctca

SEQ ID NO: 382271 - DNA, 25 bp, Mus musculus
ctgcaaccatcaatatcccaaattc

SEQ ID NO: 382272 - DNA, 25 bp, Mus musculus
ctgcaaccatcattatcccaaattc

SEQ ID NO: 382273 - DNA, 25 bp, Mus musculus
ctgcaacccatcatcgaacaaactg

SEQ ID NO: 382274 - DNA, 25 bp, Mus musculus
ctgcaacccatcttcgaacaaactg

SEQ ID NO: 382275 - DNA, 25 bp, Mus musculus
ctgcaaccctatattcgaagacatt

SEQ ID NO: 382276 - DNA, 25 bp, Mus musculus
ctgcaaccctattttcgaagacatt

SEQ ID NO: 382277 - DNA, 25 bp, Mus musculus
ctgcaaccctttagttttctcatat

SEQ ID NO: 382278 - DNA, 25 bp, Mus musculus
ctgcaacccttttgttttctcatat

SEQ ID NO: 382279 - DNA, 25 bp, Mus musculus
ctgcaacctgcaattactcaacttg

SEQ ID NO: 382280 - DNA, 25 bp, Mus musculus
ctgcaacctgcatttactcaacttg

SEQ ID NO: 382281 - DNA, 25 bp, Mus musculus
ctgcaacggattcagaagcagcgag

SEQ ID NO: 382282 - DNA, 25 bp, Mus musculus
ctgcaacggattgagaagcagcgag

SEQ ID NO: 382283 - DNA, 25 bp, Mus musculus
ctgcaacgtgccattttcaaccagg

SEQ ID NO: 382284 - DNA, 25 bp, Mus musculus
ctgcaacgtgcccttgatgttggaa

SEQ ID NO: 382285 - DNA, 25 bp, Mus musculus
ctgcaacgtgccgttgatgttggaa

SEQ ID NO: 382286 - DNA, 25 bp, Mus musculus
ctgcaacgtgcctttttcaaccagg

SEQ ID NO: 382287 - DNA, 25 bp, Mus musculus
ctgcaactcgtgctgtcctagtgaa

SEQ ID NO: 382288 - DNA, 25 bp, Mus musculus
ctgcaactcgtggtgtcctagtgaa

SEQ ID NO: 382289 - DNA, 25 bp, Mus musculus
ctgcaacttctaaatctaaccctaa

SEQ ID NO: 382290 - DNA, 25 bp, Mus musculus
ctgcaacttctatatctaaccctaa

SEQ ID NO: 382291 - DNA, 25 bp, Mus musculus
ctgcaagaattcaagcatgctgtta

SEQ ID NO: 382292 - DNA, 25 bp, Mus musculus
ctgcaagaattctagcatgctgtta

SEQ ID NO: 382293 - DNA, 25 bp, Mus musculus
ctgcaagacaggacacacaccaagg

SEQ ID NO: 382294 - DNA, 25 bp, Mus musculus
ctgcaagacaggtcacacaccaagg

SEQ ID NO: 382295 - DNA, 25 bp, Mus musculus
ctgcaagacctactcttctagagca

SEQ ID NO: 382296 - DNA, 25 bp, Mus musculus
ctgcaagacctagtcttctagagca

SEQ ID NO: 382297 - DNA, 25 bp, Mus musculus
ctgcaagagtccctttagcctggca

SEQ ID NO: 382298 - DNA, 25 bp, Mus musculus
ctgcaagagtccgtttagcctggca

SEQ ID NO: 382299 - DNA, 25 bp, Mus musculus
ctgcaagcaagactcttcactctgg

SEQ ID NO: 382300 - DNA, 25 bp, Mus musculus
ctgcaagcaagagtcttcactctgg

SEQ ID NO: 382301 - DNA, 25 bp, Mus musculus
ctgcaagcctacaacctggtttatt

SEQ ID NO: 382302 - DNA, 25 bp, Mus musculus
ctgcaagcctactacctggtttatt

SEQ ID NO: 382303 - DNA, 25 bp, Mus musculus
ctgcaagctgaacccagcgtggctc

SEQ ID NO: 382304 - DNA, 25 bp, Mus musculus
ctgcaagctgaagccagcgtggctc

SEQ ID NO: 382305 - DNA, 25 bp, Mus musculus
ctgcaaggaagcaaaatcaccaggc

SEQ ID NO: 382306 - DNA, 25 bp, Mus musculus
ctgcaaggaagctaaatcaccaggc

SEQ ID NO: 382307 - DNA, 25 bp, Mus musculus
ctgcaaggctttacgggttctgttc

SEQ ID NO: 382308 - DNA, 25 bp, Mus musculus
ctgcaaggcttttcgggttctgttc

SEQ ID NO: 382309 - DNA, 25 bp, Mus musculus
ctgcaagggcagaagtgctctttat

SEQ ID NO: 382310 - DNA, 25 bp, Mus musculus
ctgcaagggcagtagtgctctttat

SEQ ID NO: 382311 - DNA, 25 bp, Mus musculus
ctgcaagtaaacctgtgttaacact

SEQ ID NO: 382312 - DNA, 25 bp, Mus musculus
ctgcaagtaaacgtgtgttaacact

SEQ ID NO: 382313 - DNA, 25 bp, Mus musculus
ctgcaagtcaggcactctggtagct

SEQ ID NO: 382314 - DNA, 25 bp, Mus musculus
ctgcaagtcagggactctggtagct

SEQ ID NO: 382315 - DNA, 25 bp, Mus musculus
ctgcaagtgctgaccctaaacatag

SEQ ID NO: 382316 - DNA, 25 bp, Mus musculus
ctgcaagtgctgtccctaaacatag

SEQ ID NO: 382317 - DNA, 25 bp, Mus musculus
ctgcaagtggacatgcttactctct

SEQ ID NO: 382318 - DNA, 25 bp, Mus musculus
ctgcaagtggacttgcttactctct

SEQ ID NO: 382319 - DNA, 25 bp, Mus musculus
ctgcaagtgggtctccagcatggct

SEQ ID NO: 382320 - DNA, 25 bp, Mus musculus
ctgcaagtgggtgtccagcatggct

SEQ ID NO: 382321 - DNA, 25 bp, Mus musculus
ctgcaagtgtgaagtccttcagaaa

SEQ ID NO: 382322 - DNA, 25 bp, Mus musculus
ctgcaagtgtgatgtccttcagaaa

SEQ ID NO: 382323 - DNA, 25 bp, Mus musculus
ctgcaataatatcaccctaatggct

SEQ ID NO: 382324 - DNA, 25 bp, Mus musculus
ctgcaataatatgaccctaatggct

SEQ ID NO: 382325 - DNA, 25 bp, Mus musculus
ctgcaatcatgacctctcgatgtct

SEQ ID NO: 382326 - DNA, 25 bp, Mus musculus
ctgcaatcatgagctctcgatgtct

SEQ ID NO: 382327 - DNA, 25 bp, Mus musculus
ctgcaatgaatacccttgcttcaag

SEQ ID NO: 382328 - DNA, 25 bp, Mus musculus
ctgcaatgaatagccttgcttcaag

SEQ ID NO: 382329 - DNA, 25 bp, Mus musculus
ctgcaatgcatacccttcattccta

SEQ ID NO: 382330 - DNA, 25 bp, Mus musculus
ctgcaatgcatagccttcattccta

SEQ ID NO: 382331 - DNA, 25 bp, Mus musculus
ctgcaatgtcagagatggtttcaaa

SEQ ID NO: 382332 - DNA, 25 bp, Mus musculus
ctgcaatgtcagtgatggtttcaaa

SEQ ID NO: 382333 - DNA, 25 bp, Mus musculus
ctgcaatgtctgaccccaaacatag

SEQ ID NO: 382334 - DNA, 25 bp, Mus musculus
ctgcaatgtctgtccccaaacatag

SEQ ID NO: 382335 - DNA, 25 bp, Mus musculus
ctgcaatgtggcaaatggcttcttt

SEQ ID NO: 382336 - DNA, 25 bp, Mus musculus
ctgcaatgtggctaatggcttcttt

SEQ ID NO: 382337 - DNA, 25 bp, Mus musculus
ctgcaattctttcctcttgaagtgc

SEQ ID NO: 382338 - DNA, 25 bp, Mus musculus
ctgcaattctttgctcttgaagtgc

SEQ ID NO: 382339 - DNA, 25 bp, Mus musculus
ctgcaatttattaacaggcctgttg

SEQ ID NO: 382340 - DNA, 25 bp, Mus musculus
ctgcaatttatttacaggcctgttg

SEQ ID NO: 382341 - DNA, 25 bp, Mus musculus
ctgcaatttttgattcctgggaagg

SEQ ID NO: 382342 - DNA, 25 bp, Mus musculus
ctgcaatttttgtttcctgggaagg

SEQ ID NO: 382343 - DNA, 25 bp, Mus musculus
ctgcacaatgagattctgcctcagg

SEQ ID NO: 382344 - DNA, 25 bp, Mus musculus
ctgcacaatgagtttctgcctcagg

SEQ ID NO: 382345 - DNA, 25 bp, Mus musculus
ctgcacaattggcatcacatttacc

SEQ ID NO: 382346 - DNA, 25 bp, Mus musculus
ctgcacaattgggatcacatttacc

SEQ ID NO: 382347 - DNA, 25 bp, Mus musculus
ctgcacacatgccattaaagaaatg

SEQ ID NO: 382348 - DNA, 25 bp, Mus musculus
ctgcacacatgcgattaaagaaatg

SEQ ID NO: 382349 - DNA, 25 bp, Mus musculus
ctgcacacgaagctgaggaagaatc

SEQ ID NO: 382350 - DNA, 25 bp, Mus musculus
ctgcacacgaaggtgaggaagaatc

SEQ ID NO: 382351 - DNA, 25 bp, Mus musculus
ctgcacacggtgcttccatcctgag

SEQ ID NO: 382352 - DNA, 25 bp, Mus musculus
ctgcacacggtggttccatcctgag

SEQ ID NO: 382353 - DNA, 25 bp, Mus musculus
ctgcacactattctttgggcttgga

SEQ ID NO: 382354 - DNA, 25 bp, Mus musculus
ctgcacactattgtttgggcttgga

SEQ ID NO: 382355 - DNA, 25 bp, Mus musculus
ctgcacactgcaagagaggttttca

SEQ ID NO: 382356 - DNA, 25 bp, Mus musculus
ctgcacactgcatgagaggttttca

SEQ ID NO: 382357 - DNA, 25 bp, Mus musculus
ctgcacagcaacactcaattgtctg

SEQ ID NO: 382358 - DNA, 25 bp, Mus musculus
ctgcacagcaactctcaattgtctg

SEQ ID NO: 382359 - DNA, 25 bp, Mus musculus
ctgcacagcctgaaagcgctgggca

SEQ ID NO: 382360 - DNA, 25 bp, Mus musculus
ctgcacagcctgtaagcgctgggca

SEQ ID NO: 382361 - DNA, 25 bp, Mus musculus
ctgcacagcgtacaggctcaggaaa

SEQ ID NO: 382362 - DNA, 25 bp, Mus musculus
ctgcacagcgtagaggctcaggaaa

SEQ ID NO: 382363 - DNA, 25 bp, Mus musculus
ctgcacaggcacagcttgttctcct

SEQ ID NO: 382364 - DNA, 25 bp, Mus musculus
ctgcacaggcactgcttgttctcct

SEQ ID NO: 382365 - DNA, 25 bp, Mus musculus
ctgcacaggctccagtgtagatacc

SEQ ID NO: 382366 - DNA, 25 bp, Mus musculus
ctgcacaggctcgagtgtagatacc

SEQ ID NO: 382367 - DNA, 25 bp, Mus musculus
ctgcacatagctaaccatcatgctt

SEQ ID NO: 382368 - DNA, 25 bp, Mus musculus
ctgcacatagcttaccatcatgctt

SEQ ID NO: 382369 - DNA, 25 bp, Mus musculus
ctgcacatctacacggctaatcaaa

SEQ ID NO: 382370 - DNA, 25 bp, Mus musculus
ctgcacatctactcggctaatcaaa

SEQ ID NO: 382371 - DNA, 25 bp, Mus musculus
ctgcacatctcacgcgcatgcggaa

SEQ ID NO: 382372 - DNA, 25 bp, Mus musculus
ctgcacatctcaggcgcatgcggaa

SEQ ID NO: 382373 - DNA, 25 bp, Mus musculus
ctgcacatgagccacgagacggatg

SEQ ID NO: 382374 - DNA, 25 bp, Mus musculus
ctgcacatgagcgacgagacggatg

SEQ ID NO: 382375 - DNA, 25 bp, Mus musculus
ctgcacatgcatagagtatctactg

SEQ ID NO: 382376 - DNA, 25 bp, Mus musculus
ctgcacatgcattgagtatctactg

SEQ ID NO: 382377 - DNA, 25 bp, Mus musculus
ctgcacatgggcctccaaaagtaat

SEQ ID NO: 382378 - DNA, 25 bp, Mus musculus
ctgcacatgggcgtccaaaagtaat

SEQ ID NO: 382379 - DNA, 25 bp, Mus musculus
ctgcacatgtgaaattggtagagtt

SEQ ID NO: 382380 - DNA, 25 bp, Mus musculus
ctgcacatgtgatattggtagagtt

SEQ ID NO: 382381 - DNA, 25 bp, Mus musculus
ctgcacattcccagtctgtagtggg

SEQ ID NO: 382382 - DNA, 25 bp, Mus musculus
ctgcacattccctgtctgtagtggg

SEQ ID NO: 382383 - DNA, 25 bp, Mus musculus
ctgcacattgctaggactcttgaga

SEQ ID NO: 382384 - DNA, 25 bp, Mus musculus
ctgcacattgcttggactcttgaga

SEQ ID NO: 382385 - DNA, 25 bp, Mus musculus
ctgcacatttgcaatctttacttat

SEQ ID NO: 382386 - DNA, 25 bp, Mus musculus
ctgcacatttgctatctttacttat

SEQ ID NO: 382387 - DNA, 25 bp, Mus musculus
ctgcaccacagaccacgctagtttg

SEQ ID NO: 382388 - DNA, 25 bp, Mus musculus
ctgcaccacagagcacgctagtttg

SEQ ID NO: 382389 - DNA, 25 bp, Mus musculus
ctgcaccacatacctgtagctaaag

SEQ ID NO: 382390 - DNA, 25 bp, Mus musculus
ctgcaccacatagctgtagctaaag

SEQ ID NO: 382391 - DNA, 25 bp, Mus musculus
ctgcaccagtcaatgatgagcccat

SEQ ID NO: 382392 - DNA, 25 bp, Mus musculus
ctgcaccagtcattgatgagcccat

SEQ ID NO: 382393 - DNA, 25 bp, Mus musculus
ctgcaccagtgtcgaatggagtctc

SEQ ID NO: 382394 - DNA, 25 bp, Mus musculus
ctgcaccagtgtggaatggagtctc

SEQ ID NO: 382395 - DNA, 25 bp, Mus musculus
ctgcaccatttcagcaagaatcgct

SEQ ID NO: 382396 - DNA, 25 bp, Mus musculus
ctgcaccatttctgcaagaatcgct

SEQ ID NO: 382397 - DNA, 25 bp, Mus musculus
ctgcacccacataagctaagtaggc

SEQ ID NO: 382398 - DNA, 25 bp, Mus musculus
ctgcacccacattagctaagtaggc

SEQ ID NO: 382399 - DNA, 25 bp, Mus musculus
ctgcacccatatctcttcgagttac

SEQ ID NO: 382400 - DNA, 25 bp, Mus musculus
ctgcacccatatgtcttcgagttac

SEQ ID NO: 382401 - DNA, 25 bp, Mus musculus
ctgcacccatggagcgctactgcag

SEQ ID NO: 382402 - DNA, 25 bp, Mus musculus
ctgcacccatggtgcgctactgcag

SEQ ID NO: 382403 - DNA, 25 bp, Mus musculus
ctgcaccccatgaggtccgactgaa

SEQ ID NO: 382404 - DNA, 25 bp, Mus musculus
ctgcaccccatgtggtccgactgaa

SEQ ID NO: 382405 - DNA, 25 bp, Mus musculus
ctgcacccggtgatatgtttaaaaa

SEQ ID NO: 382406 - DNA, 25 bp, Mus musculus
ctgcacccggtgttatgtttaaaaa

SEQ ID NO: 382407 - DNA, 25 bp, Mus musculus
ctgcaccctgctatttacatggatg

SEQ ID NO: 382408 - DNA, 25 bp, Mus musculus
ctgcaccctgctttttacatggatg

SEQ ID NO: 382409 - DNA, 25 bp, Mus musculus
ctgcaccgcacacagttggaggatc

SEQ ID NO: 382410 - DNA, 25 bp, Mus musculus
ctgcaccgcacagagttggaggatc

SEQ ID NO: 382411 - DNA, 25 bp, Mus musculus
ctgcacctacatctagctgggaaac

SEQ ID NO: 382412 - DNA, 25 bp, Mus musculus
ctgcacctacatgtagctgggaaac

SEQ ID NO: 382413 - DNA, 25 bp, Mus musculus
ctgcacctgcagacttgccaaagat

SEQ ID NO: 382414 - DNA, 25 bp, Mus musculus
ctgcacctgcagcataaggatgatc

SEQ ID NO: 382415 - DNA, 25 bp, Mus musculus
ctgcacctgcaggataaggatgatc

SEQ ID NO: 382416 - DNA, 25 bp, Mus musculus
ctgcacctgcagtcttgccaaagat

SEQ ID NO: 382417 - DNA, 25 bp, Mus musculus
ctgcacctgcataagctgctacaaa

SEQ ID NO: 382418 - DNA, 25 bp, Mus musculus
ctgcacctgcattagctgctacaaa

SEQ ID NO: 382419 - DNA, 25 bp, Mus musculus
ctgcacctgtgtataagcctttatg

SEQ ID NO: 382420 - DNA, 25 bp, Mus musculus
ctgcacctgtgtttaagcctttatg

SEQ ID NO: 382421 - DNA, 25 bp, Mus musculus
ctgcaccttcataattcaagcttgc

SEQ ID NO: 382422 - DNA, 25 bp, Mus musculus
ctgcaccttcattattcaagcttgc

SEQ ID NO: 382423 - DNA, 25 bp, Mus musculus
ctgcaccttctactccacagaaaag

SEQ ID NO: 382424 - DNA, 25 bp, Mus musculus
ctgcaccttctagtccacagaaaag

SEQ ID NO: 382425 - DNA, 25 bp, Mus musculus
ctgcaccttgcaaatttaatcggga

SEQ ID NO: 382426 - DNA, 25 bp, Mus musculus
ctgcaccttgcatatttaatcggga

SEQ ID NO: 382427 - DNA, 25 bp, Mus musculus
ctgcaccttggacttgtcttttatc

SEQ ID NO: 382428 - DNA, 25 bp, Mus musculus
ctgcaccttggagttgtcttttatc

SEQ ID NO: 382429 - DNA, 25 bp, Mus musculus
ctgcacgatgaactcctgaacctgt

SEQ ID NO: 382430 - DNA, 25 bp, Mus musculus
ctgcacgatgaagtcctgaacctgt

SEQ ID NO: 382431 - DNA, 25 bp, Mus musculus
ctgcacgcctagcaatggatctgtt

SEQ ID NO: 382432 - DNA, 25 bp, Mus musculus
ctgcacgcctaggaatggatctgtt

SEQ ID NO: 382433 - DNA, 25 bp, Mus musculus
ctgcacgctttgattgttcctgaga

SEQ ID NO: 382434 - DNA, 25 bp, Mus musculus
ctgcacgctttgtttgttcctgaga

SEQ ID NO: 382435 - DNA, 25 bp, Mus musculus
ctgcacgggcctcatggacaacatg

SEQ ID NO: 382436 - DNA, 25 bp, Mus musculus
ctgcacgggcctgatggacaacatg

SEQ ID NO: 382437 - DNA, 25 bp, Mus musculus
ctgcacggggctactttaatactag

SEQ ID NO: 382438 - DNA, 25 bp, Mus musculus
ctgcacggggcttctttaatactag

SEQ ID NO: 382439 - DNA, 25 bp, Mus musculus
ctgcacgtatgtatgggtatcgggt

SEQ ID NO: 382440 - DNA, 25 bp, Mus musculus
ctgcacgtatgtttgggtatcgggt

SEQ ID NO: 382441 - DNA, 25 bp, Mus musculus
ctgcacgtttgcctgtatgaatttc

SEQ ID NO: 382442 - DNA, 25 bp, Mus musculus
ctgcacgtttgcgtgtatgaatttc

SEQ ID NO: 382443 - DNA, 25 bp, Mus musculus
ctgcactaagaacggttgatttgga

SEQ ID NO: 382444 - DNA, 25 bp, Mus musculus
ctgcactaagaagggttgatttgga

SEQ ID NO: 382445 - DNA, 25 bp, Mus musculus
ctgcactaatgacagcctggaccca

SEQ ID NO: 382446 - DNA, 25 bp, Mus musculus
ctgcactaatgagagcctggaccca

SEQ ID NO: 382447 - DNA, 25 bp, Mus musculus
ctgcactactgacctggagctggct

SEQ ID NO: 382448 - DNA, 25 bp, Mus musculus
ctgcactactgagctggagctggct

SEQ ID NO: 382449 - DNA, 25 bp, Mus musculus
ctgcactagtgcatggaatttttaa

SEQ ID NO: 382450 - DNA, 25 bp, Mus musculus
ctgcactagtgcttggaatttttaa

SEQ ID NO: 382451 - DNA, 25 bp, Mus musculus
ctgcactcaagtcccttaaatatat

SEQ ID NO: 382452 - DNA, 25 bp, Mus musculus
ctgcactcaagtgccttaaatatat

SEQ ID NO: 382453 - DNA, 25 bp, Mus musculus
ctgcactcctcaacactgggaaaat

SEQ ID NO: 382454 - DNA, 25 bp, Mus musculus
ctgcactcctcatcactgggaaaat

SEQ ID NO: 382455 - DNA, 25 bp, Mus musculus
ctgcactgaactagagacactcaag

SEQ ID NO: 382456 - DNA, 25 bp, Mus musculus
ctgcactgaacttgagacactcaag

SEQ ID NO: 382457 - DNA, 25 bp, Mus musculus
ctgcactgagcgaggcaaccagaat

SEQ ID NO: 382458 - DNA, 25 bp, Mus musculus
ctgcactgagcgtggcaaccagaat

SEQ ID NO: 382459 - DNA, 25 bp, Mus musculus
ctgcactgatgaagtcccctgagaa

SEQ ID NO: 382460 - DNA, 25 bp, Mus musculus
ctgcactgatgatgtcccctgagaa

SEQ ID NO: 382461 - DNA, 25 bp, Mus musculus
ctgcactgcaccagtattgagtgga

SEQ ID NO: 382462 - DNA, 25 bp, Mus musculus
ctgcactgcacctgtattgagtgga

SEQ ID NO: 382463 - DNA, 25 bp, Mus musculus
ctgcactgcactcgtaattacattc

SEQ ID NO: 382464 - DNA, 25 bp, Mus musculus
ctgcactgcactggtaattacattc

SEQ ID NO: 382465 - DNA, 25 bp, Mus musculus
ctgcactgcaggcagccttggagaa

SEQ ID NO: 382466 - DNA, 25 bp, Mus musculus
ctgcactgcagggagccttggagaa

SEQ ID NO: 382467 - DNA, 25 bp, Mus musculus
ctgcactgccaaaagcactgctatg

SEQ ID NO: 382468 - DNA, 25 bp, Mus musculus
ctgcactgccaatagcactgctatg

SEQ ID NO: 382469 - DNA, 25 bp, Mus musculus
ctgcactgctagatatatttttaga

SEQ ID NO: 382470 - DNA, 25 bp, Mus musculus
ctgcactgctagttatatttttaga

SEQ ID NO: 382471 - DNA, 25 bp, Mus musculus
ctgcactggatacatttgtacgacg

SEQ ID NO: 382472 - DNA, 25 bp, Mus musculus
ctgcactggatagatttgtacgacg

SEQ ID NO: 382473 - DNA, 25 bp, Mus musculus
ctgcactgggacatatggacgcctt

SEQ ID NO: 382474 - DNA, 25 bp, Mus musculus
ctgcactgggacttatggacgcctt

SEQ ID NO: 382475 - DNA, 25 bp, Mus musculus
ctgcactgggatccccgcaaatgaa

SEQ ID NO: 382476 - DNA, 25 bp, Mus musculus
ctgcactgggatgcccgcaaatgaa

SEQ ID NO: 382477 - DNA, 25 bp, Mus musculus
ctgcactgtggactatctgtggatt

SEQ ID NO: 382478 - DNA, 25 bp, Mus musculus
ctgcactgtggagtatctgtggatt

SEQ ID NO: 382479 - DNA, 25 bp, Mus musculus
ctgcactgtttccaaaaagcacatg

SEQ ID NO: 382480 - DNA, 25 bp, Mus musculus
ctgcactgtttcgaaaaagcacatg

SEQ ID NO: 382481 - DNA, 25 bp, Mus musculus
ctgcacttagcacggattcggtcct

SEQ ID NO: 382482 - DNA, 25 bp, Mus musculus
ctgcacttagcagggattcggtcct

SEQ ID NO: 382483 - DNA, 25 bp, Mus musculus
ctgcacttccttagtctattggtta

SEQ ID NO: 382484 - DNA, 25 bp, Mus musculus
ctgcacttcctttgtctattggtta

SEQ ID NO: 382485 - DNA, 25 bp, Mus musculus
ctgcacttcgaacgccgggctcggt

SEQ ID NO: 382486 - DNA, 25 bp, Mus musculus
ctgcacttcgaaggccgggctcggt

SEQ ID NO: 382487 - DNA, 25 bp, Mus musculus
ctgcacttgatcctcagtctgaata

SEQ ID NO: 382488 - DNA, 25 bp, Mus musculus
ctgcacttgatcgtcagtctgaata

SEQ ID NO: 382489 - DNA, 25 bp, Mus musculus
ctgcacttgctaccgtgtccatggc

SEQ ID NO: 382490 - DNA, 25 bp, Mus musculus
ctgcacttgctagcgtgtccatggc

SEQ ID NO: 382491 - DNA, 25 bp, Mus musculus
ctgcacttggatcaatcactcttcg

SEQ ID NO: 382492 - DNA, 25 bp, Mus musculus
ctgcacttggatgaatcactcttcg

SEQ ID NO: 382493 - DNA, 25 bp, Mus musculus
ctgcacttggtacgtagagctaggt

SEQ ID NO: 382494 - DNA, 25 bp, Mus musculus
ctgcacttggtaggtagagctaggt

SEQ ID NO: 382495 - DNA, 25 bp, Mus musculus
ctgcacttgtgacgccacgtgtgat

SEQ ID NO: 382496 - DNA, 25 bp, Mus musculus
ctgcacttgtgaggccacgtgtgat

SEQ ID NO: 382497 - DNA, 25 bp, Mus musculus
ctgcactttactactcgaggctgaa

SEQ ID NO: 382498 - DNA, 25 bp, Mus musculus
ctgcactttacttctcgaggctgaa

SEQ ID NO: 382499 - DNA, 25 bp, Mus musculus
ctgcactttgctatgctaggagctt

SEQ ID NO: 382500 - DNA, 25 bp, Mus musculus
ctgcactttgctttgctaggagctt

SEQ ID NO: 382501 - DNA, 25 bp, Mus musculus
ctgcacttttccatgttatactcca

SEQ ID NO: 382502 - DNA, 25 bp, Mus musculus
ctgcacttttccttgttatactcca

SEQ ID NO: 382503 - DNA, 25 bp, Mus musculus
ctgcagaaccagcaacctgtaactg

SEQ ID NO: 382504 - DNA, 25 bp, Mus musculus
ctgcagaaccaggaacctgtaactg

SEQ ID NO: 382505 - DNA, 25 bp, Mus musculus
ctgcagaactggagggctttagacc

SEQ ID NO: 382506 - DNA, 25 bp, Mus musculus
ctgcagaactggtgggctttagacc

SEQ ID NO: 382507 - DNA, 25 bp, Mus musculus
ctgcagaagactcggcccgtcagca

SEQ ID NO: 382508 - DNA, 25 bp, Mus musculus
ctgcagaagactgggcccgtcagca

SEQ ID NO: 382509 - DNA, 25 bp, Mus musculus
ctgcagaagccaaccctatatattt

SEQ ID NO: 382510 - DNA, 25 bp, Mus musculus
ctgcagaagccatccctatatattt

SEQ ID NO: 382511 - DNA, 25 bp, Mus musculus
ctgcagaagctgagtcgtgagccaa

SEQ ID NO: 382512 - DNA, 25 bp, Mus musculus
ctgcagaagctgtgtcgtgagccaa

SEQ ID NO: 382513 - DNA, 25 bp, Mus musculus
ctgcagaaggcactttcccaataaa

SEQ ID NO: 382514 - DNA, 25 bp, Mus musculus
ctgcagaaggcagtttcccaataaa

SEQ ID NO: 382515 - DNA, 25 bp, Mus musculus
ctgcagaagtcactccactgtgctc

SEQ ID NO: 382516 - DNA, 25 bp, Mus musculus
ctgcagaagtcagtccactgtgctc

SEQ ID NO: 382517 - DNA, 25 bp, Mus musculus
ctgcagacacagatatacctgcctt

SEQ ID NO: 382518 - DNA, 25 bp, Mus musculus
ctgcagacacagttatacctgcctt

SEQ ID NO: 382519 - DNA, 25 bp, Mus musculus
ctgcagaccggcctagcttttccaa

SEQ ID NO: 382520 - DNA, 25 bp, Mus musculus
ctgcagaccggcgtagcttttccaa

SEQ ID NO: 382521 - DNA, 25 bp, Mus musculus
ctgcagacctaaatgggaaggaaca

SEQ ID NO: 382522 - DNA, 25 bp, Mus musculus
ctgcagacctaattgggaaggaaca

SEQ ID NO: 382523 - DNA, 25 bp, Mus musculus
ctgcagactcaccttggtaccaaga

SEQ ID NO: 382524 - DNA, 25 bp, Mus musculus
ctgcagactcacgttggtaccaaga

SEQ ID NO: 382525 - DNA, 25 bp, Mus musculus
ctgcagactctgacaacatttccaa

SEQ ID NO: 382526 - DNA, 25 bp, Mus musculus
ctgcagactctgtcaacatttccaa

SEQ ID NO: 382527 - DNA, 25 bp, Mus musculus
ctgcagactgaacttttgcccgaca

SEQ ID NO: 382528 - DNA, 25 bp, Mus musculus
ctgcagactgaagttttgcccgaca

SEQ ID NO: 382529 - DNA, 25 bp, Mus musculus
ctgcagactgagactctgggagact

SEQ ID NO: 382530 - DNA, 25 bp, Mus musculus
ctgcagactgagtctctgggagact

SEQ ID NO: 382531 - DNA, 25 bp, Mus musculus
ctgcagactggaatcgcatcagtga

SEQ ID NO: 382532 - DNA, 25 bp, Mus musculus
ctgcagactggattcgcatcagtga

SEQ ID NO: 382533 - DNA, 25 bp, Mus musculus
ctgcagactgttacctaagtaggat

SEQ ID NO: 382534 - DNA, 25 bp, Mus musculus
ctgcagactgtttcctaagtaggat

SEQ ID NO: 382535 - DNA, 25 bp, Mus musculus
ctgcagacttagaattcagttccaa

SEQ ID NO: 382536 - DNA, 25 bp, Mus musculus
ctgcagacttagtattcagttccaa

SEQ ID NO: 382537 - DNA, 25 bp, Mus musculus
ctgcagagacagactgtgtgtatca

SEQ ID NO: 382538 - DNA, 25 bp, Mus musculus
ctgcagagacagtctgtgtgtatca

SEQ ID NO: 382539 - DNA, 25 bp, Mus musculus
ctgcagagactccagtaatttttct

SEQ ID NO: 382540 - DNA, 25 bp, Mus musculus
ctgcagagactcgagtaatttttct

SEQ ID NO: 382541 - DNA, 25 bp, Mus musculus
ctgcagagcaggacctgaccacaaa

SEQ ID NO: 382542 - DNA, 25 bp, Mus musculus
ctgcagagcaggtcctgaccacaaa

SEQ ID NO: 382543 - DNA, 25 bp, Mus musculus
ctgcagagcgctcggtagagaccaa

SEQ ID NO: 382544 - DNA, 25 bp, Mus musculus
ctgcagagcgctgggtagagaccaa

SEQ ID NO: 382545 - DNA, 25 bp, Mus musculus
ctgcagaggagtaggacgcacagct

SEQ ID NO: 382546 - DNA, 25 bp, Mus musculus
ctgcagaggagttggacgcacagct

SEQ ID NO: 382547 - DNA, 25 bp, Mus musculus
ctgcagaggctcattaagtatattt

SEQ ID NO: 382548 - DNA, 25 bp, Mus musculus
ctgcagaggctctttaagtatattt

SEQ ID NO: 382549 - DNA, 25 bp, Mus musculus
ctgcagagtaaacgctcacgagagt

SEQ ID NO: 382550 - DNA, 25 bp, Mus musculus
ctgcagagtaaaggctcacgagagt

SEQ ID NO: 382551 - DNA, 25 bp, Mus musculus
ctgcagagtattacaaggcttacat

SEQ ID NO: 382552 - DNA, 25 bp, Mus musculus
ctgcagagtattctgaggacttcct

SEQ ID NO: 382553 - DNA, 25 bp, Mus musculus
ctgcagagtattgtgaggacttcct

SEQ ID NO: 382554 - DNA, 25 bp, Mus musculus
ctgcagagtatttcaaggcttacat

SEQ ID NO: 382555 - DNA, 25 bp, Mus musculus
ctgcagagtgcaccaataccctttt

SEQ ID NO: 382556 - DNA, 25 bp, Mus musculus
ctgcagagtgcagcaataccctttt

SEQ ID NO: 382557 - DNA, 25 bp, Mus musculus
ctgcagagtggcatgcatgcacaga

SEQ ID NO: 382558 - DNA, 25 bp, Mus musculus
ctgcagagtggcttgcatgcacaga

SEQ ID NO: 382559 - DNA, 25 bp, Mus musculus
ctgcagatcctcctgtgcagttcac

SEQ ID NO: 382560 - DNA, 25 bp, Mus musculus
ctgcagatcctcgtgtgcagttcac

SEQ ID NO: 382561 - DNA, 25 bp, Mus musculus
ctgcagatcggtcgccctattgagt

SEQ ID NO: 382562 - DNA, 25 bp, Mus musculus
ctgcagatcggtggccctattgagt

SEQ ID NO: 382563 - DNA, 25 bp, Mus musculus
ctgcagatgaatcatggtgacgact

SEQ ID NO: 382564 - DNA, 25 bp, Mus musculus
ctgcagatgaatgatggtgacgact

SEQ ID NO: 382565 - DNA, 25 bp, Mus musculus
ctgcagatgccacatgccaggcgtg

SEQ ID NO: 382566 - DNA, 25 bp, Mus musculus
ctgcagatgccagatgccaggcgtg

SEQ ID NO: 382567 - DNA, 25 bp, Mus musculus
ctgcagatggcgctagatgtttata

SEQ ID NO: 382568 - DNA, 25 bp, Mus musculus
ctgcagatggcggtagatgtttata

SEQ ID NO: 382569 - DNA, 25 bp, Mus musculus
ctgcagattcgcaagagtgaacgta

SEQ ID NO: 382570 - DNA, 25 bp, Mus musculus
ctgcagattcgctagagtgaacgta

SEQ ID NO: 382571 - DNA, 25 bp, Mus musculus
ctgcagatttttcatcttggtttct

SEQ ID NO: 382572 - DNA, 25 bp, Mus musculus
ctgcagatttttgatcttggtttct

SEQ ID NO: 382573 - DNA, 25 bp, Mus musculus
ctgcagcaccctatgttaactataa

SEQ ID NO: 382574 - DNA, 25 bp, Mus musculus
ctgcagcaccctttgttaactataa

SEQ ID NO: 382575 - DNA, 25 bp, Mus musculus
ctgcagcacctgattccttgaaaat

SEQ ID NO: 382576 - DNA, 25 bp, Mus musculus
ctgcagcacctgtttccttgaaaat

SEQ ID NO: 382577 - DNA, 25 bp, Mus musculus
ctgcagcacgtacgactgtacactc

SEQ ID NO: 382578 - DNA, 25 bp, Mus musculus
ctgcagcacgtaggactgtacactc

SEQ ID NO: 382579 - DNA, 25 bp, Mus musculus
ctgcagcactcaatatttgcttgga

SEQ ID NO: 382580 - DNA, 25 bp, Mus musculus
ctgcagcactcattatttgcttgga

SEQ ID NO: 382581 - DNA, 25 bp, Mus musculus
ctgcagcagcacatcaagactgttg

SEQ ID NO: 382582 - DNA, 25 bp, Mus musculus
ctgcagcagcacttcaagactgttg

SEQ ID NO: 382583 - DNA, 25 bp, Mus musculus
ctgcagcagcagctgttatcgtgac

SEQ ID NO: 382584 - DNA, 25 bp, Mus musculus
ctgcagcagcaggtgttatcgtgac

SEQ ID NO: 382585 - DNA, 25 bp, Mus musculus
ctgcagcagcatacggacgggccga

SEQ ID NO: 382586 - DNA, 25 bp, Mus musculus
ctgcagcagcattcggacgggccga

SEQ ID NO: 382587 - DNA, 25 bp, Mus musculus
ctgcagcagccacataggccatgaa

SEQ ID NO: 382588 - DNA, 25 bp, Mus musculus
ctgcagcagccagataggccatgaa

SEQ ID NO: 382589 - DNA, 25 bp, Mus musculus
ctgcagcagggccagaaacagctgt

SEQ ID NO: 382590 - DNA, 25 bp, Mus musculus
ctgcagcagggcgagaaacagctgt

SEQ ID NO: 382591 - DNA, 25 bp, Mus musculus
ctgcagcagtcaagcccgatgatga

SEQ ID NO: 382592 - DNA, 25 bp, Mus musculus
ctgcagcagtcatgcccgatgatga

SEQ ID NO: 382593 - DNA, 25 bp, Mus musculus
ctgcagcatactactaacttggaaa

SEQ ID NO: 382594 - DNA, 25 bp, Mus musculus
ctgcagcatacttctaacttggaaa

SEQ ID NO: 382595 - DNA, 25 bp, Mus musculus
ctgcagcatcttcgctctacctctg

SEQ ID NO: 382596 - DNA, 25 bp, Mus musculus
ctgcagcatcttggctctacctctg

SEQ ID NO: 382597 - DNA, 25 bp, Mus musculus
ctgcagccaaatagttcttttggtt

SEQ ID NO: 382598 - DNA, 25 bp, Mus musculus
ctgcagccaaattgttcttttggtt

SEQ ID NO: 382599 - DNA, 25 bp, Mus musculus
ctgcagccagaaaggcgacttgcct

SEQ ID NO: 382600 - DNA, 25 bp, Mus musculus
ctgcagccagaatggcgacttgcct

SEQ ID NO: 382601 - DNA, 25 bp, Mus musculus
ctgcagccagtgaatgaccgggaaa

SEQ ID NO: 382602 - DNA, 25 bp, Mus musculus
ctgcagccagtgtatgaccgggaaa

SEQ ID NO: 382603 - DNA, 25 bp, Mus musculus
ctgcagccatgacagtctgctaaaa

SEQ ID NO: 382604 - DNA, 25 bp, Mus musculus
ctgcagccatgagagtctgctaaaa

SEQ ID NO: 382605 - DNA, 25 bp, Mus musculus
ctgcagccatgtcactgtcaaggac

SEQ ID NO: 382606 - DNA, 25 bp, Mus musculus
ctgcagccatgtgactgtcaaggac

SEQ ID NO: 382607 - DNA, 25 bp, Mus musculus
ctgcagccctctcggatgcaggaga

SEQ ID NO: 382608 - DNA, 25 bp, Mus musculus
ctgcagccctctgggatgcaggaga

SEQ ID NO: 382609 - DNA, 25 bp, Mus musculus
ctgcagccctggaaacattacattc

SEQ ID NO: 382610 - DNA, 25 bp, Mus musculus
ctgcagccctggatgagatgtttca

SEQ ID NO: 382611 - DNA, 25 bp, Mus musculus
ctgcagccctggtaacattacattc

SEQ ID NO: 382612 - DNA, 25 bp, Mus musculus
ctgcagccctggttgagatgtttca

SEQ ID NO: 382613 - DNA, 25 bp, Mus musculus
ctgcagcctagtaagaccacacaga

SEQ ID NO: 382614 - DNA, 25 bp, Mus musculus
ctgcagcctagttagaccacacaga

SEQ ID NO: 382615 - DNA, 25 bp, Mus musculus
ctgcagcctattcttccttgggaag

SEQ ID NO: 382616 - DNA, 25 bp, Mus musculus
ctgcagcctattgttccttgggaag

SEQ ID NO: 382617 - DNA, 25 bp, Mus musculus
ctgcagcctctgaggaaatagacgc

SEQ ID NO: 382618 - DNA, 25 bp, Mus musculus
ctgcagcctctgtggaaatagacgc

SEQ ID NO: 382619 - DNA, 25 bp, Mus musculus
ctgcagcctgcaagtgctttgagaa

SEQ ID NO: 382620 - DNA, 25 bp, Mus musculus
ctgcagcctgcatgtgctttgagaa

SEQ ID NO: 382621 - DNA, 25 bp, Mus musculus
ctgcagcctgtgcttctgctaggat

SEQ ID NO: 382622 - DNA, 25 bp, Mus musculus
ctgcagcctgtggttctgctaggat

SEQ ID NO: 382623 - DNA, 25 bp, Mus musculus
ctgcagcctgttactcaataaacag

SEQ ID NO: 382624 - DNA, 25 bp, Mus musculus
ctgcagcctgtttctcaataaacag

SEQ ID NO: 382625 - DNA, 25 bp, Mus musculus
ctgcagcgctcaatgcacattagaa

SEQ ID NO: 382626 - DNA, 25 bp, Mus musculus
ctgcagcgctcattgcacattagaa

SEQ ID NO: 382627 - DNA, 25 bp, Mus musculus
ctgcagcggtgacccgcaggctgcg

SEQ ID NO: 382628 - DNA, 25 bp, Mus musculus
ctgcagcggtgagccgcaggctgcg

SEQ ID NO: 382629 - DNA, 25 bp, Mus musculus
ctgcagctaccacggacaccaggag

SEQ ID NO: 382630 - DNA, 25 bp, Mus musculus
ctgcagctaccagggacaccaggag

SEQ ID NO: 382631 - DNA, 25 bp, Mus musculus
ctgcagctcactacagtatggttgt

SEQ ID NO: 382632 - DNA, 25 bp, Mus musculus
ctgcagctcacttcagtatggttgt

SEQ ID NO: 382633 - DNA, 25 bp, Mus musculus
ctgcagctctccaataacgactaat

SEQ ID NO: 382634 - DNA, 25 bp, Mus musculus
ctgcagctctcctataacgactaat

SEQ ID NO: 382635 - DNA, 25 bp, Mus musculus
ctgcagctgacgagtcgtcttcagg

SEQ ID NO: 382636 - DNA, 25 bp, Mus musculus
ctgcagctgacgtgtcgtcttcagg

SEQ ID NO: 382637 - DNA, 25 bp, Mus musculus
ctgcagctggataacgcaacagtaa

SEQ ID NO: 382638 - DNA, 25 bp, Mus musculus
ctgcagctggattacgcaacagtaa

SEQ ID NO: 382639 - DNA, 25 bp, Mus musculus
ctgcagctggctatggtagtggact

SEQ ID NO: 382640 - DNA, 25 bp, Mus musculus
ctgcagctggctttggtagtggact

SEQ ID NO: 382641 - DNA, 25 bp, Mus musculus
ctgcagctgggcacaacacagacat

SEQ ID NO: 382642 - DNA, 25 bp, Mus musculus
ctgcagctgggcaccctaaaaggga

SEQ ID NO: 382643 - DNA, 25 bp, Mus musculus
ctgcagctgggctcaacacagacat

SEQ ID NO: 382644 - DNA, 25 bp, Mus musculus
ctgcagctgggctccctaaaaggga

SEQ ID NO: 382645 - DNA, 25 bp, Mus musculus
ctgcagctgtacagtctaatcttcc

SEQ ID NO: 382646 - DNA, 25 bp, Mus musculus
ctgcagctgtactgtctaatcttcc

SEQ ID NO: 382647 - DNA, 25 bp, Mus musculus
ctgcagctgtccatggagagaggca

SEQ ID NO: 382648 - DNA, 25 bp, Mus musculus
ctgcagctgtccttggagagaggca

SEQ ID NO: 382649 - DNA, 25 bp, Mus musculus
ctgcagcttcctagacagacaggtt

SEQ ID NO: 382650 - DNA, 25 bp, Mus musculus
ctgcagcttccttgacagacaggtt

SEQ ID NO: 382651 - DNA, 25 bp, Mus musculus
ctgcagcttggactactgcactgca

SEQ ID NO: 382652 - DNA, 25 bp, Mus musculus
ctgcagcttggagtactgcactgca

SEQ ID NO: 382653 - DNA, 25 bp, Mus musculus
ctgcagcttgtgaagttgacgagga

SEQ ID NO: 382654 - DNA, 25 bp, Mus musculus
ctgcagcttgtgtagttgacgagga

SEQ ID NO: 382655 - DNA, 25 bp, Mus musculus
ctgcagcttttacagacccagggtg

SEQ ID NO: 382656 - DNA, 25 bp, Mus musculus
ctgcagcttttagagacccagggtg

SEQ ID NO: 382657 - DNA, 25 bp, Mus musculus
ctgcaggaaaccacaagtctgtgtg

SEQ ID NO: 382658 - DNA, 25 bp, Mus musculus
ctgcaggaaacctcaagtctgtgtg

SEQ ID NO: 382659 - DNA, 25 bp, Mus musculus
ctgcaggaaattctaaaccaccaca

SEQ ID NO: 382660 - DNA, 25 bp, Mus musculus
ctgcaggaaattgtaaaccaccaca

SEQ ID NO: 382661 - DNA, 25 bp, Mus musculus
ctgcaggaatatcgtgcacagaaat

SEQ ID NO: 382662 - DNA, 25 bp, Mus musculus
ctgcaggaatatggtgcacagaaat

SEQ ID NO: 382663 - DNA, 25 bp, Mus musculus
ctgcaggacactccctacaggtatc

SEQ ID NO: 382664 - DNA, 25 bp, Mus musculus
ctgcaggacactgcctacaggtatc

SEQ ID NO: 382665 - DNA, 25 bp, Mus musculus
ctgcaggacataccctcccggtgta

SEQ ID NO: 382666 - DNA, 25 bp, Mus musculus
ctgcaggacatagcctcccggtgta

SEQ ID NO: 382667 - DNA, 25 bp, Mus musculus
ctgcaggacctgagacctatcctct

SEQ ID NO: 382668 - DNA, 25 bp, Mus musculus
ctgcaggacctgtgacctatcctct

SEQ ID NO: 382669 - DNA, 25 bp, Mus musculus
ctgcaggagccgaagaattgaatct

SEQ ID NO: 382670 - DNA, 25 bp, Mus musculus
ctgcaggagccgtagaattgaatct

SEQ ID NO: 382671 - DNA, 25 bp, Mus musculus
ctgcaggatagtctgctggcgttct

SEQ ID NO: 382672 - DNA, 25 bp, Mus musculus
ctgcaggatagtgtgctggcgttct

SEQ ID NO: 382673 - DNA, 25 bp, Mus musculus
ctgcaggatttgattggcactgaaa

SEQ ID NO: 382674 - DNA, 25 bp, Mus musculus
ctgcaggatttgtttggcactgaaa

SEQ ID NO: 382675 - DNA, 25 bp, Mus musculus
ctgcaggcaaggacagcttctgtct

SEQ ID NO: 382676 - DNA, 25 bp, Mus musculus
ctgcaggcaaggtcagcttctgtct

SEQ ID NO: 382677 - DNA, 25 bp, Mus musculus
ctgcaggcagtgaacatggtaactc

SEQ ID NO: 382678 - DNA, 25 bp, Mus musculus
ctgcaggcagtgtacatggtaactc

SEQ ID NO: 382679 - DNA, 25 bp, Mus musculus
ctgcaggccaggatctgtattacgg

SEQ ID NO: 382680 - DNA, 25 bp, Mus musculus
ctgcaggccaggttctgtattacgg

SEQ ID NO: 382681 - DNA, 25 bp, Mus musculus
ctgcaggcccttcaaccagagaagg

SEQ ID NO: 382682 - DNA, 25 bp, Mus musculus
ctgcaggcccttgaaccagagaagg

SEQ ID NO: 382683 - DNA, 25 bp, Mus musculus
ctgcaggcgactatggagctgttgg

SEQ ID NO: 382684 - DNA, 25 bp, Mus musculus
ctgcaggcgactttggagctgttgg

SEQ ID NO: 382685 - DNA, 25 bp, Mus musculus
ctgcaggctgaacaccctgtgtgca

SEQ ID NO: 382686 - DNA, 25 bp, Mus musculus
ctgcaggctgaagaccctgtgtgca

SEQ ID NO: 382687 - DNA, 25 bp, Mus musculus
ctgcaggctgacaggttgtgactta

SEQ ID NO: 382688 - DNA, 25 bp, Mus musculus
ctgcaggctgactggttgtgactta

SEQ ID NO: 382689 - DNA, 25 bp, Mus musculus
ctgcaggcttcacaggaccttctca

SEQ ID NO: 382690 - DNA, 25 bp, Mus musculus
ctgcaggcttcagaggaccttctca

SEQ ID NO: 382691 - DNA, 25 bp, Mus musculus
ctgcagggcagacgccggttgcgta

SEQ ID NO: 382692 - DNA, 25 bp, Mus musculus
ctgcagggcagaggccggttgcgta

SEQ ID NO: 382693 - DNA, 25 bp, Mus musculus
ctgcagggctgaaaagttcccactg

SEQ ID NO: 382694 - DNA, 25 bp, Mus musculus
ctgcagggctgataagttcccactg

SEQ ID NO: 382695 - DNA, 25 bp, Mus musculus
ctgcagggctggaccatgtggccaa

SEQ ID NO: 382696 - DNA, 25 bp, Mus musculus
ctgcagggctggtccatgtggccaa

SEQ ID NO: 382697 - DNA, 25 bp, Mus musculus
ctgcagggtagtaaagtgccaacct

SEQ ID NO: 382698 - DNA, 25 bp, Mus musculus
ctgcagggtagttaagtgccaacct

SEQ ID NO: 382699 - DNA, 25 bp, Mus musculus
ctgcagggtcttcgccaccatggaa

SEQ ID NO: 382700 - DNA, 25 bp, Mus musculus
ctgcagggtcttggccaccatggaa

SEQ ID NO: 382701 - DNA, 25 bp, Mus musculus
ctgcaggtaactcgcgcgggacctc

SEQ ID NO: 382702 - DNA, 25 bp, Mus musculus
ctgcaggtaactggcgcgggacctc

SEQ ID NO: 382703 - DNA, 25 bp, Mus musculus
ctgcaggtacaaagaggccttctct

SEQ ID NO: 382704 - DNA, 25 bp, Mus musculus
ctgcaggtacaatgaggccttctct

SEQ ID NO: 382705 - DNA, 25 bp, Mus musculus
ctgcaggtccagcagctgccaagtg

SEQ ID NO: 382706 - DNA, 25 bp, Mus musculus
ctgcaggtccaggagctgccaagtg

SEQ ID NO: 382707 - DNA, 25 bp, Mus musculus
ctgcaggtccttcacccaagaggtg

SEQ ID NO: 382708 - DNA, 25 bp, Mus musculus
ctgcaggtccttgacccaagaggtg

SEQ ID NO: 382709 - DNA, 25 bp, Mus musculus
ctgcaggtcgcaattggatcactgt

SEQ ID NO: 382710 - DNA, 25 bp, Mus musculus
ctgcaggtcgcatttggatcactgt

SEQ ID NO: 382711 - DNA, 25 bp, Mus musculus
ctgcaggtcggcattgtggtgatat

SEQ ID NO: 382712 - DNA, 25 bp, Mus musculus
ctgcaggtcggctttgtggtgatat

SEQ ID NO: 382713 - DNA, 25 bp, Mus musculus
ctgcaggtgacaatgagctcacggg

SEQ ID NO: 382714 - DNA, 25 bp, Mus musculus
ctgcaggtgacattgagctcacggg

SEQ ID NO: 382715 - DNA, 25 bp, Mus musculus
ctgcaggtgattcacacggtgcgca

SEQ ID NO: 382716 - DNA, 25 bp, Mus musculus
ctgcaggtgattgacacggtgcgca

SEQ ID NO: 382717 - DNA, 25 bp, Mus musculus
ctgcaggtgcagctgtcttctgtga

SEQ ID NO: 382718 - DNA, 25 bp, Mus musculus
ctgcaggtgcaggtgtcttctgtga

SEQ ID NO: 382719 - DNA, 25 bp, Mus musculus
ctgcaggtgccaccttttgatgtta

SEQ ID NO: 382720 - DNA, 25 bp, Mus musculus
ctgcaggtgccagcttttgatgtta

SEQ ID NO: 382721 - DNA, 25 bp, Mus musculus
ctgcaggtgcgcacatggtgtatga

SEQ ID NO: 382722 - DNA, 25 bp, Mus musculus
ctgcaggtgcgctcatggtgtatga

SEQ ID NO: 382723 - DNA, 25 bp, Mus musculus
ctgcaggtggagatcatcaacccca

SEQ ID NO: 382724 - DNA, 25 bp, Mus musculus
ctgcaggtggagttcatcaacccca

SEQ ID NO: 382725 - DNA, 25 bp, Mus musculus
ctgcaggtggtgctacttgataatt

SEQ ID NO: 382726 - DNA, 25 bp, Mus musculus
ctgcaggtggtggtacttgataatt

SEQ ID NO: 382727 - DNA, 25 bp, Mus musculus
ctgcaggttcttaacatctgggttg

SEQ ID NO: 382728 - DNA, 25 bp, Mus musculus
ctgcaggttctttacatctgggttg

SEQ ID NO: 382729 - DNA, 25 bp, Mus musculus
ctgcagtacaccctcaagcccctgg

SEQ ID NO: 382730 - DNA, 25 bp, Mus musculus
ctgcagtacaccgtcaagcccctgg

SEQ ID NO: 382731 - DNA, 25 bp, Mus musculus
ctgcagtagcaaattcttttaatct

SEQ ID NO: 382732 - DNA, 25 bp, Mus musculus
ctgcagtagcaatttcttttaatct

SEQ ID NO: 382733 - DNA, 25 bp, Mus musculus
ctgcagtcacttctagtatccaaag

SEQ ID NO: 382734 - DNA, 25 bp, Mus musculus
ctgcagtcacttgtagtatccaaag

SEQ ID NO: 382735 - DNA, 25 bp, Mus musculus
ctgcagtcatgtctgagcctgatca

SEQ ID NO: 382736 - DNA, 25 bp, Mus musculus
ctgcagtcatgtgtgagcctgatca

SEQ ID NO: 382737 - DNA, 25 bp, Mus musculus
ctgcagtccaccagtttgtaacttt

SEQ ID NO: 382738 - DNA, 25 bp, Mus musculus
ctgcagtccacctgtttgtaacttt

SEQ ID NO: 382739 - DNA, 25 bp, Mus musculus
ctgcagtccacgaccagggtcagga

SEQ ID NO: 382740 - DNA, 25 bp, Mus musculus
ctgcagtccacgtccagggtcagga

SEQ ID NO: 382741 - DNA, 25 bp, Mus musculus
ctgcagtccctgacagacccttcat

SEQ ID NO: 382742 - DNA, 25 bp, Mus musculus
ctgcagtccctgtcagacccttcat

SEQ ID NO: 382743 - DNA, 25 bp, Mus musculus
ctgcagtctaaacatgacagaatag

SEQ ID NO: 382744 - DNA, 25 bp, Mus musculus
ctgcagtctaaagatgacagaatag

SEQ ID NO: 382745 - DNA, 25 bp, Mus musculus
ctgcagtctctcaggaagtattgct

SEQ ID NO: 382746 - DNA, 25 bp, Mus musculus
ctgcagtctctctggaagtattgct

SEQ ID NO: 382747 - DNA, 25 bp, Mus musculus
ctgcagtctggactctacactatga

SEQ ID NO: 382748 - DNA, 25 bp, Mus musculus
ctgcagtctggagtctacactatga

SEQ ID NO: 382749 - DNA, 25 bp, Mus musculus
ctgcagtctggcaatcattagtggc

SEQ ID NO: 382750 - DNA, 25 bp, Mus musculus
ctgcagtctggctatcattagtggc

SEQ ID NO: 382751 - DNA, 25 bp, Mus musculus
ctgcagtgacttcagctatcaacaa

SEQ ID NO: 382752 - DNA, 25 bp, Mus musculus
ctgcagtgacttgagctatcaacaa

SEQ ID NO: 382753 - DNA, 25 bp, Mus musculus
ctgcagtgcccactgctgcggagca

SEQ ID NO: 382754 - DNA, 25 bp, Mus musculus
ctgcagtgcccagtgctgcggagca

SEQ ID NO: 382755 - DNA, 25 bp, Mus musculus
ctgcagtgcggacctatgtcctgaa

SEQ ID NO: 382756 - DNA, 25 bp, Mus musculus
ctgcagtgcggagctatgtcctgaa

SEQ ID NO: 382757 - DNA, 25 bp, Mus musculus
ctgcagtggaagagaattcattctt

SEQ ID NO: 382758 - DNA, 25 bp, Mus musculus
ctgcagtggaagtgaattcattctt

SEQ ID NO: 382759 - DNA, 25 bp, Mus musculus
ctgcagtggactacacctgctctcc

SEQ ID NO: 382760 - DNA, 25 bp, Mus musculus
ctgcagtggacttcacctgctctcc

SEQ ID NO: 382761 - DNA, 25 bp, Mus musculus
ctgcagtgggtgactctccagaaaa

SEQ ID NO: 382762 - DNA, 25 bp, Mus musculus
ctgcagtgggtgtctctccagaaaa

SEQ ID NO: 382763 - DNA, 25 bp, Mus musculus
ctgcagtggtgtctcacttcaacaa

SEQ ID NO: 382764 - DNA, 25 bp, Mus musculus
ctgcagtggtgtgtcacttcaacaa

SEQ ID NO: 382765 - DNA, 25 bp, Mus musculus
ctgcagtgtgcaatgaagacgagga

SEQ ID NO: 382766 - DNA, 25 bp, Mus musculus
ctgcagtgtgcattgaagacgagga

SEQ ID NO: 382767 - DNA, 25 bp, Mus musculus
ctgcagtgtgtcagtgggactctag

SEQ ID NO: 382768 - DNA, 25 bp, Mus musculus
ctgcagtgtgtctgtgggactctag

SEQ ID NO: 382769 - DNA, 25 bp, Mus musculus
ctgcagttaactctcctgggtggat

SEQ ID NO: 382770 - DNA, 25 bp, Mus musculus
ctgcagttaactgtcctgggtggat

SEQ ID NO: 382771 - DNA, 25 bp, Mus musculus
ctgcagttactgatacaaatggtgt

SEQ ID NO: 382772 - DNA, 25 bp, Mus musculus
ctgcagttactgttacaaatggtgt

SEQ ID NO: 382773 - DNA, 25 bp, Mus musculus
ctgcagttcagcctggaagacatca

SEQ ID NO: 382774 - DNA, 25 bp, Mus musculus
ctgcagttcagcgtggaagacatca

SEQ ID NO: 382775 - DNA, 25 bp, Mus musculus
ctgcagttgcagatggacatattcc

SEQ ID NO: 382776 - DNA, 25 bp, Mus musculus
ctgcagttgcagttggacatattcc

SEQ ID NO: 382777 - DNA, 25 bp, Mus musculus
ctgcagttgctgaactctgggcctt

SEQ ID NO: 382778 - DNA, 25 bp, Mus musculus
ctgcagttgctgtactctgggcctt

SEQ ID NO: 382779 - DNA, 25 bp, Mus musculus
ctgcagttgtgtataggtgagccca

SEQ ID NO: 382780 - DNA, 25 bp, Mus musculus
ctgcagttgtgtttaggtgagccca

SEQ ID NO: 382781 - DNA, 25 bp, Mus musculus
ctgcagtttacacattccatgggaa

SEQ ID NO: 382782 - DNA, 25 bp, Mus musculus
ctgcagtttacagattccatgggaa

SEQ ID NO: 382783 - DNA, 25 bp, Mus musculus
ctgcagtttcctaaccagggtagtc

SEQ ID NO: 382784 - DNA, 25 bp, Mus musculus
ctgcagtttccttaccagggtagtc

SEQ ID NO: 382785 - DNA, 25 bp, Mus musculus
ctgcagtttctcaaaggccagcatt

SEQ ID NO: 382786 - DNA, 25 bp, Mus musculus
ctgcagtttctctaaggccagcatt

SEQ ID NO: 382787 - DNA, 25 bp, Mus musculus
ctgcagttttatctgaattgagcta

SEQ ID NO: 382788 - DNA, 25 bp, Mus musculus
ctgcagttttatgtgaattgagcta

SEQ ID NO: 382789 - DNA, 25 bp, Mus musculus
ctgcagttttccaccgagactaagg

SEQ ID NO: 382790 - DNA, 25 bp, Mus musculus
ctgcagttttcctccgagactaagg

SEQ ID NO: 382791 - DNA, 25 bp, Mus musculus
ctgcagttttctacaaaatgggact

SEQ ID NO: 382792 - DNA, 25 bp, Mus musculus
ctgcagttttcttcaaaatgggact

SEQ ID NO: 382793 - DNA, 25 bp, Mus musculus
ctgcagtttttcaggagcgcaagat

SEQ ID NO: 382794 - DNA, 25 bp, Mus musculus
ctgcagtttttctggagcgcaagat

SEQ ID NO: 382795 - DNA, 25 bp, Mus musculus
ctgcatacagggagcttgaggtcct

SEQ ID NO: 382796 - DNA, 25 bp, Mus musculus
ctgcatacagggtgcttgaggtcct

SEQ ID NO: 382797 - DNA, 25 bp, Mus musculus
ctgcatacctccagagtcaagagat

SEQ ID NO: 382798 - DNA, 25 bp, Mus musculus
ctgcatacctcctgagtcaagagat

SEQ ID NO: 382799 - DNA, 25 bp, Mus musculus
ctgcatagagggaacgtacgcctta

SEQ ID NO: 382800 - DNA, 25 bp, Mus musculus
ctgcatagagggtacgtacgcctta

SEQ ID NO: 382801 - DNA, 25 bp, Mus musculus
ctgcatagagtgctgtctgcatttt

SEQ ID NO: 382802 - DNA, 25 bp, Mus musculus
ctgcatagagtggtgtctgcatttt

SEQ ID NO: 382803 - DNA, 25 bp, Mus musculus
ctgcatagatggcagcccagggcta

SEQ ID NO: 382804 - DNA, 25 bp, Mus musculus
ctgcatagatgggagcccagggcta

SEQ ID NO: 382805 - DNA, 25 bp, Mus musculus
ctgcataggaatatagatcttaact

SEQ ID NO: 382806 - DNA, 25 bp, Mus musculus
ctgcataggaatttagatcttaact

SEQ ID NO: 382807 - DNA, 25 bp, Mus musculus
ctgcataggcagaagtgatgaagac

SEQ ID NO: 382808 - DNA, 25 bp, Mus musculus
ctgcataggcagtagtgatgaagac

SEQ ID NO: 382809 - DNA, 25 bp, Mus musculus
ctgcatagtgctcaggccggagcct

SEQ ID NO: 382810 - DNA, 25 bp, Mus musculus
ctgcatagtgctgaggccggagcct

SEQ ID NO: 382811 - DNA, 25 bp, Mus musculus
ctgcatattgcaatgtttacccatc

SEQ ID NO: 382812 - DNA, 25 bp, Mus musculus
ctgcatattgcattgtttacccatc

SEQ ID NO: 382813 - DNA, 25 bp, Mus musculus
ctgcatatttccctcatcttttaat

SEQ ID NO: 382814 - DNA, 25 bp, Mus musculus
ctgcatatttccgtcatcttttaat

SEQ ID NO: 382815 - DNA, 25 bp, Mus musculus
ctgcatattttgacatgcctgggtt

SEQ ID NO: 382816 - DNA, 25 bp, Mus musculus
ctgcatattttgtcatgcctgggtt

SEQ ID NO: 382817 - DNA, 25 bp, Mus musculus
ctgcatcaagtaccccgagtggaag

SEQ ID NO: 382818 - DNA, 25 bp, Mus musculus
ctgcatcaagtagcccgagtggaag

SEQ ID NO: 382819 - DNA, 25 bp, Mus musculus
ctgcatcaatccaatcgctctgtat

SEQ ID NO: 382820 - DNA, 25 bp, Mus musculus
ctgcatcaatcctatcgctctgtat

SEQ ID NO: 382821 - DNA, 25 bp, Mus musculus
ctgcatcacaacactactagcacat

SEQ ID NO: 382822 - DNA, 25 bp, Mus musculus
ctgcatcacaaccagactgtagcca

SEQ ID NO: 382823 - DNA, 25 bp, Mus musculus
ctgcatcacaacgagactgtagcca

SEQ ID NO: 382824 - DNA, 25 bp, Mus musculus
ctgcatcacaactctactagcacat

SEQ ID NO: 382825 - DNA, 25 bp, Mus musculus
ctgcatcacaccagcacagggaggg

SEQ ID NO: 382826 - DNA, 25 bp, Mus musculus
ctgcatcacacctgcacagggaggg

SEQ ID NO: 382827 - DNA, 25 bp, Mus musculus
ctgcatcagctcaggctgcttagat

SEQ ID NO: 382828 - DNA, 25 bp, Mus musculus
ctgcatcagctctggctgcttagat

SEQ ID NO: 382829 - DNA, 25 bp, Mus musculus
ctgcatcagtggaccaagggtggcc

SEQ ID NO: 382830 - DNA, 25 bp, Mus musculus
ctgcatcagtggtccaagggtggcc

SEQ ID NO: 382831 - DNA, 25 bp, Mus musculus
ctgcatcatggcagagctgttgacc

SEQ ID NO: 382832 - DNA, 25 bp, Mus musculus
ctgcatcatggctgagctgttgacc

SEQ ID NO: 382833 - DNA, 25 bp, Mus musculus
ctgcatccaagaccatgcgtacatt

SEQ ID NO: 382834 - DNA, 25 bp, Mus musculus
ctgcatccaagagcatgcgtacatt

SEQ ID NO: 382835 - DNA, 25 bp, Mus musculus
ctgcatcccgagaggagacggtaaa

SEQ ID NO: 382836 - DNA, 25 bp, Mus musculus
ctgcatcccgagtggagacggtaaa

SEQ ID NO: 382837 - DNA, 25 bp, Mus musculus
ctgcatcccttaccgaagttgtttg

SEQ ID NO: 382838 - DNA, 25 bp, Mus musculus
ctgcatcccttagcgaagttgtttg

SEQ ID NO: 382839 - DNA, 25 bp, Mus musculus
ctgcatccggataaccctgggaaat

SEQ ID NO: 382840 - DNA, 25 bp, Mus musculus
ctgcatccggattaccctgggaaat

SEQ ID NO: 382841 - DNA, 25 bp, Mus musculus
ctgcatcctcccagataacaaaaca

SEQ ID NO: 382842 - DNA, 25 bp, Mus musculus
ctgcatcctccctgataacaaaaca

SEQ ID NO: 382843 - DNA, 25 bp, Mus musculus
ctgcatcctggaccctgctggaaag

SEQ ID NO: 382844 - DNA, 25 bp, Mus musculus
ctgcatcctggagcctgctggaaag

SEQ ID NO: 382845 - DNA, 25 bp, Mus musculus
ctgcatcctgtgcacatgtatcgat

SEQ ID NO: 382846 - DNA, 25 bp, Mus musculus
ctgcatcctgtggacatgtatcgat

SEQ ID NO: 382847 - DNA, 25 bp, Mus musculus
ctgcatcctgttcctagcgcatggg

SEQ ID NO: 382848 - DNA, 25 bp, Mus musculus
ctgcatcctgttgctagcgcatggg

SEQ ID NO: 382849 - DNA, 25 bp, Mus musculus
ctgcatccttcaaccgaatcgtcgg

SEQ ID NO: 382850 - DNA, 25 bp, Mus musculus
ctgcatccttcatccgaatcgtcgg

SEQ ID NO: 382851 - DNA, 25 bp, Mus musculus
ctgcatcgagctaccttctctgtgt

SEQ ID NO: 382852 - DNA, 25 bp, Mus musculus
ctgcatcgagcttccttctctgtgt

SEQ ID NO: 382853 - DNA, 25 bp, Mus musculus
ctgcatctatacattcttcttttct

SEQ ID NO: 382854 - DNA, 25 bp, Mus musculus
ctgcatctatactttcttcttttct

SEQ ID NO: 382855 - DNA, 25 bp, Mus musculus
ctgcatctctcccttggagagagtt

SEQ ID NO: 382856 - DNA, 25 bp, Mus musculus
ctgcatctctccgttggagagagtt

SEQ ID NO: 382857 - DNA, 25 bp, Mus musculus
ctgcatctctctaaacagcttgagg

SEQ ID NO: 382858 - DNA, 25 bp, Mus musculus
ctgcatctctcttaacagcttgagg

SEQ ID NO: 382859 - DNA, 25 bp, Mus musculus
ctgcatctctgaagtgctacacata

SEQ ID NO: 382860 - DNA, 25 bp, Mus musculus
ctgcatctctgatgtgctacacata

SEQ ID NO: 382861 - DNA, 25 bp, Mus musculus
ctgcatctggcccaaagcttgtgca

SEQ ID NO: 382862 - DNA, 25 bp, Mus musculus
ctgcatctggccgaaagcttgtgca

SEQ ID NO: 382863 - DNA, 25 bp, Mus musculus
ctgcatcttatactgccaggcacct

SEQ ID NO: 382864 - DNA, 25 bp, Mus musculus
ctgcatcttatagtgccaggcacct

SEQ ID NO: 382865 - DNA, 25 bp, Mus musculus
ctgcatcttattagtattcatcctg

SEQ ID NO: 382866 - DNA, 25 bp, Mus musculus
ctgcatcttatttgtattcatcctg

SEQ ID NO: 382867 - DNA, 25 bp, Mus musculus
ctgcatcttccaattaccaacaaac

SEQ ID NO: 382868 - DNA, 25 bp, Mus musculus
ctgcatcttccatttaccaacaaac

SEQ ID NO: 382869 - DNA, 25 bp, Mus musculus
ctgcatcttgcaattttctttttca

SEQ ID NO: 382870 - DNA, 25 bp, Mus musculus
ctgcatcttgcatttttctttttca

SEQ ID NO: 382871 - DNA, 25 bp, Mus musculus
ctgcatgaaggcagaggcttggaat

SEQ ID NO: 382872 - DNA, 25 bp, Mus musculus
ctgcatgaaggctgaggcttggaat

SEQ ID NO: 382873 - DNA, 25 bp, Mus musculus
ctgcatgacctcactgcgtacgatg

SEQ ID NO: 382874 - DNA, 25 bp, Mus musculus
ctgcatgacctcagtctaagccgct

SEQ ID NO: 382875 - DNA, 25 bp, Mus musculus
ctgcatgacctctctgcgtacgatg

SEQ ID NO: 382876 - DNA, 25 bp, Mus musculus
ctgcatgacctctgtctaagccgct

SEQ ID NO: 382877 - DNA, 25 bp, Mus musculus
ctgcatgaggcgatacaaggaactt

SEQ ID NO: 382878 - DNA, 25 bp, Mus musculus
ctgcatgaggcgttacaaggaactt

SEQ ID NO: 382879 - DNA, 25 bp, Mus musculus
ctgcatgcacatctatgaacacaca

SEQ ID NO: 382880 - DNA, 25 bp, Mus musculus
ctgcatgcacatgtatgaacacaca

SEQ ID NO: 382881 - DNA, 25 bp, Mus musculus
ctgcatgcatgcacgcctaggtgag

SEQ ID NO: 382882 - DNA, 25 bp, Mus musculus
ctgcatgcatgctcgcctaggtgag

SEQ ID NO: 382883 - DNA, 25 bp, Mus musculus
ctgcatgccatgaaattctgaatca

SEQ ID NO: 382884 - DNA, 25 bp, Mus musculus
ctgcatgccatgtaattctgaatca

SEQ ID NO: 382885 - DNA, 25 bp, Mus musculus
ctgcatgctgtaacccagacccaga

SEQ ID NO: 382886 - DNA, 25 bp, Mus musculus
ctgcatgctgtatcccagacccaga

SEQ ID NO: 382887 - DNA, 25 bp, Mus musculus
ctgcatgctttcactcatttacaaa

SEQ ID NO: 382888 - DNA, 25 bp, Mus musculus
ctgcatgctttctctcatttacaaa

SEQ ID NO: 382889 - DNA, 25 bp, Mus musculus
ctgcatggaatcaagcctctggctt

SEQ ID NO: 382890 - DNA, 25 bp, Mus musculus
ctgcatggaatcattagtttctgct

SEQ ID NO: 382891 - DNA, 25 bp, Mus musculus
ctgcatggaatctagcctctggctt

SEQ ID NO: 382892 - DNA, 25 bp, Mus musculus
ctgcatggaatctttagtttctgct

SEQ ID NO: 382893 - DNA, 25 bp, Mus musculus
ctgcatggagcaccaagacctttaa

SEQ ID NO: 382894 - DNA, 25 bp, Mus musculus
ctgcatggagcagcaagacctttaa

SEQ ID NO: 382895 - DNA, 25 bp, Mus musculus
ctgcatggatagatctgggccagcc

SEQ ID NO: 382896 - DNA, 25 bp, Mus musculus
ctgcatggatagttctgggccagcc

SEQ ID NO: 382897 - DNA, 25 bp, Mus musculus
ctgcatgggacaaaagccctagatt

SEQ ID NO: 382898 - DNA, 25 bp, Mus musculus
ctgcatgggacataagccctagatt

SEQ ID NO: 382899 - DNA, 25 bp, Mus musculus
ctgcatgggcgacctgatgacctct

SEQ ID NO: 382900 - DNA, 25 bp, Mus musculus
ctgcatgggcgagctgatgacctct

SEQ ID NO: 382901 - DNA, 25 bp, Mus musculus
ctgcatggtactaatcattgaataa

SEQ ID NO: 382902 - DNA, 25 bp, Mus musculus
ctgcatggtacttatcattgaataa

SEQ ID NO: 382903 - DNA, 25 bp, Mus musculus
ctgcatgtaacactggagcctttcc

SEQ ID NO: 382904 - DNA, 25 bp, Mus musculus
ctgcatgtaacagtggagcctttcc

SEQ ID NO: 382905 - DNA, 25 bp, Mus musculus
ctgcatgtcaagcaccgcctggtat

SEQ ID NO: 382906 - DNA, 25 bp, Mus musculus
ctgcatgtcaaggaccgcctggtat

SEQ ID NO: 382907 - DNA, 25 bp, Mus musculus
ctgcatgtccttaccgtggagtaaa

SEQ ID NO: 382908 - DNA, 25 bp, Mus musculus
ctgcatgtcctttccgtggagtaaa

SEQ ID NO: 382909 - DNA, 25 bp, Mus musculus
ctgcatgtctgtaggctgtgtgatt

SEQ ID NO: 382910 - DNA, 25 bp, Mus musculus
ctgcatgtctgtagtgtactgggct

SEQ ID NO: 382911 - DNA, 25 bp, Mus musculus
ctgcatgtctgttggctgtgtgatt

SEQ ID NO: 382912 - DNA, 25 bp, Mus musculus
ctgcatgtctgttgtgtactgggct

SEQ ID NO: 382913 - DNA, 25 bp, Mus musculus
ctgcatgtgaacagtgaccatccag

SEQ ID NO: 382914 - DNA, 25 bp, Mus musculus
ctgcatgtgaactgtgaccatccag

SEQ ID NO: 382915 - DNA, 25 bp, Mus musculus
ctgcatgtgactcctagttttggct

SEQ ID NO: 382916 - DNA, 25 bp, Mus musculus
ctgcatgtgactgctagttttggct

SEQ ID NO: 382917 - DNA, 25 bp, Mus musculus
ctgcatgtgcatacctagaataaag

SEQ ID NO: 382918 - DNA, 25 bp, Mus musculus
ctgcatgtgcatattcaagtgggta

SEQ ID NO: 382919 - DNA, 25 bp, Mus musculus
ctgcatgtgcattcctagaataaag

SEQ ID NO: 382920 - DNA, 25 bp, Mus musculus
ctgcatgtgcattttcaagtgggta

SEQ ID NO: 382921 - DNA, 25 bp, Mus musculus
ctgcatgtgctcactgtaattttta

SEQ ID NO: 382922 - DNA, 25 bp, Mus musculus
ctgcatgtgctctctgtaattttta

SEQ ID NO: 382923 - DNA, 25 bp, Mus musculus
ctgcatgtggatcctcagaagccat

SEQ ID NO: 382924 - DNA, 25 bp, Mus musculus
ctgcatgtggatgctcagaagccat

SEQ ID NO: 382925 - DNA, 25 bp, Mus musculus
ctgcatgtgtcacctttctagatgt

SEQ ID NO: 382926 - DNA, 25 bp, Mus musculus
ctgcatgtgtcagctttctagatgt

SEQ ID NO: 382927 - DNA, 25 bp, Mus musculus
ctgcatgtgtgcagtttgaacgtac

SEQ ID NO: 382928 - DNA, 25 bp, Mus musculus
ctgcatgtgtgctgtttgaacgtac

SEQ ID NO: 382929 - DNA, 25 bp, Mus musculus
ctgcattagattccccctgatgatg

SEQ ID NO: 382930 - DNA, 25 bp, Mus musculus
ctgcattagattgcccctgatgatg

SEQ ID NO: 382931 - DNA, 25 bp, Mus musculus
ctgcattattcaacgctgtctttgg

SEQ ID NO: 382932 - DNA, 25 bp, Mus musculus
ctgcattattcatcgctgtctttgg

SEQ ID NO: 382933 - DNA, 25 bp, Mus musculus
ctgcattccttgatctgttgtggtg

SEQ ID NO: 382934 - DNA, 25 bp, Mus musculus
ctgcattccttgttctgttgtggtg

SEQ ID NO: 382935 - DNA, 25 bp, Mus musculus
ctgcattctagccagatcacttagg

SEQ ID NO: 382936 - DNA, 25 bp, Mus musculus
ctgcattctagcgagatcacttagg

SEQ ID NO: 382937 - DNA, 25 bp, Mus musculus
ctgcattctcacagcccgtgggcta

SEQ ID NO: 382938 - DNA, 25 bp, Mus musculus
ctgcattctcactgcccgtgggcta

SEQ ID NO: 382939 - DNA, 25 bp, Mus musculus
ctgcattctgacatcggattaaact

SEQ ID NO: 382940 - DNA, 25 bp, Mus musculus
ctgcattctgacttcggattaaact

SEQ ID NO: 382941 - DNA, 25 bp, Mus musculus
ctgcattctgcccagtgttgtttgt

SEQ ID NO: 382942 - DNA, 25 bp, Mus musculus
ctgcattctgccgagtgttgtttgt

SEQ ID NO: 382943 - DNA, 25 bp, Mus musculus
ctgcattctgctcagtgctgcttag

SEQ ID NO: 382944 - DNA, 25 bp, Mus musculus
ctgcattctgctgagtgctgcttag

SEQ ID NO: 382945 - DNA, 25 bp, Mus musculus
ctgcattgaacacatctgcaagtac

SEQ ID NO: 382946 - DNA, 25 bp, Mus musculus
ctgcattgaacagatctgcaagtac

SEQ ID NO: 382947 - DNA, 25 bp, Mus musculus
ctgcattgacagatgcaaccgatta

SEQ ID NO: 382948 - DNA, 25 bp, Mus musculus
ctgcattgacagttgcaaccgatta

SEQ ID NO: 382949 - DNA, 25 bp, Mus musculus
ctgcattgagagcacaaattttgtt

SEQ ID NO: 382950 - DNA, 25 bp, Mus musculus
ctgcattgagaggacaaattttgtt

SEQ ID NO: 382951 - DNA, 25 bp, Mus musculus
ctgcattggatcatggcccaagtca

SEQ ID NO: 382952 - DNA, 25 bp, Mus musculus
ctgcattggatcttggcccaagtca

SEQ ID NO: 382953 - DNA, 25 bp, Mus musculus
ctgcattgtctcacatttgactggt

SEQ ID NO: 382954 - DNA, 25 bp, Mus musculus
ctgcattgtctctcatttgactggt

SEQ ID NO: 382955 - DNA, 25 bp, Mus musculus
ctgcattgtttcacactgaagggtt

SEQ ID NO: 382956 - DNA, 25 bp, Mus musculus
ctgcattgtttctcactgaagggtt

SEQ ID NO: 382957 - DNA, 25 bp, Mus musculus
ctgcatttaaccacttcttctgaca

SEQ ID NO: 382958 - DNA, 25 bp, Mus musculus
ctgcatttaacctcttcttctgaca

SEQ ID NO: 382959 - DNA, 25 bp, Mus musculus
ctgcatttaatgcactggacttttc

SEQ ID NO: 382960 - DNA, 25 bp, Mus musculus
ctgcatttaatggactggacttttc

SEQ ID NO: 382961 - DNA, 25 bp, Mus musculus
ctgcatttactcacgctcggagggt

SEQ ID NO: 382962 - DNA, 25 bp, Mus musculus
ctgcatttactctcgctcggagggt

SEQ ID NO: 382963 - DNA, 25 bp, Mus musculus
ctgcatttagatcccctaaggtaga

SEQ ID NO: 382964 - DNA, 25 bp, Mus musculus
ctgcatttagatgccctaaggtaga

SEQ ID NO: 382965 - DNA, 25 bp, Mus musculus
ctgcatttaggtaggtgtgggcctt

SEQ ID NO: 382966 - DNA, 25 bp, Mus musculus
ctgcatttaggttggtgtgggcctt

SEQ ID NO: 382967 - DNA, 25 bp, Mus musculus
ctgcatttatctccctgggtgtatg

SEQ ID NO: 382968 - DNA, 25 bp, Mus musculus
ctgcatttatctgcctgggtgtatg

SEQ ID NO: 382969 - DNA, 25 bp, Mus musculus
ctgcatttatgcaaaggcacataat

SEQ ID NO: 382970 - DNA, 25 bp, Mus musculus
ctgcatttatgctaaggcacataat

SEQ ID NO: 382971 - DNA, 25 bp, Mus musculus
ctgcatttatgtagacccgctggta

SEQ ID NO: 382972 - DNA, 25 bp, Mus musculus
ctgcatttatgttgacccgctggta

SEQ ID NO: 382973 - DNA, 25 bp, Mus musculus
ctgcatttcctacattagctaagta

SEQ ID NO: 382974 - DNA, 25 bp, Mus musculus
ctgcatttcctagattagctaagta

SEQ ID NO: 382975 - DNA, 25 bp, Mus musculus
ctgcatttccttactatactgccag

SEQ ID NO: 382976 - DNA, 25 bp, Mus musculus
ctgcatttccttagctctggaacac

SEQ ID NO: 382977 - DNA, 25 bp, Mus musculus
ctgcatttcctttctatactgccag

SEQ ID NO: 382978 - DNA, 25 bp, Mus musculus
ctgcatttcctttgctctggaacac

SEQ ID NO: 382979 - DNA, 25 bp, Mus musculus
ctgcatttctgccttgtgggatgtt

SEQ ID NO: 382980 - DNA, 25 bp, Mus musculus
ctgcatttctgcgttgtgggatgtt

SEQ ID NO: 382981 - DNA, 25 bp, Mus musculus
ctgcatttgattcagagactgtgtc

SEQ ID NO: 382982 - DNA, 25 bp, Mus musculus
ctgcatttgattgagagactgtgtc

SEQ ID NO: 382983 - DNA, 25 bp, Mus musculus
ctgcatttgcccctcagaacggagt

SEQ ID NO: 382984 - DNA, 25 bp, Mus musculus
ctgcatttgcccgtcagaacggagt

SEQ ID NO: 382985 - DNA, 25 bp, Mus musculus
ctgcatttgcctatgatcattttta

SEQ ID NO: 382986 - DNA, 25 bp, Mus musculus
ctgcatttgcctttgatcattttta

SEQ ID NO: 382987 - DNA, 25 bp, Mus musculus
ctgcatttggaccatcctggattat

SEQ ID NO: 382988 - DNA, 25 bp, Mus musculus
ctgcatttggacgatcctggattat

SEQ ID NO: 382989 - DNA, 25 bp, Mus musculus
ctgcattttacaagccattcatggt

SEQ ID NO: 382990 - DNA, 25 bp, Mus musculus
ctgcattttacatgccattcatggt

SEQ ID NO: 382991 - DNA, 25 bp, Mus musculus
ctgcattttgacaagttgtgccact

SEQ ID NO: 382992 - DNA, 25 bp, Mus musculus
ctgcattttgactagttgtgccact

SEQ ID NO: 382993 - DNA, 25 bp, Mus musculus
ctgcattttgagagcctggtttacc

SEQ ID NO: 382994 - DNA, 25 bp, Mus musculus
ctgcattttgagtgcctggtttacc

SEQ ID NO: 382995 - DNA, 25 bp, Mus musculus
ctgcattttgttctaaggttttcac

SEQ ID NO: 382996 - DNA, 25 bp, Mus musculus
ctgcattttgttgtaaggttttcac

SEQ ID NO: 382997 - DNA, 25 bp, Mus musculus
ctgccaaacatcacttacggaagcg

SEQ ID NO: 382998 - DNA, 25 bp, Mus musculus
ctgccaaacatctcttacggaagcg

SEQ ID NO: 382999 - DNA, 25 bp, Mus musculus
ctgccaaactctaatgatgaacctt

SEQ ID NO: 383000 - DNA, 25 bp, Mus musculus
ctgccaaactcttatgatgaacctt

SEQ ID NO: 383001 - DNA, 25 bp, Mus musculus
ctgccaaagattaagacttctcccc

SEQ ID NO: 383002 - DNA, 25 bp, Mus musculus
ctgccaaagatttagacttctcccc

SEQ ID NO: 383003 - DNA, 25 bp, Mus musculus
ctgccaaaggcgctcaggtctctgg

SEQ ID NO: 383004 - DNA, 25 bp, Mus musculus
ctgccaaaggcggtcaggtctctgg

SEQ ID NO: 383005 - DNA, 25 bp, Mus musculus
ctgccaaatgacagccagagtctcc

SEQ ID NO: 383006 - DNA, 25 bp, Mus musculus
ctgccaaatgactgccagagtctcc

SEQ ID NO: 383007 - DNA, 25 bp, Mus musculus
ctgccaaccgggaagaggtcctgga

SEQ ID NO: 383008 - DNA, 25 bp, Mus musculus
ctgccaaccgggtagaggtcctgga

SEQ ID NO: 383009 - DNA, 25 bp, Mus musculus
ctgccaacgtcactgagggccctgc

SEQ ID NO: 383010 - DNA, 25 bp, Mus musculus
ctgccaacgtcagtgagggccctgc

SEQ ID NO: 383011 - DNA, 25 bp, Mus musculus
ctgccaagatggatcgctactctct

SEQ ID NO: 383012 - DNA, 25 bp, Mus musculus
ctgccaagatggttcgctactctct

SEQ ID NO: 383013 - DNA, 25 bp, Mus musculus
ctgccaagcctcatgtttctgaaag

SEQ ID NO: 383014 - DNA, 25 bp, Mus musculus
ctgccaagcctcttgtttctgaaag

SEQ ID NO: 383015 - DNA, 25 bp, Mus musculus
ctgccaaggccaactctgagtagga

SEQ ID NO: 383016 - DNA, 25 bp, Mus musculus
ctgccaaggccatctctgagtagga

SEQ ID NO: 383017 - DNA, 25 bp, Mus musculus
ctgccaagttatattgtaagtctta

SEQ ID NO: 383018 - DNA, 25 bp, Mus musculus
ctgccaagttattttgtaagtctta

SEQ ID NO: 383019 - DNA, 25 bp, Mus musculus
ctgccaatacgtcaagattccgaag

SEQ ID NO: 383020 - DNA, 25 bp, Mus musculus
ctgccaatacgtgaagattccgaag

SEQ ID NO: 383021 - DNA, 25 bp, Mus musculus
ctgccaatcactattctatccgatg

SEQ ID NO: 383022 - DNA, 25 bp, Mus musculus
ctgccaatcacttttctatccgatg

SEQ ID NO: 383023 - DNA, 25 bp, Mus musculus
ctgccaatcttgaatgagtgacctt

SEQ ID NO: 383024 - DNA, 25 bp, Mus musculus
ctgccaatcttgtatgagtgacctt

SEQ ID NO: 383025 - DNA, 25 bp, Mus musculus
ctgccaatgacgctgacctgtgtaa

SEQ ID NO: 383026 - DNA, 25 bp, Mus musculus
ctgccaatgacggtgacctgtgtaa

SEQ ID NO: 383027 - DNA, 25 bp, Mus musculus
ctgccaatgcctcgattgctctgaa

SEQ ID NO: 383028 - DNA, 25 bp, Mus musculus
ctgccaatgcctggattgctctgaa

SEQ ID NO: 383029 - DNA, 25 bp, Mus musculus
ctgccaatgtgcagggaagactgag

SEQ ID NO: 383030 - DNA, 25 bp, Mus musculus
ctgccaatgtgctgggaagactgag

SEQ ID NO: 383031 - DNA, 25 bp, Mus musculus
ctgccaattagtacctctgttttac

SEQ ID NO: 383032 - DNA, 25 bp, Mus musculus
ctgccaattagttcctctgttttac

SEQ ID NO: 383033 - DNA, 25 bp, Mus musculus
ctgccaattctgatagcgtgagttc

SEQ ID NO: 383034 - DNA, 25 bp, Mus musculus
ctgccaattctgttagcgtgagttc

SEQ ID NO: 383035 - DNA, 25 bp, Mus musculus
ctgccacaaaatcatttgccaataa

SEQ ID NO: 383036 - DNA, 25 bp, Mus musculus
ctgccacaaaatgatttgccaataa

SEQ ID NO: 383037 - DNA, 25 bp, Mus musculus
ctgccacaaagactgtaaagtgctt

SEQ ID NO: 383038 - DNA, 25 bp, Mus musculus
ctgccacaaagagtgtaaagtgctt

SEQ ID NO: 383039 - DNA, 25 bp, Mus musculus
ctgccacaaggtccagcctggaaag

SEQ ID NO: 383040 - DNA, 25 bp, Mus musculus
ctgccacaaggtgcagcctggaaag

SEQ ID NO: 383041 - DNA, 25 bp, Mus musculus
ctgccacaatccatttcttcaaaga

SEQ ID NO: 383042 - DNA, 25 bp, Mus musculus
ctgccacaatccttttcttcaaaga

SEQ ID NO: 383043 - DNA, 25 bp, Mus musculus
ctgccacactacagggctcgaacaa

SEQ ID NO: 383044 - DNA, 25 bp, Mus musculus
ctgccacactactgggctcgaacaa

SEQ ID NO: 383045 - DNA, 25 bp, Mus musculus
ctgccacagcttcatgactatagat

SEQ ID NO: 383046 - DNA, 25 bp, Mus musculus
ctgccacagcttgatgactatagat

SEQ ID NO: 383047 - DNA, 25 bp, Mus musculus
ctgccacaggcaccgtctttgacat

SEQ ID NO: 383048 - DNA, 25 bp, Mus musculus
ctgccacaggcagcgtctttgacat

SEQ ID NO: 383049 - DNA, 25 bp, Mus musculus
ctgccacagggcatgaccaattata

SEQ ID NO: 383050 - DNA, 25 bp, Mus musculus
ctgccacagggcttgaccaattata

SEQ ID NO: 383051 - DNA, 25 bp, Mus musculus
ctgccacatgtcctcacaagaagaa

SEQ ID NO: 383052 - DNA, 25 bp, Mus musculus
ctgccacatgtcgtcacaagaagaa

SEQ ID NO: 383053 - DNA, 25 bp, Mus musculus
ctgccaccaggaactttgtaggtct

SEQ ID NO: 383054 - DNA, 25 bp, Mus musculus
ctgccaccaggatctttgtaggtct

SEQ ID NO: 383055 - DNA, 25 bp, Mus musculus
ctgccaccaggcctttaaatacatt

SEQ ID NO: 383056 - DNA, 25 bp, Mus musculus
ctgccaccaggcgtttaaatacatt

SEQ ID NO: 383057 - DNA, 25 bp, Mus musculus
ctgccacccacaatatcaaacatgt

SEQ ID NO: 383058 - DNA, 25 bp, Mus musculus
ctgccacccacattatcaaacatgt

SEQ ID NO: 383059 - DNA, 25 bp, Mus musculus
ctgccacccaggaaaggattgaaat

SEQ ID NO: 383060 - DNA, 25 bp, Mus musculus
ctgccacccaggtaaggattgaaat

SEQ ID NO: 383061 - DNA, 25 bp, Mus musculus
ctgccaccgctgaggagtgatgtgc

SEQ ID NO: 383062 - DNA, 25 bp, Mus musculus
ctgccaccgctgtggagtgatgtgc

SEQ ID NO: 383063 - DNA, 25 bp, Mus musculus
ctgccaccggagacctagaacagga

SEQ ID NO: 383064 - DNA, 25 bp, Mus musculus
ctgccaccggagcagatagggtctc

SEQ ID NO: 383065 - DNA, 25 bp, Mus musculus
ctgccaccggaggagatagggtctc

SEQ ID NO: 383066 - DNA, 25 bp, Mus musculus
ctgccaccggagtcctagaacagga

SEQ ID NO: 383067 - DNA, 25 bp, Mus musculus
ctgccaccgtttaattgttagttga

SEQ ID NO: 383068 - DNA, 25 bp, Mus musculus
ctgccaccgttttattgttagttga

SEQ ID NO: 383069 - DNA, 25 bp, Mus musculus
ctgccacctctccactgtgatgtat

SEQ ID NO: 383070 - DNA, 25 bp, Mus musculus
ctgccacctctcgactgtgatgtat

SEQ ID NO: 383071 - DNA, 25 bp, Mus musculus
ctgccacctggacctgttatgaaca

SEQ ID NO: 383072 - DNA, 25 bp, Mus musculus
ctgccacctggagctgttatgaaca

SEQ ID NO: 383073 - DNA, 25 bp, Mus musculus
ctgccaccttgtaggatctgggaat

SEQ ID NO: 383074 - DNA, 25 bp, Mus musculus
ctgccaccttgttggatctgggaat

SEQ ID NO: 383075 - DNA, 25 bp, Mus musculus
ctgccacggaaaaggatgtgcctct

SEQ ID NO: 383076 - DNA, 25 bp, Mus musculus
ctgccacggaaatggatgtgcctct

SEQ ID NO: 383077 - DNA, 25 bp, Mus musculus
ctgccacgggtgctcggataatcac

SEQ ID NO: 383078 - DNA, 25 bp, Mus musculus
ctgccacgggtggtcggataatcac

SEQ ID NO: 383079 - DNA, 25 bp, Mus musculus
ctgccacgtaagcaagctcttctag

SEQ ID NO: 383080 - DNA, 25 bp, Mus musculus
ctgccacgtaaggaagctcttctag

SEQ ID NO: 383081 - DNA, 25 bp, Mus musculus
ctgccactaaatcttcataggcctt

SEQ ID NO: 383082 - DNA, 25 bp, Mus musculus
ctgccactaaatgttcataggcctt

SEQ ID NO: 383083 - DNA, 25 bp, Mus musculus
ctgccactcaacagacagaggaact

SEQ ID NO: 383084 - DNA, 25 bp, Mus musculus
ctgccactcaactgacagaggaact

SEQ ID NO: 383085 - DNA, 25 bp, Mus musculus
ctgccactctgcaaggtttgccttg

SEQ ID NO: 383086 - DNA, 25 bp, Mus musculus
ctgccactctgctaggtttgccttg

SEQ ID NO: 383087 - DNA, 25 bp, Mus musculus
ctgccactgactcgttaggactctg

SEQ ID NO: 383088 - DNA, 25 bp, Mus musculus
ctgccactgactggttaggactctg

SEQ ID NO: 383089 - DNA, 25 bp, Mus musculus
ctgccactgcagcatcatattttct

SEQ ID NO: 383090 - DNA, 25 bp, Mus musculus
ctgccactgcaggatcatattttct

SEQ ID NO: 383091 - DNA, 25 bp, Mus musculus
ctgccactgcatatgcacgaggagg

SEQ ID NO: 383092 - DNA, 25 bp, Mus musculus
ctgccactgcatttgcacgaggagg

SEQ ID NO: 383093 - DNA, 25 bp, Mus musculus
ctgccactggcacgcatggttgtgt

SEQ ID NO: 383094 - DNA, 25 bp, Mus musculus
ctgccactggcaggcatggttgtgt

SEQ ID NO: 383095 - DNA, 25 bp, Mus musculus
ctgccactgggtactgaggcccgga

SEQ ID NO: 383096 - DNA, 25 bp, Mus musculus
ctgccactgggttctgaggcccgga

SEQ ID NO: 383097 - DNA, 25 bp, Mus musculus
ctgccactgtggagactgcaagagt

SEQ ID NO: 383098 - DNA, 25 bp, Mus musculus
ctgccactgtggtgactgcaagagt

SEQ ID NO: 383099 - DNA, 25 bp, Mus musculus
ctgccacttaagaggcttgggctga

SEQ ID NO: 383100 - DNA, 25 bp, Mus musculus
ctgccacttaagtggcttgggctga

SEQ ID NO: 383101 - DNA, 25 bp, Mus musculus
ctgccacttcagagggacttagcaa

SEQ ID NO: 383102 - DNA, 25 bp, Mus musculus
ctgccacttcagtgggacttagcaa

SEQ ID NO: 383103 - DNA, 20 bp, Mus musculus
ctgccacttccaacatgaga

SEQ ID NO: 383104 - DNA, 20 bp, Mus musculus
ctgccacttcccacatgaga

SEQ ID NO: 383105 - DNA, 20 bp, Mus musculus
ctgccacttccgacatgaga

SEQ ID NO: 383106 - DNA, 20 bp, Mus musculus
ctgccacttcctacatgaga

SEQ ID NO: 383107 - DNA, 25 bp, Mus musculus
ctgccacttgctctgccaaatggaa

SEQ ID NO: 383108 - DNA, 25 bp, Mus musculus
ctgccacttgctgtgccaaatggaa

SEQ ID NO: 383109 - DNA, 25 bp, Mus musculus
ctgccactttctacagaagcatgat

SEQ ID NO: 383110 - DNA, 25 bp, Mus musculus
ctgccactttcttcagaagcatgat

SEQ ID NO: 383111 - DNA, 25 bp, Mus musculus
ctgccagaaatgaattatcaacctt

SEQ ID NO: 383112 - DNA, 25 bp, Mus musculus
ctgccagaaatgtattatcaacctt

SEQ ID NO: 383113 - DNA, 25 bp, Mus musculus
ctgccagaactgcaggcgctgcaag

SEQ ID NO: 383114 - DNA, 25 bp, Mus musculus
ctgccagaactggaggcgctgcaag

SEQ ID NO: 383115 - DNA, 25 bp, Mus musculus
ctgccagaagaaagacaccacccat

SEQ ID NO: 383116 - DNA, 25 bp, Mus musculus
ctgccagaagaatgacaccacccat

SEQ ID NO: 383117 - DNA, 25 bp, Mus musculus
ctgccagacaaacggttcgagaaaa

SEQ ID NO: 383118 - DNA, 25 bp, Mus musculus
ctgccagacaaagggttcgagaaaa

SEQ ID NO: 383119 - DNA, 25 bp, Mus musculus
ctgccagacatccatttactctaag

SEQ ID NO: 383120 - DNA, 25 bp, Mus musculus
ctgccagacatcgatttactctaag

SEQ ID NO: 383121 - DNA, 25 bp, Mus musculus
ctgccagaccaaaaatttctatctg

SEQ ID NO: 383122 - DNA, 25 bp, Mus musculus
ctgccagaccaataatttctatctg

SEQ ID NO: 383123 - DNA, 25 bp, Mus musculus
ctgccagactcaagaccactgctac

SEQ ID NO: 383124 - DNA, 25 bp, Mus musculus
ctgccagactcatgaccactgctac

SEQ ID NO: 383125 - DNA, 25 bp, Mus musculus
ctgccagaggatctgtgtttgattc

SEQ ID NO: 383126 - DNA, 25 bp, Mus musculus
ctgccagaggatgtgtgtttgattc

SEQ ID NO: 383127 - DNA, 25 bp, Mus musculus
ctgccagatcgtagtgtgcccattg

SEQ ID NO: 383128 - DNA, 25 bp, Mus musculus
ctgccagatcgttgtgtgcccattg

SEQ ID NO: 383129 - DNA, 25 bp, Mus musculus
ctgccagcagctagtttattcacaa

SEQ ID NO: 383130 - DNA, 25 bp, Mus musculus
ctgccagcagcttgtttattcacaa

SEQ ID NO: 383131 - DNA, 25 bp, Mus musculus
ctgccagcaggtcgcctgttgaagt

SEQ ID NO: 383132 - DNA, 25 bp, Mus musculus
ctgccagcaggtggcctgttgaagt

SEQ ID NO: 383133 - DNA, 25 bp, Mus musculus
ctgccagcagtgataccttgagttt

SEQ ID NO: 383134 - DNA, 25 bp, Mus musculus
ctgccagcagtgttaccttgagttt

SEQ ID NO: 383135 - DNA, 25 bp, Mus musculus
ctgccagcatgtccttgtcaagttt

SEQ ID NO: 383136 - DNA, 25 bp, Mus musculus
ctgccagcatgtgcttgtcaagttt

SEQ ID NO: 383137 - DNA, 25 bp, Mus musculus
ctgccagccagaccagggtggagtg

SEQ ID NO: 383138 - DNA, 25 bp, Mus musculus
ctgccagccagagcagggtggagtg

SEQ ID NO: 383139 - DNA, 25 bp, Mus musculus
ctgccagccagcctgaagaacatgg

SEQ ID NO: 383140 - DNA, 25 bp, Mus musculus
ctgccagccagcgtgaagaacatgg

SEQ ID NO: 383141 - DNA, 25 bp, Mus musculus
ctgccagccaggcagtcctgttaaa

SEQ ID NO: 383142 - DNA, 25 bp, Mus musculus
ctgccagccagggagtcctgttaaa

SEQ ID NO: 383143 - DNA, 25 bp, Mus musculus
ctgccagcctatctttgatgtctca

SEQ ID NO: 383144 - DNA, 25 bp, Mus musculus
ctgccagcctatgtttgatgtctca

SEQ ID NO: 383145 - DNA, 25 bp, Mus musculus
ctgccagcctgtcatgtggcctgca

SEQ ID NO: 383146 - DNA, 25 bp, Mus musculus
ctgccagcctgtgatgtggcctgca

SEQ ID NO: 383147 - DNA, 25 bp, Mus musculus
ctgccagccttcctactttatagaa

SEQ ID NO: 383148 - DNA, 25 bp, Mus musculus
ctgccagccttcgtactttatagaa

SEQ ID NO: 383149 - DNA, 25 bp, Mus musculus
ctgccagcgggtattcagcttctct

SEQ ID NO: 383150 - DNA, 25 bp, Mus musculus
ctgccagcgggttttcagcttctct

SEQ ID NO: 383151 - DNA, 25 bp, Mus musculus
ctgccagcgttacgttaactccgta

SEQ ID NO: 383152 - DNA, 25 bp, Mus musculus
ctgccagcgttaggttaactccgta

SEQ ID NO: 383153 - DNA, 25 bp, Mus musculus
ctgccagctgatcgctactaactgg

SEQ ID NO: 383154 - DNA, 25 bp, Mus musculus
ctgccagctgatggctactaactgg

SEQ ID NO: 383155 - DNA, 25 bp, Mus musculus
ctgccagctgtgattgtatgttatt

SEQ ID NO: 383156 - DNA, 25 bp, Mus musculus
ctgccagctgtgtttgtatgttatt

SEQ ID NO: 383157 - DNA, 25 bp, Mus musculus
ctgccagcttgtagctctgtgtaaa

SEQ ID NO: 383158 - DNA, 25 bp, Mus musculus
ctgccagcttgttgctctgtgtaaa

SEQ ID NO: 383159 - DNA, 25 bp, Mus musculus
ctgccaggacagacccatgtaaagc

SEQ ID NO: 383160 - DNA, 25 bp, Mus musculus
ctgccaggacagtcccatgtaaagc

SEQ ID NO: 383161 - DNA, 25 bp, Mus musculus
ctgccaggactacatttgccaataa

SEQ ID NO: 383162 - DNA, 25 bp, Mus musculus
ctgccaggactagatttgccaataa

SEQ ID NO: 383163 - DNA, 25 bp, Mus musculus
ctgccaggagctagggagcgagagc

SEQ ID NO: 383164 - DNA, 25 bp, Mus musculus
ctgccaggagcttgggagcgagagc

SEQ ID NO: 383165 - DNA, 25 bp, Mus musculus
ctgccaggattgctgcactgtgcat

SEQ ID NO: 383166 - DNA, 25 bp, Mus musculus
ctgccaggattggtgcactgtgcat

SEQ ID NO: 383167 - DNA, 25 bp, Mus musculus
ctgccaggcactcctggagagtatg

SEQ ID NO: 383168 - DNA, 25 bp, Mus musculus
ctgccaggcactgctggagagtatg

SEQ ID NO: 383169 - DNA, 25 bp, Mus musculus
ctgccaggccagaggaacggtctaa

SEQ ID NO: 383170 - DNA, 25 bp, Mus musculus
ctgccaggccagtggaacggtctaa

SEQ ID NO: 383171 - DNA, 25 bp, Mus musculus
ctgccaggctgccgtccatatgctg

SEQ ID NO: 383172 - DNA, 25 bp, Mus musculus
ctgccaggctgcggtccatatgctg

SEQ ID NO: 383173 - DNA, 25 bp, Mus musculus
ctgccaggctttcctagatgaaatg

SEQ ID NO: 383174 - DNA, 25 bp, Mus musculus
ctgccaggctttgctagatgaaatg

SEQ ID NO: 383175 - DNA, 25 bp, Mus musculus
ctgccagggccaaggccacagagca

SEQ ID NO: 383176 - DNA, 25 bp, Mus musculus
ctgccagggccatggccacagagca

SEQ ID NO: 383177 - DNA, 25 bp, Mus musculus
ctgccagggcctatagctgtagagt

SEQ ID NO: 383178 - DNA, 25 bp, Mus musculus
ctgccagggcctttagctgtagagt

SEQ ID NO: 383179 - DNA, 25 bp, Mus musculus
ctgccagggttaccggcccaggcat

SEQ ID NO: 383180 - DNA, 25 bp, Mus musculus
ctgccagggttagcggcccaggcat

SEQ ID NO: 383181 - DNA, 25 bp, Mus musculus
ctgccaggtgaccacttttatctga

SEQ ID NO: 383182 - DNA, 25 bp, Mus musculus
ctgccaggtgacgacttttatctga

SEQ ID NO: 383183 - DNA, 25 bp, Mus musculus
ctgccaggtgagcagctctggccta

SEQ ID NO: 383184 - DNA, 25 bp, Mus musculus
ctgccaggtgaggagctctggccta

SEQ ID NO: 383185 - DNA, 25 bp, Mus musculus
ctgccaggtgctcagtagataaaca

SEQ ID NO: 383186 - DNA, 25 bp, Mus musculus
ctgccaggtgctgagtagataaaca

SEQ ID NO: 383187 - DNA, 25 bp, Mus musculus
ctgccagtcactactcagtttttag

SEQ ID NO: 383188 - DNA, 25 bp, Mus musculus
ctgccagtcacttctcagtttttag

SEQ ID NO: 383189 - DNA, 25 bp, Mus musculus
ctgccagtccacatttgttcaggaa

SEQ ID NO: 383190 - DNA, 25 bp, Mus musculus
ctgccagtccacttttgttcaggaa

SEQ ID NO: 383191 - DNA, 25 bp, Mus musculus
ctgccagtcccaacatgtatgagtc

SEQ ID NO: 383192 - DNA, 25 bp, Mus musculus
ctgccagtcccatcatgtatgagtc

SEQ ID NO: 383193 - DNA, 25 bp, Mus musculus
ctgccagtgcctagatcttgaattt

SEQ ID NO: 383194 - DNA, 25 bp, Mus musculus
ctgccagtgccttgatcttgaattt

SEQ ID NO: 383195 - DNA, 25 bp, Mus musculus
ctgccagtgcgtaatagcccttagg

SEQ ID NO: 383196 - DNA, 25 bp, Mus musculus
ctgccagtgcgttatagcccttagg

SEQ ID NO: 383197 - DNA, 25 bp, Mus musculus
ctgccagtgttgatgttttctcatt

SEQ ID NO: 383198 - DNA, 25 bp, Mus musculus
ctgccagtgttgttgttttctcatt

SEQ ID NO: 383199 - DNA, 25 bp, Mus musculus
ctgccagttctaacacgacagacat

SEQ ID NO: 383200 - DNA, 25 bp, Mus musculus
ctgccagttctatcacgacagacat

SEQ ID NO: 383201 - DNA, 25 bp, Mus musculus
ctgccataggtactctttgtcaagc

SEQ ID NO: 383202 - DNA, 25 bp, Mus musculus
ctgccataggtagtctttgtcaagc

SEQ ID NO: 383203 - DNA, 25 bp, Mus musculus
ctgccatatactaacacagcaggcg

SEQ ID NO: 383204 - DNA, 25 bp, Mus musculus
ctgccatatacttacacagcaggcg

SEQ ID NO: 383205 - DNA, 25 bp, Mus musculus
ctgccatatgtgaggatactgctat

SEQ ID NO: 383206 - DNA, 25 bp, Mus musculus
ctgccatatgtgtggatactgctat

SEQ ID NO: 383207 - DNA, 25 bp, Mus musculus
ctgccatattccaagtcacatcatt

SEQ ID NO: 383208 - DNA, 25 bp, Mus musculus
ctgccatattccagctgttttgata

SEQ ID NO: 383209 - DNA, 25 bp, Mus musculus
ctgccatattcctagtcacatcatt

SEQ ID NO: 383210 - DNA, 25 bp, Mus musculus
ctgccatattcctgctgttttgata

SEQ ID NO: 383211 - DNA, 25 bp, Mus musculus
ctgccatccacaattctggacaggg

SEQ ID NO: 383212 - DNA, 25 bp, Mus musculus
ctgccatccacatttctggacaggg

SEQ ID NO: 383213 - DNA, 25 bp, Mus musculus
ctgccatccatgctccacatggaga

SEQ ID NO: 383214 - DNA, 25 bp, Mus musculus
ctgccatccatggtccacatggaga

SEQ ID NO: 383215 - DNA, 25 bp, Mus musculus
ctgccatcgtatcacttgctttaaa

SEQ ID NO: 383216 - DNA, 25 bp, Mus musculus
ctgccatcgtatgacttgctttaaa

SEQ ID NO: 383217 - DNA, 25 bp, Mus musculus
ctgccatcgttaatgggtctcgtga

SEQ ID NO: 383218 - DNA, 25 bp, Mus musculus
ctgccatcgttattgggtctcgtga

SEQ ID NO: 383219 - DNA, 25 bp, Mus musculus
ctgccatctcgtacaagtaccaaat

SEQ ID NO: 383220 - DNA, 25 bp, Mus musculus
ctgccatctcgttcaagtaccaaat

SEQ ID NO: 383221 - DNA, 25 bp, Mus musculus
ctgccatgataaccagacctgttgt

SEQ ID NO: 383222 - DNA, 25 bp, Mus musculus
ctgccatgataagcagacctgttgt

SEQ ID NO: 383223 - DNA, 25 bp, Mus musculus
ctgccatgattacacctgcttttta

SEQ ID NO: 383224 - DNA, 25 bp, Mus musculus
ctgccatgattagacctgcttttta

SEQ ID NO: 383225 - DNA, 25 bp, Mus musculus
ctgccatgcatgagaaccaaaagtg

SEQ ID NO: 383226 - DNA, 25 bp, Mus musculus
ctgccatgcatgtgaaccaaaagtg

SEQ ID NO: 383227 - DNA, 25 bp, Mus musculus
ctgccatgccagagctttagaagtg

SEQ ID NO: 383228 - DNA, 25 bp, Mus musculus
ctgccatgccagtgctttagaagtg

SEQ ID NO: 383229 - DNA, 25 bp, Mus musculus
ctgccatgccttacggtgtttataa

SEQ ID NO: 383230 - DNA, 25 bp, Mus musculus
ctgccatgcctttcggtgtttataa

SEQ ID NO: 383231 - DNA, 25 bp, Mus musculus
ctgccatgctctatattccattatg

SEQ ID NO: 383232 - DNA, 25 bp, Mus musculus
ctgccatgctctttattccattatg

SEQ ID NO: 383233 - DNA, 25 bp, Mus musculus
ctgccatggtcacctgaactgtgat

SEQ ID NO: 383234 - DNA, 25 bp, Mus musculus
ctgccatggtcagctgaactgtgat

SEQ ID NO: 383235 - DNA, 25 bp, Mus musculus
ctgccatgtataataaactagtctt

SEQ ID NO: 383236 - DNA, 25 bp, Mus musculus
ctgccatgtatattaaactagtctt

SEQ ID NO: 383237 - DNA, 25 bp, Mus musculus
ctgccatgtatgatgtcttcacttt

SEQ ID NO: 383238 - DNA, 25 bp, Mus musculus
ctgccatgtatgttgtcttcacttt

SEQ ID NO: 383239 - DNA, 25 bp, Mus musculus
ctgccatgtgacaatctgggtgact

SEQ ID NO: 383240 - DNA, 25 bp, Mus musculus
ctgccatgtgactatctgggtgact

SEQ ID NO: 383241 - DNA, 25 bp, Mus musculus
ctgccatgtgcccagtatgtatttg

SEQ ID NO: 383242 - DNA, 25 bp, Mus musculus
ctgccatgtgccgagtatgtatttg

SEQ ID NO: 383243 - DNA, 25 bp, Mus musculus
ctgccatgtggcatcttattctaat

SEQ ID NO: 383244 - DNA, 25 bp, Mus musculus
ctgccatgtggcttcttattctaat

SEQ ID NO: 383245 - DNA, 25 bp, Mus musculus
ctgccatgtgtgattttgtgcgatg

SEQ ID NO: 383246 - DNA, 25 bp, Mus musculus
ctgccatgtgtgtttttgtgcgatg

SEQ ID NO: 383247 - DNA, 25 bp, Mus musculus
ctgccattcattcctgagcttccaa

SEQ ID NO: 383248 - DNA, 25 bp, Mus musculus
ctgccattcattgctgagcttccaa

SEQ ID NO: 383249 - DNA, 25 bp, Mus musculus
ctgccattccggcttgtgcaataac

SEQ ID NO: 383250 - DNA, 25 bp, Mus musculus
ctgccattccgggttgtgcaataac

SEQ ID NO: 383251 - DNA, 25 bp, Mus musculus
ctgccattctgccattttgagtttt

SEQ ID NO: 383252 - DNA, 25 bp, Mus musculus
ctgccattctgcgattttgagtttt

SEQ ID NO: 383253 - DNA, 25 bp, Mus musculus
ctgccattgctcactatgattctgt

SEQ ID NO: 383254 - DNA, 25 bp, Mus musculus
ctgccattgctctctatgattctgt

SEQ ID NO: 383255 - DNA, 25 bp, Mus musculus
ctgccattggttcagggtttgattg

SEQ ID NO: 383256 - DNA, 25 bp, Mus musculus
ctgccattggttgagggtttgattg

SEQ ID NO: 383257 - DNA, 25 bp, Mus musculus
ctgccattgttaaaatgccaataaa

SEQ ID NO: 383258 - DNA, 25 bp, Mus musculus
ctgccattgttataatgccaataaa

SEQ ID NO: 383259 - DNA, 25 bp, Mus musculus
ctgccatttaatattagcctcgtat

SEQ ID NO: 383260 - DNA, 25 bp, Mus musculus
ctgccatttaattttagcctcgtat

SEQ ID NO: 383261 - DNA, 25 bp, Mus musculus
ctgccatttactctcagctcttgtt

SEQ ID NO: 383262 - DNA, 25 bp, Mus musculus
ctgccatttactgtcagctcttgtt

SEQ ID NO: 383263 - DNA, 25 bp, Mus musculus
ctgccatttccaagacacgatttca

SEQ ID NO: 383264 - DNA, 25 bp, Mus musculus
ctgccatttccatgacacgatttca

SEQ ID NO: 383265 - DNA, 25 bp, Mus musculus
ctgccatttcctaattacttgctac

SEQ ID NO: 383266 - DNA, 25 bp, Mus musculus
ctgccatttccttattacttgctac

SEQ ID NO: 383267 - DNA, 25 bp, Mus musculus
ctgccatttcttaccattgcggaaa

SEQ ID NO: 383268 - DNA, 25 bp, Mus musculus
ctgccatttctttccattgcggaaa

SEQ ID NO: 383269 - DNA, 25 bp, Mus musculus
ctgccattttggatcattctgtcat

SEQ ID NO: 383270 - DNA, 25 bp, Mus musculus
ctgccattttggttcattctgtcat

SEQ ID NO: 383271 - DNA, 25 bp, Mus musculus
ctgcccaaacagacgctctgaggtt

SEQ ID NO: 383272 - DNA, 25 bp, Mus musculus
ctgcccaaacagtcgctctgaggtt

SEQ ID NO: 383273 - DNA, 25 bp, Mus musculus
ctgcccaaatagaggcgtttaccca

SEQ ID NO: 383274 - DNA, 25 bp, Mus musculus
ctgcccaaatagtggcgtttaccca

SEQ ID NO: 383275 - DNA, 25 bp, Mus musculus
ctgcccaacaagcttcgctgaagaa

SEQ ID NO: 383276 - DNA, 25 bp, Mus musculus
ctgcccaacaaggttcgctgaagaa

SEQ ID NO: 383277 - DNA, 25 bp, Mus musculus
ctgcccaagaccctcacaggaaaaa

SEQ ID NO: 383278 - DNA, 25 bp, Mus musculus
ctgcccaagaccgtcacaggaaaaa

SEQ ID NO: 383279 - DNA, 25 bp, Mus musculus
ctgcccaagtgcaagttcactttgg

SEQ ID NO: 383280 - DNA, 25 bp, Mus musculus
ctgcccaagtgctagttcactttgg

SEQ ID NO: 383281 - DNA, 25 bp, Mus musculus
ctgcccaatcacagacctatatttt

SEQ ID NO: 383282 - DNA, 25 bp, Mus musculus
ctgcccaatcactgacctatatttt

SEQ ID NO: 383283 - DNA, 25 bp, Mus musculus
ctgcccaatcagaaggccgtacaag

SEQ ID NO: 383284 - DNA, 25 bp, Mus musculus
ctgcccaatcagtaggccgtacaag

SEQ ID NO: 383285 - DNA, 25 bp, Mus musculus
ctgcccaatgaaccttaaagggttg

SEQ ID NO: 383286 - DNA, 25 bp, Mus musculus
ctgcccaatgaagcttaaagggttg

SEQ ID NO: 383287 - DNA, 25 bp, Mus musculus
ctgcccaatgggacttgatttctaa

SEQ ID NO: 383288 - DNA, 25 bp, Mus musculus
ctgcccaatgggtcttgatttctaa

SEQ ID NO: 383289 - DNA, 25 bp, Mus musculus
ctgcccacacataggaagtccactt

SEQ ID NO: 383290 - DNA, 25 bp, Mus musculus
ctgcccacacattggaagtccactt

SEQ ID NO: 383291 - DNA, 25 bp, Mus musculus
ctgcccacacccagttaggtagtgt

SEQ ID NO: 383292 - DNA, 25 bp, Mus musculus
ctgcccacaccctgttaggtagtgt

SEQ ID NO: 383293 - DNA, 25 bp, Mus musculus
ctgcccacagcacatctattaaatg

SEQ ID NO: 383294 - DNA, 25 bp, Mus musculus
ctgcccacagcagatctattaaatg

SEQ ID NO: 383295 - DNA, 25 bp, Mus musculus
ctgcccacaggaccatgtacatatg

SEQ ID NO: 383296 - DNA, 25 bp, Mus musculus
ctgcccacaggagcatgtacatatg

SEQ ID NO: 383297 - DNA, 25 bp, Mus musculus
ctgcccacagttaattatcaccact

SEQ ID NO: 383298 - DNA, 25 bp, Mus musculus
ctgcccacagtttattatcaccact

SEQ ID NO: 383299 - DNA, 25 bp, Mus musculus
ctgcccacatcaacttggttatcaa

SEQ ID NO: 383300 - DNA, 25 bp, Mus musculus
ctgcccacatcatcttggttatcaa

SEQ ID NO: 383301 - DNA, 25 bp, Mus musculus
ctgcccaccttcattagacaatcta

SEQ ID NO: 383302 - DNA, 25 bp, Mus musculus
ctgcccaccttctttagacaatcta

SEQ ID NO: 383303 - DNA, 25 bp, Mus musculus
ctgcccactcgaatgttactatgtt

SEQ ID NO: 383304 - DNA, 25 bp, Mus musculus
ctgcccactcgattgttactatgtt

SEQ ID NO: 383305 - DNA, 25 bp, Mus musculus
ctgcccactgaactgaagccaagta

SEQ ID NO: 383306 - DNA, 25 bp, Mus musculus
ctgcccactgaagtgaagccaagta

SEQ ID NO: 383307 - DNA, 25 bp, Mus musculus
ctgcccacttctcagttgtcatggg

SEQ ID NO: 383308 - DNA, 25 bp, Mus musculus
ctgcccacttctgagttgtcatggg

SEQ ID NO: 383309 - DNA, 25 bp, Mus musculus
ctgcccagacgtccctggatgatgg

SEQ ID NO: 383310 - DNA, 25 bp, Mus musculus
ctgcccagacgtgcctggatgatgg

SEQ ID NO: 383311 - DNA, 25 bp, Mus musculus
ctgcccagagaaaccttgtctgata

SEQ ID NO: 383312 - DNA, 25 bp, Mus musculus
ctgcccagagaatccttgtctgata

SEQ ID NO: 383313 - DNA, 25 bp, Mus musculus
ctgcccagagctagggtcactgaat

SEQ ID NO: 383314 - DNA, 25 bp, Mus musculus
ctgcccagagcttgggtcactgaat

SEQ ID NO: 383315 - DNA, 25 bp, Mus musculus
ctgcccagcaccctcaagtttggga

SEQ ID NO: 383316 - DNA, 25 bp, Mus musculus
ctgcccagcaccgtcaagtttggga

SEQ ID NO: 383317 - DNA, 25 bp, Mus musculus
ctgcccagctgacctgatatttatt

SEQ ID NO: 383318 - DNA, 25 bp, Mus musculus
ctgcccagctgagctgatatttatt

SEQ ID NO: 383319 - DNA, 25 bp, Mus musculus
ctgcccagcttacgaagagttaaag

SEQ ID NO: 383320 - DNA, 25 bp, Mus musculus
ctgcccagcttaggaagagttaaag

SEQ ID NO: 383321 - DNA, 25 bp, Mus musculus
ctgcccagctttccctgggaaaata

SEQ ID NO: 383322 - DNA, 25 bp, Mus musculus
ctgcccagctttgcctgggaaaata

SEQ ID NO: 383323 - DNA, 25 bp, Mus musculus
ctgcccaggtttcgctgggatcttt

SEQ ID NO: 383324 - DNA, 25 bp, Mus musculus
ctgcccaggtttggctgggatcttt

SEQ ID NO: 383325 - DNA, 25 bp, Mus musculus
ctgcccagtaccagaatgaacttct

SEQ ID NO: 383326 - DNA, 25 bp, Mus musculus
ctgcccagtacctgaatgaacttct

SEQ ID NO: 383327 - DNA, 25 bp, Mus musculus
ctgcccagtctcagtgaatacaatt

SEQ ID NO: 383328 - DNA, 25 bp, Mus musculus
ctgcccagtctctgtgaatacaatt

SEQ ID NO: 383329 - DNA, 25 bp, Mus musculus
ctgcccagtctgcaatccttgatag

SEQ ID NO: 383330 - DNA, 25 bp, Mus musculus
ctgcccagtctggaatccttgatag

SEQ ID NO: 383331 - DNA, 25 bp, Mus musculus
ctgcccagtgatcagacgaatcctg

SEQ ID NO: 383332 - DNA, 25 bp, Mus musculus
ctgcccagtgatgagacgaatcctg

SEQ ID NO: 383333 - DNA, 25 bp, Mus musculus
ctgcccagtgccataagcttgagaa

SEQ ID NO: 383334 - DNA, 25 bp, Mus musculus
ctgcccagtgccttaagcttgagaa

SEQ ID NO: 383335 - DNA, 25 bp, Mus musculus
ctgcccagtttcaatgaataaagtt

SEQ ID NO: 383336 - DNA, 25 bp, Mus musculus
ctgcccagtttctatgaataaagtt

SEQ ID NO: 383337 - DNA, 25 bp, Mus musculus
ctgcccataagaaaacgaggataaa

SEQ ID NO: 383338 - DNA, 25 bp, Mus musculus
ctgcccataagataacgaggataaa

SEQ ID NO: 383339 - DNA, 25 bp, Mus musculus
ctgcccatagtgcaggaaaatgcat

SEQ ID NO: 383340 - DNA, 25 bp, Mus musculus
ctgcccatagtggaggaaaatgcat

SEQ ID NO: 383341 - DNA, 25 bp, Mus musculus
ctgcccatctacaccagtgataaag

SEQ ID NO: 383342 - DNA, 25 bp, Mus musculus
ctgcccatctactccagtgataaag

SEQ ID NO: 383343 - DNA, 25 bp, Mus musculus
ctgcccatctttatgttgatcttat

SEQ ID NO: 383344 - DNA, 25 bp, Mus musculus
ctgcccatctttttgttgatcttat

SEQ ID NO: 383345 - DNA, 25 bp, Mus musculus
ctgcccatgctgaggctggattaaa

SEQ ID NO: 383346 - DNA, 25 bp, Mus musculus
ctgcccatgctgtggctggattaaa

SEQ ID NO: 383347 - DNA, 25 bp, Mus musculus
ctgcccatggaacccctgagttact

SEQ ID NO: 383348 - DNA, 25 bp, Mus musculus
ctgcccatggaactgtcccaatgaa

SEQ ID NO: 383349 - DNA, 25 bp, Mus musculus
ctgcccatggaagccctgagttact

SEQ ID NO: 383350 - DNA, 25 bp, Mus musculus
ctgcccatggaagtgtcccaatgaa

SEQ ID NO: 383351 - DNA, 25 bp, Mus musculus
ctgcccatgtggagtaggaactttt

SEQ ID NO: 383352 - DNA, 25 bp, Mus musculus
ctgcccatgtggtgtaggaactttt

SEQ ID NO: 383353 - DNA, 25 bp, Mus musculus
ctgcccatgtgtacgacattgctgg

SEQ ID NO: 383354 - DNA, 25 bp, Mus musculus
ctgcccatgtgtatttaattgtgct

SEQ ID NO: 383355 - DNA, 25 bp, Mus musculus
ctgcccatgtgttcgacattgctgg

SEQ ID NO: 383356 - DNA, 25 bp, Mus musculus
ctgcccatgtgtttttaattgtgct

SEQ ID NO: 383357 - DNA, 25 bp, Mus musculus
ctgcccatgtttatatatagctgta

SEQ ID NO: 383358 - DNA, 25 bp, Mus musculus
ctgcccatgtttttatatagctgta

SEQ ID NO: 383359 - DNA, 25 bp, Mus musculus
ctgcccattcaaatgaatccgaagg

SEQ ID NO: 383360 - DNA, 25 bp, Mus musculus
ctgcccattcaattgaatccgaagg

SEQ ID NO: 383361 - DNA, 25 bp, Mus musculus
ctgcccatttaaatgtgacctatga

SEQ ID NO: 383362 - DNA, 25 bp, Mus musculus
ctgcccatttaattgtgacctatga

SEQ ID NO: 383363 - DNA, 25 bp, Mus musculus
ctgccccaaataaatccatctgaca

SEQ ID NO: 383364 - DNA, 25 bp, Mus musculus
ctgccccaaatatatccatctgaca

SEQ ID NO: 383365 - DNA, 25 bp, Mus musculus
ctgccccaactcattctgtaaggaa

SEQ ID NO: 383366 - DNA, 25 bp, Mus musculus
ctgccccaactctttctgtaaggaa

SEQ ID NO: 383367 - DNA, 25 bp, Mus musculus
ctgccccacgagactactatgttag

SEQ ID NO: 383368 - DNA, 25 bp, Mus musculus
ctgccccacgagtctactatgttag

SEQ ID NO: 383369 - DNA, 25 bp, Mus musculus
ctgccccagctaacagttgcaaata

SEQ ID NO: 383370 - DNA, 25 bp, Mus musculus
ctgccccagctatcagttgcaaata

SEQ ID NO: 383371 - DNA, 25 bp, Mus musculus
ctgcccccaataccagacttggaat

SEQ ID NO: 383372 - DNA, 25 bp, Mus musculus
ctgcccccaatagcagacttggaat

SEQ ID NO: 383373 - DNA, 25 bp, Mus musculus
ctgcccccagccaatgtctagctat

SEQ ID NO: 383374 - DNA, 25 bp, Mus musculus
ctgcccccagcctatgtctagctat

SEQ ID NO: 383375 - DNA, 25 bp, Mus musculus
ctgcccctaaaacgaatgctccata

SEQ ID NO: 383376 - DNA, 25 bp, Mus musculus
ctgcccctaaaaggaatgctccata

SEQ ID NO: 383377 - DNA, 25 bp, Mus musculus
ctgcccctaccacttttgaaacttg

SEQ ID NO: 383378 - DNA, 25 bp, Mus musculus
ctgcccctaccagttttgaaacttg

SEQ ID NO: 383379 - DNA, 25 bp, Mus musculus
ctgcccctatgtaggctctatgtaa

SEQ ID NO: 383380 - DNA, 25 bp, Mus musculus
ctgcccctatgttggctctatgtaa

SEQ ID NO: 383381 - DNA, 25 bp, Mus musculus
ctgcccctccagatgtgcttgcttt

SEQ ID NO: 383382 - DNA, 25 bp, Mus musculus
ctgcccctccagttgtgcttgcttt

SEQ ID NO: 383383 - DNA, 25 bp, Mus musculus
ctgcccctcttcagcatttgcagtt

SEQ ID NO: 383384 - DNA, 25 bp, Mus musculus
ctgcccctcttcataatttaaatct

SEQ ID NO: 383385 - DNA, 25 bp, Mus musculus
ctgcccctcttctgcatttgcagtt

SEQ ID NO: 383386 - DNA, 25 bp, Mus musculus
ctgcccctcttcttaatttaaatct

SEQ ID NO: 383387 - DNA, 25 bp, Mus musculus
ctgcccctgatcctaaagtttattg

SEQ ID NO: 383388 - DNA, 25 bp, Mus musculus
ctgcccctgatcgtaaagtttattg

SEQ ID NO: 383389 - DNA, 25 bp, Mus musculus
ctgcccctgcagagttggccaggga

SEQ ID NO: 383390 - DNA, 25 bp, Mus musculus
ctgcccctgcagtgttggccaggga

SEQ ID NO: 383391 - DNA, 25 bp, Mus musculus
ctgccccttaacctggcaatatagt

SEQ ID NO: 383392 - DNA, 25 bp, Mus musculus
ctgccccttaacgtggcaatatagt

SEQ ID NO: 383393 - DNA, 25 bp, Mus musculus
ctgccccttagtcggcgagttatta

SEQ ID NO: 383394 - DNA, 25 bp, Mus musculus
ctgccccttagtgggcgagttatta

SEQ ID NO: 383395 - DNA, 25 bp, Mus musculus
ctgccccttgggatctagatggatg

SEQ ID NO: 383396 - DNA, 25 bp, Mus musculus
ctgccccttgggttctagatggatg

SEQ ID NO: 383397 - DNA, 25 bp, Mus musculus
ctgcccctttgtcgtggtctgtgga

SEQ ID NO: 383398 - DNA, 25 bp, Mus musculus
ctgcccctttgtggtggtctgtgga

SEQ ID NO: 383399 - DNA, 25 bp, Mus musculus
ctgcccgaacgtcaactatggttac

SEQ ID NO: 383400 - DNA, 25 bp, Mus musculus
ctgcccgaacgtgaactatggttac

SEQ ID NO: 383401 - DNA, 25 bp, Mus musculus
ctgcccgaagctactgactataaca

SEQ ID NO: 383402 - DNA, 25 bp, Mus musculus
ctgcccgaagcttctgactataaca

SEQ ID NO: 383403 - DNA, 25 bp, Mus musculus
ctgcccgaattgcaaggctcatata

SEQ ID NO: 383404 - DNA, 25 bp, Mus musculus
ctgcccgaattggaaggctcatata

SEQ ID NO: 383405 - DNA, 25 bp, Mus musculus
ctgcccgagcttagcaagtttctaa

SEQ ID NO: 383406 - DNA, 25 bp, Mus musculus
ctgcccgagctttgcaagtttctaa

SEQ ID NO: 383407 - DNA, 25 bp, Mus musculus
ctgcccgatccacctagctaatctg

SEQ ID NO: 383408 - DNA, 25 bp, Mus musculus
ctgcccgatccagctagctaatctg

SEQ ID NO: 383409 - DNA, 25 bp, Mus musculus
ctgcccggcaagagttcttgttgat

SEQ ID NO: 383410 - DNA, 25 bp, Mus musculus
ctgcccggcaagtgttcttgttgat

SEQ ID NO: 383411 - DNA, 25 bp, Mus musculus
ctgcccggcatgcttacaatttttt

SEQ ID NO: 383412 - DNA, 25 bp, Mus musculus
ctgcccggcatggttacaatttttt

SEQ ID NO: 383413 - DNA, 25 bp, Mus musculus
ctgcccggctagctaccatttcatt

SEQ ID NO: 383414 - DNA, 25 bp, Mus musculus
ctgcccggctaggtaccatttcatt

SEQ ID NO: 383415 - DNA, 25 bp, Mus musculus
ctgcccgggtttatatactatagtg

SEQ ID NO: 383416 - DNA, 25 bp, Mus musculus
ctgcccgggtttttatactatagtg

SEQ ID NO: 383417 - DNA, 25 bp, Mus musculus
ctgcccggtggaaactgacatgcta

SEQ ID NO: 383418 - DNA, 25 bp, Mus musculus
ctgcccggtggatactgacatgcta

SEQ ID NO: 383419 - DNA, 25 bp, Mus musculus
ctgcccgtaactctggtttcaagga

SEQ ID NO: 383420 - DNA, 25 bp, Mus musculus
ctgcccgtaactgtggtttcaagga

SEQ ID NO: 383421 - DNA, 25 bp, Mus musculus
ctgcccgtacacctttatggacaac

SEQ ID NO: 383422 - DNA, 25 bp, Mus musculus
ctgcccgtacacgtttatggacaac

SEQ ID NO: 383423 - DNA, 25 bp, Mus musculus
ctgcccgtgtttctgagctgctgaa

SEQ ID NO: 383424 - DNA, 25 bp, Mus musculus
ctgcccgtgtttgtgagctgctgaa

SEQ ID NO: 383425 - DNA, 25 bp, Mus musculus
ctgcccgttcacatgcattagcaaa

SEQ ID NO: 383426 - DNA, 25 bp, Mus musculus
ctgcccgttcacttgcattagcaaa

SEQ ID NO: 383427 - DNA, 25 bp, Mus musculus
ctgccctaaccgattactatgttgg

SEQ ID NO: 383428 - DNA, 25 bp, Mus musculus
ctgccctaaccgtttactatgttgg

SEQ ID NO: 383429 - DNA, 25 bp, Mus musculus
ctgccctaagtgctataatcctaac

SEQ ID NO: 383430 - DNA, 25 bp, Mus musculus
ctgccctaagtggtataatcctaac

SEQ ID NO: 383431 - DNA, 25 bp, Mus musculus
ctgccctacagaaggcctggaatca

SEQ ID NO: 383432 - DNA, 25 bp, Mus musculus
ctgccctacagatggcctggaatca

SEQ ID NO: 383433 - DNA, 25 bp, Mus musculus
ctgccctacttacccaagaggagat

SEQ ID NO: 383434 - DNA, 25 bp, Mus musculus
ctgccctacttagccaagaggagat

SEQ ID NO: 383435 - DNA, 25 bp, Mus musculus
ctgccctacttgctaatcctagtaa

SEQ ID NO: 383436 - DNA, 25 bp, Mus musculus
ctgccctacttggtaatcctagtaa

SEQ ID NO: 383437 - DNA, 25 bp, Mus musculus
ctgccctagcaccatccggaagttt

SEQ ID NO: 383438 - DNA, 25 bp, Mus musculus
ctgccctagcacgatccggaagttt

SEQ ID NO: 383439 - DNA, 25 bp, Mus musculus
ctgccctaggagagtgtcaccactt

SEQ ID NO: 383440 - DNA, 25 bp, Mus musculus
ctgccctaggagtgtgtcaccactt

SEQ ID NO: 383441 - DNA, 25 bp, Mus musculus
ctgccctaggctccccttctccact

SEQ ID NO: 383442 - DNA, 25 bp, Mus musculus
ctgccctaggctctgcctaaagttt

SEQ ID NO: 383443 - DNA, 25 bp, Mus musculus
ctgccctaggctgcccttctccact

SEQ ID NO: 383444 - DNA, 25 bp, Mus musculus
ctgccctaggctgtgcctaaagttt

SEQ ID NO: 383445 - DNA, 25 bp, Mus musculus
ctgccctaggttaccttgctatata

SEQ ID NO: 383446 - DNA, 25 bp, Mus musculus
ctgccctaggtttccttgctatata

SEQ ID NO: 383447 - DNA, 25 bp, Mus musculus
ctgccctatgatcactgtgtgtttg

SEQ ID NO: 383448 - DNA, 25 bp, Mus musculus
ctgccctatgatgactgtgtgtttg

SEQ ID NO: 383449 - DNA, 25 bp, Mus musculus
ctgccctcaccaaaactgaagcata

SEQ ID NO: 383450 - DNA, 25 bp, Mus musculus
ctgccctcaccataactgaagcata

SEQ ID NO: 383451 - DNA, 25 bp, Mus musculus
ctgccctcactgctaactttataaa

SEQ ID NO: 383452 - DNA, 25 bp, Mus musculus
ctgccctcactggtaactttataaa

SEQ ID NO: 383453 - DNA, 25 bp, Mus musculus
ctgccctcagaacaagctcgagtgc

SEQ ID NO: 383454 - DNA, 25 bp, Mus musculus
ctgccctcagaagaagctcgagtgc

SEQ ID NO: 383455 - DNA, 25 bp, Mus musculus
ctgccctcagagagaaacactggtc

SEQ ID NO: 383456 - DNA, 25 bp, Mus musculus
ctgccctcagagtgaaacactggtc

SEQ ID NO: 383457 - DNA, 25 bp, Mus musculus
ctgccctcatcactgaagatctgtg

SEQ ID NO: 383458 - DNA, 25 bp, Mus musculus
ctgccctcatcagtgaagatctgtg

SEQ ID NO: 383459 - DNA, 25 bp, Mus musculus
ctgccctccacacatgatttctatg

SEQ ID NO: 383460 - DNA, 25 bp, Mus musculus
ctgccctccacagatgatttctatg

SEQ ID NO: 383461 - DNA, 25 bp, Mus musculus
ctgccctccaggctgttctaggagc

SEQ ID NO: 383462 - DNA, 25 bp, Mus musculus
ctgccctccagggtgttctaggagc

SEQ ID NO: 383463 - DNA, 25 bp, Mus musculus
ctgccctccataagcatcatacaag

SEQ ID NO: 383464 - DNA, 25 bp, Mus musculus
ctgccctccatatgcatcatacaag

SEQ ID NO: 383465 - DNA, 25 bp, Mus musculus
ctgccctccatgctcatagcaagaa

SEQ ID NO: 383466 - DNA, 25 bp, Mus musculus
ctgccctccatggtcatagcaagaa

SEQ ID NO: 383467 - DNA, 25 bp, Mus musculus
ctgccctcctggattatcaaggatg

SEQ ID NO: 383468 - DNA, 25 bp, Mus musculus
ctgccctcctggtttatcaaggatg

SEQ ID NO: 383469 - DNA, 25 bp, Mus musculus
ctgccctcgggtccctgtgctaagt

SEQ ID NO: 383470 - DNA, 25 bp, Mus musculus
ctgccctcgggtgcctgtgctaagt

SEQ ID NO: 383471 - DNA, 25 bp, Mus musculus
ctgccctctattacaactatcttga

SEQ ID NO: 383472 - DNA, 25 bp, Mus musculus
ctgccctctatttcaactatcttga

SEQ ID NO: 383473 - DNA, 25 bp, Mus musculus
ctgccctctctaattagcggttaaa

SEQ ID NO: 383474 - DNA, 25 bp, Mus musculus
ctgccctctctaattgaagtcagtg

SEQ ID NO: 383475 - DNA, 25 bp, Mus musculus
ctgccctctctatttagcggttaaa

SEQ ID NO: 383476 - DNA, 25 bp, Mus musculus
ctgccctctctatttgaagtcagtg

SEQ ID NO: 383477 - DNA, 25 bp, Mus musculus
ctgccctctgagatcatgttacatc

SEQ ID NO: 383478 - DNA, 25 bp, Mus musculus
ctgccctctgagttcatgttacatc

SEQ ID NO: 383479 - DNA, 25 bp, Mus musculus
ctgccctctgctcacagtgggagtc

SEQ ID NO: 383480 - DNA, 25 bp, Mus musculus
ctgccctctgctgacagtgggagtc

SEQ ID NO: 383481 - DNA, 25 bp, Mus musculus
ctgccctctggcagaggctgggttc

SEQ ID NO: 383482 - DNA, 25 bp, Mus musculus
ctgccctctggctgaggctgggttc

SEQ ID NO: 383483 - DNA, 25 bp, Mus musculus
ctgccctctgtaaaggctctaaggt

SEQ ID NO: 383484 - DNA, 25 bp, Mus musculus
ctgccctctgtataggctctaaggt

SEQ ID NO: 383485 - DNA, 25 bp, Mus musculus
ctgccctcttaaacttgtctggaga

SEQ ID NO: 383486 - DNA, 25 bp, Mus musculus
ctgccctcttaatcttgtctggaga

SEQ ID NO: 383487 - DNA, 25 bp, Mus musculus
ctgccctcttgcaactgtaattgta

SEQ ID NO: 383488 - DNA, 25 bp, Mus musculus
ctgccctcttgctactgtaattgta

SEQ ID NO: 383489 - DNA, 25 bp, Mus musculus
ctgccctcttggagtctttgtgact

SEQ ID NO: 383490 - DNA, 25 bp, Mus musculus
ctgccctcttggtgtctttgtgact

SEQ ID NO: 383491 - DNA, 25 bp, Mus musculus
ctgccctgagctcgatcaattggtt

SEQ ID NO: 383492 - DNA, 25 bp, Mus musculus
ctgccctgagctggatcaattggtt

SEQ ID NO: 383493 - DNA, 25 bp, Mus musculus
ctgccctgaggtacaatttctatga

SEQ ID NO: 383494 - DNA, 25 bp, Mus musculus
ctgccctgaggttcaatttctatga

SEQ ID NO: 383495 - DNA, 25 bp, Mus musculus
ctgccctgcaggagtttatgaattt

SEQ ID NO: 383496 - DNA, 25 bp, Mus musculus
ctgccctgcaggtgtttatgaattt

SEQ ID NO: 383497 - DNA, 25 bp, Mus musculus
ctgccctgccggatgtgagaagtgt

SEQ ID NO: 383498 - DNA, 25 bp, Mus musculus
ctgccctgccggttgtgagaagtgt

SEQ ID NO: 383499 - DNA, 25 bp, Mus musculus
ctgccctgctacattaaagccttta

SEQ ID NO: 383500 - DNA, 25 bp, Mus musculus
ctgccctgctactttaaagccttta

SEQ ID NO: 383501 - DNA, 25 bp, Mus musculus
ctgccctgggacatgctacattgta

SEQ ID NO: 383502 - DNA, 25 bp, Mus musculus
ctgccctgggacttgctacattgta

SEQ ID NO: 383503 - DNA, 25 bp, Mus musculus
ctgccctggtcacaattgctgcaaa

SEQ ID NO: 383504 - DNA, 25 bp, Mus musculus
ctgccctggtcagaattgctgcaaa

SEQ ID NO: 383505 - DNA, 25 bp, Mus musculus
ctgccctgtagactggttggttgta

SEQ ID NO: 383506 - DNA, 25 bp, Mus musculus
ctgccctgtagagtggttggttgta

SEQ ID NO: 383507 - DNA, 25 bp, Mus musculus
ctgccctgtatgaacaaagtcctgg

SEQ ID NO: 383508 - DNA, 25 bp, Mus musculus
ctgccctgtatgtacaaagtcctgg

SEQ ID NO: 383509 - DNA, 25 bp, Mus musculus
ctgccctgtccaaatacctggaaaa

SEQ ID NO: 383510 - DNA, 25 bp, Mus musculus
ctgccctgtccatatacctggaaaa

SEQ ID NO: 383511 - DNA, 25 bp, Mus musculus
ctgccctgttaccttcaaatgctgt

SEQ ID NO: 383512 - DNA, 25 bp, Mus musculus
ctgccctgttacgttcaaatgctgt

SEQ ID NO: 383513 - DNA, 25 bp, Mus musculus
ctgccctgttatcattttgaacatt

SEQ ID NO: 383514 - DNA, 25 bp, Mus musculus
ctgccctgttatgattttgaacatt

SEQ ID NO: 383515 - DNA, 25 bp, Mus musculus
ctgcccttaaagcagcaggcatagc

SEQ ID NO: 383516 - DNA, 25 bp, Mus musculus
ctgcccttaaaggagcaggcatagc

SEQ ID NO: 383517 - DNA, 25 bp, Mus musculus
ctgcccttaaccatgtgacttggag

SEQ ID NO: 383518 - DNA, 25 bp, Mus musculus
ctgcccttaaccttgtgacttggag

SEQ ID NO: 383519 - DNA, 25 bp, Mus musculus
ctgcccttagccagactgctgttgt

SEQ ID NO: 383520 - DNA, 25 bp, Mus musculus
ctgcccttagcctgactgctgttgt

SEQ ID NO: 383521 - DNA, 25 bp, Mus musculus
ctgcccttagggacatactttgatc

SEQ ID NO: 383522 - DNA, 25 bp, Mus musculus
ctgcccttagggtcatactttgatc

SEQ ID NO: 383523 - DNA, 25 bp, Mus musculus
ctgcccttaggtcttgctgacaaga

SEQ ID NO: 383524 - DNA, 25 bp, Mus musculus
ctgcccttaggtgttgctgacaaga

SEQ ID NO: 383525 - DNA, 25 bp, Mus musculus
ctgcccttcaacctccttggagaat

SEQ ID NO: 383526 - DNA, 25 bp, Mus musculus
ctgcccttcaacgtccttggagaat

SEQ ID NO: 383527 - DNA, 25 bp, Mus musculus
ctgcccttcataagtgtcagtacac

SEQ ID NO: 383528 - DNA, 25 bp, Mus musculus
ctgcccttcatatgtgtcagtacac

SEQ ID NO: 383529 - DNA, 25 bp, Mus musculus
ctgcccttgacacaatggttggtct

SEQ ID NO: 383530 - DNA, 25 bp, Mus musculus
ctgcccttgacactagtccatggta

SEQ ID NO: 383531 - DNA, 25 bp, Mus musculus
ctgcccttgacagaatggttggtct

SEQ ID NO: 383532 - DNA, 25 bp, Mus musculus
ctgcccttgacagtagtccatggta

SEQ ID NO: 383533 - DNA, 25 bp, Mus musculus
ctgcccttgctgagattgcttgtat

SEQ ID NO: 383534 - DNA, 25 bp, Mus musculus
ctgcccttgctgtgattgcttgtat

SEQ ID NO: 383535 - DNA, 25 bp, Mus musculus
ctgcccttggtgagagctagcgatg

SEQ ID NO: 383536 - DNA, 25 bp, Mus musculus
ctgcccttggtgtgagctagcgatg

SEQ ID NO: 383537 - DNA, 25 bp, Mus musculus
ctgcccttgtccatgaaaaagtctg

SEQ ID NO: 383538 - DNA, 25 bp, Mus musculus
ctgcccttgtccttgaaaaagtctg

SEQ ID NO: 383539 - DNA, 25 bp, Mus musculus
ctgcccttgtgtccggtgttgtttg

SEQ ID NO: 383540 - DNA, 25 bp, Mus musculus
ctgcccttgtgtgcggtgttgtttg

SEQ ID NO: 383541 - DNA, 25 bp, Mus musculus
ctgccctttcaccagggagagagac

SEQ ID NO: 383542 - DNA, 25 bp, Mus musculus
ctgccctttcacgagggagagagac

SEQ ID NO: 383543 - DNA, 25 bp, Mus musculus
ctgccctttgaaacaaggtaaactt

SEQ ID NO: 383544 - DNA, 25 bp, Mus musculus
ctgccctttgaatcaaggtaaactt

SEQ ID NO: 383545 - DNA, 25 bp, Mus musculus
ctgccctttgttatctgtccaacaa

SEQ ID NO: 383546 - DNA, 25 bp, Mus musculus
ctgccctttgttttctgtccaacaa

SEQ ID NO: 383547 - DNA, 25 bp, Mus musculus
ctgccgaatggtcggctttcagtaa

SEQ ID NO: 383548 - DNA, 25 bp, Mus musculus
ctgccgaatggtgggctttcagtaa

SEQ ID NO: 383549 - DNA, 25 bp, Mus musculus
ctgccgactgcgaggaaagcaacat

SEQ ID NO: 383550 - DNA, 25 bp, Mus musculus
ctgccgactgcgtggaaagcaacat

SEQ ID NO: 383551 - DNA, 25 bp, Mus musculus
ctgccgactgtgacgtcagtcttaa

SEQ ID NO: 383552 - DNA, 25 bp, Mus musculus
ctgccgactgtgtcgtcagtcttaa

SEQ ID NO: 383553 - DNA, 25 bp, Mus musculus
ctgccgagactgctgtgtggaacca

SEQ ID NO: 383554 - DNA, 25 bp, Mus musculus
ctgccgagactggtgtgtggaacca

SEQ ID NO: 383555 - DNA, 25 bp, Mus musculus
ctgccgagtgtgagagaaatcctac

SEQ ID NO: 383556 - DNA, 25 bp, Mus musculus
ctgccgagtgtgtgagaaatcctac

SEQ ID NO: 383557 - DNA, 25 bp, Mus musculus
ctgccgcacaggcagactcaggaaa

SEQ ID NO: 383558 - DNA, 25 bp, Mus musculus
ctgccgcacagggagactcaggaaa

SEQ ID NO: 383559 - DNA, 25 bp, Mus musculus
ctgccgcagttgcagcgacgtccaa

SEQ ID NO: 383560 - DNA, 25 bp, Mus musculus
ctgccgcagttggagcgacgtccaa

SEQ ID NO: 383561 - DNA, 25 bp, Mus musculus
ctgccgccattgatgtgttctttga

SEQ ID NO: 383562 - DNA, 25 bp, Mus musculus
ctgccgccattgttgtgttctttga

SEQ ID NO: 383563 - DNA, 25 bp, Mus musculus
ctgccgcgaagtctgtctcctgaat

SEQ ID NO: 383564 - DNA, 25 bp, Mus musculus
ctgccgcgaagtgtgtctcctgaat

SEQ ID NO: 383565 - DNA, 25 bp, Mus musculus
ctgccgctgaaacggcctgcaagga

SEQ ID NO: 383566 - DNA, 25 bp, Mus musculus
ctgccgctgaaagggcctgcaagga

SEQ ID NO: 383567 - DNA, 25 bp, Mus musculus
ctgccgctttagacaggtttctaaa

SEQ ID NO: 383568 - DNA, 25 bp, Mus musculus
ctgccgctttagtcaggtttctaaa

SEQ ID NO: 383569 - DNA, 25 bp, Mus musculus
ctgccggaacgcctcagtgaggtaa

SEQ ID NO: 383570 - DNA, 25 bp, Mus musculus
ctgccggaacgcgtcagtgaggtaa

SEQ ID NO: 383571 - DNA, 25 bp, Mus musculus
ctgccggaccctcttgaagagacga

SEQ ID NO: 383572 - DNA, 25 bp, Mus musculus
ctgccggaccctgttgaagagacga

SEQ ID NO: 383573 - DNA, 25 bp, Mus musculus
ctgccggagcgccgaggatttttaa

SEQ ID NO: 383574 - DNA, 25 bp, Mus musculus
ctgccggagcgcggaggatttttaa

SEQ ID NO: 383575 - DNA, 25 bp, Mus musculus
ctgccggatggcaacaaatcaaagg

SEQ ID NO: 383576 - DNA, 25 bp, Mus musculus
ctgccggatggctacaaatcaaagg

SEQ ID NO: 383577 - DNA, 25 bp, Mus musculus
ctgccggctacaactggagggacat

SEQ ID NO: 383578 - DNA, 25 bp, Mus musculus
ctgccggctacatctggagggacat

SEQ ID NO: 383579 - DNA, 25 bp, Mus musculus
ctgccggctgaacgctgtctggact

SEQ ID NO: 383580 - DNA, 25 bp, Mus musculus
ctgccggctgaaggctgtctggact

SEQ ID NO: 383581 - DNA, 25 bp, Mus musculus
ctgccgggatggccttaccctacct

SEQ ID NO: 383582 - DNA, 25 bp, Mus musculus
ctgccgggatgggcttaccctacct

SEQ ID NO: 383583 - DNA, 25 bp, Mus musculus
ctgccgggctgcagtgtgcatgaca

SEQ ID NO: 383584 - DNA, 25 bp, Mus musculus
ctgccgggctgctgtgtgcatgaca

SEQ ID NO: 383585 - DNA, 25 bp, Mus musculus
ctgccgggtaatcccttccttgcga

SEQ ID NO: 383586 - DNA, 25 bp, Mus musculus
ctgccgggtaatgccttccttgcga

SEQ ID NO: 383587 - DNA, 25 bp, Mus musculus
ctgccgggttatcagaccaggttgt

SEQ ID NO: 383588 - DNA, 25 bp, Mus musculus
ctgccgggttatgagaccaggttgt

SEQ ID NO: 383589 - DNA, 25 bp, Mus musculus
ctgccggtacctcaatgctggaaga

SEQ ID NO: 383590 - DNA, 25 bp, Mus musculus
ctgccggtacctgaatgctggaaga

SEQ ID NO: 383591 - DNA, 25 bp, Mus musculus
ctgccggtcatactgtcataggttt

SEQ ID NO: 383592 - DNA, 25 bp, Mus musculus
ctgccggtcatagtgtcataggttt

SEQ ID NO: 383593 - DNA, 25 bp, Mus musculus
ctgccggtgcttcggactttatcaa

SEQ ID NO: 383594 - DNA, 25 bp, Mus musculus
ctgccggtgcttgggactttatcaa

SEQ ID NO: 383595 - DNA, 25 bp, Mus musculus
ctgccggttctgcttttataaatat

SEQ ID NO: 383596 - DNA, 25 bp, Mus musculus
ctgccggttctggttttataaatat

SEQ ID NO: 383597 - DNA, 25 bp, Mus musculus
ctgccgtcccctcgtgacaaagaaa

SEQ ID NO: 383598 - DNA, 25 bp, Mus musculus
ctgccgtcccctggtgacaaagaaa

SEQ ID NO: 383599 - DNA, 25 bp, Mus musculus
ctgccgtctgtcacgtaagttctgg

SEQ ID NO: 383600 - DNA, 25 bp, Mus musculus
ctgccgtctgtctcgtaagttctgg

SEQ ID NO: 383601 - DNA, 25 bp, Mus musculus
ctgccgtgtgtgactttcatttgag

SEQ ID NO: 383602 - DNA, 25 bp, Mus musculus
ctgccgtgtgtgtctttcatttgag

SEQ ID NO: 383603 - DNA, 25 bp, Mus musculus
ctgccgttacttattcttcactggg

SEQ ID NO: 383604 - DNA, 25 bp, Mus musculus
ctgccgttactttttcttcactggg

SEQ ID NO: 383605 - DNA, 25 bp, Mus musculus
ctgccgttagcgactgcgacgttcg

SEQ ID NO: 383606 - DNA, 25 bp, Mus musculus
ctgccgttagcgtctgcgacgttcg

SEQ ID NO: 383607 - DNA, 25 bp, Mus musculus
ctgccgttcagaccgtctggcaaaa

SEQ ID NO: 383608 - DNA, 25 bp, Mus musculus
ctgccgttcagagcgtctggcaaaa

SEQ ID NO: 383609 - DNA, 25 bp, Mus musculus
ctgccgttgacgatgtactgagttt

SEQ ID NO: 383610 - DNA, 25 bp, Mus musculus
ctgccgttgacgttgtactgagttt

SEQ ID NO: 383611 - DNA, 25 bp, Mus musculus
ctgccgtttacgatttgagggtcat

SEQ ID NO: 383612 - DNA, 25 bp, Mus musculus
ctgccgtttacgttttgagggtcat

SEQ ID NO: 383613 - DNA, 25 bp, Mus musculus
ctgcctaaagatcaagcaaattttg

SEQ ID NO: 383614 - DNA, 25 bp, Mus musculus
ctgcctaaagatgaagcaaattttg

SEQ ID NO: 383615 - DNA, 25 bp, Mus musculus
ctgcctaagcatcgctgtcttggaa

SEQ ID NO: 383616 - DNA, 25 bp, Mus musculus
ctgcctaagcatggctgtcttggaa

SEQ ID NO: 383617 - DNA, 25 bp, Mus musculus
ctgcctaagcctctaacagtgtttt

SEQ ID NO: 383618 - DNA, 25 bp, Mus musculus
ctgcctaagcctgtaacagtgtttt

SEQ ID NO: 383619 - DNA, 25 bp, Mus musculus
ctgcctaaggatcggcggactactt

SEQ ID NO: 383620 - DNA, 25 bp, Mus musculus
ctgcctaaggatgggcggactactt

SEQ ID NO: 383621 - DNA, 25 bp, Mus musculus
ctgcctaatgaaaattgtgccaaag

SEQ ID NO: 383622 - DNA, 25 bp, Mus musculus
ctgcctaatgaatattgtgccaaag

SEQ ID NO: 383623 - DNA, 25 bp, Mus musculus
ctgcctaatgccagagctttgttct

SEQ ID NO: 383624 - DNA, 25 bp, Mus musculus
ctgcctaatgcctgagctttgttct

SEQ ID NO: 383625 - DNA, 25 bp, Mus musculus
ctgcctacacttcctagggtttgga

SEQ ID NO: 383626 - DNA, 25 bp, Mus musculus
ctgcctacacttgctagggtttgga

SEQ ID NO: 383627 - DNA, 25 bp, Mus musculus
ctgcctaccctgcaatctacagaat

SEQ ID NO: 383628 - DNA, 25 bp, Mus musculus
ctgcctaccctggaatctacagaat

SEQ ID NO: 383629 - DNA, 25 bp, Mus musculus
ctgcctacctttctatatcatacat

SEQ ID NO: 383630 - DNA, 25 bp, Mus musculus
ctgcctacctttgtatatcatacat

SEQ ID NO: 383631 - DNA, 25 bp, Mus musculus
ctgcctacgtggacgggaaacttgt

SEQ ID NO: 383632 - DNA, 25 bp, Mus musculus
ctgcctacgtggtcgggaaacttgt

SEQ ID NO: 383633 - DNA, 25 bp, Mus musculus
ctgcctacttagctggtggagacac

SEQ ID NO: 383634 - DNA, 25 bp, Mus musculus
ctgcctacttaggtggtggagacac

SEQ ID NO: 383635 - DNA, 25 bp, Mus musculus
ctgcctagacttcagaggtggattt

SEQ ID NO: 383636 - DNA, 25 bp, Mus musculus
ctgcctagacttgagaggtggattt

SEQ ID NO: 383637 - DNA, 25 bp, Mus musculus
ctgcctagagtgcatcatgtcggct

SEQ ID NO: 383638 - DNA, 25 bp, Mus musculus
ctgcctagagtggatcatgtcggct

SEQ ID NO: 383639 - DNA, 25 bp, Mus musculus
ctgcctagcaaaaaatatctgttgt

SEQ ID NO: 383640 - DNA, 25 bp, Mus musculus
ctgcctagcaaataatatctgttgt

SEQ ID NO: 383641 - DNA, 25 bp, Mus musculus
ctgcctagccacagcatataactaa

SEQ ID NO: 383642 - DNA, 25 bp, Mus musculus
ctgcctagccactgcatataactaa

SEQ ID NO: 383643 - DNA, 25 bp, Mus musculus
ctgcctagccatcggtatggtgaag

SEQ ID NO: 383644 - DNA, 25 bp, Mus musculus
ctgcctagccatgggtatggtgaag

SEQ ID NO: 383645 - DNA, 25 bp, Mus musculus
ctgcctaggcaaatctgagagtgac

SEQ ID NO: 383646 - DNA, 25 bp, Mus musculus
ctgcctaggcaattctgagagtgac

SEQ ID NO: 383647 - DNA, 25 bp, Mus musculus
ctgcctaggcgtcggcttcacagct

SEQ ID NO: 383648 - DNA, 25 bp, Mus musculus
ctgcctaggcgtgggcttcacagct

SEQ ID NO: 383649 - DNA, 25 bp, Mus musculus
ctgcctaggtgtatgagagccttta

SEQ ID NO: 383650 - DNA, 25 bp, Mus musculus
ctgcctaggtgtttgagagccttta

SEQ ID NO: 383651 - DNA, 25 bp, Mus musculus
ctgcctaggttaccggctcctttga

SEQ ID NO: 383652 - DNA, 25 bp, Mus musculus
ctgcctaggttagcggctcctttga

SEQ ID NO: 383653 - DNA, 25 bp, Mus musculus
ctgcctagtgcaaggtaagaagact

SEQ ID NO: 383654 - DNA, 25 bp, Mus musculus
ctgcctagtgcatggtaagaagact

SEQ ID NO: 383655 - DNA, 25 bp, Mus musculus
ctgcctataagcagctgctgggaac

SEQ ID NO: 383656 - DNA, 25 bp, Mus musculus
ctgcctataagctgctgctgggaac

SEQ ID NO: 383657 - DNA, 25 bp, Mus musculus
ctgcctatactaagctgtcttccta

SEQ ID NO: 383658 - DNA, 25 bp, Mus musculus
ctgcctatactatgctgtcttccta

SEQ ID NO: 383659 - DNA, 25 bp, Mus musculus
ctgcctatatttcctggttcttgaa

SEQ ID NO: 383660 - DNA, 25 bp, Mus musculus
ctgcctatatttgctggttcttgaa

SEQ ID NO: 383661 - DNA, 25 bp, Mus musculus
ctgcctatccatcacttagacttat

SEQ ID NO: 383662 - DNA, 25 bp, Mus musculus
ctgcctatccatgacttagacttat

SEQ ID NO: 383663 - DNA, 25 bp, Mus musculus
ctgcctatcctgagacaacttctat

SEQ ID NO: 383664 - DNA, 25 bp, Mus musculus
ctgcctatcctgtgacaacttctat

SEQ ID NO: 383665 - DNA, 25 bp, Mus musculus
ctgcctatgactacagctattctgg

SEQ ID NO: 383666 - DNA, 25 bp, Mus musculus
ctgcctatgacttcagctattctgg

SEQ ID NO: 383667 - DNA, 25 bp, Mus musculus
ctgcctatgcagacttggtgtccaa

SEQ ID NO: 383668 - DNA, 25 bp, Mus musculus
ctgcctatgcagtcttggtgtccaa

SEQ ID NO: 383669 - DNA, 25 bp, Mus musculus
ctgcctatgggcagtgatgtatata

SEQ ID NO: 383670 - DNA, 25 bp, Mus musculus
ctgcctatgggctgtgatgtatata

SEQ ID NO: 383671 - DNA, 25 bp, Mus musculus
ctgcctatgtgtcgatccttttgtc

SEQ ID NO: 383672 - DNA, 25 bp, Mus musculus
ctgcctatgtgtggatccttttgtc

SEQ ID NO: 383673 - DNA, 25 bp, Mus musculus
ctgcctattcagacctttagagttt

SEQ ID NO: 383674 - DNA, 25 bp, Mus musculus
ctgcctattcagtcctttagagttt

SEQ ID NO: 383675 - DNA, 25 bp, Mus musculus
ctgcctattggacacaaacctctgc

SEQ ID NO: 383676 - DNA, 25 bp, Mus musculus
ctgcctattggagacaaacctctgc

SEQ ID NO: 383677 - DNA, 25 bp, Mus musculus
ctgcctcaaagcctggagctggttc

SEQ ID NO: 383678 - DNA, 25 bp, Mus musculus
ctgcctcaaagcgtggagctggttc

SEQ ID NO: 383679 - DNA, 25 bp, Mus musculus
ctgcctcaaatacagctcttctgga

SEQ ID NO: 383680 - DNA, 25 bp, Mus musculus
ctgcctcaaatagagctcttctgga

SEQ ID NO: 383681 - DNA, 25 bp, Mus musculus
ctgcctcaaccccattggtagaaaa

SEQ ID NO: 383682 - DNA, 25 bp, Mus musculus
ctgcctcaacccgattggtagaaaa

SEQ ID NO: 383683 - DNA, 25 bp, Mus musculus
ctgcctcaatcacagaaatcgtcct

SEQ ID NO: 383684 - DNA, 25 bp, Mus musculus
ctgcctcaatcagagaaatcgtcct

SEQ ID NO: 383685 - DNA, 25 bp, Mus musculus
ctgcctcacaaactcaagggctatt

SEQ ID NO: 383686 - DNA, 25 bp, Mus musculus
ctgcctcacaaagtcaagggctatt

SEQ ID NO: 383687 - DNA, 25 bp, Mus musculus
ctgcctcacatcaaagcatctttgg

SEQ ID NO: 383688 - DNA, 25 bp, Mus musculus
ctgcctcacatctaagcatctttgg

SEQ ID NO: 383689 - DNA, 25 bp, Mus musculus
ctgcctcagagcaacttggaagtct

SEQ ID NO: 383690 - DNA, 25 bp, Mus musculus
ctgcctcagagctacttggaagtct

SEQ ID NO: 383691 - DNA, 25 bp, Mus musculus
ctgcctcagcaacggccacctcaag

SEQ ID NO: 383692 - DNA, 25 bp, Mus musculus
ctgcctcagcaagggccacctcaag

SEQ ID NO: 383693 - DNA, 25 bp, Mus musculus
ctgcctcaggcacttactagtattt

SEQ ID NO: 383694 - DNA, 25 bp, Mus musculus
ctgcctcaggcagttactagtattt

SEQ ID NO: 383695 - DNA, 25 bp, Mus musculus
ctgcctcaggcgatgtacaaacata

SEQ ID NO: 383696 - DNA, 25 bp, Mus musculus
ctgcctcaggcgttgtacaaacata

SEQ ID NO: 383697 - DNA, 25 bp, Mus musculus
ctgcctcagggacggtgcttcatat

SEQ ID NO: 383698 - DNA, 25 bp, Mus musculus
ctgcctcagggagggtgcttcatat

SEQ ID NO: 383699 - DNA, 25 bp, Mus musculus
ctgcctcagtatcccaatgaatcac

SEQ ID NO: 383700 - DNA, 25 bp, Mus musculus
ctgcctcagtatgccaatgaatcac

SEQ ID NO: 383701 - DNA, 25 bp, Mus musculus
ctgcctcagtctataagggctggat

SEQ ID NO: 383702 - DNA, 25 bp, Mus musculus
ctgcctcagtctttaagggctggat

SEQ ID NO: 383703 - DNA, 25 bp, Mus musculus
ctgcctcagttgaccaaaactggat

SEQ ID NO: 383704 - DNA, 25 bp, Mus musculus
ctgcctcagttgtccaaaactggat

SEQ ID NO: 383705 - DNA, 25 bp, Mus musculus
ctgcctcatgtgctcaagttcttgg

SEQ ID NO: 383706 - DNA, 25 bp, Mus musculus
ctgcctcatgtggtcaagttcttgg

SEQ ID NO: 383707 - DNA, 25 bp, Mus musculus
ctgcctccaccaagatgtcatgaaa

SEQ ID NO: 383708 - DNA, 25 bp, Mus musculus
ctgcctccaccatgatgtcatgaaa

SEQ ID NO: 383709 - DNA, 25 bp, Mus musculus
ctgcctccacttctggagtgccagt

SEQ ID NO: 383710 - DNA, 25 bp, Mus musculus
ctgcctccacttgtggagtgccagt

SEQ ID NO: 383711 - DNA, 25 bp, Mus musculus
ctgcctccagccagtattttgtaat

SEQ ID NO: 383712 - DNA, 25 bp, Mus musculus
ctgcctccagcctgtattttgtaat

SEQ ID NO: 383713 - DNA, 25 bp, Mus musculus
ctgcctccatttcaagagctgggtt

SEQ ID NO: 383714 - DNA, 25 bp, Mus musculus
ctgcctccatttgaagagctgggtt

SEQ ID NO: 383715 - DNA, 25 bp, Mus musculus
ctgcctccctataagagctacgagc

SEQ ID NO: 383716 - DNA, 25 bp, Mus musculus
ctgcctccctattagagctacgagc

SEQ ID NO: 383717 - DNA, 25 bp, Mus musculus
ctgcctccctgacaatcggaaggtg

SEQ ID NO: 383718 - DNA, 25 bp, Mus musculus
ctgcctccctgagaatcggaaggtg

SEQ ID NO: 383719 - DNA, 25 bp, Mus musculus
ctgcctccctgcactggagcaaggg

SEQ ID NO: 383720 - DNA, 25 bp, Mus musculus
ctgcctccctgctctggagcaaggg

SEQ ID NO: 383721 - DNA, 25 bp, Mus musculus
ctgcctcctcatcactgtgtaaata

SEQ ID NO: 383722 - DNA, 25 bp, Mus musculus
ctgcctcctcatgactgtgtaaata

SEQ ID NO: 383723 - DNA, 25 bp, Mus musculus
ctgcctccttgacatgctgtatata

SEQ ID NO: 383724 - DNA, 25 bp, Mus musculus
ctgcctccttgagatgctgtatata

SEQ ID NO: 383725 - DNA, 25 bp, Mus musculus
ctgcctcggttcactttatttattt

SEQ ID NO: 383726 - DNA, 25 bp, Mus musculus
ctgcctcggttctctttatttattt

SEQ ID NO: 383727 - DNA, 25 bp, Mus musculus
ctgcctcgtcttactcaagttgtat

SEQ ID NO: 383728 - DNA, 25 bp, Mus musculus
ctgcctcgtctttctcaagttgtat

SEQ ID NO: 383729 - DNA, 25 bp, Mus musculus
ctgcctctacctctgaagtgatatg

SEQ ID NO: 383730 - DNA, 25 bp, Mus musculus
ctgcctctacctgtgaagtgatatg

SEQ ID NO: 383731 - DNA, 25 bp, Mus musculus
ctgcctctagtgaatgtcctttcta

SEQ ID NO: 383732 - DNA, 25 bp, Mus musculus
ctgcctctagtgtatgtcctttcta

SEQ ID NO: 383733 - DNA, 25 bp, Mus musculus
ctgcctctattcagtttcccttccc

SEQ ID NO: 383734 - DNA, 25 bp, Mus musculus
ctgcctctattctgtttcccttccc

SEQ ID NO: 383735 - DNA, 25 bp, Mus musculus
ctgcctctcaaacatcacatggtga

SEQ ID NO: 383736 - DNA, 25 bp, Mus musculus
ctgcctctcaaagatcacatggtga

SEQ ID NO: 383737 - DNA, 25 bp, Mus musculus
ctgcctctcagacttgaatctcagg

SEQ ID NO: 383738 - DNA, 25 bp, Mus musculus
ctgcctctcagagttgaatctcagg

SEQ ID NO: 383739 - DNA, 25 bp, Mus musculus
ctgcctctcaggaagggttttttag

SEQ ID NO: 383740 - DNA, 25 bp, Mus musculus
ctgcctctcaggtagggttttttag

SEQ ID NO: 383741 - DNA, 25 bp, Mus musculus
ctgcctctcattatggacttcttga

SEQ ID NO: 383742 - DNA, 25 bp, Mus musculus
ctgcctctcattttggacttcttga

SEQ ID NO: 383743 - DNA, 25 bp, Mus musculus
ctgcctctccataggaatttcgaga

SEQ ID NO: 383744 - DNA, 25 bp, Mus musculus
ctgcctctccattggaatttcgaga

SEQ ID NO: 383745 - DNA, 25 bp, Mus musculus
ctgcctctccctctaaagaagtagg

SEQ ID NO: 383746 - DNA, 25 bp, Mus musculus
ctgcctctccctgtaaagaagtagg

SEQ ID NO: 383747 - DNA, 25 bp, Mus musculus
ctgcctctcctgaaagtcagtagta

SEQ ID NO: 383748 - DNA, 25 bp, Mus musculus
ctgcctctcctgtaagtcagtagta

SEQ ID NO: 383749 - DNA, 25 bp, Mus musculus
ctgcctctcgggacactgatcaaag

SEQ ID NO: 383750 - DNA, 25 bp, Mus musculus
ctgcctctcgggtcactgatcaaag

SEQ ID NO: 383751 - DNA, 25 bp, Mus musculus
ctgcctctctctagcctgttgactt

SEQ ID NO: 383752 - DNA, 25 bp, Mus musculus
ctgcctctctcttgcctgttgactt

SEQ ID NO: 383753 - DNA, 25 bp, Mus musculus
ctgcctctctggattacttttctaa

SEQ ID NO: 383754 - DNA, 25 bp, Mus musculus
ctgcctctctggtttacttttctaa

SEQ ID NO: 383755 - DNA, 25 bp, Mus musculus
ctgcctctctgtcttctaaacatgg

SEQ ID NO: 383756 - DNA, 25 bp, Mus musculus
ctgcctctctgtgttctaaacatgg

SEQ ID NO: 383757 - DNA, 25 bp, Mus musculus
ctgcctctgaagcttcttttttctg

SEQ ID NO: 383758 - DNA, 25 bp, Mus musculus
ctgcctctgaaggttcttttttctg

SEQ ID NO: 383759 - DNA, 25 bp, Mus musculus
ctgcctctgagaacgacgctaacaa

SEQ ID NO: 383760 - DNA, 25 bp, Mus musculus
ctgcctctgagatcgacgctaacaa

SEQ ID NO: 383761 - DNA, 25 bp, Mus musculus
ctgcctctgatcatttctggatggt

SEQ ID NO: 383762 - DNA, 25 bp, Mus musculus
ctgcctctgatcttttctggatggt

SEQ ID NO: 383763 - DNA, 25 bp, Mus musculus
ctgcctctgcttatacgggatatga

SEQ ID NO: 383764 - DNA, 25 bp, Mus musculus
ctgcctctgcttttacgggatatga

SEQ ID NO: 383765 - DNA, 25 bp, Mus musculus
ctgcctctgggcaggagactgttca

SEQ ID NO: 383766 - DNA, 25 bp, Mus musculus
ctgcctctgggctggagactgttca

SEQ ID NO: 383767 - DNA, 25 bp, Mus musculus
ctgcctctggttaactgggattgca

SEQ ID NO: 383768 - DNA, 25 bp, Mus musculus
ctgcctctggtttactgggattgca

SEQ ID NO: 383769 - DNA, 25 bp, Mus musculus
ctgcctctgtggctgtgtttgaaaa

SEQ ID NO: 383770 - DNA, 25 bp, Mus musculus
ctgcctctgtgggtgtgtttgaaaa

SEQ ID NO: 383771 - DNA, 25 bp, Mus musculus
ctgcctcttactcatacaaggtttg

SEQ ID NO: 383772 - DNA, 25 bp, Mus musculus
ctgcctcttactgatacaaggtttg

SEQ ID NO: 383773 - DNA, 25 bp, Mus musculus
ctgcctcttagtccctgggaaggaa

SEQ ID NO: 383774 - DNA, 25 bp, Mus musculus
ctgcctcttagtgcctgggaaggaa

SEQ ID NO: 383775 - DNA, 25 bp, Mus musculus
ctgcctcttgaaagggtgacagaca

SEQ ID NO: 383776 - DNA, 25 bp, Mus musculus
ctgcctcttgaatgggtgacagaca

SEQ ID NO: 383777 - DNA, 25 bp, Mus musculus
ctgcctcttgtgatcatatctgtat

SEQ ID NO: 383778 - DNA, 25 bp, Mus musculus
ctgcctcttgtgttcatatctgtat

SEQ ID NO: 383779 - DNA, 25 bp, Mus musculus
ctgcctgaattccaagagacctgat

SEQ ID NO: 383780 - DNA, 25 bp, Mus musculus
ctgcctgaattcgaagagacctgat

SEQ ID NO: 383781 - DNA, 25 bp, Mus musculus
ctgcctgacccgaagcatgtaaatg

SEQ ID NO: 383782 - DNA, 25 bp, Mus musculus
ctgcctgacccgtagcatgtaaatg

SEQ ID NO: 383783 - DNA, 25 bp, Mus musculus
ctgcctgacctgcaaacgtagagat

SEQ ID NO: 383784 - DNA, 25 bp, Mus musculus
ctgcctgacctggaaacgtagagat

SEQ ID NO: 383785 - DNA, 25 bp, Mus musculus
ctgcctgacgacatccgagggaagt

SEQ ID NO: 383786 - DNA, 25 bp, Mus musculus
ctgcctgacgacttccgagggaagt

SEQ ID NO: 383787 - DNA, 25 bp, Mus musculus
ctgcctgagctacacagactgcttt

SEQ ID NO: 383788 - DNA, 25 bp, Mus musculus
ctgcctgagctagacagactgcttt

SEQ ID NO: 383789 - DNA, 25 bp, Mus musculus
ctgcctgagggaaggatctgccctt

SEQ ID NO: 383790 - DNA, 25 bp, Mus musculus
ctgcctgagggatggatctgccctt

SEQ ID NO: 383791 - DNA, 25 bp, Mus musculus
ctgcctgagtctaggtagggatcct

SEQ ID NO: 383792 - DNA, 25 bp, Mus musculus
ctgcctgagtcttggtagggatcct

SEQ ID NO: 383793 - DNA, 25 bp, Mus musculus
ctgcctgatagtcaaggtgccctct

SEQ ID NO: 383794 - DNA, 25 bp, Mus musculus
ctgcctgatagtgaaggtgccctct

SEQ ID NO: 383795 - DNA, 25 bp, Mus musculus
ctgcctgatccaaagagccagatgg

SEQ ID NO: 383796 - DNA, 25 bp, Mus musculus
ctgcctgatccatagagccagatgg

SEQ ID NO: 383797 - DNA, 25 bp, Mus musculus
ctgcctgatgttaccactaatgtat

SEQ ID NO: 383798 - DNA, 25 bp, Mus musculus
ctgcctgatgtttccactaatgtat

SEQ ID NO: 383799 - DNA, 25 bp, Mus musculus
ctgcctgcaagtcctcatgagagtg

SEQ ID NO: 383800 - DNA, 25 bp, Mus musculus
ctgcctgcaagtgctcatgagagtg

SEQ ID NO: 383801 - DNA, 25 bp, Mus musculus
ctgcctgcacagctttttctgaggt

SEQ ID NO: 383802 - DNA, 25 bp, Mus musculus
ctgcctgcacaggtttttctgaggt

SEQ ID NO: 383803 - DNA, 25 bp, Mus musculus
ctgcctgcaccgcacagagttggag

SEQ ID NO: 383804 - DNA, 25 bp, Mus musculus
ctgcctgcaccggacagagttggag

SEQ ID NO: 383805 - DNA, 25 bp, Mus musculus
ctgcctgcactgagcagacgccatg

SEQ ID NO: 383806 - DNA, 25 bp, Mus musculus
ctgcctgcactgtgcagacgccatg

SEQ ID NO: 383807 - DNA, 25 bp, Mus musculus
ctgcctgcagagctttgatattcct

SEQ ID NO: 383808 - DNA, 25 bp, Mus musculus
ctgcctgcagaggtttgatattcct

SEQ ID NO: 383809 - DNA, 25 bp, Mus musculus
ctgcctgcagatcccttaaaagaga

SEQ ID NO: 383810 - DNA, 25 bp, Mus musculus
ctgcctgcagatgccttaaaagaga

SEQ ID NO: 383811 - DNA, 25 bp, Mus musculus
ctgcctgcagcaattctgatcagta

SEQ ID NO: 383812 - DNA, 25 bp, Mus musculus
ctgcctgcagcacatttggaggttt

SEQ ID NO: 383813 - DNA, 25 bp, Mus musculus
ctgcctgcagcagatttggaggttt

SEQ ID NO: 383814 - DNA, 25 bp, Mus musculus
ctgcctgcagcatttctgatcagta

SEQ ID NO: 383815 - DNA, 25 bp, Mus musculus
ctgcctgcaggacaaaggttcccaa

SEQ ID NO: 383816 - DNA, 25 bp, Mus musculus
ctgcctgcaggagaaaggttcccaa

SEQ ID NO: 383817 - DNA, 25 bp, Mus musculus
ctgcctgccaagaggactggaatgt

SEQ ID NO: 383818 - DNA, 25 bp, Mus musculus
ctgcctgccaagtggactggaatgt

SEQ ID NO: 383819 - DNA, 25 bp, Mus musculus
ctgcctgccacaatcttcagaaatt

SEQ ID NO: 383820 - DNA, 25 bp, Mus musculus
ctgcctgccacattcttcagaaatt

SEQ ID NO: 383821 - DNA, 25 bp, Mus musculus
ctgcctgccaggattttaccggaag

SEQ ID NO: 383822 - DNA, 25 bp, Mus musculus
ctgcctgccaggtttttaccggaag

SEQ ID NO: 383823 - DNA, 25 bp, Mus musculus
ctgcctgccagtctgaatgaacaag

SEQ ID NO: 383824 - DNA, 25 bp, Mus musculus
ctgcctgccagtgtgaatgaacaag

SEQ ID NO: 383825 - DNA, 25 bp, Mus musculus
ctgcctgcctcccaatacaaagtaa

SEQ ID NO: 383826 - DNA, 25 bp, Mus musculus
ctgcctgcctccgaatacaaagtaa

SEQ ID NO: 383827 - DNA, 25 bp, Mus musculus
ctgcctgcctttctacctcactcac

SEQ ID NO: 383828 - DNA, 25 bp, Mus musculus
ctgcctgcctttgtacctcactcac

SEQ ID NO: 383829 - DNA, 25 bp, Mus musculus
ctgcctgcggccacagtgttagagg

SEQ ID NO: 383830 - DNA, 25 bp, Mus musculus
ctgcctgcggcctcagtgttagagg

SEQ ID NO: 383831 - DNA, 25 bp, Mus musculus
ctgcctgcggtcatgatgctcatag

SEQ ID NO: 383832 - DNA, 25 bp, Mus musculus
ctgcctgcggtcttgatgctcatag

SEQ ID NO: 383833 - DNA, 25 bp, Mus musculus
ctgcctgcgtctctgtctgattccg

SEQ ID NO: 383834 - DNA, 25 bp, Mus musculus
ctgcctgcgtctgtgtctgattccg

SEQ ID NO: 383835 - DNA, 25 bp, Mus musculus
ctgcctgctgatactggaagaagtg

SEQ ID NO: 383836 - DNA, 25 bp, Mus musculus
ctgcctgctgattctggaagaagtg

SEQ ID NO: 383837 - DNA, 25 bp, Mus musculus
ctgcctgctgctctaaccaacagag

SEQ ID NO: 383838 - DNA, 25 bp, Mus musculus
ctgcctgctgctgtaaccaacagag

SEQ ID NO: 383839 - DNA, 25 bp, Mus musculus
ctgcctgctggaagtcctttctggg

SEQ ID NO: 383840 - DNA, 25 bp, Mus musculus
ctgcctgctggatgtcctttctggg

SEQ ID NO: 383841 - DNA, 25 bp, Mus musculus
ctgcctggagataggttttcgaacc

SEQ ID NO: 383842 - DNA, 25 bp, Mus musculus
ctgcctggagattggttttcgaacc

SEQ ID NO: 383843 - DNA, 25 bp, Mus musculus
ctgcctggatacacctttgtgtaat

SEQ ID NO: 383844 - DNA, 25 bp, Mus musculus
ctgcctggatactcctttgtgtaat

SEQ ID NO: 383845 - DNA, 25 bp, Mus musculus
ctgcctggcaagatttgtgtagctt

SEQ ID NO: 383846 - DNA, 25 bp, Mus musculus
ctgcctggcaagttttgtgtagctt

SEQ ID NO: 383847 - DNA, 25 bp, Mus musculus
ctgcctggcctcatttaagactgaa

SEQ ID NO: 383848 - DNA, 25 bp, Mus musculus
ctgcctggcctcttttaagactgaa

SEQ ID NO: 383849 - DNA, 25 bp, Mus musculus
ctgcctggcctgatttttatttctt

SEQ ID NO: 383850 - DNA, 25 bp, Mus musculus
ctgcctggcctgttttttatttctt

SEQ ID NO: 383851 - DNA, 25 bp, Mus musculus
ctgcctggccttaactctcagtggg

SEQ ID NO: 383852 - DNA, 25 bp, Mus musculus
ctgcctggccttctggttacattgg

SEQ ID NO: 383853 - DNA, 25 bp, Mus musculus
ctgcctggccttgtggttacattgg

SEQ ID NO: 383854 - DNA, 25 bp, Mus musculus
ctgcctggcctttactctcagtggg

SEQ ID NO: 383855 - DNA, 25 bp, Mus musculus
ctgcctggctataccagaggctttt

SEQ ID NO: 383856 - DNA, 25 bp, Mus musculus
ctgcctggctattccagaggctttt

SEQ ID NO: 383857 - DNA, 25 bp, Mus musculus
ctgcctgggattactagcatcaaag

SEQ ID NO: 383858 - DNA, 25 bp, Mus musculus
ctgcctgggatttctagcatcaaag

SEQ ID NO: 383859 - DNA, 25 bp, Mus musculus
ctgcctggggcacagcttcagagaa

SEQ ID NO: 383860 - DNA, 25 bp, Mus musculus
ctgcctggggcagagcttcagagaa

SEQ ID NO: 383861 - DNA, 25 bp, Mus musculus
ctgcctggtattagttaagtgcccc

SEQ ID NO: 383862 - DNA, 25 bp, Mus musculus
ctgcctggtatttgttaagtgcccc

SEQ ID NO: 383863 - DNA, 25 bp, Mus musculus
ctgcctggtctgaattggaactctt

SEQ ID NO: 383864 - DNA, 25 bp, Mus musculus
ctgcctggtctgtattggaactctt

SEQ ID NO: 383865 - DNA, 25 bp, Mus musculus
ctgcctggtgaaatatttctgttag

SEQ ID NO: 383866 - DNA, 25 bp, Mus musculus
ctgcctggtgaattatttctgttag

SEQ ID NO: 383867 - DNA, 25 bp, Mus musculus
ctgcctggtgccaattaaatgttac

SEQ ID NO: 383868 - DNA, 25 bp, Mus musculus
ctgcctggtgcctattaaatgttac

SEQ ID NO: 383869 - DNA, 25 bp, Mus musculus
ctgcctgtaatcacattcttgtact

SEQ ID NO: 383870 - DNA, 25 bp, Mus musculus
ctgcctgtaatctcattcttgtact

SEQ ID NO: 383871 - DNA, 25 bp, Mus musculus
ctgcctgtaggacttgctctgtgta

SEQ ID NO: 383872 - DNA, 25 bp, Mus musculus
ctgcctgtaggagttgctctgtgta

SEQ ID NO: 383873 - DNA, 25 bp, Mus musculus
ctgcctgtaggtccacaccggagag

SEQ ID NO: 383874 - DNA, 25 bp, Mus musculus
ctgcctgtaggtgcacaccggagag

SEQ ID NO: 383875 - DNA, 25 bp, Mus musculus
ctgcctgtcactctggctagtgatg

SEQ ID NO: 383876 - DNA, 25 bp, Mus musculus
ctgcctgtcactgtggctagtgatg

SEQ ID NO: 383877 - DNA, 25 bp, Mus musculus
ctgcctgtgcttagcaagcagggat

SEQ ID NO: 383878 - DNA, 25 bp, Mus musculus
ctgcctgtgctttgcaagcagggat

SEQ ID NO: 383879 - DNA, 25 bp, Mus musculus
ctgcctgtggcaagtcatctaagtt

SEQ ID NO: 383880 - DNA, 25 bp, Mus musculus
ctgcctgtggcatgtcatctaagtt

SEQ ID NO: 383881 - DNA, 25 bp, Mus musculus
ctgcctgtgtatcctaagaagctta

SEQ ID NO: 383882 - DNA, 25 bp, Mus musculus
ctgcctgtgtatgctaagaagctta

SEQ ID NO: 383883 - DNA, 25 bp, Mus musculus
ctgcctgtgtctcagtatttttctt

SEQ ID NO: 383884 - DNA, 25 bp, Mus musculus
ctgcctgtgtctgagtatttttctt

SEQ ID NO: 383885 - DNA, 25 bp, Mus musculus
ctgcctgttaaacaggaagaacctc

SEQ ID NO: 383886 - DNA, 25 bp, Mus musculus
ctgcctgttaaagaggaagaacctc

SEQ ID NO: 383887 - DNA, 25 bp, Mus musculus
ctgcctgttagcatgtgacaccagt

SEQ ID NO: 383888 - DNA, 25 bp, Mus musculus
ctgcctgttagcttgtgacaccagt

SEQ ID NO: 383889 - DNA, 25 bp, Mus musculus
ctgcctgttcacctcatgagtgaag

SEQ ID NO: 383890 - DNA, 25 bp, Mus musculus
ctgcctgttcacgtcatgagtgaag

SEQ ID NO: 383891 - DNA, 25 bp, Mus musculus
ctgcctgttcagctttgtctacata

SEQ ID NO: 383892 - DNA, 25 bp, Mus musculus
ctgcctgttcaggtttgtctacata

SEQ ID NO: 383893 - DNA, 25 bp, Mus musculus
ctgccttaaatccagttctttgcct

SEQ ID NO: 383894 - DNA, 25 bp, Mus musculus
ctgccttaaatcgagttctttgcct

SEQ ID NO: 383895 - DNA, 25 bp, Mus musculus
ctgccttaaggcaagggaccaccta

SEQ ID NO: 383896 - DNA, 25 bp, Mus musculus
ctgccttaaggctagggaccaccta

SEQ ID NO: 383897 - DNA, 25 bp, Mus musculus
ctgccttactgtcgtcctaatgagc

SEQ ID NO: 383898 - DNA, 25 bp, Mus musculus
ctgccttactgtggtcctaatgagc

SEQ ID NO: 383899 - DNA, 25 bp, Mus musculus
ctgccttagccccagggtagaagtt

SEQ ID NO: 383900 - DNA, 25 bp, Mus musculus
ctgccttagcccgagggtagaagtt

SEQ ID NO: 383901 - DNA, 25 bp, Mus musculus
ctgccttagcctctaagtatctcaa

SEQ ID NO: 383902 - DNA, 25 bp, Mus musculus
ctgccttagcctgtaagtatctcaa

SEQ ID NO: 383903 - DNA, 25 bp, Mus musculus
ctgccttaggccatagcctggcctg

SEQ ID NO: 383904 - DNA, 25 bp, Mus musculus
ctgccttaggccttagcctggcctg

SEQ ID NO: 383905 - DNA, 25 bp, Mus musculus
ctgccttatgctccagtttttcaag

SEQ ID NO: 383906 - DNA, 25 bp, Mus musculus
ctgccttatgctgcagtttttcaag

SEQ ID NO: 383907 - DNA, 25 bp, Mus musculus
ctgccttattctcccaggtatacag

SEQ ID NO: 383908 - DNA, 25 bp, Mus musculus
ctgccttattctgccaggtatacag

SEQ ID NO: 383909 - DNA, 25 bp, Mus musculus
ctgccttcacatcaggttatagaac

SEQ ID NO: 383910 - DNA, 25 bp, Mus musculus
ctgccttcacatgaggttatagaac

SEQ ID NO: 383911 - DNA, 25 bp, Mus musculus
ctgccttcacctatgtaataactgg

SEQ ID NO: 383912 - DNA, 25 bp, Mus musculus
ctgccttcacctttgtaataactgg

SEQ ID NO: 383913 - DNA, 25 bp, Mus musculus
ctgccttcagcgagtctctgattaa

SEQ ID NO: 383914 - DNA, 25 bp, Mus musculus
ctgccttcagcgtgtctctgattaa

SEQ ID NO: 383915 - DNA, 25 bp, Mus musculus
ctgccttcatttagtgtggccagtg

SEQ ID NO: 383916 - DNA, 25 bp, Mus musculus
ctgccttcattttgtgtggccagtg

SEQ ID NO: 383917 - DNA, 25 bp, Mus musculus
ctgccttccttcagtgtagattgat

SEQ ID NO: 383918 - DNA, 25 bp, Mus musculus
ctgccttccttccaggctagtaact

SEQ ID NO: 383919 - DNA, 25 bp, Mus musculus
ctgccttccttcgaggctagtaact

SEQ ID NO: 383920 - DNA, 25 bp, Mus musculus
ctgccttccttctgtgtagattgat

SEQ ID NO: 383921 - DNA, 25 bp, Mus musculus
ctgccttccttgaagcagataaggt

SEQ ID NO: 383922 - DNA, 25 bp, Mus musculus
ctgccttccttgtagcagataaggt

SEQ ID NO: 383923 - DNA, 25 bp, Mus musculus
ctgccttctactaaatcagacttgt

SEQ ID NO: 383924 - DNA, 25 bp, Mus musculus
ctgccttctacttaatcagacttgt

SEQ ID NO: 383925 - DNA, 25 bp, Mus musculus
ctgccttctcagcaaccatcatttt

SEQ ID NO: 383926 - DNA, 25 bp, Mus musculus
ctgccttctcaggaaccatcatttt

SEQ ID NO: 383927 - DNA, 25 bp, Mus musculus
ctgccttctcctattggagggcata

SEQ ID NO: 383928 - DNA, 25 bp, Mus musculus
ctgccttctccttttggagggcata

SEQ ID NO: 383929 - DNA, 25 bp, Mus musculus
ctgccttctctacccttataaagtg

SEQ ID NO: 383930 - DNA, 25 bp, Mus musculus
ctgccttctctagccttataaagtg

SEQ ID NO: 383931 - DNA, 25 bp, Mus musculus
ctgccttctgcaagatcccaaagca

SEQ ID NO: 383932 - DNA, 25 bp, Mus musculus
ctgccttctgcaatctttatgacaa

SEQ ID NO: 383933 - DNA, 25 bp, Mus musculus
ctgccttctgcatgatcccaaagca

SEQ ID NO: 383934 - DNA, 25 bp, Mus musculus
ctgccttctgcattctttatgacaa

SEQ ID NO: 383935 - DNA, 25 bp, Mus musculus
ctgccttcttagagccaggactgag

SEQ ID NO: 383936 - DNA, 25 bp, Mus musculus
ctgccttcttagtgccaggactgag

SEQ ID NO: 383937 - DNA, 25 bp, Mus musculus
ctgccttgacggctgtggaatcctt

SEQ ID NO: 383938 - DNA, 25 bp, Mus musculus
ctgccttgacgggtgtggaatcctt

SEQ ID NO: 383939 - DNA, 25 bp, Mus musculus
ctgccttgagacacagtggtgacca

SEQ ID NO: 383940 - DNA, 25 bp, Mus musculus
ctgccttgagactcagtggtgacca

SEQ ID NO: 383941 - DNA, 25 bp, Mus musculus
ctgccttgccccatgggaaagagag

SEQ ID NO: 383942 - DNA, 25 bp, Mus musculus
ctgccttgccccttgggaaagagag

SEQ ID NO: 383943 - DNA, 25 bp, Mus musculus
ctgccttgccggcacaagtcagatt

SEQ ID NO: 383944 - DNA, 25 bp, Mus musculus
ctgccttgccgggacaagtcagatt

SEQ ID NO: 383945 - DNA, 25 bp, Mus musculus
ctgccttgcctgaaactcaacaaat

SEQ ID NO: 383946 - DNA, 25 bp, Mus musculus
ctgccttgcctgtaactcaacaaat

SEQ ID NO: 383947 - DNA, 25 bp, Mus musculus
ctgccttgccttcactgtgactaca

SEQ ID NO: 383948 - DNA, 25 bp, Mus musculus
ctgccttgccttgactgtgactaca

SEQ ID NO: 383949 - DNA, 25 bp, Mus musculus
ctgccttgctgccactgttaagaaa

SEQ ID NO: 383950 - DNA, 25 bp, Mus musculus
ctgccttgctgcgactgttaagaaa

SEQ ID NO: 383951 - DNA, 25 bp, Mus musculus
ctgccttgctggctagcccaagggc

SEQ ID NO: 383952 - DNA, 25 bp, Mus musculus
ctgccttgctgggtagcccaagggc

SEQ ID NO: 383953 - DNA, 25 bp, Mus musculus
ctgccttggcttcctaagagctggg

SEQ ID NO: 383954 - DNA, 25 bp, Mus musculus
ctgccttggcttgctaagagctggg

SEQ ID NO: 383955 - DNA, 25 bp, Mus musculus
ctgccttgggatcggatgacctcgc

SEQ ID NO: 383956 - DNA, 25 bp, Mus musculus
ctgccttgggatgggatgacctcgc

SEQ ID NO: 383957 - DNA, 25 bp, Mus musculus
ctgccttgggctcaattgcctgaat

SEQ ID NO: 383958 - DNA, 25 bp, Mus musculus
ctgccttgggctctaaacagtggga

SEQ ID NO: 383959 - DNA, 25 bp, Mus musculus
ctgccttgggctgaattgcctgaat

SEQ ID NO: 383960 - DNA, 25 bp, Mus musculus
ctgccttgggctgtaaacagtggga

SEQ ID NO: 383961 - DNA, 25 bp, Mus musculus
ctgccttgggtgctgattcatctta

SEQ ID NO: 383962 - DNA, 25 bp, Mus musculus
ctgccttgggtggtgattcatctta

SEQ ID NO: 383963 - DNA, 25 bp, Mus musculus
ctgccttgtacccatgtcagagaaa

SEQ ID NO: 383964 - DNA, 25 bp, Mus musculus
ctgccttgtaccgatgtcagagaaa

SEQ ID NO: 383965 - DNA, 25 bp, Mus musculus
ctgccttgtcgaagccgtatcagag

SEQ ID NO: 383966 - DNA, 25 bp, Mus musculus
ctgccttgtcgatgccgtatcagag

SEQ ID NO: 383967 - DNA, 25 bp, Mus musculus
ctgccttgtgagatgccgagctaga

SEQ ID NO: 383968 - DNA, 25 bp, Mus musculus
ctgccttgtgagttgccgagctaga

SEQ ID NO: 383969 - DNA, 25 bp, Mus musculus
ctgccttgtggacagtgctgcatta

SEQ ID NO: 383970 - DNA, 25 bp, Mus musculus
ctgccttgtggagagtgctgcatta

SEQ ID NO: 383971 - DNA, 25 bp, Mus musculus
ctgccttgtgtaaacctttatggtt

SEQ ID NO: 383972 - DNA, 25 bp, Mus musculus
ctgccttgtgtatacctttatggtt

SEQ ID NO: 383973 - DNA, 25 bp, Mus musculus
ctgccttgtttcagagatactgtat

SEQ ID NO: 383974 - DNA, 25 bp, Mus musculus
ctgccttgtttctgagatactgtat

SEQ ID NO: 383975 - DNA, 25 bp, Mus musculus
ctgcctttacatccccagttgtgta

SEQ ID NO: 383976 - DNA, 25 bp, Mus musculus
ctgcctttacatgcccagttgtgta

SEQ ID NO: 383977 - DNA, 25 bp, Mus musculus
ctgcctttacccagctgtataataa

SEQ ID NO: 383978 - DNA, 25 bp, Mus musculus
ctgcctttaccctgctgtataataa

SEQ ID NO: 383979 - DNA, 25 bp, Mus musculus
ctgcctttaggcactttgtatgtct

SEQ ID NO: 383980 - DNA, 25 bp, Mus musculus
ctgcctttaggctctttgtatgtct

SEQ ID NO: 383981 - DNA, 25 bp, Mus musculus
ctgcctttaggtatgtccatgtgtc

SEQ ID NO: 383982 - DNA, 25 bp, Mus musculus
ctgcctttaggtttgtccatgtgtc

SEQ ID NO: 383983 - DNA, 25 bp, Mus musculus
ctgcctttcactaatctggacagtc

SEQ ID NO: 383984 - DNA, 25 bp, Mus musculus
ctgcctttcacttatctggacagtc

SEQ ID NO: 383985 - DNA, 25 bp, Mus musculus
ctgcctttccctaaactgaggaggt

SEQ ID NO: 383986 - DNA, 25 bp, Mus musculus
ctgcctttccctattcctgaaataa

SEQ ID NO: 383987 - DNA, 25 bp, Mus musculus
ctgcctttcccttaactgaggaggt

SEQ ID NO: 383988 - DNA, 25 bp, Mus musculus
ctgcctttcccttttcctgaaataa

SEQ ID NO: 383989 - DNA, 25 bp, Mus musculus
ctgcctttcggtcaggtccagcaag

SEQ ID NO: 383990 - DNA, 25 bp, Mus musculus
ctgcctttcggtgaggtccagcaag

SEQ ID NO: 383991 - DNA, 25 bp, Mus musculus
ctgcctttctagaagccagccaggg

SEQ ID NO: 383992 - DNA, 25 bp, Mus musculus
ctgcctttctagtagccagccaggg

SEQ ID NO: 383993 - DNA, 25 bp, Mus musculus
ctgcctttcttaaaagacccagctt

SEQ ID NO: 383994 - DNA, 25 bp, Mus musculus
ctgcctttcttataagacccagctt

SEQ ID NO: 383995 - DNA, 25 bp, Mus musculus
ctgcctttgaatccgtctttagaat

SEQ ID NO: 383996 - DNA, 25 bp, Mus musculus
ctgcctttgaatgcgtctttagaat

SEQ ID NO: 383997 - DNA, 25 bp, Mus musculus
ctgcctttgactcgcgagtgctggc

SEQ ID NO: 383998 - DNA, 25 bp, Mus musculus
ctgcctttgactggcgagtgctggc

SEQ ID NO: 383999 - DNA, 25 bp, Mus musculus
ctgcctttgagaaggatcccgattt

SEQ ID NO: 384000 - DNA, 25 bp, Mus musculus
ctgcctttgagatggatcccgattt

SEQ ID NO: 384001 - DNA, 25 bp, Mus musculus
ctgcctttgcagatcagagtctgga

SEQ ID NO: 384002 - DNA, 25 bp, Mus musculus
ctgcctttgcagttcagagtctgga

SEQ ID NO: 384003 - DNA, 25 bp, Mus musculus
ctgcctttgcatcgagacttcggaa

SEQ ID NO: 384004 - DNA, 25 bp, Mus musculus
ctgcctttgcatggagacttcggaa

SEQ ID NO: 384005 - DNA, 25 bp, Mus musculus
ctgcctttgccacaacggttgaaat

SEQ ID NO: 384006 - DNA, 25 bp, Mus musculus
ctgcctttgccagaacggttgaaat

SEQ ID NO: 384007 - DNA, 25 bp, Mus musculus
ctgcctttggatatcttagccagag

SEQ ID NO: 384008 - DNA, 25 bp, Mus musculus
ctgcctttggatttcttagccagag

SEQ ID NO: 384009 - DNA, 25 bp, Mus musculus
ctgcctttgggtactggttccatga

SEQ ID NO: 384010 - DNA, 25 bp, Mus musculus
ctgcctttgggttctggttccatga

SEQ ID NO: 384011 - DNA, 25 bp, Mus musculus
ctgcctttggtcagtctggaaatgc

SEQ ID NO: 384012 - DNA, 25 bp, Mus musculus
ctgcctttggtctgtctggaaatgc

SEQ ID NO: 384013 - DNA, 25 bp, Mus musculus
ctgcctttgtatatctcaaccagtt

SEQ ID NO: 384014 - DNA, 25 bp, Mus musculus
ctgcctttgtatttctcaaccagtt

SEQ ID NO: 384015 - DNA, 25 bp, Mus musculus
ctgcctttgtccatgcaagttgata

SEQ ID NO: 384016 - DNA, 25 bp, Mus musculus
ctgcctttgtccttgcaagttgata

SEQ ID NO: 384017 - DNA, 25 bp, Mus musculus
ctgcctttgtgcaaccagtgttaaa

SEQ ID NO: 384018 - DNA, 25 bp, Mus musculus
ctgcctttgtgctaccagtgttaaa

SEQ ID NO: 384019 - DNA, 25 bp, Mus musculus
ctgccttttacacctattgcgtgaa

SEQ ID NO: 384020 - DNA, 25 bp, Mus musculus
ctgccttttacagctattgcgtgaa

SEQ ID NO: 384021 - DNA, 25 bp, Mus musculus
ctgccttttaccctgagcttgaaga

SEQ ID NO: 384022 - DNA, 25 bp, Mus musculus
ctgccttttaccgtgagcttgaaga

SEQ ID NO: 384023 - DNA, 25 bp, Mus musculus
ctgccttttaggcaatctgtctgat

SEQ ID NO: 384024 - DNA, 25 bp, Mus musculus
ctgccttttagggaatctgtctgat

SEQ ID NO: 384025 - DNA, 25 bp, Mus musculus
ctgccttttagtacaatagatttat

SEQ ID NO: 384026 - DNA, 25 bp, Mus musculus
ctgccttttagttcaatagatttat

SEQ ID NO: 384027 - DNA, 25 bp, Mus musculus
ctgccttttctgacttgaggatctg

SEQ ID NO: 384028 - DNA, 25 bp, Mus musculus
ctgccttttctgtcttgaggatctg

SEQ ID NO: 384029 - DNA, 25 bp, Mus musculus
ctgcgaacgcgccttccaacttgag

SEQ ID NO: 384030 - DNA, 25 bp, Mus musculus
ctgcgaacgcgcgttccaacttgag

SEQ ID NO: 384031 - DNA, 25 bp, Mus musculus
ctgcgaacttgtacaaagacacgtt

SEQ ID NO: 384032 - DNA, 25 bp, Mus musculus
ctgcgaacttgttcaaagacacgtt

SEQ ID NO: 384033 - DNA, 25 bp, Mus musculus
ctgcgaagcggtcgccgtgtctttc

SEQ ID NO: 384034 - DNA, 25 bp, Mus musculus
ctgcgaagcggtggccgtgtctttc

SEQ ID NO: 384035 - DNA, 25 bp, Mus musculus
ctgcgaaggtgtcgttgtccgcaca

SEQ ID NO: 384036 - DNA, 25 bp, Mus musculus
ctgcgaaggtgtggttgtccgcaca

SEQ ID NO: 384037 - DNA, 25 bp, Mus musculus
ctgcgaagttcacagtggttcccaa

SEQ ID NO: 384038 - DNA, 25 bp, Mus musculus
ctgcgaagttcagagtggttcccaa

SEQ ID NO: 384039 - DNA, 25 bp, Mus musculus
ctgcgaattagacgctaacctgggc

SEQ ID NO: 384040 - DNA, 25 bp, Mus musculus
ctgcgaattagaggctaacctgggc

SEQ ID NO: 384041 - DNA, 25 bp, Mus musculus
ctgcgacaaggactctggtgatctg

SEQ ID NO: 384042 - DNA, 25 bp, Mus musculus
ctgcgacaaggagtctggtgatctg

SEQ ID NO: 384043 - DNA, 25 bp, Mus musculus
ctgcgactaaatcacttatctccgt

SEQ ID NO: 384044 - DNA, 25 bp, Mus musculus
ctgcgactaaatgacttatctccgt

SEQ ID NO: 384045 - DNA, 25 bp, Mus musculus
ctgcgactgcagaccagcagaggaa

SEQ ID NO: 384046 - DNA, 25 bp, Mus musculus
ctgcgactgcagtccagcagaggaa

SEQ ID NO: 384047 - DNA, 25 bp, Mus musculus
ctgcgagaattcagccacagtcttc

SEQ ID NO: 384048 - DNA, 25 bp, Mus musculus
ctgcgagaattctgccacagtcttc

SEQ ID NO: 384049 - DNA, 25 bp, Mus musculus
ctgcgagcgcggagagcctcaagaa

SEQ ID NO: 384050 - DNA, 25 bp, Mus musculus
ctgcgagcgcggtgagcctcaagaa

SEQ ID NO: 384051 - DNA, 25 bp, Mus musculus
ctgcgaggctgaactctttggtcct

SEQ ID NO: 384052 - DNA, 25 bp, Mus musculus
ctgcgaggctgatctctttggtcct

SEQ ID NO: 384053 - DNA, 25 bp, Mus musculus
ctgcgagggtttagatttgtggttt

SEQ ID NO: 384054 - DNA, 25 bp, Mus musculus
ctgcgagggttttgatttgtggttt

SEQ ID NO: 384055 - DNA, 25 bp, Mus musculus
ctgcgagtctggcttgtctattgct

SEQ ID NO: 384056 - DNA, 25 bp, Mus musculus
ctgcgagtctgggttgtctattgct

SEQ ID NO: 384057 - DNA, 25 bp, Mus musculus
ctgcgagtttctcctccaaaatggg

SEQ ID NO: 384058 - DNA, 25 bp, Mus musculus
ctgcgagtttctgctccaaaatggg

SEQ ID NO: 384059 - DNA, 25 bp, Mus musculus
ctgcgatacgaacttcctgaagacc

SEQ ID NO: 384060 - DNA, 25 bp, Mus musculus
ctgcgatacgaagttcctgaagacc

SEQ ID NO: 384061 - DNA, 25 bp, Mus musculus
ctgcgatcatctcggtaacctcggg

SEQ ID NO: 384062 - DNA, 25 bp, Mus musculus
ctgcgatcatctgggtaacctcggg

SEQ ID NO: 384063 - DNA, 25 bp, Mus musculus
ctgcgatcctgtagtctctttccat

SEQ ID NO: 384064 - DNA, 25 bp, Mus musculus
ctgcgatcctgttgtctctttccat

SEQ ID NO: 384065 - DNA, 25 bp, Mus musculus
ctgcgatctgttcagagcctgagca

SEQ ID NO: 384066 - DNA, 25 bp, Mus musculus
ctgcgatctgttgagagcctgagca

SEQ ID NO: 384067 - DNA, 25 bp, Mus musculus
ctgcgatgtcggagaggccattcaa

SEQ ID NO: 384068 - DNA, 25 bp, Mus musculus
ctgcgatgtcggtgaggccattcaa

SEQ ID NO: 384069 - DNA, 25 bp, Mus musculus
ctgcgattagcactggcgttccacc

SEQ ID NO: 384070 - DNA, 25 bp, Mus musculus
ctgcgattagcagtggcgttccacc

SEQ ID NO: 384071 - DNA, 25 bp, Mus musculus
ctgcgattatgcctactgtctatga

SEQ ID NO: 384072 - DNA, 25 bp, Mus musculus
ctgcgattatgcgtactgtctatga

SEQ ID NO: 384073 - DNA, 25 bp, Mus musculus
ctgcgattcttgagttagagggaac

SEQ ID NO: 384074 - DNA, 25 bp, Mus musculus
ctgcgattcttgtgttagagggaac

SEQ ID NO: 384075 - DNA, 25 bp, Mus musculus
ctgcgcaagttccagcaacgggaga

SEQ ID NO: 384076 - DNA, 25 bp, Mus musculus
ctgcgcaagttcgagcaacgggaga

SEQ ID NO: 384077 - DNA, 25 bp, Mus musculus
ctgcgcacagccaacgggcacctgt

SEQ ID NO: 384078 - DNA, 25 bp, Mus musculus
ctgcgcacagcctacgggcacctgt

SEQ ID NO: 384079 - DNA, 25 bp, Mus musculus
ctgcgcacagttcattgtttccatt

SEQ ID NO: 384080 - DNA, 25 bp, Mus musculus
ctgcgcacagttgattgtttccatt

SEQ ID NO: 384081 - DNA, 25 bp, Mus musculus
ctgcgcactttgaggtcccacagtg

SEQ ID NO: 384082 - DNA, 25 bp, Mus musculus
ctgcgcactttgtggtcccacagtg

SEQ ID NO: 384083 - DNA, 25 bp, Mus musculus
ctgcgcagagcgaggattcttcaag

SEQ ID NO: 384084 - DNA, 25 bp, Mus musculus
ctgcgcagagcgtggattcttcaag

SEQ ID NO: 384085 - DNA, 25 bp, Mus musculus
ctgcgcagatatattgagtctgtct

SEQ ID NO: 384086 - DNA, 25 bp, Mus musculus
ctgcgcagatattttgagtctgtct

SEQ ID NO: 384087 - DNA, 25 bp, Mus musculus
ctgcgcagctatacgctcaagctaa

SEQ ID NO: 384088 - DNA, 25 bp, Mus musculus
ctgcgcagctattcgctcaagctaa

SEQ ID NO: 384089 - DNA, 25 bp, Mus musculus
ctgcgcagtgaccttacactcaggg

SEQ ID NO: 384090 - DNA, 25 bp, Mus musculus
ctgcgcagtgacgttacactcaggg

SEQ ID NO: 384091 - DNA, 25 bp, Mus musculus
ctgcgcagtgagagccagtctagtt

SEQ ID NO: 384092 - DNA, 25 bp, Mus musculus
ctgcgcagtgagtgccagtctagtt

SEQ ID NO: 384093 - DNA, 25 bp, Mus musculus
ctgcgcatcagacagctgtgtggca

SEQ ID NO: 384094 - DNA, 25 bp, Mus musculus
ctgcgcatcagaccctttattacct

SEQ ID NO: 384095 - DNA, 25 bp, Mus musculus
ctgcgcatcagagagctgtgtggca

SEQ ID NO: 384096 - DNA, 25 bp, Mus musculus
ctgcgcatcagagcctttattacct

SEQ ID NO: 384097 - DNA, 25 bp, Mus musculus
ctgcgcatctctccattgcagggaa

SEQ ID NO: 384098 - DNA, 25 bp, Mus musculus
ctgcgcatctctgcattgcagggaa

SEQ ID NO: 384099 - DNA, 25 bp, Mus musculus
ctgcgcattcatcacctggaggatg

SEQ ID NO: 384100 - DNA, 25 bp, Mus musculus
ctgcgcattcatgacctggaggatg

SEQ ID NO: 384101 - DNA, 25 bp, Mus musculus
ctgcgccaacgcaatggaacttaat

SEQ ID NO: 384102 - DNA, 25 bp, Mus musculus
ctgcgccaacgctatggaacttaat

SEQ ID NO: 384103 - DNA, 25 bp, Mus musculus
ctgcgccaatgaaggtcagcaacat

SEQ ID NO: 384104 - DNA, 25 bp, Mus musculus
ctgcgccaatgatggtcagcaacat

SEQ ID NO: 384105 - DNA, 25 bp, Mus musculus
ctgcgccacagtaccgaatctaagt

SEQ ID NO: 384106 - DNA, 25 bp, Mus musculus
ctgcgccacagttccgaatctaagt

SEQ ID NO: 384107 - DNA, 25 bp, Mus musculus
ctgcgccacgcacctggttggtgaa

SEQ ID NO: 384108 - DNA, 25 bp, Mus musculus
ctgcgccacgcagctggttggtgaa

SEQ ID NO: 384109 - DNA, 25 bp, Mus musculus
ctgcgccagcagatcaaacatctgt

SEQ ID NO: 384110 - DNA, 25 bp, Mus musculus
ctgcgccagcagttcaaacatctgt

SEQ ID NO: 384111 - DNA, 25 bp, Mus musculus
ctgcgccagcgcacgtgcatagata

SEQ ID NO: 384112 - DNA, 25 bp, Mus musculus
ctgcgccagcgctcgtgcatagata

SEQ ID NO: 384113 - DNA, 25 bp, Mus musculus
ctgcgccagcggctactgaagattg

SEQ ID NO: 384114 - DNA, 25 bp, Mus musculus
ctgcgccagcgggtactgaagattg

SEQ ID NO: 384115 - DNA, 25 bp, Mus musculus
ctgcgccgggtgacattgaggctcc

SEQ ID NO: 384116 - DNA, 25 bp, Mus musculus
ctgcgccgggtgtcattgaggctcc

SEQ ID NO: 384117 - DNA, 25 bp, Mus musculus
ctgcgccttcctacctattagtatt

SEQ ID NO: 384118 - DNA, 25 bp, Mus musculus
ctgcgccttccttcctattagtatt

SEQ ID NO: 384119 - DNA, 25 bp, Mus musculus
ctgcgcgacctgatggctgtattgg

SEQ ID NO: 384120 - DNA, 25 bp, Mus musculus
ctgcgcgacctgttggctgtattgg

SEQ ID NO: 384121 - DNA, 25 bp, Mus musculus
ctgcgcgagaggaaccatcatattt

SEQ ID NO: 384122 - DNA, 25 bp, Mus musculus
ctgcgcgagaggtaccatcatattt

SEQ ID NO: 384123 - DNA, 25 bp, Mus musculus
ctgcgcgcgctgctagaactgagaa

SEQ ID NO: 384124 - DNA, 25 bp, Mus musculus
ctgcgcgcgctggtagaactgagaa

SEQ ID NO: 384125 - DNA, 25 bp, Mus musculus
ctgcgcggagcgctgacatcactcg

SEQ ID NO: 384126 - DNA, 25 bp, Mus musculus
ctgcgcggagcggtgacatcactcg

SEQ ID NO: 384127 - DNA, 25 bp, Mus musculus
ctgcgcgtactacagtactaacttc

SEQ ID NO: 384128 - DNA, 25 bp, Mus musculus
ctgcgcgtactagagtactaacttc

SEQ ID NO: 384129 - DNA, 25 bp, Mus musculus
ctgcgcgtgctgacagagcagctac

SEQ ID NO: 384130 - DNA, 25 bp, Mus musculus
ctgcgcgtgctgtcagagcagctac

SEQ ID NO: 384131 - DNA, 25 bp, Mus musculus
ctgcgcgttattagtagaattggct

SEQ ID NO: 384132 - DNA, 25 bp, Mus musculus
ctgcgcgttatttgtagaattggct

SEQ ID NO: 384133 - DNA, 25 bp, Mus musculus
ctgcgctcgtttacgcggctgctgg

SEQ ID NO: 384134 - DNA, 25 bp, Mus musculus
ctgcgctcgttttcgcggctgctgg

SEQ ID NO: 384135 - DNA, 25 bp, Mus musculus
ctgcgctctgagactgtgcacagaa

SEQ ID NO: 384136 - DNA, 25 bp, Mus musculus
ctgcgctctgagtctgtgcacagaa

SEQ ID NO: 384137 - DNA, 25 bp, Mus musculus
ctgcgctctggcataggaagagtta

SEQ ID NO: 384138 - DNA, 25 bp, Mus musculus
ctgcgctctggcttaggaagagtta

SEQ ID NO: 384139 - DNA, 25 bp, Mus musculus
ctgcgctgccacctgtgtatatata

SEQ ID NO: 384140 - DNA, 25 bp, Mus musculus
ctgcgctgccacgtgtgtatatata

SEQ ID NO: 384141 - DNA, 25 bp, Mus musculus
ctgcgctgctctaagaacatctcat

SEQ ID NO: 384142 - DNA, 25 bp, Mus musculus
ctgcgctgctcttagaacatctcat

SEQ ID NO: 384143 - DNA, 25 bp, Mus musculus
ctgcgcttctcacatcctgtatgta

SEQ ID NO: 384144 - DNA, 25 bp, Mus musculus
ctgcgcttctcagatcctgtatgta

SEQ ID NO: 384145 - DNA, 25 bp, Mus musculus
ctgcgcttggtcagtccactgttgt

SEQ ID NO: 384146 - DNA, 25 bp, Mus musculus
ctgcgcttggtctgtccactgttgt

SEQ ID NO: 384147 - DNA, 25 bp, Mus musculus
ctgcgcttgtgcatcattaatcatc

SEQ ID NO: 384148 - DNA, 25 bp, Mus musculus
ctgcgcttgtgcttcattaatcatc

SEQ ID NO: 384149 - DNA, 25 bp, Mus musculus
ctgcgctttaggacatgcggcggat

SEQ ID NO: 384150 - DNA, 25 bp, Mus musculus
ctgcgctttaggtcatgcggcggat

SEQ ID NO: 384151 - DNA, 25 bp, Mus musculus
ctgcgctttatcagtctatggtgaa

SEQ ID NO: 384152 - DNA, 25 bp, Mus musculus
ctgcgctttatctgtctatggtgaa

SEQ ID NO: 384153 - DNA, 25 bp, Mus musculus
ctgcggaaattcatgtgcgcacact

SEQ ID NO: 384154 - DNA, 25 bp, Mus musculus
ctgcggaaattcttgtgcgcacact

SEQ ID NO: 384155 - DNA, 25 bp, Mus musculus
ctgcggaagcgcaactccatgagga

SEQ ID NO: 384156 - DNA, 25 bp, Mus musculus
ctgcggaagcgctactccatgagga

SEQ ID NO: 384157 - DNA, 25 bp, Mus musculus
ctgcggacacggaggaagtagacat

SEQ ID NO: 384158 - DNA, 25 bp, Mus musculus
ctgcggacacggtggaagtagacat

SEQ ID NO: 384159 - DNA, 25 bp, Mus musculus
ctgcggaccgcacgtagcacaagat

SEQ ID NO: 384160 - DNA, 25 bp, Mus musculus
ctgcggaccgcaggtagcacaagat

SEQ ID NO: 384161 - DNA, 25 bp, Mus musculus
ctgcggacgcggacgtgtcgcttca

SEQ ID NO: 384162 - DNA, 25 bp, Mus musculus
ctgcggacgcggtcgtgtcgcttca

SEQ ID NO: 384163 - DNA, 25 bp, Mus musculus
ctgcggagcatgaactgtagcgatt

SEQ ID NO: 384164 - DNA, 25 bp, Mus musculus
ctgcggagcatgtactgtagcgatt

SEQ ID NO: 384165 - DNA, 25 bp, Mus musculus
ctgcggagcgagatggacacttgtc

SEQ ID NO: 384166 - DNA, 25 bp, Mus musculus
ctgcggagcgagttggacacttgtc

SEQ ID NO: 384167 - DNA, 25 bp, Mus musculus
ctgcggaggcgtaacctagactgga

SEQ ID NO: 384168 - DNA, 25 bp, Mus musculus
ctgcggaggcgttacctagactgga

SEQ ID NO: 384169 - DNA, 25 bp, Mus musculus
ctgcggatccatatgatattgttaa

SEQ ID NO: 384170 - DNA, 25 bp, Mus musculus
ctgcggatccatttgatattgttaa

SEQ ID NO: 384171 - DNA, 25 bp, Mus musculus
ctgcggatggatctgatgcctgtta

SEQ ID NO: 384172 - DNA, 25 bp, Mus musculus
ctgcggatggatgtgatgcctgtta

SEQ ID NO: 384173 - DNA, 25 bp, Mus musculus
ctgcggcagccacataaggttgttc

SEQ ID NO: 384174 - DNA, 25 bp, Mus musculus
ctgcggcagccagataaggttgttc

SEQ ID NO: 384175 - DNA, 25 bp, Mus musculus
ctgcggcaggtcatctcggaatatg

SEQ ID NO: 384176 - DNA, 25 bp, Mus musculus
ctgcggcaggtcttctcggaatatg

SEQ ID NO: 384177 - DNA, 25 bp, Mus musculus
ctgcggcattaccaacatggccagc

SEQ ID NO: 384178 - DNA, 25 bp, Mus musculus
ctgcggcattacgaacatggccagc

SEQ ID NO: 384179 - DNA, 25 bp, Mus musculus
ctgcggccaagtactggcagcgaat

SEQ ID NO: 384180 - DNA, 25 bp, Mus musculus
ctgcggccaagttctggcagcgaat

SEQ ID NO: 384181 - DNA, 25 bp, Mus musculus
ctgcggcccaggaggtgaagactct

SEQ ID NO: 384182 - DNA, 25 bp, Mus musculus
ctgcggcccaggtggtgaagactct

SEQ ID NO: 384183 - DNA, 25 bp, Mus musculus
ctgcggctcggtattatttgacatc

SEQ ID NO: 384184 - DNA, 25 bp, Mus musculus
ctgcggctcggttttatttgacatc

SEQ ID NO: 384185 - DNA, 25 bp, Mus musculus
ctgcggctggccatccaagagataa

SEQ ID NO: 384186 - DNA, 25 bp, Mus musculus
ctgcggctggccttccaagagataa

SEQ ID NO: 384187 - DNA, 25 bp, Mus musculus
ctgcggcttctgaactgtatgtaaa

SEQ ID NO: 384188 - DNA, 25 bp, Mus musculus
ctgcggcttctgtactgtatgtaaa

SEQ ID NO: 384189 - DNA, 25 bp, Mus musculus
ctgcggcttgtgagggcaaagccct

SEQ ID NO: 384190 - DNA, 25 bp, Mus musculus
ctgcggcttgtgtgggcaaagccct

SEQ ID NO: 384191 - DNA, 25 bp, Mus musculus
ctgcgggaagggaccatgttttctt

SEQ ID NO: 384192 - DNA, 25 bp, Mus musculus
ctgcgggaagggtccatgttttctt

SEQ ID NO: 384193 - DNA, 25 bp, Mus musculus
ctgcgggacagtcaactgtgcataa

SEQ ID NO: 384194 - DNA, 25 bp, Mus musculus
ctgcgggacagtgaactgtgcataa

SEQ ID NO: 384195 - DNA, 25 bp, Mus musculus
ctgcgggcgacgatccgattggaaa

SEQ ID NO: 384196 - DNA, 25 bp, Mus musculus
ctgcgggcgacgttccgattggaaa

SEQ ID NO: 384197 - DNA, 25 bp, Mus musculus
ctgcgggtagctcaactaggttact

SEQ ID NO: 384198 - DNA, 25 bp, Mus musculus
ctgcgggtagctgaactaggttact

SEQ ID NO: 384199 - DNA, 25 bp, Mus musculus
ctgcgggtatccagactctgggaaa

SEQ ID NO: 384200 - DNA, 25 bp, Mus musculus
ctgcgggtatcctgactctgggaaa

SEQ ID NO: 384201 - DNA, 25 bp, Mus musculus
ctgcgggtcatgaagtttcgccgct

SEQ ID NO: 384202 - DNA, 25 bp, Mus musculus
ctgcgggtcatgtagtttcgccgct

SEQ ID NO: 384203 - DNA, 25 bp, Mus musculus
ctgcgggtccatatctgagtgatga

SEQ ID NO: 384204 - DNA, 25 bp, Mus musculus
ctgcgggtccatttctgagtgatga

SEQ ID NO: 384205 - DNA, 25 bp, Mus musculus
ctgcgggtcttcctgctgtcaggac

SEQ ID NO: 384206 - DNA, 25 bp, Mus musculus
ctgcgggtcttcgtgctgtcaggac

SEQ ID NO: 384207 - DNA, 25 bp, Mus musculus
ctgcggtaaattatagcttgtctct

SEQ ID NO: 384208 - DNA, 25 bp, Mus musculus
ctgcggtaaattttagcttgtctct

SEQ ID NO: 384209 - DNA, 25 bp, Mus musculus
ctgcggtaacgaccacttccggaaa

SEQ ID NO: 384210 - DNA, 25 bp, Mus musculus
ctgcggtaacgagcacttccggaaa

SEQ ID NO: 384211 - DNA, 25 bp, Mus musculus
ctgcggtcaatgcaacggtgccgct

SEQ ID NO: 384212 - DNA, 25 bp, Mus musculus
ctgcggtcaatggaacggtgccgct

SEQ ID NO: 384213 - DNA, 25 bp, Mus musculus
ctgcggtcctcactaaacaaaaaag

SEQ ID NO: 384214 - DNA, 25 bp, Mus musculus
ctgcggtcctcagtaaacaaaaaag

SEQ ID NO: 384215 - DNA, 25 bp, Mus musculus
ctgcggtgactcatcttctgctctg

SEQ ID NO: 384216 - DNA, 25 bp, Mus musculus
ctgcggtgactcttcttctgctctg

SEQ ID NO: 384217 - DNA, 25 bp, Mus musculus
ctgcggtggcaacggccgaagtgac

SEQ ID NO: 384218 - DNA, 25 bp, Mus musculus
ctgcggtggcaagggccgaagtgac

SEQ ID NO: 384219 - DNA, 25 bp, Mus musculus
ctgcggtgtctcattctggaagcgg

SEQ ID NO: 384220 - DNA, 25 bp, Mus musculus
ctgcggtgtctctttctggaagcgg

SEQ ID NO: 384221 - DNA, 25 bp, Mus musculus
ctgcggtgtgccacagtgaagtccg

SEQ ID NO: 384222 - DNA, 25 bp, Mus musculus
ctgcggtgtgcctcagtgaagtccg

SEQ ID NO: 384223 - DNA, 25 bp, Mus musculus
ctgcggttcaggcatccaaatcggt

SEQ ID NO: 384224 - DNA, 25 bp, Mus musculus
ctgcggttcagggatccaaatcggt

SEQ ID NO: 384225 - DNA, 25 bp, Mus musculus
ctgcggttgctgctgtattccacag

SEQ ID NO: 384226 - DNA, 25 bp, Mus musculus
ctgcggttgctggtgtattccacag

SEQ ID NO: 384227 - DNA, 25 bp, Mus musculus
ctgcggttgtccatctgtacaaatc

SEQ ID NO: 384228 - DNA, 25 bp, Mus musculus
ctgcggttgtccttctgtacaaatc

SEQ ID NO: 384229 - DNA, 25 bp, Mus musculus
ctgcggtttcccaggtctagctttt

SEQ ID NO: 384230 - DNA, 25 bp, Mus musculus
ctgcggtttccctggtctagctttt

SEQ ID NO: 384231 - DNA, 25 bp, Mus musculus
ctgcgtatctgacgaggctggtttt

SEQ ID NO: 384232 - DNA, 25 bp, Mus musculus
ctgcgtatctgaggaggctggtttt

SEQ ID NO: 384233 - DNA, 25 bp, Mus musculus
ctgcgtatttatagaggcggtgccg

SEQ ID NO: 384234 - DNA, 25 bp, Mus musculus
ctgcgtatttattgaggcggtgccg

SEQ ID NO: 384235 - DNA, 25 bp, Mus musculus
ctgcgtcacaagcagcccagcggag

SEQ ID NO: 384236 - DNA, 25 bp, Mus musculus
ctgcgtcacaaggagcccagcggag

SEQ ID NO: 384237 - DNA, 25 bp, Mus musculus
ctgcgtcagaccatgggcacggaag

SEQ ID NO: 384238 - DNA, 25 bp, Mus musculus
ctgcgtcagaccttgggcacggaag

SEQ ID NO: 384239 - DNA, 25 bp, Mus musculus
ctgcgtcagctgaatttttgatcaa

SEQ ID NO: 384240 - DNA, 25 bp, Mus musculus
ctgcgtcagctgtatttttgatcaa

SEQ ID NO: 384241 - DNA, 25 bp, Mus musculus
ctgcgtcagggaccagagctcacag

SEQ ID NO: 384242 - DNA, 25 bp, Mus musculus
ctgcgtcagggagcagagctcacag

SEQ ID NO: 384243 - DNA, 25 bp, Mus musculus
ctgcgtcccagcagtgtaacacaga

SEQ ID NO: 384244 - DNA, 25 bp, Mus musculus
ctgcgtcccagctgtgtaacacaga

SEQ ID NO: 384245 - DNA, 25 bp, Mus musculus
ctgcgtcccctgatgtcagtagtag

SEQ ID NO: 384246 - DNA, 25 bp, Mus musculus
ctgcgtcccctgttgtcagtagtag

SEQ ID NO: 384247 - DNA, 25 bp, Mus musculus
ctgcgtcctcaaagttcagggtgta

SEQ ID NO: 384248 - DNA, 25 bp, Mus musculus
ctgcgtcctcaatgttcagggtgta

SEQ ID NO: 384249 - DNA, 25 bp, Mus musculus
ctgcgtcgctgtctcgagtgtataa

SEQ ID NO: 384250 - DNA, 25 bp, Mus musculus
ctgcgtcgctgtgtcgagtgtataa

SEQ ID NO: 384251 - DNA, 25 bp, Mus musculus
ctgcgtctctatcgcaccgagggca

SEQ ID NO: 384252 - DNA, 25 bp, Mus musculus
ctgcgtctctatggcaccgagggca

SEQ ID NO: 384253 - DNA, 25 bp, Mus musculus
ctgcgtgacccgcagcttttgatga

SEQ ID NO: 384254 - DNA, 25 bp, Mus musculus
ctgcgtgacccggagcttttgatga

SEQ ID NO: 384255 - DNA, 25 bp, Mus musculus
ctgcgtgagactattgtacctggat

SEQ ID NO: 384256 - DNA, 25 bp, Mus musculus
ctgcgtgagacttttgtacctggat

SEQ ID NO: 384257 - DNA, 25 bp, Mus musculus
ctgcgtgatccaccctgtgccaaaa

SEQ ID NO: 384258 - DNA, 25 bp, Mus musculus
ctgcgtgatccagcctgtgccaaaa

SEQ ID NO: 384259 - DNA, 25 bp, Mus musculus
ctgcgtgcaagcacaggatcgctat

SEQ ID NO: 384260 - DNA, 25 bp, Mus musculus
ctgcgtgcaagctcaggatcgctat

SEQ ID NO: 384261 - DNA, 25 bp, Mus musculus
ctgcgtgcaggtacttgtagggtat

SEQ ID NO: 384262 - DNA, 25 bp, Mus musculus
ctgcgtgcaggttcttgtagggtat

SEQ ID NO: 384263 - DNA, 25 bp, Mus musculus
ctgcgtgctgttctgcatgactgaa

SEQ ID NO: 384264 - DNA, 25 bp, Mus musculus
ctgcgtgctgttgtgcatgactgaa

SEQ ID NO: 384265 - DNA, 25 bp, Mus musculus
ctgcgtggagctccagggctcttaa

SEQ ID NO: 384266 - DNA, 25 bp, Mus musculus
ctgcgtggagctgcagggctcttaa

SEQ ID NO: 384267 - DNA, 25 bp, Mus musculus
ctgcgtgtccccatggaagatctaa

SEQ ID NO: 384268 - DNA, 25 bp, Mus musculus
ctgcgtgtccccttggaagatctaa

SEQ ID NO: 384269 - DNA, 25 bp, Mus musculus
ctgcgttactacctgggccacaaag

SEQ ID NO: 384270 - DNA, 25 bp, Mus musculus
ctgcgttactacgtgggccacaaag

SEQ ID NO: 384271 - DNA, 25 bp, Mus musculus
ctgcgttcacgtccaaggtgactaa

SEQ ID NO: 384272 - DNA, 25 bp, Mus musculus
ctgcgttcacgtgcaaggtgactaa

SEQ ID NO: 384273 - DNA, 25 bp, Mus musculus
ctgcgttccaacagactcaaaggga

SEQ ID NO: 384274 - DNA, 25 bp, Mus musculus
ctgcgttccaactgactcaaaggga

SEQ ID NO: 384275 - DNA, 25 bp, Mus musculus
ctgcgttccagaccctgtacaggtg

SEQ ID NO: 384276 - DNA, 25 bp, Mus musculus
ctgcgttccagagcctgtacaggtg

SEQ ID NO: 384277 - DNA, 25 bp, Mus musculus
ctgcgttcctgcaactgaggatgtg

SEQ ID NO: 384278 - DNA, 25 bp, Mus musculus
ctgcgttcctgctactgaggatgtg

SEQ ID NO: 384279 - DNA, 25 bp, Mus musculus
ctgcgttctctaactcatactgtga

SEQ ID NO: 384280 - DNA, 25 bp, Mus musculus
ctgcgttctctatctcatactgtga

SEQ ID NO: 384281 - DNA, 25 bp, Mus musculus
ctgcgttgaacgcttcattgataca

SEQ ID NO: 384282 - DNA, 25 bp, Mus musculus
ctgcgttgaacggttcattgataca

SEQ ID NO: 384283 - DNA, 25 bp, Mus musculus
ctgcgttggaaaacctgagggcata

SEQ ID NO: 384284 - DNA, 25 bp, Mus musculus
ctgcgttggaaatcctgagggcata

SEQ ID NO: 384285 - DNA, 25 bp, Mus musculus
ctgcgtttctacaggcgtgataaag

SEQ ID NO: 384286 - DNA, 25 bp, Mus musculus
ctgcgtttctactggcgtgataaag

SEQ ID NO: 384287 - DNA, 25 bp, Mus musculus
ctgcgtttgatcctcgatgttagta

SEQ ID NO: 384288 - DNA, 25 bp, Mus musculus
ctgcgtttgatcgtcgatgttagta

SEQ ID NO: 384289 - DNA, 25 bp, Mus musculus
ctgcgttttacacaactcagcactt

SEQ ID NO: 384290 - DNA, 25 bp, Mus musculus
ctgcgttttacagaactcagcactt

SEQ ID NO: 384291 - DNA, 25 bp, Mus musculus
ctgcgttttatcacaagctcgtcaa

SEQ ID NO: 384292 - DNA, 25 bp, Mus musculus
ctgcgttttatctcaagctcgtcaa

SEQ ID NO: 384293 - DNA, 25 bp, Mus musculus
ctgcgttttcataatcaaaggtcat

SEQ ID NO: 384294 - DNA, 25 bp, Mus musculus
ctgcgttttcattatcaaaggtcat

SEQ ID NO: 384295 - DNA, 25 bp, Mus musculus
ctgctaaaaactccctgctccggga

SEQ ID NO: 384296 - DNA, 25 bp, Mus musculus
ctgctaaaaactgcctgctccggga

SEQ ID NO: 384297 - DNA, 25 bp, Mus musculus
ctgctaaagtccactgccaggtgtt

SEQ ID NO: 384298 - DNA, 25 bp, Mus musculus
ctgctaaagtcctctgccaggtgtt

SEQ ID NO: 384299 - DNA, 25 bp, Mus musculus
ctgctaaattaacctgccctggtta

SEQ ID NO: 384300 - DNA, 25 bp, Mus musculus
ctgctaaattaagctgccctggtta

SEQ ID NO: 384301 - DNA, 25 bp, Mus musculus
ctgctaacagtacctcaggtgttta

SEQ ID NO: 384302 - DNA, 25 bp, Mus musculus
ctgctaacagtagctcaggtgttta

SEQ ID NO: 384303 - DNA, 25 bp, Mus musculus
ctgctaacttgcatcctgagtttga

SEQ ID NO: 384304 - DNA, 25 bp, Mus musculus
ctgctaacttgcttcctgagtttga

SEQ ID NO: 384305 - DNA, 25 bp, Mus musculus
ctgctaagaatgcattagttgggcc

SEQ ID NO: 384306 - DNA, 25 bp, Mus musculus
ctgctaagaatggattagttgggcc

SEQ ID NO: 384307 - DNA, 25 bp, Mus musculus
ctgctaaggaacagggctgcccaag

SEQ ID NO: 384308 - DNA, 25 bp, Mus musculus
ctgctaaggaactgggctgcccaag

SEQ ID NO: 384309 - DNA, 25 bp, Mus musculus
ctgctaaggcagatttggctaagtc

SEQ ID NO: 384310 - DNA, 25 bp, Mus musculus
ctgctaaggcagttttggctaagtc

SEQ ID NO: 384311 - DNA, 25 bp, Mus musculus
ctgctaatagcaactccgatactct

SEQ ID NO: 384312 - DNA, 25 bp, Mus musculus
ctgctaatagcatctccgatactct

SEQ ID NO: 384313 - DNA, 25 bp, Mus musculus
ctgctaatagttaacccctgggatt

SEQ ID NO: 384314 - DNA, 25 bp, Mus musculus
ctgctaatagtttacccctgggatt

SEQ ID NO: 384315 - DNA, 25 bp, Mus musculus
ctgctaatcattccccactaagcga

SEQ ID NO: 384316 - DNA, 25 bp, Mus musculus
ctgctaatcattgcccactaagcga

SEQ ID NO: 384317 - DNA, 25 bp, Mus musculus
ctgctaatgaagatcccctcttata

SEQ ID NO: 384318 - DNA, 25 bp, Mus musculus
ctgctaatgaagttcccctcttata

SEQ ID NO: 384319 - DNA, 25 bp, Mus musculus
ctgctaattaaccttcatgtctctc

SEQ ID NO: 384320 - DNA, 25 bp, Mus musculus
ctgctaattaacgttcatgtctctc

SEQ ID NO: 384321 - DNA, 25 bp, Mus musculus
ctgctacagtacagccatggtgaat

SEQ ID NO: 384322 - DNA, 25 bp, Mus musculus
ctgctacagtactgccatggtgaat

SEQ ID NO: 384323 - DNA, 25 bp, Mus musculus
ctgctacatctaccacgtttacaaa

SEQ ID NO: 384324 - DNA, 25 bp, Mus musculus
ctgctacatctagcacgtttacaaa

SEQ ID NO: 384325 - DNA, 25 bp, Mus musculus
ctgctaccaaagacacaagggttgt

SEQ ID NO: 384326 - DNA, 25 bp, Mus musculus
ctgctaccaaagtcacaagggttgt

SEQ ID NO: 384327 - DNA, 25 bp, Mus musculus
ctgctaccaaccagctgcacaagtg

SEQ ID NO: 384328 - DNA, 25 bp, Mus musculus
ctgctaccaacctgctgcacaagtg

SEQ ID NO: 384329 - DNA, 25 bp, Mus musculus
ctgctaccaacgcatctcatggaag

SEQ ID NO: 384330 - DNA, 25 bp, Mus musculus
ctgctaccaacggatctcatggaag

SEQ ID NO: 384331 - DNA, 25 bp, Mus musculus
ctgctaccacccatttaaattgcta

SEQ ID NO: 384332 - DNA, 25 bp, Mus musculus
ctgctaccacccttttaaattgcta

SEQ ID NO: 384333 - DNA, 25 bp, Mus musculus
ctgctaccagatcccaggtctgtgt

SEQ ID NO: 384334 - DNA, 25 bp, Mus musculus
ctgctaccagatgccaggtctgtgt

SEQ ID NO: 384335 - DNA, 25 bp, Mus musculus
ctgctaccgctgctgttcacaccgc

SEQ ID NO: 384336 - DNA, 25 bp, Mus musculus
ctgctaccgctggtgttcacaccgc

SEQ ID NO: 384337 - DNA, 25 bp, Mus musculus
ctgctaccgtagagtgccttgagtt

SEQ ID NO: 384338 - DNA, 25 bp, Mus musculus
ctgctaccgtagtgtgccttgagtt

SEQ ID NO: 384339 - DNA, 25 bp, Mus musculus
ctgctacctcaacaagggacttaga

SEQ ID NO: 384340 - DNA, 25 bp, Mus musculus
ctgctacctcaagaagggacttaga

SEQ ID NO: 384341 - DNA, 25 bp, Mus musculus
ctgctacctcacacgtggttatgaa

SEQ ID NO: 384342 - DNA, 25 bp, Mus musculus
ctgctacctcactcgtggttatgaa

SEQ ID NO: 384343 - DNA, 25 bp, Mus musculus
ctgctactcaacaattgccagtgca

SEQ ID NO: 384344 - DNA, 25 bp, Mus musculus
ctgctactcaactattgccagtgca

SEQ ID NO: 384345 - DNA, 25 bp, Mus musculus
ctgctactgagcagctgctattctt

SEQ ID NO: 384346 - DNA, 25 bp, Mus musculus
ctgctactgagctgctgctattctt

SEQ ID NO: 384347 - DNA, 25 bp, Mus musculus
ctgctactgcttagtggcccaggag

SEQ ID NO: 384348 - DNA, 25 bp, Mus musculus
ctgctactgctttgtggcccaggag

SEQ ID NO: 384349 - DNA, 25 bp, Mus musculus
ctgctagaaactcggctgcttggtc

SEQ ID NO: 384350 - DNA, 25 bp, Mus musculus
ctgctagaaactgggctgcttggtc

SEQ ID NO: 384351 - DNA, 25 bp, Mus musculus
ctgctagacaggctgatgatcatca

SEQ ID NO: 384352 - DNA, 25 bp, Mus musculus
ctgctagacagggtgatgatcatca

SEQ ID NO: 384353 - DNA, 25 bp, Mus musculus
ctgctagagctgaaatattgtaaat

SEQ ID NO: 384354 - DNA, 25 bp, Mus musculus
ctgctagagctgtaatattgtaaat

SEQ ID NO: 384355 - DNA, 25 bp, Mus musculus
ctgctagataagatccaggtcttca

SEQ ID NO: 384356 - DNA, 25 bp, Mus musculus
ctgctagataagttccaggtcttca

SEQ ID NO: 384357 - DNA, 25 bp, Mus musculus
ctgctagcagcaatgactgtggcca

SEQ ID NO: 384358 - DNA, 25 bp, Mus musculus
ctgctagcagcattgactgtggcca

SEQ ID NO: 384359 - DNA, 25 bp, Mus musculus
ctgctagccaataaacctccatatt

SEQ ID NO: 384360 - DNA, 25 bp, Mus musculus
ctgctagccaattaacctccatatt

SEQ ID NO: 384361 - DNA, 25 bp, Mus musculus
ctgctagccacgcaagctggagttt

SEQ ID NO: 384362 - DNA, 25 bp, Mus musculus
ctgctagccacggaagctggagttt

SEQ ID NO: 384363 - DNA, 25 bp, Mus musculus
ctgctagccagaagccacgttactt

SEQ ID NO: 384364 - DNA, 25 bp, Mus musculus
ctgctagccagatgccacgttactt

SEQ ID NO: 384365 - DNA, 25 bp, Mus musculus
ctgctagccttgagggcagcaacat

SEQ ID NO: 384366 - DNA, 25 bp, Mus musculus
ctgctagccttgtgggcagcaacat

SEQ ID NO: 384367 - DNA, 25 bp, Mus musculus
ctgctagcgctgagtcccaacgact

SEQ ID NO: 384368 - DNA, 25 bp, Mus musculus
ctgctagcgctgtgtcccaacgact

SEQ ID NO: 384369 - DNA, 25 bp, Mus musculus
ctgctagctaggcacgagacattca

SEQ ID NO: 384370 - DNA, 25 bp, Mus musculus
ctgctagctagggacgagacattca

SEQ ID NO: 384371 - DNA, 25 bp, Mus musculus
ctgctagctgctagtgagctgtact

SEQ ID NO: 384372 - DNA, 25 bp, Mus musculus
ctgctagctgcttgtgagctgtact

SEQ ID NO: 384373 - DNA, 25 bp, Mus musculus
ctgctagctgggatatctctcttaa

SEQ ID NO: 384374 - DNA, 25 bp, Mus musculus
ctgctagctgggttatctctcttaa

SEQ ID NO: 384375 - DNA, 25 bp, Mus musculus
ctgctagctgtgaactaataaagtt

SEQ ID NO: 384376 - DNA, 25 bp, Mus musculus
ctgctagctgtgtactaataaagtt

SEQ ID NO: 384377 - DNA, 25 bp, Mus musculus
ctgctaggcaagagcacccctgacg

SEQ ID NO: 384378 - DNA, 25 bp, Mus musculus
ctgctaggcaagtgcacccctgacg

SEQ ID NO: 384379 - DNA, 25 bp, Mus musculus
ctgctaggtataccccaaagggact

SEQ ID NO: 384380 - DNA, 25 bp, Mus musculus
ctgctaggtatagcccaaagggact

SEQ ID NO: 384381 - DNA, 25 bp, Mus musculus
ctgctaggtcatccacgaagaagga

SEQ ID NO: 384382 - DNA, 25 bp, Mus musculus
ctgctaggtcatgcacgaagaagga

SEQ ID NO: 384383 - DNA, 25 bp, Mus musculus
ctgctagtacttaaaccacatggtg

SEQ ID NO: 384384 - DNA, 25 bp, Mus musculus
ctgctagtactttaaccacatggtg

SEQ ID NO: 384385 - DNA, 25 bp, Mus musculus
ctgctagtgaagctggtttctctct

SEQ ID NO: 384386 - DNA, 25 bp, Mus musculus
ctgctagtgaaggtggtttctctct

SEQ ID NO: 384387 - DNA, 25 bp, Mus musculus
ctgctatactaaagctgcccataca

SEQ ID NO: 384388 - DNA, 25 bp, Mus musculus
ctgctatactaatgctgcccataca

SEQ ID NO: 384389 - DNA, 25 bp, Mus musculus
ctgctatcatgtcgctgctctgaag

SEQ ID NO: 384390 - DNA, 25 bp, Mus musculus
ctgctatcatgtggctgctctgaag

SEQ ID NO: 384391 - DNA, 25 bp, Mus musculus
ctgctatcctgaatccacggatgtt

SEQ ID NO: 384392 - DNA, 25 bp, Mus musculus
ctgctatcctgattccacggatgtt

SEQ ID NO: 384393 - DNA, 25 bp, Mus musculus
ctgctatctctgactactcttggaa

SEQ ID NO: 384394 - DNA, 25 bp, Mus musculus
ctgctatctctgtctactcttggaa

SEQ ID NO: 384395 - DNA, 25 bp, Mus musculus
ctgctatgcaccagcgtgcagagga

SEQ ID NO: 384396 - DNA, 25 bp, Mus musculus
ctgctatgcacctgcgtgcagagga

SEQ ID NO: 384397 - DNA, 25 bp, Mus musculus
ctgctatgcattatcttcacagcgc

SEQ ID NO: 384398 - DNA, 25 bp, Mus musculus
ctgctatgcattttcttcacagcgc

SEQ ID NO: 384399 - DNA, 25 bp, Mus musculus
ctgctatgtaacaggtgctcaataa

SEQ ID NO: 384400 - DNA, 25 bp, Mus musculus
ctgctatgtaactggtgctcaataa

SEQ ID NO: 384401 - DNA, 25 bp, Mus musculus
ctgctattacagacttaacgttttc

SEQ ID NO: 384402 - DNA, 25 bp, Mus musculus
ctgctattacagtcttaacgttttc

SEQ ID NO: 384403 - DNA, 25 bp, Mus musculus
ctgctattcttgcatcagccagagg

SEQ ID NO: 384404 - DNA, 25 bp, Mus musculus
ctgctattcttggatcagccagagg

SEQ ID NO: 384405 - DNA, 25 bp, Mus musculus
ctgctcaatgacagcgagtcccgcg

SEQ ID NO: 384406 - DNA, 25 bp, Mus musculus
ctgctcaatgactgcgagtcccgcg

SEQ ID NO: 384407 - DNA, 25 bp, Mus musculus
ctgctcacaagcactaacgaaatgg

SEQ ID NO: 384408 - DNA, 25 bp, Mus musculus
ctgctcacaagctctaacgaaatgg

SEQ ID NO: 384409 - DNA, 25 bp, Mus musculus
ctgctcacaatgagtggcctttcag

SEQ ID NO: 384410 - DNA, 25 bp, Mus musculus
ctgctcacaatgtgtggcctttcag

SEQ ID NO: 384411 - DNA, 25 bp, Mus musculus
ctgctcacaattacatgtccatcca

SEQ ID NO: 384412 - DNA, 25 bp, Mus musculus
ctgctcacaatttcatgtccatcca

SEQ ID NO: 384413 - DNA, 25 bp, Mus musculus
ctgctcacactaccctatgacttgg

SEQ ID NO: 384414 - DNA, 25 bp, Mus musculus
ctgctcacactagcctatgacttgg

SEQ ID NO: 384415 - DNA, 25 bp, Mus musculus
ctgctcacactcagacttgtaaggt

SEQ ID NO: 384416 - DNA, 25 bp, Mus musculus
ctgctcacactctgacttgtaaggt

SEQ ID NO: 384417 - DNA, 25 bp, Mus musculus
ctgctcacaggtaggctggctcgac

SEQ ID NO: 384418 - DNA, 25 bp, Mus musculus
ctgctcacaggttggctggctcgac

SEQ ID NO: 384419 - DNA, 25 bp, Mus musculus
ctgctcacataccactatgctttga

SEQ ID NO: 384420 - DNA, 25 bp, Mus musculus
ctgctcacatacgactatgctttga

SEQ ID NO: 384421 - DNA, 25 bp, Mus musculus
ctgctcaccagaactcaggtaggaa

SEQ ID NO: 384422 - DNA, 25 bp, Mus musculus
ctgctcaccagatctcaggtaggaa

SEQ ID NO: 384423 - DNA, 25 bp, Mus musculus
ctgctcacgagcagtcttttacacc

SEQ ID NO: 384424 - DNA, 25 bp, Mus musculus
ctgctcacgagctgtcttttacacc

SEQ ID NO: 384425 - DNA, 25 bp, Mus musculus
ctgctcacggtcactgcctgttggg

SEQ ID NO: 384426 - DNA, 25 bp, Mus musculus
ctgctcacggtctctgcctgttggg

SEQ ID NO: 384427 - DNA, 25 bp, Mus musculus
ctgctcactctgattgtcgtggatg

SEQ ID NO: 384428 - DNA, 25 bp, Mus musculus
ctgctcactctgtttgtcgtggatg

SEQ ID NO: 384429 - DNA, 25 bp, Mus musculus
ctgctcactgctaaagagcctgctt

SEQ ID NO: 384430 - DNA, 25 bp, Mus musculus
ctgctcactgcttaagagcctgctt

SEQ ID NO: 384431 - DNA, 25 bp, Mus musculus
ctgctcacttgtcccagagtctgaa

SEQ ID NO: 384432 - DNA, 25 bp, Mus musculus
ctgctcacttgtgccagagtctgaa

SEQ ID NO: 384433 - DNA, 25 bp, Mus musculus
ctgctcagaaacacatgtgctgtcc

SEQ ID NO: 384434 - DNA, 25 bp, Mus musculus
ctgctcagaaactcatgtgctgtcc

SEQ ID NO: 384435 - DNA, 25 bp, Mus musculus
ctgctcagacacctagaagaaacga

SEQ ID NO: 384436 - DNA, 25 bp, Mus musculus
ctgctcagacacgtagaagaaacga

SEQ ID NO: 384437 - DNA, 25 bp, Mus musculus
ctgctcagacctaaagaacatttta

SEQ ID NO: 384438 - DNA, 25 bp, Mus musculus
ctgctcagaccttaagaacatttta

SEQ ID NO: 384439 - DNA, 25 bp, Mus musculus
ctgctcagagtgagggcttcatgga

SEQ ID NO: 384440 - DNA, 25 bp, Mus musculus
ctgctcagagtgtgggcttcatgga

SEQ ID NO: 384441 - DNA, 25 bp, Mus musculus
ctgctcagcagaatccagagcttgc

SEQ ID NO: 384442 - DNA, 25 bp, Mus musculus
ctgctcagcagattccagagcttgc

SEQ ID NO: 384443 - DNA, 25 bp, Mus musculus
ctgctcagcatccttttgtttgttt

SEQ ID NO: 384444 - DNA, 25 bp, Mus musculus
ctgctcagcatcgttttgtttgttt

SEQ ID NO: 384445 - DNA, 25 bp, Mus musculus
ctgctcagccagacaaaggtacact

SEQ ID NO: 384446 - DNA, 25 bp, Mus musculus
ctgctcagccagtcaaaggtacact

SEQ ID NO: 384447 - DNA, 25 bp, Mus musculus
ctgctcaggacgaggccagtggtca

SEQ ID NO: 384448 - DNA, 25 bp, Mus musculus
ctgctcaggacgtggccagtggtca

SEQ ID NO: 384449 - DNA, 25 bp, Mus musculus
ctgctcaggcatctctcaaaactaa

SEQ ID NO: 384450 - DNA, 25 bp, Mus musculus
ctgctcaggcatgtctcaaaactaa

SEQ ID NO: 384451 - DNA, 25 bp, Mus musculus
ctgctcaggcccaagggtttcgaga

SEQ ID NO: 384452 - DNA, 25 bp, Mus musculus
ctgctcaggccctagggtttcgaga

SEQ ID NO: 384453 - DNA, 25 bp, Mus musculus
ctgctcagttccagtaggattgcct

SEQ ID NO: 384454 - DNA, 25 bp, Mus musculus
ctgctcagttcctgtaggattgcct

SEQ ID NO: 384455 - DNA, 25 bp, Mus musculus
ctgctcatggctagtgtggctgtga

SEQ ID NO: 384456 - DNA, 25 bp, Mus musculus
ctgctcatggctcccattgtgtatt

SEQ ID NO: 384457 - DNA, 25 bp, Mus musculus
ctgctcatggctgccattgtgtatt

SEQ ID NO: 384458 - DNA, 25 bp, Mus musculus
ctgctcatggcttgtgtggctgtga

SEQ ID NO: 384459 - DNA, 25 bp, Mus musculus
ctgctcatgtcaatgcttggcgtgg

SEQ ID NO: 384460 - DNA, 25 bp, Mus musculus
ctgctcatgtcattgcttggcgtgg

SEQ ID NO: 384461 - DNA, 25 bp, Mus musculus
ctgctcatttctccactgagaagga

SEQ ID NO: 384462 - DNA, 25 bp, Mus musculus
ctgctcatttctgcactgagaagga

SEQ ID NO: 384463 - DNA, 25 bp, Mus musculus
ctgctccaagagctggctgttttca

SEQ ID NO: 384464 - DNA, 25 bp, Mus musculus
ctgctccaagaggtggctgttttca

SEQ ID NO: 384465 - DNA, 25 bp, Mus musculus
ctgctccacaaaatccagtcttgaa

SEQ ID NO: 384466 - DNA, 25 bp, Mus musculus
ctgctccacaaattccagtcttgaa

SEQ ID NO: 384467 - DNA, 25 bp, Mus musculus
ctgctccacagaaatggtcaaggaa

SEQ ID NO: 384468 - DNA, 25 bp, Mus musculus
ctgctccacagacctgggatacagg

SEQ ID NO: 384469 - DNA, 25 bp, Mus musculus
ctgctccacagagctgggatacagg

SEQ ID NO: 384470 - DNA, 25 bp, Mus musculus
ctgctccacagatatggtcaaggaa

SEQ ID NO: 384471 - DNA, 25 bp, Mus musculus
ctgctccagacactgtgcacaaaga

SEQ ID NO: 384472 - DNA, 25 bp, Mus musculus
ctgctccagacagtgtgcacaaaga

SEQ ID NO: 384473 - DNA, 25 bp, Mus musculus
ctgctccagcagctcggacaaataa

SEQ ID NO: 384474 - DNA, 25 bp, Mus musculus
ctgctccagcaggtcggacaaataa

SEQ ID NO: 384475 - DNA, 25 bp, Mus musculus
ctgctccagcatacaaaggtttcaa

SEQ ID NO: 384476 - DNA, 25 bp, Mus musculus
ctgctccagcattcaaaggtttcaa

SEQ ID NO: 384477 - DNA, 25 bp, Mus musculus
ctgctccagctgaagaggaggaaga

SEQ ID NO: 384478 - DNA, 25 bp, Mus musculus
ctgctccagctgtagaggaggaaga

SEQ ID NO: 384479 - DNA, 25 bp, Mus musculus
ctgctccatactatatctctgtaac

SEQ ID NO: 384480 - DNA, 25 bp, Mus musculus
ctgctccatactttatctctgtaac

SEQ ID NO: 384481 - DNA, 25 bp, Mus musculus
ctgctccatagcaaggccaagtgta

SEQ ID NO: 384482 - DNA, 25 bp, Mus musculus
ctgctccatagctaggccaagtgta

SEQ ID NO: 384483 - DNA, 25 bp, Mus musculus
ctgctcccaatacccagtacaatgg

SEQ ID NO: 384484 - DNA, 25 bp, Mus musculus
ctgctcccaatagccagtacaatgg

SEQ ID NO: 384485 - DNA, 25 bp, Mus musculus
ctgctcccaatcatgctgttgataa

SEQ ID NO: 384486 - DNA, 25 bp, Mus musculus
ctgctcccaatcttgctgttgataa

SEQ ID NO: 384487 - DNA, 25 bp, Mus musculus
ctgctcccacagatttactttgtag

SEQ ID NO: 384488 - DNA, 25 bp, Mus musculus
ctgctcccacagttttactttgtag

SEQ ID NO: 384489 - DNA, 25 bp, Mus musculus
ctgctcccagccataagttgtgaga

SEQ ID NO: 384490 - DNA, 25 bp, Mus musculus
ctgctcccagccttaagttgtgaga

SEQ ID NO: 384491 - DNA, 25 bp, Mus musculus
ctgctccccaggaacaattttgtaa

SEQ ID NO: 384492 - DNA, 25 bp, Mus musculus
ctgctccccaggtacaattttgtaa

SEQ ID NO: 384493 - DNA, 25 bp, Mus musculus
ctgctcccctataagtcttgatgtg

SEQ ID NO: 384494 - DNA, 25 bp, Mus musculus
ctgctcccctattagtcttgatgtg

SEQ ID NO: 384495 - DNA, 25 bp, Mus musculus
ctgctccccttgctatgcaataaag

SEQ ID NO: 384496 - DNA, 25 bp, Mus musculus
ctgctccccttggtatgcaataaag

SEQ ID NO: 384497 - DNA, 25 bp, Mus musculus
ctgctcccgaagaaacgtgcattct

SEQ ID NO: 384498 - DNA, 25 bp, Mus musculus
ctgctcccgaagtaacgtgcattct

SEQ ID NO: 384499 - DNA, 25 bp, Mus musculus
ctgctcccgggcatttgtggaagat

SEQ ID NO: 384500 - DNA, 25 bp, Mus musculus
ctgctcccgggcttttgtggaagat

SEQ ID NO: 384501 - DNA, 25 bp, Mus musculus
ctgctccctactattgactcatata

SEQ ID NO: 384502 - DNA, 25 bp, Mus musculus
ctgctccctacttttgactcatata

SEQ ID NO: 384503 - DNA, 25 bp, Mus musculus
ctgctccgaatcactctggacaaag

SEQ ID NO: 384504 - DNA, 25 bp, Mus musculus
ctgctccgaatctctctggacaaag

SEQ ID NO: 384505 - DNA, 25 bp, Mus musculus
ctgctccgcaatctcagctgtaaat

SEQ ID NO: 384506 - DNA, 25 bp, Mus musculus
ctgctccgcaatgtcagctgtaaat

SEQ ID NO: 384507 - DNA, 25 bp, Mus musculus
ctgctccgtggtcctaatcaataat

SEQ ID NO: 384508 - DNA, 25 bp, Mus musculus
ctgctccgtggtgctaatcaataat

SEQ ID NO: 384509 - DNA, 25 bp, Mus musculus
ctgctcctcaaactctccaatatga

SEQ ID NO: 384510 - DNA, 25 bp, Mus musculus
ctgctcctcaaagtctccaatatga

SEQ ID NO: 384511 - DNA, 25 bp, Mus musculus
ctgctcctcccgattttaaatacac

SEQ ID NO: 384512 - DNA, 25 bp, Mus musculus
ctgctcctcccgtttttaaatacac

SEQ ID NO: 384513 - DNA, 25 bp, Mus musculus
ctgctcctgaagatagtcacaccgt

SEQ ID NO: 384514 - DNA, 25 bp, Mus musculus
ctgctcctgaagttagtcacaccgt

SEQ ID NO: 384515 - DNA, 25 bp, Mus musculus
ctgctcctgctactgatgacgaagg

SEQ ID NO: 384516 - DNA, 25 bp, Mus musculus
ctgctcctgctagtgatgacgaagg

SEQ ID NO: 384517 - DNA, 25 bp, Mus musculus
ctgctcctgtttccaagtgtcaaag

SEQ ID NO: 384518 - DNA, 25 bp, Mus musculus
ctgctcctgtttgcaagtgtcaaag

SEQ ID NO: 384519 - DNA, 25 bp, Mus musculus
ctgctccttagccatatgtgaaatc

SEQ ID NO: 384520 - DNA, 25 bp, Mus musculus
ctgctccttagcgatatgtgaaatc

SEQ ID NO: 384521 - DNA, 25 bp, Mus musculus
ctgctccttgaacattaccaaagag

SEQ ID NO: 384522 - DNA, 25 bp, Mus musculus
ctgctccttgaagattaccaaagag

SEQ ID NO: 384523 - DNA, 25 bp, Mus musculus
ctgctccttggacttttccagatta

SEQ ID NO: 384524 - DNA, 25 bp, Mus musculus
ctgctccttggagttttccagatta

SEQ ID NO: 384525 - DNA, 25 bp, Mus musculus
ctgctccttggcaatgtgatgaaac

SEQ ID NO: 384526 - DNA, 25 bp, Mus musculus
ctgctccttggctatgtgatgaaac

SEQ ID NO: 384527 - DNA, 25 bp, Mus musculus
ctgctccttgtacttgaagcgctta

SEQ ID NO: 384528 - DNA, 25 bp, Mus musculus
ctgctccttgtagttgaagcgctta

SEQ ID NO: 384529 - DNA, 25 bp, Mus musculus
ctgctcctttccaggacagatacta

SEQ ID NO: 384530 - DNA, 25 bp, Mus musculus
ctgctcctttcctggacagatacta

SEQ ID NO: 384531 - DNA, 25 bp, Mus musculus
ctgctcgaagctcgcattctgtata

SEQ ID NO: 384532 - DNA, 25 bp, Mus musculus
ctgctcgaagctggcattctgtata

SEQ ID NO: 384533 - DNA, 25 bp, Mus musculus
ctgctcgagtctccctttaaagata

SEQ ID NO: 384534 - DNA, 25 bp, Mus musculus
ctgctcgagtctgcctttaaagata

SEQ ID NO: 384535 - DNA, 25 bp, Mus musculus
ctgctcgcacgacggcctagacggt

SEQ ID NO: 384536 - DNA, 25 bp, Mus musculus
ctgctcgcacgagggcctagacggt

SEQ ID NO: 384537 - DNA, 25 bp, Mus musculus
ctgctcggaggaaagctggttctgt

SEQ ID NO: 384538 - DNA, 25 bp, Mus musculus
ctgctcggaggatagctggttctgt

SEQ ID NO: 384539 - DNA, 25 bp, Mus musculus
ctgctcgggcgcagctgctaaggct

SEQ ID NO: 384540 - DNA, 25 bp, Mus musculus
ctgctcgggcgctgctgctaaggct

SEQ ID NO: 384541 - DNA, 25 bp, Mus musculus
ctgctcgtcctacgttagagctcag

SEQ ID NO: 384542 - DNA, 25 bp, Mus musculus
ctgctcgtcctaggttagagctcag

SEQ ID NO: 384543 - DNA, 25 bp, Mus musculus
ctgctcgtctcacggatggttgacc

SEQ ID NO: 384544 - DNA, 25 bp, Mus musculus
ctgctcgtctcagggatggttgacc

SEQ ID NO: 384545 - DNA, 25 bp, Mus musculus
ctgctcgtgtttctgccagggataa

SEQ ID NO: 384546 - DNA, 25 bp, Mus musculus
ctgctcgtgtttgtgccagggataa

SEQ ID NO: 384547 - DNA, 25 bp, Mus musculus
ctgctctaattgaggctttcgtttt

SEQ ID NO: 384548 - DNA, 25 bp, Mus musculus
ctgctctaattgtggctttcgtttt

SEQ ID NO: 384549 - DNA, 25 bp, Mus musculus
ctgctctacacaccgctcggaaggt

SEQ ID NO: 384550 - DNA, 25 bp, Mus musculus
ctgctctacacagcgctcggaaggt

SEQ ID NO: 384551 - DNA, 25 bp, Mus musculus
ctgctctagccacaactcttctaaa

SEQ ID NO: 384552 - DNA, 25 bp, Mus musculus
ctgctctagccagaactcttctaaa

SEQ ID NO: 384553 - DNA, 25 bp, Mus musculus
ctgctctatcacatccaggtaaaga

SEQ ID NO: 384554 - DNA, 25 bp, Mus musculus
ctgctctatcacttccaggtaaaga

SEQ ID NO: 384555 - DNA, 25 bp, Mus musculus
ctgctctatcttaacgggctcagaa

SEQ ID NO: 384556 - DNA, 25 bp, Mus musculus
ctgctctatctttacgggctcagaa

SEQ ID NO: 384557 - DNA, 25 bp, Mus musculus
ctgctctattcacctcttgggagga

SEQ ID NO: 384558 - DNA, 25 bp, Mus musculus
ctgctctattcagctcttgggagga

SEQ ID NO: 384559 - DNA, 25 bp, Mus musculus
ctgctctcaaacctctctagaaaaa

SEQ ID NO: 384560 - DNA, 25 bp, Mus musculus
ctgctctcaaacgtctctagaaaaa

SEQ ID NO: 384561 - DNA, 25 bp, Mus musculus
ctgctctcaaggatgttcggctgaa

SEQ ID NO: 384562 - DNA, 25 bp, Mus musculus
ctgctctcaaggttgttcggctgaa

SEQ ID NO: 384563 - DNA, 25 bp, Mus musculus
ctgctctcactgcaaaatgcgggta

SEQ ID NO: 384564 - DNA, 25 bp, Mus musculus
ctgctctcactggaaaatgcgggta

SEQ ID NO: 384565 - DNA, 25 bp, Mus musculus
ctgctctcagagaagttgtgtggga

SEQ ID NO: 384566 - DNA, 25 bp, Mus musculus
ctgctctcagagtagttgtgtggga

SEQ ID NO: 384567 - DNA, 25 bp, Mus musculus
ctgctctcctagcttgacaattgga

SEQ ID NO: 384568 - DNA, 25 bp, Mus musculus
ctgctctcctaggttgacaattgga

SEQ ID NO: 384569 - DNA, 25 bp, Mus musculus
ctgctctcctatcccttttgggaag

SEQ ID NO: 384570 - DNA, 25 bp, Mus musculus
ctgctctcctatgccttttgggaag

SEQ ID NO: 384571 - DNA, 25 bp, Mus musculus
ctgctctctatgctatgctcatgaa

SEQ ID NO: 384572 - DNA, 25 bp, Mus musculus
ctgctctctatggtatgctcatgaa

SEQ ID NO: 384573 - DNA, 25 bp, Mus musculus
ctgctctctccacatactgtgtaag

SEQ ID NO: 384574 - DNA, 25 bp, Mus musculus
ctgctctctccagatactgtgtaag

SEQ ID NO: 384575 - DNA, 25 bp, Mus musculus
ctgctctctcctaaatggtctgaaa

SEQ ID NO: 384576 - DNA, 25 bp, Mus musculus
ctgctctctccttaatggtctgaaa

SEQ ID NO: 384577 - DNA, 25 bp, Mus musculus
ctgctctctgcaagtgcacaggctc

SEQ ID NO: 384578 - DNA, 25 bp, Mus musculus
ctgctctctgcatgtgcacaggctc

SEQ ID NO: 384579 - DNA, 25 bp, Mus musculus
ctgctctctgcgaccaaaaggttta

SEQ ID NO: 384580 - DNA, 25 bp, Mus musculus
ctgctctctgcgtccaaaaggttta

SEQ ID NO: 384581 - DNA, 25 bp, Mus musculus
ctgctctctgtgactatcagcttta

SEQ ID NO: 384582 - DNA, 25 bp, Mus musculus
ctgctctctgtgtctatcagcttta

SEQ ID NO: 384583 - DNA, 25 bp, Mus musculus
ctgctctcttcaacacaaggatacc

SEQ ID NO: 384584 - DNA, 25 bp, Mus musculus
ctgctctcttcatcacaaggatacc

SEQ ID NO: 384585 - DNA, 25 bp, Mus musculus
ctgctctcttttccctttctataaa

SEQ ID NO: 384586 - DNA, 25 bp, Mus musculus
ctgctctcttttgcctttctataaa

SEQ ID NO: 384587 - DNA, 25 bp, Mus musculus
ctgctctgaaatctttggtggcctg

SEQ ID NO: 384588 - DNA, 25 bp, Mus musculus
ctgctctgaaatgtttggtggcctg

SEQ ID NO: 384589 - DNA, 25 bp, Mus musculus
ctgctctgaagaaccattccggaat

SEQ ID NO: 384590 - DNA, 25 bp, Mus musculus
ctgctctgaagatccattccggaat

SEQ ID NO: 384591 - DNA, 25 bp, Mus musculus
ctgctctgaagtctgccagcctaag

SEQ ID NO: 384592 - DNA, 25 bp, Mus musculus
ctgctctgaagtgtgccagcctaag

SEQ ID NO: 384593 - DNA, 25 bp, Mus musculus
ctgctctgacttaaaacctctgtac

SEQ ID NO: 384594 - DNA, 25 bp, Mus musculus
ctgctctgactttaaacctctgtac

SEQ ID NO: 384595 - DNA, 25 bp, Mus musculus
ctgctctgatatcgtgctcttctga

SEQ ID NO: 384596 - DNA, 25 bp, Mus musculus
ctgctctgatatggtgctcttctga

SEQ ID NO: 384597 - DNA, 25 bp, Mus musculus
ctgctctgatgcctttctcatattt

SEQ ID NO: 384598 - DNA, 25 bp, Mus musculus
ctgctctgatgcgtttctcatattt

SEQ ID NO: 384599 - DNA, 25 bp, Mus musculus
ctgctctgcagtaagttttataggc

SEQ ID NO: 384600 - DNA, 25 bp, Mus musculus
ctgctctgcagttagttttataggc

SEQ ID NO: 384601 - DNA, 25 bp, Mus musculus
ctgctctgcatgagtagggctgtgt

SEQ ID NO: 384602 - DNA, 25 bp, Mus musculus
ctgctctgcatgtgtagggctgtgt

SEQ ID NO: 384603 - DNA, 25 bp, Mus musculus
ctgctctgccacaaatgagttccaa

SEQ ID NO: 384604 - DNA, 25 bp, Mus musculus
ctgctctgccactaatgagttccaa

SEQ ID NO: 384605 - DNA, 25 bp, Mus musculus
ctgctctgctctacaagtcagtcat

SEQ ID NO: 384606 - DNA, 25 bp, Mus musculus
ctgctctgctcttcaagtcagtcat

SEQ ID NO: 384607 - DNA, 25 bp, Mus musculus
ctgctctgctggagcggtctgctcc

SEQ ID NO: 384608 - DNA, 25 bp, Mus musculus
ctgctctgctggtgcggtctgctcc

SEQ ID NO: 384609 - DNA, 25 bp, Mus musculus
ctgctctggaccacgggagtcatgg

SEQ ID NO: 384610 - DNA, 25 bp, Mus musculus
ctgctctggacctcgggagtcatgg

SEQ ID NO: 384611 - DNA, 25 bp, Mus musculus
ctgctctggacgaggtggtgccacc

SEQ ID NO: 384612 - DNA, 25 bp, Mus musculus
ctgctctggacgtggtggtgccacc

SEQ ID NO: 384613 - DNA, 25 bp, Mus musculus
ctgctctggcttcattttcctgtga

SEQ ID NO: 384614 - DNA, 25 bp, Mus musculus
ctgctctggcttgattttcctgtga

SEQ ID NO: 384615 - DNA, 25 bp, Mus musculus
ctgctctggtgtattaatgtactgt

SEQ ID NO: 384616 - DNA, 25 bp, Mus musculus
ctgctctggtgttttaatgtactgt

SEQ ID NO: 384617 - DNA, 25 bp, Mus musculus
ctgctctggttactcttctgaagct

SEQ ID NO: 384618 - DNA, 25 bp, Mus musculus
ctgctctggttagtcttctgaagct

SEQ ID NO: 384619 - DNA, 25 bp, Mus musculus
ctgctctgtcacatgctttcttgaa

SEQ ID NO: 384620 - DNA, 25 bp, Mus musculus
ctgctctgtcacttgctttcttgaa

SEQ ID NO: 384621 - DNA, 25 bp, Mus musculus
ctgctctgtctcagtttatgtcttg

SEQ ID NO: 384622 - DNA, 25 bp, Mus musculus
ctgctctgtctctgtttatgtcttg

SEQ ID NO: 384623 - DNA, 25 bp, Mus musculus
ctgctctgtgatcccgtgtgaacat

SEQ ID NO: 384624 - DNA, 25 bp, Mus musculus
ctgctctgtgatgccgtgtgaacat

SEQ ID NO: 384625 - DNA, 25 bp, Mus musculus
ctgctctgtgtactcccagaggaat

SEQ ID NO: 384626 - DNA, 25 bp, Mus musculus
ctgctctgtgtagtcccagaggaat

SEQ ID NO: 384627 - DNA, 25 bp, Mus musculus
ctgctctgtgttatagggaagtgac

SEQ ID NO: 384628 - DNA, 25 bp, Mus musculus
ctgctctgtgttttagggaagtgac

SEQ ID NO: 384629 - DNA, 25 bp, Mus musculus
ctgctcttagcaccttctcaggaaa

SEQ ID NO: 384630 - DNA, 25 bp, Mus musculus
ctgctcttagcagcttctcaggaaa

SEQ ID NO: 384631 - DNA, 25 bp, Mus musculus
ctgctcttcaagatgtagcccaaag

SEQ ID NO: 384632 - DNA, 25 bp, Mus musculus
ctgctcttcaagttgtagcccaaag

SEQ ID NO: 384633 - DNA, 25 bp, Mus musculus
ctgctcttcaggatgctagctggat

SEQ ID NO: 384634 - DNA, 25 bp, Mus musculus
ctgctcttcaggttgctagctggat

SEQ ID NO: 384635 - DNA, 25 bp, Mus musculus
ctgctcttccgaaggtccagagttc

SEQ ID NO: 384636 - DNA, 25 bp, Mus musculus
ctgctcttccgatggtccagagttc

SEQ ID NO: 384637 - DNA, 25 bp, Mus musculus
ctgctcttcctcagggagtcccacc

SEQ ID NO: 384638 - DNA, 25 bp, Mus musculus
ctgctcttcctctgggagtcccacc

SEQ ID NO: 384639 - DNA, 25 bp, Mus musculus
ctgctcttcgccagtgcacagatta

SEQ ID NO: 384640 - DNA, 25 bp, Mus musculus
ctgctcttcgcctgtgcacagatta

SEQ ID NO: 384641 - DNA, 25 bp, Mus musculus
ctgctcttctgaatcttaaggacaa

SEQ ID NO: 384642 - DNA, 25 bp, Mus musculus
ctgctcttctgattcttaaggacaa

SEQ ID NO: 384643 - DNA, 25 bp, Mus musculus
ctgctcttgggtcttgcaggctgcc

SEQ ID NO: 384644 - DNA, 25 bp, Mus musculus
ctgctcttgggtgttgcaggctgcc

SEQ ID NO: 384645 - DNA, 25 bp, Mus musculus
ctgctcttggttctagctgtgtgaa

SEQ ID NO: 384646 - DNA, 25 bp, Mus musculus
ctgctcttggttgtagctgtgtgaa

SEQ ID NO: 384647 - DNA, 25 bp, Mus musculus
ctgctctttcacctcgtaggtttat

SEQ ID NO: 384648 - DNA, 25 bp, Mus musculus
ctgctctttcacgtcgtaggtttat

SEQ ID NO: 384649 - DNA, 25 bp, Mus musculus
ctgctctttcttacccacattaaaa

SEQ ID NO: 384650 - DNA, 25 bp, Mus musculus
ctgctctttctttcccacattaaaa

SEQ ID NO: 384651 - DNA, 25 bp, Mus musculus
ctgctctttggtctttcctaacggg

SEQ ID NO: 384652 - DNA, 25 bp, Mus musculus
ctgctctttggtgtttcctaacggg

SEQ ID NO: 384653 - DNA, 25 bp, Mus musculus
ctgctctttttccaaatccattcca

SEQ ID NO: 384654 - DNA, 25 bp, Mus musculus
ctgctctttttcgaaatccattcca

SEQ ID NO: 384655 - DNA, 25 bp, Mus musculus
ctgctgaaaaccaggcctgccatgg

SEQ ID NO: 384656 - DNA, 25 bp, Mus musculus
ctgctgaaaacctggcctgccatgg

SEQ ID NO: 384657 - DNA, 25 bp, Mus musculus
ctgctgaacaagagggtctgatgac

SEQ ID NO: 384658 - DNA, 25 bp, Mus musculus
ctgctgaacaagtgggtctgatgac

SEQ ID NO: 384659 - DNA, 25 bp, Mus musculus
ctgctgaacagaagggcacagtgaa

SEQ ID NO: 384660 - DNA, 25 bp, Mus musculus
ctgctgaacagatgggcacagtgaa

SEQ ID NO: 384661 - DNA, 25 bp, Mus musculus
ctgctgaacctgaagtccatggtgg

SEQ ID NO: 384662 - DNA, 25 bp, Mus musculus
ctgctgaacctgtagtccatggtgg

SEQ ID NO: 384663 - DNA, 25 bp, Mus musculus
ctgctgaactttcaactcctctcat

SEQ ID NO: 384664 - DNA, 25 bp, Mus musculus
ctgctgaactttgaactcctctcat

SEQ ID NO: 384665 - DNA, 25 bp, Mus musculus
ctgctgaagaatatactccctgggt

SEQ ID NO: 384666 - DNA, 25 bp, Mus musculus
ctgctgaagaatttactccctgggt

SEQ ID NO: 384667 - DNA, 25 bp, Mus musculus
ctgctgaagacaactgtatttacat

SEQ ID NO: 384668 - DNA, 25 bp, Mus musculus
ctgctgaagacatctgtatttacat

SEQ ID NO: 384669 - DNA, 25 bp, Mus musculus
ctgctgaagcccagcttcatatgga

SEQ ID NO: 384670 - DNA, 25 bp, Mus musculus
ctgctgaagccctgcttcatatgga

SEQ ID NO: 384671 - DNA, 25 bp, Mus musculus
ctgctgaagtgtaagtaggttttgc

SEQ ID NO: 384672 - DNA, 25 bp, Mus musculus
ctgctgaagtgttagtaggttttgc

SEQ ID NO: 384673 - DNA, 25 bp, Mus musculus
ctgctgaatcacagcttctctaaag

SEQ ID NO: 384674 - DNA, 25 bp, Mus musculus
ctgctgaatcactgcttctctaaag

SEQ ID NO: 384675 - DNA, 25 bp, Mus musculus
ctgctgaatgatagatgtatgcctt

SEQ ID NO: 384676 - DNA, 25 bp, Mus musculus
ctgctgaatgattgatgtatgcctt

SEQ ID NO: 384677 - DNA, 25 bp, Mus musculus
ctgctgacaatccttcctttaatgg

SEQ ID NO: 384678 - DNA, 25 bp, Mus musculus
ctgctgacaatcgttcctttaatgg

SEQ ID NO: 384679 - DNA, 25 bp, Mus musculus
ctgctgacagctctctcctgtgaaa

SEQ ID NO: 384680 - DNA, 25 bp, Mus musculus
ctgctgacagctgtctcctgtgaaa

SEQ ID NO: 384681 - DNA, 25 bp, Mus musculus
ctgctgaccactattcctgtcttca

SEQ ID NO: 384682 - DNA, 25 bp, Mus musculus
ctgctgaccacttttcctgtcttca

SEQ ID NO: 384683 - DNA, 25 bp, Mus musculus
ctgctgaccaggctcacatggtttg

SEQ ID NO: 384684 - DNA, 25 bp, Mus musculus
ctgctgaccagggtcacatggtttg

SEQ ID NO: 384685 - DNA, 25 bp, Mus musculus
ctgctgaccatgaacttgttgttgg

SEQ ID NO: 384686 - DNA, 25 bp, Mus musculus
ctgctgaccatgagacacttacgga

SEQ ID NO: 384687 - DNA, 25 bp, Mus musculus
ctgctgaccatgtacttgttgttgg

SEQ ID NO: 384688 - DNA, 25 bp, Mus musculus
ctgctgaccatgtgacacttacgga

SEQ ID NO: 384689 - DNA, 25 bp, Mus musculus
ctgctgaccctccatcaataaatga

SEQ ID NO: 384690 - DNA, 25 bp, Mus musculus
ctgctgaccctcgatcaataaatga

SEQ ID NO: 384691 - DNA, 25 bp, Mus musculus
ctgctgacctccagattcattggga

SEQ ID NO: 384692 - DNA, 25 bp, Mus musculus
ctgctgacctcctgattcattggga

SEQ ID NO: 384693 - DNA, 25 bp, Mus musculus
ctgctgacctggacaactttgccag

SEQ ID NO: 384694 - DNA, 25 bp, Mus musculus
ctgctgacctggtcaactttgccag

SEQ ID NO: 384695 - DNA, 25 bp, Mus musculus
ctgctgactcttatagaaacactga

SEQ ID NO: 384696 - DNA, 25 bp, Mus musculus
ctgctgactcttttagaaacactga

SEQ ID NO: 384697 - DNA, 25 bp, Mus musculus
ctgctgactggactgtcttcaagta

SEQ ID NO: 384698 - DNA, 25 bp, Mus musculus
ctgctgactggagtgtcttcaagta

SEQ ID NO: 384699 - DNA, 25 bp, Mus musculus
ctgctgacttccattccagtatgaa

SEQ ID NO: 384700 - DNA, 25 bp, Mus musculus
ctgctgacttcctttccagtatgaa

SEQ ID NO: 384701 - DNA, 25 bp, Mus musculus
ctgctgacttttcggtgggctacac

SEQ ID NO: 384702 - DNA, 25 bp, Mus musculus
ctgctgacttttgggtgggctacac

SEQ ID NO: 384703 - DNA, 25 bp, Mus musculus
ctgctgagaaggatccggactgcgt

SEQ ID NO: 384704 - DNA, 25 bp, Mus musculus
ctgctgagaaggttccggactgcgt

SEQ ID NO: 384705 - DNA, 25 bp, Mus musculus
ctgctgagagaacccttatggcagg

SEQ ID NO: 384706 - DNA, 25 bp, Mus musculus
ctgctgagagaagccttatggcagg

SEQ ID NO: 384707 - DNA, 25 bp, Mus musculus
ctgctgagagacatggagtataaga

SEQ ID NO: 384708 - DNA, 25 bp, Mus musculus
ctgctgagagacttggagtataaga

SEQ ID NO: 384709 - DNA, 25 bp, Mus musculus
ctgctgagagcccaaactggtactt

SEQ ID NO: 384710 - DNA, 25 bp, Mus musculus
ctgctgagagccgaaactggtactt

SEQ ID NO: 384711 - DNA, 25 bp, Mus musculus
ctgctgagcatcaggagtctggatc

SEQ ID NO: 384712 - DNA, 25 bp, Mus musculus
ctgctgagcatctggagtctggatc

SEQ ID NO: 384713 - DNA, 25 bp, Mus musculus
ctgctgagccacattcttttttagt

SEQ ID NO: 384714 - DNA, 25 bp, Mus musculus
ctgctgagccactttcttttttagt

SEQ ID NO: 384715 - DNA, 25 bp, Mus musculus
ctgctgagcccaagctggtagctga

SEQ ID NO: 384716 - DNA, 25 bp, Mus musculus
ctgctgagcccatgctggtagctga

SEQ ID NO: 384717 - DNA, 25 bp, Mus musculus
ctgctgagccggctaatcccaatag

SEQ ID NO: 384718 - DNA, 25 bp, Mus musculus
ctgctgagccgggtaatcccaatag

SEQ ID NO: 384719 - DNA, 25 bp, Mus musculus
ctgctgagccgtcgtcaatctcttt

SEQ ID NO: 384720 - DNA, 25 bp, Mus musculus
ctgctgagccgtggtcaatctcttt

SEQ ID NO: 384721 - DNA, 25 bp, Mus musculus
ctgctgagcctgcatctgcagggaa

SEQ ID NO: 384722 - DNA, 25 bp, Mus musculus
ctgctgagcctggatctgcagggaa

SEQ ID NO: 384723 - DNA, 25 bp, Mus musculus
ctgctgagctagctggacagagtct

SEQ ID NO: 384724 - DNA, 25 bp, Mus musculus
ctgctgagctaggtggacagagtct

SEQ ID NO: 384725 - DNA, 25 bp, Mus musculus
ctgctgagctctctattctggtgaa

SEQ ID NO: 384726 - DNA, 25 bp, Mus musculus
ctgctgagctctgtattctggtgaa

SEQ ID NO: 384727 - DNA, 25 bp, Mus musculus
ctgctgaggagtagtcaccccagga

SEQ ID NO: 384728 - DNA, 25 bp, Mus musculus
ctgctgaggagttgtcaccccagga

SEQ ID NO: 384729 - DNA, 25 bp, Mus musculus
ctgctgaggcagagtttataggaag

SEQ ID NO: 384730 - DNA, 25 bp, Mus musculus
ctgctgaggcagtgtttataggaag

SEQ ID NO: 384731 - DNA, 25 bp, Mus musculus
ctgctgagttctacatctatagagt

SEQ ID NO: 384732 - DNA, 25 bp, Mus musculus
ctgctgagttcttcatctatagagt

SEQ ID NO: 384733 - DNA, 25 bp, Mus musculus
ctgctgatcaagagtgtcaccagta

SEQ ID NO: 384734 - DNA, 25 bp, Mus musculus
ctgctgatcaagtgtgtcaccagta

SEQ ID NO: 384735 - DNA, 25 bp, Mus musculus
ctgctgatctggctgtcttgttgaa

SEQ ID NO: 384736 - DNA, 25 bp, Mus musculus
ctgctgatctgggtgtcttgttgaa

SEQ ID NO: 384737 - DNA, 25 bp, Mus musculus
ctgctgatcttgagtgtgaaatctg

SEQ ID NO: 384738 - DNA, 25 bp, Mus musculus
ctgctgatcttgtgtgtgaaatctg

SEQ ID NO: 384739 - DNA, 25 bp, Mus musculus
ctgctgatgcagagcttcttgttac

SEQ ID NO: 384740 - DNA, 25 bp, Mus musculus
ctgctgatgcagtgcttcttgttac

SEQ ID NO: 384741 - DNA, 25 bp, Mus musculus
ctgctgatgtacatctccatcttaa

SEQ ID NO: 384742 - DNA, 25 bp, Mus musculus
ctgctgatgtacttctccatcttaa

SEQ ID NO: 384743 - DNA, 25 bp, Mus musculus
ctgctgatgtctccacttgcattag

SEQ ID NO: 384744 - DNA, 25 bp, Mus musculus
ctgctgatgtctgcacttgcattag

SEQ ID NO: 384745 - DNA, 25 bp, Mus musculus
ctgctgcaagtcaccggaacagaat

SEQ ID NO: 384746 - DNA, 25 bp, Mus musculus
ctgctgcaagtctccggaacagaat

SEQ ID NO: 384747 - DNA, 25 bp, Mus musculus
ctgctgcaataccacatttgcggag

SEQ ID NO: 384748 - DNA, 25 bp, Mus musculus
ctgctgcaatacgacatttgcggag

SEQ ID NO: 384749 - DNA, 25 bp, Mus musculus
ctgctgcaatggcagtgtagaagcc

SEQ ID NO: 384750 - DNA, 25 bp, Mus musculus
ctgctgcaatgggagtgtagaagcc

SEQ ID NO: 384751 - DNA, 25 bp, Mus musculus
ctgctgcaattactgtgagtgttgt

SEQ ID NO: 384752 - DNA, 25 bp, Mus musculus
ctgctgcaattagtgtgagtgttgt

SEQ ID NO: 384753 - DNA, 25 bp, Mus musculus
ctgctgcaccttatgtgtgtggaaa

SEQ ID NO: 384754 - DNA, 25 bp, Mus musculus
ctgctgcaccttttgtgtgtggaaa

SEQ ID NO: 384755 - DNA, 25 bp, Mus musculus
ctgctgcactaaaggtatcatggat

SEQ ID NO: 384756 - DNA, 25 bp, Mus musculus
ctgctgcactaatggtatcatggat

SEQ ID NO: 384757 - DNA, 25 bp, Mus musculus
ctgctgcagcagaaacggttcctta

SEQ ID NO: 384758 - DNA, 25 bp, Mus musculus
ctgctgcagcagtaacggttcctta

SEQ ID NO: 384759 - DNA, 25 bp, Mus musculus
ctgctgcagcgcagttggtaggaaa

SEQ ID NO: 384760 - DNA, 25 bp, Mus musculus
ctgctgcagcgctgttggtaggaaa

SEQ ID NO: 384761 - DNA, 25 bp, Mus musculus
ctgctgcagcgtccacataaatatt

SEQ ID NO: 384762 - DNA, 25 bp, Mus musculus
ctgctgcagcgtgcacataaatatt

SEQ ID NO: 384763 - DNA, 25 bp, Mus musculus
ctgctgcaggcccagacacaggcaa

SEQ ID NO: 384764 - DNA, 25 bp, Mus musculus
ctgctgcaggccgagacacaggcaa

SEQ ID NO: 384765 - DNA, 25 bp, Mus musculus
ctgctgcatgagatctgggtatcca

SEQ ID NO: 384766 - DNA, 25 bp, Mus musculus
ctgctgcatgagttctgggtatcca

SEQ ID NO: 384767 - DNA, 25 bp, Mus musculus
ctgctgccaaaaagactttaatcct

SEQ ID NO: 384768 - DNA, 25 bp, Mus musculus
ctgctgccaaaatgactttaatcct

SEQ ID NO: 384769 - DNA, 25 bp, Mus musculus
ctgctgccaaccctgaatatatcaa

SEQ ID NO: 384770 - DNA, 25 bp, Mus musculus
ctgctgccaaccgtgaatatatcaa

SEQ ID NO: 384771 - DNA, 25 bp, Mus musculus
ctgctgccacagcaagaccgaatga

SEQ ID NO: 384772 - DNA, 25 bp, Mus musculus
ctgctgccacagctagaagctttac

SEQ ID NO: 384773 - DNA, 25 bp, Mus musculus
ctgctgccacaggaagaccgaatga

SEQ ID NO: 384774 - DNA, 25 bp, Mus musculus
ctgctgccacaggtagaagctttac

SEQ ID NO: 384775 - DNA, 25 bp, Mus musculus
ctgctgccagggacttgtacaattg

SEQ ID NO: 384776 - DNA, 25 bp, Mus musculus
ctgctgccagggtcttgtacaattg

SEQ ID NO: 384777 - DNA, 25 bp, Mus musculus
ctgctgccatttatgtcttctatga

SEQ ID NO: 384778 - DNA, 25 bp, Mus musculus
ctgctgccatttttgtcttctatga

SEQ ID NO: 384779 - DNA, 25 bp, Mus musculus
ctgctgcccagtcagtgcacatgag

SEQ ID NO: 384780 - DNA, 25 bp, Mus musculus
ctgctgcccagtgagtgcacatgag

SEQ ID NO: 384781 - DNA, 25 bp, Mus musculus
ctgctgcccatacgacttaggaaac

SEQ ID NO: 384782 - DNA, 25 bp, Mus musculus
ctgctgcccataggacttaggaaac

SEQ ID NO: 384783 - DNA, 25 bp, Mus musculus
ctgctgccctcacaacagggtgtca

SEQ ID NO: 384784 - DNA, 25 bp, Mus musculus
ctgctgccctcagaacagggtgtca

SEQ ID NO: 384785 - DNA, 25 bp, Mus musculus
ctgctgccctgtacatagaatgttt

SEQ ID NO: 384786 - DNA, 25 bp, Mus musculus
ctgctgccctgttcatagaatgttt

SEQ ID NO: 384787 - DNA, 25 bp, Mus musculus
ctgctgccctttaagttagctgtga

SEQ ID NO: 384788 - DNA, 25 bp, Mus musculus
ctgctgcccttttagttagctgtga

SEQ ID NO: 384789 - DNA, 25 bp, Mus musculus
ctgctgcctatgctgtacgagatga

SEQ ID NO: 384790 - DNA, 25 bp, Mus musculus
ctgctgcctatggtgtacgagatga

SEQ ID NO: 384791 - DNA, 25 bp, Mus musculus
ctgctgcctcccagtaaatattttt

SEQ ID NO: 384792 - DNA, 25 bp, Mus musculus
ctgctgcctccctgtaaatattttt

SEQ ID NO: 384793 - DNA, 25 bp, Mus musculus
ctgctgcctgcaaggattctgagtc

SEQ ID NO: 384794 - DNA, 25 bp, Mus musculus
ctgctgcctgcatggattctgagtc

SEQ ID NO: 384795 - DNA, 25 bp, Mus musculus
ctgctgccttaacgctgagatgtgg

SEQ ID NO: 384796 - DNA, 25 bp, Mus musculus
ctgctgccttaaggctgagatgtgg

SEQ ID NO: 384797 - DNA, 25 bp, Mus musculus
ctgctgccttcacacatcgataggt

SEQ ID NO: 384798 - DNA, 25 bp, Mus musculus
ctgctgccttcagacatcgataggt

SEQ ID NO: 384799 - DNA, 25 bp, Mus musculus
ctgctgccttcgaagtgtgcgaaca

SEQ ID NO: 384800 - DNA, 25 bp, Mus musculus
ctgctgccttcgtagtgtgcgaaca

SEQ ID NO: 384801 - DNA, 25 bp, Mus musculus
ctgctgcgaagactgtatttttggt

SEQ ID NO: 384802 - DNA, 25 bp, Mus musculus
ctgctgcgaagagtgtatttttggt

SEQ ID NO: 384803 - DNA, 25 bp, Mus musculus
ctgctgcgataccaagttcctgaag

SEQ ID NO: 384804 - DNA, 25 bp, Mus musculus
ctgctgcgatacgaagttcctgaag

SEQ ID NO: 384805 - DNA, 25 bp, Mus musculus
ctgctgcgctatcctgtgatcaaaa

SEQ ID NO: 384806 - DNA, 25 bp, Mus musculus
ctgctgcgctatgctgtgatcaaaa

SEQ ID NO: 384807 - DNA, 25 bp, Mus musculus
ctgctgcgtcaacgaatgaattaca

SEQ ID NO: 384808 - DNA, 25 bp, Mus musculus
ctgctgcgtcaaggaatgaattaca

SEQ ID NO: 384809 - DNA, 25 bp, Mus musculus
ctgctgctaagaccgatgacctgaa

SEQ ID NO: 384810 - DNA, 25 bp, Mus musculus
ctgctgctaagagcgatgacctgaa

SEQ ID NO: 384811 - DNA, 25 bp, Mus musculus
ctgctgctaaggacctagactactc

SEQ ID NO: 384812 - DNA, 25 bp, Mus musculus
ctgctgctaaggtcctagactactc

SEQ ID NO: 384813 - DNA, 25 bp, Mus musculus
ctgctgctactgaactctgacaaat

SEQ ID NO: 384814 - DNA, 25 bp, Mus musculus
ctgctgctactgtactctgacaaat

SEQ ID NO: 384815 - DNA, 25 bp, Mus musculus
ctgctgctacttcgtgactatgaga

SEQ ID NO: 384816 - DNA, 25 bp, Mus musculus
ctgctgctacttggtgactatgaga

SEQ ID NO: 384817 - DNA, 25 bp, Mus musculus
ctgctgctattgcacttcaccaggg

SEQ ID NO: 384818 - DNA, 25 bp, Mus musculus
ctgctgctattggacttcaccaggg

SEQ ID NO: 384819 - DNA, 25 bp, Mus musculus
ctgctgctcagaagtgcagtattaa

SEQ ID NO: 384820 - DNA, 25 bp, Mus musculus
ctgctgctcagatgtgcagtattaa

SEQ ID NO: 384821 - DNA, 25 bp, Mus musculus
ctgctgctcagcacaattgcttcag

SEQ ID NO: 384822 - DNA, 25 bp, Mus musculus
ctgctgctcagccatcagtggaaag

SEQ ID NO: 384823 - DNA, 25 bp, Mus musculus
ctgctgctcagcgatcagtggaaag

SEQ ID NO: 384824 - DNA, 25 bp, Mus musculus
ctgctgctcagctcaattgcttcag

SEQ ID NO: 384825 - DNA, 25 bp, Mus musculus
ctgctgctcatgaaggactttgtga

SEQ ID NO: 384826 - DNA, 25 bp, Mus musculus
ctgctgctcatgtaggactttgtga

SEQ ID NO: 384827 - DNA, 25 bp, Mus musculus
ctgctgctgattagattcctcaaga

SEQ ID NO: 384828 - DNA, 25 bp, Mus musculus
ctgctgctgatttgattcctcaaga

SEQ ID NO: 384829 - DNA, 25 bp, Mus musculus
ctgctgctggtgagtatttttgtaa

SEQ ID NO: 384830 - DNA, 25 bp, Mus musculus
ctgctgctggtgtgtatttttgtaa

SEQ ID NO: 384831 - DNA, 25 bp, Mus musculus
ctgctgctgtatattgtgacctgga

SEQ ID NO: 384832 - DNA, 25 bp, Mus musculus
ctgctgctgtattttgtgacctgga

SEQ ID NO: 384833 - DNA, 25 bp, Mus musculus
ctgctgctgtcgatttggtttttga

SEQ ID NO: 384834 - DNA, 25 bp, Mus musculus
ctgctgctgtcgttttggtttttga

SEQ ID NO: 384835 - DNA, 25 bp, Mus musculus
ctgctgctgtgcacaatgtgaacta

SEQ ID NO: 384836 - DNA, 25 bp, Mus musculus
ctgctgctgtgcaccgagctaagga

SEQ ID NO: 384837 - DNA, 25 bp, Mus musculus
ctgctgctgtgctcaatgtgaacta

SEQ ID NO: 384838 - DNA, 25 bp, Mus musculus
ctgctgctgtgctccgagctaagga

SEQ ID NO: 384839 - DNA, 25 bp, Mus musculus
ctgctgctgtggatgcgacaaccat

SEQ ID NO: 384840 - DNA, 25 bp, Mus musculus
ctgctgctgtggttgcgacaaccat

SEQ ID NO: 384841 - DNA, 25 bp, Mus musculus
ctgctgctgttcagggaaacttcta

SEQ ID NO: 384842 - DNA, 25 bp, Mus musculus
ctgctgctgttctgggaaacttcta

SEQ ID NO: 384843 - DNA, 25 bp, Mus musculus
ctgctgctgtttaattaacataggg

SEQ ID NO: 384844 - DNA, 25 bp, Mus musculus
ctgctgctgttttattaacataggg

SEQ ID NO: 384845 - DNA, 25 bp, Mus musculus
ctgctgcttaacacttttcttgata

SEQ ID NO: 384846 - DNA, 25 bp, Mus musculus
ctgctgcttaactcttttcttgata

SEQ ID NO: 384847 - DNA, 25 bp, Mus musculus
ctgctgcttcagaacctctttctag

SEQ ID NO: 384848 - DNA, 25 bp, Mus musculus
ctgctgcttcagtacctctttctag

SEQ ID NO: 384849 - DNA, 25 bp, Mus musculus
ctgctgcttctgagcctcacactgg

SEQ ID NO: 384850 - DNA, 25 bp, Mus musculus
ctgctgcttctgtgcctcacactgg

SEQ ID NO: 384851 - DNA, 25 bp, Mus musculus
ctgctgcttgcgcatgaagaggtca

SEQ ID NO: 384852 - DNA, 25 bp, Mus musculus
ctgctgcttgcggatgaagaggtca

SEQ ID NO: 384853 - DNA, 25 bp, Mus musculus
ctgctgctttccaagatgatctcaa

SEQ ID NO: 384854 - DNA, 25 bp, Mus musculus
ctgctgctttcctagatgatctcaa

SEQ ID NO: 384855 - DNA, 25 bp, Mus musculus
ctgctgctttgcaaggaaggctcct

SEQ ID NO: 384856 - DNA, 25 bp, Mus musculus
ctgctgctttgctaggaaggctcct

SEQ ID NO: 384857 - DNA, 25 bp, Mus musculus
ctgctggaacatcaggttttcagta

SEQ ID NO: 384858 - DNA, 25 bp, Mus musculus
ctgctggaacatgaggttttcagta

SEQ ID NO: 384859 - DNA, 25 bp, Mus musculus
ctgctggaaggacttaccttggtaa

SEQ ID NO: 384860 - DNA, 25 bp, Mus musculus
ctgctggaaggagttaccttggtaa

SEQ ID NO: 384861 - DNA, 25 bp, Mus musculus
ctgctggactggctggcttcagaac

SEQ ID NO: 384862 - DNA, 25 bp, Mus musculus
ctgctggactgggtggcttcagaac

SEQ ID NO: 384863 - DNA, 25 bp, Mus musculus
ctgctggagacactgttgttattga

SEQ ID NO: 384864 - DNA, 25 bp, Mus musculus
ctgctggagacagtgttgttattga

SEQ ID NO: 384865 - DNA, 25 bp, Mus musculus
ctgctggagaccatgggagccccaa

SEQ ID NO: 384866 - DNA, 25 bp, Mus musculus
ctgctggagaccttgggagccccaa

SEQ ID NO: 384867 - DNA, 25 bp, Mus musculus
ctgctggagaggctttagtagactt

SEQ ID NO: 384868 - DNA, 25 bp, Mus musculus
ctgctggagagggtttagtagactt

SEQ ID NO: 384869 - DNA, 25 bp, Mus musculus
ctgctggaggataccctgcacgtgg

SEQ ID NO: 384870 - DNA, 25 bp, Mus musculus
ctgctggaggattccctgcacgtgg

SEQ ID NO: 384871 - DNA, 25 bp, Mus musculus
ctgctggatcatattttgtgtagta

SEQ ID NO: 384872 - DNA, 25 bp, Mus musculus
ctgctggatcattttttgtgtagta

SEQ ID NO: 384873 - DNA, 25 bp, Mus musculus
ctgctggatgtacccgctatgtaaa

SEQ ID NO: 384874 - DNA, 25 bp, Mus musculus
ctgctggatgtagccgctatgtaaa

SEQ ID NO: 384875 - DNA, 25 bp, Mus musculus
ctgctggattttcaaggctttaaac

SEQ ID NO: 384876 - DNA, 25 bp, Mus musculus
ctgctggattttgaaggctttaaac

SEQ ID NO: 384877 - DNA, 25 bp, Mus musculus
ctgctggcaaccctcaacaaaacag

SEQ ID NO: 384878 - DNA, 25 bp, Mus musculus
ctgctggcaaccgtcaacaaaacag

SEQ ID NO: 384879 - DNA, 25 bp, Mus musculus
ctgctggcatgaatgagacacactt

SEQ ID NO: 384880 - DNA, 25 bp, Mus musculus
ctgctggcatgattgagacacactt

SEQ ID NO: 384881 - DNA, 25 bp, Mus musculus
ctgctggcattcagggctctgggat

SEQ ID NO: 384882 - DNA, 25 bp, Mus musculus
ctgctggcattctgggctctgggat

SEQ ID NO: 384883 - DNA, 25 bp, Mus musculus
ctgctggccaggaaatgaacaggtt

SEQ ID NO: 384884 - DNA, 25 bp, Mus musculus
ctgctggccaggtaatgaacaggtt

SEQ ID NO: 384885 - DNA, 25 bp, Mus musculus
ctgctggccctactggagactatag

SEQ ID NO: 384886 - DNA, 25 bp, Mus musculus
ctgctggccctagtggagactatag

SEQ ID NO: 384887 - DNA, 25 bp, Mus musculus
ctgctggcctagcagattcatctaa

SEQ ID NO: 384888 - DNA, 25 bp, Mus musculus
ctgctggcctaggagattcatctaa

SEQ ID NO: 384889 - DNA, 25 bp, Mus musculus
ctgctggcctttactagaatataag

SEQ ID NO: 384890 - DNA, 25 bp, Mus musculus
ctgctggccttttctagaatataag

SEQ ID NO: 384891 - DNA, 25 bp, Mus musculus
ctgctggcgatgaccatccaataat

SEQ ID NO: 384892 - DNA, 25 bp, Mus musculus
ctgctggcgatgtccatccaataat

SEQ ID NO: 384893 - DNA, 25 bp, Mus musculus
ctgctggctcctcttgtggtggttt

SEQ ID NO: 384894 - DNA, 25 bp, Mus musculus
ctgctggctcctgttgtggtggttt

SEQ ID NO: 384895 - DNA, 25 bp, Mus musculus
ctgctggctgcaccagtgatgcatt

SEQ ID NO: 384896 - DNA, 25 bp, Mus musculus
ctgctggctgcagcagtgatgcatt

SEQ ID NO: 384897 - DNA, 25 bp, Mus musculus
ctgctggctggacattctttctgta

SEQ ID NO: 384898 - DNA, 25 bp, Mus musculus
ctgctggctggagattctttctgta

SEQ ID NO: 384899 - DNA, 25 bp, Mus musculus
ctgctggctgtaaaggatatcctag

SEQ ID NO: 384900 - DNA, 25 bp, Mus musculus
ctgctggctgtataggatatcctag

SEQ ID NO: 384901 - DNA, 25 bp, Mus musculus
ctgctggcttagcttactcaacatg

SEQ ID NO: 384902 - DNA, 25 bp, Mus musculus
ctgctggcttaggttactcaacatg

SEQ ID NO: 384903 - DNA, 25 bp, Mus musculus
ctgctggcttctcccaaagagttat

SEQ ID NO: 384904 - DNA, 25 bp, Mus musculus
ctgctggcttctcgtaataaactct

SEQ ID NO: 384905 - DNA, 25 bp, Mus musculus
ctgctggcttctgccaaagagttat

SEQ ID NO: 384906 - DNA, 25 bp, Mus musculus
ctgctggcttctggtaataaactct

SEQ ID NO: 384907 - DNA, 25 bp, Mus musculus
ctgctggcttgcagtgcgcgtgccc

SEQ ID NO: 384908 - DNA, 25 bp, Mus musculus
ctgctggcttgctgtgcgcgtgccc

SEQ ID NO: 384909 - DNA, 25 bp, Mus musculus
ctgctgggacacacggacaggagct

SEQ ID NO: 384910 - DNA, 25 bp, Mus musculus
ctgctgggacactcggacaggagct

SEQ ID NO: 384911 - DNA, 25 bp, Mus musculus
ctgctgggacctatgctgagcggaa

SEQ ID NO: 384912 - DNA, 25 bp, Mus musculus
ctgctgggacctttgctgagcggaa

SEQ ID NO: 384913 - DNA, 25 bp, Mus musculus
ctgctgggacttaagctatggacca

SEQ ID NO: 384914 - DNA, 25 bp, Mus musculus
ctgctgggacttcagttctgagagt

SEQ ID NO: 384915 - DNA, 25 bp, Mus musculus
ctgctgggacttgagttctgagagt

SEQ ID NO: 384916 - DNA, 25 bp, Mus musculus
ctgctgggactttagctatggacca

SEQ ID NO: 384917 - DNA, 25 bp, Mus musculus
ctgctgggagagatcccctggcttg

SEQ ID NO: 384918 - DNA, 25 bp, Mus musculus
ctgctgggagagttcccctggcttg

SEQ ID NO: 384919 - DNA, 25 bp, Mus musculus
ctgctgggcaaactgacgatcgcgc

SEQ ID NO: 384920 - DNA, 25 bp, Mus musculus
ctgctgggcaaagtgacgatcgcgc

SEQ ID NO: 384921 - DNA, 25 bp, Mus musculus
ctgctgggccagacaagaaggtatc

SEQ ID NO: 384922 - DNA, 25 bp, Mus musculus
ctgctgggccagtcaagaaggtatc

SEQ ID NO: 384923 - DNA, 25 bp, Mus musculus
ctgctgggtctgaggtcgatcctgc

SEQ ID NO: 384924 - DNA, 25 bp, Mus musculus
ctgctgggtctgtggtcgatcctgc

SEQ ID NO: 384925 - DNA, 25 bp, Mus musculus
ctgctgggtgagagtcgccttaaca

SEQ ID NO: 384926 - DNA, 25 bp, Mus musculus
ctgctgggtgagtgtcgccttaaca

SEQ ID NO: 384927 - DNA, 25 bp, Mus musculus
ctgctgggtttcagccctagttttt

SEQ ID NO: 384928 - DNA, 25 bp, Mus musculus
ctgctgggtttctgccctagttttt

SEQ ID NO: 384929 - DNA, 25 bp, Mus musculus
ctgctgggtttgaaaggccttgtaa

SEQ ID NO: 384930 - DNA, 25 bp, Mus musculus
ctgctgggtttgtaaggccttgtaa

SEQ ID NO: 384931 - DNA, 25 bp, Mus musculus
ctgctggtaagcattcaccccattc

SEQ ID NO: 384932 - DNA, 25 bp, Mus musculus
ctgctggtaagctttcaccccattc

SEQ ID NO: 384933 - DNA, 25 bp, Mus musculus
ctgctggtacacattgggcatctca

SEQ ID NO: 384934 - DNA, 25 bp, Mus musculus
ctgctggtacactttgggcatctca

SEQ ID NO: 384935 - DNA, 25 bp, Mus musculus
ctgctggtatacagggacactccca

SEQ ID NO: 384936 - DNA, 25 bp, Mus musculus
ctgctggtatactgggacactccca

SEQ ID NO: 384937 - DNA, 25 bp, Mus musculus
ctgctggtccagctgtgtacacaga

SEQ ID NO: 384938 - DNA, 25 bp, Mus musculus
ctgctggtccaggtgtgtacacaga

SEQ ID NO: 384939 - DNA, 25 bp, Mus musculus
ctgctggtccttctcggatggtaaa

SEQ ID NO: 384940 - DNA, 25 bp, Mus musculus
ctgctggtccttgtcggatggtaaa

SEQ ID NO: 384941 - DNA, 25 bp, Mus musculus
ctgctggtcggacttgtcgtgtatt

SEQ ID NO: 384942 - DNA, 25 bp, Mus musculus
ctgctggtcggagttgtcgtgtatt

SEQ ID NO: 384943 - DNA, 25 bp, Mus musculus
ctgctggtgaaaactgagtctgtct

SEQ ID NO: 384944 - DNA, 25 bp, Mus musculus
ctgctggtgaaatctgagtctgtct

SEQ ID NO: 384945 - DNA, 25 bp, Mus musculus
ctgctggtgggcactccatggatgt

SEQ ID NO: 384946 - DNA, 25 bp, Mus musculus
ctgctggtgggctctccatggatgt

SEQ ID NO: 384947 - DNA, 25 bp, Mus musculus
ctgctggtgtatcactcttgatgac

SEQ ID NO: 384948 - DNA, 25 bp, Mus musculus
ctgctggtgtatgactcttgatgac

SEQ ID NO: 384949 - DNA, 25 bp, Mus musculus
ctgctggtgtctctggatgctcaca

SEQ ID NO: 384950 - DNA, 25 bp, Mus musculus
ctgctggtgtctgtggatgctcaca

SEQ ID NO: 384951 - DNA, 25 bp, Mus musculus
ctgctggttgagctccgctaggatc

SEQ ID NO: 384952 - DNA, 25 bp, Mus musculus
ctgctggttgaggtccgctaggatc

SEQ ID NO: 384953 - DNA, 25 bp, Mus musculus
ctgctggttgccatgatatttggta

SEQ ID NO: 384954 - DNA, 25 bp, Mus musculus
ctgctggttgccttgatatttggta

SEQ ID NO: 384955 - DNA, 25 bp, Mus musculus
ctgctggttgtcatccttgtcaaag

SEQ ID NO: 384956 - DNA, 25 bp, Mus musculus
ctgctggttgtcttccttgtcaaag

SEQ ID NO: 384957 - DNA, 25 bp, Mus musculus
ctgctgtaaaatatcctggctgagt

SEQ ID NO: 384958 - DNA, 25 bp, Mus musculus
ctgctgtaaaatttcctggctgagt

SEQ ID NO: 384959 - DNA, 25 bp, Mus musculus
ctgctgtacgacaccaggatttgga

SEQ ID NO: 384960 - DNA, 25 bp, Mus musculus
ctgctgtacgactccaggatttgga

SEQ ID NO: 384961 - DNA, 25 bp, Mus musculus
ctgctgtactccatggtggccataa

SEQ ID NO: 384962 - DNA, 25 bp, Mus musculus
ctgctgtactccttggtggccataa

SEQ ID NO: 384963 - DNA, 25 bp, Mus musculus
ctgctgtaggcaagagaccatattt

SEQ ID NO: 384964 - DNA, 25 bp, Mus musculus
ctgctgtaggcatgagaccatattt

SEQ ID NO: 384965 - DNA, 25 bp, Mus musculus
ctgctgtagggtctgggaagccgcc

SEQ ID NO: 384966 - DNA, 25 bp, Mus musculus
ctgctgtagggtgtgggaagccgcc

SEQ ID NO: 384967 - DNA, 25 bp, Mus musculus
ctgctgtatgccataagtcaacatt

SEQ ID NO: 384968 - DNA, 25 bp, Mus musculus
ctgctgtatgccttaagtcaacatt

SEQ ID NO: 384969 - DNA, 25 bp, Mus musculus
ctgctgtattccagatgctgcccac

SEQ ID NO: 384970 - DNA, 25 bp, Mus musculus
ctgctgtattcctgatgctgcccac

SEQ ID NO: 384971 - DNA, 25 bp, Mus musculus
ctgctgtcaaccctttctttggaaa

SEQ ID NO: 384972 - DNA, 25 bp, Mus musculus
ctgctgtcaaccgtttctttggaaa

SEQ ID NO: 384973 - DNA, 25 bp, Mus musculus
ctgctgtcacagctttctgttgaac

SEQ ID NO: 384974 - DNA, 25 bp, Mus musculus
ctgctgtcacaggtttctgttgaac

SEQ ID NO: 384975 - DNA, 25 bp, Mus musculus
ctgctgtcaccaaatctgtatgctg

SEQ ID NO: 384976 - DNA, 25 bp, Mus musculus
ctgctgtcaccatatctgtatgctg

SEQ ID NO: 384977 - DNA, 25 bp, Mus musculus
ctgctgtcacttcataaccggcgga

SEQ ID NO: 384978 - DNA, 25 bp, Mus musculus
ctgctgtcacttgataaccggcgga

SEQ ID NO: 384979 - DNA, 25 bp, Mus musculus
ctgctgtcatcaaccaaggccagac

SEQ ID NO: 384980 - DNA, 25 bp, Mus musculus
ctgctgtcatcatccaaggccagac

SEQ ID NO: 384981 - DNA, 25 bp, Mus musculus
ctgctgtccactacatcagatgtta

SEQ ID NO: 384982 - DNA, 25 bp, Mus musculus
ctgctgtccacttcatcagatgtta

SEQ ID NO: 384983 - DNA, 25 bp, Mus musculus
ctgctgtccccaaaggtctaaggtc

SEQ ID NO: 384984 - DNA, 25 bp, Mus musculus
ctgctgtccccataggtctaaggtc

SEQ ID NO: 384985 - DNA, 25 bp, Mus musculus
ctgctgtcccttctcaagtatgagt

SEQ ID NO: 384986 - DNA, 25 bp, Mus musculus
ctgctgtcccttgtcaagtatgagt

SEQ ID NO: 384987 - DNA, 25 bp, Mus musculus
ctgctgtccgctacccgggtgagtg

SEQ ID NO: 384988 - DNA, 25 bp, Mus musculus
ctgctgtccgcttcccgggtgagtg

SEQ ID NO: 384989 - DNA, 25 bp, Mus musculus
ctgctgtcgtctactggaggccatg

SEQ ID NO: 384990 - DNA, 25 bp, Mus musculus
ctgctgtcgtcttctggaggccatg

SEQ ID NO: 384991 - DNA, 25 bp, Mus musculus
ctgctgtcgttcattggatcatcaa

SEQ ID NO: 384992 - DNA, 25 bp, Mus musculus
ctgctgtcgttctttggatcatcaa

SEQ ID NO: 384993 - DNA, 25 bp, Mus musculus
ctgctgtctacaccctggctgggtg

SEQ ID NO: 384994 - DNA, 25 bp, Mus musculus
ctgctgtctacagcctggctgggtg

SEQ ID NO: 384995 - DNA, 25 bp, Mus musculus
ctgctgtctcctctagacacagaga

SEQ ID NO: 384996 - DNA, 25 bp, Mus musculus
ctgctgtctcctgtagacacagaga

SEQ ID NO: 384997 - DNA, 25 bp, Mus musculus
ctgctgtctcgacatgcacctagag

SEQ ID NO: 384998 - DNA, 25 bp, Mus musculus
ctgctgtctcgagatgcacctagag

SEQ ID NO: 384999 - DNA, 25 bp, Mus musculus
ctgctgtctcttaggtgttgttgcc

SEQ ID NO: 385000 - DNA, 25 bp, Mus musculus
ctgctgtctctttggtgttgttgcc

SEQ ID NO: 385001 - DNA, 25 bp, Mus musculus
ctgctgtctgaaaggtgctgcctcc

SEQ ID NO: 385002 - DNA, 25 bp, Mus musculus
ctgctgtctgaactgaatcgttgaa

SEQ ID NO: 385003 - DNA, 25 bp, Mus musculus
ctgctgtctgaagtgaatcgttgaa

SEQ ID NO: 385004 - DNA, 25 bp, Mus musculus
ctgctgtctgaatggtgctgcctcc

SEQ ID NO: 385005 - DNA, 25 bp, Mus musculus
ctgctgtcttccaaaggctaaattg

SEQ ID NO: 385006 - DNA, 25 bp, Mus musculus
ctgctgtcttcctaaggctaaattg

SEQ ID NO: 385007 - DNA, 25 bp, Mus musculus
ctgctgtgaggtcgtggcccttcca

SEQ ID NO: 385008 - DNA, 25 bp, Mus musculus
ctgctgtgaggtggtggcccttcca

SEQ ID NO: 385009 - DNA, 25 bp, Mus musculus
ctgctgtgatggactatgatgatgc

SEQ ID NO: 385010 - DNA, 25 bp, Mus musculus
ctgctgtgatggtctatgatgatgc

SEQ ID NO: 385011 - DNA, 25 bp, Mus musculus
ctgctgtgcagaagccctgggttag

SEQ ID NO: 385012 - DNA, 25 bp, Mus musculus
ctgctgtgcagatgccctgggttag

SEQ ID NO: 385013 - DNA, 25 bp, Mus musculus
ctgctgtgcaggctggtgggatccc

SEQ ID NO: 385014 - DNA, 25 bp, Mus musculus
ctgctgtgcagggtggtgggatccc

SEQ ID NO: 385015 - DNA, 25 bp, Mus musculus
ctgctgtgcataaacaacctgctca

SEQ ID NO: 385016 - DNA, 25 bp, Mus musculus
ctgctgtgcatatacaacctgctca

SEQ ID NO: 385017 - DNA, 25 bp, Mus musculus
ctgctgtgccataccgagtctgaag

SEQ ID NO: 385018 - DNA, 25 bp, Mus musculus
ctgctgtgccattccgagtctgaag

SEQ ID NO: 385019 - DNA, 25 bp, Mus musculus
ctgctgtgcctcaggaatgatgggt

SEQ ID NO: 385020 - DNA, 25 bp, Mus musculus
ctgctgtgcctctggaatgatgggt

SEQ ID NO: 385021 - DNA, 25 bp, Mus musculus
ctgctgtgcctgattatttcctggt

SEQ ID NO: 385022 - DNA, 25 bp, Mus musculus
ctgctgtgcctgtttatttcctggt

SEQ ID NO: 385023 - DNA, 25 bp, Mus musculus
ctgctgtgccttagggatttaagtt

SEQ ID NO: 385024 - DNA, 25 bp, Mus musculus
ctgctgtgcctttgggatttaagtt

SEQ ID NO: 385025 - DNA, 25 bp, Mus musculus
ctgctgtgctaactcctgtttggga

SEQ ID NO: 385026 - DNA, 25 bp, Mus musculus
ctgctgtgctaagtcctgtttggga

SEQ ID NO: 385027 - DNA, 25 bp, Mus musculus
ctgctgtgctgtactcattggcaaa

SEQ ID NO: 385028 - DNA, 25 bp, Mus musculus
ctgctgtgctgttctcattggcaaa

SEQ ID NO: 385029 - DNA, 25 bp, Mus musculus
ctgctgtggctcagttatccggttg

SEQ ID NO: 385030 - DNA, 25 bp, Mus musculus
ctgctgtggctctgttatccggttg

SEQ ID NO: 385031 - DNA, 25 bp, Mus musculus
ctgctgtggtcacgccgcttcaaga

SEQ ID NO: 385032 - DNA, 25 bp, Mus musculus
ctgctgtggtcaggccgcttcaaga

SEQ ID NO: 385033 - DNA, 25 bp, Mus musculus
ctgctgtgtatacatggaagatatt

SEQ ID NO: 385034 - DNA, 25 bp, Mus musculus
ctgctgtgtatagatggaagatatt

SEQ ID NO: 385035 - DNA, 25 bp, Mus musculus
ctgctgtgtatcagtccatgtgctt

SEQ ID NO: 385036 - DNA, 25 bp, Mus musculus
ctgctgtgtatctgtccatgtgctt

SEQ ID NO: 385037 - DNA, 25 bp, Mus musculus
ctgctgtgtgtcattgtcataaaaa

SEQ ID NO: 385038 - DNA, 25 bp, Mus musculus
ctgctgtgtgtctttgtcataaaaa

SEQ ID NO: 385039 - DNA, 25 bp, Mus musculus
ctgctgtgtgtgagttactctgtaa

SEQ ID NO: 385040 - DNA, 25 bp, Mus musculus
ctgctgtgtgtgtgttactctgtaa

SEQ ID NO: 385041 - DNA, 25 bp, Mus musculus
ctgctgtgttagagtaggtgccctg

SEQ ID NO: 385042 - DNA, 25 bp, Mus musculus
ctgctgtgttagtgtaggtgccctg

SEQ ID NO: 385043 - DNA, 25 bp, Mus musculus
ctgctgtgtttgcacttggtctgtt

SEQ ID NO: 385044 - DNA, 25 bp, Mus musculus
ctgctgtgtttggacttggtctgtt

SEQ ID NO: 385045 - DNA, 25 bp, Mus musculus
ctgctgttacaaacagtgctcgcct

SEQ ID NO: 385046 - DNA, 25 bp, Mus musculus
ctgctgttacaatcagtgctcgcct

SEQ ID NO: 385047 - DNA, 25 bp, Mus musculus
ctgctgttcatcaggctgcgggtct

SEQ ID NO: 385048 - DNA, 25 bp, Mus musculus
ctgctgttcatctggctgcgggtct

SEQ ID NO: 385049 - DNA, 25 bp, Mus musculus
ctgctgttcatgaccagtgtctgca

SEQ ID NO: 385050 - DNA, 25 bp, Mus musculus
ctgctgttcatgtccagtgtctgca

SEQ ID NO: 385051 - DNA, 25 bp, Mus musculus
ctgctgttccggctgcaggatatta

SEQ ID NO: 385052 - DNA, 25 bp, Mus musculus
ctgctgttccgggtgcaggatatta

SEQ ID NO: 385053 - DNA, 25 bp, Mus musculus
ctgctgttcctgctgatcatggtgg

SEQ ID NO: 385054 - DNA, 25 bp, Mus musculus
ctgctgttcctggtgatcatggtgg

SEQ ID NO: 385055 - DNA, 25 bp, Mus musculus
ctgctgttccttacttgagtgtgat

SEQ ID NO: 385056 - DNA, 25 bp, Mus musculus
ctgctgttcctttcttgagtgtgat

SEQ ID NO: 385057 - DNA, 25 bp, Mus musculus
ctgctgttctgacatttccggttaa

SEQ ID NO: 385058 - DNA, 25 bp, Mus musculus
ctgctgttctgagatttccggttaa

SEQ ID NO: 385059 - DNA, 25 bp, Mus musculus
ctgctgttgcataagctacttttat

SEQ ID NO: 385060 - DNA, 25 bp, Mus musculus
ctgctgttgcattagctacttttat

SEQ ID NO: 385061 - DNA, 25 bp, Mus musculus
ctgctgttgcctatatgaacatgta

SEQ ID NO: 385062 - DNA, 25 bp, Mus musculus
ctgctgttgcctttatgaacatgta

SEQ ID NO: 385063 - DNA, 25 bp, Mus musculus
ctgctgttgcttatgatttctggaa

SEQ ID NO: 385064 - DNA, 25 bp, Mus musculus
ctgctgttgcttttgatttctggaa

SEQ ID NO: 385065 - DNA, 25 bp, Mus musculus
ctgctgttggatccagcgctgactg

SEQ ID NO: 385066 - DNA, 25 bp, Mus musculus
ctgctgttggatgcagcgctgactg

SEQ ID NO: 385067 - DNA, 25 bp, Mus musculus
ctgctgttggcacttgcagctgtag

SEQ ID NO: 385068 - DNA, 25 bp, Mus musculus
ctgctgttggcagttgcagctgtag

SEQ ID NO: 385069 - DNA, 25 bp, Mus musculus
ctgctgttgtgaaactgtttgcaaa

SEQ ID NO: 385070 - DNA, 25 bp, Mus musculus
ctgctgttgtgatactgtttgcaaa

SEQ ID NO: 385071 - DNA, 25 bp, Mus musculus
ctgctgttgtgtctgccgtgagaaa

SEQ ID NO: 385072 - DNA, 25 bp, Mus musculus
ctgctgttgtgtgtgccgtgagaaa

SEQ ID NO: 385073 - DNA, 25 bp, Mus musculus
ctgctgttgttcagtgtgttcactt

SEQ ID NO: 385074 - DNA, 25 bp, Mus musculus
ctgctgttgttctgtgtgttcactt

SEQ ID NO: 385075 - DNA, 25 bp, Mus musculus
ctgctgtttacaatcaagacgacta

SEQ ID NO: 385076 - DNA, 25 bp, Mus musculus
ctgctgtttacattcaagacgacta

SEQ ID NO: 385077 - DNA, 25 bp, Mus musculus
ctgctgtttctgaccatgtttacat

SEQ ID NO: 385078 - DNA, 25 bp, Mus musculus
ctgctgtttctgagcaccgtgaata

SEQ ID NO: 385079 - DNA, 25 bp, Mus musculus
ctgctgtttctgtccatgtttacat

SEQ ID NO: 385080 - DNA, 25 bp, Mus musculus
ctgctgtttctgtgcaccgtgaata

SEQ ID NO: 385081 - DNA, 25 bp, Mus musculus
ctgctgtttgagacttgcctagcct

SEQ ID NO: 385082 - DNA, 25 bp, Mus musculus
ctgctgtttgagtcttgcctagcct

SEQ ID NO: 385083 - DNA, 25 bp, Mus musculus
ctgctgtttgctccccagctaaaaa

SEQ ID NO: 385084 - DNA, 25 bp, Mus musculus
ctgctgtttgctgcccagctaaaaa

SEQ ID NO: 385085 - DNA, 25 bp, Mus musculus
ctgctgttttccctttactatttgg

SEQ ID NO: 385086 - DNA, 25 bp, Mus musculus
ctgctgttttccgtttactatttgg

SEQ ID NO: 385087 - DNA, 25 bp, Mus musculus
ctgctgtttttaatgcttagcactt

SEQ ID NO: 385088 - DNA, 25 bp, Mus musculus
ctgctgtttttattgcttagcactt

SEQ ID NO: 385089 - DNA, 25 bp, Mus musculus
ctgcttaacacaagttctgatcatt

SEQ ID NO: 385090 - DNA, 25 bp, Mus musculus
ctgcttaacacatgttctgatcatt

SEQ ID NO: 385091 - DNA, 25 bp, Mus musculus
ctgcttaacatcagcgacatttctc

SEQ ID NO: 385092 - DNA, 25 bp, Mus musculus
ctgcttaacatctgcgacatttctc

SEQ ID NO: 385093 - DNA, 25 bp, Mus musculus
ctgcttaattatcacattccatctg

SEQ ID NO: 385094 - DNA, 25 bp, Mus musculus
ctgcttaattatgacattccatctg

SEQ ID NO: 385095 - DNA, 25 bp, Mus musculus
ctgcttacaacacccattgtcgtgg

SEQ ID NO: 385096 - DNA, 25 bp, Mus musculus
ctgcttacaacagccattgtcgtgg

SEQ ID NO: 385097 - DNA, 25 bp, Mus musculus
ctgcttacacccattctggtgaaat

SEQ ID NO: 385098 - DNA, 25 bp, Mus musculus
ctgcttacaccctttctggtgaaat

SEQ ID NO: 385099 - DNA, 25 bp, Mus musculus
ctgcttacagggacggcttcatgga

SEQ ID NO: 385100 - DNA, 25 bp, Mus musculus
ctgcttacagggtcggcttcatgga

SEQ ID NO: 385101 - DNA, 25 bp, Mus musculus
ctgcttaccctgacagcttaggtga

SEQ ID NO: 385102 - DNA, 25 bp, Mus musculus
ctgcttaccctgtcagcttaggtga

SEQ ID NO: 385103 - DNA, 25 bp, Mus musculus
ctgcttactataatgatccagcctt

SEQ ID NO: 385104 - DNA, 25 bp, Mus musculus
ctgcttactatattgatccagcctt

SEQ ID NO: 385105 - DNA, 25 bp, Mus musculus
ctgcttagactgaaggctgctgcct

SEQ ID NO: 385106 - DNA, 25 bp, Mus musculus
ctgcttagactgtaggctgctgcct

SEQ ID NO: 385107 - DNA, 25 bp, Mus musculus
ctgcttagagcactgtcctagaggg

SEQ ID NO: 385108 - DNA, 25 bp, Mus musculus
ctgcttagagcagtgtcctagaggg

SEQ ID NO: 385109 - DNA, 25 bp, Mus musculus
ctgcttagatctcttggtggctcca

SEQ ID NO: 385110 - DNA, 25 bp, Mus musculus
ctgcttagatctgttggtggctcca

SEQ ID NO: 385111 - DNA, 25 bp, Mus musculus
ctgcttagattcatttagagttgtt

SEQ ID NO: 385112 - DNA, 25 bp, Mus musculus
ctgcttagattcttttagagttgtt

SEQ ID NO: 385113 - DNA, 25 bp, Mus musculus
ctgcttagccctagctctggagcta

SEQ ID NO: 385114 - DNA, 25 bp, Mus musculus
ctgcttagcccttgctctggagcta

SEQ ID NO: 385115 - DNA, 25 bp, Mus musculus
ctgcttagcctaactggtgaactct

SEQ ID NO: 385116 - DNA, 25 bp, Mus musculus
ctgcttagcctactggattgttcca

SEQ ID NO: 385117 - DNA, 25 bp, Mus musculus
ctgcttagcctagtggattgttcca

SEQ ID NO: 385118 - DNA, 25 bp, Mus musculus
ctgcttagcctatctggtgaactct

SEQ ID NO: 385119 - DNA, 25 bp, Mus musculus
ctgcttagccttaataacttcaaag

SEQ ID NO: 385120 - DNA, 25 bp, Mus musculus
ctgcttagcctttataacttcaaag

SEQ ID NO: 385121 - DNA, 25 bp, Mus musculus
ctgcttagctttatgccaaacttaa

SEQ ID NO: 385122 - DNA, 25 bp, Mus musculus
ctgcttagctttttgccaaacttaa

SEQ ID NO: 385123 - DNA, 25 bp, Mus musculus
ctgcttaggcttctggtaccagtta

SEQ ID NO: 385124 - DNA, 25 bp, Mus musculus
ctgcttaggcttgtggtaccagtta

SEQ ID NO: 385125 - DNA, 25 bp, Mus musculus
ctgcttagggatctgcttcagggcc

SEQ ID NO: 385126 - DNA, 25 bp, Mus musculus
ctgcttagggatgtgcttcagggcc

SEQ ID NO: 385127 - DNA, 25 bp, Mus musculus
ctgcttagtaaaattccccttggct

SEQ ID NO: 385128 - DNA, 25 bp, Mus musculus
ctgcttagtaaatttccccttggct

SEQ ID NO: 385129 - DNA, 25 bp, Mus musculus
ctgcttatatgaatacttgtgacta

SEQ ID NO: 385130 - DNA, 25 bp, Mus musculus
ctgcttatatgattacttgtgacta

SEQ ID NO: 385131 - DNA, 25 bp, Mus musculus
ctgcttatatgtacccatatctgat

SEQ ID NO: 385132 - DNA, 25 bp, Mus musculus
ctgcttatatgttcccatatctgat

SEQ ID NO: 385133 - DNA, 25 bp, Mus musculus
ctgcttatccacatctgacattgat

SEQ ID NO: 385134 - DNA, 25 bp, Mus musculus
ctgcttatccacttctgacattgat

SEQ ID NO: 385135 - DNA, 25 bp, Mus musculus
ctgcttatccctagtatttgcttaa

SEQ ID NO: 385136 - DNA, 25 bp, Mus musculus
ctgcttatcccttgtatttgcttaa

SEQ ID NO: 385137 - DNA, 25 bp, Mus musculus
ctgcttcaacctcctagttggtagg

SEQ ID NO: 385138 - DNA, 25 bp, Mus musculus
ctgcttcaacctgctagttggtagg

SEQ ID NO: 385139 - DNA, 25 bp, Mus musculus
ctgcttcaagaccatccttggatac

SEQ ID NO: 385140 - DNA, 25 bp, Mus musculus
ctgcttcaagacgatccttggatac

SEQ ID NO: 385141 - DNA, 25 bp, Mus musculus
ctgcttcaataaaccactgtgaact

SEQ ID NO: 385142 - DNA, 25 bp, Mus musculus
ctgcttcaataatccactgtgaact

SEQ ID NO: 385143 - DNA, 25 bp, Mus musculus
ctgcttcagataactaccttgactt

SEQ ID NO: 385144 - DNA, 25 bp, Mus musculus
ctgcttcagatatctaccttgactt

SEQ ID NO: 385145 - DNA, 25 bp, Mus musculus
ctgcttcagctgcaacctactgtga

SEQ ID NO: 385146 - DNA, 25 bp, Mus musculus
ctgcttcagctggaacctactgtga

SEQ ID NO: 385147 - DNA, 25 bp, Mus musculus
ctgcttcatatgctaatctgagaat

SEQ ID NO: 385148 - DNA, 25 bp, Mus musculus
ctgcttcatatggtaatctgagaat

SEQ ID NO: 385149 - DNA, 25 bp, Mus musculus
ctgcttcatcatcctcattgctggg

SEQ ID NO: 385150 - DNA, 25 bp, Mus musculus
ctgcttcatcatgctcattgctggg

SEQ ID NO: 385151 - DNA, 25 bp, Mus musculus
ctgcttcatcttctttgtgtccata

SEQ ID NO: 385152 - DNA, 25 bp, Mus musculus
ctgcttcatcttgtttgtgtccata

SEQ ID NO: 385153 - DNA, 25 bp, Mus musculus
ctgcttccaagactggtgcttttta

SEQ ID NO: 385154 - DNA, 25 bp, Mus musculus
ctgcttccaagagtggtgcttttta

SEQ ID NO: 385155 - DNA, 25 bp, Mus musculus
ctgcttccaatcagcaacctaatag

SEQ ID NO: 385156 - DNA, 25 bp, Mus musculus
ctgcttccaatctgcaacctaatag

SEQ ID NO: 385157 - DNA, 25 bp, Mus musculus
ctgcttccaggaagctattcaagaa

SEQ ID NO: 385158 - DNA, 25 bp, Mus musculus
ctgcttccaggatgctattcaagaa

SEQ ID NO: 385159 - DNA, 25 bp, Mus musculus
ctgcttccatcacatcaactcggag

SEQ ID NO: 385160 - DNA, 25 bp, Mus musculus
ctgcttccatcagatcaactcggag

SEQ ID NO: 385161 - DNA, 25 bp, Mus musculus
ctgcttccattgaggctcattgtgt

SEQ ID NO: 385162 - DNA, 25 bp, Mus musculus
ctgcttccattgtggctcattgtgt

SEQ ID NO: 385163 - DNA, 25 bp, Mus musculus
ctgcttcccacgagtctcatatctg

SEQ ID NO: 385164 - DNA, 25 bp, Mus musculus
ctgcttcccacgtgtctcatatctg

SEQ ID NO: 385165 - DNA, 25 bp, Mus musculus
ctgcttcccagacgaacatctggat

SEQ ID NO: 385166 - DNA, 25 bp, Mus musculus
ctgcttcccagaggaacatctggat

SEQ ID NO: 385167 - DNA, 25 bp, Mus musculus
ctgcttcccagcatacagaattttc

SEQ ID NO: 385168 - DNA, 25 bp, Mus musculus
ctgcttcccagcttacagaattttc

SEQ ID NO: 385169 - DNA, 25 bp, Mus musculus
ctgcttcccaggctgaagtgattca

SEQ ID NO: 385170 - DNA, 25 bp, Mus musculus
ctgcttcccagggtgaagtgattca

SEQ ID NO: 385171 - DNA, 25 bp, Mus musculus
ctgcttccctgtaggtgcaacaaca

SEQ ID NO: 385172 - DNA, 25 bp, Mus musculus
ctgcttccctgttggtgcaacaaca

SEQ ID NO: 385173 - DNA, 25 bp, Mus musculus
ctgcttccgaaacactcaactgtta

SEQ ID NO: 385174 - DNA, 25 bp, Mus musculus
ctgcttccgaaagactcaactgtta

SEQ ID NO: 385175 - DNA, 25 bp, Mus musculus
ctgcttccggctcctgaatactgaa

SEQ ID NO: 385176 - DNA, 25 bp, Mus musculus
ctgcttccggctgctgaatactgaa

SEQ ID NO: 385177 - DNA, 25 bp, Mus musculus
ctgcttccgttgagactgacctgaa

SEQ ID NO: 385178 - DNA, 25 bp, Mus musculus
ctgcttccgttgtgactgacctgaa

SEQ ID NO: 385179 - DNA, 25 bp, Mus musculus
ctgcttcctacaatgtaaaaactgc

SEQ ID NO: 385180 - DNA, 25 bp, Mus musculus
ctgcttcctacattgtaaaaactgc

SEQ ID NO: 385181 - DNA, 25 bp, Mus musculus
ctgcttcctagaaatctccatgtgt

SEQ ID NO: 385182 - DNA, 25 bp, Mus musculus
ctgcttcctagatatctccatgtgt

SEQ ID NO: 385183 - DNA, 25 bp, Mus musculus
ctgcttcctaggaggtcagtgacaa

SEQ ID NO: 385184 - DNA, 25 bp, Mus musculus
ctgcttcctaggtggtcagtgacaa

SEQ ID NO: 385185 - DNA, 25 bp, Mus musculus
ctgcttcctcttcctataggtcaca

SEQ ID NO: 385186 - DNA, 25 bp, Mus musculus
ctgcttcctcttgctataggtcaca

SEQ ID NO: 385187 - DNA, 25 bp, Mus musculus
ctgcttcctgctccttcaaagaatg

SEQ ID NO: 385188 - DNA, 25 bp, Mus musculus
ctgcttcctgctgcttcaaagaatg

SEQ ID NO: 385189 - DNA, 25 bp, Mus musculus
ctgcttcctgtcagtctgcatttgt

SEQ ID NO: 385190 - DNA, 25 bp, Mus musculus
ctgcttcctgtctgtctgcatttgt

SEQ ID NO: 385191 - DNA, 25 bp, Mus musculus
ctgcttcctgtgcacagaatttcat

SEQ ID NO: 385192 - DNA, 25 bp, Mus musculus
ctgcttcctgtggacagaatttcat

SEQ ID NO: 385193 - DNA, 25 bp, Mus musculus
ctgcttccttggatggactcaatga

SEQ ID NO: 385194 - DNA, 25 bp, Mus musculus
ctgcttccttggttggactcaatga

SEQ ID NO: 385195 - DNA, 25 bp, Mus musculus
ctgcttcctttgctgtgtatgttta

SEQ ID NO: 385196 - DNA, 25 bp, Mus musculus
ctgcttcctttggtgtgtatgttta

SEQ ID NO: 385197 - DNA, 25 bp, Mus musculus
ctgcttcgactgctaggcttctagg

SEQ ID NO: 385198 - DNA, 25 bp, Mus musculus
ctgcttcgactggtaggcttctagg

SEQ ID NO: 385199 - DNA, 25 bp, Mus musculus
ctgcttcggcaaaagcattctctca

SEQ ID NO: 385200 - DNA, 25 bp, Mus musculus
ctgcttcggcaatagcattctctca

SEQ ID NO: 385201 - DNA, 25 bp, Mus musculus
ctgcttcgtcctcggaggattgaca

SEQ ID NO: 385202 - DNA, 25 bp, Mus musculus
ctgcttcgtcctgggaggattgaca

SEQ ID NO: 385203 - DNA, 25 bp, Mus musculus
ctgcttctaggtactgctgtttgaa

SEQ ID NO: 385204 - DNA, 25 bp, Mus musculus
ctgcttctaggttctgctgtttgaa

SEQ ID NO: 385205 - DNA, 25 bp, Mus musculus
ctgcttctcaagagcagcctctgag

SEQ ID NO: 385206 - DNA, 25 bp, Mus musculus
ctgcttctcaagtgcagcctctgag

SEQ ID NO: 385207 - DNA, 25 bp, Mus musculus
ctgcttctccagagtccttggcttt

SEQ ID NO: 385208 - DNA, 25 bp, Mus musculus
ctgcttctccagtgtccttggcttt

SEQ ID NO: 385209 - DNA, 25 bp, Mus musculus
ctgcttctccctactgaatgttgag

SEQ ID NO: 385210 - DNA, 25 bp, Mus musculus
ctgcttctcccttctgaatgttgag

SEQ ID NO: 385211 - DNA, 25 bp, Mus musculus
ctgcttctcctgaaatgtaaaaagt

SEQ ID NO: 385212 - DNA, 25 bp, Mus musculus
ctgcttctcctgtaatgtaaaaagt

SEQ ID NO: 385213 - DNA, 25 bp, Mus musculus
ctgcttctgaggaccatgatttctc

SEQ ID NO: 385214 - DNA, 25 bp, Mus musculus
ctgcttctgaggtccatgatttctc

SEQ ID NO: 385215 - DNA, 25 bp, Mus musculus
ctgcttctgcctcttaagtaacgga

SEQ ID NO: 385216 - DNA, 25 bp, Mus musculus
ctgcttctgcctgttaagtaacgga

SEQ ID NO: 385217 - DNA, 25 bp, Mus musculus
ctgcttctgctgagttttcatgttc

SEQ ID NO: 385218 - DNA, 25 bp, Mus musculus
ctgcttctgctgtgttttcatgttc

SEQ ID NO: 385219 - DNA, 25 bp, Mus musculus
ctgcttctggagagctgattttata

SEQ ID NO: 385220 - DNA, 25 bp, Mus musculus
ctgcttctggagtgctgattttata

SEQ ID NO: 385221 - DNA, 25 bp, Mus musculus
ctgcttctgggtctgaaaacacaca

SEQ ID NO: 385222 - DNA, 25 bp, Mus musculus
ctgcttctgggtgtgaaaacacaca

SEQ ID NO: 385223 - DNA, 25 bp, Mus musculus
ctgcttctgtcacctctgaggagta

SEQ ID NO: 385224 - DNA, 25 bp, Mus musculus
ctgcttctgtcagctctgaggagta

SEQ ID NO: 385225 - DNA, 25 bp, Mus musculus
ctgcttctgtgcacaaggtttactt

SEQ ID NO: 385226 - DNA, 25 bp, Mus musculus
ctgcttctgtgctcaaggtttactt

SEQ ID NO: 385227 - DNA, 25 bp, Mus musculus
ctgcttctgtgtaaatgctatttta

SEQ ID NO: 385228 - DNA, 25 bp, Mus musculus
ctgcttctgtgttaatgctatttta

SEQ ID NO: 385229 - DNA, 25 bp, Mus musculus
ctgcttctgtttactgagtgcataa

SEQ ID NO: 385230 - DNA, 25 bp, Mus musculus
ctgcttctgttttctgagtgcataa

SEQ ID NO: 385231 - DNA, 25 bp, Mus musculus
ctgcttcttaatactcaacactttc

SEQ ID NO: 385232 - DNA, 25 bp, Mus musculus
ctgcttcttaattctcaacactttc

SEQ ID NO: 385233 - DNA, 25 bp, Mus musculus
ctgcttcttgccctgaggtttggaa

SEQ ID NO: 385234 - DNA, 25 bp, Mus musculus
ctgcttcttgccgtgaggtttggaa

SEQ ID NO: 385235 - DNA, 25 bp, Mus musculus
ctgcttcttgggatattagatttat

SEQ ID NO: 385236 - DNA, 25 bp, Mus musculus
ctgcttcttgggttattagatttat

SEQ ID NO: 385237 - DNA, 25 bp, Mus musculus
ctgcttctttgacattactaggtat

SEQ ID NO: 385238 - DNA, 25 bp, Mus musculus
ctgcttctttgagattactaggtat

SEQ ID NO: 385239 - DNA, 25 bp, Mus musculus
ctgcttgaacacagtattctcccag

SEQ ID NO: 385240 - DNA, 25 bp, Mus musculus
ctgcttgaacactgtattctcccag

SEQ ID NO: 385241 - DNA, 25 bp, Mus musculus
ctgcttgagggaatcaagaagtcct

SEQ ID NO: 385242 - DNA, 25 bp, Mus musculus
ctgcttgagggattcaagaagtcct

SEQ ID NO: 385243 - DNA, 25 bp, Mus musculus
ctgcttgagggcatcctcggaaagg

SEQ ID NO: 385244 - DNA, 25 bp, Mus musculus
ctgcttgagggcttcctcggaaagg

SEQ ID NO: 385245 - DNA, 25 bp, Mus musculus
ctgcttgagtgtatctctgtgtggg

SEQ ID NO: 385246 - DNA, 25 bp, Mus musculus
ctgcttgagtgtttctctgtgtggg

SEQ ID NO: 385247 - DNA, 25 bp, Mus musculus
ctgcttgatcccatgctgaatgcaa

SEQ ID NO: 385248 - DNA, 25 bp, Mus musculus
ctgcttgatcccttgctgaatgcaa

SEQ ID NO: 385249 - DNA, 25 bp, Mus musculus
ctgcttgattctataagcatccaac

SEQ ID NO: 385250 - DNA, 25 bp, Mus musculus
ctgcttgattctttaagcatccaac

SEQ ID NO: 385251 - DNA, 25 bp, Mus musculus
ctgcttgcaagaaatggcctctcac

SEQ ID NO: 385252 - DNA, 25 bp, Mus musculus
ctgcttgcaagatatggcctctcac

SEQ ID NO: 385253 - DNA, 25 bp, Mus musculus
ctgcttgccactcatgtgtcttggt

SEQ ID NO: 385254 - DNA, 25 bp, Mus musculus
ctgcttgccactgatgtgtcttggt

SEQ ID NO: 385255 - DNA, 25 bp, Mus musculus
ctgcttgcccagcattgtgggttct

SEQ ID NO: 385256 - DNA, 25 bp, Mus musculus
ctgcttgcccaggattgtgggttct

SEQ ID NO: 385257 - DNA, 25 bp, Mus musculus
ctgcttgccctcagggagcccaaac

SEQ ID NO: 385258 - DNA, 25 bp, Mus musculus
ctgcttgccctctgggagcccaaac

SEQ ID NO: 385259 - DNA, 25 bp, Mus musculus
ctgcttgcgaatcccttccataaga

SEQ ID NO: 385260 - DNA, 25 bp, Mus musculus
ctgcttgcgaatgccttccataaga

SEQ ID NO: 385261 - DNA, 25 bp, Mus musculus
ctgcttgcggacaattataattttc

SEQ ID NO: 385262 - DNA, 25 bp, Mus musculus
ctgcttgcggactattataattttc

SEQ ID NO: 385263 - DNA, 25 bp, Mus musculus
ctgcttgctgcaatttgacttgtga

SEQ ID NO: 385264 - DNA, 25 bp, Mus musculus
ctgcttgctgcattttgacttgtga

SEQ ID NO: 385265 - DNA, 25 bp, Mus musculus
ctgcttgctttgctggactctggaa

SEQ ID NO: 385266 - DNA, 25 bp, Mus musculus
ctgcttgctttggtggactctggaa

SEQ ID NO: 385267 - DNA, 25 bp, Mus musculus
ctgcttggacacctgagcatcagat

SEQ ID NO: 385268 - DNA, 25 bp, Mus musculus
ctgcttggacacgtgagcatcagat

SEQ ID NO: 385269 - DNA, 25 bp, Mus musculus
ctgcttggacgtccctgccaggaca

SEQ ID NO: 385270 - DNA, 25 bp, Mus musculus
ctgcttggacgtgcctgccaggaca

SEQ ID NO: 385271 - DNA, 25 bp, Mus musculus
ctgcttggaggtctaagctctctga

SEQ ID NO: 385272 - DNA, 25 bp, Mus musculus
ctgcttggaggtgtaagctctctga

SEQ ID NO: 385273 - DNA, 25 bp, Mus musculus
ctgcttggatgtcaccgtgtaactc

SEQ ID NO: 385274 - DNA, 25 bp, Mus musculus
ctgcttggatgtgaccgtgtaactc

SEQ ID NO: 385275 - DNA, 25 bp, Mus musculus
ctgcttggcaggaattcattgttat

SEQ ID NO: 385276 - DNA, 25 bp, Mus musculus
ctgcttggcaggtattcattgttat

SEQ ID NO: 385277 - DNA, 25 bp, Mus musculus
ctgcttggctggatatcttatttgg

SEQ ID NO: 385278 - DNA, 25 bp, Mus musculus
ctgcttggctggttatcttatttgg

SEQ ID NO: 385279 - DNA, 25 bp, Mus musculus
ctgcttgggcatcatagttacttgt

SEQ ID NO: 385280 - DNA, 25 bp, Mus musculus
ctgcttgggcatgatagttacttgt

SEQ ID NO: 385281 - DNA, 25 bp, Mus musculus
ctgcttgggctcatggatttttcca

SEQ ID NO: 385282 - DNA, 25 bp, Mus musculus
ctgcttgggctcttggatttttcca

SEQ ID NO: 385283 - DNA, 25 bp, Mus musculus
ctgcttggtcctagctcaatgtgct

SEQ ID NO: 385284 - DNA, 25 bp, Mus musculus
ctgcttggtccttgctcaatgtgct

SEQ ID NO: 385285 - DNA, 25 bp, Mus musculus
ctgcttggtctgcatcccctagggt

SEQ ID NO: 385286 - DNA, 25 bp, Mus musculus
ctgcttggtctggatcccctagggt

SEQ ID NO: 385287 - DNA, 25 bp, Mus musculus
ctgcttggtttcatacatgggtctt

SEQ ID NO: 385288 - DNA, 25 bp, Mus musculus
ctgcttggtttcttacatgggtctt

SEQ ID NO: 385289 - DNA, 25 bp, Mus musculus
ctgcttggttttatgctatggcatt

SEQ ID NO: 385290 - DNA, 25 bp, Mus musculus
ctgcttggttttttgctatggcatt

SEQ ID NO: 385291 - DNA, 25 bp, Mus musculus
ctgcttgtaatgatggtaagtacca

SEQ ID NO: 385292 - DNA, 25 bp, Mus musculus
ctgcttgtaatgttggtaagtacca

SEQ ID NO: 385293 - DNA, 25 bp, Mus musculus
ctgcttgtagccatgggatctccaa

SEQ ID NO: 385294 - DNA, 25 bp, Mus musculus
ctgcttgtagccttgggatctccaa

SEQ ID NO: 385295 - DNA, 25 bp, Mus musculus
ctgcttgtaggaaagttgattgtca

SEQ ID NO: 385296 - DNA, 25 bp, Mus musculus
ctgcttgtaggatagttgattgtca

SEQ ID NO: 385297 - DNA, 25 bp, Mus musculus
ctgcttgtatgtatctgctgcggac

SEQ ID NO: 385298 - DNA, 25 bp, Mus musculus
ctgcttgtatgtcaggctccgaatt

SEQ ID NO: 385299 - DNA, 25 bp, Mus musculus
ctgcttgtatgtgaggctccgaatt

SEQ ID NO: 385300 - DNA, 25 bp, Mus musculus
ctgcttgtatgtttctgctgcggac

SEQ ID NO: 385301 - DNA, 25 bp, Mus musculus
ctgcttgtccccaaagatactgttt

SEQ ID NO: 385302 - DNA, 25 bp, Mus musculus
ctgcttgtcccctaagatactgttt

SEQ ID NO: 385303 - DNA, 25 bp, Mus musculus
ctgcttgtcccgactgggagtctga

SEQ ID NO: 385304 - DNA, 25 bp, Mus musculus
ctgcttgtcccgtctgggagtctga

SEQ ID NO: 385305 - DNA, 25 bp, Mus musculus
ctgcttgtgcggcatgtacaaagga

SEQ ID NO: 385306 - DNA, 25 bp, Mus musculus
ctgcttgtgcgggatgtacaaagga

SEQ ID NO: 385307 - DNA, 25 bp, Mus musculus
ctgcttgtgctgattgttattctta

SEQ ID NO: 385308 - DNA, 25 bp, Mus musculus
ctgcttgtgctgtttgttattctta

SEQ ID NO: 385309 - DNA, 25 bp, Mus musculus
ctgcttgtgggtaatgtgctgtcat

SEQ ID NO: 385310 - DNA, 25 bp, Mus musculus
ctgcttgtgggttatgtgctgtcat

SEQ ID NO: 385311 - DNA, 25 bp, Mus musculus
ctgcttgtgtgccagagttagacat

SEQ ID NO: 385312 - DNA, 25 bp, Mus musculus
ctgcttgtgtgcgagagttagacat

SEQ ID NO: 385313 - DNA, 25 bp, Mus musculus
ctgcttgttataaagtaccccttaa

SEQ ID NO: 385314 - DNA, 25 bp, Mus musculus
ctgcttgttatatagtaccccttaa

SEQ ID NO: 385315 - DNA, 25 bp, Mus musculus
ctgcttgttatgaatgagggcctca

SEQ ID NO: 385316 - DNA, 25 bp, Mus musculus
ctgcttgttatgtatgagggcctca

SEQ ID NO: 385317 - DNA, 25 bp, Mus musculus
ctgcttgttgccatttaatctaatg

SEQ ID NO: 385318 - DNA, 25 bp, Mus musculus
ctgcttgttgccttttaatctaatg

SEQ ID NO: 385319 - DNA, 25 bp, Mus musculus
ctgctttaaggcattagaggctata

SEQ ID NO: 385320 - DNA, 25 bp, Mus musculus
ctgctttaaggctttagaggctata

SEQ ID NO: 385321 - DNA, 25 bp, Mus musculus
ctgctttaatccaagagtttgctcc

SEQ ID NO: 385322 - DNA, 25 bp, Mus musculus
ctgctttaatcctagagtttgctcc

SEQ ID NO: 385323 - DNA, 25 bp, Mus musculus
ctgctttagcaaaaggatgtccact

SEQ ID NO: 385324 - DNA, 25 bp, Mus musculus
ctgctttagcaataggatgtccact

SEQ ID NO: 385325 - DNA, 25 bp, Mus musculus
ctgctttcagatactttaacctcgg

SEQ ID NO: 385326 - DNA, 25 bp, Mus musculus
ctgctttcagattctttaacctcgg

SEQ ID NO: 385327 - DNA, 25 bp, Mus musculus
ctgctttccacactggaaacactga

SEQ ID NO: 385328 - DNA, 25 bp, Mus musculus
ctgctttccacagtggaaacactga

SEQ ID NO: 385329 - DNA, 25 bp, Mus musculus
ctgctttccagaaaactctaccaat

SEQ ID NO: 385330 - DNA, 25 bp, Mus musculus
ctgctttccagataactctaccaat

SEQ ID NO: 385331 - DNA, 25 bp, Mus musculus
ctgctttccattcttaggaggttac

SEQ ID NO: 385332 - DNA, 25 bp, Mus musculus
ctgctttccattgttaggaggttac

SEQ ID NO: 385333 - DNA, 25 bp, Mus musculus
ctgctttcccctcgatatatttcat

SEQ ID NO: 385334 - DNA, 25 bp, Mus musculus
ctgctttcccctggatatatttcat

SEQ ID NO: 385335 - DNA, 25 bp, Mus musculus
ctgctttcccgtcttgatttaatac

SEQ ID NO: 385336 - DNA, 25 bp, Mus musculus
ctgctttcccgtgttgatttaatac

SEQ ID NO: 385337 - DNA, 25 bp, Mus musculus
ctgctttcctatatttatttcttga

SEQ ID NO: 385338 - DNA, 25 bp, Mus musculus
ctgctttcctatttttatttcttga

SEQ ID NO: 385339 - DNA, 25 bp, Mus musculus
ctgctttcctgaagtacgagtgtat

SEQ ID NO: 385340 - DNA, 25 bp, Mus musculus
ctgctttcctgacgtttttgttaat

SEQ ID NO: 385341 - DNA, 25 bp, Mus musculus
ctgctttcctgaggtttttgttaat

SEQ ID NO: 385342 - DNA, 25 bp, Mus musculus
ctgctttcctgatgtacgagtgtat

SEQ ID NO: 385343 - DNA, 25 bp, Mus musculus
ctgctttcctggagtgacaactgga

SEQ ID NO: 385344 - DNA, 25 bp, Mus musculus
ctgctttcctggtgtgacaactgga

SEQ ID NO: 385345 - DNA, 25 bp, Mus musculus
ctgctttcctgtacttcctaaaagt

SEQ ID NO: 385346 - DNA, 25 bp, Mus musculus
ctgctttcctgttcttcctaaaagt

SEQ ID NO: 385347 - DNA, 25 bp, Mus musculus
ctgctttctcccatattgactgaat

SEQ ID NO: 385348 - DNA, 25 bp, Mus musculus
ctgctttctcccttattgactgaat

SEQ ID NO: 385349 - DNA, 25 bp, Mus musculus
ctgctttctcctaggaatgctgttt

SEQ ID NO: 385350 - DNA, 25 bp, Mus musculus
ctgctttctccttggaatgctgttt

SEQ ID NO: 385351 - DNA, 25 bp, Mus musculus
ctgctttctgaccaaatgcttttct

SEQ ID NO: 385352 - DNA, 25 bp, Mus musculus
ctgctttctgacgaaatgcttttct

SEQ ID NO: 385353 - DNA, 25 bp, Mus musculus
ctgctttctgccacttgagtccggg

SEQ ID NO: 385354 - DNA, 25 bp, Mus musculus
ctgctttctgcccaagagtgtgtgt

SEQ ID NO: 385355 - DNA, 25 bp, Mus musculus
ctgctttctgccgaagagtgtgtgt

SEQ ID NO: 385356 - DNA, 25 bp, Mus musculus
ctgctttctgcctcttgagtccggg

SEQ ID NO: 385357 - DNA, 25 bp, Mus musculus
ctgctttctggactgtacgacacta

SEQ ID NO: 385358 - DNA, 25 bp, Mus musculus
ctgctttctggagtgtacgacacta

SEQ ID NO: 385359 - DNA, 25 bp, Mus musculus
ctgctttctgtactcacactgtctg

SEQ ID NO: 385360 - DNA, 25 bp, Mus musculus
ctgctttctgtagtcacactgtctg

SEQ ID NO: 385361 - DNA, 25 bp, Mus musculus
ctgctttctgtccatgatggagcat

SEQ ID NO: 385362 - DNA, 25 bp, Mus musculus
ctgctttctgtcgatgatggagcat

SEQ ID NO: 385363 - DNA, 25 bp, Mus musculus
ctgctttcttaaactatgcatttta

SEQ ID NO: 385364 - DNA, 25 bp, Mus musculus
ctgctttcttaatctatgcatttta

SEQ ID NO: 385365 - DNA, 25 bp, Mus musculus
ctgctttgagatcgaccctgccctt

SEQ ID NO: 385366 - DNA, 25 bp, Mus musculus
ctgctttgagatggaccctgccctt

SEQ ID NO: 385367 - DNA, 25 bp, Mus musculus
ctgctttgagctatacattcccaac

SEQ ID NO: 385368 - DNA, 25 bp, Mus musculus
ctgctttgagctatatatccctgac

SEQ ID NO: 385369 - DNA, 25 bp, Mus musculus
ctgctttgagctttacattcccaac

SEQ ID NO: 385370 - DNA, 25 bp, Mus musculus
ctgctttgagctttatatccctgac

SEQ ID NO: 385371 - DNA, 25 bp, Mus musculus
ctgctttgaggtcaggaaggcttca

SEQ ID NO: 385372 - DNA, 25 bp, Mus musculus
ctgctttgaggtgaggaaggcttca

SEQ ID NO: 385373 - DNA, 25 bp, Mus musculus
ctgctttgcactataggctgcttgt

SEQ ID NO: 385374 - DNA, 25 bp, Mus musculus
ctgctttgcactttaggctgcttgt

SEQ ID NO: 385375 - DNA, 25 bp, Mus musculus
ctgctttgccataaagtacccaata

SEQ ID NO: 385376 - DNA, 25 bp, Mus musculus
ctgctttgccattaagtacccaata

SEQ ID NO: 385377 - DNA, 25 bp, Mus musculus
ctgctttggatcctgccgaggagaa

SEQ ID NO: 385378 - DNA, 25 bp, Mus musculus
ctgctttggatcgtgccgaggagaa

SEQ ID NO: 385379 - DNA, 25 bp, Mus musculus
ctgctttgggctaggattttgatac

SEQ ID NO: 385380 - DNA, 25 bp, Mus musculus
ctgctttgggcttggattttgatac

SEQ ID NO: 385381 - DNA, 25 bp, Mus musculus
ctgctttgggtactagccttgttat

SEQ ID NO: 385382 - DNA, 25 bp, Mus musculus
ctgctttgggtagtagccttgttat

SEQ ID NO: 385383 - DNA, 25 bp, Mus musculus
ctgctttgggtcaccggtcaaaaag

SEQ ID NO: 385384 - DNA, 25 bp, Mus musculus
ctgctttgggtctccggtcaaaaag

SEQ ID NO: 385385 - DNA, 25 bp, Mus musculus
ctgctttgggtgagtgcccataagt

SEQ ID NO: 385386 - DNA, 25 bp, Mus musculus
ctgctttgggtgtgtgcccataagt

SEQ ID NO: 385387 - DNA, 25 bp, Mus musculus
ctgctttggtttctcgtttatcaca

SEQ ID NO: 385388 - DNA, 25 bp, Mus musculus
ctgctttggtttgtcgtttatcaca

SEQ ID NO: 385389 - DNA, 25 bp, Mus musculus
ctgctttgtgaaacctcagaagttt

SEQ ID NO: 385390 - DNA, 25 bp, Mus musculus
ctgctttgtgaatcctcagaagttt

SEQ ID NO: 385391 - DNA, 25 bp, Mus musculus
ctgctttgtgagataggcgtgctgg

SEQ ID NO: 385392 - DNA, 25 bp, Mus musculus
ctgctttgtgagttaggcgtgctgg

SEQ ID NO: 385393 - DNA, 25 bp, Mus musculus
ctgctttgtgtcaggagaacaggtt

SEQ ID NO: 385394 - DNA, 25 bp, Mus musculus
ctgctttgtgtctggagaacaggtt

SEQ ID NO: 385395 - DNA, 25 bp, Mus musculus
ctgcttttaggcattcactgtcttg

SEQ ID NO: 385396 - DNA, 25 bp, Mus musculus
ctgcttttaggctttcactgtcttg

SEQ ID NO: 385397 - DNA, 25 bp, Mus musculus
ctgcttttccagattgaaatattaa

SEQ ID NO: 385398 - DNA, 25 bp, Mus musculus
ctgcttttccagtttgaaatattaa

SEQ ID NO: 385399 - DNA, 25 bp, Mus musculus
ctgcttttcctgcattggatgtgtg

SEQ ID NO: 385400 - DNA, 25 bp, Mus musculus
ctgcttttcctggattggatgtgtg

SEQ ID NO: 385401 - DNA, 25 bp, Mus musculus
ctgcttttctggcacaatctctgat

SEQ ID NO: 385402 - DNA, 25 bp, Mus musculus
ctgcttttctgggacaatctctgat

SEQ ID NO: 385403 - DNA, 25 bp, Mus musculus
ctgcttttgcaaactgagcctgttt

SEQ ID NO: 385404 - DNA, 25 bp, Mus musculus
ctgcttttgcaatctgagcctgttt

SEQ ID NO: 385405 - DNA, 25 bp, Mus musculus
ctgcttttgcctactaagagatgaa

SEQ ID NO: 385406 - DNA, 25 bp, Mus musculus
ctgcttttgcctcagccatttttgg

SEQ ID NO: 385407 - DNA, 25 bp, Mus musculus
ctgcttttgcctccataagtggtgg

SEQ ID NO: 385408 - DNA, 25 bp, Mus musculus
ctgcttttgcctgagccatttttgg

SEQ ID NO: 385409 - DNA, 25 bp, Mus musculus
ctgcttttgcctgcataagtggtgg

SEQ ID NO: 385410 - DNA, 25 bp, Mus musculus
ctgcttttgccttctaagagatgaa

SEQ ID NO: 385411 - DNA, 25 bp, Mus musculus
ctgcttttggggacctgacgatcaa

SEQ ID NO: 385412 - DNA, 25 bp, Mus musculus
ctgcttttggggtcctgacgatcaa

SEQ ID NO: 385413 - DNA, 25 bp, Mus musculus
ctgcttttggttcctggttaaccag

SEQ ID NO: 385414 - DNA, 25 bp, Mus musculus
ctgcttttggttgctggttaaccag

SEQ ID NO: 385415 - DNA, 25 bp, Mus musculus
ctgcttttgttgaatccccttagac

SEQ ID NO: 385416 - DNA, 25 bp, Mus musculus
ctgcttttgttgagtacctgagatc

SEQ ID NO: 385417 - DNA, 25 bp, Mus musculus
ctgcttttgttgtatccccttagac

SEQ ID NO: 385418 - DNA, 25 bp, Mus musculus
ctgcttttgttgtgtacctgagatc

SEQ ID NO: 385419 - DNA, 25 bp, Mus musculus
ctgctttttataaagaatggttgga

SEQ ID NO: 385420 - DNA, 25 bp, Mus musculus
ctgctttttatatagaatggttgga

SEQ ID NO: 385421 - DNA, 25 bp, Mus musculus
ctgctttttcttaaatactgattga

SEQ ID NO: 385422 - DNA, 25 bp, Mus musculus
ctgctttttctttaatactgattga

SEQ ID NO: 385423 - DNA, 25 bp, Mus musculus
ctggaaaacagaccgccaggcttca

SEQ ID NO: 385424 - DNA, 25 bp, Mus musculus
ctggaaaacagagcgccaggcttca

SEQ ID NO: 385425 - DNA, 25 bp, Mus musculus
ctggaaaactcacatccgccaaaaa

SEQ ID NO: 385426 - DNA, 25 bp, Mus musculus
ctggaaaactcagatccgccaaaaa

SEQ ID NO: 385427 - DNA, 25 bp, Mus musculus
ctggaaacagtacgttcagacatac

SEQ ID NO: 385428 - DNA, 25 bp, Mus musculus
ctggaaacagtaggttcagacatac

SEQ ID NO: 385429 - DNA, 25 bp, Mus musculus
ctggaaacatgtatctcttcctgca

SEQ ID NO: 385430 - DNA, 25 bp, Mus musculus
ctggaaacatgtttctcttcctgca

SEQ ID NO: 385431 - DNA, 25 bp, Mus musculus
ctggaaacccagctgtataagaaca

SEQ ID NO: 385432 - DNA, 25 bp, Mus musculus
ctggaaacccaggtgtataagaaca

SEQ ID NO: 385433 - DNA, 25 bp, Mus musculus
ctggaaacctggaagtgaaacaata

SEQ ID NO: 385434 - DNA, 25 bp, Mus musculus
ctggaaacctggtagtgaaacaata

SEQ ID NO: 385435 - DNA, 25 bp, Mus musculus
ctggaaactctgcatgggactgaaa

SEQ ID NO: 385436 - DNA, 25 bp, Mus musculus
ctggaaactctggatgggactgaaa

SEQ ID NO: 385437 - DNA, 25 bp, Mus musculus
ctggaaactttcaatgtgactggta

SEQ ID NO: 385438 - DNA, 25 bp, Mus musculus
ctggaaactttctatgtgactggta

SEQ ID NO: 385439 - DNA, 25 bp, Mus musculus
ctggaaagatggcacagcacgtgta

SEQ ID NO: 385440 - DNA, 25 bp, Mus musculus
ctggaaagatgggacagcacgtgta

SEQ ID NO: 385441 - DNA, 25 bp, Mus musculus
ctggaaagcagaaccttttatttaa

SEQ ID NO: 385442 - DNA, 25 bp, Mus musculus
ctggaaagcagatccttttatttaa

SEQ ID NO: 385443 - DNA, 25 bp, Mus musculus
ctggaaagtcctatacgtaagtaat

SEQ ID NO: 385444 - DNA, 25 bp, Mus musculus
ctggaaagtcctttacgtaagtaat

SEQ ID NO: 385445 - DNA, 25 bp, Mus musculus
ctggaaatcagtatgtcagttcctc

SEQ ID NO: 385446 - DNA, 25 bp, Mus musculus
ctggaaatcagtttgtcagttcctc

SEQ ID NO: 385447 - DNA, 25 bp, Mus musculus
ctggaaatcggcatcggctttgtgg

SEQ ID NO: 385448 - DNA, 25 bp, Mus musculus
ctggaaatcggcttcggctttgtgg

SEQ ID NO: 385449 - DNA, 25 bp, Mus musculus
ctggaaatggtcacacaaaccttta

SEQ ID NO: 385450 - DNA, 25 bp, Mus musculus
ctggaaatggtctcacaaaccttta

SEQ ID NO: 385451 - DNA, 25 bp, Mus musculus
ctggaaattcagcatgctcacattc

SEQ ID NO: 385452 - DNA, 25 bp, Mus musculus
ctggaaattcaggatgctcacattc

SEQ ID NO: 385453 - DNA, 25 bp, Mus musculus
ctggaaattcgtcgcaatggtcgtc

SEQ ID NO: 385454 - DNA, 25 bp, Mus musculus
ctggaaattcgtggcaatggtcgtc

SEQ ID NO: 385455 - DNA, 25 bp, Mus musculus
ctggaacaagtgaacgccctggtgc

SEQ ID NO: 385456 - DNA, 25 bp, Mus musculus
ctggaacaagtgtacgccctggtgc

SEQ ID NO: 385457 - DNA, 25 bp, Mus musculus
ctggaacacgacctaccgcttttgg

SEQ ID NO: 385458 - DNA, 25 bp, Mus musculus
ctggaacacgacgtaccgcttttgg

SEQ ID NO: 385459 - DNA, 25 bp, Mus musculus
ctggaacagagaatggaaggccgct

SEQ ID NO: 385460 - DNA, 25 bp, Mus musculus
ctggaacagagattggaaggccgct

SEQ ID NO: 385461 - DNA, 25 bp, Mus musculus
ctggaacagatcaacatccggtgga

SEQ ID NO: 385462 - DNA, 25 bp, Mus musculus
ctggaacagatctacatccggtgga

SEQ ID NO: 385463 - DNA, 25 bp, Mus musculus
ctggaacagcaaccgccggcgggaa

SEQ ID NO: 385464 - DNA, 25 bp, Mus musculus
ctggaacagcaagcgccggcgggaa

SEQ ID NO: 385465 - DNA, 25 bp, Mus musculus
ctggaacagtttcgcaaggaggaca

SEQ ID NO: 385466 - DNA, 25 bp, Mus musculus
ctggaacagtttggcaaggaggaca

SEQ ID NO: 385467 - DNA, 25 bp, Mus musculus
ctggaacatggtcgcccacgagtgt

SEQ ID NO: 385468 - DNA, 25 bp, Mus musculus
ctggaacatggtggcccacgagtgt

SEQ ID NO: 385469 - DNA, 25 bp, Mus musculus
ctggaacccaagaaaaggtggagca

SEQ ID NO: 385470 - DNA, 25 bp, Mus musculus
ctggaacccaagtaaaggtggagca

SEQ ID NO: 385471 - DNA, 25 bp, Mus musculus
ctggaacccacgagaatataaaaag

SEQ ID NO: 385472 - DNA, 25 bp, Mus musculus
ctggaacccacgtgaatataaaaag

SEQ ID NO: 385473 - DNA, 25 bp, Mus musculus
ctggaaccccgcatttgacaagtga

SEQ ID NO: 385474 - DNA, 25 bp, Mus musculus
ctggaaccccgcttttgacaagtga

SEQ ID NO: 385475 - DNA, 25 bp, Mus musculus
ctggaacccgagagaggccgtttat

SEQ ID NO: 385476 - DNA, 25 bp, Mus musculus
ctggaacccgagtgaggccgtttat

SEQ ID NO: 385477 - DNA, 25 bp, Mus musculus
ctggaacgatggaccctgtgacaat

SEQ ID NO: 385478 - DNA, 25 bp, Mus musculus
ctggaacgatggtccctgtgacaat

SEQ ID NO: 385479 - DNA, 25 bp, Mus musculus
ctggaacgcgagattttctttaatg

SEQ ID NO: 385480 - DNA, 25 bp, Mus musculus
ctggaacgcgagtttttctttaatg

SEQ ID NO: 385481 - DNA, 25 bp, Mus musculus
ctggaacgtgacaggagatcctcat

SEQ ID NO: 385482 - DNA, 25 bp, Mus musculus
ctggaacgtgactggagatcctcat

SEQ ID NO: 385483 - DNA, 25 bp, Mus musculus
ctggaactaccactgatcctcttgc

SEQ ID NO: 385484 - DNA, 25 bp, Mus musculus
ctggaactaccagtgatcctcttgc

SEQ ID NO: 385485 - DNA, 25 bp, Mus musculus
ctggaactacgaacatggtgcattt

SEQ ID NO: 385486 - DNA, 25 bp, Mus musculus
ctggaactacgatcatggtgcattt

SEQ ID NO: 385487 - DNA, 25 bp, Mus musculus
ctggaactcactcataggctaatta

SEQ ID NO: 385488 - DNA, 25 bp, Mus musculus
ctggaactcactgataggctaatta

SEQ ID NO: 385489 - DNA, 25 bp, Mus musculus
ctggaactctatctgctgcaggtat

SEQ ID NO: 385490 - DNA, 25 bp, Mus musculus
ctggaactctatgtgctgcaggtat

SEQ ID NO: 385491 - DNA, 25 bp, Mus musculus
ctggaactgaatccctgagagtctt

SEQ ID NO: 385492 - DNA, 25 bp, Mus musculus
ctggaactgaatgcctgagagtctt

SEQ ID NO: 385493 - DNA, 25 bp, Mus musculus
ctggaactgcacactcttttttaaa

SEQ ID NO: 385494 - DNA, 25 bp, Mus musculus
ctggaactgcactctcttttttaaa

SEQ ID NO: 385495 - DNA, 25 bp, Mus musculus
ctggaactgtttcccgtttgtaatg

SEQ ID NO: 385496 - DNA, 25 bp, Mus musculus
ctggaactgtttgccgtttgtaatg

SEQ ID NO: 385497 - DNA, 25 bp, Mus musculus
ctggaacttactccatatgagatct

SEQ ID NO: 385498 - DNA, 25 bp, Mus musculus
ctggaacttactgcatatgagatct

SEQ ID NO: 385499 - DNA, 25 bp, Mus musculus
ctggaacttatcactgctgaagcag

SEQ ID NO: 385500 - DNA, 25 bp, Mus musculus
ctggaacttatctctgctgaagcag

SEQ ID NO: 385501 - DNA, 25 bp, Mus musculus
ctggaacttctgatgctaagcaaat

SEQ ID NO: 385502 - DNA, 25 bp, Mus musculus
ctggaacttctgttgctaagcaaat

SEQ ID NO: 385503 - DNA, 25 bp, Mus musculus
ctggaacttcttcggcatccctcag

SEQ ID NO: 385504 - DNA, 25 bp, Mus musculus
ctggaacttcttgggcatccctcag

SEQ ID NO: 385505 - DNA, 25 bp, Mus musculus
ctggaactttgcacccaggagtgga

SEQ ID NO: 385506 - DNA, 25 bp, Mus musculus
ctggaactttgctcccaggagtgga

SEQ ID NO: 385507 - DNA, 25 bp, Mus musculus
ctggaagaagagacaaggcgctacc

SEQ ID NO: 385508 - DNA, 25 bp, Mus musculus
ctggaagaagagtcaaggcgctacc

SEQ ID NO: 385509 - DNA, 25 bp, Mus musculus
ctggaagaccagcaacggctgctgc

SEQ ID NO: 385510 - DNA, 25 bp, Mus musculus
ctggaagaccaggaacggctgctgc

SEQ ID NO: 385511 - DNA, 25 bp, Mus musculus
ctggaagcaacaccgtgtctatctg

SEQ ID NO: 385512 - DNA, 25 bp, Mus musculus
ctggaagcaacagcgtgtctatctg

SEQ ID NO: 385513 - DNA, 25 bp, Mus musculus
ctggaagcaacgatctttccattca

SEQ ID NO: 385514 - DNA, 25 bp, Mus musculus
ctggaagcaacgttctttccattca

SEQ ID NO: 385515 - DNA, 25 bp, Mus musculus
ctggaagcactgatgcttgtgccat

SEQ ID NO: 385516 - DNA, 25 bp, Mus musculus
ctggaagcactgttgcttgtgccat

SEQ ID NO: 385517 - DNA, 25 bp, Mus musculus
ctggaagcacttagatttgactgat

SEQ ID NO: 385518 - DNA, 25 bp, Mus musculus
ctggaagcactttgatttgactgat

SEQ ID NO: 385519 - DNA, 25 bp, Mus musculus
ctggaagccaatcggcctcacaggg

SEQ ID NO: 385520 - DNA, 25 bp, Mus musculus
ctggaagccaatgggcctcacaggg

SEQ ID NO: 385521 - DNA, 25 bp, Mus musculus
ctggaagcctccagtattttgaaaa

SEQ ID NO: 385522 - DNA, 25 bp, Mus musculus
ctggaagcctcctgtattttgaaaa

SEQ ID NO: 385523 - DNA, 25 bp, Mus musculus
ctggaagcggaaacccttgaattgg

SEQ ID NO: 385524 - DNA, 25 bp, Mus musculus
ctggaagcggaatcccttgaattgg

SEQ ID NO: 385525 - DNA, 25 bp, Mus musculus
ctggaagctcaacccatgttggctt

SEQ ID NO: 385526 - DNA, 25 bp, Mus musculus
ctggaagctcaagccatgttggctt

SEQ ID NO: 385527 - DNA, 25 bp, Mus musculus
ctggaagctgcccaccaaaatggtg

SEQ ID NO: 385528 - DNA, 25 bp, Mus musculus
ctggaagctgccgaccaaaatggtg

SEQ ID NO: 385529 - DNA, 25 bp, Mus musculus
ctggaagctgttacccgtatcagat

SEQ ID NO: 385530 - DNA, 25 bp, Mus musculus
ctggaagctgtttcccgtatcagat

SEQ ID NO: 385531 - DNA, 25 bp, Mus musculus
ctggaagcttcaccctttcttaaag

SEQ ID NO: 385532 - DNA, 25 bp, Mus musculus
ctggaagcttcagcctttcttaaag

SEQ ID NO: 385533 - DNA, 25 bp, Mus musculus
ctggaaggatcgcttgccgctttaa

SEQ ID NO: 385534 - DNA, 25 bp, Mus musculus
ctggaaggatcggttgccgctttaa

SEQ ID NO: 385535 - DNA, 25 bp, Mus musculus
ctggaaggcagcaacggttggaatc

SEQ ID NO: 385536 - DNA, 25 bp, Mus musculus
ctggaaggcagctacggttggaatc

SEQ ID NO: 385537 - DNA, 25 bp, Mus musculus
ctggaaggccccatgaggctgatta

SEQ ID NO: 385538 - DNA, 25 bp, Mus musculus
ctggaaggccccttgaggctgatta

SEQ ID NO: 385539 - DNA, 25 bp, Mus musculus
ctggaaggctgtaactatctagaag

SEQ ID NO: 385540 - DNA, 25 bp, Mus musculus
ctggaaggctgttactatctagaag

SEQ ID NO: 385541 - DNA, 25 bp, Mus musculus
ctggaaggcttcctccagaagctgg

SEQ ID NO: 385542 - DNA, 25 bp, Mus musculus
ctggaaggcttcgtccagaagctgg

SEQ ID NO: 385543 - DNA, 25 bp, Mus musculus
ctggaagggcgtccctcactgagca

SEQ ID NO: 385544 - DNA, 25 bp, Mus musculus
ctggaagggcgtgcctcactgagca

SEQ ID NO: 385545 - DNA, 25 bp, Mus musculus
ctggaagggtcaactcgcacagcgt

SEQ ID NO: 385546 - DNA, 25 bp, Mus musculus
ctggaagggtcatctcgcacagcgt

SEQ ID NO: 385547 - DNA, 25 bp, Mus musculus
ctggaaggtgttagctcccaagttc

SEQ ID NO: 385548 - DNA, 25 bp, Mus musculus
ctggaaggtgtttgctcccaagttc

SEQ ID NO: 385549 - DNA, 25 bp, Mus musculus
ctggaagtacacacctcggaggaca

SEQ ID NO: 385550 - DNA, 25 bp, Mus musculus
ctggaagtacactcctcggaggaca

SEQ ID NO: 385551 - DNA, 25 bp, Mus musculus
ctggaagtcactcctcgatactgca

SEQ ID NO: 385552 - DNA, 25 bp, Mus musculus
ctggaagtcactgctcgatactgca

SEQ ID NO: 385553 - DNA, 25 bp, Mus musculus
ctggaagtcaggctgtgcgctcact

SEQ ID NO: 385554 - DNA, 25 bp, Mus musculus
ctggaagtcagggtgtgcgctcact

SEQ ID NO: 385555 - DNA, 25 bp, Mus musculus
ctggaagtccatagctaaatagatc

SEQ ID NO: 385556 - DNA, 25 bp, Mus musculus
ctggaagtccattgctaaatagatc

SEQ ID NO: 385557 - DNA, 25 bp, Mus musculus
ctggaagtctgaattctagtgctca

SEQ ID NO: 385558 - DNA, 25 bp, Mus musculus
ctggaagtctgatttctagtgctca

SEQ ID NO: 385559 - DNA, 25 bp, Mus musculus
ctggaagtgacacacctttgttttt

SEQ ID NO: 385560 - DNA, 25 bp, Mus musculus
ctggaagtgacagacctttgttttt

SEQ ID NO: 385561 - DNA, 25 bp, Mus musculus
ctggaagtgcacaatttatactggt

SEQ ID NO: 385562 - DNA, 25 bp, Mus musculus
ctggaagtgcactatttatactggt

SEQ ID NO: 385563 - DNA, 25 bp, Mus musculus
ctggaagtgcctccctacgagttca

SEQ ID NO: 385564 - DNA, 25 bp, Mus musculus
ctggaagtgcctgcctacgagttca

SEQ ID NO: 385565 - DNA, 25 bp, Mus musculus
ctggaagttgccactactttataat

SEQ ID NO: 385566 - DNA, 25 bp, Mus musculus
ctggaagttgcctctactttataat

SEQ ID NO: 385567 - DNA, 25 bp, Mus musculus
ctggaatacaccattgcttgctacc

SEQ ID NO: 385568 - DNA, 25 bp, Mus musculus
ctggaatacacctttgcttgctacc

SEQ ID NO: 385569 - DNA, 25 bp, Mus musculus
ctggaatacctgataagcctggccc

SEQ ID NO: 385570 - DNA, 25 bp, Mus musculus
ctggaatacctgttaagcctggccc

SEQ ID NO: 385571 - DNA, 25 bp, Mus musculus
ctggaatcccagcactatctgataa

SEQ ID NO: 385572 - DNA, 25 bp, Mus musculus
ctggaatcccaggactatctgataa

SEQ ID NO: 385573 - DNA, 25 bp, Mus musculus
ctggaatccttacctctgtagaggg

SEQ ID NO: 385574 - DNA, 25 bp, Mus musculus
ctggaatccttagctctgtagaggg

SEQ ID NO: 385575 - DNA, 25 bp, Mus musculus
ctggaatccttccaatgccttgaag

SEQ ID NO: 385576 - DNA, 25 bp, Mus musculus
ctggaatccttcgaatgccttgaag

SEQ ID NO: 385577 - DNA, 25 bp, Mus musculus
ctggaatcgggaacattctctctct

SEQ ID NO: 385578 - DNA, 25 bp, Mus musculus
ctggaatcgggatcattctctctct

SEQ ID NO: 385579 - DNA, 25 bp, Mus musculus
ctggaatctacaccttctttcctgg

SEQ ID NO: 385580 - DNA, 25 bp, Mus musculus
ctggaatctacagcttctttcctgg

SEQ ID NO: 385581 - DNA, 25 bp, Mus musculus
ctggaatctaccctcattcgtgagt

SEQ ID NO: 385582 - DNA, 25 bp, Mus musculus
ctggaatctaccgtcattcgtgagt

SEQ ID NO: 385583 - DNA, 25 bp, Mus musculus
ctggaatctgcccttttttgtgtgt

SEQ ID NO: 385584 - DNA, 25 bp, Mus musculus
ctggaatctgccgttttttgtgtgt

SEQ ID NO: 385585 - DNA, 25 bp, Mus musculus
ctggaatctgtcaagggaacccatt

SEQ ID NO: 385586 - DNA, 25 bp, Mus musculus
ctggaatctgtctagggaacccatt

SEQ ID NO: 385587 - DNA, 25 bp, Mus musculus
ctggaatgatgcattatagtagtac

SEQ ID NO: 385588 - DNA, 25 bp, Mus musculus
ctggaatgatgctttatagtagtac

SEQ ID NO: 385589 - DNA, 25 bp, Mus musculus
ctggaatgttatcccaacctctttg

SEQ ID NO: 385590 - DNA, 25 bp, Mus musculus
ctggaatgttatgccaacctctttg

SEQ ID NO: 385591 - DNA, 25 bp, Mus musculus
ctggaatgtttcctgcacagagaag

SEQ ID NO: 385592 - DNA, 25 bp, Mus musculus
ctggaatgtttcgtgcacagagaag

SEQ ID NO: 385593 - DNA, 25 bp, Mus musculus
ctggaattaccaagctagcgagcaa

SEQ ID NO: 385594 - DNA, 25 bp, Mus musculus
ctggaattaccatgctagcgagcaa

SEQ ID NO: 385595 - DNA, 25 bp, Mus musculus
ctggaattatggacttcctgcctca

SEQ ID NO: 385596 - DNA, 25 bp, Mus musculus
ctggaattatggtcttcctgcctca

SEQ ID NO: 385597 - DNA, 25 bp, Mus musculus
ctggaattcaaaaagctccctgttc

SEQ ID NO: 385598 - DNA, 25 bp, Mus musculus
ctggaattcaaatagctccctgttc

SEQ ID NO: 385599 - DNA, 25 bp, Mus musculus
ctggaattcacaaaggtcaccctgg

SEQ ID NO: 385600 - DNA, 25 bp, Mus musculus
ctggaattcacataggtcaccctgg

SEQ ID NO: 385601 - DNA, 25 bp, Mus musculus
ctggaattcactatgaagcagaggc

SEQ ID NO: 385602 - DNA, 25 bp, Mus musculus
ctggaattcactttgaagcagaggc

SEQ ID NO: 385603 - DNA, 25 bp, Mus musculus
ctggaattcgaaccacccatttggt

SEQ ID NO: 385604 - DNA, 25 bp, Mus musculus
ctggaattcgaagcacccatttggt

SEQ ID NO: 385605 - DNA, 25 bp, Mus musculus
ctggaattgaaccacagaggactga

SEQ ID NO: 385606 - DNA, 25 bp, Mus musculus
ctggaattgaacgacagaggactga

SEQ ID NO: 385607 - DNA, 25 bp, Mus musculus
ctggaatttactcgcagctacaaat

SEQ ID NO: 385608 - DNA, 25 bp, Mus musculus
ctggaatttactggcagctacaaat

SEQ ID NO: 385609 - DNA, 25 bp, Mus musculus
ctggaatttgagaactttctggtga

SEQ ID NO: 385610 - DNA, 25 bp, Mus musculus
ctggaatttgagtactttctggtga

SEQ ID NO: 385611 - DNA, 25 bp, Mus musculus
ctggacaaacccacttgtaaataca

SEQ ID NO: 385612 - DNA, 25 bp, Mus musculus
ctggacaaaccctcttgtaaataca

SEQ ID NO: 385613 - DNA, 25 bp, Mus musculus
ctggacaacattactctgagctgca

SEQ ID NO: 385614 - DNA, 25 bp, Mus musculus
ctggacaacatttctctgagctgca

SEQ ID NO: 385615 - DNA, 25 bp, Mus musculus
ctggacaagaagcacgtgctgccca

SEQ ID NO: 385616 - DNA, 25 bp, Mus musculus
ctggacaagaaggacgtgctgccca

SEQ ID NO: 385617 - DNA, 25 bp, Mus musculus
ctggacaagaggaacggaagagcat

SEQ ID NO: 385618 - DNA, 25 bp, Mus musculus
ctggacaagaggtacggaagagcat

SEQ ID NO: 385619 - DNA, 25 bp, Mus musculus
ctggacacacgcctgatgcctgctg

SEQ ID NO: 385620 - DNA, 25 bp, Mus musculus
ctggacacacgcgtgatgcctgctg

SEQ ID NO: 385621 - DNA, 25 bp, Mus musculus
ctggacacacggacacagacacctg

SEQ ID NO: 385622 - DNA, 25 bp, Mus musculus
ctggacacacggtcacagacacctg

SEQ ID NO: 385623 - DNA, 25 bp, Mus musculus
ctggacacactgaagggagtttaga

SEQ ID NO: 385624 - DNA, 25 bp, Mus musculus
ctggacacactgtagggagtttaga

SEQ ID NO: 385625 - DNA, 25 bp, Mus musculus
ctggacaccaagattttcactctta

SEQ ID NO: 385626 - DNA, 25 bp, Mus musculus
ctggacaccaagtttttcactctta

SEQ ID NO: 385627 - DNA, 25 bp, Mus musculus
ctggacaccaccaagatttctgttt

SEQ ID NO: 385628 - DNA, 25 bp, Mus musculus
ctggacaccaccacttcacagaagt

SEQ ID NO: 385629 - DNA, 25 bp, Mus musculus
ctggacaccacctagatttctgttt

SEQ ID NO: 385630 - DNA, 25 bp, Mus musculus
ctggacaccacctcttcacagaagt

SEQ ID NO: 385631 - DNA, 25 bp, Mus musculus
ctggacaccagtcgtctaccggaga

SEQ ID NO: 385632 - DNA, 25 bp, Mus musculus
ctggacaccagtggtctaccggaga

SEQ ID NO: 385633 - DNA, 25 bp, Mus musculus
ctggacaccttacaggaccctatga

SEQ ID NO: 385634 - DNA, 25 bp, Mus musculus
ctggacaccttagaggaccctatga

SEQ ID NO: 385635 - DNA, 25 bp, Mus musculus
ctggacaccttcagcaaagaccctg

SEQ ID NO: 385636 - DNA, 25 bp, Mus musculus
ctggacaccttctgcaaagaccctg

SEQ ID NO: 385637 - DNA, 25 bp, Mus musculus
ctggacacgcacaactggacttgga

SEQ ID NO: 385638 - DNA, 25 bp, Mus musculus
ctggacacgcactactggacttgga

SEQ ID NO: 385639 - DNA, 25 bp, Mus musculus
ctggacagaagcctggacacccctg

SEQ ID NO: 385640 - DNA, 25 bp, Mus musculus
ctggacagaagcgtggacacccctg

SEQ ID NO: 385641 - DNA, 25 bp, Mus musculus
ctggacagagaaacgatcgctactt

SEQ ID NO: 385642 - DNA, 25 bp, Mus musculus
ctggacagagaatcgatcgctactt

SEQ ID NO: 385643 - DNA, 25 bp, Mus musculus
ctggacagatacatggtgaacactt

SEQ ID NO: 385644 - DNA, 25 bp, Mus musculus
ctggacagatacttggtgaacactt

SEQ ID NO: 385645 - DNA, 25 bp, Mus musculus
ctggacagccccagcctgaatctaa

SEQ ID NO: 385646 - DNA, 25 bp, Mus musculus
ctggacagcccctgcctgaatctaa

SEQ ID NO: 385647 - DNA, 25 bp, Mus musculus
ctggacatgctgacggctgtgccga

SEQ ID NO: 385648 - DNA, 25 bp, Mus musculus
ctggacatgctgagtagacccttga

SEQ ID NO: 385649 - DNA, 25 bp, Mus musculus
ctggacatgctgtcggctgtgccga

SEQ ID NO: 385650 - DNA, 25 bp, Mus musculus
ctggacatgctgtgtagacccttga

SEQ ID NO: 385651 - DNA, 25 bp, Mus musculus
ctggacatgggaaccaagccaatgt

SEQ ID NO: 385652 - DNA, 25 bp, Mus musculus
ctggacatgggatccaagccaatgt

SEQ ID NO: 385653 - DNA, 25 bp, Mus musculus
ctggacatgggtcagtcagcctcga

SEQ ID NO: 385654 - DNA, 25 bp, Mus musculus
ctggacatgggtgagtcagcctcga

SEQ ID NO: 385655 - DNA, 25 bp, Mus musculus
ctggacatgtaaagcttttgtatca

SEQ ID NO: 385656 - DNA, 25 bp, Mus musculus
ctggacatgtaatgcttttgtatca

SEQ ID NO: 385657 - DNA, 25 bp, Mus musculus
ctggacattactcctaccatataca

SEQ ID NO: 385658 - DNA, 25 bp, Mus musculus
ctggacattactgctaccatataca

SEQ ID NO: 385659 - DNA, 25 bp, Mus musculus
ctggacattcggctacaagagactc

SEQ ID NO: 385660 - DNA, 25 bp, Mus musculus
ctggacattcgggtacaagagactc

SEQ ID NO: 385661 - DNA, 25 bp, Mus musculus
ctggacatttacctcagtgtagcaa

SEQ ID NO: 385662 - DNA, 25 bp, Mus musculus
ctggacatttacgtcagtgtagcaa

SEQ ID NO: 385663 - DNA, 25 bp, Mus musculus
ctggacatttagaatactgtaacct

SEQ ID NO: 385664 - DNA, 25 bp, Mus musculus
ctggacatttagtatactgtaacct

SEQ ID NO: 385665 - DNA, 25 bp, Mus musculus
ctggacattttgcaacgccaaaggg

SEQ ID NO: 385666 - DNA, 25 bp, Mus musculus
ctggacattttggaacgccaaaggg

SEQ ID NO: 385667 - DNA, 25 bp, Mus musculus
ctggaccaaaggaagccaagtgcta

SEQ ID NO: 385668 - DNA, 25 bp, Mus musculus
ctggaccaaaggtagccaagtgcta

SEQ ID NO: 385669 - DNA, 25 bp, Mus musculus
ctggaccaacctcaacacattagat

SEQ ID NO: 385670 - DNA, 25 bp, Mus musculus
ctggaccaacctgaacacattagat

SEQ ID NO: 385671 - DNA, 25 bp, Mus musculus
ctggaccacccgcagctgcggtaag

SEQ ID NO: 385672 - DNA, 25 bp, Mus musculus
ctggaccacccggagctgcggtaag

SEQ ID NO: 385673 - DNA, 25 bp, Mus musculus
ctggaccacggaacgcaaagtacat

SEQ ID NO: 385674 - DNA, 25 bp, Mus musculus
ctggaccacggatcgcaaagtacat

SEQ ID NO: 385675 - DNA, 25 bp, Mus musculus
ctggaccagccactactatatagtg

SEQ ID NO: 385676 - DNA, 25 bp, Mus musculus
ctggaccagccagtactatatagtg

SEQ ID NO: 385677 - DNA, 25 bp, Mus musculus
ctggaccaggctacccgggaagtca

SEQ ID NO: 385678 - DNA, 25 bp, Mus musculus
ctggaccaggcttcccgggaagtca

SEQ ID NO: 385679 - DNA, 25 bp, Mus musculus
ctggaccagtacaacttgttgcagg

SEQ ID NO: 385680 - DNA, 25 bp, Mus musculus
ctggaccagtactacttgttgcagg

SEQ ID NO: 385681 - DNA, 25 bp, Mus musculus
ctggaccatcgtccctataagtgta

SEQ ID NO: 385682 - DNA, 25 bp, Mus musculus
ctggaccatcgtgcctataagtgta

SEQ ID NO: 385683 - DNA, 25 bp, Mus musculus
ctggaccattagcaaccatgtttta

SEQ ID NO: 385684 - DNA, 25 bp, Mus musculus
ctggaccattaggaaccatgtttta

SEQ ID NO: 385685 - DNA, 25 bp, Mus musculus
ctggacccaaggctctggccatgct

SEQ ID NO: 385686 - DNA, 25 bp, Mus musculus
ctggacccaagggtctggccatgct

SEQ ID NO: 385687 - DNA, 25 bp, Mus musculus
ctggacccagggacgctgttaagag

SEQ ID NO: 385688 - DNA, 25 bp, Mus musculus
ctggacccagggtcgctgttaagag

SEQ ID NO: 385689 - DNA, 25 bp, Mus musculus
ctggaccctggacacttccttgtgc

SEQ ID NO: 385690 - DNA, 25 bp, Mus musculus
ctggaccctggagacttccttgtgc

SEQ ID NO: 385691 - DNA, 25 bp, Mus musculus
ctggaccctgggagtttacactaga

SEQ ID NO: 385692 - DNA, 25 bp, Mus musculus
ctggaccctgggtgtttacactaga

SEQ ID NO: 385693 - DNA, 25 bp, Mus musculus
ctggaccggttcaggaccatggtga

SEQ ID NO: 385694 - DNA, 25 bp, Mus musculus
ctggaccggttctggaccatggtga

SEQ ID NO: 385695 - DNA, 25 bp, Mus musculus
ctggacctacacagcatcagaacta

SEQ ID NO: 385696 - DNA, 25 bp, Mus musculus
ctggacctacactgcatcagaacta

SEQ ID NO: 385697 - DNA, 25 bp, Mus musculus
ctggacctcaggctgagcagctagt

SEQ ID NO: 385698 - DNA, 25 bp, Mus musculus
ctggacctcagggtgagcagctagt

SEQ ID NO: 385699 - DNA, 25 bp, Mus musculus
ctggacctccctattggcctaggag

SEQ ID NO: 385700 - DNA, 25 bp, Mus musculus
ctggacctcccttttggcctaggag

SEQ ID NO: 385701 - DNA, 25 bp, Mus musculus
ctggacctctgtcgcgtctttgaag

SEQ ID NO: 385702 - DNA, 25 bp, Mus musculus
ctggacctctgtggcgtctttgaag

SEQ ID NO: 385703 - DNA, 25 bp, Mus musculus
ctggacctgagtagtgcccacactt

SEQ ID NO: 385704 - DNA, 25 bp, Mus musculus
ctggacctgagttgtgcccacactt

SEQ ID NO: 385705 - DNA, 25 bp, Mus musculus
ctggacctggtcaccgtgataggat

SEQ ID NO: 385706 - DNA, 25 bp, Mus musculus
ctggacctggtcatgaggaggacac

SEQ ID NO: 385707 - DNA, 25 bp, Mus musculus
ctggacctggtctccgtgataggat

SEQ ID NO: 385708 - DNA, 25 bp, Mus musculus
ctggacctggtcttgaggaggacac

SEQ ID NO: 385709 - DNA, 25 bp, Mus musculus
ctggacctgtatcactcgcaaagca

SEQ ID NO: 385710 - DNA, 25 bp, Mus musculus
ctggacctgtatgactcgcaaagca

SEQ ID NO: 385711 - DNA, 25 bp, Mus musculus
ctggacctgtgtcgttcacttgaca

SEQ ID NO: 385712 - DNA, 25 bp, Mus musculus
ctggacctgtgtggttcacttgaca

SEQ ID NO: 385713 - DNA, 25 bp, Mus musculus
ctggacgacctgatgcagactattg

SEQ ID NO: 385714 - DNA, 25 bp, Mus musculus
ctggacgacctgttgcagactattg

SEQ ID NO: 385715 - DNA, 25 bp, Mus musculus
ctggacgaggaccagcatggcttac

SEQ ID NO: 385716 - DNA, 25 bp, Mus musculus
ctggacgaggacgagcatggcttac

SEQ ID NO: 385717 - DNA, 25 bp, Mus musculus
ctggacgaggtgctgccaccctcta

SEQ ID NO: 385718 - DNA, 25 bp, Mus musculus
ctggacgaggtggtgccaccctcta

SEQ ID NO: 385719 - DNA, 25 bp, Mus musculus
ctggacgcattgacagagggacagc

SEQ ID NO: 385720 - DNA, 25 bp, Mus musculus
ctggacgcattgtcagagggacagc

SEQ ID NO: 385721 - DNA, 25 bp, Mus musculus
ctggacgccactcccttaagcattg

SEQ ID NO: 385722 - DNA, 25 bp, Mus musculus
ctggacgccactgccttaagcattg

SEQ ID NO: 385723 - DNA, 25 bp, Mus musculus
ctggacgcccacattgaagaactga

SEQ ID NO: 385724 - DNA, 25 bp, Mus musculus
ctggacgcccactttgaagaactga

SEQ ID NO: 385725 - DNA, 25 bp, Mus musculus
ctggacgggacaacttagcaacaaa

SEQ ID NO: 385726 - DNA, 25 bp, Mus musculus
ctggacgggacatcttagcaacaaa

SEQ ID NO: 385727 - DNA, 25 bp, Mus musculus
ctggacgtttctcatatgtgtggtg

SEQ ID NO: 385728 - DNA, 25 bp, Mus musculus
ctggacgtttctcatcagtagagaa

SEQ ID NO: 385729 - DNA, 25 bp, Mus musculus
ctggacgtttctgatatgtgtggtg

SEQ ID NO: 385730 - DNA, 25 bp, Mus musculus
ctggacgtttctgatcagtagagaa

SEQ ID NO: 385731 - DNA, 25 bp, Mus musculus
ctggactaagttccgggtctctcta

SEQ ID NO: 385732 - DNA, 25 bp, Mus musculus
ctggactaagttgcgggtctctcta

SEQ ID NO: 385733 - DNA, 25 bp, Mus musculus
ctggactagataccaaccctgtctc

SEQ ID NO: 385734 - DNA, 25 bp, Mus musculus
ctggactagatagcaaccctgtctc

SEQ ID NO: 385735 - DNA, 25 bp, Mus musculus
ctggactcacatccaggctgaggga

SEQ ID NO: 385736 - DNA, 25 bp, Mus musculus
ctggactcacatgcaggctgaggga

SEQ ID NO: 385737 - DNA, 25 bp, Mus musculus
ctggactcagatatctcatctgtga

SEQ ID NO: 385738 - DNA, 25 bp, Mus musculus
ctggactcagatttctcatctgtga

SEQ ID NO: 385739 - DNA, 25 bp, Mus musculus
ctggactcccttatatttgacaact

SEQ ID NO: 385740 - DNA, 25 bp, Mus musculus
ctggactcccttttatttgacaact

SEQ ID NO: 385741 - DNA, 25 bp, Mus musculus
ctggactcctatacaaatttatttg

SEQ ID NO: 385742 - DNA, 25 bp, Mus musculus
ctggactcctattcaaatttatttg

SEQ ID NO: 385743 - DNA, 25 bp, Mus musculus
ctggactccttcagagtggttgggt

SEQ ID NO: 385744 - DNA, 25 bp, Mus musculus
ctggactccttctgagtggttgggt

SEQ ID NO: 385745 - DNA, 25 bp, Mus musculus
ctggactcggcacactctttaggag

SEQ ID NO: 385746 - DNA, 25 bp, Mus musculus
ctggactcggcagactctttaggag

SEQ ID NO: 385747 - DNA, 25 bp, Mus musculus
ctggactctgacattgggttaatat

SEQ ID NO: 385748 - DNA, 25 bp, Mus musculus
ctggactctgactttgggttaatat

SEQ ID NO: 385749 - DNA, 25 bp, Mus musculus
ctggactctgctaaaaggtgtacac

SEQ ID NO: 385750 - DNA, 25 bp, Mus musculus
ctggactctgcttaaaggtgtacac

SEQ ID NO: 385751 - DNA, 25 bp, Mus musculus
ctggactcttgcactgtagctaggt

SEQ ID NO: 385752 - DNA, 25 bp, Mus musculus
ctggactcttgctctgtagctaggt

SEQ ID NO: 385753 - DNA, 25 bp, Mus musculus
ctggactctttcaacacggtgttga

SEQ ID NO: 385754 - DNA, 25 bp, Mus musculus
ctggactctttctacacggtgttga

SEQ ID NO: 385755 - DNA, 25 bp, Mus musculus
ctggactcttttcagaccaacactg

SEQ ID NO: 385756 - DNA, 25 bp, Mus musculus
ctggactcttttgagaccaacactg

SEQ ID NO: 385757 - DNA, 25 bp, Mus musculus
ctggactggaacagtagcctgcgca

SEQ ID NO: 385758 - DNA, 25 bp, Mus musculus
ctggactggaactgtagcctgcgca

SEQ ID NO: 385759 - DNA, 25 bp, Mus musculus
ctggactggctaagagctcaaaact

SEQ ID NO: 385760 - DNA, 25 bp, Mus musculus
ctggactggctatgagctcaaaact

SEQ ID NO: 385761 - DNA, 25 bp, Mus musculus
ctggactggctgatggcaaacctgt

SEQ ID NO: 385762 - DNA, 25 bp, Mus musculus
ctggactggctgttggcaaacctgt

SEQ ID NO: 385763 - DNA, 25 bp, Mus musculus
ctggactgtacacctggcaggaaat

SEQ ID NO: 385764 - DNA, 25 bp, Mus musculus
ctggactgtacagctggcaggaaat

SEQ ID NO: 385765 - DNA, 25 bp, Mus musculus
ctggactgtcccacacaaagaagtg

SEQ ID NO: 385766 - DNA, 25 bp, Mus musculus
ctggactgtccctcacaaagaagtg

SEQ ID NO: 385767 - DNA, 25 bp, Mus musculus
ctggactgttgcataaagtaaacaa

SEQ ID NO: 385768 - DNA, 25 bp, Mus musculus
ctggactgttgcttaaagtaaacaa

SEQ ID NO: 385769 - DNA, 25 bp, Mus musculus
ctggacttacagaactgccaaatct

SEQ ID NO: 385770 - DNA, 25 bp, Mus musculus
ctggacttacagtactgccaaatct

SEQ ID NO: 385771 - DNA, 25 bp, Mus musculus
ctggacttctaacgtctcctttggg

SEQ ID NO: 385772 - DNA, 25 bp, Mus musculus
ctggacttctaaggtctcctttggg

SEQ ID NO: 385773 - DNA, 25 bp, Mus musculus
ctggacttctggacccttgtgaaaa

SEQ ID NO: 385774 - DNA, 25 bp, Mus musculus
ctggacttctggtcccttgtgaaaa

SEQ ID NO: 385775 - DNA, 25 bp, Mus musculus
ctggacttgcccatgggtgacgtcc

SEQ ID NO: 385776 - DNA, 25 bp, Mus musculus
ctggacttgcccttgggtgacgtcc

SEQ ID NO: 385777 - DNA, 25 bp, Mus musculus
ctggactttgtgaacggatgcggaa

SEQ ID NO: 385778 - DNA, 25 bp, Mus musculus
ctggactttgtgtacggatgcggaa

SEQ ID NO: 385779 - DNA, 25 bp, Mus musculus
ctggactttgttcgctctggacttt

SEQ ID NO: 385780 - DNA, 25 bp, Mus musculus
ctggactttgttggctctggacttt

SEQ ID NO: 385781 - DNA, 25 bp, Mus musculus
ctggagaaaagtcccatgtcctctg

SEQ ID NO: 385782 - DNA, 25 bp, Mus musculus
ctggagaaaagtgccatgtcctctg

SEQ ID NO: 385783 - DNA, 25 bp, Mus musculus
ctggagaaatatacaccggttaaga

SEQ ID NO: 385784 - DNA, 25 bp, Mus musculus
ctggagaaatattcaccggttaaga

SEQ ID NO: 385785 - DNA, 25 bp, Mus musculus
ctggagaaattaccttcaccacttt

SEQ ID NO: 385786 - DNA, 25 bp, Mus musculus
ctggagaaattagcttcaccacttt

SEQ ID NO: 385787 - DNA, 25 bp, Mus musculus
ctggagaaccacatgctgtaggagt

SEQ ID NO: 385788 - DNA, 25 bp, Mus musculus
ctggagaaccacttgctgtaggagt

SEQ ID NO: 385789 - DNA, 25 bp, Mus musculus
ctggagaataacctggaggagacca

SEQ ID NO: 385790 - DNA, 25 bp, Mus musculus
ctggagaataacgtggaggagacca

SEQ ID NO: 385791 - DNA, 25 bp, Mus musculus
ctggagacaaagatctgtttaccct

SEQ ID NO: 385792 - DNA, 25 bp, Mus musculus
ctggagacaaagcatagtggttaag

SEQ ID NO: 385793 - DNA, 25 bp, Mus musculus
ctggagacaaaggatagtggttaag

SEQ ID NO: 385794 - DNA, 25 bp, Mus musculus
ctggagacaaagttctgtttaccct

SEQ ID NO: 385795 - DNA, 25 bp, Mus musculus
ctggagacaagacacacaacctgag

SEQ ID NO: 385796 - DNA, 25 bp, Mus musculus
ctggagacaagagacacaacctgag

SEQ ID NO: 385797 - DNA, 25 bp, Mus musculus
ctggagacacacatggaaaagcctg

SEQ ID NO: 385798 - DNA, 25 bp, Mus musculus
ctggagacacacttggaaaagcctg

SEQ ID NO: 385799 - DNA, 25 bp, Mus musculus
ctggagacattgaagcattagacac

SEQ ID NO: 385800 - DNA, 25 bp, Mus musculus
ctggagacattgtagcattagacac

SEQ ID NO: 385801 - DNA, 25 bp, Mus musculus
ctggagacatttagaaagacttgcc

SEQ ID NO: 385802 - DNA, 25 bp, Mus musculus
ctggagacattttgaaagacttgcc

SEQ ID NO: 385803 - DNA, 25 bp, Mus musculus
ctggagaccaagctgtgtgaccagc

SEQ ID NO: 385804 - DNA, 25 bp, Mus musculus
ctggagaccaaggtgtgtgaccagc

SEQ ID NO: 385805 - DNA, 25 bp, Mus musculus
ctggagaccaggacgcaccggccga

SEQ ID NO: 385806 - DNA, 25 bp, Mus musculus
ctggagaccaggagccatgactctg

SEQ ID NO: 385807 - DNA, 25 bp, Mus musculus
ctggagaccaggtcgcaccggccga

SEQ ID NO: 385808 - DNA, 25 bp, Mus musculus
ctggagaccaggtgccatgactctg

SEQ ID NO: 385809 - DNA, 25 bp, Mus musculus
ctggagaccctacgagtaaacgtga

SEQ ID NO: 385810 - DNA, 25 bp, Mus musculus
ctggagaccctaggagtaaacgtga

SEQ ID NO: 385811 - DNA, 25 bp, Mus musculus
ctggagacgataccacggaggcccc

SEQ ID NO: 385812 - DNA, 25 bp, Mus musculus
ctggagacgatagcacggaggcccc

SEQ ID NO: 385813 - DNA, 25 bp, Mus musculus
ctggagactaaaattactcttttgc

SEQ ID NO: 385814 - DNA, 25 bp, Mus musculus
ctggagactaaatttactcttttgc

SEQ ID NO: 385815 - DNA, 25 bp, Mus musculus
ctggagacttgaagctgatttgtac

SEQ ID NO: 385816 - DNA, 25 bp, Mus musculus
ctggagacttgatgctgatttgtac

SEQ ID NO: 385817 - DNA, 25 bp, Mus musculus
ctggagacttgtagcattcatttgt

SEQ ID NO: 385818 - DNA, 25 bp, Mus musculus
ctggagacttgttgcattcatttgt

SEQ ID NO: 385819 - DNA, 25 bp, Mus musculus
ctggagactttactagactctgtta

SEQ ID NO: 385820 - DNA, 25 bp, Mus musculus
ctggagactttagtagactctgtta

SEQ ID NO: 385821 - DNA, 25 bp, Mus musculus
ctggagacttttcgcttagctcctg

SEQ ID NO: 385822 - DNA, 25 bp, Mus musculus
ctggagacttttggcttagctcctg

SEQ ID NO: 385823 - DNA, 25 bp, Mus musculus
ctggagagaattccttcctcagacc

SEQ ID NO: 385824 - DNA, 25 bp, Mus musculus
ctggagagaattgcttcctcagacc

SEQ ID NO: 385825 - DNA, 25 bp, Mus musculus
ctggagagagtgatggctgttcttc

SEQ ID NO: 385826 - DNA, 25 bp, Mus musculus
ctggagagagtgttggctgttcttc

SEQ ID NO: 385827 - DNA, 25 bp, Mus musculus
ctggagagcccaccccactatgggt

SEQ ID NO: 385828 - DNA, 25 bp, Mus musculus
ctggagagcccagcccactatgggt

SEQ ID NO: 385829 - DNA, 25 bp, Mus musculus
ctggagagcgatcaccactcaggtg

SEQ ID NO: 385830 - DNA, 25 bp, Mus musculus
ctggagagcgatgaccactcaggtg

SEQ ID NO: 385831 - DNA, 25 bp, Mus musculus
ctggagagctgacactgtgtgtcat

SEQ ID NO: 385832 - DNA, 25 bp, Mus musculus
ctggagagctgagactgtgtgtcat

SEQ ID NO: 385833 - DNA, 25 bp, Mus musculus
ctggagagggccagtgctgccactg

SEQ ID NO: 385834 - DNA, 25 bp, Mus musculus
ctggagagggcctgtgctgccactg

SEQ ID NO: 385835 - DNA, 25 bp, Mus musculus
ctggagataagcatgaccttgaaac

SEQ ID NO: 385836 - DNA, 25 bp, Mus musculus
ctggagataagcttgaccttgaaac

SEQ ID NO: 385837 - DNA, 25 bp, Mus musculus
ctggagatagttccttaggctacat

SEQ ID NO: 385838 - DNA, 25 bp, Mus musculus
ctggagatagttgcttaggctacat

SEQ ID NO: 385839 - DNA, 25 bp, Mus musculus
ctggagatccctaggattctgacct

SEQ ID NO: 385840 - DNA, 25 bp, Mus musculus
ctggagatcccttggattctgacct

SEQ ID NO: 385841 - DNA, 25 bp, Mus musculus
ctggagatcttgaaccctaggtatg

SEQ ID NO: 385842 - DNA, 25 bp, Mus musculus
ctggagatcttgtaccctaggtatg

SEQ ID NO: 385843 - DNA, 25 bp, Mus musculus
ctggagatggctacctgcaggcagt

SEQ ID NO: 385844 - DNA, 25 bp, Mus musculus
ctggagatggcttcctgcaggcagt

SEQ ID NO: 385845 - DNA, 25 bp, Mus musculus
ctggagatggttatacttcttcttc

SEQ ID NO: 385846 - DNA, 25 bp, Mus musculus
ctggagatggttttacttcttcttc

SEQ ID NO: 385847 - DNA, 25 bp, Mus musculus
ctggagattgatcctacagccctga

SEQ ID NO: 385848 - DNA, 25 bp, Mus musculus
ctggagattgatgctacagccctga

SEQ ID NO: 385849 - DNA, 25 bp, Mus musculus
ctggagcacccaagtcccttatgct

SEQ ID NO: 385850 - DNA, 25 bp, Mus musculus
ctggagcacccatgtcccttatgct

SEQ ID NO: 385851 - DNA, 25 bp, Mus musculus
ctggagcagactagtgttgagaatc

SEQ ID NO: 385852 - DNA, 25 bp, Mus musculus
ctggagcagacttgtgttgagaatc

SEQ ID NO: 385853 - DNA, 25 bp, Mus musculus
ctggagccacagacatattttatta

SEQ ID NO: 385854 - DNA, 25 bp, Mus musculus
ctggagccacagtcatattttatta

SEQ ID NO: 385855 - DNA, 25 bp, Mus musculus
ctggagccagctcatcttgttaaag

SEQ ID NO: 385856 - DNA, 25 bp, Mus musculus
ctggagccagctgatcttgttaaag

SEQ ID NO: 385857 - DNA, 25 bp, Mus musculus
ctggagccatctctgcagggtgata

SEQ ID NO: 385858 - DNA, 25 bp, Mus musculus
ctggagccatctgtgcagggtgata

SEQ ID NO: 385859 - DNA, 25 bp, Mus musculus
ctggagccatttccaccgtctgaca

SEQ ID NO: 385860 - DNA, 25 bp, Mus musculus
ctggagccatttgcaccgtctgaca

SEQ ID NO: 385861 - DNA, 25 bp, Mus musculus
ctggagcccggaatgttgttcatat

SEQ ID NO: 385862 - DNA, 25 bp, Mus musculus
ctggagcccggattgttgttcatat

SEQ ID NO: 385863 - DNA, 25 bp, Mus musculus
ctggagcctcacagtagcatcactg

SEQ ID NO: 385864 - DNA, 25 bp, Mus musculus
ctggagcctcactgtagcatcactg

SEQ ID NO: 385865 - DNA, 25 bp, Mus musculus
ctggagccttgcaactgggtcaggt

SEQ ID NO: 385866 - DNA, 25 bp, Mus musculus
ctggagccttgctactgggtcaggt

SEQ ID NO: 385867 - DNA, 25 bp, Mus musculus
ctggagcgatagatggctcagggct

SEQ ID NO: 385868 - DNA, 25 bp, Mus musculus
ctggagcgatagttggctcagggct

SEQ ID NO: 385869 - DNA, 25 bp, Mus musculus
ctggagcgcaaacgcatgagcaaga

SEQ ID NO: 385870 - DNA, 25 bp, Mus musculus
ctggagcgcaaaggcatgagcaaga

SEQ ID NO: 385871 - DNA, 25 bp, Mus musculus
ctggagcgcagcagctactggaaat

SEQ ID NO: 385872 - DNA, 25 bp, Mus musculus
ctggagcgcagctgctactggaaat

SEQ ID NO: 385873 - DNA, 25 bp, Mus musculus
ctggagcggctcaccgacagactgc

SEQ ID NO: 385874 - DNA, 25 bp, Mus musculus
ctggagcggctctccgacagactgc

SEQ ID NO: 385875 - DNA, 25 bp, Mus musculus
ctggagctatccctagtatctgtta

SEQ ID NO: 385876 - DNA, 25 bp, Mus musculus
ctggagctatccgtagtatctgtta

SEQ ID NO: 385877 - DNA, 25 bp, Mus musculus
ctggagctcaacactgtcagcaact

SEQ ID NO: 385878 - DNA, 25 bp, Mus musculus
ctggagctcaactctgtcagcaact

SEQ ID NO: 385879 - DNA, 25 bp, Mus musculus
ctggagctgaccctgaaagcaaggc

SEQ ID NO: 385880 - DNA, 25 bp, Mus musculus
ctggagctgaccgtgaaagcaaggc

SEQ ID NO: 385881 - DNA, 25 bp, Mus musculus
ctggagctgcacaccgagctgttgg

SEQ ID NO: 385882 - DNA, 25 bp, Mus musculus
ctggagctgcactccgagctgttgg

SEQ ID NO: 385883 - DNA, 25 bp, Mus musculus
ctggagctgcgcattgaggctgcac

SEQ ID NO: 385884 - DNA, 25 bp, Mus musculus
ctggagctgcgctttgaggctgcac

SEQ ID NO: 385885 - DNA, 25 bp, Mus musculus
ctggagctgctcacacagtgccggg

SEQ ID NO: 385886 - DNA, 25 bp, Mus musculus
ctggagctgctcatactctcaaatt

SEQ ID NO: 385887 - DNA, 25 bp, Mus musculus
ctggagctgctctcacagtgccggg

SEQ ID NO: 385888 - DNA, 25 bp, Mus musculus
ctggagctgctcttactctcaaatt

SEQ ID NO: 385889 - DNA, 25 bp, Mus musculus
ctggagctggctctcaaagccttag

SEQ ID NO: 385890 - DNA, 25 bp, Mus musculus
ctggagctggctgtcaaagccttag

SEQ ID NO: 385891 - DNA, 25 bp, Mus musculus
ctggagctgtacagcatgcatgagt

SEQ ID NO: 385892 - DNA, 25 bp, Mus musculus
ctggagctgtactgcatgcatgagt

SEQ ID NO: 385893 - DNA, 25 bp, Mus musculus
ctggagctgtggcacacctggtaca

SEQ ID NO: 385894 - DNA, 25 bp, Mus musculus
ctggagctgtgggacacctggtaca

SEQ ID NO: 385895 - DNA, 25 bp, Mus musculus
ctggagctgttgcttggcagccaac

SEQ ID NO: 385896 - DNA, 25 bp, Mus musculus
ctggagctgttggttggcagccaac

SEQ ID NO: 385897 - DNA, 25 bp, Mus musculus
ctggagcttggcaggaactggcata

SEQ ID NO: 385898 - DNA, 25 bp, Mus musculus
ctggagcttggctggaactggcata

SEQ ID NO: 385899 - DNA, 25 bp, Mus musculus
ctggagctttgccttaacacaaata

SEQ ID NO: 385900 - DNA, 25 bp, Mus musculus
ctggagctttgcgttaacacaaata

SEQ ID NO: 385901 - DNA, 25 bp, Mus musculus
ctggaggaactcagcctggaagtca

SEQ ID NO: 385902 - DNA, 25 bp, Mus musculus
ctggaggaactctgcctggaagtca

SEQ ID NO: 385903 - DNA, 25 bp, Mus musculus
ctggaggacaggcatcaagttctta

SEQ ID NO: 385904 - DNA, 25 bp, Mus musculus
ctggaggacagggatcaagttctta

SEQ ID NO: 385905 - DNA, 25 bp, Mus musculus
ctggaggaccagagtaccgagtata

SEQ ID NO: 385906 - DNA, 25 bp, Mus musculus
ctggaggaccagatcacgctcgtga

SEQ ID NO: 385907 - DNA, 25 bp, Mus musculus
ctggaggaccagtgtaccgagtata

SEQ ID NO: 385908 - DNA, 25 bp, Mus musculus
ctggaggaccagttcacgctcgtga

SEQ ID NO: 385909 - DNA, 25 bp, Mus musculus
ctggaggaccgaaccgactaatgtt

SEQ ID NO: 385910 - DNA, 25 bp, Mus musculus
ctggaggaccgatccgactaatgtt

SEQ ID NO: 385911 - DNA, 25 bp, Mus musculus
ctggaggagactcttcaggccaagt

SEQ ID NO: 385912 - DNA, 25 bp, Mus musculus
ctggaggagactgttcaggccaagt

SEQ ID NO: 385913 - DNA, 25 bp, Mus musculus
ctggaggagccgcttctgaaacact

SEQ ID NO: 385914 - DNA, 25 bp, Mus musculus
ctggaggagccggttctgaaacact

SEQ ID NO: 385915 - DNA, 25 bp, Mus musculus
ctggaggagggtattcacttcccct

SEQ ID NO: 385916 - DNA, 25 bp, Mus musculus
ctggaggagggttttcacttcccct

SEQ ID NO: 385917 - DNA, 25 bp, Mus musculus
ctggaggagtccaggtaccttgctg

SEQ ID NO: 385918 - DNA, 25 bp, Mus musculus
ctggaggagtcctggtaccttgctg

SEQ ID NO: 385919 - DNA, 25 bp, Mus musculus
ctggaggatattacagttactctta

SEQ ID NO: 385920 - DNA, 25 bp, Mus musculus
ctggaggatatttcagttactctta

SEQ ID NO: 385921 - DNA, 25 bp, Mus musculus
ctggaggcaaaaccttgtggaatct

SEQ ID NO: 385922 - DNA, 25 bp, Mus musculus
ctggaggcaaaagcttgtggaatct

SEQ ID NO: 385923 - DNA, 25 bp, Mus musculus
ctggaggcacctcatgttcttttaa

SEQ ID NO: 385924 - DNA, 25 bp, Mus musculus
ctggaggcacctgatgttcttttaa

SEQ ID NO: 385925 - DNA, 25 bp, Mus musculus
ctggaggcatcgaagctgggatctt

SEQ ID NO: 385926 - DNA, 25 bp, Mus musculus
ctggaggcatcgtagctgggatctt

SEQ ID NO: 385927 - DNA, 25 bp, Mus musculus
ctggaggcattgatttcattgtggc

SEQ ID NO: 385928 - DNA, 25 bp, Mus musculus
ctggaggcattgttttcattgtggc

SEQ ID NO: 385929 - DNA, 25 bp, Mus musculus
ctggaggccaaacggctgtaatcac

SEQ ID NO: 385930 - DNA, 25 bp, Mus musculus
ctggaggccaaagggctgtaatcac

SEQ ID NO: 385931 - DNA, 25 bp, Mus musculus
ctggaggccattcagaaccacaacc

SEQ ID NO: 385932 - DNA, 25 bp, Mus musculus
ctggaggccattgagaaccacaacc

SEQ ID NO: 385933 - DNA, 25 bp, Mus musculus
ctggaggcccacctcaaaggttgat

SEQ ID NO: 385934 - DNA, 25 bp, Mus musculus
ctggaggcccacgtcaaaggttgat

SEQ ID NO: 385935 - DNA, 25 bp, Mus musculus
ctggaggcctcgacagcaactgtgc

SEQ ID NO: 385936 - DNA, 25 bp, Mus musculus
ctggaggcctcgtcagcaactgtgc

SEQ ID NO: 385937 - DNA, 25 bp, Mus musculus
ctggaggctactcgttggagatctt

SEQ ID NO: 385938 - DNA, 25 bp, Mus musculus
ctggaggctactggttggagatctt

SEQ ID NO: 385939 - DNA, 25 bp, Mus musculus
ctggaggctcaaaagatgcaaagaa

SEQ ID NO: 385940 - DNA, 25 bp, Mus musculus
ctggaggctcaatagatgcaaagaa

SEQ ID NO: 385941 - DNA, 25 bp, Mus musculus
ctggaggctggaaacaacacataat

SEQ ID NO: 385942 - DNA, 25 bp, Mus musculus
ctggaggctggatacaacacataat

SEQ ID NO: 385943 - DNA, 25 bp, Mus musculus
ctggaggcttctagctagggaagta

SEQ ID NO: 385944 - DNA, 25 bp, Mus musculus
ctggaggcttcttgctagggaagta

SEQ ID NO: 385945 - DNA, 25 bp, Mus musculus
ctggaggcttgcacttctggggtcc

SEQ ID NO: 385946 - DNA, 25 bp, Mus musculus
ctggaggcttgctcttctggggtcc

SEQ ID NO: 385947 - DNA, 25 bp, Mus musculus
ctggaggcttttatgtctcagtgct

SEQ ID NO: 385948 - DNA, 25 bp, Mus musculus
ctggaggcttttttgtctcagtgct

SEQ ID NO: 385949 - DNA, 25 bp, Mus musculus
ctggagggtggtctacccaccaaga

SEQ ID NO: 385950 - DNA, 25 bp, Mus musculus
ctggagggtggtgtacccaccaaga

SEQ ID NO: 385951 - DNA, 25 bp, Mus musculus
ctggagggtttgactacagtcagtg

SEQ ID NO: 385952 - DNA, 25 bp, Mus musculus
ctggagggtttgtctacagtcagtg

SEQ ID NO: 385953 - DNA, 25 bp, Mus musculus
ctggaggtacctcccaggacattgg

SEQ ID NO: 385954 - DNA, 25 bp, Mus musculus
ctggaggtacctgccaggacattgg

SEQ ID NO: 385955 - DNA, 25 bp, Mus musculus
ctggaggtagtcatagctggttctt

SEQ ID NO: 385956 - DNA, 25 bp, Mus musculus
ctggaggtagtcttagctggttctt

SEQ ID NO: 385957 - DNA, 25 bp, Mus musculus
ctggaggtctccatgagtcttccac

SEQ ID NO: 385958 - DNA, 25 bp, Mus musculus
ctggaggtctccttgagtcttccac

SEQ ID NO: 385959 - DNA, 25 bp, Mus musculus
ctggaggtggctcgatctcagtctc

SEQ ID NO: 385960 - DNA, 25 bp, Mus musculus
ctggaggtggctggatctcagtctc

SEQ ID NO: 385961 - DNA, 25 bp, Mus musculus
ctggaggtgtccaaagtgtgtcatg

SEQ ID NO: 385962 - DNA, 25 bp, Mus musculus
ctggaggtgtcctaagtgtgtcatg

SEQ ID NO: 385963 - DNA, 25 bp, Mus musculus
ctggaggttcatccactgccaaaat

SEQ ID NO: 385964 - DNA, 25 bp, Mus musculus
ctggaggttcatgcactgccaaaat

SEQ ID NO: 385965 - DNA, 25 bp, Mus musculus
ctggagtaaattctgtagaacactg

SEQ ID NO: 385966 - DNA, 25 bp, Mus musculus
ctggagtaaattgtgtagaacactg

SEQ ID NO: 385967 - DNA, 25 bp, Mus musculus
ctggagtactcacacagacactgga

SEQ ID NO: 385968 - DNA, 25 bp, Mus musculus
ctggagtactcagacagacactgga

SEQ ID NO: 385969 - DNA, 25 bp, Mus musculus
ctggagtagcacactggcacagtac

SEQ ID NO: 385970 - DNA, 25 bp, Mus musculus
ctggagtagcactctggcacagtac

SEQ ID NO: 385971 - DNA, 25 bp, Mus musculus
ctggagtccagacgtagtggtttta

SEQ ID NO: 385972 - DNA, 25 bp, Mus musculus
ctggagtccagaggtagtggtttta

SEQ ID NO: 385973 - DNA, 25 bp, Mus musculus
ctggagtcccctaaagcacttagaa

SEQ ID NO: 385974 - DNA, 25 bp, Mus musculus
ctggagtccccttaagcacttagaa

SEQ ID NO: 385975 - DNA, 25 bp, Mus musculus
ctggagtccgcgcactcagactcgg

SEQ ID NO: 385976 - DNA, 25 bp, Mus musculus
ctggagtccgcggactcagactcgg

SEQ ID NO: 385977 - DNA, 25 bp, Mus musculus
ctggagtccgtcagggaatcttttt

SEQ ID NO: 385978 - DNA, 25 bp, Mus musculus
ctggagtccgtctgggaatcttttt

SEQ ID NO: 385979 - DNA, 25 bp, Mus musculus
ctggagtcctcaatattttgatgta

SEQ ID NO: 385980 - DNA, 25 bp, Mus musculus
ctggagtcctcattattttgatgta

SEQ ID NO: 385981 - DNA, 25 bp, Mus musculus
ctggagtcgccaagggtccacgtgt

SEQ ID NO: 385982 - DNA, 25 bp, Mus musculus
ctggagtcgccatgggtccacgtgt

SEQ ID NO: 385983 - DNA, 25 bp, Mus musculus
ctggagtcggcaagaccctgagcga

SEQ ID NO: 385984 - DNA, 25 bp, Mus musculus
ctggagtcggcatgaccctgagcga

SEQ ID NO: 385985 - DNA, 25 bp, Mus musculus
ctggagtctgctcaatgttttagag

SEQ ID NO: 385986 - DNA, 25 bp, Mus musculus
ctggagtctgctgaatgttttagag

SEQ ID NO: 385987 - DNA, 25 bp, Mus musculus
ctggagtctttcagtgcagctagaa

SEQ ID NO: 385988 - DNA, 25 bp, Mus musculus
ctggagtctttctgtgcagctagaa

SEQ ID NO: 385989 - DNA, 25 bp, Mus musculus
ctggagtgaaggagcctcttcgctt

SEQ ID NO: 385990 - DNA, 25 bp, Mus musculus
ctggagtgaaggtgcctcttcgctt

SEQ ID NO: 385991 - DNA, 25 bp, Mus musculus
ctggagtgcagactcttttcactaa

SEQ ID NO: 385992 - DNA, 25 bp, Mus musculus
ctggagtgcagagtcttttcactaa

SEQ ID NO: 385993 - DNA, 25 bp, Mus musculus
ctggagtgcatactgaggccttact

SEQ ID NO: 385994 - DNA, 25 bp, Mus musculus
ctggagtgcatagtgaggccttact

SEQ ID NO: 385995 - DNA, 25 bp, Mus musculus
ctggagtgcgaactgccgacataca

SEQ ID NO: 385996 - DNA, 25 bp, Mus musculus
ctggagtgcgaagtgccgacataca

SEQ ID NO: 385997 - DNA, 25 bp, Mus musculus
ctggagtgtccccagaggccttgtc

SEQ ID NO: 385998 - DNA, 25 bp, Mus musculus
ctggagtgtcccgagaggccttgtc

SEQ ID NO: 385999 - DNA, 25 bp, Mus musculus
ctggagtgtggtagttgcacgcctt

SEQ ID NO: 386000 - DNA, 25 bp, Mus musculus
ctggagtgtggttgttgcacgcctt

SEQ ID NO: 386001 - DNA, 25 bp, Mus musculus
ctggagtgtgtgacagacagcagac

SEQ ID NO: 386002 - DNA, 25 bp, Mus musculus
ctggagtgtgtgtcagacagcagac

SEQ ID NO: 386003 - DNA, 25 bp, Mus musculus
ctggagttactcattgcctggtgac

SEQ ID NO: 386004 - DNA, 25 bp, Mus musculus
ctggagttactctttgcctggtgac

SEQ ID NO: 386005 - DNA, 25 bp, Mus musculus
ctggagttactgctacctgtgcacg

SEQ ID NO: 386006 - DNA, 25 bp, Mus musculus
ctggagttactggtacctgtgcacg

SEQ ID NO: 386007 - DNA, 25 bp, Mus musculus
ctggagttagttctgtggtcaccaa

SEQ ID NO: 386008 - DNA, 25 bp, Mus musculus
ctggagttagttgtgtggtcaccaa

SEQ ID NO: 386009 - DNA, 25 bp, Mus musculus
ctggagttcagaaaatggatggctt

SEQ ID NO: 386010 - DNA, 25 bp, Mus musculus
ctggagttcagataatggatggctt

SEQ ID NO: 386011 - DNA, 25 bp, Mus musculus
ctggagttcataagagcctgaggct

SEQ ID NO: 386012 - DNA, 25 bp, Mus musculus
ctggagttcatatgagcctgaggct

SEQ ID NO: 386013 - DNA, 25 bp, Mus musculus
ctggagttgcagatcccatacctga

SEQ ID NO: 386014 - DNA, 25 bp, Mus musculus
ctggagttgcagttcccatacctga

SEQ ID NO: 386015 - DNA, 25 bp, Mus musculus
ctggagttgctcaggctcagttact

SEQ ID NO: 386016 - DNA, 25 bp, Mus musculus
ctggagttgctctggctcagttact

SEQ ID NO: 386017 - DNA, 25 bp, Mus musculus
ctggagttgcttctggcatgtgcct

SEQ ID NO: 386018 - DNA, 25 bp, Mus musculus
ctggagttgcttgtggcatgtgcct

SEQ ID NO: 386019 - DNA, 25 bp, Mus musculus
ctggagttgtggagtgtccctccaa

SEQ ID NO: 386020 - DNA, 25 bp, Mus musculus
ctggagttgtggtgtgtccctccaa

SEQ ID NO: 386021 - DNA, 25 bp, Mus musculus
ctggagtttgaacctggttatcttt

SEQ ID NO: 386022 - DNA, 25 bp, Mus musculus
ctggagtttgaagctggttatcttt

SEQ ID NO: 386023 - DNA, 25 bp, Mus musculus
ctggagtttgtcatgtagcctgtaa

SEQ ID NO: 386024 - DNA, 25 bp, Mus musculus
ctggagtttgtcttgtagcctgtaa

SEQ ID NO: 386025 - DNA, 25 bp, Mus musculus
ctggataaccatagtgctagccggt

SEQ ID NO: 386026 - DNA, 25 bp, Mus musculus
ctggataaccattgtgctagccggt

SEQ ID NO: 386027 - DNA, 25 bp, Mus musculus
ctggataatgagctcctgcctccaa

SEQ ID NO: 386028 - DNA, 25 bp, Mus musculus
ctggataatgaggtcctgcctccaa

SEQ ID NO: 386029 - DNA, 25 bp, Mus musculus
ctggataatgatccgggatttcacc

SEQ ID NO: 386030 - DNA, 25 bp, Mus musculus
ctggataatgatgcgggatttcacc

SEQ ID NO: 386031 - DNA, 25 bp, Mus musculus
ctggatacaattaccaactcataat

SEQ ID NO: 386032 - DNA, 25 bp, Mus musculus
ctggatacaatttccaactcataat

SEQ ID NO: 386033 - DNA, 25 bp, Mus musculus
ctggatacacatacactagctatgt

SEQ ID NO: 386034 - DNA, 25 bp, Mus musculus
ctggatacacatacattaactattt

SEQ ID NO: 386035 - DNA, 25 bp, Mus musculus
ctggatacacattcactagctatgt

SEQ ID NO: 386036 - DNA, 25 bp, Mus musculus
ctggatacacattcattaactattt

SEQ ID NO: 386037 - DNA, 25 bp, Mus musculus
ctggataccagacagctcaaccctg

SEQ ID NO: 386038 - DNA, 25 bp, Mus musculus
ctggataccagagagctcaaccctg

SEQ ID NO: 386039 - DNA, 25 bp, Mus musculus
ctggataccctgcatgagtcttgag

SEQ ID NO: 386040 - DNA, 25 bp, Mus musculus
ctggataccctggatgagtcttgag

SEQ ID NO: 386041 - DNA, 25 bp, Mus musculus
ctggatacgagtcacttgccctaaa

SEQ ID NO: 386042 - DNA, 25 bp, Mus musculus
ctggatacgagtgacttgccctaaa

SEQ ID NO: 386043 - DNA, 25 bp, Mus musculus
ctggatacggcccatatatatattt

SEQ ID NO: 386044 - DNA, 25 bp, Mus musculus
ctggatacggccgatatatatattt

SEQ ID NO: 386045 - DNA, 25 bp, Mus musculus
ctggatacttggatattgtgtaaga

SEQ ID NO: 386046 - DNA, 25 bp, Mus musculus
ctggatacttggttattgtgtaaga

SEQ ID NO: 386047 - DNA, 25 bp, Mus musculus
ctggatatcagtccagctggcctct

SEQ ID NO: 386048 - DNA, 25 bp, Mus musculus
ctggatatcagtgcagctggcctct

SEQ ID NO: 386049 - DNA, 25 bp, Mus musculus
ctggatatgtgcatcagcggcctat

SEQ ID NO: 386050 - DNA, 25 bp, Mus musculus
ctggatatgtgcttcagcggcctat

SEQ ID NO: 386051 - DNA, 25 bp, Mus musculus
ctggatattgtgctatgtgccttta

SEQ ID NO: 386052 - DNA, 25 bp, Mus musculus
ctggatattgtggtatgtgccttta

SEQ ID NO: 386053 - DNA, 25 bp, Mus musculus
ctggatatttggagaccttaaatgt

SEQ ID NO: 386054 - DNA, 25 bp, Mus musculus
ctggatatttggtgaccttaaatgt

SEQ ID NO: 386055 - DNA, 25 bp, Mus musculus
ctggatcaaagacactttggcccaa

SEQ ID NO: 386056 - DNA, 25 bp, Mus musculus
ctggatcaaagagactttggcccaa

SEQ ID NO: 386057 - DNA, 25 bp, Mus musculus
ctggatcaacagcagtctctggcca

SEQ ID NO: 386058 - DNA, 25 bp, Mus musculus
ctggatcaacaggagtctctggcca

SEQ ID NO: 386059 - DNA, 25 bp, Mus musculus
ctggatcaacgaccgtattcgaccg

SEQ ID NO: 386060 - DNA, 25 bp, Mus musculus
ctggatcaacgagcgtattcgaccg

SEQ ID NO: 386061 - DNA, 25 bp, Mus musculus
ctggatcacagcctcaagggaacaa

SEQ ID NO: 386062 - DNA, 25 bp, Mus musculus
ctggatcacagcgtcaagggaacaa

SEQ ID NO: 386063 - DNA, 25 bp, Mus musculus
ctggatcaccgcagctcaggaagag

SEQ ID NO: 386064 - DNA, 25 bp, Mus musculus
ctggatcaccgctgctcaggaagag

SEQ ID NO: 386065 - DNA, 25 bp, Mus musculus
ctggatcaccttactgtacaaatca

SEQ ID NO: 386066 - DNA, 25 bp, Mus musculus
ctggatcacctttctgtacaaatca

SEQ ID NO: 386067 - DNA, 25 bp, Mus musculus
ctggatcactccctaacattaaaaa

SEQ ID NO: 386068 - DNA, 25 bp, Mus musculus
ctggatcactccgtaacattaaaaa

SEQ ID NO: 386069 - DNA, 25 bp, Mus musculus
ctggatcagcggcacctatcctgtt

SEQ ID NO: 386070 - DNA, 25 bp, Mus musculus
ctggatcagcgggacctatcctgtt

SEQ ID NO: 386071 - DNA, 25 bp, Mus musculus
ctggatcaggctaacattctagaat

SEQ ID NO: 386072 - DNA, 25 bp, Mus musculus
ctggatcaggcttacattctagaat

SEQ ID NO: 386073 - DNA, 25 bp, Mus musculus
ctggatcagggcagtctgtgcacgt

SEQ ID NO: 386074 - DNA, 25 bp, Mus musculus
ctggatcagggctgtctgtgcacgt

SEQ ID NO: 386075 - DNA, 25 bp, Mus musculus
ctggatcatccacgctcttgaaaaa

SEQ ID NO: 386076 - DNA, 25 bp, Mus musculus
ctggatcatccaggctcttgaaaaa

SEQ ID NO: 386077 - DNA, 25 bp, Mus musculus
ctggatcatgacacaagatgttctt

SEQ ID NO: 386078 - DNA, 25 bp, Mus musculus
ctggatcatgactcaagatgttctt

SEQ ID NO: 386079 - DNA, 25 bp, Mus musculus
ctggatccaggcagtaccttgaata

SEQ ID NO: 386080 - DNA, 25 bp, Mus musculus
ctggatccaggctgtaccttgaata

SEQ ID NO: 386081 - DNA, 25 bp, Mus musculus
ctggatccaggtagaattcccagca

SEQ ID NO: 386082 - DNA, 25 bp, Mus musculus
ctggatccaggttgaattcccagca

SEQ ID NO: 386083 - DNA, 25 bp, Mus musculus
ctggatcccattctgcatgttctaa

SEQ ID NO: 386084 - DNA, 25 bp, Mus musculus
ctggatcccattgtgcatgttctaa

SEQ ID NO: 386085 - DNA, 25 bp, Mus musculus
ctggatccccagagctaggtgcggt

SEQ ID NO: 386086 - DNA, 25 bp, Mus musculus
ctggatccccagtgctaggtgcggt

SEQ ID NO: 386087 - DNA, 25 bp, Mus musculus
ctggatcccctgcaagtggtctaaa

SEQ ID NO: 386088 - DNA, 25 bp, Mus musculus
ctggatcccctggaagtggtctaaa

SEQ ID NO: 386089 - DNA, 25 bp, Mus musculus
ctggatccctgcagtgtcaaatgaa

SEQ ID NO: 386090 - DNA, 25 bp, Mus musculus
ctggatccctgcatcatatactaga

SEQ ID NO: 386091 - DNA, 25 bp, Mus musculus
ctggatccctgctgtgtcaaatgaa

SEQ ID NO: 386092 - DNA, 25 bp, Mus musculus
ctggatccctgcttcatatactaga

SEQ ID NO: 386093 - DNA, 25 bp, Mus musculus
ctggatcctagtaagctctactttt

SEQ ID NO: 386094 - DNA, 25 bp, Mus musculus
ctggatcctagttagctctactttt

SEQ ID NO: 386095 - DNA, 25 bp, Mus musculus
ctggatcctcagattagatgtttct

SEQ ID NO: 386096 - DNA, 25 bp, Mus musculus
ctggatcctcagtttagatgtttct

SEQ ID NO: 386097 - DNA, 25 bp, Mus musculus
ctggatccttgacctacttgggcac

SEQ ID NO: 386098 - DNA, 25 bp, Mus musculus
ctggatccttgagctacttgggcac

SEQ ID NO: 386099 - DNA, 25 bp, Mus musculus
ctggatcctttcagtgtactgttga

SEQ ID NO: 386100 - DNA, 25 bp, Mus musculus
ctggatcctttctgtgtactgttga

SEQ ID NO: 386101 - DNA, 25 bp, Mus musculus
ctggatcgcagacctgccttgggat

SEQ ID NO: 386102 - DNA, 25 bp, Mus musculus
ctggatcgcagagctgccttgggat

SEQ ID NO: 386103 - DNA, 25 bp, Mus musculus
ctggatcgtggtaatcttagccttt

SEQ ID NO: 386104 - DNA, 25 bp, Mus musculus
ctggatcgtggttatcttagccttt

SEQ ID NO: 386105 - DNA, 25 bp, Mus musculus
ctggatctactcaagtgcagaagct

SEQ ID NO: 386106 - DNA, 25 bp, Mus musculus
ctggatctactctagtgcagaagct

SEQ ID NO: 386107 - DNA, 25 bp, Mus musculus
ctggatctcaagcaagtggcgctca

SEQ ID NO: 386108 - DNA, 25 bp, Mus musculus
ctggatctcaaggaagtggcgctca

SEQ ID NO: 386109 - DNA, 25 bp, Mus musculus
ctggatctcacaaagctcaaggctt

SEQ ID NO: 386110 - DNA, 25 bp, Mus musculus
ctggatctcacatagctcaaggctt

SEQ ID NO: 386111 - DNA, 25 bp, Mus musculus
ctggatctccaacccaccaggtgtg

SEQ ID NO: 386112 - DNA, 25 bp, Mus musculus
ctggatctccaagccaccaggtgtg

SEQ ID NO: 386113 - DNA, 25 bp, Mus musculus
ctggatctccatatgtgtttccaca

SEQ ID NO: 386114 - DNA, 25 bp, Mus musculus
ctggatctccatttgtgtttccaca

SEQ ID NO: 386115 - DNA, 25 bp, Mus musculus
ctggatctcctgaactgagctttgt

SEQ ID NO: 386116 - DNA, 25 bp, Mus musculus
ctggatctcctgtactgagctttgt

SEQ ID NO: 386117 - DNA, 25 bp, Mus musculus
ctggatctccttattggacttaaga

SEQ ID NO: 386118 - DNA, 25 bp, Mus musculus
ctggatctcctttttggacttaaga

SEQ ID NO: 386119 - DNA, 25 bp, Mus musculus
ctggatctctagagtataatatgct

SEQ ID NO: 386120 - DNA, 25 bp, Mus musculus
ctggatctctagtgtataatatgct

SEQ ID NO: 386121 - DNA, 25 bp, Mus musculus
ctggatctctctctggatgagtcag

SEQ ID NO: 386122 - DNA, 25 bp, Mus musculus
ctggatctctctgtggatgagtcag

SEQ ID NO: 386123 - DNA, 25 bp, Mus musculus
ctggatctgctgagtggcataggcc

SEQ ID NO: 386124 - DNA, 25 bp, Mus musculus
ctggatctgctgattgaagcgcagc

SEQ ID NO: 386125 - DNA, 25 bp, Mus musculus
ctggatctgctgtgtggcataggcc

SEQ ID NO: 386126 - DNA, 25 bp, Mus musculus
ctggatctgctgtttgaagcgcagc

SEQ ID NO: 386127 - DNA, 25 bp, Mus musculus
ctggatctggatctgaatctggagt

SEQ ID NO: 386128 - DNA, 25 bp, Mus musculus
ctggatctggatgtgaatctggagt

SEQ ID NO: 386129 - DNA, 25 bp, Mus musculus
ctggatctgttgattcttttgggcc

SEQ ID NO: 386130 - DNA, 25 bp, Mus musculus
ctggatctgttgtttcttttgggcc

SEQ ID NO: 386131 - DNA, 25 bp, Mus musculus
ctggatgacattcccgccctggtgg

SEQ ID NO: 386132 - DNA, 25 bp, Mus musculus
ctggatgacattgccgccctggtgg

SEQ ID NO: 386133 - DNA, 25 bp, Mus musculus
ctggatgaccccaacttttagtagt

SEQ ID NO: 386134 - DNA, 25 bp, Mus musculus
ctggatgacccctacttttagtagt

SEQ ID NO: 386135 - DNA, 25 bp, Mus musculus
ctggatgatggacaaagcttcaact

SEQ ID NO: 386136 - DNA, 25 bp, Mus musculus
ctggatgatggagaaagcttcaact

SEQ ID NO: 386137 - DNA, 25 bp, Mus musculus
ctggatgcagcactgcaggctgtga

SEQ ID NO: 386138 - DNA, 25 bp, Mus musculus
ctggatgcagcagtgcaggctgtga

SEQ ID NO: 386139 - DNA, 25 bp, Mus musculus
ctggatgcagccacaatgcacgatt

SEQ ID NO: 386140 - DNA, 25 bp, Mus musculus
ctggatgcagcctcaatgcacgatt

SEQ ID NO: 386141 - DNA, 25 bp, Mus musculus
ctggatgctcttactttaggacttt

SEQ ID NO: 386142 - DNA, 25 bp, Mus musculus
ctggatgctctttctttaggacttt

SEQ ID NO: 386143 - DNA, 25 bp, Mus musculus
ctggatgcttagctgctctacttga

SEQ ID NO: 386144 - DNA, 25 bp, Mus musculus
ctggatgcttaggtgctctacttga

SEQ ID NO: 386145 - DNA, 25 bp, Mus musculus
ctggatggcaagagctctggctgaa

SEQ ID NO: 386146 - DNA, 25 bp, Mus musculus
ctggatggcaagtgctctggctgaa

SEQ ID NO: 386147 - DNA, 25 bp, Mus musculus
ctggatggcctcaggtgtgcccatg

SEQ ID NO: 386148 - DNA, 25 bp, Mus musculus
ctggatggcctctggtgtgcccatg

SEQ ID NO: 386149 - DNA, 25 bp, Mus musculus
ctggatggccttagaactctctcta

SEQ ID NO: 386150 - DNA, 25 bp, Mus musculus
ctggatggcctttgaactctctcta

SEQ ID NO: 386151 - DNA, 25 bp, Mus musculus
ctggatggctccctaccaatattga

SEQ ID NO: 386152 - DNA, 25 bp, Mus musculus
ctggatggctccgtaccaatattga

SEQ ID NO: 386153 - DNA, 25 bp, Mus musculus
ctggatggctggctgactgcaatca

SEQ ID NO: 386154 - DNA, 25 bp, Mus musculus
ctggatggctgggtgactgcaatca

SEQ ID NO: 386155 - DNA, 25 bp, Mus musculus
ctggatgtatttcttctgttttgca

SEQ ID NO: 386156 - DNA, 25 bp, Mus musculus
ctggatgtatttgttctgttttgca

SEQ ID NO: 386157 - DNA, 25 bp, Mus musculus
ctggatgtcagaaccctgggaggat

SEQ ID NO: 386158 - DNA, 25 bp, Mus musculus
ctggatgtcagatccctgggaggat

SEQ ID NO: 386159 - DNA, 25 bp, Mus musculus
ctggatgtcctaaagctgttgaata

SEQ ID NO: 386160 - DNA, 25 bp, Mus musculus
ctggatgtcctatagctgttgaata

SEQ ID NO: 386161 - DNA, 25 bp, Mus musculus
ctggatgtctgtcccaacctttcga

SEQ ID NO: 386162 - DNA, 25 bp, Mus musculus
ctggatgtctgtgccaacctttcga

SEQ ID NO: 386163 - DNA, 25 bp, Mus musculus
ctggatgtgtccactagggatccaa

SEQ ID NO: 386164 - DNA, 25 bp, Mus musculus
ctggatgtgtcctctagggatccaa

SEQ ID NO: 386165 - DNA, 25 bp, Mus musculus
ctggatgtgttactgcctttgatgc

SEQ ID NO: 386166 - DNA, 25 bp, Mus musculus
ctggatgtgttagtgcctttgatgc

SEQ ID NO: 386167 - DNA, 25 bp, Mus musculus
ctggatgtgtttattggtgctcaat

SEQ ID NO: 386168 - DNA, 25 bp, Mus musculus
ctggatgtgttttttggtgctcaat

SEQ ID NO: 386169 - DNA, 25 bp, Mus musculus
ctggatgttaacattgtttctttgc

SEQ ID NO: 386170 - DNA, 25 bp, Mus musculus
ctggatgttaactttgtttctttgc

SEQ ID NO: 386171 - DNA, 25 bp, Mus musculus
ctggatgttgagctgtactgtgtat

SEQ ID NO: 386172 - DNA, 25 bp, Mus musculus
ctggatgttgaggtgtactgtgtat

SEQ ID NO: 386173 - DNA, 25 bp, Mus musculus
ctggatgttggtaagggctgtctat

SEQ ID NO: 386174 - DNA, 25 bp, Mus musculus
ctggatgttggttagggctgtctat

SEQ ID NO: 386175 - DNA, 25 bp, Mus musculus
ctggattaagggaggtcttagtcac

SEQ ID NO: 386176 - DNA, 25 bp, Mus musculus
ctggattaagggtggtcttagtcac

SEQ ID NO: 386177 - DNA, 25 bp, Mus musculus
ctggattaatggaggcagggaacac

SEQ ID NO: 386178 - DNA, 25 bp, Mus musculus
ctggattaatggtggcagggaacac

SEQ ID NO: 386179 - DNA, 25 bp, Mus musculus
ctggattatcagcacaattgctttt

SEQ ID NO: 386180 - DNA, 25 bp, Mus musculus
ctggattatcaggacaattgctttt

SEQ ID NO: 386181 - DNA, 25 bp, Mus musculus
ctggattcacgtacctttaactgac

SEQ ID NO: 386182 - DNA, 25 bp, Mus musculus
ctggattcacgttcctttaactgac

SEQ ID NO: 386183 - DNA, 25 bp, Mus musculus
ctggattccagcaaactgtgtgtgg

SEQ ID NO: 386184 - DNA, 25 bp, Mus musculus
ctggattccagctaactgtgtgtgg

SEQ ID NO: 386185 - DNA, 25 bp, Mus musculus
ctggattcccttctaatcattgaat

SEQ ID NO: 386186 - DNA, 25 bp, Mus musculus
ctggattcccttgtaatcattgaat

SEQ ID NO: 386187 - DNA, 25 bp, Mus musculus
ctggattccgtaaagctagaagcct

SEQ ID NO: 386188 - DNA, 25 bp, Mus musculus
ctggattccgtatagctagaagcct

SEQ ID NO: 386189 - DNA, 25 bp, Mus musculus
ctggattcctgtcgctgtgctacca

SEQ ID NO: 386190 - DNA, 25 bp, Mus musculus
ctggattcctgtggctgtgctacca

SEQ ID NO: 386191 - DNA, 25 bp, Mus musculus
ctggattcgacaccctttaagacaa

SEQ ID NO: 386192 - DNA, 25 bp, Mus musculus
ctggattcgacagcctttaagacaa

SEQ ID NO: 386193 - DNA, 25 bp, Mus musculus
ctggattctcagaggtggcaaccga

SEQ ID NO: 386194 - DNA, 25 bp, Mus musculus
ctggattctcagtggtggcaaccga

SEQ ID NO: 386195 - DNA, 25 bp, Mus musculus
ctggattctcttacacagatgccaa

SEQ ID NO: 386196 - DNA, 25 bp, Mus musculus
ctggattctctttcacagatgccaa

SEQ ID NO: 386197 - DNA, 25 bp, Mus musculus
ctggattctgatagtgtcacgtctt

SEQ ID NO: 386198 - DNA, 25 bp, Mus musculus
ctggattctgattgtgtcacgtctt

SEQ ID NO: 386199 - DNA, 25 bp, Mus musculus
ctggattctgttcctagcactacac

SEQ ID NO: 386200 - DNA, 25 bp, Mus musculus
ctggattctgttgctagcactacac

SEQ ID NO: 386201 - DNA, 25 bp, Mus musculus
ctggattgacagcagtgagtttgct

SEQ ID NO: 386202 - DNA, 25 bp, Mus musculus
ctggattgacaggagtgagtttgct

SEQ ID NO: 386203 - DNA, 25 bp, Mus musculus
ctggattgcggacgcccaggccaca

SEQ ID NO: 386204 - DNA, 25 bp, Mus musculus
ctggattgcggaggcccaggccaca

SEQ ID NO: 386205 - DNA, 25 bp, Mus musculus
ctggattggcctccaaacagaggga

SEQ ID NO: 386206 - DNA, 25 bp, Mus musculus
ctggattggcctgcaaacagaggga

SEQ ID NO: 386207 - DNA, 25 bp, Mus musculus
ctggattgggtcactgggactctga

SEQ ID NO: 386208 - DNA, 25 bp, Mus musculus
ctggattgggtctctgggactctga

SEQ ID NO: 386209 - DNA, 25 bp, Mus musculus
ctggattgggttatcatgagcggct

SEQ ID NO: 386210 - DNA, 25 bp, Mus musculus
ctggattgggttttcatgagcggct

SEQ ID NO: 386211 - DNA, 25 bp, Mus musculus
ctggattggtacctgaatatgtata

SEQ ID NO: 386212 - DNA, 25 bp, Mus musculus
ctggattggtacgtgaatatgtata

SEQ ID NO: 386213 - DNA, 25 bp, Mus musculus
ctggattgtgaaagacgtttatgtt

SEQ ID NO: 386214 - DNA, 25 bp, Mus musculus
ctggattgtgaaatgcctcctctgt

SEQ ID NO: 386215 - DNA, 25 bp, Mus musculus
ctggattgtgaatgacgtttatgtt

SEQ ID NO: 386216 - DNA, 25 bp, Mus musculus
ctggattgtgaattgcctcctctgt

SEQ ID NO: 386217 - DNA, 25 bp, Mus musculus
ctggatttatggcagcaagctactg

SEQ ID NO: 386218 - DNA, 25 bp, Mus musculus
ctggatttatgggagcaagctactg

SEQ ID NO: 386219 - DNA, 25 bp, Mus musculus
ctggatttccctatgagcttcactc

SEQ ID NO: 386220 - DNA, 25 bp, Mus musculus
ctggatttccctttgagcttcactc

SEQ ID NO: 386221 - DNA, 25 bp, Mus musculus
ctggatttgagaccaggccctgatc

SEQ ID NO: 386222 - DNA, 25 bp, Mus musculus
ctggatttgagagcaggccctgatc

SEQ ID NO: 386223 - DNA, 25 bp, Mus musculus
ctggattttcagattaagccacaat

SEQ ID NO: 386224 - DNA, 25 bp, Mus musculus
ctggattttcagtttaagccacaat

SEQ ID NO: 386225 - DNA, 25 bp, Mus musculus
ctggattttgttctgcatcatttaa

SEQ ID NO: 386226 - DNA, 25 bp, Mus musculus
ctggattttgttgtgcatcatttaa

SEQ ID NO: 386227 - DNA, 25 bp, Mus musculus
ctggatttttccatctaccacatgg

SEQ ID NO: 386228 - DNA, 25 bp, Mus musculus
ctggatttttccttctaccacatgg

SEQ ID NO: 386229 - DNA, 25 bp, Mus musculus
ctggattttttaagtacaaccctga

SEQ ID NO: 386230 - DNA, 25 bp, Mus musculus
ctggattttttatgtacaaccctga

SEQ ID NO: 386231 - DNA, 25 bp, Mus musculus
ctggcaaacccaaggaagagtaagc

SEQ ID NO: 386232 - DNA, 25 bp, Mus musculus
ctggcaaacccatggaagagtaagc

SEQ ID NO: 386233 - DNA, 25 bp, Mus musculus
ctggcaaatacaccgcttttcataa

SEQ ID NO: 386234 - DNA, 25 bp, Mus musculus
ctggcaaatacagcgcttttcataa

SEQ ID NO: 386235 - DNA, 25 bp, Mus musculus
ctggcaaatactctacaactgtatt

SEQ ID NO: 386236 - DNA, 25 bp, Mus musculus
ctggcaaatactgtacaactgtatt

SEQ ID NO: 386237 - DNA, 25 bp, Mus musculus
ctggcaaatgggacctgcatcctga

SEQ ID NO: 386238 - DNA, 25 bp, Mus musculus
ctggcaaatgggtcctgcatcctga

SEQ ID NO: 386239 - DNA, 25 bp, Mus musculus
ctggcaacactcatttgctggtttg

SEQ ID NO: 386240 - DNA, 25 bp, Mus musculus
ctggcaacactcttttgctggtttg

SEQ ID NO: 386241 - DNA, 25 bp, Mus musculus
ctggcaacagtgatccggagcatct

SEQ ID NO: 386242 - DNA, 25 bp, Mus musculus
ctggcaacagtgttccggagcatct

SEQ ID NO: 386243 - DNA, 25 bp, Mus musculus
ctggcaacctgacgcagtggaccgt

SEQ ID NO: 386244 - DNA, 25 bp, Mus musculus
ctggcaacctgactctgtgatccac

SEQ ID NO: 386245 - DNA, 25 bp, Mus musculus
ctggcaacctgaggcagtggaccgt

SEQ ID NO: 386246 - DNA, 25 bp, Mus musculus
ctggcaacctgagtctgtgatccac

SEQ ID NO: 386247 - DNA, 25 bp, Mus musculus
ctggcaactccaacatttaacaaat

SEQ ID NO: 386248 - DNA, 25 bp, Mus musculus
ctggcaactccaatcataggcatat

SEQ ID NO: 386249 - DNA, 25 bp, Mus musculus
ctggcaactccatcatttaacaaat

SEQ ID NO: 386250 - DNA, 25 bp, Mus musculus
ctggcaactccattcataggcatat

SEQ ID NO: 386251 - DNA, 25 bp, Mus musculus
ctggcaagaccacgcagggcctcaa

SEQ ID NO: 386252 - DNA, 25 bp, Mus musculus
ctggcaagaccaggcagggcctcaa

SEQ ID NO: 386253 - DNA, 25 bp, Mus musculus
ctggcaagagaacctcaggctcaga

SEQ ID NO: 386254 - DNA, 25 bp, Mus musculus
ctggcaagagaagctcaggctcaga

SEQ ID NO: 386255 - DNA, 25 bp, Mus musculus
ctggcaagagtcaggctatggccaa

SEQ ID NO: 386256 - DNA, 25 bp, Mus musculus
ctggcaagagtctggctatggccaa

SEQ ID NO: 386257 - DNA, 25 bp, Mus musculus
ctggcaagattgagcaaggaggagt

SEQ ID NO: 386258 - DNA, 25 bp, Mus musculus
ctggcaagattgtgcaaggaggagt

SEQ ID NO: 386259 - DNA, 25 bp, Mus musculus
ctggcaaggaacacaggcagggacc

SEQ ID NO: 386260 - DNA, 25 bp, Mus musculus
ctggcaaggaactcaggcagggacc

SEQ ID NO: 386261 - DNA, 25 bp, Mus musculus
ctggcaaggcctagaaagaagtgat

SEQ ID NO: 386262 - DNA, 25 bp, Mus musculus
ctggcaaggccttgaaagaagtgat

SEQ ID NO: 386263 - DNA, 25 bp, Mus musculus
ctggcaaggtatatctgagcaatcg

SEQ ID NO: 386264 - DNA, 25 bp, Mus musculus
ctggcaaggtatttctgagcaatcg

SEQ ID NO: 386265 - DNA, 25 bp, Mus musculus
ctggcaaggtctactcttggaatgg

SEQ ID NO: 386266 - DNA, 25 bp, Mus musculus
ctggcaaggtcttctcttggaatgg

SEQ ID NO: 386267 - DNA, 25 bp, Mus musculus
ctggcaagttacagttagagcttcc

SEQ ID NO: 386268 - DNA, 25 bp, Mus musculus
ctggcaagttactgttagagcttcc

SEQ ID NO: 386269 - DNA, 25 bp, Mus musculus
ctggcaatactaaaccaagaccact

SEQ ID NO: 386270 - DNA, 25 bp, Mus musculus
ctggcaatactataccaagaccact

SEQ ID NO: 386271 - DNA, 25 bp, Mus musculus
ctggcaatgagactaggtcccggat

SEQ ID NO: 386272 - DNA, 25 bp, Mus musculus
ctggcaatgagagtaggtcccggat

SEQ ID NO: 386273 - DNA, 25 bp, Mus musculus
ctggcaatggcaactctatcctgtt

SEQ ID NO: 386274 - DNA, 25 bp, Mus musculus
ctggcaatggcatctctatcctgtt

SEQ ID NO: 386275 - DNA, 25 bp, Mus musculus
ctggcaatggtgatgctggcactaa

SEQ ID NO: 386276 - DNA, 25 bp, Mus musculus
ctggcaatggtgttgctggcactaa

SEQ ID NO: 386277 - DNA, 25 bp, Mus musculus
ctggcaattcttcttgatgtctaac

SEQ ID NO: 386278 - DNA, 25 bp, Mus musculus
ctggcaattcttgttgatgtctaac

SEQ ID NO: 386279 - DNA, 25 bp, Mus musculus
ctggcacacaggcactatggcaaac

SEQ ID NO: 386280 - DNA, 25 bp, Mus musculus
ctggcacacagggactatggcaaac

SEQ ID NO: 386281 - DNA, 25 bp, Mus musculus
ctggcacacggaagcctgctgatga

SEQ ID NO: 386282 - DNA, 25 bp, Mus musculus
ctggcacacggatgcctgctgatga

SEQ ID NO: 386283 - DNA, 25 bp, Mus musculus
ctggcacagcgcagcatggacaaga

SEQ ID NO: 386284 - DNA, 25 bp, Mus musculus
ctggcacagcgctgcatggacaaga

SEQ ID NO: 386285 - DNA, 25 bp, Mus musculus
ctggcacagggcagatctgagaaga

SEQ ID NO: 386286 - DNA, 25 bp, Mus musculus
ctggcacagggctgatctgagaaga

SEQ ID NO: 386287 - DNA, 25 bp, Mus musculus
ctggcacagtagctacctggatgtt

SEQ ID NO: 386288 - DNA, 25 bp, Mus musculus
ctggcacagtaggtacctggatgtt

SEQ ID NO: 386289 - DNA, 25 bp, Mus musculus
ctggcacagtcccatgcattgatct

SEQ ID NO: 386290 - DNA, 25 bp, Mus musculus
ctggcacagtccgatgcattgatct

SEQ ID NO: 386291 - DNA, 25 bp, Mus musculus
ctggcacatagactggagtcaccaa

SEQ ID NO: 386292 - DNA, 25 bp, Mus musculus
ctggcacatagagtggagtcaccaa

SEQ ID NO: 386293 - DNA, 25 bp, Mus musculus
ctggcaccaaggctacattattaga

SEQ ID NO: 386294 - DNA, 25 bp, Mus musculus
ctggcaccaagggtacattattaga

SEQ ID NO: 386295 - DNA, 25 bp, Mus musculus
ctggcaccacaaccctgatgtatag

SEQ ID NO: 386296 - DNA, 25 bp, Mus musculus
ctggcaccacaagcctgatgtatag

SEQ ID NO: 386297 - DNA, 25 bp, Mus musculus
ctggcaccagagaaggtcatttatt

SEQ ID NO: 386298 - DNA, 25 bp, Mus musculus
ctggcaccagagtaggtcatttatt

SEQ ID NO: 386299 - DNA, 25 bp, Mus musculus
ctggcaccatatcgctgctctaact

SEQ ID NO: 386300 - DNA, 25 bp, Mus musculus
ctggcaccatatggctgctctaact

SEQ ID NO: 386301 - DNA, 25 bp, Mus musculus
ctggcaccccatcgagagcattatt

SEQ ID NO: 386302 - DNA, 25 bp, Mus musculus
ctggcaccccatggagagcattatt

SEQ ID NO: 386303 - DNA, 25 bp, Mus musculus
ctggcaccctccaacaggctgagct

SEQ ID NO: 386304 - DNA, 25 bp, Mus musculus
ctggcaccctcctacaggctgagct

SEQ ID NO: 386305 - DNA, 25 bp, Mus musculus
ctggcaccctggcttgttgaaaggt

SEQ ID NO: 386306 - DNA, 25 bp, Mus musculus
ctggcaccctgggttgttgaaaggt

SEQ ID NO: 386307 - DNA, 25 bp, Mus musculus
ctggcaccgacgaaggccactgaag

SEQ ID NO: 386308 - DNA, 25 bp, Mus musculus
ctggcaccgacgtaggccactgaag

SEQ ID NO: 386309 - DNA, 25 bp, Mus musculus
ctggcacctagcacttagcagtgtg

SEQ ID NO: 386310 - DNA, 25 bp, Mus musculus
ctggcacctagctcttagcagtgtg

SEQ ID NO: 386311 - DNA, 25 bp, Mus musculus
ctggcacctcagatttatgacttaa

SEQ ID NO: 386312 - DNA, 25 bp, Mus musculus
ctggcacctcagttttatgacttaa

SEQ ID NO: 386313 - DNA, 25 bp, Mus musculus
ctggcacctgaaatgttccttccat

SEQ ID NO: 386314 - DNA, 25 bp, Mus musculus
ctggcacctgaattgttccttccat

SEQ ID NO: 386315 - DNA, 25 bp, Mus musculus
ctggcacgaccacggaagattctga

SEQ ID NO: 386316 - DNA, 25 bp, Mus musculus
ctggcacgaccagggaagattctga

SEQ ID NO: 386317 - DNA, 25 bp, Mus musculus
ctggcacgacttacatttctaagga

SEQ ID NO: 386318 - DNA, 25 bp, Mus musculus
ctggcacgactttcatttctaagga

SEQ ID NO: 386319 - DNA, 25 bp, Mus musculus
ctggcacgtcagcttttcttcagtg

SEQ ID NO: 386320 - DNA, 25 bp, Mus musculus
ctggcacgtcaggttttcttcagtg

SEQ ID NO: 386321 - DNA, 25 bp, Mus musculus
ctggcactaactaccactcaaatga

SEQ ID NO: 386322 - DNA, 25 bp, Mus musculus
ctggcactaacttccactcaaatga

SEQ ID NO: 386323 - DNA, 25 bp, Mus musculus
ctggcactccagatcttggcaggga

SEQ ID NO: 386324 - DNA, 25 bp, Mus musculus
ctggcactccagttcttggcaggga

SEQ ID NO: 386325 - DNA, 25 bp, Mus musculus
ctggcactcttgacttataatttta

SEQ ID NO: 386326 - DNA, 25 bp, Mus musculus
ctggcactcttgtcttataatttta

SEQ ID NO: 386327 - DNA, 25 bp, Mus musculus
ctggcactggcacaggagatcctgc

SEQ ID NO: 386328 - DNA, 25 bp, Mus musculus
ctggcactggcagaggagatcctgc

SEQ ID NO: 386329 - DNA, 25 bp, Mus musculus
ctggcactgtatccaatttagtact

SEQ ID NO: 386330 - DNA, 25 bp, Mus musculus
ctggcactgtatgcaatttagtact

SEQ ID NO: 386331 - DNA, 25 bp, Mus musculus
ctggcactgtgcatgtttaatgggt

SEQ ID NO: 386332 - DNA, 25 bp, Mus musculus
ctggcactgtgcttgtttaatgggt

SEQ ID NO: 386333 - DNA, 25 bp, Mus musculus
ctggcactgtgtcgatcaactgcta

SEQ ID NO: 386334 - DNA, 25 bp, Mus musculus
ctggcactgtgtggatcaactgcta

SEQ ID NO: 386335 - DNA, 25 bp, Mus musculus
ctggcagaagctaggtcccaccggg

SEQ ID NO: 386336 - DNA, 25 bp, Mus musculus
ctggcagaagcttggtcccaccggg

SEQ ID NO: 386337 - DNA, 25 bp, Mus musculus
ctggcagacactctcttgttctcca

SEQ ID NO: 386338 - DNA, 25 bp, Mus musculus
ctggcagacactgtcttgttctcca

SEQ ID NO: 386339 - DNA, 25 bp, Mus musculus
ctggcagacctactgttgcaagcta

SEQ ID NO: 386340 - DNA, 25 bp, Mus musculus
ctggcagacctagtgttgcaagcta

SEQ ID NO: 386341 - DNA, 25 bp, Mus musculus
ctggcagaccttcgcttccataaca

SEQ ID NO: 386342 - DNA, 25 bp, Mus musculus
ctggcagaccttggcttccataaca

SEQ ID NO: 386343 - DNA, 25 bp, Mus musculus
ctggcagacggacttgattctcgtt

SEQ ID NO: 386344 - DNA, 25 bp, Mus musculus
ctggcagacggagttgattctcgtt

SEQ ID NO: 386345 - DNA, 25 bp, Mus musculus
ctggcagactgcatgttgtataatt

SEQ ID NO: 386346 - DNA, 25 bp, Mus musculus
ctggcagactgcttgttgtataatt

SEQ ID NO: 386347 - DNA, 25 bp, Mus musculus
ctggcagagagcagctcacagctgt

SEQ ID NO: 386348 - DNA, 25 bp, Mus musculus
ctggcagagagctgctcacagctgt

SEQ ID NO: 386349 - DNA, 25 bp, Mus musculus
ctggcagagtacagccgcctgctgg

SEQ ID NO: 386350 - DNA, 25 bp, Mus musculus
ctggcagagtactgccgcctgctgg

SEQ ID NO: 386351 - DNA, 25 bp, Mus musculus
ctggcagagtatccctacgtgctga

SEQ ID NO: 386352 - DNA, 25 bp, Mus musculus
ctggcagagtatgcctacgtgctga

SEQ ID NO: 386353 - DNA, 25 bp, Mus musculus
ctggcagatgaactgatcacaccac

SEQ ID NO: 386354 - DNA, 25 bp, Mus musculus
ctggcagatgaagtgatcacaccac

SEQ ID NO: 386355 - DNA, 25 bp, Mus musculus
ctggcagatgacagcagttcacact

SEQ ID NO: 386356 - DNA, 25 bp, Mus musculus
ctggcagatgactgcagttcacact

SEQ ID NO: 386357 - DNA, 25 bp, Mus musculus
ctggcagatgcacatctatgttagt

SEQ ID NO: 386358 - DNA, 25 bp, Mus musculus
ctggcagatgcagatctatgttagt

SEQ ID NO: 386359 - DNA, 25 bp, Mus musculus
ctggcagcagctcctaataattatt

SEQ ID NO: 386360 - DNA, 25 bp, Mus musculus
ctggcagcagctcttacgcattgga

SEQ ID NO: 386361 - DNA, 25 bp, Mus musculus
ctggcagcagctgctaataattatt

SEQ ID NO: 386362 - DNA, 25 bp, Mus musculus
ctggcagcagctgttacgcattgga

SEQ ID NO: 386363 - DNA, 25 bp, Mus musculus
ctggcagcccagataacctgtattt

SEQ ID NO: 386364 - DNA, 25 bp, Mus musculus
ctggcagcccagttaacctgtattt

SEQ ID NO: 386365 - DNA, 25 bp, Mus musculus
ctggcagccctacagttcataaatg

SEQ ID NO: 386366 - DNA, 25 bp, Mus musculus
ctggcagccctagagttcataaatg

SEQ ID NO: 386367 - DNA, 25 bp, Mus musculus
ctggcagcctgcaagcgtaaagagc

SEQ ID NO: 386368 - DNA, 25 bp, Mus musculus
ctggcagcctgctagcgtaaagagc

SEQ ID NO: 386369 - DNA, 25 bp, Mus musculus
ctggcagccttcaacaaatcctaaa

SEQ ID NO: 386370 - DNA, 25 bp, Mus musculus
ctggcagccttctacaaatcctaaa

SEQ ID NO: 386371 - DNA, 25 bp, Mus musculus
ctggcagcgaaaagaccccggaagg

SEQ ID NO: 386372 - DNA, 25 bp, Mus musculus
ctggcagcgaaatgaccccggaagg

SEQ ID NO: 386373 - DNA, 25 bp, Mus musculus
ctggcagcgatgaagatttcctaat

SEQ ID NO: 386374 - DNA, 25 bp, Mus musculus
ctggcagcgatgtagatttcctaat

SEQ ID NO: 386375 - DNA, 25 bp, Mus musculus
ctggcagctcaccagctaaaggatg

SEQ ID NO: 386376 - DNA, 25 bp, Mus musculus
ctggcagctcacgagctaaaggatg

SEQ ID NO: 386377 - DNA, 25 bp, Mus musculus
ctggcagctcatccgtacatgaaag

SEQ ID NO: 386378 - DNA, 25 bp, Mus musculus
ctggcagctcatgcgtacatgaaag

SEQ ID NO: 386379 - DNA, 25 bp, Mus musculus
ctggcagctcctctcaagagggtag

SEQ ID NO: 386380 - DNA, 25 bp, Mus musculus
ctggcagctcctgtcaagagggtag

SEQ ID NO: 386381 - DNA, 25 bp, Mus musculus
ctggcagctcttaaaactaaggaaa

SEQ ID NO: 386382 - DNA, 25 bp, Mus musculus
ctggcagctctttaaactaaggaaa

SEQ ID NO: 386383 - DNA, 25 bp, Mus musculus
ctggcagctgagacagaacttctga

SEQ ID NO: 386384 - DNA, 25 bp, Mus musculus
ctggcagctgagtcagaacttctga

SEQ ID NO: 386385 - DNA, 25 bp, Mus musculus
ctggcagctgatagctcctgggaga

SEQ ID NO: 386386 - DNA, 25 bp, Mus musculus
ctggcagctgattgctcctgggaga

SEQ ID NO: 386387 - DNA, 25 bp, Mus musculus
ctggcagctgtacacttaattattt

SEQ ID NO: 386388 - DNA, 25 bp, Mus musculus
ctggcagctgtagacttaattattt

SEQ ID NO: 386389 - DNA, 25 bp, Mus musculus
ctggcagcttggctcagtgcataaa

SEQ ID NO: 386390 - DNA, 25 bp, Mus musculus
ctggcagcttgggtcagtgcataaa

SEQ ID NO: 386391 - DNA, 25 bp, Mus musculus
ctggcaggagataggcagttacacc

SEQ ID NO: 386392 - DNA, 25 bp, Mus musculus
ctggcaggagattggcagttacacc

SEQ ID NO: 386393 - DNA, 25 bp, Mus musculus
ctggcaggagtccagttgaatgcac

SEQ ID NO: 386394 - DNA, 25 bp, Mus musculus
ctggcaggagtcgagttgaatgcac

SEQ ID NO: 386395 - DNA, 25 bp, Mus musculus
ctggcaggccagctgttcttcgtgc

SEQ ID NO: 386396 - DNA, 25 bp, Mus musculus
ctggcaggccaggtgttcttcgtgc

SEQ ID NO: 386397 - DNA, 25 bp, Mus musculus
ctggcaggcggcaccatgatacaga

SEQ ID NO: 386398 - DNA, 25 bp, Mus musculus
ctggcaggcggctccatgatacaga

SEQ ID NO: 386399 - DNA, 25 bp, Mus musculus
ctggcaggggctaattcgattttaa

SEQ ID NO: 386400 - DNA, 25 bp, Mus musculus
ctggcaggggcttattcgattttaa

SEQ ID NO: 386401 - DNA, 25 bp, Mus musculus
ctggcaggttaaaacttctcggaca

SEQ ID NO: 386402 - DNA, 25 bp, Mus musculus
ctggcaggttaatacttctcggaca

SEQ ID NO: 386403 - DNA, 25 bp, Mus musculus
ctggcagtcagtcacctatgtaagg

SEQ ID NO: 386404 - DNA, 25 bp, Mus musculus
ctggcagtcagtgacctatgtaagg

SEQ ID NO: 386405 - DNA, 25 bp, Mus musculus
ctggcagtggccattgacaatgtgt

SEQ ID NO: 386406 - DNA, 25 bp, Mus musculus
ctggcagtggcctttgacaatgtgt

SEQ ID NO: 386407 - DNA, 25 bp, Mus musculus
ctggcagttggcatccttggagtga

SEQ ID NO: 386408 - DNA, 25 bp, Mus musculus
ctggcagttggcttccttggagtga

SEQ ID NO: 386409 - DNA, 25 bp, Mus musculus
ctggcatagcttcactaacacctga

SEQ ID NO: 386410 - DNA, 25 bp, Mus musculus
ctggcatagcttgactaacacctga

SEQ ID NO: 386411 - DNA, 25 bp, Mus musculus
ctggcatcagacaccgtgcttctga

SEQ ID NO: 386412 - DNA, 25 bp, Mus musculus
ctggcatcagactccgtgcttctga

SEQ ID NO: 386413 - DNA, 25 bp, Mus musculus
ctggcatcagagattgaacctgctt

SEQ ID NO: 386414 - DNA, 25 bp, Mus musculus
ctggcatcagagtttgaacctgctt

SEQ ID NO: 386415 - DNA, 25 bp, Mus musculus
ctggcatcagatcgcgaagggactt

SEQ ID NO: 386416 - DNA, 25 bp, Mus musculus
ctggcatcagatggcgaagggactt

SEQ ID NO: 386417 - DNA, 25 bp, Mus musculus
ctggcatcatgccaaggaactctct

SEQ ID NO: 386418 - DNA, 25 bp, Mus musculus
ctggcatcatgcgaaggaactctct

SEQ ID NO: 386419 - DNA, 25 bp, Mus musculus
ctggcatccagtaatttctaattct

SEQ ID NO: 386420 - DNA, 25 bp, Mus musculus
ctggcatccagttatttctaattct

SEQ ID NO: 386421 - DNA, 25 bp, Mus musculus
ctggcatcctgtagataactacttc

SEQ ID NO: 386422 - DNA, 25 bp, Mus musculus
ctggcatcctgtcttgctggattga

SEQ ID NO: 386423 - DNA, 25 bp, Mus musculus
ctggcatcctgtgttgctggattga

SEQ ID NO: 386424 - DNA, 25 bp, Mus musculus
ctggcatcctgttgataactacttc

SEQ ID NO: 386425 - DNA, 25 bp, Mus musculus
ctggcatccttcacaagtggtttta

SEQ ID NO: 386426 - DNA, 25 bp, Mus musculus
ctggcatccttctcaagtggtttta

SEQ ID NO: 386427 - DNA, 25 bp, Mus musculus
ctggcatctcagacatcttaggata

SEQ ID NO: 386428 - DNA, 25 bp, Mus musculus
ctggcatctcagtcatcttaggata

SEQ ID NO: 386429 - DNA, 25 bp, Mus musculus
ctggcatctggacgcatcctgtatc

SEQ ID NO: 386430 - DNA, 25 bp, Mus musculus
ctggcatctggaggcatcctgtatc

SEQ ID NO: 386431 - DNA, 25 bp, Mus musculus
ctggcatcttggctgatgtcggtat

SEQ ID NO: 386432 - DNA, 25 bp, Mus musculus
ctggcatcttgggtgatgtcggtat

SEQ ID NO: 386433 - DNA, 25 bp, Mus musculus
ctggcatgaacacgcctttggcatc

SEQ ID NO: 386434 - DNA, 25 bp, Mus musculus
ctggcatgaacaggcctttggcatc

SEQ ID NO: 386435 - DNA, 25 bp, Mus musculus
ctggcatgaatcacattctgtttga

SEQ ID NO: 386436 - DNA, 25 bp, Mus musculus
ctggcatgaatctcattctgtttga

SEQ ID NO: 386437 - DNA, 25 bp, Mus musculus
ctggcatgagcgaggttccgcatcc

SEQ ID NO: 386438 - DNA, 25 bp, Mus musculus
ctggcatgagcgtggttccgcatcc

SEQ ID NO: 386439 - DNA, 25 bp, Mus musculus
ctggcatgcagtcgctttcatatga

SEQ ID NO: 386440 - DNA, 25 bp, Mus musculus
ctggcatgcagtggctttcatatga

SEQ ID NO: 386441 - DNA, 25 bp, Mus musculus
ctggcatgctcaaggcctggattta

SEQ ID NO: 386442 - DNA, 25 bp, Mus musculus
ctggcatgctcatggcctggattta

SEQ ID NO: 386443 - DNA, 25 bp, Mus musculus
ctggcatggcagaatatctctttga

SEQ ID NO: 386444 - DNA, 25 bp, Mus musculus
ctggcatggcagtatatctctttga

SEQ ID NO: 386445 - DNA, 25 bp, Mus musculus
ctggcatggccaccgtctagtggac

SEQ ID NO: 386446 - DNA, 25 bp, Mus musculus
ctggcatggccagcgtctagtggac

SEQ ID NO: 386447 - DNA, 25 bp, Mus musculus
ctggcatgggtcaggctgagagtct

SEQ ID NO: 386448 - DNA, 25 bp, Mus musculus
ctggcatgggtctggctgagagtct

SEQ ID NO: 386449 - DNA, 25 bp, Mus musculus
ctggcatgtgccatgaaggcggcaa

SEQ ID NO: 386450 - DNA, 25 bp, Mus musculus
ctggcatgtgccttgaaggcggcaa

SEQ ID NO: 386451 - DNA, 25 bp, Mus musculus
ctggcatgtttcaggaggtttcaaa

SEQ ID NO: 386452 - DNA, 25 bp, Mus musculus
ctggcatgtttctggaggtttcaaa

SEQ ID NO: 386453 - DNA, 25 bp, Mus musculus
ctggcatgtttgctaattcccttaa

SEQ ID NO: 386454 - DNA, 25 bp, Mus musculus
ctggcatgtttggtaattcccttaa

SEQ ID NO: 386455 - DNA, 25 bp, Mus musculus
ctggcattaggaaaaatggcagcaa

SEQ ID NO: 386456 - DNA, 25 bp, Mus musculus
ctggcattaggataaatggcagcaa

SEQ ID NO: 386457 - DNA, 25 bp, Mus musculus
ctggcattcacaaagctgattcaat

SEQ ID NO: 386458 - DNA, 25 bp, Mus musculus
ctggcattcacatagctgattcaat

SEQ ID NO: 386459 - DNA, 25 bp, Mus musculus
ctggcattcagacacgagagaggaa

SEQ ID NO: 386460 - DNA, 25 bp, Mus musculus
ctggcattcagagacgagagaggaa

SEQ ID NO: 386461 - DNA, 25 bp, Mus musculus
ctggcattgcctacgaaccaagatg

SEQ ID NO: 386462 - DNA, 25 bp, Mus musculus
ctggcattgccttcgaaccaagatg

SEQ ID NO: 386463 - DNA, 25 bp, Mus musculus
ctggcatttccaagtcgagcagaaa

SEQ ID NO: 386464 - DNA, 25 bp, Mus musculus
ctggcatttccatgtcgagcagaaa

SEQ ID NO: 386465 - DNA, 25 bp, Mus musculus
ctggcatttctgcagaactttattt

SEQ ID NO: 386466 - DNA, 25 bp, Mus musculus
ctggcatttctggagaactttattt

SEQ ID NO: 386467 - DNA, 25 bp, Mus musculus
ctggccaaaaagagacacctgtgat

SEQ ID NO: 386468 - DNA, 25 bp, Mus musculus
ctggccaaaaagtgacacctgtgat

SEQ ID NO: 386469 - DNA, 25 bp, Mus musculus
ctggccaaatgtctatctcgctcaa

SEQ ID NO: 386470 - DNA, 25 bp, Mus musculus
ctggccaaatgtgtatctcgctcaa

SEQ ID NO: 386471 - DNA, 25 bp, Mus musculus
ctggccaacctcagtgttgagcatg

SEQ ID NO: 386472 - DNA, 25 bp, Mus musculus
ctggccaacctctgtgttgagcatg

SEQ ID NO: 386473 - DNA, 25 bp, Mus musculus
ctggccaacgatcagctaatcctga

SEQ ID NO: 386474 - DNA, 25 bp, Mus musculus
ctggccaacgatgagctaatcctga

SEQ ID NO: 386475 - DNA, 25 bp, Mus musculus
ctggccaactctatctatagaacaa

SEQ ID NO: 386476 - DNA, 25 bp, Mus musculus
ctggccaactctttctatagaacaa

SEQ ID NO: 386477 - DNA, 25 bp, Mus musculus
ctggccaagattagattgacaagcc

SEQ ID NO: 386478 - DNA, 25 bp, Mus musculus
ctggccaagatttgattgacaagcc

SEQ ID NO: 386479 - DNA, 25 bp, Mus musculus
ctggccaaggctcagacgtcaatga

SEQ ID NO: 386480 - DNA, 25 bp, Mus musculus
ctggccaaggctgagacgtcaatga

SEQ ID NO: 386481 - DNA, 25 bp, Mus musculus
ctggccaaggtgagcgagctgctaa

SEQ ID NO: 386482 - DNA, 25 bp, Mus musculus
ctggccaaggtgtgcgagctgctaa

SEQ ID NO: 386483 - DNA, 25 bp, Mus musculus
ctggccacctcaattttaaatgcat

SEQ ID NO: 386484 - DNA, 25 bp, Mus musculus
ctggccacctcatttttaaatgcat

SEQ ID NO: 386485 - DNA, 25 bp, Mus musculus
ctggccacgcgacatttctgttagg

SEQ ID NO: 386486 - DNA, 25 bp, Mus musculus
ctggccacgcgagatttctgttagg

SEQ ID NO: 386487 - DNA, 25 bp, Mus musculus
ctggccacgtggcaagtttatcatt

SEQ ID NO: 386488 - DNA, 25 bp, Mus musculus
ctggccacgtgggaagtttatcatt

SEQ ID NO: 386489 - DNA, 25 bp, Mus musculus
ctggccactcccaaaaagttgtgtg

SEQ ID NO: 386490 - DNA, 25 bp, Mus musculus
ctggccactccctaaaagttgtgtg

SEQ ID NO: 386491 - DNA, 25 bp, Mus musculus
ctggccactcctacgtaaggcaata

SEQ ID NO: 386492 - DNA, 25 bp, Mus musculus
ctggccactccttcgtaaggcaata

SEQ ID NO: 386493 - DNA, 25 bp, Mus musculus
ctggccacttaacaaacagcgttgt

SEQ ID NO: 386494 - DNA, 25 bp, Mus musculus
ctggccacttaagaaacagcgttgt

SEQ ID NO: 386495 - DNA, 25 bp, Mus musculus
ctggccacttgaaaggtctttccat

SEQ ID NO: 386496 - DNA, 25 bp, Mus musculus
ctggccacttgataggtctttccat

SEQ ID NO: 386497 - DNA, 25 bp, Mus musculus
ctggccagaattagggttctacttt

SEQ ID NO: 386498 - DNA, 25 bp, Mus musculus
ctggccagaatttgggttctacttt

SEQ ID NO: 386499 - DNA, 25 bp, Mus musculus
ctggccagatctccaatcataatct

SEQ ID NO: 386500 - DNA, 25 bp, Mus musculus
ctggccagatctgcaatcataatct

SEQ ID NO: 386501 - DNA, 25 bp, Mus musculus
ctggccagcaccaggttcactgaga

SEQ ID NO: 386502 - DNA, 25 bp, Mus musculus
ctggccagcacctggttcactgaga

SEQ ID NO: 386503 - DNA, 25 bp, Mus musculus
ctggccagcaggagggtcattctta

SEQ ID NO: 386504 - DNA, 25 bp, Mus musculus
ctggccagcaggtgggtcattctta

SEQ ID NO: 386505 - DNA, 25 bp, Mus musculus
ctggccagccgcatgattgaagtcg

SEQ ID NO: 386506 - DNA, 25 bp, Mus musculus
ctggccagccgcttgattgaagtcg

SEQ ID NO: 386507 - DNA, 25 bp, Mus musculus
ctggccagcttcatggcacaacaaa

SEQ ID NO: 386508 - DNA, 25 bp, Mus musculus
ctggccagcttcttggcacaacaaa

SEQ ID NO: 386509 - DNA, 25 bp, Mus musculus
ctggccaggaagctatagacaacta

SEQ ID NO: 386510 - DNA, 25 bp, Mus musculus
ctggccaggaaggtatagacaacta

SEQ ID NO: 386511 - DNA, 25 bp, Mus musculus
ctggccaggatgaataagcatgcat

SEQ ID NO: 386512 - DNA, 25 bp, Mus musculus
ctggccaggatgtataagcatgcat

SEQ ID NO: 386513 - DNA, 25 bp, Mus musculus
ctggccaggcagacacgagtgcgaa

SEQ ID NO: 386514 - DNA, 25 bp, Mus musculus
ctggccaggcagactagctgaatca

SEQ ID NO: 386515 - DNA, 25 bp, Mus musculus
ctggccaggcagtcacgagtgcgaa

SEQ ID NO: 386516 - DNA, 25 bp, Mus musculus
ctggccaggcagtctagctgaatca

SEQ ID NO: 386517 - DNA, 25 bp, Mus musculus
ctggccagggcgctatagtgatcat

SEQ ID NO: 386518 - DNA, 25 bp, Mus musculus
ctggccagggcggtatagtgatcat

SEQ ID NO: 386519 - DNA, 25 bp, Mus musculus
ctggccagggttcttgggaagcacc

SEQ ID NO: 386520 - DNA, 25 bp, Mus musculus
ctggccagggttgttgggaagcacc

SEQ ID NO: 386521 - DNA, 25 bp, Mus musculus
ctggccagtaagaagcacgccttta

SEQ ID NO: 386522 - DNA, 25 bp, Mus musculus
ctggccagtaagtagcacgccttta

SEQ ID NO: 386523 - DNA, 25 bp, Mus musculus
ctggccagtcccaattactgttaag

SEQ ID NO: 386524 - DNA, 25 bp, Mus musculus
ctggccagtccctattactgttaag

SEQ ID NO: 386525 - DNA, 25 bp, Mus musculus
ctggccataagtcttctttatttat

SEQ ID NO: 386526 - DNA, 25 bp, Mus musculus
ctggccataagtgttctttatttat

SEQ ID NO: 386527 - DNA, 25 bp, Mus musculus
ctggccatcctacaagttcctagat

SEQ ID NO: 386528 - DNA, 25 bp, Mus musculus
ctggccatcctagaagttcctagat

SEQ ID NO: 386529 - DNA, 25 bp, Mus musculus
ctggccatccttcctgaatcattag

SEQ ID NO: 386530 - DNA, 25 bp, Mus musculus
ctggccatccttgctgaatcattag

SEQ ID NO: 386531 - DNA, 25 bp, Mus musculus
ctggccatcgaacacccacaagtgg

SEQ ID NO: 386532 - DNA, 25 bp, Mus musculus
ctggccatcgaagacccacaagtgg

SEQ ID NO: 386533 - DNA, 25 bp, Mus musculus
ctggccatcggacttttctttgatc

SEQ ID NO: 386534 - DNA, 25 bp, Mus musculus
ctggccatcggagttttctttgatc

SEQ ID NO: 386535 - DNA, 25 bp, Mus musculus
ctggccatgaggaaccactgatgat

SEQ ID NO: 386536 - DNA, 25 bp, Mus musculus
ctggccatgaggtaccactgatgat

SEQ ID NO: 386537 - DNA, 25 bp, Mus musculus
ctggccatgcagcaagtgccctgta

SEQ ID NO: 386538 - DNA, 25 bp, Mus musculus
ctggccatgcaggaagtgccctgta

SEQ ID NO: 386539 - DNA, 25 bp, Mus musculus
ctggccattcaacgtcactgtcaga

SEQ ID NO: 386540 - DNA, 25 bp, Mus musculus
ctggccattcaaggtcactgtcaga

SEQ ID NO: 386541 - DNA, 25 bp, Mus musculus
ctggccattgagagattctggctca

SEQ ID NO: 386542 - DNA, 25 bp, Mus musculus
ctggccattgagtgattctggctca

SEQ ID NO: 386543 - DNA, 25 bp, Mus musculus
ctggccattggcatgatgccacaag

SEQ ID NO: 386544 - DNA, 25 bp, Mus musculus
ctggccattggcatgtcctggtctc

SEQ ID NO: 386545 - DNA, 25 bp, Mus musculus
ctggccattggcttgatgccacaag

SEQ ID NO: 386546 - DNA, 25 bp, Mus musculus
ctggccattggcttgtcctggtctc

SEQ ID NO: 386547 - DNA, 25 bp, Mus musculus
ctggccattgtgcagcgagtgaaca

SEQ ID NO: 386548 - DNA, 25 bp, Mus musculus
ctggccattgtggagcgagtgaaca

SEQ ID NO: 386549 - DNA, 25 bp, Mus musculus
ctggcccaaaatcgtgtgcagctct

SEQ ID NO: 386550 - DNA, 25 bp, Mus musculus
ctggcccaaaatggtgtgcagctct

SEQ ID NO: 386551 - DNA, 25 bp, Mus musculus
ctggcccaagcacgctgcattatga

SEQ ID NO: 386552 - DNA, 25 bp, Mus musculus
ctggcccaagcaggctgcattatga

SEQ ID NO: 386553 - DNA, 25 bp, Mus musculus
ctggcccaaggcagtttatgtgtat

SEQ ID NO: 386554 - DNA, 25 bp, Mus musculus
ctggcccaaggctgtttatgtgtat

SEQ ID NO: 386555 - DNA, 25 bp, Mus musculus
ctggcccacactagtataatcactt

SEQ ID NO: 386556 - DNA, 25 bp, Mus musculus
ctggcccacacttgtataatcactt

SEQ ID NO: 386557 - DNA, 25 bp, Mus musculus
ctggcccactaaataaggtaacaat

SEQ ID NO: 386558 - DNA, 25 bp, Mus musculus
ctggcccactaattaaggtaacaat

SEQ ID NO: 386559 - DNA, 25 bp, Mus musculus
ctggcccactgccttttttgtaagg

SEQ ID NO: 386560 - DNA, 25 bp, Mus musculus
ctggcccactgcgttttttgtaagg

SEQ ID NO: 386561 - DNA, 25 bp, Mus musculus
ctggcccacttaatcacttttgtat

SEQ ID NO: 386562 - DNA, 25 bp, Mus musculus
ctggcccacttattcacttttgtat

SEQ ID NO: 386563 - DNA, 25 bp, Mus musculus
ctggcccagcaactttctcaaaggt

SEQ ID NO: 386564 - DNA, 25 bp, Mus musculus
ctggcccagcaagtttctcaaaggt

SEQ ID NO: 386565 - DNA, 25 bp, Mus musculus
ctggcccagccaagttgacaaggag

SEQ ID NO: 386566 - DNA, 25 bp, Mus musculus
ctggcccagccatgttgacaaggag

SEQ ID NO: 386567 - DNA, 25 bp, Mus musculus
ctggcccaggccagcatgcacacac

SEQ ID NO: 386568 - DNA, 25 bp, Mus musculus
ctggcccaggcctgcatgcacacac

SEQ ID NO: 386569 - DNA, 25 bp, Mus musculus
ctggcccagggcaggcaagcagtaa

SEQ ID NO: 386570 - DNA, 25 bp, Mus musculus
ctggcccagggctggcaagcagtaa

SEQ ID NO: 386571 - DNA, 25 bp, Mus musculus
ctggcccatgcaataagacgtcaca

SEQ ID NO: 386572 - DNA, 25 bp, Mus musculus
ctggcccatgcattaagacgtcaca

SEQ ID NO: 386573 - DNA, 25 bp, Mus musculus
ctggcccattgtaaactctcacaaa

SEQ ID NO: 386574 - DNA, 25 bp, Mus musculus
ctggcccattgttaactctcacaaa

SEQ ID NO: 386575 - DNA, 25 bp, Mus musculus
ctggcccattttaaggtaatctcat

SEQ ID NO: 386576 - DNA, 25 bp, Mus musculus
ctggcccatttttaggtaatctcat

SEQ ID NO: 386577 - DNA, 25 bp, Mus musculus
ctggccccagaaacgagatcctgac

SEQ ID NO: 386578 - DNA, 25 bp, Mus musculus
ctggccccagaatcgagatcctgac

SEQ ID NO: 386579 - DNA, 25 bp, Mus musculus
ctggccccaggacctgtacaaaaag

SEQ ID NO: 386580 - DNA, 25 bp, Mus musculus
ctggccccaggacgttcaacatgaa

SEQ ID NO: 386581 - DNA, 25 bp, Mus musculus
ctggccccaggagctgtacaaaaag

SEQ ID NO: 386582 - DNA, 25 bp, Mus musculus
ctggccccaggaggttcaacatgaa

SEQ ID NO: 386583 - DNA, 25 bp, Mus musculus
ctggccccagtgcagattaaggttg

SEQ ID NO: 386584 - DNA, 25 bp, Mus musculus
ctggccccagtggagattaaggttg

SEQ ID NO: 386585 - DNA, 25 bp, Mus musculus
ctggccccattaccaaggtaagact

SEQ ID NO: 386586 - DNA, 25 bp, Mus musculus
ctggccccattagcaaggtaagact

SEQ ID NO: 386587 - DNA, 25 bp, Mus musculus
ctggccccgagtcatgtgttttgcc

SEQ ID NO: 386588 - DNA, 25 bp, Mus musculus
ctggccccgagtgatgtgttttgcc

SEQ ID NO: 386589 - DNA, 25 bp, Mus musculus
ctggccccgtggatacatggtagta

SEQ ID NO: 386590 - DNA, 25 bp, Mus musculus
ctggccccgtggttacatggtagta

SEQ ID NO: 386591 - DNA, 25 bp, Mus musculus
ctggcccctgggatagtgtcttgtg

SEQ ID NO: 386592 - DNA, 25 bp, Mus musculus
ctggcccctgggttagtgtcttgtg

SEQ ID NO: 386593 - DNA, 25 bp, Mus musculus
ctggcccgcaggacatgtgtgcaag

SEQ ID NO: 386594 - DNA, 25 bp, Mus musculus
ctggcccgcaggtcatgtgtgcaag

SEQ ID NO: 386595 - DNA, 25 bp, Mus musculus
ctggccctaatacagtaccacttat

SEQ ID NO: 386596 - DNA, 25 bp, Mus musculus
ctggccctaatagagtaccacttat

SEQ ID NO: 386597 - DNA, 25 bp, Mus musculus
ctggccctcgagaggaaatgtggat

SEQ ID NO: 386598 - DNA, 25 bp, Mus musculus
ctggccctcgagtggaaatgtggat

SEQ ID NO: 386599 - DNA, 25 bp, Mus musculus
ctggccctcggaaaactctggctat

SEQ ID NO: 386600 - DNA, 25 bp, Mus musculus
ctggccctcggataactctggctat

SEQ ID NO: 386601 - DNA, 25 bp, Mus musculus
ctggccctcttccatatggatattt

SEQ ID NO: 386602 - DNA, 25 bp, Mus musculus
ctggccctcttcgatatggatattt

SEQ ID NO: 386603 - DNA, 25 bp, Mus musculus
ctggccctgagtcatggagcgtaat

SEQ ID NO: 386604 - DNA, 25 bp, Mus musculus
ctggccctgagtgatggagcgtaat

SEQ ID NO: 386605 - DNA, 25 bp, Mus musculus
ctggccctgggcaactagaaacatt

SEQ ID NO: 386606 - DNA, 25 bp, Mus musculus
ctggccctgggcaatgaaaagacag

SEQ ID NO: 386607 - DNA, 25 bp, Mus musculus
ctggccctgggctactagaaacatt

SEQ ID NO: 386608 - DNA, 25 bp, Mus musculus
ctggccctgggctatgaaaagacag

SEQ ID NO: 386609 - DNA, 25 bp, Mus musculus
ctggccctgggtattgactttgcaa

SEQ ID NO: 386610 - DNA, 25 bp, Mus musculus
ctggccctgggttttgactttgcaa

SEQ ID NO: 386611 - DNA, 25 bp, Mus musculus
ctggcccttctgaggagctcagacc

SEQ ID NO: 386612 - DNA, 25 bp, Mus musculus
ctggcccttctgtggagctcagacc

SEQ ID NO: 386613 - DNA, 25 bp, Mus musculus
ctggcccttgcacatgtggattgat

SEQ ID NO: 386614 - DNA, 25 bp, Mus musculus
ctggcccttgcagatgtggattgat

SEQ ID NO: 386615 - DNA, 25 bp, Mus musculus
ctggccgaaattatacccttgaaga

SEQ ID NO: 386616 - DNA, 25 bp, Mus musculus
ctggccgaaattttacccttgaaga

SEQ ID NO: 386617 - DNA, 25 bp, Mus musculus
ctggccgacttcctatcctttgaca

SEQ ID NO: 386618 - DNA, 25 bp, Mus musculus
ctggccgacttcgtatcctttgaca

SEQ ID NO: 386619 - DNA, 25 bp, Mus musculus
ctggccgactttccttctgtaaagt

SEQ ID NO: 386620 - DNA, 25 bp, Mus musculus
ctggccgactttgcttctgtaaagt

SEQ ID NO: 386621 - DNA, 25 bp, Mus musculus
ctggccgaggaactccaatgggcat

SEQ ID NO: 386622 - DNA, 25 bp, Mus musculus
ctggccgaggaagtccaatgggcat

SEQ ID NO: 386623 - DNA, 25 bp, Mus musculus
ctggccgcatgtccgttcttaagaa

SEQ ID NO: 386624 - DNA, 25 bp, Mus musculus
ctggccgcatgtgcgttcttaagaa

SEQ ID NO: 386625 - DNA, 25 bp, Mus musculus
ctggccggcaacattgactacaagt

SEQ ID NO: 386626 - DNA, 25 bp, Mus musculus
ctggccggcaactttgactacaagt

SEQ ID NO: 386627 - DNA, 25 bp, Mus musculus
ctggccggcagaactcaatcttggg

SEQ ID NO: 386628 - DNA, 25 bp, Mus musculus
ctggccggcagatctcaatcttggg

SEQ ID NO: 386629 - DNA, 25 bp, Mus musculus
ctggccggccggctgcgggtggcag

SEQ ID NO: 386630 - DNA, 25 bp, Mus musculus
ctggccggccgggtgcgggtggcag

SEQ ID NO: 386631 - DNA, 25 bp, Mus musculus
ctggccgtatctcccatggagggaa

SEQ ID NO: 386632 - DNA, 25 bp, Mus musculus
ctggccgtatctgccatggagggaa

SEQ ID NO: 386633 - DNA, 25 bp, Mus musculus
ctggccgtgaatcactttgacctgg

SEQ ID NO: 386634 - DNA, 25 bp, Mus musculus
ctggccgtgaatgactttgacctgg

SEQ ID NO: 386635 - DNA, 25 bp, Mus musculus
ctggccgtgactccctgtgggcata

SEQ ID NO: 386636 - DNA, 25 bp, Mus musculus
ctggccgtgactgcctgtgggcata

SEQ ID NO: 386637 - DNA, 25 bp, Mus musculus
ctggccgtgcaactaaggtcaccgg

SEQ ID NO: 386638 - DNA, 25 bp, Mus musculus
ctggccgtgcaagtaaggtcaccgg

SEQ ID NO: 386639 - DNA, 25 bp, Mus musculus
ctggccgtgcctaaaacaagggcgg

SEQ ID NO: 386640 - DNA, 25 bp, Mus musculus
ctggccgtgcctaccacaagtacaa

SEQ ID NO: 386641 - DNA, 25 bp, Mus musculus
ctggccgtgccttaaacaagggcgg

SEQ ID NO: 386642 - DNA, 25 bp, Mus musculus
ctggccgtgccttccacaagtacaa

SEQ ID NO: 386643 - DNA, 25 bp, Mus musculus
ctggccgtggacattgacaactttg

SEQ ID NO: 386644 - DNA, 25 bp, Mus musculus
ctggccgtggactttgacaactttg

SEQ ID NO: 386645 - DNA, 25 bp, Mus musculus
ctggccgtgtgcactatcagaaggg

SEQ ID NO: 386646 - DNA, 25 bp, Mus musculus
ctggccgtgtgctctatcagaaggg

SEQ ID NO: 386647 - DNA, 25 bp, Mus musculus
ctggccgttttcatcaagtgtggta

SEQ ID NO: 386648 - DNA, 25 bp, Mus musculus
ctggccgttttcttcaagtgtggta

SEQ ID NO: 386649 - DNA, 25 bp, Mus musculus
ctggcctaactaaataacccttgac

SEQ ID NO: 386650 - DNA, 25 bp, Mus musculus
ctggcctaactatataacccttgac

SEQ ID NO: 386651 - DNA, 25 bp, Mus musculus
ctggcctaactcagtcctgaccgtt

SEQ ID NO: 386652 - DNA, 25 bp, Mus musculus
ctggcctaactcatgctgggatgca

SEQ ID NO: 386653 - DNA, 25 bp, Mus musculus
ctggcctaactctgtcctgaccgtt

SEQ ID NO: 386654 - DNA, 25 bp, Mus musculus
ctggcctaactcttgctgggatgca

SEQ ID NO: 386655 - DNA, 25 bp, Mus musculus
ctggcctacatcaactgctgtgtta

SEQ ID NO: 386656 - DNA, 25 bp, Mus musculus
ctggcctacatctactgctgtgtta

SEQ ID NO: 386657 - DNA, 25 bp, Mus musculus
ctggcctagttacgcctgtttagga

SEQ ID NO: 386658 - DNA, 25 bp, Mus musculus
ctggcctagttaggcctgtttagga

SEQ ID NO: 386659 - DNA, 25 bp, Mus musculus
ctggcctataaactacctaaattct

SEQ ID NO: 386660 - DNA, 25 bp, Mus musculus
ctggcctataaagtacctaaattct

SEQ ID NO: 386661 - DNA, 25 bp, Mus musculus
ctggcctataggaagctacccataa

SEQ ID NO: 386662 - DNA, 25 bp, Mus musculus
ctggcctataggtagctacccataa

SEQ ID NO: 386663 - DNA, 25 bp, Mus musculus
ctggcctatgaactaactgtgctgg

SEQ ID NO: 386664 - DNA, 25 bp, Mus musculus
ctggcctatgaagtaactgtgctgg

SEQ ID NO: 386665 - DNA, 25 bp, Mus musculus
ctggcctcacagacggtctgtccaa

SEQ ID NO: 386666 - DNA, 25 bp, Mus musculus
ctggcctcacagtcggtctgtccaa

SEQ ID NO: 386667 - DNA, 25 bp, Mus musculus
ctggcctcagatacattgctgtgga

SEQ ID NO: 386668 - DNA, 25 bp, Mus musculus
ctggcctcagattcattgctgtgga

SEQ ID NO: 386669 - DNA, 25 bp, Mus musculus
ctggcctcataaactacagccttga

SEQ ID NO: 386670 - DNA, 25 bp, Mus musculus
ctggcctcataatctacagccttga

SEQ ID NO: 386671 - DNA, 25 bp, Mus musculus
ctggcctcatatagctgtgtgtcag

SEQ ID NO: 386672 - DNA, 25 bp, Mus musculus
ctggcctcatattgctgtgtgtcag

SEQ ID NO: 386673 - DNA, 25 bp, Mus musculus
ctggcctccataagtgcacacacag

SEQ ID NO: 386674 - DNA, 25 bp, Mus musculus
ctggcctccatatgtgcacacacag

SEQ ID NO: 386675 - DNA, 25 bp, Mus musculus
ctggcctcccagaagtcgatagaac

SEQ ID NO: 386676 - DNA, 25 bp, Mus musculus
ctggcctcccagtagtcgatagaac

SEQ ID NO: 386677 - DNA, 25 bp, Mus musculus
ctggcctccgagatactagacaaga

SEQ ID NO: 386678 - DNA, 25 bp, Mus musculus
ctggcctccgagttactagacaaga

SEQ ID NO: 386679 - DNA, 25 bp, Mus musculus
ctggcctccttgacttatgtgtaat

SEQ ID NO: 386680 - DNA, 25 bp, Mus musculus
ctggcctccttgcaactgggtaatg

SEQ ID NO: 386681 - DNA, 25 bp, Mus musculus
ctggcctccttggaactgggtaatg

SEQ ID NO: 386682 - DNA, 25 bp, Mus musculus
ctggcctccttgtcttatgtgtaat

SEQ ID NO: 386683 - DNA, 25 bp, Mus musculus
ctggcctcgaacatttgagagtgtt

SEQ ID NO: 386684 - DNA, 25 bp, Mus musculus
ctggcctcgaacttttgagagtgtt

SEQ ID NO: 386685 - DNA, 25 bp, Mus musculus
ctggcctcgtgtctatattctaaaa

SEQ ID NO: 386686 - DNA, 25 bp, Mus musculus
ctggcctcgtgtgtatattctaaaa

SEQ ID NO: 386687 - DNA, 25 bp, Mus musculus
ctggcctctactacgtagacagcga

SEQ ID NO: 386688 - DNA, 25 bp, Mus musculus
ctggcctctacttcgtagacagcga

SEQ ID NO: 386689 - DNA, 25 bp, Mus musculus
ctggcctctccaagttagtgctttg

SEQ ID NO: 386690 - DNA, 25 bp, Mus musculus
ctggcctctccactggatgtggtaa

SEQ ID NO: 386691 - DNA, 25 bp, Mus musculus
ctggcctctccagtggatgtggtaa

SEQ ID NO: 386692 - DNA, 25 bp, Mus musculus
ctggcctctccatgttagtgctttg

SEQ ID NO: 386693 - DNA, 25 bp, Mus musculus
ctggcctctcttccagctgcattgg

SEQ ID NO: 386694 - DNA, 25 bp, Mus musculus
ctggcctctcttgcagctgcattgg

SEQ ID NO: 386695 - DNA, 25 bp, Mus musculus
ctggcctgaaggagggcgactacat

SEQ ID NO: 386696 - DNA, 25 bp, Mus musculus
ctggcctgaaggtgggcgactacat

SEQ ID NO: 386697 - DNA, 25 bp, Mus musculus
ctggcctgagccaactgtgctgggt

SEQ ID NO: 386698 - DNA, 25 bp, Mus musculus
ctggcctgagcctactgtgctgggt

SEQ ID NO: 386699 - DNA, 25 bp, Mus musculus
ctggcctgcactcacacatatgtca

SEQ ID NO: 386700 - DNA, 25 bp, Mus musculus
ctggcctgcactgacacatatgtca

SEQ ID NO: 386701 - DNA, 25 bp, Mus musculus
ctggcctgcctgcatggctacatga

SEQ ID NO: 386702 - DNA, 25 bp, Mus musculus
ctggcctgcctggatggctacatga

SEQ ID NO: 386703 - DNA, 25 bp, Mus musculus
ctggcctgcggcactgggctgacat

SEQ ID NO: 386704 - DNA, 25 bp, Mus musculus
ctggcctgcggctctgggctgacat

SEQ ID NO: 386705 - DNA, 25 bp, Mus musculus
ctggcctgcttgattgcctgaggat

SEQ ID NO: 386706 - DNA, 25 bp, Mus musculus
ctggcctgcttgtttgcctgaggat

SEQ ID NO: 386707 - DNA, 25 bp, Mus musculus
ctggcctggcagaagtccacaacat

SEQ ID NO: 386708 - DNA, 25 bp, Mus musculus
ctggcctggcagcacctaggaaaga

SEQ ID NO: 386709 - DNA, 25 bp, Mus musculus
ctggcctggcaggacctaggaaaga

SEQ ID NO: 386710 - DNA, 25 bp, Mus musculus
ctggcctggcagtagtccacaacat

SEQ ID NO: 386711 - DNA, 25 bp, Mus musculus
ctggcctggcgacaagagacgttcc

SEQ ID NO: 386712 - DNA, 25 bp, Mus musculus
ctggcctggcgagaagagacgttcc

SEQ ID NO: 386713 - DNA, 25 bp, Mus musculus
ctggcctggtaccttttcatctgtt

SEQ ID NO: 386714 - DNA, 25 bp, Mus musculus
ctggcctggtacgttttcatctgtt

SEQ ID NO: 386715 - DNA, 25 bp, Mus musculus
ctggcctggttgcacacatctgtaa

SEQ ID NO: 386716 - DNA, 25 bp, Mus musculus
ctggcctggttggacacatctgtaa

SEQ ID NO: 386717 - DNA, 25 bp, Mus musculus
ctggcctgtattatgtactccatac

SEQ ID NO: 386718 - DNA, 25 bp, Mus musculus
ctggcctgtattttgtactccatac

SEQ ID NO: 386719 - DNA, 25 bp, Mus musculus
ctggcctgtctcagtctggaggttc

SEQ ID NO: 386720 - DNA, 25 bp, Mus musculus
ctggcctgtctctgtctggaggttc

SEQ ID NO: 386721 - DNA, 25 bp, Mus musculus
ctggcctgtgccacttgggagcaag

SEQ ID NO: 386722 - DNA, 25 bp, Mus musculus
ctggcctgtgcctcttgggagcaag

SEQ ID NO: 386723 - DNA, 25 bp, Mus musculus
ctggcctgttacaatacaccttttg

SEQ ID NO: 386724 - DNA, 25 bp, Mus musculus
ctggcctgttactatacaccttttg

SEQ ID NO: 386725 - DNA, 25 bp, Mus musculus
ctggccttaagcatactattgaatt

SEQ ID NO: 386726 - DNA, 25 bp, Mus musculus
ctggccttaagcttactattgaatt

SEQ ID NO: 386727 - DNA, 25 bp, Mus musculus
ctggccttaatcctattttcgttct

SEQ ID NO: 386728 - DNA, 25 bp, Mus musculus
ctggccttaatcgtattttcgttct

SEQ ID NO: 386729 - DNA, 25 bp, Mus musculus
ctggccttacctctgtggaaataat

SEQ ID NO: 386730 - DNA, 25 bp, Mus musculus
ctggccttacctgtgtggaaataat

SEQ ID NO: 386731 - DNA, 25 bp, Mus musculus
ctggccttacttaagtctctgcttg

SEQ ID NO: 386732 - DNA, 25 bp, Mus musculus
ctggccttactttagtctctgcttg

SEQ ID NO: 386733 - DNA, 25 bp, Mus musculus
ctggccttcacgatctatgagagac

SEQ ID NO: 386734 - DNA, 25 bp, Mus musculus
ctggccttcacgttctatgagagac

SEQ ID NO: 386735 - DNA, 25 bp, Mus musculus
ctggccttcagaccatcttttaaga

SEQ ID NO: 386736 - DNA, 25 bp, Mus musculus
ctggccttcagagcatcttttaaga

SEQ ID NO: 386737 - DNA, 25 bp, Mus musculus
ctggccttcaggcaaagatccaaga

SEQ ID NO: 386738 - DNA, 25 bp, Mus musculus
ctggccttcagggaaagatccaaga

SEQ ID NO: 386739 - DNA, 25 bp, Mus musculus
ctggccttccaaccactgcaaaaga

SEQ ID NO: 386740 - DNA, 25 bp, Mus musculus
ctggccttccaagcactgcaaaaga

SEQ ID NO: 386741 - DNA, 25 bp, Mus musculus
ctggccttcgctacttaatttattt

SEQ ID NO: 386742 - DNA, 25 bp, Mus musculus
ctggccttcgcttcttaatttattt

SEQ ID NO: 386743 - DNA, 25 bp, Mus musculus
ctggccttctaaagaccattgcagc

SEQ ID NO: 386744 - DNA, 25 bp, Mus musculus
ctggccttctaatgaccattgcagc

SEQ ID NO: 386745 - DNA, 25 bp, Mus musculus
ctggccttctagaacggcagggaat

SEQ ID NO: 386746 - DNA, 25 bp, Mus musculus
ctggccttctagtacggcagggaat

SEQ ID NO: 386747 - DNA, 25 bp, Mus musculus
ctggccttctcacggcctttttgga

SEQ ID NO: 386748 - DNA, 25 bp, Mus musculus
ctggccttctcagggcctttttgga

SEQ ID NO: 386749 - DNA, 25 bp, Mus musculus
ctggccttgaacatgagtcctgttt

SEQ ID NO: 386750 - DNA, 25 bp, Mus musculus
ctggccttgaacttgagtcctgttt

SEQ ID NO: 386751 - DNA, 25 bp, Mus musculus
ctggccttgaatatatcatctggtt

SEQ ID NO: 386752 - DNA, 25 bp, Mus musculus
ctggccttgaatttatcatctggtt

SEQ ID NO: 386753 - DNA, 25 bp, Mus musculus
ctggccttgactatggagtaatgct

SEQ ID NO: 386754 - DNA, 25 bp, Mus musculus
ctggccttgactttggagtaatgct

SEQ ID NO: 386755 - DNA, 25 bp, Mus musculus
ctggccttgattcagtattccaaat

SEQ ID NO: 386756 - DNA, 25 bp, Mus musculus
ctggccttgattgagtattccaaat

SEQ ID NO: 386757 - DNA, 25 bp, Mus musculus
ctggccttgcacacattgagatctg

SEQ ID NO: 386758 - DNA, 25 bp, Mus musculus
ctggccttgcactcattgagatctg

SEQ ID NO: 386759 - DNA, 25 bp, Mus musculus
ctggccttggccaacttttttgagc

SEQ ID NO: 386760 - DNA, 25 bp, Mus musculus
ctggccttggccacaaaagtgcagg

SEQ ID NO: 386761 - DNA, 25 bp, Mus musculus
ctggccttggcctacttttttgagc

SEQ ID NO: 386762 - DNA, 25 bp, Mus musculus
ctggccttggcctcaaaagtgcagg

SEQ ID NO: 386763 - DNA, 25 bp, Mus musculus
ctggccttgggaattgctgtagctc

SEQ ID NO: 386764 - DNA, 25 bp, Mus musculus
ctggccttgggatttgctgtagctc

SEQ ID NO: 386765 - DNA, 25 bp, Mus musculus
ctggccttgtggatacattgggtac

SEQ ID NO: 386766 - DNA, 25 bp, Mus musculus
ctggccttgtggttacattgggtac

SEQ ID NO: 386767 - DNA, 25 bp, Mus musculus
ctggccttttagatctccatggaaa

SEQ ID NO: 386768 - DNA, 25 bp, Mus musculus
ctggccttttagttctccatggaaa

SEQ ID NO: 386769 - DNA, 25 bp, Mus musculus
ctggccttttctcactatctgatag

SEQ ID NO: 386770 - DNA, 25 bp, Mus musculus
ctggccttttctgactatctgatag

SEQ ID NO: 386771 - DNA, 25 bp, Mus musculus
ctggccttttgccaatgcttgaaac

SEQ ID NO: 386772 - DNA, 25 bp, Mus musculus
ctggccttttgcgaatgcttgaaac

SEQ ID NO: 386773 - DNA, 25 bp, Mus musculus
ctggcgaaccggagtcacgcgcgac

SEQ ID NO: 386774 - DNA, 25 bp, Mus musculus
ctggcgaaccggtgtcacgcgcgac

SEQ ID NO: 386775 - DNA, 25 bp, Mus musculus
ctggcgaagaatactgcaaccttgt

SEQ ID NO: 386776 - DNA, 25 bp, Mus musculus
ctggcgaagaattctgcaaccttgt

SEQ ID NO: 386777 - DNA, 25 bp, Mus musculus
ctggcgaatttaccattactttaat

SEQ ID NO: 386778 - DNA, 25 bp, Mus musculus
ctggcgaatttagcattactttaat

SEQ ID NO: 386779 - DNA, 25 bp, Mus musculus
ctggcgaccagacccgaagctggaa

SEQ ID NO: 386780 - DNA, 25 bp, Mus musculus
ctggcgaccagagccgaagctggaa

SEQ ID NO: 386781 - DNA, 25 bp, Mus musculus
ctggcgaggcccagcgattcttgaa

SEQ ID NO: 386782 - DNA, 25 bp, Mus musculus
ctggcgaggccctgcgattcttgaa

SEQ ID NO: 386783 - DNA, 25 bp, Mus musculus
ctggcgatccagcttagagctttgt

SEQ ID NO: 386784 - DNA, 25 bp, Mus musculus
ctggcgatccaggttagagctttgt

SEQ ID NO: 386785 - DNA, 25 bp, Mus musculus
ctggcgatgcccatggtgtctcaga

SEQ ID NO: 386786 - DNA, 25 bp, Mus musculus
ctggcgatgcccttggtgtctcaga

SEQ ID NO: 386787 - DNA, 25 bp, Mus musculus
ctggcgatgccgaggttgaaatgca

SEQ ID NO: 386788 - DNA, 25 bp, Mus musculus
ctggcgatgccgtggttgaaatgca

SEQ ID NO: 386789 - DNA, 25 bp, Mus musculus
ctggcgcagcagacattggtaggat

SEQ ID NO: 386790 - DNA, 25 bp, Mus musculus
ctggcgcagcagtcattggtaggat

SEQ ID NO: 386791 - DNA, 25 bp, Mus musculus
ctggcgccctggagtccaaaagaaa

SEQ ID NO: 386792 - DNA, 25 bp, Mus musculus
ctggcgccctggtgtccaaaagaaa

SEQ ID NO: 386793 - DNA, 25 bp, Mus musculus
ctggcgcctgtgatatgttcaacga

SEQ ID NO: 386794 - DNA, 25 bp, Mus musculus
ctggcgcctgtgttatgttcaacga

SEQ ID NO: 386795 - DNA, 25 bp, Mus musculus
ctggcgcgatgcagtgaatgtctca

SEQ ID NO: 386796 - DNA, 25 bp, Mus musculus
ctggcgcgatgctgtgaatgtctca

SEQ ID NO: 386797 - DNA, 25 bp, Mus musculus
ctggcgcgcgtcaccctagcaggag

SEQ ID NO: 386798 - DNA, 25 bp, Mus musculus
ctggcgcgcgtctccctagcaggag

SEQ ID NO: 386799 - DNA, 25 bp, Mus musculus
ctggcgctcctgagggattcaaagg

SEQ ID NO: 386800 - DNA, 25 bp, Mus musculus
ctggcgctcctgtgggattcaaagg

SEQ ID NO: 386801 - DNA, 25 bp, Mus musculus
ctggcgctgaacaagcaccattcaa

SEQ ID NO: 386802 - DNA, 25 bp, Mus musculus
ctggcgctgaactagcaccattcaa

SEQ ID NO: 386803 - DNA, 25 bp, Mus musculus
ctggcgctgcttagctcttaaaata

SEQ ID NO: 386804 - DNA, 25 bp, Mus musculus
ctggcgctgctttgctcttaaaata

SEQ ID NO: 386805 - DNA, 25 bp, Mus musculus
ctggcgctttttacctatgtttgtt

SEQ ID NO: 386806 - DNA, 25 bp, Mus musculus
ctggcgcttttttcctatgtttgtt

SEQ ID NO: 386807 - DNA, 25 bp, Mus musculus
ctggcggaaggcacatggcgtccaa

SEQ ID NO: 386808 - DNA, 25 bp, Mus musculus
ctggcggaaggctcatggcgtccaa

SEQ ID NO: 386809 - DNA, 25 bp, Mus musculus
ctggcggacttcattctcaaacagt

SEQ ID NO: 386810 - DNA, 25 bp, Mus musculus
ctggcggacttctttctcaaacagt

SEQ ID NO: 386811 - DNA, 25 bp, Mus musculus
ctggcggagccaagagggtcacttc

SEQ ID NO: 386812 - DNA, 25 bp, Mus musculus
ctggcggagccatgagggtcacttc

SEQ ID NO: 386813 - DNA, 25 bp, Mus musculus
ctggcgggcttgagagatctcctga

SEQ ID NO: 386814 - DNA, 25 bp, Mus musculus
ctggcgggcttgtgagatctcctga

SEQ ID NO: 386815 - DNA, 25 bp, Mus musculus
ctggcgtaagtgactcttgtgataa

SEQ ID NO: 386816 - DNA, 25 bp, Mus musculus
ctggcgtaagtgtctcttgtgataa

SEQ ID NO: 386817 - DNA, 25 bp, Mus musculus
ctggcgtatgagataccaaaaccaa

SEQ ID NO: 386818 - DNA, 25 bp, Mus musculus
ctggcgtatgagttaccaaaaccaa

SEQ ID NO: 386819 - DNA, 25 bp, Mus musculus
ctggcgtccatgactatgagttcga

SEQ ID NO: 386820 - DNA, 25 bp, Mus musculus
ctggcgtccatgtctatgagttcga

SEQ ID NO: 386821 - DNA, 25 bp, Mus musculus
ctggcgtctcacagagtttgcagag

SEQ ID NO: 386822 - DNA, 25 bp, Mus musculus
ctggcgtctcactgagtttgcagag

SEQ ID NO: 386823 - DNA, 25 bp, Mus musculus
ctggcgtgcccaagaatcaacagct

SEQ ID NO: 386824 - DNA, 25 bp, Mus musculus
ctggcgtgcccatgaatcaacagct

SEQ ID NO: 386825 - DNA, 25 bp, Mus musculus
ctggcgttaaacatcttcctttctg

SEQ ID NO: 386826 - DNA, 25 bp, Mus musculus
ctggcgttaaacttcttcctttctg

SEQ ID NO: 386827 - DNA, 25 bp, Mus musculus
ctggcgttgactcctgttaaccttt

SEQ ID NO: 386828 - DNA, 25 bp, Mus musculus
ctggcgttgactgctgttaaccttt

SEQ ID NO: 386829 - DNA, 25 bp, Mus musculus
ctggcgttgccaaatagttgcattt

SEQ ID NO: 386830 - DNA, 25 bp, Mus musculus
ctggcgttgccatatagttgcattt

SEQ ID NO: 386831 - DNA, 25 bp, Mus musculus
ctggctaaaccaagtgctcattgct

SEQ ID NO: 386832 - DNA, 25 bp, Mus musculus
ctggctaaaccatgtgctcattgct

SEQ ID NO: 386833 - DNA, 25 bp, Mus musculus
ctggctaaagttacgcagatgaact

SEQ ID NO: 386834 - DNA, 25 bp, Mus musculus
ctggctaaagtttcgcagatgaact

SEQ ID NO: 386835 - DNA, 25 bp, Mus musculus
ctggctaagagcacaaaactgccct

SEQ ID NO: 386836 - DNA, 25 bp, Mus musculus
ctggctaagagctcaaaactgccct

SEQ ID NO: 386837 - DNA, 25 bp, Mus musculus
ctggctaagcagaggactatccaat

SEQ ID NO: 386838 - DNA, 25 bp, Mus musculus
ctggctaagcagtggactatccaat

SEQ ID NO: 386839 - DNA, 25 bp, Mus musculus
ctggctaagggcatgggcagcaata

SEQ ID NO: 386840 - DNA, 25 bp, Mus musculus
ctggctaagggcttgggcagcaata

SEQ ID NO: 386841 - DNA, 25 bp, Mus musculus
ctggctacagatagacttgaggtca

SEQ ID NO: 386842 - DNA, 25 bp, Mus musculus
ctggctacagattgacttgaggtca

SEQ ID NO: 386843 - DNA, 25 bp, Mus musculus
ctggctaccgacatgtgttgttgtt

SEQ ID NO: 386844 - DNA, 25 bp, Mus musculus
ctggctaccgacttgtgttgttgtt

SEQ ID NO: 386845 - DNA, 25 bp, Mus musculus
ctggctaccgagcttttcagtacat

SEQ ID NO: 386846 - DNA, 25 bp, Mus musculus
ctggctaccgaggttttcagtacat

SEQ ID NO: 386847 - DNA, 25 bp, Mus musculus
ctggctacctgaacacagtgactgt

SEQ ID NO: 386848 - DNA, 25 bp, Mus musculus
ctggctacctgatcacagtgactgt

SEQ ID NO: 386849 - DNA, 25 bp, Mus musculus
ctggctacgcttcctgtgacttttg

SEQ ID NO: 386850 - DNA, 25 bp, Mus musculus
ctggctacgcttgctgtgacttttg

SEQ ID NO: 386851 - DNA, 25 bp, Mus musculus
ctggctactgtcaggtgtggtagat

SEQ ID NO: 386852 - DNA, 25 bp, Mus musculus
ctggctactgtctggtgtggtagat

SEQ ID NO: 386853 - DNA, 25 bp, Mus musculus
ctggctacttcccttagagaaaata

SEQ ID NO: 386854 - DNA, 25 bp, Mus musculus
ctggctacttccgttagagaaaata

SEQ ID NO: 386855 - DNA, 25 bp, Mus musculus
ctggctagccacagtgtcttagaga

SEQ ID NO: 386856 - DNA, 25 bp, Mus musculus
ctggctagccactgtgtcttagaga

SEQ ID NO: 386857 - DNA, 25 bp, Mus musculus
ctggctaggatgcaactcttcctct

SEQ ID NO: 386858 - DNA, 25 bp, Mus musculus
ctggctaggatggaactcttcctct

SEQ ID NO: 386859 - DNA, 25 bp, Mus musculus
ctggctataagacaggacaccttag

SEQ ID NO: 386860 - DNA, 25 bp, Mus musculus
ctggctataagagaggacaccttag

SEQ ID NO: 386861 - DNA, 25 bp, Mus musculus
ctggctatagcacgcagcttttctg

SEQ ID NO: 386862 - DNA, 25 bp, Mus musculus
ctggctatagcaggcagcttttctg

SEQ ID NO: 386863 - DNA, 25 bp, Mus musculus
ctggctatgactaggtgctgagacc

SEQ ID NO: 386864 - DNA, 25 bp, Mus musculus
ctggctatgacttggtgctgagacc

SEQ ID NO: 386865 - DNA, 25 bp, Mus musculus
ctggctatgttacgtggaggcaata

SEQ ID NO: 386866 - DNA, 25 bp, Mus musculus
ctggctatgttaggtggaggcaata

SEQ ID NO: 386867 - DNA, 25 bp, Mus musculus
ctggctattgttacttgtttatata

SEQ ID NO: 386868 - DNA, 25 bp, Mus musculus
ctggctattgtttcttgtttatata

SEQ ID NO: 386869 - DNA, 25 bp, Mus musculus
ctggctatttacagactgtcttttc

SEQ ID NO: 386870 - DNA, 25 bp, Mus musculus
ctggctatttactgactgtcttttc

SEQ ID NO: 386871 - DNA, 25 bp, Mus musculus
ctggctcacactctagtggagacaa

SEQ ID NO: 386872 - DNA, 25 bp, Mus musculus
ctggctcacactgtagtggagacaa

SEQ ID NO: 386873 - DNA, 25 bp, Mus musculus
ctggctcacagcaggaatggtcctt

SEQ ID NO: 386874 - DNA, 25 bp, Mus musculus
ctggctcacagctggaatggtcctt

SEQ ID NO: 386875 - DNA, 25 bp, Mus musculus
ctggctcacgtaaggacagctccaa

SEQ ID NO: 386876 - DNA, 25 bp, Mus musculus
ctggctcacgtatggacagctccaa

SEQ ID NO: 386877 - DNA, 25 bp, Mus musculus
ctggctcactgcagatctttattat

SEQ ID NO: 386878 - DNA, 25 bp, Mus musculus
ctggctcactgctgatctttattat

SEQ ID NO: 386879 - DNA, 25 bp, Mus musculus
ctggctcagagcagtcagtgtggct

SEQ ID NO: 386880 - DNA, 25 bp, Mus musculus
ctggctcagagctgtcagtgtggct

SEQ ID NO: 386881 - DNA, 25 bp, Mus musculus
ctggctcagcacatattctttctcc

SEQ ID NO: 386882 - DNA, 25 bp, Mus musculus
ctggctcagcacttattctttctcc

SEQ ID NO: 386883 - DNA, 25 bp, Mus musculus
ctggctcaggatcgtctgccacatc

SEQ ID NO: 386884 - DNA, 25 bp, Mus musculus
ctggctcaggatggtctgccacatc

SEQ ID NO: 386885 - DNA, 25 bp, Mus musculus
ctggctcaggccatacgggaagcga

SEQ ID NO: 386886 - DNA, 25 bp, Mus musculus
ctggctcaggccatgttagaggaca

SEQ ID NO: 386887 - DNA, 25 bp, Mus musculus
ctggctcaggccttacgggaagcga

SEQ ID NO: 386888 - DNA, 25 bp, Mus musculus
ctggctcaggccttgttagaggaca

SEQ ID NO: 386889 - DNA, 25 bp, Mus musculus
ctggctcagggtaatgttcactatg

SEQ ID NO: 386890 - DNA, 25 bp, Mus musculus
ctggctcagggttatgttcactatg

SEQ ID NO: 386891 - DNA, 25 bp, Mus musculus
ctggctcagtaacagtcccaattac

SEQ ID NO: 386892 - DNA, 25 bp, Mus musculus
ctggctcagtaagagtcccaattac

SEQ ID NO: 386893 - DNA, 25 bp, Mus musculus
ctggctcataatcaagaggtttcca

SEQ ID NO: 386894 - DNA, 25 bp, Mus musculus
ctggctcataatgaagaggtttcca

SEQ ID NO: 386895 - DNA, 25 bp, Mus musculus
ctggctcatgttcttattcctgtaa

SEQ ID NO: 386896 - DNA, 25 bp, Mus musculus
ctggctcatgttgttattcctgtaa

SEQ ID NO: 386897 - DNA, 25 bp, Mus musculus
ctggctcattaacgctgatcctcca

SEQ ID NO: 386898 - DNA, 25 bp, Mus musculus
ctggctcattaaggctgatcctcca

SEQ ID NO: 386899 - DNA, 25 bp, Mus musculus
ctggctccaaacaggtccttaggaa

SEQ ID NO: 386900 - DNA, 25 bp, Mus musculus
ctggctccaaactggtccttaggaa

SEQ ID NO: 386901 - DNA, 25 bp, Mus musculus
ctggctccacgcaagcaattctgaa

SEQ ID NO: 386902 - DNA, 25 bp, Mus musculus
ctggctccacgctagcaattctgaa

SEQ ID NO: 386903 - DNA, 25 bp, Mus musculus
ctggctccagcgctctgagatgaag

SEQ ID NO: 386904 - DNA, 25 bp, Mus musculus
ctggctccagcggtctgagatgaag

SEQ ID NO: 386905 - DNA, 25 bp, Mus musculus
ctggctccagctcgcaaagacagga

SEQ ID NO: 386906 - DNA, 25 bp, Mus musculus
ctggctccagctggcaaagacagga

SEQ ID NO: 386907 - DNA, 25 bp, Mus musculus
ctggctccagtgaggttggaaccac

SEQ ID NO: 386908 - DNA, 25 bp, Mus musculus
ctggctccagtgtggttggaaccac

SEQ ID NO: 386909 - DNA, 25 bp, Mus musculus
ctggctccagttagttcctgttcct

SEQ ID NO: 386910 - DNA, 25 bp, Mus musculus
ctggctccagtttgttcctgttcct

SEQ ID NO: 386911 - DNA, 25 bp, Mus musculus
ctggctccatggccacccaggtatg

SEQ ID NO: 386912 - DNA, 25 bp, Mus musculus
ctggctccatgggcacccaggtatg

SEQ ID NO: 386913 - DNA, 25 bp, Mus musculus
ctggctccattcattgaggcctggg

SEQ ID NO: 386914 - DNA, 25 bp, Mus musculus
ctggctccattctttgaggcctggg

SEQ ID NO: 386915 - DNA, 25 bp, Mus musculus
ctggctcccctaacacagaatggaa

SEQ ID NO: 386916 - DNA, 25 bp, Mus musculus
ctggctcccctatcacagaatggaa

SEQ ID NO: 386917 - DNA, 25 bp, Mus musculus
ctggctcccttgatgaggctttctt

SEQ ID NO: 386918 - DNA, 25 bp, Mus musculus
ctggctcccttgttgaggctttctt

SEQ ID NO: 386919 - DNA, 25 bp, Mus musculus
ctggctccgaggccagcttctgaga

SEQ ID NO: 386920 - DNA, 25 bp, Mus musculus
ctggctccgagggcagcttctgaga

SEQ ID NO: 386921 - DNA, 25 bp, Mus musculus
ctggctccggagacggtgaagtcca

SEQ ID NO: 386922 - DNA, 25 bp, Mus musculus
ctggctccggagtcggtgaagtcca

SEQ ID NO: 386923 - DNA, 25 bp, Mus musculus
ctggctcctaatatgctctgatcat

SEQ ID NO: 386924 - DNA, 25 bp, Mus musculus
ctggctcctaatttgctctgatcat

SEQ ID NO: 386925 - DNA, 25 bp, Mus musculus
ctggctcctcagagaagtaaggcct

SEQ ID NO: 386926 - DNA, 25 bp, Mus musculus
ctggctcctcagtgaagtaaggcct

SEQ ID NO: 386927 - DNA, 25 bp, Mus musculus
ctggctcctgaacttctggaactct

SEQ ID NO: 386928 - DNA, 25 bp, Mus musculus
ctggctcctgaagttctggaactct

SEQ ID NO: 386929 - DNA, 25 bp, Mus musculus
ctggctcctgatctatctctgttca

SEQ ID NO: 386930 - DNA, 25 bp, Mus musculus
ctggctcctgatgtatctctgttca

SEQ ID NO: 386931 - DNA, 25 bp, Mus musculus
ctggctcctggcagtgaaggaactt

SEQ ID NO: 386932 - DNA, 25 bp, Mus musculus
ctggctcctggctgtgaaggaactt

SEQ ID NO: 386933 - DNA, 25 bp, Mus musculus
ctggctcctgtcacatagctacagc

SEQ ID NO: 386934 - DNA, 25 bp, Mus musculus
ctggctcctgtctcatagctacagc

SEQ ID NO: 386935 - DNA, 25 bp, Mus musculus
ctggctccttctattgtagagactg

SEQ ID NO: 386936 - DNA, 25 bp, Mus musculus
ctggctccttcttttgtagagactg

SEQ ID NO: 386937 - DNA, 25 bp, Mus musculus
ctggctcctttgaacctgtgaatat

SEQ ID NO: 386938 - DNA, 25 bp, Mus musculus
ctggctcctttgcaaacctggagaa

SEQ ID NO: 386939 - DNA, 25 bp, Mus musculus
ctggctcctttggaaacctggagaa

SEQ ID NO: 386940 - DNA, 25 bp, Mus musculus
ctggctcctttgtacctgtgaatat

SEQ ID NO: 386941 - DNA, 25 bp, Mus musculus
ctggctcgggccatcgtgagaaaga

SEQ ID NO: 386942 - DNA, 25 bp, Mus musculus
ctggctcgggccttcgtgagaaaga

SEQ ID NO: 386943 - DNA, 25 bp, Mus musculus
ctggctctaacacaattccctggac

SEQ ID NO: 386944 - DNA, 25 bp, Mus musculus
ctggctctaacagaattccctggac

SEQ ID NO: 386945 - DNA, 25 bp, Mus musculus
ctggctctaactctcttcaaagatg

SEQ ID NO: 386946 - DNA, 25 bp, Mus musculus
ctggctctaactgtcttcaaagatg

SEQ ID NO: 386947 - DNA, 25 bp, Mus musculus
ctggctctaccaatgggaatttggg

SEQ ID NO: 386948 - DNA, 25 bp, Mus musculus
ctggctctaccattgggaatttggg

SEQ ID NO: 386949 - DNA, 25 bp, Mus musculus
ctggctctaggaccaggtggaaaaa

SEQ ID NO: 386950 - DNA, 25 bp, Mus musculus
ctggctctaggagcaggtggaaaaa

SEQ ID NO: 386951 - DNA, 25 bp, Mus musculus
ctggctctcattactcaagacagaa

SEQ ID NO: 386952 - DNA, 25 bp, Mus musculus
ctggctctcatttctcaagacagaa

SEQ ID NO: 386953 - DNA, 25 bp, Mus musculus
ctggctctcccgctgctggctagga

SEQ ID NO: 386954 - DNA, 25 bp, Mus musculus
ctggctctcccggtgctggctagga

SEQ ID NO: 386955 - DNA, 25 bp, Mus musculus
ctggctctcttaaccggcataaaat

SEQ ID NO: 386956 - DNA, 25 bp, Mus musculus
ctggctctcttatccggcataaaat

SEQ ID NO: 386957 - DNA, 25 bp, Mus musculus
ctggctctgagacaagctagcttgt

SEQ ID NO: 386958 - DNA, 25 bp, Mus musculus
ctggctctgagagaagctagcttgt

SEQ ID NO: 386959 - DNA, 25 bp, Mus musculus
ctggctctgaggactgtgacgatga

SEQ ID NO: 386960 - DNA, 25 bp, Mus musculus
ctggctctgaggtctgtgacgatga

SEQ ID NO: 386961 - DNA, 25 bp, Mus musculus
ctggctctgctaagaaagcgtctca

SEQ ID NO: 386962 - DNA, 25 bp, Mus musculus
ctggctctgctaccttacaaaattc

SEQ ID NO: 386963 - DNA, 25 bp, Mus musculus
ctggctctgctagcttacaaaattc

SEQ ID NO: 386964 - DNA, 25 bp, Mus musculus
ctggctctgctatgaaagcgtctca

SEQ ID NO: 386965 - DNA, 25 bp, Mus musculus
ctggctctgcttataacggacttat

SEQ ID NO: 386966 - DNA, 25 bp, Mus musculus
ctggctctgcttttaacggacttat

SEQ ID NO: 386967 - DNA, 25 bp, Mus musculus
ctggctcttaatcggctgcacttgt

SEQ ID NO: 386968 - DNA, 25 bp, Mus musculus
ctggctcttaatgggctgcacttgt

SEQ ID NO: 386969 - DNA, 25 bp, Mus musculus
ctggctcttggcagtttgtgtggac

SEQ ID NO: 386970 - DNA, 25 bp, Mus musculus
ctggctcttggctgtttgtgtggac

SEQ ID NO: 386971 - DNA, 25 bp, Mus musculus
ctggctcttgtaccttgggagattg

SEQ ID NO: 386972 - DNA, 25 bp, Mus musculus
ctggctcttgtagcttgggagattg

SEQ ID NO: 386973 - DNA, 25 bp, Mus musculus
ctggctcttgttagggcctaaggaa

SEQ ID NO: 386974 - DNA, 25 bp, Mus musculus
ctggctcttgtttgggcctaaggaa

SEQ ID NO: 386975 - DNA, 25 bp, Mus musculus
ctggctgaacataaggccccttttc

SEQ ID NO: 386976 - DNA, 25 bp, Mus musculus
ctggctgaacattaggccccttttc

SEQ ID NO: 386977 - DNA, 25 bp, Mus musculus
ctggctgaagtgagacagccaattt

SEQ ID NO: 386978 - DNA, 25 bp, Mus musculus
ctggctgaagtgtgacagccaattt

SEQ ID NO: 386979 - DNA, 25 bp, Mus musculus
ctggctgacatgcaaattggaggct

SEQ ID NO: 386980 - DNA, 25 bp, Mus musculus
ctggctgacatggaaattggaggct

SEQ ID NO: 386981 - DNA, 25 bp, Mus musculus
ctggctgaccagaagagagattatt

SEQ ID NO: 386982 - DNA, 25 bp, Mus musculus
ctggctgaccagtagagagattatt

SEQ ID NO: 386983 - DNA, 25 bp, Mus musculus
ctggctgagatgcttgaagaccttc

SEQ ID NO: 386984 - DNA, 25 bp, Mus musculus
ctggctgagatggttgaagaccttc

SEQ ID NO: 386985 - DNA, 25 bp, Mus musculus
ctggctgagccacatcacgggaact

SEQ ID NO: 386986 - DNA, 25 bp, Mus musculus
ctggctgagccagatcacgggaact

SEQ ID NO: 386987 - DNA, 25 bp, Mus musculus
ctggctgagctgctacacacattta

SEQ ID NO: 386988 - DNA, 25 bp, Mus musculus
ctggctgagctggtacacacattta

SEQ ID NO: 386989 - DNA, 25 bp, Mus musculus
ctggctgagtgtatacacattgctt

SEQ ID NO: 386990 - DNA, 25 bp, Mus musculus
ctggctgagtgtttacacattgctt

SEQ ID NO: 386991 - DNA, 25 bp, Mus musculus
ctggctgcagagatcaaaagggaca

SEQ ID NO: 386992 - DNA, 25 bp, Mus musculus
ctggctgcagagttcaaaagggaca

SEQ ID NO: 386993 - DNA, 25 bp, Mus musculus
ctggctgcagcgcaattttttgttt

SEQ ID NO: 386994 - DNA, 25 bp, Mus musculus
ctggctgcagcggaattttttgttt

SEQ ID NO: 386995 - DNA, 25 bp, Mus musculus
ctggctgcagctcgaccaggctagt

SEQ ID NO: 386996 - DNA, 25 bp, Mus musculus
ctggctgcagctggaccaggctagt

SEQ ID NO: 386997 - DNA, 25 bp, Mus musculus
ctggctgcatgaagcctgtctcaaa

SEQ ID NO: 386998 - DNA, 25 bp, Mus musculus
ctggctgcatgatgcctgtctcaaa

SEQ ID NO: 386999 - DNA, 25 bp, Mus musculus
ctggctgcattcagggcgtttttaa

SEQ ID NO: 387000 - DNA, 25 bp, Mus musculus
ctggctgcattctgggcgtttttaa

SEQ ID NO: 387001 - DNA, 25 bp, Mus musculus
ctggctgccaagcatgctgacctga

SEQ ID NO: 387002 - DNA, 25 bp, Mus musculus
ctggctgccaaggatgctgacctga

SEQ ID NO: 387003 - DNA, 25 bp, Mus musculus
ctggctgccattaactagtctgctt

SEQ ID NO: 387004 - DNA, 25 bp, Mus musculus
ctggctgccatttactagtctgctt

SEQ ID NO: 387005 - DNA, 25 bp, Mus musculus
ctggctgcccacagggattatgaaa

SEQ ID NO: 387006 - DNA, 25 bp, Mus musculus
ctggctgcccacagtgcacgatgga

SEQ ID NO: 387007 - DNA, 25 bp, Mus musculus
ctggctgcccactgggattatgaaa

SEQ ID NO: 387008 - DNA, 25 bp, Mus musculus
ctggctgcccactgtgcacgatgga

SEQ ID NO: 387009 - DNA, 25 bp, Mus musculus
ctggctgcctgtctttgctgccatg

SEQ ID NO: 387010 - DNA, 25 bp, Mus musculus
ctggctgcctgtgtttgctgccatg

SEQ ID NO: 387011 - DNA, 25 bp, Mus musculus
ctggctgcgattaatgactgtattc

SEQ ID NO: 387012 - DNA, 25 bp, Mus musculus
ctggctgcgatttatgactgtattc

SEQ ID NO: 387013 - DNA, 25 bp, Mus musculus
ctggctgcggaccaaccagagcaga

SEQ ID NO: 387014 - DNA, 25 bp, Mus musculus
ctggctgcggacgaaccagagcaga

SEQ ID NO: 387015 - DNA, 25 bp, Mus musculus
ctggctgctaggaacgtcctggtga

SEQ ID NO: 387016 - DNA, 25 bp, Mus musculus
ctggctgctaggtacgtcctggtga

SEQ ID NO: 387017 - DNA, 25 bp, Mus musculus
ctggctgctatcagctgcaaactag

SEQ ID NO: 387018 - DNA, 25 bp, Mus musculus
ctggctgctatctgctgcaaactag

SEQ ID NO: 387019 - DNA, 25 bp, Mus musculus
ctggctgctgacaggatgtggtact

SEQ ID NO: 387020 - DNA, 25 bp, Mus musculus
ctggctgctgactggatgtggtact

SEQ ID NO: 387021 - DNA, 25 bp, Mus musculus
ctggctgctgataacagaattttaa

SEQ ID NO: 387022 - DNA, 25 bp, Mus musculus
ctggctgctgattacagaattttaa

SEQ ID NO: 387023 - DNA, 25 bp, Mus musculus
ctggctgctgtcaatgaattttatg

SEQ ID NO: 387024 - DNA, 25 bp, Mus musculus
ctggctgctgtctatgaattttatg

SEQ ID NO: 387025 - DNA, 25 bp, Mus musculus
ctggctgcttacattgtatgacaac

SEQ ID NO: 387026 - DNA, 25 bp, Mus musculus
ctggctgcttactttgtatgacaac

SEQ ID NO: 387027 - DNA, 25 bp, Mus musculus
ctggctgcttctcaggtctagcaat

SEQ ID NO: 387028 - DNA, 25 bp, Mus musculus
ctggctgcttctgaggtctagcaat

SEQ ID NO: 387029 - DNA, 25 bp, Mus musculus
ctggctgcttttccgtgctaataaa

SEQ ID NO: 387030 - DNA, 25 bp, Mus musculus
ctggctgcttttcggtcaggatgta

SEQ ID NO: 387031 - DNA, 25 bp, Mus musculus
ctggctgcttttgcgtgctaataaa

SEQ ID NO: 387032 - DNA, 25 bp, Mus musculus
ctggctgcttttgggtcaggatgta

SEQ ID NO: 387033 - DNA, 25 bp, Mus musculus
ctggctggagccaagtagactgtat

SEQ ID NO: 387034 - DNA, 25 bp, Mus musculus
ctggctggagcctagtagactgtat

SEQ ID NO: 387035 - DNA, 25 bp, Mus musculus
ctggctggatctattctagcttcaa

SEQ ID NO: 387036 - DNA, 25 bp, Mus musculus
ctggctggatcttttctagcttcaa

SEQ ID NO: 387037 - DNA, 25 bp, Mus musculus
ctggctggatgcatacctccatcaa

SEQ ID NO: 387038 - DNA, 25 bp, Mus musculus
ctggctggatgcttacctccatcaa

SEQ ID NO: 387039 - DNA, 25 bp, Mus musculus
ctggctggcaatctaggagtctttc

SEQ ID NO: 387040 - DNA, 25 bp, Mus musculus
ctggctggcaatgtaggagtctttc

SEQ ID NO: 387041 - DNA, 25 bp, Mus musculus
ctggctggccatattttggttttgt

SEQ ID NO: 387042 - DNA, 25 bp, Mus musculus
ctggctggccattttttggttttgt

SEQ ID NO: 387043 - DNA, 25 bp, Mus musculus
ctggctggccctaccatagagaaag

SEQ ID NO: 387044 - DNA, 25 bp, Mus musculus
ctggctggcccttccatagagaaag

SEQ ID NO: 387045 - DNA, 25 bp, Mus musculus
ctggctggcctcaaattggctatgt

SEQ ID NO: 387046 - DNA, 25 bp, Mus musculus
ctggctggcctctaattggctatgt

SEQ ID NO: 387047 - DNA, 25 bp, Mus musculus
ctggctggccttcattcatgagaat

SEQ ID NO: 387048 - DNA, 25 bp, Mus musculus
ctggctggccttgattcatgagaat

SEQ ID NO: 387049 - DNA, 25 bp, Mus musculus
ctggctggctaaatgctaagctaat

SEQ ID NO: 387050 - DNA, 25 bp, Mus musculus
ctggctggctaattgctaagctaat

SEQ ID NO: 387051 - DNA, 25 bp, Mus musculus
ctggctggctctcctggatgctgca

SEQ ID NO: 387052 - DNA, 25 bp, Mus musculus
ctggctggctctgctggatgctgca

SEQ ID NO: 387053 - DNA, 25 bp, Mus musculus
ctggctggctgacgtgctactccac

SEQ ID NO: 387054 - DNA, 25 bp, Mus musculus
ctggctggctgacttttctgcagat

SEQ ID NO: 387055 - DNA, 25 bp, Mus musculus
ctggctggctgaggtgctactccac

SEQ ID NO: 387056 - DNA, 25 bp, Mus musculus
ctggctggctgagttttctgcagat

SEQ ID NO: 387057 - DNA, 25 bp, Mus musculus
ctggctggcttcacatctgatggct

SEQ ID NO: 387058 - DNA, 25 bp, Mus musculus
ctggctggcttcatggtgagcacta

SEQ ID NO: 387059 - DNA, 25 bp, Mus musculus
ctggctggcttctcatctgatggct

SEQ ID NO: 387060 - DNA, 25 bp, Mus musculus
ctggctggcttcttggtgagcacta

SEQ ID NO: 387061 - DNA, 25 bp, Mus musculus
ctggctggtattcgtgctttggata

SEQ ID NO: 387062 - DNA, 25 bp, Mus musculus
ctggctggtattggtgctttggata

SEQ ID NO: 387063 - DNA, 25 bp, Mus musculus
ctggctggtcaacgtatgctgtatt

SEQ ID NO: 387064 - DNA, 25 bp, Mus musculus
ctggctggtcaaggtatgctgtatt

SEQ ID NO: 387065 - DNA, 25 bp, Mus musculus
ctggctggtctgctaaggtgttcac

SEQ ID NO: 387066 - DNA, 25 bp, Mus musculus
ctggctggtctggtaaggtgttcac

SEQ ID NO: 387067 - DNA, 25 bp, Mus musculus
ctggctggtgtactgtctctaatac

SEQ ID NO: 387068 - DNA, 25 bp, Mus musculus
ctggctggtgtagtgtctctaatac

SEQ ID NO: 387069 - DNA, 25 bp, Mus musculus
ctggctggttttcatgaattgagaa

SEQ ID NO: 387070 - DNA, 25 bp, Mus musculus
ctggctggttttgatgaattgagaa

SEQ ID NO: 387071 - DNA, 25 bp, Mus musculus
ctggctgtactaagtattagatgtt

SEQ ID NO: 387072 - DNA, 25 bp, Mus musculus
ctggctgtactatgtattagatgtt

SEQ ID NO: 387073 - DNA, 25 bp, Mus musculus
ctggctgtacttcttatctgagggc

SEQ ID NO: 387074 - DNA, 25 bp, Mus musculus
ctggctgtacttgttatctgagggc

SEQ ID NO: 387075 - DNA, 25 bp, Mus musculus
ctggctgtattgctccctaaaagaa

SEQ ID NO: 387076 - DNA, 25 bp, Mus musculus
ctggctgtattggtccctaaaagaa

SEQ ID NO: 387077 - DNA, 25 bp, Mus musculus
ctggctgtcctaatctgcattagta

SEQ ID NO: 387078 - DNA, 25 bp, Mus musculus
ctggctgtcctattctgcattagta

SEQ ID NO: 387079 - DNA, 25 bp, Mus musculus
ctggctgtcgacctactggagaaga

SEQ ID NO: 387080 - DNA, 25 bp, Mus musculus
ctggctgtcgacgtactggagaaga

SEQ ID NO: 387081 - DNA, 25 bp, Mus musculus
ctggctgtcttgaaagctgggaaca

SEQ ID NO: 387082 - DNA, 25 bp, Mus musculus
ctggctgtcttgcagctcacagaga

SEQ ID NO: 387083 - DNA, 25 bp, Mus musculus
ctggctgtcttggagctcacagaga

SEQ ID NO: 387084 - DNA, 25 bp, Mus musculus
ctggctgtcttgtaagctgggaaca

SEQ ID NO: 387085 - DNA, 25 bp, Mus musculus
ctggctgtgacaatgtgctagtgac

SEQ ID NO: 387086 - DNA, 25 bp, Mus musculus
ctggctgtgacattgtgctagtgac

SEQ ID NO: 387087 - DNA, 25 bp, Mus musculus
ctggctgtgccaacagttctgaaca

SEQ ID NO: 387088 - DNA, 25 bp, Mus musculus
ctggctgtgccatcagttctgaaca

SEQ ID NO: 387089 - DNA, 25 bp, Mus musculus
ctggctgtgggcacaagctaagcgc

SEQ ID NO: 387090 - DNA, 25 bp, Mus musculus
ctggctgtgggctcaagctaagcgc

SEQ ID NO: 387091 - DNA, 25 bp, Mus musculus
ctggctgtgttcacagtgggtatga

SEQ ID NO: 387092 - DNA, 25 bp, Mus musculus
ctggctgtgttctcagtgggtatga

SEQ ID NO: 387093 - DNA, 25 bp, Mus musculus
ctggctgttcagaagatgaatcact

SEQ ID NO: 387094 - DNA, 25 bp, Mus musculus
ctggctgttcagtagatgaatcact

SEQ ID NO: 387095 - DNA, 25 bp, Mus musculus
ctggctgttctgcaatccacactgt

SEQ ID NO: 387096 - DNA, 25 bp, Mus musculus
ctggctgttctggaatccacactgt

SEQ ID NO: 387097 - DNA, 25 bp, Mus musculus
ctggctgttcttcatggcgtgctaa

SEQ ID NO: 387098 - DNA, 25 bp, Mus musculus
ctggctgttcttgatggcgtgctaa

SEQ ID NO: 387099 - DNA, 25 bp, Mus musculus
ctggctgttgtaactggacctccaa

SEQ ID NO: 387100 - DNA, 25 bp, Mus musculus
ctggctgttgtatctggacctccaa

SEQ ID NO: 387101 - DNA, 25 bp, Mus musculus
ctggctgttgttatacctatggtaa

SEQ ID NO: 387102 - DNA, 25 bp, Mus musculus
ctggctgttgttttacctatggtaa

SEQ ID NO: 387103 - DNA, 25 bp, Mus musculus
ctggctgtttctagatactctgctg

SEQ ID NO: 387104 - DNA, 25 bp, Mus musculus
ctggctgtttcttgatactctgctg

SEQ ID NO: 387105 - DNA, 25 bp, Mus musculus
ctggctgtttgcacctgactagttg

SEQ ID NO: 387106 - DNA, 25 bp, Mus musculus
ctggctgtttgctcctgactagttg

SEQ ID NO: 387107 - DNA, 25 bp, Mus musculus
ctggcttaaagacgaactcgaaaag

SEQ ID NO: 387108 - DNA, 25 bp, Mus musculus
ctggcttaaagaggaactcgaaaag

SEQ ID NO: 387109 - DNA, 25 bp, Mus musculus
ctggcttaagagacagtcaaaggga

SEQ ID NO: 387110 - DNA, 25 bp, Mus musculus
ctggcttaagagtcagtcaaaggga

SEQ ID NO: 387111 - DNA, 25 bp, Mus musculus
ctggcttacagcattcaacatattg

SEQ ID NO: 387112 - DNA, 25 bp, Mus musculus
ctggcttacagctttcaacatattg

SEQ ID NO: 387113 - DNA, 25 bp, Mus musculus
ctggcttaccagaccttttgcttgt

SEQ ID NO: 387114 - DNA, 25 bp, Mus musculus
ctggcttaccagtccttttgcttgt

SEQ ID NO: 387115 - DNA, 25 bp, Mus musculus
ctggcttactgcctcatagttgtaa

SEQ ID NO: 387116 - DNA, 25 bp, Mus musculus
ctggcttactgcgtcatagttgtaa

SEQ ID NO: 387117 - DNA, 25 bp, Mus musculus
ctggcttaggacagaccattccgtg

SEQ ID NO: 387118 - DNA, 25 bp, Mus musculus
ctggcttaggactgaccattccgtg

SEQ ID NO: 387119 - DNA, 25 bp, Mus musculus
ctggcttatatcaaaagactgagaa

SEQ ID NO: 387120 - DNA, 25 bp, Mus musculus
ctggcttatatctaaagactgagaa

SEQ ID NO: 387121 - DNA, 25 bp, Mus musculus
ctggcttatcccagtttcaaggatt

SEQ ID NO: 387122 - DNA, 25 bp, Mus musculus
ctggcttatccctgtttcaaggatt

SEQ ID NO: 387123 - DNA, 25 bp, Mus musculus
ctggcttatgatagttcctattttc

SEQ ID NO: 387124 - DNA, 25 bp, Mus musculus
ctggcttatgattgttcctattttc

SEQ ID NO: 387125 - DNA, 25 bp, Mus musculus
ctggcttatggcatatttagataat

SEQ ID NO: 387126 - DNA, 25 bp, Mus musculus
ctggcttatggcttatttagataat

SEQ ID NO: 387127 - DNA, 25 bp, Mus musculus
ctggcttattgacattcctcacatg

SEQ ID NO: 387128 - DNA, 25 bp, Mus musculus
ctggcttattgagattcctcacatg

SEQ ID NO: 387129 - DNA, 25 bp, Mus musculus
ctggcttatttactcaaacaggata

SEQ ID NO: 387130 - DNA, 25 bp, Mus musculus
ctggcttatttagtcaaacaggata

SEQ ID NO: 387131 - DNA, 25 bp, Mus musculus
ctggcttcaccgattggttttgtat

SEQ ID NO: 387132 - DNA, 25 bp, Mus musculus
ctggcttcaccgtttggttttgtat

SEQ ID NO: 387133 - DNA, 25 bp, Mus musculus
ctggcttcagagcacgtgtttatag

SEQ ID NO: 387134 - DNA, 25 bp, Mus musculus
ctggcttcagaggacgtgtttatag

SEQ ID NO: 387135 - DNA, 25 bp, Mus musculus
ctggcttcagtgcaccaaattttca

SEQ ID NO: 387136 - DNA, 25 bp, Mus musculus
ctggcttcagtggaccaaattttca

SEQ ID NO: 387137 - DNA, 25 bp, Mus musculus
ctggcttccaagaggactgtcactg

SEQ ID NO: 387138 - DNA, 25 bp, Mus musculus
ctggcttccaagtggactgtcactg

SEQ ID NO: 387139 - DNA, 25 bp, Mus musculus
ctggcttccacaagttgtgtgtgtg

SEQ ID NO: 387140 - DNA, 25 bp, Mus musculus
ctggcttccacatgttgtgtgtgtg

SEQ ID NO: 387141 - DNA, 25 bp, Mus musculus
ctggcttccagtcaaattaccttct

SEQ ID NO: 387142 - DNA, 25 bp, Mus musculus
ctggcttccagtgaaattaccttct

SEQ ID NO: 387143 - DNA, 25 bp, Mus musculus
ctggcttccatcatactgaatcgat

SEQ ID NO: 387144 - DNA, 25 bp, Mus musculus
ctggcttccatcttactgaatcgat

SEQ ID NO: 387145 - DNA, 25 bp, Mus musculus
ctggcttcccagaacgtagagtaga

SEQ ID NO: 387146 - DNA, 25 bp, Mus musculus
ctggcttcccagtacgtagagtaga

SEQ ID NO: 387147 - DNA, 25 bp, Mus musculus
ctggcttcctctcgcaaaggcatga

SEQ ID NO: 387148 - DNA, 25 bp, Mus musculus
ctggcttcctctggcaaaggcatga

SEQ ID NO: 387149 - DNA, 25 bp, Mus musculus
ctggcttcgtctagggcgtagccaa

SEQ ID NO: 387150 - DNA, 25 bp, Mus musculus
ctggcttcgtcttgggcgtagccaa

SEQ ID NO: 387151 - DNA, 25 bp, Mus musculus
ctggcttctcaaagaccggaatcta

SEQ ID NO: 387152 - DNA, 25 bp, Mus musculus
ctggcttctcaatgaccggaatcta

SEQ ID NO: 387153 - DNA, 25 bp, Mus musculus
ctggcttctgaactggaacttttgc

SEQ ID NO: 387154 - DNA, 25 bp, Mus musculus
ctggcttctgaagtggaacttttgc

SEQ ID NO: 387155 - DNA, 25 bp, Mus musculus
ctggcttctgagagtatttgcatgc

SEQ ID NO: 387156 - DNA, 25 bp, Mus musculus
ctggcttctgagtgtatttgcatgc

SEQ ID NO: 387157 - DNA, 25 bp, Mus musculus
ctggcttctgctcgtaccagtgaaa

SEQ ID NO: 387158 - DNA, 25 bp, Mus musculus
ctggcttctgctggtaccagtgaaa

SEQ ID NO: 387159 - DNA, 25 bp, Mus musculus
ctggcttctgtgattctgctacaaa

SEQ ID NO: 387160 - DNA, 25 bp, Mus musculus
ctggcttctgtgtttctgctacaaa

SEQ ID NO: 387161 - DNA, 25 bp, Mus musculus
ctggcttctttgctacaactgggat

SEQ ID NO: 387162 - DNA, 25 bp, Mus musculus
ctggcttctttggtacaactgggat

SEQ ID NO: 387163 - DNA, 25 bp, Mus musculus
ctggcttcttttcacttagactgtt

SEQ ID NO: 387164 - DNA, 25 bp, Mus musculus
ctggcttcttttgacttagactgtt

SEQ ID NO: 387165 - DNA, 25 bp, Mus musculus
ctggcttgagctaattaactacttt

SEQ ID NO: 387166 - DNA, 25 bp, Mus musculus
ctggcttgagcttattaactacttt

SEQ ID NO: 387167 - DNA, 25 bp, Mus musculus
ctggcttgcaaaagctggaatgaat

SEQ ID NO: 387168 - DNA, 25 bp, Mus musculus
ctggcttgcaaatgctggaatgaat

SEQ ID NO: 387169 - DNA, 25 bp, Mus musculus
ctggcttgcagcagcacaggtgaga

SEQ ID NO: 387170 - DNA, 25 bp, Mus musculus
ctggcttgcagctgcacaggtgaga

SEQ ID NO: 387171 - DNA, 25 bp, Mus musculus
ctggcttgcttaaattcctttgtat

SEQ ID NO: 387172 - DNA, 25 bp, Mus musculus
ctggcttgcttatattcctttgtat

SEQ ID NO: 387173 - DNA, 25 bp, Mus musculus
ctggcttgctttagatggatattag

SEQ ID NO: 387174 - DNA, 25 bp, Mus musculus
ctggcttgcttttgatggatattag

SEQ ID NO: 387175 - DNA, 25 bp, Mus musculus
ctggcttggaccagagtgtttgctc

SEQ ID NO: 387176 - DNA, 25 bp, Mus musculus
ctggcttggacctgagtgtttgctc

SEQ ID NO: 387177 - DNA, 25 bp, Mus musculus
ctggcttggcatcagcccggatgca

SEQ ID NO: 387178 - DNA, 25 bp, Mus musculus
ctggcttggcatgagcccggatgca

SEQ ID NO: 387179 - DNA, 25 bp, Mus musculus
ctggcttggctacccatagtgagat

SEQ ID NO: 387180 - DNA, 25 bp, Mus musculus
ctggcttggctagccatagtgagat

SEQ ID NO: 387181 - DNA, 25 bp, Mus musculus
ctggcttggctgaaaagcacttcat

SEQ ID NO: 387182 - DNA, 25 bp, Mus musculus
ctggcttggctgtaaagcacttcat

SEQ ID NO: 387183 - DNA, 25 bp, Mus musculus
ctggcttgtatgatatttctttcgg

SEQ ID NO: 387184 - DNA, 25 bp, Mus musculus
ctggcttgtatgttatttctttcgg

SEQ ID NO: 387185 - DNA, 25 bp, Mus musculus
ctggctttagaaatccaactgaggt

SEQ ID NO: 387186 - DNA, 25 bp, Mus musculus
ctggctttagaattccaactgaggt

SEQ ID NO: 387187 - DNA, 25 bp, Mus musculus
ctggctttagatcaagacagcttgt

SEQ ID NO: 387188 - DNA, 25 bp, Mus musculus
ctggctttagatgaagacagcttgt

SEQ ID NO: 387189 - DNA, 25 bp, Mus musculus
ctggctttatggctagaatacggaa

SEQ ID NO: 387190 - DNA, 25 bp, Mus musculus
ctggctttatgggtagaatacggaa

SEQ ID NO: 387191 - DNA, 25 bp, Mus musculus
ctggctttcaggaatgttttcttaa

SEQ ID NO: 387192 - DNA, 25 bp, Mus musculus
ctggctttcaggtatgttttcttaa

SEQ ID NO: 387193 - DNA, 25 bp, Mus musculus
ctggctttcatacctgcttctggaa

SEQ ID NO: 387194 - DNA, 25 bp, Mus musculus
ctggctttcatagctgcttctggaa

SEQ ID NO: 387195 - DNA, 25 bp, Mus musculus
ctggctttcatcattctctaaattt

SEQ ID NO: 387196 - DNA, 25 bp, Mus musculus
ctggctttcatctttctctaaattt

SEQ ID NO: 387197 - DNA, 25 bp, Mus musculus
ctggctttcattaatgtccgtcatg

SEQ ID NO: 387198 - DNA, 25 bp, Mus musculus
ctggctttcatttatgtccgtcatg

SEQ ID NO: 387199 - DNA, 25 bp, Mus musculus
ctggctttccagatgggcctaagga

SEQ ID NO: 387200 - DNA, 25 bp, Mus musculus
ctggctttccagttgggcctaagga

SEQ ID NO: 387201 - DNA, 25 bp, Mus musculus
ctggctttccggatccacacctagg

SEQ ID NO: 387202 - DNA, 25 bp, Mus musculus
ctggctttccggttccacacctagg

SEQ ID NO: 387203 - DNA, 25 bp, Mus musculus
ctggctttctccagtgatgggctat

SEQ ID NO: 387204 - DNA, 25 bp, Mus musculus
ctggctttctcctgtgatgggctat

SEQ ID NO: 387205 - DNA, 25 bp, Mus musculus
ctggctttctcgatgggtggcatag

SEQ ID NO: 387206 - DNA, 25 bp, Mus musculus
ctggctttctcgttgggtggcatag

SEQ ID NO: 387207 - DNA, 25 bp, Mus musculus
ctggctttctctagtcctattaaat

SEQ ID NO: 387208 - DNA, 25 bp, Mus musculus
ctggctttctcttgtcctattaaat

SEQ ID NO: 387209 - DNA, 25 bp, Mus musculus
ctggctttctgtagctgaatgcaaa

SEQ ID NO: 387210 - DNA, 25 bp, Mus musculus
ctggctttctgttgctgaatgcaaa

SEQ ID NO: 387211 - DNA, 25 bp, Mus musculus
ctggctttcttgaagcacgtgtgat

SEQ ID NO: 387212 - DNA, 25 bp, Mus musculus
ctggctttcttgcattcttctgaac

SEQ ID NO: 387213 - DNA, 25 bp, Mus musculus
ctggctttcttggattcttctgaac

SEQ ID NO: 387214 - DNA, 25 bp, Mus musculus
ctggctttcttgtagcacgtgtgat

SEQ ID NO: 387215 - DNA, 25 bp, Mus musculus
ctggctttctttactttctcatgat

SEQ ID NO: 387216 - DNA, 25 bp, Mus musculus
ctggctttcttttctttctcatgat

SEQ ID NO: 387217 - DNA, 25 bp, Mus musculus
ctggctttgaaaccaatccccaaat

SEQ ID NO: 387218 - DNA, 25 bp, Mus musculus
ctggctttgaaagcaatccccaaat

SEQ ID NO: 387219 - DNA, 25 bp, Mus musculus
ctggctttgaggacaatgctgtaga

SEQ ID NO: 387220 - DNA, 25 bp, Mus musculus
ctggctttgaggagtcagcatctgg

SEQ ID NO: 387221 - DNA, 25 bp, Mus musculus
ctggctttgaggtcaatgctgtaga

SEQ ID NO: 387222 - DNA, 25 bp, Mus musculus
ctggctttgaggtgtcagcatctgg

SEQ ID NO: 387223 - DNA, 25 bp, Mus musculus
ctggctttgataatcagggctgcac

SEQ ID NO: 387224 - DNA, 25 bp, Mus musculus
ctggctttgatattcagggctgcac

SEQ ID NO: 387225 - DNA, 25 bp, Mus musculus
ctggctttgcttacatggacacaat

SEQ ID NO: 387226 - DNA, 25 bp, Mus musculus
ctggctttgctttcatggacacaat

SEQ ID NO: 387227 - DNA, 25 bp, Mus musculus
ctggctttggtcctagtgaactcac

SEQ ID NO: 387228 - DNA, 25 bp, Mus musculus
ctggctttggtcctccctctagatt

SEQ ID NO: 387229 - DNA, 25 bp, Mus musculus
ctggctttggtcgtagtgaactcac

SEQ ID NO: 387230 - DNA, 25 bp, Mus musculus
ctggctttggtcgtccctctagatt

SEQ ID NO: 387231 - DNA, 25 bp, Mus musculus
ctggctttgtcaccattctatatat

SEQ ID NO: 387232 - DNA, 25 bp, Mus musculus
ctggctttgtcagcattctatatat

SEQ ID NO: 387233 - DNA, 25 bp, Mus musculus
ctggctttgtggagcgcatgaacct

SEQ ID NO: 387234 - DNA, 25 bp, Mus musculus
ctggctttgtggtgcgcatgaacct

SEQ ID NO: 387235 - DNA, 25 bp, Mus musculus
ctggctttgttgatttggattcctt

SEQ ID NO: 387236 - DNA, 25 bp, Mus musculus
ctggctttgttgttttggattcctt

SEQ ID NO: 387237 - DNA, 25 bp, Mus musculus
ctggcttttaaacttcattcggaag

SEQ ID NO: 387238 - DNA, 25 bp, Mus musculus
ctggcttttaaagttcattcggaag

SEQ ID NO: 387239 - DNA, 25 bp, Mus musculus
ctggcttttaccaggtagcctttga

SEQ ID NO: 387240 - DNA, 25 bp, Mus musculus
ctggcttttacctggtagcctttga

SEQ ID NO: 387241 - DNA, 25 bp, Mus musculus
ctggcttttagcacactggacttgt

SEQ ID NO: 387242 - DNA, 25 bp, Mus musculus
ctggcttttagctcactggacttgt

SEQ ID NO: 387243 - DNA, 25 bp, Mus musculus
ctggcttttcttcagcttacaattc

SEQ ID NO: 387244 - DNA, 25 bp, Mus musculus
ctggcttttcttgagcttacaattc

SEQ ID NO: 387245 - DNA, 25 bp, Mus musculus
ctggcttttgccaggtgtattatca

SEQ ID NO: 387246 - DNA, 25 bp, Mus musculus
ctggcttttgcctggtgtattatca

SEQ ID NO: 387247 - DNA, 25 bp, Mus musculus
ctggcttttggtagggaagtgcttt

SEQ ID NO: 387248 - DNA, 25 bp, Mus musculus
ctggcttttggttgggaagtgcttt

SEQ ID NO: 387249 - DNA, 25 bp, Mus musculus
ctgggaaaaccaagatcgtgctgct

SEQ ID NO: 387250 - DNA, 25 bp, Mus musculus
ctgggaaaaccatgatcgtgctgct

SEQ ID NO: 387251 - DNA, 25 bp, Mus musculus
ctgggaaaatcaccgggatgctgct

SEQ ID NO: 387252 - DNA, 25 bp, Mus musculus
ctgggaaaatcagcgggatgctgct

SEQ ID NO: 387253 - DNA, 25 bp, Mus musculus
ctgggaaacatgaggtcaaatatat

SEQ ID NO: 387254 - DNA, 25 bp, Mus musculus
ctgggaaacatgtggtcaaatatat

SEQ ID NO: 387255 - DNA, 25 bp, Mus musculus
ctgggaaacttactgcatcgtctgc

SEQ ID NO: 387256 - DNA, 25 bp, Mus musculus
ctgggaaacttagtgcatcgtctgc

SEQ ID NO: 387257 - DNA, 25 bp, Mus musculus
ctgggaaagccacacttttacttct

SEQ ID NO: 387258 - DNA, 25 bp, Mus musculus
ctgggaaagccagacttttacttct

SEQ ID NO: 387259 - DNA, 25 bp, Mus musculus
ctgggaaaggcgactcctctaactt

SEQ ID NO: 387260 - DNA, 25 bp, Mus musculus
ctgggaaaggcgtctcctctaactt

SEQ ID NO: 387261 - DNA, 25 bp, Mus musculus
ctgggaaatacacctactatcattc

SEQ ID NO: 387262 - DNA, 25 bp, Mus musculus
ctgggaaatacagctactatcattc

SEQ ID NO: 387263 - DNA, 25 bp, Mus musculus
ctgggaaatcttcctgtctactgaa

SEQ ID NO: 387264 - DNA, 25 bp, Mus musculus
ctgggaaatcttgctgtctactgaa

SEQ ID NO: 387265 - DNA, 25 bp, Mus musculus
ctgggaaattgcaggcattttagtg

SEQ ID NO: 387266 - DNA, 25 bp, Mus musculus
ctgggaaattgctggcattttagtg

SEQ ID NO: 387267 - DNA, 25 bp, Mus musculus
ctgggaacacacacatctgatgaac

SEQ ID NO: 387268 - DNA, 25 bp, Mus musculus
ctgggaacacactcatctgatgaac

SEQ ID NO: 387269 - DNA, 25 bp, Mus musculus
ctgggaacacagctcagtcggtaaa

SEQ ID NO: 387270 - DNA, 25 bp, Mus musculus
ctgggaacacaggtcagtcggtaaa

SEQ ID NO: 387271 - DNA, 25 bp, Mus musculus
ctgggaacagaaatccctgcttcct

SEQ ID NO: 387272 - DNA, 25 bp, Mus musculus
ctgggaacagaattccctgcttcct

SEQ ID NO: 387273 - DNA, 25 bp, Mus musculus
ctgggaacagcgaattataatctat

SEQ ID NO: 387274 - DNA, 25 bp, Mus musculus
ctgggaacagcgtattataatctat

SEQ ID NO: 387275 - DNA, 25 bp, Mus musculus
ctgggaacagtaactgggctaacct

SEQ ID NO: 387276 - DNA, 25 bp, Mus musculus
ctgggaacagtatctgggctaacct

SEQ ID NO: 387277 - DNA, 25 bp, Mus musculus
ctgggaacctctaaatgagccgcct

SEQ ID NO: 387278 - DNA, 25 bp, Mus musculus
ctgggaacctcttaatgagccgcct

SEQ ID NO: 387279 - DNA, 25 bp, Mus musculus
ctgggaacgtcacgcaaactctcag

SEQ ID NO: 387280 - DNA, 25 bp, Mus musculus
ctgggaacgtcaggcaaactctcag

SEQ ID NO: 387281 - DNA, 25 bp, Mus musculus
ctgggaactgttcctacatctgtat

SEQ ID NO: 387282 - DNA, 25 bp, Mus musculus
ctgggaactgttgctacatctgtat

SEQ ID NO: 387283 - DNA, 25 bp, Mus musculus
ctgggaacttaactgatgccaaatt

SEQ ID NO: 387284 - DNA, 25 bp, Mus musculus
ctgggaacttaagtgatgccaaatt

SEQ ID NO: 387285 - DNA, 25 bp, Mus musculus
ctgggaagaatcaggcccaaccttt

SEQ ID NO: 387286 - DNA, 25 bp, Mus musculus
ctgggaagaatctggcccaaccttt

SEQ ID NO: 387287 - DNA, 25 bp, Mus musculus
ctgggaagagaccacagtccctgga

SEQ ID NO: 387288 - DNA, 25 bp, Mus musculus
ctgggaagagacgacagtccctgga

SEQ ID NO: 387289 - DNA, 25 bp, Mus musculus
ctgggaagagtaatccgagagcaac

SEQ ID NO: 387290 - DNA, 25 bp, Mus musculus
ctgggaagagtattccgagagcaac

SEQ ID NO: 387291 - DNA, 25 bp, Mus musculus
ctgggaagatggaattgagaactaa

SEQ ID NO: 387292 - DNA, 25 bp, Mus musculus
ctgggaagatggtattgagaactaa

SEQ ID NO: 387293 - DNA, 25 bp, Mus musculus
ctgggaagcacacagacctggagat

SEQ ID NO: 387294 - DNA, 25 bp, Mus musculus
ctgggaagcacagagacctggagat

SEQ ID NO: 387295 - DNA, 25 bp, Mus musculus
ctgggaagccttcctagagcgagct

SEQ ID NO: 387296 - DNA, 25 bp, Mus musculus
ctgggaagccttgctagagcgagct

SEQ ID NO: 387297 - DNA, 25 bp, Mus musculus
ctgggaaggaacatgggcaccactt

SEQ ID NO: 387298 - DNA, 25 bp, Mus musculus
ctgggaaggaacttgggcaccactt

SEQ ID NO: 387299 - DNA, 25 bp, Mus musculus
ctgggaaggtagatctcgtgtcact

SEQ ID NO: 387300 - DNA, 25 bp, Mus musculus
ctgggaaggtagttctcgtgtcact

SEQ ID NO: 387301 - DNA, 25 bp, Mus musculus
ctgggaagtgtcatgcaattgtctg

SEQ ID NO: 387302 - DNA, 25 bp, Mus musculus
ctgggaagtgtcttgcaattgtctg

SEQ ID NO: 387303 - DNA, 25 bp, Mus musculus
ctgggaatatgcctctgttgataga

SEQ ID NO: 387304 - DNA, 25 bp, Mus musculus
ctgggaatatgcgtctgttgataga

SEQ ID NO: 387305 - DNA, 25 bp, Mus musculus
ctgggaatatggcagccgttggctg

SEQ ID NO: 387306 - DNA, 25 bp, Mus musculus
ctgggaatatgggagccgttggctg

SEQ ID NO: 387307 - DNA, 25 bp, Mus musculus
ctgggaatgcaaatgacgacctctt

SEQ ID NO: 387308 - DNA, 25 bp, Mus musculus
ctgggaatgcaattgacgacctctt

SEQ ID NO: 387309 - DNA, 25 bp, Mus musculus
ctgggacaaaggctctccttggctt

SEQ ID NO: 387310 - DNA, 25 bp, Mus musculus
ctgggacaaagggtctccttggctt

SEQ ID NO: 387311 - DNA, 25 bp, Mus musculus
ctgggacacagcagcagtcatttta

SEQ ID NO: 387312 - DNA, 25 bp, Mus musculus
ctgggacacagctgcagtcatttta

SEQ ID NO: 387313 - DNA, 25 bp, Mus musculus
ctgggacaccctcgagtcagatggc

SEQ ID NO: 387314 - DNA, 25 bp, Mus musculus
ctgggacaccctggagtcagatggc

SEQ ID NO: 387315 - DNA, 25 bp, Mus musculus
ctgggacagactctcatttttttta

SEQ ID NO: 387316 - DNA, 25 bp, Mus musculus
ctgggacagactgtcatttttttta

SEQ ID NO: 387317 - DNA, 25 bp, Mus musculus
ctgggacagaggaacccgcaacgga

SEQ ID NO: 387318 - DNA, 25 bp, Mus musculus
ctgggacagaggtacccgcaacgga

SEQ ID NO: 387319 - DNA, 25 bp, Mus musculus
ctgggacagcaacggtttggcatca

SEQ ID NO: 387320 - DNA, 25 bp, Mus musculus
ctgggacagcaagggtttggcatca

SEQ ID NO: 387321 - DNA, 25 bp, Mus musculus
ctgggacagcacatcaggctgggca

SEQ ID NO: 387322 - DNA, 25 bp, Mus musculus
ctgggacagcacttcaggctgggca

SEQ ID NO: 387323 - DNA, 25 bp, Mus musculus
ctgggacagccacgatggaccaaaa

SEQ ID NO: 387324 - DNA, 25 bp, Mus musculus
ctgggacagccaggatggaccaaaa

SEQ ID NO: 387325 - DNA, 25 bp, Mus musculus
ctgggacaggcaattgaggtcgctt

SEQ ID NO: 387326 - DNA, 25 bp, Mus musculus
ctgggacaggcatttgaggtcgctt

SEQ ID NO: 387327 - DNA, 25 bp, Mus musculus
ctgggacagttccactctgggaagt

SEQ ID NO: 387328 - DNA, 25 bp, Mus musculus
ctgggacagttcgactctgggaagt

SEQ ID NO: 387329 - DNA, 25 bp, Mus musculus
ctgggacatcaacagcaagtatttc

SEQ ID NO: 387330 - DNA, 25 bp, Mus musculus
ctgggacatcaagagcaagtatttc

SEQ ID NO: 387331 - DNA, 25 bp, Mus musculus
ctgggacatggcatagagtgacttt

SEQ ID NO: 387332 - DNA, 25 bp, Mus musculus
ctgggacatggcttagagtgacttt

SEQ ID NO: 387333 - DNA, 25 bp, Mus musculus
ctgggacattttagagctaccatgt

SEQ ID NO: 387334 - DNA, 25 bp, Mus musculus
ctgggacatttttgagctaccatgt

SEQ ID NO: 387335 - DNA, 25 bp, Mus musculus
ctgggaccacctattcagtgggaag

SEQ ID NO: 387336 - DNA, 25 bp, Mus musculus
ctgggaccaccttttcagtgggaag

SEQ ID NO: 387337 - DNA, 25 bp, Mus musculus
ctgggaccagagatgtgaaccacca

SEQ ID NO: 387338 - DNA, 25 bp, Mus musculus
ctgggaccagagttgtgaaccacca

SEQ ID NO: 387339 - DNA, 25 bp, Mus musculus
ctgggaccaggcaccccgtgggcaa

SEQ ID NO: 387340 - DNA, 25 bp, Mus musculus
ctgggaccaggctccccgtgggcaa

SEQ ID NO: 387341 - DNA, 25 bp, Mus musculus
ctgggacccgtgcttgtcaaacagg

SEQ ID NO: 387342 - DNA, 25 bp, Mus musculus
ctgggacccgtggttgtcaaacagg

SEQ ID NO: 387343 - DNA, 25 bp, Mus musculus
ctgggacccttcacatcaatcaaga

SEQ ID NO: 387344 - DNA, 25 bp, Mus musculus
ctgggacccttctcatcaatcaaga

SEQ ID NO: 387345 - DNA, 25 bp, Mus musculus
ctgggacctacaacttcaatctttt

SEQ ID NO: 387346 - DNA, 25 bp, Mus musculus
ctgggacctacatcttcaatctttt

SEQ ID NO: 387347 - DNA, 25 bp, Mus musculus
ctgggacctaccagaactacctggg

SEQ ID NO: 387348 - DNA, 25 bp, Mus musculus
ctgggacctacctgaactacctggg

SEQ ID NO: 387349 - DNA, 25 bp, Mus musculus
ctgggacctcctcgtagtattgagt

SEQ ID NO: 387350 - DNA, 25 bp, Mus musculus
ctgggacctcctggtagtattgagt

SEQ ID NO: 387351 - DNA, 25 bp, Mus musculus
ctgggacctgcccagtaatccggtg

SEQ ID NO: 387352 - DNA, 25 bp, Mus musculus
ctgggacctgccgagtaatccggtg

SEQ ID NO: 387353 - DNA, 25 bp, Mus musculus
ctgggaccttgcatcctttatattt

SEQ ID NO: 387354 - DNA, 25 bp, Mus musculus
ctgggaccttgcttcctttatattt

SEQ ID NO: 387355 - DNA, 25 bp, Mus musculus
ctgggacgggaacgcattcgggaga

SEQ ID NO: 387356 - DNA, 25 bp, Mus musculus
ctgggacgggaaggcattcgggaga

SEQ ID NO: 387357 - DNA, 25 bp, Mus musculus
ctgggacgtgggactgcagctcaca

SEQ ID NO: 387358 - DNA, 25 bp, Mus musculus
ctgggacgtgggtctgcagctcaca

SEQ ID NO: 387359 - DNA, 25 bp, Mus musculus
ctgggactagacagtggcttgctga

SEQ ID NO: 387360 - DNA, 25 bp, Mus musculus
ctgggactagactgtggcttgctga

SEQ ID NO: 387361 - DNA, 25 bp, Mus musculus
ctgggactcaagatcctgggaagga

SEQ ID NO: 387362 - DNA, 25 bp, Mus musculus
ctgggactcaagttcctgggaagga

SEQ ID NO: 387363 - DNA, 25 bp, Mus musculus
ctgggactccaaccttcaatcagtg

SEQ ID NO: 387364 - DNA, 25 bp, Mus musculus
ctgggactccaagcttcaatcagtg

SEQ ID NO: 387365 - DNA, 25 bp, Mus musculus
ctgggactcccaccgcagaagggat

SEQ ID NO: 387366 - DNA, 25 bp, Mus musculus
ctgggactcccagcgcagaagggat

SEQ ID NO: 387367 - DNA, 25 bp, Mus musculus
ctgggactctagcttgctgtgcttt

SEQ ID NO: 387368 - DNA, 25 bp, Mus musculus
ctgggactctaggttgctgtgcttt

SEQ ID NO: 387369 - DNA, 25 bp, Mus musculus
ctgggactctgcatcactagagcaa

SEQ ID NO: 387370 - DNA, 25 bp, Mus musculus
ctgggactctgcttcactagagcaa

SEQ ID NO: 387371 - DNA, 25 bp, Mus musculus
ctgggactgatcagcagcatttctg

SEQ ID NO: 387372 - DNA, 25 bp, Mus musculus
ctgggactgatctgcagcatttctg

SEQ ID NO: 387373 - DNA, 25 bp, Mus musculus
ctgggactgcccatgcctgctgcat

SEQ ID NO: 387374 - DNA, 25 bp, Mus musculus
ctgggactgcccttgcctgctgcat

SEQ ID NO: 387375 - DNA, 25 bp, Mus musculus
ctgggactggccatgcccactagac

SEQ ID NO: 387376 - DNA, 25 bp, Mus musculus
ctgggactggccttgcccactagac

SEQ ID NO: 387377 - DNA, 25 bp, Mus musculus
ctgggacttcacattcttagtttga

SEQ ID NO: 387378 - DNA, 25 bp, Mus musculus
ctgggacttcactttcttagtttga

SEQ ID NO: 387379 - DNA, 25 bp, Mus musculus
ctgggacttggtatagctttgacta

SEQ ID NO: 387380 - DNA, 25 bp, Mus musculus
ctgggacttggtttagctttgacta

SEQ ID NO: 387381 - DNA, 25 bp, Mus musculus
ctgggacttgtcacactgagttttt

SEQ ID NO: 387382 - DNA, 25 bp, Mus musculus
ctgggacttgtcctaacgcttgtct

SEQ ID NO: 387383 - DNA, 25 bp, Mus musculus
ctgggacttgtcgtaacgcttgtct

SEQ ID NO: 387384 - DNA, 25 bp, Mus musculus
ctgggacttgtctcactgagttttt

SEQ ID NO: 387385 - DNA, 25 bp, Mus musculus
ctgggactttttccggcaatggcct

SEQ ID NO: 387386 - DNA, 25 bp, Mus musculus
ctgggactttttgcggcaatggcct

SEQ ID NO: 387387 - DNA, 25 bp, Mus musculus
ctgggagaaagtctacaatcacctt

SEQ ID NO: 387388 - DNA, 25 bp, Mus musculus
ctgggagaaagtgtacaatcacctt

SEQ ID NO: 387389 - DNA, 25 bp, Mus musculus
ctgggagaacaacccatcagcgggt

SEQ ID NO: 387390 - DNA, 25 bp, Mus musculus
ctgggagaacaacttcctcactggg

SEQ ID NO: 387391 - DNA, 25 bp, Mus musculus
ctgggagaacaagccatcagcgggt

SEQ ID NO: 387392 - DNA, 25 bp, Mus musculus
ctgggagaacaagttcctcactggg

SEQ ID NO: 387393 - DNA, 25 bp, Mus musculus
ctgggagaactacggtgctcagcct

SEQ ID NO: 387394 - DNA, 25 bp, Mus musculus
ctgggagaactagggtgctcagcct

SEQ ID NO: 387395 - DNA, 25 bp, Mus musculus
ctgggagaagcaacaccacatctgt

SEQ ID NO: 387396 - DNA, 25 bp, Mus musculus
ctgggagaagcatcaccacatctgt

SEQ ID NO: 387397 - DNA, 25 bp, Mus musculus
ctgggagacactcgtgctacatctt

SEQ ID NO: 387398 - DNA, 25 bp, Mus musculus
ctgggagacactggtgctacatctt

SEQ ID NO: 387399 - DNA, 25 bp, Mus musculus
ctgggagacagcatagggtgtaata

SEQ ID NO: 387400 - DNA, 25 bp, Mus musculus
ctgggagacagcttagggtgtaata

SEQ ID NO: 387401 - DNA, 25 bp, Mus musculus
ctgggagacgtgagccctgtccctt

SEQ ID NO: 387402 - DNA, 25 bp, Mus musculus
ctgggagacgtgtgccctgtccctt

SEQ ID NO: 387403 - DNA, 25 bp, Mus musculus
ctgggagacttgagtgcatagctgt

SEQ ID NO: 387404 - DNA, 25 bp, Mus musculus
ctgggagacttgtgtgcatagctgt

SEQ ID NO: 387405 - DNA, 25 bp, Mus musculus
ctgggagactttcggaccacaacaa

SEQ ID NO: 387406 - DNA, 25 bp, Mus musculus
ctgggagactttgggaccacaacaa

SEQ ID NO: 387407 - DNA, 25 bp, Mus musculus
ctgggagagcacacctgctgaggaa

SEQ ID NO: 387408 - DNA, 25 bp, Mus musculus
ctgggagagcactcctgctgaggaa

SEQ ID NO: 387409 - DNA, 25 bp, Mus musculus
ctgggagaggctacctccaactgga

SEQ ID NO: 387410 - DNA, 25 bp, Mus musculus
ctgggagaggcttcctccaactgga

SEQ ID NO: 387411 - DNA, 25 bp, Mus musculus
ctgggagaggtgattaactttctag

SEQ ID NO: 387412 - DNA, 25 bp, Mus musculus
ctgggagaggtgtttaactttctag

SEQ ID NO: 387413 - DNA, 25 bp, Mus musculus
ctgggagccagacactgagagaact

SEQ ID NO: 387414 - DNA, 25 bp, Mus musculus
ctgggagccagagactgagagaact

SEQ ID NO: 387415 - DNA, 25 bp, Mus musculus
ctgggagccagcattgcaggcagaa

SEQ ID NO: 387416 - DNA, 25 bp, Mus musculus
ctgggagccagctttgcaggcagaa

SEQ ID NO: 387417 - DNA, 25 bp, Mus musculus
ctgggagctcccagactatctatgg

SEQ ID NO: 387418 - DNA, 25 bp, Mus musculus
ctgggagctccctgactatctatgg

SEQ ID NO: 387419 - DNA, 25 bp, Mus musculus
ctgggagctcttcgtgaatgtttac

SEQ ID NO: 387420 - DNA, 25 bp, Mus musculus
ctgggagctcttggtgaatgtttac

SEQ ID NO: 387421 - DNA, 25 bp, Mus musculus
ctgggagctgcactggttttgaatt

SEQ ID NO: 387422 - DNA, 25 bp, Mus musculus
ctgggagctgcagtggttttgaatt

SEQ ID NO: 387423 - DNA, 25 bp, Mus musculus
ctgggagctgccaacgatgagacaa

SEQ ID NO: 387424 - DNA, 25 bp, Mus musculus
ctgggagctgcctacgatgagacaa

SEQ ID NO: 387425 - DNA, 25 bp, Mus musculus
ctgggagctgtaatggttacctttt

SEQ ID NO: 387426 - DNA, 25 bp, Mus musculus
ctgggagctgtattggttacctttt

SEQ ID NO: 387427 - DNA, 25 bp, Mus musculus
ctgggagctgtcagagggtccatcc

SEQ ID NO: 387428 - DNA, 25 bp, Mus musculus
ctgggagctgtctgagggtccatcc

SEQ ID NO: 387429 - DNA, 25 bp, Mus musculus
ctgggaggaaacaagagactctgta

SEQ ID NO: 387430 - DNA, 25 bp, Mus musculus
ctgggaggaaactagagactctgta

SEQ ID NO: 387431 - DNA, 25 bp, Mus musculus
ctgggaggaccaaatacgccgggat

SEQ ID NO: 387432 - DNA, 25 bp, Mus musculus
ctgggaggaccatatacgccgggat

SEQ ID NO: 387433 - DNA, 25 bp, Mus musculus
ctgggaggctgactctgcagatcct

SEQ ID NO: 387434 - DNA, 25 bp, Mus musculus
ctgggaggctgagtctgcagatcct

SEQ ID NO: 387435 - DNA, 25 bp, Mus musculus
ctgggagggtgacagttgctgcact

SEQ ID NO: 387436 - DNA, 25 bp, Mus musculus
ctgggagggtgagagttgctgcact

SEQ ID NO: 387437 - DNA, 25 bp, Mus musculus
ctgggaggtttcacagaggacgcta

SEQ ID NO: 387438 - DNA, 25 bp, Mus musculus
ctgggaggtttctcagaggacgcta

SEQ ID NO: 387439 - DNA, 25 bp, Mus musculus
ctgggagtatgaatgtggcctagcc

SEQ ID NO: 387440 - DNA, 25 bp, Mus musculus
ctgggagtatgattgtggcctagcc

SEQ ID NO: 387441 - DNA, 25 bp, Mus musculus
ctgggagtcagtccagcatgctgct

SEQ ID NO: 387442 - DNA, 25 bp, Mus musculus
ctgggagtcagtgcagcatgctgct

SEQ ID NO: 387443 - DNA, 25 bp, Mus musculus
ctgggagtcattaaactatttgttt

SEQ ID NO: 387444 - DNA, 25 bp, Mus musculus
ctgggagtcatttaactatttgttt

SEQ ID NO: 387445 - DNA, 25 bp, Mus musculus
ctgggagtctgccatggagggtttt

SEQ ID NO: 387446 - DNA, 25 bp, Mus musculus
ctgggagtctgcgatggagggtttt

SEQ ID NO: 387447 - DNA, 25 bp, Mus musculus
ctgggagtgacactgctgacaagaa

SEQ ID NO: 387448 - DNA, 25 bp, Mus musculus
ctgggagtgacagtgctgacaagaa

SEQ ID NO: 387449 - DNA, 25 bp, Mus musculus
ctgggagtgcacatgtctctgaaat

SEQ ID NO: 387450 - DNA, 25 bp, Mus musculus
ctgggagtgcacttgtctctgaaat

SEQ ID NO: 387451 - DNA, 25 bp, Mus musculus
ctgggagtgcagcaagagccattct

SEQ ID NO: 387452 - DNA, 25 bp, Mus musculus
ctgggagtgcaggaagagccattct

SEQ ID NO: 387453 - DNA, 25 bp, Mus musculus
ctgggagttacaatgccgattcgcc

SEQ ID NO: 387454 - DNA, 25 bp, Mus musculus
ctgggagttacattgccgattcgcc

SEQ ID NO: 387455 - DNA, 25 bp, Mus musculus
ctgggagttagaacctgagcttgtg

SEQ ID NO: 387456 - DNA, 25 bp, Mus musculus
ctgggagttagatcctgagcttgtg

SEQ ID NO: 387457 - DNA, 25 bp, Mus musculus
ctgggagttgaaatgtttttgctac

SEQ ID NO: 387458 - DNA, 25 bp, Mus musculus
ctgggagttgaattgtttttgctac

SEQ ID NO: 387459 - DNA, 25 bp, Mus musculus
ctgggagttgacagcattgaacgga

SEQ ID NO: 387460 - DNA, 25 bp, Mus musculus
ctgggagttgactgcattgaacgga

SEQ ID NO: 387461 - DNA, 25 bp, Mus musculus
ctgggagttgtcaagagtgtctgac

SEQ ID NO: 387462 - DNA, 25 bp, Mus musculus
ctgggagttgtctagagtgtctgac

SEQ ID NO: 387463 - DNA, 25 bp, Mus musculus
ctgggataaaggaatagcgttgcat

SEQ ID NO: 387464 - DNA, 25 bp, Mus musculus
ctgggataaaggtatagcgttgcat

SEQ ID NO: 387465 - DNA, 25 bp, Mus musculus
ctgggataacccatacagcattagt

SEQ ID NO: 387466 - DNA, 25 bp, Mus musculus
ctgggataacccttacagcattagt

SEQ ID NO: 387467 - DNA, 25 bp, Mus musculus
ctgggatactatctcttacttggat

SEQ ID NO: 387468 - DNA, 25 bp, Mus musculus
ctgggatactatgtcttacttggat

SEQ ID NO: 387469 - DNA, 25 bp, Mus musculus
ctgggatatagtcagctcctacctc

SEQ ID NO: 387470 - DNA, 25 bp, Mus musculus
ctgggatatagtgagctcctacctc

SEQ ID NO: 387471 - DNA, 25 bp, Mus musculus
ctgggatattgtatgagagactagc

SEQ ID NO: 387472 - DNA, 25 bp, Mus musculus
ctgggatattgtttgagagactagc

SEQ ID NO: 387473 - DNA, 25 bp, Mus musculus
ctgggatcacagagccttcggatat

SEQ ID NO: 387474 - DNA, 25 bp, Mus musculus
ctgggatcacagtgccttcggatat

SEQ ID NO: 387475 - DNA, 25 bp, Mus musculus
ctgggatcacgtagagttctattta

SEQ ID NO: 387476 - DNA, 25 bp, Mus musculus
ctgggatcacgttgagttctattta

SEQ ID NO: 387477 - DNA, 25 bp, Mus musculus
ctgggatcactgacctctggagtcg

SEQ ID NO: 387478 - DNA, 25 bp, Mus musculus
ctgggatcactgtcctctggagtcg

SEQ ID NO: 387479 - DNA, 25 bp, Mus musculus
ctgggatccaatataagctctgtat

SEQ ID NO: 387480 - DNA, 25 bp, Mus musculus
ctgggatccaatttaagctctgtat

SEQ ID NO: 387481 - DNA, 25 bp, Mus musculus
ctgggatccagcaggacactgtgac

SEQ ID NO: 387482 - DNA, 25 bp, Mus musculus
ctgggatccagctggacactgtgac

SEQ ID NO: 387483 - DNA, 25 bp, Mus musculus
ctgggatcctgacctttgacaagag

SEQ ID NO: 387484 - DNA, 25 bp, Mus musculus
ctgggatcctgagctttgacaagag

SEQ ID NO: 387485 - DNA, 25 bp, Mus musculus
ctgggatctccacggaacagcactg

SEQ ID NO: 387486 - DNA, 25 bp, Mus musculus
ctgggatctccagggaacagcactg

SEQ ID NO: 387487 - DNA, 25 bp, Mus musculus
ctgggatctcctccacatagaatag

SEQ ID NO: 387488 - DNA, 25 bp, Mus musculus
ctgggatctcctgcacatagaatag

SEQ ID NO: 387489 - DNA, 25 bp, Mus musculus
ctgggatctgtgctaatggactctg

SEQ ID NO: 387490 - DNA, 25 bp, Mus musculus
ctgggatctgtggtaatggactctg

SEQ ID NO: 387491 - DNA, 25 bp, Mus musculus
ctgggatgatcgcactaccaacgac

SEQ ID NO: 387492 - DNA, 25 bp, Mus musculus
ctgggatgatcggactaccaacgac

SEQ ID NO: 387493 - DNA, 25 bp, Mus musculus
ctgggatgctacaacgggctctcca

SEQ ID NO: 387494 - DNA, 25 bp, Mus musculus
ctgggatgctactacgggctctcca

SEQ ID NO: 387495 - DNA, 25 bp, Mus musculus
ctgggatggcagagcaacctatttt

SEQ ID NO: 387496 - DNA, 25 bp, Mus musculus
ctgggatggcagtgcaacctatttt

SEQ ID NO: 387497 - DNA, 25 bp, Mus musculus
ctgggatgggaaccctcatcccaag

SEQ ID NO: 387498 - DNA, 25 bp, Mus musculus
ctgggatgggaagcctcatcccaag

SEQ ID NO: 387499 - DNA, 25 bp, Mus musculus
ctgggatgtactaaagtctcaacct

SEQ ID NO: 387500 - DNA, 25 bp, Mus musculus
ctgggatgtacttaagtctcaacct

SEQ ID NO: 387501 - DNA, 25 bp, Mus musculus
ctgggatgtcagcagacgaatcaat

SEQ ID NO: 387502 - DNA, 25 bp, Mus musculus
ctgggatgtcaggagacgaatcaat

SEQ ID NO: 387503 - DNA, 25 bp, Mus musculus
ctgggatgtctcatcagctgtgggt

SEQ ID NO: 387504 - DNA, 25 bp, Mus musculus
ctgggatgtctcttcagctgtgggt

SEQ ID NO: 387505 - DNA, 25 bp, Mus musculus
ctgggatgtctgacggagcacaact

SEQ ID NO: 387506 - DNA, 25 bp, Mus musculus
ctgggatgtctgtcggagcacaact

SEQ ID NO: 387507 - DNA, 25 bp, Mus musculus
ctgggatgttcaaagattgtactga

SEQ ID NO: 387508 - DNA, 25 bp, Mus musculus
ctgggatgttcatagattgtactga

SEQ ID NO: 387509 - DNA, 25 bp, Mus musculus
ctgggattaagactacctgttgttc

SEQ ID NO: 387510 - DNA, 25 bp, Mus musculus
ctgggattaagagtacctgttgttc

SEQ ID NO: 387511 - DNA, 25 bp, Mus musculus
ctgggattacagattttaagttcct

SEQ ID NO: 387512 - DNA, 25 bp, Mus musculus
ctgggattacagtttttaagttcct

SEQ ID NO: 387513 - DNA, 25 bp, Mus musculus
ctgggattacatctgtttagggaac

SEQ ID NO: 387514 - DNA, 25 bp, Mus musculus
ctgggattacatgtgtttagggaac

SEQ ID NO: 387515 - DNA, 25 bp, Mus musculus
ctgggattacttagcctggtgtgac

SEQ ID NO: 387516 - DNA, 25 bp, Mus musculus
ctgggattactttgcctggtgtgac

SEQ ID NO: 387517 - DNA, 25 bp, Mus musculus
ctgggattataccaatgcaccacca

SEQ ID NO: 387518 - DNA, 25 bp, Mus musculus
ctgggattatacgaatgcaccacca

SEQ ID NO: 387519 - DNA, 25 bp, Mus musculus
ctgggattatagacgcacacttcaa

SEQ ID NO: 387520 - DNA, 25 bp, Mus musculus
ctgggattatagatggacgttgtca

SEQ ID NO: 387521 - DNA, 25 bp, Mus musculus
ctgggattatagtcgcacacttcaa

SEQ ID NO: 387522 - DNA, 25 bp, Mus musculus
ctgggattatagttggacgttgtca

SEQ ID NO: 387523 - DNA, 25 bp, Mus musculus
ctgggattcaccagggcgttgacca

SEQ ID NO: 387524 - DNA, 25 bp, Mus musculus
ctgggattcacctgggcgttgacca

SEQ ID NO: 387525 - DNA, 25 bp, Mus musculus
ctgggattccacacagttacggatt

SEQ ID NO: 387526 - DNA, 25 bp, Mus musculus
ctgggattccactcagttacggatt

SEQ ID NO: 387527 - DNA, 25 bp, Mus musculus
ctgggattcggtacctgtaacttga

SEQ ID NO: 387528 - DNA, 25 bp, Mus musculus
ctgggattcggttcctgtaacttga

SEQ ID NO: 387529 - DNA, 25 bp, Mus musculus
ctgggattcttaaaggttcttcatt

SEQ ID NO: 387530 - DNA, 25 bp, Mus musculus
ctgggattcttataggttcttcatt

SEQ ID NO: 387531 - DNA, 25 bp, Mus musculus
ctgggattgaaaccctgtgacattt

SEQ ID NO: 387532 - DNA, 25 bp, Mus musculus
ctgggattgaaagcctgtgacattt

SEQ ID NO: 387533 - DNA, 25 bp, Mus musculus
ctgggattgcagctcagcatttgag

SEQ ID NO: 387534 - DNA, 25 bp, Mus musculus
ctgggattgcaggtcagcatttgag

SEQ ID NO: 387535 - DNA, 25 bp, Mus musculus
ctgggattggccatgctggttgcct

SEQ ID NO: 387536 - DNA, 25 bp, Mus musculus
ctgggattggccttgctggttgcct

SEQ ID NO: 387537 - DNA, 25 bp, Mus musculus
ctgggatttcttatggagtacctga

SEQ ID NO: 387538 - DNA, 25 bp, Mus musculus
ctgggatttcttttggagtacctga

SEQ ID NO: 387539 - DNA, 25 bp, Mus musculus
ctgggatttgcaagtcgggaatatt

SEQ ID NO: 387540 - DNA, 25 bp, Mus musculus
ctgggatttgcatgtcgggaatatt

SEQ ID NO: 387541 - DNA, 25 bp, Mus musculus
ctgggcaaacatcaggatgcttgat

SEQ ID NO: 387542 - DNA, 25 bp, Mus musculus
ctgggcaaacatgaggatgcttgat

SEQ ID NO: 387543 - DNA, 25 bp, Mus musculus
ctgggcaaacttacctcagtcattt

SEQ ID NO: 387544 - DNA, 25 bp, Mus musculus
ctgggcaaactttcctcagtcattt

SEQ ID NO: 387545 - DNA, 25 bp, Mus musculus
ctgggcaacaacatgagacttatat

SEQ ID NO: 387546 - DNA, 25 bp, Mus musculus
ctgggcaacaacttgagacttatat

SEQ ID NO: 387547 - DNA, 25 bp, Mus musculus
ctgggcaacaagaacaccttcaact

SEQ ID NO: 387548 - DNA, 25 bp, Mus musculus
ctgggcaacaagtacaccttcaact

SEQ ID NO: 387549 - DNA, 25 bp, Mus musculus
ctgggcaacataccatgatcgaatg

SEQ ID NO: 387550 - DNA, 25 bp, Mus musculus
ctgggcaacatagcatgatcgaatg

SEQ ID NO: 387551 - DNA, 25 bp, Mus musculus
ctgggcaacatcactggagtgtcta

SEQ ID NO: 387552 - DNA, 25 bp, Mus musculus
ctgggcaacatctctggagtgtcta

SEQ ID NO: 387553 - DNA, 25 bp, Mus musculus
ctgggcaacattataaagagctctt

SEQ ID NO: 387554 - DNA, 25 bp, Mus musculus
ctgggcaacattcgcagtggacttg

SEQ ID NO: 387555 - DNA, 25 bp, Mus musculus
ctgggcaacattggcagtggacttg

SEQ ID NO: 387556 - DNA, 25 bp, Mus musculus
ctgggcaacattttaaagagctctt

SEQ ID NO: 387557 - DNA, 25 bp, Mus musculus
ctgggcaagccaaccttgagaatgt

SEQ ID NO: 387558 - DNA, 25 bp, Mus musculus
ctgggcaagccatccttgagaatgt

SEQ ID NO: 387559 - DNA, 25 bp, Mus musculus
ctgggcaagtgcacacaggcccaca

SEQ ID NO: 387560 - DNA, 25 bp, Mus musculus
ctgggcaagtgcataagaaactgga

SEQ ID NO: 387561 - DNA, 25 bp, Mus musculus
ctgggcaagtgctcacaggcccaca

SEQ ID NO: 387562 - DNA, 25 bp, Mus musculus
ctgggcaagtgcttaagaaactgga

SEQ ID NO: 387563 - DNA, 25 bp, Mus musculus
ctgggcaagttcagagcaggacgct

SEQ ID NO: 387564 - DNA, 25 bp, Mus musculus
ctgggcaagttctgagcaggacgct

SEQ ID NO: 387565 - DNA, 25 bp, Mus musculus
ctgggcaatggaccctcacatttga

SEQ ID NO: 387566 - DNA, 25 bp, Mus musculus
ctgggcaatggagcctcacatttga

SEQ ID NO: 387567 - DNA, 25 bp, Mus musculus
ctgggcaattgtcgtgcataccttt

SEQ ID NO: 387568 - DNA, 25 bp, Mus musculus
ctgggcaattgtggtgcataccttt

SEQ ID NO: 387569 - DNA, 25 bp, Mus musculus
ctgggcaattttacctagtcaactt

SEQ ID NO: 387570 - DNA, 25 bp, Mus musculus
ctgggcaatttttcctagtcaactt

SEQ ID NO: 387571 - DNA, 25 bp, Mus musculus
ctgggcacaggacacccacagggca

SEQ ID NO: 387572 - DNA, 25 bp, Mus musculus
ctgggcacaggagacccacagggca

SEQ ID NO: 387573 - DNA, 25 bp, Mus musculus
ctgggcaccactaatagggcttcaa

SEQ ID NO: 387574 - DNA, 25 bp, Mus musculus
ctgggcaccacttatagggcttcaa

SEQ ID NO: 387575 - DNA, 25 bp, Mus musculus
ctgggcaccatcagcacataagaaa

SEQ ID NO: 387576 - DNA, 25 bp, Mus musculus
ctgggcaccatctgcacataagaaa

SEQ ID NO: 387577 - DNA, 25 bp, Mus musculus
ctgggcaccatgatctactggagca

SEQ ID NO: 387578 - DNA, 25 bp, Mus musculus
ctgggcaccatgttctactggagca

SEQ ID NO: 387579 - DNA, 25 bp, Mus musculus
ctgggcacccggccccctgacagga

SEQ ID NO: 387580 - DNA, 25 bp, Mus musculus
ctgggcacccgggcccctgacagga

SEQ ID NO: 387581 - DNA, 25 bp, Mus musculus
ctgggcaccctacgaaagctggctc

SEQ ID NO: 387582 - DNA, 25 bp, Mus musculus
ctgggcaccctaggaaagctggctc

SEQ ID NO: 387583 - DNA, 25 bp, Mus musculus
ctgggcacctaaacatctttactag

SEQ ID NO: 387584 - DNA, 25 bp, Mus musculus
ctgggcacctaatcatctttactag

SEQ ID NO: 387585 - DNA, 25 bp, Mus musculus
ctgggcacctctcacttaagtgtct

SEQ ID NO: 387586 - DNA, 25 bp, Mus musculus
ctgggcacctctgacttaagtgtct

SEQ ID NO: 387587 - DNA, 25 bp, Mus musculus
ctgggcactgaacataggctagcag

SEQ ID NO: 387588 - DNA, 25 bp, Mus musculus
ctgggcactgaagataggctagcag

SEQ ID NO: 387589 - DNA, 25 bp, Mus musculus
ctgggcactgtcacctaagagtaac

SEQ ID NO: 387590 - DNA, 25 bp, Mus musculus
ctgggcactgtctcctaagagtaac

SEQ ID NO: 387591 - DNA, 25 bp, Mus musculus
ctgggcactgtgacctataactgta

SEQ ID NO: 387592 - DNA, 25 bp, Mus musculus
ctgggcactgtgtcctataactgta

SEQ ID NO: 387593 - DNA, 25 bp, Mus musculus
ctgggcacttacctagtacttaggt

SEQ ID NO: 387594 - DNA, 25 bp, Mus musculus
ctgggcacttacgtagtacttaggt

SEQ ID NO: 387595 - DNA, 25 bp, Mus musculus
ctgggcacttcacgctgctgctgag

SEQ ID NO: 387596 - DNA, 25 bp, Mus musculus
ctgggcacttcaggctgctgctgag

SEQ ID NO: 387597 - DNA, 25 bp, Mus musculus
ctgggcagagcacgcactcatttcc

SEQ ID NO: 387598 - DNA, 25 bp, Mus musculus
ctgggcagagcaggcactcatttcc

SEQ ID NO: 387599 - DNA, 25 bp, Mus musculus
ctgggcagaggcatttgcaacagtt

SEQ ID NO: 387600 - DNA, 25 bp, Mus musculus
ctgggcagaggcttttgcaacagtt

SEQ ID NO: 387601 - DNA, 25 bp, Mus musculus
ctgggcagcaccagtagccaagtgg

SEQ ID NO: 387602 - DNA, 25 bp, Mus musculus
ctgggcagcacctgtagccaagtgg

SEQ ID NO: 387603 - DNA, 25 bp, Mus musculus
ctgggcagcagacatcatggatttt

SEQ ID NO: 387604 - DNA, 25 bp, Mus musculus
ctgggcagcagagatcatggatttt

SEQ ID NO: 387605 - DNA, 25 bp, Mus musculus
ctgggcagcgtaacccagtttgagg

SEQ ID NO: 387606 - DNA, 25 bp, Mus musculus
ctgggcagcgtatcccagtttgagg

SEQ ID NO: 387607 - DNA, 25 bp, Mus musculus
ctgggcagctgtatccgatggtgct

SEQ ID NO: 387608 - DNA, 25 bp, Mus musculus
ctgggcagctgtttccgatggtgct

SEQ ID NO: 387609 - DNA, 25 bp, Mus musculus
ctgggcagcttacctgagatgtgct

SEQ ID NO: 387610 - DNA, 25 bp, Mus musculus
ctgggcagcttagctgagatgtgct

SEQ ID NO: 387611 - DNA, 25 bp, Mus musculus
ctgggcaggattactgttagcttct

SEQ ID NO: 387612 - DNA, 25 bp, Mus musculus
ctgggcaggatttctgttagcttct

SEQ ID NO: 387613 - DNA, 25 bp, Mus musculus
ctgggcaggctcacatcttttattt

SEQ ID NO: 387614 - DNA, 25 bp, Mus musculus
ctgggcaggctctcatcttttattt

SEQ ID NO: 387615 - DNA, 25 bp, Mus musculus
ctgggcaggcttcccccagcattgg

SEQ ID NO: 387616 - DNA, 25 bp, Mus musculus
ctgggcaggcttgccccagcattgg

SEQ ID NO: 387617 - DNA, 25 bp, Mus musculus
ctgggcagtactcccacctgggcag

SEQ ID NO: 387618 - DNA, 25 bp, Mus musculus
ctgggcagtactgccacctgggcag

SEQ ID NO: 387619 - DNA, 25 bp, Mus musculus
ctgggcagtctcacatttgcttaat

SEQ ID NO: 387620 - DNA, 25 bp, Mus musculus
ctgggcagtctctcatttgcttaat

SEQ ID NO: 387621 - DNA, 25 bp, Mus musculus
ctgggcagtgctatggaccaggcac

SEQ ID NO: 387622 - DNA, 25 bp, Mus musculus
ctgggcagtgctttggaccaggcac

SEQ ID NO: 387623 - DNA, 25 bp, Mus musculus
ctgggcagtggcagcttatcctgag

SEQ ID NO: 387624 - DNA, 25 bp, Mus musculus
ctgggcagtggcagttacaaaacaa

SEQ ID NO: 387625 - DNA, 25 bp, Mus musculus
ctgggcagtggctgcttatcctgag

SEQ ID NO: 387626 - DNA, 25 bp, Mus musculus
ctgggcagtggctgttacaaaacaa

SEQ ID NO: 387627 - DNA, 25 bp, Mus musculus
ctgggcagtttcagaagaacgctac

SEQ ID NO: 387628 - DNA, 25 bp, Mus musculus
ctgggcagtttcatcgtgccaaaga

SEQ ID NO: 387629 - DNA, 25 bp, Mus musculus
ctgggcagtttctgaagaacgctac

SEQ ID NO: 387630 - DNA, 25 bp, Mus musculus
ctgggcagtttcttcgtgccaaaga

SEQ ID NO: 387631 - DNA, 25 bp, Mus musculus
ctgggcatcatacctcacatctata

SEQ ID NO: 387632 - DNA, 25 bp, Mus musculus
ctgggcatcatagctcacatctata

SEQ ID NO: 387633 - DNA, 25 bp, Mus musculus
ctgggcatccacaagggaatctggg

SEQ ID NO: 387634 - DNA, 25 bp, Mus musculus
ctgggcatccactagggaatctggg

SEQ ID NO: 387635 - DNA, 25 bp, Mus musculus
ctgggcatgaccagtggcttgagaa

SEQ ID NO: 387636 - DNA, 25 bp, Mus musculus
ctgggcatgacctgtggcttgagaa

SEQ ID NO: 387637 - DNA, 25 bp, Mus musculus
ctgggcatgagcagctgagtacctt

SEQ ID NO: 387638 - DNA, 25 bp, Mus musculus
ctgggcatgagctgctgagtacctt

SEQ ID NO: 387639 - DNA, 25 bp, Mus musculus
ctgggcatggctaagagacgtgcta

SEQ ID NO: 387640 - DNA, 25 bp, Mus musculus
ctgggcatggcttagagacgtgcta

SEQ ID NO: 387641 - DNA, 25 bp, Mus musculus
ctgggcatgttgactcaccttaaga

SEQ ID NO: 387642 - DNA, 25 bp, Mus musculus
ctgggcatgttgtctcaccttaaga

SEQ ID NO: 387643 - DNA, 25 bp, Mus musculus
ctgggcattaggaagtttcacttct

SEQ ID NO: 387644 - DNA, 25 bp, Mus musculus
ctgggcattaggtagtttcacttct

SEQ ID NO: 387645 - DNA, 25 bp, Mus musculus
ctgggcatttgcagggaagctgtat

SEQ ID NO: 387646 - DNA, 25 bp, Mus musculus
ctgggcatttgctgggaagctgtat

SEQ ID NO: 387647 - DNA, 25 bp, Mus musculus
ctgggcatttgtctggctccggtac

SEQ ID NO: 387648 - DNA, 25 bp, Mus musculus
ctgggcatttgtgtggctccggtac

SEQ ID NO: 387649 - DNA, 25 bp, Mus musculus
ctgggcatttttccagttcaatgac

SEQ ID NO: 387650 - DNA, 25 bp, Mus musculus
ctgggcatttttgcagttcaatgac

SEQ ID NO: 387651 - DNA, 25 bp, Mus musculus
ctgggccaattcctggagtttctga

SEQ ID NO: 387652 - DNA, 25 bp, Mus musculus
ctgggccaattcgtggagtttctga

SEQ ID NO: 387653 - DNA, 25 bp, Mus musculus
ctgggccacacacaactcttggatt

SEQ ID NO: 387654 - DNA, 25 bp, Mus musculus
ctgggccacacagaactcttggatt

SEQ ID NO: 387655 - DNA, 25 bp, Mus musculus
ctgggccacataccaaactcttttc

SEQ ID NO: 387656 - DNA, 25 bp, Mus musculus
ctgggccacatagcaaactcttttc

SEQ ID NO: 387657 - DNA, 25 bp, Mus musculus
ctgggccacggcattcaccaagtat

SEQ ID NO: 387658 - DNA, 25 bp, Mus musculus
ctgggccacggctttcaccaagtat

SEQ ID NO: 387659 - DNA, 25 bp, Mus musculus
ctgggccactcaaacatttacaggg

SEQ ID NO: 387660 - DNA, 25 bp, Mus musculus
ctgggccactcatacatttacaggg

SEQ ID NO: 387661 - DNA, 25 bp, Mus musculus
ctgggccactggatatctgctttgt

SEQ ID NO: 387662 - DNA, 25 bp, Mus musculus
ctgggccactggttatctgctttgt

SEQ ID NO: 387663 - DNA, 25 bp, Mus musculus
ctgggccactttatgggaatcaatt

SEQ ID NO: 387664 - DNA, 25 bp, Mus musculus
ctgggccactttttgggaatcaatt

SEQ ID NO: 387665 - DNA, 25 bp, Mus musculus
ctgggccagggtaaagtctagttct

SEQ ID NO: 387666 - DNA, 25 bp, Mus musculus
ctgggccagggttaagtctagttct

SEQ ID NO: 387667 - DNA, 25 bp, Mus musculus
ctgggccaggtgaagactgagacaa

SEQ ID NO: 387668 - DNA, 25 bp, Mus musculus
ctgggccaggtgtagactgagacaa

SEQ ID NO: 387669 - DNA, 25 bp, Mus musculus
ctgggccagtttaaaggctctgact

SEQ ID NO: 387670 - DNA, 25 bp, Mus musculus
ctgggccagttttaaggctctgact

SEQ ID NO: 387671 - DNA, 25 bp, Mus musculus
ctgggccataccaaataggcatgtt

SEQ ID NO: 387672 - DNA, 25 bp, Mus musculus
ctgggccatacctaataggcatgtt

SEQ ID NO: 387673 - DNA, 25 bp, Mus musculus
ctgggccatacgactcaattaaata

SEQ ID NO: 387674 - DNA, 25 bp, Mus musculus
ctgggccatacgtctcaattaaata

SEQ ID NO: 387675 - DNA, 25 bp, Mus musculus
ctgggccatctaagttggtgatgga

SEQ ID NO: 387676 - DNA, 25 bp, Mus musculus
ctgggccatctatgttggtgatgga

SEQ ID NO: 387677 - DNA, 25 bp, Mus musculus
ctgggccatgatccccaagtgtgtg

SEQ ID NO: 387678 - DNA, 25 bp, Mus musculus
ctgggccatgatgcccaagtgtgtg

SEQ ID NO: 387679 - DNA, 25 bp, Mus musculus
ctgggccatgtgatgtgagtttcat

SEQ ID NO: 387680 - DNA, 25 bp, Mus musculus
ctgggccatgtgttgtgagtttcat

SEQ ID NO: 387681 - DNA, 25 bp, Mus musculus
ctgggccattccagtcatggagtca

SEQ ID NO: 387682 - DNA, 25 bp, Mus musculus
ctgggccattcctgtcatggagtca

SEQ ID NO: 387683 - DNA, 25 bp, Mus musculus
ctgggccattttaattctctgataa

SEQ ID NO: 387684 - DNA, 25 bp, Mus musculus
ctgggccatttttattctctgataa

SEQ ID NO: 387685 - DNA, 25 bp, Mus musculus
ctgggcccacgtccagttttgaaca

SEQ ID NO: 387686 - DNA, 25 bp, Mus musculus
ctgggcccacgtgcagttttgaaca

SEQ ID NO: 387687 - DNA, 25 bp, Mus musculus
ctgggcccagacagcattttgttgg

SEQ ID NO: 387688 - DNA, 25 bp, Mus musculus
ctgggcccagactgcattttgttgg

SEQ ID NO: 387689 - DNA, 25 bp, Mus musculus
ctgggcccaggaactaaagtgagct

SEQ ID NO: 387690 - DNA, 25 bp, Mus musculus
ctgggcccaggatctaaagtgagct

SEQ ID NO: 387691 - DNA, 25 bp, Mus musculus
ctgggccccatgaaggatcgaatca

SEQ ID NO: 387692 - DNA, 25 bp, Mus musculus
ctgggccccatgtaggatcgaatca

SEQ ID NO: 387693 - DNA, 25 bp, Mus musculus
ctgggcccctagactagagggcaga

SEQ ID NO: 387694 - DNA, 25 bp, Mus musculus
ctgggcccctagtctagagggcaga

SEQ ID NO: 387695 - DNA, 25 bp, Mus musculus
ctgggccctcagagtggatgtcaga

SEQ ID NO: 387696 - DNA, 25 bp, Mus musculus
ctgggccctcagtgtggatgtcaga

SEQ ID NO: 387697 - DNA, 25 bp, Mus musculus
ctgggccctcctctgtcaggtaagg

SEQ ID NO: 387698 - DNA, 25 bp, Mus musculus
ctgggccctcctgtgtcaggtaagg

SEQ ID NO: 387699 - DNA, 25 bp, Mus musculus
ctgggccctggcagagacactgcgc

SEQ ID NO: 387700 - DNA, 25 bp, Mus musculus
ctgggccctggctgagacactgcgc

SEQ ID NO: 387701 - DNA, 25 bp, Mus musculus
ctgggcccttcaccatgtgtgatag

SEQ ID NO: 387702 - DNA, 25 bp, Mus musculus
ctgggcccttcagcatgtgtgatag

SEQ ID NO: 387703 - DNA, 25 bp, Mus musculus
ctgggccggtctactataggagttg

SEQ ID NO: 387704 - DNA, 25 bp, Mus musculus
ctgggccggtcttctataggagttg

SEQ ID NO: 387705 - DNA, 25 bp, Mus musculus
ctgggcctacctacatatagtggct

SEQ ID NO: 387706 - DNA, 25 bp, Mus musculus
ctgggcctaccttcatatagtggct

SEQ ID NO: 387707 - DNA, 25 bp, Mus musculus
ctgggcctcatgctgtaccacagga

SEQ ID NO: 387708 - DNA, 25 bp, Mus musculus
ctgggcctcatggtgtaccacagga

SEQ ID NO: 387709 - DNA, 25 bp, Mus musculus
ctgggcctctgaagcacagacgtag

SEQ ID NO: 387710 - DNA, 25 bp, Mus musculus
ctgggcctctgatgcacagacgtag

SEQ ID NO: 387711 - DNA, 25 bp, Mus musculus
ctgggcctctgtccatgtttggaaa

SEQ ID NO: 387712 - DNA, 25 bp, Mus musculus
ctgggcctctgtgcatgtttggaaa

SEQ ID NO: 387713 - DNA, 25 bp, Mus musculus
ctgggcctgaagcagcagatcgaaa

SEQ ID NO: 387714 - DNA, 25 bp, Mus musculus
ctgggcctgaaggagcagatcgaaa

SEQ ID NO: 387715 - DNA, 25 bp, Mus musculus
ctgggcctgacgactgggacattaa

SEQ ID NO: 387716 - DNA, 25 bp, Mus musculus
ctgggcctgacgtctgggacattaa

SEQ ID NO: 387717 - DNA, 25 bp, Mus musculus
ctgggcctgcacagggcaagccctt

SEQ ID NO: 387718 - DNA, 25 bp, Mus musculus
ctgggcctgcactgggcaagccctt

SEQ ID NO: 387719 - DNA, 25 bp, Mus musculus
ctgggcctgggaatatgaacgttta

SEQ ID NO: 387720 - DNA, 25 bp, Mus musculus
ctgggcctgggattatgaacgttta

SEQ ID NO: 387721 - DNA, 25 bp, Mus musculus
ctgggcctggtaccgtgaaagcaca

SEQ ID NO: 387722 - DNA, 25 bp, Mus musculus
ctgggcctggtagcgtgaaagcaca

SEQ ID NO: 387723 - DNA, 25 bp, Mus musculus
ctgggccttcatccaaggagagatt

SEQ ID NO: 387724 - DNA, 25 bp, Mus musculus
ctgggccttcatgcaaggagagatt

SEQ ID NO: 387725 - DNA, 25 bp, Mus musculus
ctgggccttctgaaacagctggtgt

SEQ ID NO: 387726 - DNA, 25 bp, Mus musculus
ctgggccttctgtaacagctggtgt

SEQ ID NO: 387727 - DNA, 25 bp, Mus musculus
ctgggccttcttctacaaatttgaa

SEQ ID NO: 387728 - DNA, 25 bp, Mus musculus
ctgggccttcttgtacaaatttgaa

SEQ ID NO: 387729 - DNA, 25 bp, Mus musculus
ctgggccttgcaatcctaggttggg

SEQ ID NO: 387730 - DNA, 25 bp, Mus musculus
ctgggccttgcattcctaggttggg

SEQ ID NO: 387731 - DNA, 25 bp, Mus musculus
ctgggccttggtagtattcatattg

SEQ ID NO: 387732 - DNA, 25 bp, Mus musculus
ctgggccttggttgtattcatattg

SEQ ID NO: 387733 - DNA, 25 bp, Mus musculus
ctgggcctttataacttttagatct

SEQ ID NO: 387734 - DNA, 25 bp, Mus musculus
ctgggcctttattacttttagatct

SEQ ID NO: 387735 - DNA, 25 bp, Mus musculus
ctgggcctttctacagaaccataga

SEQ ID NO: 387736 - DNA, 25 bp, Mus musculus
ctgggcctttctacatgtgtgtgga

SEQ ID NO: 387737 - DNA, 25 bp, Mus musculus
ctgggcctttctcagaagactgtaa

SEQ ID NO: 387738 - DNA, 25 bp, Mus musculus
ctgggcctttctgagaagactgtaa

SEQ ID NO: 387739 - DNA, 25 bp, Mus musculus
ctgggcctttcttcagaaccataga

SEQ ID NO: 387740 - DNA, 25 bp, Mus musculus
ctgggcctttcttcatgtgtgtgga

SEQ ID NO: 387741 - DNA, 25 bp, Mus musculus
ctgggcgagatgatgcttatgcttt

SEQ ID NO: 387742 - DNA, 25 bp, Mus musculus
ctgggcgagatgttgcttatgcttt

SEQ ID NO: 387743 - DNA, 25 bp, Mus musculus
ctgggcgaggagctcatgtacaacc

SEQ ID NO: 387744 - DNA, 25 bp, Mus musculus
ctgggcgaggaggtcatgtacaacc

SEQ ID NO: 387745 - DNA, 25 bp, Mus musculus
ctgggcgcaggaagtttggctacat

SEQ ID NO: 387746 - DNA, 25 bp, Mus musculus
ctgggcgcaggatgtttggctacat

SEQ ID NO: 387747 - DNA, 25 bp, Mus musculus
ctgggcgccgttaaagaccgagctt

SEQ ID NO: 387748 - DNA, 25 bp, Mus musculus
ctgggcgccgtttaagaccgagctt

SEQ ID NO: 387749 - DNA, 25 bp, Mus musculus
ctgggcgccttgagcggcttgaact

SEQ ID NO: 387750 - DNA, 25 bp, Mus musculus
ctgggcgccttgtgcggcttgaact

SEQ ID NO: 387751 - DNA, 25 bp, Mus musculus
ctgggcggcttcacacatgtggaga

SEQ ID NO: 387752 - DNA, 25 bp, Mus musculus
ctgggcggcttctcacatgtggaga

SEQ ID NO: 387753 - DNA, 25 bp, Mus musculus
ctgggcgggcagacatataaggact

SEQ ID NO: 387754 - DNA, 25 bp, Mus musculus
ctgggcgggcagtcatataaggact

SEQ ID NO: 387755 - DNA, 25 bp, Mus musculus
ctgggcgtgggtaaacagctcacct

SEQ ID NO: 387756 - DNA, 25 bp, Mus musculus
ctgggcgtgggttaacagctcacct

SEQ ID NO: 387757 - DNA, 25 bp, Mus musculus
ctgggcgttcatatcaaacgggata

SEQ ID NO: 387758 - DNA, 25 bp, Mus musculus
ctgggcgttcatttcaaacgggata

SEQ ID NO: 387759 - DNA, 25 bp, Mus musculus
ctgggctaaaagctatctgtcatgc

SEQ ID NO: 387760 - DNA, 25 bp, Mus musculus
ctgggctaaaaggtatctgtcatgc

SEQ ID NO: 387761 - DNA, 25 bp, Mus musculus
ctgggctacacgacggatgagaccg

SEQ ID NO: 387762 - DNA, 25 bp, Mus musculus
ctgggctacacgtcggatgagaccg

SEQ ID NO: 387763 - DNA, 25 bp, Mus musculus
ctgggctacagacggagacattgtc

SEQ ID NO: 387764 - DNA, 25 bp, Mus musculus
ctgggctacagacttagattttacc

SEQ ID NO: 387765 - DNA, 25 bp, Mus musculus
ctgggctacagagggagacattgtc

SEQ ID NO: 387766 - DNA, 25 bp, Mus musculus
ctgggctacagagttagattttacc

SEQ ID NO: 387767 - DNA, 25 bp, Mus musculus
ctgggctacctaacaagactctgat

SEQ ID NO: 387768 - DNA, 25 bp, Mus musculus
ctgggctacctatcaagactctgat

SEQ ID NO: 387769 - DNA, 25 bp, Mus musculus
ctgggctacctgacatgtcagtaaa

SEQ ID NO: 387770 - DNA, 25 bp, Mus musculus
ctgggctacctgtcatgtcagtaaa

SEQ ID NO: 387771 - DNA, 25 bp, Mus musculus
ctgggctactggctttgctacgtca

SEQ ID NO: 387772 - DNA, 25 bp, Mus musculus
ctgggctactgggtttgctacgtca

SEQ ID NO: 387773 - DNA, 25 bp, Mus musculus
ctgggctagctactgtcaaaagaaa

SEQ ID NO: 387774 - DNA, 25 bp, Mus musculus
ctgggctagctagtgtcaaaagaaa

SEQ ID NO: 387775 - DNA, 25 bp, Mus musculus
ctgggctaggcaaatccttgtagtg

SEQ ID NO: 387776 - DNA, 25 bp, Mus musculus
ctgggctaggcatatccttgtagtg

SEQ ID NO: 387777 - DNA, 25 bp, Mus musculus
ctgggctaggttccagaagtctcct

SEQ ID NO: 387778 - DNA, 25 bp, Mus musculus
ctgggctaggttgcagaagtctcct

SEQ ID NO: 387779 - DNA, 25 bp, Mus musculus
ctgggctatgtaatacctccttgaa

SEQ ID NO: 387780 - DNA, 25 bp, Mus musculus
ctgggctatgtactgtatgctacca

SEQ ID NO: 387781 - DNA, 25 bp, Mus musculus
ctgggctatgtagtgtatgctacca

SEQ ID NO: 387782 - DNA, 25 bp, Mus musculus
ctgggctatgtattacctccttgaa

SEQ ID NO: 387783 - DNA, 25 bp, Mus musculus
ctgggctatgtgagtagctccactg

SEQ ID NO: 387784 - DNA, 25 bp, Mus musculus
ctgggctatgtgtgtagctccactg

SEQ ID NO: 387785 - DNA, 25 bp, Mus musculus
ctgggctatttgaatcttcagctat

SEQ ID NO: 387786 - DNA, 25 bp, Mus musculus
ctgggctatttgtatcttcagctat

SEQ ID NO: 387787 - DNA, 25 bp, Mus musculus
ctgggctcaaccctgggaatccaca

SEQ ID NO: 387788 - DNA, 25 bp, Mus musculus
ctgggctcaaccgtgggaatccaca

SEQ ID NO: 387789 - DNA, 25 bp, Mus musculus
ctgggctcaaggactgcatctgtag

SEQ ID NO: 387790 - DNA, 25 bp, Mus musculus
ctgggctcaaggtctgcatctgtag

SEQ ID NO: 387791 - DNA, 25 bp, Mus musculus
ctgggctcactgcatggctcacaga

SEQ ID NO: 387792 - DNA, 25 bp, Mus musculus
ctgggctcactggatggctcacaga

SEQ ID NO: 387793 - DNA, 25 bp, Mus musculus
ctgggctcccctaaagatgaggtag

SEQ ID NO: 387794 - DNA, 25 bp, Mus musculus
ctgggctccccttaagatgaggtag

SEQ ID NO: 387795 - DNA, 25 bp, Mus musculus
ctgggctcctgcattcaaggatgaa

SEQ ID NO: 387796 - DNA, 25 bp, Mus musculus
ctgggctcctgctttcaaggatgaa

SEQ ID NO: 387797 - DNA, 25 bp, Mus musculus
ctgggctcctgtcctactgaggtga

SEQ ID NO: 387798 - DNA, 25 bp, Mus musculus
ctgggctcctgtgctactgaggtga

SEQ ID NO: 387799 - DNA, 25 bp, Mus musculus
ctgggctcggtactttgtatcttaa

SEQ ID NO: 387800 - DNA, 25 bp, Mus musculus
ctgggctcggtagtttgtatcttaa

SEQ ID NO: 387801 - DNA, 25 bp, Mus musculus
ctgggctctaagcaattgctttcct

SEQ ID NO: 387802 - DNA, 25 bp, Mus musculus
ctgggctctaaggaattgctttcct

SEQ ID NO: 387803 - DNA, 25 bp, Mus musculus
ctgggctctattccctaggaggctg

SEQ ID NO: 387804 - DNA, 25 bp, Mus musculus
ctgggctctattgcctaggaggctg

SEQ ID NO: 387805 - DNA, 25 bp, Mus musculus
ctgggctctcagatgtgtcacaaaa

SEQ ID NO: 387806 - DNA, 25 bp, Mus musculus
ctgggctctcagttgtgtcacaaaa

SEQ ID NO: 387807 - DNA, 25 bp, Mus musculus
ctgggctctctgctactgctatgag

SEQ ID NO: 387808 - DNA, 25 bp, Mus musculus
ctgggctctctggtactgctatgag

SEQ ID NO: 387809 - DNA, 25 bp, Mus musculus
ctgggctctgagaaagtcgtttgaa

SEQ ID NO: 387810 - DNA, 25 bp, Mus musculus
ctgggctctgagtaagtcgtttgaa

SEQ ID NO: 387811 - DNA, 25 bp, Mus musculus
ctgggctctgctaatgtcatttgaa

SEQ ID NO: 387812 - DNA, 25 bp, Mus musculus
ctgggctctgctctttaaaacattt

SEQ ID NO: 387813 - DNA, 25 bp, Mus musculus
ctgggctctgctgtttaaaacattt

SEQ ID NO: 387814 - DNA, 25 bp, Mus musculus
ctgggctctgcttatgtcatttgaa

SEQ ID NO: 387815 - DNA, 25 bp, Mus musculus
ctgggctctggccattgactggtaa

SEQ ID NO: 387816 - DNA, 25 bp, Mus musculus
ctgggctctggcgattgactggtaa

SEQ ID NO: 387817 - DNA, 25 bp, Mus musculus
ctgggctgaccacgaggaacactaa

SEQ ID NO: 387818 - DNA, 25 bp, Mus musculus
ctgggctgaccaggaggaacactaa

SEQ ID NO: 387819 - DNA, 25 bp, Mus musculus
ctgggctgccctagaacatgtgctt

SEQ ID NO: 387820 - DNA, 25 bp, Mus musculus
ctgggctgcccttgaacatgtgctt

SEQ ID NO: 387821 - DNA, 25 bp, Mus musculus
ctgggctgctcacatactcactcat

SEQ ID NO: 387822 - DNA, 25 bp, Mus musculus
ctgggctgctcagatactcactcat

SEQ ID NO: 387823 - DNA, 25 bp, Mus musculus
ctgggctgctggctttacttgagaa

SEQ ID NO: 387824 - DNA, 25 bp, Mus musculus
ctgggctgctgggtttacttgagaa

SEQ ID NO: 387825 - DNA, 25 bp, Mus musculus
ctgggctgcttaatggatctggatt

SEQ ID NO: 387826 - DNA, 25 bp, Mus musculus
ctgggctgcttattggatctggatt

SEQ ID NO: 387827 - DNA, 25 bp, Mus musculus
ctgggctgcttgagactatgtctca

SEQ ID NO: 387828 - DNA, 25 bp, Mus musculus
ctgggctgcttgtgactatgtctca

SEQ ID NO: 387829 - DNA, 25 bp, Mus musculus
ctgggctgtatcatacatttctgcc

SEQ ID NO: 387830 - DNA, 25 bp, Mus musculus
ctgggctgtatcttacatttctgcc

SEQ ID NO: 387831 - DNA, 25 bp, Mus musculus
ctgggctgtgaccagatcctggtaa

SEQ ID NO: 387832 - DNA, 25 bp, Mus musculus
ctgggctgtgacgagatcctggtaa

SEQ ID NO: 387833 - DNA, 25 bp, Mus musculus
ctgggctgtttcacgaaagtcactt

SEQ ID NO: 387834 - DNA, 25 bp, Mus musculus
ctgggctgtttctcgaaagtcactt

SEQ ID NO: 387835 - DNA, 25 bp, Mus musculus
ctgggcttactgactgatcagtctt

SEQ ID NO: 387836 - DNA, 25 bp, Mus musculus
ctgggcttactgtctgatcagtctt

SEQ ID NO: 387837 - DNA, 25 bp, Mus musculus
ctgggcttcaacatcgtcggtggga

SEQ ID NO: 387838 - DNA, 25 bp, Mus musculus
ctgggcttcaacttcgtcggtggga

SEQ ID NO: 387839 - DNA, 25 bp, Mus musculus
ctgggcttcaggcaagacaaatatg

SEQ ID NO: 387840 - DNA, 25 bp, Mus musculus
ctgggcttcagggaagacaaatatg

SEQ ID NO: 387841 - DNA, 25 bp, Mus musculus
ctgggcttcataccatgtttcaggt

SEQ ID NO: 387842 - DNA, 25 bp, Mus musculus
ctgggcttcatagcatgtttcaggt

SEQ ID NO: 387843 - DNA, 25 bp, Mus musculus
ctgggcttcatgatccacataagga

SEQ ID NO: 387844 - DNA, 25 bp, Mus musculus
ctgggcttcatgttccacataagga

SEQ ID NO: 387845 - DNA, 25 bp, Mus musculus
ctgggcttccaaccactggagagca

SEQ ID NO: 387846 - DNA, 25 bp, Mus musculus
ctgggcttccaagcactggagagca

SEQ ID NO: 387847 - DNA, 25 bp, Mus musculus
ctgggcttccatctggtagaatgtg

SEQ ID NO: 387848 - DNA, 25 bp, Mus musculus
ctgggcttccatgtggtagaatgtg

SEQ ID NO: 387849 - DNA, 25 bp, Mus musculus
ctgggcttccgaaacaagatgcggt

SEQ ID NO: 387850 - DNA, 25 bp, Mus musculus
ctgggcttccgatacaagatgcggt

SEQ ID NO: 387851 - DNA, 25 bp, Mus musculus
ctgggcttctagaacagcgttggaa

SEQ ID NO: 387852 - DNA, 25 bp, Mus musculus
ctgggcttctagtacagcgttggaa

SEQ ID NO: 387853 - DNA, 25 bp, Mus musculus
ctgggcttctgcctgattcaggaaa

SEQ ID NO: 387854 - DNA, 25 bp, Mus musculus
ctgggcttctgcgtgattcaggaaa

SEQ ID NO: 387855 - DNA, 25 bp, Mus musculus
ctgggcttctttattgatcgggatg

SEQ ID NO: 387856 - DNA, 25 bp, Mus musculus
ctgggcttcttttttgatcgggatg

SEQ ID NO: 387857 - DNA, 25 bp, Mus musculus
ctgggcttgagaatgtacctctgct

SEQ ID NO: 387858 - DNA, 25 bp, Mus musculus
ctgggcttgagattgtacctctgct

SEQ ID NO: 387859 - DNA, 25 bp, Mus musculus
ctgggcttgattacctagtttactt

SEQ ID NO: 387860 - DNA, 25 bp, Mus musculus
ctgggcttgatttcctagtttactt

SEQ ID NO: 387861 - DNA, 25 bp, Mus musculus
ctgggcttgcacagaggctgagatt

SEQ ID NO: 387862 - DNA, 25 bp, Mus musculus
ctgggcttgcactgaggctgagatt

SEQ ID NO: 387863 - DNA, 25 bp, Mus musculus
ctgggcttggagatgcacgctgcta

SEQ ID NO: 387864 - DNA, 25 bp, Mus musculus
ctgggcttggagttgcacgctgcta

SEQ ID NO: 387865 - DNA, 25 bp, Mus musculus
ctgggcttggtcacgtctgcgcaca

SEQ ID NO: 387866 - DNA, 25 bp, Mus musculus
ctgggcttggtctcgtctgcgcaca

SEQ ID NO: 387867 - DNA, 25 bp, Mus musculus
ctgggctttccaagacctgagtgag

SEQ ID NO: 387868 - DNA, 25 bp, Mus musculus
ctgggctttccatgacctgagtgag

SEQ ID NO: 387869 - DNA, 25 bp, Mus musculus
ctgggctttcctatttgtatctcaa

SEQ ID NO: 387870 - DNA, 25 bp, Mus musculus
ctgggctttcctttttgtatctcaa

SEQ ID NO: 387871 - DNA, 25 bp, Mus musculus
ctgggctttggaactgggcttgcaa

SEQ ID NO: 387872 - DNA, 25 bp, Mus musculus
ctgggctttggatctgggcttgcaa

SEQ ID NO: 387873 - DNA, 25 bp, Mus musculus
ctgggctttggcacttttgtggaaa

SEQ ID NO: 387874 - DNA, 25 bp, Mus musculus
ctgggctttggctcttttgtggaaa

SEQ ID NO: 387875 - DNA, 25 bp, Mus musculus
ctggggacttgaccagtgttccatt

SEQ ID NO: 387876 - DNA, 25 bp, Mus musculus
ctggggacttgagcagtgttccatt

SEQ ID NO: 387877 - DNA, 25 bp, Mus musculus
ctggggccgtccacagtgtttcttt

SEQ ID NO: 387878 - DNA, 25 bp, Mus musculus
ctggggccgtcctcagtgtttcttt

SEQ ID NO: 387879 - DNA, 25 bp, Mus musculus
ctggggctctggctctcacactctc

SEQ ID NO: 387880 - DNA, 25 bp, Mus musculus
ctggggctctgggtctcacactctc

SEQ ID NO: 387881 - DNA, 25 bp, Mus musculus
ctggggtcagatctgtgccactatg

SEQ ID NO: 387882 - DNA, 25 bp, Mus musculus
ctggggtcagatgtgtgccactatg

SEQ ID NO: 387883 - DNA, 25 bp, Mus musculus
ctggggttgccaaaactgcacttta

SEQ ID NO: 387884 - DNA, 25 bp, Mus musculus
ctggggttgccataactgcacttta

SEQ ID NO: 387885 - DNA, 25 bp, Mus musculus
ctgggtaacagaatcacttgacaca

SEQ ID NO: 387886 - DNA, 25 bp, Mus musculus
ctgggtaacagattcacttgacaca

SEQ ID NO: 387887 - DNA, 25 bp, Mus musculus
ctgggtaatctcatcttcatttctg

SEQ ID NO: 387888 - DNA, 25 bp, Mus musculus
ctgggtaatctcttcttcatttctg

SEQ ID NO: 387889 - DNA, 25 bp, Mus musculus
ctgggtacaacacgcaaagctattt

SEQ ID NO: 387890 - DNA, 25 bp, Mus musculus
ctgggtacaacaggcaaagctattt

SEQ ID NO: 387891 - DNA, 25 bp, Mus musculus
ctgggtacaaccctgacagcagtgg

SEQ ID NO: 387892 - DNA, 25 bp, Mus musculus
ctgggtacaaccgtgacagcagtgg

SEQ ID NO: 387893 - DNA, 25 bp, Mus musculus
ctgggtacctggcatttcacatgag

SEQ ID NO: 387894 - DNA, 25 bp, Mus musculus
ctgggtacctgggatttcacatgag

SEQ ID NO: 387895 - DNA, 25 bp, Mus musculus
ctgggtactactctcaacgtgaata

SEQ ID NO: 387896 - DNA, 25 bp, Mus musculus
ctgggtactactgtcaacgtgaata

SEQ ID NO: 387897 - DNA, 25 bp, Mus musculus
ctgggtactcatattctttttgctg

SEQ ID NO: 387898 - DNA, 25 bp, Mus musculus
ctgggtactcattttctttttgctg

SEQ ID NO: 387899 - DNA, 25 bp, Mus musculus
ctgggtactgacagagggtgcaata

SEQ ID NO: 387900 - DNA, 25 bp, Mus musculus
ctgggtactgactgagggtgcaata

SEQ ID NO: 387901 - DNA, 25 bp, Mus musculus
ctgggtactgcacctttacaacaag

SEQ ID NO: 387902 - DNA, 25 bp, Mus musculus
ctgggtactgcagctttacaacaag

SEQ ID NO: 387903 - DNA, 25 bp, Mus musculus
ctgggtagaatcatcttggaggatg

SEQ ID NO: 387904 - DNA, 25 bp, Mus musculus
ctgggtagaatcttcttggaggatg

SEQ ID NO: 387905 - DNA, 25 bp, Mus musculus
ctgggtagagggaagcacctttcag

SEQ ID NO: 387906 - DNA, 25 bp, Mus musculus
ctgggtagagggtagcacctttcag

SEQ ID NO: 387907 - DNA, 25 bp, Mus musculus
ctgggtagcctacttgtcatgtaag

SEQ ID NO: 387908 - DNA, 25 bp, Mus musculus
ctgggtagcctagttgtcatgtaag

SEQ ID NO: 387909 - DNA, 25 bp, Mus musculus
ctgggtaggcagcactttgttctct

SEQ ID NO: 387910 - DNA, 25 bp, Mus musculus
ctgggtaggcaggactttgttctct

SEQ ID NO: 387911 - DNA, 25 bp, Mus musculus
ctgggtagtccaaagaatcggcaaa

SEQ ID NO: 387912 - DNA, 25 bp, Mus musculus
ctgggtagtccatagaatcggcaaa

SEQ ID NO: 387913 - DNA, 25 bp, Mus musculus
ctgggtagtcctcaaagcatgtagt

SEQ ID NO: 387914 - DNA, 25 bp, Mus musculus
ctgggtagtcctgaaagcatgtagt

SEQ ID NO: 387915 - DNA, 25 bp, Mus musculus
ctgggtataaccctgtatgcattta

SEQ ID NO: 387916 - DNA, 25 bp, Mus musculus
ctgggtataaccgtgtatgcattta

SEQ ID NO: 387917 - DNA, 25 bp, Mus musculus
ctgggtataataccacacatcttta

SEQ ID NO: 387918 - DNA, 25 bp, Mus musculus
ctgggtataatagcacacatcttta

SEQ ID NO: 387919 - DNA, 25 bp, Mus musculus
ctgggtataggactaaagtgagtat

SEQ ID NO: 387920 - DNA, 25 bp, Mus musculus
ctgggtataggagtaaagtgagtat

SEQ ID NO: 387921 - DNA, 25 bp, Mus musculus
ctgggtatgatgacaccgtgtgcat

SEQ ID NO: 387922 - DNA, 25 bp, Mus musculus
ctgggtatgatgtcaccgtgtgcat

SEQ ID NO: 387923 - DNA, 25 bp, Mus musculus
ctgggtatgccgaatgtgaacacac

SEQ ID NO: 387924 - DNA, 25 bp, Mus musculus
ctgggtatgccgtatgtgaacacac

SEQ ID NO: 387925 - DNA, 25 bp, Mus musculus
ctgggtatggaaaggcaagcttccc

SEQ ID NO: 387926 - DNA, 25 bp, Mus musculus
ctgggtatggaacgcgcatcctcat

SEQ ID NO: 387927 - DNA, 25 bp, Mus musculus
ctgggtatggaaggcgcatcctcat

SEQ ID NO: 387928 - DNA, 25 bp, Mus musculus
ctgggtatggaatggcaagcttccc

SEQ ID NO: 387929 - DNA, 25 bp, Mus musculus
ctgggtatggtaacaaacatcccta

SEQ ID NO: 387930 - DNA, 25 bp, Mus musculus
ctgggtatggtatcaaacatcccta

SEQ ID NO: 387931 - DNA, 25 bp, Mus musculus
ctgggtatttagaccaaccaatggt

SEQ ID NO: 387932 - DNA, 25 bp, Mus musculus
ctgggtatttagtccaaccaatggt

SEQ ID NO: 387933 - DNA, 25 bp, Mus musculus
ctgggtatttggacctgacttcaaa

SEQ ID NO: 387934 - DNA, 25 bp, Mus musculus
ctgggtatttggtcctgacttcaaa

SEQ ID NO: 387935 - DNA, 25 bp, Mus musculus
ctgggtcaagttcttacctctcaag

SEQ ID NO: 387936 - DNA, 25 bp, Mus musculus
ctgggtcaagttgttacctctcaag

SEQ ID NO: 387937 - DNA, 25 bp, Mus musculus
ctgggtcacctgatgcttatacaat

SEQ ID NO: 387938 - DNA, 25 bp, Mus musculus
ctgggtcacctgttgcttatacaat

SEQ ID NO: 387939 - DNA, 25 bp, Mus musculus
ctgggtcactacacctaggcagcag

SEQ ID NO: 387940 - DNA, 25 bp, Mus musculus
ctgggtcactactcctaggcagcag

SEQ ID NO: 387941 - DNA, 25 bp, Mus musculus
ctgggtcactctaggaacgttttga

SEQ ID NO: 387942 - DNA, 25 bp, Mus musculus
ctgggtcactctaggtctttaactc

SEQ ID NO: 387943 - DNA, 25 bp, Mus musculus
ctgggtcactcttggaacgttttga

SEQ ID NO: 387944 - DNA, 25 bp, Mus musculus
ctgggtcactcttggtctttaactc

SEQ ID NO: 387945 - DNA, 25 bp, Mus musculus
ctgggtcagaccactcagagacaga

SEQ ID NO: 387946 - DNA, 25 bp, Mus musculus
ctgggtcagacctctcagagacaga

SEQ ID NO: 387947 - DNA, 25 bp, Mus musculus
ctgggtcaggcaagtatgtgagata

SEQ ID NO: 387948 - DNA, 25 bp, Mus musculus
ctgggtcaggcatgtatgtgagata

SEQ ID NO: 387949 - DNA, 25 bp, Mus musculus
ctgggtcatcaccttgtccatgaaa

SEQ ID NO: 387950 - DNA, 25 bp, Mus musculus
ctgggtcatcacgttgtccatgaaa

SEQ ID NO: 387951 - DNA, 25 bp, Mus musculus
ctgggtcatctcaggtctcaggcac

SEQ ID NO: 387952 - DNA, 25 bp, Mus musculus
ctgggtcatctctggtctcaggcac

SEQ ID NO: 387953 - DNA, 25 bp, Mus musculus
ctgggtcatgatcttgctgccaaga

SEQ ID NO: 387954 - DNA, 25 bp, Mus musculus
ctgggtcatgatgttgctgccaaga

SEQ ID NO: 387955 - DNA, 25 bp, Mus musculus
ctgggtccacagaggttcttcattg

SEQ ID NO: 387956 - DNA, 25 bp, Mus musculus
ctgggtccacagtggttcttcattg

SEQ ID NO: 387957 - DNA, 25 bp, Mus musculus
ctgggtccactgacagtactggaaa

SEQ ID NO: 387958 - DNA, 25 bp, Mus musculus
ctgggtccactgagttgcggaagat

SEQ ID NO: 387959 - DNA, 25 bp, Mus musculus
ctgggtccactgtcagtactggaaa

SEQ ID NO: 387960 - DNA, 25 bp, Mus musculus
ctgggtccactgtgttgcggaagat

SEQ ID NO: 387961 - DNA, 25 bp, Mus musculus
ctgggtccagcaagagcaccgtgga

SEQ ID NO: 387962 - DNA, 25 bp, Mus musculus
ctgggtccagcatgagcaccgtgga

SEQ ID NO: 387963 - DNA, 25 bp, Mus musculus
ctgggtccaggcaagtctctataag

SEQ ID NO: 387964 - DNA, 25 bp, Mus musculus
ctgggtccaggctagtctctataag

SEQ ID NO: 387965 - DNA, 25 bp, Mus musculus
ctgggtccagtcatcatagggtcaa

SEQ ID NO: 387966 - DNA, 25 bp, Mus musculus
ctgggtccagtcttcatagggtcaa

SEQ ID NO: 387967 - DNA, 25 bp, Mus musculus
ctgggtcccaacagtgtataaaaat

SEQ ID NO: 387968 - DNA, 25 bp, Mus musculus
ctgggtcccaactgtgtataaaaat

SEQ ID NO: 387969 - DNA, 25 bp, Mus musculus
ctgggtcccatgagcttgtttaaac

SEQ ID NO: 387970 - DNA, 25 bp, Mus musculus
ctgggtcccatgtgcttgtttaaac

SEQ ID NO: 387971 - DNA, 25 bp, Mus musculus
ctgggtccccatcagaattttcttc

SEQ ID NO: 387972 - DNA, 25 bp, Mus musculus
ctgggtccccatgagaattttcttc

SEQ ID NO: 387973 - DNA, 25 bp, Mus musculus
ctgggtcccctaaaatagctggtca

SEQ ID NO: 387974 - DNA, 25 bp, Mus musculus
ctgggtcccctataatagctggtca

SEQ ID NO: 387975 - DNA, 25 bp, Mus musculus
ctgggtccgggcacgcacatggctc

SEQ ID NO: 387976 - DNA, 25 bp, Mus musculus
ctgggtccgggctcgcacatggctc

SEQ ID NO: 387977 - DNA, 25 bp, Mus musculus
ctgggtccttggatgttattctgac

SEQ ID NO: 387978 - DNA, 25 bp, Mus musculus
ctgggtccttggttgttattctgac

SEQ ID NO: 387979 - DNA, 25 bp, Mus musculus
ctgggtcctttgctactggctgtgc

SEQ ID NO: 387980 - DNA, 25 bp, Mus musculus
ctgggtcctttggtactggctgtgc

SEQ ID NO: 387981 - DNA, 25 bp, Mus musculus
ctgggtctacatacatgggtgctgg

SEQ ID NO: 387982 - DNA, 25 bp, Mus musculus
ctgggtctacattcatgggtgctgg

SEQ ID NO: 387983 - DNA, 25 bp, Mus musculus
ctgggtctaggtatgctcagagcaa

SEQ ID NO: 387984 - DNA, 25 bp, Mus musculus
ctgggtctaggtttgctcagagcaa

SEQ ID NO: 387985 - DNA, 25 bp, Mus musculus
ctgggtctagtgacacagggctgta

SEQ ID NO: 387986 - DNA, 25 bp, Mus musculus
ctgggtctagtgtcacagggctgta

SEQ ID NO: 387987 - DNA, 25 bp, Mus musculus
ctgggtctcatcagtaagctgctac

SEQ ID NO: 387988 - DNA, 25 bp, Mus musculus
ctgggtctcatctgtaagctgctac

SEQ ID NO: 387989 - DNA, 25 bp, Mus musculus
ctgggtctcctcatggtgattctga

SEQ ID NO: 387990 - DNA, 25 bp, Mus musculus
ctgggtctcctcttggtgattctga

SEQ ID NO: 387991 - DNA, 25 bp, Mus musculus
ctgggtctcctgagtgccactgcat

SEQ ID NO: 387992 - DNA, 25 bp, Mus musculus
ctgggtctcctgtgtgccactgcat

SEQ ID NO: 387993 - DNA, 25 bp, Mus musculus
ctgggtctctagagcaggtctgcaa

SEQ ID NO: 387994 - DNA, 25 bp, Mus musculus
ctgggtctctagtgcaggtctgcaa

SEQ ID NO: 387995 - DNA, 25 bp, Mus musculus
ctgggtctctctagtgctacggcta

SEQ ID NO: 387996 - DNA, 25 bp, Mus musculus
ctgggtctctcttgtgctacggcta

SEQ ID NO: 387997 - DNA, 25 bp, Mus musculus
ctgggtctctgactctttgagtaaa

SEQ ID NO: 387998 - DNA, 25 bp, Mus musculus
ctgggtctctgagtctttgagtaaa

SEQ ID NO: 387999 - DNA, 25 bp, Mus musculus
ctgggtctgactacctgggagacat

SEQ ID NO: 388000 - DNA, 25 bp, Mus musculus
ctgggtctgacttcctgggagacat

SEQ ID NO: 388001 - DNA, 25 bp, Mus musculus
ctgggtctggagatctggtttctaa

SEQ ID NO: 388002 - DNA, 25 bp, Mus musculus
ctgggtctggagttctggtttctaa

SEQ ID NO: 388003 - DNA, 25 bp, Mus musculus
ctgggtctgggcattgccctccaca

SEQ ID NO: 388004 - DNA, 25 bp, Mus musculus
ctgggtctgggctttgccctccaca

SEQ ID NO: 388005 - DNA, 25 bp, Mus musculus
ctgggtcttccaagtttcatatcaa

SEQ ID NO: 388006 - DNA, 25 bp, Mus musculus
ctgggtcttccatgtttcatatcaa

SEQ ID NO: 388007 - DNA, 25 bp, Mus musculus
ctgggtcttgacactgggctgcaaa

SEQ ID NO: 388008 - DNA, 25 bp, Mus musculus
ctgggtcttgactctgggctgcaaa

SEQ ID NO: 388009 - DNA, 25 bp, Mus musculus
ctgggtctttacactcattttattt

SEQ ID NO: 388010 - DNA, 25 bp, Mus musculus
ctgggtctttactctcattttattt

SEQ ID NO: 388011 - DNA, 25 bp, Mus musculus
ctgggtctttgtaatcgctgatctc

SEQ ID NO: 388012 - DNA, 25 bp, Mus musculus
ctgggtctttgttatcgctgatctc

SEQ ID NO: 388013 - DNA, 25 bp, Mus musculus
ctgggtcttttcactgagcaccact

SEQ ID NO: 388014 - DNA, 25 bp, Mus musculus
ctgggtcttttctctgagcaccact

SEQ ID NO: 388015 - DNA, 25 bp, Mus musculus
ctgggtcttttgatgttccatatca

SEQ ID NO: 388016 - DNA, 25 bp, Mus musculus
ctgggtcttttgttgttccatatca

SEQ ID NO: 388017 - DNA, 25 bp, Mus musculus
ctgggtgaaatacccactgctctgc

SEQ ID NO: 388018 - DNA, 25 bp, Mus musculus
ctgggtgaaatagccactgctctgc

SEQ ID NO: 388019 - DNA, 25 bp, Mus musculus
ctgggtgacacaccctgtgaacctt

SEQ ID NO: 388020 - DNA, 25 bp, Mus musculus
ctgggtgacacagcctgtgaacctt

SEQ ID NO: 388021 - DNA, 25 bp, Mus musculus
ctgggtgacattcccactgagttct

SEQ ID NO: 388022 - DNA, 25 bp, Mus musculus
ctgggtgacattgccactgagttct

SEQ ID NO: 388023 - DNA, 25 bp, Mus musculus
ctgggtgaggagagtccctccttga

SEQ ID NO: 388024 - DNA, 25 bp, Mus musculus
ctgggtgaggagtgtccctccttga

SEQ ID NO: 388025 - DNA, 25 bp, Mus musculus
ctgggtgatggaccacctcctggca

SEQ ID NO: 388026 - DNA, 25 bp, Mus musculus
ctgggtgatggagcacctcctggca

SEQ ID NO: 388027 - DNA, 25 bp, Mus musculus
ctgggtgcagacagcaactttctct

SEQ ID NO: 388028 - DNA, 25 bp, Mus musculus
ctgggtgcagactgcaactttctct

SEQ ID NO: 388029 - DNA, 25 bp, Mus musculus
ctgggtgccctgatgtacaattatg

SEQ ID NO: 388030 - DNA, 25 bp, Mus musculus
ctgggtgccctgttgtacaattatg

SEQ ID NO: 388031 - DNA, 25 bp, Mus musculus
ctgggtgcctcgatagggctcataa

SEQ ID NO: 388032 - DNA, 25 bp, Mus musculus
ctgggtgcctcgttagggctcataa

SEQ ID NO: 388033 - DNA, 25 bp, Mus musculus
ctgggtgcctgtacatttctagaag

SEQ ID NO: 388034 - DNA, 25 bp, Mus musculus
ctgggtgcctgttcatttctagaag

SEQ ID NO: 388035 - DNA, 25 bp, Mus musculus
ctgggtgcgtgcacagtcacactat

SEQ ID NO: 388036 - DNA, 25 bp, Mus musculus
ctgggtgcgtgctcagtcacactat

SEQ ID NO: 388037 - DNA, 25 bp, Mus musculus
ctgggtggatgaacctctttattat

SEQ ID NO: 388038 - DNA, 25 bp, Mus musculus
ctgggtggatgatcctctttattat

SEQ ID NO: 388039 - DNA, 25 bp, Mus musculus
ctgggtggcacacttgctttcttaa

SEQ ID NO: 388040 - DNA, 25 bp, Mus musculus
ctgggtggcacagttgctttcttaa

SEQ ID NO: 388041 - DNA, 25 bp, Mus musculus
ctgggtggcaggcaaatgggctttc

SEQ ID NO: 388042 - DNA, 25 bp, Mus musculus
ctgggtggcagggaaatgggctttc

SEQ ID NO: 388043 - DNA, 25 bp, Mus musculus
ctgggtggcatgaattgtgtccttt

SEQ ID NO: 388044 - DNA, 25 bp, Mus musculus
ctgggtggcatgtattgtgtccttt

SEQ ID NO: 388045 - DNA, 25 bp, Mus musculus
ctgggtggccgtcttttagtaatag

SEQ ID NO: 388046 - DNA, 25 bp, Mus musculus
ctgggtggccgtgttttagtaatag

SEQ ID NO: 388047 - DNA, 25 bp, Mus musculus
ctgggtggctaacaccatggattat

SEQ ID NO: 388048 - DNA, 25 bp, Mus musculus
ctgggtggctaagaccatggattat

SEQ ID NO: 388049 - DNA, 25 bp, Mus musculus
ctgggtgggtgaactacacattcca

SEQ ID NO: 388050 - DNA, 25 bp, Mus musculus
ctgggtgggtgatctacacattcca

SEQ ID NO: 388051 - DNA, 25 bp, Mus musculus
ctgggtggtttgaacattcaagttt

SEQ ID NO: 388052 - DNA, 25 bp, Mus musculus
ctgggtggtttgtacattcaagttt

SEQ ID NO: 388053 - DNA, 25 bp, Mus musculus
ctgggtgtagccatctgatgattca

SEQ ID NO: 388054 - DNA, 25 bp, Mus musculus
ctgggtgtagccttctgatgattca

SEQ ID NO: 388055 - DNA, 25 bp, Mus musculus
ctgggtgtccttagggatctgattt

SEQ ID NO: 388056 - DNA, 25 bp, Mus musculus
ctgggtgtcctttgggatctgattt

SEQ ID NO: 388057 - DNA, 25 bp, Mus musculus
ctgggtgtctgtaagtctttgctat

SEQ ID NO: 388058 - DNA, 25 bp, Mus musculus
ctgggtgtctgttagtctttgctat

SEQ ID NO: 388059 - DNA, 25 bp, Mus musculus
ctgggtgtcttaatccctatgataa

SEQ ID NO: 388060 - DNA, 25 bp, Mus musculus
ctgggtgtcttattccctatgataa

SEQ ID NO: 388061 - DNA, 25 bp, Mus musculus
ctgggtgtgattattccttccatgc

SEQ ID NO: 388062 - DNA, 25 bp, Mus musculus
ctgggtgtgatttttccttccatgc

SEQ ID NO: 388063 - DNA, 25 bp, Mus musculus
ctgggtgtgcctatgaagaatctta

SEQ ID NO: 388064 - DNA, 25 bp, Mus musculus
ctgggtgtgcctttgaagaatctta

SEQ ID NO: 388065 - DNA, 25 bp, Mus musculus
ctgggtgtggtaccttactcctaat

SEQ ID NO: 388066 - DNA, 25 bp, Mus musculus
ctgggtgtggtagcttactcctaat

SEQ ID NO: 388067 - DNA, 25 bp, Mus musculus
ctgggtgtgtgaccctcaggaactc

SEQ ID NO: 388068 - DNA, 25 bp, Mus musculus
ctgggtgtgtgagcctcaggaactc

SEQ ID NO: 388069 - DNA, 25 bp, Mus musculus
ctgggtgttcatcactcctgttaga

SEQ ID NO: 388070 - DNA, 25 bp, Mus musculus
ctgggtgttcatgactcctgttaga

SEQ ID NO: 388071 - DNA, 25 bp, Mus musculus
ctgggtgttccgattgttggtctgc

SEQ ID NO: 388072 - DNA, 25 bp, Mus musculus
ctgggtgttccgtttgttggtctgc

SEQ ID NO: 388073 - DNA, 25 bp, Mus musculus
ctgggtgttctgagtacatctgtaa

SEQ ID NO: 388074 - DNA, 25 bp, Mus musculus
ctgggtgttctgtgtacatctgtaa

SEQ ID NO: 388075 - DNA, 25 bp, Mus musculus
ctgggttaaaatattcatcatgtgg

SEQ ID NO: 388076 - DNA, 25 bp, Mus musculus
ctgggttaaaattttcatcatgtgg

SEQ ID NO: 388077 - DNA, 25 bp, Mus musculus
ctgggttacacaacaacgcctttaa

SEQ ID NO: 388078 - DNA, 25 bp, Mus musculus
ctgggttacacatcaacgcctttaa

SEQ ID NO: 388079 - DNA, 25 bp, Mus musculus
ctgggttacatcacctgtggtggac

SEQ ID NO: 388080 - DNA, 25 bp, Mus musculus
ctgggttacatctcctgtggtggac

SEQ ID NO: 388081 - DNA, 25 bp, Mus musculus
ctgggttagaatagaggctcctgca

SEQ ID NO: 388082 - DNA, 25 bp, Mus musculus
ctgggttagaattgaggctcctgca

SEQ ID NO: 388083 - DNA, 25 bp, Mus musculus
ctgggttagatgcaggagcccttaa

SEQ ID NO: 388084 - DNA, 25 bp, Mus musculus
ctgggttagatggaggagcccttaa

SEQ ID NO: 388085 - DNA, 25 bp, Mus musculus
ctgggttagcataacatgatgtgtt

SEQ ID NO: 388086 - DNA, 25 bp, Mus musculus
ctgggttagcattacatgatgtgtt

SEQ ID NO: 388087 - DNA, 25 bp, Mus musculus
ctgggttagtaacctgcaggctgct

SEQ ID NO: 388088 - DNA, 25 bp, Mus musculus
ctgggttagtaagctgcaggctgct

SEQ ID NO: 388089 - DNA, 25 bp, Mus musculus
ctgggttatgctcactttcctagaa

SEQ ID NO: 388090 - DNA, 25 bp, Mus musculus
ctgggttatgctgactttcctagaa

SEQ ID NO: 388091 - DNA, 25 bp, Mus musculus
ctgggttatgtgacctgaacgttta

SEQ ID NO: 388092 - DNA, 25 bp, Mus musculus
ctgggttatgtgtcctgaacgttta

SEQ ID NO: 388093 - DNA, 25 bp, Mus musculus
ctgggttattcaaattccttgggat

SEQ ID NO: 388094 - DNA, 25 bp, Mus musculus
ctgggttattcatattccttgggat

SEQ ID NO: 388095 - DNA, 25 bp, Mus musculus
ctgggttcaactccctgcacagcaa

SEQ ID NO: 388096 - DNA, 25 bp, Mus musculus
ctgggttcaactgcctgcacagcaa

SEQ ID NO: 388097 - DNA, 25 bp, Mus musculus
ctgggttcaatccacgtgtcctgaa

SEQ ID NO: 388098 - DNA, 25 bp, Mus musculus
ctgggttcaatcgacgtgtcctgaa

SEQ ID NO: 388099 - DNA, 25 bp, Mus musculus
ctgggttcagatagctgccctctgc

SEQ ID NO: 388100 - DNA, 25 bp, Mus musculus
ctgggttcagattgctgccctctgc

SEQ ID NO: 388101 - DNA, 25 bp, Mus musculus
ctgggttccaacctatctgagaaaa

SEQ ID NO: 388102 - DNA, 25 bp, Mus musculus
ctgggttccaacgtatctgagaaaa

SEQ ID NO: 388103 - DNA, 25 bp, Mus musculus
ctgggttccaggaccttcatggaga

SEQ ID NO: 388104 - DNA, 25 bp, Mus musculus
ctgggttccaggtccttcatggaga

SEQ ID NO: 388105 - DNA, 25 bp, Mus musculus
ctgggttcccatcaactcagggatt

SEQ ID NO: 388106 - DNA, 25 bp, Mus musculus
ctgggttcccatctgtaccttctgg

SEQ ID NO: 388107 - DNA, 25 bp, Mus musculus
ctgggttcccatgaactcagggatt

SEQ ID NO: 388108 - DNA, 25 bp, Mus musculus
ctgggttcccatgtgtaccttctgg

SEQ ID NO: 388109 - DNA, 25 bp, Mus musculus
ctgggttcctgcacaagtatcttta

SEQ ID NO: 388110 - DNA, 25 bp, Mus musculus
ctgggttcctgctcaagtatcttta

SEQ ID NO: 388111 - DNA, 25 bp, Mus musculus
ctgggttccttaagctaattttcaa

SEQ ID NO: 388112 - DNA, 25 bp, Mus musculus
ctgggttccttatgctaattttcaa

SEQ ID NO: 388113 - DNA, 25 bp, Mus musculus
ctgggttcttataggatgtttcctg

SEQ ID NO: 388114 - DNA, 25 bp, Mus musculus
ctgggttcttattggatgtttcctg

SEQ ID NO: 388115 - DNA, 25 bp, Mus musculus
ctgggttgcagtccttttcattcaa

SEQ ID NO: 388116 - DNA, 25 bp, Mus musculus
ctgggttgcagtgcttttcattcaa

SEQ ID NO: 388117 - DNA, 25 bp, Mus musculus
ctgggttgctgcattctgaccaaat

SEQ ID NO: 388118 - DNA, 25 bp, Mus musculus
ctgggttgctgctttctgaccaaat

SEQ ID NO: 388119 - DNA, 25 bp, Mus musculus
ctgggttggaatcaggatatgcaca

SEQ ID NO: 388120 - DNA, 25 bp, Mus musculus
ctgggttggaatgaggatatgcaca

SEQ ID NO: 388121 - DNA, 25 bp, Mus musculus
ctgggttggatacatctgacggaca

SEQ ID NO: 388122 - DNA, 25 bp, Mus musculus
ctgggttggatagatctgacggaca

SEQ ID NO: 388123 - DNA, 25 bp, Mus musculus
ctgggttggttcagtattccctatg

SEQ ID NO: 388124 - DNA, 25 bp, Mus musculus
ctgggttggttctgtattccctatg

SEQ ID NO: 388125 - DNA, 25 bp, Mus musculus
ctgggttgtactacgtgtattccaa

SEQ ID NO: 388126 - DNA, 25 bp, Mus musculus
ctgggttgtacttcgtgtattccaa

SEQ ID NO: 388127 - DNA, 25 bp, Mus musculus
ctgggttgtagtatcagctaccacc

SEQ ID NO: 388128 - DNA, 25 bp, Mus musculus
ctgggttgtagtttcagctaccacc

SEQ ID NO: 388129 - DNA, 25 bp, Mus musculus
ctgggttgtctaatgcttgccaaga

SEQ ID NO: 388130 - DNA, 25 bp, Mus musculus
ctgggttgtctattgcttgccaaga

SEQ ID NO: 388131 - DNA, 25 bp, Mus musculus
ctgggtttacgaagagcctttactg

SEQ ID NO: 388132 - DNA, 25 bp, Mus musculus
ctgggtttacgatgagcctttactg

SEQ ID NO: 388133 - DNA, 25 bp, Mus musculus
ctgggtttagggattaagctctgat

SEQ ID NO: 388134 - DNA, 25 bp, Mus musculus
ctgggtttagggtttaagctctgat

SEQ ID NO: 388135 - DNA, 25 bp, Mus musculus
ctgggtttatgcaggtagtatgcac

SEQ ID NO: 388136 - DNA, 25 bp, Mus musculus
ctgggtttatgctggtagtatgcac

SEQ ID NO: 388137 - DNA, 25 bp, Mus musculus
ctgggtttcaagagagccgagcttt

SEQ ID NO: 388138 - DNA, 25 bp, Mus musculus
ctgggtttcaagtgagccgagcttt

SEQ ID NO: 388139 - DNA, 25 bp, Mus musculus
ctgggtttcattccctacatctact

SEQ ID NO: 388140 - DNA, 25 bp, Mus musculus
ctgggtttcattgcctacatctact

SEQ ID NO: 388141 - DNA, 25 bp, Mus musculus
ctgggtttctaacgacacctactgg

SEQ ID NO: 388142 - DNA, 25 bp, Mus musculus
ctgggtttctaaggacacctactgg

SEQ ID NO: 388143 - DNA, 25 bp, Mus musculus
ctgggtttctgaaacttgtggatgt

SEQ ID NO: 388144 - DNA, 25 bp, Mus musculus
ctgggtttctgatacttgtggatgt

SEQ ID NO: 388145 - DNA, 25 bp, Mus musculus
ctgggtttctgcagcacactcttcc

SEQ ID NO: 388146 - DNA, 25 bp, Mus musculus
ctgggtttctgctgcacactcttcc

SEQ ID NO: 388147 - DNA, 25 bp, Mus musculus
ctgggtttgacccacagcatcactt

SEQ ID NO: 388148 - DNA, 25 bp, Mus musculus
ctgggtttgaccgacagcatcactt

SEQ ID NO: 388149 - DNA, 25 bp, Mus musculus
ctgggtttgatcctaagcatctgtc

SEQ ID NO: 388150 - DNA, 25 bp, Mus musculus
ctgggtttgatcgtaagcatctgtc

SEQ ID NO: 388151 - DNA, 25 bp, Mus musculus
ctgggtttgatgaaaacagcactga

SEQ ID NO: 388152 - DNA, 25 bp, Mus musculus
ctgggtttgatgtaaacagcactga

SEQ ID NO: 388153 - DNA, 25 bp, Mus musculus
ctgggtttgcgtatagtgtacacac

SEQ ID NO: 388154 - DNA, 25 bp, Mus musculus
ctgggtttgcgtttagtgtacacac

SEQ ID NO: 388155 - DNA, 25 bp, Mus musculus
ctgggtttgctgagtccttttaaga

SEQ ID NO: 388156 - DNA, 25 bp, Mus musculus
ctgggtttgctgtgtccttttaaga

SEQ ID NO: 388157 - DNA, 25 bp, Mus musculus
ctgggtttggtcactgatcactatc

SEQ ID NO: 388158 - DNA, 25 bp, Mus musculus
ctgggtttggtctctgatcactatc

SEQ ID NO: 388159 - DNA, 25 bp, Mus musculus
ctgggttttagcagattctcactga

SEQ ID NO: 388160 - DNA, 25 bp, Mus musculus
ctgggttttagctgattctcactga

SEQ ID NO: 388161 - DNA, 25 bp, Mus musculus
ctgggttttcagatgtgtcttggct

SEQ ID NO: 388162 - DNA, 25 bp, Mus musculus
ctgggttttcagttgtgtcttggct

SEQ ID NO: 388163 - DNA, 25 bp, Mus musculus
ctgggttttgatacagcctggccac

SEQ ID NO: 388164 - DNA, 25 bp, Mus musculus
ctgggttttgattcagcctggccac

SEQ ID NO: 388165 - DNA, 25 bp, Mus musculus
ctggtaaacagacaagcttgtgtct

SEQ ID NO: 388166 - DNA, 25 bp, Mus musculus
ctggtaaacagagaagcttgtgtct

SEQ ID NO: 388167 - DNA, 25 bp, Mus musculus
ctggtaaatggtacacagatcctta

SEQ ID NO: 388168 - DNA, 25 bp, Mus musculus
ctggtaaatggtcttgtgcccttta

SEQ ID NO: 388169 - DNA, 25 bp, Mus musculus
ctggtaaatggtgttgtgcccttta

SEQ ID NO: 388170 - DNA, 25 bp, Mus musculus
ctggtaaatggttcacagatcctta

SEQ ID NO: 388171 - DNA, 25 bp, Mus musculus
ctggtaacacaaccctttcttgcca

SEQ ID NO: 388172 - DNA, 25 bp, Mus musculus
ctggtaacacaagcctttcttgcca

SEQ ID NO: 388173 - DNA, 25 bp, Mus musculus
ctggtaaccaggagcccaatacggc

SEQ ID NO: 388174 - DNA, 25 bp, Mus musculus
ctggtaaccaggtgcccaatacggc

SEQ ID NO: 388175 - DNA, 25 bp, Mus musculus
ctggtaacttacctgcctgttacca

SEQ ID NO: 388176 - DNA, 25 bp, Mus musculus
ctggtaacttacgtgcctgttacca

SEQ ID NO: 388177 - DNA, 25 bp, Mus musculus
ctggtaacttctagatacataatta

SEQ ID NO: 388178 - DNA, 25 bp, Mus musculus
ctggtaacttcttgatacataatta

SEQ ID NO: 388179 - DNA, 25 bp, Mus musculus
ctggtaagaactcagcttgcgggct

SEQ ID NO: 388180 - DNA, 25 bp, Mus musculus
ctggtaagaactgagcttgcgggct

SEQ ID NO: 388181 - DNA, 25 bp, Mus musculus
ctggtaagaggaagcctgtggctct

SEQ ID NO: 388182 - DNA, 25 bp, Mus musculus
ctggtaagaggatgcctgtggctct

SEQ ID NO: 388183 - DNA, 25 bp, Mus musculus
ctggtaataatgctatgcttctgat

SEQ ID NO: 388184 - DNA, 25 bp, Mus musculus
ctggtaataatggtatgcttctgat

SEQ ID NO: 388185 - DNA, 25 bp, Mus musculus
ctggtaatgcttattgaacagctcc

SEQ ID NO: 388186 - DNA, 25 bp, Mus musculus
ctggtaatgctttttgaacagctcc

SEQ ID NO: 388187 - DNA, 25 bp, Mus musculus
ctggtaattccaccacaagggagct

SEQ ID NO: 388188 - DNA, 25 bp, Mus musculus
ctggtaattccagcacaagggagct

SEQ ID NO: 388189 - DNA, 25 bp, Mus musculus
ctggtaatttaactctgtaatggaa

SEQ ID NO: 388190 - DNA, 25 bp, Mus musculus
ctggtaatttaagtctgtaatggaa

SEQ ID NO: 388191 - DNA, 25 bp, Mus musculus
ctggtacaagttacaatctccaacc

SEQ ID NO: 388192 - DNA, 25 bp, Mus musculus
ctggtacaagtttcaatctccaacc

SEQ ID NO: 388193 - DNA, 25 bp, Mus musculus
ctggtacaggagaaacccactggtt

SEQ ID NO: 388194 - DNA, 25 bp, Mus musculus
ctggtacaggagtaacccactggtt

SEQ ID NO: 388195 - DNA, 25 bp, Mus musculus
ctggtaccaggtcatgaagtcttag

SEQ ID NO: 388196 - DNA, 25 bp, Mus musculus
ctggtaccaggtgatgaagtcttag

SEQ ID NO: 388197 - DNA, 25 bp, Mus musculus
ctggtacctcagatgcttattcata

SEQ ID NO: 388198 - DNA, 25 bp, Mus musculus
ctggtacctcagttgcttattcata

SEQ ID NO: 388199 - DNA, 25 bp, Mus musculus
ctggtacctcatagcaatgttactt

SEQ ID NO: 388200 - DNA, 25 bp, Mus musculus
ctggtacctcattgcaatgttactt

SEQ ID NO: 388201 - DNA, 25 bp, Mus musculus
ctggtacctgaacgtctaggcctgt

SEQ ID NO: 388202 - DNA, 25 bp, Mus musculus
ctggtacctgaaggtctaggcctgt

SEQ ID NO: 388203 - DNA, 25 bp, Mus musculus
ctggtactaagcatcgtttatggga

SEQ ID NO: 388204 - DNA, 25 bp, Mus musculus
ctggtactaagcttcgtttatggga

SEQ ID NO: 388205 - DNA, 25 bp, Mus musculus
ctggtactcaaacgatggtgaattc

SEQ ID NO: 388206 - DNA, 25 bp, Mus musculus
ctggtactcaaaggatggtgaattc

SEQ ID NO: 388207 - DNA, 25 bp, Mus musculus
ctggtactgaaaatcctcttgagtg

SEQ ID NO: 388208 - DNA, 25 bp, Mus musculus
ctggtactgaaattcctcttgagtg

SEQ ID NO: 388209 - DNA, 25 bp, Mus musculus
ctggtactgagcctgcaagcaacag

SEQ ID NO: 388210 - DNA, 25 bp, Mus musculus
ctggtactgagcgtgcaagcaacag

SEQ ID NO: 388211 - DNA, 25 bp, Mus musculus
ctggtactggtcatgcatgattgca

SEQ ID NO: 388212 - DNA, 25 bp, Mus musculus
ctggtactggtcttgcatgattgca

SEQ ID NO: 388213 - DNA, 25 bp, Mus musculus
ctggtactgtcgatcccctggaatt

SEQ ID NO: 388214 - DNA, 25 bp, Mus musculus
ctggtactgtcgttcccctggaatt

SEQ ID NO: 388215 - DNA, 25 bp, Mus musculus
ctggtacttctacagcggctgctta

SEQ ID NO: 388216 - DNA, 25 bp, Mus musculus
ctggtacttctagagcggctgctta

SEQ ID NO: 388217 - DNA, 25 bp, Mus musculus
ctggtagagctgagctacctgctac

SEQ ID NO: 388218 - DNA, 25 bp, Mus musculus
ctggtagagctgtgctacctgctac

SEQ ID NO: 388219 - DNA, 25 bp, Mus musculus
ctggtagagtttctctgtggcccaa

SEQ ID NO: 388220 - DNA, 25 bp, Mus musculus
ctggtagagtttgtctgtggcccaa

SEQ ID NO: 388221 - DNA, 25 bp, Mus musculus
ctggtagcagatcatgcacacacat

SEQ ID NO: 388222 - DNA, 25 bp, Mus musculus
ctggtagcagatgatgcacacacat

SEQ ID NO: 388223 - DNA, 25 bp, Mus musculus
ctggtagccacccaactagaattgt

SEQ ID NO: 388224 - DNA, 25 bp, Mus musculus
ctggtagccaccgaactagaattgt

SEQ ID NO: 388225 - DNA, 25 bp, Mus musculus
ctggtagctctgaaacatgggaatg

SEQ ID NO: 388226 - DNA, 25 bp, Mus musculus
ctggtagctctgtaacatgggaatg

SEQ ID NO: 388227 - DNA, 25 bp, Mus musculus
ctggtaggttggaagctgcctctca

SEQ ID NO: 388228 - DNA, 25 bp, Mus musculus
ctggtaggttggtagctgcctctca

SEQ ID NO: 388229 - DNA, 25 bp, Mus musculus
ctggtagtcagacaggcaagccgtt

SEQ ID NO: 388230 - DNA, 25 bp, Mus musculus
ctggtagtcagagaggcaagccgtt

SEQ ID NO: 388231 - DNA, 25 bp, Mus musculus
ctggtagtgatcagagctccctggc

SEQ ID NO: 388232 - DNA, 25 bp, Mus musculus
ctggtagtgatctgagctccctggc

SEQ ID NO: 388233 - DNA, 25 bp, Mus musculus
ctggtagtggtgattgcacacctgt

SEQ ID NO: 388234 - DNA, 25 bp, Mus musculus
ctggtagtggtgtttgcacacctgt

SEQ ID NO: 388235 - DNA, 25 bp, Mus musculus
ctggtagtgtttcatcaacttgcta

SEQ ID NO: 388236 - DNA, 25 bp, Mus musculus
ctggtagtgtttgatcaacttgcta

SEQ ID NO: 388237 - DNA, 25 bp, Mus musculus
ctggtatactggagagactcctcat

SEQ ID NO: 388238 - DNA, 25 bp, Mus musculus
ctggtatactggtgagactcctcat

SEQ ID NO: 388239 - DNA, 25 bp, Mus musculus
ctggtatagctgacaccaagggcta

SEQ ID NO: 388240 - DNA, 25 bp, Mus musculus
ctggtatagctgtcaccaagggcta

SEQ ID NO: 388241 - DNA, 25 bp, Mus musculus
ctggtatatacaaggctgtgcccct

SEQ ID NO: 388242 - DNA, 25 bp, Mus musculus
ctggtatatacatggctgtgcccct

SEQ ID NO: 388243 - DNA, 25 bp, Mus musculus
ctggtatatcgtcgtgtagctgcaa

SEQ ID NO: 388244 - DNA, 25 bp, Mus musculus
ctggtatatcgtggtgtagctgcaa

SEQ ID NO: 388245 - DNA, 25 bp, Mus musculus
ctggtatccagcaatatgctgctgc

SEQ ID NO: 388246 - DNA, 25 bp, Mus musculus
ctggtatccagctatatgctgctgc

SEQ ID NO: 388247 - DNA, 25 bp, Mus musculus
ctggtatccgtaatgcagagtgata

SEQ ID NO: 388248 - DNA, 25 bp, Mus musculus
ctggtatccgtattgcagagtgata

SEQ ID NO: 388249 - DNA, 25 bp, Mus musculus
ctggtatcctttatattttctcaca

SEQ ID NO: 388250 - DNA, 25 bp, Mus musculus
ctggtatcctttttattttctcaca

SEQ ID NO: 388251 - DNA, 25 bp, Mus musculus
ctggtatctcataattgcttatgaa

SEQ ID NO: 388252 - DNA, 25 bp, Mus musculus
ctggtatctcattattgcttatgaa

SEQ ID NO: 388253 - DNA, 25 bp, Mus musculus
ctggtatgccaaaaaagcgttttta

SEQ ID NO: 388254 - DNA, 25 bp, Mus musculus
ctggtatgccaataaagcgttttta

SEQ ID NO: 388255 - DNA, 25 bp, Mus musculus
ctggtattcaccatccaaatgtatt

SEQ ID NO: 388256 - DNA, 25 bp, Mus musculus
ctggtattcaccttccaaatgtatt

SEQ ID NO: 388257 - DNA, 25 bp, Mus musculus
ctggtattcatgcaggctagcagaa

SEQ ID NO: 388258 - DNA, 25 bp, Mus musculus
ctggtattcatggaggctagcagaa

SEQ ID NO: 388259 - DNA, 25 bp, Mus musculus
ctggtatttctgatgtgttcttggc

SEQ ID NO: 388260 - DNA, 25 bp, Mus musculus
ctggtatttctgttgtgttcttggc

SEQ ID NO: 388261 - DNA, 25 bp, Mus musculus
ctggtcaaatatcttcctttccttc

SEQ ID NO: 388262 - DNA, 25 bp, Mus musculus
ctggtcaaatatgttcctttccttc

SEQ ID NO: 388263 - DNA, 25 bp, Mus musculus
ctggtcaacatgaccacaggcttgg

SEQ ID NO: 388264 - DNA, 25 bp, Mus musculus
ctggtcaacatgtccacaggcttgg

SEQ ID NO: 388265 - DNA, 25 bp, Mus musculus
ctggtcaaccacacctttcctattg

SEQ ID NO: 388266 - DNA, 25 bp, Mus musculus
ctggtcaaccaccttagttagataa

SEQ ID NO: 388267 - DNA, 25 bp, Mus musculus
ctggtcaaccacgttagttagataa

SEQ ID NO: 388268 - DNA, 25 bp, Mus musculus
ctggtcaaccactcctttcctattg

SEQ ID NO: 388269 - DNA, 25 bp, Mus musculus
ctggtcaagacacctatctggaaag

SEQ ID NO: 388270 - DNA, 25 bp, Mus musculus
ctggtcaagacagctatctggaaag

SEQ ID NO: 388271 - DNA, 25 bp, Mus musculus
ctggtcaagtacctagcgtcagcta

SEQ ID NO: 388272 - DNA, 25 bp, Mus musculus
ctggtcaagtacgtagcgtcagcta

SEQ ID NO: 388273 - DNA, 25 bp, Mus musculus
ctggtcacatggctttggaatcttt

SEQ ID NO: 388274 - DNA, 25 bp, Mus musculus
ctggtcacatgggtttggaatcttt

SEQ ID NO: 388275 - DNA, 25 bp, Mus musculus
ctggtcaccaagcactgagcagccg

SEQ ID NO: 388276 - DNA, 25 bp, Mus musculus
ctggtcaccaaggactgagcagccg

SEQ ID NO: 388277 - DNA, 25 bp, Mus musculus
ctggtcaccatgatactgaagaaca

SEQ ID NO: 388278 - DNA, 25 bp, Mus musculus
ctggtcaccatgttactgaagaaca

SEQ ID NO: 388279 - DNA, 25 bp, Mus musculus
ctggtcacctgactagtaggctaga

SEQ ID NO: 388280 - DNA, 25 bp, Mus musculus
ctggtcacctgagtagtaggctaga

SEQ ID NO: 388281 - DNA, 25 bp, Mus musculus
ctggtcacgtcaaggacaattccaa

SEQ ID NO: 388282 - DNA, 25 bp, Mus musculus
ctggtcacgtcatggacaattccaa

SEQ ID NO: 388283 - DNA, 25 bp, Mus musculus
ctggtcactgacagcaggcagcact

SEQ ID NO: 388284 - DNA, 25 bp, Mus musculus
ctggtcactgactgcaggcagcact

SEQ ID NO: 388285 - DNA, 25 bp, Mus musculus
ctggtcactttcagtgaccgtccca

SEQ ID NO: 388286 - DNA, 25 bp, Mus musculus
ctggtcactttctgtgaccgtccca

SEQ ID NO: 388287 - DNA, 25 bp, Mus musculus
ctggtcactttgaacaatgtagatt

SEQ ID NO: 388288 - DNA, 25 bp, Mus musculus
ctggtcactttgtacaatgtagatt

SEQ ID NO: 388289 - DNA, 25 bp, Mus musculus
ctggtcagccggacagtgttttgcg

SEQ ID NO: 388290 - DNA, 25 bp, Mus musculus
ctggtcagccggtcagtgttttgcg

SEQ ID NO: 388291 - DNA, 25 bp, Mus musculus
ctggtcagctttctcctagaacaaa

SEQ ID NO: 388292 - DNA, 25 bp, Mus musculus
ctggtcagctttgtcctagaacaaa

SEQ ID NO: 388293 - DNA, 25 bp, Mus musculus
ctggtcatcattaccaccacgtggg

SEQ ID NO: 388294 - DNA, 25 bp, Mus musculus
ctggtcatcatttccaccacgtggg

SEQ ID NO: 388295 - DNA, 25 bp, Mus musculus
ctggtcatgaccatgtttttccaat

SEQ ID NO: 388296 - DNA, 25 bp, Mus musculus
ctggtcatgaccttgtttttccaat

SEQ ID NO: 388297 - DNA, 25 bp, Mus musculus
ctggtcatgatcattgtccgtgcaa

SEQ ID NO: 388298 - DNA, 25 bp, Mus musculus
ctggtcatgatctttgtccgtgcaa

SEQ ID NO: 388299 - DNA, 25 bp, Mus musculus
ctggtcattctgaattccccttctg

SEQ ID NO: 388300 - DNA, 25 bp, Mus musculus
ctggtcattctgtattccccttctg

SEQ ID NO: 388301 - DNA, 25 bp, Mus musculus
ctggtcattgggaggctgagcaccc

SEQ ID NO: 388302 - DNA, 25 bp, Mus musculus
ctggtcattgggtggctgagcaccc

SEQ ID NO: 388303 - DNA, 25 bp, Mus musculus
ctggtcatttttcctctcataaata

SEQ ID NO: 388304 - DNA, 25 bp, Mus musculus
ctggtcatttttgctctcataaata

SEQ ID NO: 388305 - DNA, 25 bp, Mus musculus
ctggtccaaactattctcagacgac

SEQ ID NO: 388306 - DNA, 25 bp, Mus musculus
ctggtccaaacttttctcagacgac

SEQ ID NO: 388307 - DNA, 25 bp, Mus musculus
ctggtccacagaacttagctatatg

SEQ ID NO: 388308 - DNA, 25 bp, Mus musculus
ctggtccacagacctacttctatga

SEQ ID NO: 388309 - DNA, 25 bp, Mus musculus
ctggtccacagagctacttctatga

SEQ ID NO: 388310 - DNA, 25 bp, Mus musculus
ctggtccacagatcttagctatatg

SEQ ID NO: 388311 - DNA, 25 bp, Mus musculus
ctggtccaccctcaggaggttgtaa

SEQ ID NO: 388312 - DNA, 25 bp, Mus musculus
ctggtccaccctgaggaggttgtaa

SEQ ID NO: 388313 - DNA, 25 bp, Mus musculus
ctggtccaggagatgctcacttgaa

SEQ ID NO: 388314 - DNA, 25 bp, Mus musculus
ctggtccaggagttgctcacttgaa

SEQ ID NO: 388315 - DNA, 25 bp, Mus musculus
ctggtccatctgagactgcatgtaa

SEQ ID NO: 388316 - DNA, 25 bp, Mus musculus
ctggtccatctgtgactgcatgtaa

SEQ ID NO: 388317 - DNA, 25 bp, Mus musculus
ctggtcccaccactctggtttggag

SEQ ID NO: 388318 - DNA, 25 bp, Mus musculus
ctggtcccaccagtctggtttggag

SEQ ID NO: 388319 - DNA, 25 bp, Mus musculus
ctggtcccagatctcatggctgcag

SEQ ID NO: 388320 - DNA, 25 bp, Mus musculus
ctggtcccagatgtcatggctgcag

SEQ ID NO: 388321 - DNA, 25 bp, Mus musculus
ctggtcccgcaaaacttgaatgaat

SEQ ID NO: 388322 - DNA, 25 bp, Mus musculus
ctggtcccgcaatacttgaatgaat

SEQ ID NO: 388323 - DNA, 25 bp, Mus musculus
ctggtccctcagcatatgtgtgaac

SEQ ID NO: 388324 - DNA, 25 bp, Mus musculus
ctggtccctcagcatgacgattata

SEQ ID NO: 388325 - DNA, 25 bp, Mus musculus
ctggtccctcaggatatgtgtgaac

SEQ ID NO: 388326 - DNA, 25 bp, Mus musculus
ctggtccctcaggatgacgattata

SEQ ID NO: 388327 - DNA, 25 bp, Mus musculus
ctggtccctgtcactgatgacaggt

SEQ ID NO: 388328 - DNA, 25 bp, Mus musculus
ctggtccctgtctctgatgacaggt

SEQ ID NO: 388329 - DNA, 25 bp, Mus musculus
ctggtccgcctacttgaaaatgctt

SEQ ID NO: 388330 - DNA, 25 bp, Mus musculus
ctggtccgcctagttgaaaatgctt

SEQ ID NO: 388331 - DNA, 25 bp, Mus musculus
ctggtcctacttattcggatggttg

SEQ ID NO: 388332 - DNA, 25 bp, Mus musculus
ctggtcctactttttcggatggttg

SEQ ID NO: 388333 - DNA, 25 bp, Mus musculus
ctggtcctagtgctacaggcgtaaa

SEQ ID NO: 388334 - DNA, 25 bp, Mus musculus
ctggtcctagtggtacaggcgtaaa

SEQ ID NO: 388335 - DNA, 25 bp, Mus musculus
ctggtcctctctctaggactctgca

SEQ ID NO: 388336 - DNA, 25 bp, Mus musculus
ctggtcctctctgtaggactctgca

SEQ ID NO: 388337 - DNA, 25 bp, Mus musculus
ctggtcctgctgatcaactttatct

SEQ ID NO: 388338 - DNA, 25 bp, Mus musculus
ctggtcctgctgttcaactttatct

SEQ ID NO: 388339 - DNA, 25 bp, Mus musculus
ctggtcctgcttctggttgtctctg

SEQ ID NO: 388340 - DNA, 25 bp, Mus musculus
ctggtcctgcttgtggttgtctctg

SEQ ID NO: 388341 - DNA, 25 bp, Mus musculus
ctggtcctggaacgtctgccaagag

SEQ ID NO: 388342 - DNA, 25 bp, Mus musculus
ctggtcctggaaggtctgccaagag

SEQ ID NO: 388343 - DNA, 25 bp, Mus musculus
ctggtcctggccaggagtgcagagg

SEQ ID NO: 388344 - DNA, 25 bp, Mus musculus
ctggtcctggcctggagtgcagagg

SEQ ID NO: 388345 - DNA, 25 bp, Mus musculus
ctggtcctgtacagttccatgaagg

SEQ ID NO: 388346 - DNA, 25 bp, Mus musculus
ctggtcctgtactgttccatgaagg

SEQ ID NO: 388347 - DNA, 25 bp, Mus musculus
ctggtccttcagattcgtagatggt

SEQ ID NO: 388348 - DNA, 25 bp, Mus musculus
ctggtccttcagtttcgtagatggt

SEQ ID NO: 388349 - DNA, 25 bp, Mus musculus
ctggtcgatccacaagtgccacaat

SEQ ID NO: 388350 - DNA, 25 bp, Mus musculus
ctggtcgatccagaagtgccacaat

SEQ ID NO: 388351 - DNA, 25 bp, Mus musculus
ctggtcgccacacagttgtcgagtt

SEQ ID NO: 388352 - DNA, 25 bp, Mus musculus
ctggtcgccacagagttgtcgagtt

SEQ ID NO: 388353 - DNA, 25 bp, Mus musculus
ctggtcgccgtcatctgtaaaagag

SEQ ID NO: 388354 - DNA, 25 bp, Mus musculus
ctggtcgccgtcttctgtaaaagag

SEQ ID NO: 388355 - DNA, 25 bp, Mus musculus
ctggtcggacacagctggacagaca

SEQ ID NO: 388356 - DNA, 25 bp, Mus musculus
ctggtcggacactgctggacagaca

SEQ ID NO: 388357 - DNA, 25 bp, Mus musculus
ctggtctataaaccgagttttaggt

SEQ ID NO: 388358 - DNA, 25 bp, Mus musculus
ctggtctataaagcgagttttaggt

SEQ ID NO: 388359 - DNA, 25 bp, Mus musculus
ctggtctatgtaccgaacccctgtc

SEQ ID NO: 388360 - DNA, 25 bp, Mus musculus
ctggtctatgtagcgaacccctgtc

SEQ ID NO: 388361 - DNA, 25 bp, Mus musculus
ctggtctcaaacatctgatcgacaa

SEQ ID NO: 388362 - DNA, 25 bp, Mus musculus
ctggtctcaaacttctgatcgacaa

SEQ ID NO: 388363 - DNA, 25 bp, Mus musculus
ctggtctcatagcaagctcttgatc

SEQ ID NO: 388364 - DNA, 25 bp, Mus musculus
ctggtctcataggaagctcttgatc

SEQ ID NO: 388365 - DNA, 25 bp, Mus musculus
ctggtctctgttagctttggctgaa

SEQ ID NO: 388366 - DNA, 25 bp, Mus musculus
ctggtctctgtttgctttggctgaa

SEQ ID NO: 388367 - DNA, 25 bp, Mus musculus
ctggtctcttctcgctcgggacaga

SEQ ID NO: 388368 - DNA, 25 bp, Mus musculus
ctggtctcttctggctcgggacaga

SEQ ID NO: 388369 - DNA, 25 bp, Mus musculus
ctggtctgacctcacaactttggtg

SEQ ID NO: 388370 - DNA, 25 bp, Mus musculus
ctggtctgacctgacaactttggtg

SEQ ID NO: 388371 - DNA, 25 bp, Mus musculus
ctggtctgagaaagaaagtacacta

SEQ ID NO: 388372 - DNA, 25 bp, Mus musculus
ctggtctgagaatgaaagtacacta

SEQ ID NO: 388373 - DNA, 25 bp, Mus musculus
ctggtctgcaggacagtttgaatca

SEQ ID NO: 388374 - DNA, 25 bp, Mus musculus
ctggtctgcaggtcagtttgaatca

SEQ ID NO: 388375 - DNA, 25 bp, Mus musculus
ctggtctgccttaatgtatcttctg

SEQ ID NO: 388376 - DNA, 25 bp, Mus musculus
ctggtctgcctttatgtatcttctg

SEQ ID NO: 388377 - DNA, 25 bp, Mus musculus
ctggtctggacacagtgcccgtgtc

SEQ ID NO: 388378 - DNA, 25 bp, Mus musculus
ctggtctggacagagtgcccgtgtc

SEQ ID NO: 388379 - DNA, 25 bp, Mus musculus
ctggtctgttaccagcaggagaatg

SEQ ID NO: 388380 - DNA, 25 bp, Mus musculus
ctggtctgttacgagcaggagaatg

SEQ ID NO: 388381 - DNA, 25 bp, Mus musculus
ctggtctgttctctgtaactggaca

SEQ ID NO: 388382 - DNA, 25 bp, Mus musculus
ctggtctgttctgtgtaactggaca

SEQ ID NO: 388383 - DNA, 25 bp, Mus musculus
ctggtctgtttgcatttgataggtt

SEQ ID NO: 388384 - DNA, 25 bp, Mus musculus
ctggtctgtttggatttgataggtt

SEQ ID NO: 388385 - DNA, 25 bp, Mus musculus
ctggtcttactcacagcaaaggagg

SEQ ID NO: 388386 - DNA, 25 bp, Mus musculus
ctggtcttactctcagcaaaggagg

SEQ ID NO: 388387 - DNA, 25 bp, Mus musculus
ctggtcttatgtcgtcttttcttaa

SEQ ID NO: 388388 - DNA, 25 bp, Mus musculus
ctggtcttatgtggtcttttcttaa

SEQ ID NO: 388389 - DNA, 25 bp, Mus musculus
ctggtcttccataatgacgctgcga

SEQ ID NO: 388390 - DNA, 25 bp, Mus musculus
ctggtcttccatcctcatttatcat

SEQ ID NO: 388391 - DNA, 25 bp, Mus musculus
ctggtcttccatgctcatttatcat

SEQ ID NO: 388392 - DNA, 25 bp, Mus musculus
ctggtcttccattatgacgctgcga

SEQ ID NO: 388393 - DNA, 25 bp, Mus musculus
ctggtcttgaacaggtggtaatcat

SEQ ID NO: 388394 - DNA, 25 bp, Mus musculus
ctggtcttgaactggtggtaatcat

SEQ ID NO: 388395 - DNA, 25 bp, Mus musculus
ctggtcttggatcgcaaactgctgc

SEQ ID NO: 388396 - DNA, 25 bp, Mus musculus
ctggtcttggatggcaaactgctgc

SEQ ID NO: 388397 - DNA, 25 bp, Mus musculus
ctggtctttaggacgatctgatgta

SEQ ID NO: 388398 - DNA, 25 bp, Mus musculus
ctggtctttaggtcgatctgatgta

SEQ ID NO: 388399 - DNA, 25 bp, Mus musculus
ctggtctttcatacttttcccatga

SEQ ID NO: 388400 - DNA, 25 bp, Mus musculus
ctggtctttcattcttttcccatga

SEQ ID NO: 388401 - DNA, 25 bp, Mus musculus
ctggtcttttcacggctggtgcctc

SEQ ID NO: 388402 - DNA, 25 bp, Mus musculus
ctggtcttttcagggctggtgcctc

SEQ ID NO: 388403 - DNA, 25 bp, Mus musculus
ctggtgaaacagacacactcacttg

SEQ ID NO: 388404 - DNA, 25 bp, Mus musculus
ctggtgaaacagtcacactcacttg

SEQ ID NO: 388405 - DNA, 25 bp, Mus musculus
ctggtgaacacaacatttgcttaga

SEQ ID NO: 388406 - DNA, 25 bp, Mus musculus
ctggtgaacacatcatttgcttaga

SEQ ID NO: 388407 - DNA, 25 bp, Mus musculus
ctggtgaacagcacgttattgtgga

SEQ ID NO: 388408 - DNA, 25 bp, Mus musculus
ctggtgaacagctcgttattgtgga

SEQ ID NO: 388409 - DNA, 25 bp, Mus musculus
ctggtgaacgagaccctttgcccta

SEQ ID NO: 388410 - DNA, 25 bp, Mus musculus
ctggtgaacgagtccctttgcccta

SEQ ID NO: 388411 - DNA, 25 bp, Mus musculus
ctggtgaagaagctgcatcaatgat

SEQ ID NO: 388412 - DNA, 25 bp, Mus musculus
ctggtgaagaaggtgcatcaatgat

SEQ ID NO: 388413 - DNA, 25 bp, Mus musculus
ctggtgaagccacgcaataaagcat

SEQ ID NO: 388414 - DNA, 25 bp, Mus musculus
ctggtgaagccaggcaataaagcat

SEQ ID NO: 388415 - DNA, 25 bp, Mus musculus
ctggtgaattcactgccacacggta

SEQ ID NO: 388416 - DNA, 25 bp, Mus musculus
ctggtgaattcagtgccacacggta

SEQ ID NO: 388417 - DNA, 25 bp, Mus musculus
ctggtgacagcgagactactgtaaa

SEQ ID NO: 388418 - DNA, 25 bp, Mus musculus
ctggtgacagcgtgactactgtaaa

SEQ ID NO: 388419 - DNA, 25 bp, Mus musculus
ctggtgacagtgacctattgatgac

SEQ ID NO: 388420 - DNA, 25 bp, Mus musculus
ctggtgacagtgtcctattgatgac

SEQ ID NO: 388421 - DNA, 25 bp, Mus musculus
ctggtgacgtcaacttctattgcat

SEQ ID NO: 388422 - DNA, 25 bp, Mus musculus
ctggtgacgtcatcttctattgcat

SEQ ID NO: 388423 - DNA, 25 bp, Mus musculus
ctggtgacgtgacctgggccaaact

SEQ ID NO: 388424 - DNA, 25 bp, Mus musculus
ctggtgacgtgagctgggccaaact

SEQ ID NO: 388425 - DNA, 25 bp, Mus musculus
ctggtgactacacatgtttccctct

SEQ ID NO: 388426 - DNA, 25 bp, Mus musculus
ctggtgactacagatgtttccctct

SEQ ID NO: 388427 - DNA, 25 bp, Mus musculus
ctggtgactctaccctctgatgtgt

SEQ ID NO: 388428 - DNA, 25 bp, Mus musculus
ctggtgactctagcctctgatgtgt

SEQ ID NO: 388429 - DNA, 25 bp, Mus musculus
ctggtgactgtcaacactggtgtgc

SEQ ID NO: 388430 - DNA, 25 bp, Mus musculus
ctggtgactgtctacactggtgtgc

SEQ ID NO: 388431 - DNA, 25 bp, Mus musculus
ctggtgagagagaagcccttgccct

SEQ ID NO: 388432 - DNA, 25 bp, Mus musculus
ctggtgagagagtagcccttgccct

SEQ ID NO: 388433 - DNA, 25 bp, Mus musculus
ctggtgagcatcagtgtaggaattt

SEQ ID NO: 388434 - DNA, 25 bp, Mus musculus
ctggtgagcatctgtgtaggaattt

SEQ ID NO: 388435 - DNA, 25 bp, Mus musculus
ctggtgaggtccacaaagtctactc

SEQ ID NO: 388436 - DNA, 25 bp, Mus musculus
ctggtgaggtcctcaaagtctactc

SEQ ID NO: 388437 - DNA, 25 bp, Mus musculus
ctggtgatacctcgagaagtggtca

SEQ ID NO: 388438 - DNA, 25 bp, Mus musculus
ctggtgatacctggagaagtggtca

SEQ ID NO: 388439 - DNA, 25 bp, Mus musculus
ctggtgatagataagcttcctgctt

SEQ ID NO: 388440 - DNA, 25 bp, Mus musculus
ctggtgatagattagcttcctgctt

SEQ ID NO: 388441 - DNA, 25 bp, Mus musculus
ctggtgatatccatcataattttat

SEQ ID NO: 388442 - DNA, 25 bp, Mus musculus
ctggtgatatccttcataattttat

SEQ ID NO: 388443 - DNA, 25 bp, Mus musculus
ctggtgatcactctcttctgtggtc

SEQ ID NO: 388444 - DNA, 25 bp, Mus musculus
ctggtgatcactgtcttctgtggtc

SEQ ID NO: 388445 - DNA, 25 bp, Mus musculus
ctggtgatccagaggcgggacacat

SEQ ID NO: 388446 - DNA, 25 bp, Mus musculus
ctggtgatccagtggcgggacacat

SEQ ID NO: 388447 - DNA, 25 bp, Mus musculus
ctggtgatccgacttcgatccctag

SEQ ID NO: 388448 - DNA, 25 bp, Mus musculus
ctggtgatccgagttcgatccctag

SEQ ID NO: 388449 - DNA, 25 bp, Mus musculus
ctggtgatggctaccctgaaggacg

SEQ ID NO: 388450 - DNA, 25 bp, Mus musculus
ctggtgatggcttccctgaaggacg

SEQ ID NO: 388451 - DNA, 25 bp, Mus musculus
ctggtgatgtcaatgcagctgctaa

SEQ ID NO: 388452 - DNA, 25 bp, Mus musculus
ctggtgatgtcattgcagctgctaa

SEQ ID NO: 388453 - DNA, 25 bp, Mus musculus
ctggtgatgtggagcgcttacacgt

SEQ ID NO: 388454 - DNA, 25 bp, Mus musculus
ctggtgatgtggtgcgcttacacgt

SEQ ID NO: 388455 - DNA, 25 bp, Mus musculus
ctggtgatgttcaggtggcttctgt

SEQ ID NO: 388456 - DNA, 25 bp, Mus musculus
ctggtgatgttctggtggcttctgt

SEQ ID NO: 388457 - DNA, 25 bp, Mus musculus
ctggtgattaagaagggtccctggc

SEQ ID NO: 388458 - DNA, 25 bp, Mus musculus
ctggtgattaagtagggtccctggc

SEQ ID NO: 388459 - DNA, 25 bp, Mus musculus
ctggtgattgctctcctggtagata

SEQ ID NO: 388460 - DNA, 25 bp, Mus musculus
ctggtgattgctgtcctggtagata

SEQ ID NO: 388461 - DNA, 25 bp, Mus musculus
ctggtgatttgtaccatctgggtca

SEQ ID NO: 388462 - DNA, 25 bp, Mus musculus
ctggtgatttgttccatctgggtca

SEQ ID NO: 388463 - DNA, 25 bp, Mus musculus
ctggtgattttgcttccttgcagta

SEQ ID NO: 388464 - DNA, 25 bp, Mus musculus
ctggtgattttggttccttgcagta

SEQ ID NO: 388465 - DNA, 25 bp, Mus musculus
ctggtgcaccagatgacggaacttt

SEQ ID NO: 388466 - DNA, 25 bp, Mus musculus
ctggtgcaccagttgacggaacttt

SEQ ID NO: 388467 - DNA, 25 bp, Mus musculus
ctggtgcactctacatgaaggtaga

SEQ ID NO: 388468 - DNA, 25 bp, Mus musculus
ctggtgcactcttcatgaaggtaga

SEQ ID NO: 388469 - DNA, 25 bp, Mus musculus
ctggtgcagacccaaggaggcttct

SEQ ID NO: 388470 - DNA, 25 bp, Mus musculus
ctggtgcagaccgaaggaggcttct

SEQ ID NO: 388471 - DNA, 25 bp, Mus musculus
ctggtgcaggtcatctcggaggaca

SEQ ID NO: 388472 - DNA, 25 bp, Mus musculus
ctggtgcaggtcttctcggaggaca

SEQ ID NO: 388473 - DNA, 20 bp, Mus musculus
ctggtgcatccctatacagc

SEQ ID NO: 388474 - DNA, 25 bp, Mus musculus
ctggtgccaagtcaccactgcagag

SEQ ID NO: 388475 - DNA, 25 bp, Mus musculus
ctggtgccaagtgaccactgcagag

SEQ ID NO: 388476 - DNA, 25 bp, Mus musculus
ctggtgccagtgagagctgcttgcc

SEQ ID NO: 388477 - DNA, 25 bp, Mus musculus
ctggtgccagtgtgagctgcttgcc

SEQ ID NO: 388478 - DNA, 25 bp, Mus musculus
ctggtgccatggaactctgggcgta

SEQ ID NO: 388479 - DNA, 25 bp, Mus musculus
ctggtgccatggtactctgggcgta

SEQ ID NO: 388480 - DNA, 25 bp, Mus musculus
ctggtgcccacaacatctacctggg

SEQ ID NO: 388481 - DNA, 25 bp, Mus musculus
ctggtgcccacatcatctacctggg

SEQ ID NO: 388482 - DNA, 25 bp, Mus musculus
ctggtgccgtttatcatcatggtaa

SEQ ID NO: 388483 - DNA, 25 bp, Mus musculus
ctggtgccgtttttcatcatggtaa

SEQ ID NO: 388484 - DNA, 25 bp, Mus musculus
ctggtgcctagaccttcatgttata

SEQ ID NO: 388485 - DNA, 25 bp, Mus musculus
ctggtgcctagagcttcatgttata

SEQ ID NO: 388486 - DNA, 25 bp, Mus musculus
ctggtgcctatgagctgagatgtta

SEQ ID NO: 388487 - DNA, 25 bp, Mus musculus
ctggtgcctatgtgctgagatgtta

SEQ ID NO: 388488 - DNA, 25 bp, Mus musculus
ctggtgcctccacccctggatttgg

SEQ ID NO: 388489 - DNA, 25 bp, Mus musculus
ctggtgcctccagccctggatttgg

SEQ ID NO: 388490 - DNA, 20 bp, Mus musculus
ctggtgcctccctatacagc

SEQ ID NO: 388491 - DNA, 25 bp, Mus musculus
ctggtgcctcctcctgacattgaca

SEQ ID NO: 388492 - DNA, 25 bp, Mus musculus
ctggtgcctcctgctgacattgaca

SEQ ID NO: 388493 - DNA, 25 bp, Mus musculus
ctggtgcctgcacagatcaaaagag

SEQ ID NO: 388494 - DNA, 25 bp, Mus musculus
ctggtgcctgcagagatcaaaagag

SEQ ID NO: 388495 - DNA, 25 bp, Mus musculus
ctggtgcctgttccgtgctcctgaa

SEQ ID NO: 388496 - DNA, 25 bp, Mus musculus
ctggtgcctgttctgtgactaaact

SEQ ID NO: 388497 - DNA, 25 bp, Mus musculus
ctggtgcctgttgcgtgctcctgaa

SEQ ID NO: 388498 - DNA, 25 bp, Mus musculus
ctggtgcctgttgtgtgactaaact

SEQ ID NO: 388499 - DNA, 25 bp, Mus musculus
ctggtgcgatggctgcatggaaatg

SEQ ID NO: 388500 - DNA, 25 bp, Mus musculus
ctggtgcgatgggtgcatggaaatg

SEQ ID NO: 388501 - DNA, 20 bp, Mus musculus
ctggtgcgtccctatacagc

SEQ ID NO: 388502 - DNA, 25 bp, Mus musculus
ctggtgcgtgtcagtttctggagat

SEQ ID NO: 388503 - DNA, 25 bp, Mus musculus
ctggtgcgtgtctgtttctggagat

SEQ ID NO: 388504 - DNA, 25 bp, Mus musculus
ctggtgctaactcagccccttaatg

SEQ ID NO: 388505 - DNA, 25 bp, Mus musculus
ctggtgctaactgagccccttaatg

SEQ ID NO: 388506 - DNA, 25 bp, Mus musculus
ctggtgctcagcacagtagctggct

SEQ ID NO: 388507 - DNA, 25 bp, Mus musculus
ctggtgctcagctcagtagctggct

SEQ ID NO: 388508 - DNA, 25 bp, Mus musculus
ctggtgctcagtcttcattggaatc

SEQ ID NO: 388509 - DNA, 25 bp, Mus musculus
ctggtgctcagtgttcattggaatc

SEQ ID NO: 388510 - DNA, 25 bp, Mus musculus
ctggtgctcatgatactcttaataa

SEQ ID NO: 388511 - DNA, 25 bp, Mus musculus
ctggtgctcatgttactcttaataa

SEQ ID NO: 388512 - DNA, 25 bp, Mus musculus
ctggtgctcattctggccagcagag

SEQ ID NO: 388513 - DNA, 25 bp, Mus musculus
ctggtgctcattgtggccagcagag

SEQ ID NO: 388514 - DNA, 25 bp, Mus musculus
ctggtgctccagcaataagaggtat

SEQ ID NO: 388515 - DNA, 25 bp, Mus musculus
ctggtgctccaggaataagaggtat

SEQ ID NO: 388516 - DNA, 25 bp, Mus musculus
ctggtgctgcgtccttatgaatgtt

SEQ ID NO: 388517 - DNA, 25 bp, Mus musculus
ctggtgctgcgtgcttatgaatgtt

SEQ ID NO: 388518 - DNA, 25 bp, Mus musculus
ctggtgctggcactggtgttcaata

SEQ ID NO: 388519 - DNA, 25 bp, Mus musculus
ctggtgctggcagtggtgttcaata

SEQ ID NO: 388520 - DNA, 25 bp, Mus musculus
ctggtgctgtgcacggtgaagaacc

SEQ ID NO: 388521 - DNA, 25 bp, Mus musculus
ctggtgctgtgctcggtgaagaacc

SEQ ID NO: 388522 - DNA, 25 bp, Mus musculus
ctggtgcttaagctaaggtgcattt

SEQ ID NO: 388523 - DNA, 25 bp, Mus musculus
ctggtgcttaaggtaaggtgcattt

SEQ ID NO: 388524 - DNA, 25 bp, Mus musculus
ctggtgcttcatacaatcaacactt

SEQ ID NO: 388525 - DNA, 25 bp, Mus musculus
ctggtgcttcattcaatcaacactt

SEQ ID NO: 388526 - DNA, 20 bp, Mus musculus
ctggtgcttccctatacagc

SEQ ID NO: 388527 - DNA, 25 bp, Mus musculus
ctggtgcttcgcatgctgtttcaac

SEQ ID NO: 388528 - DNA, 25 bp, Mus musculus
ctggtgcttcgcttgctgtttcaac

SEQ ID NO: 388529 - DNA, 25 bp, Mus musculus
ctggtgcttctaaggcaggacagaa

SEQ ID NO: 388530 - DNA, 25 bp, Mus musculus
ctggtgcttctatggcaggacagaa

SEQ ID NO: 388531 - DNA, 25 bp, Mus musculus
ctggtgcttgccctgacagtgatcc

SEQ ID NO: 388532 - DNA, 25 bp, Mus musculus
ctggtgcttgccgtgacagtgatcc

SEQ ID NO: 388533 - DNA, 25 bp, Mus musculus
ctggtgcttgttaatctcatcgtct

SEQ ID NO: 388534 - DNA, 25 bp, Mus musculus
ctggtgcttgtttatctcatcgtct

SEQ ID NO: 388535 - DNA, 25 bp, Mus musculus
ctggtgcttttccttaacatggtgg

SEQ ID NO: 388536 - DNA, 25 bp, Mus musculus
ctggtgcttttcgttaacatggtgg

SEQ ID NO: 388537 - DNA, 25 bp, Mus musculus
ctggtggaacagcagtcattttctt

SEQ ID NO: 388538 - DNA, 25 bp, Mus musculus
ctggtggaacaggagtcattttctt

SEQ ID NO: 388539 - DNA, 25 bp, Mus musculus
ctggtggactctctggcaaagacaa

SEQ ID NO: 388540 - DNA, 25 bp, Mus musculus
ctggtggactctgtggcaaagacaa

SEQ ID NO: 388541 - DNA, 25 bp, Mus musculus
ctggtggatgtcatgccggaagtaa

SEQ ID NO: 388542 - DNA, 25 bp, Mus musculus
ctggtggatgtcttgccggaagtaa

SEQ ID NO: 388543 - DNA, 25 bp, Mus musculus
ctggtggatttacggactgtcccct

SEQ ID NO: 388544 - DNA, 25 bp, Mus musculus
ctggtggatttagggactgtcccct

SEQ ID NO: 388545 - DNA, 25 bp, Mus musculus
ctggtggcaattcatcatggaacat

SEQ ID NO: 388546 - DNA, 25 bp, Mus musculus
ctggtggcaattgatcatggaacat

SEQ ID NO: 388547 - DNA, 25 bp, Mus musculus
ctggtggcacaacgatgttcagaac

SEQ ID NO: 388548 - DNA, 25 bp, Mus musculus
ctggtggcacaaggatgttcagaac

SEQ ID NO: 388549 - DNA, 25 bp, Mus musculus
ctggtggcacgactgggcttcccaa

SEQ ID NO: 388550 - DNA, 25 bp, Mus musculus
ctggtggcacgagtgggcttcccaa

SEQ ID NO: 388551 - DNA, 25 bp, Mus musculus
ctggtggcatcgctgaacatgcaga

SEQ ID NO: 388552 - DNA, 25 bp, Mus musculus
ctggtggcatcggtgaacatgcaga

SEQ ID NO: 388553 - DNA, 25 bp, Mus musculus
ctggtggccacacgctcccataatg

SEQ ID NO: 388554 - DNA, 25 bp, Mus musculus
ctggtggccacaggctcccataatg

SEQ ID NO: 388555 - DNA, 25 bp, Mus musculus
ctggtggccactcctaacaggagag

SEQ ID NO: 388556 - DNA, 25 bp, Mus musculus
ctggtggccactgctaacaggagag

SEQ ID NO: 388557 - DNA, 25 bp, Mus musculus
ctggtggcccttctgaggacagaac

SEQ ID NO: 388558 - DNA, 25 bp, Mus musculus
ctggtggcccttgtgaggacagaac

SEQ ID NO: 388559 - DNA, 25 bp, Mus musculus
ctggtggcctcgagcaagtgcaagc

SEQ ID NO: 388560 - DNA, 25 bp, Mus musculus
ctggtggcctcgtgcaagtgcaagc

SEQ ID NO: 388561 - DNA, 25 bp, Mus musculus
ctggtggcctctatagtctatgtca

SEQ ID NO: 388562 - DNA, 25 bp, Mus musculus
ctggtggcctctttagtctatgtca

SEQ ID NO: 388563 - DNA, 25 bp, Mus musculus
ctggtggcctggactcccaaataga

SEQ ID NO: 388564 - DNA, 25 bp, Mus musculus
ctggtggcctggtctcccaaataga

SEQ ID NO: 388565 - DNA, 25 bp, Mus musculus
ctggtggctacacgcttagatgtgc

SEQ ID NO: 388566 - DNA, 25 bp, Mus musculus
ctggtggctacaggcttagatgtgc

SEQ ID NO: 388567 - DNA, 25 bp, Mus musculus
ctggtggctagcaatgaaggtagtc

SEQ ID NO: 388568 - DNA, 25 bp, Mus musculus
ctggtggctagctatgaaggtagtc

SEQ ID NO: 388569 - DNA, 25 bp, Mus musculus
ctggtggctgccctatcaaaggatt

SEQ ID NO: 388570 - DNA, 25 bp, Mus musculus
ctggtggctgccgtatcaaaggatt

SEQ ID NO: 388571 - DNA, 25 bp, Mus musculus
ctggtggctggaccaatgtaaatat

SEQ ID NO: 388572 - DNA, 25 bp, Mus musculus
ctggtggctggagcaatgtaaatat

SEQ ID NO: 388573 - DNA, 25 bp, Mus musculus
ctggtggctggcaaagctgatcccc

SEQ ID NO: 388574 - DNA, 25 bp, Mus musculus
ctggtggctggctaagctgatcccc

SEQ ID NO: 388575 - DNA, 25 bp, Mus musculus
ctggtggcttacacctacccttaat

SEQ ID NO: 388576 - DNA, 25 bp, Mus musculus
ctggtggcttactcctacccttaat

SEQ ID NO: 388577 - DNA, 25 bp, Mus musculus
ctggtgggaacacccgagccaagct

SEQ ID NO: 388578 - DNA, 25 bp, Mus musculus
ctggtgggaacagccgagccaagct

SEQ ID NO: 388579 - DNA, 25 bp, Mus musculus
ctggtgggcactcccagctccttgg

SEQ ID NO: 388580 - DNA, 25 bp, Mus musculus
ctggtgggcactgccagctccttgg

SEQ ID NO: 388581 - DNA, 25 bp, Mus musculus
ctggtgggcagtacgaactcaatgg

SEQ ID NO: 388582 - DNA, 25 bp, Mus musculus
ctggtgggcagttcgaactcaatgg

SEQ ID NO: 388583 - DNA, 25 bp, Mus musculus
ctggtgggctacagctagggaccct

SEQ ID NO: 388584 - DNA, 25 bp, Mus musculus
ctggtgggctactgctagggaccct

SEQ ID NO: 388585 - DNA, 25 bp, Mus musculus
ctggtggtactgattggatggaaaa

SEQ ID NO: 388586 - DNA, 25 bp, Mus musculus
ctggtggtactgtttggatggaaaa

SEQ ID NO: 388587 - DNA, 25 bp, Mus musculus
ctggtggtcatacggcggttccctc

SEQ ID NO: 388588 - DNA, 25 bp, Mus musculus
ctggtggtcatagggcggttccctc

SEQ ID NO: 388589 - DNA, 25 bp, Mus musculus
ctggtggtcatcactgttctcctgt

SEQ ID NO: 388590 - DNA, 25 bp, Mus musculus
ctggtggtcatctctgttctcctgt

SEQ ID NO: 388591 - DNA, 25 bp, Mus musculus
ctggtggtccctcatatgccctaga

SEQ ID NO: 388592 - DNA, 25 bp, Mus musculus
ctggtggtccctgatatgccctaga

SEQ ID NO: 388593 - DNA, 25 bp, Mus musculus
ctggtggtctccacctgtgtgctgg

SEQ ID NO: 388594 - DNA, 25 bp, Mus musculus
ctggtggtctcctcctgtgtgctgg

SEQ ID NO: 388595 - DNA, 25 bp, Mus musculus
ctggtggtctttaatgagccctgtt

SEQ ID NO: 388596 - DNA, 25 bp, Mus musculus
ctggtggtctttactatccatgtga

SEQ ID NO: 388597 - DNA, 25 bp, Mus musculus
ctggtggtcttttatgagccctgtt

SEQ ID NO: 388598 - DNA, 25 bp, Mus musculus
ctggtggtcttttctatccatgtga

SEQ ID NO: 388599 - DNA, 25 bp, Mus musculus
ctggtggtgatcagcacccgtgtaa

SEQ ID NO: 388600 - DNA, 25 bp, Mus musculus
ctggtggtgatctgcacccgtgtaa

SEQ ID NO: 388601 - DNA, 25 bp, Mus musculus
ctggtggtggccacttgttgactct

SEQ ID NO: 388602 - DNA, 25 bp, Mus musculus
ctggtggtggcctcttgttgactct

SEQ ID NO: 388603 - DNA, 25 bp, Mus musculus
ctggtggttcctcagtgtgcatagt

SEQ ID NO: 388604 - DNA, 25 bp, Mus musculus
ctggtggttcctgagtgtgcatagt

SEQ ID NO: 388605 - DNA, 25 bp, Mus musculus
ctggtggttgcactgaccatcctta

SEQ ID NO: 388606 - DNA, 25 bp, Mus musculus
ctggtggttgcagtgaccatcctta

SEQ ID NO: 388607 - DNA, 25 bp, Mus musculus
ctggtggttggacttatgtctgttt

SEQ ID NO: 388608 - DNA, 25 bp, Mus musculus
ctggtggttggagttatgtctgttt

SEQ ID NO: 388609 - DNA, 25 bp, Mus musculus
ctggtggttgtgactcgctttttca

SEQ ID NO: 388610 - DNA, 25 bp, Mus musculus
ctggtggttgtgtctcgctttttca

SEQ ID NO: 388611 - DNA, 25 bp, Mus musculus
ctggtgtactacaaaggtcttatga

SEQ ID NO: 388612 - DNA, 25 bp, Mus musculus
ctggtgtactactaaggtcttatga

SEQ ID NO: 388613 - DNA, 25 bp, Mus musculus
ctggtgtacttgagccaaacagaca

SEQ ID NO: 388614 - DNA, 25 bp, Mus musculus
ctggtgtacttgtgccaaacagaca

SEQ ID NO: 388615 - DNA, 25 bp, Mus musculus
ctggtgtagcccaatctagcgttaa

SEQ ID NO: 388616 - DNA, 25 bp, Mus musculus
ctggtgtagccctatctagcgttaa

SEQ ID NO: 388617 - DNA, 25 bp, Mus musculus
ctggtgtatgacacttgatgacggt

SEQ ID NO: 388618 - DNA, 25 bp, Mus musculus
ctggtgtatgactcttgatgacggt

SEQ ID NO: 388619 - DNA, 25 bp, Mus musculus
ctggtgtcacttctttccccatggg

SEQ ID NO: 388620 - DNA, 25 bp, Mus musculus
ctggtgtcacttgtttccccatggg

SEQ ID NO: 388621 - DNA, 25 bp, Mus musculus
ctggtgtccagtaggtcttgggaaa

SEQ ID NO: 388622 - DNA, 25 bp, Mus musculus
ctggtgtccagttggtcttgggaaa

SEQ ID NO: 388623 - DNA, 25 bp, Mus musculus
ctggtgtcccacagctaggaatcta

SEQ ID NO: 388624 - DNA, 25 bp, Mus musculus
ctggtgtcccactgctaggaatcta

SEQ ID NO: 388625 - DNA, 25 bp, Mus musculus
ctggtgtccgagacttctgatgtcg

SEQ ID NO: 388626 - DNA, 25 bp, Mus musculus
ctggtgtccgagtcttctgatgtcg

SEQ ID NO: 388627 - DNA, 25 bp, Mus musculus
ctggtgtcctggcaaggctcacaat

SEQ ID NO: 388628 - DNA, 25 bp, Mus musculus
ctggtgtcctgggaaggctcacaat

SEQ ID NO: 388629 - DNA, 25 bp, Mus musculus
ctggtgtccttgaccgcatgatgaa

SEQ ID NO: 388630 - DNA, 25 bp, Mus musculus
ctggtgtccttgtccgcatgatgaa

SEQ ID NO: 388631 - DNA, 25 bp, Mus musculus
ctggtgtctcggacctggcagagcc

SEQ ID NO: 388632 - DNA, 25 bp, Mus musculus
ctggtgtctcggtcctggcagagcc

SEQ ID NO: 388633 - DNA, 25 bp, Mus musculus
ctggtgtctgaaattgctgtgtttc

SEQ ID NO: 388634 - DNA, 25 bp, Mus musculus
ctggtgtctgaatttgctgtgtttc

SEQ ID NO: 388635 - DNA, 25 bp, Mus musculus
ctggtgtctggaccatttatgttaa

SEQ ID NO: 388636 - DNA, 25 bp, Mus musculus
ctggtgtctggagcatttatgttaa

SEQ ID NO: 388637 - DNA, 25 bp, Mus musculus
ctggtgtctgggatttctattttgt

SEQ ID NO: 388638 - DNA, 25 bp, Mus musculus
ctggtgtctgggttttctattttgt

SEQ ID NO: 388639 - DNA, 25 bp, Mus musculus
ctggtgtcttcactgttaagtatga

SEQ ID NO: 388640 - DNA, 25 bp, Mus musculus
ctggtgtcttcagtgttaagtatga

SEQ ID NO: 388641 - DNA, 25 bp, Mus musculus
ctggtgtgagagatcctaatgtgta

SEQ ID NO: 388642 - DNA, 25 bp, Mus musculus
ctggtgtgagagttcctaatgtgta

SEQ ID NO: 388643 - DNA, 25 bp, Mus musculus
ctggtgtgatggacttctttacttc

SEQ ID NO: 388644 - DNA, 25 bp, Mus musculus
ctggtgtgatggtcttctttacttc

SEQ ID NO: 388645 - DNA, 25 bp, Mus musculus
ctggtgtggcacacatggtttttaa

SEQ ID NO: 388646 - DNA, 25 bp, Mus musculus
ctggtgtggcactcatggtttttaa

SEQ ID NO: 388647 - DNA, 25 bp, Mus musculus
ctggtgtggccaccgtccccaggat

SEQ ID NO: 388648 - DNA, 25 bp, Mus musculus
ctggtgtggccagcgtccccaggat

SEQ ID NO: 388649 - DNA, 25 bp, Mus musculus
ctggtgtgggacactggtgtttttc

SEQ ID NO: 388650 - DNA, 25 bp, Mus musculus
ctggtgtgggactctggtgtttttc

SEQ ID NO: 388651 - DNA, 25 bp, Mus musculus
ctggtgtgggctcctttaaaaatga

SEQ ID NO: 388652 - DNA, 25 bp, Mus musculus
ctggtgtgggctgctttaaaaatga

SEQ ID NO: 388653 - DNA, 25 bp, Mus musculus
ctggtgtgtctgaggtcaatgactg

SEQ ID NO: 388654 - DNA, 25 bp, Mus musculus
ctggtgtgtctgatttccaactttt

SEQ ID NO: 388655 - DNA, 25 bp, Mus musculus
ctggtgtgtctgtggtcaatgactg

SEQ ID NO: 388656 - DNA, 25 bp, Mus musculus
ctggtgtgtctgttttccaactttt

SEQ ID NO: 388657 - DNA, 25 bp, Mus musculus
ctggtgtgtgaaattggtctctgca

SEQ ID NO: 388658 - DNA, 25 bp, Mus musculus
ctggtgtgtgaatttggtctctgca

SEQ ID NO: 388659 - DNA, 25 bp, Mus musculus
ctggtgtgttggacgcctttcttcg

SEQ ID NO: 388660 - DNA, 25 bp, Mus musculus
ctggtgtgttggtcgcctttcttcg

SEQ ID NO: 388661 - DNA, 25 bp, Mus musculus
ctggtgttacagagcttttaagcct

SEQ ID NO: 388662 - DNA, 25 bp, Mus musculus
ctggtgttacagtgcttttaagcct

SEQ ID NO: 388663 - DNA, 25 bp, Mus musculus
ctggtgttaccaaaagacattgtat

SEQ ID NO: 388664 - DNA, 25 bp, Mus musculus
ctggtgttaccataagacattgtat

SEQ ID NO: 388665 - DNA, 25 bp, Mus musculus
ctggtgttctgtagcctactacgaa

SEQ ID NO: 388666 - DNA, 25 bp, Mus musculus
ctggtgttctgtagctaagcgacgg

SEQ ID NO: 388667 - DNA, 25 bp, Mus musculus
ctggtgttctgttgcctactacgaa

SEQ ID NO: 388668 - DNA, 25 bp, Mus musculus
ctggtgttctgttgctaagcgacgg

SEQ ID NO: 388669 - DNA, 25 bp, Mus musculus
ctggtgttgactcggcccggaaatc

SEQ ID NO: 388670 - DNA, 25 bp, Mus musculus
ctggtgttgactgggcccggaaatc

SEQ ID NO: 388671 - DNA, 25 bp, Mus musculus
ctggtgttgatgaaagctgagagta

SEQ ID NO: 388672 - DNA, 25 bp, Mus musculus
ctggtgttgatgtaagctgagagta

SEQ ID NO: 388673 - DNA, 25 bp, Mus musculus
ctggtgttgcacacgaacacgtttt

SEQ ID NO: 388674 - DNA, 25 bp, Mus musculus
ctggtgttgcactcgaacacgtttt

SEQ ID NO: 388675 - DNA, 25 bp, Mus musculus
ctggtgttgcagacgctcctggaac

SEQ ID NO: 388676 - DNA, 25 bp, Mus musculus
ctggtgttgcagtcgctcctggaac

SEQ ID NO: 388677 - DNA, 25 bp, Mus musculus
ctggtgttggacagacggctgggct

SEQ ID NO: 388678 - DNA, 25 bp, Mus musculus
ctggtgttggactgacggctgggct

SEQ ID NO: 388679 - DNA, 25 bp, Mus musculus
ctggtgttgttcataaccgtctgtg

SEQ ID NO: 388680 - DNA, 25 bp, Mus musculus
ctggtgttgttcttaaccgtctgtg

SEQ ID NO: 388681 - DNA, 25 bp, Mus musculus
ctggtgtttgagacaggcacagcat

SEQ ID NO: 388682 - DNA, 25 bp, Mus musculus
ctggtgtttgagtcaggcacagcat

SEQ ID NO: 388683 - DNA, 25 bp, Mus musculus
ctggtgtttggcacctggctactgg

SEQ ID NO: 388684 - DNA, 25 bp, Mus musculus
ctggtgtttggctcctggctactgg

SEQ ID NO: 388685 - DNA, 25 bp, Mus musculus
ctggtgtttggtagcttttgctttc

SEQ ID NO: 388686 - DNA, 25 bp, Mus musculus
ctggtgtttggttgcttttgctttc

SEQ ID NO: 388687 - DNA, 25 bp, Mus musculus
ctggttaaagccagccagagagccc

SEQ ID NO: 388688 - DNA, 25 bp, Mus musculus
ctggttaaagcctgccagagagccc

SEQ ID NO: 388689 - DNA, 25 bp, Mus musculus
ctggttacacatattttaggctttt

SEQ ID NO: 388690 - DNA, 25 bp, Mus musculus
ctggttacacattttttaggctttt

SEQ ID NO: 388691 - DNA, 25 bp, Mus musculus
ctggttacatacagatgctggctcc

SEQ ID NO: 388692 - DNA, 25 bp, Mus musculus
ctggttacatactgatgctggctcc

SEQ ID NO: 388693 - DNA, 25 bp, Mus musculus
ctggttacatgtcgcacctgggtca

SEQ ID NO: 388694 - DNA, 25 bp, Mus musculus
ctggttacatgtggcacctgggtca

SEQ ID NO: 388695 - DNA, 25 bp, Mus musculus
ctggttagatttaatcttctcacag

SEQ ID NO: 388696 - DNA, 25 bp, Mus musculus
ctggttagattttatcttctcacag

SEQ ID NO: 388697 - DNA, 25 bp, Mus musculus
ctggttatcaaaatcaagccctctt

SEQ ID NO: 388698 - DNA, 25 bp, Mus musculus
ctggttatcaaattcaagccctctt

SEQ ID NO: 388699 - DNA, 25 bp, Mus musculus
ctggttatccaaccctggcaactat

SEQ ID NO: 388700 - DNA, 25 bp, Mus musculus
ctggttatccaagcctggcaactat

SEQ ID NO: 388701 - DNA, 25 bp, Mus musculus
ctggttatgcccaggaacacttata

SEQ ID NO: 388702 - DNA, 25 bp, Mus musculus
ctggttatgccctggaacacttata

SEQ ID NO: 388703 - DNA, 25 bp, Mus musculus
ctggttatgggcacagttaagactg

SEQ ID NO: 388704 - DNA, 25 bp, Mus musculus
ctggttatgggctcagttaagactg

SEQ ID NO: 388705 - DNA, 25 bp, Mus musculus
ctggttatgtttctgtttctagtca

SEQ ID NO: 388706 - DNA, 25 bp, Mus musculus
ctggttatgtttgtgtttctagtca

SEQ ID NO: 388707 - DNA, 25 bp, Mus musculus
ctggttcaagccagctgtgtgtagt

SEQ ID NO: 388708 - DNA, 25 bp, Mus musculus
ctggttcaagcctgctgtgtgtagt

SEQ ID NO: 388709 - DNA, 25 bp, Mus musculus
ctggttcaaggcacacagaggacct

SEQ ID NO: 388710 - DNA, 25 bp, Mus musculus
ctggttcaaggctcacagaggacct

SEQ ID NO: 388711 - DNA, 25 bp, Mus musculus
ctggttcacagtagtggcttccaac

SEQ ID NO: 388712 - DNA, 25 bp, Mus musculus
ctggttcacagttgtggcttccaac

SEQ ID NO: 388713 - DNA, 25 bp, Mus musculus
ctggttcacatgaggtgactgccaa

SEQ ID NO: 388714 - DNA, 25 bp, Mus musculus
ctggttcacatgtggtgactgccaa

SEQ ID NO: 388715 - DNA, 25 bp, Mus musculus
ctggttcaccagcaatactcacaag

SEQ ID NO: 388716 - DNA, 25 bp, Mus musculus
ctggttcaccaggaatactcacaag

SEQ ID NO: 388717 - DNA, 25 bp, Mus musculus
ctggttcacccactcagtattgagt

SEQ ID NO: 388718 - DNA, 25 bp, Mus musculus
ctggttcacccagtcagtattgagt

SEQ ID NO: 388719 - DNA, 25 bp, Mus musculus
ctggttcagcatacactgtcagtgg

SEQ ID NO: 388720 - DNA, 25 bp, Mus musculus
ctggttcagcattcactgtcagtgg

SEQ ID NO: 388721 - DNA, 25 bp, Mus musculus
ctggttcagcgtacactgtcatggg

SEQ ID NO: 388722 - DNA, 25 bp, Mus musculus
ctggttcagcgttcactgtcatggg

SEQ ID NO: 388723 - DNA, 25 bp, Mus musculus
ctggttcagctgagagccgttcaag

SEQ ID NO: 388724 - DNA, 25 bp, Mus musculus
ctggttcagctgtgagccgttcaag

SEQ ID NO: 388725 - DNA, 25 bp, Mus musculus
ctggttcataggcatctgggttttc

SEQ ID NO: 388726 - DNA, 25 bp, Mus musculus
ctggttcatagggatctgggttttc

SEQ ID NO: 388727 - DNA, 25 bp, Mus musculus
ctggttcatcgcagcagggtcagat

SEQ ID NO: 388728 - DNA, 25 bp, Mus musculus
ctggttcatcgctgcagggtcagat

SEQ ID NO: 388729 - DNA, 25 bp, Mus musculus
ctggttcatggaacctggtcactgg

SEQ ID NO: 388730 - DNA, 25 bp, Mus musculus
ctggttcatggatcctggtcactgg

SEQ ID NO: 388731 - DNA, 25 bp, Mus musculus
ctggttcatgtgctttcgttttcct

SEQ ID NO: 388732 - DNA, 25 bp, Mus musculus
ctggttcatgtggtttcgttttcct

SEQ ID NO: 388733 - DNA, 25 bp, Mus musculus
ctggttcatttacctgtttggcaga

SEQ ID NO: 388734 - DNA, 25 bp, Mus musculus
ctggttcatttagctgtttggcaga

SEQ ID NO: 388735 - DNA, 25 bp, Mus musculus
ctggttccaggcctaagaagacagt

SEQ ID NO: 388736 - DNA, 25 bp, Mus musculus
ctggttccaggcgtaagaagacagt

SEQ ID NO: 388737 - DNA, 25 bp, Mus musculus
ctggttccatacatccattaacgtg

SEQ ID NO: 388738 - DNA, 25 bp, Mus musculus
ctggttccatacttccattaacgtg

SEQ ID NO: 388739 - DNA, 25 bp, Mus musculus
ctggttccatcgatcattgtcaggg

SEQ ID NO: 388740 - DNA, 25 bp, Mus musculus
ctggttccatcgttcattgtcaggg

SEQ ID NO: 388741 - DNA, 25 bp, Mus musculus
ctggttccctcgctcaagaaatgaa

SEQ ID NO: 388742 - DNA, 25 bp, Mus musculus
ctggttccctcggtcaagaaatgaa

SEQ ID NO: 388743 - DNA, 25 bp, Mus musculus
ctggttcccttcagaggcacagttt

SEQ ID NO: 388744 - DNA, 25 bp, Mus musculus
ctggttcccttctgaggcacagttt

SEQ ID NO: 388745 - DNA, 25 bp, Mus musculus
ctggttcctctgattaagatcaaca

SEQ ID NO: 388746 - DNA, 25 bp, Mus musculus
ctggttcctctgtttaagatcaaca

SEQ ID NO: 388747 - DNA, 25 bp, Mus musculus
ctggttcctgacaatctttcttaca

SEQ ID NO: 388748 - DNA, 25 bp, Mus musculus
ctggttcctgactatctttcttaca

SEQ ID NO: 388749 - DNA, 25 bp, Mus musculus
ctggttcctgatccagtcactgatt

SEQ ID NO: 388750 - DNA, 25 bp, Mus musculus
ctggttcctgatgcagtcactgatt

SEQ ID NO: 388751 - DNA, 25 bp, Mus musculus
ctggttcggaagcacgacctgcaca

SEQ ID NO: 388752 - DNA, 25 bp, Mus musculus
ctggttcggaaggacgacctgcaca

SEQ ID NO: 388753 - DNA, 25 bp, Mus musculus
ctggttctccacagtccacattgta

SEQ ID NO: 388754 - DNA, 25 bp, Mus musculus
ctggttctccactgtccacattgta

SEQ ID NO: 388755 - DNA, 25 bp, Mus musculus
ctggttctgcttcttggttcgagga

SEQ ID NO: 388756 - DNA, 25 bp, Mus musculus
ctggttctgcttgttggttcgagga

SEQ ID NO: 388757 - DNA, 25 bp, Mus musculus
ctggttctgtctcgatcctaaccga

SEQ ID NO: 388758 - DNA, 25 bp, Mus musculus
ctggttctgtctggatcctaaccga

SEQ ID NO: 388759 - DNA, 25 bp, Mus musculus
ctggttcttaaaagtctgtagcaaa

SEQ ID NO: 388760 - DNA, 25 bp, Mus musculus
ctggttcttaaatgtctgtagcaaa

SEQ ID NO: 388761 - DNA, 25 bp, Mus musculus
ctggttcttgaactgctgaatctaa

SEQ ID NO: 388762 - DNA, 25 bp, Mus musculus
ctggttcttgaagtgctgaatctaa

SEQ ID NO: 388763 - DNA, 25 bp, Mus musculus
ctggttctttctacagctctgggat

SEQ ID NO: 388764 - DNA, 25 bp, Mus musculus
ctggttctttcttcagctctgggat

SEQ ID NO: 388765 - DNA, 25 bp, Mus musculus
ctggttctttgtacttacttctttg

SEQ ID NO: 388766 - DNA, 25 bp, Mus musculus
ctggttctttgttcttacttctttg

SEQ ID NO: 388767 - DNA, 25 bp, Mus musculus
ctggttgaaagacctcccggtggcc

SEQ ID NO: 388768 - DNA, 25 bp, Mus musculus
ctggttgaaagagctcccggtggcc

SEQ ID NO: 388769 - DNA, 25 bp, Mus musculus
ctggttgaaccaagtgcgactgtta

SEQ ID NO: 388770 - DNA, 25 bp, Mus musculus
ctggttgaaccatgtgcgactgtta

SEQ ID NO: 388771 - DNA, 25 bp, Mus musculus
ctggttgaagtgaccagttcacctt

SEQ ID NO: 388772 - DNA, 25 bp, Mus musculus
ctggttgaagtgtccagttcacctt

SEQ ID NO: 388773 - DNA, 25 bp, Mus musculus
ctggttgagagcatcttggaacaga

SEQ ID NO: 388774 - DNA, 25 bp, Mus musculus
ctggttgagagcttcttggaacaga

SEQ ID NO: 388775 - DNA, 25 bp, Mus musculus
ctggttgataatactgtcactctct

SEQ ID NO: 388776 - DNA, 25 bp, Mus musculus
ctggttgataattctgtcactctct

SEQ ID NO: 388777 - DNA, 25 bp, Mus musculus
ctggttgataccatggttgctgctt

SEQ ID NO: 388778 - DNA, 25 bp, Mus musculus
ctggttgataccttggttgctgctt

SEQ ID NO: 388779 - DNA, 25 bp, Mus musculus
ctggttgcattcctaatttcctaca

SEQ ID NO: 388780 - DNA, 25 bp, Mus musculus
ctggttgcattcgtaatttcctaca

SEQ ID NO: 388781 - DNA, 25 bp, Mus musculus
ctggttgccgtcaggattttggtat

SEQ ID NO: 388782 - DNA, 25 bp, Mus musculus
ctggttgccgtctggattttggtat

SEQ ID NO: 388783 - DNA, 25 bp, Mus musculus
ctggttgctctcagtttccagtgat

SEQ ID NO: 388784 - DNA, 25 bp, Mus musculus
ctggttgctctctgtttccagtgat

SEQ ID NO: 388785 - DNA, 25 bp, Mus musculus
ctggttggacacaacatcatctttc

SEQ ID NO: 388786 - DNA, 25 bp, Mus musculus
ctggttggacactacatcatctttc

SEQ ID NO: 388787 - DNA, 25 bp, Mus musculus
ctggttggcaaacggccatttccct

SEQ ID NO: 388788 - DNA, 25 bp, Mus musculus
ctggttggcaaagggccatttccct

SEQ ID NO: 388789 - DNA, 25 bp, Mus musculus
ctggttggcccacgtcttaaacatg

SEQ ID NO: 388790 - DNA, 25 bp, Mus musculus
ctggttggcccaggtcttaaacatg

SEQ ID NO: 388791 - DNA, 25 bp, Mus musculus
ctggttggctaacgaactatgttgc

SEQ ID NO: 388792 - DNA, 25 bp, Mus musculus
ctggttggctaaggaactatgttgc

SEQ ID NO: 388793 - DNA, 25 bp, Mus musculus
ctggttggctggctgaagaacacaa

SEQ ID NO: 388794 - DNA, 25 bp, Mus musculus
ctggttggctgggtgaagaacacaa

SEQ ID NO: 388795 - DNA, 25 bp, Mus musculus
ctggttggtggcactggtgttcctc

SEQ ID NO: 388796 - DNA, 25 bp, Mus musculus
ctggttggtggctctggtgttcctc

SEQ ID NO: 388797 - DNA, 25 bp, Mus musculus
ctggttgtacgaacactaggaggaa

SEQ ID NO: 388798 - DNA, 25 bp, Mus musculus
ctggttgtacgatcactaggaggaa

SEQ ID NO: 388799 - DNA, 25 bp, Mus musculus
ctggttgtcagtacgcgtccgggtc

SEQ ID NO: 388800 - DNA, 25 bp, Mus musculus
ctggttgtcagttcgcgtccgggtc

SEQ ID NO: 388801 - DNA, 25 bp, Mus musculus
ctggttgtccttcgacttctcatcg

SEQ ID NO: 388802 - DNA, 25 bp, Mus musculus
ctggttgtccttggacttctcatcg

SEQ ID NO: 388803 - DNA, 25 bp, Mus musculus
ctggttgtctgaattgatacgtagc

SEQ ID NO: 388804 - DNA, 25 bp, Mus musculus
ctggttgtctgatttgatacgtagc

SEQ ID NO: 388805 - DNA, 25 bp, Mus musculus
ctggttgtctgcagttctgttgact

SEQ ID NO: 388806 - DNA, 25 bp, Mus musculus
ctggttgtctgctgttctgttgact

SEQ ID NO: 388807 - DNA, 25 bp, Mus musculus
ctggttgtgtgcatctctgtatttg

SEQ ID NO: 388808 - DNA, 25 bp, Mus musculus
ctggttgtgtgcttctctgtatttg

SEQ ID NO: 388809 - DNA, 25 bp, Mus musculus
ctggttgttcccacgtaagacacat

SEQ ID NO: 388810 - DNA, 25 bp, Mus musculus
ctggttgttccctcgtaagacacat

SEQ ID NO: 388811 - DNA, 25 bp, Mus musculus
ctggttgttcctccccatattggga

SEQ ID NO: 388812 - DNA, 25 bp, Mus musculus
ctggttgttcctgcccatattggga

SEQ ID NO: 388813 - DNA, 25 bp, Mus musculus
ctggttgttctacctcactgagaga

SEQ ID NO: 388814 - DNA, 25 bp, Mus musculus
ctggttgttctagctcactgagaga

SEQ ID NO: 388815 - DNA, 25 bp, Mus musculus
ctggttgttctgaaattgggtgtgc

SEQ ID NO: 388816 - DNA, 25 bp, Mus musculus
ctggttgttctgtaattgggtgtgc

SEQ ID NO: 388817 - DNA, 25 bp, Mus musculus
ctggttgttgctatggaatcctgtc

SEQ ID NO: 388818 - DNA, 25 bp, Mus musculus
ctggttgttgctttggaatcctgtc

SEQ ID NO: 388819 - DNA, 25 bp, Mus musculus
ctggttgtttatattcggtgtgctg

SEQ ID NO: 388820 - DNA, 25 bp, Mus musculus
ctggttgtttattttcggtgtgctg

SEQ ID NO: 388821 - DNA, 25 bp, Mus musculus
ctggttgtttctctgcttatttgtt

SEQ ID NO: 388822 - DNA, 25 bp, Mus musculus
ctggttgtttctgtgcttatttgtt

SEQ ID NO: 388823 - DNA, 25 bp, Mus musculus
ctggtttaactcacagcaactttta

SEQ ID NO: 388824 - DNA, 25 bp, Mus musculus
ctggtttaactctcagcaactttta

SEQ ID NO: 388825 - DNA, 25 bp, Mus musculus
ctggtttaatctcagttccttagtt

SEQ ID NO: 388826 - DNA, 25 bp, Mus musculus
ctggtttaatctgagttccttagtt

SEQ ID NO: 388827 - DNA, 25 bp, Mus musculus
ctggtttaatgtcatctatccccgg

SEQ ID NO: 388828 - DNA, 25 bp, Mus musculus
ctggtttaatgtgatctatccccgg

SEQ ID NO: 388829 - DNA, 25 bp, Mus musculus
ctggtttacacacgacataggcact

SEQ ID NO: 388830 - DNA, 25 bp, Mus musculus
ctggtttacacaggacataggcact

SEQ ID NO: 388831 - DNA, 25 bp, Mus musculus
ctggtttacatactgtgctctagaa

SEQ ID NO: 388832 - DNA, 25 bp, Mus musculus
ctggtttacatagtgtgctctagaa

SEQ ID NO: 388833 - DNA, 25 bp, Mus musculus
ctggtttaccttattgattgctcta

SEQ ID NO: 388834 - DNA, 25 bp, Mus musculus
ctggtttacctttttgattgctcta

SEQ ID NO: 388835 - DNA, 25 bp, Mus musculus
ctggtttatattcttcctcctggaa

SEQ ID NO: 388836 - DNA, 25 bp, Mus musculus
ctggtttatattgttcctcctggaa

SEQ ID NO: 388837 - DNA, 25 bp, Mus musculus
ctggtttatgagacatggactttcc

SEQ ID NO: 388838 - DNA, 25 bp, Mus musculus
ctggtttatgagtcatggactttcc

SEQ ID NO: 388839 - DNA, 25 bp, Mus musculus
ctggtttcaggaaatcaagaagttt

SEQ ID NO: 388840 - DNA, 25 bp, Mus musculus
ctggtttcaggatatcaagaagttt

SEQ ID NO: 388841 - DNA, 25 bp, Mus musculus
ctggtttcccagacatagtaaagaa

SEQ ID NO: 388842 - DNA, 25 bp, Mus musculus
ctggtttcccagtcatagtaaagaa

SEQ ID NO: 388843 - DNA, 25 bp, Mus musculus
ctggtttcctggagagggtcctgca

SEQ ID NO: 388844 - DNA, 25 bp, Mus musculus
ctggtttcctggtgagggtcctgca

SEQ ID NO: 388845 - DNA, 25 bp, Mus musculus
ctggtttctgacatgagattctctt

SEQ ID NO: 388846 - DNA, 25 bp, Mus musculus
ctggtttctgacttgagattctctt

SEQ ID NO: 388847 - DNA, 25 bp, Mus musculus
ctggtttctgagagtttcaccggaa

SEQ ID NO: 388848 - DNA, 25 bp, Mus musculus
ctggtttctgagtgtttcaccggaa

SEQ ID NO: 388849 - DNA, 25 bp, Mus musculus
ctggtttcttctaatcctttataca

SEQ ID NO: 388850 - DNA, 25 bp, Mus musculus
ctggtttcttcttatcctttataca

SEQ ID NO: 388851 - DNA, 25 bp, Mus musculus
ctggtttgaagcaggactttctttc

SEQ ID NO: 388852 - DNA, 25 bp, Mus musculus
ctggtttgaagctggactttctttc

SEQ ID NO: 388853 - DNA, 25 bp, Mus musculus
ctggtttgatacaatctgtcagttc

SEQ ID NO: 388854 - DNA, 25 bp, Mus musculus
ctggtttgatactatctgtcagttc

SEQ ID NO: 388855 - DNA, 25 bp, Mus musculus
ctggtttgatttctaagtcattgta

SEQ ID NO: 388856 - DNA, 25 bp, Mus musculus
ctggtttgatttgtaagtcattgta

SEQ ID NO: 388857 - DNA, 25 bp, Mus musculus
ctggtttgccttagtgtgatttgtg

SEQ ID NO: 388858 - DNA, 25 bp, Mus musculus
ctggtttgcctttgtgtgatttgtg

SEQ ID NO: 388859 - DNA, 25 bp, Mus musculus
ctggtttgctcccttgtgaaaatat

SEQ ID NO: 388860 - DNA, 25 bp, Mus musculus
ctggtttgctccgttgtgaaaatat

SEQ ID NO: 388861 - DNA, 25 bp, Mus musculus
ctggtttggaaacgatttgaggata

SEQ ID NO: 388862 - DNA, 25 bp, Mus musculus
ctggtttggaaaggatttgaggata

SEQ ID NO: 388863 - DNA, 25 bp, Mus musculus
ctggtttggatacattcacattgca

SEQ ID NO: 388864 - DNA, 25 bp, Mus musculus
ctggtttggatagattcacattgca

SEQ ID NO: 388865 - DNA, 25 bp, Mus musculus
ctggtttggcatctaggtttttgtt

SEQ ID NO: 388866 - DNA, 25 bp, Mus musculus
ctggtttggcatgtaggtttttgtt

SEQ ID NO: 388867 - DNA, 25 bp, Mus musculus
ctggtttgtcacacctcaagaatca

SEQ ID NO: 388868 - DNA, 25 bp, Mus musculus
ctggtttgtcactcctcaagaatca

SEQ ID NO: 388869 - DNA, 25 bp, Mus musculus
ctggttttactgcttatctcctgtg

SEQ ID NO: 388870 - DNA, 25 bp, Mus musculus
ctggttttactggttatctcctgtg

SEQ ID NO: 388871 - DNA, 25 bp, Mus musculus
ctggttttagttcagctttatctgt

SEQ ID NO: 388872 - DNA, 25 bp, Mus musculus
ctggttttagttgagctttatctgt

SEQ ID NO: 388873 - DNA, 25 bp, Mus musculus
ctggttttatatcctcagaggcggc

SEQ ID NO: 388874 - DNA, 25 bp, Mus musculus
ctggttttatatgctcagaggcggc

SEQ ID NO: 388875 - DNA, 25 bp, Mus musculus
ctggttttcagtctgatagctttca

SEQ ID NO: 388876 - DNA, 25 bp, Mus musculus
ctggttttcagtgtgatagctttca

SEQ ID NO: 388877 - DNA, 25 bp, Mus musculus
ctggttttcattctggagtgtcctc

SEQ ID NO: 388878 - DNA, 25 bp, Mus musculus
ctggttttcattgtggagtgtcctc

SEQ ID NO: 388879 - DNA, 25 bp, Mus musculus
ctggttttcgtcatctcaatctgaa

SEQ ID NO: 388880 - DNA, 25 bp, Mus musculus
ctggttttcgtcttctcaatctgaa

SEQ ID NO: 388881 - DNA, 25 bp, Mus musculus
ctggttttgagcaatggttgaaact

SEQ ID NO: 388882 - DNA, 25 bp, Mus musculus
ctggttttgagctatggttgaaact

SEQ ID NO: 388883 - DNA, 25 bp, Mus musculus
ctggttttgtagctgtcgccaatat

SEQ ID NO: 388884 - DNA, 25 bp, Mus musculus
ctggttttgtaggtgtcgccaatat

SEQ ID NO: 388885 - DNA, 25 bp, Mus musculus
ctggtttttaccctgtcaacttgat

SEQ ID NO: 388886 - DNA, 25 bp, Mus musculus
ctggtttttaccgtgtcaacttgat

SEQ ID NO: 388887 - DNA, 25 bp, Mus musculus
ctggtttttatgaatgctgatcttt

SEQ ID NO: 388888 - DNA, 25 bp, Mus musculus
ctggtttttatgtatgctgatcttt

SEQ ID NO: 388889 - DNA, 25 bp, Mus musculus
ctggtttttcaaactctccacagaa

SEQ ID NO: 388890 - DNA, 25 bp, Mus musculus
ctggtttttcaatctctccacagaa

SEQ ID NO: 388891 - DNA, 25 bp, Mus musculus
ctggtttttctgagctttgtcattt

SEQ ID NO: 388892 - DNA, 25 bp, Mus musculus
ctggtttttctgtgctttgtcattt

SEQ ID NO: 388893 - DNA, 25 bp, Mus musculus
ctggtttttgatatgtgggagctag

SEQ ID NO: 388894 - DNA, 25 bp, Mus musculus
ctggtttttgatttgtgggagctag

SEQ ID NO: 388895 - DNA, 25 bp, Mus musculus
ctgtaaaaattcaatcgggcaaaat

SEQ ID NO: 388896 - DNA, 25 bp, Mus musculus
ctgtaaaaattctatcgggcaaaat

SEQ ID NO: 388897 - DNA, 25 bp, Mus musculus
ctgtaaaatcttccctgcttgcctg

SEQ ID NO: 388898 - DNA, 25 bp, Mus musculus
ctgtaaaatcttgcctgcttgcctg

SEQ ID NO: 388899 - DNA, 25 bp, Mus musculus
ctgtaaacagcccatcctctgcaag

SEQ ID NO: 388900 - DNA, 25 bp, Mus musculus
ctgtaaacagccgatcctctgcaag

SEQ ID NO: 388901 - DNA, 25 bp, Mus musculus
ctgtaaacagctatactctagagaa

SEQ ID NO: 388902 - DNA, 25 bp, Mus musculus
ctgtaaacagctttactctagagaa

SEQ ID NO: 388903 - DNA, 25 bp, Mus musculus
ctgtaaacccagctgtccaggtggg

SEQ ID NO: 388904 - DNA, 25 bp, Mus musculus
ctgtaaacccaggtgtccaggtggg

SEQ ID NO: 388905 - DNA, 25 bp, Mus musculus
ctgtaaagacagataccgatgacct

SEQ ID NO: 388906 - DNA, 25 bp, Mus musculus
ctgtaaagacagttaccgatgacct

SEQ ID NO: 388907 - DNA, 25 bp, Mus musculus
ctgtaaaggcacagccttacctgta

SEQ ID NO: 388908 - DNA, 25 bp, Mus musculus
ctgtaaaggcactgccttacctgta

SEQ ID NO: 388909 - DNA, 25 bp, Mus musculus
ctgtaaagttcacgcccaagctaag

SEQ ID NO: 388910 - DNA, 25 bp, Mus musculus
ctgtaaagttcaggcccaagctaag

SEQ ID NO: 388911 - DNA, 25 bp, Mus musculus
ctgtaaagttttcatcgaaagcttt

SEQ ID NO: 388912 - DNA, 25 bp, Mus musculus
ctgtaaagttttgatcgaaagcttt

SEQ ID NO: 388913 - DNA, 25 bp, Mus musculus
ctgtaaataaatctacccttcctat

SEQ ID NO: 388914 - DNA, 25 bp, Mus musculus
ctgtaaataaatgtacccttcctat

SEQ ID NO: 388915 - DNA, 25 bp, Mus musculus
ctgtaaatagtcagttctcagggag

SEQ ID NO: 388916 - DNA, 25 bp, Mus musculus
ctgtaaatagtctgttctcagggag

SEQ ID NO: 388917 - DNA, 25 bp, Mus musculus
ctgtaaatgatcctgacctcagcgc

SEQ ID NO: 388918 - DNA, 25 bp, Mus musculus
ctgtaaatgatcgtgacctcagcgc

SEQ ID NO: 388919 - DNA, 25 bp, Mus musculus
ctgtaaatgcttctaattcttcccc

SEQ ID NO: 388920 - DNA, 25 bp, Mus musculus
ctgtaaatgcttgtaattcttcccc

SEQ ID NO: 388921 - DNA, 25 bp, Mus musculus
ctgtaaatgtccactaaacctctgt

SEQ ID NO: 388922 - DNA, 25 bp, Mus musculus
ctgtaaatgtcctctaaacctctgt

SEQ ID NO: 388923 - DNA, 25 bp, Mus musculus
ctgtaacaatgtcatagtccctgag

SEQ ID NO: 388924 - DNA, 25 bp, Mus musculus
ctgtaacaatgtgatagtccctgag

SEQ ID NO: 388925 - DNA, 25 bp, Mus musculus
ctgtaacactggcactgaaataaag

SEQ ID NO: 388926 - DNA, 25 bp, Mus musculus
ctgtaacactgggactgaaataaag

SEQ ID NO: 388927 - DNA, 25 bp, Mus musculus
ctgtaacagatcaaacaccggcgct

SEQ ID NO: 388928 - DNA, 25 bp, Mus musculus
ctgtaacagatctaacaccggcgct

SEQ ID NO: 388929 - DNA, 25 bp, Mus musculus
ctgtaacatagactggccttcatca

SEQ ID NO: 388930 - DNA, 25 bp, Mus musculus
ctgtaacatagagtggccttcatca

SEQ ID NO: 388931 - DNA, 25 bp, Mus musculus
ctgtaacatcagagtcggacgctaa

SEQ ID NO: 388932 - DNA, 25 bp, Mus musculus
ctgtaacatcagtgtcggacgctaa

SEQ ID NO: 388933 - DNA, 25 bp, Mus musculus
ctgtaaccaggtctgctggctactc

SEQ ID NO: 388934 - DNA, 25 bp, Mus musculus
ctgtaaccaggtgtgctggctactc

SEQ ID NO: 388935 - DNA, 25 bp, Mus musculus
ctgtaacccacaaagattctgggca

SEQ ID NO: 388936 - DNA, 25 bp, Mus musculus
ctgtaacccacatagattctgggca

SEQ ID NO: 388937 - DNA, 25 bp, Mus musculus
ctgtaacccacgagctgctgtgagg

SEQ ID NO: 388938 - DNA, 25 bp, Mus musculus
ctgtaacccacgtgctgctgtgagg

SEQ ID NO: 388939 - DNA, 25 bp, Mus musculus
ctgtaaccctcacgcctgtgtgtgg

SEQ ID NO: 388940 - DNA, 25 bp, Mus musculus
ctgtaaccctcaggcctgtgtgtgg

SEQ ID NO: 388941 - DNA, 25 bp, Mus musculus
ctgtaaccctgtcggcctttagtat

SEQ ID NO: 388942 - DNA, 25 bp, Mus musculus
ctgtaaccctgtgggcctttagtat

SEQ ID NO: 388943 - DNA, 25 bp, Mus musculus
ctgtaacctggacgtgcttggactg

SEQ ID NO: 388944 - DNA, 25 bp, Mus musculus
ctgtaacctggaggtgcttggactg

SEQ ID NO: 388945 - DNA, 25 bp, Mus musculus
ctgtaacctgtaaaatcctagcact

SEQ ID NO: 388946 - DNA, 25 bp, Mus musculus
ctgtaacctgtataatcctagcact

SEQ ID NO: 388947 - DNA, 25 bp, Mus musculus
ctgtaacctttaatacattgtaaat

SEQ ID NO: 388948 - DNA, 25 bp, Mus musculus
ctgtaacctttattacattgtaaat

SEQ ID NO: 388949 - DNA, 25 bp, Mus musculus
ctgtaacggcgtctgataacatctt

SEQ ID NO: 388950 - DNA, 25 bp, Mus musculus
ctgtaacggcgtgtgataacatctt

SEQ ID NO: 388951 - DNA, 25 bp, Mus musculus
ctgtaactacagaggcccagagaaa

SEQ ID NO: 388952 - DNA, 25 bp, Mus musculus
ctgtaactacagtggcccagagaaa

SEQ ID NO: 388953 - DNA, 25 bp, Mus musculus
ctgtaactagcaatgttccaggcaa

SEQ ID NO: 388954 - DNA, 25 bp, Mus musculus
ctgtaactagcattgttccaggcaa

SEQ ID NO: 388955 - DNA, 25 bp, Mus musculus
ctgtaactcgtgacaagcattggtt

SEQ ID NO: 388956 - DNA, 25 bp, Mus musculus
ctgtaactcgtgtcaagcattggtt

SEQ ID NO: 388957 - DNA, 25 bp, Mus musculus
ctgtaactctgcctggactgtggac

SEQ ID NO: 388958 - DNA, 25 bp, Mus musculus
ctgtaactctgcgtggactgtggac

SEQ ID NO: 388959 - DNA, 25 bp, Mus musculus
ctgtaactcttcctgtgggtgtgag

SEQ ID NO: 388960 - DNA, 25 bp, Mus musculus
ctgtaactcttcgtgtgggtgtgag

SEQ ID NO: 388961 - DNA, 25 bp, Mus musculus
ctgtaactgcttatatatggctgat

SEQ ID NO: 388962 - DNA, 25 bp, Mus musculus
ctgtaactgcttttatatggctgat

SEQ ID NO: 388963 - DNA, 25 bp, Mus musculus
ctgtaactgggtcgactgtagcttg

SEQ ID NO: 388964 - DNA, 25 bp, Mus musculus
ctgtaactgggtggactgtagcttg

SEQ ID NO: 388965 - DNA, 25 bp, Mus musculus
ctgtaactgtctatgcttgagcata

SEQ ID NO: 388966 - DNA, 25 bp, Mus musculus
ctgtaactgtctttgcttgagcata

SEQ ID NO: 388967 - DNA, 25 bp, Mus musculus
ctgtaactgttgcttcaggccattg

SEQ ID NO: 388968 - DNA, 25 bp, Mus musculus
ctgtaactgttggttcaggccattg

SEQ ID NO: 388969 - DNA, 25 bp, Mus musculus
ctgtaacttatgatccagaaaatta

SEQ ID NO: 388970 - DNA, 25 bp, Mus musculus
ctgtaacttatgttccagaaaatta

SEQ ID NO: 388971 - DNA, 25 bp, Mus musculus
ctgtaactttccaaccgttatggat

SEQ ID NO: 388972 - DNA, 25 bp, Mus musculus
ctgtaactttcctaccgttatggat

SEQ ID NO: 388973 - DNA, 25 bp, Mus musculus
ctgtaagacaagatggcctgctgga

SEQ ID NO: 388974 - DNA, 25 bp, Mus musculus
ctgtaagacaagttggcctgctgga

SEQ ID NO: 388975 - DNA, 25 bp, Mus musculus
ctgtaagagtccatccctgtcagga

SEQ ID NO: 388976 - DNA, 25 bp, Mus musculus
ctgtaagagtccttccctgtcagga

SEQ ID NO: 388977 - DNA, 25 bp, Mus musculus
ctgtaagcattcagtcattgttgac

SEQ ID NO: 388978 - DNA, 25 bp, Mus musculus
ctgtaagcattctgtcattgttgac

SEQ ID NO: 388979 - DNA, 25 bp, Mus musculus
ctgtaagcgcttctttggaggcaaa

SEQ ID NO: 388980 - DNA, 25 bp, Mus musculus
ctgtaagcgcttgtttggaggcaaa

SEQ ID NO: 388981 - DNA, 25 bp, Mus musculus
ctgtaagctaggacgtggacattta

SEQ ID NO: 388982 - DNA, 25 bp, Mus musculus
ctgtaagctaggtcgtggacattta

SEQ ID NO: 388983 - DNA, 25 bp, Mus musculus
ctgtaaggacaaacgcggagctgct

SEQ ID NO: 388984 - DNA, 25 bp, Mus musculus
ctgtaaggacaatcgcggagctgct

SEQ ID NO: 388985 - DNA, 25 bp, Mus musculus
ctgtaaggagagaccatcaccgttg

SEQ ID NO: 388986 - DNA, 25 bp, Mus musculus
ctgtaaggagagtccatcaccgttg

SEQ ID NO: 388987 - DNA, 25 bp, Mus musculus
ctgtaaggcttcattgcactataga

SEQ ID NO: 388988 - DNA, 25 bp, Mus musculus
ctgtaaggcttctttgcactataga

SEQ ID NO: 388989 - DNA, 25 bp, Mus musculus
ctgtaagtacagatccaagggatac

SEQ ID NO: 388990 - DNA, 25 bp, Mus musculus
ctgtaagtacagttccaagggatac

SEQ ID NO: 388991 - DNA, 25 bp, Mus musculus
ctgtaagtgggtaagctgtgctctt

SEQ ID NO: 388992 - DNA, 25 bp, Mus musculus
ctgtaagtgggttagctgtgctctt

SEQ ID NO: 388993 - DNA, 25 bp, Mus musculus
ctgtaagtttctctcatcgttatgt

SEQ ID NO: 388994 - DNA, 25 bp, Mus musculus
ctgtaagtttctgtcatcgttatgt

SEQ ID NO: 388995 - DNA, 25 bp, Mus musculus
ctgtaataatcaccttggcttccct

SEQ ID NO: 388996 - DNA, 25 bp, Mus musculus
ctgtaataatcagcttggcttccct

SEQ ID NO: 388997 - DNA, 25 bp, Mus musculus
ctgtaataattcctacttctgcatt

SEQ ID NO: 388998 - DNA, 25 bp, Mus musculus
ctgtaataattcgtacttctgcatt

SEQ ID NO: 388999 - DNA, 25 bp, Mus musculus
ctgtaatacatgctgtactcaatgg

SEQ ID NO: 389000 - DNA, 25 bp, Mus musculus
ctgtaatacatggtgtactcaatgg

SEQ ID NO: 389001 - DNA, 25 bp, Mus musculus
ctgtaatcacagaacaggcaacttt

SEQ ID NO: 389002 - DNA, 25 bp, Mus musculus
ctgtaatcacagatggcccatagga

SEQ ID NO: 389003 - DNA, 25 bp, Mus musculus
ctgtaatcacagtacaggcaacttt

SEQ ID NO: 389004 - DNA, 25 bp, Mus musculus
ctgtaatcacagttggcccatagga

SEQ ID NO: 389005 - DNA, 25 bp, Mus musculus
ctgtaatcactactgttgtaacgtg

SEQ ID NO: 389006 - DNA, 25 bp, Mus musculus
ctgtaatcactagtgttgtaacgtg

SEQ ID NO: 389007 - DNA, 25 bp, Mus musculus
ctgtaatcatctctcagcagcatac

SEQ ID NO: 389008 - DNA, 25 bp, Mus musculus
ctgtaatcatctgtcagcagcatac

SEQ ID NO: 389009 - DNA, 25 bp, Mus musculus
ctgtaatccaccatttcagctataa

SEQ ID NO: 389010 - DNA, 25 bp, Mus musculus
ctgtaatccaccttttcagctataa

SEQ ID NO: 389011 - DNA, 25 bp, Mus musculus
ctgtaatccattatttgtgagaaag

SEQ ID NO: 389012 - DNA, 25 bp, Mus musculus
ctgtaatccattttttgtgagaaag

SEQ ID NO: 389013 - DNA, 25 bp, Mus musculus
ctgtaatccccgatcttatgagtga

SEQ ID NO: 389014 - DNA, 25 bp, Mus musculus
ctgtaatccccgttcttatgagtga

SEQ ID NO: 389015 - DNA, 25 bp, Mus musculus
ctgtaatcctatcgtgtttctggtt

SEQ ID NO: 389016 - DNA, 25 bp, Mus musculus
ctgtaatcctatggtgtttctggtt

SEQ ID NO: 389017 - DNA, 25 bp, Mus musculus
ctgtaatctattcggcttctggcta

SEQ ID NO: 389018 - DNA, 25 bp, Mus musculus
ctgtaatctattgggcttctggcta

SEQ ID NO: 389019 - DNA, 25 bp, Mus musculus
ctgtaatgagagcttctggcctgca

SEQ ID NO: 389020 - DNA, 25 bp, Mus musculus
ctgtaatgagaggttctggcctgca

SEQ ID NO: 389021 - DNA, 25 bp, Mus musculus
ctgtaatgctatacaggaggccctg

SEQ ID NO: 389022 - DNA, 25 bp, Mus musculus
ctgtaatgctattcaggaggccctg

SEQ ID NO: 389023 - DNA, 25 bp, Mus musculus
ctgtaatgggtcaggttccttcttc

SEQ ID NO: 389024 - DNA, 25 bp, Mus musculus
ctgtaatgggtctggttccttcttc

SEQ ID NO: 389025 - DNA, 25 bp, Mus musculus
ctgtaatgtattaggagttcttggg

SEQ ID NO: 389026 - DNA, 25 bp, Mus musculus
ctgtaatgtatttggagttcttggg

SEQ ID NO: 389027 - DNA, 25 bp, Mus musculus
ctgtaatgtttcagtatatttccaa

SEQ ID NO: 389028 - DNA, 25 bp, Mus musculus
ctgtaatgtttctgtatatttccaa

SEQ ID NO: 389029 - DNA, 25 bp, Mus musculus
ctgtaattagttaccaatcacctgg

SEQ ID NO: 389030 - DNA, 25 bp, Mus musculus
ctgtaattagtttccaatcacctgg

SEQ ID NO: 389031 - DNA, 25 bp, Mus musculus
ctgtaattcagtcccaggttatctg

SEQ ID NO: 389032 - DNA, 25 bp, Mus musculus
ctgtaattcagtgccaggttatctg

SEQ ID NO: 389033 - DNA, 25 bp, Mus musculus
ctgtaattcattccttgacgcagca

SEQ ID NO: 389034 - DNA, 25 bp, Mus musculus
ctgtaattcattgcttgacgcagca

SEQ ID NO: 389035 - DNA, 25 bp, Mus musculus
ctgtaattccagcatccagaaggat

SEQ ID NO: 389036 - DNA, 25 bp, Mus musculus
ctgtaattccaggatccagaaggat

SEQ ID NO: 389037 - DNA, 25 bp, Mus musculus
ctgtaattgcgtatttaatgataga

SEQ ID NO: 389038 - DNA, 25 bp, Mus musculus
ctgtaattgcgtttttaatgataga

SEQ ID NO: 389039 - DNA, 25 bp, Mus musculus
ctgtaatttatgactctccctgagg

SEQ ID NO: 389040 - DNA, 25 bp, Mus musculus
ctgtaatttatgtctctccctgagg

SEQ ID NO: 389041 - DNA, 25 bp, Mus musculus
ctgtaatttcctaggcacaataaaa

SEQ ID NO: 389042 - DNA, 25 bp, Mus musculus
ctgtaatttccttggcacaataaaa

SEQ ID NO: 389043 - DNA, 25 bp, Mus musculus
ctgtaattttatatagagtttgagc

SEQ ID NO: 389044 - DNA, 25 bp, Mus musculus
ctgtaattttatttagagtttgagc

SEQ ID NO: 389045 - DNA, 25 bp, Mus musculus
ctgtacaaaccaaacatttctatgt

SEQ ID NO: 389046 - DNA, 25 bp, Mus musculus
ctgtacaaaccatacatttctatgt

SEQ ID NO: 389047 - DNA, 25 bp, Mus musculus
ctgtacaaactcctgcgtgcaggca

SEQ ID NO: 389048 - DNA, 25 bp, Mus musculus
ctgtacaaactcgtgcgtgcaggca

SEQ ID NO: 389049 - DNA, 25 bp, Mus musculus
ctgtacaacgcccatgacattggga

SEQ ID NO: 389050 - DNA, 25 bp, Mus musculus
ctgtacaacgccgatgacattggga

SEQ ID NO: 389051 - DNA, 25 bp, Mus musculus
ctgtacaagggccagatgctgcata

SEQ ID NO: 389052 - DNA, 25 bp, Mus musculus
ctgtacaagggcgagatgctgcata

SEQ ID NO: 389053 - DNA, 25 bp, Mus musculus
ctgtacaatcgtatcatcattcggc

SEQ ID NO: 389054 - DNA, 25 bp, Mus musculus
ctgtacaatcgtttcatcattcggc

SEQ ID NO: 389055 - DNA, 25 bp, Mus musculus
ctgtacaatgaactccctgcagaag

SEQ ID NO: 389056 - DNA, 25 bp, Mus musculus
ctgtacaatgaagtccctgcagaag

SEQ ID NO: 389057 - DNA, 25 bp, Mus musculus
ctgtacaattgcatcacgggtgggt

SEQ ID NO: 389058 - DNA, 25 bp, Mus musculus
ctgtacaattgcttcacgggtgggt

SEQ ID NO: 389059 - DNA, 25 bp, Mus musculus
ctgtacaccaagatatacacactgg

SEQ ID NO: 389060 - DNA, 25 bp, Mus musculus
ctgtacaccaagttatacacactgg

SEQ ID NO: 389061 - DNA, 25 bp, Mus musculus
ctgtacacccaaattagaagttagt

SEQ ID NO: 389062 - DNA, 25 bp, Mus musculus
ctgtacacccaatttagaagttagt

SEQ ID NO: 389063 - DNA, 25 bp, Mus musculus
ctgtacagactgaccatgacgctga

SEQ ID NO: 389064 - DNA, 25 bp, Mus musculus
ctgtacagactgtccatgacgctga

SEQ ID NO: 389065 - DNA, 25 bp, Mus musculus
ctgtacagccagctcagccgactgg

SEQ ID NO: 389066 - DNA, 25 bp, Mus musculus
ctgtacagccaggtcagccgactgg

SEQ ID NO: 389067 - DNA, 25 bp, Mus musculus
ctgtacaggccgacatgcgtgtggc

SEQ ID NO: 389068 - DNA, 25 bp, Mus musculus
ctgtacaggccgtcatgcgtgtggc

SEQ ID NO: 389069 - DNA, 25 bp, Mus musculus
ctgtacagtagaatttgcagatgta

SEQ ID NO: 389070 - DNA, 25 bp, Mus musculus
ctgtacagtagattttgcagatgta

SEQ ID NO: 389071 - DNA, 25 bp, Mus musculus
ctgtacatactgcatctcttttctc

SEQ ID NO: 389072 - DNA, 25 bp, Mus musculus
ctgtacatactggatctcttttctc

SEQ ID NO: 389073 - DNA, 25 bp, Mus musculus
ctgtacatcttgaatcttttttggg

SEQ ID NO: 389074 - DNA, 25 bp, Mus musculus
ctgtacatcttgtatcttttttggg

SEQ ID NO: 389075 - DNA, 25 bp, Mus musculus
ctgtacatgcgcagttatgctgtgg

SEQ ID NO: 389076 - DNA, 25 bp, Mus musculus
ctgtacatgcgctgttatgctgtgg

SEQ ID NO: 389077 - DNA, 25 bp, Mus musculus
ctgtacattaggagactttcttggg

SEQ ID NO: 389078 - DNA, 25 bp, Mus musculus
ctgtacattaggtgactttcttggg

SEQ ID NO: 389079 - DNA, 25 bp, Mus musculus
ctgtacattgttcacgggatgccaa

SEQ ID NO: 389080 - DNA, 25 bp, Mus musculus
ctgtacattgttgacgggatgccaa

SEQ ID NO: 389081 - DNA, 25 bp, Mus musculus
ctgtaccacagaacatacctttgct

SEQ ID NO: 389082 - DNA, 25 bp, Mus musculus
ctgtaccacagatcatacctttgct

SEQ ID NO: 389083 - DNA, 25 bp, Mus musculus
ctgtaccaccagcaggacggacgag

SEQ ID NO: 389084 - DNA, 25 bp, Mus musculus
ctgtaccaccaggaggacggacgag

SEQ ID NO: 389085 - DNA, 25 bp, Mus musculus
ctgtaccagcttcattaaaataaac

SEQ ID NO: 389086 - DNA, 25 bp, Mus musculus
ctgtaccagcttgattaaaataaac

SEQ ID NO: 389087 - DNA, 25 bp, Mus musculus
ctgtaccaggtaccccaatagaaat

SEQ ID NO: 389088 - DNA, 25 bp, Mus musculus
ctgtaccaggtagcccaatagaaat

SEQ ID NO: 389089 - DNA, 25 bp, Mus musculus
ctgtaccagtcgagaatatcttctt

SEQ ID NO: 389090 - DNA, 25 bp, Mus musculus
ctgtaccagtcgtgaatatcttctt

SEQ ID NO: 389091 - DNA, 25 bp, Mus musculus
ctgtacccacggctgtctttctgaa

SEQ ID NO: 389092 - DNA, 25 bp, Mus musculus
ctgtacccacgggtgtctttctgaa

SEQ ID NO: 389093 - DNA, 25 bp, Mus musculus
ctgtacccatctccttacagctggg

SEQ ID NO: 389094 - DNA, 25 bp, Mus musculus
ctgtacccatctgcttacagctggg

SEQ ID NO: 389095 - DNA, 25 bp, Mus musculus
ctgtacccgtatcctgttcatgtag

SEQ ID NO: 389096 - DNA, 25 bp, Mus musculus
ctgtacccgtatgctgttcatgtag

SEQ ID NO: 389097 - DNA, 25 bp, Mus musculus
ctgtaccctgggaattagattacgt

SEQ ID NO: 389098 - DNA, 25 bp, Mus musculus
ctgtaccctgggtattagattacgt

SEQ ID NO: 389099 - DNA, 25 bp, Mus musculus
ctgtacctagcaatttgagtcctta

SEQ ID NO: 389100 - DNA, 25 bp, Mus musculus
ctgtacctagcattttgagtcctta

SEQ ID NO: 389101 - DNA, 25 bp, Mus musculus
ctgtacctaggtagtcaatccagtt

SEQ ID NO: 389102 - DNA, 25 bp, Mus musculus
ctgtacctaggttgtcaatccagtt

SEQ ID NO: 389103 - DNA, 25 bp, Mus musculus
ctgtaccttcctcaaatgtttcaaa

SEQ ID NO: 389104 - DNA, 25 bp, Mus musculus
ctgtaccttcctgaaatgtttcaaa

SEQ ID NO: 389105 - DNA, 25 bp, Mus musculus
ctgtaccttctgcagggtatctcaa

SEQ ID NO: 389106 - DNA, 25 bp, Mus musculus
ctgtaccttctggagggtatctcaa

SEQ ID NO: 389107 - DNA, 25 bp, Mus musculus
ctgtaccttgtgatgaatgttaata

SEQ ID NO: 389108 - DNA, 25 bp, Mus musculus
ctgtaccttgtgttgaatgttaata

SEQ ID NO: 389109 - DNA, 25 bp, Mus musculus
ctgtacctttcaattcacgccaaag

SEQ ID NO: 389110 - DNA, 25 bp, Mus musculus
ctgtacctttcatttcacgccaaag

SEQ ID NO: 389111 - DNA, 25 bp, Mus musculus
ctgtacgcagaaacagcatcccagg

SEQ ID NO: 389112 - DNA, 25 bp, Mus musculus
ctgtacgcagaatcagcatcccagg

SEQ ID NO: 389113 - DNA, 25 bp, Mus musculus
ctgtacgttttcagggatgtggttc

SEQ ID NO: 389114 - DNA, 25 bp, Mus musculus
ctgtacgttttctgggatgtggttc

SEQ ID NO: 389115 - DNA, 25 bp, Mus musculus
ctgtactactgtcctctgagtgaca

SEQ ID NO: 389116 - DNA, 25 bp, Mus musculus
ctgtactactgtgctctgagtgaca

SEQ ID NO: 389117 - DNA, 25 bp, Mus musculus
ctgtactaggctacatgatgcattt

SEQ ID NO: 389118 - DNA, 25 bp, Mus musculus
ctgtactaggcttcatgatgcattt

SEQ ID NO: 389119 - DNA, 25 bp, Mus musculus
ctgtactatcacatccaaagctttc

SEQ ID NO: 389120 - DNA, 25 bp, Mus musculus
ctgtactatcacttccaaagctttc

SEQ ID NO: 389121 - DNA, 25 bp, Mus musculus
ctgtactatgggagtagctgtgctc

SEQ ID NO: 389122 - DNA, 25 bp, Mus musculus
ctgtactatgggtgtagctgtgctc

SEQ ID NO: 389123 - DNA, 25 bp, Mus musculus
ctgtactcagttagcatgtccattt

SEQ ID NO: 389124 - DNA, 25 bp, Mus musculus
ctgtactcagtttgcatgtccattt

SEQ ID NO: 389125 - DNA, 25 bp, Mus musculus
ctgtactcatccatatagccagtgt

SEQ ID NO: 389126 - DNA, 25 bp, Mus musculus
ctgtactcatccttatagccagtgt

SEQ ID NO: 389127 - DNA, 25 bp, Mus musculus
ctgtactccatccagggtcagggca

SEQ ID NO: 389128 - DNA, 25 bp, Mus musculus
ctgtactccatcgagggtcagggca

SEQ ID NO: 389129 - DNA, 25 bp, Mus musculus
ctgtactcgtgaaggccgccgggaa

SEQ ID NO: 389130 - DNA, 25 bp, Mus musculus
ctgtactcgtgatggccgccgggaa

SEQ ID NO: 389131 - DNA, 25 bp, Mus musculus
ctgtactcgtttcttactttggcaa

SEQ ID NO: 389132 - DNA, 25 bp, Mus musculus
ctgtactcgtttgttactttggcaa

SEQ ID NO: 389133 - DNA, 25 bp, Mus musculus
ctgtactctgctccatctaaggaga

SEQ ID NO: 389134 - DNA, 25 bp, Mus musculus
ctgtactctgctgcatctaaggaga

SEQ ID NO: 389135 - DNA, 25 bp, Mus musculus
ctgtactctgtgaatgcccagatat

SEQ ID NO: 389136 - DNA, 25 bp, Mus musculus
ctgtactctgtgtatgcccagatat

SEQ ID NO: 389137 - DNA, 25 bp, Mus musculus
ctgtactcttgcatctgtctagtaa

SEQ ID NO: 389138 - DNA, 25 bp, Mus musculus
ctgtactcttgcttctgtctagtaa

SEQ ID NO: 389139 - DNA, 25 bp, Mus musculus
ctgtactgactcagtgtatggctct

SEQ ID NO: 389140 - DNA, 25 bp, Mus musculus
ctgtactgactctgtgtatggctct

SEQ ID NO: 389141 - DNA, 25 bp, Mus musculus
ctgtactgggctcagaaggcacagt

SEQ ID NO: 389142 - DNA, 25 bp, Mus musculus
ctgtactgggctgagaaggcacagt

SEQ ID NO: 389143 - DNA, 25 bp, Mus musculus
ctgtactgtaaccatttctccttta

SEQ ID NO: 389144 - DNA, 25 bp, Mus musculus
ctgtactgtaacgatttctccttta

SEQ ID NO: 389145 - DNA, 25 bp, Mus musculus
ctgtactgtgatcgccaccaacatt

SEQ ID NO: 389146 - DNA, 25 bp, Mus musculus
ctgtactgtgatggccaccaacatt

SEQ ID NO: 389147 - DNA, 25 bp, Mus musculus
ctgtacttagatccactttgactga

SEQ ID NO: 389148 - DNA, 25 bp, Mus musculus
ctgtacttagatgcactttgactga

SEQ ID NO: 389149 - DNA, 25 bp, Mus musculus
ctgtacttcctgattctccagggaa

SEQ ID NO: 389150 - DNA, 25 bp, Mus musculus
ctgtacttcctgtttctccagggaa

SEQ ID NO: 389151 - DNA, 25 bp, Mus musculus
ctgtacttgaccctgtggaaagtaa

SEQ ID NO: 389152 - DNA, 25 bp, Mus musculus
ctgtacttgaccgtgtggaaagtaa

SEQ ID NO: 389153 - DNA, 25 bp, Mus musculus
ctgtacttgactagtgcgatttaat

SEQ ID NO: 389154 - DNA, 25 bp, Mus musculus
ctgtacttgacttgtgcgatttaat

SEQ ID NO: 389155 - DNA, 25 bp, Mus musculus
ctgtacttgatcatagcgcataact

SEQ ID NO: 389156 - DNA, 25 bp, Mus musculus
ctgtacttgatcttagcgcataact

SEQ ID NO: 389157 - DNA, 25 bp, Mus musculus
ctgtacttgtttctgctgggcacaa

SEQ ID NO: 389158 - DNA, 25 bp, Mus musculus
ctgtacttgtttgtgctgggcacaa

SEQ ID NO: 389159 - DNA, 25 bp, Mus musculus
ctgtactttaatactaagcagtcca

SEQ ID NO: 389160 - DNA, 25 bp, Mus musculus
ctgtactttaattctaagcagtcca

SEQ ID NO: 389161 - DNA, 25 bp, Mus musculus
ctgtactttactctgcttctcaatg

SEQ ID NO: 389162 - DNA, 25 bp, Mus musculus
ctgtactttactgtgcttctcaatg

SEQ ID NO: 389163 - DNA, 25 bp, Mus musculus
ctgtactttctcaattgagtttcct

SEQ ID NO: 389164 - DNA, 25 bp, Mus musculus
ctgtactttctctattgagtttcct

SEQ ID NO: 389165 - DNA, 25 bp, Mus musculus
ctgtactttggaaatgaaagccaat

SEQ ID NO: 389166 - DNA, 25 bp, Mus musculus
ctgtactttggatatgaaagccaat

SEQ ID NO: 389167 - DNA, 25 bp, Mus musculus
ctgtactttttcaaggattgtattt

SEQ ID NO: 389168 - DNA, 25 bp, Mus musculus
ctgtactttttctaggattgtattt

SEQ ID NO: 389169 - DNA, 25 bp, Mus musculus
ctgtagaaaaatctagtcctgcacc

SEQ ID NO: 389170 - DNA, 25 bp, Mus musculus
ctgtagaaaaatgtagtcctgcacc

SEQ ID NO: 389171 - DNA, 25 bp, Mus musculus
ctgtagaacagacagacactctctc

SEQ ID NO: 389172 - DNA, 25 bp, Mus musculus
ctgtagaacagagagacactctctc

SEQ ID NO: 389173 - DNA, 25 bp, Mus musculus
ctgtagaagttcagcatgttttgct

SEQ ID NO: 389174 - DNA, 25 bp, Mus musculus
ctgtagaagttctgcatgttttgct

SEQ ID NO: 389175 - DNA, 25 bp, Mus musculus
ctgtagaatttgatgagcttaactt

SEQ ID NO: 389176 - DNA, 25 bp, Mus musculus
ctgtagaatttgttgagcttaactt

SEQ ID NO: 389177 - DNA, 25 bp, Mus musculus
ctgtagaccgtgctggctggaactc

SEQ ID NO: 389178 - DNA, 25 bp, Mus musculus
ctgtagaccgtggtggctggaactc

SEQ ID NO: 389179 - DNA, 25 bp, Mus musculus
ctgtagacctgacacataatggagc

SEQ ID NO: 389180 - DNA, 25 bp, Mus musculus
ctgtagacctgagacataatggagc

SEQ ID NO: 389181 - DNA, 25 bp, Mus musculus
ctgtagactgtcacagagcctaaat

SEQ ID NO: 389182 - DNA, 25 bp, Mus musculus
ctgtagactgtctcagagcctaaat

SEQ ID NO: 389183 - DNA, 25 bp, Mus musculus
ctgtagagacgcaccaggacctgct

SEQ ID NO: 389184 - DNA, 25 bp, Mus musculus
ctgtagagacgctccaggacctgct

SEQ ID NO: 389185 - DNA, 25 bp, Mus musculus
ctgtagagcagaatcccttggtatt

SEQ ID NO: 389186 - DNA, 25 bp, Mus musculus
ctgtagagcagattcccttggtatt

SEQ ID NO: 389187 - DNA, 25 bp, Mus musculus
ctgtagagtcgcactgtttccttca

SEQ ID NO: 389188 - DNA, 25 bp, Mus musculus
ctgtagagtcgctctgtttccttca

SEQ ID NO: 389189 - DNA, 25 bp, Mus musculus
ctgtagagtggcctgggctgaactg

SEQ ID NO: 389190 - DNA, 25 bp, Mus musculus
ctgtagagtggcgtgggctgaactg

SEQ ID NO: 389191 - DNA, 25 bp, Mus musculus
ctgtagagttagaattggcatcccc

SEQ ID NO: 389192 - DNA, 25 bp, Mus musculus
ctgtagagttagtattggcatcccc

SEQ ID NO: 389193 - DNA, 25 bp, Mus musculus
ctgtagataatgagaagggctgaat

SEQ ID NO: 389194 - DNA, 25 bp, Mus musculus
ctgtagataatgtgaagggctgaat

SEQ ID NO: 389195 - DNA, 25 bp, Mus musculus
ctgtagatgcttcggcgagtgttca

SEQ ID NO: 389196 - DNA, 25 bp, Mus musculus
ctgtagatgcttgggcgagtgttca

SEQ ID NO: 389197 - DNA, 25 bp, Mus musculus
ctgtagcacactatctcaccagcaa

SEQ ID NO: 389198 - DNA, 25 bp, Mus musculus
ctgtagcacactttctcaccagcaa

SEQ ID NO: 389199 - DNA, 25 bp, Mus musculus
ctgtagcacttgagttgcttggcct

SEQ ID NO: 389200 - DNA, 25 bp, Mus musculus
ctgtagcacttgtgttgcttggcct

SEQ ID NO: 389201 - DNA, 25 bp, Mus musculus
ctgtagcagggaagtgctctggcaa

SEQ ID NO: 389202 - DNA, 25 bp, Mus musculus
ctgtagcagggatgtgctctggcaa

SEQ ID NO: 389203 - DNA, 25 bp, Mus musculus
ctgtagccatacctcttgttagatt

SEQ ID NO: 389204 - DNA, 25 bp, Mus musculus
ctgtagccatacgtcttgttagatt

SEQ ID NO: 389205 - DNA, 25 bp, Mus musculus
ctgtagcctctgactagtcctgaaa

SEQ ID NO: 389206 - DNA, 25 bp, Mus musculus
ctgtagcctctgtctagtcctgaaa

SEQ ID NO: 389207 - DNA, 25 bp, Mus musculus
ctgtagcctgctaattactttgtgt

SEQ ID NO: 389208 - DNA, 25 bp, Mus musculus
ctgtagcctgctcaccaaatagata

SEQ ID NO: 389209 - DNA, 25 bp, Mus musculus
ctgtagcctgctgaccaaatagata

SEQ ID NO: 389210 - DNA, 25 bp, Mus musculus
ctgtagcctgcttattactttgtgt

SEQ ID NO: 389211 - DNA, 25 bp, Mus musculus
ctgtagcgacaccttttatcatggc

SEQ ID NO: 389212 - DNA, 25 bp, Mus musculus
ctgtagcgacacgttttatcatggc

SEQ ID NO: 389213 - DNA, 25 bp, Mus musculus
ctgtagcgtcgtccggcaatatttt

SEQ ID NO: 389214 - DNA, 25 bp, Mus musculus
ctgtagcgtcgtgcggcaatatttt

SEQ ID NO: 389215 - DNA, 25 bp, Mus musculus
ctgtagcgtttacagcgttaccgct

SEQ ID NO: 389216 - DNA, 25 bp, Mus musculus
ctgtagcgtttagagcgttaccgct

SEQ ID NO: 389217 - DNA, 25 bp, Mus musculus
ctgtagctagatcttccatgtccat

SEQ ID NO: 389218 - DNA, 25 bp, Mus musculus
ctgtagctagatgttccatgtccat

SEQ ID NO: 389219 - DNA, 25 bp, Mus musculus
ctgtagctattcctggatagttgtt

SEQ ID NO: 389220 - DNA, 25 bp, Mus musculus
ctgtagctattcgtggatagttgtt

SEQ ID NO: 389221 - DNA, 25 bp, Mus musculus
ctgtagctatttcaagccatgttga

SEQ ID NO: 389222 - DNA, 25 bp, Mus musculus
ctgtagctatttgaagccatgttga

SEQ ID NO: 389223 - DNA, 25 bp, Mus musculus
ctgtagctccatcgccgaaaggcaa

SEQ ID NO: 389224 - DNA, 25 bp, Mus musculus
ctgtagctccatggccgaaaggcaa

SEQ ID NO: 389225 - DNA, 25 bp, Mus musculus
ctgtagctcctgaacaacgtagtaa

SEQ ID NO: 389226 - DNA, 25 bp, Mus musculus
ctgtagctcctgtacaacgtagtaa

SEQ ID NO: 389227 - DNA, 25 bp, Mus musculus
ctgtagctgatcagtgggctctgct

SEQ ID NO: 389228 - DNA, 25 bp, Mus musculus
ctgtagctgatctgtgggctctgct

SEQ ID NO: 389229 - DNA, 25 bp, Mus musculus
ctgtagctgccaccaataacttgta

SEQ ID NO: 389230 - DNA, 25 bp, Mus musculus
ctgtagctgccagcaataacttgta

SEQ ID NO: 389231 - DNA, 25 bp, Mus musculus
ctgtagctgcttaggcgatgtcatt

SEQ ID NO: 389232 - DNA, 25 bp, Mus musculus
ctgtagctgctttggcgatgtcatt

SEQ ID NO: 389233 - DNA, 25 bp, Mus musculus
ctgtagctggagatagtctggtttt

SEQ ID NO: 389234 - DNA, 25 bp, Mus musculus
ctgtagctggagttagtctggtttt

SEQ ID NO: 389235 - DNA, 25 bp, Mus musculus
ctgtagctgtcgctcttgagattta

SEQ ID NO: 389236 - DNA, 25 bp, Mus musculus
ctgtagctgtcggtcttgagattta

SEQ ID NO: 389237 - DNA, 25 bp, Mus musculus
ctgtagcttgcccacttgatgaaat

SEQ ID NO: 389238 - DNA, 25 bp, Mus musculus
ctgtagcttgccgacttgatgaaat

SEQ ID NO: 389239 - DNA, 25 bp, Mus musculus
ctgtaggaaagcaccctgactgtca

SEQ ID NO: 389240 - DNA, 25 bp, Mus musculus
ctgtaggaaagctccctgactgtca

SEQ ID NO: 389241 - DNA, 25 bp, Mus musculus
ctgtaggaacaaacatcctctggcc

SEQ ID NO: 389242 - DNA, 25 bp, Mus musculus
ctgtaggaacaatcatcctctggcc

SEQ ID NO: 389243 - DNA, 25 bp, Mus musculus
ctgtaggaagggaccgacgactccg

SEQ ID NO: 389244 - DNA, 25 bp, Mus musculus
ctgtaggaagggtccgacgactccg

SEQ ID NO: 389245 - DNA, 25 bp, Mus musculus
ctgtaggaccagagggctccaagga

SEQ ID NO: 389246 - DNA, 25 bp, Mus musculus
ctgtaggaccagtgggctccaagga

SEQ ID NO: 389247 - DNA, 25 bp, Mus musculus
ctgtaggactgaccctcatctgaga

SEQ ID NO: 389248 - DNA, 25 bp, Mus musculus
ctgtaggactgagcctcatctgaga

SEQ ID NO: 389249 - DNA, 25 bp, Mus musculus
ctgtaggcagacagttggtgtccct

SEQ ID NO: 389250 - DNA, 25 bp, Mus musculus
ctgtaggcagactgttggtgtccct

SEQ ID NO: 389251 - DNA, 25 bp, Mus musculus
ctgtaggccaatcatgagaagagtc

SEQ ID NO: 389252 - DNA, 25 bp, Mus musculus
ctgtaggccaatgatgagaagagtc

SEQ ID NO: 389253 - DNA, 25 bp, Mus musculus
ctgtaggcctctcagagataggaca

SEQ ID NO: 389254 - DNA, 25 bp, Mus musculus
ctgtaggcctctgagagataggaca

SEQ ID NO: 389255 - DNA, 25 bp, Mus musculus
ctgtaggcgacactgttcaggtgta

SEQ ID NO: 389256 - DNA, 25 bp, Mus musculus
ctgtaggcgacagtgttcaggtgta

SEQ ID NO: 389257 - DNA, 25 bp, Mus musculus
ctgtaggctttaccctccagacttc

SEQ ID NO: 389258 - DNA, 25 bp, Mus musculus
ctgtaggctttactcagatccttta

SEQ ID NO: 389259 - DNA, 25 bp, Mus musculus
ctgtaggctttagcctccagacttc

SEQ ID NO: 389260 - DNA, 25 bp, Mus musculus
ctgtaggctttagtcagatccttta

SEQ ID NO: 389261 - DNA, 25 bp, Mus musculus
ctgtagggactaagttggccgacat

SEQ ID NO: 389262 - DNA, 25 bp, Mus musculus
ctgtagggactatgttggccgacat

SEQ ID NO: 389263 - DNA, 25 bp, Mus musculus
ctgtagggagaaaaaactgactgta

SEQ ID NO: 389264 - DNA, 25 bp, Mus musculus
ctgtagggagaataaactgactgta

SEQ ID NO: 389265 - DNA, 25 bp, Mus musculus
ctgtagggatagctgaagactcttt

SEQ ID NO: 389266 - DNA, 25 bp, Mus musculus
ctgtagggataggtgaagactcttt

SEQ ID NO: 389267 - DNA, 25 bp, Mus musculus
ctgtagggattacccgccagcctgt

SEQ ID NO: 389268 - DNA, 25 bp, Mus musculus
ctgtagggattagccgccagcctgt

SEQ ID NO: 389269 - DNA, 25 bp, Mus musculus
ctgtagggcacaatgacttttcttt

SEQ ID NO: 389270 - DNA, 25 bp, Mus musculus
ctgtagggcacattgacttttcttt

SEQ ID NO: 389271 - DNA, 25 bp, Mus musculus
ctgtagggcagtatcctgccatgta

SEQ ID NO: 389272 - DNA, 25 bp, Mus musculus
ctgtagggcagtttcctgccatgta

SEQ ID NO: 389273 - DNA, 25 bp, Mus musculus
ctgtagggtagacagcatgtcaact

SEQ ID NO: 389274 - DNA, 25 bp, Mus musculus
ctgtagggtagagagcatgtcaact

SEQ ID NO: 389275 - DNA, 25 bp, Mus musculus
ctgtagggtattatgactttctgtc

SEQ ID NO: 389276 - DNA, 25 bp, Mus musculus
ctgtagggtattttgactttctgtc

SEQ ID NO: 389277 - DNA, 25 bp, Mus musculus
ctgtaggttgttacatttgttgcat

SEQ ID NO: 389278 - DNA, 25 bp, Mus musculus
ctgtaggttgtttcatttgttgcat

SEQ ID NO: 389279 - DNA, 25 bp, Mus musculus
ctgtagtactggctgataggattat

SEQ ID NO: 389280 - DNA, 25 bp, Mus musculus
ctgtagtactgggtgataggattat

SEQ ID NO: 389281 - DNA, 25 bp, Mus musculus
ctgtagtacttaccttcaaggcaga

SEQ ID NO: 389282 - DNA, 25 bp, Mus musculus
ctgtagtacttagcttcaaggcaga

SEQ ID NO: 389283 - DNA, 25 bp, Mus musculus
ctgtagtaggcacctgttggcatta

SEQ ID NO: 389284 - DNA, 25 bp, Mus musculus
ctgtagtaggcagctgttggcatta

SEQ ID NO: 389285 - DNA, 25 bp, Mus musculus
ctgtagtcagtgctttcatcatggg

SEQ ID NO: 389286 - DNA, 25 bp, Mus musculus
ctgtagtcagtggtttcatcatggg

SEQ ID NO: 389287 - DNA, 25 bp, Mus musculus
ctgtagtcggctctgcttctaaggc

SEQ ID NO: 389288 - DNA, 25 bp, Mus musculus
ctgtagtcggctgtgcttctaaggc

SEQ ID NO: 389289 - DNA, 25 bp, Mus musculus
ctgtagtctcaacacttgggctcaa

SEQ ID NO: 389290 - DNA, 25 bp, Mus musculus
ctgtagtctcaagacttgggctcaa

SEQ ID NO: 389291 - DNA, 25 bp, Mus musculus
ctgtagtctcggattctgggaggta

SEQ ID NO: 389292 - DNA, 25 bp, Mus musculus
ctgtagtctcggtttctgggaggta

SEQ ID NO: 389293 - DNA, 25 bp, Mus musculus
ctgtagtctctcaaacagctttctc

SEQ ID NO: 389294 - DNA, 25 bp, Mus musculus
ctgtagtctctctaacagctttctc

SEQ ID NO: 389295 - DNA, 25 bp, Mus musculus
ctgtagtgacacattctcagatttc

SEQ ID NO: 389296 - DNA, 25 bp, Mus musculus
ctgtagtgacactttctcagatttc

SEQ ID NO: 389297 - DNA, 25 bp, Mus musculus
ctgtagtgccaaccgggagagccct

SEQ ID NO: 389298 - DNA, 25 bp, Mus musculus
ctgtagtgccaagcgggagagccct

SEQ ID NO: 389299 - DNA, 25 bp, Mus musculus
ctgtagtggtcaaaggttctgccaa

SEQ ID NO: 389300 - DNA, 25 bp, Mus musculus
ctgtagtggtcataggttctgccaa

SEQ ID NO: 389301 - DNA, 25 bp, Mus musculus
ctgtagtgtgacatcagccttcatg

SEQ ID NO: 389302 - DNA, 25 bp, Mus musculus
ctgtagtgtgacttcagccttcatg

SEQ ID NO: 389303 - DNA, 25 bp, Mus musculus
ctgtagtgttgtatctgtttcctgt

SEQ ID NO: 389304 - DNA, 25 bp, Mus musculus
ctgtagtgttgtttctgtttcctgt

SEQ ID NO: 389305 - DNA, 25 bp, Mus musculus
ctgtagttccaactgttttagtggc

SEQ ID NO: 389306 - DNA, 25 bp, Mus musculus
ctgtagttccaagtgttttagtggc

SEQ ID NO: 389307 - DNA, 25 bp, Mus musculus
ctgtagttctaacatctctcaggaa

SEQ ID NO: 389308 - DNA, 25 bp, Mus musculus
ctgtagttctaagatctctcaggaa

SEQ ID NO: 389309 - DNA, 25 bp, Mus musculus
ctgtagttctagagaattccagcta

SEQ ID NO: 389310 - DNA, 25 bp, Mus musculus
ctgtagttctagtgaattccagcta

SEQ ID NO: 389311 - DNA, 25 bp, Mus musculus
ctgtagttgcacaagaactgagcag

SEQ ID NO: 389312 - DNA, 25 bp, Mus musculus
ctgtagttgcactagaactgagcag

SEQ ID NO: 389313 - DNA, 25 bp, Mus musculus
ctgtagttggtgactctgcacttta

SEQ ID NO: 389314 - DNA, 25 bp, Mus musculus
ctgtagttggtgtctctgcacttta

SEQ ID NO: 389315 - DNA, 25 bp, Mus musculus
ctgtagttgtaacagccaggctgtc

SEQ ID NO: 389316 - DNA, 25 bp, Mus musculus
ctgtagttgtaagagccaggctgtc

SEQ ID NO: 389317 - DNA, 25 bp, Mus musculus
ctgtagttttctatcctaggacttg

SEQ ID NO: 389318 - DNA, 25 bp, Mus musculus
ctgtagttttctttcctaggacttg

SEQ ID NO: 389319 - DNA, 25 bp, Mus musculus
ctgtataaattgaacctgttaggtt

SEQ ID NO: 389320 - DNA, 25 bp, Mus musculus
ctgtataaattgtacctgttaggtt

SEQ ID NO: 389321 - DNA, 25 bp, Mus musculus
ctgtataaccttaaatctgctgagt

SEQ ID NO: 389322 - DNA, 25 bp, Mus musculus
ctgtataacctttaatctgctgagt

SEQ ID NO: 389323 - DNA, 25 bp, Mus musculus
ctgtataaggtgctaagcgggctcc

SEQ ID NO: 389324 - DNA, 25 bp, Mus musculus
ctgtataaggtggtaagcgggctcc

SEQ ID NO: 389325 - DNA, 25 bp, Mus musculus
ctgtataatccactccagcctgaaa

SEQ ID NO: 389326 - DNA, 25 bp, Mus musculus
ctgtataatccagtccagcctgaaa

SEQ ID NO: 389327 - DNA, 25 bp, Mus musculus
ctgtataatggacgctgaccagagc

SEQ ID NO: 389328 - DNA, 25 bp, Mus musculus
ctgtataatggaggctgaccagagc

SEQ ID NO: 389329 - DNA, 25 bp, Mus musculus
ctgtatactgccatctgcttagatt

SEQ ID NO: 389330 - DNA, 25 bp, Mus musculus
ctgtatactgccttctgcttagatt

SEQ ID NO: 389331 - DNA, 25 bp, Mus musculus
ctgtatagccctctaccataaacaa

SEQ ID NO: 389332 - DNA, 25 bp, Mus musculus
ctgtatagccctgtaccataaacaa

SEQ ID NO: 389333 - DNA, 25 bp, Mus musculus
ctgtatagttagatctcctcagagc

SEQ ID NO: 389334 - DNA, 25 bp, Mus musculus
ctgtatagttagttctcctcagagc

SEQ ID NO: 389335 - DNA, 25 bp, Mus musculus
ctgtatataccgatctattgagaaa

SEQ ID NO: 389336 - DNA, 25 bp, Mus musculus
ctgtatataccgttctattgagaaa

SEQ ID NO: 389337 - DNA, 25 bp, Mus musculus
ctgtatatatctatgcagttcaatt

SEQ ID NO: 389338 - DNA, 25 bp, Mus musculus
ctgtatatatctttgcagttcaatt

SEQ ID NO: 389339 - DNA, 25 bp, Mus musculus
ctgtatatggctcgtcccacttcat

SEQ ID NO: 389340 - DNA, 25 bp, Mus musculus
ctgtatatggctggtcccacttcat

SEQ ID NO: 389341 - DNA, 25 bp, Mus musculus
ctgtatatggtcctgttattctcct

SEQ ID NO: 389342 - DNA, 25 bp, Mus musculus
ctgtatatggtcgtgttattctcct

SEQ ID NO: 389343 - DNA, 25 bp, Mus musculus
ctgtatatgtggacccaggctttgg

SEQ ID NO: 389344 - DNA, 25 bp, Mus musculus
ctgtatatgtggtcccaggctttgg

SEQ ID NO: 389345 - DNA, 25 bp, Mus musculus
ctgtatatttaaatcacatgaacta

SEQ ID NO: 389346 - DNA, 25 bp, Mus musculus
ctgtatatttaattcacatgaacta

SEQ ID NO: 389347 - DNA, 25 bp, Mus musculus
ctgtatcacacaagacgtctcgctt

SEQ ID NO: 389348 - DNA, 25 bp, Mus musculus
ctgtatcacacatgacgtctcgctt

SEQ ID NO: 389349 - DNA, 25 bp, Mus musculus
ctgtatcacggccacttcatgctag

SEQ ID NO: 389350 - DNA, 25 bp, Mus musculus
ctgtatcacggcgacttcatgctag

SEQ ID NO: 389351 - DNA, 25 bp, Mus musculus
ctgtatcactgtattttctgccaat

SEQ ID NO: 389352 - DNA, 25 bp, Mus musculus
ctgtatcactgttttttctgccaat

SEQ ID NO: 389353 - DNA, 25 bp, Mus musculus
ctgtatcataaaccacacacttagt

SEQ ID NO: 389354 - DNA, 25 bp, Mus musculus
ctgtatcataaagcacacacttagt

SEQ ID NO: 389355 - DNA, 25 bp, Mus musculus
ctgtatccaaacatgttgagtagta

SEQ ID NO: 389356 - DNA, 25 bp, Mus musculus
ctgtatccaaacttgttgagtagta

SEQ ID NO: 389357 - DNA, 25 bp, Mus musculus
ctgtatccaccaagggtgtctgtgt

SEQ ID NO: 389358 - DNA, 25 bp, Mus musculus
ctgtatccaccatgggtgtctgtgt

SEQ ID NO: 389359 - DNA, 25 bp, Mus musculus
ctgtatccagagctgggccacagag

SEQ ID NO: 389360 - DNA, 25 bp, Mus musculus
ctgtatccagaggtgggccacagag

SEQ ID NO: 389361 - DNA, 25 bp, Mus musculus
ctgtatccagttacttgctggttct

SEQ ID NO: 389362 - DNA, 25 bp, Mus musculus
ctgtatccagtttcttgctggttct

SEQ ID NO: 389363 - DNA, 25 bp, Mus musculus
ctgtatcccactagagaaaaactgt

SEQ ID NO: 389364 - DNA, 25 bp, Mus musculus
ctgtatcccacttgagaaaaactgt

SEQ ID NO: 389365 - DNA, 25 bp, Mus musculus
ctgtatccccatagggcttggtagt

SEQ ID NO: 389366 - DNA, 25 bp, Mus musculus
ctgtatccccattgggcttggtagt

SEQ ID NO: 389367 - DNA, 25 bp, Mus musculus
ctgtatcctaggagccagtggccaa

SEQ ID NO: 389368 - DNA, 25 bp, Mus musculus
ctgtatcctaggtgccagtggccaa

SEQ ID NO: 389369 - DNA, 25 bp, Mus musculus
ctgtatcctgtaactcaaggtgtaa

SEQ ID NO: 389370 - DNA, 25 bp, Mus musculus
ctgtatcctgtatctcaaggtgtaa

SEQ ID NO: 389371 - DNA, 25 bp, Mus musculus
ctgtatctaaagctccatgggatct

SEQ ID NO: 389372 - DNA, 25 bp, Mus musculus
ctgtatctaaaggtccatgggatct

SEQ ID NO: 389373 - DNA, 25 bp, Mus musculus
ctgtatctacctagctgcccggaca

SEQ ID NO: 389374 - DNA, 25 bp, Mus musculus
ctgtatctaccttgctgcccggaca

SEQ ID NO: 389375 - DNA, 25 bp, Mus musculus
ctgtatctacgccattctgtgaaag

SEQ ID NO: 389376 - DNA, 25 bp, Mus musculus
ctgtatctacgcgattctgtgaaag

SEQ ID NO: 389377 - DNA, 25 bp, Mus musculus
ctgtatctagaaagagagtccccac

SEQ ID NO: 389378 - DNA, 25 bp, Mus musculus
ctgtatctagaatgagagtccccac

SEQ ID NO: 389379 - DNA, 25 bp, Mus musculus
ctgtatctatgacgctagagaatat

SEQ ID NO: 389380 - DNA, 25 bp, Mus musculus
ctgtatctatgaggctagagaatat

SEQ ID NO: 389381 - DNA, 25 bp, Mus musculus
ctgtatctctccaatgggaaacccc

SEQ ID NO: 389382 - DNA, 25 bp, Mus musculus
ctgtatctctcctatgggaaacccc

SEQ ID NO: 389383 - DNA, 25 bp, Mus musculus
ctgtatctgaaaacggtcccaggga

SEQ ID NO: 389384 - DNA, 25 bp, Mus musculus
ctgtatctgaaatcggtcccaggga

SEQ ID NO: 389385 - DNA, 25 bp, Mus musculus
ctgtatctgaccccactgagcacag

SEQ ID NO: 389386 - DNA, 25 bp, Mus musculus
ctgtatctgaccgcactgagcacag

SEQ ID NO: 389387 - DNA, 25 bp, Mus musculus
ctgtatctgggtacatggtgtgtgt

SEQ ID NO: 389388 - DNA, 25 bp, Mus musculus
ctgtatctgggttcatggtgtgtgt

SEQ ID NO: 389389 - DNA, 25 bp, Mus musculus
ctgtatctgtgtctacgtggaccag

SEQ ID NO: 389390 - DNA, 25 bp, Mus musculus
ctgtatctgtgtgtacgtggaccag

SEQ ID NO: 389391 - DNA, 25 bp, Mus musculus
ctgtatcttaacatctctgacagct

SEQ ID NO: 389392 - DNA, 25 bp, Mus musculus
ctgtatcttaacttctctgacagct

SEQ ID NO: 389393 - DNA, 25 bp, Mus musculus
ctgtatcttgctcgaaagaacccaa

SEQ ID NO: 389394 - DNA, 25 bp, Mus musculus
ctgtatcttgctggaaagaacccaa

SEQ ID NO: 389395 - DNA, 25 bp, Mus musculus
ctgtatgaagagatctctacaccta

SEQ ID NO: 389396 - DNA, 25 bp, Mus musculus
ctgtatgaagagttctctacaccta

SEQ ID NO: 389397 - DNA, 25 bp, Mus musculus
ctgtatgaaggtctcagaagttctg

SEQ ID NO: 389398 - DNA, 25 bp, Mus musculus
ctgtatgaaggtgtcagaagttctg

SEQ ID NO: 389399 - DNA, 25 bp, Mus musculus
ctgtatgactctcctcaaagtgtgt

SEQ ID NO: 389400 - DNA, 25 bp, Mus musculus
ctgtatgactctgctcaaagtgtgt

SEQ ID NO: 389401 - DNA, 25 bp, Mus musculus
ctgtatgagcttcgattctgggcac

SEQ ID NO: 389402 - DNA, 25 bp, Mus musculus
ctgtatgagcttggattctgggcac

SEQ ID NO: 389403 - DNA, 25 bp, Mus musculus
ctgtatgatatcaacctcaggatga

SEQ ID NO: 389404 - DNA, 25 bp, Mus musculus
ctgtatgatatcaagttcctggaac

SEQ ID NO: 389405 - DNA, 25 bp, Mus musculus
ctgtatgatatctacctcaggatga

SEQ ID NO: 389406 - DNA, 25 bp, Mus musculus
ctgtatgatatctagttcctggaac

SEQ ID NO: 389407 - DNA, 25 bp, Mus musculus
ctgtatgattctcgacgagtcactt

SEQ ID NO: 389408 - DNA, 25 bp, Mus musculus
ctgtatgattctggacgagtcactt

SEQ ID NO: 389409 - DNA, 25 bp, Mus musculus
ctgtatgcaaatccactgtgtcctt

SEQ ID NO: 389410 - DNA, 25 bp, Mus musculus
ctgtatgcaaatgcactgtgtcctt

SEQ ID NO: 389411 - DNA, 25 bp, Mus musculus
ctgtatgcaagaccctaacccagca

SEQ ID NO: 389412 - DNA, 25 bp, Mus musculus
ctgtatgcaagagcctaacccagca

SEQ ID NO: 389413 - DNA, 25 bp, Mus musculus
ctgtatgcagctagtcatctggaag

SEQ ID NO: 389414 - DNA, 25 bp, Mus musculus
ctgtatgcagcttgtcatctggaag

SEQ ID NO: 389415 - DNA, 25 bp, Mus musculus
ctgtatgccggaaagttgctctgcc

SEQ ID NO: 389416 - DNA, 25 bp, Mus musculus
ctgtatgccggatagttgctctgcc

SEQ ID NO: 389417 - DNA, 25 bp, Mus musculus
ctgtatgcggcgatgcgcatcaatt

SEQ ID NO: 389418 - DNA, 25 bp, Mus musculus
ctgtatgcggcgttgcgcatcaatt

SEQ ID NO: 389419 - DNA, 25 bp, Mus musculus
ctgtatgctcctcgccctgagaggg

SEQ ID NO: 389420 - DNA, 25 bp, Mus musculus
ctgtatgctcctggccctgagaggg

SEQ ID NO: 389421 - DNA, 25 bp, Mus musculus
ctgtatggacatatcctcccacgcc

SEQ ID NO: 389422 - DNA, 25 bp, Mus musculus
ctgtatggacatttcctcccacgcc

SEQ ID NO: 389423 - DNA, 25 bp, Mus musculus
ctgtatggacttcagatggcttcat

SEQ ID NO: 389424 - DNA, 25 bp, Mus musculus
ctgtatggacttgagatggcttcat

SEQ ID NO: 389425 - DNA, 25 bp, Mus musculus
ctgtatggccttcaactaaactatg

SEQ ID NO: 389426 - DNA, 25 bp, Mus musculus
ctgtatggccttgaactaaactatg

SEQ ID NO: 389427 - DNA, 25 bp, Mus musculus
ctgtatggctgcaaggaagaagaaa

SEQ ID NO: 389428 - DNA, 25 bp, Mus musculus
ctgtatggctgctaggaagaagaaa

SEQ ID NO: 389429 - DNA, 25 bp, Mus musculus
ctgtatgggacactatggcctcaga

SEQ ID NO: 389430 - DNA, 25 bp, Mus musculus
ctgtatgggacagtatggcctcaga

SEQ ID NO: 389431 - DNA, 25 bp, Mus musculus
ctgtatggtggacatgtttctgaca

SEQ ID NO: 389432 - DNA, 25 bp, Mus musculus
ctgtatggtggagatgtttctgaca

SEQ ID NO: 389433 - DNA, 25 bp, Mus musculus
ctgtatggtttacgaaattgctttt

SEQ ID NO: 389434 - DNA, 25 bp, Mus musculus
ctgtatggtttaggaaattgctttt

SEQ ID NO: 389435 - DNA, 25 bp, Mus musculus
ctgtatgtaacacccacacatggga

SEQ ID NO: 389436 - DNA, 25 bp, Mus musculus
ctgtatgtaacagccacacatggga

SEQ ID NO: 389437 - DNA, 25 bp, Mus musculus
ctgtatgtagccctcatgttagact

SEQ ID NO: 389438 - DNA, 25 bp, Mus musculus
ctgtatgtagccgtcatgttagact

SEQ ID NO: 389439 - DNA, 25 bp, Mus musculus
ctgtatgtagttacataggcactgt

SEQ ID NO: 389440 - DNA, 25 bp, Mus musculus
ctgtatgtagtttcataggcactgt

SEQ ID NO: 389441 - DNA, 25 bp, Mus musculus
ctgtatgtccgaccccgagggagac

SEQ ID NO: 389442 - DNA, 25 bp, Mus musculus
ctgtatgtccgagcccgagggagac

SEQ ID NO: 389443 - DNA, 25 bp, Mus musculus
ctgtatgtcttgaaactctatgata

SEQ ID NO: 389444 - DNA, 25 bp, Mus musculus
ctgtatgtcttgtaactctatgata

SEQ ID NO: 389445 - DNA, 25 bp, Mus musculus
ctgtatgtgcctatctttcagcttc

SEQ ID NO: 389446 - DNA, 25 bp, Mus musculus
ctgtatgtgcctttctttcagcttc

SEQ ID NO: 389447 - DNA, 25 bp, Mus musculus
ctgtatgtgcttatgttagtctcaa

SEQ ID NO: 389448 - DNA, 25 bp, Mus musculus
ctgtatgtgcttttgttagtctcaa

SEQ ID NO: 389449 - DNA, 25 bp, Mus musculus
ctgtatgtgtgcactccggtgaaga

SEQ ID NO: 389450 - DNA, 25 bp, Mus musculus
ctgtatgtgtgctctccggtgaaga

SEQ ID NO: 389451 - DNA, 25 bp, Mus musculus
ctgtatgttcatctctgggtcattt

SEQ ID NO: 389452 - DNA, 25 bp, Mus musculus
ctgtatgttcatgtctgggtcattt

SEQ ID NO: 389453 - DNA, 25 bp, Mus musculus
ctgtatgttcttagagccgctcttg

SEQ ID NO: 389454 - DNA, 25 bp, Mus musculus
ctgtatgttctttgagccgctcttg

SEQ ID NO: 389455 - DNA, 25 bp, Mus musculus
ctgtatgtttggaagcctgctttca

SEQ ID NO: 389456 - DNA, 25 bp, Mus musculus
ctgtatgtttggtagcctgctttca

SEQ ID NO: 389457 - DNA, 25 bp, Mus musculus
ctgtattatttacacttgtatttag

SEQ ID NO: 389458 - DNA, 25 bp, Mus musculus
ctgtattatttagacttgtatttag

SEQ ID NO: 389459 - DNA, 25 bp, Mus musculus
ctgtattcacctattctgtctttct

SEQ ID NO: 389460 - DNA, 25 bp, Mus musculus
ctgtattcaccttttctgtctttct

SEQ ID NO: 389461 - DNA, 25 bp, Mus musculus
ctgtattcatctaagggcctgggag

SEQ ID NO: 389462 - DNA, 25 bp, Mus musculus
ctgtattcatcttagggcctgggag

SEQ ID NO: 389463 - DNA, 25 bp, Mus musculus
ctgtattcccagaggcaggcagaat

SEQ ID NO: 389464 - DNA, 25 bp, Mus musculus
ctgtattcccagtggcaggcagaat

SEQ ID NO: 389465 - DNA, 25 bp, Mus musculus
ctgtattgacctctattcagctgct

SEQ ID NO: 389466 - DNA, 25 bp, Mus musculus
ctgtattgacctgtattcagctgct

SEQ ID NO: 389467 - DNA, 25 bp, Mus musculus
ctgtattgccctatcttgtggtata

SEQ ID NO: 389468 - DNA, 25 bp, Mus musculus
ctgtattgccctttcttgtggtata

SEQ ID NO: 389469 - DNA, 25 bp, Mus musculus
ctgtattgcttaaaacgatacttga

SEQ ID NO: 389470 - DNA, 25 bp, Mus musculus
ctgtattgcttataacgatacttga

SEQ ID NO: 389471 - DNA, 25 bp, Mus musculus
ctgtattggcataggtgtgtgacaa

SEQ ID NO: 389472 - DNA, 25 bp, Mus musculus
ctgtattggcattggtgtgtgacaa

SEQ ID NO: 389473 - DNA, 25 bp, Mus musculus
ctgtattgtgtaaagccggtgtccc

SEQ ID NO: 389474 - DNA, 25 bp, Mus musculus
ctgtattgtgtatagccggtgtccc

SEQ ID NO: 389475 - DNA, 25 bp, Mus musculus
ctgtattgtttaaaatctttgtgga

SEQ ID NO: 389476 - DNA, 25 bp, Mus musculus
ctgtattgtttataatctttgtgga

SEQ ID NO: 389477 - DNA, 25 bp, Mus musculus
ctgtatttaaagctcgtcttgaact

SEQ ID NO: 389478 - DNA, 25 bp, Mus musculus
ctgtatttaaaggtcgtcttgaact

SEQ ID NO: 389479 - DNA, 25 bp, Mus musculus
ctgtatttacttctagtccttgtgt

SEQ ID NO: 389480 - DNA, 25 bp, Mus musculus
ctgtatttacttgtagtccttgtgt

SEQ ID NO: 389481 - DNA, 25 bp, Mus musculus
ctgtatttcacaccccagctagaat

SEQ ID NO: 389482 - DNA, 25 bp, Mus musculus
ctgtatttcacagcccagctagaat

SEQ ID NO: 389483 - DNA, 25 bp, Mus musculus
ctgtatttctgtcacattgtggcag

SEQ ID NO: 389484 - DNA, 25 bp, Mus musculus
ctgtatttctgtgacattgtggcag

SEQ ID NO: 389485 - DNA, 25 bp, Mus musculus
ctgtatttcttgcttccctggtgaa

SEQ ID NO: 389486 - DNA, 25 bp, Mus musculus
ctgtatttcttggttccctggtgaa

SEQ ID NO: 389487 - DNA, 25 bp, Mus musculus
ctgtatttgattaaggcagcagaaa

SEQ ID NO: 389488 - DNA, 25 bp, Mus musculus
ctgtatttgatttaggcagcagaaa

SEQ ID NO: 389489 - DNA, 25 bp, Mus musculus
ctgtatttgtggcacttgctaaatt

SEQ ID NO: 389490 - DNA, 25 bp, Mus musculus
ctgtatttgtgggacttgctaaatt

SEQ ID NO: 389491 - DNA, 25 bp, Mus musculus
ctgtattttacaccagtttcataga

SEQ ID NO: 389492 - DNA, 25 bp, Mus musculus
ctgtattttacagcagtttcataga

SEQ ID NO: 389493 - DNA, 25 bp, Mus musculus
ctgtattttttgctttctggtgtga

SEQ ID NO: 389494 - DNA, 25 bp, Mus musculus
ctgtattttttggtttctggtgtga

SEQ ID NO: 389495 - DNA, 25 bp, Mus musculus
ctgtcaaaaattcagtcacgtccga

SEQ ID NO: 389496 - DNA, 25 bp, Mus musculus
ctgtcaaaaattgagtcacgtccga

SEQ ID NO: 389497 - DNA, 25 bp, Mus musculus
ctgtcaaaatgtacacctttccttc

SEQ ID NO: 389498 - DNA, 25 bp, Mus musculus
ctgtcaaaatgttcacctttccttc

SEQ ID NO: 389499 - DNA, 25 bp, Mus musculus
ctgtcaaactgtctggcaatcccaa

SEQ ID NO: 389500 - DNA, 25 bp, Mus musculus
ctgtcaaactgtgtggcaatcccaa

SEQ ID NO: 389501 - DNA, 25 bp, Mus musculus
ctgtcaaagcgcaagccagccaggg

SEQ ID NO: 389502 - DNA, 25 bp, Mus musculus
ctgtcaaagcgctagccagccaggg

SEQ ID NO: 389503 - DNA, 25 bp, Mus musculus
ctgtcaaagctgacgggcgactcag

SEQ ID NO: 389504 - DNA, 25 bp, Mus musculus
ctgtcaaagctgtcgggcgactcag

SEQ ID NO: 389505 - DNA, 25 bp, Mus musculus
ctgtcaacaattaaaccgccaagaa

SEQ ID NO: 389506 - DNA, 25 bp, Mus musculus
ctgtcaacaatttaaccgccaagaa

SEQ ID NO: 389507 - DNA, 25 bp, Mus musculus
ctgtcaacctctagctgatatcagc

SEQ ID NO: 389508 - DNA, 25 bp, Mus musculus
ctgtcaacctcttgctgatatcagc

SEQ ID NO: 389509 - DNA, 25 bp, Mus musculus
ctgtcaagaagcctgtttaccgtaa

SEQ ID NO: 389510 - DNA, 25 bp, Mus musculus
ctgtcaagaagcgtgtttaccgtaa

SEQ ID NO: 389511 - DNA, 25 bp, Mus musculus
ctgtcaagaatgagcccgagaatct

SEQ ID NO: 389512 - DNA, 25 bp, Mus musculus
ctgtcaagaatgtgcccgagaatct

SEQ ID NO: 389513 - DNA, 25 bp, Mus musculus
ctgtcaagagccacaggatttctga

SEQ ID NO: 389514 - DNA, 25 bp, Mus musculus
ctgtcaagagcctcaggatttctga

SEQ ID NO: 389515 - DNA, 25 bp, Mus musculus
ctgtcaagcaacaccagttgccatt

SEQ ID NO: 389516 - DNA, 25 bp, Mus musculus
ctgtcaagcaactccagttgccatt

SEQ ID NO: 389517 - DNA, 25 bp, Mus musculus
ctgtcaagcattccaggccatgaga

SEQ ID NO: 389518 - DNA, 25 bp, Mus musculus
ctgtcaagcattgcaggccatgaga

SEQ ID NO: 389519 - DNA, 25 bp, Mus musculus
ctgtcaagccttccaggtcagaaat

SEQ ID NO: 389520 - DNA, 25 bp, Mus musculus
ctgtcaagccttgcaggtcagaaat

SEQ ID NO: 389521 - DNA, 25 bp, Mus musculus
ctgtcaaggttaattaaagtcttct

SEQ ID NO: 389522 - DNA, 25 bp, Mus musculus
ctgtcaaggttatttaaagtcttct

SEQ ID NO: 389523 - DNA, 25 bp, Mus musculus
ctgtcaagttcaatgcgctggagct

SEQ ID NO: 389524 - DNA, 25 bp, Mus musculus
ctgtcaagttcattgcgctggagct

SEQ ID NO: 389525 - DNA, 25 bp, Mus musculus
ctgtcaataggcatcttgtactatt

SEQ ID NO: 389526 - DNA, 25 bp, Mus musculus
ctgtcaataggcttcttgtactatt

SEQ ID NO: 389527 - DNA, 25 bp, Mus musculus
ctgtcaatatatcaggaaattcaat

SEQ ID NO: 389528 - DNA, 25 bp, Mus musculus
ctgtcaatatatgaggaaattcaat

SEQ ID NO: 389529 - DNA, 25 bp, Mus musculus
ctgtcaatatggctggcgtctatcc

SEQ ID NO: 389530 - DNA, 25 bp, Mus musculus
ctgtcaatatgggtggcgtctatcc

SEQ ID NO: 389531 - DNA, 25 bp, Mus musculus
ctgtcaatcggactacctattggat

SEQ ID NO: 389532 - DNA, 25 bp, Mus musculus
ctgtcaatcggagtacctattggat

SEQ ID NO: 389533 - DNA, 25 bp, Mus musculus
ctgtcacaacagaacgagattgaaa

SEQ ID NO: 389534 - DNA, 25 bp, Mus musculus
ctgtcacaacagtacgagattgaaa

SEQ ID NO: 389535 - DNA, 25 bp, Mus musculus
ctgtcacactagctgctgccaaaaa

SEQ ID NO: 389536 - DNA, 25 bp, Mus musculus
ctgtcacactaggtgctgccaaaaa

SEQ ID NO: 389537 - DNA, 25 bp, Mus musculus
ctgtcacagtgcaatccaagggtta

SEQ ID NO: 389538 - DNA, 25 bp, Mus musculus
ctgtcacagtgctatccaagggtta

SEQ ID NO: 389539 - DNA, 25 bp, Mus musculus
ctgtcacatcagatctagggatcga

SEQ ID NO: 389540 - DNA, 25 bp, Mus musculus
ctgtcacatcagttctagggatcga

SEQ ID NO: 389541 - DNA, 25 bp, Mus musculus
ctgtcacattgtcgcagcacctctg

SEQ ID NO: 389542 - DNA, 25 bp, Mus musculus
ctgtcacattgtggcagcacctctg

SEQ ID NO: 389543 - DNA, 25 bp, Mus musculus
ctgtcacattttcttgggaaggatt

SEQ ID NO: 389544 - DNA, 25 bp, Mus musculus
ctgtcacattttgttgggaaggatt

SEQ ID NO: 389545 - DNA, 25 bp, Mus musculus
ctgtcaccaaatatcaactcctgta

SEQ ID NO: 389546 - DNA, 25 bp, Mus musculus
ctgtcaccaaatttcaactcctgta

SEQ ID NO: 389547 - DNA, 25 bp, Mus musculus
ctgtcaccaagacgaggcagattca

SEQ ID NO: 389548 - DNA, 25 bp, Mus musculus
ctgtcaccaagaggaggcagattca

SEQ ID NO: 389549 - DNA, 25 bp, Mus musculus
ctgtcaccatgccaaccaaaacaag

SEQ ID NO: 389550 - DNA, 25 bp, Mus musculus
ctgtcaccatgcgaaccaaaacaag

SEQ ID NO: 389551 - DNA, 25 bp, Mus musculus
ctgtcaccccacatctgagaagaat

SEQ ID NO: 389552 - DNA, 25 bp, Mus musculus
ctgtcaccccacttctgagaagaat

SEQ ID NO: 389553 - DNA, 25 bp, Mus musculus
ctgtcaccccagagtgttgagatga

SEQ ID NO: 389554 - DNA, 25 bp, Mus musculus
ctgtcaccccagtgtgttgagatga

SEQ ID NO: 389555 - DNA, 25 bp, Mus musculus
ctgtcacccctgcagttgggttagt

SEQ ID NO: 389556 - DNA, 25 bp, Mus musculus
ctgtcacccctggagttgggttagt

SEQ ID NO: 389557 - DNA, 25 bp, Mus musculus
ctgtcaccgggtctgctgtttttct

SEQ ID NO: 389558 - DNA, 25 bp, Mus musculus
ctgtcaccgggtgtgctgtttttct

SEQ ID NO: 389559 - DNA, 25 bp, Mus musculus
ctgtcaccttccagctagcttaaaa

SEQ ID NO: 389560 - DNA, 25 bp, Mus musculus
ctgtcaccttcctgctagcttaaaa

SEQ ID NO: 389561 - DNA, 25 bp, Mus musculus
ctgtcaccttctcgtacccagtaga

SEQ ID NO: 389562 - DNA, 25 bp, Mus musculus
ctgtcaccttctggtacccagtaga

SEQ ID NO: 389563 - DNA, 25 bp, Mus musculus
ctgtcaccttgcaggatggcacaaa

SEQ ID NO: 389564 - DNA, 25 bp, Mus musculus
ctgtcaccttgctggatggcacaaa

SEQ ID NO: 389565 - DNA, 25 bp, Mus musculus
ctgtcactaaaacacgtgttcccac

SEQ ID NO: 389566 - DNA, 25 bp, Mus musculus
ctgtcactaaaagacgtgttcccac

SEQ ID NO: 389567 - DNA, 25 bp, Mus musculus
ctgtcactaaggacgcactgaggac

SEQ ID NO: 389568 - DNA, 25 bp, Mus musculus
ctgtcactaaggtcgcactgaggac

SEQ ID NO: 389569 - DNA, 25 bp, Mus musculus
ctgtcactatggctgcccagttggg

SEQ ID NO: 389570 - DNA, 25 bp, Mus musculus
ctgtcactatgggtgcccagttggg

SEQ ID NO: 389571 - DNA, 25 bp, Mus musculus
ctgtcactcggaatcggcaaacttt

SEQ ID NO: 389572 - DNA, 25 bp, Mus musculus
ctgtcactcggattcggcaaacttt

SEQ ID NO: 389573 - DNA, 25 bp, Mus musculus
ctgtcactctatcgctggccgactt

SEQ ID NO: 389574 - DNA, 25 bp, Mus musculus
ctgtcactctatggctggccgactt

SEQ ID NO: 389575 - DNA, 25 bp, Mus musculus
ctgtcactgacacctgggtgtagag

SEQ ID NO: 389576 - DNA, 25 bp, Mus musculus
ctgtcactgacagctgggtgtagag

SEQ ID NO: 389577 - DNA, 25 bp, Mus musculus
ctgtcactgatgctggcgatgatgc

SEQ ID NO: 389578 - DNA, 25 bp, Mus musculus
ctgtcactgatggtggcgatgatgc

SEQ ID NO: 389579 - DNA, 25 bp, Mus musculus
ctgtcactgctgctattgaaccaac

SEQ ID NO: 389580 - DNA, 25 bp, Mus musculus
ctgtcactgctggtattgaaccaac

SEQ ID NO: 389581 - DNA, 25 bp, Mus musculus
ctgtcactggacagttgcaatccta

SEQ ID NO: 389582 - DNA, 25 bp, Mus musculus
ctgtcactggactgttgcaatccta

SEQ ID NO: 389583 - DNA, 25 bp, Mus musculus
ctgtcactgtctattaaagactccc

SEQ ID NO: 389584 - DNA, 25 bp, Mus musculus
ctgtcactgtcttttaaagactccc

SEQ ID NO: 389585 - DNA, 25 bp, Mus musculus
ctgtcacttaacaaactgctcttgg

SEQ ID NO: 389586 - DNA, 25 bp, Mus musculus
ctgtcacttaactaactgctcttgg

SEQ ID NO: 389587 - DNA, 25 bp, Mus musculus
ctgtcacttactacttgtgtgtggc

SEQ ID NO: 389588 - DNA, 25 bp, Mus musculus
ctgtcacttacttcttgtgtgtggc

SEQ ID NO: 389589 - DNA, 25 bp, Mus musculus
ctgtcacttgaaacctgtagctgtc

SEQ ID NO: 389590 - DNA, 25 bp, Mus musculus
ctgtcacttgaatcctgtagctgtc

SEQ ID NO: 389591 - DNA, 25 bp, Mus musculus
ctgtcagaagaaaagcgccctatgg

SEQ ID NO: 389592 - DNA, 25 bp, Mus musculus
ctgtcagaagaatagcgccctatgg

SEQ ID NO: 389593 - DNA, 25 bp, Mus musculus
ctgtcagaattactttcaatcaata

SEQ ID NO: 389594 - DNA, 25 bp, Mus musculus
ctgtcagaattagtttcaatcaata

SEQ ID NO: 389595 - DNA, 25 bp, Mus musculus
ctgtcagactgaaatcttgtacact

SEQ ID NO: 389596 - DNA, 25 bp, Mus musculus
ctgtcagactgatatcttgtacact

SEQ ID NO: 389597 - DNA, 25 bp, Mus musculus
ctgtcagagagaaggccgccgtagc

SEQ ID NO: 389598 - DNA, 25 bp, Mus musculus
ctgtcagagagatggccgccgtagc

SEQ ID NO: 389599 - DNA, 25 bp, Mus musculus
ctgtcagataataccggctagagat

SEQ ID NO: 389600 - DNA, 25 bp, Mus musculus
ctgtcagataattccggctagagat

SEQ ID NO: 389601 - DNA, 25 bp, Mus musculus
ctgtcagatggaattggttgggttc

SEQ ID NO: 389602 - DNA, 25 bp, Mus musculus
ctgtcagatggatttggttgggttc

SEQ ID NO: 389603 - DNA, 25 bp, Mus musculus
ctgtcagcacagaagggagcttccg

SEQ ID NO: 389604 - DNA, 25 bp, Mus musculus
ctgtcagcacagtagggagcttccg

SEQ ID NO: 389605 - DNA, 25 bp, Mus musculus
ctgtcagcagaaccaaggggcctcc

SEQ ID NO: 389606 - DNA, 25 bp, Mus musculus
ctgtcagcagaagcaaggggcctcc

SEQ ID NO: 389607 - DNA, 25 bp, Mus musculus
ctgtcagcagctattatatatacat

SEQ ID NO: 389608 - DNA, 25 bp, Mus musculus
ctgtcagcagcttttatatatacat

SEQ ID NO: 389609 - DNA, 25 bp, Mus musculus
ctgtcagcggttagtggagaagtac

SEQ ID NO: 389610 - DNA, 25 bp, Mus musculus
ctgtcagcggtttgtggagaagtac

SEQ ID NO: 389611 - DNA, 25 bp, Mus musculus
ctgtcagcttgacaattgggcctat

SEQ ID NO: 389612 - DNA, 25 bp, Mus musculus
ctgtcagcttgagaattgggcctat

SEQ ID NO: 389613 - DNA, 25 bp, Mus musculus
ctgtcaggagcacccctcgtgagat

SEQ ID NO: 389614 - DNA, 25 bp, Mus musculus
ctgtcaggagcagccctcgtgagat

SEQ ID NO: 389615 - DNA, 25 bp, Mus musculus
ctgtcaggccagaattcttcagtga

SEQ ID NO: 389616 - DNA, 25 bp, Mus musculus
ctgtcaggccagtattcttcagtga

SEQ ID NO: 389617 - DNA, 25 bp, Mus musculus
ctgtcaggctcaccgttcatttgac

SEQ ID NO: 389618 - DNA, 25 bp, Mus musculus
ctgtcaggctcagcgttcatttgac

SEQ ID NO: 389619 - DNA, 25 bp, Mus musculus
ctgtcagggcccagggtagttctat

SEQ ID NO: 389620 - DNA, 25 bp, Mus musculus
ctgtcagggccctgggtagttctat

SEQ ID NO: 389621 - DNA, 25 bp, Mus musculus
ctgtcagggtataaacactgttcct

SEQ ID NO: 389622 - DNA, 25 bp, Mus musculus
ctgtcagggtattaacactgttcct

SEQ ID NO: 389623 - DNA, 25 bp, Mus musculus
ctgtcaggtctgagttgatgcttta

SEQ ID NO: 389624 - DNA, 25 bp, Mus musculus
ctgtcaggtctgtgttgatgcttta

SEQ ID NO: 389625 - DNA, 25 bp, Mus musculus
ctgtcagtagctagggtgccccaga

SEQ ID NO: 389626 - DNA, 25 bp, Mus musculus
ctgtcagtagcttgggtgccccaga

SEQ ID NO: 389627 - DNA, 25 bp, Mus musculus
ctgtcagtccatcgtttcacatcag

SEQ ID NO: 389628 - DNA, 25 bp, Mus musculus
ctgtcagtccatggtttcacatcag

SEQ ID NO: 389629 - DNA, 25 bp, Mus musculus
ctgtcagtccccaaatggttctatt

SEQ ID NO: 389630 - DNA, 25 bp, Mus musculus
ctgtcagtcccctaatggttctatt

SEQ ID NO: 389631 - DNA, 25 bp, Mus musculus
ctgtcagtcttcctgtgttattcaa

SEQ ID NO: 389632 - DNA, 25 bp, Mus musculus
ctgtcagtcttcgtgtgttattcaa

SEQ ID NO: 389633 - DNA, 25 bp, Mus musculus
ctgtcagtgacaacacattctgtga

SEQ ID NO: 389634 - DNA, 25 bp, Mus musculus
ctgtcagtgacatcacattctgtga

SEQ ID NO: 389635 - DNA, 25 bp, Mus musculus
ctgtcagttaatacgggtcagcccc

SEQ ID NO: 389636 - DNA, 25 bp, Mus musculus
ctgtcagttaattcgggtcagcccc

SEQ ID NO: 389637 - DNA, 25 bp, Mus musculus
ctgtcataatagatcatctcgggta

SEQ ID NO: 389638 - DNA, 25 bp, Mus musculus
ctgtcataatagttcatctcgggta

SEQ ID NO: 389639 - DNA, 25 bp, Mus musculus
ctgtcatcaactctctaggattgtt

SEQ ID NO: 389640 - DNA, 25 bp, Mus musculus
ctgtcatcaactgtctaggattgtt

SEQ ID NO: 389641 - DNA, 25 bp, Mus musculus
ctgtcatcaatcattctatgtgctg

SEQ ID NO: 389642 - DNA, 25 bp, Mus musculus
ctgtcatcaatctttctatgtgctg

SEQ ID NO: 389643 - DNA, 25 bp, Mus musculus
ctgtcatcagacagctttgctcact

SEQ ID NO: 389644 - DNA, 25 bp, Mus musculus
ctgtcatcagactgctttgctcact

SEQ ID NO: 389645 - DNA, 25 bp, Mus musculus
ctgtcatcagccatcactaatctat

SEQ ID NO: 389646 - DNA, 25 bp, Mus musculus
ctgtcatcagccttcactaatctat

SEQ ID NO: 389647 - DNA, 25 bp, Mus musculus
ctgtcatccagaccacgtatggtat

SEQ ID NO: 389648 - DNA, 25 bp, Mus musculus
ctgtcatccagagcacgtatggtat

SEQ ID NO: 389649 - DNA, 25 bp, Mus musculus
ctgtcatcccctagtatcggtagag

SEQ ID NO: 389650 - DNA, 25 bp, Mus musculus
ctgtcatccccttgtatcggtagag

SEQ ID NO: 389651 - DNA, 25 bp, Mus musculus
ctgtcatccgatctgttagcgaaca

SEQ ID NO: 389652 - DNA, 25 bp, Mus musculus
ctgtcatccgatgtgttagcgaaca

SEQ ID NO: 389653 - DNA, 25 bp, Mus musculus
ctgtcatcctagaaaataaagcgtt

SEQ ID NO: 389654 - DNA, 25 bp, Mus musculus
ctgtcatcctagtaaataaagcgtt

SEQ ID NO: 389655 - DNA, 25 bp, Mus musculus
ctgtcatcctgtagtgtggcgcttg

SEQ ID NO: 389656 - DNA, 25 bp, Mus musculus
ctgtcatcctgttgtgtggcgcttg

SEQ ID NO: 389657 - DNA, 25 bp, Mus musculus
ctgtcatcgtgaaggccaaattctt

SEQ ID NO: 389658 - DNA, 25 bp, Mus musculus
ctgtcatcgtgatggccaaattctt

SEQ ID NO: 389659 - DNA, 25 bp, Mus musculus
ctgtcatcgtgcagcggttaacata

SEQ ID NO: 389660 - DNA, 25 bp, Mus musculus
ctgtcatcgtgctgcggttaacata

SEQ ID NO: 389661 - DNA, 25 bp, Mus musculus
ctgtcatctcaaatatcctccaaag

SEQ ID NO: 389662 - DNA, 25 bp, Mus musculus
ctgtcatctcaattatcctccaaag

SEQ ID NO: 389663 - DNA, 25 bp, Mus musculus
ctgtcatctcagcaagtcctaagga

SEQ ID NO: 389664 - DNA, 25 bp, Mus musculus
ctgtcatctcaggaagtcctaagga

SEQ ID NO: 389665 - DNA, 25 bp, Mus musculus
ctgtcatctctgcttgtgataggat

SEQ ID NO: 389666 - DNA, 25 bp, Mus musculus
ctgtcatctctggttgtgataggat

SEQ ID NO: 389667 - DNA, 25 bp, Mus musculus
ctgtcatcttacctgtagtctagtg

SEQ ID NO: 389668 - DNA, 25 bp, Mus musculus
ctgtcatcttacgtgtagtctagtg

SEQ ID NO: 389669 - DNA, 25 bp, Mus musculus
ctgtcatcttccaagttacatctac

SEQ ID NO: 389670 - DNA, 25 bp, Mus musculus
ctgtcatcttcctagttacatctac

SEQ ID NO: 389671 - DNA, 25 bp, Mus musculus
ctgtcatgaaggctaaccggatggc

SEQ ID NO: 389672 - DNA, 25 bp, Mus musculus
ctgtcatgaagggtaaccggatggc

SEQ ID NO: 389673 - DNA, 25 bp, Mus musculus
ctgtcatgacagcaggtagccctga

SEQ ID NO: 389674 - DNA, 25 bp, Mus musculus
ctgtcatgacaggaggtagccctga

SEQ ID NO: 389675 - DNA, 25 bp, Mus musculus
ctgtcatggaacaagctctgttgat

SEQ ID NO: 389676 - DNA, 25 bp, Mus musculus
ctgtcatggaactagctctgttgat

SEQ ID NO: 389677 - DNA, 25 bp, Mus musculus
ctgtcatggcttcttgctgtcttac

SEQ ID NO: 389678 - DNA, 25 bp, Mus musculus
ctgtcatggcttgttgctgtcttac

SEQ ID NO: 389679 - DNA, 25 bp, Mus musculus
ctgtcatggtatccatgggctggat

SEQ ID NO: 389680 - DNA, 25 bp, Mus musculus
ctgtcatggtatgcatgggctggat

SEQ ID NO: 389681 - DNA, 25 bp, Mus musculus
ctgtcatggttaaatcatccgcctg

SEQ ID NO: 389682 - DNA, 25 bp, Mus musculus
ctgtcatggttatatcatccgcctg

SEQ ID NO: 389683 - DNA, 25 bp, Mus musculus
ctgtcatgtaaacctgccccttaaa

SEQ ID NO: 389684 - DNA, 25 bp, Mus musculus
ctgtcatgtaaagctgccccttaaa

SEQ ID NO: 389685 - DNA, 25 bp, Mus musculus
ctgtcatgtcttatcaactgtctta

SEQ ID NO: 389686 - DNA, 25 bp, Mus musculus
ctgtcatgtcttttcaactgtctta

SEQ ID NO: 389687 - DNA, 25 bp, Mus musculus
ctgtcattatgcagctggtgctttt

SEQ ID NO: 389688 - DNA, 25 bp, Mus musculus
ctgtcattatgctgctggtgctttt

SEQ ID NO: 389689 - DNA, 25 bp, Mus musculus
ctgtcattccaaactttaagatttc

SEQ ID NO: 389690 - DNA, 25 bp, Mus musculus
ctgtcattccaatctttaagatttc

SEQ ID NO: 389691 - DNA, 25 bp, Mus musculus
ctgtcattccccagaagttctgagt

SEQ ID NO: 389692 - DNA, 25 bp, Mus musculus
ctgtcattcccctgaagttctgagt

SEQ ID NO: 389693 - DNA, 25 bp, Mus musculus
ctgtcattcgctcatcctttatgta

SEQ ID NO: 389694 - DNA, 25 bp, Mus musculus
ctgtcattcgctgatcctttatgta

SEQ ID NO: 389695 - DNA, 25 bp, Mus musculus
ctgtcattctctctgcatgcacatg

SEQ ID NO: 389696 - DNA, 25 bp, Mus musculus
ctgtcattctctgtgcatgcacatg

SEQ ID NO: 389697 - DNA, 25 bp, Mus musculus
ctgtcattcttaaggcagggcccag

SEQ ID NO: 389698 - DNA, 25 bp, Mus musculus
ctgtcattcttatggcagggcccag

SEQ ID NO: 389699 - DNA, 25 bp, Mus musculus
ctgtcattctttccattgtgccaaa

SEQ ID NO: 389700 - DNA, 25 bp, Mus musculus
ctgtcattctttgcattgtgccaaa

SEQ ID NO: 389701 - DNA, 25 bp, Mus musculus
ctgtcattgcttcctctagtcctag

SEQ ID NO: 389702 - DNA, 25 bp, Mus musculus
ctgtcattgcttgctctagtcctag

SEQ ID NO: 389703 - DNA, 25 bp, Mus musculus
ctgtcattgtgaactttgctgttag

SEQ ID NO: 389704 - DNA, 25 bp, Mus musculus
ctgtcattgtgatctttgctgttag

SEQ ID NO: 389705 - DNA, 25 bp, Mus musculus
ctgtcattgttaaatcatcctgcct

SEQ ID NO: 389706 - DNA, 25 bp, Mus musculus
ctgtcattgttatatcatcctgcct

SEQ ID NO: 389707 - DNA, 25 bp, Mus musculus
ctgtccaaactgacttgaactcctg

SEQ ID NO: 389708 - DNA, 25 bp, Mus musculus
ctgtccaaactgtcttgaactcctg

SEQ ID NO: 389709 - DNA, 25 bp, Mus musculus
ctgtccaacattacatctgtgtatg

SEQ ID NO: 389710 - DNA, 25 bp, Mus musculus
ctgtccaacatttcatctgtgtatg

SEQ ID NO: 389711 - DNA, 25 bp, Mus musculus
ctgtccaacggtccctattatgata

SEQ ID NO: 389712 - DNA, 25 bp, Mus musculus
ctgtccaacggtgcctattatgata

SEQ ID NO: 389713 - DNA, 25 bp, Mus musculus
ctgtccaagcctagctgctgtatgc

SEQ ID NO: 389714 - DNA, 25 bp, Mus musculus
ctgtccaagccttgctgctgtatgc

SEQ ID NO: 389715 - DNA, 25 bp, Mus musculus
ctgtccaatcttctctttacgtaat

SEQ ID NO: 389716 - DNA, 25 bp, Mus musculus
ctgtccaatcttgtctttacgtaat

SEQ ID NO: 389717 - DNA, 25 bp, Mus musculus
ctgtccacaacaccactgaagtttt

SEQ ID NO: 389718 - DNA, 25 bp, Mus musculus
ctgtccacaacagcactgaagtttt

SEQ ID NO: 389719 - DNA, 25 bp, Mus musculus
ctgtccactgttctttaatcacata

SEQ ID NO: 389720 - DNA, 25 bp, Mus musculus
ctgtccactgttgtttaatcacata

SEQ ID NO: 389721 - DNA, 25 bp, Mus musculus
ctgtccagaaccatcctatcaatta

SEQ ID NO: 389722 - DNA, 25 bp, Mus musculus
ctgtccagaaccttcctatcaatta

SEQ ID NO: 389723 - DNA, 25 bp, Mus musculus
ctgtccagaatgatctaccccatcc

SEQ ID NO: 389724 - DNA, 25 bp, Mus musculus
ctgtccagaatgttctaccccatcc

SEQ ID NO: 389725 - DNA, 25 bp, Mus musculus
ctgtccagagtgaacttacccaaca

SEQ ID NO: 389726 - DNA, 25 bp, Mus musculus
ctgtccagagtgtacttacccaaca

SEQ ID NO: 389727 - DNA, 25 bp, Mus musculus
ctgtccagatggatcagctataaag

SEQ ID NO: 389728 - DNA, 25 bp, Mus musculus
ctgtccagatggttcagctataaag

SEQ ID NO: 389729 - DNA, 25 bp, Mus musculus
ctgtccagcgggatttgccagaact

SEQ ID NO: 389730 - DNA, 25 bp, Mus musculus
ctgtccagcgggttttgccagaact

SEQ ID NO: 389731 - DNA, 25 bp, Mus musculus
ctgtccaggcgtcccaggaatagaa

SEQ ID NO: 389732 - DNA, 25 bp, Mus musculus
ctgtccaggcgtgccaggaatagaa

SEQ ID NO: 389733 - DNA, 25 bp, Mus musculus
ctgtccaggtgcagcttttaacaag

SEQ ID NO: 389734 - DNA, 25 bp, Mus musculus
ctgtccaggtgctgcttttaacaag

SEQ ID NO: 389735 - DNA, 25 bp, Mus musculus
ctgtccagtagacttactttaaaat

SEQ ID NO: 389736 - DNA, 25 bp, Mus musculus
ctgtccagtagagttactttaaaat

SEQ ID NO: 389737 - DNA, 25 bp, Mus musculus
ctgtccagtgaaccataaattagga

SEQ ID NO: 389738 - DNA, 25 bp, Mus musculus
ctgtccagtgaagcataaattagga

SEQ ID NO: 389739 - DNA, 25 bp, Mus musculus
ctgtccagtgcaatgtctgctgcga

SEQ ID NO: 389740 - DNA, 25 bp, Mus musculus
ctgtccagtgcattgtctgctgcga

SEQ ID NO: 389741 - DNA, 25 bp, Mus musculus
ctgtccagtgcccataatgtcacaa

SEQ ID NO: 389742 - DNA, 25 bp, Mus musculus
ctgtccagtgccgataatgtcacaa

SEQ ID NO: 389743 - DNA, 25 bp, Mus musculus
ctgtccagtgggattatggtgactc

SEQ ID NO: 389744 - DNA, 25 bp, Mus musculus
ctgtccagtgggtttatggtgactc

SEQ ID NO: 389745 - DNA, 25 bp, Mus musculus
ctgtccatcgtgagcctgatgatca

SEQ ID NO: 389746 - DNA, 25 bp, Mus musculus
ctgtccatcgtgtgcctgatgatca

SEQ ID NO: 389747 - DNA, 25 bp, Mus musculus
ctgtccatctaacctgggcactgga

SEQ ID NO: 389748 - DNA, 25 bp, Mus musculus
ctgtccatctaagctgggcactgga

SEQ ID NO: 389749 - DNA, 25 bp, Mus musculus
ctgtccatctagagttagccatgac

SEQ ID NO: 389750 - DNA, 25 bp, Mus musculus
ctgtccatctagtgttagccatgac

SEQ ID NO: 389751 - DNA, 25 bp, Mus musculus
ctgtccatctcaagggtcaagcatt

SEQ ID NO: 389752 - DNA, 25 bp, Mus musculus
ctgtccatctcatgggtcaagcatt

SEQ ID NO: 389753 - DNA, 25 bp, Mus musculus
ctgtccatgcagagttgaaccacca

SEQ ID NO: 389754 - DNA, 25 bp, Mus musculus
ctgtccatgcagtgttgaaccacca

SEQ ID NO: 389755 - DNA, 25 bp, Mus musculus
ctgtccatgctccttggttagcaga

SEQ ID NO: 389756 - DNA, 25 bp, Mus musculus
ctgtccatgctcgttggttagcaga

SEQ ID NO: 389757 - DNA, 25 bp, Mus musculus
ctgtccatgtgaccagtctccttca

SEQ ID NO: 389758 - DNA, 25 bp, Mus musculus
ctgtccatgtgagcagtctccttca

SEQ ID NO: 389759 - DNA, 25 bp, Mus musculus
ctgtccatgtgtatgtattaagtgc

SEQ ID NO: 389760 - DNA, 25 bp, Mus musculus
ctgtccatgtgtttgtattaagtgc

SEQ ID NO: 389761 - DNA, 25 bp, Mus musculus
ctgtccattcaaaactaccacgtgt

SEQ ID NO: 389762 - DNA, 25 bp, Mus musculus
ctgtccattcaatactaccacgtgt

SEQ ID NO: 389763 - DNA, 25 bp, Mus musculus
ctgtcccaacagctgcaaagtggat

SEQ ID NO: 389764 - DNA, 25 bp, Mus musculus
ctgtcccaacaggtgcaaagtggat

SEQ ID NO: 389765 - DNA, 25 bp, Mus musculus
ctgtcccaacgtattatacacacac

SEQ ID NO: 389766 - DNA, 25 bp, Mus musculus
ctgtcccaacgttttatacacacac

SEQ ID NO: 389767 - DNA, 25 bp, Mus musculus
ctgtcccaagtaatatttagctacc

SEQ ID NO: 389768 - DNA, 25 bp, Mus musculus
ctgtcccaagtattatttagctacc

SEQ ID NO: 389769 - DNA, 25 bp, Mus musculus
ctgtcccacaacacttggtgtgata

SEQ ID NO: 389770 - DNA, 25 bp, Mus musculus
ctgtcccacaactcttggtgtgata

SEQ ID NO: 389771 - DNA, 25 bp, Mus musculus
ctgtcccacttcaaattgcggtgtt

SEQ ID NO: 389772 - DNA, 25 bp, Mus musculus
ctgtcccacttctaattgcggtgtt

SEQ ID NO: 389773 - DNA, 25 bp, Mus musculus
ctgtcccagatacggcctcaggatg

SEQ ID NO: 389774 - DNA, 25 bp, Mus musculus
ctgtcccagatagggcctcaggatg

SEQ ID NO: 389775 - DNA, 25 bp, Mus musculus
ctgtcccagctgctggcacatctga

SEQ ID NO: 389776 - DNA, 25 bp, Mus musculus
ctgtcccagctggtggcacatctga

SEQ ID NO: 389777 - DNA, 25 bp, Mus musculus
ctgtcccagtgacgcgctgggataa

SEQ ID NO: 389778 - DNA, 25 bp, Mus musculus
ctgtcccagtgaggcgctgggataa

SEQ ID NO: 389779 - DNA, 25 bp, Mus musculus
ctgtcccagttgatactctgaggtg

SEQ ID NO: 389780 - DNA, 25 bp, Mus musculus
ctgtcccagttgttactctgaggtg

SEQ ID NO: 389781 - DNA, 25 bp, Mus musculus
ctgtcccatagcagagtgacctcaa

SEQ ID NO: 389782 - DNA, 25 bp, Mus musculus
ctgtcccatagctgagtgacctcaa

SEQ ID NO: 389783 - DNA, 25 bp, Mus musculus
ctgtcccatctcagtttgcaaaaag

SEQ ID NO: 389784 - DNA, 25 bp, Mus musculus
ctgtcccatctctgtttgcaaaaag

SEQ ID NO: 389785 - DNA, 25 bp, Mus musculus
ctgtcccattcaagtcaacatatcc

SEQ ID NO: 389786 - DNA, 25 bp, Mus musculus
ctgtcccattcatgtcaacatatcc

SEQ ID NO: 389787 - DNA, 25 bp, Mus musculus
ctgtcccattttagccacttaaaga

SEQ ID NO: 389788 - DNA, 25 bp, Mus musculus
ctgtcccatttttgccacttaaaga

SEQ ID NO: 389789 - DNA, 25 bp, Mus musculus
ctgtccccaaccaaagtaagtatga

SEQ ID NO: 389790 - DNA, 25 bp, Mus musculus
ctgtccccaacctaagtaagtatga

SEQ ID NO: 389791 - DNA, 25 bp, Mus musculus
ctgtccccacaactctttattctat

SEQ ID NO: 389792 - DNA, 25 bp, Mus musculus
ctgtccccacaagtctttattctat

SEQ ID NO: 389793 - DNA, 25 bp, Mus musculus
ctgtccccagtcagggagacttgtg

SEQ ID NO: 389794 - DNA, 25 bp, Mus musculus
ctgtccccagtctgggagacttgtg

SEQ ID NO: 389795 - DNA, 25 bp, Mus musculus
ctgtcccctctaaacattaataaat

SEQ ID NO: 389796 - DNA, 25 bp, Mus musculus
ctgtcccctctatacattaataaat

SEQ ID NO: 389797 - DNA, 25 bp, Mus musculus
ctgtcccgagccaggaagatagtct

SEQ ID NO: 389798 - DNA, 25 bp, Mus musculus
ctgtcccgagcctggaagatagtct

SEQ ID NO: 389799 - DNA, 25 bp, Mus musculus
ctgtcccgaggcacagcaataatca

SEQ ID NO: 389800 - DNA, 25 bp, Mus musculus
ctgtcccgaggctcagcaataatca

SEQ ID NO: 389801 - DNA, 25 bp, Mus musculus
ctgtcccgggagctctcaatgctat

SEQ ID NO: 389802 - DNA, 25 bp, Mus musculus
ctgtcccgggaggtctcaatgctat

SEQ ID NO: 389803 - DNA, 25 bp, Mus musculus
ctgtcccgttgtctagtctcctgtg

SEQ ID NO: 389804 - DNA, 25 bp, Mus musculus
ctgtcccgttgtgtagtctcctgtg

SEQ ID NO: 389805 - DNA, 25 bp, Mus musculus
ctgtccctaatgatctttaactctt

SEQ ID NO: 389806 - DNA, 25 bp, Mus musculus
ctgtccctaatgttctttaactctt

SEQ ID NO: 389807 - DNA, 25 bp, Mus musculus
ctgtccctagacagcatccgtgtaa

SEQ ID NO: 389808 - DNA, 25 bp, Mus musculus
ctgtccctagactgcatccgtgtaa

SEQ ID NO: 389809 - DNA, 25 bp, Mus musculus
ctgtccctcaatcctgattgattgg

SEQ ID NO: 389810 - DNA, 25 bp, Mus musculus
ctgtccctcaatgctgattgattgg

SEQ ID NO: 389811 - DNA, 25 bp, Mus musculus
ctgtccctcagtattgaacttggct

SEQ ID NO: 389812 - DNA, 25 bp, Mus musculus
ctgtccctcagttttgaacttggct

SEQ ID NO: 389813 - DNA, 25 bp, Mus musculus
ctgtccctgattagagattttcaca

SEQ ID NO: 389814 - DNA, 25 bp, Mus musculus
ctgtccctgatttgagattttcaca

SEQ ID NO: 389815 - DNA, 25 bp, Mus musculus
ctgtccctggttattttgatagtct

SEQ ID NO: 389816 - DNA, 25 bp, Mus musculus
ctgtccctggtttttttgatagtct

SEQ ID NO: 389817 - DNA, 25 bp, Mus musculus
ctgtccctgtctccttagaatggaa

SEQ ID NO: 389818 - DNA, 25 bp, Mus musculus
ctgtccctgtctgcttagaatggaa

SEQ ID NO: 389819 - DNA, 25 bp, Mus musculus
ctgtccctgtttacctaagtataga

SEQ ID NO: 389820 - DNA, 25 bp, Mus musculus
ctgtccctgttttcctaagtataga

SEQ ID NO: 389821 - DNA, 25 bp, Mus musculus
ctgtcccttgaaatgaaagttatgc

SEQ ID NO: 389822 - DNA, 25 bp, Mus musculus
ctgtcccttgaattgaaagttatgc

SEQ ID NO: 389823 - DNA, 25 bp, Mus musculus
ctgtcccttgtacgcagtactcgga

SEQ ID NO: 389824 - DNA, 25 bp, Mus musculus
ctgtcccttgtaggcagtactcgga

SEQ ID NO: 389825 - DNA, 25 bp, Mus musculus
ctgtccctttgccagaacataaaga

SEQ ID NO: 389826 - DNA, 25 bp, Mus musculus
ctgtccctttgcgagaacataaaga

SEQ ID NO: 389827 - DNA, 25 bp, Mus musculus
ctgtccctttttagctcactttgat

SEQ ID NO: 389828 - DNA, 25 bp, Mus musculus
ctgtcccttttttgctcactttgat

SEQ ID NO: 389829 - DNA, 25 bp, Mus musculus
ctgtccgccacgacgaaaagacttt

SEQ ID NO: 389830 - DNA, 25 bp, Mus musculus
ctgtccgccacgtcgaaaagacttt

SEQ ID NO: 389831 - DNA, 25 bp, Mus musculus
ctgtccgctaatctgctttagctgg

SEQ ID NO: 389832 - DNA, 25 bp, Mus musculus
ctgtccgctaatgtgctttagctgg

SEQ ID NO: 389833 - DNA, 25 bp, Mus musculus
ctgtccgctttaacctttagagtta

SEQ ID NO: 389834 - DNA, 25 bp, Mus musculus
ctgtccgctttatcctttagagtta

SEQ ID NO: 389835 - DNA, 25 bp, Mus musculus
ctgtccgtagtgaccaaaggccaag

SEQ ID NO: 389836 - DNA, 25 bp, Mus musculus
ctgtccgtagtgtccaaaggccaag

SEQ ID NO: 389837 - DNA, 25 bp, Mus musculus
ctgtccgtggacaacactggtctgt

SEQ ID NO: 389838 - DNA, 25 bp, Mus musculus
ctgtccgtggactacactggtctgt

SEQ ID NO: 389839 - DNA, 25 bp, Mus musculus
ctgtccgtttcactatcacttatta

SEQ ID NO: 389840 - DNA, 25 bp, Mus musculus
ctgtccgtttcagtatcacttatta

SEQ ID NO: 389841 - DNA, 25 bp, Mus musculus
ctgtcctaccttattccactaaagt

SEQ ID NO: 389842 - DNA, 25 bp, Mus musculus
ctgtcctaccttcctatttgtaata

SEQ ID NO: 389843 - DNA, 25 bp, Mus musculus
ctgtcctaccttgctatttgtaata

SEQ ID NO: 389844 - DNA, 25 bp, Mus musculus
ctgtcctacctttttccactaaagt

SEQ ID NO: 389845 - DNA, 25 bp, Mus musculus
ctgtcctaggtcatactatggagaa

SEQ ID NO: 389846 - DNA, 25 bp, Mus musculus
ctgtcctaggtcttactatggagaa

SEQ ID NO: 389847 - DNA, 25 bp, Mus musculus
ctgtcctatacgagtgaccgataat

SEQ ID NO: 389848 - DNA, 25 bp, Mus musculus
ctgtcctatacgtgtgaccgataat

SEQ ID NO: 389849 - DNA, 25 bp, Mus musculus
ctgtcctatctgctgcagcgaatat

SEQ ID NO: 389850 - DNA, 25 bp, Mus musculus
ctgtcctatctggtgcagcgaatat

SEQ ID NO: 389851 - DNA, 25 bp, Mus musculus
ctgtcctattaaccccatgtttcat

SEQ ID NO: 389852 - DNA, 25 bp, Mus musculus
ctgtcctattaagcccatgtttcat

SEQ ID NO: 389853 - DNA, 25 bp, Mus musculus
ctgtcctcaagcctaggccgaagct

SEQ ID NO: 389854 - DNA, 25 bp, Mus musculus
ctgtcctcaagcgtaggccgaagct

SEQ ID NO: 389855 - DNA, 25 bp, Mus musculus
ctgtcctcacccagttctcaaaaga

SEQ ID NO: 389856 - DNA, 25 bp, Mus musculus
ctgtcctcaccctgttctcaaaaga

SEQ ID NO: 389857 - DNA, 25 bp, Mus musculus
ctgtcctcactgaagcacttatgca

SEQ ID NO: 389858 - DNA, 25 bp, Mus musculus
ctgtcctcactgtagcacttatgca

SEQ ID NO: 389859 - DNA, 25 bp, Mus musculus
ctgtcctccagaagtgttcgtgcag

SEQ ID NO: 389860 - DNA, 25 bp, Mus musculus
ctgtcctccagatgtgttcgtgcag

SEQ ID NO: 389861 - DNA, 25 bp, Mus musculus
ctgtcctcccaaagatgggtaaggt

SEQ ID NO: 389862 - DNA, 25 bp, Mus musculus
ctgtcctcccaatgatgggtaaggt

SEQ ID NO: 389863 - DNA, 25 bp, Mus musculus
ctgtcctccgctcagttgtagaaag

SEQ ID NO: 389864 - DNA, 25 bp, Mus musculus
ctgtcctccgctgagttgtagaaag

SEQ ID NO: 389865 - DNA, 25 bp, Mus musculus
ctgtcctccgttccctaggatggct

SEQ ID NO: 389866 - DNA, 25 bp, Mus musculus
ctgtcctccgttgcctaggatggct

SEQ ID NO: 389867 - DNA, 25 bp, Mus musculus
ctgtcctcctagatgggtcttggaa

SEQ ID NO: 389868 - DNA, 25 bp, Mus musculus
ctgtcctcctagttgggtcttggaa

SEQ ID NO: 389869 - DNA, 25 bp, Mus musculus
ctgtcctcctgtaaagtgcagctga

SEQ ID NO: 389870 - DNA, 25 bp, Mus musculus
ctgtcctcctgttaagtgcagctga

SEQ ID NO: 389871 - DNA, 25 bp, Mus musculus
ctgtcctcgagcattactgtttttg

SEQ ID NO: 389872 - DNA, 25 bp, Mus musculus
ctgtcctcgagctttactgtttttg

SEQ ID NO: 389873 - DNA, 25 bp, Mus musculus
ctgtcctcgcctatcaggatgatat

SEQ ID NO: 389874 - DNA, 25 bp, Mus musculus
ctgtcctcgcctttcaggatgatat

SEQ ID NO: 389875 - DNA, 25 bp, Mus musculus
ctgtcctcgtccattttagagcaag

SEQ ID NO: 389876 - DNA, 25 bp, Mus musculus
ctgtcctcgtcctttttagagcaag

SEQ ID NO: 389877 - DNA, 25 bp, Mus musculus
ctgtcctctactctgtgtgacagag

SEQ ID NO: 389878 - DNA, 25 bp, Mus musculus
ctgtcctctactgtgtgtgacagag

SEQ ID NO: 389879 - DNA, 25 bp, Mus musculus
ctgtcctctatgctaactatgtaga

SEQ ID NO: 389880 - DNA, 25 bp, Mus musculus
ctgtcctctatggtaactatgtaga

SEQ ID NO: 389881 - DNA, 25 bp, Mus musculus
ctgtcctctcgacctatcttgacag

SEQ ID NO: 389882 - DNA, 25 bp, Mus musculus
ctgtcctctcgagctatcttgacag

SEQ ID NO: 389883 - DNA, 25 bp, Mus musculus
ctgtcctctggaccctttaagggag

SEQ ID NO: 389884 - DNA, 25 bp, Mus musculus
ctgtcctctggagcctttaagggag

SEQ ID NO: 389885 - DNA, 25 bp, Mus musculus
ctgtcctgctagatggaacatagat

SEQ ID NO: 389886 - DNA, 25 bp, Mus musculus
ctgtcctgctagttggaacatagat

SEQ ID NO: 389887 - DNA, 25 bp, Mus musculus
ctgtcctggagcacatggtcacaag

SEQ ID NO: 389888 - DNA, 25 bp, Mus musculus
ctgtcctggagctcatggtcacaag

SEQ ID NO: 389889 - DNA, 25 bp, Mus musculus
ctgtcctggcacagtgtattcaggg

SEQ ID NO: 389890 - DNA, 25 bp, Mus musculus
ctgtcctggcactgtgtattcaggg

SEQ ID NO: 389891 - DNA, 25 bp, Mus musculus
ctgtcctgggtgcattcagtgtcca

SEQ ID NO: 389892 - DNA, 25 bp, Mus musculus
ctgtcctgggtggattcagtgtcca

SEQ ID NO: 389893 - DNA, 25 bp, Mus musculus
ctgtcctggtcacaagtttcaactt

SEQ ID NO: 389894 - DNA, 25 bp, Mus musculus
ctgtcctggtcagaagtttcaactt

SEQ ID NO: 389895 - DNA, 25 bp, Mus musculus
ctgtcctggtctagagatctgcctg

SEQ ID NO: 389896 - DNA, 25 bp, Mus musculus
ctgtcctggtcttgagatctgcctg

SEQ ID NO: 389897 - DNA, 25 bp, Mus musculus
ctgtcctgtcagattgtcaccaagt

SEQ ID NO: 389898 - DNA, 25 bp, Mus musculus
ctgtcctgtcagtttgtcaccaagt

SEQ ID NO: 389899 - DNA, 25 bp, Mus musculus
ctgtcctgtgacaaatccaggcatt

SEQ ID NO: 389900 - DNA, 25 bp, Mus musculus
ctgtcctgtgactaatccaggcatt

SEQ ID NO: 389901 - DNA, 25 bp, Mus musculus
ctgtccttaaacaaagagcacaccc

SEQ ID NO: 389902 - DNA, 25 bp, Mus musculus
ctgtccttaaactaagagcacaccc

SEQ ID NO: 389903 - DNA, 25 bp, Mus musculus
ctgtccttaggccttggtcacacag

SEQ ID NO: 389904 - DNA, 25 bp, Mus musculus
ctgtccttaggcgttggtcacacag

SEQ ID NO: 389905 - DNA, 25 bp, Mus musculus
ctgtccttattactttttgattcga

SEQ ID NO: 389906 - DNA, 25 bp, Mus musculus
ctgtccttattagtttttgattcga

SEQ ID NO: 389907 - DNA, 25 bp, Mus musculus
ctgtccttcacgaaaatgcctttgt

SEQ ID NO: 389908 - DNA, 25 bp, Mus musculus
ctgtccttcacgtaaatgcctttgt

SEQ ID NO: 389909 - DNA, 25 bp, Mus musculus
ctgtccttcactatgccgaggctat

SEQ ID NO: 389910 - DNA, 25 bp, Mus musculus
ctgtccttcactttgccgaggctat

SEQ ID NO: 389911 - DNA, 25 bp, Mus musculus
ctgtccttccctcaaaatccaaggg

SEQ ID NO: 389912 - DNA, 25 bp, Mus musculus
ctgtccttccctcgcattttatttg

SEQ ID NO: 389913 - DNA, 25 bp, Mus musculus
ctgtccttccctgaaaatccaaggg

SEQ ID NO: 389914 - DNA, 25 bp, Mus musculus
ctgtccttccctggcattttatttg

SEQ ID NO: 389915 - DNA, 25 bp, Mus musculus
ctgtccttctctcccaaagagtttt

SEQ ID NO: 389916 - DNA, 25 bp, Mus musculus
ctgtccttctctgccaaagagtttt

SEQ ID NO: 389917 - DNA, 25 bp, Mus musculus
ctgtccttctttcggatcgccagca

SEQ ID NO: 389918 - DNA, 25 bp, Mus musculus
ctgtccttctttgggatcgccagca

SEQ ID NO: 389919 - DNA, 25 bp, Mus musculus
ctgtccttgaagatttgttcccata

SEQ ID NO: 389920 - DNA, 25 bp, Mus musculus
ctgtccttgaagttttgttcccata

SEQ ID NO: 389921 - DNA, 25 bp, Mus musculus
ctgtccttgaatacactaagatgaa

SEQ ID NO: 389922 - DNA, 25 bp, Mus musculus
ctgtccttgaattcactaagatgaa

SEQ ID NO: 389923 - DNA, 25 bp, Mus musculus
ctgtccttgcacatggcgtttctgt

SEQ ID NO: 389924 - DNA, 25 bp, Mus musculus
ctgtccttgcacttggcgtttctgt

SEQ ID NO: 389925 - DNA, 25 bp, Mus musculus
ctgtccttgcagctgagactagctt

SEQ ID NO: 389926 - DNA, 25 bp, Mus musculus
ctgtccttgcaggtgagactagctt

SEQ ID NO: 389927 - DNA, 25 bp, Mus musculus
ctgtccttgccaatgtttcagttaa

SEQ ID NO: 389928 - DNA, 25 bp, Mus musculus
ctgtccttgccattgtttcagttaa

SEQ ID NO: 389929 - DNA, 25 bp, Mus musculus
ctgtccttgcttctcaaaatgctgg

SEQ ID NO: 389930 - DNA, 25 bp, Mus musculus
ctgtccttgcttgtcaaaatgctgg

SEQ ID NO: 389931 - DNA, 25 bp, Mus musculus
ctgtccttgtgccatctgcagaaag

SEQ ID NO: 389932 - DNA, 25 bp, Mus musculus
ctgtccttgtgcgatctgcagaaag

SEQ ID NO: 389933 - DNA, 25 bp, Mus musculus
ctgtccttgtgtagtgatttggtga

SEQ ID NO: 389934 - DNA, 25 bp, Mus musculus
ctgtccttgtgttgtgatttggtga

SEQ ID NO: 389935 - DNA, 25 bp, Mus musculus
ctgtcctttaggatcatgtgtcaaa

SEQ ID NO: 389936 - DNA, 25 bp, Mus musculus
ctgtcctttaggttcatgtgtcaaa

SEQ ID NO: 389937 - DNA, 25 bp, Mus musculus
ctgtcctttcaacacacttgctgga

SEQ ID NO: 389938 - DNA, 25 bp, Mus musculus
ctgtcctttcaagacacttgctgga

SEQ ID NO: 389939 - DNA, 25 bp, Mus musculus
ctgtcctttgatcgaaatgtagaaa

SEQ ID NO: 389940 - DNA, 25 bp, Mus musculus
ctgtcctttgatggaaatgtagaaa

SEQ ID NO: 389941 - DNA, 25 bp, Mus musculus
ctgtcctttttcctgctggctttct

SEQ ID NO: 389942 - DNA, 25 bp, Mus musculus
ctgtcctttttcgtgctggctttct

SEQ ID NO: 389943 - DNA, 25 bp, Mus musculus
ctgtcgatgacactggagataccag

SEQ ID NO: 389944 - DNA, 25 bp, Mus musculus
ctgtcgatgacagtggagataccag

SEQ ID NO: 389945 - DNA, 25 bp, Mus musculus
ctgtcgcagctcacccttgaaggaa

SEQ ID NO: 389946 - DNA, 25 bp, Mus musculus
ctgtcgcagctctcccttgaaggaa

SEQ ID NO: 389947 - DNA, 25 bp, Mus musculus
ctgtcgcccctgatggaggtagcaa

SEQ ID NO: 389948 - DNA, 25 bp, Mus musculus
ctgtcgcccctgttggaggtagcaa

SEQ ID NO: 389949 - DNA, 25 bp, Mus musculus
ctgtcgccgtaacctgcaagtgtgg

SEQ ID NO: 389950 - DNA, 25 bp, Mus musculus
ctgtcgccgtaagctgcaagtgtgg

SEQ ID NO: 389951 - DNA, 25 bp, Mus musculus
ctgtcgctaggaagcaggcaaccgg

SEQ ID NO: 389952 - DNA, 25 bp, Mus musculus
ctgtcgctaggatgcaggcaaccgg

SEQ ID NO: 389953 - DNA, 25 bp, Mus musculus
ctgtcgctctgaactgaaccagcag

SEQ ID NO: 389954 - DNA, 25 bp, Mus musculus
ctgtcgctctgatctgaaccagcag

SEQ ID NO: 389955 - DNA, 25 bp, Mus musculus
ctgtcgctggttcttccaagttaaa

SEQ ID NO: 389956 - DNA, 25 bp, Mus musculus
ctgtcgctggttgttccaagttaaa

SEQ ID NO: 389957 - DNA, 25 bp, Mus musculus
ctgtcgcttcagcttgttgcaatac

SEQ ID NO: 389958 - DNA, 25 bp, Mus musculus
ctgtcgcttcaggttgttgcaatac

SEQ ID NO: 389959 - DNA, 25 bp, Mus musculus
ctgtcgcttcggagcgcgctgccgt

SEQ ID NO: 389960 - DNA, 25 bp, Mus musculus
ctgtcgcttcggtgcgcgctgccgt

SEQ ID NO: 389961 - DNA, 25 bp, Mus musculus
ctgtcggcaggcatctgttattata

SEQ ID NO: 389962 - DNA, 25 bp, Mus musculus
ctgtcggcaggcttctgttattata

SEQ ID NO: 389963 - DNA, 25 bp, Mus musculus
ctgtcggctgaaagataatttgtaa

SEQ ID NO: 389964 - DNA, 25 bp, Mus musculus
ctgtcggctgaatgataatttgtaa

SEQ ID NO: 389965 - DNA, 25 bp, Mus musculus
ctgtcgggagtgagtttccccttat

SEQ ID NO: 389966 - DNA, 25 bp, Mus musculus
ctgtcgggagtgtgtttccccttat

SEQ ID NO: 389967 - DNA, 25 bp, Mus musculus
ctgtcgggcatactacttgctcagg

SEQ ID NO: 389968 - DNA, 25 bp, Mus musculus
ctgtcgggcatagtacttgctcagg

SEQ ID NO: 389969 - DNA, 25 bp, Mus musculus
ctgtcgggtcagaatattttactat

SEQ ID NO: 389970 - DNA, 25 bp, Mus musculus
ctgtcgggtcagtatattttactat

SEQ ID NO: 389971 - DNA, 25 bp, Mus musculus
ctgtcgggtgtaagcctgagcagca

SEQ ID NO: 389972 - DNA, 25 bp, Mus musculus
ctgtcgggtgtatgcctgagcagca

SEQ ID NO: 389973 - DNA, 25 bp, Mus musculus
ctgtcggtcagaatgaaagctacat

SEQ ID NO: 389974 - DNA, 25 bp, Mus musculus
ctgtcggtcagattgaaagctacat

SEQ ID NO: 389975 - DNA, 25 bp, Mus musculus
ctgtcgtaaaagctgctgtccctgc

SEQ ID NO: 389976 - DNA, 25 bp, Mus musculus
ctgtcgtaaaaggtgctgtccctgc

SEQ ID NO: 389977 - DNA, 25 bp, Mus musculus
ctgtcgtacatgaagctctgtctgt

SEQ ID NO: 389978 - DNA, 25 bp, Mus musculus
ctgtcgtacatgtagctctgtctgt

SEQ ID NO: 389979 - DNA, 25 bp, Mus musculus
ctgtcgtatattccgtttgattcac

SEQ ID NO: 389980 - DNA, 25 bp, Mus musculus
ctgtcgtatattgcgtttgattcac

SEQ ID NO: 389981 - DNA, 25 bp, Mus musculus
ctgtcgtcagctcgccgtcggtaaa

SEQ ID NO: 389982 - DNA, 25 bp, Mus musculus
ctgtcgtcagctggccgtcggtaaa

SEQ ID NO: 389983 - DNA, 25 bp, Mus musculus
ctgtcgtctctgctaattgttgtgg

SEQ ID NO: 389984 - DNA, 25 bp, Mus musculus
ctgtcgtctctggtaattgttgtgg

SEQ ID NO: 389985 - DNA, 25 bp, Mus musculus
ctgtcgtctttccaccagaataggg

SEQ ID NO: 389986 - DNA, 25 bp, Mus musculus
ctgtcgtctttcgaccagaataggg

SEQ ID NO: 389987 - DNA, 25 bp, Mus musculus
ctgtcgtggctgctgttactattat

SEQ ID NO: 389988 - DNA, 25 bp, Mus musculus
ctgtcgtggctggtgttactattat

SEQ ID NO: 389989 - DNA, 25 bp, Mus musculus
ctgtcgtgtgtcagagtttgaatct

SEQ ID NO: 389990 - DNA, 25 bp, Mus musculus
ctgtcgtgtgtctgagtttgaatct

SEQ ID NO: 389991 - DNA, 25 bp, Mus musculus
ctgtcgttaacaagagttagtgcct

SEQ ID NO: 389992 - DNA, 25 bp, Mus musculus
ctgtcgttaacatgagttagtgcct

SEQ ID NO: 389993 - DNA, 25 bp, Mus musculus
ctgtcgttcactcggtgtgatttat

SEQ ID NO: 389994 - DNA, 25 bp, Mus musculus
ctgtcgttcactgggtgtgatttat

SEQ ID NO: 389995 - DNA, 25 bp, Mus musculus
ctgtcgttgcctatgtgtgcatgac

SEQ ID NO: 389996 - DNA, 25 bp, Mus musculus
ctgtcgttgcctttgtgtgcatgac

SEQ ID NO: 389997 - DNA, 25 bp, Mus musculus
ctgtcgtttactcagctcttagaag

SEQ ID NO: 389998 - DNA, 25 bp, Mus musculus
ctgtcgtttactgagctcttagaag

SEQ ID NO: 389999 - DNA, 25 bp, Mus musculus
ctgtctaagcagctcaagcctgaaa

SEQ ID NO: 390000 - DNA, 25 bp, Mus musculus
ctgtctaagcaggtcaagcctgaaa

SEQ ID NO: 390001 - DNA, 25 bp, Mus musculus
ctgtctaagggaccttgcctctata

SEQ ID NO: 390002 - DNA, 25 bp, Mus musculus
ctgtctaagggagcttgcctctata

SEQ ID NO: 390003 - DNA, 25 bp, Mus musculus
ctgtctaaggtaatcaaaggtattc

SEQ ID NO: 390004 - DNA, 25 bp, Mus musculus
ctgtctaaggtattcaaaggtattc

SEQ ID NO: 390005 - DNA, 25 bp, Mus musculus
ctgtctaatgatatccttgagatgg

SEQ ID NO: 390006 - DNA, 25 bp, Mus musculus
ctgtctaatgatttccttgagatgg

SEQ ID NO: 390007 - DNA, 25 bp, Mus musculus
ctgtctaatggtcatcgcccacctt

SEQ ID NO: 390008 - DNA, 25 bp, Mus musculus
ctgtctaatggtgatcgcccacctt

SEQ ID NO: 390009 - DNA, 25 bp, Mus musculus
ctgtctacacagatgggttcctgtt

SEQ ID NO: 390010 - DNA, 25 bp, Mus musculus
ctgtctacacagttgggttcctgtt

SEQ ID NO: 390011 - DNA, 25 bp, Mus musculus
ctgtctacaccaccctgtagtaatt

SEQ ID NO: 390012 - DNA, 25 bp, Mus musculus
ctgtctacaccagcctgtagtaatt

SEQ ID NO: 390013 - DNA, 25 bp, Mus musculus
ctgtctaccacacgagggagtctaa

SEQ ID NO: 390014 - DNA, 25 bp, Mus musculus
ctgtctaccacaggagggagtctaa

SEQ ID NO: 390015 - DNA, 25 bp, Mus musculus
ctgtctacccaaaatgtctagcctg

SEQ ID NO: 390016 - DNA, 25 bp, Mus musculus
ctgtctacccaatatgtctagcctg

SEQ ID NO: 390017 - DNA, 25 bp, Mus musculus
ctgtctactaacaactgctcatggg

SEQ ID NO: 390018 - DNA, 25 bp, Mus musculus
ctgtctactaactactgctcatggg

SEQ ID NO: 390019 - DNA, 25 bp, Mus musculus
ctgtctagaggtatgtccccttaat

SEQ ID NO: 390020 - DNA, 25 bp, Mus musculus
ctgtctagaggtttgtccccttaat

SEQ ID NO: 390021 - DNA, 25 bp, Mus musculus
ctgtctagctttcaacaaacttggg

SEQ ID NO: 390022 - DNA, 25 bp, Mus musculus
ctgtctagctttgaacaaacttggg

SEQ ID NO: 390023 - DNA, 25 bp, Mus musculus
ctgtctaggtcacggttactgctct

SEQ ID NO: 390024 - DNA, 25 bp, Mus musculus
ctgtctaggtcagggttactgctct

SEQ ID NO: 390025 - DNA, 25 bp, Mus musculus
ctgtctagtcttcggcttcctctct

SEQ ID NO: 390026 - DNA, 25 bp, Mus musculus
ctgtctagtcttgggcttcctctct

SEQ ID NO: 390027 - DNA, 25 bp, Mus musculus
ctgtctatagcccacactgaggagt

SEQ ID NO: 390028 - DNA, 25 bp, Mus musculus
ctgtctatagccgacactgaggagt

SEQ ID NO: 390029 - DNA, 25 bp, Mus musculus
ctgtctatcaacacatcactgtcat

SEQ ID NO: 390030 - DNA, 25 bp, Mus musculus
ctgtctatcaactcatcactgtcat

SEQ ID NO: 390031 - DNA, 25 bp, Mus musculus
ctgtctatttagctgttttattgaa

SEQ ID NO: 390032 - DNA, 25 bp, Mus musculus
ctgtctatttaggtgttttattgaa

SEQ ID NO: 390033 - DNA, 25 bp, Mus musculus
ctgtctcaacccatttctcagtgtt

SEQ ID NO: 390034 - DNA, 25 bp, Mus musculus
ctgtctcaacccttttctcagtgtt

SEQ ID NO: 390035 - DNA, 25 bp, Mus musculus
ctgtctcaacctcgagtttctcaat

SEQ ID NO: 390036 - DNA, 25 bp, Mus musculus
ctgtctcaacctcgcacactgaatg

SEQ ID NO: 390037 - DNA, 25 bp, Mus musculus
ctgtctcaacctggagtttctcaat

SEQ ID NO: 390038 - DNA, 25 bp, Mus musculus
ctgtctcaacctggcacactgaatg

SEQ ID NO: 390039 - DNA, 25 bp, Mus musculus
ctgtctcaagcccttggactttttt

SEQ ID NO: 390040 - DNA, 25 bp, Mus musculus
ctgtctcaagccgttggactttttt

SEQ ID NO: 390041 - DNA, 25 bp, Mus musculus
ctgtctcaatggaaacctgtatttt

SEQ ID NO: 390042 - DNA, 25 bp, Mus musculus
ctgtctcaatggtaacctgtatttt

SEQ ID NO: 390043 - DNA, 25 bp, Mus musculus
ctgtctcacatacgctgtaagctct

SEQ ID NO: 390044 - DNA, 25 bp, Mus musculus
ctgtctcacataggctgtaagctct

SEQ ID NO: 390045 - DNA, 25 bp, Mus musculus
ctgtctcaccaaaatgatgaatgtc

SEQ ID NO: 390046 - DNA, 25 bp, Mus musculus
ctgtctcaccaatatgatgaatgtc

SEQ ID NO: 390047 - DNA, 25 bp, Mus musculus
ctgtctcaccttagacttattcttg

SEQ ID NO: 390048 - DNA, 25 bp, Mus musculus
ctgtctcacctttgacttattcttg

SEQ ID NO: 390049 - DNA, 25 bp, Mus musculus
ctgtctcactggattgttctggtta

SEQ ID NO: 390050 - DNA, 25 bp, Mus musculus
ctgtctcactggtttgttctggtta

SEQ ID NO: 390051 - DNA, 25 bp, Mus musculus
ctgtctcactttaccttttcagatg

SEQ ID NO: 390052 - DNA, 25 bp, Mus musculus
ctgtctcacttttccttttcagatg

SEQ ID NO: 390053 - DNA, 25 bp, Mus musculus
ctgtctcagactcacatgtactatc

SEQ ID NO: 390054 - DNA, 25 bp, Mus musculus
ctgtctcagactgacatgtactatc

SEQ ID NO: 390055 - DNA, 25 bp, Mus musculus
ctgtctcagtaacaaaccactttcc

SEQ ID NO: 390056 - DNA, 25 bp, Mus musculus
ctgtctcagtaagaaaccactttcc

SEQ ID NO: 390057 - DNA, 25 bp, Mus musculus
ctgtctcagtgaatagcttttggta

SEQ ID NO: 390058 - DNA, 25 bp, Mus musculus
ctgtctcagtgattagcttttggta

SEQ ID NO: 390059 - DNA, 25 bp, Mus musculus
ctgtctcatattcttccttggtaga

SEQ ID NO: 390060 - DNA, 25 bp, Mus musculus
ctgtctcatattgttccttggtaga

SEQ ID NO: 390061 - DNA, 25 bp, Mus musculus
ctgtctccaagacttccagagctgc

SEQ ID NO: 390062 - DNA, 25 bp, Mus musculus
ctgtctccaagagttccagagctgc

SEQ ID NO: 390063 - DNA, 25 bp, Mus musculus
ctgtctccaataatacttttctgta

SEQ ID NO: 390064 - DNA, 25 bp, Mus musculus
ctgtctccaatattacttttctgta

SEQ ID NO: 390065 - DNA, 25 bp, Mus musculus
ctgtctccacagattgttgcctcag

SEQ ID NO: 390066 - DNA, 25 bp, Mus musculus
ctgtctccacagtttgttgcctcag

SEQ ID NO: 390067 - DNA, 25 bp, Mus musculus
ctgtctccactgaaggtatcagcat

SEQ ID NO: 390068 - DNA, 25 bp, Mus musculus
ctgtctccactgcaaagccatgaga

SEQ ID NO: 390069 - DNA, 25 bp, Mus musculus
ctgtctccactggaaagccatgaga

SEQ ID NO: 390070 - DNA, 25 bp, Mus musculus
ctgtctccactgtaggtatcagcat

SEQ ID NO: 390071 - DNA, 25 bp, Mus musculus
ctgtctccacttccggaagtacaat

SEQ ID NO: 390072 - DNA, 25 bp, Mus musculus
ctgtctccacttgcggaagtacaat

SEQ ID NO: 390073 - DNA, 25 bp, Mus musculus
ctgtctccatggctttcaggagcat

SEQ ID NO: 390074 - DNA, 25 bp, Mus musculus
ctgtctccatgggtttcaggagcat

SEQ ID NO: 390075 - DNA, 25 bp, Mus musculus
ctgtctcccgatcaaaacatatctt

SEQ ID NO: 390076 - DNA, 25 bp, Mus musculus
ctgtctcccgatgaaaacatatctt

SEQ ID NO: 390077 - DNA, 25 bp, Mus musculus
ctgtctcccttactgtgacttggta

SEQ ID NO: 390078 - DNA, 25 bp, Mus musculus
ctgtctcccttagtgtgacttggta

SEQ ID NO: 390079 - DNA, 25 bp, Mus musculus
ctgtctcctacactaacactcagta

SEQ ID NO: 390080 - DNA, 25 bp, Mus musculus
ctgtctcctacagtaacactcagta

SEQ ID NO: 390081 - DNA, 25 bp, Mus musculus
ctgtctcctctacgctttcttagaa

SEQ ID NO: 390082 - DNA, 25 bp, Mus musculus
ctgtctcctctaggctttcttagaa

SEQ ID NO: 390083 - DNA, 25 bp, Mus musculus
ctgtctcctggaacttgaagtatgt

SEQ ID NO: 390084 - DNA, 25 bp, Mus musculus
ctgtctcctggatcttgaagtatgt

SEQ ID NO: 390085 - DNA, 25 bp, Mus musculus
ctgtctcctgtaactgttggttcag

SEQ ID NO: 390086 - DNA, 25 bp, Mus musculus
ctgtctcctgtatctgttggttcag

SEQ ID NO: 390087 - DNA, 25 bp, Mus musculus
ctgtctcctgtcaaaggacccagat

SEQ ID NO: 390088 - DNA, 25 bp, Mus musculus
ctgtctcctgtctaaggacccagat

SEQ ID NO: 390089 - DNA, 25 bp, Mus musculus
ctgtctcctgtgatgctctaagtat

SEQ ID NO: 390090 - DNA, 25 bp, Mus musculus
ctgtctcctgtgttgctctaagtat

SEQ ID NO: 390091 - DNA, 25 bp, Mus musculus
ctgtctccttaacgccatgtaatta

SEQ ID NO: 390092 - DNA, 25 bp, Mus musculus
ctgtctccttaaggccatgtaatta

SEQ ID NO: 390093 - DNA, 25 bp, Mus musculus
ctgtctccttagaggtactggtcat

SEQ ID NO: 390094 - DNA, 25 bp, Mus musculus
ctgtctccttagtggtactggtcat

SEQ ID NO: 390095 - DNA, 25 bp, Mus musculus
ctgtctcctttgcaggcacagaagg

SEQ ID NO: 390096 - DNA, 25 bp, Mus musculus
ctgtctcctttggaggcacagaagg

SEQ ID NO: 390097 - DNA, 25 bp, Mus musculus
ctgtctcgatccatgtctcaggaag

SEQ ID NO: 390098 - DNA, 25 bp, Mus musculus
ctgtctcgatccttgtctcaggaag

SEQ ID NO: 390099 - DNA, 25 bp, Mus musculus
ctgtctcgatctacctgaatgttga

SEQ ID NO: 390100 - DNA, 25 bp, Mus musculus
ctgtctcgatcttcctgaatgttga

SEQ ID NO: 390101 - DNA, 25 bp, Mus musculus
ctgtctcgcggaaacctggaaataa

SEQ ID NO: 390102 - DNA, 25 bp, Mus musculus
ctgtctcgcggatacctggaaataa

SEQ ID NO: 390103 - DNA, 25 bp, Mus musculus
ctgtctctaaaacgctagcggaaac

SEQ ID NO: 390104 - DNA, 25 bp, Mus musculus
ctgtctctaaaaggctagcggaaac

SEQ ID NO: 390105 - DNA, 25 bp, Mus musculus
ctgtctctaacacgcaacacggttg

SEQ ID NO: 390106 - DNA, 25 bp, Mus musculus
ctgtctctaacaggcaacacggttg

SEQ ID NO: 390107 - DNA, 25 bp, Mus musculus
ctgtctctacctccagagaactgga

SEQ ID NO: 390108 - DNA, 25 bp, Mus musculus
ctgtctctacctgcagagaactgga

SEQ ID NO: 390109 - DNA, 25 bp, Mus musculus
ctgtctctactgagactctctgaaa

SEQ ID NO: 390110 - DNA, 25 bp, Mus musculus
ctgtctctactgtgactctctgaaa

SEQ ID NO: 390111 - DNA, 25 bp, Mus musculus
ctgtctctaggcaatattctctgaa

SEQ ID NO: 390112 - DNA, 25 bp, Mus musculus
ctgtctctaggctatattctctgaa

SEQ ID NO: 390113 - DNA, 25 bp, Mus musculus
ctgtctctaggtctaagccgtggtt

SEQ ID NO: 390114 - DNA, 25 bp, Mus musculus
ctgtctctaggtgtaagccgtggtt

SEQ ID NO: 390115 - DNA, 25 bp, Mus musculus
ctgtctctatttaagtactgtatat

SEQ ID NO: 390116 - DNA, 25 bp, Mus musculus
ctgtctctattttagtactgtatat

SEQ ID NO: 390117 - DNA, 25 bp, Mus musculus
ctgtctctcagcattagcttgttca

SEQ ID NO: 390118 - DNA, 25 bp, Mus musculus
ctgtctctcagctttagcttgttca

SEQ ID NO: 390119 - DNA, 25 bp, Mus musculus
ctgtctctcaggcaatgtgcattat

SEQ ID NO: 390120 - DNA, 25 bp, Mus musculus
ctgtctctcagggaatgtgcattat

SEQ ID NO: 390121 - DNA, 25 bp, Mus musculus
ctgtctctccggcatctagaggaac

SEQ ID NO: 390122 - DNA, 25 bp, Mus musculus
ctgtctctccgggatctagaggaac

SEQ ID NO: 390123 - DNA, 25 bp, Mus musculus
ctgtctctccttctaaagctcaaga

SEQ ID NO: 390124 - DNA, 25 bp, Mus musculus
ctgtctctccttgtaaagctcaaga

SEQ ID NO: 390125 - DNA, 25 bp, Mus musculus
ctgtctctctctaatataatttcaa

SEQ ID NO: 390126 - DNA, 25 bp, Mus musculus
ctgtctctctctctcataatttttt

SEQ ID NO: 390127 - DNA, 25 bp, Mus musculus
ctgtctctctctgtcataatttttt

SEQ ID NO: 390128 - DNA, 25 bp, Mus musculus
ctgtctctctcttatataatttcaa

SEQ ID NO: 390129 - DNA, 25 bp, Mus musculus
ctgtctctgagaaactgtcctggta

SEQ ID NO: 390130 - DNA, 25 bp, Mus musculus
ctgtctctgagatactgtcctggta

SEQ ID NO: 390131 - DNA, 25 bp, Mus musculus
ctgtctctgatgacaggtcagcagt

SEQ ID NO: 390132 - DNA, 25 bp, Mus musculus
ctgtctctgatgatggttcacattg

SEQ ID NO: 390133 - DNA, 25 bp, Mus musculus
ctgtctctgatgtcaggtcagcagt

SEQ ID NO: 390134 - DNA, 25 bp, Mus musculus
ctgtctctgatgttggttcacattg

SEQ ID NO: 390135 - DNA, 25 bp, Mus musculus
ctgtctctgcaaaaacgaggcaata

SEQ ID NO: 390136 - DNA, 25 bp, Mus musculus
ctgtctctgcaataacgaggcaata

SEQ ID NO: 390137 - DNA, 25 bp, Mus musculus
ctgtctctgcagaacacctgttggg

SEQ ID NO: 390138 - DNA, 25 bp, Mus musculus
ctgtctctgcagaccaaacagtgag

SEQ ID NO: 390139 - DNA, 25 bp, Mus musculus
ctgtctctgcagtacacctgttggg

SEQ ID NO: 390140 - DNA, 25 bp, Mus musculus
ctgtctctgcagtccaaacagtgag

SEQ ID NO: 390141 - DNA, 25 bp, Mus musculus
ctgtctctgccgagtacgcttatgt

SEQ ID NO: 390142 - DNA, 25 bp, Mus musculus
ctgtctctgccgtgtacgcttatgt

SEQ ID NO: 390143 - DNA, 25 bp, Mus musculus
ctgtctctgctcatgtatcataggc

SEQ ID NO: 390144 - DNA, 25 bp, Mus musculus
ctgtctctgctcttgtatcataggc

SEQ ID NO: 390145 - DNA, 25 bp, Mus musculus
ctgtctctggacaaatcacctatgt

SEQ ID NO: 390146 - DNA, 25 bp, Mus musculus
ctgtctctggactaatcacctatgt

SEQ ID NO: 390147 - DNA, 25 bp, Mus musculus
ctgtctctggagagctgcggttaca

SEQ ID NO: 390148 - DNA, 25 bp, Mus musculus
ctgtctctggagtgctgcggttaca

SEQ ID NO: 390149 - DNA, 25 bp, Mus musculus
ctgtctctgggcattcacttgggca

SEQ ID NO: 390150 - DNA, 25 bp, Mus musculus
ctgtctctgggctttcacttgggca

SEQ ID NO: 390151 - DNA, 25 bp, Mus musculus
ctgtctctggtgagcaggagcccca

SEQ ID NO: 390152 - DNA, 25 bp, Mus musculus
ctgtctctggtgtgcaggagcccca

SEQ ID NO: 390153 - DNA, 25 bp, Mus musculus
ctgtctctgtaaaaccggcctagta

SEQ ID NO: 390154 - DNA, 25 bp, Mus musculus
ctgtctctgtaataccggcctagta

SEQ ID NO: 390155 - DNA, 25 bp, Mus musculus
ctgtctcttccaactgctgggaata

SEQ ID NO: 390156 - DNA, 25 bp, Mus musculus
ctgtctcttccatctgctgggaata

SEQ ID NO: 390157 - DNA, 25 bp, Mus musculus
ctgtctctttgaagccatggctggc

SEQ ID NO: 390158 - DNA, 25 bp, Mus musculus
ctgtctctttgatgccatggctggc

SEQ ID NO: 390159 - DNA, 25 bp, Mus musculus
ctgtctgaacagacacttgcagaag

SEQ ID NO: 390160 - DNA, 25 bp, Mus musculus
ctgtctgaacagtcacttgcagaag

SEQ ID NO: 390161 - DNA, 25 bp, Mus musculus
ctgtctgaaggtccagagaggctca

SEQ ID NO: 390162 - DNA, 25 bp, Mus musculus
ctgtctgaaggtgcagagaggctca

SEQ ID NO: 390163 - DNA, 25 bp, Mus musculus
ctgtctgacagaaggtcgctactga

SEQ ID NO: 390164 - DNA, 25 bp, Mus musculus
ctgtctgacagatggtcgctactga

SEQ ID NO: 390165 - DNA, 25 bp, Mus musculus
ctgtctgactcgactctactagagt

SEQ ID NO: 390166 - DNA, 25 bp, Mus musculus
ctgtctgactcgtctctactagagt

SEQ ID NO: 390167 - DNA, 25 bp, Mus musculus
ctgtctgagactataatgtcactga

SEQ ID NO: 390168 - DNA, 25 bp, Mus musculus
ctgtctgagactttaatgtcactga

SEQ ID NO: 390169 - DNA, 25 bp, Mus musculus
ctgtctgaggacacaagggtttctt

SEQ ID NO: 390170 - DNA, 25 bp, Mus musculus
ctgtctgaggactcaagggtttctt

SEQ ID NO: 390171 - DNA, 25 bp, Mus musculus
ctgtctgaggataccactgaagaga

SEQ ID NO: 390172 - DNA, 25 bp, Mus musculus
ctgtctgaggattccactgaagaga

SEQ ID NO: 390173 - DNA, 25 bp, Mus musculus
ctgtctgcagctctaatcttgatag

SEQ ID NO: 390174 - DNA, 25 bp, Mus musculus
ctgtctgcagctctatttcagcaga

SEQ ID NO: 390175 - DNA, 25 bp, Mus musculus
ctgtctgcagctgtaatcttgatag

SEQ ID NO: 390176 - DNA, 25 bp, Mus musculus
ctgtctgcagctgtatttcagcaga

SEQ ID NO: 390177 - DNA, 25 bp, Mus musculus
ctgtctgcagtgatcctcacacttt

SEQ ID NO: 390178 - DNA, 25 bp, Mus musculus
ctgtctgcagtgttcctcacacttt

SEQ ID NO: 390179 - DNA, 25 bp, Mus musculus
ctgtctgcccctcataggtcagaac

SEQ ID NO: 390180 - DNA, 25 bp, Mus musculus
ctgtctgcccctgataggtcagaac

SEQ ID NO: 390181 - DNA, 25 bp, Mus musculus
ctgtctgcctgcaggagtagatgga

SEQ ID NO: 390182 - DNA, 25 bp, Mus musculus
ctgtctgcctgctggagtagatgga

SEQ ID NO: 390183 - DNA, 25 bp, Mus musculus
ctgtctgccttgcacttagggaaga

SEQ ID NO: 390184 - DNA, 25 bp, Mus musculus
ctgtctgccttggacttagggaaga

SEQ ID NO: 390185 - DNA, 25 bp, Mus musculus
ctgtctgcgaggcacttatggacca

SEQ ID NO: 390186 - DNA, 25 bp, Mus musculus
ctgtctgcgagggacttatggacca

SEQ ID NO: 390187 - DNA, 25 bp, Mus musculus
ctgtctgcgttgagtagggaaccct

SEQ ID NO: 390188 - DNA, 25 bp, Mus musculus
ctgtctgcgttgtgtagggaaccct

SEQ ID NO: 390189 - DNA, 25 bp, Mus musculus
ctgtctgctctacttatggcagtgt

SEQ ID NO: 390190 - DNA, 25 bp, Mus musculus
ctgtctgctctagttatggcagtgt

SEQ ID NO: 390191 - DNA, 25 bp, Mus musculus
ctgtctgctctgacaccagaaatca

SEQ ID NO: 390192 - DNA, 25 bp, Mus musculus
ctgtctgctctgtcaccagaaatca

SEQ ID NO: 390193 - DNA, 25 bp, Mus musculus
ctgtctgctgaaccaggtagtcttt

SEQ ID NO: 390194 - DNA, 25 bp, Mus musculus
ctgtctgctgaagcaggtagtcttt

SEQ ID NO: 390195 - DNA, 25 bp, Mus musculus
ctgtctgctgcacacctgtctgctg

SEQ ID NO: 390196 - DNA, 25 bp, Mus musculus
ctgtctgctgcagacctgtctgctg

SEQ ID NO: 390197 - DNA, 25 bp, Mus musculus
ctgtctgctgctaaagtgggtctga

SEQ ID NO: 390198 - DNA, 25 bp, Mus musculus
ctgtctgctgcttaagtgggtctga

SEQ ID NO: 390199 - DNA, 25 bp, Mus musculus
ctgtctgctgtcagttaactgtcaa

SEQ ID NO: 390200 - DNA, 25 bp, Mus musculus
ctgtctgctgtctgttaactgtcaa

SEQ ID NO: 390201 - DNA, 25 bp, Mus musculus
ctgtctgctgtgattttctccagaa

SEQ ID NO: 390202 - DNA, 25 bp, Mus musculus
ctgtctgctgtgtttttctccagaa

SEQ ID NO: 390203 - DNA, 25 bp, Mus musculus
ctgtctgcttatccagctctggaag

SEQ ID NO: 390204 - DNA, 25 bp, Mus musculus
ctgtctgcttatgcagctctggaag

SEQ ID NO: 390205 - DNA, 25 bp, Mus musculus
ctgtctgcttctatttcccaagtgc

SEQ ID NO: 390206 - DNA, 25 bp, Mus musculus
ctgtctgcttctttttcccaagtgc

SEQ ID NO: 390207 - DNA, 25 bp, Mus musculus
ctgtctggagaaaggatcgttctta

SEQ ID NO: 390208 - DNA, 25 bp, Mus musculus
ctgtctggagaatggatcgttctta

SEQ ID NO: 390209 - DNA, 25 bp, Mus musculus
ctgtctggatttattgtgtggtgat

SEQ ID NO: 390210 - DNA, 25 bp, Mus musculus
ctgtctggattttttgtgtggtgat

SEQ ID NO: 390211 - DNA, 25 bp, Mus musculus
ctgtctggcaagctggttttctgta

SEQ ID NO: 390212 - DNA, 25 bp, Mus musculus
ctgtctggcaaggtggttttctgta

SEQ ID NO: 390213 - DNA, 25 bp, Mus musculus
ctgtctggcaggagtctttcattaa

SEQ ID NO: 390214 - DNA, 25 bp, Mus musculus
ctgtctggcaggtgtctttcattaa

SEQ ID NO: 390215 - DNA, 25 bp, Mus musculus
ctgtctgggagcacatctctagaga

SEQ ID NO: 390216 - DNA, 25 bp, Mus musculus
ctgtctgggagctcatctctagaga

SEQ ID NO: 390217 - DNA, 25 bp, Mus musculus
ctgtctgggtgaagcctcttttgga

SEQ ID NO: 390218 - DNA, 25 bp, Mus musculus
ctgtctgggtgatgcctcttttgga

SEQ ID NO: 390219 - DNA, 25 bp, Mus musculus
ctgtctgtacacattcaggtttgga

SEQ ID NO: 390220 - DNA, 25 bp, Mus musculus
ctgtctgtacactttcaggtttgga

SEQ ID NO: 390221 - DNA, 25 bp, Mus musculus
ctgtctgtacatcccgtgagagagt

SEQ ID NO: 390222 - DNA, 25 bp, Mus musculus
ctgtctgtacatgccgtgagagagt

SEQ ID NO: 390223 - DNA, 25 bp, Mus musculus
ctgtctgtatctattttgtgtagac

SEQ ID NO: 390224 - DNA, 25 bp, Mus musculus
ctgtctgtatctcactcgaaagttg

SEQ ID NO: 390225 - DNA, 25 bp, Mus musculus
ctgtctgtatctgactcgaaagttg

SEQ ID NO: 390226 - DNA, 25 bp, Mus musculus
ctgtctgtatcttttttgtgtagac

SEQ ID NO: 390227 - DNA, 25 bp, Mus musculus
ctgtctgtatgccaagtgtatccct

SEQ ID NO: 390228 - DNA, 25 bp, Mus musculus
ctgtctgtatgcgaagtgtatccct

SEQ ID NO: 390229 - DNA, 25 bp, Mus musculus
ctgtctgtcaggcttcttggaaaac

SEQ ID NO: 390230 - DNA, 25 bp, Mus musculus
ctgtctgtcagggttcttggaaaac

SEQ ID NO: 390231 - DNA, 25 bp, Mus musculus
ctgtctgtccgtctcttaatttttt

SEQ ID NO: 390232 - DNA, 25 bp, Mus musculus
ctgtctgtccgtgtcttaatttttt

SEQ ID NO: 390233 - DNA, 25 bp, Mus musculus
ctgtctgtccttagttaaatgtgtg

SEQ ID NO: 390234 - DNA, 25 bp, Mus musculus
ctgtctgtccttctcctcatggtga

SEQ ID NO: 390235 - DNA, 25 bp, Mus musculus
ctgtctgtccttgtcctcatggtga

SEQ ID NO: 390236 - DNA, 25 bp, Mus musculus
ctgtctgtcctttgttaaatgtgtg

SEQ ID NO: 390237 - DNA, 25 bp, Mus musculus
ctgtctgtctagcaacaagctgtca

SEQ ID NO: 390238 - DNA, 25 bp, Mus musculus
ctgtctgtctaggaacaagctgtca

SEQ ID NO: 390239 - DNA, 25 bp, Mus musculus
ctgtctgtctctcggatctgctgtt

SEQ ID NO: 390240 - DNA, 25 bp, Mus musculus
ctgtctgtctctgggatctgctgtt

SEQ ID NO: 390241 - DNA, 25 bp, Mus musculus
ctgtctgtcttcagatgggaatcct

SEQ ID NO: 390242 - DNA, 25 bp, Mus musculus
ctgtctgtcttctgatgggaatcct

SEQ ID NO: 390243 - DNA, 25 bp, Mus musculus
ctgtctgtctttatattcacactgt

SEQ ID NO: 390244 - DNA, 25 bp, Mus musculus
ctgtctgtctttttattcacactgt

SEQ ID NO: 390245 - DNA, 25 bp, Mus musculus
ctgtctgtgacacgctgttggtgca

SEQ ID NO: 390246 - DNA, 25 bp, Mus musculus
ctgtctgtgacaggctgttggtgca

SEQ ID NO: 390247 - DNA, 25 bp, Mus musculus
ctgtctgtgaccctgtaacacatga

SEQ ID NO: 390248 - DNA, 25 bp, Mus musculus
ctgtctgtgaccgtgtaacacatga

SEQ ID NO: 390249 - DNA, 25 bp, Mus musculus
ctgtctgtgactcatctggcgcgat

SEQ ID NO: 390250 - DNA, 25 bp, Mus musculus
ctgtctgtgactgatctggcgcgat

SEQ ID NO: 390251 - DNA, 25 bp, Mus musculus
ctgtctgtgtgtaggaatgtggatg

SEQ ID NO: 390252 - DNA, 25 bp, Mus musculus
ctgtctgtgtgtagttcatgtctta

SEQ ID NO: 390253 - DNA, 25 bp, Mus musculus
ctgtctgtgtgttggaatgtggatg

SEQ ID NO: 390254 - DNA, 25 bp, Mus musculus
ctgtctgtgtgttgttcatgtctta

SEQ ID NO: 390255 - DNA, 25 bp, Mus musculus
ctgtctgttattagcttttatattc

SEQ ID NO: 390256 - DNA, 25 bp, Mus musculus
ctgtctgttatttgcttttatattc

SEQ ID NO: 390257 - DNA, 25 bp, Mus musculus
ctgtctgttcacaattgtcctttca

SEQ ID NO: 390258 - DNA, 25 bp, Mus musculus
ctgtctgttcactattgtcctttca

SEQ ID NO: 390259 - DNA, 25 bp, Mus musculus
ctgtctgttggacagaagctcggat

SEQ ID NO: 390260 - DNA, 25 bp, Mus musculus
ctgtctgttggagagaagctcggat

SEQ ID NO: 390261 - DNA, 25 bp, Mus musculus
ctgtctgttgtgctgggcattacat

SEQ ID NO: 390262 - DNA, 25 bp, Mus musculus
ctgtctgttgtggtgggcattacat

SEQ ID NO: 390263 - DNA, 25 bp, Mus musculus
ctgtctgtttagatttctcctgttt

SEQ ID NO: 390264 - DNA, 25 bp, Mus musculus
ctgtctgtttagttttctcctgttt

SEQ ID NO: 390265 - DNA, 25 bp, Mus musculus
ctgtcttaaaacatgctgggtgtgc

SEQ ID NO: 390266 - DNA, 25 bp, Mus musculus
ctgtcttaaaacttgctgggtgtgc

SEQ ID NO: 390267 - DNA, 25 bp, Mus musculus
ctgtcttaaatacgcctgggatcaa

SEQ ID NO: 390268 - DNA, 25 bp, Mus musculus
ctgtcttaaataggcctgggatcaa

SEQ ID NO: 390269 - DNA, 25 bp, Mus musculus
ctgtcttaatcaccagtcagtcaga

SEQ ID NO: 390270 - DNA, 25 bp, Mus musculus
ctgtcttaatcagcagtcagtcaga

SEQ ID NO: 390271 - DNA, 25 bp, Mus musculus
ctgtcttaatccatgtatcctttcc

SEQ ID NO: 390272 - DNA, 25 bp, Mus musculus
ctgtcttaatccttgtatcctttcc

SEQ ID NO: 390273 - DNA, 25 bp, Mus musculus
ctgtcttaatggaatcctactgagc

SEQ ID NO: 390274 - DNA, 25 bp, Mus musculus
ctgtcttaatggtatcctactgagc

SEQ ID NO: 390275 - DNA, 25 bp, Mus musculus
ctgtcttacagtatcactcacaaaa

SEQ ID NO: 390276 - DNA, 25 bp, Mus musculus
ctgtcttacagtttcactcacaaaa

SEQ ID NO: 390277 - DNA, 25 bp, Mus musculus
ctgtcttacatcctgggttccatga

SEQ ID NO: 390278 - DNA, 25 bp, Mus musculus
ctgtcttacatcgtgggttccatga

SEQ ID NO: 390279 - DNA, 25 bp, Mus musculus
ctgtcttactcacccctaaagaaga

SEQ ID NO: 390280 - DNA, 25 bp, Mus musculus
ctgtcttactcagccctaaagaaga

SEQ ID NO: 390281 - DNA, 25 bp, Mus musculus
ctgtcttacttaactcaacttctgt

SEQ ID NO: 390282 - DNA, 25 bp, Mus musculus
ctgtcttacttatctcaacttctgt

SEQ ID NO: 390283 - DNA, 25 bp, Mus musculus
ctgtcttagtgaccccacaagtggg

SEQ ID NO: 390284 - DNA, 25 bp, Mus musculus
ctgtcttagtgagcccacaagtggg

SEQ ID NO: 390285 - DNA, 25 bp, Mus musculus
ctgtcttatctgaggccaaattctt

SEQ ID NO: 390286 - DNA, 25 bp, Mus musculus
ctgtcttatctgtggccaaattctt

SEQ ID NO: 390287 - DNA, 25 bp, Mus musculus
ctgtcttatgtcagtatactgggca

SEQ ID NO: 390288 - DNA, 25 bp, Mus musculus
ctgtcttatgtctgtatactgggca

SEQ ID NO: 390289 - DNA, 25 bp, Mus musculus
ctgtcttcagcacattcaagtccat

SEQ ID NO: 390290 - DNA, 25 bp, Mus musculus
ctgtcttcagcagattcaagtccat

SEQ ID NO: 390291 - DNA, 25 bp, Mus musculus
ctgtcttccaccagctggtgccggg

SEQ ID NO: 390292 - DNA, 25 bp, Mus musculus
ctgtcttccaccattggcagattgt

SEQ ID NO: 390293 - DNA, 25 bp, Mus musculus
ctgtcttccacctgctggtgccggg

SEQ ID NO: 390294 - DNA, 25 bp, Mus musculus
ctgtcttccacctttggcagattgt

SEQ ID NO: 390295 - DNA, 25 bp, Mus musculus
ctgtcttctaggcatagatgcccag

SEQ ID NO: 390296 - DNA, 25 bp, Mus musculus
ctgtcttctaggctctaagccaatg

SEQ ID NO: 390297 - DNA, 25 bp, Mus musculus
ctgtcttctagggatagatgcccag

SEQ ID NO: 390298 - DNA, 25 bp, Mus musculus
ctgtcttctagggtctaagccaatg

SEQ ID NO: 390299 - DNA, 25 bp, Mus musculus
ctgtcttctcttcgcactacaaata

SEQ ID NO: 390300 - DNA, 25 bp, Mus musculus
ctgtcttctcttggcactacaaata

SEQ ID NO: 390301 - DNA, 25 bp, Mus musculus
ctgtcttctgaaactcagctctcat

SEQ ID NO: 390302 - DNA, 25 bp, Mus musculus
ctgtcttctgaatctcagctctcat

SEQ ID NO: 390303 - DNA, 25 bp, Mus musculus
ctgtcttcttgcaatctccaataat

SEQ ID NO: 390304 - DNA, 25 bp, Mus musculus
ctgtcttcttgctatctccaataat

SEQ ID NO: 390305 - DNA, 25 bp, Mus musculus
ctgtcttcttggatccctcatgaat

SEQ ID NO: 390306 - DNA, 25 bp, Mus musculus
ctgtcttcttggttccctcatgaat

SEQ ID NO: 390307 - DNA, 25 bp, Mus musculus
ctgtcttctttgacctctgtaagag

SEQ ID NO: 390308 - DNA, 25 bp, Mus musculus
ctgtcttctttgagtgtaattgcca

SEQ ID NO: 390309 - DNA, 25 bp, Mus musculus
ctgtcttctttgtcctctgtaagag

SEQ ID NO: 390310 - DNA, 25 bp, Mus musculus
ctgtcttctttgtgtgtaattgcca

SEQ ID NO: 390311 - DNA, 25 bp, Mus musculus
ctgtcttcttttcgtgacccaggag

SEQ ID NO: 390312 - DNA, 25 bp, Mus musculus
ctgtcttcttttggtgacccaggag

SEQ ID NO: 390313 - DNA, 25 bp, Mus musculus
ctgtcttgaaaaatgccatgaatga

SEQ ID NO: 390314 - DNA, 25 bp, Mus musculus
ctgtcttgaaaattgccatgaatga

SEQ ID NO: 390315 - DNA, 25 bp, Mus musculus
ctgtcttgaaccatactttgaaaga

SEQ ID NO: 390316 - DNA, 25 bp, Mus musculus
ctgtcttgaaccttactttgaaaga

SEQ ID NO: 390317 - DNA, 25 bp, Mus musculus
ctgtcttgaagaatatgctgtttat

SEQ ID NO: 390318 - DNA, 25 bp, Mus musculus
ctgtcttgaagattatgctgtttat

SEQ ID NO: 390319 - DNA, 25 bp, Mus musculus
ctgtcttgacatatctataccagtg

SEQ ID NO: 390320 - DNA, 25 bp, Mus musculus
ctgtcttgacatttctataccagtg

SEQ ID NO: 390321 - DNA, 25 bp, Mus musculus
ctgtcttgacctccggtgataggga

SEQ ID NO: 390322 - DNA, 25 bp, Mus musculus
ctgtcttgacctgcggtgataggga

SEQ ID NO: 390323 - DNA, 25 bp, Mus musculus
ctgtcttgactcaaaagctgggcaa

SEQ ID NO: 390324 - DNA, 25 bp, Mus musculus
ctgtcttgactctaaagctgggcaa

SEQ ID NO: 390325 - DNA, 25 bp, Mus musculus
ctgtcttgagacaaagtatccatat

SEQ ID NO: 390326 - DNA, 25 bp, Mus musculus
ctgtcttgagacagcccctggtgct

SEQ ID NO: 390327 - DNA, 25 bp, Mus musculus
ctgtcttgagactaagtatccatat

SEQ ID NO: 390328 - DNA, 25 bp, Mus musculus
ctgtcttgagactgcccctggtgct

SEQ ID NO: 390329 - DNA, 25 bp, Mus musculus
ctgtcttgagtgagcaggttttaca

SEQ ID NO: 390330 - DNA, 25 bp, Mus musculus
ctgtcttgagtgtgcaggttttaca

SEQ ID NO: 390331 - DNA, 25 bp, Mus musculus
ctgtcttgccaacaactgcagatgg

SEQ ID NO: 390332 - DNA, 25 bp, Mus musculus
ctgtcttgccaagaactgcagatgg

SEQ ID NO: 390333 - DNA, 25 bp, Mus musculus
ctgtcttgcctgagggaccgagcaa

SEQ ID NO: 390334 - DNA, 25 bp, Mus musculus
ctgtcttgcctgtgggaccgagcaa

SEQ ID NO: 390335 - DNA, 25 bp, Mus musculus
ctgtcttgctatctgatctccgtaa

SEQ ID NO: 390336 - DNA, 25 bp, Mus musculus
ctgtcttgctatgtgatctccgtaa

SEQ ID NO: 390337 - DNA, 25 bp, Mus musculus
ctgtcttgctgtattgcagttcttt

SEQ ID NO: 390338 - DNA, 25 bp, Mus musculus
ctgtcttgctgttttgcagttcttt

SEQ ID NO: 390339 - DNA, 25 bp, Mus musculus
ctgtcttggactactctttgtttat

SEQ ID NO: 390340 - DNA, 25 bp, Mus musculus
ctgtcttggacttctctttgtttat

SEQ ID NO: 390341 - DNA, 25 bp, Mus musculus
ctgtcttggcagagctaagctgtcg

SEQ ID NO: 390342 - DNA, 25 bp, Mus musculus
ctgtcttggcagtgctaagctgtcg

SEQ ID NO: 390343 - DNA, 25 bp, Mus musculus
ctgtcttgtcatactcacctaggaa

SEQ ID NO: 390344 - DNA, 25 bp, Mus musculus
ctgtcttgtcattctcacctaggaa

SEQ ID NO: 390345 - DNA, 25 bp, Mus musculus
ctgtcttgtctcaggagacttgaaa

SEQ ID NO: 390346 - DNA, 25 bp, Mus musculus
ctgtcttgtctctggagacttgaaa

SEQ ID NO: 390347 - DNA, 25 bp, Mus musculus
ctgtcttgtcttctggtgagtgaac

SEQ ID NO: 390348 - DNA, 25 bp, Mus musculus
ctgtcttgtcttgtggtgagtgaac

SEQ ID NO: 390349 - DNA, 25 bp, Mus musculus
ctgtcttgttagaactggtagccat

SEQ ID NO: 390350 - DNA, 25 bp, Mus musculus
ctgtcttgttagtactggtagccat

SEQ ID NO: 390351 - DNA, 25 bp, Mus musculus
ctgtctttatggaatgttctaggtg

SEQ ID NO: 390352 - DNA, 25 bp, Mus musculus
ctgtctttatggtatgttctaggtg

SEQ ID NO: 390353 - DNA, 25 bp, Mus musculus
ctgtctttccaaactagccgttaca

SEQ ID NO: 390354 - DNA, 25 bp, Mus musculus
ctgtctttccaatctagccgttaca

SEQ ID NO: 390355 - DNA, 25 bp, Mus musculus
ctgtctttcttcaatgttaggcaaa

SEQ ID NO: 390356 - DNA, 25 bp, Mus musculus
ctgtctttcttcctattcgagcgat

SEQ ID NO: 390357 - DNA, 25 bp, Mus musculus
ctgtctttcttcgtattcgagcgat

SEQ ID NO: 390358 - DNA, 25 bp, Mus musculus
ctgtctttcttctatgttaggcaaa

SEQ ID NO: 390359 - DNA, 25 bp, Mus musculus
ctgtctttgcgtatctcttctgtct

SEQ ID NO: 390360 - DNA, 25 bp, Mus musculus
ctgtctttgcgtttctcttctgtct

SEQ ID NO: 390361 - DNA, 25 bp, Mus musculus
ctgtctttgctgatacgttggtcac

SEQ ID NO: 390362 - DNA, 25 bp, Mus musculus
ctgtctttgctgttacgttggtcac

SEQ ID NO: 390363 - DNA, 25 bp, Mus musculus
ctgtctttgtccatgcctattttgc

SEQ ID NO: 390364 - DNA, 25 bp, Mus musculus
ctgtctttgtccttgcctattttgc

SEQ ID NO: 390365 - DNA, 25 bp, Mus musculus
ctgtctttgttcagagacatttctg

SEQ ID NO: 390366 - DNA, 25 bp, Mus musculus
ctgtctttgttctgagacatttctg

SEQ ID NO: 390367 - DNA, 25 bp, Mus musculus
ctgtcttttaagctctgatgagctc

SEQ ID NO: 390368 - DNA, 25 bp, Mus musculus
ctgtcttttaaggtctgatgagctc

SEQ ID NO: 390369 - DNA, 25 bp, Mus musculus
ctgtcttttagcatgcctttttgga

SEQ ID NO: 390370 - DNA, 25 bp, Mus musculus
ctgtcttttagcttgcctttttgga

SEQ ID NO: 390371 - DNA, 25 bp, Mus musculus
ctgtcttttgcgctgtgggtaataa

SEQ ID NO: 390372 - DNA, 25 bp, Mus musculus
ctgtcttttgcggtgtgggtaataa

SEQ ID NO: 390373 - DNA, 25 bp, Mus musculus
ctgtctttttctaacaggagcctca

SEQ ID NO: 390374 - DNA, 25 bp, Mus musculus
ctgtctttttcttacaggagcctca

SEQ ID NO: 390375 - DNA, 25 bp, Mus musculus
ctgtctttttgcatgccagtagaag

SEQ ID NO: 390376 - DNA, 25 bp, Mus musculus
ctgtctttttgcttgccagtagaag

SEQ ID NO: 390377 - DNA, 25 bp, Mus musculus
ctgtgaaacaccatgggccatagcc

SEQ ID NO: 390378 - DNA, 25 bp, Mus musculus
ctgtgaaacaccttgggccatagcc

SEQ ID NO: 390379 - DNA, 25 bp, Mus musculus
ctgtgaaactatcaggccctacctg

SEQ ID NO: 390380 - DNA, 25 bp, Mus musculus
ctgtgaaactatgaggccctacctg

SEQ ID NO: 390381 - DNA, 25 bp, Mus musculus
ctgtgaaactccaggtgtgggtgct

SEQ ID NO: 390382 - DNA, 25 bp, Mus musculus
ctgtgaaactcctggtgtgggtgct

SEQ ID NO: 390383 - DNA, 25 bp, Mus musculus
ctgtgaaactgactattggtttttt

SEQ ID NO: 390384 - DNA, 25 bp, Mus musculus
ctgtgaaactgagtattggtttttt

SEQ ID NO: 390385 - DNA, 25 bp, Mus musculus
ctgtgaaagattcccagtatctgat

SEQ ID NO: 390386 - DNA, 25 bp, Mus musculus
ctgtgaaagattgccagtatctgat

SEQ ID NO: 390387 - DNA, 25 bp, Mus musculus
ctgtgaaagtccatctgctgtcccc

SEQ ID NO: 390388 - DNA, 25 bp, Mus musculus
ctgtgaaagtccttctgctgtcccc

SEQ ID NO: 390389 - DNA, 25 bp, Mus musculus
ctgtgaaatctgaggcactcgcttc

SEQ ID NO: 390390 - DNA, 25 bp, Mus musculus
ctgtgaaatctgtggcactcgcttc

SEQ ID NO: 390391 - DNA, 25 bp, Mus musculus
ctgtgaacacagaagtagggccttt

SEQ ID NO: 390392 - DNA, 25 bp, Mus musculus
ctgtgaacacagtagtagggccttt

SEQ ID NO: 390393 - DNA, 25 bp, Mus musculus
ctgtgaacacctcctttacgattat

SEQ ID NO: 390394 - DNA, 25 bp, Mus musculus
ctgtgaacacctgctttacgattat

SEQ ID NO: 390395 - DNA, 25 bp, Mus musculus
ctgtgaacagaaatgcaaacgctaa

SEQ ID NO: 390396 - DNA, 25 bp, Mus musculus
ctgtgaacagaattgcaaacgctaa

SEQ ID NO: 390397 - DNA, 25 bp, Mus musculus
ctgtgaacagcacgataaagatcaa

SEQ ID NO: 390398 - DNA, 25 bp, Mus musculus
ctgtgaacagcacgcccgcaatgtg

SEQ ID NO: 390399 - DNA, 25 bp, Mus musculus
ctgtgaacagcaggataaagatcaa

SEQ ID NO: 390400 - DNA, 25 bp, Mus musculus
ctgtgaacagcaggcccgcaatgtg

SEQ ID NO: 390401 - DNA, 25 bp, Mus musculus
ctgtgaacccctctagaaaattgtg

SEQ ID NO: 390402 - DNA, 25 bp, Mus musculus
ctgtgaacccctgtagaaaattgtg

SEQ ID NO: 390403 - DNA, 25 bp, Mus musculus
ctgtgaactgggagctggaaattac

SEQ ID NO: 390404 - DNA, 25 bp, Mus musculus
ctgtgaactgggtgctggaaattac

SEQ ID NO: 390405 - DNA, 25 bp, Mus musculus
ctgtgaacttgcaggctgtgagcct

SEQ ID NO: 390406 - DNA, 25 bp, Mus musculus
ctgtgaacttgctggctgtgagcct

SEQ ID NO: 390407 - DNA, 25 bp, Mus musculus
ctgtgaagagacagtggctggccct

SEQ ID NO: 390408 - DNA, 25 bp, Mus musculus
ctgtgaagagactgtggctggccct

SEQ ID NO: 390409 - DNA, 25 bp, Mus musculus
ctgtgaagatgcagcccacgtcatg

SEQ ID NO: 390410 - DNA, 25 bp, Mus musculus
ctgtgaagatgctgcccacgtcatg

SEQ ID NO: 390411 - DNA, 25 bp, Mus musculus
ctgtgaagctttcccagtgcacttt

SEQ ID NO: 390412 - DNA, 25 bp, Mus musculus
ctgtgaagctttgccagtgcacttt

SEQ ID NO: 390413 - DNA, 25 bp, Mus musculus
ctgtgaagggccatgcttataatcc

SEQ ID NO: 390414 - DNA, 25 bp, Mus musculus
ctgtgaagggccttgcttataatcc

SEQ ID NO: 390415 - DNA, 25 bp, Mus musculus
ctgtgaagtgtgcttttgaccctca

SEQ ID NO: 390416 - DNA, 25 bp, Mus musculus
ctgtgaagtgtggttttgaccctca

SEQ ID NO: 390417 - DNA, 25 bp, Mus musculus
ctgtgaagttataccgaggcgtgaa

SEQ ID NO: 390418 - DNA, 25 bp, Mus musculus
ctgtgaagttattccgaggcgtgaa

SEQ ID NO: 390419 - DNA, 25 bp, Mus musculus
ctgtgaagttctccctcgaaaggtt

SEQ ID NO: 390420 - DNA, 25 bp, Mus musculus
ctgtgaagttctgcctcgaaaggtt

SEQ ID NO: 390421 - DNA, 25 bp, Mus musculus
ctgtgaagtttaaccctagtcacct

SEQ ID NO: 390422 - DNA, 25 bp, Mus musculus
ctgtgaagtttatccctagtcacct

SEQ ID NO: 390423 - DNA, 25 bp, Mus musculus
ctgtgaatcttcagccaggcagggt

SEQ ID NO: 390424 - DNA, 25 bp, Mus musculus
ctgtgaatcttctgccaggcagggt

SEQ ID NO: 390425 - DNA, 25 bp, Mus musculus
ctgtgaatgctgaatggtgtgtgtt

SEQ ID NO: 390426 - DNA, 25 bp, Mus musculus
ctgtgaatgctgtatggtgtgtgtt

SEQ ID NO: 390427 - DNA, 25 bp, Mus musculus
ctgtgaatgcttaccgtttactgtg

SEQ ID NO: 390428 - DNA, 25 bp, Mus musculus
ctgtgaatgctttccgtttactgtg

SEQ ID NO: 390429 - DNA, 25 bp, Mus musculus
ctgtgaatgtcgaaggccctaaaac

SEQ ID NO: 390430 - DNA, 25 bp, Mus musculus
ctgtgaatgtcgaatattgagaaac

SEQ ID NO: 390431 - DNA, 25 bp, Mus musculus
ctgtgaatgtcgtaggccctaaaac

SEQ ID NO: 390432 - DNA, 25 bp, Mus musculus
ctgtgaatgtcgtatattgagaaac

SEQ ID NO: 390433 - DNA, 25 bp, Mus musculus
ctgtgaattccgattttttgttctg

SEQ ID NO: 390434 - DNA, 25 bp, Mus musculus
ctgtgaattccgtttttttgttctg

SEQ ID NO: 390435 - DNA, 25 bp, Mus musculus
ctgtgaatttgtcttatcggcgctt

SEQ ID NO: 390436 - DNA, 25 bp, Mus musculus
ctgtgaatttgtgttatcggcgctt

SEQ ID NO: 390437 - DNA, 25 bp, Mus musculus
ctgtgaattttacggattcggaagc

SEQ ID NO: 390438 - DNA, 25 bp, Mus musculus
ctgtgaattttagggattcggaagc

SEQ ID NO: 390439 - DNA, 25 bp, Mus musculus
ctgtgaattttcaccccccagagtt

SEQ ID NO: 390440 - DNA, 25 bp, Mus musculus
ctgtgaattttctccccccagagtt

SEQ ID NO: 390441 - DNA, 25 bp, Mus musculus
ctgtgacaacacattgctgacaaat

SEQ ID NO: 390442 - DNA, 25 bp, Mus musculus
ctgtgacaacactttgctgacaaat

SEQ ID NO: 390443 - DNA, 25 bp, Mus musculus
ctgtgacaatacattcctagggaat

SEQ ID NO: 390444 - DNA, 25 bp, Mus musculus
ctgtgacaatactttcctagggaat

SEQ ID NO: 390445 - DNA, 25 bp, Mus musculus
ctgtgacacagaaagcctaagaatt

SEQ ID NO: 390446 - DNA, 25 bp, Mus musculus
ctgtgacacagatagcctaagaatt

SEQ ID NO: 390447 - DNA, 25 bp, Mus musculus
ctgtgacacagtccctaaggatccc

SEQ ID NO: 390448 - DNA, 25 bp, Mus musculus
ctgtgacacagtgcctaaggatccc

SEQ ID NO: 390449 - DNA, 25 bp, Mus musculus
ctgtgacagacacgcggctgtgcaa

SEQ ID NO: 390450 - DNA, 25 bp, Mus musculus
ctgtgacagacaggcggctgtgcaa

SEQ ID NO: 390451 - DNA, 25 bp, Mus musculus
ctgtgacagaccacttggaccagga

SEQ ID NO: 390452 - DNA, 25 bp, Mus musculus
ctgtgacagacctcttggaccagga

SEQ ID NO: 390453 - DNA, 25 bp, Mus musculus
ctgtgacagcaccatggtgacccgt

SEQ ID NO: 390454 - DNA, 25 bp, Mus musculus
ctgtgacagcacgatggtgacccgt

SEQ ID NO: 390455 - DNA, 25 bp, Mus musculus
ctgtgacatcatcaagtgtaaatga

SEQ ID NO: 390456 - DNA, 25 bp, Mus musculus
ctgtgacatcatgaagtgtaaatga

SEQ ID NO: 390457 - DNA, 25 bp, Mus musculus
ctgtgacatgaaaagttcctgtatt

SEQ ID NO: 390458 - DNA, 25 bp, Mus musculus
ctgtgacatgaatagttcctgtatt

SEQ ID NO: 390459 - DNA, 25 bp, Mus musculus
ctgtgacatggaattctgctctgct

SEQ ID NO: 390460 - DNA, 25 bp, Mus musculus
ctgtgacatggatttctgctctgct

SEQ ID NO: 390461 - DNA, 25 bp, Mus musculus
ctgtgacattccacagtgttcagaa

SEQ ID NO: 390462 - DNA, 25 bp, Mus musculus
ctgtgacattcctcagtgttcagaa

SEQ ID NO: 390463 - DNA, 25 bp, Mus musculus
ctgtgacatttgctgcaataaactt

SEQ ID NO: 390464 - DNA, 25 bp, Mus musculus
ctgtgacatttggtgcaataaactt

SEQ ID NO: 390465 - DNA, 25 bp, Mus musculus
ctgtgaccatgaaaatgcagccttc

SEQ ID NO: 390466 - DNA, 25 bp, Mus musculus
ctgtgaccatgataatgcagccttc

SEQ ID NO: 390467 - DNA, 25 bp, Mus musculus
ctgtgacccacactgaccttcatgt

SEQ ID NO: 390468 - DNA, 25 bp, Mus musculus
ctgtgacccacagtgaccttcatgt

SEQ ID NO: 390469 - DNA, 25 bp, Mus musculus
ctgtgacccagtcgcatactgtttg

SEQ ID NO: 390470 - DNA, 25 bp, Mus musculus
ctgtgacccagtggcatactgtttg

SEQ ID NO: 390471 - DNA, 25 bp, Mus musculus
ctgtgaccccagacccaagggattt

SEQ ID NO: 390472 - DNA, 25 bp, Mus musculus
ctgtgaccccagtcccaagggattt

SEQ ID NO: 390473 - DNA, 25 bp, Mus musculus
ctgtgacccccaatttgacctcaga

SEQ ID NO: 390474 - DNA, 25 bp, Mus musculus
ctgtgacccccattttgacctcaga

SEQ ID NO: 390475 - DNA, 25 bp, Mus musculus
ctgtgaccctaacatttgactcgtg

SEQ ID NO: 390476 - DNA, 25 bp, Mus musculus
ctgtgaccctaagatttgactcgtg

SEQ ID NO: 390477 - DNA, 25 bp, Mus musculus
ctgtgacctaatactgaggctttag

SEQ ID NO: 390478 - DNA, 25 bp, Mus musculus
ctgtgacctaattctgaggctttag

SEQ ID NO: 390479 - DNA, 25 bp, Mus musculus
ctgtgacctctcatctgggagaaaa

SEQ ID NO: 390480 - DNA, 25 bp, Mus musculus
ctgtgacctctcttctgggagaaaa

SEQ ID NO: 390481 - DNA, 25 bp, Mus musculus
ctgtgaccttcacctgacaggtttg

SEQ ID NO: 390482 - DNA, 25 bp, Mus musculus
ctgtgaccttcagctgacaggtttg

SEQ ID NO: 390483 - DNA, 25 bp, Mus musculus
ctgtgacgacagaggaacctgcgat

SEQ ID NO: 390484 - DNA, 25 bp, Mus musculus
ctgtgacgacagtggaacctgcgat

SEQ ID NO: 390485 - DNA, 25 bp, Mus musculus
ctgtgacgagaacaacggctgtgta

SEQ ID NO: 390486 - DNA, 25 bp, Mus musculus
ctgtgacgagaagaacggctgtgta

SEQ ID NO: 390487 - DNA, 25 bp, Mus musculus
ctgtgactcccaccggtgtgtccct

SEQ ID NO: 390488 - DNA, 25 bp, Mus musculus
ctgtgactcccagcggtgtgtccct

SEQ ID NO: 390489 - DNA, 25 bp, Mus musculus
ctgtgactccgcaggccctgtgggt

SEQ ID NO: 390490 - DNA, 25 bp, Mus musculus
ctgtgactccgctggccctgtgggt

SEQ ID NO: 390491 - DNA, 25 bp, Mus musculus
ctgtgactctctacctgggcatggg

SEQ ID NO: 390492 - DNA, 25 bp, Mus musculus
ctgtgactctcttcctgggcatggg

SEQ ID NO: 390493 - DNA, 25 bp, Mus musculus
ctgtgactgattacctcatgttcct

SEQ ID NO: 390494 - DNA, 25 bp, Mus musculus
ctgtgactgatttcctcatgttcct

SEQ ID NO: 390495 - DNA, 25 bp, Mus musculus
ctgtgactggcactggaccactgat

SEQ ID NO: 390496 - DNA, 25 bp, Mus musculus
ctgtgactggcagtggaccactgat

SEQ ID NO: 390497 - DNA, 25 bp, Mus musculus
ctgtgactggtactttctggatctc

SEQ ID NO: 390498 - DNA, 25 bp, Mus musculus
ctgtgactggtagtttctggatctc

SEQ ID NO: 390499 - DNA, 25 bp, Mus musculus
ctgtgactgtgaagtccgcatcttg

SEQ ID NO: 390500 - DNA, 25 bp, Mus musculus
ctgtgactgtgatgtccgcatcttg

SEQ ID NO: 390501 - DNA, 25 bp, Mus musculus
ctgtgacttcacctcaagttgtaat

SEQ ID NO: 390502 - DNA, 25 bp, Mus musculus
ctgtgacttcacgtcaagttgtaat

SEQ ID NO: 390503 - DNA, 25 bp, Mus musculus
ctgtgacttcttcactaatatttta

SEQ ID NO: 390504 - DNA, 25 bp, Mus musculus
ctgtgacttcttgactaatatttta

SEQ ID NO: 390505 - DNA, 25 bp, Mus musculus
ctgtgacttgggagtcaataaagag

SEQ ID NO: 390506 - DNA, 25 bp, Mus musculus
ctgtgacttgggtgtcaataaagag

SEQ ID NO: 390507 - DNA, 25 bp, Mus musculus
ctgtgactttgacgatctatattgt

SEQ ID NO: 390508 - DNA, 25 bp, Mus musculus
ctgtgactttgaggatctatattgt

SEQ ID NO: 390509 - DNA, 25 bp, Mus musculus
ctgtgactttgtaaagctacgggaa

SEQ ID NO: 390510 - DNA, 25 bp, Mus musculus
ctgtgactttgttaagctacgggaa

SEQ ID NO: 390511 - DNA, 25 bp, Mus musculus
ctgtgagaatgcagagccccgacat

SEQ ID NO: 390512 - DNA, 25 bp, Mus musculus
ctgtgagaatgctgagccccgacat

SEQ ID NO: 390513 - DNA, 25 bp, Mus musculus
ctgtgagactgcagctgaactggat

SEQ ID NO: 390514 - DNA, 25 bp, Mus musculus
ctgtgagactgctgctgaactggat

SEQ ID NO: 390515 - DNA, 25 bp, Mus musculus
ctgtgagagccaacgggagactgtc

SEQ ID NO: 390516 - DNA, 25 bp, Mus musculus
ctgtgagagccatcgggagactgtc

SEQ ID NO: 390517 - DNA, 25 bp, Mus musculus
ctgtgagagtgacgcccagttccct

SEQ ID NO: 390518 - DNA, 25 bp, Mus musculus
ctgtgagagtgaggcccagttccct

SEQ ID NO: 390519 - DNA, 25 bp, Mus musculus
ctgtgagcacagcatggtcggaact

SEQ ID NO: 390520 - DNA, 25 bp, Mus musculus
ctgtgagcacaggatggtcggaact

SEQ ID NO: 390521 - DNA, 25 bp, Mus musculus
ctgtgagcactaaaggtccccctga

SEQ ID NO: 390522 - DNA, 25 bp, Mus musculus
ctgtgagcactataggtccccctga

SEQ ID NO: 390523 - DNA, 25 bp, Mus musculus
ctgtgagcagaaagcagcctctgtt

SEQ ID NO: 390524 - DNA, 25 bp, Mus musculus
ctgtgagcagaatgcagcctctgtt

SEQ ID NO: 390525 - DNA, 25 bp, Mus musculus
ctgtgagccacaaacctaggtgttt

SEQ ID NO: 390526 - DNA, 25 bp, Mus musculus
ctgtgagccacatacctaggtgttt

SEQ ID NO: 390527 - DNA, 25 bp, Mus musculus
ctgtgagccaccaagagtgaacgga

SEQ ID NO: 390528 - DNA, 25 bp, Mus musculus
ctgtgagccacctagagtgaacgga

SEQ ID NO: 390529 - DNA, 25 bp, Mus musculus
ctgtgagcccatagtattacaaacc

SEQ ID NO: 390530 - DNA, 25 bp, Mus musculus
ctgtgagcccattgtattacaaacc

SEQ ID NO: 390531 - DNA, 25 bp, Mus musculus
ctgtgagccctcaataaaacttttt

SEQ ID NO: 390532 - DNA, 25 bp, Mus musculus
ctgtgagccctctataaaacttttt

SEQ ID NO: 390533 - DNA, 25 bp, Mus musculus
ctgtgagccgacacttcaggaacat

SEQ ID NO: 390534 - DNA, 25 bp, Mus musculus
ctgtgagccgactcttcaggaacat

SEQ ID NO: 390535 - DNA, 25 bp, Mus musculus
ctgtgagcctcaccagcttgtagag

SEQ ID NO: 390536 - DNA, 25 bp, Mus musculus
ctgtgagcctcagcagcttgtagag

SEQ ID NO: 390537 - DNA, 25 bp, Mus musculus
ctgtgagcgattattccagcagtca

SEQ ID NO: 390538 - DNA, 25 bp, Mus musculus
ctgtgagcgatttttccagcagtca

SEQ ID NO: 390539 - DNA, 25 bp, Mus musculus
ctgtgagctacactatgtggtgtat

SEQ ID NO: 390540 - DNA, 25 bp, Mus musculus
ctgtgagctacagtatgtggtgtat

SEQ ID NO: 390541 - DNA, 25 bp, Mus musculus
ctgtgagctgccattagacgctggg

SEQ ID NO: 390542 - DNA, 25 bp, Mus musculus
ctgtgagctgcctttagacgctggg

SEQ ID NO: 390543 - DNA, 25 bp, Mus musculus
ctgtgagctgtcagaaataggtgca

SEQ ID NO: 390544 - DNA, 25 bp, Mus musculus
ctgtgagctgtctgaaataggtgca

SEQ ID NO: 390545 - DNA, 25 bp, Mus musculus
ctgtgagcttcactctcctcatctg

SEQ ID NO: 390546 - DNA, 25 bp, Mus musculus
ctgtgagcttcagtctcctcatctg

SEQ ID NO: 390547 - DNA, 25 bp, Mus musculus
ctgtgaggacataatgccttggttt

SEQ ID NO: 390548 - DNA, 25 bp, Mus musculus
ctgtgaggacattatgccttggttt

SEQ ID NO: 390549 - DNA, 25 bp, Mus musculus
ctgtgaggaccaattttggcattcc

SEQ ID NO: 390550 - DNA, 25 bp, Mus musculus
ctgtgaggaccatttttggcattcc

SEQ ID NO: 390551 - DNA, 25 bp, Mus musculus
ctgtgaggagtaatctgctgctgaa

SEQ ID NO: 390552 - DNA, 25 bp, Mus musculus
ctgtgaggagtattctgctgctgaa

SEQ ID NO: 390553 - DNA, 25 bp, Mus musculus
ctgtgaggatgcagccaaaaggccc

SEQ ID NO: 390554 - DNA, 25 bp, Mus musculus
ctgtgaggatgctgccaaaaggccc

SEQ ID NO: 390555 - DNA, 25 bp, Mus musculus
ctgtgaggccccagcagtgtgtaca

SEQ ID NO: 390556 - DNA, 25 bp, Mus musculus
ctgtgaggcccctgcagtgtgtaca

SEQ ID NO: 390557 - DNA, 25 bp, Mus musculus
ctgtgagggctaccctggttgacat

SEQ ID NO: 390558 - DNA, 25 bp, Mus musculus
ctgtgagggctagcctggttgacat

SEQ ID NO: 390559 - DNA, 25 bp, Mus musculus
ctgtgagggtcaccagagcaggctt

SEQ ID NO: 390560 - DNA, 25 bp, Mus musculus
ctgtgagggtcagcagagcaggctt

SEQ ID NO: 390561 - DNA, 25 bp, Mus musculus
ctgtgaggtgaaatgggactacttt

SEQ ID NO: 390562 - DNA, 25 bp, Mus musculus
ctgtgaggtgaattgggactacttt

SEQ ID NO: 390563 - DNA, 25 bp, Mus musculus
ctgtgaggtgcgagctctggaagag

SEQ ID NO: 390564 - DNA, 25 bp, Mus musculus
ctgtgaggtgcgtgctctggaagag

SEQ ID NO: 390565 - DNA, 25 bp, Mus musculus
ctgtgaggtgttagctgctccatca

SEQ ID NO: 390566 - DNA, 25 bp, Mus musculus
ctgtgaggtgtttgctgctccatca

SEQ ID NO: 390567 - DNA, 25 bp, Mus musculus
ctgtgagtaactcccatgacgactt

SEQ ID NO: 390568 - DNA, 25 bp, Mus musculus
ctgtgagtaactgccatgacgactt

SEQ ID NO: 390569 - DNA, 25 bp, Mus musculus
ctgtgagtacgtctgggagcaacca

SEQ ID NO: 390570 - DNA, 25 bp, Mus musculus
ctgtgagtacgtgtgggagcaacca

SEQ ID NO: 390571 - DNA, 25 bp, Mus musculus
ctgtgagtcctcagaagcgggttca

SEQ ID NO: 390572 - DNA, 25 bp, Mus musculus
ctgtgagtcctctgaagcgggttca

SEQ ID NO: 390573 - DNA, 25 bp, Mus musculus
ctgtgagtcgcaccaccgaggtgaa

SEQ ID NO: 390574 - DNA, 25 bp, Mus musculus
ctgtgagtcgcagcaccgaggtgaa

SEQ ID NO: 390575 - DNA, 25 bp, Mus musculus
ctgtgagtcgctacttcgggaatgt

SEQ ID NO: 390576 - DNA, 25 bp, Mus musculus
ctgtgagtcgcttcttcgggaatgt

SEQ ID NO: 390577 - DNA, 25 bp, Mus musculus
ctgtgagtgcctattggtctggaaa

SEQ ID NO: 390578 - DNA, 25 bp, Mus musculus
ctgtgagtgccttttggtctggaaa

SEQ ID NO: 390579 - DNA, 25 bp, Mus musculus
ctgtgagtgggaccctttgttttat

SEQ ID NO: 390580 - DNA, 25 bp, Mus musculus
ctgtgagtgggagcctttgttttat

SEQ ID NO: 390581 - DNA, 25 bp, Mus musculus
ctgtgagtgtctaggagttcttgct

SEQ ID NO: 390582 - DNA, 25 bp, Mus musculus
ctgtgagtgtcttggagttcttgct

SEQ ID NO: 390583 - DNA, 25 bp, Mus musculus
ctgtgagttactctagaacaagcat

SEQ ID NO: 390584 - DNA, 25 bp, Mus musculus
ctgtgagttactgtagaacaagcat

SEQ ID NO: 390585 - DNA, 25 bp, Mus musculus
ctgtgagttcagaatcagtctggta

SEQ ID NO: 390586 - DNA, 25 bp, Mus musculus
ctgtgagttcagtatcagtctggta

SEQ ID NO: 390587 - DNA, 25 bp, Mus musculus
ctgtgagttgctatggagtccttga

SEQ ID NO: 390588 - DNA, 25 bp, Mus musculus
ctgtgagttgctttggagtccttga

SEQ ID NO: 390589 - DNA, 25 bp, Mus musculus
ctgtgagtttagatacctggtttac

SEQ ID NO: 390590 - DNA, 25 bp, Mus musculus
ctgtgagtttagttacctggtttac

SEQ ID NO: 390591 - DNA, 25 bp, Mus musculus
ctgtgagtttgcatgggctggcctt

SEQ ID NO: 390592 - DNA, 25 bp, Mus musculus
ctgtgagtttgcttgggctggcctt

SEQ ID NO: 390593 - DNA, 25 bp, Mus musculus
ctgtgatacacacctctcaagatga

SEQ ID NO: 390594 - DNA, 25 bp, Mus musculus
ctgtgatacacagctctcaagatga

SEQ ID NO: 390595 - DNA, 25 bp, Mus musculus
ctgtgataccgacgcctggtgcatg

SEQ ID NO: 390596 - DNA, 25 bp, Mus musculus
ctgtgataccgaggcctggtgcatg

SEQ ID NO: 390597 - DNA, 25 bp, Mus musculus
ctgtgatatgatcggctaatgattt

SEQ ID NO: 390598 - DNA, 25 bp, Mus musculus
ctgtgatatgatgggctaatgattt

SEQ ID NO: 390599 - DNA, 25 bp, Mus musculus
ctgtgatattcaaaagggtacttct

SEQ ID NO: 390600 - DNA, 25 bp, Mus musculus
ctgtgatattcataagggtacttct

SEQ ID NO: 390601 - DNA, 25 bp, Mus musculus
ctgtgatcaacaaggagctatggtg

SEQ ID NO: 390602 - DNA, 25 bp, Mus musculus
ctgtgatcaacatggagctatggtg

SEQ ID NO: 390603 - DNA, 25 bp, Mus musculus
ctgtgatcaactctgcagacaacac

SEQ ID NO: 390604 - DNA, 25 bp, Mus musculus
ctgtgatcaactgtgcagacaacac

SEQ ID NO: 390605 - DNA, 25 bp, Mus musculus
ctgtgatcatacctggtcctgatga

SEQ ID NO: 390606 - DNA, 25 bp, Mus musculus
ctgtgatcatacgtggtcctgatga

SEQ ID NO: 390607 - DNA, 25 bp, Mus musculus
ctgtgatccaagacatgggcgctac

SEQ ID NO: 390608 - DNA, 25 bp, Mus musculus
ctgtgatccaagtcatgggcgctac

SEQ ID NO: 390609 - DNA, 25 bp, Mus musculus
ctgtgatccatcagagggcagctca

SEQ ID NO: 390610 - DNA, 25 bp, Mus musculus
ctgtgatccatctgagggcagctca

SEQ ID NO: 390611 - DNA, 25 bp, Mus musculus
ctgtgatcccctcaagagtccagat

SEQ ID NO: 390612 - DNA, 25 bp, Mus musculus
ctgtgatcccctgaagagtccagat

SEQ ID NO: 390613 - DNA, 25 bp, Mus musculus
ctgtgatcctataagcttgtgatgt

SEQ ID NO: 390614 - DNA, 25 bp, Mus musculus
ctgtgatcctattagcttgtgatgt

SEQ ID NO: 390615 - DNA, 25 bp, Mus musculus
ctgtgatcctgacaactgctgtcaa

SEQ ID NO: 390616 - DNA, 25 bp, Mus musculus
ctgtgatcctgagaactgctgtcaa

SEQ ID NO: 390617 - DNA, 25 bp, Mus musculus
ctgtgatcctttccagtcttaggga

SEQ ID NO: 390618 - DNA, 25 bp, Mus musculus
ctgtgatcctttgcagtcttaggga

SEQ ID NO: 390619 - DNA, 25 bp, Mus musculus
ctgtgatctgtgctagtggactcta

SEQ ID NO: 390620 - DNA, 25 bp, Mus musculus
ctgtgatctgtggtagtggactcta

SEQ ID NO: 390621 - DNA, 25 bp, Mus musculus
ctgtgatgaagaccctcagactcgg

SEQ ID NO: 390622 - DNA, 25 bp, Mus musculus
ctgtgatgaagagcctcagactcgg

SEQ ID NO: 390623 - DNA, 25 bp, Mus musculus
ctgtgatgagttcatgaccaggcat

SEQ ID NO: 390624 - DNA, 25 bp, Mus musculus
ctgtgatgagttgatgaccaggcat

SEQ ID NO: 390625 - DNA, 25 bp, Mus musculus
ctgtgatgatcaccccaattttggt

SEQ ID NO: 390626 - DNA, 25 bp, Mus musculus
ctgtgatgatcagcccaattttggt

SEQ ID NO: 390627 - DNA, 25 bp, Mus musculus
ctgtgatgcagcagctaactcagaa

SEQ ID NO: 390628 - DNA, 25 bp, Mus musculus
ctgtgatgcagctgctaactcagaa

SEQ ID NO: 390629 - DNA, 25 bp, Mus musculus
ctgtgatgcgtaagtgtgatgttct

SEQ ID NO: 390630 - DNA, 25 bp, Mus musculus
ctgtgatgcgtatgtgtgatgttct

SEQ ID NO: 390631 - DNA, 25 bp, Mus musculus
ctgtgatgctatcgtatccccactg

SEQ ID NO: 390632 - DNA, 25 bp, Mus musculus
ctgtgatgctatggtatccccactg

SEQ ID NO: 390633 - DNA, 25 bp, Mus musculus
ctgtgatggagcacccgaggactcg

SEQ ID NO: 390634 - DNA, 25 bp, Mus musculus
ctgtgatggagctcccgaggactcg

SEQ ID NO: 390635 - DNA, 25 bp, Mus musculus
ctgtgatgggaaccccgcataaagc

SEQ ID NO: 390636 - DNA, 25 bp, Mus musculus
ctgtgatgggaagcccgcataaagc

SEQ ID NO: 390637 - DNA, 25 bp, Mus musculus
ctgtgatgtactctgggcagttctt

SEQ ID NO: 390638 - DNA, 25 bp, Mus musculus
ctgtgatgtactgtgggcagttctt

SEQ ID NO: 390639 - DNA, 25 bp, Mus musculus
ctgtgatgtgaacccatacagcgct

SEQ ID NO: 390640 - DNA, 25 bp, Mus musculus
ctgtgatgtgaagccatacagcgct

SEQ ID NO: 390641 - DNA, 25 bp, Mus musculus
ctgtgatgtgtgaattccacctttt

SEQ ID NO: 390642 - DNA, 25 bp, Mus musculus
ctgtgatgtgtgtattccacctttt

SEQ ID NO: 390643 - DNA, 25 bp, Mus musculus
ctgtgatgttggacttggtggcttc

SEQ ID NO: 390644 - DNA, 25 bp, Mus musculus
ctgtgatgttggtcttggtggcttc

SEQ ID NO: 390645 - DNA, 25 bp, Mus musculus
ctgtgattacagaacgtcgaggaga

SEQ ID NO: 390646 - DNA, 25 bp, Mus musculus
ctgtgattacagtacgtcgaggaga

SEQ ID NO: 390647 - DNA, 25 bp, Mus musculus
ctgtgattactaactgtcatccacc

SEQ ID NO: 390648 - DNA, 25 bp, Mus musculus
ctgtgattactatctgtcatccacc

SEQ ID NO: 390649 - DNA, 25 bp, Mus musculus
ctgtgattaggtccccttatggcag

SEQ ID NO: 390650 - DNA, 25 bp, Mus musculus
ctgtgattaggtgcccttatggcag

SEQ ID NO: 390651 - DNA, 25 bp, Mus musculus
ctgtgattccacctatgatgtttga

SEQ ID NO: 390652 - DNA, 25 bp, Mus musculus
ctgtgattccacgtatgatgtttga

SEQ ID NO: 390653 - DNA, 25 bp, Mus musculus
ctgtgattccttatagttaccgagt

SEQ ID NO: 390654 - DNA, 25 bp, Mus musculus
ctgtgattccttttagttaccgagt

SEQ ID NO: 390655 - DNA, 25 bp, Mus musculus
ctgtgattgaagacccacacgtgac

SEQ ID NO: 390656 - DNA, 25 bp, Mus musculus
ctgtgattgaagtcccacacgtgac

SEQ ID NO: 390657 - DNA, 25 bp, Mus musculus
ctgtgatttcacctccagaatttgg

SEQ ID NO: 390658 - DNA, 25 bp, Mus musculus
ctgtgatttcacgtccagaatttgg

SEQ ID NO: 390659 - DNA, 25 bp, Mus musculus
ctgtgatttcccatctgtgtgtcat

SEQ ID NO: 390660 - DNA, 25 bp, Mus musculus
ctgtgatttccccatactttccatc

SEQ ID NO: 390661 - DNA, 25 bp, Mus musculus
ctgtgatttcccgatactttccatc

SEQ ID NO: 390662 - DNA, 25 bp, Mus musculus
ctgtgatttcccttctgtgtgtcat

SEQ ID NO: 390663 - DNA, 25 bp, Mus musculus
ctgtgatttcctattgggtgtattt

SEQ ID NO: 390664 - DNA, 25 bp, Mus musculus
ctgtgatttccttttgggtgtattt

SEQ ID NO: 390665 - DNA, 25 bp, Mus musculus
ctgtgattttccagttgcccgggat

SEQ ID NO: 390666 - DNA, 25 bp, Mus musculus
ctgtgattttcccagtcagcgactg

SEQ ID NO: 390667 - DNA, 25 bp, Mus musculus
ctgtgattttccgagtcagcgactg

SEQ ID NO: 390668 - DNA, 25 bp, Mus musculus
ctgtgattttcctgttgcccgggat

SEQ ID NO: 390669 - DNA, 25 bp, Mus musculus
ctgtgcaaacaaactcaagagctgc

SEQ ID NO: 390670 - DNA, 25 bp, Mus musculus
ctgtgcaaacaatctcaagagctgc

SEQ ID NO: 390671 - DNA, 25 bp, Mus musculus
ctgtgcaaacagacagtggccagca

SEQ ID NO: 390672 - DNA, 25 bp, Mus musculus
ctgtgcaaacagtcagtggccagca

SEQ ID NO: 390673 - DNA, 25 bp, Mus musculus
ctgtgcaaatagaaccatgtgtagc

SEQ ID NO: 390674 - DNA, 25 bp, Mus musculus
ctgtgcaaatagtaccatgtgtagc

SEQ ID NO: 390675 - DNA, 25 bp, Mus musculus
ctgtgcaacaaaagcttagaacctg

SEQ ID NO: 390676 - DNA, 25 bp, Mus musculus
ctgtgcaacaaatgcttagaacctg

SEQ ID NO: 390677 - DNA, 25 bp, Mus musculus
ctgtgcaactgaatcccttccagac

SEQ ID NO: 390678 - DNA, 25 bp, Mus musculus
ctgtgcaactgattcccttccagac

SEQ ID NO: 390679 - DNA, 25 bp, Mus musculus
ctgtgcaagcttcaggttccaagca

SEQ ID NO: 390680 - DNA, 25 bp, Mus musculus
ctgtgcaagcttgaggttccaagca

SEQ ID NO: 390681 - DNA, 25 bp, Mus musculus
ctgtgcaattgtcttccctttacct

SEQ ID NO: 390682 - DNA, 25 bp, Mus musculus
ctgtgcaattgtgttccctttacct

SEQ ID NO: 390683 - DNA, 25 bp, Mus musculus
ctgtgcacagatactggcagccctg

SEQ ID NO: 390684 - DNA, 25 bp, Mus musculus
ctgtgcacagattctggcagccctg

SEQ ID NO: 390685 - DNA, 25 bp, Mus musculus
ctgtgcacagcaccaggagttttca

SEQ ID NO: 390686 - DNA, 25 bp, Mus musculus
ctgtgcacagcagcaggagttttca

SEQ ID NO: 390687 - DNA, 25 bp, Mus musculus
ctgtgcaccacgagtattcagtgat

SEQ ID NO: 390688 - DNA, 25 bp, Mus musculus
ctgtgcaccacgtgtattcagtgat

SEQ ID NO: 390689 - DNA, 25 bp, Mus musculus
ctgtgcaccactcaacttacagtaa

SEQ ID NO: 390690 - DNA, 25 bp, Mus musculus
ctgtgcaccactcgctggctcaaaa

SEQ ID NO: 390691 - DNA, 25 bp, Mus musculus
ctgtgcaccactgaacttacagtaa

SEQ ID NO: 390692 - DNA, 25 bp, Mus musculus
ctgtgcaccactggctggctcaaaa

SEQ ID NO: 390693 - DNA, 25 bp, Mus musculus
ctgtgcaccgagaaccttagagcca

SEQ ID NO: 390694 - DNA, 25 bp, Mus musculus
ctgtgcaccgagtaccttagagcca

SEQ ID NO: 390695 - DNA, 25 bp, Mus musculus
ctgtgcaccttgcagatgctcaata

SEQ ID NO: 390696 - DNA, 25 bp, Mus musculus
ctgtgcaccttggagatgctcaata

SEQ ID NO: 390697 - DNA, 25 bp, Mus musculus
ctgtgcactaagaggctaacttttt

SEQ ID NO: 390698 - DNA, 25 bp, Mus musculus
ctgtgcactaagtggctaacttttt

SEQ ID NO: 390699 - DNA, 25 bp, Mus musculus
ctgtgcactctgctcagtattggga

SEQ ID NO: 390700 - DNA, 25 bp, Mus musculus
ctgtgcactctggtcagtattggga

SEQ ID NO: 390701 - DNA, 25 bp, Mus musculus
ctgtgcactgatcgcgactgtaatg

SEQ ID NO: 390702 - DNA, 25 bp, Mus musculus
ctgtgcactgatggcgactgtaatg

SEQ ID NO: 390703 - DNA, 25 bp, Mus musculus
ctgtgcactggtatacgtacgggcc

SEQ ID NO: 390704 - DNA, 25 bp, Mus musculus
ctgtgcactggtttacgtacgggcc

SEQ ID NO: 390705 - DNA, 25 bp, Mus musculus
ctgtgcactgtgaatggactttgta

SEQ ID NO: 390706 - DNA, 25 bp, Mus musculus
ctgtgcactgtgtatggactttgta

SEQ ID NO: 390707 - DNA, 25 bp, Mus musculus
ctgtgcacttttaggtttcaattac

SEQ ID NO: 390708 - DNA, 25 bp, Mus musculus
ctgtgcactttttggtttcaattac

SEQ ID NO: 390709 - DNA, 25 bp, Mus musculus
ctgtgcagactgaggtgtttttact

SEQ ID NO: 390710 - DNA, 25 bp, Mus musculus
ctgtgcagactgtggtgtttttact

SEQ ID NO: 390711 - DNA, 25 bp, Mus musculus
ctgtgcagagagattccagtttaca

SEQ ID NO: 390712 - DNA, 25 bp, Mus musculus
ctgtgcagagagtttccagtttaca

SEQ ID NO: 390713 - DNA, 25 bp, Mus musculus
ctgtgcagcaaaccagttagcagta

SEQ ID NO: 390714 - DNA, 25 bp, Mus musculus
ctgtgcagcaaagcagttagcagta

SEQ ID NO: 390715 - DNA, 25 bp, Mus musculus
ctgtgcagctaaacagattcttgtt

SEQ ID NO: 390716 - DNA, 25 bp, Mus musculus
ctgtgcagctaatcagattcttgtt

SEQ ID NO: 390717 - DNA, 25 bp, Mus musculus
ctgtgcagctggatgaacgtttctt

SEQ ID NO: 390718 - DNA, 25 bp, Mus musculus
ctgtgcagctggttgaacgtttctt

SEQ ID NO: 390719 - DNA, 25 bp, Mus musculus
ctgtgcaggaaaccggagccctcag

SEQ ID NO: 390720 - DNA, 25 bp, Mus musculus
ctgtgcaggaaagcggagccctcag

SEQ ID NO: 390721 - DNA, 25 bp, Mus musculus
ctgtgcaggctgctgtaacgatgaa

SEQ ID NO: 390722 - DNA, 25 bp, Mus musculus
ctgtgcaggctggtgtaacgatgaa

SEQ ID NO: 390723 - DNA, 25 bp, Mus musculus
ctgtgcagggaactgtaggtcatct

SEQ ID NO: 390724 - DNA, 25 bp, Mus musculus
ctgtgcagggaagtgtaggtcatct

SEQ ID NO: 390725 - DNA, 25 bp, Mus musculus
ctgtgcagggtcatgggcctctaac

SEQ ID NO: 390726 - DNA, 25 bp, Mus musculus
ctgtgcagggtcttgggcctctaac

SEQ ID NO: 390727 - DNA, 25 bp, Mus musculus
ctgtgcagggttccttatgcagaga

SEQ ID NO: 390728 - DNA, 25 bp, Mus musculus
ctgtgcagggttgcttatgcagaga

SEQ ID NO: 390729 - DNA, 25 bp, Mus musculus
ctgtgcagttcacacctgcaatcct

SEQ ID NO: 390730 - DNA, 25 bp, Mus musculus
ctgtgcagttcagacctgcaatcct

SEQ ID NO: 390731 - DNA, 25 bp, Mus musculus
ctgtgcagtttcaacccgaagcaag

SEQ ID NO: 390732 - DNA, 25 bp, Mus musculus
ctgtgcagtttcagcgggtacaaga

SEQ ID NO: 390733 - DNA, 25 bp, Mus musculus
ctgtgcagtttctacccgaagcaag

SEQ ID NO: 390734 - DNA, 25 bp, Mus musculus
ctgtgcagtttctgcgggtacaaga

SEQ ID NO: 390735 - DNA, 25 bp, Mus musculus
ctgtgcatacagcaggcagtggccc

SEQ ID NO: 390736 - DNA, 25 bp, Mus musculus
ctgtgcatacaggaggcagtggccc

SEQ ID NO: 390737 - DNA, 25 bp, Mus musculus
ctgtgcataggtccctggctttttc

SEQ ID NO: 390738 - DNA, 25 bp, Mus musculus
ctgtgcataggtgcctggctttttc

SEQ ID NO: 390739 - DNA, 25 bp, Mus musculus
ctgtgcatattcaggatgtcctcgt

SEQ ID NO: 390740 - DNA, 25 bp, Mus musculus
ctgtgcatattctggatgtcctcgt

SEQ ID NO: 390741 - DNA, 25 bp, Mus musculus
ctgtgcatcatgagtagttggttat

SEQ ID NO: 390742 - DNA, 25 bp, Mus musculus
ctgtgcatcatgtgtagttggttat

SEQ ID NO: 390743 - DNA, 25 bp, Mus musculus
ctgtgcatccaaacgtaatgagtct

SEQ ID NO: 390744 - DNA, 25 bp, Mus musculus
ctgtgcatccaatcgtaatgagtct

SEQ ID NO: 390745 - DNA, 25 bp, Mus musculus
ctgtgcatctgaacatattcctctg

SEQ ID NO: 390746 - DNA, 25 bp, Mus musculus
ctgtgcatctgatcatattcctctg

SEQ ID NO: 390747 - DNA, 25 bp, Mus musculus
ctgtgcatcttgctttgtttctttt

SEQ ID NO: 390748 - DNA, 25 bp, Mus musculus
ctgtgcatcttggtttgtttctttt

SEQ ID NO: 390749 - DNA, 25 bp, Mus musculus
ctgtgcatgagcctcactgtgaggt

SEQ ID NO: 390750 - DNA, 25 bp, Mus musculus
ctgtgcatgagcgtcactgtgaggt

SEQ ID NO: 390751 - DNA, 25 bp, Mus musculus
ctgtgcattggacttgactggtgaa

SEQ ID NO: 390752 - DNA, 25 bp, Mus musculus
ctgtgcattggagttgactggtgaa

SEQ ID NO: 390753 - DNA, 25 bp, Mus musculus
ctgtgccaagcccttatgctaataa

SEQ ID NO: 390754 - DNA, 25 bp, Mus musculus
ctgtgccaagccgttatgctaataa

SEQ ID NO: 390755 - DNA, 25 bp, Mus musculus
ctgtgccaaggtctcttaagttact

SEQ ID NO: 390756 - DNA, 25 bp, Mus musculus
ctgtgccaaggtgtcttaagttact

SEQ ID NO: 390757 - DNA, 25 bp, Mus musculus
ctgtgccaagttatagctccatttt

SEQ ID NO: 390758 - DNA, 25 bp, Mus musculus
ctgtgccaagttttagctccatttt

SEQ ID NO: 390759 - DNA, 25 bp, Mus musculus
ctgtgccacaaccaatgcttgtgat

SEQ ID NO: 390760 - DNA, 25 bp, Mus musculus
ctgtgccacaacgaatgcttgtgat

SEQ ID NO: 390761 - DNA, 25 bp, Mus musculus
ctgtgccacaggatttctggtagga

SEQ ID NO: 390762 - DNA, 25 bp, Mus musculus
ctgtgccacaggttttctggtagga

SEQ ID NO: 390763 - DNA, 25 bp, Mus musculus
ctgtgccacctgagatagtgctgtg

SEQ ID NO: 390764 - DNA, 25 bp, Mus musculus
ctgtgccacctgtgatagtgctgtg

SEQ ID NO: 390765 - DNA, 25 bp, Mus musculus
ctgtgccacgtcagcaggccgggca

SEQ ID NO: 390766 - DNA, 25 bp, Mus musculus
ctgtgccacgtctgcaggccgggca

SEQ ID NO: 390767 - DNA, 25 bp, Mus musculus
ctgtgccagagtatcctgaaggaaa

SEQ ID NO: 390768 - DNA, 25 bp, Mus musculus
ctgtgccagagtttcctgaaggaaa

SEQ ID NO: 390769 - DNA, 25 bp, Mus musculus
ctgtgccaggtcctttccagaagga

SEQ ID NO: 390770 - DNA, 25 bp, Mus musculus
ctgtgccaggtcgtttccagaagga

SEQ ID NO: 390771 - DNA, 25 bp, Mus musculus
ctgtgccatagtcccttgtacaaag

SEQ ID NO: 390772 - DNA, 25 bp, Mus musculus
ctgtgccatagtgccttgtacaaag

SEQ ID NO: 390773 - DNA, 25 bp, Mus musculus
ctgtgccatcttcaggcaggctaaa

SEQ ID NO: 390774 - DNA, 25 bp, Mus musculus
ctgtgccatcttgaggcaggctaaa

SEQ ID NO: 390775 - DNA, 25 bp, Mus musculus
ctgtgccatgttctgtgtttgacca

SEQ ID NO: 390776 - DNA, 25 bp, Mus musculus
ctgtgccatgttgtgtgtttgacca

SEQ ID NO: 390777 - DNA, 25 bp, Mus musculus
ctgtgccatttcacaggagttacac

SEQ ID NO: 390778 - DNA, 25 bp, Mus musculus
ctgtgccatttctcaggagttacac

SEQ ID NO: 390779 - DNA, 25 bp, Mus musculus
ctgtgcccagacagggtggtttcca

SEQ ID NO: 390780 - DNA, 25 bp, Mus musculus
ctgtgcccagactgggtggtttcca

SEQ ID NO: 390781 - DNA, 25 bp, Mus musculus
ctgtgcccagccaacggttgtctac

SEQ ID NO: 390782 - DNA, 25 bp, Mus musculus
ctgtgcccagcctacggttgtctac

SEQ ID NO: 390783 - DNA, 25 bp, Mus musculus
ctgtgcccatccagggtcacctgtg

SEQ ID NO: 390784 - DNA, 25 bp, Mus musculus
ctgtgcccatcctgggtcacctgtg

SEQ ID NO: 390785 - DNA, 25 bp, Mus musculus
ctgtgccccactcagggagactgat

SEQ ID NO: 390786 - DNA, 25 bp, Mus musculus
ctgtgccccactcgtgtgattgtga

SEQ ID NO: 390787 - DNA, 25 bp, Mus musculus
ctgtgccccactgagggagactgat

SEQ ID NO: 390788 - DNA, 25 bp, Mus musculus
ctgtgccccactggtgtgattgtga

SEQ ID NO: 390789 - DNA, 25 bp, Mus musculus
ctgtgccccattatcaggaacactg

SEQ ID NO: 390790 - DNA, 25 bp, Mus musculus
ctgtgccccattttcaggaacactg

SEQ ID NO: 390791 - DNA, 25 bp, Mus musculus
ctgtgcccctaaacactacattaga

SEQ ID NO: 390792 - DNA, 25 bp, Mus musculus
ctgtgcccctaatcactacattaga

SEQ ID NO: 390793 - DNA, 25 bp, Mus musculus
ctgtgcccctggatatgtgctgaag

SEQ ID NO: 390794 - DNA, 25 bp, Mus musculus
ctgtgcccctggttatgtgctgaag

SEQ ID NO: 390795 - DNA, 25 bp, Mus musculus
ctgtgccccttgaattttaagacat

SEQ ID NO: 390796 - DNA, 25 bp, Mus musculus
ctgtgccccttgtattttaagacat

SEQ ID NO: 390797 - DNA, 25 bp, Mus musculus
ctgtgccctcacaatagtgcgagat

SEQ ID NO: 390798 - DNA, 25 bp, Mus musculus
ctgtgccctcactatagtgcgagat

SEQ ID NO: 390799 - DNA, 25 bp, Mus musculus
ctgtgccctctcagatttaatttca

SEQ ID NO: 390800 - DNA, 25 bp, Mus musculus
ctgtgccctctctgatttaatttca

SEQ ID NO: 390801 - DNA, 25 bp, Mus musculus
ctgtgccctgtacagaacccttaaa

SEQ ID NO: 390802 - DNA, 25 bp, Mus musculus
ctgtgccctgtagagaacccttaaa

SEQ ID NO: 390803 - DNA, 25 bp, Mus musculus
ctgtgccctgtgattgttttgggta

SEQ ID NO: 390804 - DNA, 25 bp, Mus musculus
ctgtgccctgtgtttgttttgggta

SEQ ID NO: 390805 - DNA, 25 bp, Mus musculus
ctgtgccgacccagcctgagtgaga

SEQ ID NO: 390806 - DNA, 25 bp, Mus musculus
ctgtgccgaccctgcctgagtgaga

SEQ ID NO: 390807 - DNA, 25 bp, Mus musculus
ctgtgccgcctccatttatgggtgg

SEQ ID NO: 390808 - DNA, 25 bp, Mus musculus
ctgtgccgcctcgatttatgggtgg

SEQ ID NO: 390809 - DNA, 25 bp, Mus musculus
ctgtgcctaaagatggtgatccact

SEQ ID NO: 390810 - DNA, 25 bp, Mus musculus
ctgtgcctaaagttggtgatccact

SEQ ID NO: 390811 - DNA, 25 bp, Mus musculus
ctgtgcctagagagtcgatgtgagt

SEQ ID NO: 390812 - DNA, 25 bp, Mus musculus
ctgtgcctagagtgtcgatgtgagt

SEQ ID NO: 390813 - DNA, 25 bp, Mus musculus
ctgtgcctagctcccaggcagctgt

SEQ ID NO: 390814 - DNA, 25 bp, Mus musculus
ctgtgcctagctgccaggcagctgt

SEQ ID NO: 390815 - DNA, 25 bp, Mus musculus
ctgtgcctattcactgccataatag

SEQ ID NO: 390816 - DNA, 25 bp, Mus musculus
ctgtgcctattctctgccataatag

SEQ ID NO: 390817 - DNA, 25 bp, Mus musculus
ctgtgcctcaacctcttgaatgctg

SEQ ID NO: 390818 - DNA, 25 bp, Mus musculus
ctgtgcctcaacgtcttgaatgctg

SEQ ID NO: 390819 - DNA, 25 bp, Mus musculus
ctgtgcctcacaaccagatttaggg

SEQ ID NO: 390820 - DNA, 25 bp, Mus musculus
ctgtgcctcacatccagatttaggg

SEQ ID NO: 390821 - DNA, 25 bp, Mus musculus
ctgtgcctccaactgatgttctgac

SEQ ID NO: 390822 - DNA, 25 bp, Mus musculus
ctgtgcctccaagtgatgttctgac

SEQ ID NO: 390823 - DNA, 25 bp, Mus musculus
ctgtgcctcccaaattccttatcac

SEQ ID NO: 390824 - DNA, 25 bp, Mus musculus
ctgtgcctcccatattccttatcac

SEQ ID NO: 390825 - DNA, 25 bp, Mus musculus
ctgtgcctctcgaagcttctagtag

SEQ ID NO: 390826 - DNA, 25 bp, Mus musculus
ctgtgcctctcgtagcttctagtag

SEQ ID NO: 390827 - DNA, 25 bp, Mus musculus
ctgtgcctctctcaaggaagtaaaa

SEQ ID NO: 390828 - DNA, 25 bp, Mus musculus
ctgtgcctctctgaaggaagtaaaa

SEQ ID NO: 390829 - DNA, 25 bp, Mus musculus
ctgtgcctgactccctgggtgtgca

SEQ ID NO: 390830 - DNA, 25 bp, Mus musculus
ctgtgcctgactgcctgggtgtgca

SEQ ID NO: 390831 - DNA, 25 bp, Mus musculus
ctgtgcctgccaatgatgtgatgct

SEQ ID NO: 390832 - DNA, 25 bp, Mus musculus
ctgtgcctgccattgatgtgatgct

SEQ ID NO: 390833 - DNA, 25 bp, Mus musculus
ctgtgcctggacagtgtatgctata

SEQ ID NO: 390834 - DNA, 25 bp, Mus musculus
ctgtgcctggactgtgtatgctata

SEQ ID NO: 390835 - DNA, 25 bp, Mus musculus
ctgtgcctggctaagaggaccatct

SEQ ID NO: 390836 - DNA, 25 bp, Mus musculus
ctgtgcctggcttagaggaccatct

SEQ ID NO: 390837 - DNA, 25 bp, Mus musculus
ctgtgcctgggtctacatacatggg

SEQ ID NO: 390838 - DNA, 25 bp, Mus musculus
ctgtgcctgggtgtacatacatggg

SEQ ID NO: 390839 - DNA, 25 bp, Mus musculus
ctgtgcctggttctcagtaagcatt

SEQ ID NO: 390840 - DNA, 25 bp, Mus musculus
ctgtgcctggttgtcagtaagcatt

SEQ ID NO: 390841 - DNA, 25 bp, Mus musculus
ctgtgcctgtccagaccagtataag

SEQ ID NO: 390842 - DNA, 25 bp, Mus musculus
ctgtgcctgtcctgaccagtataag

SEQ ID NO: 390843 - DNA, 25 bp, Mus musculus
ctgtgccttacaattagacctttca

SEQ ID NO: 390844 - DNA, 25 bp, Mus musculus
ctgtgccttacatttagacctttca

SEQ ID NO: 390845 - DNA, 25 bp, Mus musculus
ctgtgccttagaacctgatgacttt

SEQ ID NO: 390846 - DNA, 25 bp, Mus musculus
ctgtgccttagatcctgatgacttt

SEQ ID NO: 390847 - DNA, 25 bp, Mus musculus
ctgtgccttagcactcttaaatgta

SEQ ID NO: 390848 - DNA, 25 bp, Mus musculus
ctgtgccttagctctcttaaatgta

SEQ ID NO: 390849 - DNA, 25 bp, Mus musculus
ctgtgcctttctaaaggcttttgtt

SEQ ID NO: 390850 - DNA, 25 bp, Mus musculus
ctgtgcctttcttaaggcttttgtt

SEQ ID NO: 390851 - DNA, 25 bp, Mus musculus
ctgtgccttttccttgattaacgta

SEQ ID NO: 390852 - DNA, 25 bp, Mus musculus
ctgtgccttttcgttgattaacgta

SEQ ID NO: 390853 - DNA, 25 bp, Mus musculus
ctgtgcgagactactaagggagcca

SEQ ID NO: 390854 - DNA, 25 bp, Mus musculus
ctgtgcgagacttctaagggagcca

SEQ ID NO: 390855 - DNA, 25 bp, Mus musculus
ctgtgcgaggaccagaacttgccct

SEQ ID NO: 390856 - DNA, 25 bp, Mus musculus
ctgtgcgaggacgagaacttgccct

SEQ ID NO: 390857 - DNA, 25 bp, Mus musculus
ctgtgcgcaaagaaggcaccggcgt

SEQ ID NO: 390858 - DNA, 25 bp, Mus musculus
ctgtgcgcaaagtaggcaccggcgt

SEQ ID NO: 390859 - DNA, 25 bp, Mus musculus
ctgtgcgcattgcattggagtgact

SEQ ID NO: 390860 - DNA, 25 bp, Mus musculus
ctgtgcgcattggattggagtgact

SEQ ID NO: 390861 - DNA, 25 bp, Mus musculus
ctgtgcgctggaacagccctgagga

SEQ ID NO: 390862 - DNA, 25 bp, Mus musculus
ctgtgcgctggatcagccctgagga

SEQ ID NO: 390863 - DNA, 25 bp, Mus musculus
ctgtgcggactgatctacctgttcg

SEQ ID NO: 390864 - DNA, 25 bp, Mus musculus
ctgtgcggactgttctacctgttcg

SEQ ID NO: 390865 - DNA, 25 bp, Mus musculus
ctgtgcggatcacttctgcgaaatt

SEQ ID NO: 390866 - DNA, 25 bp, Mus musculus
ctgtgcggatcagttctgcgaaatt

SEQ ID NO: 390867 - DNA, 25 bp, Mus musculus
ctgtgcgtctcgaaaaggctatgaa

SEQ ID NO: 390868 - DNA, 25 bp, Mus musculus
ctgtgcgtctcgtaaaggctatgaa

SEQ ID NO: 390869 - DNA, 25 bp, Mus musculus
ctgtgcgtgcgaagagatcgtgtat

SEQ ID NO: 390870 - DNA, 25 bp, Mus musculus
ctgtgcgtgcgatgagatcgtgtat

SEQ ID NO: 390871 - DNA, 25 bp, Mus musculus
ctgtgcgttctacatctgctggctc

SEQ ID NO: 390872 - DNA, 25 bp, Mus musculus
ctgtgcgttctagatctgctggctc

SEQ ID NO: 390873 - DNA, 25 bp, Mus musculus
ctgtgctaagtgagttttcaaacaa

SEQ ID NO: 390874 - DNA, 25 bp, Mus musculus
ctgtgctaagtgtgttttcaaacaa

SEQ ID NO: 390875 - DNA, 25 bp, Mus musculus
ctgtgctacaaacgaggttctgcca

SEQ ID NO: 390876 - DNA, 25 bp, Mus musculus
ctgtgctacaaaggaggttctgcca

SEQ ID NO: 390877 - DNA, 25 bp, Mus musculus
ctgtgctacagtaccgagcgcggtg

SEQ ID NO: 390878 - DNA, 25 bp, Mus musculus
ctgtgctacagttccgagcgcggtg

SEQ ID NO: 390879 - DNA, 25 bp, Mus musculus
ctgtgctaccaactgcctatgaatt

SEQ ID NO: 390880 - DNA, 25 bp, Mus musculus
ctgtgctaccaagtgcctatgaatt

SEQ ID NO: 390881 - DNA, 25 bp, Mus musculus
ctgtgctacgggatgatgaccggca

SEQ ID NO: 390882 - DNA, 25 bp, Mus musculus
ctgtgctacgggttgatgaccggca

SEQ ID NO: 390883 - DNA, 25 bp, Mus musculus
ctgtgctagggcagtgtcccaggat

SEQ ID NO: 390884 - DNA, 25 bp, Mus musculus
ctgtgctagggctgtgtcccaggat

SEQ ID NO: 390885 - DNA, 25 bp, Mus musculus
ctgtgctagtttcggtgcttttgta

SEQ ID NO: 390886 - DNA, 25 bp, Mus musculus
ctgtgctagtttgggtgcttttgta

SEQ ID NO: 390887 - DNA, 25 bp, Mus musculus
ctgtgctatgttagaagcctgaggt

SEQ ID NO: 390888 - DNA, 25 bp, Mus musculus
ctgtgctatgttcctctagacttcg

SEQ ID NO: 390889 - DNA, 25 bp, Mus musculus
ctgtgctatgttgctctagacttcg

SEQ ID NO: 390890 - DNA, 25 bp, Mus musculus
ctgtgctatgtttgaagcctgaggt

SEQ ID NO: 390891 - DNA, 25 bp, Mus musculus
ctgtgctattcgatcttgattttca

SEQ ID NO: 390892 - DNA, 25 bp, Mus musculus
ctgtgctattcgttcttgattttca

SEQ ID NO: 390893 - DNA, 25 bp, Mus musculus
ctgtgctattctctgctgatcaaaa

SEQ ID NO: 390894 - DNA, 25 bp, Mus musculus
ctgtgctattctctgttctcataga

SEQ ID NO: 390895 - DNA, 25 bp, Mus musculus
ctgtgctattctgtgctgatcaaaa

SEQ ID NO: 390896 - DNA, 25 bp, Mus musculus
ctgtgctattctgtgttctcataga

SEQ ID NO: 390897 - DNA, 25 bp, Mus musculus
ctgtgctcacagagggcagagtcat

SEQ ID NO: 390898 - DNA, 25 bp, Mus musculus
ctgtgctcacagtgggcagagtcat

SEQ ID NO: 390899 - DNA, 25 bp, Mus musculus
ctgtgctcaggcaagcaaccctaat

SEQ ID NO: 390900 - DNA, 25 bp, Mus musculus
ctgtgctcaggctagcaaccctaat

SEQ ID NO: 390901 - DNA, 25 bp, Mus musculus
ctgtgctcatgtatgtccacgacta

SEQ ID NO: 390902 - DNA, 25 bp, Mus musculus
ctgtgctcatgtttgtccacgacta

SEQ ID NO: 390903 - DNA, 25 bp, Mus musculus
ctgtgctcctgtcgaagatgggctt

SEQ ID NO: 390904 - DNA, 25 bp, Mus musculus
ctgtgctcctgtggaagatgggctt

SEQ ID NO: 390905 - DNA, 25 bp, Mus musculus
ctgtgctctgggacattggtcagct

SEQ ID NO: 390906 - DNA, 25 bp, Mus musculus
ctgtgctctgggagtgtctctaaga

SEQ ID NO: 390907 - DNA, 25 bp, Mus musculus
ctgtgctctgggtcattggtcagct

SEQ ID NO: 390908 - DNA, 25 bp, Mus musculus
ctgtgctctgggtgtgtctctaaga

SEQ ID NO: 390909 - DNA, 25 bp, Mus musculus
ctgtgctctgtcagatttgtatgca

SEQ ID NO: 390910 - DNA, 25 bp, Mus musculus
ctgtgctctgtctgatttgtatgca

SEQ ID NO: 390911 - DNA, 25 bp, Mus musculus
ctgtgctctgtgagatctgaggcta

SEQ ID NO: 390912 - DNA, 25 bp, Mus musculus
ctgtgctctgtgtgatctgaggcta

SEQ ID NO: 390913 - DNA, 25 bp, Mus musculus
ctgtgctcttaactgggcatccatc

SEQ ID NO: 390914 - DNA, 25 bp, Mus musculus
ctgtgctcttaagtgggcatccatc

SEQ ID NO: 390915 - DNA, 25 bp, Mus musculus
ctgtgctcttagattggacatcagt

SEQ ID NO: 390916 - DNA, 25 bp, Mus musculus
ctgtgctcttagtttggacatcagt

SEQ ID NO: 390917 - DNA, 25 bp, Mus musculus
ctgtgctgaccaatggctttggatt

SEQ ID NO: 390918 - DNA, 25 bp, Mus musculus
ctgtgctgaccactactgtactgga

SEQ ID NO: 390919 - DNA, 25 bp, Mus musculus
ctgtgctgaccagtactgtactgga

SEQ ID NO: 390920 - DNA, 25 bp, Mus musculus
ctgtgctgaccattggctttggatt

SEQ ID NO: 390921 - DNA, 25 bp, Mus musculus
ctgtgctgactgaagaaccctacca

SEQ ID NO: 390922 - DNA, 25 bp, Mus musculus
ctgtgctgactgcatccttcaggaa

SEQ ID NO: 390923 - DNA, 25 bp, Mus musculus
ctgtgctgactggatccttcaggaa

SEQ ID NO: 390924 - DNA, 25 bp, Mus musculus
ctgtgctgactgtagaaccctacca

SEQ ID NO: 390925 - DNA, 25 bp, Mus musculus
ctgtgctgagatccttggcctagtc

SEQ ID NO: 390926 - DNA, 25 bp, Mus musculus
ctgtgctgagatgcttggcctagtc

SEQ ID NO: 390927 - DNA, 25 bp, Mus musculus
ctgtgctgatcacggccatttttaa

SEQ ID NO: 390928 - DNA, 25 bp, Mus musculus
ctgtgctgatcagggccatttttaa

SEQ ID NO: 390929 - DNA, 25 bp, Mus musculus
ctgtgctgatttctgaagtgccctt

SEQ ID NO: 390930 - DNA, 25 bp, Mus musculus
ctgtgctgatttgtgaagtgccctt

SEQ ID NO: 390931 - DNA, 25 bp, Mus musculus
ctgtgctgcagaatacttacctgtc

SEQ ID NO: 390932 - DNA, 25 bp, Mus musculus
ctgtgctgcagattacttacctgtc

SEQ ID NO: 390933 - DNA, 25 bp, Mus musculus
ctgtgctgcagcctcggtcagaaaa

SEQ ID NO: 390934 - DNA, 25 bp, Mus musculus
ctgtgctgcagcgtcggtcagaaaa

SEQ ID NO: 390935 - DNA, 25 bp, Mus musculus
ctgtgctgcatacgtagaatgttgt

SEQ ID NO: 390936 - DNA, 25 bp, Mus musculus
ctgtgctgcataggtagaatgttgt

SEQ ID NO: 390937 - DNA, 25 bp, Mus musculus
ctgtgctgcctgaagcggaaagctt

SEQ ID NO: 390938 - DNA, 25 bp, Mus musculus
ctgtgctgcctgtagcggaaagctt

SEQ ID NO: 390939 - DNA, 25 bp, Mus musculus
ctgtgctgcgtgattctcaagaaca

SEQ ID NO: 390940 - DNA, 25 bp, Mus musculus
ctgtgctgcgtgtttctcaagaaca

SEQ ID NO: 390941 - DNA, 25 bp, Mus musculus
ctgtgctgctgtaatcatcctgtta

SEQ ID NO: 390942 - DNA, 25 bp, Mus musculus
ctgtgctgctgtacgaagataaacc

SEQ ID NO: 390943 - DNA, 25 bp, Mus musculus
ctgtgctgctgttatcatcctgtta

SEQ ID NO: 390944 - DNA, 25 bp, Mus musculus
ctgtgctgctgttcgaagataaacc

SEQ ID NO: 390945 - DNA, 25 bp, Mus musculus
ctgtgctgctttagagctggactca

SEQ ID NO: 390946 - DNA, 25 bp, Mus musculus
ctgtgctgcttttgagctggactca

SEQ ID NO: 390947 - DNA, 25 bp, Mus musculus
ctgtgctggccacagatattctcac

SEQ ID NO: 390948 - DNA, 25 bp, Mus musculus
ctgtgctggccagagatattctcac

SEQ ID NO: 390949 - DNA, 25 bp, Mus musculus
ctgtgctggcctcgagtcaaagcat

SEQ ID NO: 390950 - DNA, 25 bp, Mus musculus
ctgtgctggcctggagtcaaagcat

SEQ ID NO: 390951 - DNA, 25 bp, Mus musculus
ctgtgctgggtcacttttcatatcc

SEQ ID NO: 390952 - DNA, 25 bp, Mus musculus
ctgtgctgggtcaggtcagtgaacc

SEQ ID NO: 390953 - DNA, 25 bp, Mus musculus
ctgtgctgggtctcttttcatatcc

SEQ ID NO: 390954 - DNA, 25 bp, Mus musculus
ctgtgctgggtctggtcagtgaacc

SEQ ID NO: 390955 - DNA, 25 bp, Mus musculus
ctgtgctggtgcagccaggacagct

SEQ ID NO: 390956 - DNA, 25 bp, Mus musculus
ctgtgctggtgcaggaagaacatga

SEQ ID NO: 390957 - DNA, 25 bp, Mus musculus
ctgtgctggtgctgccaggacagct

SEQ ID NO: 390958 - DNA, 25 bp, Mus musculus
ctgtgctggtgctggaagaacatga

SEQ ID NO: 390959 - DNA, 25 bp, Mus musculus
ctgtgctgtaagagaataggctgat

SEQ ID NO: 390960 - DNA, 25 bp, Mus musculus
ctgtgctgtaagtgaataggctgat

SEQ ID NO: 390961 - DNA, 25 bp, Mus musculus
ctgtgctgtctaaagttctatctca

SEQ ID NO: 390962 - DNA, 25 bp, Mus musculus
ctgtgctgtctatagttctatctca

SEQ ID NO: 390963 - DNA, 25 bp, Mus musculus
ctgtgctgtgctaaagtgtcgctta

SEQ ID NO: 390964 - DNA, 25 bp, Mus musculus
ctgtgctgtgcttaagtgtcgctta

SEQ ID NO: 390965 - DNA, 25 bp, Mus musculus
ctgtgctgtgtccttgttgctctgc

SEQ ID NO: 390966 - DNA, 25 bp, Mus musculus
ctgtgctgtgtcgttgttgctctgc

SEQ ID NO: 390967 - DNA, 25 bp, Mus musculus
ctgtgctgttgcataagtcaataca

SEQ ID NO: 390968 - DNA, 25 bp, Mus musculus
ctgtgctgttgcttaagtcaataca

SEQ ID NO: 390969 - DNA, 25 bp, Mus musculus
ctgtgcttagttagtgctgggttat

SEQ ID NO: 390970 - DNA, 25 bp, Mus musculus
ctgtgcttagtttgtgctgggttat

SEQ ID NO: 390971 - DNA, 25 bp, Mus musculus
ctgtgcttattaatcacccttcctt

SEQ ID NO: 390972 - DNA, 25 bp, Mus musculus
ctgtgcttattattcacccttcctt

SEQ ID NO: 390973 - DNA, 25 bp, Mus musculus
ctgtgcttcagaccccagaactgat

SEQ ID NO: 390974 - DNA, 25 bp, Mus musculus
ctgtgcttcagagcccagaactgat

SEQ ID NO: 390975 - DNA, 25 bp, Mus musculus
ctgtgcttccaactcgctgttggtt

SEQ ID NO: 390976 - DNA, 25 bp, Mus musculus
ctgtgcttccaagtcgctgttggtt

SEQ ID NO: 390977 - DNA, 25 bp, Mus musculus
ctgtgcttccctagtcccgcggagt

SEQ ID NO: 390978 - DNA, 25 bp, Mus musculus
ctgtgcttcccttgtcccgcggagt

SEQ ID NO: 390979 - DNA, 25 bp, Mus musculus
ctgtgcttctagataaagttgtaac

SEQ ID NO: 390980 - DNA, 25 bp, Mus musculus
ctgtgcttctagttaaagttgtaac

SEQ ID NO: 390981 - DNA, 25 bp, Mus musculus
ctgtgcttctctaggaacctgtata

SEQ ID NO: 390982 - DNA, 25 bp, Mus musculus
ctgtgcttctcttggaacctgtata

SEQ ID NO: 390983 - DNA, 25 bp, Mus musculus
ctgtgcttgactactgaccgttagg

SEQ ID NO: 390984 - DNA, 25 bp, Mus musculus
ctgtgcttgacttctgaccgttagg

SEQ ID NO: 390985 - DNA, 25 bp, Mus musculus
ctgtgcttgggcagtgctcacttaa

SEQ ID NO: 390986 - DNA, 25 bp, Mus musculus
ctgtgcttgggctgtgctcacttaa

SEQ ID NO: 390987 - DNA, 25 bp, Mus musculus
ctgtgcttgtatagtactctcacct

SEQ ID NO: 390988 - DNA, 25 bp, Mus musculus
ctgtgcttgtattgtactctcacct

SEQ ID NO: 390989 - DNA, 25 bp, Mus musculus
ctgtgctttcacctttgtaattttt

SEQ ID NO: 390990 - DNA, 25 bp, Mus musculus
ctgtgctttcacgtttgtaattttt

SEQ ID NO: 390991 - DNA, 25 bp, Mus musculus
ctgtgctttctgctatcttgttctg

SEQ ID NO: 390992 - DNA, 25 bp, Mus musculus
ctgtgctttctgctgagcatgctac

SEQ ID NO: 390993 - DNA, 25 bp, Mus musculus
ctgtgctttctggtatcttgttctg

SEQ ID NO: 390994 - DNA, 25 bp, Mus musculus
ctgtgctttctggtgagcatgctac

SEQ ID NO: 390995 - DNA, 25 bp, Mus musculus
ctgtgctttggacgcgctcgctttc

SEQ ID NO: 390996 - DNA, 25 bp, Mus musculus
ctgtgctttggaggcgctcgctttc

SEQ ID NO: 390997 - DNA, 25 bp, Mus musculus
ctgtgctttggtctcctgggagtcc

SEQ ID NO: 390998 - DNA, 25 bp, Mus musculus
ctgtgctttggtgtcctgggagtcc

SEQ ID NO: 390999 - DNA, 25 bp, Mus musculus
ctgtgctttgtcatctacgctagaa

SEQ ID NO: 391000 - DNA, 25 bp, Mus musculus
ctgtgctttgtcttctacgctagaa

SEQ ID NO: 391001 - DNA, 25 bp, Mus musculus
ctgtgctttgttaggctcttgtgtt

SEQ ID NO: 391002 - DNA, 25 bp, Mus musculus
ctgtgctttgtttggctcttgtgtt

SEQ ID NO: 391003 - DNA, 25 bp, Mus musculus
ctgtgcttttctagtgttgggagga

SEQ ID NO: 391004 - DNA, 25 bp, Mus musculus
ctgtgcttttcttgtgttgggagga

SEQ ID NO: 391005 - DNA, 25 bp, Mus musculus
ctgtgcttttggcatagctcacctt

SEQ ID NO: 391006 - DNA, 25 bp, Mus musculus
ctgtgcttttgggatagctcacctt

SEQ ID NO: 391007 - DNA, 25 bp, Mus musculus
ctgtgcttttgtccattattctgag

SEQ ID NO: 391008 - DNA, 25 bp, Mus musculus
ctgtgcttttgtgcattattctgag

SEQ ID NO: 391009 - DNA, 25 bp, Mus musculus
ctgtggaaacctcgaccctgtgttt

SEQ ID NO: 391010 - DNA, 25 bp, Mus musculus
ctgtggaaacctggaccctgtgttt

SEQ ID NO: 391011 - DNA, 25 bp, Mus musculus
ctgtggaaatccatattgccctttt

SEQ ID NO: 391012 - DNA, 25 bp, Mus musculus
ctgtggaaatccttattgccctttt

SEQ ID NO: 391013 - DNA, 25 bp, Mus musculus
ctgtggaaattcctggtagcttctt

SEQ ID NO: 391014 - DNA, 25 bp, Mus musculus
ctgtggaaattcgtggtagcttctt

SEQ ID NO: 391015 - DNA, 25 bp, Mus musculus
ctgtggaacaacacggtgcagtgct

SEQ ID NO: 391016 - DNA, 25 bp, Mus musculus
ctgtggaacaactcggtgcagtgct

SEQ ID NO: 391017 - DNA, 25 bp, Mus musculus
ctgtggaacacaaacctctgcatca

SEQ ID NO: 391018 - DNA, 25 bp, Mus musculus
ctgtggaacacatacctctgcatca

SEQ ID NO: 391019 - DNA, 25 bp, Mus musculus
ctgtggaactgaagctgacctttaa

SEQ ID NO: 391020 - DNA, 25 bp, Mus musculus
ctgtggaactgatgctgacctttaa

SEQ ID NO: 391021 - DNA, 25 bp, Mus musculus
ctgtggaagaaaccccaggcttggc

SEQ ID NO: 391022 - DNA, 25 bp, Mus musculus
ctgtggaagaaagcccaggcttggc

SEQ ID NO: 391023 - DNA, 25 bp, Mus musculus
ctgtggaagatcatgaaccggtcaa

SEQ ID NO: 391024 - DNA, 25 bp, Mus musculus
ctgtggaagatcttgaaccggtcaa

SEQ ID NO: 391025 - DNA, 25 bp, Mus musculus
ctgtggaatcccagtgacctgaatt

SEQ ID NO: 391026 - DNA, 25 bp, Mus musculus
ctgtggaatccctgtgacctgaatt

SEQ ID NO: 391027 - DNA, 25 bp, Mus musculus
ctgtggaatccgagcattgttgaga

SEQ ID NO: 391028 - DNA, 25 bp, Mus musculus
ctgtggaatccgtgcattgttgaga

SEQ ID NO: 391029 - DNA, 25 bp, Mus musculus
ctgtggaatgaaagtgacgagaaac

SEQ ID NO: 391030 - DNA, 25 bp, Mus musculus
ctgtggaatgaatgtgacgagaaac

SEQ ID NO: 391031 - DNA, 25 bp, Mus musculus
ctgtggacaatcaccctgcaagatt

SEQ ID NO: 391032 - DNA, 25 bp, Mus musculus
ctgtggacaatctccctgcaagatt

SEQ ID NO: 391033 - DNA, 25 bp, Mus musculus
ctgtggacagctccattagcttgtt

SEQ ID NO: 391034 - DNA, 25 bp, Mus musculus
ctgtggacagctgcattagcttgtt

SEQ ID NO: 391035 - DNA, 25 bp, Mus musculus
ctgtggacagtcctgagaacccaat

SEQ ID NO: 391036 - DNA, 25 bp, Mus musculus
ctgtggacagtcgtgagaacccaat

SEQ ID NO: 391037 - DNA, 25 bp, Mus musculus
ctgtggacataactgctggcctgaa

SEQ ID NO: 391038 - DNA, 25 bp, Mus musculus
ctgtggacataagtgctggcctgaa

SEQ ID NO: 391039 - DNA, 25 bp, Mus musculus
ctgtggacattgactcagagctggt

SEQ ID NO: 391040 - DNA, 25 bp, Mus musculus
ctgtggacattgtctcagagctggt

SEQ ID NO: 391041 - DNA, 25 bp, Mus musculus
ctgtggaccatgagcagcgcagcct

SEQ ID NO: 391042 - DNA, 25 bp, Mus musculus
ctgtggaccatgtgcagcgcagcct

SEQ ID NO: 391043 - DNA, 25 bp, Mus musculus
ctgtggaccccgaatgtggactgga

SEQ ID NO: 391044 - DNA, 25 bp, Mus musculus
ctgtggaccccgtatgtggactgga

SEQ ID NO: 391045 - DNA, 25 bp, Mus musculus
ctgtggacggagaaacaccggctta

SEQ ID NO: 391046 - DNA, 25 bp, Mus musculus
ctgtggacggagactatgattacct

SEQ ID NO: 391047 - DNA, 25 bp, Mus musculus
ctgtggacggagtaacaccggctta

SEQ ID NO: 391048 - DNA, 25 bp, Mus musculus
ctgtggacggagtctatgattacct

SEQ ID NO: 391049 - DNA, 25 bp, Mus musculus
ctgtggactatcagtggattctgtg

SEQ ID NO: 391050 - DNA, 25 bp, Mus musculus
ctgtggactatctgtggattctgtg

SEQ ID NO: 391051 - DNA, 25 bp, Mus musculus
ctgtggactctgagcagactgactt

SEQ ID NO: 391052 - DNA, 25 bp, Mus musculus
ctgtggactctgtgcagactgactt

SEQ ID NO: 391053 - DNA, 25 bp, Mus musculus
ctgtggacttcacggatctttattc

SEQ ID NO: 391054 - DNA, 25 bp, Mus musculus
ctgtggacttcagggatctttattc

SEQ ID NO: 391055 - DNA, 25 bp, Mus musculus
ctgtggacttctcagcaagagcctg

SEQ ID NO: 391056 - DNA, 25 bp, Mus musculus
ctgtggacttctgagcaagagcctg

SEQ ID NO: 391057 - DNA, 25 bp, Mus musculus
ctgtggactttcatggctggcattt

SEQ ID NO: 391058 - DNA, 25 bp, Mus musculus
ctgtggactttcttggctggcattt

SEQ ID NO: 391059 - DNA, 25 bp, Mus musculus
ctgtggagagagaccctcttaagcc

SEQ ID NO: 391060 - DNA, 25 bp, Mus musculus
ctgtggagagagtccctcttaagcc

SEQ ID NO: 391061 - DNA, 25 bp, Mus musculus
ctgtggagaggacccgttcctgcct

SEQ ID NO: 391062 - DNA, 25 bp, Mus musculus
ctgtggagaggagccgttcctgcct

SEQ ID NO: 391063 - DNA, 25 bp, Mus musculus
ctgtggagatgcactctgccgtcat

SEQ ID NO: 391064 - DNA, 25 bp, Mus musculus
ctgtggagatgctctctgccgtcat

SEQ ID NO: 391065 - DNA, 25 bp, Mus musculus
ctgtggagccaacaactatgtcttt

SEQ ID NO: 391066 - DNA, 25 bp, Mus musculus
ctgtggagccaagaactatgtcttt

SEQ ID NO: 391067 - DNA, 25 bp, Mus musculus
ctgtggagcccaccaatgacggaca

SEQ ID NO: 391068 - DNA, 25 bp, Mus musculus
ctgtggagcccagcaatgacggaca

SEQ ID NO: 391069 - DNA, 25 bp, Mus musculus
ctgtggagcgcccaccaatgaagtc

SEQ ID NO: 391070 - DNA, 25 bp, Mus musculus
ctgtggagcgccgaccaatgaagtc

SEQ ID NO: 391071 - DNA, 25 bp, Mus musculus
ctgtggagggcaccataacccagta

SEQ ID NO: 391072 - DNA, 25 bp, Mus musculus
ctgtggagggcagcataacccagta

SEQ ID NO: 391073 - DNA, 25 bp, Mus musculus
ctgtggagtacaccttcagcttgta

SEQ ID NO: 391074 - DNA, 25 bp, Mus musculus
ctgtggagtacagcttcagcttgta

SEQ ID NO: 391075 - DNA, 25 bp, Mus musculus
ctgtggagtcacatttgtattcttt

SEQ ID NO: 391076 - DNA, 25 bp, Mus musculus
ctgtggagtcacttttgtattcttt

SEQ ID NO: 391077 - DNA, 25 bp, Mus musculus
ctgtggagttgtatgaaagcagaaa

SEQ ID NO: 391078 - DNA, 25 bp, Mus musculus
ctgtggagttgtttgaaagcagaaa

SEQ ID NO: 391079 - DNA, 25 bp, Mus musculus
ctgtggataaagctgtatttctgtc

SEQ ID NO: 391080 - DNA, 25 bp, Mus musculus
ctgtggataaaggtgtatttctgtc

SEQ ID NO: 391081 - DNA, 25 bp, Mus musculus
ctgtggatatggaccagctgctgaa

SEQ ID NO: 391082 - DNA, 25 bp, Mus musculus
ctgtggatatggtccagctgctgaa

SEQ ID NO: 391083 - DNA, 25 bp, Mus musculus
ctgtggatatttctaggagtcttta

SEQ ID NO: 391084 - DNA, 25 bp, Mus musculus
ctgtggatatttgtaggagtcttta

SEQ ID NO: 391085 - DNA, 25 bp, Mus musculus
ctgtggatgcagagggtgctcccca

SEQ ID NO: 391086 - DNA, 25 bp, Mus musculus
ctgtggatgcagtgggtgctcccca

SEQ ID NO: 391087 - DNA, 25 bp, Mus musculus
ctgtggatgcctctagcccattgag

SEQ ID NO: 391088 - DNA, 25 bp, Mus musculus
ctgtggatgcctgtagcccattgag

SEQ ID NO: 391089 - DNA, 25 bp, Mus musculus
ctgtggatgtgaatcccgccagtga

SEQ ID NO: 391090 - DNA, 25 bp, Mus musculus
ctgtggatgtgattcccgccagtga

SEQ ID NO: 391091 - DNA, 25 bp, Mus musculus
ctgtggattgtgattttctgtaaat

SEQ ID NO: 391092 - DNA, 25 bp, Mus musculus
ctgtggattgtgtttttctgtaaat

SEQ ID NO: 391093 - DNA, 25 bp, Mus musculus
ctgtggcaaggcaggaaacgagatc

SEQ ID NO: 391094 - DNA, 25 bp, Mus musculus
ctgtggcaaggctggaaacgagatc

SEQ ID NO: 391095 - DNA, 25 bp, Mus musculus
ctgtggcaagtgatagtttcctctg

SEQ ID NO: 391096 - DNA, 25 bp, Mus musculus
ctgtggcaagtgttagtttcctctg

SEQ ID NO: 391097 - DNA, 25 bp, Mus musculus
ctgtggcacctgaagctcatgtgga

SEQ ID NO: 391098 - DNA, 25 bp, Mus musculus
ctgtggcacctgtagctcatgtgga

SEQ ID NO: 391099 - DNA, 25 bp, Mus musculus
ctgtggcactccagtgaaggtcaga

SEQ ID NO: 391100 - DNA, 25 bp, Mus musculus
ctgtggcactcctgtgaaggtcaga

SEQ ID NO: 391101 - DNA, 25 bp, Mus musculus
ctgtggcactttctcctcttctgca

SEQ ID NO: 391102 - DNA, 25 bp, Mus musculus
ctgtggcactttgtcctcttctgca

SEQ ID NO: 391103 - DNA, 25 bp, Mus musculus
ctgtggcagcagattcacgtcgtaa

SEQ ID NO: 391104 - DNA, 25 bp, Mus musculus
ctgtggcagcagtttcacgtcgtaa

SEQ ID NO: 391105 - DNA, 25 bp, Mus musculus
ctgtggcaggccacgatgcaagcca

SEQ ID NO: 391106 - DNA, 25 bp, Mus musculus
ctgtggcaggcctcgatgcaagcca

SEQ ID NO: 391107 - DNA, 25 bp, Mus musculus
ctgtggcaggtgagatctggaacca

SEQ ID NO: 391108 - DNA, 25 bp, Mus musculus
ctgtggcaggtgtgatctggaacca

SEQ ID NO: 391109 - DNA, 25 bp, Mus musculus
ctgtggcaggttctagctcaaagct

SEQ ID NO: 391110 - DNA, 25 bp, Mus musculus
ctgtggcaggttgtagctcaaagct

SEQ ID NO: 391111 - DNA, 25 bp, Mus musculus
ctgtggcagtttccgcagactgggc

SEQ ID NO: 391112 - DNA, 25 bp, Mus musculus
ctgtggcagtttgcgcagactgggc

SEQ ID NO: 391113 - DNA, 25 bp, Mus musculus
ctgtggcatcccatttttctttggt

SEQ ID NO: 391114 - DNA, 25 bp, Mus musculus
ctgtggcatcccttttttctttggt

SEQ ID NO: 391115 - DNA, 25 bp, Mus musculus
ctgtggcatctcctgtgacaagtta

SEQ ID NO: 391116 - DNA, 25 bp, Mus musculus
ctgtggcatctcgtgtgacaagtta

SEQ ID NO: 391117 - DNA, 25 bp, Mus musculus
ctgtggcattctatcactggtgtta

SEQ ID NO: 391118 - DNA, 25 bp, Mus musculus
ctgtggcattctttcactggtgtta

SEQ ID NO: 391119 - DNA, 25 bp, Mus musculus
ctgtggcattttcccgacactgtga

SEQ ID NO: 391120 - DNA, 25 bp, Mus musculus
ctgtggcattttgccgacactgtga

SEQ ID NO: 391121 - DNA, 25 bp, Mus musculus
ctgtggccagcgcttaatcccattt

SEQ ID NO: 391122 - DNA, 25 bp, Mus musculus
ctgtggccagcggttaatcccattt

SEQ ID NO: 391123 - DNA, 25 bp, Mus musculus
ctgtggcccaggagtttggttctta

SEQ ID NO: 391124 - DNA, 25 bp, Mus musculus
ctgtggcccaggtgtttggttctta

SEQ ID NO: 391125 - DNA, 25 bp, Mus musculus
ctgtggcccgaaagcctggagcgaa

SEQ ID NO: 391126 - DNA, 25 bp, Mus musculus
ctgtggcccgaatgcctggagcgaa

SEQ ID NO: 391127 - DNA, 25 bp, Mus musculus
ctgtggcccggtatattggagagaa

SEQ ID NO: 391128 - DNA, 25 bp, Mus musculus
ctgtggcccggtttattggagagaa

SEQ ID NO: 391129 - DNA, 25 bp, Mus musculus
ctgtggccctcactagcaaagctga

SEQ ID NO: 391130 - DNA, 25 bp, Mus musculus
ctgtggccctcagtagcaaagctga

SEQ ID NO: 391131 - DNA, 25 bp, Mus musculus
ctgtggccctgacagcattaaaatc

SEQ ID NO: 391132 - DNA, 25 bp, Mus musculus
ctgtggccctgagagcattaaaatc

SEQ ID NO: 391133 - DNA, 25 bp, Mus musculus
ctgtggcccttccaatctaaatgga

SEQ ID NO: 391134 - DNA, 25 bp, Mus musculus
ctgtggcccttcgaatctaaatgga

SEQ ID NO: 391135 - DNA, 25 bp, Mus musculus
ctgtggccgactattggcgcatggt

SEQ ID NO: 391136 - DNA, 25 bp, Mus musculus
ctgtggccgacttttggcgcatggt

SEQ ID NO: 391137 - DNA, 25 bp, Mus musculus
ctgtggccgcagatggacagctgca

SEQ ID NO: 391138 - DNA, 25 bp, Mus musculus
ctgtggccgcagttggacagctgca

SEQ ID NO: 391139 - DNA, 25 bp, Mus musculus
ctgtggccggtgatcaagtgtctaa

SEQ ID NO: 391140 - DNA, 25 bp, Mus musculus
ctgtggccggtgttcaagtgtctaa

SEQ ID NO: 391141 - DNA, 25 bp, Mus musculus
ctgtggcctaaaacagagatttccc

SEQ ID NO: 391142 - DNA, 25 bp, Mus musculus
ctgtggcctaaatcagagatttccc

SEQ ID NO: 391143 - DNA, 25 bp, Mus musculus
ctgtggcctcaccttactgtgtaaa

SEQ ID NO: 391144 - DNA, 25 bp, Mus musculus
ctgtggcctcacgttactgtgtaaa

SEQ ID NO: 391145 - DNA, 25 bp, Mus musculus
ctgtggcctcagatgtgtggagctt

SEQ ID NO: 391146 - DNA, 25 bp, Mus musculus
ctgtggcctcagttgtgtggagctt

SEQ ID NO: 391147 - DNA, 25 bp, Mus musculus
ctgtggcctcatcataataacctat

SEQ ID NO: 391148 - DNA, 25 bp, Mus musculus
ctgtggcctcatgataataacctat

SEQ ID NO: 391149 - DNA, 25 bp, Mus musculus
ctgtggcctggtatttatcgtcttt

SEQ ID NO: 391150 - DNA, 25 bp, Mus musculus
ctgtggcctggtttttatcgtcttt

SEQ ID NO: 391151 - DNA, 25 bp, Mus musculus
ctgtggcctgttagcagcaagtcat

SEQ ID NO: 391152 - DNA, 25 bp, Mus musculus
ctgtggcctgttcgcagagagtaaa

SEQ ID NO: 391153 - DNA, 25 bp, Mus musculus
ctgtggcctgttggcagagagtaaa

SEQ ID NO: 391154 - DNA, 25 bp, Mus musculus
ctgtggcctgtttgcagcaagtcat

SEQ ID NO: 391155 - DNA, 25 bp, Mus musculus
ctgtggcgactcagtggaggcccca

SEQ ID NO: 391156 - DNA, 25 bp, Mus musculus
ctgtggcgactctgtggaggcccca

SEQ ID NO: 391157 - DNA, 25 bp, Mus musculus
ctgtggcgcatccagattgtgaaaa

SEQ ID NO: 391158 - DNA, 25 bp, Mus musculus
ctgtggcgcatcgagattgtgaaaa

SEQ ID NO: 391159 - DNA, 25 bp, Mus musculus
ctgtggcgctgcagttattccttat

SEQ ID NO: 391160 - DNA, 25 bp, Mus musculus
ctgtggcgctgctgttattccttat

SEQ ID NO: 391161 - DNA, 25 bp, Mus musculus
ctgtggctaactcaggttctactga

SEQ ID NO: 391162 - DNA, 25 bp, Mus musculus
ctgtggctaactgaggttctactga

SEQ ID NO: 391163 - DNA, 25 bp, Mus musculus
ctgtggctaaggcacaagttgtcca

SEQ ID NO: 391164 - DNA, 25 bp, Mus musculus
ctgtggctaagggacaagttgtcca

SEQ ID NO: 391165 - DNA, 25 bp, Mus musculus
ctgtggctacagattggaactcttt

SEQ ID NO: 391166 - DNA, 25 bp, Mus musculus
ctgtggctacagtttggaactcttt

SEQ ID NO: 391167 - DNA, 25 bp, Mus musculus
ctgtggctagccagtgaaatataaa

SEQ ID NO: 391168 - DNA, 25 bp, Mus musculus
ctgtggctagcctgtgaaatataaa

SEQ ID NO: 391169 - DNA, 25 bp, Mus musculus
ctgtggctcagaattctggaggcat

SEQ ID NO: 391170 - DNA, 25 bp, Mus musculus
ctgtggctcagatttctggaggcat

SEQ ID NO: 391171 - DNA, 25 bp, Mus musculus
ctgtggctcagtacatgtggatcat

SEQ ID NO: 391172 - DNA, 25 bp, Mus musculus
ctgtggctcagttcatgtggatcat

SEQ ID NO: 391173 - DNA, 25 bp, Mus musculus
ctgtggctccatacaagtacgcctc

SEQ ID NO: 391174 - DNA, 25 bp, Mus musculus
ctgtggctccattcaagtacgcctc

SEQ ID NO: 391175 - DNA, 25 bp, Mus musculus
ctgtggctctaccaagcagtgtcat

SEQ ID NO: 391176 - DNA, 25 bp, Mus musculus
ctgtggctctacgaagcagtgtcat

SEQ ID NO: 391177 - DNA, 25 bp, Mus musculus
ctgtggctctctctatttgttccca

SEQ ID NO: 391178 - DNA, 25 bp, Mus musculus
ctgtggctctctcttcttgagaaaa

SEQ ID NO: 391179 - DNA, 25 bp, Mus musculus
ctgtggctctctgtatttgttccca

SEQ ID NO: 391180 - DNA, 25 bp, Mus musculus
ctgtggctctctgttcttgagaaaa

SEQ ID NO: 391181 - DNA, 25 bp, Mus musculus
ctgtggctctgtcctggtgcgtctc

SEQ ID NO: 391182 - DNA, 25 bp, Mus musculus
ctgtggctctgtgctggtgcgtctc

SEQ ID NO: 391183 - DNA, 25 bp, Mus musculus
ctgtggctgaatagcaaggagtgtc

SEQ ID NO: 391184 - DNA, 25 bp, Mus musculus
ctgtggctgaattgcaaggagtgtc

SEQ ID NO: 391185 - DNA, 25 bp, Mus musculus
ctgtggctgacaattgacttagggc

SEQ ID NO: 391186 - DNA, 25 bp, Mus musculus
ctgtggctgacatttgacttagggc

SEQ ID NO: 391187 - DNA, 25 bp, Mus musculus
ctgtggctgatgcacacacaccctt

SEQ ID NO: 391188 - DNA, 25 bp, Mus musculus
ctgtggctgatggacacacaccctt

SEQ ID NO: 391189 - DNA, 25 bp, Mus musculus
ctgtggctgcacaatgttatgttta

SEQ ID NO: 391190 - DNA, 25 bp, Mus musculus
ctgtggctgcactatgttatgttta

SEQ ID NO: 391191 - DNA, 25 bp, Mus musculus
ctgtggctgcggagagagctttcac

SEQ ID NO: 391192 - DNA, 25 bp, Mus musculus
ctgtggctgcggtgagagctttcac

SEQ ID NO: 391193 - DNA, 25 bp, Mus musculus
ctgtggctggaaagaaggacaacca

SEQ ID NO: 391194 - DNA, 25 bp, Mus musculus
ctgtggctggaatgaaggacaacca

SEQ ID NO: 391195 - DNA, 25 bp, Mus musculus
ctgtggctgggaaacattttagttt

SEQ ID NO: 391196 - DNA, 25 bp, Mus musculus
ctgtggctgggatacattttagttt

SEQ ID NO: 391197 - DNA, 25 bp, Mus musculus
ctgtggctggttcttttttagactt

SEQ ID NO: 391198 - DNA, 25 bp, Mus musculus
ctgtggctggttgttttttagactt

SEQ ID NO: 391199 - DNA, 25 bp, Mus musculus
ctgtggcttagtcaaatctctgcgc

SEQ ID NO: 391200 - DNA, 25 bp, Mus musculus
ctgtggcttagtgaaatctctgcgc

SEQ ID NO: 391201 - DNA, 25 bp, Mus musculus
ctgtggcttggaccatgttggttat

SEQ ID NO: 391202 - DNA, 25 bp, Mus musculus
ctgtggcttggagcatgttggttat

SEQ ID NO: 391203 - DNA, 25 bp, Mus musculus
ctgtggcttgtcattggttattttg

SEQ ID NO: 391204 - DNA, 25 bp, Mus musculus
ctgtggcttgtctttggttattttg

SEQ ID NO: 391205 - DNA, 25 bp, Mus musculus
ctgtggcttttgcacatccgtttaa

SEQ ID NO: 391206 - DNA, 25 bp, Mus musculus
ctgtggcttttggacatccgtttaa

SEQ ID NO: 391207 - DNA, 25 bp, Mus musculus
ctgtgggaaccacccattctaagga

SEQ ID NO: 391208 - DNA, 25 bp, Mus musculus
ctgtgggaaccagccattctaagga

SEQ ID NO: 391209 - DNA, 25 bp, Mus musculus
ctgtgggaacccacgcgctgagagt

SEQ ID NO: 391210 - DNA, 25 bp, Mus musculus
ctgtgggaaccctcgcgctgagagt

SEQ ID NO: 391211 - DNA, 25 bp, Mus musculus
ctgtgggaacttcaccagaggtctc

SEQ ID NO: 391212 - DNA, 25 bp, Mus musculus
ctgtgggaacttgaccagaggtctc

SEQ ID NO: 391213 - DNA, 25 bp, Mus musculus
ctgtgggaagagctcaagtctgcaa

SEQ ID NO: 391214 - DNA, 25 bp, Mus musculus
ctgtgggaagaggtcaagtctgcaa

SEQ ID NO: 391215 - DNA, 25 bp, Mus musculus
ctgtgggaatggctgtttatcaatt

SEQ ID NO: 391216 - DNA, 25 bp, Mus musculus
ctgtgggaatgggtgtttatcaatt

SEQ ID NO: 391217 - DNA, 25 bp, Mus musculus
ctgtgggaattgacctatttttagc

SEQ ID NO: 391218 - DNA, 25 bp, Mus musculus
ctgtgggaattgtcctatttttagc

SEQ ID NO: 391219 - DNA, 25 bp, Mus musculus
ctgtgggacactactaactgcccag

SEQ ID NO: 391220 - DNA, 25 bp, Mus musculus
ctgtgggacacttctaactgcccag

SEQ ID NO: 391221 - DNA, 25 bp, Mus musculus
ctgtgggacatgaaccccagcatga

SEQ ID NO: 391222 - DNA, 25 bp, Mus musculus
ctgtgggacatgtaccccagcatga

SEQ ID NO: 391223 - DNA, 25 bp, Mus musculus
ctgtgggaccgtcgctagtttgctc

SEQ ID NO: 391224 - DNA, 25 bp, Mus musculus
ctgtgggaccgtggctagtttgctc

SEQ ID NO: 391225 - DNA, 25 bp, Mus musculus
ctgtgggacggtcccttcatgaatg

SEQ ID NO: 391226 - DNA, 25 bp, Mus musculus
ctgtgggacggtgccttcatgaatg

SEQ ID NO: 391227 - DNA, 25 bp, Mus musculus
ctgtgggactctagtggtctgctag

SEQ ID NO: 391228 - DNA, 25 bp, Mus musculus
ctgtgggactcttgtggtctgctag

SEQ ID NO: 391229 - DNA, 25 bp, Mus musculus
ctgtgggagggaccctgctaatctt

SEQ ID NO: 391230 - DNA, 25 bp, Mus musculus
ctgtgggagggagcctgctaatctt

SEQ ID NO: 391231 - DNA, 25 bp, Mus musculus
ctgtgggatcttccctgggattgaa

SEQ ID NO: 391232 - DNA, 25 bp, Mus musculus
ctgtgggatcttgcctgggattgaa

SEQ ID NO: 391233 - DNA, 25 bp, Mus musculus
ctgtgggatgatcctagtgtctact

SEQ ID NO: 391234 - DNA, 25 bp, Mus musculus
ctgtgggatgatgctagtgtctact

SEQ ID NO: 391235 - DNA, 25 bp, Mus musculus
ctgtgggcaacacttcatcctggaa

SEQ ID NO: 391236 - DNA, 25 bp, Mus musculus
ctgtgggcaacagttcatcctggaa

SEQ ID NO: 391237 - DNA, 25 bp, Mus musculus
ctgtgggcaataatgtgaagttcct

SEQ ID NO: 391238 - DNA, 25 bp, Mus musculus
ctgtgggcaatattgtgaagttcct

SEQ ID NO: 391239 - DNA, 25 bp, Mus musculus
ctgtgggcacaactgctccatcaac

SEQ ID NO: 391240 - DNA, 25 bp, Mus musculus
ctgtgggcacaagtgctccatcaac

SEQ ID NO: 391241 - DNA, 25 bp, Mus musculus
ctgtgggcaccacatatgcacgcat

SEQ ID NO: 391242 - DNA, 25 bp, Mus musculus
ctgtgggcaccagatatgcacgcat

SEQ ID NO: 391243 - DNA, 25 bp, Mus musculus
ctgtgggcactcactgcagagagga

SEQ ID NO: 391244 - DNA, 25 bp, Mus musculus
ctgtgggcactctctgcagagagga

SEQ ID NO: 391245 - DNA, 25 bp, Mus musculus
ctgtgggcagtcacatcctgggata

SEQ ID NO: 391246 - DNA, 25 bp, Mus musculus
ctgtgggcagtctcatcctgggata

SEQ ID NO: 391247 - DNA, 25 bp, Mus musculus
ctgtgggcattcagctcagagcgga

SEQ ID NO: 391248 - DNA, 25 bp, Mus musculus
ctgtgggcattctgctcagagcgga

SEQ ID NO: 391249 - DNA, 25 bp, Mus musculus
ctgtgggccacaaatctctacaagt

SEQ ID NO: 391250 - DNA, 25 bp, Mus musculus
ctgtgggccacatatctctacaagt

SEQ ID NO: 391251 - DNA, 25 bp, Mus musculus
ctgtgggccactcagtaactttgct

SEQ ID NO: 391252 - DNA, 25 bp, Mus musculus
ctgtgggccactgagtaactttgct

SEQ ID NO: 391253 - DNA, 25 bp, Mus musculus
ctgtgggccatgcaactcctttgta

SEQ ID NO: 391254 - DNA, 25 bp, Mus musculus
ctgtgggccatggaactcctttgta

SEQ ID NO: 391255 - DNA, 25 bp, Mus musculus
ctgtgggccctgcagaggtacataa

SEQ ID NO: 391256 - DNA, 25 bp, Mus musculus
ctgtgggccctggagaggtacataa

SEQ ID NO: 391257 - DNA, 25 bp, Mus musculus
ctgtgggcctaacctggccgcctgt

SEQ ID NO: 391258 - DNA, 25 bp, Mus musculus
ctgtgggcctaagctggccgcctgt

SEQ ID NO: 391259 - DNA, 25 bp, Mus musculus
ctgtgggcctgacacacactggtta

SEQ ID NO: 391260 - DNA, 25 bp, Mus musculus
ctgtgggcctgagacacactggtta

SEQ ID NO: 391261 - DNA, 25 bp, Mus musculus
ctgtgggcgatgatcaagagaatct

SEQ ID NO: 391262 - DNA, 25 bp, Mus musculus
ctgtgggcgatgttcaagagaatct

SEQ ID NO: 391263 - DNA, 25 bp, Mus musculus
ctgtgggctccacgaattgaacgta

SEQ ID NO: 391264 - DNA, 25 bp, Mus musculus
ctgtgggctccaggaattgaacgta

SEQ ID NO: 391265 - DNA, 25 bp, Mus musculus
ctgtgggctctccaaccttaattaa

SEQ ID NO: 391266 - DNA, 25 bp, Mus musculus
ctgtgggctctcgaaccttaattaa

SEQ ID NO: 391267 - DNA, 25 bp, Mus musculus
ctgtgggcttacagacggcaggcat

SEQ ID NO: 391268 - DNA, 25 bp, Mus musculus
ctgtgggcttacaggtttgttgaac

SEQ ID NO: 391269 - DNA, 25 bp, Mus musculus
ctgtgggcttactgacggcaggcat

SEQ ID NO: 391270 - DNA, 25 bp, Mus musculus
ctgtgggcttactggtttgttgaac

SEQ ID NO: 391271 - DNA, 25 bp, Mus musculus
ctgtgggcttccaacattatccaga

SEQ ID NO: 391272 - DNA, 25 bp, Mus musculus
ctgtgggcttcctacattatccaga

SEQ ID NO: 391273 - DNA, 25 bp, Mus musculus
ctgtggggcacaccccaaagtatta

SEQ ID NO: 391274 - DNA, 25 bp, Mus musculus
ctgtggggcacagcccaaagtatta

SEQ ID NO: 391275 - DNA, 25 bp, Mus musculus
ctgtgggggataacttgaagcatga

SEQ ID NO: 391276 - DNA, 25 bp, Mus musculus
ctgtgggggatatcttgaagcatga

SEQ ID NO: 391277 - DNA, 25 bp, Mus musculus
ctgtgggtccgaagcagtaccctta

SEQ ID NO: 391278 - DNA, 25 bp, Mus musculus
ctgtgggtccgatgcagtaccctta

SEQ ID NO: 391279 - DNA, 25 bp, Mus musculus
ctgtgggtctcaataaacggaaaca

SEQ ID NO: 391280 - DNA, 25 bp, Mus musculus
ctgtgggtctcattaaacggaaaca

SEQ ID NO: 391281 - DNA, 25 bp, Mus musculus
ctgtgggtgatcacgggctacataa

SEQ ID NO: 391282 - DNA, 25 bp, Mus musculus
ctgtgggtgatctcgggctacataa

SEQ ID NO: 391283 - DNA, 25 bp, Mus musculus
ctgtgggtgattcctggtgctacca

SEQ ID NO: 391284 - DNA, 25 bp, Mus musculus
ctgtgggtgattgctggtgctacca

SEQ ID NO: 391285 - DNA, 25 bp, Mus musculus
ctgtgggtgccactagtgtcctgct

SEQ ID NO: 391286 - DNA, 25 bp, Mus musculus
ctgtgggtgccagtagtgtcctgct

SEQ ID NO: 391287 - DNA, 25 bp, Mus musculus
ctgtgggtgtatccaagaagaaatg

SEQ ID NO: 391288 - DNA, 25 bp, Mus musculus
ctgtgggtgtatgcaagaagaaatg

SEQ ID NO: 391289 - DNA, 25 bp, Mus musculus
ctgtgggtgtcaacaaagctgtgga

SEQ ID NO: 391290 - DNA, 25 bp, Mus musculus
ctgtgggtgtcatcaaagctgtgga

SEQ ID NO: 391291 - DNA, 25 bp, Mus musculus
ctgtgggttcagcttttgagtctta

SEQ ID NO: 391292 - DNA, 25 bp, Mus musculus
ctgtgggttcaggttttgagtctta

SEQ ID NO: 391293 - DNA, 25 bp, Mus musculus
ctgtgggtttctaccactcttccct

SEQ ID NO: 391294 - DNA, 25 bp, Mus musculus
ctgtgggtttcttccactcttccct

SEQ ID NO: 391295 - DNA, 25 bp, Mus musculus
ctgtggtaagtgatgacgagccgtt

SEQ ID NO: 391296 - DNA, 25 bp, Mus musculus
ctgtggtaagtgttgacgagccgtt

SEQ ID NO: 391297 - DNA, 25 bp, Mus musculus
ctgtggtacaagataacacctgtgt

SEQ ID NO: 391298 - DNA, 25 bp, Mus musculus
ctgtggtacaagttaacacctgtgt

SEQ ID NO: 391299 - DNA, 25 bp, Mus musculus
ctgtggtacagaaagcaaaggcgtt

SEQ ID NO: 391300 - DNA, 25 bp, Mus musculus
ctgtggtacagatagcaaaggcgtt

SEQ ID NO: 391301 - DNA, 25 bp, Mus musculus
ctgtggtaccacatcattcagtatt

SEQ ID NO: 391302 - DNA, 25 bp, Mus musculus
ctgtggtaccacttcattcagtatt

SEQ ID NO: 391303 - DNA, 25 bp, Mus musculus
ctgtggtaccagcatgcaagggcca

SEQ ID NO: 391304 - DNA, 25 bp, Mus musculus
ctgtggtaccaggatgcaagggcca

SEQ ID NO: 391305 - DNA, 25 bp, Mus musculus
ctgtggtactgaaaattctcttaat

SEQ ID NO: 391306 - DNA, 25 bp, Mus musculus
ctgtggtactgataattctcttaat

SEQ ID NO: 391307 - DNA, 25 bp, Mus musculus
ctgtggtactgccaggaaggaatct

SEQ ID NO: 391308 - DNA, 25 bp, Mus musculus
ctgtggtactgcgaggaaggaatct

SEQ ID NO: 391309 - DNA, 25 bp, Mus musculus
ctgtggtagcagagtgcacacatct

SEQ ID NO: 391310 - DNA, 25 bp, Mus musculus
ctgtggtagcagtgtgcacacatct

SEQ ID NO: 391311 - DNA, 25 bp, Mus musculus
ctgtggtagtatatccttagcatat

SEQ ID NO: 391312 - DNA, 25 bp, Mus musculus
ctgtggtagtatttccttagcatat

SEQ ID NO: 391313 - DNA, 25 bp, Mus musculus
ctgtggtatcagactttgtgaaaac

SEQ ID NO: 391314 - DNA, 25 bp, Mus musculus
ctgtggtatcagtctttgtgaaaac

SEQ ID NO: 391315 - DNA, 25 bp, Mus musculus
ctgtggtatccaacatattgctgac

SEQ ID NO: 391316 - DNA, 25 bp, Mus musculus
ctgtggtatccatcatattgctgac

SEQ ID NO: 391317 - DNA, 25 bp, Mus musculus
ctgtggtatcttctcctgtaactga

SEQ ID NO: 391318 - DNA, 25 bp, Mus musculus
ctgtggtatcttgtcctgtaactga

SEQ ID NO: 391319 - DNA, 25 bp, Mus musculus
ctgtggtcaagacctaaaggattga

SEQ ID NO: 391320 - DNA, 25 bp, Mus musculus
ctgtggtcaagagctaaaggattga

SEQ ID NO: 391321 - DNA, 25 bp, Mus musculus
ctgtggtcacttatatggccttggt

SEQ ID NO: 391322 - DNA, 25 bp, Mus musculus
ctgtggtcacttttatggccttggt

SEQ ID NO: 391323 - DNA, 25 bp, Mus musculus
ctgtggtccaatcacgatgacactt

SEQ ID NO: 391324 - DNA, 25 bp, Mus musculus
ctgtggtccaatgacgatgacactt

SEQ ID NO: 391325 - DNA, 25 bp, Mus musculus
ctgtggtccacaaataggtctattg

SEQ ID NO: 391326 - DNA, 25 bp, Mus musculus
ctgtggtccacatataggtctattg

SEQ ID NO: 391327 - DNA, 25 bp, Mus musculus
ctgtggtccagaaacctgggctgat

SEQ ID NO: 391328 - DNA, 25 bp, Mus musculus
ctgtggtccagatacctgggctgat

SEQ ID NO: 391329 - DNA, 25 bp, Mus musculus
ctgtggtccaggctccatacaaaat

SEQ ID NO: 391330 - DNA, 25 bp, Mus musculus
ctgtggtccagggtccatacaaaat

SEQ ID NO: 391331 - DNA, 25 bp, Mus musculus
ctgtggtccctgattcaactttgat

SEQ ID NO: 391332 - DNA, 25 bp, Mus musculus
ctgtggtccctgtttcaactttgat

SEQ ID NO: 391333 - DNA, 25 bp, Mus musculus
ctgtggtccgttatcctatccagat

SEQ ID NO: 391334 - DNA, 25 bp, Mus musculus
ctgtggtccgttttcctatccagat

SEQ ID NO: 391335 - DNA, 25 bp, Mus musculus
ctgtggtcctggactggcttacagt

SEQ ID NO: 391336 - DNA, 25 bp, Mus musculus
ctgtggtcctggtctggcttacagt

SEQ ID NO: 391337 - DNA, 25 bp, Mus musculus
ctgtggtccttgatctttgtatctt

SEQ ID NO: 391338 - DNA, 25 bp, Mus musculus
ctgtggtccttgttctttgtatctt

SEQ ID NO: 391339 - DNA, 25 bp, Mus musculus
ctgtggtcctttcatggctggagta

SEQ ID NO: 391340 - DNA, 25 bp, Mus musculus
ctgtggtcctttgatggctggagta

SEQ ID NO: 391341 - DNA, 25 bp, Mus musculus
ctgtggtcgtggacttatttttatc

SEQ ID NO: 391342 - DNA, 25 bp, Mus musculus
ctgtggtcgtggtcttatttttatc

SEQ ID NO: 391343 - DNA, 25 bp, Mus musculus
ctgtggtctattattgtgcaagata

SEQ ID NO: 391344 - DNA, 25 bp, Mus musculus
ctgtggtctatttttgtgcaagata

SEQ ID NO: 391345 - DNA, 25 bp, Mus musculus
ctgtggtcttcaccgtttgtgtgaa

SEQ ID NO: 391346 - DNA, 25 bp, Mus musculus
ctgtggtcttcagcgtttgtgtgaa

SEQ ID NO: 391347 - DNA, 25 bp, Mus musculus
ctgtggtgaaacctgctcatcagag

SEQ ID NO: 391348 - DNA, 25 bp, Mus musculus
ctgtggtgaaacgtgctcatcagag

SEQ ID NO: 391349 - DNA, 25 bp, Mus musculus
ctgtggtgaacccaaataagttatt

SEQ ID NO: 391350 - DNA, 25 bp, Mus musculus
ctgtggtgaaccgaaataagttatt

SEQ ID NO: 391351 - DNA, 25 bp, Mus musculus
ctgtggtgaaggacctgacagagct

SEQ ID NO: 391352 - DNA, 25 bp, Mus musculus
ctgtggtgaaggtcctgacagagct

SEQ ID NO: 391353 - DNA, 25 bp, Mus musculus
ctgtggtgcacacgaggagattctc

SEQ ID NO: 391354 - DNA, 25 bp, Mus musculus
ctgtggtgcacaggaggagattctc

SEQ ID NO: 391355 - DNA, 25 bp, Mus musculus
ctgtggtgcattagccatatgcaaa

SEQ ID NO: 391356 - DNA, 25 bp, Mus musculus
ctgtggtgcattagctaaggaactg

SEQ ID NO: 391357 - DNA, 25 bp, Mus musculus
ctgtggtgcatttgccatatgcaaa

SEQ ID NO: 391358 - DNA, 25 bp, Mus musculus
ctgtggtgcatttgctaaggaactg

SEQ ID NO: 391359 - DNA, 25 bp, Mus musculus
ctgtggtgcttgaatcttgggaatc

SEQ ID NO: 391360 - DNA, 25 bp, Mus musculus
ctgtggtgcttgtatcttgggaatc

SEQ ID NO: 391361 - DNA, 25 bp, Mus musculus
ctgtggtggacaaggttccttgcca

SEQ ID NO: 391362 - DNA, 25 bp, Mus musculus
ctgtggtggacatggttccttgcca

SEQ ID NO: 391363 - DNA, 25 bp, Mus musculus
ctgtggtggactactagctgacatc

SEQ ID NO: 391364 - DNA, 25 bp, Mus musculus
ctgtggtggacttctagctgacatc

SEQ ID NO: 391365 - DNA, 25 bp, Mus musculus
ctgtggtggatccaaacgcatggca

SEQ ID NO: 391366 - DNA, 25 bp, Mus musculus
ctgtggtggatcgaaacgcatggca

SEQ ID NO: 391367 - DNA, 25 bp, Mus musculus
ctgtggtggcacaacttgggctaat

SEQ ID NO: 391368 - DNA, 25 bp, Mus musculus
ctgtggtggcactacttgggctaat

SEQ ID NO: 391369 - DNA, 25 bp, Mus musculus
ctgtggtggcatattgtgaccagac

SEQ ID NO: 391370 - DNA, 25 bp, Mus musculus
ctgtggtggcatctggtaccttaag

SEQ ID NO: 391371 - DNA, 25 bp, Mus musculus
ctgtggtggcatgtggtaccttaag

SEQ ID NO: 391372 - DNA, 25 bp, Mus musculus
ctgtggtggcattttgtgaccagac

SEQ ID NO: 391373 - DNA, 25 bp, Mus musculus
ctgtggtggctgatgtacttgtgaa

SEQ ID NO: 391374 - DNA, 25 bp, Mus musculus
ctgtggtggctgttgtacttgtgaa

SEQ ID NO: 391375 - DNA, 25 bp, Mus musculus
ctgtggtggcttcaactgtaggtaa

SEQ ID NO: 391376 - DNA, 25 bp, Mus musculus
ctgtggtggcttgaactgtaggtaa

SEQ ID NO: 391377 - DNA, 25 bp, Mus musculus
ctgtggtgggtcatggttgttttct

SEQ ID NO: 391378 - DNA, 25 bp, Mus musculus
ctgtggtgggtcttggttgttttct

SEQ ID NO: 391379 - DNA, 25 bp, Mus musculus
ctgtggtgtgcgcattcttcaaaca

SEQ ID NO: 391380 - DNA, 25 bp, Mus musculus
ctgtggtgtgcggattcttcaaaca

SEQ ID NO: 391381 - DNA, 25 bp, Mus musculus
ctgtggttattgatgagctgttgct

SEQ ID NO: 391382 - DNA, 25 bp, Mus musculus
ctgtggttattgttgagctgttgct

SEQ ID NO: 391383 - DNA, 25 bp, Mus musculus
ctgtggttcagtcctctattgagca

SEQ ID NO: 391384 - DNA, 25 bp, Mus musculus
ctgtggttcagtgctctattgagca

SEQ ID NO: 391385 - DNA, 25 bp, Mus musculus
ctgtggttcatcaaataaaactgtt

SEQ ID NO: 391386 - DNA, 25 bp, Mus musculus
ctgtggttcatctaataaaactgtt

SEQ ID NO: 391387 - DNA, 25 bp, Mus musculus
ctgtggttcattagggagagtcctt

SEQ ID NO: 391388 - DNA, 25 bp, Mus musculus
ctgtggttcatttgggagagtcctt

SEQ ID NO: 391389 - DNA, 25 bp, Mus musculus
ctgtggttcccaagtgtgtgtgatc

SEQ ID NO: 391390 - DNA, 25 bp, Mus musculus
ctgtggttcccatgtgtgtgtgatc

SEQ ID NO: 391391 - DNA, 25 bp, Mus musculus
ctgtggttccctaatggttatattt

SEQ ID NO: 391392 - DNA, 25 bp, Mus musculus
ctgtggttccctccccaaggtgctg

SEQ ID NO: 391393 - DNA, 25 bp, Mus musculus
ctgtggttccctgcccaaggtgctg

SEQ ID NO: 391394 - DNA, 25 bp, Mus musculus
ctgtggttcccttatggttatattt

SEQ ID NO: 391395 - DNA, 25 bp, Mus musculus
ctgtggttgaaacctctcctaagtt

SEQ ID NO: 391396 - DNA, 25 bp, Mus musculus
ctgtggttgaaagctctcctaagtt

SEQ ID NO: 391397 - DNA, 25 bp, Mus musculus
ctgtggttgcagatcttaggtcaat

SEQ ID NO: 391398 - DNA, 25 bp, Mus musculus
ctgtggttgcagttcttaggtcaat

SEQ ID NO: 391399 - DNA, 25 bp, Mus musculus
ctgtggttggtacaattccctggga

SEQ ID NO: 391400 - DNA, 25 bp, Mus musculus
ctgtggttggtagaattccctggga

SEQ ID NO: 391401 - DNA, 25 bp, Mus musculus
ctgtggttggtgctagctctgctca

SEQ ID NO: 391402 - DNA, 25 bp, Mus musculus
ctgtggttggtggtagctctgctca

SEQ ID NO: 391403 - DNA, 25 bp, Mus musculus
ctgtggttgtgtctcttctgtagac

SEQ ID NO: 391404 - DNA, 25 bp, Mus musculus
ctgtggttgtgtgtcttctgtagac

SEQ ID NO: 391405 - DNA, 25 bp, Mus musculus
ctgtggtttccaattcaagttccag

SEQ ID NO: 391406 - DNA, 25 bp, Mus musculus
ctgtggtttccatttcaagttccag

SEQ ID NO: 391407 - DNA, 25 bp, Mus musculus
ctgtggtttcgcaggatagtaggta

SEQ ID NO: 391408 - DNA, 25 bp, Mus musculus
ctgtggtttcgctggatagtaggta

SEQ ID NO: 391409 - DNA, 25 bp, Mus musculus
ctgtggtttctgacctgagctgaag

SEQ ID NO: 391410 - DNA, 25 bp, Mus musculus
ctgtggtttctgctaaggactcgta

SEQ ID NO: 391411 - DNA, 25 bp, Mus musculus
ctgtggtttctggtaaggactcgta

SEQ ID NO: 391412 - DNA, 25 bp, Mus musculus
ctgtggtttctgtcctgagctgaag

SEQ ID NO: 391413 - DNA, 25 bp, Mus musculus
ctgtggtttgaactcccagaggtga

SEQ ID NO: 391414 - DNA, 25 bp, Mus musculus
ctgtggtttgaagtcccagaggtga

SEQ ID NO: 391415 - DNA, 25 bp, Mus musculus
ctgtgtaaagccatcccagtccctt

SEQ ID NO: 391416 - DNA, 25 bp, Mus musculus
ctgtgtaaagccttcccagtccctt

SEQ ID NO: 391417 - DNA, 25 bp, Mus musculus
ctgtgtaacctgctttaaatgctac

SEQ ID NO: 391418 - DNA, 25 bp, Mus musculus
ctgtgtaacctggtttaaatgctac

SEQ ID NO: 391419 - DNA, 25 bp, Mus musculus
ctgtgtaactgcagtccagaggcac

SEQ ID NO: 391420 - DNA, 25 bp, Mus musculus
ctgtgtaactgctgtccagaggcac

SEQ ID NO: 391421 - DNA, 25 bp, Mus musculus
ctgtgtaatgttcctagtctgtaat

SEQ ID NO: 391422 - DNA, 25 bp, Mus musculus
ctgtgtaatgttgctagtctgtaat

SEQ ID NO: 391423 - DNA, 25 bp, Mus musculus
ctgtgtacacacaacattcttcaaa

SEQ ID NO: 391424 - DNA, 25 bp, Mus musculus
ctgtgtacacactacattcttcaaa

SEQ ID NO: 391425 - DNA, 25 bp, Mus musculus
ctgtgtacacagagctcctgtgcgg

SEQ ID NO: 391426 - DNA, 25 bp, Mus musculus
ctgtgtacacagtgctcctgtgcgg

SEQ ID NO: 391427 - DNA, 25 bp, Mus musculus
ctgtgtacactgagttgcaagagca

SEQ ID NO: 391428 - DNA, 25 bp, Mus musculus
ctgtgtacactgtgttgcaagagca

SEQ ID NO: 391429 - DNA, 25 bp, Mus musculus
ctgtgtacagtgacaggcatgggta

SEQ ID NO: 391430 - DNA, 25 bp, Mus musculus
ctgtgtacagtgctaaccagagcat

SEQ ID NO: 391431 - DNA, 25 bp, Mus musculus
ctgtgtacagtggtaaccagagcat

SEQ ID NO: 391432 - DNA, 25 bp, Mus musculus
ctgtgtacagtgtcaggcatgggta

SEQ ID NO: 391433 - DNA, 25 bp, Mus musculus
ctgtgtaccatgctttcctaacaag

SEQ ID NO: 391434 - DNA, 25 bp, Mus musculus
ctgtgtaccatggtttcctaacaag

SEQ ID NO: 391435 - DNA, 25 bp, Mus musculus
ctgtgtaccgtcaggtggtgaagat

SEQ ID NO: 391436 - DNA, 25 bp, Mus musculus
ctgtgtaccgtctggtggtgaagat

SEQ ID NO: 391437 - DNA, 25 bp, Mus musculus
ctgtgtacctccctgcaatggaaac

SEQ ID NO: 391438 - DNA, 25 bp, Mus musculus
ctgtgtacctccgtgcaatggaaac

SEQ ID NO: 391439 - DNA, 25 bp, Mus musculus
ctgtgtacctgcacgattacagaca

SEQ ID NO: 391440 - DNA, 25 bp, Mus musculus
ctgtgtacctgctcgattacagaca

SEQ ID NO: 391441 - DNA, 25 bp, Mus musculus
ctgtgtacgagcaggactacggcaa

SEQ ID NO: 391442 - DNA, 25 bp, Mus musculus
ctgtgtacgagctggactacggcaa

SEQ ID NO: 391443 - DNA, 25 bp, Mus musculus
ctgtgtacgtgtacttccatctgtg

SEQ ID NO: 391444 - DNA, 25 bp, Mus musculus
ctgtgtacgtgttcttccatctgtg

SEQ ID NO: 391445 - DNA, 25 bp, Mus musculus
ctgtgtactccaacgtaaaggccaa

SEQ ID NO: 391446 - DNA, 25 bp, Mus musculus
ctgtgtactccatcgtaaaggccaa

SEQ ID NO: 391447 - DNA, 25 bp, Mus musculus
ctgtgtactgacatcattcggctta

SEQ ID NO: 391448 - DNA, 25 bp, Mus musculus
ctgtgtactgacttcattcggctta

SEQ ID NO: 391449 - DNA, 25 bp, Mus musculus
ctgtgtactgtaagcaggtggctgc

SEQ ID NO: 391450 - DNA, 25 bp, Mus musculus
ctgtgtactgtatgcaggtggctgc

SEQ ID NO: 391451 - DNA, 25 bp, Mus musculus
ctgtgtagcaccctgtatctatgtt

SEQ ID NO: 391452 - DNA, 25 bp, Mus musculus
ctgtgtagcaccgtgtatctatgtt

SEQ ID NO: 391453 - DNA, 25 bp, Mus musculus
ctgtgtagcctgcattttgaaccca

SEQ ID NO: 391454 - DNA, 25 bp, Mus musculus
ctgtgtagcctggattttgaaccca

SEQ ID NO: 391455 - DNA, 25 bp, Mus musculus
ctgtgtagcgagatgcagcctcaaa

SEQ ID NO: 391456 - DNA, 25 bp, Mus musculus
ctgtgtagcgagttgcagcctcaaa

SEQ ID NO: 391457 - DNA, 25 bp, Mus musculus
ctgtgtagctgcagtccagaggcac

SEQ ID NO: 391458 - DNA, 25 bp, Mus musculus
ctgtgtagctgctgtccagaggcac

SEQ ID NO: 391459 - DNA, 25 bp, Mus musculus
ctgtgtagctgtactgcatgtgaat

SEQ ID NO: 391460 - DNA, 25 bp, Mus musculus
ctgtgtagctgttctgcatgtgaat

SEQ ID NO: 391461 - DNA, 25 bp, Mus musculus
ctgtgtagttatccttttttctccc

SEQ ID NO: 391462 - DNA, 25 bp, Mus musculus
ctgtgtagttatgcttttttctccc

SEQ ID NO: 391463 - DNA, 25 bp, Mus musculus
ctgtgtagttcacggaaacttccca

SEQ ID NO: 391464 - DNA, 25 bp, Mus musculus
ctgtgtagttcagggaaacttccca

SEQ ID NO: 391465 - DNA, 25 bp, Mus musculus
ctgtgtagtttcacacttcagtgtc

SEQ ID NO: 391466 - DNA, 25 bp, Mus musculus
ctgtgtagtttctcacttcagtgtc

SEQ ID NO: 391467 - DNA, 25 bp, Mus musculus
ctgtgtataaaccaccaaatcataa

SEQ ID NO: 391468 - DNA, 25 bp, Mus musculus
ctgtgtataaacgaccaaatcataa

SEQ ID NO: 391469 - DNA, 25 bp, Mus musculus
ctgtgtataaatcctttgtcatata

SEQ ID NO: 391470 - DNA, 25 bp, Mus musculus
ctgtgtataaatgctttgtcatata

SEQ ID NO: 391471 - DNA, 25 bp, Mus musculus
ctgtgtatacatcggagctggctgc

SEQ ID NO: 391472 - DNA, 25 bp, Mus musculus
ctgtgtatacatgggagctggctgc

SEQ ID NO: 391473 - DNA, 25 bp, Mus musculus
ctgtgtatccctctagctaccaatt

SEQ ID NO: 391474 - DNA, 25 bp, Mus musculus
ctgtgtatccctgtagctaccaatt

SEQ ID NO: 391475 - DNA, 25 bp, Mus musculus
ctgtgtatccgccatcatttgaaat

SEQ ID NO: 391476 - DNA, 25 bp, Mus musculus
ctgtgtatccgcgatcatttgaaat

SEQ ID NO: 391477 - DNA, 25 bp, Mus musculus
ctgtgtatcttgctgtgactccgaa

SEQ ID NO: 391478 - DNA, 25 bp, Mus musculus
ctgtgtatcttggtgtgactccgaa

SEQ ID NO: 391479 - DNA, 25 bp, Mus musculus
ctgtgtatgcttcccagtgctctac

SEQ ID NO: 391480 - DNA, 25 bp, Mus musculus
ctgtgtatgcttgccagtgctctac

SEQ ID NO: 391481 - DNA, 25 bp, Mus musculus
ctgtgtattactaaaggctgtgtgt

SEQ ID NO: 391482 - DNA, 25 bp, Mus musculus
ctgtgtattacttaaggctgtgtgt

SEQ ID NO: 391483 - DNA, 25 bp, Mus musculus
ctgtgtattctgatttctccatgag

SEQ ID NO: 391484 - DNA, 25 bp, Mus musculus
ctgtgtattctgttttctccatgag

SEQ ID NO: 391485 - DNA, 25 bp, Mus musculus
ctgtgtatttgcaaaaccctttctg

SEQ ID NO: 391486 - DNA, 25 bp, Mus musculus
ctgtgtatttgctaaaccctttctg

SEQ ID NO: 391487 - DNA, 25 bp, Mus musculus
ctgtgtattttaagagtcttggttt

SEQ ID NO: 391488 - DNA, 25 bp, Mus musculus
ctgtgtattttatgagtcttggttt

SEQ ID NO: 391489 - DNA, 25 bp, Mus musculus
ctgtgtcaacgccagtgctgttgag

SEQ ID NO: 391490 - DNA, 25 bp, Mus musculus
ctgtgtcaacgccatcaaggtgtat

SEQ ID NO: 391491 - DNA, 25 bp, Mus musculus
ctgtgtcaacgcgagtgctgttgag

SEQ ID NO: 391492 - DNA, 25 bp, Mus musculus
ctgtgtcaacgcgatcaaggtgtat

SEQ ID NO: 391493 - DNA, 25 bp, Mus musculus
ctgtgtcaagacctgcccagctggc

SEQ ID NO: 391494 - DNA, 25 bp, Mus musculus
ctgtgtcaagacgtgcccagctggc

SEQ ID NO: 391495 - DNA, 25 bp, Mus musculus
ctgtgtcaagcacctaacttgtata

SEQ ID NO: 391496 - DNA, 25 bp, Mus musculus
ctgtgtcaagcagctaacttgtata

SEQ ID NO: 391497 - DNA, 25 bp, Mus musculus
ctgtgtcacattctctgacagggac

SEQ ID NO: 391498 - DNA, 25 bp, Mus musculus
ctgtgtcacattgtctgacagggac

SEQ ID NO: 391499 - DNA, 25 bp, Mus musculus
ctgtgtcaccccatgtccactgggt

SEQ ID NO: 391500 - DNA, 25 bp, Mus musculus
ctgtgtcaccccttgtccactgggt

SEQ ID NO: 391501 - DNA, 25 bp, Mus musculus
ctgtgtcactccagtggaatttaat

SEQ ID NO: 391502 - DNA, 25 bp, Mus musculus
ctgtgtcactcctgtggaatttaat

SEQ ID NO: 391503 - DNA, 25 bp, Mus musculus
ctgtgtcactggattcaattctgga

SEQ ID NO: 391504 - DNA, 25 bp, Mus musculus
ctgtgtcactggtttcaattctgga

SEQ ID NO: 391505 - DNA, 25 bp, Mus musculus
ctgtgtcagcctcttcctgtgtgcc

SEQ ID NO: 391506 - DNA, 25 bp, Mus musculus
ctgtgtcagcctgttcctgtgtgcc

SEQ ID NO: 391507 - DNA, 25 bp, Mus musculus
ctgtgtcaggaaaagcatctctcat

SEQ ID NO: 391508 - DNA, 25 bp, Mus musculus
ctgtgtcaggaatagcatctctcat

SEQ ID NO: 391509 - DNA, 25 bp, Mus musculus
ctgtgtcagtgtatccttagggcaa

SEQ ID NO: 391510 - DNA, 25 bp, Mus musculus
ctgtgtcagtgtttccttagggcaa

SEQ ID NO: 391511 - DNA, 25 bp, Mus musculus
ctgtgtcatcctaactgtgaaatgc

SEQ ID NO: 391512 - DNA, 25 bp, Mus musculus
ctgtgtcatccttactgtgaaatgc

SEQ ID NO: 391513 - DNA, 25 bp, Mus musculus
ctgtgtcatgtgaagtccttgactt

SEQ ID NO: 391514 - DNA, 25 bp, Mus musculus
ctgtgtcatgtgtagtccttgactt

SEQ ID NO: 391515 - DNA, 25 bp, Mus musculus
ctgtgtcatgttagagactgtctct

SEQ ID NO: 391516 - DNA, 25 bp, Mus musculus
ctgtgtcatgtttgagactgtctct

SEQ ID NO: 391517 - DNA, 25 bp, Mus musculus
ctgtgtccaatcaggctctgcagtt

SEQ ID NO: 391518 - DNA, 25 bp, Mus musculus
ctgtgtccaatctggctctgcagtt

SEQ ID NO: 391519 - DNA, 25 bp, Mus musculus
ctgtgtccacagatcttgggagcca

SEQ ID NO: 391520 - DNA, 25 bp, Mus musculus
ctgtgtccacagttcttgggagcca

SEQ ID NO: 391521 - DNA, 25 bp, Mus musculus
ctgtgtccacgccactcactaatgt

SEQ ID NO: 391522 - DNA, 25 bp, Mus musculus
ctgtgtccacgcgactcactaatgt

SEQ ID NO: 391523 - DNA, 25 bp, Mus musculus
ctgtgtccagctcctgaagtgggaa

SEQ ID NO: 391524 - DNA, 25 bp, Mus musculus
ctgtgtccagctgctgaagtgggaa

SEQ ID NO: 391525 - DNA, 25 bp, Mus musculus
ctgtgtccaggcaagaagctctctt

SEQ ID NO: 391526 - DNA, 25 bp, Mus musculus
ctgtgtccaggctagaagctctctt

SEQ ID NO: 391527 - DNA, 25 bp, Mus musculus
ctgtgtccagtgagcacccaccagg

SEQ ID NO: 391528 - DNA, 25 bp, Mus musculus
ctgtgtccagtgtgcacccaccagg

SEQ ID NO: 391529 - DNA, 20 bp, Mus musculus
ctgtgtccatccagatggtc

SEQ ID NO: 391530 - DNA, 25 bp, Mus musculus
ctgtgtcccagccattcaagagctg

SEQ ID NO: 391531 - DNA, 25 bp, Mus musculus
ctgtgtcccagcgattcaagagctg

SEQ ID NO: 391532 - DNA, 25 bp, Mus musculus
ctgtgtcccaggctgactagaacta

SEQ ID NO: 391533 - DNA, 25 bp, Mus musculus
ctgtgtcccagggtgactagaacta

SEQ ID NO: 391534 - DNA, 25 bp, Mus musculus
ctgtgtccccaactgttgttgtgaa

SEQ ID NO: 391535 - DNA, 25 bp, Mus musculus
ctgtgtccccaagtgttgttgtgaa

SEQ ID NO: 391536 - DNA, 25 bp, Mus musculus
ctgtgtcccctgacaatgtgtttgt

SEQ ID NO: 391537 - DNA, 25 bp, Mus musculus
ctgtgtcccctgtcaatgtgtttgt

SEQ ID NO: 391538 - DNA, 20 bp, Mus musculus
ctgtgtccctccagatggtc

SEQ ID NO: 391539 - DNA, 25 bp, Mus musculus
ctgtgtccctgtcaaatatctgttc

SEQ ID NO: 391540 - DNA, 25 bp, Mus musculus
ctgtgtccctgtgaaatatctgttc

SEQ ID NO: 391541 - DNA, 25 bp, Mus musculus
ctgtgtcccttaaaattttcttcct

SEQ ID NO: 391542 - DNA, 25 bp, Mus musculus
ctgtgtcccttataattttcttcct

SEQ ID NO: 391543 - DNA, 25 bp, Mus musculus
ctgtgtccgaagagtctgtaggaaa

SEQ ID NO: 391544 - DNA, 25 bp, Mus musculus
ctgtgtccgaagtgtctgtaggaaa

SEQ ID NO: 391545 - DNA, 20 bp, Mus musculus
ctgtgtccgtccagatggtc

SEQ ID NO: 391546 - DNA, 25 bp, Mus musculus
ctgtgtcctggaaatgatggcctca

SEQ ID NO: 391547 - DNA, 25 bp, Mus musculus
ctgtgtcctggatatgatggcctca

SEQ ID NO: 391548 - DNA, 20 bp, Mus musculus
ctgtgtccttccagatggtc

SEQ ID NO: 391549 - DNA, 25 bp, Mus musculus
ctgtgtcctttgcagtttggtgtgt

SEQ ID NO: 391550 - DNA, 25 bp, Mus musculus
ctgtgtcctttggagtttggtgtgt

SEQ ID NO: 391551 - DNA, 25 bp, Mus musculus
ctgtgtcgccttcttgtaaatgttg

SEQ ID NO: 391552 - DNA, 25 bp, Mus musculus
ctgtgtcgccttgttgtaaatgttg

SEQ ID NO: 391553 - DNA, 25 bp, Mus musculus
ctgtgtcggatcaccttaagaaaat

SEQ ID NO: 391554 - DNA, 25 bp, Mus musculus
ctgtgtcggatctccttaagaaaat

SEQ ID NO: 391555 - DNA, 25 bp, Mus musculus
ctgtgtctacaacctggtgtctgta

SEQ ID NO: 391556 - DNA, 25 bp, Mus musculus
ctgtgtctacaagctggtgtctgta

SEQ ID NO: 391557 - DNA, 25 bp, Mus musculus
ctgtgtctacctacgggctgtcagg

SEQ ID NO: 391558 - DNA, 25 bp, Mus musculus
ctgtgtctaccttcgggctgtcagg

SEQ ID NO: 391559 - DNA, 25 bp, Mus musculus
ctgtgtctaggcagaatagcacttt

SEQ ID NO: 391560 - DNA, 25 bp, Mus musculus
ctgtgtctaggctgaatagcacttt

SEQ ID NO: 391561 - DNA, 25 bp, Mus musculus
ctgtgtctagggattcagatgatca

SEQ ID NO: 391562 - DNA, 25 bp, Mus musculus
ctgtgtctagggtttcagatgatca

SEQ ID NO: 391563 - DNA, 25 bp, Mus musculus
ctgtgtctatccaacagactgtgaa

SEQ ID NO: 391564 - DNA, 25 bp, Mus musculus
ctgtgtctatcctacagactgtgaa

SEQ ID NO: 391565 - DNA, 25 bp, Mus musculus
ctgtgtctcataataacctgtgcat

SEQ ID NO: 391566 - DNA, 25 bp, Mus musculus
ctgtgtctcatattaacctgtgcat

SEQ ID NO: 391567 - DNA, 25 bp, Mus musculus
ctgtgtctccagagagtcagcttta

SEQ ID NO: 391568 - DNA, 25 bp, Mus musculus
ctgtgtctccagtgagtcagcttta

SEQ ID NO: 391569 - DNA, 25 bp, Mus musculus
ctgtgtctcctccaatgggtttgtg

SEQ ID NO: 391570 - DNA, 25 bp, Mus musculus
ctgtgtctcctcgaatgggtttgtg

SEQ ID NO: 391571 - DNA, 25 bp, Mus musculus
ctgtgtctcgacctgtgttatttac

SEQ ID NO: 391572 - DNA, 25 bp, Mus musculus
ctgtgtctcgacgtgtgttatttac

SEQ ID NO: 391573 - DNA, 25 bp, Mus musculus
ctgtgtctgagaaactagccctgat

SEQ ID NO: 391574 - DNA, 25 bp, Mus musculus
ctgtgtctgagatactagccctgat

SEQ ID NO: 391575 - DNA, 25 bp, Mus musculus
ctgtgtctgcagagtgccttcaaac

SEQ ID NO: 391576 - DNA, 25 bp, Mus musculus
ctgtgtctgcagcacctcagattgt

SEQ ID NO: 391577 - DNA, 25 bp, Mus musculus
ctgtgtctgcaggacctcagattgt

SEQ ID NO: 391578 - DNA, 25 bp, Mus musculus
ctgtgtctgcagtgtgccttcaaac

SEQ ID NO: 391579 - DNA, 25 bp, Mus musculus
ctgtgtctgccaattattagccatg

SEQ ID NO: 391580 - DNA, 25 bp, Mus musculus
ctgtgtctgccatttattagccatg

SEQ ID NO: 391581 - DNA, 25 bp, Mus musculus
ctgtgtctgcctcaggattattagg

SEQ ID NO: 391582 - DNA, 25 bp, Mus musculus
ctgtgtctgcctgaggattattagg

SEQ ID NO: 391583 - DNA, 25 bp, Mus musculus
ctgtgtctgcgacgccaatgcaaat

SEQ ID NO: 391584 - DNA, 25 bp, Mus musculus
ctgtgtctgcgaggccaatgcaaat

SEQ ID NO: 391585 - DNA, 25 bp, Mus musculus
ctgtgtctgcgtctctgtataccta

SEQ ID NO: 391586 - DNA, 25 bp, Mus musculus
ctgtgtctgcgtgtctgtataccta

SEQ ID NO: 391587 - DNA, 25 bp, Mus musculus
ctgtgtctgctgaatctaccgcgat

SEQ ID NO: 391588 - DNA, 25 bp, Mus musculus
ctgtgtctgctgaccttgttgatag

SEQ ID NO: 391589 - DNA, 25 bp, Mus musculus
ctgtgtctgctgctagagttcctaa

SEQ ID NO: 391590 - DNA, 25 bp, Mus musculus
ctgtgtctgctggtagagttcctaa

SEQ ID NO: 391591 - DNA, 25 bp, Mus musculus
ctgtgtctgctgtatctaccgcgat

SEQ ID NO: 391592 - DNA, 25 bp, Mus musculus
ctgtgtctgctgtccttgttgatag

SEQ ID NO: 391593 - DNA, 25 bp, Mus musculus
ctgtgtctgcttcggactcagcggt

SEQ ID NO: 391594 - DNA, 25 bp, Mus musculus
ctgtgtctgcttgggactcagcggt

SEQ ID NO: 391595 - DNA, 25 bp, Mus musculus
ctgtgtctggaaagccacgtggcta

SEQ ID NO: 391596 - DNA, 25 bp, Mus musculus
ctgtgtctggaatgccacgtggcta

SEQ ID NO: 391597 - DNA, 25 bp, Mus musculus
ctgtgtctgggaacgagccttattc

SEQ ID NO: 391598 - DNA, 25 bp, Mus musculus
ctgtgtctgggatcgagccttattc

SEQ ID NO: 391599 - DNA, 25 bp, Mus musculus
ctgtgtctggttacagtgccttctc

SEQ ID NO: 391600 - DNA, 25 bp, Mus musculus
ctgtgtctggttccctgcatttgac

SEQ ID NO: 391601 - DNA, 25 bp, Mus musculus
ctgtgtctggttgcctgcatttgac

SEQ ID NO: 391602 - DNA, 25 bp, Mus musculus
ctgtgtctggtttcagtgccttctc

SEQ ID NO: 391603 - DNA, 25 bp, Mus musculus
ctgtgtctgtcacctgggtctgaaa

SEQ ID NO: 391604 - DNA, 25 bp, Mus musculus
ctgtgtctgtcagctgggtctgaaa

SEQ ID NO: 391605 - DNA, 25 bp, Mus musculus
ctgtgtctgtctcagcgccagatca

SEQ ID NO: 391606 - DNA, 25 bp, Mus musculus
ctgtgtctgtctgagcgccagatca

SEQ ID NO: 391607 - DNA, 25 bp, Mus musculus
ctgtgtctgtgtaggtaccagcaag

SEQ ID NO: 391608 - DNA, 25 bp, Mus musculus
ctgtgtctgtgttggtaccagcaag

SEQ ID NO: 391609 - DNA, 25 bp, Mus musculus
ctgtgtctttgccatgctctttaaa

SEQ ID NO: 391610 - DNA, 25 bp, Mus musculus
ctgtgtctttgcgatgctctttaaa

SEQ ID NO: 391611 - DNA, 25 bp, Mus musculus
ctgtgtctttgtatgttgtactcat

SEQ ID NO: 391612 - DNA, 25 bp, Mus musculus
ctgtgtctttgtcgttagctctcgt

SEQ ID NO: 391613 - DNA, 25 bp, Mus musculus
ctgtgtctttgtggttagctctcgt

SEQ ID NO: 391614 - DNA, 25 bp, Mus musculus
ctgtgtctttgtttgttgtactcat

SEQ ID NO: 391615 - DNA, 25 bp, Mus musculus
ctgtgtctttttagtgcaccacaag

SEQ ID NO: 391616 - DNA, 25 bp, Mus musculus
ctgtgtcttttttgtgcaccacaag

SEQ ID NO: 391617 - DNA, 25 bp, Mus musculus
ctgtgtgaaatgctgagactcgttt

SEQ ID NO: 391618 - DNA, 25 bp, Mus musculus
ctgtgtgaaatggtgagactcgttt

SEQ ID NO: 391619 - DNA, 25 bp, Mus musculus
ctgtgtgaacaacaccatcgtggcg

SEQ ID NO: 391620 - DNA, 25 bp, Mus musculus
ctgtgtgaacaagaccatcgtggcg

SEQ ID NO: 391621 - DNA, 25 bp, Mus musculus
ctgtgtgaacttcccttcataacct

SEQ ID NO: 391622 - DNA, 25 bp, Mus musculus
ctgtgtgaacttgccttcataacct

SEQ ID NO: 391623 - DNA, 25 bp, Mus musculus
ctgtgtgaagaaaagggaccattat

SEQ ID NO: 391624 - DNA, 25 bp, Mus musculus
ctgtgtgaagaatagggaccattat

SEQ ID NO: 391625 - DNA, 25 bp, Mus musculus
ctgtgtgaccgtctgaatcagcttg

SEQ ID NO: 391626 - DNA, 25 bp, Mus musculus
ctgtgtgaccgtgtgaatcagcttg

SEQ ID NO: 391627 - DNA, 25 bp, Mus musculus
ctgtgtgacgacaaccagcgtgaga

SEQ ID NO: 391628 - DNA, 25 bp, Mus musculus
ctgtgtgacgactaccagcgtgaga

SEQ ID NO: 391629 - DNA, 25 bp, Mus musculus
ctgtgtgagcaacagtccgagtgcc

SEQ ID NO: 391630 - DNA, 25 bp, Mus musculus
ctgtgtgagcaagagtccgagtgcc

SEQ ID NO: 391631 - DNA, 25 bp, Mus musculus
ctgtgtgagctcaccgactgggagc

SEQ ID NO: 391632 - DNA, 25 bp, Mus musculus
ctgtgtgagctctccgactgggagc

SEQ ID NO: 391633 - DNA, 25 bp, Mus musculus
ctgtgtgagtaacccctagaggtaa

SEQ ID NO: 391634 - DNA, 25 bp, Mus musculus
ctgtgtgagtaagccctagaggtaa

SEQ ID NO: 391635 - DNA, 25 bp, Mus musculus
ctgtgtgagtcgacaccaatgtgtc

SEQ ID NO: 391636 - DNA, 25 bp, Mus musculus
ctgtgtgagtcgtcaccaatgtgtc

SEQ ID NO: 391637 - DNA, 25 bp, Mus musculus
ctgtgtgagtctctactgaggttct

SEQ ID NO: 391638 - DNA, 25 bp, Mus musculus
ctgtgtgagtctgtactgaggttct

SEQ ID NO: 391639 - DNA, 25 bp, Mus musculus
ctgtgtgatgtcaactgcactgtgt

SEQ ID NO: 391640 - DNA, 25 bp, Mus musculus
ctgtgtgatgtctactgcactgtgt

SEQ ID NO: 391641 - DNA, 25 bp, Mus musculus
ctgtgtgcaagacggacagttttct

SEQ ID NO: 391642 - DNA, 25 bp, Mus musculus
ctgtgtgcaagagggacagttttct

SEQ ID NO: 391643 - DNA, 25 bp, Mus musculus
ctgtgtgcaattccctggtgtgaag

SEQ ID NO: 391644 - DNA, 25 bp, Mus musculus
ctgtgtgcaattgcctggtgtgaag

SEQ ID NO: 391645 - DNA, 25 bp, Mus musculus
ctgtgtgcactgctctttggatatt

SEQ ID NO: 391646 - DNA, 25 bp, Mus musculus
ctgtgtgcactggtctttggatatt

SEQ ID NO: 391647 - DNA, 25 bp, Mus musculus
ctgtgtgcacttcctgtagcgtaaa

SEQ ID NO: 391648 - DNA, 25 bp, Mus musculus
ctgtgtgcacttgctgtagcgtaaa

SEQ ID NO: 391649 - DNA, 25 bp, Mus musculus
ctgtgtgcagcaaaggaaggttctc

SEQ ID NO: 391650 - DNA, 25 bp, Mus musculus
ctgtgtgcagcataggaaggttctc

SEQ ID NO: 391651 - DNA, 25 bp, Mus musculus
ctgtgtgcatctctaaaggcaaacc

SEQ ID NO: 391652 - DNA, 25 bp, Mus musculus
ctgtgtgcatctgtaaaggcaaacc

SEQ ID NO: 391653 - DNA, 25 bp, Mus musculus
ctgtgtgcatttatctatgctttat

SEQ ID NO: 391654 - DNA, 25 bp, Mus musculus
ctgtgtgcatttttctatgctttat

SEQ ID NO: 391655 - DNA, 25 bp, Mus musculus
ctgtgtgccacgcaaagtaatgtag

SEQ ID NO: 391656 - DNA, 25 bp, Mus musculus
ctgtgtgccacggaaagtaatgtag

SEQ ID NO: 391657 - DNA, 25 bp, Mus musculus
ctgtgtgccagcagcggacccgtag

SEQ ID NO: 391658 - DNA, 25 bp, Mus musculus
ctgtgtgccagctgcggacccgtag

SEQ ID NO: 391659 - DNA, 25 bp, Mus musculus
ctgtgtgccattccgggtgtcttaa

SEQ ID NO: 391660 - DNA, 25 bp, Mus musculus
ctgtgtgccattgcgggtgtcttaa

SEQ ID NO: 391661 - DNA, 25 bp, Mus musculus
ctgtgtgccgctcatgcgctgtgca

SEQ ID NO: 391662 - DNA, 25 bp, Mus musculus
ctgtgtgccgctgatgcgctgtgca

SEQ ID NO: 391663 - DNA, 25 bp, Mus musculus
ctgtgtgccggcagaccaatatggg

SEQ ID NO: 391664 - DNA, 25 bp, Mus musculus
ctgtgtgccggctgaccaatatggg

SEQ ID NO: 391665 - DNA, 25 bp, Mus musculus
ctgtgtgccggtatctgtgtgtatc

SEQ ID NO: 391666 - DNA, 25 bp, Mus musculus
ctgtgtgccggtttctgtgtgtatc

SEQ ID NO: 391667 - DNA, 25 bp, Mus musculus
ctgtgtgcctgcagttgtgtcagta

SEQ ID NO: 391668 - DNA, 25 bp, Mus musculus
ctgtgtgcctgctgttgtgtcagta

SEQ ID NO: 391669 - DNA, 25 bp, Mus musculus
ctgtgtgcctgtaatacttgtgaga

SEQ ID NO: 391670 - DNA, 25 bp, Mus musculus
ctgtgtgcctgttatacttgtgaga

SEQ ID NO: 391671 - DNA, 25 bp, Mus musculus
ctgtgtgccttcatcagtgttattt

SEQ ID NO: 391672 - DNA, 25 bp, Mus musculus
ctgtgtgccttcttcagtgttattt

SEQ ID NO: 391673 - DNA, 25 bp, Mus musculus
ctgtgtgcgcatctgagagtgtcta

SEQ ID NO: 391674 - DNA, 25 bp, Mus musculus
ctgtgtgcgcatgtgagagtgtcta

SEQ ID NO: 391675 - DNA, 25 bp, Mus musculus
ctgtgtgcgtctctcagctgcaaga

SEQ ID NO: 391676 - DNA, 25 bp, Mus musculus
ctgtgtgcgtctgtcagctgcaaga

SEQ ID NO: 391677 - DNA, 25 bp, Mus musculus
ctgtgtgctcagacgtggagaccgt

SEQ ID NO: 391678 - DNA, 25 bp, Mus musculus
ctgtgtgctcagtcgtggagaccgt

SEQ ID NO: 391679 - DNA, 25 bp, Mus musculus
ctgtgtgctgagagtgtcaacaaag

SEQ ID NO: 391680 - DNA, 25 bp, Mus musculus
ctgtgtgctgagctcctgtagagcc

SEQ ID NO: 391681 - DNA, 25 bp, Mus musculus
ctgtgtgctgaggtcctgtagagcc

SEQ ID NO: 391682 - DNA, 25 bp, Mus musculus
ctgtgtgctgagtgtgtcaacaaag

SEQ ID NO: 391683 - DNA, 25 bp, Mus musculus
ctgtgtgctgatccactgctgtcag

SEQ ID NO: 391684 - DNA, 25 bp, Mus musculus
ctgtgtgctgatgcactgctgtcag

SEQ ID NO: 391685 - DNA, 25 bp, Mus musculus
ctgtgtgctgcacttttgaattccc

SEQ ID NO: 391686 - DNA, 25 bp, Mus musculus
ctgtgtgctgcagttttgaattccc

SEQ ID NO: 391687 - DNA, 25 bp, Mus musculus
ctgtgtgctgccctaagcgtgtcag

SEQ ID NO: 391688 - DNA, 25 bp, Mus musculus
ctgtgtgctgccgtaagcgtgtcag

SEQ ID NO: 391689 - DNA, 25 bp, Mus musculus
ctgtgtgctgttcaacctgggacat

SEQ ID NO: 391690 - DNA, 25 bp, Mus musculus
ctgtgtgctgttgaacctgggacat

SEQ ID NO: 391691 - DNA, 25 bp, Mus musculus
ctgtgtgcttacagggtaaaatatg

SEQ ID NO: 391692 - DNA, 25 bp, Mus musculus
ctgtgtgcttactgggtaaaatatg

SEQ ID NO: 391693 - DNA, 25 bp, Mus musculus
ctgtgtgcttggatcgcctgaagaa

SEQ ID NO: 391694 - DNA, 25 bp, Mus musculus
ctgtgtgcttggttcgcctgaagaa

SEQ ID NO: 391695 - DNA, 25 bp, Mus musculus
ctgtgtggaaataacgcgacttgtc

SEQ ID NO: 391696 - DNA, 25 bp, Mus musculus
ctgtgtggaaattacgcgacttgtc

SEQ ID NO: 391697 - DNA, 25 bp, Mus musculus
ctgtgtggacagagaagctccatgt

SEQ ID NO: 391698 - DNA, 25 bp, Mus musculus
ctgtgtggacagtgaagctccatgt

SEQ ID NO: 391699 - DNA, 25 bp, Mus musculus
ctgtgtggacccctagacttgctag

SEQ ID NO: 391700 - DNA, 25 bp, Mus musculus
ctgtgtggacccgtagacttgctag

SEQ ID NO: 391701 - DNA, 25 bp, Mus musculus
ctgtgtggacctaattgattgcttg

SEQ ID NO: 391702 - DNA, 25 bp, Mus musculus
ctgtgtggaccttattgattgcttg

SEQ ID NO: 391703 - DNA, 25 bp, Mus musculus
ctgtgtggactcagtaggttggact

SEQ ID NO: 391704 - DNA, 25 bp, Mus musculus
ctgtgtggactctgtaggttggact

SEQ ID NO: 391705 - DNA, 25 bp, Mus musculus
ctgtgtggaggacgctgggcccatt

SEQ ID NO: 391706 - DNA, 25 bp, Mus musculus
ctgtgtggaggaggctgggcccatt

SEQ ID NO: 391707 - DNA, 25 bp, Mus musculus
ctgtgtggatggaaccagcagactt

SEQ ID NO: 391708 - DNA, 25 bp, Mus musculus
ctgtgtggatggtaccagcagactt

SEQ ID NO: 391709 - DNA, 25 bp, Mus musculus
ctgtgtggccaaagcatttactaag

SEQ ID NO: 391710 - DNA, 25 bp, Mus musculus
ctgtgtggccaatgcatttactaag

SEQ ID NO: 391711 - DNA, 25 bp, Mus musculus
ctgtgtggcgagaaggtgtgaacct

SEQ ID NO: 391712 - DNA, 25 bp, Mus musculus
ctgtgtggcgagtaggtgtgaacct

SEQ ID NO: 391713 - DNA, 25 bp, Mus musculus
ctgtgtggctagcagactctggtct

SEQ ID NO: 391714 - DNA, 25 bp, Mus musculus
ctgtgtggctaggagactctggtct

SEQ ID NO: 391715 - DNA, 25 bp, Mus musculus
ctgtgtggctctcggcacccaagca

SEQ ID NO: 391716 - DNA, 25 bp, Mus musculus
ctgtgtggctctgggcacccaagca

SEQ ID NO: 391717 - DNA, 25 bp, Mus musculus
ctgtgtgggtgtcagctaaaagcac

SEQ ID NO: 391718 - DNA, 25 bp, Mus musculus
ctgtgtgggtgtgagctaaaagcac

SEQ ID NO: 391719 - DNA, 25 bp, Mus musculus
ctgtgtggtatgctagatctaaacg

SEQ ID NO: 391720 - DNA, 25 bp, Mus musculus
ctgtgtggtatggtagatctaaacg

SEQ ID NO: 391721 - DNA, 25 bp, Mus musculus
ctgtgtgtaagccacgttggaagac

SEQ ID NO: 391722 - DNA, 25 bp, Mus musculus
ctgtgtgtaagcgacgttggaagac

SEQ ID NO: 391723 - DNA, 25 bp, Mus musculus
ctgtgtgtaatgctgctctttgttt

SEQ ID NO: 391724 - DNA, 25 bp, Mus musculus
ctgtgtgtaatgctggaggtccttc

SEQ ID NO: 391725 - DNA, 25 bp, Mus musculus
ctgtgtgtaatggtgctctttgttt

SEQ ID NO: 391726 - DNA, 25 bp, Mus musculus
ctgtgtgtaatggtggaggtccttc

SEQ ID NO: 391727 - DNA, 25 bp, Mus musculus
ctgtgtgtaccccagtacaacagag

SEQ ID NO: 391728 - DNA, 25 bp, Mus musculus
ctgtgtgtacccgagtacaacagag

SEQ ID NO: 391729 - DNA, 25 bp, Mus musculus
ctgtgtgtagcaatgtactctctct

SEQ ID NO: 391730 - DNA, 25 bp, Mus musculus
ctgtgtgtagcattgtactctctct

SEQ ID NO: 391731 - DNA, 25 bp, Mus musculus
ctgtgtgtcacacaatcgcccaaca

SEQ ID NO: 391732 - DNA, 25 bp, Mus musculus
ctgtgtgtcacagaatcgcccaaca

SEQ ID NO: 391733 - DNA, 25 bp, Mus musculus
ctgtgtgtcctgagaacaagtgatt

SEQ ID NO: 391734 - DNA, 25 bp, Mus musculus
ctgtgtgtcctgtgaacaagtgatt

SEQ ID NO: 391735 - DNA, 25 bp, Mus musculus
ctgtgtgtccttaaatcctccatct

SEQ ID NO: 391736 - DNA, 25 bp, Mus musculus
ctgtgtgtcctttaatcctccatct

SEQ ID NO: 391737 - DNA, 25 bp, Mus musculus
ctgtgtgtctccataccaaacttcc

SEQ ID NO: 391738 - DNA, 25 bp, Mus musculus
ctgtgtgtctccttaccaaacttcc

SEQ ID NO: 391739 - DNA, 25 bp, Mus musculus
ctgtgtgtctctcctttgaggttgt

SEQ ID NO: 391740 - DNA, 25 bp, Mus musculus
ctgtgtgtctctgctttgaggttgt

SEQ ID NO: 391741 - DNA, 25 bp, Mus musculus
ctgtgtgtctgcattacctgggaaa

SEQ ID NO: 391742 - DNA, 25 bp, Mus musculus
ctgtgtgtctgctttacctgggaaa

SEQ ID NO: 391743 - DNA, 25 bp, Mus musculus
ctgtgtgtgactagagaggctccag

SEQ ID NO: 391744 - DNA, 25 bp, Mus musculus
ctgtgtgtgacttgagaggctccag

SEQ ID NO: 391745 - DNA, 25 bp, Mus musculus
ctgtgtgtgagaactgagctccaag

SEQ ID NO: 391746 - DNA, 25 bp, Mus musculus
ctgtgtgtgagatctgagctccaag

SEQ ID NO: 391747 - DNA, 25 bp, Mus musculus
ctgtgtgtgatgagggcttctctct

SEQ ID NO: 391748 - DNA, 25 bp, Mus musculus
ctgtgtgtgatgtgggcttctctct

SEQ ID NO: 391749 - DNA, 25 bp, Mus musculus
ctgtgtgtgcacaaatgaggatcct

SEQ ID NO: 391750 - DNA, 25 bp, Mus musculus
ctgtgtgtgcacatggcagtaatga

SEQ ID NO: 391751 - DNA, 25 bp, Mus musculus
ctgtgtgtgcactaatgaggatcct

SEQ ID NO: 391752 - DNA, 25 bp, Mus musculus
ctgtgtgtgcacttggcagtaatga

SEQ ID NO: 391753 - DNA, 25 bp, Mus musculus
ctgtgtgtgcgccaattaaaaacca

SEQ ID NO: 391754 - DNA, 25 bp, Mus musculus
ctgtgtgtgcgcgaattaaaaacca

SEQ ID NO: 391755 - DNA, 25 bp, Mus musculus
ctgtgtgtgctcattgtctttgcaa

SEQ ID NO: 391756 - DNA, 25 bp, Mus musculus
ctgtgtgtgctctttgtctttgcaa

SEQ ID NO: 391757 - DNA, 25 bp, Mus musculus
ctgtgtgtggttcgtggcacacatc

SEQ ID NO: 391758 - DNA, 25 bp, Mus musculus
ctgtgtgtggttggtggcacacatc

SEQ ID NO: 391759 - DNA, 25 bp, Mus musculus
ctgtgtgtgtaaattctcatgctaa

SEQ ID NO: 391760 - DNA, 25 bp, Mus musculus
ctgtgtgtgtaatttctcatgctaa

SEQ ID NO: 391761 - DNA, 25 bp, Mus musculus
ctgtgtgtgtgactaagcctcttcc

SEQ ID NO: 391762 - DNA, 25 bp, Mus musculus
ctgtgtgtgtgagtaagcctcttcc

SEQ ID NO: 391763 - DNA, 25 bp, Mus musculus
ctgtgtgtgttgataagtgtttagt

SEQ ID NO: 391764 - DNA, 25 bp, Mus musculus
ctgtgtgtgttgttaagtgtttagt

SEQ ID NO: 391765 - DNA, 25 bp, Mus musculus
ctgtgtgttaaactgcactctttgg

SEQ ID NO: 391766 - DNA, 25 bp, Mus musculus
ctgtgtgttaaagtgcactctttgg

SEQ ID NO: 391767 - DNA, 25 bp, Mus musculus
ctgtgtgttacacgagctctggaag

SEQ ID NO: 391768 - DNA, 25 bp, Mus musculus
ctgtgtgttacaggagctctggaag

SEQ ID NO: 391769 - DNA, 25 bp, Mus musculus
ctgtgtgttcagagatgtatgttct

SEQ ID NO: 391770 - DNA, 25 bp, Mus musculus
ctgtgtgttcagtgatgtatgttct

SEQ ID NO: 391771 - DNA, 25 bp, Mus musculus
ctgtgtgttgttcaattgtgctgcc

SEQ ID NO: 391772 - DNA, 25 bp, Mus musculus
ctgtgtgttgttgaattgtgctgcc

SEQ ID NO: 391773 - DNA, 25 bp, Mus musculus
ctgtgtgtttatcactagacctttg

SEQ ID NO: 391774 - DNA, 25 bp, Mus musculus
ctgtgtgtttatgactagacctttg

SEQ ID NO: 391775 - DNA, 25 bp, Mus musculus
ctgtgtgtttgcagagttactgtcc

SEQ ID NO: 391776 - DNA, 25 bp, Mus musculus
ctgtgtgtttgctgagttactgtcc

SEQ ID NO: 391777 - DNA, 25 bp, Mus musculus
ctgtgttaaaggagctcagcgttag

SEQ ID NO: 391778 - DNA, 25 bp, Mus musculus
ctgtgttaaaggtgctcagcgttag

SEQ ID NO: 391779 - DNA, 25 bp, Mus musculus
ctgtgttaacacatgtcacactgca

SEQ ID NO: 391780 - DNA, 25 bp, Mus musculus
ctgtgttaacacttgtcacactgca

SEQ ID NO: 391781 - DNA, 25 bp, Mus musculus
ctgtgttaacttaaaggtgtcagga

SEQ ID NO: 391782 - DNA, 25 bp, Mus musculus
ctgtgttaactttaaggtgtcagga

SEQ ID NO: 391783 - DNA, 25 bp, Mus musculus
ctgtgttacatcacccaccttaggg

SEQ ID NO: 391784 - DNA, 25 bp, Mus musculus
ctgtgttacatctcccaccttaggg

SEQ ID NO: 391785 - DNA, 25 bp, Mus musculus
ctgtgttagaaaaccttaagcgctt

SEQ ID NO: 391786 - DNA, 25 bp, Mus musculus
ctgtgttagaaatccttaagcgctt

SEQ ID NO: 391787 - DNA, 25 bp, Mus musculus
ctgtgttagtgtctgccctgccctt

SEQ ID NO: 391788 - DNA, 25 bp, Mus musculus
ctgtgttagtgtgtgccctgccctt

SEQ ID NO: 391789 - DNA, 25 bp, Mus musculus
ctgtgttatctaacatgtttgcttt

SEQ ID NO: 391790 - DNA, 25 bp, Mus musculus
ctgtgttatctatcatgtttgcttt

SEQ ID NO: 391791 - DNA, 25 bp, Mus musculus
ctgtgttatctgacatttcctaccc

SEQ ID NO: 391792 - DNA, 25 bp, Mus musculus
ctgtgttatctgtcatttcctaccc

SEQ ID NO: 391793 - DNA, 25 bp, Mus musculus
ctgtgttatcttatcagaatgtaaa

SEQ ID NO: 391794 - DNA, 25 bp, Mus musculus
ctgtgttatcttttcagaatgtaaa

SEQ ID NO: 391795 - DNA, 25 bp, Mus musculus
ctgtgttatgaactgctgcggtgtt

SEQ ID NO: 391796 - DNA, 25 bp, Mus musculus
ctgtgttatgaagtgctgcggtgtt

SEQ ID NO: 391797 - DNA, 25 bp, Mus musculus
ctgtgttcaacaaattaggcaattc

SEQ ID NO: 391798 - DNA, 25 bp, Mus musculus
ctgtgttcaacatattaggcaattc

SEQ ID NO: 391799 - DNA, 25 bp, Mus musculus
ctgtgttcaagtaggttcaggatgg

SEQ ID NO: 391800 - DNA, 25 bp, Mus musculus
ctgtgttcaagttggttcaggatgg

SEQ ID NO: 391801 - DNA, 25 bp, Mus musculus
ctgtgttcacaaatgcatgtttttg

SEQ ID NO: 391802 - DNA, 25 bp, Mus musculus
ctgtgttcacaattgcatgtttttg

SEQ ID NO: 391803 - DNA, 25 bp, Mus musculus
ctgtgttcactgcttgtcttttaga

SEQ ID NO: 391804 - DNA, 25 bp, Mus musculus
ctgtgttcactggttgtcttttaga

SEQ ID NO: 391805 - DNA, 25 bp, Mus musculus
ctgtgttcagtaccatggttaatgc

SEQ ID NO: 391806 - DNA, 25 bp, Mus musculus
ctgtgttcagtaccctgagttgaaa

SEQ ID NO: 391807 - DNA, 25 bp, Mus musculus
ctgtgttcagtagcatggttaatgc

SEQ ID NO: 391808 - DNA, 25 bp, Mus musculus
ctgtgttcagtagcctgagttgaaa

SEQ ID NO: 391809 - DNA, 25 bp, Mus musculus
ctgtgttcatccctctaatttattt

SEQ ID NO: 391810 - DNA, 25 bp, Mus musculus
ctgtgttcatccgtctaatttattt

SEQ ID NO: 391811 - DNA, 25 bp, Mus musculus
ctgtgttccgtgatctgtctggtgc

SEQ ID NO: 391812 - DNA, 25 bp, Mus musculus
ctgtgttccgtgttctgtctggtgc

SEQ ID NO: 391813 - DNA, 25 bp, Mus musculus
ctgtgttcctctcctgaaggttaca

SEQ ID NO: 391814 - DNA, 25 bp, Mus musculus
ctgtgttcctctgctgaaggttaca

SEQ ID NO: 391815 - DNA, 25 bp, Mus musculus
ctgtgttcctgaagattctcagtaa

SEQ ID NO: 391816 - DNA, 25 bp, Mus musculus
ctgtgttcctgatgattctcagtaa

SEQ ID NO: 391817 - DNA, 25 bp, Mus musculus
ctgtgttcctgtcggctcaatgtga

SEQ ID NO: 391818 - DNA, 25 bp, Mus musculus
ctgtgttcctgtgggctcaatgtga

SEQ ID NO: 391819 - DNA, 25 bp, Mus musculus
ctgtgttcgggaccctaaaggaaga

SEQ ID NO: 391820 - DNA, 25 bp, Mus musculus
ctgtgttcgggagcctaaaggaaga

SEQ ID NO: 391821 - DNA, 25 bp, Mus musculus
ctgtgttctagccatgcagttacat

SEQ ID NO: 391822 - DNA, 25 bp, Mus musculus
ctgtgttctagcgatgcagttacat

SEQ ID NO: 391823 - DNA, 25 bp, Mus musculus
ctgtgttctctactgattcattgga

SEQ ID NO: 391824 - DNA, 25 bp, Mus musculus
ctgtgttctctagtgattcattgga

SEQ ID NO: 391825 - DNA, 25 bp, Mus musculus
ctgtgttctctgatacgtaagaagg

SEQ ID NO: 391826 - DNA, 25 bp, Mus musculus
ctgtgttctctgttacgtaagaagg

SEQ ID NO: 391827 - DNA, 25 bp, Mus musculus
ctgtgttctgctcgcctgcgtcagt

SEQ ID NO: 391828 - DNA, 25 bp, Mus musculus
ctgtgttctgctggcctgcgtcagt

SEQ ID NO: 391829 - DNA, 25 bp, Mus musculus
ctgtgttcttagcagagtgaggctc

SEQ ID NO: 391830 - DNA, 25 bp, Mus musculus
ctgtgttcttaggagagtgaggctc

SEQ ID NO: 391831 - DNA, 25 bp, Mus musculus
ctgtgttcttatattcagttctaca

SEQ ID NO: 391832 - DNA, 25 bp, Mus musculus
ctgtgttcttattttcagttctaca

SEQ ID NO: 391833 - DNA, 25 bp, Mus musculus
ctgtgttcttgtactctacatttac

SEQ ID NO: 391834 - DNA, 25 bp, Mus musculus
ctgtgttcttgttctctacatttac

SEQ ID NO: 391835 - DNA, 25 bp, Mus musculus
ctgtgttctttaacatcgacgggta

SEQ ID NO: 391836 - DNA, 25 bp, Mus musculus
ctgtgttctttatcatcgacgggta

SEQ ID NO: 391837 - DNA, 25 bp, Mus musculus
ctgtgttgaattactgcttcagttt

SEQ ID NO: 391838 - DNA, 25 bp, Mus musculus
ctgtgttgaatttctgcttcagttt

SEQ ID NO: 391839 - DNA, 25 bp, Mus musculus
ctgtgttgacagctggaagatctta

SEQ ID NO: 391840 - DNA, 25 bp, Mus musculus
ctgtgttgacaggtggaagatctta

SEQ ID NO: 391841 - DNA, 25 bp, Mus musculus
ctgtgttgactcatcttcattactg

SEQ ID NO: 391842 - DNA, 25 bp, Mus musculus
ctgtgttgactcttcttcattactg

SEQ ID NO: 391843 - DNA, 25 bp, Mus musculus
ctgtgttgacttcattattcccatg

SEQ ID NO: 391844 - DNA, 25 bp, Mus musculus
ctgtgttgacttgattattcccatg

SEQ ID NO: 391845 - DNA, 25 bp, Mus musculus
ctgtgttgcagcattgctctgacta

SEQ ID NO: 391846 - DNA, 25 bp, Mus musculus
ctgtgttgcagctttgctctgacta

SEQ ID NO: 391847 - DNA, 25 bp, Mus musculus
ctgtgttgcattaagatctccatat

SEQ ID NO: 391848 - DNA, 25 bp, Mus musculus
ctgtgttgcatttagatctccatat

SEQ ID NO: 391849 - DNA, 25 bp, Mus musculus
ctgtgttgcgagctctgcgtaagaa

SEQ ID NO: 391850 - DNA, 25 bp, Mus musculus
ctgtgttgcgaggtctgcgtaagaa

SEQ ID NO: 391851 - DNA, 25 bp, Mus musculus
ctgtgttgctaacgacagtaatggg

SEQ ID NO: 391852 - DNA, 25 bp, Mus musculus
ctgtgttgctaaggacagtaatggg

SEQ ID NO: 391853 - DNA, 25 bp, Mus musculus
ctgtgttggcttcggattgttgaat

SEQ ID NO: 391854 - DNA, 25 bp, Mus musculus
ctgtgttggcttgggattgttgaat

SEQ ID NO: 391855 - DNA, 25 bp, Mus musculus
ctgtgttgggacatggacatctgtg

SEQ ID NO: 391856 - DNA, 25 bp, Mus musculus
ctgtgttgggacttggacatctgtg

SEQ ID NO: 391857 - DNA, 25 bp, Mus musculus
ctgtgttgggcgaggtatacttttt

SEQ ID NO: 391858 - DNA, 25 bp, Mus musculus
ctgtgttgggcgtggtatacttttt

SEQ ID NO: 391859 - DNA, 25 bp, Mus musculus
ctgtgttggtggcaagagttctaca

SEQ ID NO: 391860 - DNA, 25 bp, Mus musculus
ctgtgttggtgggaagagttctaca

SEQ ID NO: 391861 - DNA, 25 bp, Mus musculus
ctgtgttgtgagctttgaatgtgaa

SEQ ID NO: 391862 - DNA, 25 bp, Mus musculus
ctgtgttgtgaggtttgaatgtgaa

SEQ ID NO: 391863 - DNA, 25 bp, Mus musculus
ctgtgttgtgtcaaaatgatttctg

SEQ ID NO: 391864 - DNA, 25 bp, Mus musculus
ctgtgttgtgtcaatcctatgatta

SEQ ID NO: 391865 - DNA, 25 bp, Mus musculus
ctgtgttgtgtctaaatgatttctg

SEQ ID NO: 391866 - DNA, 25 bp, Mus musculus
ctgtgttgtgtctatcctatgatta

SEQ ID NO: 391867 - DNA, 25 bp, Mus musculus
ctgtgttgtgttacagaggcctcgg

SEQ ID NO: 391868 - DNA, 25 bp, Mus musculus
ctgtgttgtgtttcagaggcctcgg

SEQ ID NO: 391869 - DNA, 25 bp, Mus musculus
ctgtgttgttggattctccacctgc

SEQ ID NO: 391870 - DNA, 25 bp, Mus musculus
ctgtgttgttggtttctccacctgc

SEQ ID NO: 391871 - DNA, 25 bp, Mus musculus
ctgtgttgttgtccctgactggtca

SEQ ID NO: 391872 - DNA, 25 bp, Mus musculus
ctgtgttgttgtgcctgactggtca

SEQ ID NO: 391873 - DNA, 25 bp, Mus musculus
ctgtgttgttttcgaggcctgatac

SEQ ID NO: 391874 - DNA, 25 bp, Mus musculus
ctgtgttgttttggaggcctgatac

SEQ ID NO: 391875 - DNA, 25 bp, Mus musculus
ctgtgtttaagtatcgtgttgcaag

SEQ ID NO: 391876 - DNA, 25 bp, Mus musculus
ctgtgtttaagtttcgtgttgcaag

SEQ ID NO: 391877 - DNA, 25 bp, Mus musculus
ctgtgtttactaagatagcccagtg

SEQ ID NO: 391878 - DNA, 25 bp, Mus musculus
ctgtgtttactatgatagcccagtg

SEQ ID NO: 391879 - DNA, 25 bp, Mus musculus
ctgtgtttagcaccacttttagtgc

SEQ ID NO: 391880 - DNA, 25 bp, Mus musculus
ctgtgtttagcagcacttttagtgc

SEQ ID NO: 391881 - DNA, 25 bp, Mus musculus
ctgtgtttatgacttggtaaaataa

SEQ ID NO: 391882 - DNA, 25 bp, Mus musculus
ctgtgtttatgagttggtaaaataa

SEQ ID NO: 391883 - DNA, 25 bp, Mus musculus
ctgtgtttatggcttcctcagagca

SEQ ID NO: 391884 - DNA, 25 bp, Mus musculus
ctgtgtttatgggttcctcagagca

SEQ ID NO: 391885 - DNA, 25 bp, Mus musculus
ctgtgtttcaggacttttttgctgt

SEQ ID NO: 391886 - DNA, 25 bp, Mus musculus
ctgtgtttcaggtcttttttgctgt

SEQ ID NO: 391887 - DNA, 25 bp, Mus musculus
ctgtgtttcagtatcatctctttta

SEQ ID NO: 391888 - DNA, 25 bp, Mus musculus
ctgtgtttcagtttcatctctttta

SEQ ID NO: 391889 - DNA, 25 bp, Mus musculus
ctgtgtttccagatggtcctagagg

SEQ ID NO: 391890 - DNA, 25 bp, Mus musculus
ctgtgtttccagttggtcctagagg

SEQ ID NO: 391891 - DNA, 25 bp, Mus musculus
ctgtgtttcccaaagactcaaggta

SEQ ID NO: 391892 - DNA, 25 bp, Mus musculus
ctgtgtttcccatagactcaaggta

SEQ ID NO: 391893 - DNA, 25 bp, Mus musculus
ctgtgtttcctgcattgtgattcag

SEQ ID NO: 391894 - DNA, 25 bp, Mus musculus
ctgtgtttcctggattgtgattcag

SEQ ID NO: 391895 - DNA, 25 bp, Mus musculus
ctgtgtttctacatctgtctcttca

SEQ ID NO: 391896 - DNA, 25 bp, Mus musculus
ctgtgtttctacttctgtctcttca

SEQ ID NO: 391897 - DNA, 25 bp, Mus musculus
ctgtgtttctggacttggctgggaa

SEQ ID NO: 391898 - DNA, 25 bp, Mus musculus
ctgtgtttctggtcttggctgggaa

SEQ ID NO: 391899 - DNA, 25 bp, Mus musculus
ctgtgtttctgtcaccctggtgtga

SEQ ID NO: 391900 - DNA, 25 bp, Mus musculus
ctgtgtttctgtccagagggtttta

SEQ ID NO: 391901 - DNA, 25 bp, Mus musculus
ctgtgtttctgtgaccctggtgtga

SEQ ID NO: 391902 - DNA, 25 bp, Mus musculus
ctgtgtttctgtgcagagggtttta

SEQ ID NO: 391903 - DNA, 25 bp, Mus musculus
ctgtgtttgaagataagtttaggcc

SEQ ID NO: 391904 - DNA, 25 bp, Mus musculus
ctgtgtttgaagttaagtttaggcc

SEQ ID NO: 391905 - DNA, 25 bp, Mus musculus
ctgtgtttgactctttgggtgacag

SEQ ID NO: 391906 - DNA, 25 bp, Mus musculus
ctgtgtttgactgtttgggtgacag

SEQ ID NO: 391907 - DNA, 25 bp, Mus musculus
ctgtgtttggtaccagcatttgttt

SEQ ID NO: 391908 - DNA, 25 bp, Mus musculus
ctgtgtttggtagcagcatttgttt

SEQ ID NO: 391909 - DNA, 25 bp, Mus musculus
ctgtgtttgtaaattgatggccaac

SEQ ID NO: 391910 - DNA, 25 bp, Mus musculus
ctgtgtttgtaatttgatggccaac

SEQ ID NO: 391911 - DNA, 25 bp, Mus musculus
ctgtgtttgtatcgaacccaactcc

SEQ ID NO: 391912 - DNA, 25 bp, Mus musculus
ctgtgtttgtatggaacccaactcc

SEQ ID NO: 391913 - DNA, 25 bp, Mus musculus
ctgtgtttgtggatgggctaatata

SEQ ID NO: 391914 - DNA, 25 bp, Mus musculus
ctgtgtttgtggcagatggttcttt

SEQ ID NO: 391915 - DNA, 25 bp, Mus musculus
ctgtgtttgtgggagatggttcttt

SEQ ID NO: 391916 - DNA, 25 bp, Mus musculus
ctgtgtttgtggttgggctaatata

SEQ ID NO: 391917 - DNA, 25 bp, Mus musculus
ctgtgtttgttcaagcaataaatgc

SEQ ID NO: 391918 - DNA, 25 bp, Mus musculus
ctgtgtttgttctagcaataaatgc

SEQ ID NO: 391919 - DNA, 25 bp, Mus musculus
ctgtgttttacaaaactgcttggca

SEQ ID NO: 391920 - DNA, 25 bp, Mus musculus
ctgtgttttacaactgagggccttt

SEQ ID NO: 391921 - DNA, 25 bp, Mus musculus
ctgtgttttacataactgcttggca

SEQ ID NO: 391922 - DNA, 25 bp, Mus musculus
ctgtgttttacatctgagggccttt

SEQ ID NO: 391923 - DNA, 25 bp, Mus musculus
ctgtgttttacccaacagcactcat

SEQ ID NO: 391924 - DNA, 25 bp, Mus musculus
ctgtgttttaccgaacagcactcat

SEQ ID NO: 391925 - DNA, 25 bp, Mus musculus
ctgtgttttagtctgacttggtgtt

SEQ ID NO: 391926 - DNA, 25 bp, Mus musculus
ctgtgttttagtgtgacttggtgtt

SEQ ID NO: 391927 - DNA, 25 bp, Mus musculus
ctgtgttttcagatgcagaatttta

SEQ ID NO: 391928 - DNA, 25 bp, Mus musculus
ctgtgttttcagttgcagaatttta

SEQ ID NO: 391929 - DNA, 25 bp, Mus musculus
ctgtgttttcccacatcttgttaga

SEQ ID NO: 391930 - DNA, 25 bp, Mus musculus
ctgtgttttccccagtgccaaaaga

SEQ ID NO: 391931 - DNA, 25 bp, Mus musculus
ctgtgttttcccgagtgccaaaaga

SEQ ID NO: 391932 - DNA, 25 bp, Mus musculus
ctgtgttttccctcatcttgttaga

SEQ ID NO: 391933 - DNA, 25 bp, Mus musculus
ctgtgttttcttaagcgctttatag

SEQ ID NO: 391934 - DNA, 25 bp, Mus musculus
ctgtgttttctttagcgctttatag

SEQ ID NO: 391935 - DNA, 25 bp, Mus musculus
ctgtgttttgtgagaactttggtta

SEQ ID NO: 391936 - DNA, 25 bp, Mus musculus
ctgtgttttgtgtgaactttggtta

SEQ ID NO: 391937 - DNA, 25 bp, Mus musculus
ctgtgtttttcccattgctgtgacc

SEQ ID NO: 391938 - DNA, 25 bp, Mus musculus
ctgtgtttttccgattgctgtgacc

SEQ ID NO: 391939 - DNA, 25 bp, Mus musculus
ctgttaaacatgaaagatccttgcc

SEQ ID NO: 391940 - DNA, 25 bp, Mus musculus
ctgttaaacatgtaagatccttgcc

SEQ ID NO: 391941 - DNA, 25 bp, Mus musculus
ctgttaaagagcattttcatggaca

SEQ ID NO: 391942 - DNA, 25 bp, Mus musculus
ctgttaaagagctttttcatggaca

SEQ ID NO: 391943 - DNA, 25 bp, Mus musculus
ctgttaacaactcagtgtgtgctct

SEQ ID NO: 391944 - DNA, 25 bp, Mus musculus
ctgttaacaactgagtgtgtgctct

SEQ ID NO: 391945 - DNA, 25 bp, Mus musculus
ctgttaaccaacaatgagtattatt

SEQ ID NO: 391946 - DNA, 25 bp, Mus musculus
ctgttaaccaactatgagtattatt

SEQ ID NO: 391947 - DNA, 25 bp, Mus musculus
ctgttaacgaaaccagcaccttagc

SEQ ID NO: 391948 - DNA, 25 bp, Mus musculus
ctgttaacgaaagcagcaccttagc

SEQ ID NO: 391949 - DNA, 25 bp, Mus musculus
ctgttaagaatcattcctagtgctc

SEQ ID NO: 391950 - DNA, 25 bp, Mus musculus
ctgttaagaatctttcctagtgctc

SEQ ID NO: 391951 - DNA, 25 bp, Mus musculus
ctgttaagagtcagctgatttctga

SEQ ID NO: 391952 - DNA, 25 bp, Mus musculus
ctgttaagagtctgctgatttctga

SEQ ID NO: 391953 - DNA, 25 bp, Mus musculus
ctgttaagcactagtcactatagtg

SEQ ID NO: 391954 - DNA, 25 bp, Mus musculus
ctgttaagcacttgtcactatagtg

SEQ ID NO: 391955 - DNA, 25 bp, Mus musculus
ctgttaaggaataggactttagctt

SEQ ID NO: 391956 - DNA, 25 bp, Mus musculus
ctgttaaggaattggactttagctt

SEQ ID NO: 391957 - DNA, 25 bp, Mus musculus
ctgttaaggattatgctccttccgc

SEQ ID NO: 391958 - DNA, 25 bp, Mus musculus
ctgttaaggattttgctccttccgc

SEQ ID NO: 391959 - DNA, 25 bp, Mus musculus
ctgttaagggctcaatcctttttct

SEQ ID NO: 391960 - DNA, 25 bp, Mus musculus
ctgttaagggctgaatcctttttct

SEQ ID NO: 391961 - DNA, 25 bp, Mus musculus
ctgttaagtccaaggccaagagtaa

SEQ ID NO: 391962 - DNA, 25 bp, Mus musculus
ctgttaagtccatggccaagagtaa

SEQ ID NO: 391963 - DNA, 25 bp, Mus musculus
ctgttaatacacctcagagccatgt

SEQ ID NO: 391964 - DNA, 25 bp, Mus musculus
ctgttaatacacgtcagagccatgt

SEQ ID NO: 391965 - DNA, 25 bp, Mus musculus
ctgttaatcctgagccatttttcaa

SEQ ID NO: 391966 - DNA, 25 bp, Mus musculus
ctgttaatcctgtgccatttttcaa

SEQ ID NO: 391967 - DNA, 25 bp, Mus musculus
ctgttacaagtacatgacttcgatt

SEQ ID NO: 391968 - DNA, 25 bp, Mus musculus
ctgttacaagtagatgacttcgatt

SEQ ID NO: 391969 - DNA, 25 bp, Mus musculus
ctgttaccatatcccaagtgtctga

SEQ ID NO: 391970 - DNA, 25 bp, Mus musculus
ctgttaccatatgccaagtgtctga

SEQ ID NO: 391971 - DNA, 25 bp, Mus musculus
ctgttacccatacactcatcatgaa

SEQ ID NO: 391972 - DNA, 25 bp, Mus musculus
ctgttacccatagactcatcatgaa

SEQ ID NO: 391973 - DNA, 25 bp, Mus musculus
ctgttacctacacacagtccatgtg

SEQ ID NO: 391974 - DNA, 25 bp, Mus musculus
ctgttacctacagacagtccatgtg

SEQ ID NO: 391975 - DNA, 25 bp, Mus musculus
ctgttaccttttccagtcggtctta

SEQ ID NO: 391976 - DNA, 25 bp, Mus musculus
ctgttaccttttgcagtcggtctta

SEQ ID NO: 391977 - DNA, 25 bp, Mus musculus
ctgttacgcctgatggtgactggga

SEQ ID NO: 391978 - DNA, 25 bp, Mus musculus
ctgttacgcctgttggtgactggga

SEQ ID NO: 391979 - DNA, 25 bp, Mus musculus
ctgttacgctcccatgataatgttc

SEQ ID NO: 391980 - DNA, 25 bp, Mus musculus
ctgttacgctccgatgataatgttc

SEQ ID NO: 391981 - DNA, 25 bp, Mus musculus
ctgttacgttcacctgcagttctaa

SEQ ID NO: 391982 - DNA, 25 bp, Mus musculus
ctgttacgttcagctgcagttctaa

SEQ ID NO: 391983 - DNA, 25 bp, Mus musculus
ctgttactagagctccctttccagt

SEQ ID NO: 391984 - DNA, 25 bp, Mus musculus
ctgttactagaggtccctttccagt

SEQ ID NO: 391985 - DNA, 25 bp, Mus musculus
ctgttactaggacttcttcatgggt

SEQ ID NO: 391986 - DNA, 25 bp, Mus musculus
ctgttactaggagttcttcatgggt

SEQ ID NO: 391987 - DNA, 25 bp, Mus musculus
ctgttactgagaccatatcgtgatg

SEQ ID NO: 391988 - DNA, 25 bp, Mus musculus
ctgttactgagagcatatcgtgatg

SEQ ID NO: 391989 - DNA, 25 bp, Mus musculus
ctgttagactacagctcagcactac

SEQ ID NO: 391990 - DNA, 25 bp, Mus musculus
ctgttagactactgctcagcactac

SEQ ID NO: 391991 - DNA, 25 bp, Mus musculus
ctgttagagagcatttccgggttgt

SEQ ID NO: 391992 - DNA, 25 bp, Mus musculus
ctgttagagagcttttccgggttgt

SEQ ID NO: 391993 - DNA, 25 bp, Mus musculus
ctgttagcagctagggcacccagca

SEQ ID NO: 391994 - DNA, 25 bp, Mus musculus
ctgttagcagcttgggcacccagca

SEQ ID NO: 391995 - DNA, 25 bp, Mus musculus
ctgttagcatctcaattcctgtgga

SEQ ID NO: 391996 - DNA, 25 bp, Mus musculus
ctgttagcatctgaattcctgtgga

SEQ ID NO: 391997 - DNA, 25 bp, Mus musculus
ctgttagccaaacattttgcctgtt

SEQ ID NO: 391998 - DNA, 25 bp, Mus musculus
ctgttagccaaagattttgcctgtt

SEQ ID NO: 391999 - DNA, 25 bp, Mus musculus
ctgttagccactccccaattagaag

SEQ ID NO: 392000 - DNA, 25 bp, Mus musculus
ctgttagccactgcccaattagaag

SEQ ID NO: 392001 - DNA, 25 bp, Mus musculus
ctgttagctggtcccgccgatatca

SEQ ID NO: 392002 - DNA, 25 bp, Mus musculus
ctgttagctggtgccgccgatatca

SEQ ID NO: 392003 - DNA, 25 bp, Mus musculus
ctgttaggatctacttgtctctgcc

SEQ ID NO: 392004 - DNA, 25 bp, Mus musculus
ctgttaggatcttcttgtctctgcc

SEQ ID NO: 392005 - DNA, 25 bp, Mus musculus
ctgttaggcaggctgtttctggatt

SEQ ID NO: 392006 - DNA, 25 bp, Mus musculus
ctgttaggcagggtgtttctggatt

SEQ ID NO: 392007 - DNA, 25 bp, Mus musculus
ctgttaggcttcagcagtttactgc

SEQ ID NO: 392008 - DNA, 25 bp, Mus musculus
ctgttaggcttctgcagtttactgc

SEQ ID NO: 392009 - DNA, 25 bp, Mus musculus
ctgttagggtagcaagaggcacaaa

SEQ ID NO: 392010 - DNA, 25 bp, Mus musculus
ctgttagggtaggaagaggcacaaa

SEQ ID NO: 392011 - DNA, 25 bp, Mus musculus
ctgttaggtgggcaccctgcagatt

SEQ ID NO: 392012 - DNA, 25 bp, Mus musculus
ctgttaggtggggaccctgcagatt

SEQ ID NO: 392013 - DNA, 25 bp, Mus musculus
ctgttaggttctagtgttccgtctt

SEQ ID NO: 392014 - DNA, 25 bp, Mus musculus
ctgttaggttcttgtgttccgtctt

SEQ ID NO: 392015 - DNA, 25 bp, Mus musculus
ctgttagtaacaccatgctccgagc

SEQ ID NO: 392016 - DNA, 25 bp, Mus musculus
ctgttagtaacagcatgctccgagc

SEQ ID NO: 392017 - DNA, 25 bp, Mus musculus
ctgttagtaggtatagtatccaaga

SEQ ID NO: 392018 - DNA, 25 bp, Mus musculus
ctgttagtaggtttagtatccaaga

SEQ ID NO: 392019 - DNA, 25 bp, Mus musculus
ctgttagtgggtactcctgagttca

SEQ ID NO: 392020 - DNA, 25 bp, Mus musculus
ctgttagtgggttctcctgagttca

SEQ ID NO: 392021 - DNA, 25 bp, Mus musculus
ctgttagttagcctggttcaaagtg

SEQ ID NO: 392022 - DNA, 25 bp, Mus musculus
ctgttagttagcgtggttcaaagtg

SEQ ID NO: 392023 - DNA, 25 bp, Mus musculus
ctgttagtttttaatagtcttccat

SEQ ID NO: 392024 - DNA, 25 bp, Mus musculus
ctgttagttttttatagtcttccat

SEQ ID NO: 392025 - DNA, 25 bp, Mus musculus
ctgttataatgtctaattctctcaa

SEQ ID NO: 392026 - DNA, 25 bp, Mus musculus
ctgttataatgtgtaattctctcaa

SEQ ID NO: 392027 - DNA, 25 bp, Mus musculus
ctgttatcacatcccagaggctgga

SEQ ID NO: 392028 - DNA, 25 bp, Mus musculus
ctgttatcacatgccagaggctgga

SEQ ID NO: 392029 - DNA, 25 bp, Mus musculus
ctgttatcatttctggtgggaaccc

SEQ ID NO: 392030 - DNA, 25 bp, Mus musculus
ctgttatcatttgtggtgggaaccc

SEQ ID NO: 392031 - DNA, 25 bp, Mus musculus
ctgttatcccagcaccttggtgatg

SEQ ID NO: 392032 - DNA, 25 bp, Mus musculus
ctgttatcccaggaccttggtgatg

SEQ ID NO: 392033 - DNA, 25 bp, Mus musculus
ctgttatcctaaatcactcatgtat

SEQ ID NO: 392034 - DNA, 25 bp, Mus musculus
ctgttatcctaattcactcatgtat

SEQ ID NO: 392035 - DNA, 25 bp, Mus musculus
ctgttatcgctgattgtcgcctggg

SEQ ID NO: 392036 - DNA, 25 bp, Mus musculus
ctgttatcgctgtttgtcgcctggg

SEQ ID NO: 392037 - DNA, 25 bp, Mus musculus
ctgttatctacacttggtgctctgc

SEQ ID NO: 392038 - DNA, 25 bp, Mus musculus
ctgttatctacagttggtgctctgc

SEQ ID NO: 392039 - DNA, 25 bp, Mus musculus
ctgttatcttgaccctcaaaagtgc

SEQ ID NO: 392040 - DNA, 25 bp, Mus musculus
ctgttatcttgagcctcaaaagtgc

SEQ ID NO: 392041 - DNA, 25 bp, Mus musculus
ctgttatgaattattgccctgccca

SEQ ID NO: 392042 - DNA, 25 bp, Mus musculus
ctgttatgaatttttgccctgccca

SEQ ID NO: 392043 - DNA, 25 bp, Mus musculus
ctgttatgccagctggtcccacaaa

SEQ ID NO: 392044 - DNA, 25 bp, Mus musculus
ctgttatgccaggtggtcccacaaa

SEQ ID NO: 392045 - DNA, 25 bp, Mus musculus
ctgttatgccttacagtgcgttact

SEQ ID NO: 392046 - DNA, 25 bp, Mus musculus
ctgttatgcctttcagtgcgttact

SEQ ID NO: 392047 - DNA, 25 bp, Mus musculus
ctgttatggaccctccttcaaggag

SEQ ID NO: 392048 - DNA, 25 bp, Mus musculus
ctgttatggaccgtccttcaaggag

SEQ ID NO: 392049 - DNA, 25 bp, Mus musculus
ctgttatgtttcatagcccctgaga

SEQ ID NO: 392050 - DNA, 25 bp, Mus musculus
ctgttatgtttcttagcccctgaga

SEQ ID NO: 392051 - DNA, 25 bp, Mus musculus
ctgttatgttttaatccagtaagac

SEQ ID NO: 392052 - DNA, 25 bp, Mus musculus
ctgttatgtttttatccagtaagac

SEQ ID NO: 392053 - DNA, 25 bp, Mus musculus
ctgttattagcgatacacaaatgta

SEQ ID NO: 392054 - DNA, 25 bp, Mus musculus
ctgttattagcgttacacaaatgta

SEQ ID NO: 392055 - DNA, 25 bp, Mus musculus
ctgttattctggcatggttctggta

SEQ ID NO: 392056 - DNA, 25 bp, Mus musculus
ctgttattctgggatggttctggta

SEQ ID NO: 392057 - DNA, 25 bp, Mus musculus
ctgttattgagaaccctgagatgct

SEQ ID NO: 392058 - DNA, 25 bp, Mus musculus
ctgttattgagatccctgagatgct

SEQ ID NO: 392059 - DNA, 25 bp, Mus musculus
ctgttatttatacatgttcccttaa

SEQ ID NO: 392060 - DNA, 25 bp, Mus musculus
ctgttatttatagatgttcccttaa

SEQ ID NO: 392061 - DNA, 25 bp, Mus musculus
ctgttatttattatccacaccccac

SEQ ID NO: 392062 - DNA, 25 bp, Mus musculus
ctgttatttattttccacaccccac

SEQ ID NO: 392063 - DNA, 25 bp, Mus musculus
ctgttcaaagtcaagtcacctccaa

SEQ ID NO: 392064 - DNA, 25 bp, Mus musculus
ctgttcaaagtctagtcacctccaa

SEQ ID NO: 392065 - DNA, 25 bp, Mus musculus
ctgttcaactagcaaatttccccat

SEQ ID NO: 392066 - DNA, 25 bp, Mus musculus
ctgttcaactaggaaatttccccat

SEQ ID NO: 392067 - DNA, 25 bp, Mus musculus
ctgttcaagctccatgtcttgtttt

SEQ ID NO: 392068 - DNA, 25 bp, Mus musculus
ctgttcaagctcgatgtcttgtttt

SEQ ID NO: 392069 - DNA, 25 bp, Mus musculus
ctgttcaatattatagtcactgggc

SEQ ID NO: 392070 - DNA, 25 bp, Mus musculus
ctgttcaatattttagtcactgggc

SEQ ID NO: 392071 - DNA, 25 bp, Mus musculus
ctgttcaatgttcccaggaggctga

SEQ ID NO: 392072 - DNA, 25 bp, Mus musculus
ctgttcaatgttgccaggaggctga

SEQ ID NO: 392073 - DNA, 25 bp, Mus musculus
ctgttcacccatcagaattggaagg

SEQ ID NO: 392074 - DNA, 25 bp, Mus musculus
ctgttcacccatgagaattggaagg

SEQ ID NO: 392075 - DNA, 25 bp, Mus musculus
ctgttcaccctgctggtgtatgggt

SEQ ID NO: 392076 - DNA, 25 bp, Mus musculus
ctgttcaccctggtggtgtatgggt

SEQ ID NO: 392077 - DNA, 25 bp, Mus musculus
ctgttcacctttcgctggctgtatt

SEQ ID NO: 392078 - DNA, 25 bp, Mus musculus
ctgttcacctttggctggctgtatt

SEQ ID NO: 392079 - DNA, 25 bp, Mus musculus
ctgttcagagagagggagctgccca

SEQ ID NO: 392080 - DNA, 25 bp, Mus musculus
ctgttcagagagtgggagctgccca

SEQ ID NO: 392081 - DNA, 25 bp, Mus musculus
ctgttcagccacctctcggctcaga

SEQ ID NO: 392082 - DNA, 25 bp, Mus musculus
ctgttcagccacgtctcggctcaga

SEQ ID NO: 392083 - DNA, 25 bp, Mus musculus
ctgttcagctatctctgtagaggaa

SEQ ID NO: 392084 - DNA, 25 bp, Mus musculus
ctgttcagctatgtctgtagaggaa

SEQ ID NO: 392085 - DNA, 25 bp, Mus musculus
ctgttcagcttgattcttgcctgaa

SEQ ID NO: 392086 - DNA, 25 bp, Mus musculus
ctgttcagcttgtttcttgcctgaa

SEQ ID NO: 392087 - DNA, 25 bp, Mus musculus
ctgttcatacagattcatcccaggg

SEQ ID NO: 392088 - DNA, 25 bp, Mus musculus
ctgttcatacagtttcatcccaggg

SEQ ID NO: 392089 - DNA, 25 bp, Mus musculus
ctgttcatcaggctgcgggtcttcc

SEQ ID NO: 392090 - DNA, 25 bp, Mus musculus
ctgttcatcagggtgcgggtcttcc

SEQ ID NO: 392091 - DNA, 25 bp, Mus musculus
ctgttcatccccagaatgtgtgaat

SEQ ID NO: 392092 - DNA, 25 bp, Mus musculus
ctgttcatcccctgaatgtgtgaat

SEQ ID NO: 392093 - DNA, 25 bp, Mus musculus
ctgttcatcgtcaaaaccactcaga

SEQ ID NO: 392094 - DNA, 25 bp, Mus musculus
ctgttcatcgtctaaaccactcaga

SEQ ID NO: 392095 - DNA, 25 bp, Mus musculus
ctgttcatctgaactttcaattttt

SEQ ID NO: 392096 - DNA, 25 bp, Mus musculus
ctgttcatctgatctttcaattttt

SEQ ID NO: 392097 - DNA, 25 bp, Mus musculus
ctgttcatctgtctagcggaggcca

SEQ ID NO: 392098 - DNA, 25 bp, Mus musculus
ctgttcatctgtcttccttatgttt

SEQ ID NO: 392099 - DNA, 25 bp, Mus musculus
ctgttcatctgtgtagcggaggcca

SEQ ID NO: 392100 - DNA, 25 bp, Mus musculus
ctgttcatctgtgttccttatgttt

SEQ ID NO: 392101 - DNA, 25 bp, Mus musculus
ctgttcatcttaagccagggtctta

SEQ ID NO: 392102 - DNA, 25 bp, Mus musculus
ctgttcatcttatgccagggtctta

SEQ ID NO: 392103 - DNA, 25 bp, Mus musculus
ctgttcatgtgtctatgccccaaaa

SEQ ID NO: 392104 - DNA, 25 bp, Mus musculus
ctgttcatgtgtgtatgccccaaaa

SEQ ID NO: 392105 - DNA, 25 bp, Mus musculus
ctgttcattggtacgaggataagga

SEQ ID NO: 392106 - DNA, 25 bp, Mus musculus
ctgttcattggttcgaggataagga

SEQ ID NO: 392107 - DNA, 25 bp, Mus musculus
ctgttcatttctcgctgtcttatta

SEQ ID NO: 392108 - DNA, 25 bp, Mus musculus
ctgttcatttctggctgtcttatta

SEQ ID NO: 392109 - DNA, 25 bp, Mus musculus
ctgttcatttgccagggacctggta

SEQ ID NO: 392110 - DNA, 25 bp, Mus musculus
ctgttcatttgcctgtgataatgtg

SEQ ID NO: 392111 - DNA, 25 bp, Mus musculus
ctgttcatttgcgagggacctggta

SEQ ID NO: 392112 - DNA, 25 bp, Mus musculus
ctgttcatttgcgtgtgataatgtg

SEQ ID NO: 392113 - DNA, 25 bp, Mus musculus
ctgttccaaaatcgctccagatgat

SEQ ID NO: 392114 - DNA, 25 bp, Mus musculus
ctgttccaaaatggctccagatgat

SEQ ID NO: 392115 - DNA, 25 bp, Mus musculus
ctgttccacataccctaaaatttca

SEQ ID NO: 392116 - DNA, 25 bp, Mus musculus
ctgttccacatagcctaaaatttca

SEQ ID NO: 392117 - DNA, 25 bp, Mus musculus
ctgttccaccgtattctgcatatgt

SEQ ID NO: 392118 - DNA, 25 bp, Mus musculus
ctgttccaccgttttctgcatatgt

SEQ ID NO: 392119 - DNA, 25 bp, Mus musculus
ctgttccagatccttcattgctaga

SEQ ID NO: 392120 - DNA, 25 bp, Mus musculus
ctgttccagatcgttcattgctaga

SEQ ID NO: 392121 - DNA, 25 bp, Mus musculus
ctgttccagttgattgcatgtagta

SEQ ID NO: 392122 - DNA, 25 bp, Mus musculus
ctgttccagttgtttgcatgtagta

SEQ ID NO: 392123 - DNA, 25 bp, Mus musculus
ctgttccatgcaaggtgacaggccg

SEQ ID NO: 392124 - DNA, 25 bp, Mus musculus
ctgttccatgcatggtgacaggccg

SEQ ID NO: 392125 - DNA, 25 bp, Mus musculus
ctgttccatgggatgtgtgactcac

SEQ ID NO: 392126 - DNA, 25 bp, Mus musculus
ctgttccatgggttgtgtgactcac

SEQ ID NO: 392127 - DNA, 25 bp, Mus musculus
ctgttcccaatcagagggtcctgaa

SEQ ID NO: 392128 - DNA, 25 bp, Mus musculus
ctgttcccaatctgagggtcctgaa

SEQ ID NO: 392129 - DNA, 25 bp, Mus musculus
ctgttcccagcacatgacctgtagg

SEQ ID NO: 392130 - DNA, 25 bp, Mus musculus
ctgttcccagcagatgacctgtagg

SEQ ID NO: 392131 - DNA, 25 bp, Mus musculus
ctgttcccagggacacttagtgcac

SEQ ID NO: 392132 - DNA, 25 bp, Mus musculus
ctgttcccagggtcacttagtgcac

SEQ ID NO: 392133 - DNA, 25 bp, Mus musculus
ctgttccccttcatggcagagagca

SEQ ID NO: 392134 - DNA, 25 bp, Mus musculus
ctgttccccttcttggcagagagca

SEQ ID NO: 392135 - DNA, 25 bp, Mus musculus
ctgttcccgcgtagtcacttcctgt

SEQ ID NO: 392136 - DNA, 25 bp, Mus musculus
ctgttcccgcgttgtcacttcctgt

SEQ ID NO: 392137 - DNA, 25 bp, Mus musculus
ctgttccctatgcttctgatgtgaa

SEQ ID NO: 392138 - DNA, 25 bp, Mus musculus
ctgttccctatggttctgatgtgaa

SEQ ID NO: 392139 - DNA, 25 bp, Mus musculus
ctgttccctgtaagcaaacaaaatc

SEQ ID NO: 392140 - DNA, 25 bp, Mus musculus
ctgttccctgtatgcaaacaaaatc

SEQ ID NO: 392141 - DNA, 25 bp, Mus musculus
ctgttcccttagatctttcatgtat

SEQ ID NO: 392142 - DNA, 25 bp, Mus musculus
ctgttcccttagttctttcatgtat

SEQ ID NO: 392143 - DNA, 25 bp, Mus musculus
ctgttccggagcacttatataccag

SEQ ID NO: 392144 - DNA, 25 bp, Mus musculus
ctgttccggagctcttatataccag

SEQ ID NO: 392145 - DNA, 25 bp, Mus musculus
ctgttcctaggccatagtctgccat

SEQ ID NO: 392146 - DNA, 25 bp, Mus musculus
ctgttcctaggcgatagtctgccat

SEQ ID NO: 392147 - DNA, 25 bp, Mus musculus
ctgttcctagttccagtttggaggt

SEQ ID NO: 392148 - DNA, 25 bp, Mus musculus
ctgttcctagttgcagtttggaggt

SEQ ID NO: 392149 - DNA, 25 bp, Mus musculus
ctgttcctcatcagctactaggagc

SEQ ID NO: 392150 - DNA, 25 bp, Mus musculus
ctgttcctcatctgctactaggagc

SEQ ID NO: 392151 - DNA, 25 bp, Mus musculus
ctgttcctctctcttcggcagcgat

SEQ ID NO: 392152 - DNA, 25 bp, Mus musculus
ctgttcctctctgttcggcagcgat

SEQ ID NO: 392153 - DNA, 25 bp, Mus musculus
ctgttcctcttgacgattccaacag

SEQ ID NO: 392154 - DNA, 25 bp, Mus musculus
ctgttcctcttgtcgattccaacag

SEQ ID NO: 392155 - DNA, 25 bp, Mus musculus
ctgttcctgaacaccaggacttgct

SEQ ID NO: 392156 - DNA, 25 bp, Mus musculus
ctgttcctgaactccaggacttgct

SEQ ID NO: 392157 - DNA, 25 bp, Mus musculus
ctgttcctgaagatggcgtccgggc

SEQ ID NO: 392158 - DNA, 25 bp, Mus musculus
ctgttcctgaagttggcgtccgggc

SEQ ID NO: 392159 - DNA, 25 bp, Mus musculus
ctgttcctgcttctcatttcagaga

SEQ ID NO: 392160 - DNA, 25 bp, Mus musculus
ctgttcctgcttgtcatttcagaga

SEQ ID NO: 392161 - DNA, 25 bp, Mus musculus
ctgttcctggagaagagatagcatt

SEQ ID NO: 392162 - DNA, 25 bp, Mus musculus
ctgttcctggagtagagatagcatt

SEQ ID NO: 392163 - DNA, 25 bp, Mus musculus
ctgttcctgtaactttgctattaaa

SEQ ID NO: 392164 - DNA, 25 bp, Mus musculus
ctgttcctgtaagtttgctattaaa

SEQ ID NO: 392165 - DNA, 25 bp, Mus musculus
ctgttcctgtagacgtatagattat

SEQ ID NO: 392166 - DNA, 25 bp, Mus musculus
ctgttcctgtagtcgtatagattat

SEQ ID NO: 392167 - DNA, 25 bp, Mus musculus
ctgttcctgtgacctagtagtaaat

SEQ ID NO: 392168 - DNA, 25 bp, Mus musculus
ctgttcctgtgagctagtagtaaat

SEQ ID NO: 392169 - DNA, 25 bp, Mus musculus
ctgttcctgtttcttgcatttattt

SEQ ID NO: 392170 - DNA, 25 bp, Mus musculus
ctgttcctgtttgttgcatttattt

SEQ ID NO: 392171 - DNA, 25 bp, Mus musculus
ctgttccttcacactagttctagta

SEQ ID NO: 392172 - DNA, 25 bp, Mus musculus
ctgttccttcactctagttctagta

SEQ ID NO: 392173 - DNA, 25 bp, Mus musculus
ctgttccttgaaagcacatcatgtt

SEQ ID NO: 392174 - DNA, 25 bp, Mus musculus
ctgttccttgaatgcacatcatgtt

SEQ ID NO: 392175 - DNA, 25 bp, Mus musculus
ctgttccttgcacacctcggaaggg

SEQ ID NO: 392176 - DNA, 25 bp, Mus musculus
ctgttccttgcagacctcggaaggg

SEQ ID NO: 392177 - DNA, 25 bp, Mus musculus
ctgttcctttagagactgtccaacc

SEQ ID NO: 392178 - DNA, 25 bp, Mus musculus
ctgttcctttagtgactgtccaacc

SEQ ID NO: 392179 - DNA, 25 bp, Mus musculus
ctgttcgaatttaatccacttttgt

SEQ ID NO: 392180 - DNA, 25 bp, Mus musculus
ctgttcgaattttatccacttttgt

SEQ ID NO: 392181 - DNA, 25 bp, Mus musculus
ctgttcgcaaatcaactggcttcgt

SEQ ID NO: 392182 - DNA, 25 bp, Mus musculus
ctgttcgcaaatgaactggcttcgt

SEQ ID NO: 392183 - DNA, 25 bp, Mus musculus
ctgttcgctgggatcattcttgatt

SEQ ID NO: 392184 - DNA, 25 bp, Mus musculus
ctgttcgctgggttcattcttgatt

SEQ ID NO: 392185 - DNA, 25 bp, Mus musculus
ctgttctacagaatgtttccagtac

SEQ ID NO: 392186 - DNA, 25 bp, Mus musculus
ctgttctacagattgtttccagtac

SEQ ID NO: 392187 - DNA, 25 bp, Mus musculus
ctgttctactatagcttttttctaa

SEQ ID NO: 392188 - DNA, 25 bp, Mus musculus
ctgttctactattgcttttttctaa

SEQ ID NO: 392189 - DNA, 25 bp, Mus musculus
ctgttctataaaacgaccttgggct

SEQ ID NO: 392190 - DNA, 25 bp, Mus musculus
ctgttctataaatcgaccttgggct

SEQ ID NO: 392191 - DNA, 25 bp, Mus musculus
ctgttctattgccatcaaccctctt

SEQ ID NO: 392192 - DNA, 25 bp, Mus musculus
ctgttctattgcgatcaaccctctt

SEQ ID NO: 392193 - DNA, 25 bp, Mus musculus
ctgttctcagcaccctggaatgatt

SEQ ID NO: 392194 - DNA, 25 bp, Mus musculus
ctgttctcagcagcctggaatgatt

SEQ ID NO: 392195 - DNA, 25 bp, Mus musculus
ctgttctcagtcacagaagccacaa

SEQ ID NO: 392196 - DNA, 25 bp, Mus musculus
ctgttctcagtctcagaagccacaa

SEQ ID NO: 392197 - DNA, 25 bp, Mus musculus
ctgttctcctacacgggctgggaca

SEQ ID NO: 392198 - DNA, 25 bp, Mus musculus
ctgttctcctactcgggctgggaca

SEQ ID NO: 392199 - DNA, 25 bp, Mus musculus
ctgttctcctgtcctttgttctttt

SEQ ID NO: 392200 - DNA, 25 bp, Mus musculus
ctgttctcctgtgctttgttctttt

SEQ ID NO: 392201 - DNA, 25 bp, Mus musculus
ctgttctcggctccgggcaagactg

SEQ ID NO: 392202 - DNA, 25 bp, Mus musculus
ctgttctcggctgcgggcaagactg

SEQ ID NO: 392203 - DNA, 25 bp, Mus musculus
ctgttctctgagataggatgttagg

SEQ ID NO: 392204 - DNA, 25 bp, Mus musculus
ctgttctctgagttaggatgttagg

SEQ ID NO: 392205 - DNA, 25 bp, Mus musculus
ctgttctctggcattagtaagtcat

SEQ ID NO: 392206 - DNA, 25 bp, Mus musculus
ctgttctctggctttagtaagtcat

SEQ ID NO: 392207 - DNA, 25 bp, Mus musculus
ctgttctgaagaaacaatgtcctcc

SEQ ID NO: 392208 - DNA, 25 bp, Mus musculus
ctgttctgaagatacaatgtcctcc

SEQ ID NO: 392209 - DNA, 25 bp, Mus musculus
ctgttctgatggagattagcggctc

SEQ ID NO: 392210 - DNA, 25 bp, Mus musculus
ctgttctgatggtgattagcggctc

SEQ ID NO: 392211 - DNA, 25 bp, Mus musculus
ctgttctgatttaaggttataccca

SEQ ID NO: 392212 - DNA, 25 bp, Mus musculus
ctgttctgattttaggttataccca

SEQ ID NO: 392213 - DNA, 25 bp, Mus musculus
ctgttctgctacaggcatgatcaaa

SEQ ID NO: 392214 - DNA, 25 bp, Mus musculus
ctgttctgctactggcatgatcaaa

SEQ ID NO: 392215 - DNA, 25 bp, Mus musculus
ctgttctgctctatcggtactaggg

SEQ ID NO: 392216 - DNA, 25 bp, Mus musculus
ctgttctgctctttcggtactaggg

SEQ ID NO: 392217 - DNA, 25 bp, Mus musculus
ctgttctggaatatacaatgtagac

SEQ ID NO: 392218 - DNA, 25 bp, Mus musculus
ctgttctggaatttacaatgtagac

SEQ ID NO: 392219 - DNA, 25 bp, Mus musculus
ctgttctggcttccagtggatggtt

SEQ ID NO: 392220 - DNA, 25 bp, Mus musculus
ctgttctggcttgcagtggatggtt

SEQ ID NO: 392221 - DNA, 25 bp, Mus musculus
ctgttctggtataaccaaaccacac

SEQ ID NO: 392222 - DNA, 25 bp, Mus musculus
ctgttctggtattaccaaaccacac

SEQ ID NO: 392223 - DNA, 25 bp, Mus musculus
ctgttctgtactcacctaggttgaa

SEQ ID NO: 392224 - DNA, 25 bp, Mus musculus
ctgttctgtactgacctaggttgaa

SEQ ID NO: 392225 - DNA, 25 bp, Mus musculus
ctgttctgtatcagcatagctctgt

SEQ ID NO: 392226 - DNA, 25 bp, Mus musculus
ctgttctgtatcagctatcctaact

SEQ ID NO: 392227 - DNA, 25 bp, Mus musculus
ctgttctgtatctgcatagctctgt

SEQ ID NO: 392228 - DNA, 25 bp, Mus musculus
ctgttctgtatctgctatcctaact

SEQ ID NO: 392229 - DNA, 25 bp, Mus musculus
ctgttctgtgcccatagcttaagac

SEQ ID NO: 392230 - DNA, 25 bp, Mus musculus
ctgttctgtgccgatagcttaagac

SEQ ID NO: 392231 - DNA, 25 bp, Mus musculus
ctgttctgtgtaaatctttatagat

SEQ ID NO: 392232 - DNA, 25 bp, Mus musculus
ctgttctgtgtatatctttatagat

SEQ ID NO: 392233 - DNA, 25 bp, Mus musculus
ctgttctgtttgaggttgtttcact

SEQ ID NO: 392234 - DNA, 25 bp, Mus musculus
ctgttctgtttgcagatgtccctgg

SEQ ID NO: 392235 - DNA, 25 bp, Mus musculus
ctgttctgtttggagatgtccctgg

SEQ ID NO: 392236 - DNA, 25 bp, Mus musculus
ctgttctgtttgtggttgtttcact

SEQ ID NO: 392237 - DNA, 25 bp, Mus musculus
ctgttcttattcagagttatctctg

SEQ ID NO: 392238 - DNA, 25 bp, Mus musculus
ctgttcttattctgagttatctctg

SEQ ID NO: 392239 - DNA, 25 bp, Mus musculus
ctgttcttcacacaagagcactcac

SEQ ID NO: 392240 - DNA, 25 bp, Mus musculus
ctgttcttcacagaagagcactcac

SEQ ID NO: 392241 - DNA, 25 bp, Mus musculus
ctgttcttccagcgaggtactgagt

SEQ ID NO: 392242 - DNA, 25 bp, Mus musculus
ctgttcttccagggaggtactgagt

SEQ ID NO: 392243 - DNA, 25 bp, Mus musculus
ctgttcttctagacccagttgtttc

SEQ ID NO: 392244 - DNA, 25 bp, Mus musculus
ctgttcttctagcagctgctgatta

SEQ ID NO: 392245 - DNA, 25 bp, Mus musculus
ctgttcttctaggagctgctgatta

SEQ ID NO: 392246 - DNA, 25 bp, Mus musculus
ctgttcttctagtcccagttgtttc

SEQ ID NO: 392247 - DNA, 25 bp, Mus musculus
ctgttcttgtagattaaccagggca

SEQ ID NO: 392248 - DNA, 25 bp, Mus musculus
ctgttcttgtagtttaaccagggca

SEQ ID NO: 392249 - DNA, 25 bp, Mus musculus
ctgttctttaacatggatttaggaa

SEQ ID NO: 392250 - DNA, 25 bp, Mus musculus
ctgttctttaacttggatttaggaa

SEQ ID NO: 392251 - DNA, 25 bp, Mus musculus
ctgttctttatgaggttgggtgtga

SEQ ID NO: 392252 - DNA, 25 bp, Mus musculus
ctgttctttatgtggttgggtgtga

SEQ ID NO: 392253 - DNA, 25 bp, Mus musculus
ctgttctttgaaatggccctgggct

SEQ ID NO: 392254 - DNA, 25 bp, Mus musculus
ctgttctttgaaccatgtgcaagtc

SEQ ID NO: 392255 - DNA, 25 bp, Mus musculus
ctgttctttgaagcatgtgcaagtc

SEQ ID NO: 392256 - DNA, 25 bp, Mus musculus
ctgttctttgaattggccctgggct

SEQ ID NO: 392257 - DNA, 25 bp, Mus musculus
ctgttctttgtaacagcctgtcaca

SEQ ID NO: 392258 - DNA, 25 bp, Mus musculus
ctgttctttgtatcagcctgtcaca

SEQ ID NO: 392259 - DNA, 25 bp, Mus musculus
ctgttcttttagagtacgatcctga

SEQ ID NO: 392260 - DNA, 25 bp, Mus musculus
ctgttcttttagtgtacgatcctga

SEQ ID NO: 392261 - DNA, 25 bp, Mus musculus
ctgttcttttatctggcgagccatc

SEQ ID NO: 392262 - DNA, 25 bp, Mus musculus
ctgttcttttatgtggcgagccatc

SEQ ID NO: 392263 - DNA, 25 bp, Mus musculus
ctgttcttttggattatcacctgaa

SEQ ID NO: 392264 - DNA, 25 bp, Mus musculus
ctgttcttttggtttatcacctgaa

SEQ ID NO: 392265 - DNA, 25 bp, Mus musculus
ctgttgaaacttaatgtttattcct

SEQ ID NO: 392266 - DNA, 25 bp, Mus musculus
ctgttgaaactttatgtttattcct

SEQ ID NO: 392267 - DNA, 25 bp, Mus musculus
ctgttgaaatgtccaggaccctttt

SEQ ID NO: 392268 - DNA, 25 bp, Mus musculus
ctgttgaaatgtgcaggaccctttt

SEQ ID NO: 392269 - DNA, 25 bp, Mus musculus
ctgttgaactttcctgtccttggaa

SEQ ID NO: 392270 - DNA, 25 bp, Mus musculus
ctgttgaactttgctgtccttggaa

SEQ ID NO: 392271 - DNA, 25 bp, Mus musculus
ctgttgaagtaacttacctgttgtg

SEQ ID NO: 392272 - DNA, 25 bp, Mus musculus
ctgttgaagtaagttacctgttgtg

SEQ ID NO: 392273 - DNA, 25 bp, Mus musculus
ctgttgaataaaacctaggattaga

SEQ ID NO: 392274 - DNA, 25 bp, Mus musculus
ctgttgaataaatcctaggattaga

SEQ ID NO: 392275 - DNA, 25 bp, Mus musculus
ctgttgacactgagccgagggcatt

SEQ ID NO: 392276 - DNA, 25 bp, Mus musculus
ctgttgacactgtgccgagggcatt

SEQ ID NO: 392277 - DNA, 25 bp, Mus musculus
ctgttgacggcaagtggtggcacac

SEQ ID NO: 392278 - DNA, 25 bp, Mus musculus
ctgttgacggcatgtggtggcacac

SEQ ID NO: 392279 - DNA, 25 bp, Mus musculus
ctgttgactacacggcccaggactg

SEQ ID NO: 392280 - DNA, 25 bp, Mus musculus
ctgttgactacagggcccaggactg

SEQ ID NO: 392281 - DNA, 25 bp, Mus musculus
ctgttgactatgcagggtccctcgt

SEQ ID NO: 392282 - DNA, 25 bp, Mus musculus
ctgttgactatggagggtccctcgt

SEQ ID NO: 392283 - DNA, 25 bp, Mus musculus
ctgttgagacagatgctcctggagt

SEQ ID NO: 392284 - DNA, 25 bp, Mus musculus
ctgttgagacagttgctcctggagt

SEQ ID NO: 392285 - DNA, 25 bp, Mus musculus
ctgttgagtaacatgctacctgctc

SEQ ID NO: 392286 - DNA, 25 bp, Mus musculus
ctgttgagtaacttgctacctgctc

SEQ ID NO: 392287 - DNA, 25 bp, Mus musculus
ctgttgagtatgactgttgtagcca

SEQ ID NO: 392288 - DNA, 25 bp, Mus musculus
ctgttgagtatgtctgttgtagcca

SEQ ID NO: 392289 - DNA, 25 bp, Mus musculus
ctgttgagtattaaagaggctgtac

SEQ ID NO: 392290 - DNA, 25 bp, Mus musculus
ctgttgagtatttaagaggctgtac

SEQ ID NO: 392291 - DNA, 25 bp, Mus musculus
ctgttgagtctgctgttaccggcta

SEQ ID NO: 392292 - DNA, 25 bp, Mus musculus
ctgttgagtctggtgttaccggcta

SEQ ID NO: 392293 - DNA, 25 bp, Mus musculus
ctgttgatagccattttgttctgta

SEQ ID NO: 392294 - DNA, 25 bp, Mus musculus
ctgttgatagcctttttgttctgta

SEQ ID NO: 392295 - DNA, 25 bp, Mus musculus
ctgttgatctgtcgagcctcggaat

SEQ ID NO: 392296 - DNA, 25 bp, Mus musculus
ctgttgatctgtggagcctcggaat

SEQ ID NO: 392297 - DNA, 25 bp, Mus musculus
ctgttgatcttaaactaaatgtgag

SEQ ID NO: 392298 - DNA, 25 bp, Mus musculus
ctgttgatcttatactaaatgtgag

SEQ ID NO: 392299 - DNA, 25 bp, Mus musculus
ctgttgatgaaacatgacggctcct

SEQ ID NO: 392300 - DNA, 25 bp, Mus musculus
ctgttgatgaaagatgacggctcct

SEQ ID NO: 392301 - DNA, 25 bp, Mus musculus
ctgttgatgagaccacgttcgggct

SEQ ID NO: 392302 - DNA, 25 bp, Mus musculus
ctgttgatgagagcacgttcgggct

SEQ ID NO: 392303 - DNA, 25 bp, Mus musculus
ctgttgattgggatgctgttggtat

SEQ ID NO: 392304 - DNA, 25 bp, Mus musculus
ctgttgattgggttgctgttggtat

SEQ ID NO: 392305 - DNA, 25 bp, Mus musculus
ctgttgatttctctttgcattgctt

SEQ ID NO: 392306 - DNA, 25 bp, Mus musculus
ctgttgatttctgtttgcattgctt

SEQ ID NO: 392307 - DNA, 25 bp, Mus musculus
ctgttgcaacagatgtcccgggtct

SEQ ID NO: 392308 - DNA, 25 bp, Mus musculus
ctgttgcaacagttgtcccgggtct

SEQ ID NO: 392309 - DNA, 25 bp, Mus musculus
ctgttgcaactacaattcccttgaa

SEQ ID NO: 392310 - DNA, 25 bp, Mus musculus
ctgttgcaactagaattcccttgaa

SEQ ID NO: 392311 - DNA, 25 bp, Mus musculus
ctgttgcacacaaggcagccccaaa

SEQ ID NO: 392312 - DNA, 25 bp, Mus musculus
ctgttgcacacatggcagccccaaa

SEQ ID NO: 392313 - DNA, 25 bp, Mus musculus
ctgttgcaccagcttctagggtttc

SEQ ID NO: 392314 - DNA, 25 bp, Mus musculus
ctgttgcaccaggttctagggtttc

SEQ ID NO: 392315 - DNA, 25 bp, Mus musculus
ctgttgcactctagaatttgaaggc

SEQ ID NO: 392316 - DNA, 25 bp, Mus musculus
ctgttgcactcttgaatttgaaggc

SEQ ID NO: 392317 - DNA, 25 bp, Mus musculus
ctgttgcagaggatggcgacgtggc

SEQ ID NO: 392318 - DNA, 25 bp, Mus musculus
ctgttgcagaggttggcgacgtggc

SEQ ID NO: 392319 - DNA, 25 bp, Mus musculus
ctgttgcatcttaggacccagggaa

SEQ ID NO: 392320 - DNA, 25 bp, Mus musculus
ctgttgcatctttggacccagggaa

SEQ ID NO: 392321 - DNA, 25 bp, Mus musculus
ctgttgccaagtaagagatgtttct

SEQ ID NO: 392322 - DNA, 25 bp, Mus musculus
ctgttgccaagttagagatgtttct

SEQ ID NO: 392323 - DNA, 25 bp, Mus musculus
ctgttgccatctacgtatcattttc

SEQ ID NO: 392324 - DNA, 25 bp, Mus musculus
ctgttgccatcttcgtatcattttc

SEQ ID NO: 392325 - DNA, 25 bp, Mus musculus
ctgttgcccaaaccacagatgcgtg

SEQ ID NO: 392326 - DNA, 25 bp, Mus musculus
ctgttgcccaaagcacagatgcgtg

SEQ ID NO: 392327 - DNA, 25 bp, Mus musculus
ctgttgcccgatccgttagttagtt

SEQ ID NO: 392328 - DNA, 25 bp, Mus musculus
ctgttgcccgatgcgttagttagtt

SEQ ID NO: 392329 - DNA, 25 bp, Mus musculus
ctgttgcctattcagttctgtgcca

SEQ ID NO: 392330 - DNA, 25 bp, Mus musculus
ctgttgcctattgagttctgtgcca

SEQ ID NO: 392331 - DNA, 25 bp, Mus musculus
ctgttgcctcgccatctgtggagaa

SEQ ID NO: 392332 - DNA, 25 bp, Mus musculus
ctgttgcctcgcgatctgtggagaa

SEQ ID NO: 392333 - DNA, 25 bp, Mus musculus
ctgttgcctgagaacacaatgcacc

SEQ ID NO: 392334 - DNA, 25 bp, Mus musculus
ctgttgcctgagtacacaatgcacc

SEQ ID NO: 392335 - DNA, 25 bp, Mus musculus
ctgttgcctgatcctaagatgaggg

SEQ ID NO: 392336 - DNA, 25 bp, Mus musculus
ctgttgcctgatgctaagatgaggg

SEQ ID NO: 392337 - DNA, 25 bp, Mus musculus
ctgttgctagccatcttgtgagtgc

SEQ ID NO: 392338 - DNA, 25 bp, Mus musculus
ctgttgctagccttcttgtgagtgc

SEQ ID NO: 392339 - DNA, 25 bp, Mus musculus
ctgttgctatctcatgtgttcccat

SEQ ID NO: 392340 - DNA, 25 bp, Mus musculus
ctgttgctatctgatgtgttcccat

SEQ ID NO: 392341 - DNA, 25 bp, Mus musculus
ctgttgctcagtccgcttgctcctg

SEQ ID NO: 392342 - DNA, 25 bp, Mus musculus
ctgttgctcagtgcgcttgctcctg

SEQ ID NO: 392343 - DNA, 25 bp, Mus musculus
ctgttgctgaggctttcatacacat

SEQ ID NO: 392344 - DNA, 25 bp, Mus musculus
ctgttgctgagggtttcatacacat

SEQ ID NO: 392345 - DNA, 25 bp, Mus musculus
ctgttgctgccacgaaggaggacaa

SEQ ID NO: 392346 - DNA, 25 bp, Mus musculus
ctgttgctgccaggaaggaggacaa

SEQ ID NO: 392347 - DNA, 25 bp, Mus musculus
ctgttgctgcccattcatgacttta

SEQ ID NO: 392348 - DNA, 25 bp, Mus musculus
ctgttgctgccctttcatgacttta

SEQ ID NO: 392349 - DNA, 25 bp, Mus musculus
ctgttgctgtggatttcatgtagtt

SEQ ID NO: 392350 - DNA, 25 bp, Mus musculus
ctgttgctgtggttttcatgtagtt

SEQ ID NO: 392351 - DNA, 25 bp, Mus musculus
ctgttgctgtttcggagctgttgcc

SEQ ID NO: 392352 - DNA, 25 bp, Mus musculus
ctgttgctgtttgggagctgttgcc

SEQ ID NO: 392353 - DNA, 25 bp, Mus musculus
ctgttgcttaacctgtccttgtgaa

SEQ ID NO: 392354 - DNA, 25 bp, Mus musculus
ctgttgcttaacgtgtccttgtgaa

SEQ ID NO: 392355 - DNA, 25 bp, Mus musculus
ctgttgcttaatctgagccagagtt

SEQ ID NO: 392356 - DNA, 25 bp, Mus musculus
ctgttgcttaatgtgagccagagtt

SEQ ID NO: 392357 - DNA, 25 bp, Mus musculus
ctgttgcttatcaggcacacacaag

SEQ ID NO: 392358 - DNA, 25 bp, Mus musculus
ctgttgcttatctggcacacacaag

SEQ ID NO: 392359 - DNA, 25 bp, Mus musculus
ctgttgcttgagctgtttgcttttt

SEQ ID NO: 392360 - DNA, 25 bp, Mus musculus
ctgttgcttgaggtgtttgcttttt

SEQ ID NO: 392361 - DNA, 25 bp, Mus musculus
ctgttgcttggccattgagcctaat

SEQ ID NO: 392362 - DNA, 25 bp, Mus musculus
ctgttgcttggcgattgagcctaat

SEQ ID NO: 392363 - DNA, 25 bp, Mus musculus
ctgttggaaaggatgacgaggatta

SEQ ID NO: 392364 - DNA, 25 bp, Mus musculus
ctgttggaaaggttgacgaggatta

SEQ ID NO: 392365 - DNA, 25 bp, Mus musculus
ctgttggactccagtgtatctgtgt

SEQ ID NO: 392366 - DNA, 25 bp, Mus musculus
ctgttggactcctgtgtatctgtgt

SEQ ID NO: 392367 - DNA, 25 bp, Mus musculus
ctgttggagcctctgcttcagggta

SEQ ID NO: 392368 - DNA, 25 bp, Mus musculus
ctgttggagcctgtgcttcagggta

SEQ ID NO: 392369 - DNA, 25 bp, Mus musculus
ctgttggagctgatggtttcacact

SEQ ID NO: 392370 - DNA, 25 bp, Mus musculus
ctgttggagctgttggtttcacact

SEQ ID NO: 392371 - DNA, 25 bp, Mus musculus
ctgttggatgaactcactggtcccc

SEQ ID NO: 392372 - DNA, 25 bp, Mus musculus
ctgttggatgaagtcactggtcccc

SEQ ID NO: 392373 - DNA, 25 bp, Mus musculus
ctgttggcaattaaaacccacttgc

SEQ ID NO: 392374 - DNA, 25 bp, Mus musculus
ctgttggcaatttaaacccacttgc

SEQ ID NO: 392375 - DNA, 25 bp, Mus musculus
ctgttggccaagaatataggaaata

SEQ ID NO: 392376 - DNA, 25 bp, Mus musculus
ctgttggccaagtatataggaaata

SEQ ID NO: 392377 - DNA, 25 bp, Mus musculus
ctgttggcccagaccatagagagac

SEQ ID NO: 392378 - DNA, 25 bp, Mus musculus
ctgttggcccagtccatagagagac

SEQ ID NO: 392379 - DNA, 25 bp, Mus musculus
ctgttggctgagactgagatgtgac

SEQ ID NO: 392380 - DNA, 25 bp, Mus musculus
ctgttggctgagtctgagatgtgac

SEQ ID NO: 392381 - DNA, 25 bp, Mus musculus
ctgttggctgccaacgatgaggaga

SEQ ID NO: 392382 - DNA, 25 bp, Mus musculus
ctgttggctgcctacgatgaggaga

SEQ ID NO: 392383 - DNA, 25 bp, Mus musculus
ctgttgggcatgatctcactctggt

SEQ ID NO: 392384 - DNA, 25 bp, Mus musculus
ctgttgggcatgttctcactctggt

SEQ ID NO: 392385 - DNA, 25 bp, Mus musculus
ctgttgggcctgcctaaccactggg

SEQ ID NO: 392386 - DNA, 25 bp, Mus musculus
ctgttgggcctggctaaccactggg

SEQ ID NO: 392387 - DNA, 25 bp, Mus musculus
ctgttggtactgagtggttgttctt

SEQ ID NO: 392388 - DNA, 25 bp, Mus musculus
ctgttggtactgtgtggttgttctt

SEQ ID NO: 392389 - DNA, 25 bp, Mus musculus
ctgttggtcacaccttgggcaaggt

SEQ ID NO: 392390 - DNA, 25 bp, Mus musculus
ctgttggtcacagcttgggcaaggt

SEQ ID NO: 392391 - DNA, 25 bp, Mus musculus
ctgttggtccccagatacttttctt

SEQ ID NO: 392392 - DNA, 25 bp, Mus musculus
ctgttggtcccctgatacttttctt

SEQ ID NO: 392393 - DNA, 25 bp, Mus musculus
ctgttggttcgtaaattacagttct

SEQ ID NO: 392394 - DNA, 25 bp, Mus musculus
ctgttggttcgttaattacagttct

SEQ ID NO: 392395 - DNA, 25 bp, Mus musculus
ctgttggttggtaatttcctgcttt

SEQ ID NO: 392396 - DNA, 25 bp, Mus musculus
ctgttggttggttatttcctgcttt

SEQ ID NO: 392397 - DNA, 25 bp, Mus musculus
ctgttgtaacaccagcagcgtcaag

SEQ ID NO: 392398 - DNA, 25 bp, Mus musculus
ctgttgtaacacgagcagcgtcaag

SEQ ID NO: 392399 - DNA, 25 bp, Mus musculus
ctgttgtaacgtcatgcagctgtga

SEQ ID NO: 392400 - DNA, 25 bp, Mus musculus
ctgttgtaacgtgatgcagctgtga

SEQ ID NO: 392401 - DNA, 25 bp, Mus musculus
ctgttgtaatagaccatgggcgatt

SEQ ID NO: 392402 - DNA, 25 bp, Mus musculus
ctgttgtaatagtccatgggcgatt

SEQ ID NO: 392403 - DNA, 25 bp, Mus musculus
ctgttgtaatcgatgcatggcatga

SEQ ID NO: 392404 - DNA, 25 bp, Mus musculus
ctgttgtaatcgttgcatggcatga

SEQ ID NO: 392405 - DNA, 25 bp, Mus musculus
ctgttgtactttctgtatccaccaa

SEQ ID NO: 392406 - DNA, 25 bp, Mus musculus
ctgttgtactttgtgtatccaccaa

SEQ ID NO: 392407 - DNA, 25 bp, Mus musculus
ctgttgtatatcatttagctcatta

SEQ ID NO: 392408 - DNA, 25 bp, Mus musculus
ctgttgtatatcttttagctcatta

SEQ ID NO: 392409 - DNA, 25 bp, Mus musculus
ctgttgtcaaatagaggcctccatg

SEQ ID NO: 392410 - DNA, 25 bp, Mus musculus
ctgttgtcaaatcggagtgcctcct

SEQ ID NO: 392411 - DNA, 25 bp, Mus musculus
ctgttgtcaaatgggagtgcctcct

SEQ ID NO: 392412 - DNA, 25 bp, Mus musculus
ctgttgtcaaattgaggcctccatg

SEQ ID NO: 392413 - DNA, 25 bp, Mus musculus
ctgttgtcacacagtaggcagctgt

SEQ ID NO: 392414 - DNA, 25 bp, Mus musculus
ctgttgtcacacattgcagtgttga

SEQ ID NO: 392415 - DNA, 25 bp, Mus musculus
ctgttgtcacactgtaggcagctgt

SEQ ID NO: 392416 - DNA, 25 bp, Mus musculus
ctgttgtcacactttgcagtgttga

SEQ ID NO: 392417 - DNA, 25 bp, Mus musculus
ctgttgtcacttctggctgttagca

SEQ ID NO: 392418 - DNA, 25 bp, Mus musculus
ctgttgtcacttgtggctgttagca

SEQ ID NO: 392419 - DNA, 25 bp, Mus musculus
ctgttgtcatcacagtgacagccct

SEQ ID NO: 392420 - DNA, 25 bp, Mus musculus
ctgttgtcatcagagtgacagccct

SEQ ID NO: 392421 - DNA, 25 bp, Mus musculus
ctgttgtccggaacatttgtcccca

SEQ ID NO: 392422 - DNA, 25 bp, Mus musculus
ctgttgtccggatcatttgtcccca

SEQ ID NO: 392423 - DNA, 25 bp, Mus musculus
ctgttgtctacaccctcaggaacaa

SEQ ID NO: 392424 - DNA, 25 bp, Mus musculus
ctgttgtctacagcctcaggaacaa

SEQ ID NO: 392425 - DNA, 25 bp, Mus musculus
ctgttgtgaggaccaccgtgatcaa

SEQ ID NO: 392426 - DNA, 25 bp, Mus musculus
ctgttgtgaggagcaccgtgatcaa

SEQ ID NO: 392427 - DNA, 25 bp, Mus musculus
ctgttgtgagtgatggcaaggctat

SEQ ID NO: 392428 - DNA, 25 bp, Mus musculus
ctgttgtgagtgttggcaaggctat

SEQ ID NO: 392429 - DNA, 25 bp, Mus musculus
ctgttgtgatcaaccctcttttaaa

SEQ ID NO: 392430 - DNA, 25 bp, Mus musculus
ctgttgtgatcatccctcttttaaa

SEQ ID NO: 392431 - DNA, 25 bp, Mus musculus
ctgttgtgatccactgaacacatag

SEQ ID NO: 392432 - DNA, 25 bp, Mus musculus
ctgttgtgatcctctgaacacatag

SEQ ID NO: 392433 - DNA, 25 bp, Mus musculus
ctgttgtgctgtactgttgtgatca

SEQ ID NO: 392434 - DNA, 25 bp, Mus musculus
ctgttgtgctgttctgttgtgatca

SEQ ID NO: 392435 - DNA, 25 bp, Mus musculus
ctgttgtggcgtcttttctatttga

SEQ ID NO: 392436 - DNA, 25 bp, Mus musculus
ctgttgtggcgtgttttctatttga

SEQ ID NO: 392437 - DNA, 25 bp, Mus musculus
ctgttgtgggtgaaagtgacatgat

SEQ ID NO: 392438 - DNA, 25 bp, Mus musculus
ctgttgtgggtgtaagtgacatgat

SEQ ID NO: 392439 - DNA, 25 bp, Mus musculus
ctgttgtggtctcccagggttatgt

SEQ ID NO: 392440 - DNA, 25 bp, Mus musculus
ctgttgtggtctgccagggttatgt

SEQ ID NO: 392441 - DNA, 25 bp, Mus musculus
ctgttgtgtaccatgtgctgtgtga

SEQ ID NO: 392442 - DNA, 25 bp, Mus musculus
ctgttgtgtaccttgtgctgtgtga

SEQ ID NO: 392443 - DNA, 25 bp, Mus musculus
ctgttgtgtagccttgcagcttatt

SEQ ID NO: 392444 - DNA, 25 bp, Mus musculus
ctgttgtgtagcgttgcagcttatt

SEQ ID NO: 392445 - DNA, 25 bp, Mus musculus
ctgttgtgtaggatgccgtgtgcca

SEQ ID NO: 392446 - DNA, 25 bp, Mus musculus
ctgttgtgtaggttgccgtgtgcca

SEQ ID NO: 392447 - DNA, 25 bp, Mus musculus
ctgttgtgtcacaagcagaggcctt

SEQ ID NO: 392448 - DNA, 25 bp, Mus musculus
ctgttgtgtcacatagtttctgcca

SEQ ID NO: 392449 - DNA, 25 bp, Mus musculus
ctgttgtgtcactagcagaggcctt

SEQ ID NO: 392450 - DNA, 25 bp, Mus musculus
ctgttgtgtcacttagtttctgcca

SEQ ID NO: 392451 - DNA, 25 bp, Mus musculus
ctgttgtgttctctagagggcctca

SEQ ID NO: 392452 - DNA, 25 bp, Mus musculus
ctgttgtgttctgtagagggcctca

SEQ ID NO: 392453 - DNA, 25 bp, Mus musculus
ctgttgtgttgtcccgattgtctcg

SEQ ID NO: 392454 - DNA, 25 bp, Mus musculus
ctgttgtgttgtgccgattgtctcg

SEQ ID NO: 392455 - DNA, 25 bp, Mus musculus
ctgttgttcaaaagctgctgctttt

SEQ ID NO: 392456 - DNA, 25 bp, Mus musculus
ctgttgttcaaatgctgctgctttt

SEQ ID NO: 392457 - DNA, 25 bp, Mus musculus
ctgttgttcacaatgcaactcttcc

SEQ ID NO: 392458 - DNA, 25 bp, Mus musculus
ctgttgttcacattgcaactcttcc

SEQ ID NO: 392459 - DNA, 25 bp, Mus musculus
ctgttgttcagactgggatcgtcct

SEQ ID NO: 392460 - DNA, 25 bp, Mus musculus
ctgttgttcagagtgggatcgtcct

SEQ ID NO: 392461 - DNA, 25 bp, Mus musculus
ctgttgttccgtaaacctgaggtgt

SEQ ID NO: 392462 - DNA, 25 bp, Mus musculus
ctgttgttccgttaacctgaggtgt

SEQ ID NO: 392463 - DNA, 25 bp, Mus musculus
ctgttgttggtcctgggtcccagta

SEQ ID NO: 392464 - DNA, 25 bp, Mus musculus
ctgttgttggtcgtgggtcccagta

SEQ ID NO: 392465 - DNA, 25 bp, Mus musculus
ctgttgttggtgactttgctatgac

SEQ ID NO: 392466 - DNA, 25 bp, Mus musculus
ctgttgttggtgtctttgctatgac

SEQ ID NO: 392467 - DNA, 25 bp, Mus musculus
ctgttgttgtttcccttctgatgct

SEQ ID NO: 392468 - DNA, 25 bp, Mus musculus
ctgttgttgtttgccttctgatgct

SEQ ID NO: 392469 - DNA, 25 bp, Mus musculus
ctgttgtttcatctgtttaggtagc

SEQ ID NO: 392470 - DNA, 25 bp, Mus musculus
ctgttgtttcatgtgtttaggtagc

SEQ ID NO: 392471 - DNA, 25 bp, Mus musculus
ctgttgtttgcgatttatactctaa

SEQ ID NO: 392472 - DNA, 25 bp, Mus musculus
ctgttgtttgcgttttatactctaa

SEQ ID NO: 392473 - DNA, 25 bp, Mus musculus
ctgttgtttggaatagctcccacgg

SEQ ID NO: 392474 - DNA, 25 bp, Mus musculus
ctgttgtttggattagctcccacgg

SEQ ID NO: 392475 - DNA, 25 bp, Mus musculus
ctgttgtttgtgagtaatgcgatta

SEQ ID NO: 392476 - DNA, 25 bp, Mus musculus
ctgttgtttgtgtgtaatgcgatta

SEQ ID NO: 392477 - DNA, 25 bp, Mus musculus
ctgttgtttttcactgcgtcgtcat

SEQ ID NO: 392478 - DNA, 25 bp, Mus musculus
ctgttgtttttctctgcgtcgtcat

SEQ ID NO: 392479 - DNA, 25 bp, Mus musculus
ctgtttaaaggcattctcttgggca

SEQ ID NO: 392480 - DNA, 25 bp, Mus musculus
ctgtttaaaggctttctcttgggca

SEQ ID NO: 392481 - DNA, 25 bp, Mus musculus
ctgtttaactgtcaggtgaccaacc

SEQ ID NO: 392482 - DNA, 25 bp, Mus musculus
ctgtttaactgtgaggtgaccaacc

SEQ ID NO: 392483 - DNA, 25 bp, Mus musculus
ctgtttacaacactaagcactcgga

SEQ ID NO: 392484 - DNA, 25 bp, Mus musculus
ctgtttacaacagtaagcactcgga

SEQ ID NO: 392485 - DNA, 25 bp, Mus musculus
ctgtttacacggatatgaggttctc

SEQ ID NO: 392486 - DNA, 25 bp, Mus musculus
ctgtttacacggttatgaggttctc

SEQ ID NO: 392487 - DNA, 25 bp, Mus musculus
ctgtttacatatagaggcgttcctc

SEQ ID NO: 392488 - DNA, 25 bp, Mus musculus
ctgtttacatattgaggcgttcctc

SEQ ID NO: 392489 - DNA, 25 bp, Mus musculus
ctgtttaccaacctatgtgtgcatt

SEQ ID NO: 392490 - DNA, 25 bp, Mus musculus
ctgtttaccaacgtatgtgtgcatt

SEQ ID NO: 392491 - DNA, 25 bp, Mus musculus
ctgtttaccacaccagcagtatgtt

SEQ ID NO: 392492 - DNA, 25 bp, Mus musculus
ctgtttaccacagcagcagtatgtt

SEQ ID NO: 392493 - DNA, 25 bp, Mus musculus
ctgtttactagactggtggctggct

SEQ ID NO: 392494 - DNA, 25 bp, Mus musculus
ctgtttactagagtggtggctggct

SEQ ID NO: 392495 - DNA, 25 bp, Mus musculus
ctgtttacttgaaaaggctctcttg

SEQ ID NO: 392496 - DNA, 25 bp, Mus musculus
ctgtttacttgataaggctctcttg

SEQ ID NO: 392497 - DNA, 25 bp, Mus musculus
ctgtttagaagacccactagcctgt

SEQ ID NO: 392498 - DNA, 25 bp, Mus musculus
ctgtttagaagagccactagcctgt

SEQ ID NO: 392499 - DNA, 25 bp, Mus musculus
ctgtttagctaaccaaattgtcctt

SEQ ID NO: 392500 - DNA, 25 bp, Mus musculus
ctgtttagctaagcaaattgtcctt

SEQ ID NO: 392501 - DNA, 25 bp, Mus musculus
ctgtttagctgcctgggagctagaa

SEQ ID NO: 392502 - DNA, 25 bp, Mus musculus
ctgtttagctgcgtgggagctagaa

SEQ ID NO: 392503 - DNA, 25 bp, Mus musculus
ctgtttaggcccaagaaggaagctt

SEQ ID NO: 392504 - DNA, 25 bp, Mus musculus
ctgtttaggccctagaaggaagctt

SEQ ID NO: 392505 - DNA, 25 bp, Mus musculus
ctgtttaggtctagtcttccttctc

SEQ ID NO: 392506 - DNA, 25 bp, Mus musculus
ctgtttaggtcttgtcttccttctc

SEQ ID NO: 392507 - DNA, 25 bp, Mus musculus
ctgtttatacacatcgggactgata

SEQ ID NO: 392508 - DNA, 25 bp, Mus musculus
ctgtttatacacttcgggactgata

SEQ ID NO: 392509 - DNA, 25 bp, Mus musculus
ctgtttatacgtctgttgtcttgca

SEQ ID NO: 392510 - DNA, 25 bp, Mus musculus
ctgtttatacgtgtgttgtcttgca

SEQ ID NO: 392511 - DNA, 25 bp, Mus musculus
ctgtttatcacaagtaggccaggtg

SEQ ID NO: 392512 - DNA, 25 bp, Mus musculus
ctgtttatcacatgtaggccaggtg

SEQ ID NO: 392513 - DNA, 25 bp, Mus musculus
ctgtttatctgtctgtaggactgta

SEQ ID NO: 392514 - DNA, 25 bp, Mus musculus
ctgtttatctgtgtgtaggactgta

SEQ ID NO: 392515 - DNA, 25 bp, Mus musculus
ctgtttattggcatactctgttatt

SEQ ID NO: 392516 - DNA, 25 bp, Mus musculus
ctgtttattggcttactctgttatt

SEQ ID NO: 392517 - DNA, 25 bp, Mus musculus
ctgtttcacattcttttcctcactg

SEQ ID NO: 392518 - DNA, 25 bp, Mus musculus
ctgtttcacattgttttcctcactg

SEQ ID NO: 392519 - DNA, 25 bp, Mus musculus
ctgtttcactcccaagtagcttgaa

SEQ ID NO: 392520 - DNA, 25 bp, Mus musculus
ctgtttcactccgaagtagcttgaa

SEQ ID NO: 392521 - DNA, 25 bp, Mus musculus
ctgtttcactggctgttttagcttt

SEQ ID NO: 392522 - DNA, 25 bp, Mus musculus
ctgtttcactgggtgttttagcttt

SEQ ID NO: 392523 - DNA, 25 bp, Mus musculus
ctgtttcagcatcaagcaagtggct

SEQ ID NO: 392524 - DNA, 25 bp, Mus musculus
ctgtttcagcatgaagcaagtggct

SEQ ID NO: 392525 - DNA, 25 bp, Mus musculus
ctgtttcagtggctttctgctagaa

SEQ ID NO: 392526 - DNA, 25 bp, Mus musculus
ctgtttcagtgggtttctgctagaa

SEQ ID NO: 392527 - DNA, 25 bp, Mus musculus
ctgtttcatgggacttgttggcact

SEQ ID NO: 392528 - DNA, 25 bp, Mus musculus
ctgtttcatgggtcttgttggcact

SEQ ID NO: 392529 - DNA, 25 bp, Mus musculus
ctgtttcatgtcagtggctttgctc

SEQ ID NO: 392530 - DNA, 25 bp, Mus musculus
ctgtttcatgtctgtggctttgctc

SEQ ID NO: 392531 - DNA, 25 bp, Mus musculus
ctgtttcattctccctgcagatggc

SEQ ID NO: 392532 - DNA, 25 bp, Mus musculus
ctgtttcattctgcctgcagatggc

SEQ ID NO: 392533 - DNA, 25 bp, Mus musculus
ctgtttcccacacctgggtcagctg

SEQ ID NO: 392534 - DNA, 25 bp, Mus musculus
ctgtttcccacagctgggtcagctg

SEQ ID NO: 392535 - DNA, 25 bp, Mus musculus
ctgtttcccagcatccgttcaatac

SEQ ID NO: 392536 - DNA, 25 bp, Mus musculus
ctgtttcccagcttccgttcaatac

SEQ ID NO: 392537 - DNA, 25 bp, Mus musculus
ctgtttcccatgatccaactgtgta

SEQ ID NO: 392538 - DNA, 25 bp, Mus musculus
ctgtttcccatgttccaactgtgta

SEQ ID NO: 392539 - DNA, 25 bp, Mus musculus
ctgtttcccctcaaggctgagttca

SEQ ID NO: 392540 - DNA, 25 bp, Mus musculus
ctgtttcccctcactgattgaatat

SEQ ID NO: 392541 - DNA, 25 bp, Mus musculus
ctgtttcccctctaggctgagttca

SEQ ID NO: 392542 - DNA, 25 bp, Mus musculus
ctgtttcccctctctgattgaatat

SEQ ID NO: 392543 - DNA, 25 bp, Mus musculus
ctgtttccctccagtaagatgatgt

SEQ ID NO: 392544 - DNA, 25 bp, Mus musculus
ctgtttccctcctgtaagatgatgt

SEQ ID NO: 392545 - DNA, 25 bp, Mus musculus
ctgtttccctgcatgtcacttaaag

SEQ ID NO: 392546 - DNA, 25 bp, Mus musculus
ctgtttccctgcttgtcacttaaag

SEQ ID NO: 392547 - DNA, 25 bp, Mus musculus
ctgtttcccttccttgattatgagg

SEQ ID NO: 392548 - DNA, 25 bp, Mus musculus
ctgtttcccttcgttgattatgagg

SEQ ID NO: 392549 - DNA, 25 bp, Mus musculus
ctgtttcccttgagaggcgttcaaa

SEQ ID NO: 392550 - DNA, 25 bp, Mus musculus
ctgtttcccttgtgaggcgttcaaa

SEQ ID NO: 392551 - DNA, 25 bp, Mus musculus
ctgtttcctaatcatgggacagaca

SEQ ID NO: 392552 - DNA, 25 bp, Mus musculus
ctgtttcctaatgatgggacagaca

SEQ ID NO: 392553 - DNA, 25 bp, Mus musculus
ctgtttcctctacctatagctagga

SEQ ID NO: 392554 - DNA, 25 bp, Mus musculus
ctgtttcctctagctatagctagga

SEQ ID NO: 392555 - DNA, 25 bp, Mus musculus
ctgtttcctgacaggttttcagaat

SEQ ID NO: 392556 - DNA, 25 bp, Mus musculus
ctgtttcctgactggttttcagaat

SEQ ID NO: 392557 - DNA, 25 bp, Mus musculus
ctgtttcctggaaatctgttggtct

SEQ ID NO: 392558 - DNA, 25 bp, Mus musculus
ctgtttcctggaatgagcatttctt

SEQ ID NO: 392559 - DNA, 25 bp, Mus musculus
ctgtttcctggatatctgttggtct

SEQ ID NO: 392560 - DNA, 25 bp, Mus musculus
ctgtttcctggattgagcatttctt

SEQ ID NO: 392561 - DNA, 25 bp, Mus musculus
ctgtttcctgtcaacctgtgtgttc

SEQ ID NO: 392562 - DNA, 25 bp, Mus musculus
ctgtttcctgtctacctgtgtgttc

SEQ ID NO: 392563 - DNA, 25 bp, Mus musculus
ctgtttccttcccaaaaggctgtat

SEQ ID NO: 392564 - DNA, 25 bp, Mus musculus
ctgtttccttccgaaaaggctgtat

SEQ ID NO: 392565 - DNA, 25 bp, Mus musculus
ctgtttcgatgcctagctgctgtta

SEQ ID NO: 392566 - DNA, 25 bp, Mus musculus
ctgtttcgatgcgtagctgctgtta

SEQ ID NO: 392567 - DNA, 25 bp, Mus musculus
ctgtttcgtagtcttgtatatgtgc

SEQ ID NO: 392568 - DNA, 25 bp, Mus musculus
ctgtttcgtagtgttgtatatgtgc

SEQ ID NO: 392569 - DNA, 25 bp, Mus musculus
ctgtttcgtggcctgctatgcaaat

SEQ ID NO: 392570 - DNA, 25 bp, Mus musculus
ctgtttcgtggcgtgctatgcaaat

SEQ ID NO: 392571 - DNA, 25 bp, Mus musculus
ctgtttctaataagactttccagaa

SEQ ID NO: 392572 - DNA, 25 bp, Mus musculus
ctgtttctaatatgactttccagaa

SEQ ID NO: 392573 - DNA, 25 bp, Mus musculus
ctgtttctacataggaggctgctgc

SEQ ID NO: 392574 - DNA, 25 bp, Mus musculus
ctgtttctacattggaggctgctgc

SEQ ID NO: 392575 - DNA, 25 bp, Mus musculus
ctgtttctacctaagtgacagaatg

SEQ ID NO: 392576 - DNA, 25 bp, Mus musculus
ctgtttctaccttagtgacagaatg

SEQ ID NO: 392577 - DNA, 25 bp, Mus musculus
ctgtttctagagagagtcccaatta

SEQ ID NO: 392578 - DNA, 25 bp, Mus musculus
ctgtttctagagtgagtcccaatta

SEQ ID NO: 392579 - DNA, 25 bp, Mus musculus
ctgtttctagttaaggtgtgcgttc

SEQ ID NO: 392580 - DNA, 25 bp, Mus musculus
ctgtttctagtttaggtgtgcgttc

SEQ ID NO: 392581 - DNA, 25 bp, Mus musculus
ctgtttctcgcaccaaatgttgtgt

SEQ ID NO: 392582 - DNA, 25 bp, Mus musculus
ctgtttctcgcagcaaatgttgtgt

SEQ ID NO: 392583 - DNA, 25 bp, Mus musculus
ctgtttctcgctctgcagggagagt

SEQ ID NO: 392584 - DNA, 25 bp, Mus musculus
ctgtttctcgctgtgcagggagagt

SEQ ID NO: 392585 - DNA, 25 bp, Mus musculus
ctgtttctcggtctaagtcatgtca

SEQ ID NO: 392586 - DNA, 25 bp, Mus musculus
ctgtttctcggtgtaagtcatgtca

SEQ ID NO: 392587 - DNA, 25 bp, Mus musculus
ctgtttctcgtaaccacttgggtgg

SEQ ID NO: 392588 - DNA, 25 bp, Mus musculus
ctgtttctcgtatccacttgggtgg

SEQ ID NO: 392589 - DNA, 25 bp, Mus musculus
ctgtttctctacaaatcctgggcaa

SEQ ID NO: 392590 - DNA, 25 bp, Mus musculus
ctgtttctctactaatcctgggcaa

SEQ ID NO: 392591 - DNA, 25 bp, Mus musculus
ctgtttctctcaaggtgactttgtg

SEQ ID NO: 392592 - DNA, 25 bp, Mus musculus
ctgtttctctcatggtgactttgtg

SEQ ID NO: 392593 - DNA, 25 bp, Mus musculus
ctgtttctgagtcggaccccagatt

SEQ ID NO: 392594 - DNA, 25 bp, Mus musculus
ctgtttctgagtgggaccccagatt

SEQ ID NO: 392595 - DNA, 25 bp, Mus musculus
ctgtttctggacatcttttcttcac

SEQ ID NO: 392596 - DNA, 25 bp, Mus musculus
ctgtttctggacttcttttcttcac

SEQ ID NO: 392597 - DNA, 25 bp, Mus musculus
ctgtttctgtttatagtagctgtcc

SEQ ID NO: 392598 - DNA, 25 bp, Mus musculus
ctgtttctgtttccctgattcaagt

SEQ ID NO: 392599 - DNA, 25 bp, Mus musculus
ctgtttctgtttgcctgattcaagt

SEQ ID NO: 392600 - DNA, 25 bp, Mus musculus
ctgtttctgtttttagtagctgtcc

SEQ ID NO: 392601 - DNA, 25 bp, Mus musculus
ctgtttcttactcattggagttaga

SEQ ID NO: 392602 - DNA, 25 bp, Mus musculus
ctgtttcttactgattggagttaga

SEQ ID NO: 392603 - DNA, 25 bp, Mus musculus
ctgtttcttcacaggtagcgtcatc

SEQ ID NO: 392604 - DNA, 25 bp, Mus musculus
ctgtttcttcactggtagcgtcatc

SEQ ID NO: 392605 - DNA, 25 bp, Mus musculus
ctgtttcttcctcagttgacatttc

SEQ ID NO: 392606 - DNA, 25 bp, Mus musculus
ctgtttcttcctgagttgacatttc

SEQ ID NO: 392607 - DNA, 25 bp, Mus musculus
ctgtttcttggaatgtgtctcttgc

SEQ ID NO: 392608 - DNA, 25 bp, Mus musculus
ctgtttcttggattgtgtctcttgc

SEQ ID NO: 392609 - DNA, 25 bp, Mus musculus
ctgtttcttttccttgtgcagatta

SEQ ID NO: 392610 - DNA, 25 bp, Mus musculus
ctgtttcttttcgttgtgcagatta

SEQ ID NO: 392611 - DNA, 25 bp, Mus musculus
ctgtttctttttcccagggagacaa

SEQ ID NO: 392612 - DNA, 25 bp, Mus musculus
ctgtttctttttgccagggagacaa

SEQ ID NO: 392613 - DNA, 25 bp, Mus musculus
ctgtttgaacagcaaataggtgctc

SEQ ID NO: 392614 - DNA, 25 bp, Mus musculus
ctgtttgaacaggaaataggtgctc

SEQ ID NO: 392615 - DNA, 25 bp, Mus musculus
ctgtttgaactgcataaatacccca

SEQ ID NO: 392616 - DNA, 25 bp, Mus musculus
ctgtttgaactggataaatacccca

SEQ ID NO: 392617 - DNA, 25 bp, Mus musculus
ctgtttgaagaacacttggctgtgg

SEQ ID NO: 392618 - DNA, 25 bp, Mus musculus
ctgtttgaagaagacttggctgtgg

SEQ ID NO: 392619 - DNA, 25 bp, Mus musculus
ctgtttgaataccagcaggctcagc

SEQ ID NO: 392620 - DNA, 25 bp, Mus musculus
ctgtttgaatacgagcaggctcagc

SEQ ID NO: 392621 - DNA, 25 bp, Mus musculus
ctgtttgacctcaggctttgagaca

SEQ ID NO: 392622 - DNA, 25 bp, Mus musculus
ctgtttgacctctggctttgagaca

SEQ ID NO: 392623 - DNA, 25 bp, Mus musculus
ctgtttgacctgatgaggaggatgt

SEQ ID NO: 392624 - DNA, 25 bp, Mus musculus
ctgtttgacctgttgaggaggatgt

SEQ ID NO: 392625 - DNA, 25 bp, Mus musculus
ctgtttgactttactcttcagttgg

SEQ ID NO: 392626 - DNA, 25 bp, Mus musculus
ctgtttgacttttctcttcagttgg

SEQ ID NO: 392627 - DNA, 25 bp, Mus musculus
ctgtttgaggacagtttcatgagct

SEQ ID NO: 392628 - DNA, 25 bp, Mus musculus
ctgtttgaggactgtttcatgagct

SEQ ID NO: 392629 - DNA, 25 bp, Mus musculus
ctgtttgcacgcaacctgaatgttg

SEQ ID NO: 392630 - DNA, 25 bp, Mus musculus
ctgtttgcacgctacctgaatgttg

SEQ ID NO: 392631 - DNA, 25 bp, Mus musculus
ctgtttgccagtcttttgtgtgaca

SEQ ID NO: 392632 - DNA, 25 bp, Mus musculus
ctgtttgccagtgttttgtgtgaca

SEQ ID NO: 392633 - DNA, 25 bp, Mus musculus
ctgtttgcccacaggtgttaccaaa

SEQ ID NO: 392634 - DNA, 25 bp, Mus musculus
ctgtttgcccactggtgttaccaaa

SEQ ID NO: 392635 - DNA, 25 bp, Mus musculus
ctgtttgcccctcaaagctttagaa

SEQ ID NO: 392636 - DNA, 25 bp, Mus musculus
ctgtttgcccctgaaagctttagaa

SEQ ID NO: 392637 - DNA, 25 bp, Mus musculus
ctgtttgcgctccagatttctataa

SEQ ID NO: 392638 - DNA, 25 bp, Mus musculus
ctgtttgcgctcgagatttctataa

SEQ ID NO: 392639 - DNA, 25 bp, Mus musculus
ctgtttgctagtccggacactgcgt

SEQ ID NO: 392640 - DNA, 25 bp, Mus musculus
ctgtttgctagtgcggacactgcgt

SEQ ID NO: 392641 - DNA, 25 bp, Mus musculus
ctgtttgctctaccatgtacttatg

SEQ ID NO: 392642 - DNA, 25 bp, Mus musculus
ctgtttgctctagcatgtacttatg

SEQ ID NO: 392643 - DNA, 25 bp, Mus musculus
ctgtttgcttaactgacctgggtca

SEQ ID NO: 392644 - DNA, 25 bp, Mus musculus
ctgtttgcttaagtgacctgggtca

SEQ ID NO: 392645 - DNA, 25 bp, Mus musculus
ctgtttgcttgcagagtggctttct

SEQ ID NO: 392646 - DNA, 25 bp, Mus musculus
ctgtttgcttgctgagtggctttct

SEQ ID NO: 392647 - DNA, 25 bp, Mus musculus
ctgtttgctttacatccgtggaaga

SEQ ID NO: 392648 - DNA, 25 bp, Mus musculus
ctgtttgctttagatccgtggaaga

SEQ ID NO: 392649 - DNA, 25 bp, Mus musculus
ctgtttggaaatcctgagacagcac

SEQ ID NO: 392650 - DNA, 25 bp, Mus musculus
ctgtttggaaatgctgagacagcac

SEQ ID NO: 392651 - DNA, 25 bp, Mus musculus
ctgtttggccctagtcctagtatta

SEQ ID NO: 392652 - DNA, 25 bp, Mus musculus
ctgtttggcccttgtcctagtatta

SEQ ID NO: 392653 - DNA, 25 bp, Mus musculus
ctgtttggcttcctgatgcagcaag

SEQ ID NO: 392654 - DNA, 25 bp, Mus musculus
ctgtttggcttcgtgatgcagcaag

SEQ ID NO: 392655 - DNA, 25 bp, Mus musculus
ctgtttggggacctatatggactat

SEQ ID NO: 392656 - DNA, 25 bp, Mus musculus
ctgtttggggacgtatatggactat

SEQ ID NO: 392657 - DNA, 25 bp, Mus musculus
ctgtttggtaccagccattggcgat

SEQ ID NO: 392658 - DNA, 25 bp, Mus musculus
ctgtttggtacctgccattggcgat

SEQ ID NO: 392659 - DNA, 25 bp, Mus musculus
ctgtttgtagggacgtgcacaccct

SEQ ID NO: 392660 - DNA, 25 bp, Mus musculus
ctgtttgtagggtcgtgcacaccct

SEQ ID NO: 392661 - DNA, 25 bp, Mus musculus
ctgtttgtagtgacctctctataat

SEQ ID NO: 392662 - DNA, 25 bp, Mus musculus
ctgtttgtagtgtcctctctataat

SEQ ID NO: 392663 - DNA, 25 bp, Mus musculus
ctgtttgtatggagggagctagctc

SEQ ID NO: 392664 - DNA, 25 bp, Mus musculus
ctgtttgtatggtgggagctagctc

SEQ ID NO: 392665 - DNA, 25 bp, Mus musculus
ctgtttgtcagtcacttagccctgt

SEQ ID NO: 392666 - DNA, 25 bp, Mus musculus
ctgtttgtcagtgacttagccctgt

SEQ ID NO: 392667 - DNA, 25 bp, Mus musculus
ctgtttgtcgttcgccttcatataa

SEQ ID NO: 392668 - DNA, 25 bp, Mus musculus
ctgtttgtcgttggccttcatataa

SEQ ID NO: 392669 - DNA, 25 bp, Mus musculus
ctgtttgtctggagcactttaaaac

SEQ ID NO: 392670 - DNA, 25 bp, Mus musculus
ctgtttgtctggtgcactttaaaac

SEQ ID NO: 392671 - DNA, 25 bp, Mus musculus
ctgtttgtcttgcagctccctatgt

SEQ ID NO: 392672 - DNA, 25 bp, Mus musculus
ctgtttgtcttggagctccctatgt

SEQ ID NO: 392673 - DNA, 25 bp, Mus musculus
ctgtttgtgctcatgctattgggaa

SEQ ID NO: 392674 - DNA, 25 bp, Mus musculus
ctgtttgtgctcttgctattgggaa

SEQ ID NO: 392675 - DNA, 25 bp, Mus musculus
ctgtttgtggccaacctttgagagg

SEQ ID NO: 392676 - DNA, 25 bp, Mus musculus
ctgtttgtggcctacctttgagagg

SEQ ID NO: 392677 - DNA, 25 bp, Mus musculus
ctgtttgtgtgacgccgtttcttgg

SEQ ID NO: 392678 - DNA, 25 bp, Mus musculus
ctgtttgtgtgaggccgtttcttgg

SEQ ID NO: 392679 - DNA, 25 bp, Mus musculus
ctgtttgtgtgtagcctgcagcctg

SEQ ID NO: 392680 - DNA, 25 bp, Mus musculus
ctgtttgtgtgttgcctgcagcctg

SEQ ID NO: 392681 - DNA, 25 bp, Mus musculus
ctgtttgtgttcagtaggtggcttt

SEQ ID NO: 392682 - DNA, 25 bp, Mus musculus
ctgtttgtgttctgtaggtggcttt

SEQ ID NO: 392683 - DNA, 25 bp, Mus musculus
ctgtttgttcagaatggccaggcaa

SEQ ID NO: 392684 - DNA, 25 bp, Mus musculus
ctgtttgttcagtatggccaggcaa

SEQ ID NO: 392685 - DNA, 25 bp, Mus musculus
ctgtttgttggtaagttcgcttgtt

SEQ ID NO: 392686 - DNA, 25 bp, Mus musculus
ctgtttgttggttagttcgcttgtt

SEQ ID NO: 392687 - DNA, 25 bp, Mus musculus
ctgtttgttgtgaaagcgggaatgc

SEQ ID NO: 392688 - DNA, 25 bp, Mus musculus
ctgtttgttgtgtaagcgggaatgc

SEQ ID NO: 392689 - DNA, 25 bp, Mus musculus
ctgtttgtttaaatccagtaggaca

SEQ ID NO: 392690 - DNA, 25 bp, Mus musculus
ctgtttgtttaattccagtaggaca

SEQ ID NO: 392691 - DNA, 25 bp, Mus musculus
ctgtttgtttgaattatgtgggttt

SEQ ID NO: 392692 - DNA, 25 bp, Mus musculus
ctgtttgtttgatttatgtgggttt

SEQ ID NO: 392693 - DNA, 25 bp, Mus musculus
ctgttttacaagacaagtccctcac

SEQ ID NO: 392694 - DNA, 25 bp, Mus musculus
ctgttttacaagtcaagtccctcac

SEQ ID NO: 392695 - DNA, 25 bp, Mus musculus
ctgttttacacacaccttccttaat

SEQ ID NO: 392696 - DNA, 25 bp, Mus musculus
ctgttttacacagaccttccttaat

SEQ ID NO: 392697 - DNA, 25 bp, Mus musculus
ctgttttatataactcttcccttct

SEQ ID NO: 392698 - DNA, 25 bp, Mus musculus
ctgttttatatatctcttcccttct

SEQ ID NO: 392699 - DNA, 25 bp, Mus musculus
ctgttttatcgccatcctcattggc

SEQ ID NO: 392700 - DNA, 25 bp, Mus musculus
ctgttttatcgcgatcctcattggc

SEQ ID NO: 392701 - DNA, 25 bp, Mus musculus
ctgttttcacaactaacttgtctct

SEQ ID NO: 392702 - DNA, 25 bp, Mus musculus
ctgttttcacaagtaacttgtctct

SEQ ID NO: 392703 - DNA, 25 bp, Mus musculus
ctgttttccaggcaatgtctttaaa

SEQ ID NO: 392704 - DNA, 25 bp, Mus musculus
ctgttttccagggaatgtctttaaa

SEQ ID NO: 392705 - DNA, 25 bp, Mus musculus
ctgttttcctccatcaaggacattc

SEQ ID NO: 392706 - DNA, 25 bp, Mus musculus
ctgttttcctcccagaaggctggga

SEQ ID NO: 392707 - DNA, 25 bp, Mus musculus
ctgttttcctccgagaaggctggga

SEQ ID NO: 392708 - DNA, 25 bp, Mus musculus
ctgttttcctccttcaaggacattc

SEQ ID NO: 392709 - DNA, 25 bp, Mus musculus
ctgttttctaagctgaatgatgcaa

SEQ ID NO: 392710 - DNA, 25 bp, Mus musculus
ctgttttctaaggtgaatgatgcaa

SEQ ID NO: 392711 - DNA, 25 bp, Mus musculus
ctgttttctcccatgtcaagtcaga

SEQ ID NO: 392712 - DNA, 25 bp, Mus musculus
ctgttttctcccttgtcaagtcaga

SEQ ID NO: 392713 - DNA, 25 bp, Mus musculus
ctgttttctcttagtcgtgtgctaa

SEQ ID NO: 392714 - DNA, 25 bp, Mus musculus
ctgttttctctttgtcgtgtgctaa

SEQ ID NO: 392715 - DNA, 25 bp, Mus musculus
ctgttttctggtcaacttccaagaa

SEQ ID NO: 392716 - DNA, 25 bp, Mus musculus
ctgttttctggtgaacttccaagaa

SEQ ID NO: 392717 - DNA, 25 bp, Mus musculus
ctgttttcttctcttaacctgaaag

SEQ ID NO: 392718 - DNA, 25 bp, Mus musculus
ctgttttcttctgttaacctgaaag

SEQ ID NO: 392719 - DNA, 25 bp, Mus musculus
ctgttttcttgcctgtggctgaaga

SEQ ID NO: 392720 - DNA, 25 bp, Mus musculus
ctgttttcttgcgtgtggctgaaga

SEQ ID NO: 392721 - DNA, 25 bp, Mus musculus
ctgttttctttcatggctttgccaa

SEQ ID NO: 392722 - DNA, 25 bp, Mus musculus
ctgttttctttcttggctttgccaa

SEQ ID NO: 392723 - DNA, 25 bp, Mus musculus
ctgttttgagtgactttctttgcag

SEQ ID NO: 392724 - DNA, 25 bp, Mus musculus
ctgttttgagtgtctttctttgcag

SEQ ID NO: 392725 - DNA, 25 bp, Mus musculus
ctgttttgcaatctttctttctctc

SEQ ID NO: 392726 - DNA, 25 bp, Mus musculus
ctgttttgcaatgtttctttctctc

SEQ ID NO: 392727 - DNA, 25 bp, Mus musculus
ctgttttgcagtactttgccagtat

SEQ ID NO: 392728 - DNA, 25 bp, Mus musculus
ctgttttgcagttctttgccagtat

SEQ ID NO: 392729 - DNA, 25 bp, Mus musculus
ctgttttgcccaaatccctagaaat

SEQ ID NO: 392730 - DNA, 25 bp, Mus musculus
ctgttttgcccatatccctagaaat

SEQ ID NO: 392731 - DNA, 25 bp, Mus musculus
ctgttttgccggctcagaaaaaatg

SEQ ID NO: 392732 - DNA, 25 bp, Mus musculus
ctgttttgccgggtcagaaaaaatg

SEQ ID NO: 392733 - DNA, 25 bp, Mus musculus
ctgttttgcttgaagcagtctggcc

SEQ ID NO: 392734 - DNA, 25 bp, Mus musculus
ctgttttgcttgtagcagtctggcc

SEQ ID NO: 392735 - DNA, 25 bp, Mus musculus
ctgttttggatgatgcgatagtgac

SEQ ID NO: 392736 - DNA, 25 bp, Mus musculus
ctgttttggatgttgcgatagtgac

SEQ ID NO: 392737 - DNA, 25 bp, Mus musculus
ctgttttgtaatctgtgcttgggtt

SEQ ID NO: 392738 - DNA, 25 bp, Mus musculus
ctgttttgtaatgtgtgcttgggtt

SEQ ID NO: 392739 - DNA, 25 bp, Mus musculus
ctgttttgtactcataactttggga

SEQ ID NO: 392740 - DNA, 25 bp, Mus musculus
ctgttttgtactgataactttggga

SEQ ID NO: 392741 - DNA, 25 bp, Mus musculus
ctgttttgtctgacttttgttaccg

SEQ ID NO: 392742 - DNA, 25 bp, Mus musculus
ctgttttgtctgtcttttgttaccg

SEQ ID NO: 392743 - DNA, 25 bp, Mus musculus
ctgttttgttatccctatctctatt

SEQ ID NO: 392744 - DNA, 25 bp, Mus musculus
ctgttttgttatgcctatctctatt

SEQ ID NO: 392745 - DNA, 25 bp, Mus musculus
ctgtttttaactatgcagcctggga

SEQ ID NO: 392746 - DNA, 25 bp, Mus musculus
ctgtttttaactttgcagcctggga

SEQ ID NO: 392747 - DNA, 25 bp, Mus musculus
ctgtttttccacatcatggtcagaa

SEQ ID NO: 392748 - DNA, 25 bp, Mus musculus
ctgtttttccacttcatggtcagaa

SEQ ID NO: 392749 - DNA, 25 bp, Mus musculus
ctgtttttcgctcttattccagaga

SEQ ID NO: 392750 - DNA, 25 bp, Mus musculus
ctgtttttcgctgttattccagaga

SEQ ID NO: 392751 - DNA, 25 bp, Mus musculus
ctgtttttcgttcccatggcagtca

SEQ ID NO: 392752 - DNA, 25 bp, Mus musculus
ctgtttttcgttgccatggcagtca

SEQ ID NO: 392753 - DNA, 25 bp, Mus musculus
ctgtttttctatcagtacctgttat

SEQ ID NO: 392754 - DNA, 25 bp, Mus musculus
ctgtttttctatgagtacctgttat

SEQ ID NO: 392755 - DNA, 25 bp, Mus musculus
ctgtttttctgtctgaattcaagcc

SEQ ID NO: 392756 - DNA, 25 bp, Mus musculus
ctgtttttctgtgtgaattcaagcc

SEQ ID NO: 392757 - DNA, 25 bp, Mus musculus
ctgtttttgcatatggtcagaggat

SEQ ID NO: 392758 - DNA, 25 bp, Mus musculus
ctgtttttgcatttggtcagaggat

SEQ ID NO: 392759 - DNA, 25 bp, Mus musculus
ctgtttttgccccaggctgtttagc

SEQ ID NO: 392760 - DNA, 25 bp, Mus musculus
ctgtttttgcccgaggctgtttagc

SEQ ID NO: 392761 - DNA, 25 bp, Mus musculus
ctgtttttgtgaccccgagcagtgg

SEQ ID NO: 392762 - DNA, 25 bp, Mus musculus
ctgtttttgtgagcccgagcagtgg

SEQ ID NO: 392763 - DNA, 25 bp, Mus musculus
ctgtttttgtttctcgtcaagcatg

SEQ ID NO: 392764 - DNA, 25 bp, Mus musculus
ctgtttttgtttgtcgtcaagcatg

SEQ ID NO: 392765 - DNA, 25 bp, Mus musculus
ctgttttttccaagaatagactcat

SEQ ID NO: 392766 - DNA, 25 bp, Mus musculus
ctgttttttccatgaatagactcat

SEQ ID NO: 392767 - DNA, 25 bp, Mus musculus
cttaaaaatgtgatgctgttgttgt

SEQ ID NO: 392768 - DNA, 25 bp, Mus musculus
cttaaaaatgtgttgctgttgttgt

SEQ ID NO: 392769 - DNA, 25 bp, Mus musculus
cttaaaagactgaaaacctgatatt

SEQ ID NO: 392770 - DNA, 25 bp, Mus musculus
cttaaaagactgtaaacctgatatt

SEQ ID NO: 392771 - DNA, 25 bp, Mus musculus
cttaaaagatttcctccaaagagca

SEQ ID NO: 392772 - DNA, 25 bp, Mus musculus
cttaaaagatttgctccaaagagca

SEQ ID NO: 392773 - DNA, 25 bp, Mus musculus
cttaaaagtgttagagcctaccatt

SEQ ID NO: 392774 - DNA, 25 bp, Mus musculus
cttaaaagtgtttgagcctaccatt

SEQ ID NO: 392775 - DNA, 25 bp, Mus musculus
cttaaaatccttctcatactcatat

SEQ ID NO: 392776 - DNA, 25 bp, Mus musculus
cttaaaatccttgtcatactcatat

SEQ ID NO: 392777 - DNA, 25 bp, Mus musculus
cttaaaatgatccttgcccagcggt

SEQ ID NO: 392778 - DNA, 25 bp, Mus musculus
cttaaaatgatcgttgcccagcggt

SEQ ID NO: 392779 - DNA, 25 bp, Mus musculus
cttaaacaacacagctgcttttatg

SEQ ID NO: 392780 - DNA, 25 bp, Mus musculus
cttaaacaacactgctgcttttatg

SEQ ID NO: 392781 - DNA, 25 bp, Mus musculus
cttaaacagcttaacgtatgggtgc

SEQ ID NO: 392782 - DNA, 25 bp, Mus musculus
cttaaacagctttacgtatgggtgc

SEQ ID NO: 392783 - DNA, 25 bp, Mus musculus
cttaaacatccaccgcagtactttg

SEQ ID NO: 392784 - DNA, 25 bp, Mus musculus
cttaaacatccagcgcagtactttg

SEQ ID NO: 392785 - DNA, 25 bp, Mus musculus
cttaaactgcttagacactcttctt

SEQ ID NO: 392786 - DNA, 25 bp, Mus musculus
cttaaactgctttgacactcttctt

SEQ ID NO: 392787 - DNA, 25 bp, Mus musculus
cttaaagcccctcacgaatacataa

SEQ ID NO: 392788 - DNA, 25 bp, Mus musculus
cttaaagcccctgacgaatacataa

SEQ ID NO: 392789 - DNA, 25 bp, Mus musculus
cttaaagcgatcaccagcctggatt

SEQ ID NO: 392790 - DNA, 25 bp, Mus musculus
cttaaagcgatctccagcctggatt

SEQ ID NO: 392791 - DNA, 25 bp, Mus musculus
cttaaagctaagattttgactgtgc

SEQ ID NO: 392792 - DNA, 25 bp, Mus musculus
cttaaagctaagtttttgactgtgc

SEQ ID NO: 392793 - DNA, 25 bp, Mus musculus
cttaaagctgttatcagtgcccttt

SEQ ID NO: 392794 - DNA, 25 bp, Mus musculus
cttaaagctgttttcagtgcccttt

SEQ ID NO: 392795 - DNA, 25 bp, Mus musculus
cttaaagcttttcctctgtgttctc

SEQ ID NO: 392796 - DNA, 25 bp, Mus musculus
cttaaagcttttgctctgtgttctc

SEQ ID NO: 392797 - DNA, 25 bp, Mus musculus
cttaaaggacacatctgtccattgg

SEQ ID NO: 392798 - DNA, 25 bp, Mus musculus
cttaaaggacacttctgtccattgg

SEQ ID NO: 392799 - DNA, 25 bp, Mus musculus
cttaaagtctccagtgttgcaacca

SEQ ID NO: 392800 - DNA, 25 bp, Mus musculus
cttaaagtctcctgtgttgcaacca

SEQ ID NO: 392801 - DNA, 25 bp, Mus musculus
cttaaagtctggatcctgttctcac

SEQ ID NO: 392802 - DNA, 25 bp, Mus musculus
cttaaagtctggttcctgttctcac

SEQ ID NO: 392803 - DNA, 25 bp, Mus musculus
cttaaagttgttaaccactgtggtg

SEQ ID NO: 392804 - DNA, 25 bp, Mus musculus
cttaaagttgtttaccactgtggtg

SEQ ID NO: 392805 - DNA, 25 bp, Mus musculus
cttaaatactgacctttctctccgc

SEQ ID NO: 392806 - DNA, 25 bp, Mus musculus
cttaaatactgagctttctctccgc

SEQ ID NO: 392807 - DNA, 25 bp, Mus musculus
cttaaatataataccgtggtcctga

SEQ ID NO: 392808 - DNA, 25 bp, Mus musculus
cttaaatataattccgtggtcctga

SEQ ID NO: 392809 - DNA, 25 bp, Mus musculus
cttaaatcccaaaggcacagcagtg

SEQ ID NO: 392810 - DNA, 25 bp, Mus musculus
cttaaatcccaatggcacagcagtg

SEQ ID NO: 392811 - DNA, 25 bp, Mus musculus
cttaaatgctgacctgtcgttccag

SEQ ID NO: 392812 - DNA, 25 bp, Mus musculus
cttaaatgctgagctgtcgttccag

SEQ ID NO: 392813 - DNA, 25 bp, Mus musculus
cttaaatggaacctctgctgctggg

SEQ ID NO: 392814 - DNA, 25 bp, Mus musculus
cttaaatggaacgtctgctgctggg

SEQ ID NO: 392815 - DNA, 25 bp, Mus musculus
cttaaatgtcagaggattcttgccc

SEQ ID NO: 392816 - DNA, 25 bp, Mus musculus
cttaaatgtcagtggattcttgccc

SEQ ID NO: 392817 - DNA, 25 bp, Mus musculus
cttaaatgtgagagcttagaactgt

SEQ ID NO: 392818 - DNA, 25 bp, Mus musculus
cttaaatgtgagtgcttagaactgt

SEQ ID NO: 392819 - DNA, 25 bp, Mus musculus
cttaaattctttccactggatctca

SEQ ID NO: 392820 - DNA, 25 bp, Mus musculus
cttaaattctttgcactggatctca

SEQ ID NO: 392821 - DNA, 25 bp, Mus musculus
cttaaattgattaccacagaccagg

SEQ ID NO: 392822 - DNA, 25 bp, Mus musculus
cttaaattgatttccacagaccagg

SEQ ID NO: 392823 - DNA, 25 bp, Mus musculus
cttaacaaagcactcagggcctgtc

SEQ ID NO: 392824 - DNA, 25 bp, Mus musculus
cttaacaaagcagtcagggcctgtc

SEQ ID NO: 392825 - DNA, 25 bp, Mus musculus
cttaacaaccaaagagccagagaga

SEQ ID NO: 392826 - DNA, 25 bp, Mus musculus
cttaacaaccaatgagccagagaga

SEQ ID NO: 392827 - DNA, 25 bp, Mus musculus
cttaacaacttcactacctttatag

SEQ ID NO: 392828 - DNA, 25 bp, Mus musculus
cttaacaacttctctacctttatag

SEQ ID NO: 392829 - DNA, 25 bp, Mus musculus
cttaacacacacatagccttgctat

SEQ ID NO: 392830 - DNA, 25 bp, Mus musculus
cttaacacacacttagccttgctat

SEQ ID NO: 392831 - DNA, 25 bp, Mus musculus
cttaacagactacagagcatcagct

SEQ ID NO: 392832 - DNA, 25 bp, Mus musculus
cttaacagactagagagcatcagct

SEQ ID NO: 392833 - DNA, 25 bp, Mus musculus
cttaacagagccacatttctagccc

SEQ ID NO: 392834 - DNA, 25 bp, Mus musculus
cttaacagagcctcatttctagccc

SEQ ID NO: 392835 - DNA, 25 bp, Mus musculus
cttaacagagtaccgctgagtcctc

SEQ ID NO: 392836 - DNA, 25 bp, Mus musculus
cttaacagagtagcgctgagtcctc

SEQ ID NO: 392837 - DNA, 25 bp, Mus musculus
cttaacaggtgaacccacgcgtggg

SEQ ID NO: 392838 - DNA, 25 bp, Mus musculus
cttaacaggtgatcccacgcgtggg

SEQ ID NO: 392839 - DNA, 25 bp, Mus musculus
cttaacatagttaccacttgaagtg

SEQ ID NO: 392840 - DNA, 25 bp, Mus musculus
cttaacatagtttccacttgaagtg

SEQ ID NO: 392841 - DNA, 25 bp, Mus musculus
cttaacatctctcacagctcctcat

SEQ ID NO: 392842 - DNA, 25 bp, Mus musculus
cttaacatctctgacagctcctcat

SEQ ID NO: 392843 - DNA, 25 bp, Mus musculus
cttaacatttgacccatttctccac

SEQ ID NO: 392844 - DNA, 25 bp, Mus musculus
cttaacatttgagccatttctccac

SEQ ID NO: 392845 - DNA, 25 bp, Mus musculus
cttaaccaagatcggctgggctcca

SEQ ID NO: 392846 - DNA, 25 bp, Mus musculus
cttaaccaagatgggctgggctcca

SEQ ID NO: 392847 - DNA, 25 bp, Mus musculus
cttaaccagaggaggccctggattt

SEQ ID NO: 392848 - DNA, 25 bp, Mus musculus
cttaaccagaggtggccctggattt

SEQ ID NO: 392849 - DNA, 25 bp, Mus musculus
cttaaccatcagacctacagacgag

SEQ ID NO: 392850 - DNA, 25 bp, Mus musculus
cttaaccatcagtcctacagacgag

SEQ ID NO: 392851 - DNA, 25 bp, Mus musculus
cttaaccatgtgacttggaggagca

SEQ ID NO: 392852 - DNA, 25 bp, Mus musculus
cttaaccatgtgtcttggaggagca

SEQ ID NO: 392853 - DNA, 25 bp, Mus musculus
cttaaccccacactagctgtggtgt

SEQ ID NO: 392854 - DNA, 25 bp, Mus musculus
cttaaccccacagtagctgtggtgt

SEQ ID NO: 392855 - DNA, 25 bp, Mus musculus
cttaaccccttacctgagaatgaag

SEQ ID NO: 392856 - DNA, 25 bp, Mus musculus
cttaaccccttagctgagaatgaag

SEQ ID NO: 392857 - DNA, 25 bp, Mus musculus
cttaacctatctcacaaatcaccaa

SEQ ID NO: 392858 - DNA, 25 bp, Mus musculus
cttaacctatctgacaaatcaccaa

SEQ ID NO: 392859 - DNA, 25 bp, Mus musculus
cttaacgaaggcagatggaaaccca

SEQ ID NO: 392860 - DNA, 25 bp, Mus musculus
cttaacgaaggctgatggaaaccca

SEQ ID NO: 392861 - DNA, 25 bp, Mus musculus
cttaacgttcgcattctgtcacaga

SEQ ID NO: 392862 - DNA, 25 bp, Mus musculus
cttaacgttcgctttctgtcacaga

SEQ ID NO: 392863 - DNA, 25 bp, Mus musculus
cttaactcactgaatctcacaccaa

SEQ ID NO: 392864 - DNA, 25 bp, Mus musculus
cttaactcactgtatctcacaccaa

SEQ ID NO: 392865 - DNA, 25 bp, Mus musculus
cttaactccgccatgtggttggtgg

SEQ ID NO: 392866 - DNA, 25 bp, Mus musculus
cttaactccgccttgtggttggtgg

SEQ ID NO: 392867 - DNA, 25 bp, Mus musculus
cttaactgtgtgcaacatgctggcc

SEQ ID NO: 392868 - DNA, 25 bp, Mus musculus
cttaactgtgtggaacatgctggcc

SEQ ID NO: 392869 - DNA, 25 bp, Mus musculus
cttaacttaagccagccacgtcagg

SEQ ID NO: 392870 - DNA, 25 bp, Mus musculus
cttaacttaagcgagccacgtcagg

SEQ ID NO: 392871 - DNA, 25 bp, Mus musculus
cttaagaactacaaaccttgctggg

SEQ ID NO: 392872 - DNA, 25 bp, Mus musculus
cttaagaactactaaccttgctggg

SEQ ID NO: 392873 - DNA, 25 bp, Mus musculus
cttaagactgagctaaatacacatt

SEQ ID NO: 392874 - DNA, 25 bp, Mus musculus
cttaagactgaggtaaatacacatt

SEQ ID NO: 392875 - DNA, 25 bp, Mus musculus
cttaagacttatctggattcctgct

SEQ ID NO: 392876 - DNA, 25 bp, Mus musculus
cttaagacttatgtggattcctgct

SEQ ID NO: 392877 - DNA, 25 bp, Mus musculus
cttaagacttgaatatttgttatac

SEQ ID NO: 392878 - DNA, 25 bp, Mus musculus
cttaagacttgattatttgttatac

SEQ ID NO: 392879 - DNA, 25 bp, Mus musculus
cttaagagccagatccagcgcggaa

SEQ ID NO: 392880 - DNA, 25 bp, Mus musculus
cttaagagccagttccagcgcggaa

SEQ ID NO: 392881 - DNA, 25 bp, Mus musculus
cttaagagtttgcaagtcttcagag

SEQ ID NO: 392882 - DNA, 25 bp, Mus musculus
cttaagagtttggaagtcttcagag

SEQ ID NO: 392883 - DNA, 25 bp, Mus musculus
cttaagatagctccatataccctgc

SEQ ID NO: 392884 - DNA, 25 bp, Mus musculus
cttaagatagctgcatataccctgc

SEQ ID NO: 392885 - DNA, 25 bp, Mus musculus
cttaagatgtagctgattcccctca

SEQ ID NO: 392886 - DNA, 25 bp, Mus musculus
cttaagatgtaggtgattcccctca

SEQ ID NO: 392887 - DNA, 25 bp, Mus musculus
cttaagcagcccctttgacctgtca

SEQ ID NO: 392888 - DNA, 25 bp, Mus musculus
cttaagcagcccgtttgacctgtca

SEQ ID NO: 392889 - DNA, 25 bp, Mus musculus
cttaagcatcttactccgtgagtga

SEQ ID NO: 392890 - DNA, 25 bp, Mus musculus
cttaagcatctttctccgtgagtga

SEQ ID NO: 392891 - DNA, 25 bp, Mus musculus
cttaagcatgttcgagtacaggaat

SEQ ID NO: 392892 - DNA, 25 bp, Mus musculus
cttaagcatgttggagtacaggaat

SEQ ID NO: 392893 - DNA, 25 bp, Mus musculus
cttaagccaagtctagcacatgcat

SEQ ID NO: 392894 - DNA, 25 bp, Mus musculus
cttaagccaagtgtagcacatgcat

SEQ ID NO: 392895 - DNA, 25 bp, Mus musculus
cttaagcccatgctgttcatggaat

SEQ ID NO: 392896 - DNA, 25 bp, Mus musculus
cttaagcccatggtgttcatggaat

SEQ ID NO: 392897 - DNA, 25 bp, Mus musculus
cttaagctctagcactgtggattct

SEQ ID NO: 392898 - DNA, 25 bp, Mus musculus
cttaagctctaggactgtggattct

SEQ ID NO: 392899 - DNA, 25 bp, Mus musculus
cttaagcttaacactgcaaccattt

SEQ ID NO: 392900 - DNA, 25 bp, Mus musculus
cttaagcttaactctgcaaccattt

SEQ ID NO: 392901 - DNA, 25 bp, Mus musculus
cttaaggaaaagctcggcaggcatc

SEQ ID NO: 392902 - DNA, 25 bp, Mus musculus
cttaaggaaaaggtcggcaggcatc

SEQ ID NO: 392903 - DNA, 25 bp, Mus musculus
cttaaggacccactgtggttctctt

SEQ ID NO: 392904 - DNA, 25 bp, Mus musculus
cttaaggacccagtgtggttctctt

SEQ ID NO: 392905 - DNA, 25 bp, Mus musculus
cttaaggatctaaactaccaggcag

SEQ ID NO: 392906 - DNA, 25 bp, Mus musculus
cttaaggatctatactaccaggcag

SEQ ID NO: 392907 - DNA, 25 bp, Mus musculus
cttaaggatgcaactaaggataagc

SEQ ID NO: 392908 - DNA, 25 bp, Mus musculus
cttaaggatgcatctaaggataagc

SEQ ID NO: 392909 - DNA, 25 bp, Mus musculus
cttaaggattaaccccagtgacttg

SEQ ID NO: 392910 - DNA, 25 bp, Mus musculus
cttaaggattaagcccagtgacttg

SEQ ID NO: 392911 - DNA, 25 bp, Mus musculus
cttaaggccggtcactgacagagaa

SEQ ID NO: 392912 - DNA, 25 bp, Mus musculus
cttaaggccggtgactgacagagaa

SEQ ID NO: 392913 - DNA, 25 bp, Mus musculus
cttaagggaaccagggaacaagctg

SEQ ID NO: 392914 - DNA, 25 bp, Mus musculus
cttaagggaacctgggaacaagctg

SEQ ID NO: 392915 - DNA, 25 bp, Mus musculus
cttaaggttctgatccaagctttga

SEQ ID NO: 392916 - DNA, 25 bp, Mus musculus
cttaaggttctgttccaagctttga

SEQ ID NO: 392917 - DNA, 25 bp, Mus musculus
cttaagtaaagaatgctgatgccta

SEQ ID NO: 392918 - DNA, 25 bp, Mus musculus
cttaagtaaagattgctgatgccta

SEQ ID NO: 392919 - DNA, 25 bp, Mus musculus
cttaagtaacctactgtggaatatt

SEQ ID NO: 392920 - DNA, 25 bp, Mus musculus
cttaagtaaccttctgtggaatatt

SEQ ID NO: 392921 - DNA, 25 bp, Mus musculus
cttaagtaggagactccatccagtc

SEQ ID NO: 392922 - DNA, 25 bp, Mus musculus
cttaagtaggagtctccatccagtc

SEQ ID NO: 392923 - DNA, 25 bp, Mus musculus
cttaagtcctttcgtctggtatgag

SEQ ID NO: 392924 - DNA, 25 bp, Mus musculus
cttaagtcctttggtctggtatgag

SEQ ID NO: 392925 - DNA, 25 bp, Mus musculus
cttaagttgggcagctttcctcaac

SEQ ID NO: 392926 - DNA, 25 bp, Mus musculus
cttaagttgggctgctttcctcaac

SEQ ID NO: 392927 - DNA, 25 bp, Mus musculus
cttaagttgggtccacactgaccat

SEQ ID NO: 392928 - DNA, 25 bp, Mus musculus
cttaagttgggtgcacactgaccat

SEQ ID NO: 392929 - DNA, 25 bp, Mus musculus
cttaagttttccatgatgtctcaaa

SEQ ID NO: 392930 - DNA, 25 bp, Mus musculus
cttaagttttccttgatgtctcaaa

SEQ ID NO: 392931 - DNA, 25 bp, Mus musculus
cttaataagcaacgtgacactgcat

SEQ ID NO: 392932 - DNA, 25 bp, Mus musculus
cttaataagcaaggtgacactgcat

SEQ ID NO: 392933 - DNA, 25 bp, Mus musculus
cttaatactggaagacaagtcacat

SEQ ID NO: 392934 - DNA, 25 bp, Mus musculus
cttaatactggatgacaagtcacat

SEQ ID NO: 392935 - DNA, 25 bp, Mus musculus
cttaatagaggaatccgacttccgg

SEQ ID NO: 392936 - DNA, 25 bp, Mus musculus
cttaatagaggattccgacttccgg

SEQ ID NO: 392937 - DNA, 25 bp, Mus musculus
cttaatagtggtcacttctggcctc

SEQ ID NO: 392938 - DNA, 25 bp, Mus musculus
cttaatagtggtgacttctggcctc

SEQ ID NO: 392939 - DNA, 25 bp, Mus musculus
cttaatatatacctgcaccgtctgt

SEQ ID NO: 392940 - DNA, 25 bp, Mus musculus
cttaatatatacgtgcaccgtctgt

SEQ ID NO: 392941 - DNA, 25 bp, Mus musculus
cttaatatcaccagggcatcgggta

SEQ ID NO: 392942 - DNA, 25 bp, Mus musculus
cttaatatcacctgggcatcgggta

SEQ ID NO: 392943 - DNA, 25 bp, Mus musculus
cttaatatccttacattttcatgtt

SEQ ID NO: 392944 - DNA, 25 bp, Mus musculus
cttaatatcctttcattttcatgtt

SEQ ID NO: 392945 - DNA, 25 bp, Mus musculus
cttaatcaatctctccttctcttgg

SEQ ID NO: 392946 - DNA, 25 bp, Mus musculus
cttaatcaatctgtccttctcttgg

SEQ ID NO: 392947 - DNA, 25 bp, Mus musculus
cttaatcaatgcatttctccagctc

SEQ ID NO: 392948 - DNA, 25 bp, Mus musculus
cttaatcaatgcttttctccagctc

SEQ ID NO: 392949 - DNA, 25 bp, Mus musculus
cttaatcactgacccgccaatcatt

SEQ ID NO: 392950 - DNA, 25 bp, Mus musculus
cttaatcactgagccgccaatcatt

SEQ ID NO: 392951 - DNA, 25 bp, Mus musculus
cttaatcactgcaattctgatcttt

SEQ ID NO: 392952 - DNA, 25 bp, Mus musculus
cttaatcactgctattctgatcttt

SEQ ID NO: 392953 - DNA, 25 bp, Mus musculus
cttaatcatatcattccgaaggcaa

SEQ ID NO: 392954 - DNA, 25 bp, Mus musculus
cttaatcatatctttccgaaggcaa

SEQ ID NO: 392955 - DNA, 25 bp, Mus musculus
cttaatcctctgaggtgatgagaca

SEQ ID NO: 392956 - DNA, 25 bp, Mus musculus
cttaatcctctgtggtgatgagaca

SEQ ID NO: 392957 - DNA, 25 bp, Mus musculus
cttaatcgcagcctttaggaggcag

SEQ ID NO: 392958 - DNA, 25 bp, Mus musculus
cttaatcgcagcgtttaggaggcag

SEQ ID NO: 392959 - DNA, 25 bp, Mus musculus
cttaatctaatcatgtctggctccg

SEQ ID NO: 392960 - DNA, 25 bp, Mus musculus
cttaatctaatcttgtctggctccg

SEQ ID NO: 392961 - DNA, 25 bp, Mus musculus
cttaatctagtgcactttcctggct

SEQ ID NO: 392962 - DNA, 25 bp, Mus musculus
cttaatctagtggactttcctggct

SEQ ID NO: 392963 - DNA, 25 bp, Mus musculus
cttaatctatgcatctttgggagtt

SEQ ID NO: 392964 - DNA, 25 bp, Mus musculus
cttaatctatgcttctttgggagtt

SEQ ID NO: 392965 - DNA, 25 bp, Mus musculus
cttaatctcaggctaacattttaaa

SEQ ID NO: 392966 - DNA, 25 bp, Mus musculus
cttaatctcagggtaacattttaaa

SEQ ID NO: 392967 - DNA, 25 bp, Mus musculus
cttaatctccacaacagctctttga

SEQ ID NO: 392968 - DNA, 25 bp, Mus musculus
cttaatctccactacagctctttga

SEQ ID NO: 392969 - DNA, 25 bp, Mus musculus
cttaatctttctcctttctatctga

SEQ ID NO: 392970 - DNA, 25 bp, Mus musculus
cttaatctttctgctttctatctga

SEQ ID NO: 392971 - DNA, 25 bp, Mus musculus
cttaatgagactcagttcaccatct

SEQ ID NO: 392972 - DNA, 25 bp, Mus musculus
cttaatgagactgagttcaccatct

SEQ ID NO: 392973 - DNA, 25 bp, Mus musculus
cttaatgcacataccttcacacaga

SEQ ID NO: 392974 - DNA, 25 bp, Mus musculus
cttaatgcacattccttcacacaga

SEQ ID NO: 392975 - DNA, 25 bp, Mus musculus
cttaatgcacctcctggtacttggt

SEQ ID NO: 392976 - DNA, 25 bp, Mus musculus
cttaatgcacctgctggtacttggt

SEQ ID NO: 392977 - DNA, 25 bp, Mus musculus
cttaatgcacttaaaccaaggtact

SEQ ID NO: 392978 - DNA, 25 bp, Mus musculus
cttaatgcactttaaccaaggtact

SEQ ID NO: 392979 - DNA, 25 bp, Mus musculus
cttaatgctaacatgcccttggcat

SEQ ID NO: 392980 - DNA, 25 bp, Mus musculus
cttaatgctaacttgcccttggcat

SEQ ID NO: 392981 - DNA, 25 bp, Mus musculus
cttaatgctacaccccttgttgaaa

SEQ ID NO: 392982 - DNA, 25 bp, Mus musculus
cttaatgctacagcccttgttgaaa

SEQ ID NO: 392983 - DNA, 25 bp, Mus musculus
cttaatggacagagtacccatgctt

SEQ ID NO: 392984 - DNA, 25 bp, Mus musculus
cttaatggacagtgtacccatgctt

SEQ ID NO: 392985 - DNA, 25 bp, Mus musculus
cttaatggcagtcgtctgggcacct

SEQ ID NO: 392986 - DNA, 25 bp, Mus musculus
cttaatggcagtggtctgggcacct

SEQ ID NO: 392987 - DNA, 25 bp, Mus musculus
cttaatgtaaccatctctcagcctg

SEQ ID NO: 392988 - DNA, 25 bp, Mus musculus
cttaatgtaaccttctctcagcctg

SEQ ID NO: 392989 - DNA, 25 bp, Mus musculus
cttaatgtccctatctgtggtgtgt

SEQ ID NO: 392990 - DNA, 25 bp, Mus musculus
cttaatgtccctttctgtggtgtgt

SEQ ID NO: 392991 - DNA, 25 bp, Mus musculus
cttaatgtctataccgacagccggt

SEQ ID NO: 392992 - DNA, 25 bp, Mus musculus
cttaatgtctattccgacagccggt

SEQ ID NO: 392993 - DNA, 25 bp, Mus musculus
cttaattagctgagagtgactcgat

SEQ ID NO: 392994 - DNA, 25 bp, Mus musculus
cttaattagctgtgagtgactcgat

SEQ ID NO: 392995 - DNA, 25 bp, Mus musculus
cttaattcacctagtatccagatca

SEQ ID NO: 392996 - DNA, 25 bp, Mus musculus
cttaattcaccttgtatccagatca

SEQ ID NO: 392997 - DNA, 25 bp, Mus musculus
cttaattcaggaatcagcgttctag

SEQ ID NO: 392998 - DNA, 25 bp, Mus musculus
cttaattcaggattcagcgttctag

SEQ ID NO: 392999 - DNA, 25 bp, Mus musculus
cttaattcaggtcccagatttatca

SEQ ID NO: 393000 - DNA, 25 bp, Mus musculus
cttaattcaggtgccagatttatca

SEQ ID NO: 393001 - DNA, 25 bp, Mus musculus
cttaattctaagatgggcagtagta

SEQ ID NO: 393002 - DNA, 25 bp, Mus musculus
cttaattctaagttgggcagtagta

SEQ ID NO: 393003 - DNA, 25 bp, Mus musculus
cttaattcttctcctgtcactggga

SEQ ID NO: 393004 - DNA, 25 bp, Mus musculus
cttaattcttctgctgtcactggga

SEQ ID NO: 393005 - DNA, 25 bp, Mus musculus
cttaattgccttaacattatgtgga

SEQ ID NO: 393006 - DNA, 25 bp, Mus musculus
cttaattgcctttacattatgtgga

SEQ ID NO: 393007 - DNA, 25 bp, Mus musculus
cttaatttctaaaaccatggtgcta

SEQ ID NO: 393008 - DNA, 25 bp, Mus musculus
cttaatttctaataccatggtgcta

SEQ ID NO: 393009 - DNA, 25 bp, Mus musculus
cttaatttggacaggcgcacgggat

SEQ ID NO: 393010 - DNA, 25 bp, Mus musculus
cttaatttggactggcgcacgggat

SEQ ID NO: 393011 - DNA, 25 bp, Mus musculus
cttaatttggtaatgatgcttcagt

SEQ ID NO: 393012 - DNA, 25 bp, Mus musculus
cttaatttggtattgatgcttcagt

SEQ ID NO: 393013 - DNA, 25 bp, Mus musculus
cttaattttgagcagttacgcattt

SEQ ID NO: 393014 - DNA, 25 bp, Mus musculus
cttaattttgaggagttacgcattt

SEQ ID NO: 393015 - DNA, 25 bp, Mus musculus
cttacaaagtagatccttgggcata

SEQ ID NO: 393016 - DNA, 25 bp, Mus musculus
cttacaaagtagttccttgggcata

SEQ ID NO: 393017 - DNA, 25 bp, Mus musculus
cttacaaatggtacctatgtctatg

SEQ ID NO: 393018 - DNA, 25 bp, Mus musculus
cttacaaatggttcctatgtctatg

SEQ ID NO: 393019 - DNA, 25 bp, Mus musculus
cttacaagttggagggcagcaggct

SEQ ID NO: 393020 - DNA, 25 bp, Mus musculus
cttacaagttggtgggcagcaggct

SEQ ID NO: 393021 - DNA, 25 bp, Mus musculus
cttacaatccgccacacatttgtgg

SEQ ID NO: 393022 - DNA, 25 bp, Mus musculus
cttacaatccgcgacacatttgtgg

SEQ ID NO: 393023 - DNA, 25 bp, Mus musculus
cttacacaccacctccataaaggag

SEQ ID NO: 393024 - DNA, 25 bp, Mus musculus
cttacacaccacgtccataaaggag

SEQ ID NO: 393025 - DNA, 25 bp, Mus musculus
cttacacatttaatctcctgcattg

SEQ ID NO: 393026 - DNA, 25 bp, Mus musculus
cttacacatttattctcctgcattg

SEQ ID NO: 393027 - DNA, 25 bp, Mus musculus
cttacacctgacacttccagaagaa

SEQ ID NO: 393028 - DNA, 25 bp, Mus musculus
cttacacctgactcttccagaagaa

SEQ ID NO: 393029 - DNA, 25 bp, Mus musculus
cttacaccttcgcagaacccacttc

SEQ ID NO: 393030 - DNA, 25 bp, Mus musculus
cttacaccttcggagaacccacttc

SEQ ID NO: 393031 - DNA, 25 bp, Mus musculus
cttacacgcatcatttagttgactg

SEQ ID NO: 393032 - DNA, 25 bp, Mus musculus
cttacacgcatcttttagttgactg

SEQ ID NO: 393033 - DNA, 25 bp, Mus musculus
cttacacggttcaaagactgacaac

SEQ ID NO: 393034 - DNA, 25 bp, Mus musculus
cttacacggttctaagactgacaac

SEQ ID NO: 393035 - DNA, 25 bp, Mus musculus
cttacactaacaacctggctttggc

SEQ ID NO: 393036 - DNA, 25 bp, Mus musculus
cttacactaacatcctggctttggc

SEQ ID NO: 393037 - DNA, 25 bp, Mus musculus
cttacactgaaacttctggagattt

SEQ ID NO: 393038 - DNA, 25 bp, Mus musculus
cttacactgaaagttctggagattt

SEQ ID NO: 393039 - DNA, 25 bp, Mus musculus
cttacactgtaaagggctgcactct

SEQ ID NO: 393040 - DNA, 25 bp, Mus musculus
cttacactgtaatgggctgcactct

SEQ ID NO: 393041 - DNA, 25 bp, Mus musculus
cttacactgtttaatcagaggaatt

SEQ ID NO: 393042 - DNA, 25 bp, Mus musculus
cttacactgttttatcagaggaatt

SEQ ID NO: 393043 - DNA, 25 bp, Mus musculus
cttacacttgctctctggaaagaga

SEQ ID NO: 393044 - DNA, 25 bp, Mus musculus
cttacacttgctgtctggaaagaga

SEQ ID NO: 393045 - DNA, 25 bp, Mus musculus
cttacacttgtaatgcacgttggat

SEQ ID NO: 393046 - DNA, 25 bp, Mus musculus
cttacacttgtattgcacgttggat

SEQ ID NO: 393047 - DNA, 25 bp, Mus musculus
cttacagaaggtctggtatgactac

SEQ ID NO: 393048 - DNA, 25 bp, Mus musculus
cttacagaaggtgtggtatgactac

SEQ ID NO: 393049 - DNA, 25 bp, Mus musculus
cttacagacatcagagccttggctg

SEQ ID NO: 393050 - DNA, 25 bp, Mus musculus
cttacagacatctgagccttggctg

SEQ ID NO: 393051 - DNA, 25 bp, Mus musculus
cttacagactggagatgtctttggc

SEQ ID NO: 393052 - DNA, 25 bp, Mus musculus
cttacagactggtgatgtctttggc

SEQ ID NO: 393053 - DNA, 25 bp, Mus musculus
cttacagactttaccaagatgctat

SEQ ID NO: 393054 - DNA, 25 bp, Mus musculus
cttacagacttttccaagatgctat

SEQ ID NO: 393055 - DNA, 25 bp, Mus musculus
cttacagagaatcagcagcggtttt

SEQ ID NO: 393056 - DNA, 25 bp, Mus musculus
cttacagagaatgagcagcggtttt

SEQ ID NO: 393057 - DNA, 25 bp, Mus musculus
cttacagagaggccccttgggttga

SEQ ID NO: 393058 - DNA, 25 bp, Mus musculus
cttacagagagggcccttgggttga

SEQ ID NO: 393059 - DNA, 25 bp, Mus musculus
cttacagcgacgcttacggcagggt

SEQ ID NO: 393060 - DNA, 25 bp, Mus musculus
cttacagcgacgcttgagatgaatt

SEQ ID NO: 393061 - DNA, 25 bp, Mus musculus
cttacagcgacggttacggcagggt

SEQ ID NO: 393062 - DNA, 25 bp, Mus musculus
cttacagcgacggttgagatgaatt

SEQ ID NO: 393063 - DNA, 25 bp, Mus musculus
cttacaggcacgagcatatatgcaa

SEQ ID NO: 393064 - DNA, 25 bp, Mus musculus
cttacaggcacgtgcatatatgcaa

SEQ ID NO: 393065 - DNA, 25 bp, Mus musculus
cttacaggcatacccacaaaaccag

SEQ ID NO: 393066 - DNA, 25 bp, Mus musculus
cttacaggcatagccacaaaaccag

SEQ ID NO: 393067 - DNA, 25 bp, Mus musculus
cttacaggtcgtagccagagaagcc

SEQ ID NO: 393068 - DNA, 25 bp, Mus musculus
cttacaggtcgttgccagagaagcc

SEQ ID NO: 393069 - DNA, 25 bp, Mus musculus
cttacagtatttcttctgcaataaa

SEQ ID NO: 393070 - DNA, 25 bp, Mus musculus
cttacagtatttgttctgcaataaa

SEQ ID NO: 393071 - DNA, 25 bp, Mus musculus
cttacagttcagaggcagagtttta

SEQ ID NO: 393072 - DNA, 25 bp, Mus musculus
cttacagttcagtggcagagtttta

SEQ ID NO: 393073 - DNA, 25 bp, Mus musculus
cttacatcatctccctgggtttaaa

SEQ ID NO: 393074 - DNA, 25 bp, Mus musculus
cttacatcatctgcctgggtttaaa

SEQ ID NO: 393075 - DNA, 25 bp, Mus musculus
cttacatcatgaccaattcccaggg

SEQ ID NO: 393076 - DNA, 25 bp, Mus musculus
cttacatcatgagcaattcccaggg

SEQ ID NO: 393077 - DNA, 25 bp, Mus musculus
cttacatcatttccaatctggagga

SEQ ID NO: 393078 - DNA, 25 bp, Mus musculus
cttacatcatttgcaatctggagga

SEQ ID NO: 393079 - DNA, 25 bp, Mus musculus
cttacatccttacccttaaccttag

SEQ ID NO: 393080 - DNA, 25 bp, Mus musculus
cttacatccttagccttaaccttag

SEQ ID NO: 393081 - DNA, 25 bp, Mus musculus
cttacatcgtggcttccatgacagc

SEQ ID NO: 393082 - DNA, 25 bp, Mus musculus
cttacatcgtgggttccatgacagc

SEQ ID NO: 393083 - DNA, 25 bp, Mus musculus
cttacatgccttatattctctgatt

SEQ ID NO: 393084 - DNA, 25 bp, Mus musculus
cttacatgccttttattctctgatt

SEQ ID NO: 393085 - DNA, 25 bp, Mus musculus
cttacattgggtaccaggcatgcat

SEQ ID NO: 393086 - DNA, 25 bp, Mus musculus
cttacattgggttccaggcatgcat

SEQ ID NO: 393087 - DNA, 25 bp, Mus musculus
cttacattggtaaacttaggttgga

SEQ ID NO: 393088 - DNA, 25 bp, Mus musculus
cttacattggtatacttaggttgga

SEQ ID NO: 393089 - DNA, 25 bp, Mus musculus
cttaccaaagacactatccattgaa

SEQ ID NO: 393090 - DNA, 25 bp, Mus musculus
cttaccaaagactctatccattgaa

SEQ ID NO: 393091 - DNA, 25 bp, Mus musculus
cttaccaagtgtatccaagcgtgca

SEQ ID NO: 393092 - DNA, 25 bp, Mus musculus
cttaccaagtgtttccaagcgtgca

SEQ ID NO: 393093 - DNA, 25 bp, Mus musculus
cttaccagagagaggcagtcaactg

SEQ ID NO: 393094 - DNA, 25 bp, Mus musculus
cttaccagagagtggcagtcaactg

SEQ ID NO: 393095 - DNA, 25 bp, Mus musculus
cttaccagatggaacaaaacgatca

SEQ ID NO: 393096 - DNA, 25 bp, Mus musculus
cttaccagatggtacaaaacgatca

SEQ ID NO: 393097 - DNA, 25 bp, Mus musculus
cttaccagcagaaatccttgttcct

SEQ ID NO: 393098 - DNA, 25 bp, Mus musculus
cttaccagcagatatccttgttcct

SEQ ID NO: 393099 - DNA, 25 bp, Mus musculus
cttaccagcccaattcaggaaagaa

SEQ ID NO: 393100 - DNA, 25 bp, Mus musculus
cttaccagcccatttcaggaaagaa

SEQ ID NO: 393101 - DNA, 25 bp, Mus musculus
cttaccaggcacattatacacacag

SEQ ID NO: 393102 - DNA, 25 bp, Mus musculus
cttaccaggcactttatacacacag

SEQ ID NO: 393103 - DNA, 25 bp, Mus musculus
cttaccatccttcggagctatgagg

SEQ ID NO: 393104 - DNA, 25 bp, Mus musculus
cttaccatccttgggagctatgagg

SEQ ID NO: 393105 - DNA, 25 bp, Mus musculus
cttaccatctaccatataaagagat

SEQ ID NO: 393106 - DNA, 25 bp, Mus musculus
cttaccatctacgatataaagagat

SEQ ID NO: 393107 - DNA, 25 bp, Mus musculus
cttaccatgggcatcactgtataaa

SEQ ID NO: 393108 - DNA, 25 bp, Mus musculus
cttaccatgggcttcactgtataaa

SEQ ID NO: 393109 - DNA, 25 bp, Mus musculus
cttaccatgtggatctcagggattt

SEQ ID NO: 393110 - DNA, 25 bp, Mus musculus
cttaccatgtggttctcagggattt

SEQ ID NO: 393111 - DNA, 25 bp, Mus musculus
cttaccattcaaactaggaacttgg

SEQ ID NO: 393112 - DNA, 25 bp, Mus musculus
cttaccattcaatctaggaacttgg

SEQ ID NO: 393113 - DNA, 25 bp, Mus musculus
cttaccattgtaatagcttctaaaa

SEQ ID NO: 393114 - DNA, 25 bp, Mus musculus
cttaccattgtattagcttctaaaa

SEQ ID NO: 393115 - DNA, 25 bp, Mus musculus
cttacccacttcaggaacttcaaag

SEQ ID NO: 393116 - DNA, 25 bp, Mus musculus
cttacccacttctggaacttcaaag

SEQ ID NO: 393117 - DNA, 25 bp, Mus musculus
cttacccagcatactgtacttcggg

SEQ ID NO: 393118 - DNA, 25 bp, Mus musculus
cttacccagcattctgtacttcggg

SEQ ID NO: 393119 - DNA, 25 bp, Mus musculus
cttacccatcatcaggagacaaaca

SEQ ID NO: 393120 - DNA, 25 bp, Mus musculus
cttacccatcatgaggagacaaaca

SEQ ID NO: 393121 - DNA, 25 bp, Mus musculus
cttacccgatgcactatgccagtga

SEQ ID NO: 393122 - DNA, 25 bp, Mus musculus
cttacccgatgctctatgccagtga

SEQ ID NO: 393123 - DNA, 25 bp, Mus musculus
cttacccggatgagtgcagctttag

SEQ ID NO: 393124 - DNA, 25 bp, Mus musculus
cttacccggatgtgtgcagctttag

SEQ ID NO: 393125 - DNA, 25 bp, Mus musculus
cttaccctcaacaggctctgtggct

SEQ ID NO: 393126 - DNA, 25 bp, Mus musculus
cttaccctcaactggctctgtggct

SEQ ID NO: 393127 - DNA, 25 bp, Mus musculus
cttaccctcgccaggaagagtaccg

SEQ ID NO: 393128 - DNA, 25 bp, Mus musculus
cttaccctcgcctggaagagtaccg

SEQ ID NO: 393129 - DNA, 25 bp, Mus musculus
cttaccctgaggagcccgagaggag

SEQ ID NO: 393130 - DNA, 25 bp, Mus musculus
cttaccctgaggtgcccgagaggag

SEQ ID NO: 393131 - DNA, 25 bp, Mus musculus
cttacccttcacattccagatgttg

SEQ ID NO: 393132 - DNA, 25 bp, Mus musculus
cttacccttcactttccagatgttg

SEQ ID NO: 393133 - DNA, 25 bp, Mus musculus
cttacccttcagctgtttgctaaaa

SEQ ID NO: 393134 - DNA, 25 bp, Mus musculus
cttacccttcaggtgtttgctaaaa

SEQ ID NO: 393135 - DNA, 25 bp, Mus musculus
cttaccctttgccactatttgtgta

SEQ ID NO: 393136 - DNA, 25 bp, Mus musculus
cttaccctttgcgactatttgtgta

SEQ ID NO: 393137 - DNA, 25 bp, Mus musculus
cttaccgcatttatattttctccca

SEQ ID NO: 393138 - DNA, 25 bp, Mus musculus
cttaccgcatttttattttctccca

SEQ ID NO: 393139 - DNA, 25 bp, Mus musculus
cttaccgggattagactgtttcatt

SEQ ID NO: 393140 - DNA, 25 bp, Mus musculus
cttaccgggatttgactgtttcatt

SEQ ID NO: 393141 - DNA, 25 bp, Mus musculus
cttaccgtgtgaatgaggctcagaa

SEQ ID NO: 393142 - DNA, 25 bp, Mus musculus
cttaccgtgtgattgaggctcagaa

SEQ ID NO: 393143 - DNA, 25 bp, Mus musculus
cttaccgtgtgcacgtgtgcccagg

SEQ ID NO: 393144 - DNA, 25 bp, Mus musculus
cttaccgtgtgctcgtgtgcccagg

SEQ ID NO: 393145 - DNA, 25 bp, Mus musculus
cttaccgttacccttgaacatagct

SEQ ID NO: 393146 - DNA, 25 bp, Mus musculus
cttaccgttaccgttgaacatagct

SEQ ID NO: 393147 - DNA, 25 bp, Mus musculus
cttaccgttcacatttagcacaaaa

SEQ ID NO: 393148 - DNA, 25 bp, Mus musculus
cttaccgttcacttttagcacaaaa

SEQ ID NO: 393149 - DNA, 25 bp, Mus musculus
cttacctaatggaaacgagcttgtt

SEQ ID NO: 393150 - DNA, 25 bp, Mus musculus
cttacctaatggtaacgagcttgtt

SEQ ID NO: 393151 - DNA, 25 bp, Mus musculus
cttacctactgaactgctactgctc

SEQ ID NO: 393152 - DNA, 25 bp, Mus musculus
cttacctactgatctgctactgctc

SEQ ID NO: 393153 - DNA, 25 bp, Mus musculus
cttacctatctacttggttactata

SEQ ID NO: 393154 - DNA, 25 bp, Mus musculus
cttacctatctagttggttactata

SEQ ID NO: 393155 - DNA, 25 bp, Mus musculus
cttacctcattgctctaatctctga

SEQ ID NO: 393156 - DNA, 25 bp, Mus musculus
cttacctcattggtctaatctctga

SEQ ID NO: 393157 - DNA, 25 bp, Mus musculus
cttacctcgctaattgttatccatt

SEQ ID NO: 393158 - DNA, 25 bp, Mus musculus
cttacctcgctatttgttatccatt

SEQ ID NO: 393159 - DNA, 25 bp, Mus musculus
cttacctgataactcccatcgtatc

SEQ ID NO: 393160 - DNA, 25 bp, Mus musculus
cttacctgataagtcccatcgtatc

SEQ ID NO: 393161 - DNA, 25 bp, Mus musculus
cttacctgcagcaccttaaggagga

SEQ ID NO: 393162 - DNA, 25 bp, Mus musculus
cttacctgcagctccttaaggagga

SEQ ID NO: 393163 - DNA, 25 bp, Mus musculus
cttacctgctgcactgtggaggtga

SEQ ID NO: 393164 - DNA, 25 bp, Mus musculus
cttacctgctgctctgtggaggtga

SEQ ID NO: 393165 - DNA, 25 bp, Mus musculus
cttacctggcagaacctgcaattag

SEQ ID NO: 393166 - DNA, 25 bp, Mus musculus
cttacctggcagtacctgcaattag

SEQ ID NO: 393167 - DNA, 25 bp, Mus musculus
cttacctggtctaggtatctaattc

SEQ ID NO: 393168 - DNA, 25 bp, Mus musculus
cttacctggtcttggtatctaattc

SEQ ID NO: 393169 - DNA, 25 bp, Mus musculus
cttacctgtcatcttacaaaagcat

SEQ ID NO: 393170 - DNA, 25 bp, Mus musculus
cttacctgtcatgttacaaaagcat

SEQ ID NO: 393171 - DNA, 25 bp, Mus musculus
cttacctgtgagctagcctggataa

SEQ ID NO: 393172 - DNA, 25 bp, Mus musculus
cttacctgtgaggtagcctggataa

SEQ ID NO: 393173 - DNA, 25 bp, Mus musculus
cttacctgtgcaaaccttggagact

SEQ ID NO: 393174 - DNA, 25 bp, Mus musculus
cttacctgtgcataccttggagact

SEQ ID NO: 393175 - DNA, 25 bp, Mus musculus
cttaccttaaatctgcgggctgcag

SEQ ID NO: 393176 - DNA, 25 bp, Mus musculus
cttaccttaaatgtgcgggctgcag

SEQ ID NO: 393177 - DNA, 25 bp, Mus musculus
cttaccttgccccatctatattaaa

SEQ ID NO: 393178 - DNA, 25 bp, Mus musculus
cttaccttgcccgatctatattaaa

SEQ ID NO: 393179 - DNA, 25 bp, Mus musculus
cttacctttccaccggcatgacatg

SEQ ID NO: 393180 - DNA, 25 bp, Mus musculus
cttacctttccagcggcatgacatg

SEQ ID NO: 393181 - DNA, 25 bp, Mus musculus
cttacgaacttccttatttccagat

SEQ ID NO: 393182 - DNA, 25 bp, Mus musculus
cttacgaacttcgttatttccagat

SEQ ID NO: 393183 - DNA, 25 bp, Mus musculus
cttacgaatttgatacagtgctgtt

SEQ ID NO: 393184 - DNA, 25 bp, Mus musculus
cttacgaatttgttacagtgctgtt

SEQ ID NO: 393185 - DNA, 25 bp, Mus musculus
cttacgacggtaacagagagcctgc

SEQ ID NO: 393186 - DNA, 25 bp, Mus musculus
cttacgacggtatcagagagcctgc

SEQ ID NO: 393187 - DNA, 25 bp, Mus musculus
cttacgattgatatcagtctgggac

SEQ ID NO: 393188 - DNA, 25 bp, Mus musculus
cttacgattgatttcagtctgggac

SEQ ID NO: 393189 - DNA, 25 bp, Mus musculus
cttacgcagtttatggtcccaggag

SEQ ID NO: 393190 - DNA, 25 bp, Mus musculus
cttacgcagtttttggtcccaggag

SEQ ID NO: 393191 - DNA, 25 bp, Mus musculus
cttacgctgtttatactgtgcactt

SEQ ID NO: 393192 - DNA, 25 bp, Mus musculus
cttacgctgtttttactgtgcactt

SEQ ID NO: 393193 - DNA, 25 bp, Mus musculus
cttacggaatgtcctgtttgctgga

SEQ ID NO: 393194 - DNA, 25 bp, Mus musculus
cttacggaatgtgctgtttgctgga

SEQ ID NO: 393195 - DNA, 25 bp, Mus musculus
cttacggagagtcccgagactgcta

SEQ ID NO: 393196 - DNA, 25 bp, Mus musculus
cttacggagagtgccgagactgcta

SEQ ID NO: 393197 - DNA, 25 bp, Mus musculus
cttacggctgagcagtctagttcat

SEQ ID NO: 393198 - DNA, 25 bp, Mus musculus
cttacggctgaggagtctagttcat

SEQ ID NO: 393199 - DNA, 25 bp, Mus musculus
cttacgtctccaatacaaacatttt

SEQ ID NO: 393200 - DNA, 25 bp, Mus musculus
cttacgtctccattacaaacatttt

SEQ ID NO: 393201 - DNA, 25 bp, Mus musculus
cttacgtgaacacacacaagctggg

SEQ ID NO: 393202 - DNA, 25 bp, Mus musculus
cttacgtgaacagacacaagctggg

SEQ ID NO: 393203 - DNA, 25 bp, Mus musculus
cttacgtgagtcctggcatgggaat

SEQ ID NO: 393204 - DNA, 25 bp, Mus musculus
cttacgtgagtcgtggcatgggaat

SEQ ID NO: 393205 - DNA, 25 bp, Mus musculus
cttacgtttatgacttttctcagcc

SEQ ID NO: 393206 - DNA, 25 bp, Mus musculus
cttacgtttatgtcttttctcagcc

SEQ ID NO: 393207 - DNA, 25 bp, Mus musculus
cttactaattaaacagtgcatctgt

SEQ ID NO: 393208 - DNA, 25 bp, Mus musculus
cttactaattaatcagtgcatctgt

SEQ ID NO: 393209 - DNA, 25 bp, Mus musculus
cttactacacaaagtgtatatgtta

SEQ ID NO: 393210 - DNA, 25 bp, Mus musculus
cttactacacaatgtgtatatgtta

SEQ ID NO: 393211 - DNA, 25 bp, Mus musculus
cttactaccccaagccaacagaaag

SEQ ID NO: 393212 - DNA, 25 bp, Mus musculus
cttactaccccatgccaacagaaag

SEQ ID NO: 393213 - DNA, 25 bp, Mus musculus
cttactagctctatccatagaccag

SEQ ID NO: 393214 - DNA, 25 bp, Mus musculus
cttactagctctttccatagaccag

SEQ ID NO: 393215 - DNA, 25 bp, Mus musculus
cttactatacaactctgtgtgttga

SEQ ID NO: 393216 - DNA, 25 bp, Mus musculus
cttactatacaagtctgtgtgttga

SEQ ID NO: 393217 - DNA, 25 bp, Mus musculus
cttactatattgaccaagctggctt

SEQ ID NO: 393218 - DNA, 25 bp, Mus musculus
cttactatattgtccaagctggctt

SEQ ID NO: 393219 - DNA, 25 bp, Mus musculus
cttactatccttactcagctttgag

SEQ ID NO: 393220 - DNA, 25 bp, Mus musculus
cttactatcctttctcagctttgag

SEQ ID NO: 393221 - DNA, 25 bp, Mus musculus
cttactatgcagattccgtttccga

SEQ ID NO: 393222 - DNA, 25 bp, Mus musculus
cttactatgcagtttccgtttccga

SEQ ID NO: 393223 - DNA, 25 bp, Mus musculus
cttactatgtagatcagggtgcaga

SEQ ID NO: 393224 - DNA, 25 bp, Mus musculus
cttactatgtagttcagggtgcaga

SEQ ID NO: 393225 - DNA, 25 bp, Mus musculus
cttactattgatatacgcttgcccc

SEQ ID NO: 393226 - DNA, 25 bp, Mus musculus
cttactattgatttacgcttgcccc

SEQ ID NO: 393227 - DNA, 25 bp, Mus musculus
cttactcaccttccaaagacttgta

SEQ ID NO: 393228 - DNA, 25 bp, Mus musculus
cttactcaccttgcaaagacttgta

SEQ ID NO: 393229 - DNA, 25 bp, Mus musculus
cttactcactaaaatgggcagtttt

SEQ ID NO: 393230 - DNA, 25 bp, Mus musculus
cttactcactaatatgggcagtttt

SEQ ID NO: 393231 - DNA, 25 bp, Mus musculus
cttactcagagaactcccacaggaa

SEQ ID NO: 393232 - DNA, 25 bp, Mus musculus
cttactcagagatctcccacaggaa

SEQ ID NO: 393233 - DNA, 25 bp, Mus musculus
cttactcaggctatgtgggtttcga

SEQ ID NO: 393234 - DNA, 25 bp, Mus musculus
cttactcaggctttgtgggtttcga

SEQ ID NO: 393235 - DNA, 25 bp, Mus musculus
cttactcatgtgaccaaaagatgct

SEQ ID NO: 393236 - DNA, 25 bp, Mus musculus
cttactcatgtgtccaaaagatgct

SEQ ID NO: 393237 - DNA, 25 bp, Mus musculus
cttactcccatcaccaggaaagact

SEQ ID NO: 393238 - DNA, 25 bp, Mus musculus
cttactcccatctccaggaaagact

SEQ ID NO: 393239 - DNA, 25 bp, Mus musculus
cttactccctgcatatttctatgta

SEQ ID NO: 393240 - DNA, 25 bp, Mus musculus
cttactccctgcttatttctatgta

SEQ ID NO: 393241 - DNA, 25 bp, Mus musculus
cttactcgaagtacacagtctagga

SEQ ID NO: 393242 - DNA, 25 bp, Mus musculus
cttactcgaagttcacagtctagga

SEQ ID NO: 393243 - DNA, 25 bp, Mus musculus
cttactctagtacttggtgatggta

SEQ ID NO: 393244 - DNA, 25 bp, Mus musculus
cttactctagtagttggtgatggta

SEQ ID NO: 393245 - DNA, 25 bp, Mus musculus
cttactctcagcctcatcaatgtgt

SEQ ID NO: 393246 - DNA, 25 bp, Mus musculus
cttactctcagcgtcatcaatgtgt

SEQ ID NO: 393247 - DNA, 25 bp, Mus musculus
cttactctcaggctgccctttgtca

SEQ ID NO: 393248 - DNA, 25 bp, Mus musculus
cttactctcagggtgccctttgtca

SEQ ID NO: 393249 - DNA, 25 bp, Mus musculus
cttactctcctgaggagggcaggat

SEQ ID NO: 393250 - DNA, 25 bp, Mus musculus
cttactctcctgtggagggcaggat

SEQ ID NO: 393251 - DNA, 25 bp, Mus musculus
cttactctgcagagaagctggaaat

SEQ ID NO: 393252 - DNA, 25 bp, Mus musculus
cttactctgcagtgaagctggaaat

SEQ ID NO: 393253 - DNA, 25 bp, Mus musculus
cttactctggagcaactactgtcta

SEQ ID NO: 393254 - DNA, 25 bp, Mus musculus
cttactctggaggaactactgtcta

SEQ ID NO: 393255 - DNA, 25 bp, Mus musculus
cttactcttaagatctcctgccttg

SEQ ID NO: 393256 - DNA, 25 bp, Mus musculus
cttactcttaagttctcctgccttg

SEQ ID NO: 393257 - DNA, 25 bp, Mus musculus
cttactctttctagcgacacttatt

SEQ ID NO: 393258 - DNA, 25 bp, Mus musculus
cttactctttcttgcgacacttatt

SEQ ID NO: 393259 - DNA, 25 bp, Mus musculus
cttactgaaggtatgatgtggaatc

SEQ ID NO: 393260 - DNA, 25 bp, Mus musculus
cttactgaaggtttgatgtggaatc

SEQ ID NO: 393261 - DNA, 25 bp, Mus musculus
cttactgactctctttacttatgtg

SEQ ID NO: 393262 - DNA, 25 bp, Mus musculus
cttactgactctgtttacttatgtg

SEQ ID NO: 393263 - DNA, 25 bp, Mus musculus
cttactgactttactgggtttgctg

SEQ ID NO: 393264 - DNA, 25 bp, Mus musculus
cttactgacttttctgggtttgctg

SEQ ID NO: 393265 - DNA, 25 bp, Mus musculus
cttactgagtggatgttagactttt

SEQ ID NO: 393266 - DNA, 25 bp, Mus musculus
cttactgagtggttgttagactttt

SEQ ID NO: 393267 - DNA, 25 bp, Mus musculus
cttactgatccaataaaaccaaagc

SEQ ID NO: 393268 - DNA, 25 bp, Mus musculus
cttactgatccattaaaaccaaagc

SEQ ID NO: 393269 - DNA, 25 bp, Mus musculus
cttactgattggagttagacactgt

SEQ ID NO: 393270 - DNA, 25 bp, Mus musculus
cttactgattggtgttagacactgt

SEQ ID NO: 393271 - DNA, 25 bp, Mus musculus
cttactgcacatatgagaactcata

SEQ ID NO: 393272 - DNA, 25 bp, Mus musculus
cttactgcacatttgagaactcata

SEQ ID NO: 393273 - DNA, 25 bp, Mus musculus
cttactgcataactactttgtccgc

SEQ ID NO: 393274 - DNA, 25 bp, Mus musculus
cttactgcataagtactttgtccgc

SEQ ID NO: 393275 - DNA, 25 bp, Mus musculus
cttactgcattaactatagataata

SEQ ID NO: 393276 - DNA, 25 bp, Mus musculus
cttactgcattatctatagataata

SEQ ID NO: 393277 - DNA, 25 bp, Mus musculus
cttactgccagaacatcaaggagtt

SEQ ID NO: 393278 - DNA, 25 bp, Mus musculus
cttactgccagatcatcaaggagtt

SEQ ID NO: 393279 - DNA, 25 bp, Mus musculus
cttactgctcgcaggatacatcctg

SEQ ID NO: 393280 - DNA, 25 bp, Mus musculus
cttactgctcgctggatacatcctg

SEQ ID NO: 393281 - DNA, 25 bp, Mus musculus
cttactgctggcctagactctacta

SEQ ID NO: 393282 - DNA, 25 bp, Mus musculus
cttactgctggcgtagactctacta

SEQ ID NO: 393283 - DNA, 25 bp, Mus musculus
cttactgcttatcacccatttgaca

SEQ ID NO: 393284 - DNA, 25 bp, Mus musculus
cttactgcttatgacccatttgaca

SEQ ID NO: 393285 - DNA, 25 bp, Mus musculus
cttactggcaatctgatggctctca

SEQ ID NO: 393286 - DNA, 25 bp, Mus musculus
cttactggcaatgtgatggctctca

SEQ ID NO: 393287 - DNA, 25 bp, Mus musculus
cttactgggcttactctgagggttc

SEQ ID NO: 393288 - DNA, 25 bp, Mus musculus
cttactgggctttctctgagggttc

SEQ ID NO: 393289 - DNA, 25 bp, Mus musculus
cttactgggtccatgcaacttttat

SEQ ID NO: 393290 - DNA, 25 bp, Mus musculus
cttactgggtccttgcaacttttat

SEQ ID NO: 393291 - DNA, 25 bp, Mus musculus
cttactggtaggatcattcttttca

SEQ ID NO: 393292 - DNA, 25 bp, Mus musculus
cttactggtaggttcattcttttca

SEQ ID NO: 393293 - DNA, 25 bp, Mus musculus
cttactggtgctacgtcgtattaga

SEQ ID NO: 393294 - DNA, 25 bp, Mus musculus
cttactggtgcttcgtcgtattaga

SEQ ID NO: 393295 - DNA, 25 bp, Mus musculus
cttactgtgcgtagtataaagccat

SEQ ID NO: 393296 - DNA, 25 bp, Mus musculus
cttactgtgcgttgtataaagccat

SEQ ID NO: 393297 - DNA, 25 bp, Mus musculus
cttactgtgggaagctcctgtggat

SEQ ID NO: 393298 - DNA, 25 bp, Mus musculus
cttactgtgggatgctcctgtggat

SEQ ID NO: 393299 - DNA, 25 bp, Mus musculus
cttactgtgtagcaaactgacctgt

SEQ ID NO: 393300 - DNA, 25 bp, Mus musculus
cttactgtgtaggaaactgacctgt

SEQ ID NO: 393301 - DNA, 25 bp, Mus musculus
cttactgttctgattgggtgactta

SEQ ID NO: 393302 - DNA, 25 bp, Mus musculus
cttactgttctgtttgggtgactta

SEQ ID NO: 393303 - DNA, 25 bp, Mus musculus
cttacttacagtatgcatctagctt

SEQ ID NO: 393304 - DNA, 25 bp, Mus musculus
cttacttacagtttgcatctagctt

SEQ ID NO: 393305 - DNA, 25 bp, Mus musculus
cttacttacggtaatagcatctggg

SEQ ID NO: 393306 - DNA, 25 bp, Mus musculus
cttacttacggttatagcatctggg

SEQ ID NO: 393307 - DNA, 25 bp, Mus musculus
cttacttcaacactgagattgtggt

SEQ ID NO: 393308 - DNA, 25 bp, Mus musculus
cttacttcaacagtgagattgtggt

SEQ ID NO: 393309 - DNA, 25 bp, Mus musculus
cttacttcatggatgtgaaatgtcc

SEQ ID NO: 393310 - DNA, 25 bp, Mus musculus
cttacttcatggttgtgaaatgtcc

SEQ ID NO: 393311 - DNA, 25 bp, Mus musculus
cttacttcctgtacataagcctaag

SEQ ID NO: 393312 - DNA, 25 bp, Mus musculus
cttacttcctgttcataagcctaag

SEQ ID NO: 393313 - DNA, 25 bp, Mus musculus
cttacttctcacagcaaaggagcaa

SEQ ID NO: 393314 - DNA, 25 bp, Mus musculus
cttacttctcactgcaaaggagcaa

SEQ ID NO: 393315 - DNA, 25 bp, Mus musculus
cttacttctggtatgatgaatgttc

SEQ ID NO: 393316 - DNA, 25 bp, Mus musculus
cttacttctggtttgatgaatgttc

SEQ ID NO: 393317 - DNA, 25 bp, Mus musculus
cttacttgacttcaatgtgcaccca

SEQ ID NO: 393318 - DNA, 25 bp, Mus musculus
cttacttgacttgaatgtgcaccca

SEQ ID NO: 393319 - DNA, 25 bp, Mus musculus
cttacttgatacacatgtaattcaa

SEQ ID NO: 393320 - DNA, 25 bp, Mus musculus
cttacttgatactcatgtaattcaa

SEQ ID NO: 393321 - DNA, 25 bp, Mus musculus
cttacttgtgtgctgccaggttggt

SEQ ID NO: 393322 - DNA, 25 bp, Mus musculus
cttacttgtgtggtgccaggttggt

SEQ ID NO: 393323 - DNA, 25 bp, Mus musculus
cttacttgttctcatttggagtgga

SEQ ID NO: 393324 - DNA, 25 bp, Mus musculus
cttacttgttctgatttggagtgga

SEQ ID NO: 393325 - DNA, 25 bp, Mus musculus
cttactttaaatacttccacttcat

SEQ ID NO: 393326 - DNA, 25 bp, Mus musculus
cttactttaaattcttccacttcat

SEQ ID NO: 393327 - DNA, 25 bp, Mus musculus
cttactttactaaccacacctaatg

SEQ ID NO: 393328 - DNA, 25 bp, Mus musculus
cttactttactatccacacctaatg

SEQ ID NO: 393329 - DNA, 25 bp, Mus musculus
cttactttagtcactgcttgctcat

SEQ ID NO: 393330 - DNA, 25 bp, Mus musculus
cttactttagtctctgcttgctcat

SEQ ID NO: 393331 - DNA, 25 bp, Mus musculus
cttactttcaaaaggctgcatggca

SEQ ID NO: 393332 - DNA, 25 bp, Mus musculus
cttactttcaaatggctgcatggca

SEQ ID NO: 393333 - DNA, 25 bp, Mus musculus
cttactttccaacttcagaatgtgt

SEQ ID NO: 393334 - DNA, 25 bp, Mus musculus
cttactttccaagttcagaatgtgt

SEQ ID NO: 393335 - DNA, 25 bp, Mus musculus
cttactttctatattttgtgacatc

SEQ ID NO: 393336 - DNA, 25 bp, Mus musculus
cttactttctattttttgtgacatc

SEQ ID NO: 393337 - DNA, 25 bp, Mus musculus
cttactttgccaaggtcaagaggta

SEQ ID NO: 393338 - DNA, 25 bp, Mus musculus
cttactttgccatggtcaagaggta

SEQ ID NO: 393339 - DNA, 25 bp, Mus musculus
cttacttttctgagttgacttcatt

SEQ ID NO: 393340 - DNA, 25 bp, Mus musculus
cttacttttctgtgttgacttcatt

SEQ ID NO: 393341 - DNA, 25 bp, Mus musculus
cttacttttgtaccctgtcatcttc

SEQ ID NO: 393342 - DNA, 25 bp, Mus musculus
cttacttttgtagcctgtcatcttc

SEQ ID NO: 393343 - DNA, 25 bp, Mus musculus
cttagaaacataatatgggacctat

SEQ ID NO: 393344 - DNA, 25 bp, Mus musculus
cttagaaacatattatgggacctat

SEQ ID NO: 393345 - DNA, 25 bp, Mus musculus
cttagaaactcaaggtcaggctgga

SEQ ID NO: 393346 - DNA, 25 bp, Mus musculus
cttagaaactcatggtcaggctgga

SEQ ID NO: 393347 - DNA, 25 bp, Mus musculus
cttagaaagtctctgtgctctactg

SEQ ID NO: 393348 - DNA, 25 bp, Mus musculus
cttagaaagtctgtgtgctctactg

SEQ ID NO: 393349 - DNA, 25 bp, Mus musculus
cttagaacccatcgccttagtgtga

SEQ ID NO: 393350 - DNA, 25 bp, Mus musculus
cttagaacccatggccttagtgtga

SEQ ID NO: 393351 - DNA, 25 bp, Mus musculus
cttagaaccgggaattcttcagttg

SEQ ID NO: 393352 - DNA, 25 bp, Mus musculus
cttagaaccgggtattcttcagttg

SEQ ID NO: 393353 - DNA, 25 bp, Mus musculus
cttagaacctagctgcttgcagcca

SEQ ID NO: 393354 - DNA, 25 bp, Mus musculus
cttagaacctaggtgcttgcagcca

SEQ ID NO: 393355 - DNA, 25 bp, Mus musculus
cttagaactagtcaggtgctcctcc

SEQ ID NO: 393356 - DNA, 25 bp, Mus musculus
cttagaactagtgaggtgctcctcc

SEQ ID NO: 393357 - DNA, 25 bp, Mus musculus
cttagaactgttctcctgtggagag

SEQ ID NO: 393358 - DNA, 25 bp, Mus musculus
cttagaactgttgtcctgtggagag

SEQ ID NO: 393359 - DNA, 25 bp, Mus musculus
cttagaagactcctgattttctctc

SEQ ID NO: 393360 - DNA, 25 bp, Mus musculus
cttagaagactcgtgattttctctc

SEQ ID NO: 393361 - DNA, 25 bp, Mus musculus
cttagaaggaagcacactcggaggt

SEQ ID NO: 393362 - DNA, 25 bp, Mus musculus
cttagaaggaaggacactcggaggt

SEQ ID NO: 393363 - DNA, 25 bp, Mus musculus
cttagaagtatgctggctgagttgc

SEQ ID NO: 393364 - DNA, 25 bp, Mus musculus
cttagaagtatggtggctgagttgc

SEQ ID NO: 393365 - DNA, 25 bp, Mus musculus
cttagaatatagaggctgtccgtgt

SEQ ID NO: 393366 - DNA, 25 bp, Mus musculus
cttagaatatagtggctgtccgtgt

SEQ ID NO: 393367 - DNA, 25 bp, Mus musculus
cttagaatttgaaagacagctttat

SEQ ID NO: 393368 - DNA, 25 bp, Mus musculus
cttagaatttgatagacagctttat

SEQ ID NO: 393369 - DNA, 25 bp, Mus musculus
cttagacaatgacggcacaagtgcc

SEQ ID NO: 393370 - DNA, 25 bp, Mus musculus
cttagacaatgagggcacaagtgcc

SEQ ID NO: 393371 - DNA, 25 bp, Mus musculus
cttagacagttcattcccgggtgat

SEQ ID NO: 393372 - DNA, 25 bp, Mus musculus
cttagacagttctttcccgggtgat

SEQ ID NO: 393373 - DNA, 25 bp, Mus musculus
cttagacatgaaaaccccaactcca

SEQ ID NO: 393374 - DNA, 25 bp, Mus musculus
cttagacatgaataccccaactcca

SEQ ID NO: 393375 - DNA, 25 bp, Mus musculus
cttagacccagtcgagtctcccgag

SEQ ID NO: 393376 - DNA, 25 bp, Mus musculus
cttagacccagtggagtctcccgag

SEQ ID NO: 393377 - DNA, 25 bp, Mus musculus
cttagacctcacacacacagtaaat

SEQ ID NO: 393378 - DNA, 25 bp, Mus musculus
cttagacctcactcacacagtaaat

SEQ ID NO: 393379 - DNA, 25 bp, Mus musculus
cttagacctttccaatgactgtacc

SEQ ID NO: 393380 - DNA, 25 bp, Mus musculus
cttagacctttcgaatgactgtacc

SEQ ID NO: 393381 - DNA, 25 bp, Mus musculus
cttagacgtgaacacggccctggga

SEQ ID NO: 393382 - DNA, 25 bp, Mus musculus
cttagacgtgaagacggccctggga

SEQ ID NO: 393383 - DNA, 25 bp, Mus musculus
cttagacgtggcaacttcagaccca

SEQ ID NO: 393384 - DNA, 25 bp, Mus musculus
cttagacgtggctacttcagaccca

SEQ ID NO: 393385 - DNA, 25 bp, Mus musculus
cttagactgaggctctggccagcaa

SEQ ID NO: 393386 - DNA, 25 bp, Mus musculus
cttagactgagggtctggccagcaa

SEQ ID NO: 393387 - DNA, 25 bp, Mus musculus
cttagacttgcactactgtgatggg

SEQ ID NO: 393388 - DNA, 25 bp, Mus musculus
cttagacttgcagtactgtgatggg

SEQ ID NO: 393389 - DNA, 25 bp, Mus musculus
cttagactttatatccagctcttat

SEQ ID NO: 393390 - DNA, 25 bp, Mus musculus
cttagactttatttccagctcttat

SEQ ID NO: 393391 - DNA, 25 bp, Mus musculus
cttagactttttaaatgcctgccat

SEQ ID NO: 393392 - DNA, 25 bp, Mus musculus
cttagacttttttaatgcctgccat

SEQ ID NO: 393393 - DNA, 25 bp, Mus musculus
cttagagacattccttttccctctt

SEQ ID NO: 393394 - DNA, 25 bp, Mus musculus
cttagagacattgcttttccctctt

SEQ ID NO: 393395 - DNA, 25 bp, Mus musculus
cttagagactagcacccagtgacct

SEQ ID NO: 393396 - DNA, 25 bp, Mus musculus
cttagagactaggacccagtgacct

SEQ ID NO: 393397 - DNA, 25 bp, Mus musculus
cttagagagggcacagatccctggg

SEQ ID NO: 393398 - DNA, 25 bp, Mus musculus
cttagagagggctcagatccctggg

SEQ ID NO: 393399 - DNA, 25 bp, Mus musculus
cttagagagtgacatggacagcgtc

SEQ ID NO: 393400 - DNA, 25 bp, Mus musculus
cttagagagtgagatggacagcgtc

SEQ ID NO: 393401 - DNA, 25 bp, Mus musculus
cttagagataccacatgctcctctg

SEQ ID NO: 393402 - DNA, 25 bp, Mus musculus
cttagagatacctcatgctcctctg

SEQ ID NO: 393403 - DNA, 25 bp, Mus musculus
cttagagatttaattatgtcatgta

SEQ ID NO: 393404 - DNA, 25 bp, Mus musculus
cttagagatttatttatgtcatgta

SEQ ID NO: 393405 - DNA, 25 bp, Mus musculus
cttagagccaatcattttctcagcc

SEQ ID NO: 393406 - DNA, 25 bp, Mus musculus
cttagagccaatgattttctcagcc

SEQ ID NO: 393407 - DNA, 25 bp, Mus musculus
cttagagcccacatcagacagtaaa

SEQ ID NO: 393408 - DNA, 25 bp, Mus musculus
cttagagcccacttcagacagtaaa

SEQ ID NO: 393409 - DNA, 25 bp, Mus musculus
cttagagccgctagttaaatgtcat

SEQ ID NO: 393410 - DNA, 25 bp, Mus musculus
cttagagccgcttgttaaatgtcat

SEQ ID NO: 393411 - DNA, 25 bp, Mus musculus
cttagagcgggacagtattctttct

SEQ ID NO: 393412 - DNA, 25 bp, Mus musculus
cttagagcgggagagtattctttct

SEQ ID NO: 393413 - DNA, 25 bp, Mus musculus
cttagagctcatccatgttgcaggg

SEQ ID NO: 393414 - DNA, 25 bp, Mus musculus
cttagagctcatgcatgttgcaggg

SEQ ID NO: 393415 - DNA, 25 bp, Mus musculus
cttagaggaagtccagaccctggat

SEQ ID NO: 393416 - DNA, 25 bp, Mus musculus
cttagaggaagtgcagaccctggat

SEQ ID NO: 393417 - DNA, 25 bp, Mus musculus
cttagaggacgcctgtgatgacatc

SEQ ID NO: 393418 - DNA, 25 bp, Mus musculus
cttagaggacgcgtgtgatgacatc

SEQ ID NO: 393419 - DNA, 25 bp, Mus musculus
cttagaggctttcgctgctcagtgc

SEQ ID NO: 393420 - DNA, 25 bp, Mus musculus
cttagaggctttggctgctcagtgc

SEQ ID NO: 393421 - DNA, 25 bp, Mus musculus
cttagaggttggaagcaagagcttc

SEQ ID NO: 393422 - DNA, 25 bp, Mus musculus
cttagaggttggtagcaagagcttc

SEQ ID NO: 393423 - DNA, 25 bp, Mus musculus
cttagataaggtctggcggccatca

SEQ ID NO: 393424 - DNA, 25 bp, Mus musculus
cttagataaggtgtggcggccatca

SEQ ID NO: 393425 - DNA, 25 bp, Mus musculus
cttagatctcacacagcaacaagta

SEQ ID NO: 393426 - DNA, 25 bp, Mus musculus
cttagatctcactcagcaacaagta

SEQ ID NO: 393427 - DNA, 25 bp, Mus musculus
cttagatgccttatcagcctcttaa

SEQ ID NO: 393428 - DNA, 25 bp, Mus musculus
cttagatgccttttcagcctcttaa

SEQ ID NO: 393429 - DNA, 25 bp, Mus musculus
cttagatggcagcttcagcggaaag

SEQ ID NO: 393430 - DNA, 25 bp, Mus musculus
cttagatggcaggttcagcggaaag

SEQ ID NO: 393431 - DNA, 25 bp, Mus musculus
cttagatgttgacagcagcttgact

SEQ ID NO: 393432 - DNA, 25 bp, Mus musculus
cttagatgttgagagcagcttgact

SEQ ID NO: 393433 - DNA, 25 bp, Mus musculus
cttagattagccattactctgttaa

SEQ ID NO: 393434 - DNA, 25 bp, Mus musculus
cttagattagcctttactctgttaa

SEQ ID NO: 393435 - DNA, 25 bp, Mus musculus
cttagcaacagtcagatatctttaa

SEQ ID NO: 393436 - DNA, 25 bp, Mus musculus
cttagcaacagtgagatatctttaa

SEQ ID NO: 393437 - DNA, 25 bp, Mus musculus
cttagcaagcatctctgtagtagat

SEQ ID NO: 393438 - DNA, 25 bp, Mus musculus
cttagcaagcatgtctgtagtagat

SEQ ID NO: 393439 - DNA, 25 bp, Mus musculus
cttagcacactgaattgggattctc

SEQ ID NO: 393440 - DNA, 25 bp, Mus musculus
cttagcacactgtattgggattctc

SEQ ID NO: 393441 - DNA, 25 bp, Mus musculus
cttagcactaaaattgtcactttaa

SEQ ID NO: 393442 - DNA, 25 bp, Mus musculus
cttagcactaaatttgtcactttaa

SEQ ID NO: 393443 - DNA, 25 bp, Mus musculus
cttagcagacaaacctggagcatac

SEQ ID NO: 393444 - DNA, 25 bp, Mus musculus
cttagcagacaatcctggagcatac

SEQ ID NO: 393445 - DNA, 25 bp, Mus musculus
cttagcagcaggacccatgttatgg

SEQ ID NO: 393446 - DNA, 25 bp, Mus musculus
cttagcagcaggtcccatgttatgg

SEQ ID NO: 393447 - DNA, 25 bp, Mus musculus
cttagcataaggctgggtgtttcat

SEQ ID NO: 393448 - DNA, 25 bp, Mus musculus
cttagcataagggtgggtgtttcat

SEQ ID NO: 393449 - DNA, 25 bp, Mus musculus
cttagcataattctgccaggcaggc

SEQ ID NO: 393450 - DNA, 25 bp, Mus musculus
cttagcataattgtgccaggcaggc

SEQ ID NO: 393451 - DNA, 25 bp, Mus musculus
cttagcatccagaaggtgagaagaa

SEQ ID NO: 393452 - DNA, 25 bp, Mus musculus
cttagcatccagtaggtgagaagaa

SEQ ID NO: 393453 - DNA, 25 bp, Mus musculus
cttagcatgctaaattaacctgaaa

SEQ ID NO: 393454 - DNA, 25 bp, Mus musculus
cttagcatgctatattaacctgaaa

SEQ ID NO: 393455 - DNA, 25 bp, Mus musculus
cttagcatgctgcaccaagacctgc

SEQ ID NO: 393456 - DNA, 25 bp, Mus musculus
cttagcatgctggaccaagacctgc

SEQ ID NO: 393457 - DNA, 25 bp, Mus musculus
cttagcatggttctgctaccatcca

SEQ ID NO: 393458 - DNA, 25 bp, Mus musculus
cttagcatggttgtgctaccatcca

SEQ ID NO: 393459 - DNA, 25 bp, Mus musculus
cttagcattgtcagtggtgggtatc

SEQ ID NO: 393460 - DNA, 25 bp, Mus musculus
cttagcattgtctgtggtgggtatc

SEQ ID NO: 393461 - DNA, 25 bp, Mus musculus
cttagccaaagtctgcgtctgtcga

SEQ ID NO: 393462 - DNA, 25 bp, Mus musculus
cttagccaaagtgtgcgtctgtcga

SEQ ID NO: 393463 - DNA, 25 bp, Mus musculus
cttagccagcagatatttttgcccc

SEQ ID NO: 393464 - DNA, 25 bp, Mus musculus
cttagccagcagttatttttgcccc

SEQ ID NO: 393465 - DNA, 25 bp, Mus musculus
cttagccagctaactgcagtaaccc

SEQ ID NO: 393466 - DNA, 25 bp, Mus musculus
cttagccagctatctgcagtaaccc

SEQ ID NO: 393467 - DNA, 25 bp, Mus musculus
cttagccatctcctgttaatgtatt

SEQ ID NO: 393468 - DNA, 25 bp, Mus musculus
cttagccatctcgtgttaatgtatt

SEQ ID NO: 393469 - DNA, 25 bp, Mus musculus
cttagcccagatcgaccacggtgat

SEQ ID NO: 393470 - DNA, 25 bp, Mus musculus
cttagcccagatggaccacggtgat

SEQ ID NO: 393471 - DNA, 25 bp, Mus musculus
cttagcctacatactgggcctgaca

SEQ ID NO: 393472 - DNA, 25 bp, Mus musculus
cttagcctacattctgggcctgaca

SEQ ID NO: 393473 - DNA, 25 bp, Mus musculus
cttagcctacctaatattcaggatg

SEQ ID NO: 393474 - DNA, 25 bp, Mus musculus
cttagcctaccttatattcaggatg

SEQ ID NO: 393475 - DNA, 25 bp, Mus musculus
cttagcctgcgcaggcagatctctg

SEQ ID NO: 393476 - DNA, 25 bp, Mus musculus
cttagcctgcgctggcagatctctg

SEQ ID NO: 393477 - DNA, 25 bp, Mus musculus
cttagccttctgcaagctgatgaat

SEQ ID NO: 393478 - DNA, 25 bp, Mus musculus
cttagccttctggaagctgatgaat

SEQ ID NO: 393479 - DNA, 25 bp, Mus musculus
cttagccttgatctcctggaaggaa

SEQ ID NO: 393480 - DNA, 25 bp, Mus musculus
cttagccttgatgtcctggaaggaa

SEQ ID NO: 393481 - DNA, 25 bp, Mus musculus
cttagcctttctcgtttgtcgacaa

SEQ ID NO: 393482 - DNA, 25 bp, Mus musculus
cttagcctttctggtttgtcgacaa

SEQ ID NO: 393483 - DNA, 25 bp, Mus musculus
cttagcctttttagtttcagagcat

SEQ ID NO: 393484 - DNA, 25 bp, Mus musculus
cttagccttttttgtttcagagcat

SEQ ID NO: 393485 - DNA, 25 bp, Mus musculus
cttagcgatgagcatttcttgtaat

SEQ ID NO: 393486 - DNA, 25 bp, Mus musculus
cttagcgatgaggatttcttgtaat

SEQ ID NO: 393487 - DNA, 25 bp, Mus musculus
cttagcgcttccacttgggactgaa

SEQ ID NO: 393488 - DNA, 25 bp, Mus musculus
cttagcgcttcctcttgggactgaa

SEQ ID NO: 393489 - DNA, 25 bp, Mus musculus
cttagcggacacaatgatcggcaaa

SEQ ID NO: 393490 - DNA, 25 bp, Mus musculus
cttagcggacactatgatcggcaaa

SEQ ID NO: 393491 - DNA, 25 bp, Mus musculus
cttagcggctcaccgacgaggagaa

SEQ ID NO: 393492 - DNA, 25 bp, Mus musculus
cttagcggctcagcgacgaggagaa

SEQ ID NO: 393493 - DNA, 25 bp, Mus musculus
cttagcgtatagcttctaggaagac

SEQ ID NO: 393494 - DNA, 25 bp, Mus musculus
cttagcgtataggttctaggaagac

SEQ ID NO: 393495 - DNA, 25 bp, Mus musculus
cttagcgtctatcccaacttgtgat

SEQ ID NO: 393496 - DNA, 25 bp, Mus musculus
cttagcgtctatgccaacttgtgat

SEQ ID NO: 393497 - DNA, 25 bp, Mus musculus
cttagctaaacaatctgcagaggta

SEQ ID NO: 393498 - DNA, 25 bp, Mus musculus
cttagctaaacattctgcagaggta

SEQ ID NO: 393499 - DNA, 25 bp, Mus musculus
cttagctcctctaacctggtaggtt

SEQ ID NO: 393500 - DNA, 25 bp, Mus musculus
cttagctcctcttacctggtaggtt

SEQ ID NO: 393501 - DNA, 25 bp, Mus musculus
cttagctcctgtagactggaagata

SEQ ID NO: 393502 - DNA, 25 bp, Mus musculus
cttagctcctgttgactggaagata

SEQ ID NO: 393503 - DNA, 25 bp, Mus musculus
cttagctctgacctgatatctctgc

SEQ ID NO: 393504 - DNA, 25 bp, Mus musculus
cttagctctgacgtgatatctctgc

SEQ ID NO: 393505 - DNA, 25 bp, Mus musculus
cttagctggacacccagggcacaga

SEQ ID NO: 393506 - DNA, 25 bp, Mus musculus
cttagctggacagccagggcacaga

SEQ ID NO: 393507 - DNA, 25 bp, Mus musculus
cttagctggccactaagccttgggc

SEQ ID NO: 393508 - DNA, 25 bp, Mus musculus
cttagctggccagtaagccttgggc

SEQ ID NO: 393509 - DNA, 25 bp, Mus musculus
cttagctgtgtaaatttgaccatgt

SEQ ID NO: 393510 - DNA, 25 bp, Mus musculus
cttagctgtgtatatttgaccatgt

SEQ ID NO: 393511 - DNA, 25 bp, Mus musculus
cttagctgttcccttgtgatcttta

SEQ ID NO: 393512 - DNA, 25 bp, Mus musculus
cttagctgttccgttgtgatcttta

SEQ ID NO: 393513 - DNA, 25 bp, Mus musculus
cttagcttaagacaggtgtttctct

SEQ ID NO: 393514 - DNA, 25 bp, Mus musculus
cttagcttaagagaggtgtttctct

SEQ ID NO: 393515 - DNA, 25 bp, Mus musculus
cttagcttcgaactggaactttgga

SEQ ID NO: 393516 - DNA, 25 bp, Mus musculus
cttagcttcgaagtggaactttgga

SEQ ID NO: 393517 - DNA, 25 bp, Mus musculus
cttagctttagaaatcctggtatta

SEQ ID NO: 393518 - DNA, 25 bp, Mus musculus
cttagctttagatatcctggtatta

SEQ ID NO: 393519 - DNA, 25 bp, Mus musculus
cttagctttggtctcagtgaaccag

SEQ ID NO: 393520 - DNA, 25 bp, Mus musculus
cttagctttggtgtcagtgaaccag

SEQ ID NO: 393521 - DNA, 25 bp, Mus musculus
cttaggaaatgtccaaatgagatcc

SEQ ID NO: 393522 - DNA, 25 bp, Mus musculus
cttaggaaatgtgcaaatgagatcc

SEQ ID NO: 393523 - DNA, 25 bp, Mus musculus
cttaggaacctacggcaggaagcaa

SEQ ID NO: 393524 - DNA, 25 bp, Mus musculus
cttaggaacctagggcaggaagcaa

SEQ ID NO: 393525 - DNA, 25 bp, Mus musculus
cttaggaagggtattatacagacag

SEQ ID NO: 393526 - DNA, 25 bp, Mus musculus
cttaggaagggttttatacagacag

SEQ ID NO: 393527 - DNA, 25 bp, Mus musculus
cttaggaatcaacggtgaccgagga

SEQ ID NO: 393528 - DNA, 25 bp, Mus musculus
cttaggaatcaagggtgaccgagga

SEQ ID NO: 393529 - DNA, 25 bp, Mus musculus
cttaggaattagctcgatgctcata

SEQ ID NO: 393530 - DNA, 25 bp, Mus musculus
cttaggaattaggtcgatgctcata

SEQ ID NO: 393531 - DNA, 25 bp, Mus musculus
cttaggacacagactctatggaaat

SEQ ID NO: 393532 - DNA, 25 bp, Mus musculus
cttaggacacagtctctatggaaat

SEQ ID NO: 393533 - DNA, 25 bp, Mus musculus
cttaggacactcacaccttcacttg

SEQ ID NO: 393534 - DNA, 25 bp, Mus musculus
cttaggacactctcaccttcacttg

SEQ ID NO: 393535 - DNA, 25 bp, Mus musculus
cttaggaggcagcagtcacttctgg

SEQ ID NO: 393536 - DNA, 25 bp, Mus musculus
cttaggaggcaggagtcacttctgg

SEQ ID NO: 393537 - DNA, 25 bp, Mus musculus
cttaggatcagcagtgaggcacatc

SEQ ID NO: 393538 - DNA, 25 bp, Mus musculus
cttaggatcagctgtgaggcacatc

SEQ ID NO: 393539 - DNA, 25 bp, Mus musculus
cttaggatcctcaaaatgtgttcat

SEQ ID NO: 393540 - DNA, 25 bp, Mus musculus
cttaggatcctctaaatgtgttcat

SEQ ID NO: 393541 - DNA, 25 bp, Mus musculus
cttaggatgtgtcctattaaataca

SEQ ID NO: 393542 - DNA, 25 bp, Mus musculus
cttaggatgtgtgctattaaataca

SEQ ID NO: 393543 - DNA, 25 bp, Mus musculus
cttaggcactgcacctgtgggtaga

SEQ ID NO: 393544 - DNA, 25 bp, Mus musculus
cttaggcactgctcctgtgggtaga

SEQ ID NO: 393545 - DNA, 25 bp, Mus musculus
cttaggccactgagggtggagccta

SEQ ID NO: 393546 - DNA, 25 bp, Mus musculus
cttaggccactgtgggtggagccta

SEQ ID NO: 393547 - DNA, 25 bp, Mus musculus
cttaggcgacctctgtgaaaggatt

SEQ ID NO: 393548 - DNA, 25 bp, Mus musculus
cttaggcgacctgtgtgaaaggatt

SEQ ID NO: 393549 - DNA, 25 bp, Mus musculus
cttaggcggctgaaaacacttttgt

SEQ ID NO: 393550 - DNA, 25 bp, Mus musculus
cttaggcggctgtaaacacttttgt

SEQ ID NO: 393551 - DNA, 25 bp, Mus musculus
cttaggctcagtagaacagtatcat

SEQ ID NO: 393552 - DNA, 25 bp, Mus musculus
cttaggctcagttgaacagtatcat

SEQ ID NO: 393553 - DNA, 25 bp, Mus musculus
cttaggctttggaggtgctggacat

SEQ ID NO: 393554 - DNA, 25 bp, Mus musculus
cttaggctttggtggtgctggacat

SEQ ID NO: 393555 - DNA, 25 bp, Mus musculus
cttagggaccaaagtcaggcccttt

SEQ ID NO: 393556 - DNA, 25 bp, Mus musculus
cttagggaccaatgtcaggcccttt

SEQ ID NO: 393557 - DNA, 25 bp, Mus musculus
cttagggacgctacaatggcagtaa

SEQ ID NO: 393558 - DNA, 25 bp, Mus musculus
cttagggacgcttcaatggcagtaa

SEQ ID NO: 393559 - DNA, 25 bp, Mus musculus
cttagggcctgtctgaggaccccat

SEQ ID NO: 393560 - DNA, 25 bp, Mus musculus
cttagggcctgtgtgaggaccccat

SEQ ID NO: 393561 - DNA, 25 bp, Mus musculus
cttagggctacaccgctcaaagcaa

SEQ ID NO: 393562 - DNA, 25 bp, Mus musculus
cttagggctacagcgctcaaagcaa

SEQ ID NO: 393563 - DNA, 25 bp, Mus musculus
cttagggctgctctgttccaagttc

SEQ ID NO: 393564 - DNA, 25 bp, Mus musculus
cttagggctgctgtgttccaagttc

SEQ ID NO: 393565 - DNA, 25 bp, Mus musculus
cttagggtaactcctaggtgtcttt

SEQ ID NO: 393566 - DNA, 25 bp, Mus musculus
cttagggtaactgctaggtgtcttt

SEQ ID NO: 393567 - DNA, 25 bp, Mus musculus
cttagggtgactaagggtgtccgca

SEQ ID NO: 393568 - DNA, 25 bp, Mus musculus
cttagggtgacttagggtgtccgca

SEQ ID NO: 393569 - DNA, 25 bp, Mus musculus
cttagggtgttgaggttctttacat

SEQ ID NO: 393570 - DNA, 25 bp, Mus musculus
cttagggtgttgtggttctttacat

SEQ ID NO: 393571 - DNA, 25 bp, Mus musculus
cttaggtagaaactcgtggtgattt

SEQ ID NO: 393572 - DNA, 25 bp, Mus musculus
cttaggtagaaagtcgtggtgattt

SEQ ID NO: 393573 - DNA, 25 bp, Mus musculus
cttaggtatctgctgcggcaaggta

SEQ ID NO: 393574 - DNA, 25 bp, Mus musculus
cttaggtatctggtgcggcaaggta

SEQ ID NO: 393575 - DNA, 25 bp, Mus musculus
cttaggtattgcactttggctgttt

SEQ ID NO: 393576 - DNA, 25 bp, Mus musculus
cttaggtattgctctttggctgttt

SEQ ID NO: 393577 - DNA, 25 bp, Mus musculus
cttaggtcctgaatacctgagggta

SEQ ID NO: 393578 - DNA, 25 bp, Mus musculus
cttaggtcctgattacctgagggta

SEQ ID NO: 393579 - DNA, 25 bp, Mus musculus
cttaggtctcgcactggaatctata

SEQ ID NO: 393580 - DNA, 25 bp, Mus musculus
cttaggtctcgctctggaatctata

SEQ ID NO: 393581 - DNA, 25 bp, Mus musculus
cttaggtggcacacatttttccata

SEQ ID NO: 393582 - DNA, 25 bp, Mus musculus
cttaggtggcactcatttttccata

SEQ ID NO: 393583 - DNA, 25 bp, Mus musculus
cttaggtgggttcggacctatcgct

SEQ ID NO: 393584 - DNA, 25 bp, Mus musculus
cttaggtgggttgggacctatcgct

SEQ ID NO: 393585 - DNA, 25 bp, Mus musculus
cttaggttactcaacatgactgtgt

SEQ ID NO: 393586 - DNA, 25 bp, Mus musculus
cttaggttactctacatgactgtgt

SEQ ID NO: 393587 - DNA, 25 bp, Mus musculus
cttaggttgaggcaggctatctcct

SEQ ID NO: 393588 - DNA, 25 bp, Mus musculus
cttaggttgagggaggctatctcct

SEQ ID NO: 393589 - DNA, 25 bp, Mus musculus
cttaggtttagcatgacttcagaga

SEQ ID NO: 393590 - DNA, 25 bp, Mus musculus
cttaggtttagcttgacttcagaga

SEQ ID NO: 393591 - DNA, 25 bp, Mus musculus
cttaggtttatgaggcaagccgtaa

SEQ ID NO: 393592 - DNA, 25 bp, Mus musculus
cttaggtttatgtggcaagccgtaa

SEQ ID NO: 393593 - DNA, 25 bp, Mus musculus
cttagtaatgagatcctttgcagga

SEQ ID NO: 393594 - DNA, 25 bp, Mus musculus
cttagtaatgagttcctttgcagga

SEQ ID NO: 393595 - DNA, 25 bp, Mus musculus
cttagtacatggctgctctggattc

SEQ ID NO: 393596 - DNA, 25 bp, Mus musculus
cttagtacatgggtgctctggattc

SEQ ID NO: 393597 - DNA, 25 bp, Mus musculus
cttagtactttaatgtgagctgtta

SEQ ID NO: 393598 - DNA, 25 bp, Mus musculus
cttagtactttattgtgagctgtta

SEQ ID NO: 393599 - DNA, 25 bp, Mus musculus
cttagtagaaggcatgcgtttgact

SEQ ID NO: 393600 - DNA, 25 bp, Mus musculus
cttagtagaagggatgcgtttgact

SEQ ID NO: 393601 - DNA, 25 bp, Mus musculus
cttagtagtggaccgacgggctttt

SEQ ID NO: 393602 - DNA, 25 bp, Mus musculus
cttagtagtggagcgacgggctttt

SEQ ID NO: 393603 - DNA, 25 bp, Mus musculus
cttagtatttttcatgcgtagtgtt

SEQ ID NO: 393604 - DNA, 25 bp, Mus musculus
cttagtatttttgatgcgtagtgtt

SEQ ID NO: 393605 - DNA, 25 bp, Mus musculus
cttagtcacagtagggtagttttgg

SEQ ID NO: 393606 - DNA, 25 bp, Mus musculus
cttagtcacagttgggtagttttgg

SEQ ID NO: 393607 - DNA, 25 bp, Mus musculus
cttagtcctctgatacttccaggaa

SEQ ID NO: 393608 - DNA, 25 bp, Mus musculus
cttagtcctctgttacttccaggaa

SEQ ID NO: 393609 - DNA, 25 bp, Mus musculus
cttagtcctggccataccatttgaa

SEQ ID NO: 393610 - DNA, 25 bp, Mus musculus
cttagtcctggcgataccatttgaa

SEQ ID NO: 393611 - DNA, 25 bp, Mus musculus
cttagtccttatctctgtcagttgt

SEQ ID NO: 393612 - DNA, 25 bp, Mus musculus
cttagtccttatgtctgtcagttgt

SEQ ID NO: 393613 - DNA, 25 bp, Mus musculus
cttagtctaggacgtcaggcctgtt

SEQ ID NO: 393614 - DNA, 25 bp, Mus musculus
cttagtctaggaggtcaggcctgtt

SEQ ID NO: 393615 - DNA, 25 bp, Mus musculus
cttagtctcccgagtaactcagaaa

SEQ ID NO: 393616 - DNA, 25 bp, Mus musculus
cttagtctcccgtgtaactcagaaa

SEQ ID NO: 393617 - DNA, 25 bp, Mus musculus
cttagtctctttacaatgttcacga

SEQ ID NO: 393618 - DNA, 25 bp, Mus musculus
cttagtctcttttcaatgttcacga

SEQ ID NO: 393619 - DNA, 25 bp, Mus musculus
cttagtctggaactggctacataca

SEQ ID NO: 393620 - DNA, 25 bp, Mus musculus
cttagtctggaagtggctacataca

SEQ ID NO: 393621 - DNA, 25 bp, Mus musculus
cttagtgaacttctggaagattcca

SEQ ID NO: 393622 - DNA, 25 bp, Mus musculus
cttagtgaacttgtggaagattcca

SEQ ID NO: 393623 - DNA, 25 bp, Mus musculus
cttagtgaagaaagttcagggctct

SEQ ID NO: 393624 - DNA, 25 bp, Mus musculus
cttagtgaagaatgttcagggctct

SEQ ID NO: 393625 - DNA, 25 bp, Mus musculus
cttagtgacggccctccctagagtt

SEQ ID NO: 393626 - DNA, 25 bp, Mus musculus
cttagtgacggcgctccctagagtt

SEQ ID NO: 393627 - DNA, 25 bp, Mus musculus
cttagtgatagcaagcctggagttt

SEQ ID NO: 393628 - DNA, 25 bp, Mus musculus
cttagtgatagctagcctggagttt

SEQ ID NO: 393629 - DNA, 25 bp, Mus musculus
cttagtgattggctgtgttcctgag

SEQ ID NO: 393630 - DNA, 25 bp, Mus musculus
cttagtgattgggtgtgttcctgag

SEQ ID NO: 393631 - DNA, 25 bp, Mus musculus
cttagtgcagcacggtcgagctctg

SEQ ID NO: 393632 - DNA, 25 bp, Mus musculus
cttagtgcagcagggtcgagctctg

SEQ ID NO: 393633 - DNA, 25 bp, Mus musculus
cttagtgcagtacaaatgtcttttt

SEQ ID NO: 393634 - DNA, 25 bp, Mus musculus
cttagtgcagtagaaatgtcttttt

SEQ ID NO: 393635 - DNA, 25 bp, Mus musculus
cttagtgctttcagcaccagacaac

SEQ ID NO: 393636 - DNA, 25 bp, Mus musculus
cttagtgctttctgcaccagacaac

SEQ ID NO: 393637 - DNA, 25 bp, Mus musculus
cttagtggatgtcttggcaacctta

SEQ ID NO: 393638 - DNA, 25 bp, Mus musculus
cttagtggatgtgttggcaacctta

SEQ ID NO: 393639 - DNA, 25 bp, Mus musculus
cttagtggcaaacccctgtatggat

SEQ ID NO: 393640 - DNA, 25 bp, Mus musculus
cttagtggcaaagccctgtatggat

SEQ ID NO: 393641 - DNA, 25 bp, Mus musculus
cttagtggttataagcactgactta

SEQ ID NO: 393642 - DNA, 25 bp, Mus musculus
cttagtggttattagcactgactta

SEQ ID NO: 393643 - DNA, 25 bp, Mus musculus
cttagtgtatctcttgctgtatggt

SEQ ID NO: 393644 - DNA, 25 bp, Mus musculus
cttagtgtatctgttgctgtatggt

SEQ ID NO: 393645 - DNA, 25 bp, Mus musculus
cttagtgtgagtactttacctgcct

SEQ ID NO: 393646 - DNA, 25 bp, Mus musculus
cttagtgtgagttctttacctgcct

SEQ ID NO: 393647 - DNA, 25 bp, Mus musculus
cttagtgttctcatggtatgatata

SEQ ID NO: 393648 - DNA, 25 bp, Mus musculus
cttagtgttctcttggtatgatata

SEQ ID NO: 393649 - DNA, 25 bp, Mus musculus
cttagtgttgtgactctgagtcccg

SEQ ID NO: 393650 - DNA, 25 bp, Mus musculus
cttagtgttgtgtctctgagtcccg

SEQ ID NO: 393651 - DNA, 25 bp, Mus musculus
cttagtgttgttatgtccctctttt

SEQ ID NO: 393652 - DNA, 25 bp, Mus musculus
cttagtgttgttttgtccctctttt

SEQ ID NO: 393653 - DNA, 25 bp, Mus musculus
cttagttaggtcacacgcgtgttca

SEQ ID NO: 393654 - DNA, 25 bp, Mus musculus
cttagttaggtctcacgcgtgttca

SEQ ID NO: 393655 - DNA, 25 bp, Mus musculus
cttagttataagctatcatcccatt

SEQ ID NO: 393656 - DNA, 25 bp, Mus musculus
cttagttataaggtatcatcccatt

SEQ ID NO: 393657 - DNA, 25 bp, Mus musculus
cttagttatgaaagcacatgggttc

SEQ ID NO: 393658 - DNA, 25 bp, Mus musculus
cttagttatgaatgcacatgggttc

SEQ ID NO: 393659 - DNA, 25 bp, Mus musculus
cttagttcagatctctttccagcac

SEQ ID NO: 393660 - DNA, 25 bp, Mus musculus
cttagttcagatgtctttccagcac

SEQ ID NO: 393661 - DNA, 25 bp, Mus musculus
cttagttcctcactcttggttgtat

SEQ ID NO: 393662 - DNA, 25 bp, Mus musculus
cttagttcctcagtcttggttgtat

SEQ ID NO: 393663 - DNA, 25 bp, Mus musculus
cttagttcgattcgcaaaccctggt

SEQ ID NO: 393664 - DNA, 25 bp, Mus musculus
cttagttcgattggcaaaccctggt

SEQ ID NO: 393665 - DNA, 25 bp, Mus musculus
cttagttctgaaagatcctgacaaa

SEQ ID NO: 393666 - DNA, 25 bp, Mus musculus
cttagttctgaatgatcctgacaaa

SEQ ID NO: 393667 - DNA, 25 bp, Mus musculus
cttagttgactacaggcgcatggtt

SEQ ID NO: 393668 - DNA, 25 bp, Mus musculus
cttagttgactagaggcgcatggtt

SEQ ID NO: 393669 - DNA, 25 bp, Mus musculus
cttagttgcctaaatgatatctttc

SEQ ID NO: 393670 - DNA, 25 bp, Mus musculus
cttagttgcctatatgatatctttc

SEQ ID NO: 393671 - DNA, 25 bp, Mus musculus
cttagtttaagactgtatgtactgt

SEQ ID NO: 393672 - DNA, 25 bp, Mus musculus
cttagtttaagagtgtatgtactgt

SEQ ID NO: 393673 - DNA, 25 bp, Mus musculus
cttagtttacttaggcagggatgca

SEQ ID NO: 393674 - DNA, 25 bp, Mus musculus
cttagtttactttggcagggatgca

SEQ ID NO: 393675 - DNA, 25 bp, Mus musculus
cttagtttcaaaatggctgtgcagc

SEQ ID NO: 393676 - DNA, 25 bp, Mus musculus
cttagtttcaaattggctgtgcagc

SEQ ID NO: 393677 - DNA, 25 bp, Mus musculus
cttagtttcagtcaagtacaagttg

SEQ ID NO: 393678 - DNA, 25 bp, Mus musculus
cttagtttcagtgaagtacaagttg

SEQ ID NO: 393679 - DNA, 25 bp, Mus musculus
cttagtttctctcaattgctgtgat

SEQ ID NO: 393680 - DNA, 25 bp, Mus musculus
cttagtttctctgaattgctgtgat

SEQ ID NO: 393681 - DNA, 25 bp, Mus musculus
cttagtttctggagggctggttgtc

SEQ ID NO: 393682 - DNA, 25 bp, Mus musculus
cttagtttctggtgggctggttgtc

SEQ ID NO: 393683 - DNA, 25 bp, Mus musculus
cttagtttgcagaattttagtcatt

SEQ ID NO: 393684 - DNA, 25 bp, Mus musculus
cttagtttgcagtattttagtcatt

SEQ ID NO: 393685 - DNA, 25 bp, Mus musculus
cttagtttgctgatatatatgtctg

SEQ ID NO: 393686 - DNA, 25 bp, Mus musculus
cttagtttgctgttatatatgtctg

SEQ ID NO: 393687 - DNA, 25 bp, Mus musculus
cttagtttgggcatggaatcacagg

SEQ ID NO: 393688 - DNA, 25 bp, Mus musculus
cttagtttgggcttggaatcacagg

SEQ ID NO: 393689 - DNA, 25 bp, Mus musculus
cttagtttgtacatcctttgtttga

SEQ ID NO: 393690 - DNA, 25 bp, Mus musculus
cttagtttgtacttcctttgtttga

SEQ ID NO: 393691 - DNA, 25 bp, Mus musculus
cttagttttaaaaccggcagccatg

SEQ ID NO: 393692 - DNA, 25 bp, Mus musculus
cttagttttaaatccggcagccatg

SEQ ID NO: 393693 - DNA, 25 bp, Mus musculus
cttagttttgttagctcccagtgga

SEQ ID NO: 393694 - DNA, 25 bp, Mus musculus
cttagttttgtttgctcccagtgga

SEQ ID NO: 393695 - DNA, 25 bp, Mus musculus
cttataaaattgctgtttgcttgct

SEQ ID NO: 393696 - DNA, 25 bp, Mus musculus
cttataaaattggtgtttgcttgct

SEQ ID NO: 393697 - DNA, 25 bp, Mus musculus
cttataacttcaaatcaacctactg

SEQ ID NO: 393698 - DNA, 25 bp, Mus musculus
cttataacttcatatcaacctactg

SEQ ID NO: 393699 - DNA, 25 bp, Mus musculus
cttataatatctacagcaatggcaa

SEQ ID NO: 393700 - DNA, 25 bp, Mus musculus
cttataatatcttcagcaatggcaa

SEQ ID NO: 393701 - DNA, 25 bp, Mus musculus
cttataattggcatacctgaactat

SEQ ID NO: 393702 - DNA, 25 bp, Mus musculus
cttataattggcttacctgaactat

SEQ ID NO: 393703 - DNA, 25 bp, Mus musculus
cttatacaccctcttgacgaactca

SEQ ID NO: 393704 - DNA, 25 bp, Mus musculus
cttatacaccctgttgacgaactca

SEQ ID NO: 393705 - DNA, 25 bp, Mus musculus
cttatacattctatccagagtgtct

SEQ ID NO: 393706 - DNA, 25 bp, Mus musculus
cttatacattctttccagagtgtct

SEQ ID NO: 393707 - DNA, 25 bp, Mus musculus
cttatacgttccaatttcacatgtt

SEQ ID NO: 393708 - DNA, 25 bp, Mus musculus
cttatacgttcctatttcacatgtt

SEQ ID NO: 393709 - DNA, 25 bp, Mus musculus
cttatactcaggcatcccaggactc

SEQ ID NO: 393710 - DNA, 25 bp, Mus musculus
cttatactcagggatcccaggactc

SEQ ID NO: 393711 - DNA, 25 bp, Mus musculus
cttatagagactcggccctgtggtt

SEQ ID NO: 393712 - DNA, 25 bp, Mus musculus
cttatagagactgggccctgtggtt

SEQ ID NO: 393713 - DNA, 25 bp, Mus musculus
cttatagcaaaacgccatgtgtggc

SEQ ID NO: 393714 - DNA, 25 bp, Mus musculus
cttatagcaaaaggccatgtgtggc

SEQ ID NO: 393715 - DNA, 25 bp, Mus musculus
cttatagcatctcactctcattgta

SEQ ID NO: 393716 - DNA, 25 bp, Mus musculus
cttatagcatctgactctcattgta

SEQ ID NO: 393717 - DNA, 25 bp, Mus musculus
cttataggtttgaatggtgccagaa

SEQ ID NO: 393718 - DNA, 25 bp, Mus musculus
cttataggtttgtatggtgccagaa

SEQ ID NO: 393719 - DNA, 25 bp, Mus musculus
cttatatatcccagggttcctcact

SEQ ID NO: 393720 - DNA, 25 bp, Mus musculus
cttatatatccctgggttcctcact

SEQ ID NO: 393721 - DNA, 25 bp, Mus musculus
cttatatatgacatccatgttttca

SEQ ID NO: 393722 - DNA, 25 bp, Mus musculus
cttatatatgacttccatgttttca

SEQ ID NO: 393723 - DNA, 25 bp, Mus musculus
cttatatcccccacttaacaaatca

SEQ ID NO: 393724 - DNA, 25 bp, Mus musculus
cttatatccccctcttaacaaatca

SEQ ID NO: 393725 - DNA, 25 bp, Mus musculus
cttatatctcagacctttgttctct

SEQ ID NO: 393726 - DNA, 25 bp, Mus musculus
cttatatctcagtcctttgttctct

SEQ ID NO: 393727 - DNA, 25 bp, Mus musculus
cttatatctgccaagccaccaaggg

SEQ ID NO: 393728 - DNA, 25 bp, Mus musculus
cttatatctgcctagccaccaaggg

SEQ ID NO: 393729 - DNA, 25 bp, Mus musculus
cttatatgcagtcctagaggcaggt

SEQ ID NO: 393730 - DNA, 25 bp, Mus musculus
cttatatgcagtgctagaggcaggt

SEQ ID NO: 393731 - DNA, 25 bp, Mus musculus
cttatatgttagagagcacttgcaa

SEQ ID NO: 393732 - DNA, 25 bp, Mus musculus
cttatatgttagtgagcacttgcaa

SEQ ID NO: 393733 - DNA, 25 bp, Mus musculus
cttatcaatgatcagtgtttggttt

SEQ ID NO: 393734 - DNA, 25 bp, Mus musculus
cttatcaatgatgagtgtttggttt

SEQ ID NO: 393735 - DNA, 25 bp, Mus musculus
cttatcaccaccctaccaaaatgcc

SEQ ID NO: 393736 - DNA, 25 bp, Mus musculus
cttatcaccaccgtaccaaaatgcc

SEQ ID NO: 393737 - DNA, 25 bp, Mus musculus
cttatcactctaatttcccttctaa

SEQ ID NO: 393738 - DNA, 25 bp, Mus musculus
cttatcactctattttcccttctaa

SEQ ID NO: 393739 - DNA, 25 bp, Mus musculus
cttatcacttgcagtagatggctta

SEQ ID NO: 393740 - DNA, 25 bp, Mus musculus
cttatcacttgctgtagatggctta

SEQ ID NO: 393741 - DNA, 25 bp, Mus musculus
cttatcagtgtcaaagatgtctcca

SEQ ID NO: 393742 - DNA, 25 bp, Mus musculus
cttatcagtgtctaagatgtctcca

SEQ ID NO: 393743 - DNA, 25 bp, Mus musculus
cttatcccattacaggttccttatg

SEQ ID NO: 393744 - DNA, 25 bp, Mus musculus
cttatcccattagaggttccttatg

SEQ ID NO: 393745 - DNA, 25 bp, Mus musculus
cttatcccgcttcatctgtgagatg

SEQ ID NO: 393746 - DNA, 25 bp, Mus musculus
cttatcccgcttgatctgtgagatg

SEQ ID NO: 393747 - DNA, 25 bp, Mus musculus
cttatccctggtcatagttcgttat

SEQ ID NO: 393748 - DNA, 25 bp, Mus musculus
cttatccctggtgatagttcgttat

SEQ ID NO: 393749 - DNA, 25 bp, Mus musculus
cttatcctaataaggctggctgtaa

SEQ ID NO: 393750 - DNA, 25 bp, Mus musculus
cttatcctaatatggctggctgtaa

SEQ ID NO: 393751 - DNA, 25 bp, Mus musculus
cttatcctgcgtccccagaggcggg

SEQ ID NO: 393752 - DNA, 25 bp, Mus musculus
cttatcctgcgtgcccagaggcggg

SEQ ID NO: 393753 - DNA, 25 bp, Mus musculus
cttatcctgtttcagaggatgcaac

SEQ ID NO: 393754 - DNA, 25 bp, Mus musculus
cttatcctgtttgagaggatgcaac

SEQ ID NO: 393755 - DNA, 25 bp, Mus musculus
cttatctcagccatgtccatatgat

SEQ ID NO: 393756 - DNA, 25 bp, Mus musculus
cttatctcagccttgtccatatgat

SEQ ID NO: 393757 - DNA, 25 bp, Mus musculus
cttatctctcttattgttgtcttgt

SEQ ID NO: 393758 - DNA, 25 bp, Mus musculus
cttatctctctttttgttgtcttgt

SEQ ID NO: 393759 - DNA, 25 bp, Mus musculus
cttatctcttatcagtcaccttact

SEQ ID NO: 393760 - DNA, 25 bp, Mus musculus
cttatctcttatgagtcaccttact

SEQ ID NO: 393761 - DNA, 25 bp, Mus musculus
cttatctgcactcgccagaatactc

SEQ ID NO: 393762 - DNA, 25 bp, Mus musculus
cttatctgcactggccagaatactc

SEQ ID NO: 393763 - DNA, 25 bp, Mus musculus
cttatctgtattacatagcaacgtt

SEQ ID NO: 393764 - DNA, 25 bp, Mus musculus
cttatctgtatttcatagcaacgtt

SEQ ID NO: 393765 - DNA, 25 bp, Mus musculus
cttatctgtcatagtgcttttggtt

SEQ ID NO: 393766 - DNA, 25 bp, Mus musculus
cttatctgtcattgtgcttttggtt

SEQ ID NO: 393767 - DNA, 25 bp, Mus musculus
cttatctgtggtctactgtgattct

SEQ ID NO: 393768 - DNA, 25 bp, Mus musculus
cttatctgtggtgtactgtgattct

SEQ ID NO: 393769 - DNA, 25 bp, Mus musculus
cttatcttcaagaatttcactgcaa

SEQ ID NO: 393770 - DNA, 25 bp, Mus musculus
cttatcttcaagtatttcactgcaa

SEQ ID NO: 393771 - DNA, 25 bp, Mus musculus
cttatcttggacactaggctgcagg

SEQ ID NO: 393772 - DNA, 25 bp, Mus musculus
cttatcttggactctaggctgcagg

SEQ ID NO: 393773 - DNA, 25 bp, Mus musculus
cttatcttggctcttgcctttgagt

SEQ ID NO: 393774 - DNA, 25 bp, Mus musculus
cttatcttggctgttgcctttgagt

SEQ ID NO: 393775 - DNA, 25 bp, Mus musculus
cttatgaaacctatcactttgtatt

SEQ ID NO: 393776 - DNA, 25 bp, Mus musculus
cttatgaaacctttcactttgtatt

SEQ ID NO: 393777 - DNA, 25 bp, Mus musculus
cttatgaatctgctgctcttgggtt

SEQ ID NO: 393778 - DNA, 25 bp, Mus musculus
cttatgaatctggtgctcttgggtt

SEQ ID NO: 393779 - DNA, 25 bp, Mus musculus
cttatgaatgttatgaccattttca

SEQ ID NO: 393780 - DNA, 25 bp, Mus musculus
cttatgaatgttttgaccattttca

SEQ ID NO: 393781 - DNA, 25 bp, Mus musculus
cttatgacccatcagaggccttaat

SEQ ID NO: 393782 - DNA, 25 bp, Mus musculus
cttatgacccatgagaggccttaat

SEQ ID NO: 393783 - DNA, 25 bp, Mus musculus
cttatgaccgcactagtgaaggaca

SEQ ID NO: 393784 - DNA, 25 bp, Mus musculus
cttatgaccgcagtagtgaaggaca

SEQ ID NO: 393785 - DNA, 25 bp, Mus musculus
cttatgactaacacagtgatctcca

SEQ ID NO: 393786 - DNA, 25 bp, Mus musculus
cttatgactaactcagtgatctcca

SEQ ID NO: 393787 - DNA, 25 bp, Mus musculus
cttatgagcccaagtctgtatgtaa

SEQ ID NO: 393788 - DNA, 25 bp, Mus musculus
cttatgagcccatgtctgtatgtaa

SEQ ID NO: 393789 - DNA, 25 bp, Mus musculus
cttatgatcctcacgacatactctg

SEQ ID NO: 393790 - DNA, 25 bp, Mus musculus
cttatgatcctctcgacatactctg

SEQ ID NO: 393791 - DNA, 25 bp, Mus musculus
cttatgcagagtaagcctggtggca

SEQ ID NO: 393792 - DNA, 25 bp, Mus musculus
cttatgcagagttagcctggtggca

SEQ ID NO: 393793 - DNA, 25 bp, Mus musculus
cttatgcagctaatgtggatggcgt

SEQ ID NO: 393794 - DNA, 25 bp, Mus musculus
cttatgcagctattgtggatggcgt

SEQ ID NO: 393795 - DNA, 25 bp, Mus musculus
cttatgcatacacggaaagttcagc

SEQ ID NO: 393796 - DNA, 25 bp, Mus musculus
cttatgcatacagggaaagttcagc

SEQ ID NO: 393797 - DNA, 25 bp, Mus musculus
cttatgccaattacagactcctttt

SEQ ID NO: 393798 - DNA, 25 bp, Mus musculus
cttatgccaatttcagactcctttt

SEQ ID NO: 393799 - DNA, 25 bp, Mus musculus
cttatgcccctgacacagagcaaaa

SEQ ID NO: 393800 - DNA, 25 bp, Mus musculus
cttatgcccctgtcacagagcaaaa

SEQ ID NO: 393801 - DNA, 25 bp, Mus musculus
cttatgcctggaaacttctctgagc

SEQ ID NO: 393802 - DNA, 25 bp, Mus musculus
cttatgcctggatacttctctgagc

SEQ ID NO: 393803 - DNA, 25 bp, Mus musculus
cttatgcgttatcactatctctcct

SEQ ID NO: 393804 - DNA, 25 bp, Mus musculus
cttatgcgttatgactatctctcct

SEQ ID NO: 393805 - DNA, 25 bp, Mus musculus
cttatgctccccaagtatgctgacc

SEQ ID NO: 393806 - DNA, 25 bp, Mus musculus
cttatgctcccctagtatgctgacc

SEQ ID NO: 393807 - DNA, 25 bp, Mus musculus
cttatgctgagcacgaagatgccag

SEQ ID NO: 393808 - DNA, 25 bp, Mus musculus
cttatgctgagctcgaagatgccag

SEQ ID NO: 393809 - DNA, 25 bp, Mus musculus
cttatggaaagtcgtactcagctaa

SEQ ID NO: 393810 - DNA, 25 bp, Mus musculus
cttatggaaagtggtactcagctaa

SEQ ID NO: 393811 - DNA, 25 bp, Mus musculus
cttatggaacaactggctcagctca

SEQ ID NO: 393812 - DNA, 25 bp, Mus musculus
cttatggaacaagtggctcagctca

SEQ ID NO: 393813 - DNA, 25 bp, Mus musculus
cttatggagcggcactggagcaaac

SEQ ID NO: 393814 - DNA, 25 bp, Mus musculus
cttatggagcgggactggagcaaac

SEQ ID NO: 393815 - DNA, 25 bp, Mus musculus
cttatggatttcattcatcttttca

SEQ ID NO: 393816 - DNA, 25 bp, Mus musculus
cttatggatttctttcatcttttca

SEQ ID NO: 393817 - DNA, 25 bp, Mus musculus
cttatggcaccgataatctgtatcg

SEQ ID NO: 393818 - DNA, 25 bp, Mus musculus
cttatggcaccgttaatctgtatcg

SEQ ID NO: 393819 - DNA, 25 bp, Mus musculus
cttatggccaggatgaagaatatgt

SEQ ID NO: 393820 - DNA, 25 bp, Mus musculus
cttatggccaggttgaagaatatgt

SEQ ID NO: 393821 - DNA, 25 bp, Mus musculus
cttatggcctcacggatattccaca

SEQ ID NO: 393822 - DNA, 25 bp, Mus musculus
cttatggcctcagggatattccaca

SEQ ID NO: 393823 - DNA, 25 bp, Mus musculus
cttatggctcctaagtgtttagtaa

SEQ ID NO: 393824 - DNA, 25 bp, Mus musculus
cttatggctccttagtgtttagtaa

SEQ ID NO: 393825 - DNA, 25 bp, Mus musculus
cttatgggactaattcagtggtgta

SEQ ID NO: 393826 - DNA, 25 bp, Mus musculus
cttatgggactatttcagtggtgta

SEQ ID NO: 393827 - DNA, 25 bp, Mus musculus
cttatgggccatccagcagcaagga

SEQ ID NO: 393828 - DNA, 25 bp, Mus musculus
cttatgggccatgcagcagcaagga

SEQ ID NO: 393829 - DNA, 25 bp, Mus musculus
cttatgggtgatacaggctgcctga

SEQ ID NO: 393830 - DNA, 25 bp, Mus musculus
cttatgggtgattcaggctgcctga

SEQ ID NO: 393831 - DNA, 25 bp, Mus musculus
cttatggtcaagagcaaaagcagtt

SEQ ID NO: 393832 - DNA, 25 bp, Mus musculus
cttatggtcaagtgcaaaagcagtt

SEQ ID NO: 393833 - DNA, 25 bp, Mus musculus
cttatggttgggacgatggttcttc

SEQ ID NO: 393834 - DNA, 25 bp, Mus musculus
cttatggttgggtcgatggttcttc

SEQ ID NO: 393835 - DNA, 25 bp, Mus musculus
cttatgtaacacatggtccttgtaa

SEQ ID NO: 393836 - DNA, 25 bp, Mus musculus
cttatgtaacacttggtccttgtaa

SEQ ID NO: 393837 - DNA, 25 bp, Mus musculus
cttatgtaacatagacctgtggaca

SEQ ID NO: 393838 - DNA, 25 bp, Mus musculus
cttatgtaacattgacctgtggaca

SEQ ID NO: 393839 - DNA, 25 bp, Mus musculus
cttatgtaattgcattccggccagt

SEQ ID NO: 393840 - DNA, 25 bp, Mus musculus
cttatgtaattggattccggccagt

SEQ ID NO: 393841 - DNA, 25 bp, Mus musculus
cttatgtacttcagaaaagtcccca

SEQ ID NO: 393842 - DNA, 25 bp, Mus musculus
cttatgtacttctgaaaagtcccca

SEQ ID NO: 393843 - DNA, 25 bp, Mus musculus
cttatgtactttcactggccttgaa

SEQ ID NO: 393844 - DNA, 25 bp, Mus musculus
cttatgtactttgactggccttgaa

SEQ ID NO: 393845 - DNA, 25 bp, Mus musculus
cttatgtagaagctgttcgcctgga

SEQ ID NO: 393846 - DNA, 25 bp, Mus musculus
cttatgtagaaggtgttcgcctgga

SEQ ID NO: 393847 - DNA, 25 bp, Mus musculus
cttatgtatacgcttgcctcggata

SEQ ID NO: 393848 - DNA, 25 bp, Mus musculus
cttatgtatacggttgcctcggata

SEQ ID NO: 393849 - DNA, 25 bp, Mus musculus
cttatgtcagaactttccaggcact

SEQ ID NO: 393850 - DNA, 25 bp, Mus musculus
cttatgtcagaagtttccaggcact

SEQ ID NO: 393851 - DNA, 25 bp, Mus musculus
cttatgtgccagaaacttcggtttc

SEQ ID NO: 393852 - DNA, 25 bp, Mus musculus
cttatgtgccagtaacttcggtttc

SEQ ID NO: 393853 - DNA, 25 bp, Mus musculus
cttatgtggacacttccaggtaaac

SEQ ID NO: 393854 - DNA, 25 bp, Mus musculus
cttatgtggacagttccaggtaaac

SEQ ID NO: 393855 - DNA, 25 bp, Mus musculus
cttatgtgtgttcccattgtggtca

SEQ ID NO: 393856 - DNA, 25 bp, Mus musculus
cttatgtgtgttgccattgtggtca

SEQ ID NO: 393857 - DNA, 25 bp, Mus musculus
cttatgttaatgactgtgagattct

SEQ ID NO: 393858 - DNA, 25 bp, Mus musculus
cttatgttaatgtctgtgagattct

SEQ ID NO: 393859 - DNA, 25 bp, Mus musculus
cttatgttctctaccaaatcttcag

SEQ ID NO: 393860 - DNA, 25 bp, Mus musculus
cttatgttctcttccaaatcttcag

SEQ ID NO: 393861 - DNA, 25 bp, Mus musculus
cttatgtttttgagcactggtttgt

SEQ ID NO: 393862 - DNA, 25 bp, Mus musculus
cttatgtttttgtgcactggtttgt

SEQ ID NO: 393863 - DNA, 25 bp, Mus musculus
cttattactcttcctatgcgcatag

SEQ ID NO: 393864 - DNA, 25 bp, Mus musculus
cttattactcttgctatgcgcatag

SEQ ID NO: 393865 - DNA, 25 bp, Mus musculus
cttattagctaactgcagcctggta

SEQ ID NO: 393866 - DNA, 25 bp, Mus musculus
cttattagctaagtgcagcctggta

SEQ ID NO: 393867 - DNA, 25 bp, Mus musculus
cttattcaccctcagagccgggaaa

SEQ ID NO: 393868 - DNA, 25 bp, Mus musculus
cttattcaccctgagagccgggaaa

SEQ ID NO: 393869 - DNA, 25 bp, Mus musculus
cttattccatgactgcttcccctaa

SEQ ID NO: 393870 - DNA, 25 bp, Mus musculus
cttattccatgagtgcttcccctaa

SEQ ID NO: 393871 - DNA, 25 bp, Mus musculus
cttattcccaagatctggccattat

SEQ ID NO: 393872 - DNA, 25 bp, Mus musculus
cttattcccaagttctggccattat

SEQ ID NO: 393873 - DNA, 25 bp, Mus musculus
cttattcccaggatgaattgggact

SEQ ID NO: 393874 - DNA, 25 bp, Mus musculus
cttattcccaggttgaattgggact

SEQ ID NO: 393875 - DNA, 25 bp, Mus musculus
cttattccccggacttcaagatgaa

SEQ ID NO: 393876 - DNA, 25 bp, Mus musculus
cttattccccggtcttcaagatgaa

SEQ ID NO: 393877 - DNA, 25 bp, Mus musculus
cttattcccgtgctggtgattccca

SEQ ID NO: 393878 - DNA, 25 bp, Mus musculus
cttattcccgtggtggtgattccca

SEQ ID NO: 393879 - DNA, 25 bp, Mus musculus
cttattcccttcaccttgagatttt

SEQ ID NO: 393880 - DNA, 25 bp, Mus musculus
cttattcccttctccttgagatttt

SEQ ID NO: 393881 - DNA, 25 bp, Mus musculus
cttattccttgcaaccatggtgata

SEQ ID NO: 393882 - DNA, 25 bp, Mus musculus
cttattccttgctaccatggtgata

SEQ ID NO: 393883 - DNA, 25 bp, Mus musculus
cttattcttaacacatgggccggtt

SEQ ID NO: 393884 - DNA, 25 bp, Mus musculus
cttattcttaactcatgggccggtt

SEQ ID NO: 393885 - DNA, 25 bp, Mus musculus
cttattgaagccctgattgactgat

SEQ ID NO: 393886 - DNA, 25 bp, Mus musculus
cttattgaagccgtgattgactgat

SEQ ID NO: 393887 - DNA, 25 bp, Mus musculus
cttattgaggctccatgggacggca

SEQ ID NO: 393888 - DNA, 25 bp, Mus musculus
cttattgaggctgcatgggacggca

SEQ ID NO: 393889 - DNA, 25 bp, Mus musculus
cttattgagtctagcagtttctgtt

SEQ ID NO: 393890 - DNA, 25 bp, Mus musculus
cttattgagtcttgcagtttctgtt

SEQ ID NO: 393891 - DNA, 25 bp, Mus musculus
cttattgccctcattgtggtgctgg

SEQ ID NO: 393892 - DNA, 25 bp, Mus musculus
cttattgccctctttgtggtgctgg

SEQ ID NO: 393893 - DNA, 25 bp, Mus musculus
cttattggccttcccttgctgctga

SEQ ID NO: 393894 - DNA, 25 bp, Mus musculus
cttattggccttgccttgctgctga

SEQ ID NO: 393895 - DNA, 25 bp, Mus musculus
cttattgggacgacatctctgactc

SEQ ID NO: 393896 - DNA, 25 bp, Mus musculus
cttattgggacgtcatctctgactc

SEQ ID NO: 393897 - DNA, 25 bp, Mus musculus
cttattggtgcgctccaggctggcc

SEQ ID NO: 393898 - DNA, 25 bp, Mus musculus
cttattggtgcggtccaggctggcc

SEQ ID NO: 393899 - DNA, 25 bp, Mus musculus
cttattgtcaccagggtgtcctatt

SEQ ID NO: 393900 - DNA, 25 bp, Mus musculus
cttattgtcacctgggtgtcctatt

SEQ ID NO: 393901 - DNA, 25 bp, Mus musculus
cttattgtgacaaccttcccttggc

SEQ ID NO: 393902 - DNA, 25 bp, Mus musculus
cttattgtgacatccttcccttggc

SEQ ID NO: 393903 - DNA, 25 bp, Mus musculus
cttatttaccaacttatcatctctg

SEQ ID NO: 393904 - DNA, 25 bp, Mus musculus
cttatttaccaagttatcatctctg

SEQ ID NO: 393905 - DNA, 25 bp, Mus musculus
cttatttacctaagaatcgcttgtc

SEQ ID NO: 393906 - DNA, 25 bp, Mus musculus
cttatttacctatgaatcgcttgtc

SEQ ID NO: 393907 - DNA, 25 bp, Mus musculus
cttatttattcccatcattgatcca

SEQ ID NO: 393908 - DNA, 25 bp, Mus musculus
cttatttattccgatcattgatcca

SEQ ID NO: 393909 - DNA, 25 bp, Mus musculus
cttatttcacaacgatggagagaag

SEQ ID NO: 393910 - DNA, 25 bp, Mus musculus
cttatttcacaaggatggagagaag

SEQ ID NO: 393911 - DNA, 25 bp, Mus musculus
cttatttccataatccgggaggcaa

SEQ ID NO: 393912 - DNA, 25 bp, Mus musculus
cttatttccatattccgggaggcaa

SEQ ID NO: 393913 - DNA, 25 bp, Mus musculus
cttatttccgttactcaaggcaggg

SEQ ID NO: 393914 - DNA, 25 bp, Mus musculus
cttatttccgtttctcaaggcaggg

SEQ ID NO: 393915 - DNA, 25 bp, Mus musculus
cttatttcgttgctctttgtgtctg

SEQ ID NO: 393916 - DNA, 25 bp, Mus musculus
cttatttcgttggtctttgtgtctg

SEQ ID NO: 393917 - DNA, 25 bp, Mus musculus
cttatttgcacccatctagtcaacc

SEQ ID NO: 393918 - DNA, 25 bp, Mus musculus
cttatttgcaccgatctagtcaacc

SEQ ID NO: 393919 - DNA, 25 bp, Mus musculus
cttatttggaggagggaccacgctc

SEQ ID NO: 393920 - DNA, 25 bp, Mus musculus
cttatttggaggtgggaccacgctc

SEQ ID NO: 393921 - DNA, 25 bp, Mus musculus
cttatttgggcccccagagttatgt

SEQ ID NO: 393922 - DNA, 25 bp, Mus musculus
cttatttgggccgccagagttatgt

SEQ ID NO: 393923 - DNA, 25 bp, Mus musculus
cttatttgtgataggtaggcagttc

SEQ ID NO: 393924 - DNA, 25 bp, Mus musculus
cttatttgtgattggtaggcagttc

SEQ ID NO: 393925 - DNA, 25 bp, Mus musculus
cttattttcagcctaatgtctacag

SEQ ID NO: 393926 - DNA, 25 bp, Mus musculus
cttattttcagcgtaatgtctacag

SEQ ID NO: 393927 - DNA, 25 bp, Mus musculus
cttattttgcttagatgtgctgggc

SEQ ID NO: 393928 - DNA, 25 bp, Mus musculus
cttattttgctttgatgtgctgggc

SEQ ID NO: 393929 - DNA, 25 bp, Mus musculus
cttatttttgaacggcactgaacca

SEQ ID NO: 393930 - DNA, 25 bp, Mus musculus
cttatttttgaagggcactgaacca

SEQ ID NO: 393931 - DNA, 25 bp, Mus musculus
cttatttttgtcagctttatggttc

SEQ ID NO: 393932 - DNA, 25 bp, Mus musculus
cttatttttgtctgctttatggttc

SEQ ID NO: 393933 - DNA, 25 bp, Mus musculus
cttcaaaaccacatatgaccagatg

SEQ ID NO: 393934 - DNA, 25 bp, Mus musculus
cttcaaaaccacttatgaccagatg

SEQ ID NO: 393935 - DNA, 25 bp, Mus musculus
cttcaaaagcaaccctcagcacagg

SEQ ID NO: 393936 - DNA, 25 bp, Mus musculus
cttcaaaagcaagcctcagcacagg

SEQ ID NO: 393937 - DNA, 25 bp, Mus musculus
cttcaaaatagcacaaacggttggg

SEQ ID NO: 393938 - DNA, 25 bp, Mus musculus
cttcaaaatagctcaaacggttggg

SEQ ID NO: 393939 - DNA, 25 bp, Mus musculus
cttcaaacagttctgccgagtgtgt

SEQ ID NO: 393940 - DNA, 25 bp, Mus musculus
cttcaaacagttgtgccgagtgtgt

SEQ ID NO: 393941 - DNA, 25 bp, Mus musculus
cttcaaaccactccgaactttctaa

SEQ ID NO: 393942 - DNA, 25 bp, Mus musculus
cttcaaaccactgcgaactttctaa

SEQ ID NO: 393943 - DNA, 25 bp, Mus musculus
cttcaaaccctgaccactatcgctg

SEQ ID NO: 393944 - DNA, 25 bp, Mus musculus
cttcaaaccctgtccactatcgctg

SEQ ID NO: 393945 - DNA, 25 bp, Mus musculus
cttcaaacggacctgcatcctggag

SEQ ID NO: 393946 - DNA, 25 bp, Mus musculus
cttcaaacggacgtgcatcctggag

SEQ ID NO: 393947 - DNA, 25 bp, Mus musculus
cttcaaactatgaagccgaggctag

SEQ ID NO: 393948 - DNA, 25 bp, Mus musculus
cttcaaactatgtagccgaggctag

SEQ ID NO: 393949 - DNA, 25 bp, Mus musculus
cttcaaaggcaacagctggaggcta

SEQ ID NO: 393950 - DNA, 25 bp, Mus musculus
cttcaaaggcaagagctggaggcta

SEQ ID NO: 393951 - DNA, 25 bp, Mus musculus
cttcaaagtttaattccagccagga

SEQ ID NO: 393952 - DNA, 25 bp, Mus musculus
cttcaaagtttatttccagccagga

SEQ ID NO: 393953 - DNA, 25 bp, Mus musculus
cttcaaagtttgagctcctatgttt

SEQ ID NO: 393954 - DNA, 25 bp, Mus musculus
cttcaaagtttgtgctcctatgttt

SEQ ID NO: 393955 - DNA, 25 bp, Mus musculus
cttcaaataagccagctgccagctg

SEQ ID NO: 393956 - DNA, 25 bp, Mus musculus
cttcaaataagcgagctgccagctg

SEQ ID NO: 393957 - DNA, 25 bp, Mus musculus
cttcaaatagagctctcctgtgtgc

SEQ ID NO: 393958 - DNA, 25 bp, Mus musculus
cttcaaatagaggtctcctgtgtgc

SEQ ID NO: 393959 - DNA, 25 bp, Mus musculus
cttcaaatatagctgcttccttcta

SEQ ID NO: 393960 - DNA, 25 bp, Mus musculus
cttcaaatataggtgcttccttcta

SEQ ID NO: 393961 - DNA, 25 bp, Mus musculus
cttcaaatcgagaccaggacaggca

SEQ ID NO: 393962 - DNA, 25 bp, Mus musculus
cttcaaatcgagtccaggacaggca

SEQ ID NO: 393963 - DNA, 25 bp, Mus musculus
cttcaacacactcggactcatttgt

SEQ ID NO: 393964 - DNA, 25 bp, Mus musculus
cttcaacacactgggactcatttgt

SEQ ID NO: 393965 - DNA, 25 bp, Mus musculus
cttcaacacggcacagaatccaaac

SEQ ID NO: 393966 - DNA, 25 bp, Mus musculus
cttcaacacggctcagaatccaaac

SEQ ID NO: 393967 - DNA, 25 bp, Mus musculus
cttcaacacttaagcatctttcttt

SEQ ID NO: 393968 - DNA, 25 bp, Mus musculus
cttcaacacttatgcatctttcttt

SEQ ID NO: 393969 - DNA, 25 bp, Mus musculus
cttcaaccacaacttctacagaagc

SEQ ID NO: 393970 - DNA, 25 bp, Mus musculus
cttcaaccacaagttctacagaagc

SEQ ID NO: 393971 - DNA, 25 bp, Mus musculus
cttcaacccttcaatcttcaaagat

SEQ ID NO: 393972 - DNA, 25 bp, Mus musculus
cttcaacccttctatcttcaaagat

SEQ ID NO: 393973 - DNA, 25 bp, Mus musculus
cttcaaccttgtcgcagggaggaca

SEQ ID NO: 393974 - DNA, 25 bp, Mus musculus
cttcaaccttgtggcagggaggaca

SEQ ID NO: 393975 - DNA, 25 bp, Mus musculus
cttcaactaagaatgtccttgtaga

SEQ ID NO: 393976 - DNA, 25 bp, Mus musculus
cttcaactaagattgtccttgtaga

SEQ ID NO: 393977 - DNA, 25 bp, Mus musculus
cttcaactgcaaagtctgggactct

SEQ ID NO: 393978 - DNA, 25 bp, Mus musculus
cttcaactgcaatgtctgggactct

SEQ ID NO: 393979 - DNA, 25 bp, Mus musculus
cttcaactgctgagccatgctattt

SEQ ID NO: 393980 - DNA, 25 bp, Mus musculus
cttcaactgctgtgccatgctattt

SEQ ID NO: 393981 - DNA, 25 bp, Mus musculus
cttcaactgcttcttgtcttctgtc

SEQ ID NO: 393982 - DNA, 25 bp, Mus musculus
cttcaactgcttgttgtcttctgtc

SEQ ID NO: 393983 - DNA, 25 bp, Mus musculus
cttcaactggaaatttctccttcta

SEQ ID NO: 393984 - DNA, 25 bp, Mus musculus
cttcaactggaattttctccttcta

SEQ ID NO: 393985 - DNA, 25 bp, Mus musculus
cttcaactggcaaggacaggagcct

SEQ ID NO: 393986 - DNA, 25 bp, Mus musculus
cttcaactggcatggacaggagcct

SEQ ID NO: 393987 - DNA, 25 bp, Mus musculus
cttcaactgtatatattgctgcgtt

SEQ ID NO: 393988 - DNA, 25 bp, Mus musculus
cttcaactgtatttattgctgcgtt

SEQ ID NO: 393989 - DNA, 25 bp, Mus musculus
cttcaactgtgtactccctggcatt

SEQ ID NO: 393990 - DNA, 25 bp, Mus musculus
cttcaactgtgttctccctggcatt

SEQ ID NO: 393991 - DNA, 25 bp, Mus musculus
cttcaactgttgaccatattactgt

SEQ ID NO: 393992 - DNA, 25 bp, Mus musculus
cttcaactgttgtccatattactgt

SEQ ID NO: 393993 - DNA, 25 bp, Mus musculus
cttcaacttcctcatcagtacattt

SEQ ID NO: 393994 - DNA, 25 bp, Mus musculus
cttcaacttcctgatcagtacattt

SEQ ID NO: 393995 - DNA, 25 bp, Mus musculus
cttcaacttcgtcggcgcctttatg

SEQ ID NO: 393996 - DNA, 25 bp, Mus musculus
cttcaacttcgtgggcgcctttatg

SEQ ID NO: 393997 - DNA, 25 bp, Mus musculus
cttcaacttctaattggtcctttgt

SEQ ID NO: 393998 - DNA, 25 bp, Mus musculus
cttcaacttctatttggtcctttgt

SEQ ID NO: 393999 - DNA, 25 bp, Mus musculus
cttcaagaaatcattcaggcgggac

SEQ ID NO: 394000 - DNA, 25 bp, Mus musculus
cttcaagaaatctttcaggcgggac

SEQ ID NO: 394001 - DNA, 25 bp, Mus musculus
cttcaagaagatcctctgccgtggg

SEQ ID NO: 394002 - DNA, 25 bp, Mus musculus
cttcaagaagatgctctgccgtggg

SEQ ID NO: 394003 - DNA, 25 bp, Mus musculus
cttcaagaaggacctgcacaaagcg

SEQ ID NO: 394004 - DNA, 25 bp, Mus musculus
cttcaagaaggagctgcacaaagcg

SEQ ID NO: 394005 - DNA, 25 bp, Mus musculus
cttcaagacaacctcccagaaggtg

SEQ ID NO: 394006 - DNA, 25 bp, Mus musculus
cttcaagacaacgtcccagaaggtg

SEQ ID NO: 394007 - DNA, 25 bp, Mus musculus
cttcaagatgcacccctaggatggg

SEQ ID NO: 394008 - DNA, 25 bp, Mus musculus
cttcaagatgcagccctaggatggg

SEQ ID NO: 394009 - DNA, 25 bp, Mus musculus
cttcaagattaactgcgtggccttt

SEQ ID NO: 394010 - DNA, 25 bp, Mus musculus
cttcaagattaagtgcgtggccttt

SEQ ID NO: 394011 - DNA, 25 bp, Mus musculus
cttcaagattatatgttttcccttg

SEQ ID NO: 394012 - DNA, 25 bp, Mus musculus
cttcaagattatttgttttcccttg

SEQ ID NO: 394013 - DNA, 25 bp, Mus musculus
cttcaagcacaacccagagctactg

SEQ ID NO: 394014 - DNA, 25 bp, Mus musculus
cttcaagcacaagccagagctactg

SEQ ID NO: 394015 - DNA, 25 bp, Mus musculus
cttcaagcacatcgtcacgcgggtg

SEQ ID NO: 394016 - DNA, 25 bp, Mus musculus
cttcaagcacatggtcacgcgggtg

SEQ ID NO: 394017 - DNA, 25 bp, Mus musculus
cttcaagccattcccaggatcatta

SEQ ID NO: 394018 - DNA, 25 bp, Mus musculus
cttcaagccattgccaggatcatta

SEQ ID NO: 394019 - DNA, 25 bp, Mus musculus
cttcaagcccacattccagcgaaag

SEQ ID NO: 394020 - DNA, 25 bp, Mus musculus
cttcaagcccactttccagcgaaag

SEQ ID NO: 394021 - DNA, 25 bp, Mus musculus
cttcaagctataatgctatgcacat

SEQ ID NO: 394022 - DNA, 25 bp, Mus musculus
cttcaagctatattgctatgcacat

SEQ ID NO: 394023 - DNA, 25 bp, Mus musculus
cttcaaggaactcaaaggaggctgt

SEQ ID NO: 394024 - DNA, 25 bp, Mus musculus
cttcaaggaactgaaaggaggctgt

SEQ ID NO: 394025 - DNA, 25 bp, Mus musculus
cttcaaggctggatctctgagtcaa

SEQ ID NO: 394026 - DNA, 25 bp, Mus musculus
cttcaaggctggttctctgagtcaa

SEQ ID NO: 394027 - DNA, 25 bp, Mus musculus
cttcaaggcttcaagaggacatttt

SEQ ID NO: 394028 - DNA, 25 bp, Mus musculus
cttcaaggcttctagaggacatttt

SEQ ID NO: 394029 - DNA, 25 bp, Mus musculus
cttcaagtgggcagtttctgatcat

SEQ ID NO: 394030 - DNA, 25 bp, Mus musculus
cttcaagtgggctgtttctgatcat

SEQ ID NO: 394031 - DNA, 25 bp, Mus musculus
cttcaagtggtaatgccgcatacca

SEQ ID NO: 394032 - DNA, 25 bp, Mus musculus
cttcaagtggtattgccgcatacca

SEQ ID NO: 394033 - DNA, 25 bp, Mus musculus
cttcaagttatcatccccacgaggt

SEQ ID NO: 394034 - DNA, 25 bp, Mus musculus
cttcaagttatcttccccacgaggt

SEQ ID NO: 394035 - DNA, 25 bp, Mus musculus
cttcaatagagacttccagccaggg

SEQ ID NO: 394036 - DNA, 25 bp, Mus musculus
cttcaatagagagttccagccaggg

SEQ ID NO: 394037 - DNA, 25 bp, Mus musculus
cttcaatatagtcctaacgtgggat

SEQ ID NO: 394038 - DNA, 25 bp, Mus musculus
cttcaatatagtgctaacgtgggat

SEQ ID NO: 394039 - DNA, 25 bp, Mus musculus
cttcaatcacctagagctgcacgag

SEQ ID NO: 394040 - DNA, 25 bp, Mus musculus
cttcaatcaccttgagctgcacgag

SEQ ID NO: 394041 - DNA, 25 bp, Mus musculus
cttcaatcctgtctgtcccggaaca

SEQ ID NO: 394042 - DNA, 25 bp, Mus musculus
cttcaatcctgtgtgtcccggaaca

SEQ ID NO: 394043 - DNA, 25 bp, Mus musculus
cttcaatctaagcacttgttttggg

SEQ ID NO: 394044 - DNA, 25 bp, Mus musculus
cttcaatctaaggacttgttttggg

SEQ ID NO: 394045 - DNA, 25 bp, Mus musculus
cttcaatctctaacctaccattagt

SEQ ID NO: 394046 - DNA, 25 bp, Mus musculus
cttcaatctctatcctaccattagt

SEQ ID NO: 394047 - DNA, 25 bp, Mus musculus
cttcaatctgttaggctggcttgct

SEQ ID NO: 394048 - DNA, 25 bp, Mus musculus
cttcaatctgtttggctggcttgct

SEQ ID NO: 394049 - DNA, 25 bp, Mus musculus
cttcaatgattgaagatgtatagga

SEQ ID NO: 394050 - DNA, 25 bp, Mus musculus
cttcaatgattgtagatgtatagga

SEQ ID NO: 394051 - DNA, 25 bp, Mus musculus
cttcaatggcctcgccgctgtacga

SEQ ID NO: 394052 - DNA, 25 bp, Mus musculus
cttcaatggcctggccgctgtacga

SEQ ID NO: 394053 - DNA, 25 bp, Mus musculus
cttcaatgtagtcccttgatttatt

SEQ ID NO: 394054 - DNA, 25 bp, Mus musculus
cttcaatgtagtgccttgatttatt

SEQ ID NO: 394055 - DNA, 25 bp, Mus musculus
cttcaatgttcacatggagcccaaa

SEQ ID NO: 394056 - DNA, 25 bp, Mus musculus
cttcaatgttcagatggagcccaaa

SEQ ID NO: 394057 - DNA, 25 bp, Mus musculus
cttcacaaagttaggctcccttttg

SEQ ID NO: 394058 - DNA, 25 bp, Mus musculus
cttcacaaagtttggctcccttttg

SEQ ID NO: 394059 - DNA, 25 bp, Mus musculus
cttcacaaggtcatgctgttgttgt

SEQ ID NO: 394060 - DNA, 25 bp, Mus musculus
cttcacaaggtcttgctgttgttgt

SEQ ID NO: 394061 - DNA, 25 bp, Mus musculus
cttcacaatgaacccagatgctctg

SEQ ID NO: 394062 - DNA, 25 bp, Mus musculus
cttcacaatgaagccagatgctctg

SEQ ID NO: 394063 - DNA, 25 bp, Mus musculus
cttcacaccaagcacaacttcagga

SEQ ID NO: 394064 - DNA, 25 bp, Mus musculus
cttcacaccaaggacaacttcagga

SEQ ID NO: 394065 - DNA, 25 bp, Mus musculus
cttcacacctccaataggcagattg

SEQ ID NO: 394066 - DNA, 25 bp, Mus musculus
cttcacacctcctataggcagattg

SEQ ID NO: 394067 - DNA, 25 bp, Mus musculus
cttcacacttctcacttcaagtact

SEQ ID NO: 394068 - DNA, 25 bp, Mus musculus
cttcacacttctgacttcaagtact

SEQ ID NO: 394069 - DNA, 25 bp, Mus musculus
cttcacagaacaagggccccgggag

SEQ ID NO: 394070 - DNA, 25 bp, Mus musculus
cttcacagaacatgggccccgggag

SEQ ID NO: 394071 - DNA, 25 bp, Mus musculus
cttcacagtgaccagtagttttata

SEQ ID NO: 394072 - DNA, 25 bp, Mus musculus
cttcacagtgacgagtagttttata

SEQ ID NO: 394073 - DNA, 25 bp, Mus musculus
cttcacagttctctttgcattttag

SEQ ID NO: 394074 - DNA, 25 bp, Mus musculus
cttcacagttctgtttgcattttag

SEQ ID NO: 394075 - DNA, 25 bp, Mus musculus
cttcacatacagcagcgacagtttt

SEQ ID NO: 394076 - DNA, 25 bp, Mus musculus
cttcacatacaggagcgacagtttt

SEQ ID NO: 394077 - DNA, 25 bp, Mus musculus
cttcacatcgagcatctgccggaaa

SEQ ID NO: 394078 - DNA, 25 bp, Mus musculus
cttcacatcgaggatctgccggaaa

SEQ ID NO: 394079 - DNA, 25 bp, Mus musculus
cttcacatgggtacttagtgtcctt

SEQ ID NO: 394080 - DNA, 25 bp, Mus musculus
cttcacatgggttcttagtgtcctt

SEQ ID NO: 394081 - DNA, 25 bp, Mus musculus
cttcacattcaacagctgcctgatt

SEQ ID NO: 394082 - DNA, 25 bp, Mus musculus
cttcacattcaagagctgcctgatt

SEQ ID NO: 394083 - DNA, 25 bp, Mus musculus
cttcacatttccagattcagataac

SEQ ID NO: 394084 - DNA, 25 bp, Mus musculus
cttcacatttcctgattcagataac

SEQ ID NO: 394085 - DNA, 25 bp, Mus musculus
cttcaccacagtagcctaggtcaaa

SEQ ID NO: 394086 - DNA, 25 bp, Mus musculus
cttcaccacagttgcctaggtcaaa

SEQ ID NO: 394087 - DNA, 25 bp, Mus musculus
cttcaccaggctcttgtcttgtctt

SEQ ID NO: 394088 - DNA, 25 bp, Mus musculus
cttcaccaggctgttgtcttgtctt

SEQ ID NO: 394089 - DNA, 25 bp, Mus musculus
cttcaccagtttagccttcgggcag

SEQ ID NO: 394090 - DNA, 25 bp, Mus musculus
cttcaccagttttgccttcgggcag

SEQ ID NO: 394091 - DNA, 25 bp, Mus musculus
cttcaccatggcagaactgatccaa

SEQ ID NO: 394092 - DNA, 25 bp, Mus musculus
cttcaccatggctgaactgatccaa

SEQ ID NO: 394093 - DNA, 25 bp, Mus musculus
cttcacccacagagcacataaatct

SEQ ID NO: 394094 - DNA, 25 bp, Mus musculus
cttcacccacagtgcacataaatct

SEQ ID NO: 394095 - DNA, 25 bp, Mus musculus
cttcacccagagaaccaatcttatt

SEQ ID NO: 394096 - DNA, 25 bp, Mus musculus
cttcacccagagtaccaatcttatt

SEQ ID NO: 394097 - DNA, 25 bp, Mus musculus
cttcacccagtgcatccagtagctg

SEQ ID NO: 394098 - DNA, 25 bp, Mus musculus
cttcacccagtggatccagtagctg

SEQ ID NO: 394099 - DNA, 25 bp, Mus musculus
cttcaccccgttctatgaagccagg

SEQ ID NO: 394100 - DNA, 25 bp, Mus musculus
cttcaccccgttgtatgaagccagg

SEQ ID NO: 394101 - DNA, 25 bp, Mus musculus
cttcacccgcaccatttatttgaat

SEQ ID NO: 394102 - DNA, 25 bp, Mus musculus
cttcacccgcacgatttatttgaat

SEQ ID NO: 394103 - DNA, 25 bp, Mus musculus
cttcaccctggcagccttgtgggaa

SEQ ID NO: 394104 - DNA, 25 bp, Mus musculus
cttcaccctggctgccttgtgggaa

SEQ ID NO: 394105 - DNA, 25 bp, Mus musculus
cttcaccctgggaaacattggaata

SEQ ID NO: 394106 - DNA, 25 bp, Mus musculus
cttcaccctgggtaacattggaata

SEQ ID NO: 394107 - DNA, 25 bp, Mus musculus
cttcacccttctaattcatctatca

SEQ ID NO: 394108 - DNA, 25 bp, Mus musculus
cttcacccttcttattcatctatca

SEQ ID NO: 394109 - DNA, 25 bp, Mus musculus
cttcaccgcatccagcaggattatt

SEQ ID NO: 394110 - DNA, 25 bp, Mus musculus
cttcaccgcatcgagcaggattatt

SEQ ID NO: 394111 - DNA, 25 bp, Mus musculus
cttcaccgtgccagactagagtcaa

SEQ ID NO: 394112 - DNA, 25 bp, Mus musculus
cttcaccgtgcctgactagagtcaa

SEQ ID NO: 394113 - DNA, 25 bp, Mus musculus
cttcaccgttcaacagaggctattt

SEQ ID NO: 394114 - DNA, 25 bp, Mus musculus
cttcaccgttcatcagaggctattt

SEQ ID NO: 394115 - DNA, 25 bp, Mus musculus
cttcacctatttatctttgcacgat

SEQ ID NO: 394116 - DNA, 25 bp, Mus musculus
cttcacctatttttctttgcacgat

SEQ ID NO: 394117 - DNA, 25 bp, Mus musculus
cttcacctcctgagtagtattacag

SEQ ID NO: 394118 - DNA, 25 bp, Mus musculus
cttcacctcctgtgtagtattacag

SEQ ID NO: 394119 - DNA, 25 bp, Mus musculus
cttcacctgaagaaattagctattt

SEQ ID NO: 394120 - DNA, 25 bp, Mus musculus
cttcacctgaagtaattagctattt

SEQ ID NO: 394121 - DNA, 25 bp, Mus musculus
cttcacgaagctccccagaaaggaa

SEQ ID NO: 394122 - DNA, 25 bp, Mus musculus
cttcacgaagctgcccagaaaggaa

SEQ ID NO: 394123 - DNA, 25 bp, Mus musculus
cttcacgatctaaatgtcttgcaaa

SEQ ID NO: 394124 - DNA, 25 bp, Mus musculus
cttcacgatctatatgtcttgcaaa

SEQ ID NO: 394125 - DNA, 25 bp, Mus musculus
cttcacgatgacaggttgcttaggg

SEQ ID NO: 394126 - DNA, 25 bp, Mus musculus
cttcacgatgactggttgcttaggg

SEQ ID NO: 394127 - DNA, 25 bp, Mus musculus
cttcacgcggatcctgcagatggag

SEQ ID NO: 394128 - DNA, 25 bp, Mus musculus
cttcacgcggatgctgcagatggag

SEQ ID NO: 394129 - DNA, 25 bp, Mus musculus
cttcacgctcttcgccacagggaga

SEQ ID NO: 394130 - DNA, 25 bp, Mus musculus
cttcacgctcttggccacagggaga

SEQ ID NO: 394131 - DNA, 25 bp, Mus musculus
cttcacgctgctagcatcccaggaa

SEQ ID NO: 394132 - DNA, 25 bp, Mus musculus
cttcacgctgcttgcatcccaggaa

SEQ ID NO: 394133 - DNA, 25 bp, Mus musculus
cttcacggcactaacacctgacggg

SEQ ID NO: 394134 - DNA, 25 bp, Mus musculus
cttcacggcacttacacctgacggg

SEQ ID NO: 394135 - DNA, 25 bp, Mus musculus
cttcacgtcagaatccagcaaacag

SEQ ID NO: 394136 - DNA, 25 bp, Mus musculus
cttcacgtcagattccagcaaacag

SEQ ID NO: 394137 - DNA, 25 bp, Mus musculus
cttcacgtcccaacatcagatgggt

SEQ ID NO: 394138 - DNA, 25 bp, Mus musculus
cttcacgtcccatcatcagatgggt

SEQ ID NO: 394139 - DNA, 25 bp, Mus musculus
cttcactaaagtctgtcctgtttct

SEQ ID NO: 394140 - DNA, 25 bp, Mus musculus
cttcactaaagtgtgtcctgtttct

SEQ ID NO: 394141 - DNA, 25 bp, Mus musculus
cttcactaccgtatcagaactggtg

SEQ ID NO: 394142 - DNA, 25 bp, Mus musculus
cttcactaccgtttcagaactggtg

SEQ ID NO: 394143 - DNA, 25 bp, Mus musculus
cttcactcagatctgttcttggatc

SEQ ID NO: 394144 - DNA, 25 bp, Mus musculus
cttcactcagatgtgttcttggatc

SEQ ID NO: 394145 - DNA, 25 bp, Mus musculus
cttcactcatctctctacttaagaa

SEQ ID NO: 394146 - DNA, 25 bp, Mus musculus
cttcactcatctgtctacttaagaa

SEQ ID NO: 394147 - DNA, 25 bp, Mus musculus
cttcactccagtcttgcgttataaa

SEQ ID NO: 394148 - DNA, 25 bp, Mus musculus
cttcactccagtgttgcgttataaa

SEQ ID NO: 394149 - DNA, 25 bp, Mus musculus
cttcactccgttcaagacaaggtct

SEQ ID NO: 394150 - DNA, 25 bp, Mus musculus
cttcactccgttgaagacaaggtct

SEQ ID NO: 394151 - DNA, 25 bp, Mus musculus
cttcactctgacatgggactgagaa

SEQ ID NO: 394152 - DNA, 25 bp, Mus musculus
cttcactctgacttgggactgagaa

SEQ ID NO: 394153 - DNA, 25 bp, Mus musculus
cttcactctgccatcatttaattta

SEQ ID NO: 394154 - DNA, 25 bp, Mus musculus
cttcactctgccttcatttaattta

SEQ ID NO: 394155 - DNA, 25 bp, Mus musculus
cttcactgaagcagtcattactgcc

SEQ ID NO: 394156 - DNA, 25 bp, Mus musculus
cttcactgaagctgtcattactgcc

SEQ ID NO: 394157 - DNA, 25 bp, Mus musculus
cttcactgactgatcctaaaactat

SEQ ID NO: 394158 - DNA, 25 bp, Mus musculus
cttcactgactgttcctaaaactat

SEQ ID NO: 394159 - DNA, 25 bp, Mus musculus
cttcactgcaataccgtaatctcaa

SEQ ID NO: 394160 - DNA, 25 bp, Mus musculus
cttcactgcaattccgtaatctcaa

SEQ ID NO: 394161 - DNA, 25 bp, Mus musculus
cttcactgctgcctaccaaaatata

SEQ ID NO: 394162 - DNA, 25 bp, Mus musculus
cttcactgctgcgtaccaaaatata

SEQ ID NO: 394163 - DNA, 25 bp, Mus musculus
cttcactggacaagtgcactttggg

SEQ ID NO: 394164 - DNA, 25 bp, Mus musculus
cttcactggacatgtgcactttggg

SEQ ID NO: 394165 - DNA, 25 bp, Mus musculus
cttcactgggaaactagcttatatg

SEQ ID NO: 394166 - DNA, 25 bp, Mus musculus
cttcactgggaatctagcttatatg

SEQ ID NO: 394167 - DNA, 25 bp, Mus musculus
cttcactgttggacattctggcata

SEQ ID NO: 394168 - DNA, 25 bp, Mus musculus
cttcactgttggtcattctggcata

SEQ ID NO: 394169 - DNA, 25 bp, Mus musculus
cttcactgttttagtggcttttgag

SEQ ID NO: 394170 - DNA, 25 bp, Mus musculus
cttcactgtttttgtggcttttgag

SEQ ID NO: 394171 - DNA, 25 bp, Mus musculus
cttcacttctttcatgaggtagcat

SEQ ID NO: 394172 - DNA, 25 bp, Mus musculus
cttcacttctttgatgaggtagcat

SEQ ID NO: 394173 - DNA, 25 bp, Mus musculus
cttcacttggtgcatcgggagcaat

SEQ ID NO: 394174 - DNA, 25 bp, Mus musculus
cttcacttggtggatcgggagcaat

SEQ ID NO: 394175 - DNA, 25 bp, Mus musculus
cttcacttgttgcatccttcacaag

SEQ ID NO: 394176 - DNA, 25 bp, Mus musculus
cttcacttgttggatccttcacaag

SEQ ID NO: 394177 - DNA, 25 bp, Mus musculus
cttcactttcatagttccttttcca

SEQ ID NO: 394178 - DNA, 25 bp, Mus musculus
cttcactttcattgttccttttcca

SEQ ID NO: 394179 - DNA, 25 bp, Mus musculus
cttcagaaacacagcggatcatgtt

SEQ ID NO: 394180 - DNA, 25 bp, Mus musculus
cttcagaaacactgcggatcatgtt

SEQ ID NO: 394181 - DNA, 25 bp, Mus musculus
cttcagaacaatcatggctatacga

SEQ ID NO: 394182 - DNA, 25 bp, Mus musculus
cttcagaacaatgatggctatacga

SEQ ID NO: 394183 - DNA, 25 bp, Mus musculus
cttcagaacgtgcatcagtgatgtg

SEQ ID NO: 394184 - DNA, 25 bp, Mus musculus
cttcagaacgtggatcagtgatgtg

SEQ ID NO: 394185 - DNA, 25 bp, Mus musculus
cttcagaactgcagcgacaagagaa

SEQ ID NO: 394186 - DNA, 25 bp, Mus musculus
cttcagaactgctgcgacaagagaa

SEQ ID NO: 394187 - DNA, 25 bp, Mus musculus
cttcagaagatcagcctatcagggc

SEQ ID NO: 394188 - DNA, 25 bp, Mus musculus
cttcagaagatctgcctatcagggc

SEQ ID NO: 394189 - DNA, 25 bp, Mus musculus
cttcagaagcaacacaaggcatgta

SEQ ID NO: 394190 - DNA, 25 bp, Mus musculus
cttcagaagcaagacaaggcatgta

SEQ ID NO: 394191 - DNA, 25 bp, Mus musculus
cttcagaaggacaaacattggattg

SEQ ID NO: 394192 - DNA, 25 bp, Mus musculus
cttcagaaggactaacattggattg

SEQ ID NO: 394193 - DNA, 25 bp, Mus musculus
cttcagaaggtaagtttatgattac

SEQ ID NO: 394194 - DNA, 25 bp, Mus musculus
cttcagaaggtatgtttatgattac

SEQ ID NO: 394195 - DNA, 25 bp, Mus musculus
cttcagaagttcattcttgaggaga

SEQ ID NO: 394196 - DNA, 25 bp, Mus musculus
cttcagaagttctttcttgaggaga

SEQ ID NO: 394197 - DNA, 25 bp, Mus musculus
cttcagaatcaaccgcaagctttta

SEQ ID NO: 394198 - DNA, 25 bp, Mus musculus
cttcagaatcaagcgcaagctttta

SEQ ID NO: 394199 - DNA, 25 bp, Mus musculus
cttcagaattgtctcatggtctatt

SEQ ID NO: 394200 - DNA, 25 bp, Mus musculus
cttcagaattgtgtcatggtctatt

SEQ ID NO: 394201 - DNA, 25 bp, Mus musculus
cttcagacaacgactcttggtagag

SEQ ID NO: 394202 - DNA, 25 bp, Mus musculus
cttcagacaacgtctcttggtagag

SEQ ID NO: 394203 - DNA, 25 bp, Mus musculus
cttcagacatcacccacagtacaga

SEQ ID NO: 394204 - DNA, 25 bp, Mus musculus
cttcagacatcagccacagtacaga

SEQ ID NO: 394205 - DNA, 25 bp, Mus musculus
cttcagacccagatagccctaagaa

SEQ ID NO: 394206 - DNA, 25 bp, Mus musculus
cttcagacccagttagccctaagaa

SEQ ID NO: 394207 - DNA, 25 bp, Mus musculus
cttcagactctgcttcggcatttag

SEQ ID NO: 394208 - DNA, 25 bp, Mus musculus
cttcagactctggttcggcatttag

SEQ ID NO: 394209 - DNA, 25 bp, Mus musculus
cttcagactgttctgggtaggtttc

SEQ ID NO: 394210 - DNA, 25 bp, Mus musculus
cttcagactgttgtgggtaggtttc

SEQ ID NO: 394211 - DNA, 25 bp, Mus musculus
cttcagagatgacaatgcctctttg

SEQ ID NO: 394212 - DNA, 25 bp, Mus musculus
cttcagagatgagaatgcctctttg

SEQ ID NO: 394213 - DNA, 25 bp, Mus musculus
cttcagagctatctgctgggtttca

SEQ ID NO: 394214 - DNA, 25 bp, Mus musculus
cttcagagctatgtgctgggtttca

SEQ ID NO: 394215 - DNA, 25 bp, Mus musculus
cttcagagctttaatttgtgccaaa

SEQ ID NO: 394216 - DNA, 25 bp, Mus musculus
cttcagagcttttatttgtgccaaa

SEQ ID NO: 394217 - DNA, 25 bp, Mus musculus
cttcagaggctgctttttagaacca

SEQ ID NO: 394218 - DNA, 25 bp, Mus musculus
cttcagaggctggtttttagaacca

SEQ ID NO: 394219 - DNA, 25 bp, Mus musculus
cttcagatcctgatttaatttgcac

SEQ ID NO: 394220 - DNA, 25 bp, Mus musculus
cttcagatcctgttttaatttgcac

SEQ ID NO: 394221 - DNA, 25 bp, Mus musculus
cttcagatctacaccatccagtaag

SEQ ID NO: 394222 - DNA, 25 bp, Mus musculus
cttcagatctactccatccagtaag

SEQ ID NO: 394223 - DNA, 25 bp, Mus musculus
cttcagatgaagacagagcccgcag

SEQ ID NO: 394224 - DNA, 25 bp, Mus musculus
cttcagatgaagtcagagcccgcag

SEQ ID NO: 394225 - DNA, 25 bp, Mus musculus
cttcagatgtgtaacttaagtgtgc

SEQ ID NO: 394226 - DNA, 25 bp, Mus musculus
cttcagatgtgttacttaagtgtgc

SEQ ID NO: 394227 - DNA, 25 bp, Mus musculus
cttcagattttcaggacccctcttc

SEQ ID NO: 394228 - DNA, 25 bp, Mus musculus
cttcagattttctggacccctcttc

SEQ ID NO: 394229 - DNA, 25 bp, Mus musculus
cttcagcaaaacaacaactcctctt

SEQ ID NO: 394230 - DNA, 25 bp, Mus musculus
cttcagcaaaactacaactcctctt

SEQ ID NO: 394231 - DNA, 25 bp, Mus musculus
cttcagcaacttcaggccaggctca

SEQ ID NO: 394232 - DNA, 25 bp, Mus musculus
cttcagcaacttgaggccaggctca

SEQ ID NO: 394233 - DNA, 25 bp, Mus musculus
cttcagcactatatcttaggctaga

SEQ ID NO: 394234 - DNA, 25 bp, Mus musculus
cttcagcactatttcttaggctaga

SEQ ID NO: 394235 - DNA, 25 bp, Mus musculus
cttcagcacttcagctacttctaaa

SEQ ID NO: 394236 - DNA, 25 bp, Mus musculus
cttcagcacttctgctacttctaaa

SEQ ID NO: 394237 - DNA, 25 bp, Mus musculus
cttcagcagagtcatggctttcctg

SEQ ID NO: 394238 - DNA, 25 bp, Mus musculus
cttcagcagagtgatggctttcctg

SEQ ID NO: 394239 - DNA, 25 bp, Mus musculus
cttcagcagctgaactaagtctaaa

SEQ ID NO: 394240 - DNA, 25 bp, Mus musculus
cttcagcagctgtactaagtctaaa

SEQ ID NO: 394241 - DNA, 25 bp, Mus musculus
cttcagcagtcacccaggataaggg

SEQ ID NO: 394242 - DNA, 25 bp, Mus musculus
cttcagcagtcagccaggataaggg

SEQ ID NO: 394243 - DNA, 25 bp, Mus musculus
cttcagcatggtccgtgacctcatg

SEQ ID NO: 394244 - DNA, 25 bp, Mus musculus
cttcagcatggtgcgtgacctcatg

SEQ ID NO: 394245 - DNA, 25 bp, Mus musculus
cttcagcattgccttcttaactgga

SEQ ID NO: 394246 - DNA, 25 bp, Mus musculus
cttcagcattgcgttcttaactgga

SEQ ID NO: 394247 - DNA, 25 bp, Mus musculus
cttcagccaaggagggcatcgagat

SEQ ID NO: 394248 - DNA, 25 bp, Mus musculus
cttcagccaaggtgggcatcgagat

SEQ ID NO: 394249 - DNA, 25 bp, Mus musculus
cttcagccctctaatggaccaatta

SEQ ID NO: 394250 - DNA, 25 bp, Mus musculus
cttcagccctcttatggaccaatta

SEQ ID NO: 394251 - DNA, 25 bp, Mus musculus
cttcagcccttgacctcactaaagt

SEQ ID NO: 394252 - DNA, 25 bp, Mus musculus
cttcagcccttgtcctcactaaagt

SEQ ID NO: 394253 - DNA, 25 bp, Mus musculus
cttcagccgggacgttttcaggtgc

SEQ ID NO: 394254 - DNA, 25 bp, Mus musculus
cttcagccgggaggttttcaggtgc

SEQ ID NO: 394255 - DNA, 25 bp, Mus musculus
cttcagccgtggaaacaggttctct

SEQ ID NO: 394256 - DNA, 25 bp, Mus musculus
cttcagccgtggtaacaggttctct

SEQ ID NO: 394257 - DNA, 25 bp, Mus musculus
cttcagcctggactcaattactaaa

SEQ ID NO: 394258 - DNA, 25 bp, Mus musculus
cttcagcctggagtcaattactaaa

SEQ ID NO: 394259 - DNA, 25 bp, Mus musculus
cttcagccttgtacaaagatgtttg

SEQ ID NO: 394260 - DNA, 25 bp, Mus musculus
cttcagccttgttcaaagatgtttg

SEQ ID NO: 394261 - DNA, 25 bp, Mus musculus
cttcagcctttactgcttgctatta

SEQ ID NO: 394262 - DNA, 25 bp, Mus musculus
cttcagcctttagtgcttgctatta

SEQ ID NO: 394263 - DNA, 25 bp, Mus musculus
cttcagcgccatcttattacagagg

SEQ ID NO: 394264 - DNA, 25 bp, Mus musculus
cttcagcgccatgttattacagagg

SEQ ID NO: 394265 - DNA, 25 bp, Mus musculus
cttcagcggttcaaaggataccgaa

SEQ ID NO: 394266 - DNA, 25 bp, Mus musculus
cttcagcggttctaaggataccgaa

SEQ ID NO: 394267 - DNA, 25 bp, Mus musculus
cttcagctactgagtcatgaccatg

SEQ ID NO: 394268 - DNA, 25 bp, Mus musculus
cttcagctactgtgtcatgaccatg

SEQ ID NO: 394269 - DNA, 25 bp, Mus musculus
cttcagctcacgctgccattgagaa

SEQ ID NO: 394270 - DNA, 25 bp, Mus musculus
cttcagctcacggtgccattgagaa

SEQ ID NO: 394271 - DNA, 25 bp, Mus musculus
cttcagctcaggatgggtggtgcat

SEQ ID NO: 394272 - DNA, 25 bp, Mus musculus
cttcagctcaggttgggtggtgcat

SEQ ID NO: 394273 - DNA, 25 bp, Mus musculus
cttcagctctgaatgcaaggcatac

SEQ ID NO: 394274 - DNA, 25 bp, Mus musculus
cttcagctctgattgcaaggcatac

SEQ ID NO: 394275 - DNA, 25 bp, Mus musculus
cttcagcttcctcccaaggaggcag

SEQ ID NO: 394276 - DNA, 25 bp, Mus musculus
cttcagcttcctgccaaggaggcag

SEQ ID NO: 394277 - DNA, 25 bp, Mus musculus
cttcagcttgtcattctttaatcct

SEQ ID NO: 394278 - DNA, 25 bp, Mus musculus
cttcagcttgtctttctttaatcct

SEQ ID NO: 394279 - DNA, 25 bp, Mus musculus
cttcaggaaggtcctgcggcagtac

SEQ ID NO: 394280 - DNA, 25 bp, Mus musculus
cttcaggaaggtgctgcggcagtac

SEQ ID NO: 394281 - DNA, 25 bp, Mus musculus
cttcaggaatggcatctccaggctg

SEQ ID NO: 394282 - DNA, 25 bp, Mus musculus
cttcaggaatgggatctccaggctg

SEQ ID NO: 394283 - DNA, 25 bp, Mus musculus
cttcaggacttcatggatttggaat

SEQ ID NO: 394284 - DNA, 25 bp, Mus musculus
cttcaggacttcttggatttggaat

SEQ ID NO: 394285 - DNA, 25 bp, Mus musculus
cttcaggagagaccaccgggccttg

SEQ ID NO: 394286 - DNA, 25 bp, Mus musculus
cttcaggagagagcaccgggccttg

SEQ ID NO: 394287 - DNA, 25 bp, Mus musculus
cttcaggagggacggaggtctgtaa

SEQ ID NO: 394288 - DNA, 25 bp, Mus musculus
cttcaggagggagggaggtctgtaa

SEQ ID NO: 394289 - DNA, 25 bp, Mus musculus
cttcaggaggtcaagtgtcctcttt

SEQ ID NO: 394290 - DNA, 25 bp, Mus musculus
cttcaggaggtctagtgtcctcttt

SEQ ID NO: 394291 - DNA, 25 bp, Mus musculus
cttcaggatggtcaccactgtggga

SEQ ID NO: 394292 - DNA, 25 bp, Mus musculus
cttcaggatggtgaccactgtggga

SEQ ID NO: 394293 - DNA, 25 bp, Mus musculus
cttcaggattcgcagagagactcgt

SEQ ID NO: 394294 - DNA, 25 bp, Mus musculus
cttcaggattcggagagagactcgt

SEQ ID NO: 394295 - DNA, 25 bp, Mus musculus
cttcaggcaatccaaagctttgaga

SEQ ID NO: 394296 - DNA, 25 bp, Mus musculus
cttcaggcaatcgaaagctttgaga

SEQ ID NO: 394297 - DNA, 25 bp, Mus musculus
cttcaggcacacagggagtggctct

SEQ ID NO: 394298 - DNA, 25 bp, Mus musculus
cttcaggcacactgggagtggctct

SEQ ID NO: 394299 - DNA, 25 bp, Mus musculus
cttcaggcagtgattatccagtaaa

SEQ ID NO: 394300 - DNA, 25 bp, Mus musculus
cttcaggcagtgtttatccagtaaa

SEQ ID NO: 394301 - DNA, 25 bp, Mus musculus
cttcaggcgaagatggagctgctga

SEQ ID NO: 394302 - DNA, 25 bp, Mus musculus
cttcaggcgaagttggagctgctga

SEQ ID NO: 394303 - DNA, 25 bp, Mus musculus
cttcaggctgagatgtggtctcaca

SEQ ID NO: 394304 - DNA, 25 bp, Mus musculus
cttcaggctgagttgtggtctcaca

SEQ ID NO: 394305 - DNA, 25 bp, Mus musculus
cttcaggcttcactagacatgtccc

SEQ ID NO: 394306 - DNA, 25 bp, Mus musculus
cttcaggcttcagtagacatgtccc

SEQ ID NO: 394307 - DNA, 25 bp, Mus musculus
cttcagggaccaccgtttgagcatg

SEQ ID NO: 394308 - DNA, 25 bp, Mus musculus
cttcagggaccagcgtttgagcatg

SEQ ID NO: 394309 - DNA, 25 bp, Mus musculus
cttcagggctcacgacaggacagta

SEQ ID NO: 394310 - DNA, 25 bp, Mus musculus
cttcagggctcaggacaggacagta

SEQ ID NO: 394311 - DNA, 25 bp, Mus musculus
cttcaggtacaactcatataggtag

SEQ ID NO: 394312 - DNA, 25 bp, Mus musculus
cttcaggtacaagtcatataggtag

SEQ ID NO: 394313 - DNA, 25 bp, Mus musculus
cttcaggtctagctttctcacagaa

SEQ ID NO: 394314 - DNA, 25 bp, Mus musculus
cttcaggtctaggtttctcacagaa

SEQ ID NO: 394315 - DNA, 25 bp, Mus musculus
cttcaggttcaaaggaaaccctgtt

SEQ ID NO: 394316 - DNA, 25 bp, Mus musculus
cttcaggttcaatggaaaccctgtt

SEQ ID NO: 394317 - DNA, 25 bp, Mus musculus
cttcaggttcagcagttgtgttgta

SEQ ID NO: 394318 - DNA, 25 bp, Mus musculus
cttcaggttcaggagttgtgttgta

SEQ ID NO: 394319 - DNA, 25 bp, Mus musculus
cttcaggttccaagcaggcagtagg

SEQ ID NO: 394320 - DNA, 25 bp, Mus musculus
cttcaggttccatgcaggcagtagg

SEQ ID NO: 394321 - DNA, 25 bp, Mus musculus
cttcagtaaaaacgagcctccagct

SEQ ID NO: 394322 - DNA, 25 bp, Mus musculus
cttcagtaaaaaggagcctccagct

SEQ ID NO: 394323 - DNA, 25 bp, Mus musculus
cttcagtataatagatatgtcccct

SEQ ID NO: 394324 - DNA, 25 bp, Mus musculus
cttcagtataattgatatgtcccct

SEQ ID NO: 394325 - DNA, 25 bp, Mus musculus
cttcagtatccaatttgtagttata

SEQ ID NO: 394326 - DNA, 25 bp, Mus musculus
cttcagtatccattttgtagttata

SEQ ID NO: 394327 - DNA, 25 bp, Mus musculus
cttcagtatttgatgaggtcatgta

SEQ ID NO: 394328 - DNA, 25 bp, Mus musculus
cttcagtatttgttgaggtcatgta

SEQ ID NO: 394329 - DNA, 25 bp, Mus musculus
cttcagtccactcttcattgtattt

SEQ ID NO: 394330 - DNA, 25 bp, Mus musculus
cttcagtccactgttcattgtattt

SEQ ID NO: 394331 - DNA, 25 bp, Mus musculus
cttcagtcctgaagccgtctgacct

SEQ ID NO: 394332 - DNA, 25 bp, Mus musculus
cttcagtcctgatgccgtctgacct

SEQ ID NO: 394333 - DNA, 25 bp, Mus musculus
cttcagtcctttatctcctgtataa

SEQ ID NO: 394334 - DNA, 25 bp, Mus musculus
cttcagtcctttttctcctgtataa

SEQ ID NO: 394335 - DNA, 25 bp, Mus musculus
cttcagtctccactcaggaggcagg

SEQ ID NO: 394336 - DNA, 25 bp, Mus musculus
cttcagtctccagtcaggaggcagg

SEQ ID NO: 394337 - DNA, 25 bp, Mus musculus
cttcagtctgacaccaaacatcatg

SEQ ID NO: 394338 - DNA, 25 bp, Mus musculus
cttcagtctgactccaaacatcatg

SEQ ID NO: 394339 - DNA, 25 bp, Mus musculus
cttcagtctggaatagcttagggag

SEQ ID NO: 394340 - DNA, 25 bp, Mus musculus
cttcagtctggattagcttagggag

SEQ ID NO: 394341 - DNA, 25 bp, Mus musculus
cttcagtgacctctgcgctgtgcgg

SEQ ID NO: 394342 - DNA, 25 bp, Mus musculus
cttcagtgacctgtgcgctgtgcgg

SEQ ID NO: 394343 - DNA, 25 bp, Mus musculus
cttcagtgactcagggctcagctca

SEQ ID NO: 394344 - DNA, 25 bp, Mus musculus
cttcagtgactctgggctcagctca

SEQ ID NO: 394345 - DNA, 25 bp, Mus musculus
cttcagtgatgccaacatatttgca

SEQ ID NO: 394346 - DNA, 25 bp, Mus musculus
cttcagtgatgcgaacatatttgca

SEQ ID NO: 394347 - DNA, 25 bp, Mus musculus
cttcagtgcgcactgagtgttgtct

SEQ ID NO: 394348 - DNA, 25 bp, Mus musculus
cttcagtgcgcagtgagtgttgtct

SEQ ID NO: 394349 - DNA, 25 bp, Mus musculus
cttcagtgctgacatttctagggtt

SEQ ID NO: 394350 - DNA, 25 bp, Mus musculus
cttcagtgctgagatttctagggtt

SEQ ID NO: 394351 - DNA, 25 bp, Mus musculus
cttcagtgcttgcttcagaatctca

SEQ ID NO: 394352 - DNA, 25 bp, Mus musculus
cttcagtgcttggttcagaatctca

SEQ ID NO: 394353 - DNA, 25 bp, Mus musculus
cttcagtgggagacttgaccctggg

SEQ ID NO: 394354 - DNA, 25 bp, Mus musculus
cttcagtgggagtcttgaccctggg

SEQ ID NO: 394355 - DNA, 25 bp, Mus musculus
cttcagtgtaagagagccggcccat

SEQ ID NO: 394356 - DNA, 25 bp, Mus musculus
cttcagtgtaagagcattcccaata

SEQ ID NO: 394357 - DNA, 25 bp, Mus musculus
cttcagtgtaagtgagccggcccat

SEQ ID NO: 394358 - DNA, 25 bp, Mus musculus
cttcagtgtaagtgcattcccaata

SEQ ID NO: 394359 - DNA, 25 bp, Mus musculus
cttcagtgtcatcgccaggagaatc

SEQ ID NO: 394360 - DNA, 25 bp, Mus musculus
cttcagtgtcatggccaggagaatc

SEQ ID NO: 394361 - DNA, 25 bp, Mus musculus
cttcagtgtctgagtggtggtaaac

SEQ ID NO: 394362 - DNA, 25 bp, Mus musculus
cttcagtgtctgtgtggtggtaaac

SEQ ID NO: 394363 - DNA, 25 bp, Mus musculus
cttcagttagacattcagtgatctg

SEQ ID NO: 394364 - DNA, 25 bp, Mus musculus
cttcagttagactttcagtgatctg

SEQ ID NO: 394365 - DNA, 25 bp, Mus musculus
cttcagttagttcccactcaaatct

SEQ ID NO: 394366 - DNA, 25 bp, Mus musculus
cttcagttagttgccactcaaatct

SEQ ID NO: 394367 - DNA, 25 bp, Mus musculus
cttcagttatatactgtggtcaata

SEQ ID NO: 394368 - DNA, 25 bp, Mus musculus
cttcagttatattctgtggtcaata

SEQ ID NO: 394369 - DNA, 25 bp, Mus musculus
cttcagttgaggatctttcttccca

SEQ ID NO: 394370 - DNA, 25 bp, Mus musculus
cttcagttgaggttctttcttccca

SEQ ID NO: 394371 - DNA, 25 bp, Mus musculus
cttcagttgtctcccagactgagaa

SEQ ID NO: 394372 - DNA, 25 bp, Mus musculus
cttcagttgtctgccagactgagaa

SEQ ID NO: 394373 - DNA, 25 bp, Mus musculus
cttcagtttcctaagctttgcaaag

SEQ ID NO: 394374 - DNA, 25 bp, Mus musculus
cttcagtttccttagctttgcaaag

SEQ ID NO: 394375 - DNA, 25 bp, Mus musculus
cttcataagatgaaccgacctggat

SEQ ID NO: 394376 - DNA, 25 bp, Mus musculus
cttcataagatgtaccgacctggat

SEQ ID NO: 394377 - DNA, 25 bp, Mus musculus
cttcataagcagagacctccaggtc

SEQ ID NO: 394378 - DNA, 25 bp, Mus musculus
cttcataagcagtgacctccaggtc

SEQ ID NO: 394379 - DNA, 25 bp, Mus musculus
cttcataagtctcaccgtgggtggg

SEQ ID NO: 394380 - DNA, 25 bp, Mus musculus
cttcataagtctgaccgtgggtggg

SEQ ID NO: 394381 - DNA, 25 bp, Mus musculus
cttcataatggcattattcctttgg

SEQ ID NO: 394382 - DNA, 25 bp, Mus musculus
cttcataatggctttattcctttgg

SEQ ID NO: 394383 - DNA, 25 bp, Mus musculus
cttcatacactacagttgccatcac

SEQ ID NO: 394384 - DNA, 25 bp, Mus musculus
cttcatacactagagttgccatcac

SEQ ID NO: 394385 - DNA, 25 bp, Mus musculus
cttcatacctgaattctgattttgt

SEQ ID NO: 394386 - DNA, 25 bp, Mus musculus
cttcatacctgatttctgattttgt

SEQ ID NO: 394387 - DNA, 25 bp, Mus musculus
cttcatactggacaggtgcaggtta

SEQ ID NO: 394388 - DNA, 25 bp, Mus musculus
cttcatactggagaggtgcaggtta

SEQ ID NO: 394389 - DNA, 25 bp, Mus musculus
cttcatactttgactgccacagaac

SEQ ID NO: 394390 - DNA, 25 bp, Mus musculus
cttcatactttgtctgccacagaac

SEQ ID NO: 394391 - DNA, 25 bp, Mus musculus
cttcatagaacactttctggccctg

SEQ ID NO: 394392 - DNA, 25 bp, Mus musculus
cttcatagaacagtttctggccctg

SEQ ID NO: 394393 - DNA, 25 bp, Mus musculus
cttcatagaaggcatttgggcactc

SEQ ID NO: 394394 - DNA, 25 bp, Mus musculus
cttcatagaagggatttgggcactc

SEQ ID NO: 394395 - DNA, 25 bp, Mus musculus
cttcatagtgccctctacttttaaa

SEQ ID NO: 394396 - DNA, 25 bp, Mus musculus
cttcatagtgccgtctacttttaaa

SEQ ID NO: 394397 - DNA, 25 bp, Mus musculus
cttcatatcgttcgcccttgctatt

SEQ ID NO: 394398 - DNA, 25 bp, Mus musculus
cttcatatcgttggcccttgctatt

SEQ ID NO: 394399 - DNA, 25 bp, Mus musculus
cttcatatttctcgaggtgccaccg

SEQ ID NO: 394400 - DNA, 25 bp, Mus musculus
cttcatatttctggaggtgccaccg

SEQ ID NO: 394401 - DNA, 25 bp, Mus musculus
cttcatatttgacacgttttgtcgt

SEQ ID NO: 394402 - DNA, 25 bp, Mus musculus
cttcatatttgagacgttttgtcgt

SEQ ID NO: 394403 - DNA, 25 bp, Mus musculus
cttcatatttttcccttcttagaat

SEQ ID NO: 394404 - DNA, 25 bp, Mus musculus
cttcatatttttcctgtgtctaaaa

SEQ ID NO: 394405 - DNA, 25 bp, Mus musculus
cttcatatttttgccttcttagaat

SEQ ID NO: 394406 - DNA, 25 bp, Mus musculus
cttcatatttttgctgtgtctaaaa

SEQ ID NO: 394407 - DNA, 25 bp, Mus musculus
cttcatcacactcgctgtttctaat

SEQ ID NO: 394408 - DNA, 25 bp, Mus musculus
cttcatcacactggctgtttctaat

SEQ ID NO: 394409 - DNA, 25 bp, Mus musculus
cttcatcactctcatagccatgatt

SEQ ID NO: 394410 - DNA, 25 bp, Mus musculus
cttcatcactctgatagccatgatt

SEQ ID NO: 394411 - DNA, 25 bp, Mus musculus
cttcatcagactcaatcagcacttt

SEQ ID NO: 394412 - DNA, 25 bp, Mus musculus
cttcatcagactgaatcagcacttt

SEQ ID NO: 394413 - DNA, 25 bp, Mus musculus
cttcatcagaggctgagcagtggca

SEQ ID NO: 394414 - DNA, 25 bp, Mus musculus
cttcatcagagggtgagcagtggca

SEQ ID NO: 394415 - DNA, 25 bp, Mus musculus
cttcatcagcatatcagaactcatg

SEQ ID NO: 394416 - DNA, 25 bp, Mus musculus
cttcatcagcatttcagaactcatg

SEQ ID NO: 394417 - DNA, 25 bp, Mus musculus
cttcatcaggccaaagcaccaagtt

SEQ ID NO: 394418 - DNA, 25 bp, Mus musculus
cttcatcaggcctaagcaccaagtt

SEQ ID NO: 394419 - DNA, 25 bp, Mus musculus
cttcatcagggcagaataatcccaa

SEQ ID NO: 394420 - DNA, 25 bp, Mus musculus
cttcatcagggctgaataatcccaa

SEQ ID NO: 394421 - DNA, 25 bp, Mus musculus
cttcatccctagatggtagaactgt

SEQ ID NO: 394422 - DNA, 25 bp, Mus musculus
cttcatccctagttggtagaactgt

SEQ ID NO: 394423 - DNA, 25 bp, Mus musculus
cttcatccctcccaaaatctggaat

SEQ ID NO: 394424 - DNA, 25 bp, Mus musculus
cttcatccctccgaaaatctggaat

SEQ ID NO: 394425 - DNA, 25 bp, Mus musculus
cttcatcccttccttagtcagaaat

SEQ ID NO: 394426 - DNA, 25 bp, Mus musculus
cttcatcccttcgttagtcagaaat

SEQ ID NO: 394427 - DNA, 25 bp, Mus musculus
cttcatccgctaccagaattgttgt

SEQ ID NO: 394428 - DNA, 25 bp, Mus musculus
cttcatccgctagcagaattgttgt

SEQ ID NO: 394429 - DNA, 25 bp, Mus musculus
cttcatcctcatctatcagtattct

SEQ ID NO: 394430 - DNA, 25 bp, Mus musculus
cttcatcctcatgtatcagtattct

SEQ ID NO: 394431 - DNA, 25 bp, Mus musculus
cttcatcctgttctttttctattaa

SEQ ID NO: 394432 - DNA, 25 bp, Mus musculus
cttcatcctgttgtttttctattaa

SEQ ID NO: 394433 - DNA, 25 bp, Mus musculus
cttcatcctttcatccaacaacaga

SEQ ID NO: 394434 - DNA, 25 bp, Mus musculus
cttcatcctttcttccaacaacaga

SEQ ID NO: 394435 - DNA, 25 bp, Mus musculus
cttcatctcccacagtaatttctgg

SEQ ID NO: 394436 - DNA, 25 bp, Mus musculus
cttcatctcccagagtaatttctgg

SEQ ID NO: 394437 - DNA, 25 bp, Mus musculus
cttcatctctttcacatcagtttgt

SEQ ID NO: 394438 - DNA, 25 bp, Mus musculus
cttcatctctttgacatcagtttgt

SEQ ID NO: 394439 - DNA, 25 bp, Mus musculus
cttcatctgagaatgccgtggcaca

SEQ ID NO: 394440 - DNA, 25 bp, Mus musculus
cttcatctgagattgccgtggcaca

SEQ ID NO: 394441 - DNA, 25 bp, Mus musculus
cttcatctgctccaaagtgattctt

SEQ ID NO: 394442 - DNA, 25 bp, Mus musculus
cttcatctgctcgaaagtgattctt

SEQ ID NO: 394443 - DNA, 25 bp, Mus musculus
cttcatcttagaatgcaagctttgt

SEQ ID NO: 394444 - DNA, 25 bp, Mus musculus
cttcatcttagattgcaagctttgt

SEQ ID NO: 394445 - DNA, 25 bp, Mus musculus
cttcatcttctcagcttttctctga

SEQ ID NO: 394446 - DNA, 25 bp, Mus musculus
cttcatcttctctgcttttctctga

SEQ ID NO: 394447 - DNA, 25 bp, Mus musculus
cttcatcttcttaagcagtggagca

SEQ ID NO: 394448 - DNA, 25 bp, Mus musculus
cttcatcttcttccctggagaaaag

SEQ ID NO: 394449 - DNA, 25 bp, Mus musculus
cttcatcttcttgcctggagaaaag

SEQ ID NO: 394450 - DNA, 25 bp, Mus musculus
cttcatcttctttagcagtggagca

SEQ ID NO: 394451 - DNA, 25 bp, Mus musculus
cttcatctttttaggagggctggtt

SEQ ID NO: 394452 - DNA, 25 bp, Mus musculus
cttcatcttttttggagggctggtt

SEQ ID NO: 394453 - DNA, 25 bp, Mus musculus
cttcatgaaaaaactttgagaggtt

SEQ ID NO: 394454 - DNA, 25 bp, Mus musculus
cttcatgaaaaatctttgagaggtt

SEQ ID NO: 394455 - DNA, 25 bp, Mus musculus
cttcatgaaacccagcatccagtat

SEQ ID NO: 394456 - DNA, 25 bp, Mus musculus
cttcatgaaaccgagcatccagtat

SEQ ID NO: 394457 - DNA, 25 bp, Mus musculus
cttcatgacattattgtgggttata

SEQ ID NO: 394458 - DNA, 25 bp, Mus musculus
cttcatgacatttttgtgggttata

SEQ ID NO: 394459 - DNA, 25 bp, Mus musculus
cttcatgactgaataaaatcccact

SEQ ID NO: 394460 - DNA, 25 bp, Mus musculus
cttcatgactgattaaaatcccact

SEQ ID NO: 394461 - DNA, 25 bp, Mus musculus
cttcatgaggaaattcagcggttac

SEQ ID NO: 394462 - DNA, 25 bp, Mus musculus
cttcatgaggaatttcagcggttac

SEQ ID NO: 394463 - DNA, 25 bp, Mus musculus
cttcatgagtgcaggtgttttcggg

SEQ ID NO: 394464 - DNA, 25 bp, Mus musculus
cttcatgagtgctggtgttttcggg

SEQ ID NO: 394465 - DNA, 25 bp, Mus musculus
cttcatgatcccatcaaagcaaata

SEQ ID NO: 394466 - DNA, 25 bp, Mus musculus
cttcatgatcccttcaaagcaaata

SEQ ID NO: 394467 - DNA, 25 bp, Mus musculus
cttcatgattggatgtgacaactgc

SEQ ID NO: 394468 - DNA, 25 bp, Mus musculus
cttcatgattggttgtgacaactgc

SEQ ID NO: 394469 - DNA, 25 bp, Mus musculus
cttcatgcatcacagggtgcacagt

SEQ ID NO: 394470 - DNA, 25 bp, Mus musculus
cttcatgcatcagagggtgcacagt

SEQ ID NO: 394471 - DNA, 25 bp, Mus musculus
cttcatgcattaaggatcccgaccc

SEQ ID NO: 394472 - DNA, 25 bp, Mus musculus
cttcatgcattatggatcccgaccc

SEQ ID NO: 394473 - DNA, 25 bp, Mus musculus
cttcatgccacaaatgtaagactgt

SEQ ID NO: 394474 - DNA, 25 bp, Mus musculus
cttcatgccacatatgtaagactgt

SEQ ID NO: 394475 - DNA, 25 bp, Mus musculus
cttcatgcctacatttcagacactg

SEQ ID NO: 394476 - DNA, 25 bp, Mus musculus
cttcatgcctacttttcagacactg

SEQ ID NO: 394477 - DNA, 25 bp, Mus musculus
cttcatgcgtgtctttgaggccata

SEQ ID NO: 394478 - DNA, 25 bp, Mus musculus
cttcatgcgtgtgtttgaggccata

SEQ ID NO: 394479 - DNA, 25 bp, Mus musculus
cttcatgctgaactcttggctatca

SEQ ID NO: 394480 - DNA, 25 bp, Mus musculus
cttcatgctgaagtcttggctatca

SEQ ID NO: 394481 - DNA, 25 bp, Mus musculus
cttcatgctgctcccctgtggaagg

SEQ ID NO: 394482 - DNA, 25 bp, Mus musculus
cttcatgctgctgccctgtggaagg

SEQ ID NO: 394483 - DNA, 25 bp, Mus musculus
cttcatgcttaaattgtacccttct

SEQ ID NO: 394484 - DNA, 25 bp, Mus musculus
cttcatgcttaatttgtacccttct

SEQ ID NO: 394485 - DNA, 25 bp, Mus musculus
cttcatgctttccaaaccttgcttt

SEQ ID NO: 394486 - DNA, 25 bp, Mus musculus
cttcatgctttcgaaaccttgcttt

SEQ ID NO: 394487 - DNA, 25 bp, Mus musculus
cttcatggaccaacataacttcagt

SEQ ID NO: 394488 - DNA, 25 bp, Mus musculus
cttcatggaccatcataacttcagt

SEQ ID NO: 394489 - DNA, 25 bp, Mus musculus
cttcatggatcaccaactcacgtca

SEQ ID NO: 394490 - DNA, 25 bp, Mus musculus
cttcatggatcagcaactcacgtca

SEQ ID NO: 394491 - DNA, 25 bp, Mus musculus
cttcatggtgacagggaaacaaaag

SEQ ID NO: 394492 - DNA, 25 bp, Mus musculus
cttcatggtgactgggaaacaaaag

SEQ ID NO: 394493 - DNA, 25 bp, Mus musculus
cttcatggtgtgataagatttctat

SEQ ID NO: 394494 - DNA, 25 bp, Mus musculus
cttcatggtgtgttaagatttctat

SEQ ID NO: 394495 - DNA, 25 bp, Mus musculus
cttcatggttggaacagcttttgcc

SEQ ID NO: 394496 - DNA, 25 bp, Mus musculus
cttcatggttggtacagcttttgcc

SEQ ID NO: 394497 - DNA, 25 bp, Mus musculus
cttcatgtcatcctctcatgtaatg

SEQ ID NO: 394498 - DNA, 25 bp, Mus musculus
cttcatgtcatcgtctcatgtaatg

SEQ ID NO: 394499 - DNA, 25 bp, Mus musculus
cttcatgtccaaccaggagggcaat

SEQ ID NO: 394500 - DNA, 25 bp, Mus musculus
cttcatgtccaagcaggagggcaat

SEQ ID NO: 394501 - DNA, 25 bp, Mus musculus
cttcatgtcctaaggaagacatttt

SEQ ID NO: 394502 - DNA, 25 bp, Mus musculus
cttcatgtcctatggaagacatttt

SEQ ID NO: 394503 - DNA, 25 bp, Mus musculus
cttcatgtgtagatgattgggcttt

SEQ ID NO: 394504 - DNA, 25 bp, Mus musculus
cttcatgtgtagttgattgggcttt

SEQ ID NO: 394505 - DNA, 25 bp, Mus musculus
cttcatgtgttcatgggccagccaa

SEQ ID NO: 394506 - DNA, 25 bp, Mus musculus
cttcatgtgttcttgggccagccaa

SEQ ID NO: 394507 - DNA, 25 bp, Mus musculus
cttcatgttgacactctggttacaa

SEQ ID NO: 394508 - DNA, 25 bp, Mus musculus
cttcatgttgactctctggttacaa

SEQ ID NO: 394509 - DNA, 25 bp, Mus musculus
cttcatgttgtcaagctggtgggca

SEQ ID NO: 394510 - DNA, 25 bp, Mus musculus
cttcatgttgtctagctggtgggca

SEQ ID NO: 394511 - DNA, 25 bp, Mus musculus
cttcatgtttgaaagtcactgccaa

SEQ ID NO: 394512 - DNA, 25 bp, Mus musculus
cttcatgtttgatagtcactgccaa

SEQ ID NO: 394513 - DNA, 25 bp, Mus musculus
cttcatgttttcattgtgcaagtaa

SEQ ID NO: 394514 - DNA, 25 bp, Mus musculus
cttcatgttttctttgtgcaagtaa

SEQ ID NO: 394515 - DNA, 25 bp, Mus musculus
cttcatgttttgattcactgtcatt

SEQ ID NO: 394516 - DNA, 25 bp, Mus musculus
cttcatgttttgtttcactgtcatt

SEQ ID NO: 394517 - DNA, 25 bp, Mus musculus
cttcattaaatgatgcttgcctggg

SEQ ID NO: 394518 - DNA, 25 bp, Mus musculus
cttcattaaatgttgcttgcctggg

SEQ ID NO: 394519 - DNA, 25 bp, Mus musculus
cttcattaagggaggcttggctcgg

SEQ ID NO: 394520 - DNA, 25 bp, Mus musculus
cttcattaagggtggcttggctcgg

SEQ ID NO: 394521 - DNA, 25 bp, Mus musculus
cttcattactacataccacagcttc

SEQ ID NO: 394522 - DNA, 25 bp, Mus musculus
cttcattactacttaccacagcttc

SEQ ID NO: 394523 - DNA, 25 bp, Mus musculus
cttcattatagtattccttgcatac

SEQ ID NO: 394524 - DNA, 25 bp, Mus musculus
cttcattatagttttccttgcatac

SEQ ID NO: 394525 - DNA, 25 bp, Mus musculus
cttcattatggccaataaacctgtt

SEQ ID NO: 394526 - DNA, 25 bp, Mus musculus
cttcattatggcgaataaacctgtt

SEQ ID NO: 394527 - DNA, 25 bp, Mus musculus
cttcattcacaaagtccctgaattt

SEQ ID NO: 394528 - DNA, 25 bp, Mus musculus
cttcattcacaatgtccctgaattt

SEQ ID NO: 394529 - DNA, 25 bp, Mus musculus
cttcattcagcacattaagaccaat

SEQ ID NO: 394530 - DNA, 25 bp, Mus musculus
cttcattcagcagattaagaccaat

SEQ ID NO: 394531 - DNA, 25 bp, Mus musculus
cttcattccagcattctgcacagcg

SEQ ID NO: 394532 - DNA, 25 bp, Mus musculus
cttcattccagctttctgcacagcg

SEQ ID NO: 394533 - DNA, 25 bp, Mus musculus
cttcattcccctcctgacagaggag

SEQ ID NO: 394534 - DNA, 25 bp, Mus musculus
cttcattcccctgctgacagaggag

SEQ ID NO: 394535 - DNA, 25 bp, Mus musculus
cttcattcctttagtcggtatcttg

SEQ ID NO: 394536 - DNA, 25 bp, Mus musculus
cttcattcctttcctgtgacacctt

SEQ ID NO: 394537 - DNA, 25 bp, Mus musculus
cttcattcctttgctgtgacacctt

SEQ ID NO: 394538 - DNA, 25 bp, Mus musculus
cttcattccttttgtcggtatcttg

SEQ ID NO: 394539 - DNA, 25 bp, Mus musculus
cttcattcttgtcccctttccacct

SEQ ID NO: 394540 - DNA, 25 bp, Mus musculus
cttcattcttgtgccctttccacct

SEQ ID NO: 394541 - DNA, 25 bp, Mus musculus
cttcattgcaacattcatcgctgac

SEQ ID NO: 394542 - DNA, 25 bp, Mus musculus
cttcattgcaactttcatcgctgac

SEQ ID NO: 394543 - DNA, 25 bp, Mus musculus
cttcattgcctgagtatgagaaaaa

SEQ ID NO: 394544 - DNA, 25 bp, Mus musculus
cttcattgcctgtgtatgagaaaaa

SEQ ID NO: 394545 - DNA, 25 bp, Mus musculus
cttcattggcagaaattgcaaaaca

SEQ ID NO: 394546 - DNA, 25 bp, Mus musculus
cttcattggcagtaattgcaaaaca

SEQ ID NO: 394547 - DNA, 25 bp, Mus musculus
cttcattggcccctgaaattaggga

SEQ ID NO: 394548 - DNA, 25 bp, Mus musculus
cttcattggcccgtgaaattaggga

SEQ ID NO: 394549 - DNA, 25 bp, Mus musculus
cttcattgtcacacctctggaaagg

SEQ ID NO: 394550 - DNA, 25 bp, Mus musculus
cttcattgtcactcctctggaaagg

SEQ ID NO: 394551 - DNA, 25 bp, Mus musculus
cttcattgtgtgcatgcggacggct

SEQ ID NO: 394552 - DNA, 25 bp, Mus musculus
cttcattgtgtggatgcggacggct

SEQ ID NO: 394553 - DNA, 25 bp, Mus musculus
cttcatttaaccctatattctgagt

SEQ ID NO: 394554 - DNA, 25 bp, Mus musculus
cttcatttaaccgtatattctgagt

SEQ ID NO: 394555 - DNA, 25 bp, Mus musculus
cttcatttagccagggctggtgacc

SEQ ID NO: 394556 - DNA, 25 bp, Mus musculus
cttcatttagcctgggctggtgacc

SEQ ID NO: 394557 - DNA, 25 bp, Mus musculus
cttcatttccgcatgtgtgtggctg

SEQ ID NO: 394558 - DNA, 25 bp, Mus musculus
cttcatttccgcttgtgtgtggctg

SEQ ID NO: 394559 - DNA, 25 bp, Mus musculus
cttcatttgccccagcagttaatag

SEQ ID NO: 394560 - DNA, 25 bp, Mus musculus
cttcatttgcccgagcagttaatag

SEQ ID NO: 394561 - DNA, 25 bp, Mus musculus
cttcatttggaacacgatctggtcc

SEQ ID NO: 394562 - DNA, 25 bp, Mus musculus
cttcatttggaagacgatctggtcc

SEQ ID NO: 394563 - DNA, 25 bp, Mus musculus
cttcatttttcaatgaacccgagac

SEQ ID NO: 394564 - DNA, 25 bp, Mus musculus
cttcatttttcattgaacccgagac

SEQ ID NO: 394565 - DNA, 25 bp, Mus musculus
cttcatttttggctaatcttttcat

SEQ ID NO: 394566 - DNA, 25 bp, Mus musculus
cttcatttttgggtaatcttttcat

SEQ ID NO: 394567 - DNA, 25 bp, Mus musculus
cttcatttttttcgacttgcgtatt

SEQ ID NO: 394568 - DNA, 25 bp, Mus musculus
cttcatttttttggacttgcgtatt

SEQ ID NO: 394569 - DNA, 25 bp, Mus musculus
cttccaaacccaaagatttgtctcc

SEQ ID NO: 394570 - DNA, 25 bp, Mus musculus
cttccaaacccatagatttgtctcc

SEQ ID NO: 394571 - DNA, 25 bp, Mus musculus
cttccaaagccaattgtcttcttca

SEQ ID NO: 394572 - DNA, 25 bp, Mus musculus
cttccaaagccatttgtcttcttca

SEQ ID NO: 394573 - DNA, 25 bp, Mus musculus
cttccaaatctgctcatcttttact

SEQ ID NO: 394574 - DNA, 25 bp, Mus musculus
cttccaaatctggtcatcttttact

SEQ ID NO: 394575 - DNA, 25 bp, Mus musculus
cttccaaccagaacactgagttttc

SEQ ID NO: 394576 - DNA, 25 bp, Mus musculus
cttccaaccagatcactgagttttc

SEQ ID NO: 394577 - DNA, 25 bp, Mus musculus
cttccaacgaaaccactgtccagtg

SEQ ID NO: 394578 - DNA, 25 bp, Mus musculus
cttccaacgaaagcactgtccagtg

SEQ ID NO: 394579 - DNA, 25 bp, Mus musculus
cttccaactccaaaaggctaggcca

SEQ ID NO: 394580 - DNA, 25 bp, Mus musculus
cttccaactccataaggctaggcca

SEQ ID NO: 394581 - DNA, 25 bp, Mus musculus
cttccaactcttccagttctatgat

SEQ ID NO: 394582 - DNA, 25 bp, Mus musculus
cttccaactcttctcctgatatgta

SEQ ID NO: 394583 - DNA, 25 bp, Mus musculus
cttccaactcttgcagttctatgat

SEQ ID NO: 394584 - DNA, 25 bp, Mus musculus
cttccaactcttgtcctgatatgta

SEQ ID NO: 394585 - DNA, 25 bp, Mus musculus
cttccaactggaccctcaagaaata

SEQ ID NO: 394586 - DNA, 25 bp, Mus musculus
cttccaactggagcctcaagaaata

SEQ ID NO: 394587 - DNA, 25 bp, Mus musculus
cttccaactgtaatcactgtgtcca

SEQ ID NO: 394588 - DNA, 25 bp, Mus musculus
cttccaactgtattcactgtgtcca

SEQ ID NO: 394589 - DNA, 25 bp, Mus musculus
cttccaactttcagagtaacctcca

SEQ ID NO: 394590 - DNA, 25 bp, Mus musculus
cttccaactttctgagtaacctcca

SEQ ID NO: 394591 - DNA, 25 bp, Mus musculus
cttccaagaaccagcttctactagg

SEQ ID NO: 394592 - DNA, 25 bp, Mus musculus
cttccaagaacctgcttctactagg

SEQ ID NO: 394593 - DNA, 25 bp, Mus musculus
cttccaagacgtcagtccagtgacg

SEQ ID NO: 394594 - DNA, 25 bp, Mus musculus
cttccaagacgtgagtccagtgacg

SEQ ID NO: 394595 - DNA, 25 bp, Mus musculus
cttccaagatggctaagaacaagga

SEQ ID NO: 394596 - DNA, 25 bp, Mus musculus
cttccaagatgggtaagaacaagga

SEQ ID NO: 394597 - DNA, 25 bp, Mus musculus
cttccaagctcaatagtgtctgttt

SEQ ID NO: 394598 - DNA, 25 bp, Mus musculus
cttccaagctcattagtgtctgttt

SEQ ID NO: 394599 - DNA, 25 bp, Mus musculus
cttccaagctttactactgtaaact

SEQ ID NO: 394600 - DNA, 25 bp, Mus musculus
cttccaagcttttctactgtaaact

SEQ ID NO: 394601 - DNA, 25 bp, Mus musculus
cttccaaggctcacactacaaaata

SEQ ID NO: 394602 - DNA, 25 bp, Mus musculus
cttccaaggctctcactacaaaata

SEQ ID NO: 394603 - DNA, 25 bp, Mus musculus
cttccaaggcttagcattctgctca

SEQ ID NO: 394604 - DNA, 25 bp, Mus musculus
cttccaaggctttgcattctgctca

SEQ ID NO: 394605 - DNA, 25 bp, Mus musculus
cttccaagggaacctgtgacacaca

SEQ ID NO: 394606 - DNA, 25 bp, Mus musculus
cttccaagggaagctgtgacacaca

SEQ ID NO: 394607 - DNA, 25 bp, Mus musculus
cttccaagtaagagggcaggcgttt

SEQ ID NO: 394608 - DNA, 25 bp, Mus musculus
cttccaagtaagtgggcaggcgttt

SEQ ID NO: 394609 - DNA, 25 bp, Mus musculus
cttccaagtgagatccctattgctt

SEQ ID NO: 394610 - DNA, 25 bp, Mus musculus
cttccaagtgagttccctattgctt

SEQ ID NO: 394611 - DNA, 25 bp, Mus musculus
cttccaagtgctcaggtgacaggtt

SEQ ID NO: 394612 - DNA, 25 bp, Mus musculus
cttccaagtgctgaggtgacaggtt

SEQ ID NO: 394613 - DNA, 25 bp, Mus musculus
cttccaagttccctaagcatagata

SEQ ID NO: 394614 - DNA, 25 bp, Mus musculus
cttccaagttccgtaagcatagata

SEQ ID NO: 394615 - DNA, 25 bp, Mus musculus
cttccaagttctcttttctcaacac

SEQ ID NO: 394616 - DNA, 25 bp, Mus musculus
cttccaagttctgttttctcaacac

SEQ ID NO: 394617 - DNA, 25 bp, Mus musculus
cttccaataggcctagtcatttcta

SEQ ID NO: 394618 - DNA, 25 bp, Mus musculus
cttccaataggcgtagtcatttcta

SEQ ID NO: 394619 - DNA, 25 bp, Mus musculus
cttccaattttaacagttagggtct

SEQ ID NO: 394620 - DNA, 25 bp, Mus musculus
cttccaattttatcagttagggtct

SEQ ID NO: 394621 - DNA, 25 bp, Mus musculus
cttccacaatgtagaatttttcctt

SEQ ID NO: 394622 - DNA, 25 bp, Mus musculus
cttccacaatgttgaatttttcctt

SEQ ID NO: 394623 - DNA, 25 bp, Mus musculus
cttccacacctaccattagtcaaga

SEQ ID NO: 394624 - DNA, 25 bp, Mus musculus
cttccacacctacggtcatctttaa

SEQ ID NO: 394625 - DNA, 25 bp, Mus musculus
cttccacacctagcattagtcaaga

SEQ ID NO: 394626 - DNA, 25 bp, Mus musculus
cttccacacctagggtcatctttaa

SEQ ID NO: 394627 - DNA, 25 bp, Mus musculus
cttccacagaacctttgatagccat

SEQ ID NO: 394628 - DNA, 25 bp, Mus musculus
cttccacagaacgtttgatagccat

SEQ ID NO: 394629 - DNA, 25 bp, Mus musculus
cttccacaggagctacaggcatctt

SEQ ID NO: 394630 - DNA, 25 bp, Mus musculus
cttccacaggaggtacaggcatctt

SEQ ID NO: 394631 - DNA, 25 bp, Mus musculus
cttccacatacaagcaacagaaagc

SEQ ID NO: 394632 - DNA, 25 bp, Mus musculus
cttccacatacatgcaacagaaagc

SEQ ID NO: 394633 - DNA, 25 bp, Mus musculus
cttccacatcgaatcctgtggatct

SEQ ID NO: 394634 - DNA, 25 bp, Mus musculus
cttccacatcgattcctgtggatct

SEQ ID NO: 394635 - DNA, 25 bp, Mus musculus
cttccacattccatttgatttttca

SEQ ID NO: 394636 - DNA, 25 bp, Mus musculus
cttccacattccttttgatttttca

SEQ ID NO: 394637 - DNA, 25 bp, Mus musculus
cttccaccagcaccagtagatgggt

SEQ ID NO: 394638 - DNA, 25 bp, Mus musculus
cttccaccagcagcagtagatgggt

SEQ ID NO: 394639 - DNA, 25 bp, Mus musculus
cttccaccaggaacatactgcaatt

SEQ ID NO: 394640 - DNA, 25 bp, Mus musculus
cttccaccaggacccgtttaagatt

SEQ ID NO: 394641 - DNA, 25 bp, Mus musculus
cttccaccaggagccgtttaagatt

SEQ ID NO: 394642 - DNA, 25 bp, Mus musculus
cttccaccaggatcatactgcaatt

SEQ ID NO: 394643 - DNA, 25 bp, Mus musculus
cttccaccatctcttggaggttggg

SEQ ID NO: 394644 - DNA, 25 bp, Mus musculus
cttccaccatctgttggaggttggg

SEQ ID NO: 394645 - DNA, 25 bp, Mus musculus
cttccacccagaatggtttgtgtcc

SEQ ID NO: 394646 - DNA, 25 bp, Mus musculus
cttccacccagattggtttgtgtcc

SEQ ID NO: 394647 - DNA, 25 bp, Mus musculus
cttccaccgggaatttaatgcaggt

SEQ ID NO: 394648 - DNA, 25 bp, Mus musculus
cttccaccgggattttaatgcaggt

SEQ ID NO: 394649 - DNA, 25 bp, Mus musculus
cttccaccttacagttttcacagca

SEQ ID NO: 394650 - DNA, 25 bp, Mus musculus
cttccaccttacatttgacagaatg

SEQ ID NO: 394651 - DNA, 25 bp, Mus musculus
cttccaccttactgttttcacagca

SEQ ID NO: 394652 - DNA, 25 bp, Mus musculus
cttccaccttacttttgacagaatg

SEQ ID NO: 394653 - DNA, 25 bp, Mus musculus
cttccacctttgatgtatcctgttt

SEQ ID NO: 394654 - DNA, 25 bp, Mus musculus
cttccacctttgttgtatcctgttt

SEQ ID NO: 394655 - DNA, 25 bp, Mus musculus
cttccacgacatcacaaagcgtgct

SEQ ID NO: 394656 - DNA, 25 bp, Mus musculus
cttccacgacatgacaaagcgtgct

SEQ ID NO: 394657 - DNA, 25 bp, Mus musculus
cttccacgatccatattcagactat

SEQ ID NO: 394658 - DNA, 25 bp, Mus musculus
cttccacgatccttattcagactat

SEQ ID NO: 394659 - DNA, 25 bp, Mus musculus
cttccacgtcaaagctcacttaatt

SEQ ID NO: 394660 - DNA, 25 bp, Mus musculus
cttccacgtcaatgctcacttaatt

SEQ ID NO: 394661 - DNA, 25 bp, Mus musculus
cttccacgtgccattttgcagagtg

SEQ ID NO: 394662 - DNA, 25 bp, Mus musculus
cttccacgtgcctttttgcagagtg

SEQ ID NO: 394663 - DNA, 25 bp, Mus musculus
cttccactaattctcagctctttaa

SEQ ID NO: 394664 - DNA, 25 bp, Mus musculus
cttccactaattgtcagctctttaa

SEQ ID NO: 394665 - DNA, 25 bp, Mus musculus
cttccactatggcacctggagacta

SEQ ID NO: 394666 - DNA, 25 bp, Mus musculus
cttccactatgggacctggagacta

SEQ ID NO: 394667 - DNA, 25 bp, Mus musculus
cttccactcaggacagaggtcattt

SEQ ID NO: 394668 - DNA, 25 bp, Mus musculus
cttccactcaggtcagaggtcattt

SEQ ID NO: 394669 - DNA, 25 bp, Mus musculus
cttccactctgtagaggttttttct

SEQ ID NO: 394670 - DNA, 25 bp, Mus musculus
cttccactctgttgaggttttttct

SEQ ID NO: 394671 - DNA, 25 bp, Mus musculus
cttccactgaagatgggtggcagct

SEQ ID NO: 394672 - DNA, 25 bp, Mus musculus
cttccactgaagttgggtggcagct

SEQ ID NO: 394673 - DNA, 25 bp, Mus musculus
cttccactgagtagcattttgtaga

SEQ ID NO: 394674 - DNA, 25 bp, Mus musculus
cttccactgagttgcattttgtaga

SEQ ID NO: 394675 - DNA, 25 bp, Mus musculus
cttccactgctcctcaaattaaatg

SEQ ID NO: 394676 - DNA, 25 bp, Mus musculus
cttccactgctcgtcaaattaaatg

SEQ ID NO: 394677 - DNA, 25 bp, Mus musculus
cttccactgttcaatcacatgctct

SEQ ID NO: 394678 - DNA, 25 bp, Mus musculus
cttccactgttctatcacatgctct

SEQ ID NO: 394679 - DNA, 25 bp, Mus musculus
cttccacttcttctaagccttgctt

SEQ ID NO: 394680 - DNA, 25 bp, Mus musculus
cttccacttcttgtaagccttgctt

SEQ ID NO: 394681 - DNA, 25 bp, Mus musculus
cttccacttggcatggtaaaagtat

SEQ ID NO: 394682 - DNA, 25 bp, Mus musculus
cttccacttggcttggtaaaagtat

SEQ ID NO: 394683 - DNA, 25 bp, Mus musculus
cttccacttgtaccggccacaggag

SEQ ID NO: 394684 - DNA, 25 bp, Mus musculus
cttccacttgtagcggccacaggag

SEQ ID NO: 394685 - DNA, 25 bp, Mus musculus
cttccacttgtgaatgggcccttaa

SEQ ID NO: 394686 - DNA, 25 bp, Mus musculus
cttccacttgtgtatgggcccttaa

SEQ ID NO: 394687 - DNA, 25 bp, Mus musculus
cttccactttgcaggcagaggcgag

SEQ ID NO: 394688 - DNA, 25 bp, Mus musculus
cttccactttgctggcagaggcgag

SEQ ID NO: 394689 - DNA, 25 bp, Mus musculus
cttccagaaaggctcttcaagagca

SEQ ID NO: 394690 - DNA, 25 bp, Mus musculus
cttccagaaagggtcttcaagagca

SEQ ID NO: 394691 - DNA, 25 bp, Mus musculus
cttccagaagcacgctgtgttcttt

SEQ ID NO: 394692 - DNA, 25 bp, Mus musculus
cttccagaagcaggctgtgttcttt

SEQ ID NO: 394693 - DNA, 25 bp, Mus musculus
cttccagaagctacccattacagta

SEQ ID NO: 394694 - DNA, 25 bp, Mus musculus
cttccagaagcttcccattacagta

SEQ ID NO: 394695 - DNA, 25 bp, Mus musculus
cttccagagaatagcattcatggct

SEQ ID NO: 394696 - DNA, 25 bp, Mus musculus
cttccagagaattgcattcatggct

SEQ ID NO: 394697 - DNA, 25 bp, Mus musculus
cttccagagcaacggaacatctgta

SEQ ID NO: 394698 - DNA, 25 bp, Mus musculus
cttccagagcaagggaacatctgta

SEQ ID NO: 394699 - DNA, 25 bp, Mus musculus
cttccagagcttctattttatctag

SEQ ID NO: 394700 - DNA, 25 bp, Mus musculus
cttccagagcttgtattttatctag

SEQ ID NO: 394701 - DNA, 25 bp, Mus musculus
cttccagaggatatcgaggatcttc

SEQ ID NO: 394702 - DNA, 25 bp, Mus musculus
cttccagaggatttcgaggatcttc

SEQ ID NO: 394703 - DNA, 25 bp, Mus musculus
cttccagagggcatcgttcgtgcgg

SEQ ID NO: 394704 - DNA, 25 bp, Mus musculus
cttccagagggcttcgttcgtgcgg

SEQ ID NO: 394705 - DNA, 25 bp, Mus musculus
cttccagagggtaccacacctgaaa

SEQ ID NO: 394706 - DNA, 25 bp, Mus musculus
cttccagagggttccacacctgaaa

SEQ ID NO: 394707 - DNA, 25 bp, Mus musculus
cttccagatcgccaaaggaccagaa

SEQ ID NO: 394708 - DNA, 25 bp, Mus musculus
cttccagatcgcgaaaggaccagaa

SEQ ID NO: 394709 - DNA, 25 bp, Mus musculus
cttccagattctactaggtacagta

SEQ ID NO: 394710 - DNA, 25 bp, Mus musculus
cttccagattcttctaggtacagta

SEQ ID NO: 394711 - DNA, 25 bp, Mus musculus
cttccagcaattccaagccagaggg

SEQ ID NO: 394712 - DNA, 25 bp, Mus musculus
cttccagcaattgcaagccagaggg

SEQ ID NO: 394713 - DNA, 25 bp, Mus musculus
cttccagcactgcatgagcttcaaa

SEQ ID NO: 394714 - DNA, 25 bp, Mus musculus
cttccagcactggatgagcttcaaa

SEQ ID NO: 394715 - DNA, 25 bp, Mus musculus
cttccagcagatctggatcagcaag

SEQ ID NO: 394716 - DNA, 25 bp, Mus musculus
cttccagcagatgtggatcagcaag

SEQ ID NO: 394717 - DNA, 25 bp, Mus musculus
cttccagcccatcaacatttatttt

SEQ ID NO: 394718 - DNA, 25 bp, Mus musculus
cttccagcccatgaacatttatttt

SEQ ID NO: 394719 - DNA, 25 bp, Mus musculus
cttccagccccactagtgatgagag

SEQ ID NO: 394720 - DNA, 25 bp, Mus musculus
cttccagccccagtagtgatgagag

SEQ ID NO: 394721 - DNA, 25 bp, Mus musculus
cttccagcctgacttgaggctaaga

SEQ ID NO: 394722 - DNA, 25 bp, Mus musculus
cttccagcctgagttgaggctaaga

SEQ ID NO: 394723 - DNA, 25 bp, Mus musculus
cttccagctcgactctgatttcaga

SEQ ID NO: 394724 - DNA, 25 bp, Mus musculus
cttccagctcgagtctgatttcaga

SEQ ID NO: 394725 - DNA, 25 bp, Mus musculus
cttccagctcttccaatttacttta

SEQ ID NO: 394726 - DNA, 25 bp, Mus musculus
cttccagctcttgcaatttacttta

SEQ ID NO: 394727 - DNA, 25 bp, Mus musculus
cttccaggactgacagaggctacaa

SEQ ID NO: 394728 - DNA, 25 bp, Mus musculus
cttccaggactgtcagaggctacaa

SEQ ID NO: 394729 - DNA, 25 bp, Mus musculus
cttccaggatcactaccatgaaaac

SEQ ID NO: 394730 - DNA, 25 bp, Mus musculus
cttccaggatcagtaccatgaaaac

SEQ ID NO: 394731 - DNA, 25 bp, Mus musculus
cttccaggcattagtgtgggagcca

SEQ ID NO: 394732 - DNA, 25 bp, Mus musculus
cttccaggcatttgtgtgggagcca

SEQ ID NO: 394733 - DNA, 25 bp, Mus musculus
cttccagggacacattctctttgtt

SEQ ID NO: 394734 - DNA, 25 bp, Mus musculus
cttccagggacagattctctttgtt

SEQ ID NO: 394735 - DNA, 25 bp, Mus musculus
cttccagggctgaccagtttgagta

SEQ ID NO: 394736 - DNA, 25 bp, Mus musculus
cttccagggctgtccagtttgagta

SEQ ID NO: 394737 - DNA, 25 bp, Mus musculus
cttccaggtcagcatctcacgtaga

SEQ ID NO: 394738 - DNA, 25 bp, Mus musculus
cttccaggtcaggatctcacgtaga

SEQ ID NO: 394739 - DNA, 25 bp, Mus musculus
cttccaggtcgcacagtcgggttgg

SEQ ID NO: 394740 - DNA, 25 bp, Mus musculus
cttccaggtcgctcagtcgggttgg

SEQ ID NO: 394741 - DNA, 25 bp, Mus musculus
cttccaggtgctatgtgctgattgt

SEQ ID NO: 394742 - DNA, 25 bp, Mus musculus
cttccaggtgctttgtgctgattgt

SEQ ID NO: 394743 - DNA, 25 bp, Mus musculus
cttccaggtgtgcatcccaacaatg

SEQ ID NO: 394744 - DNA, 25 bp, Mus musculus
cttccaggtgtggatcccaacaatg

SEQ ID NO: 394745 - DNA, 25 bp, Mus musculus
cttccaggttttcccgtaatgatct

SEQ ID NO: 394746 - DNA, 25 bp, Mus musculus
cttccaggttttgccgtaatgatct

SEQ ID NO: 394747 - DNA, 25 bp, Mus musculus
cttccagtacccctaacagtcatga

SEQ ID NO: 394748 - DNA, 25 bp, Mus musculus
cttccagtacccgtaacagtcatga

SEQ ID NO: 394749 - DNA, 25 bp, Mus musculus
cttccagtccatctgtgctgatact

SEQ ID NO: 394750 - DNA, 25 bp, Mus musculus
cttccagtccatgtgtgctgatact

SEQ ID NO: 394751 - DNA, 25 bp, Mus musculus
cttccagtctttctcagttgtactt

SEQ ID NO: 394752 - DNA, 25 bp, Mus musculus
cttccagtctttgtcagttgtactt

SEQ ID NO: 394753 - DNA, 25 bp, Mus musculus
cttccagtgagacgccatctctaaa

SEQ ID NO: 394754 - DNA, 25 bp, Mus musculus
cttccagtgagaggccatctctaaa

SEQ ID NO: 394755 - DNA, 25 bp, Mus musculus
cttccagtgatgcttatgaggccag

SEQ ID NO: 394756 - DNA, 25 bp, Mus musculus
cttccagtgatggttatgaggccag

SEQ ID NO: 394757 - DNA, 25 bp, Mus musculus
cttccagtggtacgagatttgcccc

SEQ ID NO: 394758 - DNA, 25 bp, Mus musculus
cttccagtggtaggagatttgcccc

SEQ ID NO: 394759 - DNA, 25 bp, Mus musculus
cttccagttcttcttctggattggc

SEQ ID NO: 394760 - DNA, 25 bp, Mus musculus
cttccagttcttgttctggattggc

SEQ ID NO: 394761 - DNA, 25 bp, Mus musculus
cttccagtttgtatgagtcattttt

SEQ ID NO: 394762 - DNA, 25 bp, Mus musculus
cttccagtttgtttgagtcattttt

SEQ ID NO: 394763 - DNA, 25 bp, Mus musculus
cttccatataagacccgagtgcaga

SEQ ID NO: 394764 - DNA, 25 bp, Mus musculus
cttccatataagtcccgagtgcaga

SEQ ID NO: 394765 - DNA, 25 bp, Mus musculus
cttccatataataccttttcttagg

SEQ ID NO: 394766 - DNA, 25 bp, Mus musculus
cttccatataattccttttcttagg

SEQ ID NO: 394767 - DNA, 25 bp, Mus musculus
cttccatatttcaccttactctaga

SEQ ID NO: 394768 - DNA, 25 bp, Mus musculus
cttccatatttctccttactctaga

SEQ ID NO: 394769 - DNA, 25 bp, Mus musculus
cttccatcatgtctcacagacaggt

SEQ ID NO: 394770 - DNA, 25 bp, Mus musculus
cttccatcatgtgtcacagacaggt

SEQ ID NO: 394771 - DNA, 25 bp, Mus musculus
cttccatccacaactacattaatct

SEQ ID NO: 394772 - DNA, 25 bp, Mus musculus
cttccatccacatctacattaatct

SEQ ID NO: 394773 - DNA, 25 bp, Mus musculus
cttccatcccaaaacaatgccaagt

SEQ ID NO: 394774 - DNA, 25 bp, Mus musculus
cttccatcccaatacaatgccaagt

SEQ ID NO: 394775 - DNA, 25 bp, Mus musculus
cttccatcctttcggacccaaggag

SEQ ID NO: 394776 - DNA, 25 bp, Mus musculus
cttccatcctttgggacccaaggag

SEQ ID NO: 394777 - DNA, 25 bp, Mus musculus
cttccatctgctaccacttattatt

SEQ ID NO: 394778 - DNA, 25 bp, Mus musculus
cttccatctgcttccacttattatt

SEQ ID NO: 394779 - DNA, 25 bp, Mus musculus
cttccatctggtcagcgacatgtat

SEQ ID NO: 394780 - DNA, 25 bp, Mus musculus
cttccatctggtgagcgacatgtat

SEQ ID NO: 394781 - DNA, 25 bp, Mus musculus
cttccatcttgtcaggctgttatgc

SEQ ID NO: 394782 - DNA, 25 bp, Mus musculus
cttccatcttgtgaggctgttatgc

SEQ ID NO: 394783 - DNA, 25 bp, Mus musculus
cttccatgaaagagttaggctaggc

SEQ ID NO: 394784 - DNA, 25 bp, Mus musculus
cttccatgaaagtgttaggctaggc

SEQ ID NO: 394785 - DNA, 25 bp, Mus musculus
cttccatgagaccactcttgtcaca

SEQ ID NO: 394786 - DNA, 25 bp, Mus musculus
cttccatgagacgactcttgtcaca

SEQ ID NO: 394787 - DNA, 25 bp, Mus musculus
cttccatgagtgaatccatgctcaa

SEQ ID NO: 394788 - DNA, 25 bp, Mus musculus
cttccatgagtgtatccatgctcaa

SEQ ID NO: 394789 - DNA, 25 bp, Mus musculus
cttccatgatagagtgcgaccagag

SEQ ID NO: 394790 - DNA, 25 bp, Mus musculus
cttccatgatagtgtgcgaccagag

SEQ ID NO: 394791 - DNA, 25 bp, Mus musculus
cttccatgcctgacaaattggatgt

SEQ ID NO: 394792 - DNA, 25 bp, Mus musculus
cttccatgcctgtcaaattggatgt

SEQ ID NO: 394793 - DNA, 25 bp, Mus musculus
cttccatgctgccttgttgaaagat

SEQ ID NO: 394794 - DNA, 25 bp, Mus musculus
cttccatgctgcgttgttgaaagat

SEQ ID NO: 394795 - DNA, 25 bp, Mus musculus
cttccatggcctatcacgtaattga

SEQ ID NO: 394796 - DNA, 25 bp, Mus musculus
cttccatggcctttcacgtaattga

SEQ ID NO: 394797 - DNA, 25 bp, Mus musculus
cttccatggcgtacaagtgctcagt

SEQ ID NO: 394798 - DNA, 25 bp, Mus musculus
cttccatggcgttcaagtgctcagt

SEQ ID NO: 394799 - DNA, 25 bp, Mus musculus
cttccatggctcacatatgtgtaac

SEQ ID NO: 394800 - DNA, 25 bp, Mus musculus
cttccatggctctcatatgtgtaac

SEQ ID NO: 394801 - DNA, 25 bp, Mus musculus
cttccatgtgttccctggaggtttg

SEQ ID NO: 394802 - DNA, 25 bp, Mus musculus
cttccatgtgttgcctggaggtttg

SEQ ID NO: 394803 - DNA, 25 bp, Mus musculus
cttccatgttccatgattaagtgaa

SEQ ID NO: 394804 - DNA, 25 bp, Mus musculus
cttccatgttccttgattaagtgaa

SEQ ID NO: 394805 - DNA, 25 bp, Mus musculus
cttccattaatacctaaattgtcag

SEQ ID NO: 394806 - DNA, 25 bp, Mus musculus
cttccattaatagctaaattgtcag

SEQ ID NO: 394807 - DNA, 25 bp, Mus musculus
cttccattcaaacctaatgctagtg

SEQ ID NO: 394808 - DNA, 25 bp, Mus musculus
cttccattcaaagctaatgctagtg

SEQ ID NO: 394809 - DNA, 25 bp, Mus musculus
cttccattgggcattttagtagcaa

SEQ ID NO: 394810 - DNA, 25 bp, Mus musculus
cttccattgggctttttagtagcaa

SEQ ID NO: 394811 - DNA, 25 bp, Mus musculus
cttccattgtttcccaaggcaactt

SEQ ID NO: 394812 - DNA, 25 bp, Mus musculus
cttccattgtttgccaaggcaactt

SEQ ID NO: 394813 - DNA, 25 bp, Mus musculus
cttccatttattatgtggctgtatg

SEQ ID NO: 394814 - DNA, 25 bp, Mus musculus
cttccatttattttgtggctgtatg

SEQ ID NO: 394815 - DNA, 25 bp, Mus musculus
cttccatttccgctttgattgatgg

SEQ ID NO: 394816 - DNA, 25 bp, Mus musculus
cttccatttccggtttgattgatgg

SEQ ID NO: 394817 - DNA, 25 bp, Mus musculus
cttccatttgaaaagcacttcctta

SEQ ID NO: 394818 - DNA, 25 bp, Mus musculus
cttccatttgaactatcaactcatt

SEQ ID NO: 394819 - DNA, 25 bp, Mus musculus
cttccatttgaagtatcaactcatt

SEQ ID NO: 394820 - DNA, 25 bp, Mus musculus
cttccatttgaatagcacttcctta

SEQ ID NO: 394821 - DNA, 25 bp, Mus musculus
cttccatttttcaagtaagtctttg

SEQ ID NO: 394822 - DNA, 25 bp, Mus musculus
cttccatttttctagtaagtctttg

SEQ ID NO: 394823 - DNA, 25 bp, Mus musculus
cttcccaaaggtctgtaggtaggag

SEQ ID NO: 394824 - DNA, 25 bp, Mus musculus
cttcccaaaggtgtgtaggtaggag

SEQ ID NO: 394825 - DNA, 25 bp, Mus musculus
cttcccaacatcatgtagctgcggg

SEQ ID NO: 394826 - DNA, 25 bp, Mus musculus
cttcccaacatcttgtagctgcggg

SEQ ID NO: 394827 - DNA, 25 bp, Mus musculus
cttcccaacatgactatcccaaaat

SEQ ID NO: 394828 - DNA, 25 bp, Mus musculus
cttcccaacatgtctatcccaaaat

SEQ ID NO: 394829 - DNA, 25 bp, Mus musculus
cttcccaagctaattcagcaaaggc

SEQ ID NO: 394830 - DNA, 25 bp, Mus musculus
cttcccaagctatttcagcaaaggc

SEQ ID NO: 394831 - DNA, 25 bp, Mus musculus
cttcccaagggcagtgtgagtcaac

SEQ ID NO: 394832 - DNA, 25 bp, Mus musculus
cttcccaagggctgtgtgagtcaac

SEQ ID NO: 394833 - DNA, 25 bp, Mus musculus
cttcccaagtacctgttagcactta

SEQ ID NO: 394834 - DNA, 25 bp, Mus musculus
cttcccaagtacgtgttagcactta

SEQ ID NO: 394835 - DNA, 25 bp, Mus musculus
cttcccaagtgtagattatgtgact

SEQ ID NO: 394836 - DNA, 25 bp, Mus musculus
cttcccaagtgttgattatgtgact

SEQ ID NO: 394837 - DNA, 25 bp, Mus musculus
cttcccaatatcctcatttctcatt

SEQ ID NO: 394838 - DNA, 25 bp, Mus musculus
cttcccaatatcgtcatttctcatt

SEQ ID NO: 394839 - DNA, 25 bp, Mus musculus
cttcccacaataacgaggctctgat

SEQ ID NO: 394840 - DNA, 25 bp, Mus musculus
cttcccacaatatcgaggctctgat

SEQ ID NO: 394841 - DNA, 25 bp, Mus musculus
cttcccacacagagcactgaggaga

SEQ ID NO: 394842 - DNA, 25 bp, Mus musculus
cttcccacacagtgcactgaggaga

SEQ ID NO: 394843 - DNA, 25 bp, Mus musculus
cttcccacagatccatgtctagaat

SEQ ID NO: 394844 - DNA, 25 bp, Mus musculus
cttcccacagatgcatgtctagaat

SEQ ID NO: 394845 - DNA, 25 bp, Mus musculus
cttcccacagttctaatgtcattca

SEQ ID NO: 394846 - DNA, 25 bp, Mus musculus
cttcccacagttgtaatgtcattca

SEQ ID NO: 394847 - DNA, 25 bp, Mus musculus
cttcccacatgcatcctagtctttt

SEQ ID NO: 394848 - DNA, 25 bp, Mus musculus
cttcccacatgcttcctagtctttt

SEQ ID NO: 394849 - DNA, 25 bp, Mus musculus
cttcccacatttacagtaccaaaca

SEQ ID NO: 394850 - DNA, 25 bp, Mus musculus
cttcccacattttcagtaccaaaca

SEQ ID NO: 394851 - DNA, 25 bp, Mus musculus
cttcccactcctatttcaaatggac

SEQ ID NO: 394852 - DNA, 25 bp, Mus musculus
cttcccactcctttttcaaatggac

SEQ ID NO: 394853 - DNA, 25 bp, Mus musculus
cttcccactctccaggatcaatata

SEQ ID NO: 394854 - DNA, 25 bp, Mus musculus
cttcccactctcgaggatcaatata

SEQ ID NO: 394855 - DNA, 25 bp, Mus musculus
cttcccactctgctgttggatggta

SEQ ID NO: 394856 - DNA, 25 bp, Mus musculus
cttcccactctggtgttggatggta

SEQ ID NO: 394857 - DNA, 25 bp, Mus musculus
cttcccactcttccaagttaggagg

SEQ ID NO: 394858 - DNA, 25 bp, Mus musculus
cttcccactcttgcaagttaggagg

SEQ ID NO: 394859 - DNA, 25 bp, Mus musculus
cttcccactgatataggctttcaca

SEQ ID NO: 394860 - DNA, 25 bp, Mus musculus
cttcccactgatttaggctttcaca

SEQ ID NO: 394861 - DNA, 25 bp, Mus musculus
cttcccactggaatactgctattgt

SEQ ID NO: 394862 - DNA, 25 bp, Mus musculus
cttcccactggattactgctattgt

SEQ ID NO: 394863 - DNA, 25 bp, Mus musculus
cttcccagaagcatagggcctgtgt

SEQ ID NO: 394864 - DNA, 25 bp, Mus musculus
cttcccagaagcttagggcctgtgt

SEQ ID NO: 394865 - DNA, 25 bp, Mus musculus
cttcccagacacaattctgacttac

SEQ ID NO: 394866 - DNA, 25 bp, Mus musculus
cttcccagacactattctgacttac

SEQ ID NO: 394867 - DNA, 25 bp, Mus musculus
cttcccagagctaggctgcagaaat

SEQ ID NO: 394868 - DNA, 25 bp, Mus musculus
cttcccagagcttggctgcagaaat

SEQ ID NO: 394869 - DNA, 25 bp, Mus musculus
cttcccagataccatgtcattttgc

SEQ ID NO: 394870 - DNA, 25 bp, Mus musculus
cttcccagatacgatgtcattttgc

SEQ ID NO: 394871 - DNA, 25 bp, Mus musculus
cttcccagcaggcacaagttgtagt

SEQ ID NO: 394872 - DNA, 25 bp, Mus musculus
cttcccagcagggacaagttgtagt

SEQ ID NO: 394873 - DNA, 25 bp, Mus musculus
cttcccaggaaccagtccactggag

SEQ ID NO: 394874 - DNA, 25 bp, Mus musculus
cttcccaggaacgagtccactggag

SEQ ID NO: 394875 - DNA, 25 bp, Mus musculus
cttcccaggacgacagatgagcagg

SEQ ID NO: 394876 - DNA, 25 bp, Mus musculus
cttcccaggacgtcagatgagcagg

SEQ ID NO: 394877 - DNA, 25 bp, Mus musculus
cttcccagggttcctgtcttgagag

SEQ ID NO: 394878 - DNA, 25 bp, Mus musculus
cttcccagggttgctgtcttgagag

SEQ ID NO: 394879 - DNA, 25 bp, Mus musculus
cttcccaggtggagtacatcgatgt

SEQ ID NO: 394880 - DNA, 25 bp, Mus musculus
cttcccaggtggtgtacatcgatgt

SEQ ID NO: 394881 - DNA, 25 bp, Mus musculus
cttcccagtgcacgagctacaggtg

SEQ ID NO: 394882 - DNA, 25 bp, Mus musculus
cttcccagtgcaggagctacaggtg

SEQ ID NO: 394883 - DNA, 25 bp, Mus musculus
cttcccagtgttatttattcctgtg

SEQ ID NO: 394884 - DNA, 25 bp, Mus musculus
cttcccagtgttcagatggctgtag

SEQ ID NO: 394885 - DNA, 25 bp, Mus musculus
cttcccagtgttgagatggctgtag

SEQ ID NO: 394886 - DNA, 25 bp, Mus musculus
cttcccagtgttttttattcctgtg

SEQ ID NO: 394887 - DNA, 25 bp, Mus musculus
cttcccatagctaaaccatttctca

SEQ ID NO: 394888 - DNA, 25 bp, Mus musculus
cttcccatagcttaaccatttctca

SEQ ID NO: 394889 - DNA, 25 bp, Mus musculus
cttcccatcaaaactgcacttcata

SEQ ID NO: 394890 - DNA, 25 bp, Mus musculus
cttcccatcaaatctgcacttcata

SEQ ID NO: 394891 - DNA, 25 bp, Mus musculus
cttcccatcagcattcaggatacat

SEQ ID NO: 394892 - DNA, 25 bp, Mus musculus
cttcccatcagctttcaggatacat

SEQ ID NO: 394893 - DNA, 25 bp, Mus musculus
cttcccatcgaaattatggcttcat

SEQ ID NO: 394894 - DNA, 25 bp, Mus musculus
cttcccatcgaatttatggcttcat

SEQ ID NO: 394895 - DNA, 25 bp, Mus musculus
cttcccatctcactagaaccgaaat

SEQ ID NO: 394896 - DNA, 25 bp, Mus musculus
cttcccatctcagtagaaccgaaat

SEQ ID NO: 394897 - DNA, 25 bp, Mus musculus
cttcccatggaaacactaacacctt

SEQ ID NO: 394898 - DNA, 25 bp, Mus musculus
cttcccatggaatcactaacacctt

SEQ ID NO: 394899 - DNA, 25 bp, Mus musculus
cttcccatggatcctggcagatgaa

SEQ ID NO: 394900 - DNA, 25 bp, Mus musculus
cttcccatggatgctggcagatgaa

SEQ ID NO: 394901 - DNA, 25 bp, Mus musculus
cttcccatgtggactatgagtgata

SEQ ID NO: 394902 - DNA, 25 bp, Mus musculus
cttcccatgtggaggtcaacccagc

SEQ ID NO: 394903 - DNA, 25 bp, Mus musculus
cttcccatgtggtctatgagtgata

SEQ ID NO: 394904 - DNA, 25 bp, Mus musculus
cttcccatgtggtggtcaacccagc

SEQ ID NO: 394905 - DNA, 25 bp, Mus musculus
cttcccattcacattcatctagtta

SEQ ID NO: 394906 - DNA, 25 bp, Mus musculus
cttcccattcactttcatctagtta

SEQ ID NO: 394907 - DNA, 25 bp, Mus musculus
cttcccattcctaccacaaatactg

SEQ ID NO: 394908 - DNA, 25 bp, Mus musculus
cttcccattccttccacaaatactg

SEQ ID NO: 394909 - DNA, 25 bp, Mus musculus
cttccccaaagtactgttagctcag

SEQ ID NO: 394910 - DNA, 25 bp, Mus musculus
cttccccaaagttctgttagctcag

SEQ ID NO: 394911 - DNA, 25 bp, Mus musculus
cttccccaactaatttgtgctgtgt

SEQ ID NO: 394912 - DNA, 25 bp, Mus musculus
cttccccaactattttgtgctgtgt

SEQ ID NO: 394913 - DNA, 25 bp, Mus musculus
cttccccaaggtcagacgtaacttg

SEQ ID NO: 394914 - DNA, 25 bp, Mus musculus
cttccccaaggtgagacgtaacttg

SEQ ID NO: 394915 - DNA, 25 bp, Mus musculus
cttccccactccagcagagttggag

SEQ ID NO: 394916 - DNA, 25 bp, Mus musculus
cttccccactcctgcagagttggag

SEQ ID NO: 394917 - DNA, 25 bp, Mus musculus
cttccccactggctgaataaactag

SEQ ID NO: 394918 - DNA, 25 bp, Mus musculus
cttccccactgggtgaataaactag

SEQ ID NO: 394919 - DNA, 25 bp, Mus musculus
cttccccagatcacatttctagttt

SEQ ID NO: 394920 - DNA, 25 bp, Mus musculus
cttccccagatctcatttctagttt

SEQ ID NO: 394921 - DNA, 25 bp, Mus musculus
cttccccaggacaagagtttcaact

SEQ ID NO: 394922 - DNA, 25 bp, Mus musculus
cttccccaggactagagtttcaact

SEQ ID NO: 394923 - DNA, 25 bp, Mus musculus
cttccccagggaagtggactctgat

SEQ ID NO: 394924 - DNA, 25 bp, Mus musculus
cttccccagggatgtggactctgat

SEQ ID NO: 394925 - DNA, 25 bp, Mus musculus
cttccccagtggcagctctgtgagc

SEQ ID NO: 394926 - DNA, 25 bp, Mus musculus
cttccccagtgggagctctgtgagc

SEQ ID NO: 394927 - DNA, 25 bp, Mus musculus
cttccccatgcaagcagttattcat

SEQ ID NO: 394928 - DNA, 25 bp, Mus musculus
cttccccatgcatgcagttattcat

SEQ ID NO: 394929 - DNA, 25 bp, Mus musculus
cttccccatgggagctgagggtttg

SEQ ID NO: 394930 - DNA, 25 bp, Mus musculus
cttccccatgggtgctgagggtttg

SEQ ID NO: 394931 - DNA, 25 bp, Mus musculus
cttccccattctccactaattgaga

SEQ ID NO: 394932 - DNA, 25 bp, Mus musculus
cttccccattctgcactaattgaga

SEQ ID NO: 394933 - DNA, 25 bp, Mus musculus
cttccccgagaaactctaacttttg

SEQ ID NO: 394934 - DNA, 25 bp, Mus musculus
cttccccgagaatctctaacttttg

SEQ ID NO: 394935 - DNA, 25 bp, Mus musculus
cttcccctaaagagttcattgaact

SEQ ID NO: 394936 - DNA, 25 bp, Mus musculus
cttcccctaaagtgttcattgaact

SEQ ID NO: 394937 - DNA, 25 bp, Mus musculus
cttcccctaagcaggaatccacgaa

SEQ ID NO: 394938 - DNA, 25 bp, Mus musculus
cttcccctaagctggaatccacgaa

SEQ ID NO: 394939 - DNA, 25 bp, Mus musculus
cttcccctacaaagcttcttgtgaa

SEQ ID NO: 394940 - DNA, 25 bp, Mus musculus
cttcccctacaatgcttcttgtgaa

SEQ ID NO: 394941 - DNA, 25 bp, Mus musculus
cttcccctagaacgctgtgtatagt

SEQ ID NO: 394942 - DNA, 25 bp, Mus musculus
cttcccctagaaggctgtgtatagt

SEQ ID NO: 394943 - DNA, 25 bp, Mus musculus
cttcccctgattccagtgttcctga

SEQ ID NO: 394944 - DNA, 25 bp, Mus musculus
cttcccctgattgcagtgttcctga

SEQ ID NO: 394945 - DNA, 25 bp, Mus musculus
cttcccctgtctacgttggatagaa

SEQ ID NO: 394946 - DNA, 25 bp, Mus musculus
cttcccctgtcttcgttggatagaa

SEQ ID NO: 394947 - DNA, 25 bp, Mus musculus
cttccccttagacaatctgatgtgc

SEQ ID NO: 394948 - DNA, 25 bp, Mus musculus
cttccccttagagaatctgatgtgc

SEQ ID NO: 394949 - DNA, 25 bp, Mus musculus
cttccccttagcagtcctcgagatg

SEQ ID NO: 394950 - DNA, 25 bp, Mus musculus
cttccccttagctgtcctcgagatg

SEQ ID NO: 394951 - DNA, 25 bp, Mus musculus
cttccccttcttatacttgtgtagt

SEQ ID NO: 394952 - DNA, 25 bp, Mus musculus
cttccccttcttcgtgatttgaaca

SEQ ID NO: 394953 - DNA, 25 bp, Mus musculus
cttccccttcttggtgatttgaaca

SEQ ID NO: 394954 - DNA, 25 bp, Mus musculus
cttccccttcttttacttgtgtagt

SEQ ID NO: 394955 - DNA, 25 bp, Mus musculus
cttcccctttgtactgatggctgaa

SEQ ID NO: 394956 - DNA, 25 bp, Mus musculus
cttcccctttgttctgatggctgaa

SEQ ID NO: 394957 - DNA, 25 bp, Mus musculus
cttcccgctcttcgaagttggagaa

SEQ ID NO: 394958 - DNA, 25 bp, Mus musculus
cttcccgctcttggaagttggagaa

SEQ ID NO: 394959 - DNA, 25 bp, Mus musculus
cttcccgctgtaataaaaatggaat

SEQ ID NO: 394960 - DNA, 25 bp, Mus musculus
cttcccgctgtattaaaaatggaat

SEQ ID NO: 394961 - DNA, 25 bp, Mus musculus
cttcccggtggtatgccatccagca

SEQ ID NO: 394962 - DNA, 25 bp, Mus musculus
cttcccggtggtttgccatccagca

SEQ ID NO: 394963 - DNA, 25 bp, Mus musculus
cttcccggtgtccaaatctaacagt

SEQ ID NO: 394964 - DNA, 25 bp, Mus musculus
cttcccggtgtcgaaatctaacagt

SEQ ID NO: 394965 - DNA, 25 bp, Mus musculus
cttccctaaacaagctctaaatcat

SEQ ID NO: 394966 - DNA, 25 bp, Mus musculus
cttccctaaacatgctctaaatcat

SEQ ID NO: 394967 - DNA, 25 bp, Mus musculus
cttccctactggacacaagtgtcag

SEQ ID NO: 394968 - DNA, 25 bp, Mus musculus
cttccctactggtcacaagtgtcag

SEQ ID NO: 394969 - DNA, 25 bp, Mus musculus
cttccctactgtacagaatcctgta

SEQ ID NO: 394970 - DNA, 25 bp, Mus musculus
cttccctactgttcagaatcctgta

SEQ ID NO: 394971 - DNA, 25 bp, Mus musculus
cttccctagactcgcttcattatgg

SEQ ID NO: 394972 - DNA, 25 bp, Mus musculus
cttccctagactggcttcattatgg

SEQ ID NO: 394973 - DNA, 25 bp, Mus musculus
cttccctagggacacagtacgattg

SEQ ID NO: 394974 - DNA, 25 bp, Mus musculus
cttccctagggagacagtacgattg

SEQ ID NO: 394975 - DNA, 25 bp, Mus musculus
cttccctatactcagctgtcataag

SEQ ID NO: 394976 - DNA, 25 bp, Mus musculus
cttccctatactgagctgtcataag

SEQ ID NO: 394977 - DNA, 25 bp, Mus musculus
cttccctatctgaaaaaggtagaga

SEQ ID NO: 394978 - DNA, 25 bp, Mus musculus
cttccctatctgtaaaaggtagaga

SEQ ID NO: 394979 - DNA, 25 bp, Mus musculus
cttccctatttccattgtgcagtgt

SEQ ID NO: 394980 - DNA, 25 bp, Mus musculus
cttccctatttcgattgtgcagtgt

SEQ ID NO: 394981 - DNA, 25 bp, Mus musculus
cttccctccaaaacaccataatgta

SEQ ID NO: 394982 - DNA, 25 bp, Mus musculus
cttccctccaaatcaccataatgta

SEQ ID NO: 394983 - DNA, 25 bp, Mus musculus
cttccctcgctaaatatctatcttt

SEQ ID NO: 394984 - DNA, 25 bp, Mus musculus
cttccctcgctatatatctatcttt

SEQ ID NO: 394985 - DNA, 25 bp, Mus musculus
cttccctctataaccaagtagccaa

SEQ ID NO: 394986 - DNA, 25 bp, Mus musculus
cttccctctatatccaagtagccaa

SEQ ID NO: 394987 - DNA, 25 bp, Mus musculus
cttccctctgtcattctatcagatt

SEQ ID NO: 394988 - DNA, 25 bp, Mus musculus
cttccctctgtctttctatcagatt

SEQ ID NO: 394989 - DNA, 25 bp, Mus musculus
cttccctcttgtaattgcatgcata

SEQ ID NO: 394990 - DNA, 25 bp, Mus musculus
cttccctcttgttattgcatgcata

SEQ ID NO: 394991 - DNA, 25 bp, Mus musculus
cttccctgacagaaggagagcccca

SEQ ID NO: 394992 - DNA, 25 bp, Mus musculus
cttccctgacagtaggagagcccca

SEQ ID NO: 394993 - DNA, 25 bp, Mus musculus
cttccctgacctcgaagctgtgatc

SEQ ID NO: 394994 - DNA, 25 bp, Mus musculus
cttccctgacctggaagctgtgatc

SEQ ID NO: 394995 - DNA, 25 bp, Mus musculus
cttccctgactcaagcaacatatag

SEQ ID NO: 394996 - DNA, 25 bp, Mus musculus
cttccctgactctagcaacatatag

SEQ ID NO: 394997 - DNA, 25 bp, Mus musculus
cttccctgaggtaaaagaacactga

SEQ ID NO: 394998 - DNA, 25 bp, Mus musculus
cttccctgaggttaaagaacactga

SEQ ID NO: 394999 - DNA, 25 bp, Mus musculus
cttccctgagtgaaaatgttctaat

SEQ ID NO: 395000 - DNA, 25 bp, Mus musculus
cttccctgagtgtaaatgttctaat

SEQ ID NO: 395001 - DNA, 25 bp, Mus musculus
cttccctgatgaactatctatccat

SEQ ID NO: 395002 - DNA, 25 bp, Mus musculus
cttccctgatgacttgctgtgaatc

SEQ ID NO: 395003 - DNA, 25 bp, Mus musculus
cttccctgatgagttgctgtgaatc

SEQ ID NO: 395004 - DNA, 25 bp, Mus musculus
cttccctgatgatctatctatccat

SEQ ID NO: 395005 - DNA, 25 bp, Mus musculus
cttccctgatttcctggactgcctt

SEQ ID NO: 395006 - DNA, 25 bp, Mus musculus
cttccctgatttgctggactgcctt

SEQ ID NO: 395007 - DNA, 25 bp, Mus musculus
cttccctgcactcaattccaaagaa

SEQ ID NO: 395008 - DNA, 25 bp, Mus musculus
cttccctgcactgaattccaaagaa

SEQ ID NO: 395009 - DNA, 25 bp, Mus musculus
cttccctgcagactaaatttgtcaa

SEQ ID NO: 395010 - DNA, 25 bp, Mus musculus
cttccctgcagagtaaatttgtcaa

SEQ ID NO: 395011 - DNA, 25 bp, Mus musculus
cttccctgctgtatatttgctaagc

SEQ ID NO: 395012 - DNA, 25 bp, Mus musculus
cttccctgctgtttatttgctaagc

SEQ ID NO: 395013 - DNA, 25 bp, Mus musculus
cttccctggagtccctacgctatga

SEQ ID NO: 395014 - DNA, 25 bp, Mus musculus
cttccctggagtgcctacgctatga

SEQ ID NO: 395015 - DNA, 25 bp, Mus musculus
cttccctggcagaagatgcttcatc

SEQ ID NO: 395016 - DNA, 25 bp, Mus musculus
cttccctggcagtagatgcttcatc

SEQ ID NO: 395017 - DNA, 25 bp, Mus musculus
cttccctggctacatatgtagtttc

SEQ ID NO: 395018 - DNA, 25 bp, Mus musculus
cttccctggctagatatgtagtttc

SEQ ID NO: 395019 - DNA, 25 bp, Mus musculus
cttccctggcttccgtagataatgg

SEQ ID NO: 395020 - DNA, 25 bp, Mus musculus
cttccctggcttgcgtagataatgg

SEQ ID NO: 395021 - DNA, 25 bp, Mus musculus
cttccctgggcaatactgatgaatt

SEQ ID NO: 395022 - DNA, 25 bp, Mus musculus
cttccctgggcattactgatgaatt

SEQ ID NO: 395023 - DNA, 25 bp, Mus musculus
cttccctggtgtaatgccttggtta

SEQ ID NO: 395024 - DNA, 25 bp, Mus musculus
cttccctggtgttatgccttggtta

SEQ ID NO: 395025 - DNA, 25 bp, Mus musculus
cttccctggttcattctacctaaat

SEQ ID NO: 395026 - DNA, 25 bp, Mus musculus
cttccctggttctttctacctaaat

SEQ ID NO: 395027 - DNA, 25 bp, Mus musculus
cttccctgtaggagcaacaacatta

SEQ ID NO: 395028 - DNA, 25 bp, Mus musculus
cttccctgtaggtgcaacaacatta

SEQ ID NO: 395029 - DNA, 25 bp, Mus musculus
cttccctgtggacgatagagctgta

SEQ ID NO: 395030 - DNA, 25 bp, Mus musculus
cttccctgtggaggatagagctgta

SEQ ID NO: 395031 - DNA, 25 bp, Mus musculus
cttccctgtggccaaaagagcaaca

SEQ ID NO: 395032 - DNA, 25 bp, Mus musculus
cttccctgtggcgaaaagagcaaca

SEQ ID NO: 395033 - DNA, 25 bp, Mus musculus
cttccctgtttgaggacattggctt

SEQ ID NO: 395034 - DNA, 25 bp, Mus musculus
cttccctgtttgtggacattggctt

SEQ ID NO: 395035 - DNA, 25 bp, Mus musculus
cttccctgttttcttaggtaatgtg

SEQ ID NO: 395036 - DNA, 25 bp, Mus musculus
cttccctgttttgttaggtaatgtg

SEQ ID NO: 395037 - DNA, 25 bp, Mus musculus
cttcccttaggcacttttatactga

SEQ ID NO: 395038 - DNA, 25 bp, Mus musculus
cttcccttaggctcttttatactga

SEQ ID NO: 395039 - DNA, 25 bp, Mus musculus
cttcccttatggcactttagccaat

SEQ ID NO: 395040 - DNA, 25 bp, Mus musculus
cttcccttatgggactttagccaat

SEQ ID NO: 395041 - DNA, 25 bp, Mus musculus
cttcccttcaacatggagcttgtag

SEQ ID NO: 395042 - DNA, 25 bp, Mus musculus
cttcccttcaacttggagcttgtag

SEQ ID NO: 395043 - DNA, 25 bp, Mus musculus
cttcccttcctgcttgtgggcaagg

SEQ ID NO: 395044 - DNA, 25 bp, Mus musculus
cttcccttcctggttgtgggcaagg

SEQ ID NO: 395045 - DNA, 25 bp, Mus musculus
cttcccttctaacgtcttggaggct

SEQ ID NO: 395046 - DNA, 25 bp, Mus musculus
cttcccttctaaggtcttggaggct

SEQ ID NO: 395047 - DNA, 25 bp, Mus musculus
cttcccttctgcagtttgttcaata

SEQ ID NO: 395048 - DNA, 25 bp, Mus musculus
cttcccttctgctgtttgttcaata

SEQ ID NO: 395049 - DNA, 25 bp, Mus musculus
cttcccttgagtagaaagccagaga

SEQ ID NO: 395050 - DNA, 25 bp, Mus musculus
cttcccttgagttgaaagccagaga

SEQ ID NO: 395051 - DNA, 25 bp, Mus musculus
cttcccttgcaaactgaattcctat

SEQ ID NO: 395052 - DNA, 25 bp, Mus musculus
cttcccttgcaatctgaattcctat

SEQ ID NO: 395053 - DNA, 25 bp, Mus musculus
cttcccttgcagattgtgagatgta

SEQ ID NO: 395054 - DNA, 25 bp, Mus musculus
cttcccttgcagtttgtgagatgta

SEQ ID NO: 395055 - DNA, 25 bp, Mus musculus
cttcccttggaaatggtagagcttg

SEQ ID NO: 395056 - DNA, 25 bp, Mus musculus
cttcccttggaattggtagagcttg

SEQ ID NO: 395057 - DNA, 25 bp, Mus musculus
cttcccttggagaaaggcacctgtg

SEQ ID NO: 395058 - DNA, 25 bp, Mus musculus
cttcccttggagtaaggcacctgtg

SEQ ID NO: 395059 - DNA, 25 bp, Mus musculus
cttcccttgtacagaacttttccat

SEQ ID NO: 395060 - DNA, 25 bp, Mus musculus
cttcccttgtactgaacttttccat

SEQ ID NO: 395061 - DNA, 25 bp, Mus musculus
cttccctttagaatcctgatgttgc

SEQ ID NO: 395062 - DNA, 25 bp, Mus musculus
cttccctttagattcctgatgttgc

SEQ ID NO: 395063 - DNA, 25 bp, Mus musculus
cttccctttagtcctgtggtagaca

SEQ ID NO: 395064 - DNA, 25 bp, Mus musculus
cttccctttagtgctgtggtagaca

SEQ ID NO: 395065 - DNA, 25 bp, Mus musculus
cttccctttataatctctttctcaa

SEQ ID NO: 395066 - DNA, 25 bp, Mus musculus
cttccctttatattctctttctcaa

SEQ ID NO: 395067 - DNA, 25 bp, Mus musculus
cttccgaaccatccagaactaattc

SEQ ID NO: 395068 - DNA, 25 bp, Mus musculus
cttccgaaccatgcagaactaattc

SEQ ID NO: 395069 - DNA, 25 bp, Mus musculus
cttccgaatggtcttctgaaataca

SEQ ID NO: 395070 - DNA, 25 bp, Mus musculus
cttccgaatggtgttctgaaataca

SEQ ID NO: 395071 - DNA, 25 bp, Mus musculus
cttccgatcgatacagcattgggtg

SEQ ID NO: 395072 - DNA, 25 bp, Mus musculus
cttccgatcgattcagcattgggtg

SEQ ID NO: 395073 - DNA, 25 bp, Mus musculus
cttccgatctccctcattagaataa

SEQ ID NO: 395074 - DNA, 25 bp, Mus musculus
cttccgatctccgtcattagaataa

SEQ ID NO: 395075 - DNA, 25 bp, Mus musculus
cttccgattttacttccagttgcag

SEQ ID NO: 395076 - DNA, 25 bp, Mus musculus
cttccgattttagttccagttgcag

SEQ ID NO: 395077 - DNA, 25 bp, Mus musculus
cttccgcacaacatcaacacagaaa

SEQ ID NO: 395078 - DNA, 25 bp, Mus musculus
cttccgcacaacttcaacacagaaa

SEQ ID NO: 395079 - DNA, 25 bp, Mus musculus
cttccgcatgttctgcaagcaggga

SEQ ID NO: 395080 - DNA, 25 bp, Mus musculus
cttccgcatgttgtgcaagcaggga

SEQ ID NO: 395081 - DNA, 25 bp, Mus musculus
cttccgccctgcagattgagaagct

SEQ ID NO: 395082 - DNA, 25 bp, Mus musculus
cttccgccctgctgattgagaagct

SEQ ID NO: 395083 - DNA, 25 bp, Mus musculus
cttccgcctaaaagctgttgaccag

SEQ ID NO: 395084 - DNA, 25 bp, Mus musculus
cttccgcctaaatgctgttgaccag

SEQ ID NO: 395085 - DNA, 25 bp, Mus musculus
cttccgccttgaatgtcattcaaag

SEQ ID NO: 395086 - DNA, 25 bp, Mus musculus
cttccgccttgattgtcattcaaag

SEQ ID NO: 395087 - DNA, 25 bp, Mus musculus
cttccgcggccgaggtgctttctgg

SEQ ID NO: 395088 - DNA, 25 bp, Mus musculus
cttccgcggccgtggtgctttctgg

SEQ ID NO: 395089 - DNA, 25 bp, Mus musculus
cttccgcttccaccaggaaaatctt

SEQ ID NO: 395090 - DNA, 25 bp, Mus musculus
cttccgcttccagcaggaaaatctt

SEQ ID NO: 395091 - DNA, 25 bp, Mus musculus
cttccggaatccagctacctaaagt

SEQ ID NO: 395092 - DNA, 25 bp, Mus musculus
cttccggaatcctgctacctaaagt

SEQ ID NO: 395093 - DNA, 25 bp, Mus musculus
cttccggagagccacacttgtggat

SEQ ID NO: 395094 - DNA, 25 bp, Mus musculus
cttccggagagcgacacttgtggat

SEQ ID NO: 395095 - DNA, 25 bp, Mus musculus
cttccggattctcgcttctgataag

SEQ ID NO: 395096 - DNA, 25 bp, Mus musculus
cttccggattctggcttctgataag

SEQ ID NO: 395097 - DNA, 25 bp, Mus musculus
cttccggcagtacgcgaaggacata

SEQ ID NO: 395098 - DNA, 25 bp, Mus musculus
cttccggcagtaggcgaaggacata

SEQ ID NO: 395099 - DNA, 25 bp, Mus musculus
cttccggcttgaacggaccaagatg

SEQ ID NO: 395100 - DNA, 25 bp, Mus musculus
cttccggcttgatcggaccaagatg

SEQ ID NO: 395101 - DNA, 25 bp, Mus musculus
cttccggtacagcttcaactaggtt

SEQ ID NO: 395102 - DNA, 25 bp, Mus musculus
cttccggtacaggttcaactaggtt

SEQ ID NO: 395103 - DNA, 25 bp, Mus musculus
cttccggtcaagctcaggactggtc

SEQ ID NO: 395104 - DNA, 25 bp, Mus musculus
cttccggtcaaggtcaggactggtc

SEQ ID NO: 395105 - DNA, 25 bp, Mus musculus
cttccggtgctgagcgattgcgtta

SEQ ID NO: 395106 - DNA, 25 bp, Mus musculus
cttccggtgctgtgcgattgcgtta

SEQ ID NO: 395107 - DNA, 25 bp, Mus musculus
cttccgtgatgcactttatgaaagg

SEQ ID NO: 395108 - DNA, 25 bp, Mus musculus
cttccgtgatgctctttatgaaagg

SEQ ID NO: 395109 - DNA, 25 bp, Mus musculus
cttccgtgcgtgagcagagcggcac

SEQ ID NO: 395110 - DNA, 25 bp, Mus musculus
cttccgtgcgtgtgcagagcggcac

SEQ ID NO: 395111 - DNA, 25 bp, Mus musculus
cttccgtggtgtatttccatagtga

SEQ ID NO: 395112 - DNA, 25 bp, Mus musculus
cttccgtggtgtttttccatagtga

SEQ ID NO: 395113 - DNA, 25 bp, Mus musculus
cttccgtgtgctcccagatgacaag

SEQ ID NO: 395114 - DNA, 25 bp, Mus musculus
cttccgtgtgctgccagatgacaag

SEQ ID NO: 395115 - DNA, 25 bp, Mus musculus
cttccgtgtttaatgtggcctggca

SEQ ID NO: 395116 - DNA, 25 bp, Mus musculus
cttccgtgtttattgtggcctggca

SEQ ID NO: 395117 - DNA, 25 bp, Mus musculus
cttccgttaatgaagtaacgcctag

SEQ ID NO: 395118 - DNA, 25 bp, Mus musculus
cttccgttaatgtagtaacgcctag

SEQ ID NO: 395119 - DNA, 25 bp, Mus musculus
cttccgtttcggcatttgcagggag

SEQ ID NO: 395120 - DNA, 25 bp, Mus musculus
cttccgtttcgggatttgcagggag

SEQ ID NO: 395121 - DNA, 25 bp, Mus musculus
cttcctaaagtgctgtgggaggcca

SEQ ID NO: 395122 - DNA, 25 bp, Mus musculus
cttcctaaagtggtgtgggaggcca

SEQ ID NO: 395123 - DNA, 25 bp, Mus musculus
cttcctaaggaactggtgcctccca

SEQ ID NO: 395124 - DNA, 25 bp, Mus musculus
cttcctaaggaagtggtgcctccca

SEQ ID NO: 395125 - DNA, 25 bp, Mus musculus
cttcctaatgcgatacatgggctga

SEQ ID NO: 395126 - DNA, 25 bp, Mus musculus
cttcctaatgcgttacatgggctga

SEQ ID NO: 395127 - DNA, 25 bp, Mus musculus
cttcctacattcaggtcatttgcat

SEQ ID NO: 395128 - DNA, 25 bp, Mus musculus
cttcctacattctggtcatttgcat

SEQ ID NO: 395129 - DNA, 25 bp, Mus musculus
cttcctactcttcctgtacaacaga

SEQ ID NO: 395130 - DNA, 25 bp, Mus musculus
cttcctactcttgctgtacaacaga

SEQ ID NO: 395131 - DNA, 25 bp, Mus musculus
cttcctactgtcagttggtcccatt

SEQ ID NO: 395132 - DNA, 25 bp, Mus musculus
cttcctactgtctgttggtcccatt

SEQ ID NO: 395133 - DNA, 25 bp, Mus musculus
cttcctagacacatcaactgtttaa

SEQ ID NO: 395134 - DNA, 25 bp, Mus musculus
cttcctagacacttcaactgtttaa

SEQ ID NO: 395135 - DNA, 25 bp, Mus musculus
cttcctagaggtcgatgtttccatt

SEQ ID NO: 395136 - DNA, 25 bp, Mus musculus
cttcctagaggtggatgtttccatt

SEQ ID NO: 395137 - DNA, 25 bp, Mus musculus
cttcctagatgccattaccaagaaa

SEQ ID NO: 395138 - DNA, 25 bp, Mus musculus
cttcctagatgcgattaccaagaaa

SEQ ID NO: 395139 - DNA, 25 bp, Mus musculus
cttcctagcatgagtaaagccctaa

SEQ ID NO: 395140 - DNA, 25 bp, Mus musculus
cttcctagcatgtgtaaagccctaa

SEQ ID NO: 395141 - DNA, 25 bp, Mus musculus
cttcctagccgcatggagatgagtt

SEQ ID NO: 395142 - DNA, 25 bp, Mus musculus
cttcctagccgcttggagatgagtt

SEQ ID NO: 395143 - DNA, 25 bp, Mus musculus
cttcctagctcaagtctcccaagtg

SEQ ID NO: 395144 - DNA, 25 bp, Mus musculus
cttcctagctcatgtctcccaagtg

SEQ ID NO: 395145 - DNA, 25 bp, Mus musculus
cttcctagctgcatattccatgaac

SEQ ID NO: 395146 - DNA, 25 bp, Mus musculus
cttcctagctgcttattccatgaac

SEQ ID NO: 395147 - DNA, 25 bp, Mus musculus
cttcctaggagacctgtgtgaccag

SEQ ID NO: 395148 - DNA, 25 bp, Mus musculus
cttcctaggagagctgtgtgaccag

SEQ ID NO: 395149 - DNA, 25 bp, Mus musculus
cttcctaggcgcagagctgggttgc

SEQ ID NO: 395150 - DNA, 25 bp, Mus musculus
cttcctaggcgctgagctgggttgc

SEQ ID NO: 395151 - DNA, 25 bp, Mus musculus
cttcctagtttcagacagtgatcaa

SEQ ID NO: 395152 - DNA, 25 bp, Mus musculus
cttcctagtttctgacagtgatcaa

SEQ ID NO: 395153 - DNA, 25 bp, Mus musculus
cttcctatggacagccaataaaatg

SEQ ID NO: 395154 - DNA, 25 bp, Mus musculus
cttcctatggactgccaataaaatg

SEQ ID NO: 395155 - DNA, 25 bp, Mus musculus
cttcctatgtctaccaagcacttgg

SEQ ID NO: 395156 - DNA, 25 bp, Mus musculus
cttcctatgtcttccaagcacttgg

SEQ ID NO: 395157 - DNA, 25 bp, Mus musculus
cttcctatttgtcaccattggtagc

SEQ ID NO: 395158 - DNA, 25 bp, Mus musculus
cttcctatttgtgaccattggtagc

SEQ ID NO: 395159 - DNA, 25 bp, Mus musculus
cttcctcaaatcacataccttgtgg

SEQ ID NO: 395160 - DNA, 25 bp, Mus musculus
cttcctcaaatctcataccttgtgg

SEQ ID NO: 395161 - DNA, 25 bp, Mus musculus
cttcctcaagatactatcctgctga

SEQ ID NO: 395162 - DNA, 25 bp, Mus musculus
cttcctcaagattctatcctgctga

SEQ ID NO: 395163 - DNA, 25 bp, Mus musculus
cttcctcaagcacagccgggagaac

SEQ ID NO: 395164 - DNA, 25 bp, Mus musculus
cttcctcaagcagagccgggagaac

SEQ ID NO: 395165 - DNA, 25 bp, Mus musculus
cttcctcaagttaggcactgctaag

SEQ ID NO: 395166 - DNA, 25 bp, Mus musculus
cttcctcaagtttggcactgctaag

SEQ ID NO: 395167 - DNA, 25 bp, Mus musculus
cttcctcacagcattggcccagggt

SEQ ID NO: 395168 - DNA, 25 bp, Mus musculus
cttcctcacagctttggcccagggt

SEQ ID NO: 395169 - DNA, 25 bp, Mus musculus
cttcctcacgagacagagctggttg

SEQ ID NO: 395170 - DNA, 25 bp, Mus musculus
cttcctcacgagtcagagctggttg

SEQ ID NO: 395171 - DNA, 25 bp, Mus musculus
cttcctcagacgctggcttgagagg

SEQ ID NO: 395172 - DNA, 25 bp, Mus musculus
cttcctcagacggtggcttgagagg

SEQ ID NO: 395173 - DNA, 25 bp, Mus musculus
cttcctcagcaccaaaatagcaaca

SEQ ID NO: 395174 - DNA, 25 bp, Mus musculus
cttcctcagcacgaaaatagcaaca

SEQ ID NO: 395175 - DNA, 25 bp, Mus musculus
cttcctcaggataggtggtgcttat

SEQ ID NO: 395176 - DNA, 25 bp, Mus musculus
cttcctcaggatcgagatccggctc

SEQ ID NO: 395177 - DNA, 25 bp, Mus musculus
cttcctcaggatggagatccggctc

SEQ ID NO: 395178 - DNA, 25 bp, Mus musculus
cttcctcaggattggtggtgcttat

SEQ ID NO: 395179 - DNA, 25 bp, Mus musculus
cttcctcaggccatgtctaaatgtt

SEQ ID NO: 395180 - DNA, 25 bp, Mus musculus
cttcctcaggccttgtctaaatgtt

SEQ ID NO: 395181 - DNA, 25 bp, Mus musculus
cttcctcagttgacatttccttcat

SEQ ID NO: 395182 - DNA, 25 bp, Mus musculus
cttcctcagttgtcatttccttcat

SEQ ID NO: 395183 - DNA, 25 bp, Mus musculus
cttcctcatacaccctgattaagtc

SEQ ID NO: 395184 - DNA, 25 bp, Mus musculus
cttcctcatacagcctgattaagtc

SEQ ID NO: 395185 - DNA, 25 bp, Mus musculus
cttcctcatgaactgacataaccct

SEQ ID NO: 395186 - DNA, 25 bp, Mus musculus
cttcctcatgaagtgacataaccct

SEQ ID NO: 395187 - DNA, 25 bp, Mus musculus
cttcctcatgctctaactctttaga

SEQ ID NO: 395188 - DNA, 25 bp, Mus musculus
cttcctcatgctgtaactctttaga

SEQ ID NO: 395189 - DNA, 25 bp, Mus musculus
cttcctcatgggaccttttctctgc

SEQ ID NO: 395190 - DNA, 25 bp, Mus musculus
cttcctcatgggtccttttctctgc

SEQ ID NO: 395191 - DNA, 25 bp, Mus musculus
cttcctccatgtctgggtttaagac

SEQ ID NO: 395192 - DNA, 25 bp, Mus musculus
cttcctccatgtgtgggtttaagac

SEQ ID NO: 395193 - DNA, 25 bp, Mus musculus
cttcctcccagaaccatatgtagat

SEQ ID NO: 395194 - DNA, 25 bp, Mus musculus
cttcctcccagatccatatgtagat

SEQ ID NO: 395195 - DNA, 25 bp, Mus musculus
cttcctcccctaatgctgtaaatat

SEQ ID NO: 395196 - DNA, 25 bp, Mus musculus
cttcctcccctattgctgtaaatat

SEQ ID NO: 395197 - DNA, 25 bp, Mus musculus
cttcctcctcacagagtacatcgaa

SEQ ID NO: 395198 - DNA, 25 bp, Mus musculus
cttcctcctcactgagtacatcgaa

SEQ ID NO: 395199 - DNA, 25 bp, Mus musculus
cttcctcctcgtctttgaaacagaa

SEQ ID NO: 395200 - DNA, 25 bp, Mus musculus
cttcctcctcgtgtttgaaacagaa

SEQ ID NO: 395201 - DNA, 25 bp, Mus musculus
cttcctcctcttcatacattttata

SEQ ID NO: 395202 - DNA, 25 bp, Mus musculus
cttcctcctcttgatacattttata

SEQ ID NO: 395203 - DNA, 25 bp, Mus musculus
cttcctcctggaaagacatcttgtt

SEQ ID NO: 395204 - DNA, 25 bp, Mus musculus
cttcctcctggatagacatcttgtt

SEQ ID NO: 395205 - DNA, 25 bp, Mus musculus
cttcctccttagcaactgacattat

SEQ ID NO: 395206 - DNA, 25 bp, Mus musculus
cttcctccttaggaactgacattat

SEQ ID NO: 395207 - DNA, 25 bp, Mus musculus
cttcctccttccacgaatattttat

SEQ ID NO: 395208 - DNA, 25 bp, Mus musculus
cttcctccttcctcgaatattttat

SEQ ID NO: 395209 - DNA, 25 bp, Mus musculus
cttcctcgagctcttactgcctgta

SEQ ID NO: 395210 - DNA, 25 bp, Mus musculus
cttcctcgagctgttactgcctgta

SEQ ID NO: 395211 - DNA, 25 bp, Mus musculus
cttcctcgcagaattcccagaattt

SEQ ID NO: 395212 - DNA, 25 bp, Mus musculus
cttcctcgcagatttcccagaattt

SEQ ID NO: 395213 - DNA, 25 bp, Mus musculus
cttcctcgctgaccgaagggcatga

SEQ ID NO: 395214 - DNA, 25 bp, Mus musculus
cttcctcgctgagcgaagggcatga

SEQ ID NO: 395215 - DNA, 25 bp, Mus musculus
cttcctcgcttactccaaacattta

SEQ ID NO: 395216 - DNA, 25 bp, Mus musculus
cttcctcgcttagtccaaacattta

SEQ ID NO: 395217 - DNA, 25 bp, Mus musculus
cttcctcggtcacgttcacgaaaat

SEQ ID NO: 395218 - DNA, 25 bp, Mus musculus
cttcctcggtcaggttcacgaaaat

SEQ ID NO: 395219 - DNA, 25 bp, Mus musculus
cttcctcggtgacgcacggtggctc

SEQ ID NO: 395220 - DNA, 25 bp, Mus musculus
cttcctcggtgaggcacggtggctc

SEQ ID NO: 395221 - DNA, 25 bp, Mus musculus
cttcctcgtcttccaagaattacgt

SEQ ID NO: 395222 - DNA, 25 bp, Mus musculus
cttcctcgtcttgcaagaattacgt

SEQ ID NO: 395223 - DNA, 25 bp, Mus musculus
cttcctctaagtagacaccagtgtc

SEQ ID NO: 395224 - DNA, 25 bp, Mus musculus
cttcctctaagttgacaccagtgtc

SEQ ID NO: 395225 - DNA, 25 bp, Mus musculus
cttcctctacctaggctcaagttta

SEQ ID NO: 395226 - DNA, 25 bp, Mus musculus
cttcctctaccttggctcaagttta

SEQ ID NO: 395227 - DNA, 25 bp, Mus musculus
cttcctctagacagttagcctgggt

SEQ ID NO: 395228 - DNA, 25 bp, Mus musculus
cttcctctagactgttagcctgggt

SEQ ID NO: 395229 - DNA, 25 bp, Mus musculus
cttcctctcccaattatatgtagca

SEQ ID NO: 395230 - DNA, 25 bp, Mus musculus
cttcctctcccatttatatgtagca

SEQ ID NO: 395231 - DNA, 25 bp, Mus musculus
cttcctctctatcgacttgcggtca

SEQ ID NO: 395232 - DNA, 25 bp, Mus musculus
cttcctctctatggacttgcggtca

SEQ ID NO: 395233 - DNA, 25 bp, Mus musculus
cttcctctctcaagatggtgctgag

SEQ ID NO: 395234 - DNA, 25 bp, Mus musculus
cttcctctctcatgatggtgctgag

SEQ ID NO: 395235 - DNA, 25 bp, Mus musculus
cttcctctctcccacagaaatatta

SEQ ID NO: 395236 - DNA, 25 bp, Mus musculus
cttcctctctccgacagaaatatta

SEQ ID NO: 395237 - DNA, 25 bp, Mus musculus
cttcctctctgtacacttgatttaa

SEQ ID NO: 395238 - DNA, 25 bp, Mus musculus
cttcctctctgtcgaccaactagaa

SEQ ID NO: 395239 - DNA, 25 bp, Mus musculus
cttcctctctgtggaccaactagaa

SEQ ID NO: 395240 - DNA, 25 bp, Mus musculus
cttcctctctgttcacttgatttaa

SEQ ID NO: 395241 - DNA, 25 bp, Mus musculus
cttcctctcttcatagatacttcag

SEQ ID NO: 395242 - DNA, 25 bp, Mus musculus
cttcctctcttcatgaaataataat

SEQ ID NO: 395243 - DNA, 25 bp, Mus musculus
cttcctctcttcttagatacttcag

SEQ ID NO: 395244 - DNA, 25 bp, Mus musculus
cttcctctcttcttgaaataataat

SEQ ID NO: 395245 - DNA, 25 bp, Mus musculus
cttcctctcttgaacggtggctcag

SEQ ID NO: 395246 - DNA, 25 bp, Mus musculus
cttcctctcttgtacggtggctcag

SEQ ID NO: 395247 - DNA, 25 bp, Mus musculus
cttcctctgaacattctggcttaat

SEQ ID NO: 395248 - DNA, 25 bp, Mus musculus
cttcctctgaacattttggcatcca

SEQ ID NO: 395249 - DNA, 25 bp, Mus musculus
cttcctctgaactttctggcttaat

SEQ ID NO: 395250 - DNA, 25 bp, Mus musculus
cttcctctgaactttttggcatcca

SEQ ID NO: 395251 - DNA, 25 bp, Mus musculus
cttcctctgagaaacagggtctctg

SEQ ID NO: 395252 - DNA, 25 bp, Mus musculus
cttcctctgagatacagggtctctg

SEQ ID NO: 395253 - DNA, 25 bp, Mus musculus
cttcctctgccaatgtgctgggaag

SEQ ID NO: 395254 - DNA, 25 bp, Mus musculus
cttcctctgccattgtgctgggaag

SEQ ID NO: 395255 - DNA, 25 bp, Mus musculus
cttcctctgcccacatctttttata

SEQ ID NO: 395256 - DNA, 25 bp, Mus musculus
cttcctctgccctcatctttttata

SEQ ID NO: 395257 - DNA, 25 bp, Mus musculus
cttcctctgcgcctgtgctgagaca

SEQ ID NO: 395258 - DNA, 25 bp, Mus musculus
cttcctctgcgcgtgtgctgagaca

SEQ ID NO: 395259 - DNA, 25 bp, Mus musculus
cttcctctgtagctcattaggcatt

SEQ ID NO: 395260 - DNA, 25 bp, Mus musculus
cttcctctgtaggtcattaggcatt

SEQ ID NO: 395261 - DNA, 25 bp, Mus musculus
cttcctctgtggcaagtcagacgtg

SEQ ID NO: 395262 - DNA, 25 bp, Mus musculus
cttcctctgtgggaagtcagacgtg

SEQ ID NO: 395263 - DNA, 25 bp, Mus musculus
cttcctcttcatacactgattggtt

SEQ ID NO: 395264 - DNA, 25 bp, Mus musculus
cttcctcttcattcactgattggtt

SEQ ID NO: 395265 - DNA, 25 bp, Mus musculus
cttcctcttccaacattaacttagg

SEQ ID NO: 395266 - DNA, 25 bp, Mus musculus
cttcctcttccatcattaacttagg

SEQ ID NO: 395267 - DNA, 25 bp, Mus musculus
cttcctcttggcaggtaaaattaca

SEQ ID NO: 395268 - DNA, 25 bp, Mus musculus
cttcctcttggccttgcaaagatga

SEQ ID NO: 395269 - DNA, 25 bp, Mus musculus
cttcctcttggcgttgcaaagatga

SEQ ID NO: 395270 - DNA, 25 bp, Mus musculus
cttcctcttggctggtaaaattaca

SEQ ID NO: 395271 - DNA, 25 bp, Mus musculus
cttcctcttttgaactttggacaca

SEQ ID NO: 395272 - DNA, 25 bp, Mus musculus
cttcctcttttgtactttggacaca

SEQ ID NO: 395273 - DNA, 25 bp, Mus musculus
cttcctgaaccaccgcaagaataag

SEQ ID NO: 395274 - DNA, 25 bp, Mus musculus
cttcctgaaccagcgcaagaataag

SEQ ID NO: 395275 - DNA, 25 bp, Mus musculus
cttcctgaaccgctgtcttgagatg

SEQ ID NO: 395276 - DNA, 25 bp, Mus musculus
cttcctgaaccggtgtcttgagatg

SEQ ID NO: 395277 - DNA, 25 bp, Mus musculus
cttcctgaaggtcgcgcagacccgg

SEQ ID NO: 395278 - DNA, 25 bp, Mus musculus
cttcctgaaggtcgctgctgagcaa

SEQ ID NO: 395279 - DNA, 25 bp, Mus musculus
cttcctgaaggtggcgcagacccgg

SEQ ID NO: 395280 - DNA, 25 bp, Mus musculus
cttcctgaaggtggctgctgagcaa

SEQ ID NO: 395281 - DNA, 25 bp, Mus musculus
cttcctgacaaactgattgttactg

SEQ ID NO: 395282 - DNA, 25 bp, Mus musculus
cttcctgacaaagtgattgttactg

SEQ ID NO: 395283 - DNA, 25 bp, Mus musculus
cttcctgaccaaactggcgcaagaa

SEQ ID NO: 395284 - DNA, 25 bp, Mus musculus
cttcctgaccaatctggcgcaagaa

SEQ ID NO: 395285 - DNA, 25 bp, Mus musculus
cttcctgactgtcgacacggtgtga

SEQ ID NO: 395286 - DNA, 25 bp, Mus musculus
cttcctgactgtggacacggtgtga

SEQ ID NO: 395287 - DNA, 25 bp, Mus musculus
cttcctgagataagcaacaccctgg

SEQ ID NO: 395288 - DNA, 25 bp, Mus musculus
cttcctgagatatgcaacaccctgg

SEQ ID NO: 395289 - DNA, 25 bp, Mus musculus
cttcctgagtttacccaaggatgtt

SEQ ID NO: 395290 - DNA, 25 bp, Mus musculus
cttcctgagttttcccaaggatgtt

SEQ ID NO: 395291 - DNA, 25 bp, Mus musculus
cttcctgatagcagccatctcaata

SEQ ID NO: 395292 - DNA, 25 bp, Mus musculus
cttcctgatagctgccatctcaata

SEQ ID NO: 395293 - DNA, 25 bp, Mus musculus
cttcctgatgtcatccagagagact

SEQ ID NO: 395294 - DNA, 25 bp, Mus musculus
cttcctgatgtcttccagagagact

SEQ ID NO: 395295 - DNA, 25 bp, Mus musculus
cttcctgattacaccctttgaacta

SEQ ID NO: 395296 - DNA, 25 bp, Mus musculus
cttcctgattactccctttgaacta

SEQ ID NO: 395297 - DNA, 25 bp, Mus musculus
cttcctgattatctgcactgaacaa

SEQ ID NO: 395298 - DNA, 25 bp, Mus musculus
cttcctgattatgtgcactgaacaa

SEQ ID NO: 395299 - DNA, 25 bp, Mus musculus
cttcctgcaataagtggcttttctg

SEQ ID NO: 395300 - DNA, 25 bp, Mus musculus
cttcctgcaatatgtggcttttctg

SEQ ID NO: 395301 - DNA, 25 bp, Mus musculus
cttcctgcatctcataatgtgtcag

SEQ ID NO: 395302 - DNA, 25 bp, Mus musculus
cttcctgcatctgataatgtgtcag

SEQ ID NO: 395303 - DNA, 25 bp, Mus musculus
cttcctgcccaacagactcagtata

SEQ ID NO: 395304 - DNA, 25 bp, Mus musculus
cttcctgcccaagagactcagtata

SEQ ID NO: 395305 - DNA, 25 bp, Mus musculus
cttcctgcccttctgcatagggtag

SEQ ID NO: 395306 - DNA, 25 bp, Mus musculus
cttcctgcccttgtgcatagggtag

SEQ ID NO: 395307 - DNA, 25 bp, Mus musculus
cttcctgcctgaactacaagtgctt

SEQ ID NO: 395308 - DNA, 25 bp, Mus musculus
cttcctgcctgatctacaagtgctt

SEQ ID NO: 395309 - DNA, 25 bp, Mus musculus
cttcctgccttgcaagcagcaggct

SEQ ID NO: 395310 - DNA, 25 bp, Mus musculus
cttcctgccttggaagcagcaggct

SEQ ID NO: 395311 - DNA, 25 bp, Mus musculus
cttcctgcctttcatccttagaaat

SEQ ID NO: 395312 - DNA, 25 bp, Mus musculus
cttcctgcctttgatccttagaaat

SEQ ID NO: 395313 - DNA, 25 bp, Mus musculus
cttcctgcgcctaggtatggcgagt

SEQ ID NO: 395314 - DNA, 25 bp, Mus musculus
cttcctgcgccttggtatggcgagt

SEQ ID NO: 395315 - DNA, 25 bp, Mus musculus
cttcctgctatcagagccttatggg

SEQ ID NO: 395316 - DNA, 25 bp, Mus musculus
cttcctgctatctgagccttatggg

SEQ ID NO: 395317 - DNA, 25 bp, Mus musculus
cttcctgctctgaagcttagagtgt

SEQ ID NO: 395318 - DNA, 25 bp, Mus musculus
cttcctgctctgtagcttagagtgt

SEQ ID NO: 395319 - DNA, 25 bp, Mus musculus
cttcctgctcttaaccagaggtcct

SEQ ID NO: 395320 - DNA, 25 bp, Mus musculus
cttcctgctctttaccagaggtcct

SEQ ID NO: 395321 - DNA, 25 bp, Mus musculus
cttcctgctgcaacttgatgcgata

SEQ ID NO: 395322 - DNA, 25 bp, Mus musculus
cttcctgctgcatcttgatgcgata

SEQ ID NO: 395323 - DNA, 25 bp, Mus musculus
cttcctgcttatacaactgaaatca

SEQ ID NO: 395324 - DNA, 25 bp, Mus musculus
cttcctgcttattcaactgaaatca

SEQ ID NO: 395325 - DNA, 25 bp, Mus musculus
cttcctgcttgacgtgacttgagca

SEQ ID NO: 395326 - DNA, 25 bp, Mus musculus
cttcctgcttgaggtgacttgagca

SEQ ID NO: 395327 - DNA, 25 bp, Mus musculus
cttcctgcttgtacttccagtataa

SEQ ID NO: 395328 - DNA, 25 bp, Mus musculus
cttcctgcttgttcttccagtataa

SEQ ID NO: 395329 - DNA, 25 bp, Mus musculus
cttcctggacctcattttaacacct

SEQ ID NO: 395330 - DNA, 25 bp, Mus musculus
cttcctggacctgattttaacacct

SEQ ID NO: 395331 - DNA, 25 bp, Mus musculus
cttcctggatgtactctgttaattc

SEQ ID NO: 395332 - DNA, 25 bp, Mus musculus
cttcctggatgtccctcataaaaag

SEQ ID NO: 395333 - DNA, 25 bp, Mus musculus
cttcctggatgtgcctcataaaaag

SEQ ID NO: 395334 - DNA, 25 bp, Mus musculus
cttcctggatgttctctgttaattc

SEQ ID NO: 395335 - DNA, 25 bp, Mus musculus
cttcctggcaggaggtagtcacttt

SEQ ID NO: 395336 - DNA, 25 bp, Mus musculus
cttcctggcaggtggtagtcacttt

SEQ ID NO: 395337 - DNA, 25 bp, Mus musculus
cttcctggccgccagaacaagactg

SEQ ID NO: 395338 - DNA, 25 bp, Mus musculus
cttcctggccgcgagaacaagactg

SEQ ID NO: 395339 - DNA, 25 bp, Mus musculus
cttcctggccttagacaagtacaca

SEQ ID NO: 395340 - DNA, 25 bp, Mus musculus
cttcctggcctttgacaagtacaca

SEQ ID NO: 395341 - DNA, 25 bp, Mus musculus
cttcctggctctcctaaactgaaag

SEQ ID NO: 395342 - DNA, 25 bp, Mus musculus
cttcctggctctgctaaactgaaag

SEQ ID NO: 395343 - DNA, 25 bp, Mus musculus
cttcctgggaagctaatttatttgt

SEQ ID NO: 395344 - DNA, 25 bp, Mus musculus
cttcctgggaaggtaatttatttgt

SEQ ID NO: 395345 - DNA, 25 bp, Mus musculus
cttcctgggactactcataagtcat

SEQ ID NO: 395346 - DNA, 25 bp, Mus musculus
cttcctgggacttctcataagtcat

SEQ ID NO: 395347 - DNA, 25 bp, Mus musculus
cttcctgggatgctggcatttggac

SEQ ID NO: 395348 - DNA, 25 bp, Mus musculus
cttcctgggatggtggcatttggac

SEQ ID NO: 395349 - DNA, 25 bp, Mus musculus
cttcctgggattatggctgccaaat

SEQ ID NO: 395350 - DNA, 25 bp, Mus musculus
cttcctgggattttggctgccaaat

SEQ ID NO: 395351 - DNA, 25 bp, Mus musculus
cttcctgggcccacaatcatagagg

SEQ ID NO: 395352 - DNA, 25 bp, Mus musculus
cttcctgggccctcaatcatagagg

SEQ ID NO: 395353 - DNA, 25 bp, Mus musculus
cttcctggtagtagtaatgaccact

SEQ ID NO: 395354 - DNA, 25 bp, Mus musculus
cttcctggtagttgtaatgaccact

SEQ ID NO: 395355 - DNA, 25 bp, Mus musculus
cttcctggtcgtaatgacaactcct

SEQ ID NO: 395356 - DNA, 25 bp, Mus musculus
cttcctggtcgttatgacaactcct

SEQ ID NO: 395357 - DNA, 25 bp, Mus musculus
cttcctgtagcgattttgcttgttt

SEQ ID NO: 395358 - DNA, 25 bp, Mus musculus
cttcctgtagcgtttttgcttgttt

SEQ ID NO: 395359 - DNA, 25 bp, Mus musculus
cttcctgtaggcatagaaaggctga

SEQ ID NO: 395360 - DNA, 25 bp, Mus musculus
cttcctgtaggcttagaaaggctga

SEQ ID NO: 395361 - DNA, 25 bp, Mus musculus
cttcctgtattgctcactggtttct

SEQ ID NO: 395362 - DNA, 25 bp, Mus musculus
cttcctgtattggtcactggtttct

SEQ ID NO: 395363 - DNA, 25 bp, Mus musculus
cttcctgtcaccacatgagatgtca

SEQ ID NO: 395364 - DNA, 25 bp, Mus musculus
cttcctgtcacctcatgagatgtca

SEQ ID NO: 395365 - DNA, 25 bp, Mus musculus
cttcctgtcgccctatgtatctcca

SEQ ID NO: 395366 - DNA, 25 bp, Mus musculus
cttcctgtcgccgtatgtatctcca

SEQ ID NO: 395367 - DNA, 25 bp, Mus musculus
cttcctgtgaagatatagctcgagt

SEQ ID NO: 395368 - DNA, 25 bp, Mus musculus
cttcctgtgaagttatagctcgagt

SEQ ID NO: 395369 - DNA, 25 bp, Mus musculus
cttcctgtgcatcgcattgctaaag

SEQ ID NO: 395370 - DNA, 25 bp, Mus musculus
cttcctgtgcatggcattgctaaag

SEQ ID NO: 395371 - DNA, 25 bp, Mus musculus
cttcctgtggagactttaggttcaa

SEQ ID NO: 395372 - DNA, 25 bp, Mus musculus
cttcctgtggagtctttaggttcaa

SEQ ID NO: 395373 - DNA, 25 bp, Mus musculus
cttcctgtggccaggctttggagag

SEQ ID NO: 395374 - DNA, 25 bp, Mus musculus
cttcctgtggcctggctttggagag

SEQ ID NO: 395375 - DNA, 25 bp, Mus musculus
cttcctgtggttagagtagctcggg

SEQ ID NO: 395376 - DNA, 25 bp, Mus musculus
cttcctgtggtttgagtagctcggg

SEQ ID NO: 395377 - DNA, 25 bp, Mus musculus
cttcctgtgttaccccaaactgtga

SEQ ID NO: 395378 - DNA, 25 bp, Mus musculus
cttcctgtgttagcccaaactgtga

SEQ ID NO: 395379 - DNA, 25 bp, Mus musculus
cttcctgttcatattggtgtttgtg

SEQ ID NO: 395380 - DNA, 25 bp, Mus musculus
cttcctgttcattttggtgtttgtg

SEQ ID NO: 395381 - DNA, 25 bp, Mus musculus
cttcctgttcctctgattcttagaa

SEQ ID NO: 395382 - DNA, 25 bp, Mus musculus
cttcctgttcctgtgattcttagaa

SEQ ID NO: 395383 - DNA, 25 bp, Mus musculus
cttcctgttctaccccatataaaat

SEQ ID NO: 395384 - DNA, 25 bp, Mus musculus
cttcctgttctagcccatataaaat

SEQ ID NO: 395385 - DNA, 25 bp, Mus musculus
cttcctgttgcccatgatggagtac

SEQ ID NO: 395386 - DNA, 25 bp, Mus musculus
cttcctgttgccgatgatggagtac

SEQ ID NO: 395387 - DNA, 25 bp, Mus musculus
cttcctgttggccaagagtcatgtt

SEQ ID NO: 395388 - DNA, 25 bp, Mus musculus
cttcctgttggcgaagagtcatgtt

SEQ ID NO: 395389 - DNA, 25 bp, Mus musculus
cttcctgttgttatatttgatgtca

SEQ ID NO: 395390 - DNA, 25 bp, Mus musculus
cttcctgttgttttatttgatgtca

SEQ ID NO: 395391 - DNA, 25 bp, Mus musculus
cttcctgtttgtacacatttgacat

SEQ ID NO: 395392 - DNA, 25 bp, Mus musculus
cttcctgtttgtatgcacctgaact

SEQ ID NO: 395393 - DNA, 25 bp, Mus musculus
cttcctgtttgttcacatttgacat

SEQ ID NO: 395394 - DNA, 25 bp, Mus musculus
cttcctgtttgtttgcacctgaact

SEQ ID NO: 395395 - DNA, 25 bp, Mus musculus
cttccttaacagctagctcacattt

SEQ ID NO: 395396 - DNA, 25 bp, Mus musculus
cttccttaacaggtagctcacattt

SEQ ID NO: 395397 - DNA, 25 bp, Mus musculus
cttccttagagtagatccagcctga

SEQ ID NO: 395398 - DNA, 25 bp, Mus musculus
cttccttagagttgatccagcctga

SEQ ID NO: 395399 - DNA, 25 bp, Mus musculus
cttccttagcctcatgttttttcat

SEQ ID NO: 395400 - DNA, 25 bp, Mus musculus
cttccttagcctgatgttttttcat

SEQ ID NO: 395401 - DNA, 25 bp, Mus musculus
cttccttagggtaagcacttgagga

SEQ ID NO: 395402 - DNA, 25 bp, Mus musculus
cttccttagggttagcacttgagga

SEQ ID NO: 395403 - DNA, 25 bp, Mus musculus
cttccttatgatagatgtggtgcta

SEQ ID NO: 395404 - DNA, 25 bp, Mus musculus
cttccttatgattgatgtggtgcta

SEQ ID NO: 395405 - DNA, 25 bp, Mus musculus
cttccttcaaggaggccgtcagata

SEQ ID NO: 395406 - DNA, 25 bp, Mus musculus
cttccttcaaggtggccgtcagata

SEQ ID NO: 395407 - DNA, 25 bp, Mus musculus
cttccttcatccagttgattgggaa

SEQ ID NO: 395408 - DNA, 25 bp, Mus musculus
cttccttcatcctgttgattgggaa

SEQ ID NO: 395409 - DNA, 25 bp, Mus musculus
cttccttcattcctttgcatagtga

SEQ ID NO: 395410 - DNA, 25 bp, Mus musculus
cttccttcattcgtttgcatagtga

SEQ ID NO: 395411 - DNA, 25 bp, Mus musculus
cttccttcattgagcccaaactaga

SEQ ID NO: 395412 - DNA, 25 bp, Mus musculus
cttccttcattgtgcccaaactaga

SEQ ID NO: 395413 - DNA, 25 bp, Mus musculus
cttccttccaagacctgtgtactta

SEQ ID NO: 395414 - DNA, 25 bp, Mus musculus
cttccttccaagtcctgtgtactta

SEQ ID NO: 395415 - DNA, 25 bp, Mus musculus
cttccttccagtatgctgagttgta

SEQ ID NO: 395416 - DNA, 25 bp, Mus musculus
cttccttccagtttgctgagttgta

SEQ ID NO: 395417 - DNA, 25 bp, Mus musculus
cttccttccgctaggtcaaatcaat

SEQ ID NO: 395418 - DNA, 25 bp, Mus musculus
cttccttccgcttggtcaaatcaat

SEQ ID NO: 395419 - DNA, 25 bp, Mus musculus
cttccttccttgaaaaattctgatg

SEQ ID NO: 395420 - DNA, 25 bp, Mus musculus
cttccttccttgtaaaattctgatg

SEQ ID NO: 395421 - DNA, 25 bp, Mus musculus
cttccttcgaatacgctccaagaaa

SEQ ID NO: 395422 - DNA, 25 bp, Mus musculus
cttccttcgaattcgctccaagaaa

SEQ ID NO: 395423 - DNA, 25 bp, Mus musculus
cttccttcgttaaatccactacatg

SEQ ID NO: 395424 - DNA, 25 bp, Mus musculus
cttccttcgttatatccactacatg

SEQ ID NO: 395425 - DNA, 25 bp, Mus musculus
cttccttctaagatgcttcttttca

SEQ ID NO: 395426 - DNA, 25 bp, Mus musculus
cttccttctaagttgcttcttttca

SEQ ID NO: 395427 - DNA, 25 bp, Mus musculus
cttccttctagaatcgagaactaca

SEQ ID NO: 395428 - DNA, 25 bp, Mus musculus
cttccttctagattcgagaactaca

SEQ ID NO: 395429 - DNA, 25 bp, Mus musculus
cttccttctctaaaacacaaaactg

SEQ ID NO: 395430 - DNA, 25 bp, Mus musculus
cttccttctctataacacaaaactg

SEQ ID NO: 395431 - DNA, 25 bp, Mus musculus
cttccttctctgagcgggctgggac

SEQ ID NO: 395432 - DNA, 25 bp, Mus musculus
cttccttctctgtgcgggctgggac

SEQ ID NO: 395433 - DNA, 25 bp, Mus musculus
cttccttctggtctcatctatttga

SEQ ID NO: 395434 - DNA, 25 bp, Mus musculus
cttccttctggtgtcatctatttga

SEQ ID NO: 395435 - DNA, 25 bp, Mus musculus
cttccttctgtgattccatattcat

SEQ ID NO: 395436 - DNA, 25 bp, Mus musculus
cttccttctgtgtttccatattcat

SEQ ID NO: 395437 - DNA, 25 bp, Mus musculus
cttccttctttactggacattctga

SEQ ID NO: 395438 - DNA, 25 bp, Mus musculus
cttccttctttagtggacattctga

SEQ ID NO: 395439 - DNA, 25 bp, Mus musculus
cttccttgaaggctgtgggtgtctt

SEQ ID NO: 395440 - DNA, 25 bp, Mus musculus
cttccttgaagggtgtgggtgtctt

SEQ ID NO: 395441 - DNA, 25 bp, Mus musculus
cttccttgccataccattgtagcat

SEQ ID NO: 395442 - DNA, 25 bp, Mus musculus
cttccttgccattccattgtagcat

SEQ ID NO: 395443 - DNA, 25 bp, Mus musculus
cttccttgcttcactaactttagac

SEQ ID NO: 395444 - DNA, 25 bp, Mus musculus
cttccttgcttctctaactttagac

SEQ ID NO: 395445 - DNA, 25 bp, Mus musculus
cttccttgggaaacgcacagtaata

SEQ ID NO: 395446 - DNA, 25 bp, Mus musculus
cttccttgggaatcgcacagtaata

SEQ ID NO: 395447 - DNA, 25 bp, Mus musculus
cttccttgggagactggcgctggca

SEQ ID NO: 395448 - DNA, 25 bp, Mus musculus
cttccttgggagtctggcgctggca

SEQ ID NO: 395449 - DNA, 25 bp, Mus musculus
cttccttggtctacactgtgagctc

SEQ ID NO: 395450 - DNA, 25 bp, Mus musculus
cttccttggtcttcactgtgagctc

SEQ ID NO: 395451 - DNA, 25 bp, Mus musculus
cttccttggttcagcgaagctggat

SEQ ID NO: 395452 - DNA, 25 bp, Mus musculus
cttccttggttctgcgaagctggat

SEQ ID NO: 395453 - DNA, 25 bp, Mus musculus
cttccttgtgcaacctgaccaagaa

SEQ ID NO: 395454 - DNA, 25 bp, Mus musculus
cttccttgtgcatcctgaccaagaa

SEQ ID NO: 395455 - DNA, 25 bp, Mus musculus
cttccttgtgggatggtactgataa

SEQ ID NO: 395456 - DNA, 25 bp, Mus musculus
cttccttgtgggttggtactgataa

SEQ ID NO: 395457 - DNA, 25 bp, Mus musculus
cttccttgttggctcagttggatca

SEQ ID NO: 395458 - DNA, 25 bp, Mus musculus
cttccttgttgggtcagttggatca

SEQ ID NO: 395459 - DNA, 25 bp, Mus musculus
cttcctttaacaaaagttgtgggtg

SEQ ID NO: 395460 - DNA, 25 bp, Mus musculus
cttcctttaacataagttgtgggtg

SEQ ID NO: 395461 - DNA, 25 bp, Mus musculus
cttcctttacccaatgtagctgata

SEQ ID NO: 395462 - DNA, 25 bp, Mus musculus
cttcctttaccctatgtagctgata

SEQ ID NO: 395463 - DNA, 25 bp, Mus musculus
cttcctttaggcagaatgcgctcta

SEQ ID NO: 395464 - DNA, 25 bp, Mus musculus
cttcctttaggctgaatgcgctcta

SEQ ID NO: 395465 - DNA, 25 bp, Mus musculus
cttcctttatcccacatatgcaatg

SEQ ID NO: 395466 - DNA, 25 bp, Mus musculus
cttcctttatccgacatatgcaatg

SEQ ID NO: 395467 - DNA, 25 bp, Mus musculus
cttcctttatgtccaatggattgcc

SEQ ID NO: 395468 - DNA, 25 bp, Mus musculus
cttcctttatgtgcaatggattgcc

SEQ ID NO: 395469 - DNA, 25 bp, Mus musculus
cttcctttcaagaagacatccctag

SEQ ID NO: 395470 - DNA, 25 bp, Mus musculus
cttcctttcaagtagacatccctag

SEQ ID NO: 395471 - DNA, 25 bp, Mus musculus
cttcctttcatgcaggttcctcttc

SEQ ID NO: 395472 - DNA, 25 bp, Mus musculus
cttcctttcatggaggttcctcttc

SEQ ID NO: 395473 - DNA, 25 bp, Mus musculus
cttcctttgagcaccgtaagcagaa

SEQ ID NO: 395474 - DNA, 25 bp, Mus musculus
cttcctttgagctccgtaagcagaa

SEQ ID NO: 395475 - DNA, 25 bp, Mus musculus
cttcctttgcttcctggtgtgacag

SEQ ID NO: 395476 - DNA, 25 bp, Mus musculus
cttcctttgcttgctggtgtgacag

SEQ ID NO: 395477 - DNA, 25 bp, Mus musculus
cttcctttggtgactggtgccgcag

SEQ ID NO: 395478 - DNA, 25 bp, Mus musculus
cttcctttggtgtctggtgccgcag

SEQ ID NO: 395479 - DNA, 25 bp, Mus musculus
cttcctttgtctagcattggctatt

SEQ ID NO: 395480 - DNA, 25 bp, Mus musculus
cttcctttgtcttgcattggctatt

SEQ ID NO: 395481 - DNA, 25 bp, Mus musculus
cttcctttgttacgcttatcccaag

SEQ ID NO: 395482 - DNA, 25 bp, Mus musculus
cttcctttgttaggcttatcccaag

SEQ ID NO: 395483 - DNA, 25 bp, Mus musculus
cttccttttcgcactacagtttcag

SEQ ID NO: 395484 - DNA, 25 bp, Mus musculus
cttccttttcgctctacagtttcag

SEQ ID NO: 395485 - DNA, 25 bp, Mus musculus
cttccttttgccacccttcagaaat

SEQ ID NO: 395486 - DNA, 25 bp, Mus musculus
cttccttttgcctcccttcagaaat

SEQ ID NO: 395487 - DNA, 25 bp, Mus musculus
cttccttttggactttgcttgcttt

SEQ ID NO: 395488 - DNA, 25 bp, Mus musculus
cttccttttggagtttgcttgcttt

SEQ ID NO: 395489 - DNA, 25 bp, Mus musculus
cttcctttttcaaagctgccagagc

SEQ ID NO: 395490 - DNA, 25 bp, Mus musculus
cttcctttttcatagctgccagagc

SEQ ID NO: 395491 - DNA, 25 bp, Mus musculus
cttcgaaaagacatgcaaggagcta

SEQ ID NO: 395492 - DNA, 25 bp, Mus musculus
cttcgaaaagacttgcaaggagcta

SEQ ID NO: 395493 - DNA, 25 bp, Mus musculus
cttcgaaagagtcaacccgggagct

SEQ ID NO: 395494 - DNA, 25 bp, Mus musculus
cttcgaaagagtgaacccgggagct

SEQ ID NO: 395495 - DNA, 25 bp, Mus musculus
cttcgaaagtttatgatgggcacct

SEQ ID NO: 395496 - DNA, 25 bp, Mus musculus
cttcgaaagtttttgatgggcacct

SEQ ID NO: 395497 - DNA, 25 bp, Mus musculus
cttcgaagagtgcttgcttcggtac

SEQ ID NO: 395498 - DNA, 25 bp, Mus musculus
cttcgaagagtggttgcttcggtac

SEQ ID NO: 395499 - DNA, 25 bp, Mus musculus
cttcgaagccgcaccactcgcatgt

SEQ ID NO: 395500 - DNA, 25 bp, Mus musculus
cttcgaagccgctccactcgcatgt

SEQ ID NO: 395501 - DNA, 25 bp, Mus musculus
cttcgaatacaacggcgagctgcat

SEQ ID NO: 395502 - DNA, 25 bp, Mus musculus
cttcgaatacaagggcgagctgcat

SEQ ID NO: 395503 - DNA, 25 bp, Mus musculus
cttcgacattatagctgacagcttg

SEQ ID NO: 395504 - DNA, 25 bp, Mus musculus
cttcgacattattgctgacagcttg

SEQ ID NO: 395505 - DNA, 25 bp, Mus musculus
cttcgacctctaagatgatgcccag

SEQ ID NO: 395506 - DNA, 25 bp, Mus musculus
cttcgacctctatgatgatgcccag

SEQ ID NO: 395507 - DNA, 25 bp, Mus musculus
cttcgactggcgcatgtacgtttga

SEQ ID NO: 395508 - DNA, 25 bp, Mus musculus
cttcgactggcggatgtacgtttga

SEQ ID NO: 395509 - DNA, 25 bp, Mus musculus
cttcgacttggccaggttctatgga

SEQ ID NO: 395510 - DNA, 25 bp, Mus musculus
cttcgacttggcgaggttctatgga

SEQ ID NO: 395511 - DNA, 25 bp, Mus musculus
cttcgagaaggtaggtgtggctttt

SEQ ID NO: 395512 - DNA, 25 bp, Mus musculus
cttcgagaaggttggtgtggctttt

SEQ ID NO: 395513 - DNA, 25 bp, Mus musculus
cttcgagatccgctggagggttcct

SEQ ID NO: 395514 - DNA, 25 bp, Mus musculus
cttcgagatccggtggagggttcct

SEQ ID NO: 395515 - DNA, 25 bp, Mus musculus
cttcgagcactgatcaacaagcaca

SEQ ID NO: 395516 - DNA, 25 bp, Mus musculus
cttcgagcactgttcaacaagcaca

SEQ ID NO: 395517 - DNA, 25 bp, Mus musculus
cttcgagccagccaatcagatggtc

SEQ ID NO: 395518 - DNA, 25 bp, Mus musculus
cttcgagccagcgaatcagatggtc

SEQ ID NO: 395519 - DNA, 25 bp, Mus musculus
cttcgagccttcatccttaagatta

SEQ ID NO: 395520 - DNA, 25 bp, Mus musculus
cttcgagccttcttccttaagatta

SEQ ID NO: 395521 - DNA, 25 bp, Mus musculus
cttcgagtgaatctggcagttaaac

SEQ ID NO: 395522 - DNA, 25 bp, Mus musculus
cttcgagtgaatgtggcagttaaac

SEQ ID NO: 395523 - DNA, 25 bp, Mus musculus
cttcgagtgactagtgtgcaggttt

SEQ ID NO: 395524 - DNA, 25 bp, Mus musculus
cttcgagtgacttgtgtgcaggttt

SEQ ID NO: 395525 - DNA, 25 bp, Mus musculus
cttcgagttcgcctactggatgaat

SEQ ID NO: 395526 - DNA, 25 bp, Mus musculus
cttcgagttcgcgtactggatgaat

SEQ ID NO: 395527 - DNA, 25 bp, Mus musculus
cttcgatcgctaaggagtggagtgt

SEQ ID NO: 395528 - DNA, 25 bp, Mus musculus
cttcgatcgctatggagtggagtgt

SEQ ID NO: 395529 - DNA, 25 bp, Mus musculus
cttcgatctaatatttccatggtac

SEQ ID NO: 395530 - DNA, 25 bp, Mus musculus
cttcgatctaatttttccatggtac

SEQ ID NO: 395531 - DNA, 25 bp, Mus musculus
cttcgatgactcagctcctaatgaa

SEQ ID NO: 395532 - DNA, 25 bp, Mus musculus
cttcgatgactctgctcctaatgaa

SEQ ID NO: 395533 - DNA, 25 bp, Mus musculus
cttcgatgagaaagccaccctggag

SEQ ID NO: 395534 - DNA, 25 bp, Mus musculus
cttcgatgagaatgccaccctggag

SEQ ID NO: 395535 - DNA, 25 bp, Mus musculus
cttcgatgagtcctttttcagtcta

SEQ ID NO: 395536 - DNA, 25 bp, Mus musculus
cttcgatgagtcgtttttcagtcta

SEQ ID NO: 395537 - DNA, 25 bp, Mus musculus
cttcgatggttcaatgctgtttgta

SEQ ID NO: 395538 - DNA, 25 bp, Mus musculus
cttcgatggttctatgctgtttgta

SEQ ID NO: 395539 - DNA, 25 bp, Mus musculus
cttcgatgtatgcgctcgttgccct

SEQ ID NO: 395540 - DNA, 25 bp, Mus musculus
cttcgatgtatgggctcgttgccct

SEQ ID NO: 395541 - DNA, 25 bp, Mus musculus
cttcgatgtgcacctagtgttttca

SEQ ID NO: 395542 - DNA, 25 bp, Mus musculus
cttcgatgtgcagctagtgttttca

SEQ ID NO: 395543 - DNA, 25 bp, Mus musculus
cttcgccagccaatctgctagtgca

SEQ ID NO: 395544 - DNA, 25 bp, Mus musculus
cttcgccagccattctgctagtgca

SEQ ID NO: 395545 - DNA, 25 bp, Mus musculus
cttcgccagtctaagcacagtatca

SEQ ID NO: 395546 - DNA, 25 bp, Mus musculus
cttcgccagtcttagcacagtatca

SEQ ID NO: 395547 - DNA, 25 bp, Mus musculus
cttcgcccgagtacaagactccagt

SEQ ID NO: 395548 - DNA, 25 bp, Mus musculus
cttcgcccgagttcaagactccagt

SEQ ID NO: 395549 - DNA, 25 bp, Mus musculus
cttcgcccggagagcagccagtgga

SEQ ID NO: 395550 - DNA, 25 bp, Mus musculus
cttcgcccggagtgcagccagtgga

SEQ ID NO: 395551 - DNA, 25 bp, Mus musculus
cttcgcccttttatgcaatgtagag

SEQ ID NO: 395552 - DNA, 25 bp, Mus musculus
cttcgcccttttttgcaatgtagag

SEQ ID NO: 395553 - DNA, 25 bp, Mus musculus
cttcgcctatgtaggtcactcaagt

SEQ ID NO: 395554 - DNA, 25 bp, Mus musculus
cttcgcctatgttggtcactcaagt

SEQ ID NO: 395555 - DNA, 25 bp, Mus musculus
cttcgcctcaatcctgaccaaaaag

SEQ ID NO: 395556 - DNA, 25 bp, Mus musculus
cttcgcctcaatgctgaccaaaaag

SEQ ID NO: 395557 - DNA, 25 bp, Mus musculus
cttcgcctctgtactgtgtagatgt

SEQ ID NO: 395558 - DNA, 25 bp, Mus musculus
cttcgcctctgttctgtgtagatgt

SEQ ID NO: 395559 - DNA, 25 bp, Mus musculus
cttcgccttccacgtatgacggtct

SEQ ID NO: 395560 - DNA, 25 bp, Mus musculus
cttcgccttccaggtatgacggtct

SEQ ID NO: 395561 - DNA, 25 bp, Mus musculus
cttcgcgcacaactacgacctgaag

SEQ ID NO: 395562 - DNA, 25 bp, Mus musculus
cttcgcgcacaagtacgacctgaag

SEQ ID NO: 395563 - DNA, 25 bp, Mus musculus
cttcgcgcccatattatttaggagg

SEQ ID NO: 395564 - DNA, 25 bp, Mus musculus
cttcgcgcccattttatttaggagg

SEQ ID NO: 395565 - DNA, 25 bp, Mus musculus
cttcgcgcttggatttactttgggc

SEQ ID NO: 395566 - DNA, 25 bp, Mus musculus
cttcgcgcttggttttactttgggc

SEQ ID NO: 395567 - DNA, 25 bp, Mus musculus
cttcgcggagctagcacaaatctat

SEQ ID NO: 395568 - DNA, 25 bp, Mus musculus
cttcgcggagcttgcacaaatctat

SEQ ID NO: 395569 - DNA, 25 bp, Mus musculus
cttcgctaccagatacagcgtggga

SEQ ID NO: 395570 - DNA, 25 bp, Mus musculus
cttcgctaccagttacagcgtggga

SEQ ID NO: 395571 - DNA, 25 bp, Mus musculus
cttcgctctcaaacactcttttcac

SEQ ID NO: 395572 - DNA, 25 bp, Mus musculus
cttcgctctcaatcactcttttcac

SEQ ID NO: 395573 - DNA, 25 bp, Mus musculus
cttcgctgtaaacttcacgcccaag

SEQ ID NO: 395574 - DNA, 25 bp, Mus musculus
cttcgctgtaaagttcacgcccaag

SEQ ID NO: 395575 - DNA, 25 bp, Mus musculus
cttcgctgtctgaggtagtcttgca

SEQ ID NO: 395576 - DNA, 25 bp, Mus musculus
cttcgctgtctgtggtagtcttgca

SEQ ID NO: 395577 - DNA, 25 bp, Mus musculus
cttcgcttctctagatcagcagaaa

SEQ ID NO: 395578 - DNA, 25 bp, Mus musculus
cttcgcttctcttgatcagcagaaa

SEQ ID NO: 395579 - DNA, 25 bp, Mus musculus
cttcgcttctggctagacaggcaaa

SEQ ID NO: 395580 - DNA, 25 bp, Mus musculus
cttcgcttctgggtagacaggcaaa

SEQ ID NO: 395581 - DNA, 25 bp, Mus musculus
cttcgcttggttctttattggcatg

SEQ ID NO: 395582 - DNA, 25 bp, Mus musculus
cttcgcttggttgtttattggcatg

SEQ ID NO: 395583 - DNA, 25 bp, Mus musculus
cttcggaaagtgcttttatgccaga

SEQ ID NO: 395584 - DNA, 25 bp, Mus musculus
cttcggaaagtggttttatgccaga

SEQ ID NO: 395585 - DNA, 25 bp, Mus musculus
cttcggagctatcaggaacgcctga

SEQ ID NO: 395586 - DNA, 25 bp, Mus musculus
cttcggagctatgaggaacgcctga

SEQ ID NO: 395587 - DNA, 25 bp, Mus musculus
cttcggatatggctacaggcgcccc

SEQ ID NO: 395588 - DNA, 25 bp, Mus musculus
cttcggatatgggtacaggcgcccc

SEQ ID NO: 395589 - DNA, 25 bp, Mus musculus
cttcggatcaagactgcaaccatgt

SEQ ID NO: 395590 - DNA, 25 bp, Mus musculus
cttcggatcaagtctgcaaccatgt

SEQ ID NO: 395591 - DNA, 25 bp, Mus musculus
cttcggatcacgcccggagtagaag

SEQ ID NO: 395592 - DNA, 25 bp, Mus musculus
cttcggatcacggccggagtagaag

SEQ ID NO: 395593 - DNA, 25 bp, Mus musculus
cttcggcagctcatcaataaattct

SEQ ID NO: 395594 - DNA, 25 bp, Mus musculus
cttcggcagctcttcaataaattct

SEQ ID NO: 395595 - DNA, 25 bp, Mus musculus
cttcggccatagagtgttttgttgt

SEQ ID NO: 395596 - DNA, 25 bp, Mus musculus
cttcggccatagtgtgttttgttgt

SEQ ID NO: 395597 - DNA, 25 bp, Mus musculus
cttcggcctgctcggtcgaaaacca

SEQ ID NO: 395598 - DNA, 25 bp, Mus musculus
cttcggcctgctgggtcgaaaacca

SEQ ID NO: 395599 - DNA, 25 bp, Mus musculus
cttcggcctgtgcttgtccttgaaa

SEQ ID NO: 395600 - DNA, 25 bp, Mus musculus
cttcggcctgtggttgtccttgaaa

SEQ ID NO: 395601 - DNA, 25 bp, Mus musculus
cttcggctacagatgtaagctgctg

SEQ ID NO: 395602 - DNA, 25 bp, Mus musculus
cttcggctacagttgtaagctgctg

SEQ ID NO: 395603 - DNA, 25 bp, Mus musculus
cttcggctgtagcttaggctcggca

SEQ ID NO: 395604 - DNA, 25 bp, Mus musculus
cttcggctgtaggttaggctcggca

SEQ ID NO: 395605 - DNA, 25 bp, Mus musculus
cttcgggagttaatggagctctcta

SEQ ID NO: 395606 - DNA, 25 bp, Mus musculus
cttcgggagttattggagctctcta

SEQ ID NO: 395607 - DNA, 25 bp, Mus musculus
cttcgggtgacaagcttctaatcac

SEQ ID NO: 395608 - DNA, 25 bp, Mus musculus
cttcgggtgacatgcttctaatcac

SEQ ID NO: 395609 - DNA, 25 bp, Mus musculus
cttcgggtgactcaaagtgctgact

SEQ ID NO: 395610 - DNA, 25 bp, Mus musculus
cttcgggtgactgaaagtgctgact

SEQ ID NO: 395611 - DNA, 25 bp, Mus musculus
cttcggtatctgcacctgccttggg

SEQ ID NO: 395612 - DNA, 25 bp, Mus musculus
cttcggtatctggacctgccttggg

SEQ ID NO: 395613 - DNA, 25 bp, Mus musculus
cttcggtcagcactctctgtgcatt

SEQ ID NO: 395614 - DNA, 25 bp, Mus musculus
cttcggtcagcagtctctgtgcatt

SEQ ID NO: 395615 - DNA, 25 bp, Mus musculus
cttcggtcctatattttgttgctca

SEQ ID NO: 395616 - DNA, 25 bp, Mus musculus
cttcggtcctattttttgttgctca

SEQ ID NO: 395617 - DNA, 25 bp, Mus musculus
cttcggtctcgtagttgtatgcaat

SEQ ID NO: 395618 - DNA, 25 bp, Mus musculus
cttcggtctcgttgttgtatgcaat

SEQ ID NO: 395619 - DNA, 25 bp, Mus musculus
cttcggtggacaagaaagttcttga

SEQ ID NO: 395620 - DNA, 25 bp, Mus musculus
cttcggtggacatgaaagttcttga

SEQ ID NO: 395621 - DNA, 25 bp, Mus musculus
cttcggtgggaaatactctttctgt

SEQ ID NO: 395622 - DNA, 25 bp, Mus musculus
cttcggtgggaattactctttctgt

SEQ ID NO: 395623 - DNA, 25 bp, Mus musculus
cttcggtggtatcatgcttattctt

SEQ ID NO: 395624 - DNA, 25 bp, Mus musculus
cttcggtggtatgatgcttattctt

SEQ ID NO: 395625 - DNA, 25 bp, Mus musculus
cttcggtggtgtctgttgcagtttc

SEQ ID NO: 395626 - DNA, 25 bp, Mus musculus
cttcggtggtgtgtgttgcagtttc

SEQ ID NO: 395627 - DNA, 25 bp, Mus musculus
cttcggttagctccgtacattaact

SEQ ID NO: 395628 - DNA, 25 bp, Mus musculus
cttcggttagctgcgtacattaact

SEQ ID NO: 395629 - DNA, 25 bp, Mus musculus
cttcggttgcaaccccaatggtaag

SEQ ID NO: 395630 - DNA, 25 bp, Mus musculus
cttcggttgcaagcccaatggtaag

SEQ ID NO: 395631 - DNA, 25 bp, Mus musculus
cttcggttttgacctgtgagagcaa

SEQ ID NO: 395632 - DNA, 25 bp, Mus musculus
cttcggttttgagctgtgagagcaa

SEQ ID NO: 395633 - DNA, 25 bp, Mus musculus
cttcgtagaaaacaagaagcgcttc

SEQ ID NO: 395634 - DNA, 25 bp, Mus musculus
cttcgtagaaaagaagaagcgcttc

SEQ ID NO: 395635 - DNA, 25 bp, Mus musculus
cttcgtagagtcacccttgaaagtg

SEQ ID NO: 395636 - DNA, 25 bp, Mus musculus
cttcgtagagtctcccttgaaagtg

SEQ ID NO: 395637 - DNA, 25 bp, Mus musculus
cttcgtagctctcgtattcacttta

SEQ ID NO: 395638 - DNA, 25 bp, Mus musculus
cttcgtagctctggtattcacttta

SEQ ID NO: 395639 - DNA, 25 bp, Mus musculus
cttcgtcaccttagcagatgataag

SEQ ID NO: 395640 - DNA, 25 bp, Mus musculus
cttcgtcacctttgcagatgataag

SEQ ID NO: 395641 - DNA, 25 bp, Mus musculus
cttcgtccgggtaatatgcaattta

SEQ ID NO: 395642 - DNA, 25 bp, Mus musculus
cttcgtccgggttatatgcaattta

SEQ ID NO: 395643 - DNA, 25 bp, Mus musculus
cttcgtcctgccagatagatcatga

SEQ ID NO: 395644 - DNA, 25 bp, Mus musculus
cttcgtcctgcctgatagatcatga

SEQ ID NO: 395645 - DNA, 25 bp, Mus musculus
cttcgtctcacacacattgcaaaga

SEQ ID NO: 395646 - DNA, 25 bp, Mus musculus
cttcgtctcacagacattgcaaaga

SEQ ID NO: 395647 - DNA, 25 bp, Mus musculus
cttcgtcttcgacagatcttcaatg

SEQ ID NO: 395648 - DNA, 25 bp, Mus musculus
cttcgtcttcgagagatcttcaatg

SEQ ID NO: 395649 - DNA, 25 bp, Mus musculus
cttcgtgccagtctatgaggaattc

SEQ ID NO: 395650 - DNA, 25 bp, Mus musculus
cttcgtgccagtgtatgaggaattc

SEQ ID NO: 395651 - DNA, 25 bp, Mus musculus
cttcgtggaggacgctaagcgtctt

SEQ ID NO: 395652 - DNA, 25 bp, Mus musculus
cttcgtggaggaggctaagcgtctt

SEQ ID NO: 395653 - DNA, 25 bp, Mus musculus
cttcgtggcaatcaaatgcaagcgt

SEQ ID NO: 395654 - DNA, 25 bp, Mus musculus
cttcgtggcaatgaaatgcaagcgt

SEQ ID NO: 395655 - DNA, 25 bp, Mus musculus
cttcgtggcctgacatttactggaa

SEQ ID NO: 395656 - DNA, 25 bp, Mus musculus
cttcgtggcctgtcatttactggaa

SEQ ID NO: 395657 - DNA, 25 bp, Mus musculus
cttcgtgtccgccttgttaagaaag

SEQ ID NO: 395658 - DNA, 25 bp, Mus musculus
cttcgtgtccgcgttgttaagaaag

SEQ ID NO: 395659 - DNA, 25 bp, Mus musculus
cttcgtgtgcggagggctatatgac

SEQ ID NO: 395660 - DNA, 25 bp, Mus musculus
cttcgtgtgcggtgggctatatgac

SEQ ID NO: 395661 - DNA, 25 bp, Mus musculus
cttcgttcatctctggtacttctgt

SEQ ID NO: 395662 - DNA, 25 bp, Mus musculus
cttcgttcatctgtggtacttctgt

SEQ ID NO: 395663 - DNA, 25 bp, Mus musculus
cttcgttctctaccgtgatttttct

SEQ ID NO: 395664 - DNA, 25 bp, Mus musculus
cttcgttctctagcgtgatttttct

SEQ ID NO: 395665 - DNA, 25 bp, Mus musculus
cttcgttctgagacatgtatcgtga

SEQ ID NO: 395666 - DNA, 25 bp, Mus musculus
cttcgttctgagtcatgtatcgtga

SEQ ID NO: 395667 - DNA, 25 bp, Mus musculus
cttcgtttacgcctgactaagagga

SEQ ID NO: 395668 - DNA, 25 bp, Mus musculus
cttcgtttacgcgtgactaagagga

SEQ ID NO: 395669 - DNA, 25 bp, Mus musculus
cttcgtttcatgatggcatgccatt

SEQ ID NO: 395670 - DNA, 25 bp, Mus musculus
cttcgtttcatgttggcatgccatt

SEQ ID NO: 395671 - DNA, 25 bp, Mus musculus
cttcgtttgaagaactcccacattt

SEQ ID NO: 395672 - DNA, 25 bp, Mus musculus
cttcgtttgaagtactcccacattt

SEQ ID NO: 395673 - DNA, 25 bp, Mus musculus
cttcgttttgtaccaaatcacagga

SEQ ID NO: 395674 - DNA, 25 bp, Mus musculus
cttcgttttgtagcaaatcacagga

SEQ ID NO: 395675 - DNA, 25 bp, Mus musculus
cttctaaagtggaccatccctcatt

SEQ ID NO: 395676 - DNA, 25 bp, Mus musculus
cttctaaagtggtccatccctcatt

SEQ ID NO: 395677 - DNA, 25 bp, Mus musculus
cttctaaatatcaccctttttgcgg

SEQ ID NO: 395678 - DNA, 25 bp, Mus musculus
cttctaaatatctccctttttgcgg

SEQ ID NO: 395679 - DNA, 25 bp, Mus musculus
cttctaacaagtctggttggtgctt

SEQ ID NO: 395680 - DNA, 25 bp, Mus musculus
cttctaacaagtgtggttggtgctt

SEQ ID NO: 395681 - DNA, 25 bp, Mus musculus
cttctaaccaacagcatcactttga

SEQ ID NO: 395682 - DNA, 25 bp, Mus musculus
cttctaaccaactgcatcactttga

SEQ ID NO: 395683 - DNA, 25 bp, Mus musculus
cttctaactccacgtcatagtcact

SEQ ID NO: 395684 - DNA, 25 bp, Mus musculus
cttctaactccaggtcatagtcact

SEQ ID NO: 395685 - DNA, 25 bp, Mus musculus
cttctaacttcacgcctagggaaag

SEQ ID NO: 395686 - DNA, 25 bp, Mus musculus
cttctaacttcaggcctagggaaag

SEQ ID NO: 395687 - DNA, 25 bp, Mus musculus
cttctaagtctgagtccagtcaaaa

SEQ ID NO: 395688 - DNA, 25 bp, Mus musculus
cttctaagtctgtgtccagtcaaaa

SEQ ID NO: 395689 - DNA, 25 bp, Mus musculus
cttctaattctgcatcattttaagg

SEQ ID NO: 395690 - DNA, 25 bp, Mus musculus
cttctaattctggatcattttaagg

SEQ ID NO: 395691 - DNA, 25 bp, Mus musculus
cttctacagactcgttgctaagcac

SEQ ID NO: 395692 - DNA, 25 bp, Mus musculus
cttctacagactggttgctaagcac

SEQ ID NO: 395693 - DNA, 25 bp, Mus musculus
cttctacagtagcaggttttcatgt

SEQ ID NO: 395694 - DNA, 25 bp, Mus musculus
cttctacagtaggaggttttcatgt

SEQ ID NO: 395695 - DNA, 25 bp, Mus musculus
cttctaccagtgactttatgggagg

SEQ ID NO: 395696 - DNA, 25 bp, Mus musculus
cttctaccagtgtctttatgggagg

SEQ ID NO: 395697 - DNA, 25 bp, Mus musculus
cttctaccctagaactcaggttgca

SEQ ID NO: 395698 - DNA, 25 bp, Mus musculus
cttctaccctagtactcaggttgca

SEQ ID NO: 395699 - DNA, 25 bp, Mus musculus
cttctacctggacgtgggcctaagc

SEQ ID NO: 395700 - DNA, 25 bp, Mus musculus
cttctacctggaggtgggcctaagc

SEQ ID NO: 395701 - DNA, 25 bp, Mus musculus
cttctacgacttcatcgtggccaaa

SEQ ID NO: 395702 - DNA, 25 bp, Mus musculus
cttctacgacttgatcgtggccaaa

SEQ ID NO: 395703 - DNA, 25 bp, Mus musculus
cttctacggcgacgagtgtcagttc

SEQ ID NO: 395704 - DNA, 25 bp, Mus musculus
cttctacggcgaggagtgtcagttc

SEQ ID NO: 395705 - DNA, 25 bp, Mus musculus
cttctactagggcaggcaagttctt

SEQ ID NO: 395706 - DNA, 25 bp, Mus musculus
cttctactaggggaggcaagttctt

SEQ ID NO: 395707 - DNA, 25 bp, Mus musculus
cttctactctttaatgtaccgcttg

SEQ ID NO: 395708 - DNA, 25 bp, Mus musculus
cttctactcttttatgtaccgcttg

SEQ ID NO: 395709 - DNA, 25 bp, Mus musculus
cttctacttctaagtctgagtccag

SEQ ID NO: 395710 - DNA, 25 bp, Mus musculus
cttctacttctatgtctgagtccag

SEQ ID NO: 395711 - DNA, 25 bp, Mus musculus
cttctacttggaccccttcaatagg

SEQ ID NO: 395712 - DNA, 25 bp, Mus musculus
cttctacttggagcccttcaatagg

SEQ ID NO: 395713 - DNA, 25 bp, Mus musculus
cttctagaatgtcctttcatgatgg

SEQ ID NO: 395714 - DNA, 25 bp, Mus musculus
cttctagaatgtgctttcatgatgg

SEQ ID NO: 395715 - DNA, 25 bp, Mus musculus
cttctagctgctcgtggttctttga

SEQ ID NO: 395716 - DNA, 25 bp, Mus musculus
cttctagctgctggtggttctttga

SEQ ID NO: 395717 - DNA, 25 bp, Mus musculus
cttctaggatctaccctgggtggga

SEQ ID NO: 395718 - DNA, 25 bp, Mus musculus
cttctaggatcttccctgggtggga

SEQ ID NO: 395719 - DNA, 25 bp, Mus musculus
cttctaggattcaagcatggctcag

SEQ ID NO: 395720 - DNA, 25 bp, Mus musculus
cttctaggattctagcatggctcag

SEQ ID NO: 395721 - DNA, 25 bp, Mus musculus
cttctaggcgtcattcagagatggc

SEQ ID NO: 395722 - DNA, 25 bp, Mus musculus
cttctaggcgtctttcagagatggc

SEQ ID NO: 395723 - DNA, 25 bp, Mus musculus
cttctagtctctcattcctaagatc

SEQ ID NO: 395724 - DNA, 25 bp, Mus musculus
cttctagtctctgattcctaagatc

SEQ ID NO: 395725 - DNA, 25 bp, Mus musculus
cttctagtctttatcatcacagtca

SEQ ID NO: 395726 - DNA, 25 bp, Mus musculus
cttctagtctttttcatcacagtca

SEQ ID NO: 395727 - DNA, 25 bp, Mus musculus
cttctagtgagcatgtgatctgtgg

SEQ ID NO: 395728 - DNA, 25 bp, Mus musculus
cttctagtgagcttgtgatctgtgg

SEQ ID NO: 395729 - DNA, 25 bp, Mus musculus
cttctagtgtgtatgcccaaacgct

SEQ ID NO: 395730 - DNA, 25 bp, Mus musculus
cttctagtgtgtttgcccaaacgct

SEQ ID NO: 395731 - DNA, 25 bp, Mus musculus
cttctatacagtcagatggtccagt

SEQ ID NO: 395732 - DNA, 25 bp, Mus musculus
cttctatacagtgagatggtccagt

SEQ ID NO: 395733 - DNA, 25 bp, Mus musculus
cttctatagcccctgtgattgatgt

SEQ ID NO: 395734 - DNA, 25 bp, Mus musculus
cttctatagcccgtgtgattgatgt

SEQ ID NO: 395735 - DNA, 25 bp, Mus musculus
cttctatcactgctccaatgacgat

SEQ ID NO: 395736 - DNA, 25 bp, Mus musculus
cttctatcactggtccaatgacgat

SEQ ID NO: 395737 - DNA, 25 bp, Mus musculus
cttctatccagtcaggacccagtga

SEQ ID NO: 395738 - DNA, 25 bp, Mus musculus
cttctatccagtgaggacccagtga

SEQ ID NO: 395739 - DNA, 25 bp, Mus musculus
cttctatcttagcttctgacacttg

SEQ ID NO: 395740 - DNA, 25 bp, Mus musculus
cttctatcttaggttctgacacttg

SEQ ID NO: 395741 - DNA, 25 bp, Mus musculus
cttctatctttgaatgtccatatca

SEQ ID NO: 395742 - DNA, 25 bp, Mus musculus
cttctatctttgtatgtccatatca

SEQ ID NO: 395743 - DNA, 25 bp, Mus musculus
cttctatggcttctggtttgctgaa

SEQ ID NO: 395744 - DNA, 25 bp, Mus musculus
cttctatggcttgtggtttgctgaa

SEQ ID NO: 395745 - DNA, 25 bp, Mus musculus
cttctattaaacacgtgggcttcca

SEQ ID NO: 395746 - DNA, 25 bp, Mus musculus
cttctattaaactcgtgggcttcca

SEQ ID NO: 395747 - DNA, 25 bp, Mus musculus
cttctattcttcattcagtcggttt

SEQ ID NO: 395748 - DNA, 25 bp, Mus musculus
cttctattcttctttcagtcggttt

SEQ ID NO: 395749 - DNA, 25 bp, Mus musculus
cttctcaaaacacaggcaccaattt

SEQ ID NO: 395750 - DNA, 25 bp, Mus musculus
cttctcaaaacagaggcaccaattt

SEQ ID NO: 395751 - DNA, 25 bp, Mus musculus
cttctcaaaactagcctcatgctga

SEQ ID NO: 395752 - DNA, 25 bp, Mus musculus
cttctcaaaacttgcctcatgctga

SEQ ID NO: 395753 - DNA, 25 bp, Mus musculus
cttctcaaatcaacgaaatctgtga

SEQ ID NO: 395754 - DNA, 25 bp, Mus musculus
cttctcaaatcatcgaaatctgtga

SEQ ID NO: 395755 - DNA, 25 bp, Mus musculus
cttctcaaatgcatgttaggataac

SEQ ID NO: 395756 - DNA, 25 bp, Mus musculus
cttctcaaatgcttgttaggataac

SEQ ID NO: 395757 - DNA, 25 bp, Mus musculus
cttctcaaggagcactacactgacc

SEQ ID NO: 395758 - DNA, 25 bp, Mus musculus
cttctcaaggaggactacactgacc

SEQ ID NO: 395759 - DNA, 25 bp, Mus musculus
cttctcaatggtcagtgtgcaggct

SEQ ID NO: 395760 - DNA, 25 bp, Mus musculus
cttctcaatggtgagtgtgcaggct

SEQ ID NO: 395761 - DNA, 25 bp, Mus musculus
cttctcaatgtcagcatggatgcca

SEQ ID NO: 395762 - DNA, 25 bp, Mus musculus
cttctcaatgtctgcatggatgcca

SEQ ID NO: 395763 - DNA, 25 bp, Mus musculus
cttctcacccatcaagggagggcat

SEQ ID NO: 395764 - DNA, 25 bp, Mus musculus
cttctcacccatgaagggagggcat

SEQ ID NO: 395765 - DNA, 25 bp, Mus musculus
cttctcacccttaactaacatagca

SEQ ID NO: 395766 - DNA, 25 bp, Mus musculus
cttctcaccctttactaacatagca

SEQ ID NO: 395767 - DNA, 25 bp, Mus musculus
cttctcaccgtaccctttttaaatg

SEQ ID NO: 395768 - DNA, 25 bp, Mus musculus
cttctcaccgtagcctttttaaatg

SEQ ID NO: 395769 - DNA, 25 bp, Mus musculus
cttctcacctatcgaagttgtctca

SEQ ID NO: 395770 - DNA, 25 bp, Mus musculus
cttctcacctatggaagttgtctca

SEQ ID NO: 395771 - DNA, 25 bp, Mus musculus
cttctcagacagactctactcagaa

SEQ ID NO: 395772 - DNA, 25 bp, Mus musculus
cttctcagacagtctctactcagaa

SEQ ID NO: 395773 - DNA, 25 bp, Mus musculus
cttctcagacttaccgtaggagcta

SEQ ID NO: 395774 - DNA, 25 bp, Mus musculus
cttctcagactttccgtaggagcta

SEQ ID NO: 395775 - DNA, 25 bp, Mus musculus
cttctcagatgcacactggttggga

SEQ ID NO: 395776 - DNA, 25 bp, Mus musculus
cttctcagatgctcactggttggga

SEQ ID NO: 395777 - DNA, 25 bp, Mus musculus
cttctcagcattcacattccattca

SEQ ID NO: 395778 - DNA, 25 bp, Mus musculus
cttctcagcattgacattccattca

SEQ ID NO: 395779 - DNA, 25 bp, Mus musculus
cttctcaggaagcagtaccgttcaa

SEQ ID NO: 395780 - DNA, 25 bp, Mus musculus
cttctcaggaaggagtaccgttcaa

SEQ ID NO: 395781 - DNA, 25 bp, Mus musculus
cttctcagtagaactgtgcagggca

SEQ ID NO: 395782 - DNA, 25 bp, Mus musculus
cttctcagtagatctgtgcagggca

SEQ ID NO: 395783 - DNA, 25 bp, Mus musculus
cttctcagtagtagaactagctact

SEQ ID NO: 395784 - DNA, 25 bp, Mus musculus
cttctcagtagttgaactagctact

SEQ ID NO: 395785 - DNA, 25 bp, Mus musculus
cttctcatatctacagaccattcga

SEQ ID NO: 395786 - DNA, 25 bp, Mus musculus
cttctcatatcttcagaccattcga

SEQ ID NO: 395787 - DNA, 25 bp, Mus musculus
cttctcatcaagcatactctctgaa

SEQ ID NO: 395788 - DNA, 25 bp, Mus musculus
cttctcatcaaggatactctctgaa

SEQ ID NO: 395789 - DNA, 25 bp, Mus musculus
cttctcatctccacaagctggaaaa

SEQ ID NO: 395790 - DNA, 25 bp, Mus musculus
cttctcatctcctcaagctggaaaa

SEQ ID NO: 395791 - DNA, 25 bp, Mus musculus
cttctcatctgtacctacacagaac

SEQ ID NO: 395792 - DNA, 25 bp, Mus musculus
cttctcatctgttcctacacagaac

SEQ ID NO: 395793 - DNA, 25 bp, Mus musculus
cttctcattattaccattttcatag

SEQ ID NO: 395794 - DNA, 25 bp, Mus musculus
cttctcattatttccattttcatag

SEQ ID NO: 395795 - DNA, 25 bp, Mus musculus
cttctcattggcattggcttaaacc

SEQ ID NO: 395796 - DNA, 25 bp, Mus musculus
cttctcattggctttggcttaaacc

SEQ ID NO: 395797 - DNA, 25 bp, Mus musculus
cttctcatttatagctcaaagcatc

SEQ ID NO: 395798 - DNA, 25 bp, Mus musculus
cttctcatttattgctcaaagcatc

SEQ ID NO: 395799 - DNA, 25 bp, Mus musculus
cttctccaaagaaagcgatcctgct

SEQ ID NO: 395800 - DNA, 25 bp, Mus musculus
cttctccaaagatagcgatcctgct

SEQ ID NO: 395801 - DNA, 25 bp, Mus musculus
cttctccaacatactgtccttaaag

SEQ ID NO: 395802 - DNA, 25 bp, Mus musculus
cttctccaacattctgtccttaaag

SEQ ID NO: 395803 - DNA, 25 bp, Mus musculus
cttctccaatctagcagcacttaga

SEQ ID NO: 395804 - DNA, 25 bp, Mus musculus
cttctccaatcttgcagcacttaga

SEQ ID NO: 395805 - DNA, 25 bp, Mus musculus
cttctccactgtctaagtctgtaac

SEQ ID NO: 395806 - DNA, 25 bp, Mus musculus
cttctccactgtgtaagtctgtaac

SEQ ID NO: 395807 - DNA, 25 bp, Mus musculus
cttctccagcatctgaaagggtcac

SEQ ID NO: 395808 - DNA, 25 bp, Mus musculus
cttctccagcatgtgaaagggtcac

SEQ ID NO: 395809 - DNA, 25 bp, Mus musculus
cttctccagccccaatatttactta

SEQ ID NO: 395810 - DNA, 25 bp, Mus musculus
cttctccagcccgaatatttactta

SEQ ID NO: 395811 - DNA, 25 bp, Mus musculus
cttctccagcttatgcagtgtactg

SEQ ID NO: 395812 - DNA, 25 bp, Mus musculus
cttctccagcttttgcagtgtactg

SEQ ID NO: 395813 - DNA, 25 bp, Mus musculus
cttctccaggctcacaggtctgaga

SEQ ID NO: 395814 - DNA, 25 bp, Mus musculus
cttctccaggctgacaggtctgaga

SEQ ID NO: 395815 - DNA, 25 bp, Mus musculus
cttctccagttcataggcagtgctt

SEQ ID NO: 395816 - DNA, 25 bp, Mus musculus
cttctccagttcttaggcagtgctt

SEQ ID NO: 395817 - DNA, 25 bp, Mus musculus
cttctccagttgatttcttaagcaa

SEQ ID NO: 395818 - DNA, 25 bp, Mus musculus
cttctccagttgttttcttaagcaa

SEQ ID NO: 395819 - DNA, 25 bp, Mus musculus
cttctccatatgacctaacttgatc

SEQ ID NO: 395820 - DNA, 25 bp, Mus musculus
cttctccatatgtcctaacttgatc

SEQ ID NO: 395821 - DNA, 25 bp, Mus musculus
cttctccatattagctgtcacagtg

SEQ ID NO: 395822 - DNA, 25 bp, Mus musculus
cttctccatatttgctgtcacagtg

SEQ ID NO: 395823 - DNA, 25 bp, Mus musculus
cttctccatgttagttggtaattag

SEQ ID NO: 395824 - DNA, 25 bp, Mus musculus
cttctccatgtttgttggtaattag

SEQ ID NO: 395825 - DNA, 25 bp, Mus musculus
cttctccattacctctgctttaaga

SEQ ID NO: 395826 - DNA, 25 bp, Mus musculus
cttctccattacgtctgctttaaga

SEQ ID NO: 395827 - DNA, 25 bp, Mus musculus
cttctccatttccttcgttgtaaag

SEQ ID NO: 395828 - DNA, 25 bp, Mus musculus
cttctccatttcgttcgttgtaaag

SEQ ID NO: 395829 - DNA, 25 bp, Mus musculus
cttctcccaaacactggatttatag

SEQ ID NO: 395830 - DNA, 25 bp, Mus musculus
cttctcccaaactctggatttatag

SEQ ID NO: 395831 - DNA, 25 bp, Mus musculus
cttctcccactgacagaagcaggat

SEQ ID NO: 395832 - DNA, 25 bp, Mus musculus
cttctcccactgtcagaagcaggat

SEQ ID NO: 395833 - DNA, 25 bp, Mus musculus
cttctcccagacatttcattcatcc

SEQ ID NO: 395834 - DNA, 25 bp, Mus musculus
cttctcccagacttttcattcatcc

SEQ ID NO: 395835 - DNA, 25 bp, Mus musculus
cttctcccatctagagacacctgtg

SEQ ID NO: 395836 - DNA, 25 bp, Mus musculus
cttctcccatcttgagacacctgtg

SEQ ID NO: 395837 - DNA, 25 bp, Mus musculus
cttctccctacaacggacatggttg

SEQ ID NO: 395838 - DNA, 25 bp, Mus musculus
cttctccctacatcggacatggttg

SEQ ID NO: 395839 - DNA, 25 bp, Mus musculus
cttctccctcaaaatgacacactta

SEQ ID NO: 395840 - DNA, 25 bp, Mus musculus
cttctccctcaatatgacacactta

SEQ ID NO: 395841 - DNA, 25 bp, Mus musculus
cttctccctcttcgacaaggatgga

SEQ ID NO: 395842 - DNA, 25 bp, Mus musculus
cttctccctcttggacaaggatgga

SEQ ID NO: 395843 - DNA, 25 bp, Mus musculus
cttctccctgtgaggtacaagcatg

SEQ ID NO: 395844 - DNA, 25 bp, Mus musculus
cttctccctgtgtggtacaagcatg

SEQ ID NO: 395845 - DNA, 25 bp, Mus musculus
cttctccctttgacaatgcttcaat

SEQ ID NO: 395846 - DNA, 25 bp, Mus musculus
cttctccctttgtcaatgcttcaat

SEQ ID NO: 395847 - DNA, 25 bp, Mus musculus
cttctccggctgagtgtacagtatg

SEQ ID NO: 395848 - DNA, 25 bp, Mus musculus
cttctccggctgtgtgtacagtatg

SEQ ID NO: 395849 - DNA, 25 bp, Mus musculus
cttctcctaacgaggtgcaacatga

SEQ ID NO: 395850 - DNA, 25 bp, Mus musculus
cttctcctaacgtggtgcaacatga

SEQ ID NO: 395851 - DNA, 25 bp, Mus musculus
cttctcctcactctagtaaagcaca

SEQ ID NO: 395852 - DNA, 25 bp, Mus musculus
cttctcctcactgtagtaaagcaca

SEQ ID NO: 395853 - DNA, 25 bp, Mus musculus
cttctcctcgtaaggtattatgatc

SEQ ID NO: 395854 - DNA, 25 bp, Mus musculus
cttctcctcgtatggtattatgatc

SEQ ID NO: 395855 - DNA, 25 bp, Mus musculus
cttctcctctgaagttggtattcat

SEQ ID NO: 395856 - DNA, 25 bp, Mus musculus
cttctcctctgatgttggtattcat

SEQ ID NO: 395857 - DNA, 25 bp, Mus musculus
cttctcctctgccagtaactgatta

SEQ ID NO: 395858 - DNA, 25 bp, Mus musculus
cttctcctctgcgagtaactgatta

SEQ ID NO: 395859 - DNA, 25 bp, Mus musculus
cttctcctgaggctgtacatgtaca

SEQ ID NO: 395860 - DNA, 25 bp, Mus musculus
cttctcctgagggtgtacatgtaca

SEQ ID NO: 395861 - DNA, 25 bp, Mus musculus
cttctcctggaactcctgccagaaa

SEQ ID NO: 395862 - DNA, 25 bp, Mus musculus
cttctcctggaagtcctgccagaaa

SEQ ID NO: 395863 - DNA, 25 bp, Mus musculus
cttctcctggcaacttagggcaaca

SEQ ID NO: 395864 - DNA, 25 bp, Mus musculus
cttctcctggcatcttagggcaaca

SEQ ID NO: 395865 - DNA, 25 bp, Mus musculus
cttctcctgggcatagcattggtga

SEQ ID NO: 395866 - DNA, 25 bp, Mus musculus
cttctcctgggcttagcattggtga

SEQ ID NO: 395867 - DNA, 25 bp, Mus musculus
cttctcctggtcaaaagtttctgat

SEQ ID NO: 395868 - DNA, 25 bp, Mus musculus
cttctcctggtctaaagtttctgat

SEQ ID NO: 395869 - DNA, 25 bp, Mus musculus
cttctccttcagctctcatgtaaga

SEQ ID NO: 395870 - DNA, 25 bp, Mus musculus
cttctccttcaggtctcatgtaaga

SEQ ID NO: 395871 - DNA, 25 bp, Mus musculus
cttctccttccaaagagaccggaaa

SEQ ID NO: 395872 - DNA, 25 bp, Mus musculus
cttctccttccatagagaccggaaa

SEQ ID NO: 395873 - DNA, 25 bp, Mus musculus
cttctccttgaccaaacaaaagcaa

SEQ ID NO: 395874 - DNA, 25 bp, Mus musculus
cttctccttgacgaaacaaaagcaa

SEQ ID NO: 395875 - DNA, 25 bp, Mus musculus
cttctccttgataacagctaccatg

SEQ ID NO: 395876 - DNA, 25 bp, Mus musculus
cttctccttgattacagctaccatg

SEQ ID NO: 395877 - DNA, 25 bp, Mus musculus
cttctcgcctctcaaagtattgcat

SEQ ID NO: 395878 - DNA, 25 bp, Mus musculus
cttctcgcctctgaaagtattgcat

SEQ ID NO: 395879 - DNA, 25 bp, Mus musculus
cttctcgggtgaaaatggacctgcc

SEQ ID NO: 395880 - DNA, 25 bp, Mus musculus
cttctcgggtgataatggacctgcc

SEQ ID NO: 395881 - DNA, 25 bp, Mus musculus
cttctcgtcgtcacggagggtggtt

SEQ ID NO: 395882 - DNA, 25 bp, Mus musculus
cttctcgtcgtctcggagggtggtt

SEQ ID NO: 395883 - DNA, 25 bp, Mus musculus
cttctcgtctttcatgaacttcttg

SEQ ID NO: 395884 - DNA, 25 bp, Mus musculus
cttctcgtctttgatgaacttcttg

SEQ ID NO: 395885 - DNA, 25 bp, Mus musculus
cttctctaaattccaccaatgcttt

SEQ ID NO: 395886 - DNA, 25 bp, Mus musculus
cttctctaaattgcaccaatgcttt

SEQ ID NO: 395887 - DNA, 25 bp, Mus musculus
cttctctaacccacgattgccggag

SEQ ID NO: 395888 - DNA, 25 bp, Mus musculus
cttctctaaccctcgattgccggag

SEQ ID NO: 395889 - DNA, 25 bp, Mus musculus
cttctctactacatgactttggcat

SEQ ID NO: 395890 - DNA, 25 bp, Mus musculus
cttctctactacttgactttggcat

SEQ ID NO: 395891 - DNA, 25 bp, Mus musculus
cttctctagcctccacagtaaattg

SEQ ID NO: 395892 - DNA, 25 bp, Mus musculus
cttctctagcctgcacagtaaattg

SEQ ID NO: 395893 - DNA, 25 bp, Mus musculus
cttctctatattattcctgtttgct

SEQ ID NO: 395894 - DNA, 25 bp, Mus musculus
cttctctatatttttcctgtttgct

SEQ ID NO: 395895 - DNA, 25 bp, Mus musculus
cttctctatccaccttatttctcaa

SEQ ID NO: 395896 - DNA, 25 bp, Mus musculus
cttctctatccagcttatttctcaa

SEQ ID NO: 395897 - DNA, 25 bp, Mus musculus
cttctctcactgatggtaagactta

SEQ ID NO: 395898 - DNA, 25 bp, Mus musculus
cttctctcactgatgtccgactagg

SEQ ID NO: 395899 - DNA, 25 bp, Mus musculus
cttctctcactgttggtaagactta

SEQ ID NO: 395900 - DNA, 25 bp, Mus musculus
cttctctcactgttgtccgactagg

SEQ ID NO: 395901 - DNA, 25 bp, Mus musculus
cttctctcagcaagctgcaaaacct

SEQ ID NO: 395902 - DNA, 25 bp, Mus musculus
cttctctcagcatgctgcaaaacct

SEQ ID NO: 395903 - DNA, 25 bp, Mus musculus
cttctctcaggtctagtacagtcag

SEQ ID NO: 395904 - DNA, 25 bp, Mus musculus
cttctctcaggtgtagtacagtcag

SEQ ID NO: 395905 - DNA, 25 bp, Mus musculus
cttctctcatctactgattggttta

SEQ ID NO: 395906 - DNA, 25 bp, Mus musculus
cttctctcatcttctgattggttta

SEQ ID NO: 395907 - DNA, 25 bp, Mus musculus
cttctctcatgtaatgcctttgcta

SEQ ID NO: 395908 - DNA, 25 bp, Mus musculus
cttctctcatgttatgcctttgcta

SEQ ID NO: 395909 - DNA, 25 bp, Mus musculus
cttctctcattcagtctgtacaaca

SEQ ID NO: 395910 - DNA, 25 bp, Mus musculus
cttctctcattctgtctgtacaaca

SEQ ID NO: 395911 - DNA, 25 bp, Mus musculus
cttctctccctcaagctgcttttgg

SEQ ID NO: 395912 - DNA, 25 bp, Mus musculus
cttctctccctctagctgcttttgg

SEQ ID NO: 395913 - DNA, 25 bp, Mus musculus
cttctctccctgagctaccagaaag

SEQ ID NO: 395914 - DNA, 25 bp, Mus musculus
cttctctccctgtgctaccagaaag

SEQ ID NO: 395915 - DNA, 25 bp, Mus musculus
cttctctcctatacacttgcatttg

SEQ ID NO: 395916 - DNA, 25 bp, Mus musculus
cttctctcctattcacttgcatttg

SEQ ID NO: 395917 - DNA, 25 bp, Mus musculus
cttctctcctgcaattggtttgtac

SEQ ID NO: 395918 - DNA, 25 bp, Mus musculus
cttctctcctgctattggtttgtac

SEQ ID NO: 395919 - DNA, 25 bp, Mus musculus
cttctctccttcacttaggatttag

SEQ ID NO: 395920 - DNA, 25 bp, Mus musculus
cttctctccttcagacactaggaag

SEQ ID NO: 395921 - DNA, 25 bp, Mus musculus
cttctctccttcatagcacattgag

SEQ ID NO: 395922 - DNA, 25 bp, Mus musculus
cttctctccttctcttaggatttag

SEQ ID NO: 395923 - DNA, 25 bp, Mus musculus
cttctctccttctgacactaggaag

SEQ ID NO: 395924 - DNA, 25 bp, Mus musculus
cttctctccttcttagcacattgag

SEQ ID NO: 395925 - DNA, 25 bp, Mus musculus
cttctctcgtgtcatccatgtggaa

SEQ ID NO: 395926 - DNA, 25 bp, Mus musculus
cttctctcgtgtgatccatgtggaa

SEQ ID NO: 395927 - DNA, 25 bp, Mus musculus
cttctctctaaccagcacagatagc

SEQ ID NO: 395928 - DNA, 25 bp, Mus musculus
cttctctctaacgagcacagatagc

SEQ ID NO: 395929 - DNA, 25 bp, Mus musculus
cttctctctagccaggacattgaca

SEQ ID NO: 395930 - DNA, 25 bp, Mus musculus
cttctctctagcgaggacattgaca

SEQ ID NO: 395931 - DNA, 25 bp, Mus musculus
cttctctctcccagaacgattaaga

SEQ ID NO: 395932 - DNA, 25 bp, Mus musculus
cttctctctccctgaacgattaaga

SEQ ID NO: 395933 - DNA, 25 bp, Mus musculus
cttctctctgaaacagctgccttag

SEQ ID NO: 395934 - DNA, 25 bp, Mus musculus
cttctctctgaatcagctgccttag

SEQ ID NO: 395935 - DNA, 25 bp, Mus musculus
cttctctctggaatggctcacagtg

SEQ ID NO: 395936 - DNA, 25 bp, Mus musculus
cttctctctggattggctcacagtg

SEQ ID NO: 395937 - DNA, 25 bp, Mus musculus
cttctctcttagagctcccagaact

SEQ ID NO: 395938 - DNA, 25 bp, Mus musculus
cttctctcttagtgctcccagaact

SEQ ID NO: 395939 - DNA, 25 bp, Mus musculus
cttctctcttcaactagctgtaagc

SEQ ID NO: 395940 - DNA, 25 bp, Mus musculus
cttctctcttcatctagctgtaagc

SEQ ID NO: 395941 - DNA, 25 bp, Mus musculus
cttctctcttccaggaaaaccaaag

SEQ ID NO: 395942 - DNA, 25 bp, Mus musculus
cttctctcttcctggaaaaccaaag

SEQ ID NO: 395943 - DNA, 25 bp, Mus musculus
cttctctcttctatcacttgtggct

SEQ ID NO: 395944 - DNA, 25 bp, Mus musculus
cttctctcttctttcacttgtggct

SEQ ID NO: 395945 - DNA, 25 bp, Mus musculus
cttctctcttgaatgggttgtcctc

SEQ ID NO: 395946 - DNA, 25 bp, Mus musculus
cttctctcttgattgggttgtcctc

SEQ ID NO: 395947 - DNA, 25 bp, Mus musculus
cttctctctttacctggcttaataa

SEQ ID NO: 395948 - DNA, 25 bp, Mus musculus
cttctctctttagctggcttaataa

SEQ ID NO: 395949 - DNA, 25 bp, Mus musculus
cttctctgaattctcactgctgata

SEQ ID NO: 395950 - DNA, 25 bp, Mus musculus
cttctctgaattgtcactgctgata

SEQ ID NO: 395951 - DNA, 25 bp, Mus musculus
cttctctgacacagtgggaagaaag

SEQ ID NO: 395952 - DNA, 25 bp, Mus musculus
cttctctgacactgtgggaagaaag

SEQ ID NO: 395953 - DNA, 25 bp, Mus musculus
cttctctgagatcgccccagtatgt

SEQ ID NO: 395954 - DNA, 25 bp, Mus musculus
cttctctgagatggccccagtatgt

SEQ ID NO: 395955 - DNA, 25 bp, Mus musculus
cttctctgagctccgttcactcgta

SEQ ID NO: 395956 - DNA, 25 bp, Mus musculus
cttctctgagctgcgttcactcgta

SEQ ID NO: 395957 - DNA, 25 bp, Mus musculus
cttctctgaggacctactgtgacct

SEQ ID NO: 395958 - DNA, 25 bp, Mus musculus
cttctctgaggagctactgtgacct

SEQ ID NO: 395959 - DNA, 25 bp, Mus musculus
cttctctgaggcagattggtgggca

SEQ ID NO: 395960 - DNA, 25 bp, Mus musculus
cttctctgaggctgattggtgggca

SEQ ID NO: 395961 - DNA, 25 bp, Mus musculus
cttctctgcatactttttggattca

SEQ ID NO: 395962 - DNA, 25 bp, Mus musculus
cttctctgcatagtttttggattca

SEQ ID NO: 395963 - DNA, 25 bp, Mus musculus
cttctctgcatgagtgggactgggt

SEQ ID NO: 395964 - DNA, 25 bp, Mus musculus
cttctctgcatgatatcagtgtatt

SEQ ID NO: 395965 - DNA, 25 bp, Mus musculus
cttctctgcatgtgtgggactgggt

SEQ ID NO: 395966 - DNA, 25 bp, Mus musculus
cttctctgcatgttatcagtgtatt

SEQ ID NO: 395967 - DNA, 25 bp, Mus musculus
cttctctgccaacggtagagttgct

SEQ ID NO: 395968 - DNA, 25 bp, Mus musculus
cttctctgccaagggtagagttgct

SEQ ID NO: 395969 - DNA, 25 bp, Mus musculus
cttctctgcggtagtctgactggac

SEQ ID NO: 395970 - DNA, 25 bp, Mus musculus
cttctctgcggttgtctgactggac

SEQ ID NO: 395971 - DNA, 25 bp, Mus musculus
cttctctggacaagtaggctctggc

SEQ ID NO: 395972 - DNA, 25 bp, Mus musculus
cttctctggacatgtaggctctggc

SEQ ID NO: 395973 - DNA, 25 bp, Mus musculus
cttctctggctgcttataaactacc

SEQ ID NO: 395974 - DNA, 25 bp, Mus musculus
cttctctggctggttataaactacc

SEQ ID NO: 395975 - DNA, 25 bp, Mus musculus
cttctctggtggcagcaacgagggt

SEQ ID NO: 395976 - DNA, 25 bp, Mus musculus
cttctctggtgggagcaacgagggt

SEQ ID NO: 395977 - DNA, 25 bp, Mus musculus
cttctctgtgcaattagctgggaat

SEQ ID NO: 395978 - DNA, 25 bp, Mus musculus
cttctctgtgcatttagctgggaat

SEQ ID NO: 395979 - DNA, 25 bp, Mus musculus
cttctctgtgccctcaaatttcaga

SEQ ID NO: 395980 - DNA, 25 bp, Mus musculus
cttctctgtgccgtcaaatttcaga

SEQ ID NO: 395981 - DNA, 25 bp, Mus musculus
cttctctgtgtaaaggcgattccct

SEQ ID NO: 395982 - DNA, 25 bp, Mus musculus
cttctctgtgtataggcgattccct

SEQ ID NO: 395983 - DNA, 25 bp, Mus musculus
cttctctgttggagtggcttgggca

SEQ ID NO: 395984 - DNA, 25 bp, Mus musculus
cttctctgttggtgtggcttgggca

SEQ ID NO: 395985 - DNA, 25 bp, Mus musculus
cttctcttacttactgcccattgac

SEQ ID NO: 395986 - DNA, 25 bp, Mus musculus
cttctcttactttctgcccattgac

SEQ ID NO: 395987 - DNA, 25 bp, Mus musculus
cttctcttcagacaggaagggcaat

SEQ ID NO: 395988 - DNA, 25 bp, Mus musculus
cttctcttcagagaggaagggcaat

SEQ ID NO: 395989 - DNA, 25 bp, Mus musculus
cttctcttcattattatcttccggt

SEQ ID NO: 395990 - DNA, 25 bp, Mus musculus
cttctcttcattattcacttcttat

SEQ ID NO: 395991 - DNA, 25 bp, Mus musculus
cttctcttcatttttatcttccggt

SEQ ID NO: 395992 - DNA, 25 bp, Mus musculus
cttctcttcatttttcacttcttat

SEQ ID NO: 395993 - DNA, 25 bp, Mus musculus
cttctcttccacctgaatggttgaa

SEQ ID NO: 395994 - DNA, 25 bp, Mus musculus
cttctcttccacgtgaatggttgaa

SEQ ID NO: 395995 - DNA, 25 bp, Mus musculus
cttctcttccagatgtatagtacag

SEQ ID NO: 395996 - DNA, 25 bp, Mus musculus
cttctcttccagttgtatagtacag

SEQ ID NO: 395997 - DNA, 25 bp, Mus musculus
cttctcttccatcaatttctttatc

SEQ ID NO: 395998 - DNA, 25 bp, Mus musculus
cttctcttccatgaatttctttatc

SEQ ID NO: 395999 - DNA, 25 bp, Mus musculus
cttctcttcctgctaaagcttcaaa

SEQ ID NO: 396000 - DNA, 25 bp, Mus musculus
cttctcttcctggtaaagcttcaaa

SEQ ID NO: 396001 - DNA, 25 bp, Mus musculus
cttctcttctccagcatctattaaa

SEQ ID NO: 396002 - DNA, 25 bp, Mus musculus
cttctcttctcctgcatctattaaa

SEQ ID NO: 396003 - DNA, 25 bp, Mus musculus
cttctcttctgtcatgtcataaatg

SEQ ID NO: 396004 - DNA, 25 bp, Mus musculus
cttctcttctgtgatgtcataaatg

SEQ ID NO: 396005 - DNA, 25 bp, Mus musculus
cttctcttgagaccttgggatgctg

SEQ ID NO: 396006 - DNA, 25 bp, Mus musculus
cttctcttgagagcttgggatgctg

SEQ ID NO: 396007 - DNA, 25 bp, Mus musculus
cttctcttgctaaaatctggccttt

SEQ ID NO: 396008 - DNA, 25 bp, Mus musculus
cttctcttgctataatctggccttt

SEQ ID NO: 396009 - DNA, 25 bp, Mus musculus
cttctcttgctgaaaccattcacaa

SEQ ID NO: 396010 - DNA, 25 bp, Mus musculus
cttctcttgctgtaaccattcacaa

SEQ ID NO: 396011 - DNA, 25 bp, Mus musculus
cttctcttgtggcatgcatgactct

SEQ ID NO: 396012 - DNA, 25 bp, Mus musculus
cttctcttgtgggatgcatgactct

SEQ ID NO: 396013 - DNA, 25 bp, Mus musculus
cttctcttgttcaggattcacttta

SEQ ID NO: 396014 - DNA, 25 bp, Mus musculus
cttctcttgttctggattcacttta

SEQ ID NO: 396015 - DNA, 25 bp, Mus musculus
cttctctttagcaggaactcactac

SEQ ID NO: 396016 - DNA, 25 bp, Mus musculus
cttctctttagctggaactcactac

SEQ ID NO: 396017 - DNA, 25 bp, Mus musculus
cttctctttcatacagcctaattat

SEQ ID NO: 396018 - DNA, 25 bp, Mus musculus
cttctctttcattcagcctaattat

SEQ ID NO: 396019 - DNA, 25 bp, Mus musculus
cttctctttgatctggaggaaacca

SEQ ID NO: 396020 - DNA, 25 bp, Mus musculus
cttctctttgatgtggaggaaacca

SEQ ID NO: 396021 - DNA, 25 bp, Mus musculus
cttctgaaacacaaagggccctctt

SEQ ID NO: 396022 - DNA, 25 bp, Mus musculus
cttctgaaacactaagggccctctt

SEQ ID NO: 396023 - DNA, 25 bp, Mus musculus
cttctgaaagaaatgggcccatctg

SEQ ID NO: 396024 - DNA, 25 bp, Mus musculus
cttctgaaagaattgggcccatctg

SEQ ID NO: 396025 - DNA, 25 bp, Mus musculus
cttctgacagcaataatttcccatg

SEQ ID NO: 396026 - DNA, 25 bp, Mus musculus
cttctgacagcattaatttcccatg

SEQ ID NO: 396027 - DNA, 25 bp, Mus musculus
cttctgacatgccagttaagtctct

SEQ ID NO: 396028 - DNA, 25 bp, Mus musculus
cttctgacatgcgagttaagtctct

SEQ ID NO: 396029 - DNA, 25 bp, Mus musculus
cttctgaccccacgactacatactt

SEQ ID NO: 396030 - DNA, 25 bp, Mus musculus
cttctgaccccaggactacatactt

SEQ ID NO: 396031 - DNA, 25 bp, Mus musculus
cttctgacccggagggcgggcctga

SEQ ID NO: 396032 - DNA, 25 bp, Mus musculus
cttctgacccggtgggcgggcctga

SEQ ID NO: 396033 - DNA, 25 bp, Mus musculus
cttctgaccgcaccaagtgttcttg

SEQ ID NO: 396034 - DNA, 25 bp, Mus musculus
cttctgaccgcagcaagtgttcttg

SEQ ID NO: 396035 - DNA, 25 bp, Mus musculus
cttctgacctctacttctatagtga

SEQ ID NO: 396036 - DNA, 25 bp, Mus musculus
cttctgacctctcagaacactagga

SEQ ID NO: 396037 - DNA, 25 bp, Mus musculus
cttctgacctctgagaacactagga

SEQ ID NO: 396038 - DNA, 25 bp, Mus musculus
cttctgacctcttcttctatagtga

SEQ ID NO: 396039 - DNA, 25 bp, Mus musculus
cttctgaccttgactacatctcata

SEQ ID NO: 396040 - DNA, 25 bp, Mus musculus
cttctgaccttgtctacatctcata

SEQ ID NO: 396041 - DNA, 25 bp, Mus musculus
cttctgactctcagactacaatatt

SEQ ID NO: 396042 - DNA, 25 bp, Mus musculus
cttctgactctctgactacaatatt

SEQ ID NO: 396043 - DNA, 25 bp, Mus musculus
cttctgacttggctttgccattttt

SEQ ID NO: 396044 - DNA, 25 bp, Mus musculus
cttctgacttgggtttgccattttt

SEQ ID NO: 396045 - DNA, 25 bp, Mus musculus
cttctgagaaagatccagcccatca

SEQ ID NO: 396046 - DNA, 25 bp, Mus musculus
cttctgagaaagttccagcccatca

SEQ ID NO: 396047 - DNA, 25 bp, Mus musculus
cttctgagctttacctgcaacagga

SEQ ID NO: 396048 - DNA, 25 bp, Mus musculus
cttctgagcttttcctgcaacagga

SEQ ID NO: 396049 - DNA, 25 bp, Mus musculus
cttctgaggcttcagctcacagcag

SEQ ID NO: 396050 - DNA, 25 bp, Mus musculus
cttctgaggcttgagctcacagcag

SEQ ID NO: 396051 - DNA, 25 bp, Mus musculus
cttctgagtcagcagtactgtccct

SEQ ID NO: 396052 - DNA, 25 bp, Mus musculus
cttctgagtcaggagtactgtccct

SEQ ID NO: 396053 - DNA, 25 bp, Mus musculus
cttctgagtgctcggtaccaccata

SEQ ID NO: 396054 - DNA, 25 bp, Mus musculus
cttctgagtgctgggtaccaccata

SEQ ID NO: 396055 - DNA, 25 bp, Mus musculus
cttctgatagaaccactgcaatatg

SEQ ID NO: 396056 - DNA, 25 bp, Mus musculus
cttctgatagaagcactgcaatatg

SEQ ID NO: 396057 - DNA, 25 bp, Mus musculus
cttctgattgaaaagcctctgcttg

SEQ ID NO: 396058 - DNA, 25 bp, Mus musculus
cttctgattgaatagcctctgcttg

SEQ ID NO: 396059 - DNA, 25 bp, Mus musculus
cttctgattttcacctcaaacaggc

SEQ ID NO: 396060 - DNA, 25 bp, Mus musculus
cttctgattttctcctcaaacaggc

SEQ ID NO: 396061 - DNA, 25 bp, Mus musculus
cttctgcaacatcagtactctaggg

SEQ ID NO: 396062 - DNA, 25 bp, Mus musculus
cttctgcaacatgagtactctaggg

SEQ ID NO: 396063 - DNA, 25 bp, Mus musculus
cttctgcaagaacagtgctagtgct

SEQ ID NO: 396064 - DNA, 25 bp, Mus musculus
cttctgcaagaagagtgctagtgct

SEQ ID NO: 396065 - DNA, 25 bp, Mus musculus
cttctgcaagacatttctctttctg

SEQ ID NO: 396066 - DNA, 25 bp, Mus musculus
cttctgcaagacttttctctttctg

SEQ ID NO: 396067 - DNA, 25 bp, Mus musculus
cttctgcacacacccaaaatgacat

SEQ ID NO: 396068 - DNA, 25 bp, Mus musculus
cttctgcacacagccaaaatgacat

SEQ ID NO: 396069 - DNA, 25 bp, Mus musculus
cttctgcacagacctcagcgaggag

SEQ ID NO: 396070 - DNA, 25 bp, Mus musculus
cttctgcacagagctcagcgaggag

SEQ ID NO: 396071 - DNA, 25 bp, Mus musculus
cttctgcagctactctgatcaacat

SEQ ID NO: 396072 - DNA, 25 bp, Mus musculus
cttctgcagctagtctgatcaacat

SEQ ID NO: 396073 - DNA, 25 bp, Mus musculus
cttctgccaaaacccacagtggtta

SEQ ID NO: 396074 - DNA, 25 bp, Mus musculus
cttctgccaaaagccacagtggtta

SEQ ID NO: 396075 - DNA, 25 bp, Mus musculus
cttctgcccagcatgacttcttaat

SEQ ID NO: 396076 - DNA, 25 bp, Mus musculus
cttctgcccagcttgacttcttaat

SEQ ID NO: 396077 - DNA, 25 bp, Mus musculus
cttctgcccatcatctgagttgtaa

SEQ ID NO: 396078 - DNA, 25 bp, Mus musculus
cttctgcccatcttctgagttgtaa

SEQ ID NO: 396079 - DNA, 25 bp, Mus musculus
cttctgcccattccctgaaacgaag

SEQ ID NO: 396080 - DNA, 25 bp, Mus musculus
cttctgcccattgcctgaaacgaag

SEQ ID NO: 396081 - DNA, 25 bp, Mus musculus
cttctgccctctctagatagtatat

SEQ ID NO: 396082 - DNA, 25 bp, Mus musculus
cttctgccctctgtagatagtatat

SEQ ID NO: 396083 - DNA, 25 bp, Mus musculus
cttctgcctcttccctgtggattag

SEQ ID NO: 396084 - DNA, 25 bp, Mus musculus
cttctgcctcttgcctgtggattag

SEQ ID NO: 396085 - DNA, 25 bp, Mus musculus
cttctgcctgagagacttttgggta

SEQ ID NO: 396086 - DNA, 25 bp, Mus musculus
cttctgcctgagtgacttttgggta

SEQ ID NO: 396087 - DNA, 25 bp, Mus musculus
cttctgcctgcgacttaaaaaataa

SEQ ID NO: 396088 - DNA, 25 bp, Mus musculus
cttctgcctgcgtcttaaaaaataa

SEQ ID NO: 396089 - DNA, 25 bp, Mus musculus
cttctgccttggagtgtccatgaaa

SEQ ID NO: 396090 - DNA, 25 bp, Mus musculus
cttctgccttggtgtgtccatgaaa

SEQ ID NO: 396091 - DNA, 25 bp, Mus musculus
cttctgcgattcattggagctgatg

SEQ ID NO: 396092 - DNA, 25 bp, Mus musculus
cttctgcgattctttggagctgatg

SEQ ID NO: 396093 - DNA, 25 bp, Mus musculus
cttctgcgccatcacttctttcaaa

SEQ ID NO: 396094 - DNA, 25 bp, Mus musculus
cttctgcgccatgacttctttcaaa

SEQ ID NO: 396095 - DNA, 25 bp, Mus musculus
cttctgctacacacctctgtgattt

SEQ ID NO: 396096 - DNA, 25 bp, Mus musculus
cttctgctacactcctctgtgattt

SEQ ID NO: 396097 - DNA, 25 bp, Mus musculus
cttctgctcctgatgcagctatagt

SEQ ID NO: 396098 - DNA, 25 bp, Mus musculus
cttctgctcctgttgcagctatagt

SEQ ID NO: 396099 - DNA, 25 bp, Mus musculus
cttctgctcttgctaaggttgacat

SEQ ID NO: 396100 - DNA, 25 bp, Mus musculus
cttctgctcttggtaaggttgacat

SEQ ID NO: 396101 - DNA, 25 bp, Mus musculus
cttctgctggtcagctgatgggtag

SEQ ID NO: 396102 - DNA, 25 bp, Mus musculus
cttctgctggtctgctgatgggtag

SEQ ID NO: 396103 - DNA, 25 bp, Mus musculus
cttctgctttcaagtcttgtgtata

SEQ ID NO: 396104 - DNA, 25 bp, Mus musculus
cttctgctttcatgtcttgtgtata

SEQ ID NO: 396105 - DNA, 25 bp, Mus musculus
cttctgctttccaacaccaaatgta

SEQ ID NO: 396106 - DNA, 25 bp, Mus musculus
cttctgctttcctacaccaaatgta

SEQ ID NO: 396107 - DNA, 25 bp, Mus musculus
cttctggaatctcagctgatgcttc

SEQ ID NO: 396108 - DNA, 25 bp, Mus musculus
cttctggaatctgagctgatgcttc

SEQ ID NO: 396109 - DNA, 25 bp, Mus musculus
cttctggacaagaccctgaggaggg

SEQ ID NO: 396110 - DNA, 25 bp, Mus musculus
cttctggacaagtccctgaggaggg

SEQ ID NO: 396111 - DNA, 25 bp, Mus musculus
cttctggacccaccgtgaggatgga

SEQ ID NO: 396112 - DNA, 25 bp, Mus musculus
cttctggacccagcgtgaggatgga

SEQ ID NO: 396113 - DNA, 25 bp, Mus musculus
cttctggacctaatgatttgagttg

SEQ ID NO: 396114 - DNA, 25 bp, Mus musculus
cttctggacctattgatttgagttg

SEQ ID NO: 396115 - DNA, 25 bp, Mus musculus
cttctggacctcaaccaacaatatg

SEQ ID NO: 396116 - DNA, 25 bp, Mus musculus
cttctggacctctaccaacaatatg

SEQ ID NO: 396117 - DNA, 25 bp, Mus musculus
cttctggaggaacagcgtgctcagt

SEQ ID NO: 396118 - DNA, 25 bp, Mus musculus
cttctggaggaagagcgtgctcagt

SEQ ID NO: 396119 - DNA, 25 bp, Mus musculus
cttctggaggccagcattacaaact

SEQ ID NO: 396120 - DNA, 25 bp, Mus musculus
cttctggaggcctgcattacaaact

SEQ ID NO: 396121 - DNA, 25 bp, Mus musculus
cttctggaggtaacagatgatccac

SEQ ID NO: 396122 - DNA, 25 bp, Mus musculus
cttctggaggtatcagatgatccac

SEQ ID NO: 396123 - DNA, 25 bp, Mus musculus
cttctggatggcactttctgccagg

SEQ ID NO: 396124 - DNA, 25 bp, Mus musculus
cttctggatggctctttctgccagg

SEQ ID NO: 396125 - DNA, 25 bp, Mus musculus
cttctggcaagacgtgcggacatca

SEQ ID NO: 396126 - DNA, 25 bp, Mus musculus
cttctggcaagaggtgcggacatca

SEQ ID NO: 396127 - DNA, 25 bp, Mus musculus
cttctggcactcatggacaatattc

SEQ ID NO: 396128 - DNA, 25 bp, Mus musculus
cttctggcactcttggacaatattc

SEQ ID NO: 396129 - DNA, 25 bp, Mus musculus
cttctggcagaaaagctcttgctgt

SEQ ID NO: 396130 - DNA, 25 bp, Mus musculus
cttctggcagaatagctcttgctgt

SEQ ID NO: 396131 - DNA, 25 bp, Mus musculus
cttctggcaggaacttggcaaccta

SEQ ID NO: 396132 - DNA, 25 bp, Mus musculus
cttctggcaggatcttggcaaccta

SEQ ID NO: 396133 - DNA, 25 bp, Mus musculus
cttctggccgctcgagacaaggatg

SEQ ID NO: 396134 - DNA, 25 bp, Mus musculus
cttctggccgctggagacaaggatg

SEQ ID NO: 396135 - DNA, 25 bp, Mus musculus
cttctggcgcaaagttacccaggat

SEQ ID NO: 396136 - DNA, 25 bp, Mus musculus
cttctggcgcaatgttacccaggat

SEQ ID NO: 396137 - DNA, 25 bp, Mus musculus
cttctggctcatatgtcacttatac

SEQ ID NO: 396138 - DNA, 25 bp, Mus musculus
cttctggctcatttgtcacttatac

SEQ ID NO: 396139 - DNA, 25 bp, Mus musculus
cttctggcttggagtttctaacatt

SEQ ID NO: 396140 - DNA, 25 bp, Mus musculus
cttctggcttggtgtttctaacatt

SEQ ID NO: 396141 - DNA, 25 bp, Mus musculus
cttctggctttcaaggaactgcaca

SEQ ID NO: 396142 - DNA, 25 bp, Mus musculus
cttctggctttctaggaactgcaca

SEQ ID NO: 396143 - DNA, 25 bp, Mus musculus
cttctgggagttctactgctagtaa

SEQ ID NO: 396144 - DNA, 25 bp, Mus musculus
cttctgggagttgtactgctagtaa

SEQ ID NO: 396145 - DNA, 25 bp, Mus musculus
cttctgggatggactcctctggaaa

SEQ ID NO: 396146 - DNA, 25 bp, Mus musculus
cttctgggatggtctcctctggaaa

SEQ ID NO: 396147 - DNA, 25 bp, Mus musculus
cttctgggcaaacccttgcgagtca

SEQ ID NO: 396148 - DNA, 25 bp, Mus musculus
cttctgggcaaagccttgcgagtca

SEQ ID NO: 396149 - DNA, 25 bp, Mus musculus
cttctgggcacaccctaaggttgtt

SEQ ID NO: 396150 - DNA, 25 bp, Mus musculus
cttctgggcacagcctaaggttgtt

SEQ ID NO: 396151 - DNA, 25 bp, Mus musculus
cttctgggcgggatgatgacattga

SEQ ID NO: 396152 - DNA, 25 bp, Mus musculus
cttctgggcgggttgatgacattga

SEQ ID NO: 396153 - DNA, 25 bp, Mus musculus
cttctgggctacaaacagggcctgg

SEQ ID NO: 396154 - DNA, 25 bp, Mus musculus
cttctgggctactaacagggcctgg

SEQ ID NO: 396155 - DNA, 25 bp, Mus musculus
cttctgggtgcaaaccagtcttacc

SEQ ID NO: 396156 - DNA, 25 bp, Mus musculus
cttctgggtgcataccagtcttacc

SEQ ID NO: 396157 - DNA, 25 bp, Mus musculus
cttctggtactacagcaacttccta

SEQ ID NO: 396158 - DNA, 25 bp, Mus musculus
cttctggtactagagcaacttccta

SEQ ID NO: 396159 - DNA, 25 bp, Mus musculus
cttctggtatgtctggagagcaaca

SEQ ID NO: 396160 - DNA, 25 bp, Mus musculus
cttctggtatgtgtggagagcaaca

SEQ ID NO: 396161 - DNA, 25 bp, Mus musculus
cttctggtctagagagtcctgagag

SEQ ID NO: 396162 - DNA, 25 bp, Mus musculus
cttctggtctagtgagtcctgagag

SEQ ID NO: 396163 - DNA, 25 bp, Mus musculus
cttctggtgaggagaaaggactgaa

SEQ ID NO: 396164 - DNA, 25 bp, Mus musculus
cttctggtgaggtgaaaggactgaa

SEQ ID NO: 396165 - DNA, 25 bp, Mus musculus
cttctggtgatgcttagtctcctac

SEQ ID NO: 396166 - DNA, 25 bp, Mus musculus
cttctggtgatggttagtctcctac

SEQ ID NO: 396167 - DNA, 25 bp, Mus musculus
cttctggtgcagagctgtagtttct

SEQ ID NO: 396168 - DNA, 25 bp, Mus musculus
cttctggtgcagtgctgtagtttct

SEQ ID NO: 396169 - DNA, 25 bp, Mus musculus
cttctggtgcttcggtttttcctag

SEQ ID NO: 396170 - DNA, 25 bp, Mus musculus
cttctggtgcttgggtttttcctag

SEQ ID NO: 396171 - DNA, 25 bp, Mus musculus
cttctggtggctcttgttgtcaagt

SEQ ID NO: 396172 - DNA, 25 bp, Mus musculus
cttctggtggctgttgttgtcaagt

SEQ ID NO: 396173 - DNA, 25 bp, Mus musculus
cttctggtggtaaacatgccttttt

SEQ ID NO: 396174 - DNA, 25 bp, Mus musculus
cttctggtggtatacatgccttttt

SEQ ID NO: 396175 - DNA, 25 bp, Mus musculus
cttctggtggtcattaatgagccct

SEQ ID NO: 396176 - DNA, 25 bp, Mus musculus
cttctggtggtctttaatgagccct

SEQ ID NO: 396177 - DNA, 25 bp, Mus musculus
cttctggtgtaaattgtctcattga

SEQ ID NO: 396178 - DNA, 25 bp, Mus musculus
cttctggtgtaatttgtctcattga

SEQ ID NO: 396179 - DNA, 25 bp, Mus musculus
cttctggtgtgtctgaagacagcta

SEQ ID NO: 396180 - DNA, 25 bp, Mus musculus
cttctggtgtgtgtgaagacagcta

SEQ ID NO: 396181 - DNA, 25 bp, Mus musculus
cttctggttccaaaacacgactatg

SEQ ID NO: 396182 - DNA, 25 bp, Mus musculus
cttctggttccacaccttcaggatt

SEQ ID NO: 396183 - DNA, 25 bp, Mus musculus
cttctggttccagaccttcaggatt

SEQ ID NO: 396184 - DNA, 25 bp, Mus musculus
cttctggttccataacacgactatg

SEQ ID NO: 396185 - DNA, 25 bp, Mus musculus
cttctggttgccacagactccaggg

SEQ ID NO: 396186 - DNA, 25 bp, Mus musculus
cttctggttgcctcagactccaggg

SEQ ID NO: 396187 - DNA, 25 bp, Mus musculus
cttctgtaaaagaccaccgatgctg

SEQ ID NO: 396188 - DNA, 25 bp, Mus musculus
cttctgtaaaagtccaccgatgctg

SEQ ID NO: 396189 - DNA, 25 bp, Mus musculus
cttctgtaaccacttttccatttca

SEQ ID NO: 396190 - DNA, 25 bp, Mus musculus
cttctgtaaccagttttccatttca

SEQ ID NO: 396191 - DNA, 25 bp, Mus musculus
cttctgtaagaaatgcatcctgcgc

SEQ ID NO: 396192 - DNA, 25 bp, Mus musculus
cttctgtaagaattgcatcctgcgc

SEQ ID NO: 396193 - DNA, 25 bp, Mus musculus
cttctgtacctgactttgggcaaca

SEQ ID NO: 396194 - DNA, 25 bp, Mus musculus
cttctgtacctgtctttgggcaaca

SEQ ID NO: 396195 - DNA, 25 bp, Mus musculus
cttctgtaggctccgttctgctggg

SEQ ID NO: 396196 - DNA, 25 bp, Mus musculus
cttctgtaggctgcgttctgctggg

SEQ ID NO: 396197 - DNA, 25 bp, Mus musculus
cttctgtaggtcagatggttctgtt

SEQ ID NO: 396198 - DNA, 25 bp, Mus musculus
cttctgtaggtctgatggttctgtt

SEQ ID NO: 396199 - DNA, 25 bp, Mus musculus
cttctgtagttgaccctcattacaa

SEQ ID NO: 396200 - DNA, 25 bp, Mus musculus
cttctgtagttgtccctcattacaa

SEQ ID NO: 396201 - DNA, 25 bp, Mus musculus
cttctgtatcagatgtggtgtcctt

SEQ ID NO: 396202 - DNA, 25 bp, Mus musculus
cttctgtatcagttgtggtgtcctt

SEQ ID NO: 396203 - DNA, 25 bp, Mus musculus
cttctgtcagcccatctgtaaaagg

SEQ ID NO: 396204 - DNA, 25 bp, Mus musculus
cttctgtcagccgatctgtaaaagg

SEQ ID NO: 396205 - DNA, 25 bp, Mus musculus
cttctgtcagtgccagtcctgtctc

SEQ ID NO: 396206 - DNA, 25 bp, Mus musculus
cttctgtcagtggcagtcctgtctc

SEQ ID NO: 396207 - DNA, 25 bp, Mus musculus
cttctgtccccaaattaataggtag

SEQ ID NO: 396208 - DNA, 25 bp, Mus musculus
cttctgtccccatattaataggtag

SEQ ID NO: 396209 - DNA, 25 bp, Mus musculus
cttctgtcggtgatctgtctgagga

SEQ ID NO: 396210 - DNA, 25 bp, Mus musculus
cttctgtcggtgttctgtctgagga

SEQ ID NO: 396211 - DNA, 25 bp, Mus musculus
cttctgtcgttgatcacttgtcaga

SEQ ID NO: 396212 - DNA, 25 bp, Mus musculus
cttctgtcgttgttcacttgtcaga

SEQ ID NO: 396213 - DNA, 25 bp, Mus musculus
cttctgtctaccagggaacccgatg

SEQ ID NO: 396214 - DNA, 25 bp, Mus musculus
cttctgtctacctgggaacccgatg

SEQ ID NO: 396215 - DNA, 25 bp, Mus musculus
cttctgtcttcaagtggttttgggt

SEQ ID NO: 396216 - DNA, 25 bp, Mus musculus
cttctgtcttcatgtggttttgggt

SEQ ID NO: 396217 - DNA, 25 bp, Mus musculus
cttctgtcttccattgttaatgtgg

SEQ ID NO: 396218 - DNA, 25 bp, Mus musculus
cttctgtcttcctttgttaatgtgg

SEQ ID NO: 396219 - DNA, 25 bp, Mus musculus
cttctgtgaccgagtgcgctagaaa

SEQ ID NO: 396220 - DNA, 25 bp, Mus musculus
cttctgtgaccgtgtgcgctagaaa

SEQ ID NO: 396221 - DNA, 25 bp, Mus musculus
cttctgtgacttctgccttaagttt

SEQ ID NO: 396222 - DNA, 25 bp, Mus musculus
cttctgtgacttgtgccttaagttt

SEQ ID NO: 396223 - DNA, 25 bp, Mus musculus
cttctgtgagcgctttcccgaggat

SEQ ID NO: 396224 - DNA, 25 bp, Mus musculus
cttctgtgagcggtttcccgaggat

SEQ ID NO: 396225 - DNA, 25 bp, Mus musculus
cttctgtgatacagaggagagccca

SEQ ID NO: 396226 - DNA, 25 bp, Mus musculus
cttctgtgatactgaggagagccca

SEQ ID NO: 396227 - DNA, 25 bp, Mus musculus
cttctgtgccagcagtggagcaggg

SEQ ID NO: 396228 - DNA, 25 bp, Mus musculus
cttctgtgccaggagtggagcaggg

SEQ ID NO: 396229 - DNA, 25 bp, Mus musculus
cttctgtggtcccaatgtgataaac

SEQ ID NO: 396230 - DNA, 25 bp, Mus musculus
cttctgtggtccgaatgtgataaac

SEQ ID NO: 396231 - DNA, 25 bp, Mus musculus
cttctgtggtctcatctttgtcttt

SEQ ID NO: 396232 - DNA, 25 bp, Mus musculus
cttctgtggtctgatctttgtcttt

SEQ ID NO: 396233 - DNA, 25 bp, Mus musculus
cttctgtgtacaatgctataggatc

SEQ ID NO: 396234 - DNA, 25 bp, Mus musculus
cttctgtgtacattgctataggatc

SEQ ID NO: 396235 - DNA, 25 bp, Mus musculus
cttctgtgtgatagctgtgtcatta

SEQ ID NO: 396236 - DNA, 25 bp, Mus musculus
cttctgtgtgattgctgtgtcatta

SEQ ID NO: 396237 - DNA, 25 bp, Mus musculus
cttctgtgtgctcctaatcttattt

SEQ ID NO: 396238 - DNA, 25 bp, Mus musculus
cttctgtgtgctgctaatcttattt

SEQ ID NO: 396239 - DNA, 25 bp, Mus musculus
cttctgtgttctatgttggtattgg

SEQ ID NO: 396240 - DNA, 25 bp, Mus musculus
cttctgtgttctttgttggtattgg

SEQ ID NO: 396241 - DNA, 25 bp, Mus musculus
cttctgttaaacattatgaccatat

SEQ ID NO: 396242 - DNA, 25 bp, Mus musculus
cttctgttaaactttatgaccatat

SEQ ID NO: 396243 - DNA, 25 bp, Mus musculus
cttctgttaaatctgggctcggtct

SEQ ID NO: 396244 - DNA, 25 bp, Mus musculus
cttctgttaaatgtgggctcggtct

SEQ ID NO: 396245 - DNA, 25 bp, Mus musculus
cttctgttacaactgaagattttct

SEQ ID NO: 396246 - DNA, 25 bp, Mus musculus
cttctgttacaagtgaagattttct

SEQ ID NO: 396247 - DNA, 25 bp, Mus musculus
cttctgttcaaactcaagtggtcat

SEQ ID NO: 396248 - DNA, 25 bp, Mus musculus
cttctgttcaaagtcaagtggtcat

SEQ ID NO: 396249 - DNA, 25 bp, Mus musculus
cttctgttcaagattccttagctgg

SEQ ID NO: 396250 - DNA, 25 bp, Mus musculus
cttctgttcaagtttccttagctgg

SEQ ID NO: 396251 - DNA, 25 bp, Mus musculus
cttctgttcctgagtagtatcagca

SEQ ID NO: 396252 - DNA, 25 bp, Mus musculus
cttctgttcctgtgtagtatcagca

SEQ ID NO: 396253 - DNA, 25 bp, Mus musculus
cttctgttctccagtgatttggtta

SEQ ID NO: 396254 - DNA, 25 bp, Mus musculus
cttctgttctcctgtgatttggtta

SEQ ID NO: 396255 - DNA, 25 bp, Mus musculus
cttctgttctcgcagcttgaattga

SEQ ID NO: 396256 - DNA, 25 bp, Mus musculus
cttctgttctcggagcttgaattga

SEQ ID NO: 396257 - DNA, 25 bp, Mus musculus
cttctgtttcctatttgggcactga

SEQ ID NO: 396258 - DNA, 25 bp, Mus musculus
cttctgtttcctttttgggcactga

SEQ ID NO: 396259 - DNA, 25 bp, Mus musculus
cttctgttttgcagttagtcttcac

SEQ ID NO: 396260 - DNA, 25 bp, Mus musculus
cttctgttttgctgttagtcttcac

SEQ ID NO: 396261 - DNA, 25 bp, Mus musculus
cttctgtttttgagaccaccaacac

SEQ ID NO: 396262 - DNA, 25 bp, Mus musculus
cttctgtttttgtgaccaccaacac

SEQ ID NO: 396263 - DNA, 25 bp, Mus musculus
cttcttaagcccaggtaaagcctgg

SEQ ID NO: 396264 - DNA, 25 bp, Mus musculus
cttcttaagccctggtaaagcctgg

SEQ ID NO: 396265 - DNA, 25 bp, Mus musculus
cttcttaagtgaactgtgacatttt

SEQ ID NO: 396266 - DNA, 25 bp, Mus musculus
cttcttaagtgatctgtgacatttt

SEQ ID NO: 396267 - DNA, 25 bp, Mus musculus
cttcttaatctcacactactctgaa

SEQ ID NO: 396268 - DNA, 25 bp, Mus musculus
cttcttaatctctcactactctgaa

SEQ ID NO: 396269 - DNA, 25 bp, Mus musculus
cttcttacatacctgctgttggaga

SEQ ID NO: 396270 - DNA, 25 bp, Mus musculus
cttcttacatacgtgctgttggaga

SEQ ID NO: 396271 - DNA, 25 bp, Mus musculus
cttcttaccactatgttttggcatc

SEQ ID NO: 396272 - DNA, 25 bp, Mus musculus
cttcttaccactttgttttggcatc

SEQ ID NO: 396273 - DNA, 25 bp, Mus musculus
cttcttaccccacgctatatgatgt

SEQ ID NO: 396274 - DNA, 25 bp, Mus musculus
cttcttaccccaggctatatgatgt

SEQ ID NO: 396275 - DNA, 25 bp, Mus musculus
cttcttagactgagatgttcctgag

SEQ ID NO: 396276 - DNA, 25 bp, Mus musculus
cttcttagactgtgatgttcctgag

SEQ ID NO: 396277 - DNA, 25 bp, Mus musculus
cttcttagctaaccctggactacca

SEQ ID NO: 396278 - DNA, 25 bp, Mus musculus
cttcttagctaagcctggactacca

SEQ ID NO: 396279 - DNA, 25 bp, Mus musculus
cttcttaggctcagtcgtgtgactt

SEQ ID NO: 396280 - DNA, 25 bp, Mus musculus
cttcttaggctctgtcgtgtgactt

SEQ ID NO: 396281 - DNA, 25 bp, Mus musculus
cttcttaggtggcttataccttctt

SEQ ID NO: 396282 - DNA, 25 bp, Mus musculus
cttcttaggtgggttataccttctt

SEQ ID NO: 396283 - DNA, 25 bp, Mus musculus
cttcttagttgtcttccttttggag

SEQ ID NO: 396284 - DNA, 25 bp, Mus musculus
cttcttagttgtgttccttttggag

SEQ ID NO: 396285 - DNA, 25 bp, Mus musculus
cttcttataggcacttacatctgga

SEQ ID NO: 396286 - DNA, 25 bp, Mus musculus
cttcttataggctcttacatctgga

SEQ ID NO: 396287 - DNA, 25 bp, Mus musculus
cttcttatataccttaatgaaacat

SEQ ID NO: 396288 - DNA, 25 bp, Mus musculus
cttcttatatacgttaatgaaacat

SEQ ID NO: 396289 - DNA, 25 bp, Mus musculus
cttcttatcaagagctctctctttc

SEQ ID NO: 396290 - DNA, 25 bp, Mus musculus
cttcttatcaagtgctctctctttc

SEQ ID NO: 396291 - DNA, 25 bp, Mus musculus
cttcttatccctacagtttattatc

SEQ ID NO: 396292 - DNA, 25 bp, Mus musculus
cttcttatcccttcagtttattatc

SEQ ID NO: 396293 - DNA, 25 bp, Mus musculus
cttcttatctgtcccctatcaatta

SEQ ID NO: 396294 - DNA, 25 bp, Mus musculus
cttcttatctgtgccctatcaatta

SEQ ID NO: 396295 - DNA, 25 bp, Mus musculus
cttcttatgtggcttattacagtaa

SEQ ID NO: 396296 - DNA, 25 bp, Mus musculus
cttcttatgtgggttattacagtaa

SEQ ID NO: 396297 - DNA, 25 bp, Mus musculus
cttcttattctgatcaaggccctag

SEQ ID NO: 396298 - DNA, 25 bp, Mus musculus
cttcttattctgttcaaggccctag

SEQ ID NO: 396299 - DNA, 25 bp, Mus musculus
cttcttattgctaaacccttcttat

SEQ ID NO: 396300 - DNA, 25 bp, Mus musculus
cttcttattgcttaacccttcttat

SEQ ID NO: 396301 - DNA, 25 bp, Mus musculus
cttcttattgttcctaaaactcgtg

SEQ ID NO: 396302 - DNA, 25 bp, Mus musculus
cttcttattgttgctaaaactcgtg

SEQ ID NO: 396303 - DNA, 25 bp, Mus musculus
cttcttatttcaagtccactcatcc

SEQ ID NO: 396304 - DNA, 25 bp, Mus musculus
cttcttatttcatgtccactcatcc

SEQ ID NO: 396305 - DNA, 25 bp, Mus musculus
cttcttcaaataaccactcctgtgg

SEQ ID NO: 396306 - DNA, 25 bp, Mus musculus
cttcttcaaatatccactcctgtgg

SEQ ID NO: 396307 - DNA, 25 bp, Mus musculus
cttcttcaagtcacagcagttacca

SEQ ID NO: 396308 - DNA, 25 bp, Mus musculus
cttcttcaagtctcagcagttacca

SEQ ID NO: 396309 - DNA, 25 bp, Mus musculus
cttcttcaattgagtgtcctgttaa

SEQ ID NO: 396310 - DNA, 25 bp, Mus musculus
cttcttcaattgtgtgtcctgttaa

SEQ ID NO: 396311 - DNA, 25 bp, Mus musculus
cttcttcacaaaagaggccttccct

SEQ ID NO: 396312 - DNA, 25 bp, Mus musculus
cttcttcacaaatgaggccttccct

SEQ ID NO: 396313 - DNA, 25 bp, Mus musculus
cttcttcactttaaccaagtctata

SEQ ID NO: 396314 - DNA, 25 bp, Mus musculus
cttcttcacttttaccaagtctata

SEQ ID NO: 396315 - DNA, 25 bp, Mus musculus
cttcttcagcttagagcgtgggcca

SEQ ID NO: 396316 - DNA, 25 bp, Mus musculus
cttcttcagctttgagcgtgggcca

SEQ ID NO: 396317 - DNA, 25 bp, Mus musculus
cttcttcaggctctcaagcacggga

SEQ ID NO: 396318 - DNA, 25 bp, Mus musculus
cttcttcaggctgtcaagcacggga

SEQ ID NO: 396319 - DNA, 25 bp, Mus musculus
cttcttcagttaacctcctcgtggg

SEQ ID NO: 396320 - DNA, 25 bp, Mus musculus
cttcttcagttatcctcctcgtggg

SEQ ID NO: 396321 - DNA, 25 bp, Mus musculus
cttcttcatctgcaggacgtcaagg

SEQ ID NO: 396322 - DNA, 25 bp, Mus musculus
cttcttcatctggaggacgtcaagg

SEQ ID NO: 396323 - DNA, 25 bp, Mus musculus
cttcttcattgacatcctgctggat

SEQ ID NO: 396324 - DNA, 25 bp, Mus musculus
cttcttcattgagatcctgctggat

SEQ ID NO: 396325 - DNA, 25 bp, Mus musculus
cttcttccaacccattagatgctga

SEQ ID NO: 396326 - DNA, 25 bp, Mus musculus
cttcttccaaccgattagatgctga

SEQ ID NO: 396327 - DNA, 25 bp, Mus musculus
cttcttccactcaaggtttctacaa

SEQ ID NO: 396328 - DNA, 25 bp, Mus musculus
cttcttccactctaggtttctacaa

SEQ ID NO: 396329 - DNA, 25 bp, Mus musculus
cttcttccagaacggtgagcacctg

SEQ ID NO: 396330 - DNA, 25 bp, Mus musculus
cttcttccagaagggtgagcacctg

SEQ ID NO: 396331 - DNA, 25 bp, Mus musculus
cttcttccagtgattctgctgagga

SEQ ID NO: 396332 - DNA, 25 bp, Mus musculus
cttcttccagtgtttctgctgagga

SEQ ID NO: 396333 - DNA, 25 bp, Mus musculus
cttcttccatccagagggctcttag

SEQ ID NO: 396334 - DNA, 25 bp, Mus musculus
cttcttccatcctgagggctcttag

SEQ ID NO: 396335 - DNA, 25 bp, Mus musculus
cttcttccatgtcggttgtggaaac

SEQ ID NO: 396336 - DNA, 25 bp, Mus musculus
cttcttccatgtgggttgtggaaac

SEQ ID NO: 396337 - DNA, 25 bp, Mus musculus
cttcttcccacacctaatttgtcta

SEQ ID NO: 396338 - DNA, 25 bp, Mus musculus
cttcttcccacagctaatttgtcta

SEQ ID NO: 396339 - DNA, 25 bp, Mus musculus
cttcttcccctccagggcgatttga

SEQ ID NO: 396340 - DNA, 25 bp, Mus musculus
cttcttcccctcgagggcgatttga

SEQ ID NO: 396341 - DNA, 25 bp, Mus musculus
cttcttccctggctagatatgtagt

SEQ ID NO: 396342 - DNA, 25 bp, Mus musculus
cttcttccctgggtagatatgtagt

SEQ ID NO: 396343 - DNA, 25 bp, Mus musculus
cttcttcccttaactgagctctgct

SEQ ID NO: 396344 - DNA, 25 bp, Mus musculus
cttcttcccttatctgagctctgct

SEQ ID NO: 396345 - DNA, 25 bp, Mus musculus
cttcttccgaatcgtggtggccaac

SEQ ID NO: 396346 - DNA, 25 bp, Mus musculus
cttcttccgaatggtggtggccaac

SEQ ID NO: 396347 - DNA, 25 bp, Mus musculus
cttcttccgcacactgatgtttgaa

SEQ ID NO: 396348 - DNA, 25 bp, Mus musculus
cttcttccgcactctgatgtttgaa

SEQ ID NO: 396349 - DNA, 25 bp, Mus musculus
cttcttcctcccaagagaacacata

SEQ ID NO: 396350 - DNA, 25 bp, Mus musculus
cttcttcctccctagagaacacata

SEQ ID NO: 396351 - DNA, 25 bp, Mus musculus
cttcttcctctgaaacatacgtgtg

SEQ ID NO: 396352 - DNA, 25 bp, Mus musculus
cttcttcctctgtaacatacgtgtg

SEQ ID NO: 396353 - DNA, 25 bp, Mus musculus
cttcttcctgagatatgctcatgta

SEQ ID NO: 396354 - DNA, 25 bp, Mus musculus
cttcttcctgagttatgctcatgta

SEQ ID NO: 396355 - DNA, 25 bp, Mus musculus
cttcttcctgtgcaggatgatccag

SEQ ID NO: 396356 - DNA, 25 bp, Mus musculus
cttcttcctgtggaggatgatccag

SEQ ID NO: 396357 - DNA, 25 bp, Mus musculus
cttcttcctgttatcagtagttctg

SEQ ID NO: 396358 - DNA, 25 bp, Mus musculus
cttcttcctgttttcagtagttctg

SEQ ID NO: 396359 - DNA, 25 bp, Mus musculus
cttcttccttccagaactgtaatta

SEQ ID NO: 396360 - DNA, 25 bp, Mus musculus
cttcttccttcctgaactgtaatta

SEQ ID NO: 396361 - DNA, 25 bp, Mus musculus
cttcttcgctctaattctatcaggg

SEQ ID NO: 396362 - DNA, 25 bp, Mus musculus
cttcttcgctcttattctatcaggg

SEQ ID NO: 396363 - DNA, 25 bp, Mus musculus
cttcttcgtcatcttgtggttccaa

SEQ ID NO: 396364 - DNA, 25 bp, Mus musculus
cttcttcgtcatgttgtggttccaa

SEQ ID NO: 396365 - DNA, 25 bp, Mus musculus
cttcttcgtgaaagcatttttgcta

SEQ ID NO: 396366 - DNA, 25 bp, Mus musculus
cttcttcgtgaatgcatttttgcta

SEQ ID NO: 396367 - DNA, 25 bp, Mus musculus
cttcttctaaatatttcaggatgga

SEQ ID NO: 396368 - DNA, 25 bp, Mus musculus
cttcttctaaatttttcaggatgga

SEQ ID NO: 396369 - DNA, 25 bp, Mus musculus
cttcttctaaggctttgtttgggca

SEQ ID NO: 396370 - DNA, 25 bp, Mus musculus
cttcttctaagggtttgtttgggca

SEQ ID NO: 396371 - DNA, 25 bp, Mus musculus
cttcttctccggatcaatatctcat

SEQ ID NO: 396372 - DNA, 25 bp, Mus musculus
cttcttctccggttcaatatctcat

SEQ ID NO: 396373 - DNA, 25 bp, Mus musculus
cttcttctcgcacttcatgatgctt

SEQ ID NO: 396374 - DNA, 25 bp, Mus musculus
cttcttctcgcagttcatgatgctt

SEQ ID NO: 396375 - DNA, 25 bp, Mus musculus
cttcttctgatccttgtgggttttt

SEQ ID NO: 396376 - DNA, 25 bp, Mus musculus
cttcttctgatcgttgtgggttttt

SEQ ID NO: 396377 - DNA, 25 bp, Mus musculus
cttcttctgctgctatgaggagtgc

SEQ ID NO: 396378 - DNA, 25 bp, Mus musculus
cttcttctgctggtatgaggagtgc

SEQ ID NO: 396379 - DNA, 25 bp, Mus musculus
cttcttctggtcagtatttggcttt

SEQ ID NO: 396380 - DNA, 25 bp, Mus musculus
cttcttctggtctgtatttggcttt

SEQ ID NO: 396381 - DNA, 25 bp, Mus musculus
cttcttctggttcgtgggtttctgc

SEQ ID NO: 396382 - DNA, 25 bp, Mus musculus
cttcttctggttggtgggtttctgc

SEQ ID NO: 396383 - DNA, 25 bp, Mus musculus
cttcttctgttgactgtgctgcgta

SEQ ID NO: 396384 - DNA, 25 bp, Mus musculus
cttcttctgttgtctgtgctgcgta

SEQ ID NO: 396385 - DNA, 25 bp, Mus musculus
cttcttcttgacacacgttcttaat

SEQ ID NO: 396386 - DNA, 25 bp, Mus musculus
cttcttcttgactcacgttcttaat

SEQ ID NO: 396387 - DNA, 25 bp, Mus musculus
cttcttcttgttctgttctgagtac

SEQ ID NO: 396388 - DNA, 25 bp, Mus musculus
cttcttcttgttgtgttctgagtac

SEQ ID NO: 396389 - DNA, 25 bp, Mus musculus
cttcttcttttgcatctagtggcga

SEQ ID NO: 396390 - DNA, 25 bp, Mus musculus
cttcttcttttggatctagtggcga

SEQ ID NO: 396391 - DNA, 25 bp, Mus musculus
cttcttgaacagagtgctgttgtaa

SEQ ID NO: 396392 - DNA, 25 bp, Mus musculus
cttcttgaacagtgtgctgttgtaa

SEQ ID NO: 396393 - DNA, 25 bp, Mus musculus
cttcttgacaacacagacatccatc

SEQ ID NO: 396394 - DNA, 25 bp, Mus musculus
cttcttgacaactcagacatccatc

SEQ ID NO: 396395 - DNA, 25 bp, Mus musculus
cttcttgacaagatacctgctaata

SEQ ID NO: 396396 - DNA, 25 bp, Mus musculus
cttcttgacaagttacctgctaata

SEQ ID NO: 396397 - DNA, 25 bp, Mus musculus
cttcttgacagaatgccaccttgtg

SEQ ID NO: 396398 - DNA, 25 bp, Mus musculus
cttcttgacagattgccaccttgtg

SEQ ID NO: 396399 - DNA, 25 bp, Mus musculus
cttcttgactaaaattttaacgcat

SEQ ID NO: 396400 - DNA, 25 bp, Mus musculus
cttcttgactaatattttaacgcat

SEQ ID NO: 396401 - DNA, 25 bp, Mus musculus
cttcttgaggaaaggccgatctgcc

SEQ ID NO: 396402 - DNA, 25 bp, Mus musculus
cttcttgaggaatggccgatctgcc

SEQ ID NO: 396403 - DNA, 25 bp, Mus musculus
cttcttgagtagaactatggttgac

SEQ ID NO: 396404 - DNA, 25 bp, Mus musculus
cttcttgagtagtactatggttgac

SEQ ID NO: 396405 - DNA, 25 bp, Mus musculus
cttcttgatgtgatgattgggctgt

SEQ ID NO: 396406 - DNA, 25 bp, Mus musculus
cttcttgatgtgttgattgggctgt

SEQ ID NO: 396407 - DNA, 25 bp, Mus musculus
cttcttgattcaacccagaggcttg

SEQ ID NO: 396408 - DNA, 25 bp, Mus musculus
cttcttgattcatcccagaggcttg

SEQ ID NO: 396409 - DNA, 25 bp, Mus musculus
cttcttgcccaacaatgacagacca

SEQ ID NO: 396410 - DNA, 25 bp, Mus musculus
cttcttgcccaagaatgacagacca

SEQ ID NO: 396411 - DNA, 25 bp, Mus musculus
cttcttgccgttagcatttgctgta

SEQ ID NO: 396412 - DNA, 25 bp, Mus musculus
cttcttgccgtttgcatttgctgta

SEQ ID NO: 396413 - DNA, 25 bp, Mus musculus
cttcttgcgtgtagcctcacaagtt

SEQ ID NO: 396414 - DNA, 25 bp, Mus musculus
cttcttgcgtgttgcctcacaagtt

SEQ ID NO: 396415 - DNA, 25 bp, Mus musculus
cttcttgctaaacctgagcagctag

SEQ ID NO: 396416 - DNA, 25 bp, Mus musculus
cttcttgctaaagctgagcagctag

SEQ ID NO: 396417 - DNA, 25 bp, Mus musculus
cttcttgctctgacctgcaaatgaa

SEQ ID NO: 396418 - DNA, 25 bp, Mus musculus
cttcttgctctgtcctgcaaatgaa

SEQ ID NO: 396419 - DNA, 25 bp, Mus musculus
cttcttgctgaacttatctcttgtc

SEQ ID NO: 396420 - DNA, 25 bp, Mus musculus
cttcttgctgaagttatctcttgtc

SEQ ID NO: 396421 - DNA, 25 bp, Mus musculus
cttcttgcttctatccagtttgatc

SEQ ID NO: 396422 - DNA, 25 bp, Mus musculus
cttcttgcttctttccagtttgatc

SEQ ID NO: 396423 - DNA, 25 bp, Mus musculus
cttcttggaagaaacgaggttaaat

SEQ ID NO: 396424 - DNA, 25 bp, Mus musculus
cttcttggaagatacgaggttaaat

SEQ ID NO: 396425 - DNA, 25 bp, Mus musculus
cttcttggcatgagacgggctcaga

SEQ ID NO: 396426 - DNA, 25 bp, Mus musculus
cttcttggcatgtgacgggctcaga

SEQ ID NO: 396427 - DNA, 25 bp, Mus musculus
cttcttgggcatcaggtacacacat

SEQ ID NO: 396428 - DNA, 25 bp, Mus musculus
cttcttgggcatgaggtacacacat

SEQ ID NO: 396429 - DNA, 25 bp, Mus musculus
cttcttgggctgaggacctaaggag

SEQ ID NO: 396430 - DNA, 25 bp, Mus musculus
cttcttgggctgtggacctaaggag

SEQ ID NO: 396431 - DNA, 25 bp, Mus musculus
cttcttggtatgaataaaacttggc

SEQ ID NO: 396432 - DNA, 25 bp, Mus musculus
cttcttggtatgtataaaacttggc

SEQ ID NO: 396433 - DNA, 25 bp, Mus musculus
cttcttggtgatactgacagaaatt

SEQ ID NO: 396434 - DNA, 25 bp, Mus musculus
cttcttggtgattctgacagaaatt

SEQ ID NO: 396435 - DNA, 25 bp, Mus musculus
cttcttggtgccagggtagccctgg

SEQ ID NO: 396436 - DNA, 25 bp, Mus musculus
cttcttggtgcctgggtagccctgg

SEQ ID NO: 396437 - DNA, 25 bp, Mus musculus
cttcttggttctagtgacaggtctc

SEQ ID NO: 396438 - DNA, 25 bp, Mus musculus
cttcttggttcttgtgacaggtctc

SEQ ID NO: 396439 - DNA, 25 bp, Mus musculus
cttcttgtaactcttccggaggatc

SEQ ID NO: 396440 - DNA, 25 bp, Mus musculus
cttcttgtaactgttccggaggatc

SEQ ID NO: 396441 - DNA, 25 bp, Mus musculus
cttcttgtagagcagcacctgtcta

SEQ ID NO: 396442 - DNA, 25 bp, Mus musculus
cttcttgtagaggagcacctgtcta

SEQ ID NO: 396443 - DNA, 25 bp, Mus musculus
cttcttgtattcagctatcccatca

SEQ ID NO: 396444 - DNA, 25 bp, Mus musculus
cttcttgtattctgctatcccatca

SEQ ID NO: 396445 - DNA, 25 bp, Mus musculus
cttcttgtattgaagcagagacaat

SEQ ID NO: 396446 - DNA, 25 bp, Mus musculus
cttcttgtattgtagcagagacaat

SEQ ID NO: 396447 - DNA, 25 bp, Mus musculus
cttcttgtcaacactactcatggat

SEQ ID NO: 396448 - DNA, 25 bp, Mus musculus
cttcttgtcaactctactcatggat

SEQ ID NO: 396449 - DNA, 25 bp, Mus musculus
cttcttgtcacaatgttatgccaat

SEQ ID NO: 396450 - DNA, 25 bp, Mus musculus
cttcttgtcacattgttatgccaat

SEQ ID NO: 396451 - DNA, 25 bp, Mus musculus
cttcttgtgatgcttgtatctgctg

SEQ ID NO: 396452 - DNA, 25 bp, Mus musculus
cttcttgtgatggttgtatctgctg

SEQ ID NO: 396453 - DNA, 25 bp, Mus musculus
cttcttgtggcaactgggtttttgt

SEQ ID NO: 396454 - DNA, 25 bp, Mus musculus
cttcttgtggcatctgggtttttgt

SEQ ID NO: 396455 - DNA, 25 bp, Mus musculus
cttcttgtgtctccgcagtgcggca

SEQ ID NO: 396456 - DNA, 25 bp, Mus musculus
cttcttgtgtctgcgcagtgcggca

SEQ ID NO: 396457 - DNA, 25 bp, Mus musculus
cttcttgttctcagtggtaggtcat

SEQ ID NO: 396458 - DNA, 25 bp, Mus musculus
cttcttgttctctgtggtaggtcat

SEQ ID NO: 396459 - DNA, 25 bp, Mus musculus
cttcttgttcttcttttcatttcta

SEQ ID NO: 396460 - DNA, 25 bp, Mus musculus
cttcttgttcttgttttcatttcta

SEQ ID NO: 396461 - DNA, 25 bp, Mus musculus
cttctttacgttacagccgaacgtg

SEQ ID NO: 396462 - DNA, 25 bp, Mus musculus
cttctttacgtttcagccgaacgtg

SEQ ID NO: 396463 - DNA, 25 bp, Mus musculus
cttctttagcttccattgctgatgg

SEQ ID NO: 396464 - DNA, 25 bp, Mus musculus
cttctttagcttgcattgctgatgg

SEQ ID NO: 396465 - DNA, 25 bp, Mus musculus
cttctttccatcatgctgggtaaag

SEQ ID NO: 396466 - DNA, 25 bp, Mus musculus
cttctttccatcttgctgggtaaag

SEQ ID NO: 396467 - DNA, 25 bp, Mus musculus
cttctttcccagatcttcaatattt

SEQ ID NO: 396468 - DNA, 25 bp, Mus musculus
cttctttcccagttcttcaatattt

SEQ ID NO: 396469 - DNA, 25 bp, Mus musculus
cttctttcctctcctttatatgatt

SEQ ID NO: 396470 - DNA, 25 bp, Mus musculus
cttctttcctctgctttatatgatt

SEQ ID NO: 396471 - DNA, 25 bp, Mus musculus
cttctttcctgacctacagacaatt

SEQ ID NO: 396472 - DNA, 25 bp, Mus musculus
cttctttcctgagctacagacaatt

SEQ ID NO: 396473 - DNA, 25 bp, Mus musculus
cttctttcgccaatgcaccagagta

SEQ ID NO: 396474 - DNA, 25 bp, Mus musculus
cttctttcgccattgcaccagagta

SEQ ID NO: 396475 - DNA, 25 bp, Mus musculus
cttctttctaagacaccatcagtgg

SEQ ID NO: 396476 - DNA, 25 bp, Mus musculus
cttctttctaagtcaccatcagtgg

SEQ ID NO: 396477 - DNA, 25 bp, Mus musculus
cttctttcttcacctatggttgtct

SEQ ID NO: 396478 - DNA, 25 bp, Mus musculus
cttctttcttcagctatggttgtct

SEQ ID NO: 396479 - DNA, 25 bp, Mus musculus
cttctttgactcagcagctatcata

SEQ ID NO: 396480 - DNA, 25 bp, Mus musculus
cttctttgactctgcagctatcata

SEQ ID NO: 396481 - DNA, 25 bp, Mus musculus
cttctttgacttctacatataggga

SEQ ID NO: 396482 - DNA, 25 bp, Mus musculus
cttctttgacttctatgtgagtaga

SEQ ID NO: 396483 - DNA, 25 bp, Mus musculus
cttctttgacttgtacatataggga

SEQ ID NO: 396484 - DNA, 25 bp, Mus musculus
cttctttgacttgtatgtgagtaga

SEQ ID NO: 396485 - DNA, 25 bp, Mus musculus
cttctttgatgcacctttgacattt

SEQ ID NO: 396486 - DNA, 25 bp, Mus musculus
cttctttgatgctcctttgacattt

SEQ ID NO: 396487 - DNA, 25 bp, Mus musculus
cttctttgcagactgacctgtggca

SEQ ID NO: 396488 - DNA, 25 bp, Mus musculus
cttctttgcagagtgacctgtggca

SEQ ID NO: 396489 - DNA, 25 bp, Mus musculus
cttctttgccaaatctgaggtgtca

SEQ ID NO: 396490 - DNA, 25 bp, Mus musculus
cttctttgccaattctgaggtgtca

SEQ ID NO: 396491 - DNA, 25 bp, Mus musculus
cttctttggaccagttcaacttcag

SEQ ID NO: 396492 - DNA, 25 bp, Mus musculus
cttctttggacctgttcaacttcag

SEQ ID NO: 396493 - DNA, 25 bp, Mus musculus
cttctttggccaatattctgatatc

SEQ ID NO: 396494 - DNA, 25 bp, Mus musculus
cttctttggccattattctgatatc

SEQ ID NO: 396495 - DNA, 25 bp, Mus musculus
cttctttgggatcctatttcagcca

SEQ ID NO: 396496 - DNA, 25 bp, Mus musculus
cttctttgggatgctatttcagcca

SEQ ID NO: 396497 - DNA, 25 bp, Mus musculus
cttctttgtataagggcttctcact

SEQ ID NO: 396498 - DNA, 25 bp, Mus musculus
cttctttgtatatgggcttctcact

SEQ ID NO: 396499 - DNA, 25 bp, Mus musculus
cttctttgtatgaacagaggtaata

SEQ ID NO: 396500 - DNA, 25 bp, Mus musculus
cttctttgtatgtacagaggtaata

SEQ ID NO: 396501 - DNA, 25 bp, Mus musculus
cttctttgtcagacttgtcacacca

SEQ ID NO: 396502 - DNA, 25 bp, Mus musculus
cttctttgtcagtcttgtcacacca

SEQ ID NO: 396503 - DNA, 25 bp, Mus musculus
cttctttgtctcagtcagttggttt

SEQ ID NO: 396504 - DNA, 25 bp, Mus musculus
cttctttgtctctgtcagttggttt

SEQ ID NO: 396505 - DNA, 25 bp, Mus musculus
cttctttgtggccagcatagctcag

SEQ ID NO: 396506 - DNA, 25 bp, Mus musculus
cttctttgtggcgagcatagctcag

SEQ ID NO: 396507 - DNA, 25 bp, Mus musculus
cttcttttcaaaatcctgggtcaag

SEQ ID NO: 396508 - DNA, 25 bp, Mus musculus
cttcttttcaaattcctgggtcaag

SEQ ID NO: 396509 - DNA, 25 bp, Mus musculus
cttcttttcactccagggtaccata

SEQ ID NO: 396510 - DNA, 25 bp, Mus musculus
cttcttttcactgcagggtaccata

SEQ ID NO: 396511 - DNA, 25 bp, Mus musculus
cttcttttcccaacaataaatgtgt

SEQ ID NO: 396512 - DNA, 25 bp, Mus musculus
cttcttttcccatcaataaatgtgt

SEQ ID NO: 396513 - DNA, 25 bp, Mus musculus
cttcttttctccagcatagtgttac

SEQ ID NO: 396514 - DNA, 25 bp, Mus musculus
cttcttttctcctgcatagtgttac

SEQ ID NO: 396515 - DNA, 25 bp, Mus musculus
cttcttttgagccaccttccatttt

SEQ ID NO: 396516 - DNA, 25 bp, Mus musculus
cttcttttgagcgaccttccatttt

SEQ ID NO: 396517 - DNA, 25 bp, Mus musculus
cttcttttgccaaacattggtgcag

SEQ ID NO: 396518 - DNA, 25 bp, Mus musculus
cttcttttgccatacattggtgcag

SEQ ID NO: 396519 - DNA, 25 bp, Mus musculus
cttcttttggctacattgggtacct

SEQ ID NO: 396520 - DNA, 25 bp, Mus musculus
cttcttttggcttcattgggtacct

SEQ ID NO: 396521 - DNA, 25 bp, Mus musculus
cttcttttgtctacagcatactgct

SEQ ID NO: 396522 - DNA, 25 bp, Mus musculus
cttcttttgtcttcagcatactgct

SEQ ID NO: 396523 - DNA, 25 bp, Mus musculus
cttctttttctaatttcaacttcat

SEQ ID NO: 396524 - DNA, 25 bp, Mus musculus
cttctttttctattttcaacttcat

SEQ ID NO: 396525 - DNA, 25 bp, Mus musculus
cttctttttgaacttgactgttgga

SEQ ID NO: 396526 - DNA, 25 bp, Mus musculus
cttctttttgaagttgactgttgga

SEQ ID NO: 396527 - DNA, 25 bp, Mus musculus
cttcttttttgaacgggatgacgtg

SEQ ID NO: 396528 - DNA, 25 bp, Mus musculus
cttcttttttgatcgggatgacgtg

SEQ ID NO: 396529 - DNA, 25 bp, Mus musculus
cttgaaaactcgattccctgtggct

SEQ ID NO: 396530 - DNA, 25 bp, Mus musculus
cttgaaaactcgtttccctgtggct

SEQ ID NO: 396531 - DNA, 25 bp, Mus musculus
cttgaaaagggcaggaggacctgct

SEQ ID NO: 396532 - DNA, 25 bp, Mus musculus
cttgaaaagggctggaggacctgct

SEQ ID NO: 396533 - DNA, 25 bp, Mus musculus
cttgaaaaggtgacacctgggagcc

SEQ ID NO: 396534 - DNA, 25 bp, Mus musculus
cttgaaaaggtgtcacctgggagcc

SEQ ID NO: 396535 - DNA, 25 bp, Mus musculus
cttgaaaattccagatacctggcac

SEQ ID NO: 396536 - DNA, 25 bp, Mus musculus
cttgaaaattcctgatacctggcac

SEQ ID NO: 396537 - DNA, 25 bp, Mus musculus
cttgaaactcaacgaagcagctgtg

SEQ ID NO: 396538 - DNA, 25 bp, Mus musculus
cttgaaactcaaggaagcagctgtg

SEQ ID NO: 396539 - DNA, 25 bp, Mus musculus
cttgaaagcggccttagctgagact

SEQ ID NO: 396540 - DNA, 25 bp, Mus musculus
cttgaaagcggcgttagctgagact

SEQ ID NO: 396541 - DNA, 25 bp, Mus musculus
cttgaaaggagacccactgatattt

SEQ ID NO: 396542 - DNA, 25 bp, Mus musculus
cttgaaaggagagccactgatattt

SEQ ID NO: 396543 - DNA, 25 bp, Mus musculus
cttgaaaggattcagcagctaattg

SEQ ID NO: 396544 - DNA, 25 bp, Mus musculus
cttgaaaggattgagcagctaattg

SEQ ID NO: 396545 - DNA, 25 bp, Mus musculus
cttgaaaggcctcccttggctctgg

SEQ ID NO: 396546 - DNA, 25 bp, Mus musculus
cttgaaaggcctgccttggctctgg

SEQ ID NO: 396547 - DNA, 25 bp, Mus musculus
cttgaaatttggagtgtctttgcgg

SEQ ID NO: 396548 - DNA, 25 bp, Mus musculus
cttgaaatttggtgtgtctttgcgg

SEQ ID NO: 396549 - DNA, 25 bp, Mus musculus
cttgaacaagttccgcagggtgctg

SEQ ID NO: 396550 - DNA, 25 bp, Mus musculus
cttgaacaagttgcgcagggtgctg

SEQ ID NO: 396551 - DNA, 25 bp, Mus musculus
cttgaacagcagctccttggcaggg

SEQ ID NO: 396552 - DNA, 25 bp, Mus musculus
cttgaacagcaggtccttggcaggg

SEQ ID NO: 396553 - DNA, 25 bp, Mus musculus
cttgaacatgatcagctcagctcta

SEQ ID NO: 396554 - DNA, 25 bp, Mus musculus
cttgaacatgatgagctcagctcta

SEQ ID NO: 396555 - DNA, 25 bp, Mus musculus
cttgaacccattattcagagttctt

SEQ ID NO: 396556 - DNA, 25 bp, Mus musculus
cttgaacccatttttcagagttctt

SEQ ID NO: 396557 - DNA, 25 bp, Mus musculus
cttgaacctgtcaatgtgggcctca

SEQ ID NO: 396558 - DNA, 25 bp, Mus musculus
cttgaacctgtctatgtgggcctca

SEQ ID NO: 396559 - DNA, 25 bp, Mus musculus
cttgaacctttcaaggcgcaggata

SEQ ID NO: 396560 - DNA, 25 bp, Mus musculus
cttgaacctttctaggcgcaggata

SEQ ID NO: 396561 - DNA, 25 bp, Mus musculus
cttgaacgagtaccacaccagggcc

SEQ ID NO: 396562 - DNA, 25 bp, Mus musculus
cttgaacgagtagcacaccagggcc

SEQ ID NO: 396563 - DNA, 25 bp, Mus musculus
cttgaacgtggactttagaggacaa

SEQ ID NO: 396564 - DNA, 25 bp, Mus musculus
cttgaacgtggagtttagaggacaa

SEQ ID NO: 396565 - DNA, 25 bp, Mus musculus
cttgaactcacaattctcagtctct

SEQ ID NO: 396566 - DNA, 25 bp, Mus musculus
cttgaactcacatttctcagtctct

SEQ ID NO: 396567 - DNA, 25 bp, Mus musculus
cttgaactcaggctagctttcttgt

SEQ ID NO: 396568 - DNA, 25 bp, Mus musculus
cttgaactcagggtagctttcttgt

SEQ ID NO: 396569 - DNA, 25 bp, Mus musculus
cttgaactcatgcagctctatcctc

SEQ ID NO: 396570 - DNA, 25 bp, Mus musculus
cttgaactcatggagctctatcctc

SEQ ID NO: 396571 - DNA, 25 bp, Mus musculus
cttgaactcggtcctggtggtgcat

SEQ ID NO: 396572 - DNA, 25 bp, Mus musculus
cttgaactcggtgctggtggtgcat

SEQ ID NO: 396573 - DNA, 25 bp, Mus musculus
cttgaactcttaatgcatgtggaca

SEQ ID NO: 396574 - DNA, 25 bp, Mus musculus
cttgaactcttattgcatgtggaca

SEQ ID NO: 396575 - DNA, 25 bp, Mus musculus
cttgaactggcccaatagtcagaag

SEQ ID NO: 396576 - DNA, 25 bp, Mus musculus
cttgaactggccgaatagtcagaag

SEQ ID NO: 396577 - DNA, 25 bp, Mus musculus
cttgaactgtttcttgactaggttt

SEQ ID NO: 396578 - DNA, 25 bp, Mus musculus
cttgaactgtttgttgactaggttt

SEQ ID NO: 396579 - DNA, 25 bp, Mus musculus
cttgaagacatccaatggaccccac

SEQ ID NO: 396580 - DNA, 25 bp, Mus musculus
cttgaagacatcgaatggaccccac

SEQ ID NO: 396581 - DNA, 25 bp, Mus musculus
cttgaagacctgactaagccctcaa

SEQ ID NO: 396582 - DNA, 25 bp, Mus musculus
cttgaagacctgtctaagccctcaa

SEQ ID NO: 396583 - DNA, 25 bp, Mus musculus
cttgaagatggactcttcacctctc

SEQ ID NO: 396584 - DNA, 25 bp, Mus musculus
cttgaagatggagtcttcacctctc

SEQ ID NO: 396585 - DNA, 25 bp, Mus musculus
cttgaagattgtacccacagtgtat

SEQ ID NO: 396586 - DNA, 25 bp, Mus musculus
cttgaagattgttcccacagtgtat

SEQ ID NO: 396587 - DNA, 25 bp, Mus musculus
cttgaagcagaactttctttcgaga

SEQ ID NO: 396588 - DNA, 25 bp, Mus musculus
cttgaagcagaagtttctttcgaga

SEQ ID NO: 396589 - DNA, 25 bp, Mus musculus
cttgaagccgtgaagcttatgtgaa

SEQ ID NO: 396590 - DNA, 25 bp, Mus musculus
cttgaagccgtgtagcttatgtgaa

SEQ ID NO: 396591 - DNA, 25 bp, Mus musculus
cttgaagcgcaactgggtctggacc

SEQ ID NO: 396592 - DNA, 25 bp, Mus musculus
cttgaagcgcaagtgggtctggacc

SEQ ID NO: 396593 - DNA, 25 bp, Mus musculus
cttgaagctgttctgagcacacact

SEQ ID NO: 396594 - DNA, 25 bp, Mus musculus
cttgaagctgttgtgagcacacact

SEQ ID NO: 396595 - DNA, 25 bp, Mus musculus
cttgaaggcttgctctacaagtggg

SEQ ID NO: 396596 - DNA, 25 bp, Mus musculus
cttgaaggcttggtctacaagtggg

SEQ ID NO: 396597 - DNA, 25 bp, Mus musculus
cttgaagggcccatgggacactggc

SEQ ID NO: 396598 - DNA, 25 bp, Mus musculus
cttgaagggcccttgggacactggc

SEQ ID NO: 396599 - DNA, 25 bp, Mus musculus
cttgaaggtctgattagctactgct

SEQ ID NO: 396600 - DNA, 25 bp, Mus musculus
cttgaaggtctgtttagctactgct

SEQ ID NO: 396601 - DNA, 25 bp, Mus musculus
cttgaaggtgccaccgtcgactgtg

SEQ ID NO: 396602 - DNA, 25 bp, Mus musculus
cttgaaggtgcctccgtcgactgtg

SEQ ID NO: 396603 - DNA, 25 bp, Mus musculus
cttgaaggttccaccggctgtggta

SEQ ID NO: 396604 - DNA, 25 bp, Mus musculus
cttgaaggttcctccggctgtggta

SEQ ID NO: 396605 - DNA, 25 bp, Mus musculus
cttgaagtactccttcatgcttcct

SEQ ID NO: 396606 - DNA, 25 bp, Mus musculus
cttgaagtactcgttcatgcttcct

SEQ ID NO: 396607 - DNA, 25 bp, Mus musculus
cttgaagtaggcacgtattggccaa

SEQ ID NO: 396608 - DNA, 25 bp, Mus musculus
cttgaagtaggctcgtattggccaa

SEQ ID NO: 396609 - DNA, 25 bp, Mus musculus
cttgaagtgactagatccagactga

SEQ ID NO: 396610 - DNA, 25 bp, Mus musculus
cttgaagtgacttgatccagactga

SEQ ID NO: 396611 - DNA, 25 bp, Mus musculus
cttgaagtggcaacccctctgctgt

SEQ ID NO: 396612 - DNA, 25 bp, Mus musculus
cttgaagtggcatcccctctgctgt

SEQ ID NO: 396613 - DNA, 25 bp, Mus musculus
cttgaagtgtttatgcctgcatctg

SEQ ID NO: 396614 - DNA, 25 bp, Mus musculus
cttgaagtgtttttgcctgcatctg

SEQ ID NO: 396615 - DNA, 25 bp, Mus musculus
cttgaagttactctgaatctctatt

SEQ ID NO: 396616 - DNA, 25 bp, Mus musculus
cttgaagttactgtgaatctctatt

SEQ ID NO: 396617 - DNA, 25 bp, Mus musculus
cttgaagttcacagttttgtgcccc

SEQ ID NO: 396618 - DNA, 25 bp, Mus musculus
cttgaagttcactgttttgtgcccc

SEQ ID NO: 396619 - DNA, 25 bp, Mus musculus
cttgaagttgcaaaaggacccgtgt

SEQ ID NO: 396620 - DNA, 25 bp, Mus musculus
cttgaagttgcaatgctgattccaa

SEQ ID NO: 396621 - DNA, 25 bp, Mus musculus
cttgaagttgcataaggacccgtgt

SEQ ID NO: 396622 - DNA, 25 bp, Mus musculus
cttgaagttgcattgctgattccaa

SEQ ID NO: 396623 - DNA, 25 bp, Mus musculus
cttgaagttggcagtcccatttgga

SEQ ID NO: 396624 - DNA, 25 bp, Mus musculus
cttgaagttggctgtcccatttgga

SEQ ID NO: 396625 - DNA, 25 bp, Mus musculus
cttgaagttttcacaggagatcctg

SEQ ID NO: 396626 - DNA, 25 bp, Mus musculus
cttgaagttttctcaggagatcctg

SEQ ID NO: 396627 - DNA, 25 bp, Mus musculus
cttgaatcattcatttactgttgtt

SEQ ID NO: 396628 - DNA, 25 bp, Mus musculus
cttgaatcattcttttactgttgtt

SEQ ID NO: 396629 - DNA, 25 bp, Mus musculus
cttgaatgacatccgacacagcaat

SEQ ID NO: 396630 - DNA, 25 bp, Mus musculus
cttgaatgacatgcgacacagcaat

SEQ ID NO: 396631 - DNA, 25 bp, Mus musculus
cttgaatggctccacgttggtgcca

SEQ ID NO: 396632 - DNA, 25 bp, Mus musculus
cttgaatggctcgacgttggtgcca

SEQ ID NO: 396633 - DNA, 25 bp, Mus musculus
cttgaattcaaacacagcctgatct

SEQ ID NO: 396634 - DNA, 25 bp, Mus musculus
cttgaattcaaagacagcctgatct

SEQ ID NO: 396635 - DNA, 25 bp, Mus musculus
cttgaattgattccggaaaactgtt

SEQ ID NO: 396636 - DNA, 25 bp, Mus musculus
cttgaattgattgcggaaaactgtt

SEQ ID NO: 396637 - DNA, 25 bp, Mus musculus
cttgaattgctgctcatctttttcc

SEQ ID NO: 396638 - DNA, 25 bp, Mus musculus
cttgaattgctggtcatctttttcc

SEQ ID NO: 396639 - DNA, 25 bp, Mus musculus
cttgaatttcaaccctgtgacttct

SEQ ID NO: 396640 - DNA, 25 bp, Mus musculus
cttgaatttcaagcctgtgacttct

SEQ ID NO: 396641 - DNA, 25 bp, Mus musculus
cttgaatttgcacccatcttcgtgc

SEQ ID NO: 396642 - DNA, 25 bp, Mus musculus
cttgaatttgcagccatcttcgtgc

SEQ ID NO: 396643 - DNA, 25 bp, Mus musculus
cttgaatttgtgatttttgttgaat

SEQ ID NO: 396644 - DNA, 25 bp, Mus musculus
cttgaatttgtgttttttgttgaat

SEQ ID NO: 396645 - DNA, 25 bp, Mus musculus
cttgacaacaaccacctcagagata

SEQ ID NO: 396646 - DNA, 25 bp, Mus musculus
cttgacaacaacgacctcagagata

SEQ ID NO: 396647 - DNA, 25 bp, Mus musculus
cttgacaacaccaacttacaccata

SEQ ID NO: 396648 - DNA, 25 bp, Mus musculus
cttgacaacacctacttacaccata

SEQ ID NO: 396649 - DNA, 25 bp, Mus musculus
cttgacacacccacgagatgttatt

SEQ ID NO: 396650 - DNA, 25 bp, Mus musculus
cttgacacaccctcgagatgttatt

SEQ ID NO: 396651 - DNA, 25 bp, Mus musculus
cttgacacccatcgctgaaatgcta

SEQ ID NO: 396652 - DNA, 25 bp, Mus musculus
cttgacacccatggctgaaatgcta

SEQ ID NO: 396653 - DNA, 25 bp, Mus musculus
cttgacaccctgcatgtcctgttaa

SEQ ID NO: 396654 - DNA, 25 bp, Mus musculus
cttgacaccctggatgtcctgttaa

SEQ ID NO: 396655 - DNA, 25 bp, Mus musculus
cttgacacgggaaacaggcaccagt

SEQ ID NO: 396656 - DNA, 25 bp, Mus musculus
cttgacacgggatacaggcaccagt

SEQ ID NO: 396657 - DNA, 25 bp, Mus musculus
cttgacactccacctttttgtgtaa

SEQ ID NO: 396658 - DNA, 25 bp, Mus musculus
cttgacactccagctttttgtgtaa

SEQ ID NO: 396659 - DNA, 25 bp, Mus musculus
cttgacagaaatcgccagagtccaa

SEQ ID NO: 396660 - DNA, 25 bp, Mus musculus
cttgacagaaatggccagagtccaa

SEQ ID NO: 396661 - DNA, 25 bp, Mus musculus
cttgacagaagcaggagtcatgtga

SEQ ID NO: 396662 - DNA, 25 bp, Mus musculus
cttgacagaagctggagtcatgtga

SEQ ID NO: 396663 - DNA, 25 bp, Mus musculus
cttgacagaatgaccacggctgagt

SEQ ID NO: 396664 - DNA, 25 bp, Mus musculus
cttgacagaatgtccacggctgagt

SEQ ID NO: 396665 - DNA, 25 bp, Mus musculus
cttgacagagaactgaggcgactgc

SEQ ID NO: 396666 - DNA, 25 bp, Mus musculus
cttgacagagaagtgaggcgactgc

SEQ ID NO: 396667 - DNA, 25 bp, Mus musculus
cttgacagatgaaaggagtctctag

SEQ ID NO: 396668 - DNA, 25 bp, Mus musculus
cttgacagatgataggagtctctag

SEQ ID NO: 396669 - DNA, 25 bp, Mus musculus
cttgacagatgtaagactttagtct

SEQ ID NO: 396670 - DNA, 25 bp, Mus musculus
cttgacagatgttagactttagtct

SEQ ID NO: 396671 - DNA, 25 bp, Mus musculus
cttgacagcagtacgtgaggtggat

SEQ ID NO: 396672 - DNA, 25 bp, Mus musculus
cttgacagcagttcgtgaggtggat

SEQ ID NO: 396673 - DNA, 25 bp, Mus musculus
cttgacagtcacactagcgtgtgta

SEQ ID NO: 396674 - DNA, 25 bp, Mus musculus
cttgacagtcactctagcgtgtgta

SEQ ID NO: 396675 - DNA, 25 bp, Mus musculus
cttgacataatcatccagcctcatg

SEQ ID NO: 396676 - DNA, 25 bp, Mus musculus
cttgacataatcttccagcctcatg

SEQ ID NO: 396677 - DNA, 25 bp, Mus musculus
cttgacatggccattggaaagacgt

SEQ ID NO: 396678 - DNA, 25 bp, Mus musculus
cttgacatggcctttggaaagacgt

SEQ ID NO: 396679 - DNA, 25 bp, Mus musculus
cttgacattaccatggaaagttcca

SEQ ID NO: 396680 - DNA, 25 bp, Mus musculus
cttgacattaccttggaaagttcca

SEQ ID NO: 396681 - DNA, 25 bp, Mus musculus
cttgacattccaccctgtcctttgg

SEQ ID NO: 396682 - DNA, 25 bp, Mus musculus
cttgacattccagcctgtcctttgg

SEQ ID NO: 396683 - DNA, 25 bp, Mus musculus
cttgacattgccaaaattccttaat

SEQ ID NO: 396684 - DNA, 25 bp, Mus musculus
cttgacattgcctaaattccttaat

SEQ ID NO: 396685 - DNA, 25 bp, Mus musculus
cttgacatttcaaaggctgccctga

SEQ ID NO: 396686 - DNA, 25 bp, Mus musculus
cttgacatttcataggctgccctga

SEQ ID NO: 396687 - DNA, 25 bp, Mus musculus
cttgaccagctaaaatgtatttcct

SEQ ID NO: 396688 - DNA, 25 bp, Mus musculus
cttgaccagctataatgtatttcct

SEQ ID NO: 396689 - DNA, 25 bp, Mus musculus
cttgaccagttcaattgatgggaca

SEQ ID NO: 396690 - DNA, 25 bp, Mus musculus
cttgaccagttctattgatgggaca

SEQ ID NO: 396691 - DNA, 25 bp, Mus musculus
cttgacccacccagatttgacagtt

SEQ ID NO: 396692 - DNA, 25 bp, Mus musculus
cttgacccaccctgatttgacagtt

SEQ ID NO: 396693 - DNA, 25 bp, Mus musculus
cttgaccccaggaggtttctagctc

SEQ ID NO: 396694 - DNA, 25 bp, Mus musculus
cttgaccccaggtggtttctagctc

SEQ ID NO: 396695 - DNA, 25 bp, Mus musculus
cttgaccctcaaaagtgccctcact

SEQ ID NO: 396696 - DNA, 25 bp, Mus musculus
cttgaccctcaatagtgccctcact

SEQ ID NO: 396697 - DNA, 25 bp, Mus musculus
cttgaccctggcaaaggatggcagc

SEQ ID NO: 396698 - DNA, 25 bp, Mus musculus
cttgaccctggctaaggatggcagc

SEQ ID NO: 396699 - DNA, 25 bp, Mus musculus
cttgaccctgtgcaaagtaaagaat

SEQ ID NO: 396700 - DNA, 25 bp, Mus musculus
cttgaccctgtggaaagtaaagaat

SEQ ID NO: 396701 - DNA, 25 bp, Mus musculus
cttgacctcagtagggcacaaccag

SEQ ID NO: 396702 - DNA, 25 bp, Mus musculus
cttgacctcagttgggcacaaccag

SEQ ID NO: 396703 - DNA, 25 bp, Mus musculus
cttgacctccgcaggaagctgacca

SEQ ID NO: 396704 - DNA, 25 bp, Mus musculus
cttgacctccgctggaagctgacca

SEQ ID NO: 396705 - DNA, 25 bp, Mus musculus
cttgacctggaaccctagaggccca

SEQ ID NO: 396706 - DNA, 25 bp, Mus musculus
cttgacctggaagcctagaggccca

SEQ ID NO: 396707 - DNA, 25 bp, Mus musculus
cttgaccttcagagtacattttgga

SEQ ID NO: 396708 - DNA, 25 bp, Mus musculus
cttgaccttcagtgtacattttgga

SEQ ID NO: 396709 - DNA, 25 bp, Mus musculus
cttgaccttgtcatctggccagaac

SEQ ID NO: 396710 - DNA, 25 bp, Mus musculus
cttgaccttgtcttctggccagaac

SEQ ID NO: 396711 - DNA, 25 bp, Mus musculus
cttgacgctgggacacagacaagca

SEQ ID NO: 396712 - DNA, 25 bp, Mus musculus
cttgacgctgggtcacagacaagca

SEQ ID NO: 396713 - DNA, 25 bp, Mus musculus
cttgacgcttgaacttccttctaag

SEQ ID NO: 396714 - DNA, 25 bp, Mus musculus
cttgacgcttgatcttccttctaag

SEQ ID NO: 396715 - DNA, 25 bp, Mus musculus
cttgactaaatgctaccccatacat

SEQ ID NO: 396716 - DNA, 25 bp, Mus musculus
cttgactaaatggtaccccatacat

SEQ ID NO: 396717 - DNA, 25 bp, Mus musculus
cttgactcactgatttaagggttca

SEQ ID NO: 396718 - DNA, 25 bp, Mus musculus
cttgactcactgttttaagggttca

SEQ ID NO: 396719 - DNA, 25 bp, Mus musculus
cttgactctgtcaagaatcacccgg

SEQ ID NO: 396720 - DNA, 25 bp, Mus musculus
cttgactctgtctagaatcacccgg

SEQ ID NO: 396721 - DNA, 25 bp, Mus musculus
cttgactgcctgaaacccagaccag

SEQ ID NO: 396722 - DNA, 25 bp, Mus musculus
cttgactgcctgtaacccagaccag

SEQ ID NO: 396723 - DNA, 25 bp, Mus musculus
cttgactgcgatcgtctgggcgaca

SEQ ID NO: 396724 - DNA, 25 bp, Mus musculus
cttgactgcgatggtctgggcgaca

SEQ ID NO: 396725 - DNA, 25 bp, Mus musculus
cttgactgcgtgaggccatgttgga

SEQ ID NO: 396726 - DNA, 25 bp, Mus musculus
cttgactgcgtgtggccatgttgga

SEQ ID NO: 396727 - DNA, 25 bp, Mus musculus
cttgactggaggcagattctgaaat

SEQ ID NO: 396728 - DNA, 25 bp, Mus musculus
cttgactggagggagattctgaaat

SEQ ID NO: 396729 - DNA, 25 bp, Mus musculus
cttgactgttaaatggatgctggct

SEQ ID NO: 396730 - DNA, 25 bp, Mus musculus
cttgactgttaattggatgctggct

SEQ ID NO: 396731 - DNA, 25 bp, Mus musculus
cttgacttatccaggcctttataga

SEQ ID NO: 396732 - DNA, 25 bp, Mus musculus
cttgacttatcctggcctttataga

SEQ ID NO: 396733 - DNA, 25 bp, Mus musculus
cttgacttcatacctttgcctatga

SEQ ID NO: 396734 - DNA, 25 bp, Mus musculus
cttgacttcatagctttgcctatga

SEQ ID NO: 396735 - DNA, 25 bp, Mus musculus
cttgacttgcgtagatctttttaca

SEQ ID NO: 396736 - DNA, 25 bp, Mus musculus
cttgacttgcgttgatctttttaca

SEQ ID NO: 396737 - DNA, 25 bp, Mus musculus
cttgagaaaaccagcgagtgctcca

SEQ ID NO: 396738 - DNA, 25 bp, Mus musculus
cttgagaaaacctgcgagtgctcca

SEQ ID NO: 396739 - DNA, 25 bp, Mus musculus
cttgagaaccatcgaagcgaggctc

SEQ ID NO: 396740 - DNA, 25 bp, Mus musculus
cttgagaaccatggaagcgaggctc

SEQ ID NO: 396741 - DNA, 25 bp, Mus musculus
cttgagaactctacagacaaaacag

SEQ ID NO: 396742 - DNA, 25 bp, Mus musculus
cttgagaactcttcagacaaaacag

SEQ ID NO: 396743 - DNA, 25 bp, Mus musculus
cttgagaagtcaattcttgtgttct

SEQ ID NO: 396744 - DNA, 25 bp, Mus musculus
cttgagaagtcatttcttgtgttct

SEQ ID NO: 396745 - DNA, 25 bp, Mus musculus
cttgagaataggatgctttaaggca

SEQ ID NO: 396746 - DNA, 25 bp, Mus musculus
cttgagaataggttgctttaaggca

SEQ ID NO: 396747 - DNA, 25 bp, Mus musculus
cttgagaatcccctgaggcagcttg

SEQ ID NO: 396748 - DNA, 25 bp, Mus musculus
cttgagaatcccgtgaggcagcttg

SEQ ID NO: 396749 - DNA, 25 bp, Mus musculus
cttgagacaagacgccaccttaact

SEQ ID NO: 396750 - DNA, 25 bp, Mus musculus
cttgagacaagaggccaccttaact

SEQ ID NO: 396751 - DNA, 25 bp, Mus musculus
cttgagacacaaaaactcatatttg

SEQ ID NO: 396752 - DNA, 25 bp, Mus musculus
cttgagacacaataactcatatttg

SEQ ID NO: 396753 - DNA, 25 bp, Mus musculus
cttgagacactgctaagtttgctgt

SEQ ID NO: 396754 - DNA, 25 bp, Mus musculus
cttgagacactggtaagtttgctgt

SEQ ID NO: 396755 - DNA, 25 bp, Mus musculus
cttgagacccctagaaaacaactgt

SEQ ID NO: 396756 - DNA, 25 bp, Mus musculus
cttgagaccccttgaaaacaactgt

SEQ ID NO: 396757 - DNA, 25 bp, Mus musculus
cttgagaccgagagcatttactgcc

SEQ ID NO: 396758 - DNA, 25 bp, Mus musculus
cttgagaccgagtgcatttactgcc

SEQ ID NO: 396759 - DNA, 25 bp, Mus musculus
cttgagactgcaatctctgttgtga

SEQ ID NO: 396760 - DNA, 25 bp, Mus musculus
cttgagactgcattctctgttgtga

SEQ ID NO: 396761 - DNA, 25 bp, Mus musculus
cttgagagaagcattctccctgaac

SEQ ID NO: 396762 - DNA, 25 bp, Mus musculus
cttgagagaagctttctccctgaac

SEQ ID NO: 396763 - DNA, 25 bp, Mus musculus
cttgagagaggtaagttcccaccct

SEQ ID NO: 396764 - DNA, 25 bp, Mus musculus
cttgagagaggttagttcccaccct

SEQ ID NO: 396765 - DNA, 25 bp, Mus musculus
cttgagagtcagagtctggagcaca

SEQ ID NO: 396766 - DNA, 25 bp, Mus musculus
cttgagagtcagtgtctggagcaca

SEQ ID NO: 396767 - DNA, 25 bp, Mus musculus
cttgagagttcacggcccacatgac

SEQ ID NO: 396768 - DNA, 25 bp, Mus musculus
cttgagagttcagggcccacatgac

SEQ ID NO: 396769 - DNA, 25 bp, Mus musculus
cttgagataccaccatctctggtgc

SEQ ID NO: 396770 - DNA, 25 bp, Mus musculus
cttgagataccagcatctctggtgc

SEQ ID NO: 396771 - DNA, 25 bp, Mus musculus
cttgagatcataacttcttttccat

SEQ ID NO: 396772 - DNA, 25 bp, Mus musculus
cttgagatcatatcttcttttccat

SEQ ID NO: 396773 - DNA, 25 bp, Mus musculus
cttgagatctgactctcttgcctct

SEQ ID NO: 396774 - DNA, 25 bp, Mus musculus
cttgagatctgagtctcttgcctct

SEQ ID NO: 396775 - DNA, 25 bp, Mus musculus
cttgagatctttcgagtcttggaac

SEQ ID NO: 396776 - DNA, 25 bp, Mus musculus
cttgagatctttggagtcttggaac

SEQ ID NO: 396777 - DNA, 25 bp, Mus musculus
cttgagattgctcactcagtgacca

SEQ ID NO: 396778 - DNA, 25 bp, Mus musculus
cttgagattgctgactcagtgacca

SEQ ID NO: 396779 - DNA, 25 bp, Mus musculus
cttgagcaacttaactacctagtca

SEQ ID NO: 396780 - DNA, 25 bp, Mus musculus
cttgagcaactttactacctagtca

SEQ ID NO: 396781 - DNA, 25 bp, Mus musculus
cttgagcactcacaccacagggtct

SEQ ID NO: 396782 - DNA, 25 bp, Mus musculus
cttgagcactcagaccacagggtct

SEQ ID NO: 396783 - DNA, 25 bp, Mus musculus
cttgagcagggcagacatgtcacag

SEQ ID NO: 396784 - DNA, 25 bp, Mus musculus
cttgagcagggctgacatgtcacag

SEQ ID NO: 396785 - DNA, 25 bp, Mus musculus
cttgagccacacacttaaatcagaa

SEQ ID NO: 396786 - DNA, 25 bp, Mus musculus
cttgagccacactcttaaatcagaa

SEQ ID NO: 396787 - DNA, 25 bp, Mus musculus
cttgagcccatgctctacatgttaa

SEQ ID NO: 396788 - DNA, 25 bp, Mus musculus
cttgagcccatggtctacatgttaa

SEQ ID NO: 396789 - DNA, 25 bp, Mus musculus
cttgagcccctaattgctttggaat

SEQ ID NO: 396790 - DNA, 25 bp, Mus musculus
cttgagcccctatttgctttggaat

SEQ ID NO: 396791 - DNA, 25 bp, Mus musculus
cttgagccggatccacagtcctgtt

SEQ ID NO: 396792 - DNA, 25 bp, Mus musculus
cttgagccggatgcacagtcctgtt

SEQ ID NO: 396793 - DNA, 25 bp, Mus musculus
cttgagccgtaccttttagaaactg

SEQ ID NO: 396794 - DNA, 25 bp, Mus musculus
cttgagccgtacgttttagaaactg

SEQ ID NO: 396795 - DNA, 25 bp, Mus musculus
cttgagcctcaccttgaagccaagg

SEQ ID NO: 396796 - DNA, 25 bp, Mus musculus
cttgagcctcacgttgaagccaagg

SEQ ID NO: 396797 - DNA, 25 bp, Mus musculus
cttgagccttggctacaggaactgt

SEQ ID NO: 396798 - DNA, 25 bp, Mus musculus
cttgagccttgggtacaggaactgt

SEQ ID NO: 396799 - DNA, 25 bp, Mus musculus
cttgagctaggtcgctttggaccat

SEQ ID NO: 396800 - DNA, 25 bp, Mus musculus
cttgagctaggtggctttggaccat

SEQ ID NO: 396801 - DNA, 25 bp, Mus musculus
cttgagctcactccatttttgaaca

SEQ ID NO: 396802 - DNA, 25 bp, Mus musculus
cttgagctcactgcatttttgaaca

SEQ ID NO: 396803 - DNA, 25 bp, Mus musculus
cttgagctgctcaggtgtactgggt

SEQ ID NO: 396804 - DNA, 25 bp, Mus musculus
cttgagctgctctggtgtactgggt

SEQ ID NO: 396805 - DNA, 25 bp, Mus musculus
cttgagctggatccccagagttcaa

SEQ ID NO: 396806 - DNA, 25 bp, Mus musculus
cttgagctggatgcccagagttcaa

SEQ ID NO: 396807 - DNA, 25 bp, Mus musculus
cttgagctgttgctgtacccctgaa

SEQ ID NO: 396808 - DNA, 25 bp, Mus musculus
cttgagctgttggtgtacccctgaa

SEQ ID NO: 396809 - DNA, 25 bp, Mus musculus
cttgagcttcctccagggtgtgaat

SEQ ID NO: 396810 - DNA, 25 bp, Mus musculus
cttgagcttcctccattgaaaagta

SEQ ID NO: 396811 - DNA, 25 bp, Mus musculus
cttgagcttcctgcagggtgtgaat

SEQ ID NO: 396812 - DNA, 25 bp, Mus musculus
cttgagcttcctgcattgaaaagta

SEQ ID NO: 396813 - DNA, 25 bp, Mus musculus
cttgaggagagtcttcttgcagcat

SEQ ID NO: 396814 - DNA, 25 bp, Mus musculus
cttgaggagagtgttcttgcagcat

SEQ ID NO: 396815 - DNA, 25 bp, Mus musculus
cttgaggagcccagaactgggactc

SEQ ID NO: 396816 - DNA, 25 bp, Mus musculus
cttgaggagccctgaactgggactc

SEQ ID NO: 396817 - DNA, 25 bp, Mus musculus
cttgaggcagttacccgtgtctctg

SEQ ID NO: 396818 - DNA, 25 bp, Mus musculus
cttgaggcagtttcccgtgtctctg

SEQ ID NO: 396819 - DNA, 25 bp, Mus musculus
cttgaggctgttagctccggagcaa

SEQ ID NO: 396820 - DNA, 25 bp, Mus musculus
cttgaggctgtttgctccggagcaa

SEQ ID NO: 396821 - DNA, 25 bp, Mus musculus
cttgagggacacaggagcactgcca

SEQ ID NO: 396822 - DNA, 25 bp, Mus musculus
cttgagggacactggagcactgcca

SEQ ID NO: 396823 - DNA, 25 bp, Mus musculus
cttgagggctgcatgccaaaggcat

SEQ ID NO: 396824 - DNA, 25 bp, Mus musculus
cttgagggctgcttgccaaaggcat

SEQ ID NO: 396825 - DNA, 25 bp, Mus musculus
cttgagggttagaatctgcttagat

SEQ ID NO: 396826 - DNA, 25 bp, Mus musculus
cttgagggttagtatctgcttagat

SEQ ID NO: 396827 - DNA, 25 bp, Mus musculus
cttgaggtaaatactcatgtggtac

SEQ ID NO: 396828 - DNA, 25 bp, Mus musculus
cttgaggtaaattctcatgtggtac

SEQ ID NO: 396829 - DNA, 25 bp, Mus musculus
cttgaggtactcacttatctacatg

SEQ ID NO: 396830 - DNA, 25 bp, Mus musculus
cttgaggtactctcttatctacatg

SEQ ID NO: 396831 - DNA, 25 bp, Mus musculus
cttgaggtaggacgacccacccact

SEQ ID NO: 396832 - DNA, 25 bp, Mus musculus
cttgaggtaggaggacccacccact

SEQ ID NO: 396833 - DNA, 25 bp, Mus musculus
cttgaggtcctgacccatgggacag

SEQ ID NO: 396834 - DNA, 25 bp, Mus musculus
cttgaggtcctgtcccatgggacag

SEQ ID NO: 396835 - DNA, 25 bp, Mus musculus
cttgaggtctgaaggattccacact

SEQ ID NO: 396836 - DNA, 25 bp, Mus musculus
cttgaggtctgatggattccacact

SEQ ID NO: 396837 - DNA, 25 bp, Mus musculus
cttgaggtgagaatccttgggcatc

SEQ ID NO: 396838 - DNA, 25 bp, Mus musculus
cttgaggtgagattccttgggcatc

SEQ ID NO: 396839 - DNA, 25 bp, Mus musculus
cttgagtaacaaaccctgtatgaaa

SEQ ID NO: 396840 - DNA, 25 bp, Mus musculus
cttgagtaacaatccctgtatgaaa

SEQ ID NO: 396841 - DNA, 25 bp, Mus musculus
cttgagtagaggaaccatgtccctg

SEQ ID NO: 396842 - DNA, 25 bp, Mus musculus
cttgagtagaggtaccatgtccctg

SEQ ID NO: 396843 - DNA, 25 bp, Mus musculus
cttgagtagcagcaagcacaggcct

SEQ ID NO: 396844 - DNA, 25 bp, Mus musculus
cttgagtagcaggaagcacaggcct

SEQ ID NO: 396845 - DNA, 25 bp, Mus musculus
cttgagtagtacaatggttgacctg

SEQ ID NO: 396846 - DNA, 25 bp, Mus musculus
cttgagtagtactatggttgacctg

SEQ ID NO: 396847 - DNA, 25 bp, Mus musculus
cttgagtcatctacacatttggcaa

SEQ ID NO: 396848 - DNA, 25 bp, Mus musculus
cttgagtcatcttcacatttggcaa

SEQ ID NO: 396849 - DNA, 25 bp, Mus musculus
cttgagtcctctatagatgaacatt

SEQ ID NO: 396850 - DNA, 25 bp, Mus musculus
cttgagtcctctttagatgaacatt

SEQ ID NO: 396851 - DNA, 25 bp, Mus musculus
cttgagtcctggatggctcctgcag

SEQ ID NO: 396852 - DNA, 25 bp, Mus musculus
cttgagtcctggttggctcctgcag

SEQ ID NO: 396853 - DNA, 25 bp, Mus musculus
cttgagtctaacacgggtgagggca

SEQ ID NO: 396854 - DNA, 25 bp, Mus musculus
cttgagtctaactcgggtgagggca

SEQ ID NO: 396855 - DNA, 25 bp, Mus musculus
cttgagtctctcatttatggctaaa

SEQ ID NO: 396856 - DNA, 25 bp, Mus musculus
cttgagtctctcttttatggctaaa

SEQ ID NO: 396857 - DNA, 25 bp, Mus musculus
cttgagtgcactcggtttgggattt

SEQ ID NO: 396858 - DNA, 25 bp, Mus musculus
cttgagtgcactgggtttgggattt

SEQ ID NO: 396859 - DNA, 25 bp, Mus musculus
cttgagtggagaaggctcaacccct

SEQ ID NO: 396860 - DNA, 25 bp, Mus musculus
cttgagtggagatggctcaacccct

SEQ ID NO: 396861 - DNA, 25 bp, Mus musculus
cttgagtggctaataagtcagtaca

SEQ ID NO: 396862 - DNA, 25 bp, Mus musculus
cttgagtggctattaagtcagtaca

SEQ ID NO: 396863 - DNA, 25 bp, Mus musculus
cttgagtgggtgctccctgtattta

SEQ ID NO: 396864 - DNA, 25 bp, Mus musculus
cttgagtgggtggtccctgtattta

SEQ ID NO: 396865 - DNA, 25 bp, Mus musculus
cttgagtgtgacattgccaggcatt

SEQ ID NO: 396866 - DNA, 25 bp, Mus musculus
cttgagtgtgactttgccaggcatt

SEQ ID NO: 396867 - DNA, 25 bp, Mus musculus
cttgagttataacccaacctgatcc

SEQ ID NO: 396868 - DNA, 25 bp, Mus musculus
cttgagttataagccaacctgatcc

SEQ ID NO: 396869 - DNA, 25 bp, Mus musculus
cttgagttgccacgcttgtgctgta

SEQ ID NO: 396870 - DNA, 25 bp, Mus musculus
cttgagttgccaggcttgtgctgta

SEQ ID NO: 396871 - DNA, 25 bp, Mus musculus
cttgagttgctacggttgagacgtt

SEQ ID NO: 396872 - DNA, 25 bp, Mus musculus
cttgagttgctagggttgagacgtt

SEQ ID NO: 396873 - DNA, 25 bp, Mus musculus
cttgagtttctccagcacctggagg

SEQ ID NO: 396874 - DNA, 25 bp, Mus musculus
cttgagtttctcgagcacctggagg

SEQ ID NO: 396875 - DNA, 25 bp, Mus musculus
cttgagtttgtgactgtctttcccc

SEQ ID NO: 396876 - DNA, 25 bp, Mus musculus
cttgagtttgtgtctgtctttcccc

SEQ ID NO: 396877 - DNA, 25 bp, Mus musculus
cttgataagcaactgttaggcttca

SEQ ID NO: 396878 - DNA, 25 bp, Mus musculus
cttgataagcaagtgttaggcttca

SEQ ID NO: 396879 - DNA, 25 bp, Mus musculus
cttgataaggaccaatgcgcctact

SEQ ID NO: 396880 - DNA, 25 bp, Mus musculus
cttgataaggacgaatgcgcctact

SEQ ID NO: 396881 - DNA, 25 bp, Mus musculus
cttgatacatcaatccgagtctggg

SEQ ID NO: 396882 - DNA, 25 bp, Mus musculus
cttgatacatcattccgagtctggg

SEQ ID NO: 396883 - DNA, 25 bp, Mus musculus
cttgatactctgctgcctggtccag

SEQ ID NO: 396884 - DNA, 25 bp, Mus musculus
cttgatactctggtgcctggtccag

SEQ ID NO: 396885 - DNA, 25 bp, Mus musculus
cttgatagactaagttcaatggata

SEQ ID NO: 396886 - DNA, 25 bp, Mus musculus
cttgatagactatgttcaatggata

SEQ ID NO: 396887 - DNA, 25 bp, Mus musculus
cttgatagccaactagcatgcatat

SEQ ID NO: 396888 - DNA, 25 bp, Mus musculus
cttgatagccaagtagcatgcatat

SEQ ID NO: 396889 - DNA, 25 bp, Mus musculus
cttgatagtgtgaattgtccccttc

SEQ ID NO: 396890 - DNA, 25 bp, Mus musculus
cttgatagtgtgtattgtccccttc

SEQ ID NO: 396891 - DNA, 25 bp, Mus musculus
cttgatatcatgagcttgtctagac

SEQ ID NO: 396892 - DNA, 25 bp, Mus musculus
cttgatatcatgtgcttgtctagac

SEQ ID NO: 396893 - DNA, 25 bp, Mus musculus
cttgatatgtaaagggcacttccca

SEQ ID NO: 396894 - DNA, 25 bp, Mus musculus
cttgatatgtaatgggcacttccca

SEQ ID NO: 396895 - DNA, 25 bp, Mus musculus
cttgatatttatccagggttttgta

SEQ ID NO: 396896 - DNA, 25 bp, Mus musculus
cttgatatttatgcagggttttgta

SEQ ID NO: 396897 - DNA, 25 bp, Mus musculus
cttgatcactctcgtctgctatgga

SEQ ID NO: 396898 - DNA, 25 bp, Mus musculus
cttgatcactctggtctgctatgga

SEQ ID NO: 396899 - DNA, 25 bp, Mus musculus
cttgatcaggagcatgtgacaccaa

SEQ ID NO: 396900 - DNA, 25 bp, Mus musculus
cttgatcaggaggatgtgacaccaa

SEQ ID NO: 396901 - DNA, 25 bp, Mus musculus
cttgatcatgggacttgtaatcagg

SEQ ID NO: 396902 - DNA, 25 bp, Mus musculus
cttgatcatgggtcttgtaatcagg

SEQ ID NO: 396903 - DNA, 25 bp, Mus musculus
cttgatcatgtgaccatcttggttt

SEQ ID NO: 396904 - DNA, 25 bp, Mus musculus
cttgatcatgtgtccatcttggttt

SEQ ID NO: 396905 - DNA, 25 bp, Mus musculus
cttgatcatgttatggtgtgtgttt

SEQ ID NO: 396906 - DNA, 25 bp, Mus musculus
cttgatcatgttttggtgtgtgttt

SEQ ID NO: 396907 - DNA, 25 bp, Mus musculus
cttgatccagcaagggtgtcccggg

SEQ ID NO: 396908 - DNA, 25 bp, Mus musculus
cttgatccagcacccttacagatta

SEQ ID NO: 396909 - DNA, 25 bp, Mus musculus
cttgatccagcagccttacagatta

SEQ ID NO: 396910 - DNA, 25 bp, Mus musculus
cttgatccagcatgggtgtcccggg

SEQ ID NO: 396911 - DNA, 25 bp, Mus musculus
cttgatcccgagcttctgtggcgtg

SEQ ID NO: 396912 - DNA, 25 bp, Mus musculus
cttgatcccgaggttctgtggcgtg

SEQ ID NO: 396913 - DNA, 25 bp, Mus musculus
cttgatccctgcaaatctcacagaa

SEQ ID NO: 396914 - DNA, 25 bp, Mus musculus
cttgatccctgctaatctcacagaa

SEQ ID NO: 396915 - DNA, 25 bp, Mus musculus
cttgatcctcaaattgggactcttt

SEQ ID NO: 396916 - DNA, 25 bp, Mus musculus
cttgatcctcaatttgggactcttt

SEQ ID NO: 396917 - DNA, 25 bp, Mus musculus
cttgatcctcccaccagagtacagt

SEQ ID NO: 396918 - DNA, 25 bp, Mus musculus
cttgatcctccctccagagtacagt

SEQ ID NO: 396919 - DNA, 25 bp, Mus musculus
cttgatcctctaagttgtttataat

SEQ ID NO: 396920 - DNA, 25 bp, Mus musculus
cttgatcctctatgttgtttataat

SEQ ID NO: 396921 - DNA, 25 bp, Mus musculus
cttgatcgctttacatggctgtgat

SEQ ID NO: 396922 - DNA, 25 bp, Mus musculus
cttgatcgcttttcatggctgtgat

SEQ ID NO: 396923 - DNA, 25 bp, Mus musculus
cttgatctagttatacggagtcgga

SEQ ID NO: 396924 - DNA, 25 bp, Mus musculus
cttgatctagttttacggagtcgga

SEQ ID NO: 396925 - DNA, 25 bp, Mus musculus
cttgatctgtttaggtttgtattgt

SEQ ID NO: 396926 - DNA, 25 bp, Mus musculus
cttgatctgttttggtttgtattgt

SEQ ID NO: 396927 - DNA, 25 bp, Mus musculus
cttgatcttcatatggtgaaactgg

SEQ ID NO: 396928 - DNA, 25 bp, Mus musculus
cttgatcttcatttggtgaaactgg

SEQ ID NO: 396929 - DNA, 25 bp, Mus musculus
cttgatcttggtaaggcgaggaaat

SEQ ID NO: 396930 - DNA, 25 bp, Mus musculus
cttgatcttggttaggcgaggaaat

SEQ ID NO: 396931 - DNA, 25 bp, Mus musculus
cttgatgaagcaattctggcatgag

SEQ ID NO: 396932 - DNA, 25 bp, Mus musculus
cttgatgaagcatttctggcatgag

SEQ ID NO: 396933 - DNA, 25 bp, Mus musculus
cttgatgaccccactttgatagggt

SEQ ID NO: 396934 - DNA, 25 bp, Mus musculus
cttgatgacccctctttgatagggt

SEQ ID NO: 396935 - DNA, 25 bp, Mus musculus
cttgatgaggttagcttctgtctta

SEQ ID NO: 396936 - DNA, 25 bp, Mus musculus
cttgatgaggtttgcttctgtctta

SEQ ID NO: 396937 - DNA, 25 bp, Mus musculus
cttgatgatgctagagtgtcacgta

SEQ ID NO: 396938 - DNA, 25 bp, Mus musculus
cttgatgatgcttgagtgtcacgta

SEQ ID NO: 396939 - DNA, 25 bp, Mus musculus
cttgatgatttaccctgagttcttc

SEQ ID NO: 396940 - DNA, 25 bp, Mus musculus
cttgatgatttagcctgagttcttc

SEQ ID NO: 396941 - DNA, 25 bp, Mus musculus
cttgatgcataaattctcttggctt

SEQ ID NO: 396942 - DNA, 25 bp, Mus musculus
cttgatgcataatttctcttggctt

SEQ ID NO: 396943 - DNA, 25 bp, Mus musculus
cttgatgccacccttgttctgaaga

SEQ ID NO: 396944 - DNA, 25 bp, Mus musculus
cttgatgccaccgttgttctgaaga

SEQ ID NO: 396945 - DNA, 25 bp, Mus musculus
cttgatgccctgactttctgctgga

SEQ ID NO: 396946 - DNA, 25 bp, Mus musculus
cttgatgccctgtctttctgctgga

SEQ ID NO: 396947 - DNA, 25 bp, Mus musculus
cttgatgctctactaaaagacagtg

SEQ ID NO: 396948 - DNA, 25 bp, Mus musculus
cttgatgctctagtaaaagacagtg

SEQ ID NO: 396949 - DNA, 25 bp, Mus musculus
cttgatgctgatattgaaactttct

SEQ ID NO: 396950 - DNA, 25 bp, Mus musculus
cttgatgctgattttgaaactttct

SEQ ID NO: 396951 - DNA, 25 bp, Mus musculus
cttgatggaattagcctatctgtct

SEQ ID NO: 396952 - DNA, 25 bp, Mus musculus
cttgatggaatttgcctatctgtct

SEQ ID NO: 396953 - DNA, 25 bp, Mus musculus
cttgatggacgtcgcccgactaggt

SEQ ID NO: 396954 - DNA, 25 bp, Mus musculus
cttgatggacgtggcccgactaggt

SEQ ID NO: 396955 - DNA, 25 bp, Mus musculus
cttgatggccttccgggaacgcaga

SEQ ID NO: 396956 - DNA, 25 bp, Mus musculus
cttgatggccttgcgggaacgcaga

SEQ ID NO: 396957 - DNA, 25 bp, Mus musculus
cttgatggtaacacttggtatcccc

SEQ ID NO: 396958 - DNA, 25 bp, Mus musculus
cttgatggtaactcttggtatcccc

SEQ ID NO: 396959 - DNA, 25 bp, Mus musculus
cttgatgtagagacaaagtcggttc

SEQ ID NO: 396960 - DNA, 25 bp, Mus musculus
cttgatgtagagtcaaagtcggttc

SEQ ID NO: 396961 - DNA, 25 bp, Mus musculus
cttgatgtcttaccacaatgtgcaa

SEQ ID NO: 396962 - DNA, 25 bp, Mus musculus
cttgatgtcttagcacaatgtgcaa

SEQ ID NO: 396963 - DNA, 25 bp, Mus musculus
cttgatgtgactactaacagtgatc

SEQ ID NO: 396964 - DNA, 25 bp, Mus musculus
cttgatgtgacttctaacagtgatc

SEQ ID NO: 396965 - DNA, 25 bp, Mus musculus
cttgattactccaatgtccagcagt

SEQ ID NO: 396966 - DNA, 25 bp, Mus musculus
cttgattactcctatgtccagcagt

SEQ ID NO: 396967 - DNA, 25 bp, Mus musculus
cttgattactctagatttccaagct

SEQ ID NO: 396968 - DNA, 25 bp, Mus musculus
cttgattactcttgatttccaagct

SEQ ID NO: 396969 - DNA, 25 bp, Mus musculus
cttgattatcctccgaactgtacct

SEQ ID NO: 396970 - DNA, 25 bp, Mus musculus
cttgattatcctgcgaactgtacct

SEQ ID NO: 396971 - DNA, 25 bp, Mus musculus
cttgattccgtcaaacgtcagtggg

SEQ ID NO: 396972 - DNA, 25 bp, Mus musculus
cttgattccgtctaacgtcagtggg

SEQ ID NO: 396973 - DNA, 25 bp, Mus musculus
cttgattctttgagtgatgtgggta

SEQ ID NO: 396974 - DNA, 25 bp, Mus musculus
cttgattctttgtgtgatgtgggta

SEQ ID NO: 396975 - DNA, 25 bp, Mus musculus
cttgattgatgaatggacctgagtt

SEQ ID NO: 396976 - DNA, 25 bp, Mus musculus
cttgattgatgattggacctgagtt

SEQ ID NO: 396977 - DNA, 25 bp, Mus musculus
cttgattgatgtagaggctatgtta

SEQ ID NO: 396978 - DNA, 25 bp, Mus musculus
cttgattgatgttgaggctatgtta

SEQ ID NO: 396979 - DNA, 25 bp, Mus musculus
cttgattgcgtccatagttttgcct

SEQ ID NO: 396980 - DNA, 25 bp, Mus musculus
cttgattgcgtcgatagttttgcct

SEQ ID NO: 396981 - DNA, 25 bp, Mus musculus
cttgattgctaaaattaaccttggt

SEQ ID NO: 396982 - DNA, 25 bp, Mus musculus
cttgattgctaatattaaccttggt

SEQ ID NO: 396983 - DNA, 25 bp, Mus musculus
cttgattggcccagtgcctgagggt

SEQ ID NO: 396984 - DNA, 25 bp, Mus musculus
cttgattggccctgtgcctgagggt

SEQ ID NO: 396985 - DNA, 25 bp, Mus musculus
cttgattgtcccagtgactgctgct

SEQ ID NO: 396986 - DNA, 25 bp, Mus musculus
cttgattgtccctgtgactgctgct

SEQ ID NO: 396987 - DNA, 25 bp, Mus musculus
cttgattgttttacaatgtttcaat

SEQ ID NO: 396988 - DNA, 25 bp, Mus musculus
cttgattgtttttcaatgtttcaat

SEQ ID NO: 396989 - DNA, 25 bp, Mus musculus
cttgatttcaccagataacctttgg

SEQ ID NO: 396990 - DNA, 25 bp, Mus musculus
cttgatttcacctgataacctttgg

SEQ ID NO: 396991 - DNA, 25 bp, Mus musculus
cttgatttccggctagccgtgatca

SEQ ID NO: 396992 - DNA, 25 bp, Mus musculus
cttgatttccgggtagccgtgatca

SEQ ID NO: 396993 - DNA, 25 bp, Mus musculus
cttgattttccaagtgtagcttgag

SEQ ID NO: 396994 - DNA, 25 bp, Mus musculus
cttgattttccatgtgtagcttgag

SEQ ID NO: 396995 - DNA, 25 bp, Mus musculus
cttgattttttcagcggtgactttc

SEQ ID NO: 396996 - DNA, 25 bp, Mus musculus
cttgattttttctgcggtgactttc

SEQ ID NO: 396997 - DNA, 25 bp, Mus musculus
cttgcaaaacatcgcttggctcctt

SEQ ID NO: 396998 - DNA, 25 bp, Mus musculus
cttgcaaaacatggcttggctcctt

SEQ ID NO: 396999 - DNA, 25 bp, Mus musculus
cttgcaaattggattagggagcttg

SEQ ID NO: 397000 - DNA, 25 bp, Mus musculus
cttgcaaattggtttagggagcttg

SEQ ID NO: 397001 - DNA, 25 bp, Mus musculus
cttgcaacacaaatctggagtcact

SEQ ID NO: 397002 - DNA, 25 bp, Mus musculus
cttgcaacacaattctggagtcact

SEQ ID NO: 397003 - DNA, 25 bp, Mus musculus
cttgcaacccctagtgaattctgat

SEQ ID NO: 397004 - DNA, 25 bp, Mus musculus
cttgcaaccccttgtgaattctgat

SEQ ID NO: 397005 - DNA, 25 bp, Mus musculus
cttgcaaggaaaacagccgtgaatt

SEQ ID NO: 397006 - DNA, 25 bp, Mus musculus
cttgcaaggaaatcagccgtgaatt

SEQ ID NO: 397007 - DNA, 25 bp, Mus musculus
cttgcaagggatcagacacccttta

SEQ ID NO: 397008 - DNA, 25 bp, Mus musculus
cttgcaagggatgagacacccttta

SEQ ID NO: 397009 - DNA, 25 bp, Mus musculus
cttgcaagggctctctgttgtgtca

SEQ ID NO: 397010 - DNA, 25 bp, Mus musculus
cttgcaagggctgtctgttgtgtca

SEQ ID NO: 397011 - DNA, 25 bp, Mus musculus
cttgcaagtaaaactgaccagagtc

SEQ ID NO: 397012 - DNA, 25 bp, Mus musculus
cttgcaagtaaatctgaccagagtc

SEQ ID NO: 397013 - DNA, 25 bp, Mus musculus
cttgcaatcgaaccagttttctctc

SEQ ID NO: 397014 - DNA, 25 bp, Mus musculus
cttgcaatcgaagcagttttctctc

SEQ ID NO: 397015 - DNA, 25 bp, Mus musculus
cttgcaatgagtagaatttcccttc

SEQ ID NO: 397016 - DNA, 25 bp, Mus musculus
cttgcaatgagttgaatttcccttc

SEQ ID NO: 397017 - DNA, 25 bp, Mus musculus
cttgcaattgctacagcccgagaaa

SEQ ID NO: 397018 - DNA, 25 bp, Mus musculus
cttgcaattgcttcagcccgagaaa

SEQ ID NO: 397019 - DNA, 25 bp, Mus musculus
cttgcacaatcacttcgggttcgtt

SEQ ID NO: 397020 - DNA, 25 bp, Mus musculus
cttgcacaatcagttcgggttcgtt

SEQ ID NO: 397021 - DNA, 25 bp, Mus musculus
cttgcacagagcacgggtcacagac

SEQ ID NO: 397022 - DNA, 25 bp, Mus musculus
cttgcacagagctcgggtcacagac

SEQ ID NO: 397023 - DNA, 25 bp, Mus musculus
cttgcacagcatagggagagcgtat

SEQ ID NO: 397024 - DNA, 25 bp, Mus musculus
cttgcacagcattgggagagcgtat

SEQ ID NO: 397025 - DNA, 25 bp, Mus musculus
cttgcacagtggctagacagctact

SEQ ID NO: 397026 - DNA, 25 bp, Mus musculus
cttgcacagtgggtagacagctact

SEQ ID NO: 397027 - DNA, 25 bp, Mus musculus
cttgcacattccaaccatttaacta

SEQ ID NO: 397028 - DNA, 25 bp, Mus musculus
cttgcacattcctaccatttaacta

SEQ ID NO: 397029 - DNA, 25 bp, Mus musculus
cttgcactgcaaccccgtagatatt

SEQ ID NO: 397030 - DNA, 25 bp, Mus musculus
cttgcactgcaagcccgtagatatt

SEQ ID NO: 397031 - DNA, 25 bp, Mus musculus
cttgcacttgtaattctggtttgtt

SEQ ID NO: 397032 - DNA, 25 bp, Mus musculus
cttgcacttgtatttctggtttgtt

SEQ ID NO: 397033 - DNA, 25 bp, Mus musculus
cttgcactttgacattcccaggagg

SEQ ID NO: 397034 - DNA, 25 bp, Mus musculus
cttgcactttgagattcccaggagg

SEQ ID NO: 397035 - DNA, 25 bp, Mus musculus
cttgcagaagatcccagttcagttc

SEQ ID NO: 397036 - DNA, 25 bp, Mus musculus
cttgcagaagatgccagttcagttc

SEQ ID NO: 397037 - DNA, 25 bp, Mus musculus
cttgcagacaaaagaattccttcga

SEQ ID NO: 397038 - DNA, 25 bp, Mus musculus
cttgcagacaaatgaattccttcga

SEQ ID NO: 397039 - DNA, 25 bp, Mus musculus
cttgcagacagaagaactccgtgtt

SEQ ID NO: 397040 - DNA, 25 bp, Mus musculus
cttgcagacagatgaactccgtgtt

SEQ ID NO: 397041 - DNA, 25 bp, Mus musculus
cttgcagagaccagaaaggctcact

SEQ ID NO: 397042 - DNA, 25 bp, Mus musculus
cttgcagagacctgaaaggctcact

SEQ ID NO: 397043 - DNA, 25 bp, Mus musculus
cttgcagaggacagtttccatcaca

SEQ ID NO: 397044 - DNA, 25 bp, Mus musculus
cttgcagaggactgtttccatcaca

SEQ ID NO: 397045 - DNA, 25 bp, Mus musculus
cttgcagagggacgcactgccacga

SEQ ID NO: 397046 - DNA, 25 bp, Mus musculus
cttgcagagggaggcactgccacga

SEQ ID NO: 397047 - DNA, 25 bp, Mus musculus
cttgcagaggtgacctagccttaga

SEQ ID NO: 397048 - DNA, 25 bp, Mus musculus
cttgcagaggtgtcctagccttaga

SEQ ID NO: 397049 - DNA, 25 bp, Mus musculus
cttgcagcacacacgttggaatctt

SEQ ID NO: 397050 - DNA, 25 bp, Mus musculus
cttgcagcacactcgttggaatctt

SEQ ID NO: 397051 - DNA, 25 bp, Mus musculus
cttgcagcactcactattcagaagc

SEQ ID NO: 397052 - DNA, 25 bp, Mus musculus
cttgcagcactctctattcagaagc

SEQ ID NO: 397053 - DNA, 25 bp, Mus musculus
cttgcagcactgaaatgtttgggtt

SEQ ID NO: 397054 - DNA, 25 bp, Mus musculus
cttgcagcactgagacccatttgaa

SEQ ID NO: 397055 - DNA, 25 bp, Mus musculus
cttgcagcactgtaatgtttgggtt

SEQ ID NO: 397056 - DNA, 25 bp, Mus musculus
cttgcagcactgtgacccatttgaa

SEQ ID NO: 397057 - DNA, 25 bp, Mus musculus
cttgcagcagttagttggtaaggtg

SEQ ID NO: 397058 - DNA, 25 bp, Mus musculus
cttgcagcagtttgttggtaaggtg

SEQ ID NO: 397059 - DNA, 25 bp, Mus musculus
cttgcagcatcacgacttggaaatt

SEQ ID NO: 397060 - DNA, 25 bp, Mus musculus
cttgcagcatcaggacttggaaatt

SEQ ID NO: 397061 - DNA, 25 bp, Mus musculus
cttgcagcatggcaacaaagacatc

SEQ ID NO: 397062 - DNA, 25 bp, Mus musculus
cttgcagcatgggaacaaagacatc

SEQ ID NO: 397063 - DNA, 25 bp, Mus musculus
cttgcagcctttacccaaattatca

SEQ ID NO: 397064 - DNA, 25 bp, Mus musculus
cttgcagccttttcccaaattatca

SEQ ID NO: 397065 - DNA, 25 bp, Mus musculus
cttgcagctcgccattttgctgaaa

SEQ ID NO: 397066 - DNA, 25 bp, Mus musculus
cttgcagctcgcgattttgctgaaa

SEQ ID NO: 397067 - DNA, 25 bp, Mus musculus
cttgcagcttccattccctgtttat

SEQ ID NO: 397068 - DNA, 25 bp, Mus musculus
cttgcagcttcctttccctgtttat

SEQ ID NO: 397069 - DNA, 25 bp, Mus musculus
cttgcaggcctaccggagcccgagt

SEQ ID NO: 397070 - DNA, 25 bp, Mus musculus
cttgcaggcctagcggagcccgagt

SEQ ID NO: 397071 - DNA, 25 bp, Mus musculus
cttgcaggcttcagtgtgtacaatc

SEQ ID NO: 397072 - DNA, 25 bp, Mus musculus
cttgcaggcttctgtgtgtacaatc

SEQ ID NO: 397073 - DNA, 25 bp, Mus musculus
cttgcagggctcaggtggatgaatt

SEQ ID NO: 397074 - DNA, 25 bp, Mus musculus
cttgcagggctctggtggatgaatt

SEQ ID NO: 397075 - DNA, 25 bp, Mus musculus
cttgcaggtatcaaaggcttccaat

SEQ ID NO: 397076 - DNA, 25 bp, Mus musculus
cttgcaggtatctaaggcttccaat

SEQ ID NO: 397077 - DNA, 25 bp, Mus musculus
cttgcaggtggcagaacggaatcac

SEQ ID NO: 397078 - DNA, 25 bp, Mus musculus
cttgcaggtggctgaacggaatcac

SEQ ID NO: 397079 - DNA, 25 bp, Mus musculus
cttgcaggttgaatgaggtagctct

SEQ ID NO: 397080 - DNA, 25 bp, Mus musculus
cttgcaggttgattgaggtagctct

SEQ ID NO: 397081 - DNA, 25 bp, Mus musculus
cttgcaggtttaatttctcattttc

SEQ ID NO: 397082 - DNA, 25 bp, Mus musculus
cttgcaggtttattttctcattttc

SEQ ID NO: 397083 - DNA, 25 bp, Mus musculus
cttgcagtatgtatcctgatcgtgc

SEQ ID NO: 397084 - DNA, 25 bp, Mus musculus
cttgcagtatgtttcctgatcgtgc

SEQ ID NO: 397085 - DNA, 25 bp, Mus musculus
cttgcagtcagcatcataccatttt

SEQ ID NO: 397086 - DNA, 25 bp, Mus musculus
cttgcagtcagcttcataccatttt

SEQ ID NO: 397087 - DNA, 25 bp, Mus musculus
cttgcagtcctgaatgctttgttca

SEQ ID NO: 397088 - DNA, 25 bp, Mus musculus
cttgcagtcctgtatgctttgttca

SEQ ID NO: 397089 - DNA, 25 bp, Mus musculus
cttgcagtgactaacatggaatatg

SEQ ID NO: 397090 - DNA, 25 bp, Mus musculus
cttgcagtgacttacatggaatatg

SEQ ID NO: 397091 - DNA, 25 bp, Mus musculus
cttgcagtgcaaagccaggccagtg

SEQ ID NO: 397092 - DNA, 25 bp, Mus musculus
cttgcagtgcaatgccaggccagtg

SEQ ID NO: 397093 - DNA, 25 bp, Mus musculus
cttgcagtgggcaggatcatgcaga

SEQ ID NO: 397094 - DNA, 25 bp, Mus musculus
cttgcagtgggctggatcatgcaga

SEQ ID NO: 397095 - DNA, 25 bp, Mus musculus
cttgcagttaaaatggccttggtac

SEQ ID NO: 397096 - DNA, 25 bp, Mus musculus
cttgcagttaaattggccttggtac

SEQ ID NO: 397097 - DNA, 25 bp, Mus musculus
cttgcagttgtccatctgtaggctt

SEQ ID NO: 397098 - DNA, 25 bp, Mus musculus
cttgcagttgtcgatctgtaggctt

SEQ ID NO: 397099 - DNA, 25 bp, Mus musculus
cttgcatatgtacaggcagaccgaa

SEQ ID NO: 397100 - DNA, 25 bp, Mus musculus
cttgcatatgtagaggcagaccgaa

SEQ ID NO: 397101 - DNA, 25 bp, Mus musculus
cttgcatcagaaataatgctgacct

SEQ ID NO: 397102 - DNA, 25 bp, Mus musculus
cttgcatcagaattaatgctgacct

SEQ ID NO: 397103 - DNA, 25 bp, Mus musculus
cttgcatccagcagtgtgtccctat

SEQ ID NO: 397104 - DNA, 25 bp, Mus musculus
cttgcatccagctgtgtgtccctat

SEQ ID NO: 397105 - DNA, 25 bp, Mus musculus
cttgcatccccaacagtgcgtgtgg

SEQ ID NO: 397106 - DNA, 25 bp, Mus musculus
cttgcatccccatcagtgcgtgtgg

SEQ ID NO: 397107 - DNA, 25 bp, Mus musculus
cttgcatcgggtctgcgaagacttt

SEQ ID NO: 397108 - DNA, 25 bp, Mus musculus
cttgcatcgggtgtgcgaagacttt

SEQ ID NO: 397109 - DNA, 25 bp, Mus musculus
cttgcatcgtgtctgttctatgttt

SEQ ID NO: 397110 - DNA, 25 bp, Mus musculus
cttgcatcgtgtgtgttctatgttt

SEQ ID NO: 397111 - DNA, 25 bp, Mus musculus
cttgcatctcttacagcagaccaaa

SEQ ID NO: 397112 - DNA, 25 bp, Mus musculus
cttgcatctctttcagcagaccaaa

SEQ ID NO: 397113 - DNA, 25 bp, Mus musculus
cttgcatgcggtaattctttccttt

SEQ ID NO: 397114 - DNA, 25 bp, Mus musculus
cttgcatgcggttattctttccttt

SEQ ID NO: 397115 - DNA, 25 bp, Mus musculus
cttgcatgctaactttagggaccaa

SEQ ID NO: 397116 - DNA, 25 bp, Mus musculus
cttgcatgctaagtttagggaccaa

SEQ ID NO: 397117 - DNA, 25 bp, Mus musculus
cttgcatggcaaccattttacttac

SEQ ID NO: 397118 - DNA, 25 bp, Mus musculus
cttgcatggcaagcattttacttac

SEQ ID NO: 397119 - DNA, 25 bp, Mus musculus
cttgcatggctcaaaacttcctgta

SEQ ID NO: 397120 - DNA, 25 bp, Mus musculus
cttgcatggctctaaacttcctgta

SEQ ID NO: 397121 - DNA, 25 bp, Mus musculus
cttgcatgtcttctgtaagagctct

SEQ ID NO: 397122 - DNA, 25 bp, Mus musculus
cttgcatgtcttgtgtaagagctct

SEQ ID NO: 397123 - DNA, 25 bp, Mus musculus
cttgcatgtgcaaaagcatctctta

SEQ ID NO: 397124 - DNA, 25 bp, Mus musculus
cttgcatgtgcataagcatctctta

SEQ ID NO: 397125 - DNA, 25 bp, Mus musculus
cttgcatgtgtgacagaagctctgg

SEQ ID NO: 397126 - DNA, 25 bp, Mus musculus
cttgcatgtgtgtcagaagctctgg

SEQ ID NO: 397127 - DNA, 25 bp, Mus musculus
cttgcatgttgtatgtatcatcttg

SEQ ID NO: 397128 - DNA, 25 bp, Mus musculus
cttgcatgttgtttgtatcatcttg

SEQ ID NO: 397129 - DNA, 25 bp, Mus musculus
cttgcattagagcttacatacgggt

SEQ ID NO: 397130 - DNA, 25 bp, Mus musculus
cttgcattagaggttacatacgggt

SEQ ID NO: 397131 - DNA, 25 bp, Mus musculus
cttgcattagtcattgtcacaccga

SEQ ID NO: 397132 - DNA, 25 bp, Mus musculus
cttgcattagtctttgtcacaccga

SEQ ID NO: 397133 - DNA, 25 bp, Mus musculus
cttgcattagttattcctacttcat

SEQ ID NO: 397134 - DNA, 25 bp, Mus musculus
cttgcattagtttttcctacttcat

SEQ ID NO: 397135 - DNA, 25 bp, Mus musculus
cttgcattctctagttttctattgg

SEQ ID NO: 397136 - DNA, 25 bp, Mus musculus
cttgcattctcttgttttctattgg

SEQ ID NO: 397137 - DNA, 25 bp, Mus musculus
cttgcattgtgaagatctagtgggc

SEQ ID NO: 397138 - DNA, 25 bp, Mus musculus
cttgcattgtgatgatctagtgggc

SEQ ID NO: 397139 - DNA, 25 bp, Mus musculus
cttgccaaaatgacagagtcccagg

SEQ ID NO: 397140 - DNA, 25 bp, Mus musculus
cttgccaaaatgtcagagtcccagg

SEQ ID NO: 397141 - DNA, 25 bp, Mus musculus
cttgccaaagaaccacaggatcctt

SEQ ID NO: 397142 - DNA, 25 bp, Mus musculus
cttgccaaagaagcacaggatcctt

SEQ ID NO: 397143 - DNA, 25 bp, Mus musculus
cttgccaacaggcagccgagtttta

SEQ ID NO: 397144 - DNA, 25 bp, Mus musculus
cttgccaacagggagccgagtttta

SEQ ID NO: 397145 - DNA, 25 bp, Mus musculus
cttgccaactctctagggaacattt

SEQ ID NO: 397146 - DNA, 25 bp, Mus musculus
cttgccaactctgtagggaacattt

SEQ ID NO: 397147 - DNA, 25 bp, Mus musculus
cttgccaagagaattaatgtgcgta

SEQ ID NO: 397148 - DNA, 25 bp, Mus musculus
cttgccaagagatttaatgtgcgta

SEQ ID NO: 397149 - DNA, 25 bp, Mus musculus
cttgccacaagcatcatttgtacct

SEQ ID NO: 397150 - DNA, 25 bp, Mus musculus
cttgccacaagcttcatttgtacct

SEQ ID NO: 397151 - DNA, 25 bp, Mus musculus
cttgccacagatacctgatgttaga

SEQ ID NO: 397152 - DNA, 25 bp, Mus musculus
cttgccacagattcctgatgttaga

SEQ ID NO: 397153 - DNA, 25 bp, Mus musculus
cttgccacagggactgtaccttaac

SEQ ID NO: 397154 - DNA, 25 bp, Mus musculus
cttgccacagggagcactcatgggc

SEQ ID NO: 397155 - DNA, 25 bp, Mus musculus
cttgccacagggtctgtaccttaac

SEQ ID NO: 397156 - DNA, 25 bp, Mus musculus
cttgccacagggtgcactcatgggc

SEQ ID NO: 397157 - DNA, 25 bp, Mus musculus
cttgccactgacactactcaatgga

SEQ ID NO: 397158 - DNA, 25 bp, Mus musculus
cttgccactgactctactcaatgga

SEQ ID NO: 397159 - DNA, 25 bp, Mus musculus
cttgccagccccatgaaaagaattt

SEQ ID NO: 397160 - DNA, 25 bp, Mus musculus
cttgccagccccttgaaaagaattt

SEQ ID NO: 397161 - DNA, 25 bp, Mus musculus
cttgccaggattctgtacttgagtg

SEQ ID NO: 397162 - DNA, 25 bp, Mus musculus
cttgccaggattgtgtacttgagtg

SEQ ID NO: 397163 - DNA, 25 bp, Mus musculus
cttgccagtcatctgcttagttaaa

SEQ ID NO: 397164 - DNA, 25 bp, Mus musculus
cttgccagtcatgtgcttagttaaa

SEQ ID NO: 397165 - DNA, 25 bp, Mus musculus
cttgccagtctcctgtgtaaattac

SEQ ID NO: 397166 - DNA, 25 bp, Mus musculus
cttgccagtctcgtgtgtaaattac

SEQ ID NO: 397167 - DNA, 25 bp, Mus musculus
cttgccatcggtccccgggctaggc

SEQ ID NO: 397168 - DNA, 25 bp, Mus musculus
cttgccatcggtgcccgggctaggc

SEQ ID NO: 397169 - DNA, 25 bp, Mus musculus
cttgccatctcacaaaagtttcgaa

SEQ ID NO: 397170 - DNA, 25 bp, Mus musculus
cttgccatctcagaaaagtttcgaa

SEQ ID NO: 397171 - DNA, 25 bp, Mus musculus
cttgccatgcatctttgaagagctg

SEQ ID NO: 397172 - DNA, 25 bp, Mus musculus
cttgccatgcatgtttgaagagctg

SEQ ID NO: 397173 - DNA, 25 bp, Mus musculus
cttgccatgtggacttagcatcaac

SEQ ID NO: 397174 - DNA, 25 bp, Mus musculus
cttgccatgtggtcttagcatcaac

SEQ ID NO: 397175 - DNA, 25 bp, Mus musculus
cttgccattgataggatcacaggaa

SEQ ID NO: 397176 - DNA, 25 bp, Mus musculus
cttgccattgattggatcacaggaa

SEQ ID NO: 397177 - DNA, 25 bp, Mus musculus
cttgccatttatagtaaatagggtt

SEQ ID NO: 397178 - DNA, 25 bp, Mus musculus
cttgccatttattgtaaatagggtt

SEQ ID NO: 397179 - DNA, 25 bp, Mus musculus
cttgcccaaggtcacggaacagaag

SEQ ID NO: 397180 - DNA, 25 bp, Mus musculus
cttgcccaaggtgacggaacagaag

SEQ ID NO: 397181 - DNA, 25 bp, Mus musculus
cttgcccacaggaacttttaactca

SEQ ID NO: 397182 - DNA, 25 bp, Mus musculus
cttgcccacaggagctgttgttaat

SEQ ID NO: 397183 - DNA, 25 bp, Mus musculus
cttgcccacaggtacttttaactca

SEQ ID NO: 397184 - DNA, 25 bp, Mus musculus
cttgcccacaggtgctgttgttaat

SEQ ID NO: 397185 - DNA, 25 bp, Mus musculus
cttgcccactacaactttcagtttg

SEQ ID NO: 397186 - DNA, 25 bp, Mus musculus
cttgcccactactactttcagtttg

SEQ ID NO: 397187 - DNA, 25 bp, Mus musculus
cttgcccactggagcactaggtgtg

SEQ ID NO: 397188 - DNA, 25 bp, Mus musculus
cttgcccactggtgcactaggtgtg

SEQ ID NO: 397189 - DNA, 25 bp, Mus musculus
cttgcccagacaattacttaatcat

SEQ ID NO: 397190 - DNA, 25 bp, Mus musculus
cttgcccagacatttacttaatcat

SEQ ID NO: 397191 - DNA, 25 bp, Mus musculus
cttgcccagccaatggctgtatgga

SEQ ID NO: 397192 - DNA, 25 bp, Mus musculus
cttgcccagccattggctgtatgga

SEQ ID NO: 397193 - DNA, 25 bp, Mus musculus
cttgcccatgagcagatgtttacaa

SEQ ID NO: 397194 - DNA, 25 bp, Mus musculus
cttgcccatgaggagatgtttacaa

SEQ ID NO: 397195 - DNA, 25 bp, Mus musculus
cttgcccatggactctcttaaatta

SEQ ID NO: 397196 - DNA, 25 bp, Mus musculus
cttgcccatggagtctcttaaatta

SEQ ID NO: 397197 - DNA, 25 bp, Mus musculus
cttgccccagttcacaggttttaga

SEQ ID NO: 397198 - DNA, 25 bp, Mus musculus
cttgccccagttgacaggttttaga

SEQ ID NO: 397199 - DNA, 25 bp, Mus musculus
cttgccccataaccccattgtaata

SEQ ID NO: 397200 - DNA, 25 bp, Mus musculus
cttgccccataagcccattgtaata

SEQ ID NO: 397201 - DNA, 25 bp, Mus musculus
cttgccccatgtccttttacaataa

SEQ ID NO: 397202 - DNA, 25 bp, Mus musculus
cttgccccatgtgcttttacaataa

SEQ ID NO: 397203 - DNA, 25 bp, Mus musculus
cttgccccgtatcatctgtgacaac

SEQ ID NO: 397204 - DNA, 25 bp, Mus musculus
cttgccccgtatgatctgtgacaac

SEQ ID NO: 397205 - DNA, 25 bp, Mus musculus
cttgccccttcaagtgaatcaagtg

SEQ ID NO: 397206 - DNA, 25 bp, Mus musculus
cttgccccttcatgtgaatcaagtg

SEQ ID NO: 397207 - DNA, 25 bp, Mus musculus
cttgcccgcctcattgtgaaggaag

SEQ ID NO: 397208 - DNA, 25 bp, Mus musculus
cttgcccgcctctttgtgaaggaag

SEQ ID NO: 397209 - DNA, 25 bp, Mus musculus
cttgcccggcagatgttttaggctt

SEQ ID NO: 397210 - DNA, 25 bp, Mus musculus
cttgcccggcagttgttttaggctt

SEQ ID NO: 397211 - DNA, 25 bp, Mus musculus
cttgccctagcaatcttgttcttct

SEQ ID NO: 397212 - DNA, 25 bp, Mus musculus
cttgccctagcattcttgttcttct

SEQ ID NO: 397213 - DNA, 25 bp, Mus musculus
cttgccctcagtattccacttttgg

SEQ ID NO: 397214 - DNA, 25 bp, Mus musculus
cttgccctcagttttccacttttgg

SEQ ID NO: 397215 - DNA, 25 bp, Mus musculus
cttgccctcgcaaaactaacttgag

SEQ ID NO: 397216 - DNA, 25 bp, Mus musculus
cttgccctcgcataactaacttgag

SEQ ID NO: 397217 - DNA, 25 bp, Mus musculus
cttgccctgagccaactgagaaata

SEQ ID NO: 397218 - DNA, 25 bp, Mus musculus
cttgccctgagcgaactgagaaata

SEQ ID NO: 397219 - DNA, 25 bp, Mus musculus
cttgccctgatcagtttttgtctaa

SEQ ID NO: 397220 - DNA, 25 bp, Mus musculus
cttgccctgatctgtttttgtctaa

SEQ ID NO: 397221 - DNA, 25 bp, Mus musculus
cttgccctgcacataaataacttcc

SEQ ID NO: 397222 - DNA, 25 bp, Mus musculus
cttgccctgcacttaaataacttcc

SEQ ID NO: 397223 - DNA, 25 bp, Mus musculus
cttgccctgcatcccatgtcatgta

SEQ ID NO: 397224 - DNA, 25 bp, Mus musculus
cttgccctgcatgccatgtcatgta

SEQ ID NO: 397225 - DNA, 25 bp, Mus musculus
cttgcccttcacagttcaagtgttg

SEQ ID NO: 397226 - DNA, 25 bp, Mus musculus
cttgcccttcactgttcaagtgttg

SEQ ID NO: 397227 - DNA, 25 bp, Mus musculus
cttgcccttgaacttctcattgtag

SEQ ID NO: 397228 - DNA, 25 bp, Mus musculus
cttgcccttgaagttctcattgtag

SEQ ID NO: 397229 - DNA, 25 bp, Mus musculus
cttgcccttgcaatctaacctagaa

SEQ ID NO: 397230 - DNA, 25 bp, Mus musculus
cttgcccttgcattctaacctagaa

SEQ ID NO: 397231 - DNA, 25 bp, Mus musculus
cttgccgatgaaccctagcattctt

SEQ ID NO: 397232 - DNA, 25 bp, Mus musculus
cttgccgatgaagcctagcattctt

SEQ ID NO: 397233 - DNA, 25 bp, Mus musculus
cttgccgccattcagtgcatggata

SEQ ID NO: 397234 - DNA, 25 bp, Mus musculus
cttgccgccattgagtgcatggata

SEQ ID NO: 397235 - DNA, 25 bp, Mus musculus
cttgccgcctttcgaaagtgggact

SEQ ID NO: 397236 - DNA, 25 bp, Mus musculus
cttgccgcctttggaaagtgggact

SEQ ID NO: 397237 - DNA, 25 bp, Mus musculus
cttgccgctttgatgttccataata

SEQ ID NO: 397238 - DNA, 25 bp, Mus musculus
cttgccgctttgttgttccataata

SEQ ID NO: 397239 - DNA, 25 bp, Mus musculus
cttgccggagctcctgcatatagat

SEQ ID NO: 397240 - DNA, 25 bp, Mus musculus
cttgccggagctgctgcatatagat

SEQ ID NO: 397241 - DNA, 25 bp, Mus musculus
cttgccgtttatcttggtcgcatca

SEQ ID NO: 397242 - DNA, 25 bp, Mus musculus
cttgccgtttatgttggtcgcatca

SEQ ID NO: 397243 - DNA, 25 bp, Mus musculus
cttgcctaactcacaaactgttggg

SEQ ID NO: 397244 - DNA, 25 bp, Mus musculus
cttgcctaactctcaaactgttggg

SEQ ID NO: 397245 - DNA, 25 bp, Mus musculus
cttgcctaaggcctttgggatctgt

SEQ ID NO: 397246 - DNA, 25 bp, Mus musculus
cttgcctaaggcgtttgggatctgt

SEQ ID NO: 397247 - DNA, 25 bp, Mus musculus
cttgcctaggaaccccaaggttgga

SEQ ID NO: 397248 - DNA, 25 bp, Mus musculus
cttgcctaggaagcccaaggttgga

SEQ ID NO: 397249 - DNA, 25 bp, Mus musculus
cttgcctagtgtcactgagggccta

SEQ ID NO: 397250 - DNA, 25 bp, Mus musculus
cttgcctagtgtgactgagggccta

SEQ ID NO: 397251 - DNA, 25 bp, Mus musculus
cttgcctcatgcagaaagctgagct

SEQ ID NO: 397252 - DNA, 25 bp, Mus musculus
cttgcctcatgctgaaagctgagct

SEQ ID NO: 397253 - DNA, 25 bp, Mus musculus
cttgcctctatgcatgtagttgaga

SEQ ID NO: 397254 - DNA, 25 bp, Mus musculus
cttgcctctatggatgtagttgaga

SEQ ID NO: 397255 - DNA, 25 bp, Mus musculus
cttgcctctcacctgtaagatattt

SEQ ID NO: 397256 - DNA, 25 bp, Mus musculus
cttgcctctcacgtgtaagatattt

SEQ ID NO: 397257 - DNA, 25 bp, Mus musculus
cttgcctcttcaaggaacttatgtg

SEQ ID NO: 397258 - DNA, 25 bp, Mus musculus
cttgcctcttcatggaacttatgtg

SEQ ID NO: 397259 - DNA, 25 bp, Mus musculus
cttgcctcttccagctggtagaaaa

SEQ ID NO: 397260 - DNA, 25 bp, Mus musculus
cttgcctcttcctgctggtagaaaa

SEQ ID NO: 397261 - DNA, 25 bp, Mus musculus
cttgcctgacccaactgagaaagag

SEQ ID NO: 397262 - DNA, 25 bp, Mus musculus
cttgcctgaccctactgagaaagag

SEQ ID NO: 397263 - DNA, 25 bp, Mus musculus
cttgcctgaggcaccactgtcatcg

SEQ ID NO: 397264 - DNA, 25 bp, Mus musculus
cttgcctgaggctccactgtcatcg

SEQ ID NO: 397265 - DNA, 25 bp, Mus musculus
cttgcctgcactaggcaggtgctat

SEQ ID NO: 397266 - DNA, 25 bp, Mus musculus
cttgcctgcacttggcaggtgctat

SEQ ID NO: 397267 - DNA, 25 bp, Mus musculus
cttgcctgcatgcactatgcacatg

SEQ ID NO: 397268 - DNA, 25 bp, Mus musculus
cttgcctgcatggactatgcacatg

SEQ ID NO: 397269 - DNA, 25 bp, Mus musculus
cttgcctgctggaagtctgttttgg

SEQ ID NO: 397270 - DNA, 25 bp, Mus musculus
cttgcctgctggtagtctgttttgg

SEQ ID NO: 397271 - DNA, 25 bp, Mus musculus
cttgcctgctgtcccaagtggtcag

SEQ ID NO: 397272 - DNA, 25 bp, Mus musculus
cttgcctgctgtgccaagtggtcag

SEQ ID NO: 397273 - DNA, 25 bp, Mus musculus
cttgcctggctaccatgaggtacta

SEQ ID NO: 397274 - DNA, 25 bp, Mus musculus
cttgcctggctagcatgaggtacta

SEQ ID NO: 397275 - DNA, 25 bp, Mus musculus
cttgcctggtaaagactgcttttgg

SEQ ID NO: 397276 - DNA, 25 bp, Mus musculus
cttgcctggtaaagtcatcctctcc

SEQ ID NO: 397277 - DNA, 25 bp, Mus musculus
cttgcctggtaatgactgcttttgg

SEQ ID NO: 397278 - DNA, 25 bp, Mus musculus
cttgcctggtaatgtcatcctctcc

SEQ ID NO: 397279 - DNA, 25 bp, Mus musculus
cttgcctggtggaatctatgatatt

SEQ ID NO: 397280 - DNA, 25 bp, Mus musculus
cttgcctggtggtatctatgatatt

SEQ ID NO: 397281 - DNA, 25 bp, Mus musculus
cttgcctgttgacttccacttgtac

SEQ ID NO: 397282 - DNA, 25 bp, Mus musculus
cttgcctgttgagttccacttgtac

SEQ ID NO: 397283 - DNA, 25 bp, Mus musculus
cttgcctgttgtatggattacattt

SEQ ID NO: 397284 - DNA, 25 bp, Mus musculus
cttgcctgttgtttggattacattt

SEQ ID NO: 397285 - DNA, 25 bp, Mus musculus
cttgcctgttttccatcgggtgaaa

SEQ ID NO: 397286 - DNA, 25 bp, Mus musculus
cttgcctgttttgcatcgggtgaaa

SEQ ID NO: 397287 - DNA, 25 bp, Mus musculus
cttgccttaagccagtgactcagat

SEQ ID NO: 397288 - DNA, 25 bp, Mus musculus
cttgccttaagcgagtgactcagat

SEQ ID NO: 397289 - DNA, 25 bp, Mus musculus
cttgccttacctagattacatccta

SEQ ID NO: 397290 - DNA, 25 bp, Mus musculus
cttgccttaccttgattacatccta

SEQ ID NO: 397291 - DNA, 25 bp, Mus musculus
cttgccttataaactgctcctgaga

SEQ ID NO: 397292 - DNA, 25 bp, Mus musculus
cttgccttataatctgctcctgaga

SEQ ID NO: 397293 - DNA, 25 bp, Mus musculus
cttgccttatggaatgcctcctgaa

SEQ ID NO: 397294 - DNA, 25 bp, Mus musculus
cttgccttatggtatgcctcctgaa

SEQ ID NO: 397295 - DNA, 25 bp, Mus musculus
cttgccttcaaactaagatgtggac

SEQ ID NO: 397296 - DNA, 25 bp, Mus musculus
cttgccttcaaagtaagatgtggac

SEQ ID NO: 397297 - DNA, 25 bp, Mus musculus
cttgccttcaggatgcactcaaggt

SEQ ID NO: 397298 - DNA, 25 bp, Mus musculus
cttgccttcaggttgcactcaaggt

SEQ ID NO: 397299 - DNA, 25 bp, Mus musculus
cttgccttcagtacagatgtgctct

SEQ ID NO: 397300 - DNA, 25 bp, Mus musculus
cttgccttcagttcagatgtgctct

SEQ ID NO: 397301 - DNA, 25 bp, Mus musculus
cttgccttccacaggtaagcactgt

SEQ ID NO: 397302 - DNA, 25 bp, Mus musculus
cttgccttccactggtaagcactgt

SEQ ID NO: 397303 - DNA, 25 bp, Mus musculus
cttgccttctcaactcttaccttaa

SEQ ID NO: 397304 - DNA, 25 bp, Mus musculus
cttgccttctcatctcttaccttaa

SEQ ID NO: 397305 - DNA, 25 bp, Mus musculus
cttgccttctcgaaacacacatgaa

SEQ ID NO: 397306 - DNA, 25 bp, Mus musculus
cttgccttctcgtaacacacatgaa

SEQ ID NO: 397307 - DNA, 25 bp, Mus musculus
cttgccttctgaactgtgcacaaag

SEQ ID NO: 397308 - DNA, 25 bp, Mus musculus
cttgccttctgatctgtgcacaaag

SEQ ID NO: 397309 - DNA, 25 bp, Mus musculus
cttgccttgaacatgtagacatctg

SEQ ID NO: 397310 - DNA, 25 bp, Mus musculus
cttgccttgaacttgtagacatctg

SEQ ID NO: 397311 - DNA, 25 bp, Mus musculus
cttgccttgatacctgacctggata

SEQ ID NO: 397312 - DNA, 25 bp, Mus musculus
cttgccttgatagctgacctggata

SEQ ID NO: 397313 - DNA, 25 bp, Mus musculus
cttgccttgggaatcactgttggaa

SEQ ID NO: 397314 - DNA, 25 bp, Mus musculus
cttgccttgggattcactgttggaa

SEQ ID NO: 397315 - DNA, 25 bp, Mus musculus
cttgccttgggtatgcagatttgtt

SEQ ID NO: 397316 - DNA, 25 bp, Mus musculus
cttgccttgggtttgcagatttgtt

SEQ ID NO: 397317 - DNA, 25 bp, Mus musculus
cttgccttgtctcagcttggatgga

SEQ ID NO: 397318 - DNA, 25 bp, Mus musculus
cttgccttgtctgagcttggatgga

SEQ ID NO: 397319 - DNA, 25 bp, Mus musculus
cttgccttgttgactttcatgctaa

SEQ ID NO: 397320 - DNA, 25 bp, Mus musculus
cttgccttgttgtctttcatgctaa

SEQ ID NO: 397321 - DNA, 25 bp, Mus musculus
cttgcctttagcactgttctcaaat

SEQ ID NO: 397322 - DNA, 25 bp, Mus musculus
cttgcctttagctctgttctcaaat

SEQ ID NO: 397323 - DNA, 25 bp, Mus musculus
cttgcctttttgctgcagttggaga

SEQ ID NO: 397324 - DNA, 25 bp, Mus musculus
cttgcctttttggtgcagttggaga

SEQ ID NO: 397325 - DNA, 25 bp, Mus musculus
cttgccttttttcccattatgagta

SEQ ID NO: 397326 - DNA, 25 bp, Mus musculus
cttgccttttttgccattatgagta

SEQ ID NO: 397327 - DNA, 25 bp, Mus musculus
cttgcgaccattagaaccagttgat

SEQ ID NO: 397328 - DNA, 25 bp, Mus musculus
cttgcgaccatttgaaccagttgat

SEQ ID NO: 397329 - DNA, 25 bp, Mus musculus
cttgcgacccagcagcttaattcgg

SEQ ID NO: 397330 - DNA, 25 bp, Mus musculus
cttgcgacccaggagcttaattcgg

SEQ ID NO: 397331 - DNA, 25 bp, Mus musculus
cttgcgacgtctctggacctgtacc

SEQ ID NO: 397332 - DNA, 25 bp, Mus musculus
cttgcgacgtctgtggacctgtacc

SEQ ID NO: 397333 - DNA, 25 bp, Mus musculus
cttgcgagcttaaggatggaggaca

SEQ ID NO: 397334 - DNA, 25 bp, Mus musculus
cttgcgagcttatggatggaggaca

SEQ ID NO: 397335 - DNA, 25 bp, Mus musculus
cttgcgagtgctacaaagtaagaac

SEQ ID NO: 397336 - DNA, 25 bp, Mus musculus
cttgcgagtgcttcaaagtaagaac

SEQ ID NO: 397337 - DNA, 25 bp, Mus musculus
cttgcgatgattctggacgtaaagc

SEQ ID NO: 397338 - DNA, 25 bp, Mus musculus
cttgcgatgattgtggacgtaaagc

SEQ ID NO: 397339 - DNA, 25 bp, Mus musculus
cttgcgcaggtgaaagacagtgcct

SEQ ID NO: 397340 - DNA, 25 bp, Mus musculus
cttgcgcaggtgtaagacagtgcct

SEQ ID NO: 397341 - DNA, 25 bp, Mus musculus
cttgcggaccaactgatgaggcaga

SEQ ID NO: 397342 - DNA, 25 bp, Mus musculus
cttgcggaccaagtgatgaggcaga

SEQ ID NO: 397343 - DNA, 25 bp, Mus musculus
cttgcggttgttcagatatgcctac

SEQ ID NO: 397344 - DNA, 25 bp, Mus musculus
cttgcggttgttgagatatgcctac

SEQ ID NO: 397345 - DNA, 25 bp, Mus musculus
cttgcgttcattcctcttgagatga

SEQ ID NO: 397346 - DNA, 25 bp, Mus musculus
cttgcgttcattgctcttgagatga

SEQ ID NO: 397347 - DNA, 25 bp, Mus musculus
cttgcgttgtagacctgccgggctt

SEQ ID NO: 397348 - DNA, 25 bp, Mus musculus
cttgcgttgtagtcctgccgggctt

SEQ ID NO: 397349 - DNA, 25 bp, Mus musculus
cttgcgttgtctcgattttgttatc

SEQ ID NO: 397350 - DNA, 25 bp, Mus musculus
cttgcgttgtctggattttgttatc

SEQ ID NO: 397351 - DNA, 25 bp, Mus musculus
cttgcgtttgccacagcggatatgt

SEQ ID NO: 397352 - DNA, 25 bp, Mus musculus
cttgcgtttgcctcagcggatatgt

SEQ ID NO: 397353 - DNA, 25 bp, Mus musculus
cttgctaaatgtatgcagcctcata

SEQ ID NO: 397354 - DNA, 25 bp, Mus musculus
cttgctaaatgtttgcagcctcata

SEQ ID NO: 397355 - DNA, 25 bp, Mus musculus
cttgctaatataatcttataggcta

SEQ ID NO: 397356 - DNA, 25 bp, Mus musculus
cttgctaatatattcttataggcta

SEQ ID NO: 397357 - DNA, 25 bp, Mus musculus
cttgctaatgatctctgctgtttga

SEQ ID NO: 397358 - DNA, 25 bp, Mus musculus
cttgctaatgatgtctgctgtttga

SEQ ID NO: 397359 - DNA, 25 bp, Mus musculus
cttgctacagacacccagtagacaa

SEQ ID NO: 397360 - DNA, 25 bp, Mus musculus
cttgctacagactcccagtagacaa

SEQ ID NO: 397361 - DNA, 25 bp, Mus musculus
cttgctacagagacactttaatgtt

SEQ ID NO: 397362 - DNA, 25 bp, Mus musculus
cttgctacagagtcactttaatgtt

SEQ ID NO: 397363 - DNA, 25 bp, Mus musculus
cttgctacagtaagggacgttcaca

SEQ ID NO: 397364 - DNA, 25 bp, Mus musculus
cttgctacagtatgggacgttcaca

SEQ ID NO: 397365 - DNA, 25 bp, Mus musculus
cttgctacatagcagttcagacttc

SEQ ID NO: 397366 - DNA, 25 bp, Mus musculus
cttgctacataggagttcagacttc

SEQ ID NO: 397367 - DNA, 25 bp, Mus musculus
cttgctagcttgattgtgggttggt

SEQ ID NO: 397368 - DNA, 25 bp, Mus musculus
cttgctagcttgtttgtgggttggt

SEQ ID NO: 397369 - DNA, 25 bp, Mus musculus
cttgctaggaagattctttggatca

SEQ ID NO: 397370 - DNA, 25 bp, Mus musculus
cttgctaggaagtttctttggatca

SEQ ID NO: 397371 - DNA, 25 bp, Mus musculus
cttgctaggccacagatatctgctg

SEQ ID NO: 397372 - DNA, 25 bp, Mus musculus
cttgctaggccagagatatctgctg

SEQ ID NO: 397373 - DNA, 25 bp, Mus musculus
cttgctatccagctatggtgtgcca

SEQ ID NO: 397374 - DNA, 25 bp, Mus musculus
cttgctatccaggtatggtgtgcca

SEQ ID NO: 397375 - DNA, 25 bp, Mus musculus
cttgctatccgacccattaaactgt

SEQ ID NO: 397376 - DNA, 25 bp, Mus musculus
cttgctatccgagccattaaactgt

SEQ ID NO: 397377 - DNA, 25 bp, Mus musculus
cttgctatgctcaacagaagtgtaa

SEQ ID NO: 397378 - DNA, 25 bp, Mus musculus
cttgctatgctctacagaagtgtaa

SEQ ID NO: 397379 - DNA, 25 bp, Mus musculus
cttgctatgtatctgatttgtgatt

SEQ ID NO: 397380 - DNA, 25 bp, Mus musculus
cttgctatgtatgtgatttgtgatt

SEQ ID NO: 397381 - DNA, 25 bp, Mus musculus
cttgctatgtggagtctctgtgcta

SEQ ID NO: 397382 - DNA, 25 bp, Mus musculus
cttgctatgtggtgtctctgtgcta

SEQ ID NO: 397383 - DNA, 25 bp, Mus musculus
cttgctatgttcatgttcaactaaa

SEQ ID NO: 397384 - DNA, 25 bp, Mus musculus
cttgctatgttcttgttcaactaaa

SEQ ID NO: 397385 - DNA, 25 bp, Mus musculus
cttgctattagtatctttaatgcct

SEQ ID NO: 397386 - DNA, 25 bp, Mus musculus
cttgctattagtttctttaatgcct

SEQ ID NO: 397387 - DNA, 25 bp, Mus musculus
cttgctattataactgctgtccatg

SEQ ID NO: 397388 - DNA, 25 bp, Mus musculus
cttgctattatatctgctgtccatg

SEQ ID NO: 397389 - DNA, 25 bp, Mus musculus
cttgctattcaccagtgcatctgga

SEQ ID NO: 397390 - DNA, 25 bp, Mus musculus
cttgctattcacgagtgcatctgga

SEQ ID NO: 397391 - DNA, 25 bp, Mus musculus
cttgctcacttcatcttactgaatg

SEQ ID NO: 397392 - DNA, 25 bp, Mus musculus
cttgctcacttcttcttactgaatg

SEQ ID NO: 397393 - DNA, 25 bp, Mus musculus
cttgctcagattatacagtgtcact

SEQ ID NO: 397394 - DNA, 25 bp, Mus musculus
cttgctcagattttacagtgtcact

SEQ ID NO: 397395 - DNA, 25 bp, Mus musculus
cttgctcatgaccttgattcgttat

SEQ ID NO: 397396 - DNA, 25 bp, Mus musculus
cttgctcatgacgttgattcgttat

SEQ ID NO: 397397 - DNA, 25 bp, Mus musculus
cttgctcatgctcggcaagttgctt

SEQ ID NO: 397398 - DNA, 25 bp, Mus musculus
cttgctcatgctgggcaagttgctt

SEQ ID NO: 397399 - DNA, 25 bp, Mus musculus
cttgctcattgcatagtttcactct

SEQ ID NO: 397400 - DNA, 25 bp, Mus musculus
cttgctcattgcttagtttcactct

SEQ ID NO: 397401 - DNA, 25 bp, Mus musculus
cttgctccaggcaggacatcagact

SEQ ID NO: 397402 - DNA, 25 bp, Mus musculus
cttgctccaggctggacatcagact

SEQ ID NO: 397403 - DNA, 25 bp, Mus musculus
cttgctccattgaccagactggcct

SEQ ID NO: 397404 - DNA, 25 bp, Mus musculus
cttgctccattgtccagactggcct

SEQ ID NO: 397405 - DNA, 25 bp, Mus musculus
cttgctcctgcaactatggaagtgg

SEQ ID NO: 397406 - DNA, 25 bp, Mus musculus
cttgctcctgcatctatggaagtgg

SEQ ID NO: 397407 - DNA, 25 bp, Mus musculus
cttgctcggcatctatgaaggctga

SEQ ID NO: 397408 - DNA, 25 bp, Mus musculus
cttgctcggcatgtatgaaggctga

SEQ ID NO: 397409 - DNA, 25 bp, Mus musculus
cttgctctagaaagcccctgtaatt

SEQ ID NO: 397410 - DNA, 25 bp, Mus musculus
cttgctctagaatgcccctgtaatt

SEQ ID NO: 397411 - DNA, 25 bp, Mus musculus
cttgctctatgtcccttagtgtaag

SEQ ID NO: 397412 - DNA, 25 bp, Mus musculus
cttgctctatgtgccttagtgtaag

SEQ ID NO: 397413 - DNA, 25 bp, Mus musculus
cttgctctcacacaaggagcttttt

SEQ ID NO: 397414 - DNA, 25 bp, Mus musculus
cttgctctcacagaaggagcttttt

SEQ ID NO: 397415 - DNA, 25 bp, Mus musculus
cttgctctccagactactaaaacag

SEQ ID NO: 397416 - DNA, 25 bp, Mus musculus
cttgctctccagtctactaaaacag

SEQ ID NO: 397417 - DNA, 25 bp, Mus musculus
cttgctctctctcgatctgatcgag

SEQ ID NO: 397418 - DNA, 25 bp, Mus musculus
cttgctctctctggatctgatcgag

SEQ ID NO: 397419 - DNA, 25 bp, Mus musculus
cttgctctgagacgtctaatctcct

SEQ ID NO: 397420 - DNA, 25 bp, Mus musculus
cttgctctgagaggtctaatctcct

SEQ ID NO: 397421 - DNA, 25 bp, Mus musculus
cttgctctgtgtaaatacccttgga

SEQ ID NO: 397422 - DNA, 25 bp, Mus musculus
cttgctctgtgttaatacccttgga

SEQ ID NO: 397423 - DNA, 25 bp, Mus musculus
cttgctcttaacaaaactaagctga

SEQ ID NO: 397424 - DNA, 25 bp, Mus musculus
cttgctcttaactaaactaagctga

SEQ ID NO: 397425 - DNA, 25 bp, Mus musculus
cttgctcttaggcaactcgttttct

SEQ ID NO: 397426 - DNA, 25 bp, Mus musculus
cttgctcttagggaactcgttttct

SEQ ID NO: 397427 - DNA, 25 bp, Mus musculus
cttgctcttatacttactgaattgt

SEQ ID NO: 397428 - DNA, 25 bp, Mus musculus
cttgctcttatagttactgaattgt

SEQ ID NO: 397429 - DNA, 25 bp, Mus musculus
cttgctcttccactccaagatggca

SEQ ID NO: 397430 - DNA, 25 bp, Mus musculus
cttgctcttccagtccaagatggca

SEQ ID NO: 397431 - DNA, 25 bp, Mus musculus
cttgctcttgatacagactgagagg

SEQ ID NO: 397432 - DNA, 25 bp, Mus musculus
cttgctcttgattcagactgagagg

SEQ ID NO: 397433 - DNA, 25 bp, Mus musculus
cttgctcttttcaaaaacaccggtg

SEQ ID NO: 397434 - DNA, 25 bp, Mus musculus
cttgctcttttctaaaacaccggtg

SEQ ID NO: 397435 - DNA, 25 bp, Mus musculus
cttgctgaatgaaacccaccttcct

SEQ ID NO: 397436 - DNA, 25 bp, Mus musculus
cttgctgaatgatacccaccttcct

SEQ ID NO: 397437 - DNA, 25 bp, Mus musculus
cttgctgacagaatgcttcgtgtgt

SEQ ID NO: 397438 - DNA, 25 bp, Mus musculus
cttgctgacagattgcttcgtgtgt

SEQ ID NO: 397439 - DNA, 25 bp, Mus musculus
cttgctgaggcacaatattcccatg

SEQ ID NO: 397440 - DNA, 25 bp, Mus musculus
cttgctgaggcagaatattcccatg

SEQ ID NO: 397441 - DNA, 25 bp, Mus musculus
cttgctgatgctcctcttttgtggg

SEQ ID NO: 397442 - DNA, 25 bp, Mus musculus
cttgctgatgctgctcttttgtggg

SEQ ID NO: 397443 - DNA, 25 bp, Mus musculus
cttgctgcacgtaggattgggtctt

SEQ ID NO: 397444 - DNA, 25 bp, Mus musculus
cttgctgcacgttggattgggtctt

SEQ ID NO: 397445 - DNA, 25 bp, Mus musculus
cttgctgcagaccttgtttttcaca

SEQ ID NO: 397446 - DNA, 25 bp, Mus musculus
cttgctgcagacgttgtttttcaca

SEQ ID NO: 397447 - DNA, 25 bp, Mus musculus
cttgctgcctttccagatttgtgta

SEQ ID NO: 397448 - DNA, 25 bp, Mus musculus
cttgctgcctttgcagatttgtgta

SEQ ID NO: 397449 - DNA, 25 bp, Mus musculus
cttgctgcggcgatcactgtaagga

SEQ ID NO: 397450 - DNA, 25 bp, Mus musculus
cttgctgcggcgttcactgtaagga

SEQ ID NO: 397451 - DNA, 25 bp, Mus musculus
cttgctgcgtttctctttctataga

SEQ ID NO: 397452 - DNA, 25 bp, Mus musculus
cttgctgcgtttgtctttctataga

SEQ ID NO: 397453 - DNA, 25 bp, Mus musculus
cttgctgctgatatggaaactttta

SEQ ID NO: 397454 - DNA, 25 bp, Mus musculus
cttgctgctgatttggaaactttta

SEQ ID NO: 397455 - DNA, 25 bp, Mus musculus
cttgctgctgcactgggtcaagact

SEQ ID NO: 397456 - DNA, 25 bp, Mus musculus
cttgctgctgcagtgggtcaagact

SEQ ID NO: 397457 - DNA, 25 bp, Mus musculus
cttgctgctggcatcacacggaggt

SEQ ID NO: 397458 - DNA, 25 bp, Mus musculus
cttgctgctggcttcacacggaggt

SEQ ID NO: 397459 - DNA, 25 bp, Mus musculus
cttgctgctgttcagtttttattta

SEQ ID NO: 397460 - DNA, 25 bp, Mus musculus
cttgctgctgttgagtttttattta

SEQ ID NO: 397461 - DNA, 25 bp, Mus musculus
cttgctgcttctatgattatgactg

SEQ ID NO: 397462 - DNA, 25 bp, Mus musculus
cttgctgcttctttgattatgactg

SEQ ID NO: 397463 - DNA, 25 bp, Mus musculus
cttgctgcttggagtaatagtactt

SEQ ID NO: 397464 - DNA, 25 bp, Mus musculus
cttgctgcttggtgtaatagtactt

SEQ ID NO: 397465 - DNA, 25 bp, Mus musculus
cttgctgctttgatagttccttatt

SEQ ID NO: 397466 - DNA, 25 bp, Mus musculus
cttgctgctttgttagttccttatt

SEQ ID NO: 397467 - DNA, 25 bp, Mus musculus
cttgctgcttttctggacttgtgac

SEQ ID NO: 397468 - DNA, 25 bp, Mus musculus
cttgctgcttttgtggacttgtgac

SEQ ID NO: 397469 - DNA, 25 bp, Mus musculus
cttgctggacaaactatgggcgtag

SEQ ID NO: 397470 - DNA, 25 bp, Mus musculus
cttgctggacaatctatgggcgtag

SEQ ID NO: 397471 - DNA, 25 bp, Mus musculus
cttgctggacataggagacttcttg

SEQ ID NO: 397472 - DNA, 25 bp, Mus musculus
cttgctggacattggagacttcttg

SEQ ID NO: 397473 - DNA, 25 bp, Mus musculus
cttgctggagaaagatatctgtcaa

SEQ ID NO: 397474 - DNA, 25 bp, Mus musculus
cttgctggagaatgatatctgtcaa

SEQ ID NO: 397475 - DNA, 25 bp, Mus musculus
cttgctggagatcattgcttatacc

SEQ ID NO: 397476 - DNA, 25 bp, Mus musculus
cttgctggagatgattgcttatacc

SEQ ID NO: 397477 - DNA, 25 bp, Mus musculus
cttgctggagctcattgctgatcta

SEQ ID NO: 397478 - DNA, 25 bp, Mus musculus
cttgctggagctgattgctgatcta

SEQ ID NO: 397479 - DNA, 25 bp, Mus musculus
cttgctggagtaagcccacgtgtac

SEQ ID NO: 397480 - DNA, 25 bp, Mus musculus
cttgctggagtatgcccacgtgtac

SEQ ID NO: 397481 - DNA, 25 bp, Mus musculus
cttgctggccagagagagttcttaa

SEQ ID NO: 397482 - DNA, 25 bp, Mus musculus
cttgctggccagtgagagttcttaa

SEQ ID NO: 397483 - DNA, 25 bp, Mus musculus
cttgctggctacaggactcttaaaa

SEQ ID NO: 397484 - DNA, 25 bp, Mus musculus
cttgctggctactggactcttaaaa

SEQ ID NO: 397485 - DNA, 25 bp, Mus musculus
cttgctgggcagacgtggtatacac

SEQ ID NO: 397486 - DNA, 25 bp, Mus musculus
cttgctgggcagatgctctgtgagt

SEQ ID NO: 397487 - DNA, 25 bp, Mus musculus
cttgctgggcagtcgtggtatacac

SEQ ID NO: 397488 - DNA, 25 bp, Mus musculus
cttgctgggcagttgctctgtgagt

SEQ ID NO: 397489 - DNA, 25 bp, Mus musculus
cttgctgggctgctaagatggctca

SEQ ID NO: 397490 - DNA, 25 bp, Mus musculus
cttgctgggctggtaagatggctca

SEQ ID NO: 397491 - DNA, 25 bp, Mus musculus
cttgctgggtcgagatcctgatgaa

SEQ ID NO: 397492 - DNA, 25 bp, Mus musculus
cttgctgggtcgtgatcctgatgaa

SEQ ID NO: 397493 - DNA, 25 bp, Mus musculus
cttgctggtcaacacacctatctgg

SEQ ID NO: 397494 - DNA, 25 bp, Mus musculus
cttgctggtcaagacacctatctgg

SEQ ID NO: 397495 - DNA, 25 bp, Mus musculus
cttgctggtctgatgcttgttttga

SEQ ID NO: 397496 - DNA, 25 bp, Mus musculus
cttgctggtctgttgcttgttttga

SEQ ID NO: 397497 - DNA, 25 bp, Mus musculus
cttgctggtttgaggttgtttatgt

SEQ ID NO: 397498 - DNA, 25 bp, Mus musculus
cttgctggtttgtggttgtttatgt

SEQ ID NO: 397499 - DNA, 25 bp, Mus musculus
cttgctgtacaacgccaaaggctgc

SEQ ID NO: 397500 - DNA, 25 bp, Mus musculus
cttgctgtacaaggccaaaggctgc

SEQ ID NO: 397501 - DNA, 25 bp, Mus musculus
cttgctgtactgacacaggaaaccc

SEQ ID NO: 397502 - DNA, 25 bp, Mus musculus
cttgctgtactgtcacaggaaaccc

SEQ ID NO: 397503 - DNA, 25 bp, Mus musculus
cttgctgtagcaatttcttagagga

SEQ ID NO: 397504 - DNA, 25 bp, Mus musculus
cttgctgtagcattttcttagagga

SEQ ID NO: 397505 - DNA, 25 bp, Mus musculus
cttgctgtaggccacatgctgaagg

SEQ ID NO: 397506 - DNA, 25 bp, Mus musculus
cttgctgtaggcgacatgctgaagg

SEQ ID NO: 397507 - DNA, 25 bp, Mus musculus
cttgctgtaggtcattcttgactgt

SEQ ID NO: 397508 - DNA, 25 bp, Mus musculus
cttgctgtaggtgattcttgactgt

SEQ ID NO: 397509 - DNA, 25 bp, Mus musculus
cttgctgtatatagaatagctactt

SEQ ID NO: 397510 - DNA, 25 bp, Mus musculus
cttgctgtatattgaatagctactt

SEQ ID NO: 397511 - DNA, 25 bp, Mus musculus
cttgctgtatcgagacagctgtgat

SEQ ID NO: 397512 - DNA, 25 bp, Mus musculus
cttgctgtatcgtgacagctgtgat

SEQ ID NO: 397513 - DNA, 25 bp, Mus musculus
cttgctgtatctatttgttgtcttg

SEQ ID NO: 397514 - DNA, 25 bp, Mus musculus
cttgctgtatctttttgttgtcttg

SEQ ID NO: 397515 - DNA, 25 bp, Mus musculus
cttgctgtatgcacacccctagaat

SEQ ID NO: 397516 - DNA, 25 bp, Mus musculus
cttgctgtatgctcacccctagaat

SEQ ID NO: 397517 - DNA, 25 bp, Mus musculus
cttgctgtccagctgacagatgcag

SEQ ID NO: 397518 - DNA, 25 bp, Mus musculus
cttgctgtccaggtgacagatgcag

SEQ ID NO: 397519 - DNA, 25 bp, Mus musculus
cttgctgtctccatgaacctctgaa

SEQ ID NO: 397520 - DNA, 25 bp, Mus musculus
cttgctgtctccttgaacctctgaa

SEQ ID NO: 397521 - DNA, 25 bp, Mus musculus
cttgctgtgaagaacagagcccacc

SEQ ID NO: 397522 - DNA, 25 bp, Mus musculus
cttgctgtgaagtacagagcccacc

SEQ ID NO: 397523 - DNA, 25 bp, Mus musculus
cttgctgtgacgcttcttcatctca

SEQ ID NO: 397524 - DNA, 25 bp, Mus musculus
cttgctgtgacggttcttcatctca

SEQ ID NO: 397525 - DNA, 25 bp, Mus musculus
cttgctgtgcctcttggcagggaaa

SEQ ID NO: 397526 - DNA, 25 bp, Mus musculus
cttgctgtgcctgttggcagggaaa

SEQ ID NO: 397527 - DNA, 25 bp, Mus musculus
cttgctgtgcgaccctggaagagtt

SEQ ID NO: 397528 - DNA, 25 bp, Mus musculus
cttgctgtgcgagcctggaagagtt

SEQ ID NO: 397529 - DNA, 25 bp, Mus musculus
cttgctgtgtaaatgtttctgtctc

SEQ ID NO: 397530 - DNA, 25 bp, Mus musculus
cttgctgtgtaattgtttctgtctc

SEQ ID NO: 397531 - DNA, 25 bp, Mus musculus
cttgctgtgtttattcagtaagact

SEQ ID NO: 397532 - DNA, 25 bp, Mus musculus
cttgctgtgttttttcagtaagact

SEQ ID NO: 397533 - DNA, 25 bp, Mus musculus
cttgctgttgatcaggctctccaaa

SEQ ID NO: 397534 - DNA, 25 bp, Mus musculus
cttgctgttgatgaggctctccaaa

SEQ ID NO: 397535 - DNA, 25 bp, Mus musculus
cttgctgtttgacctggaaaccaat

SEQ ID NO: 397536 - DNA, 25 bp, Mus musculus
cttgctgtttgagctggaaaccaat

SEQ ID NO: 397537 - DNA, 25 bp, Mus musculus
cttgctgttttcactacgtgcttca

SEQ ID NO: 397538 - DNA, 25 bp, Mus musculus
cttgctgttttctctacgtgcttca

SEQ ID NO: 397539 - DNA, 25 bp, Mus musculus
cttgctgttttgcagttctttgcca

SEQ ID NO: 397540 - DNA, 25 bp, Mus musculus
cttgctgttttggagttctttgcca

SEQ ID NO: 397541 - DNA, 25 bp, Mus musculus
cttgctgtttttaattgtcactgaa

SEQ ID NO: 397542 - DNA, 25 bp, Mus musculus
cttgctgttttttattgtcactgaa

SEQ ID NO: 397543 - DNA, 25 bp, Mus musculus
cttgcttaaaaaacctttcactctt

SEQ ID NO: 397544 - DNA, 25 bp, Mus musculus
cttgcttaaaaatcctttcactctt

SEQ ID NO: 397545 - DNA, 25 bp, Mus musculus
cttgcttaaaagatcctcaggtggt

SEQ ID NO: 397546 - DNA, 25 bp, Mus musculus
cttgcttaaaagttcctcaggtggt

SEQ ID NO: 397547 - DNA, 25 bp, Mus musculus
cttgcttaaagcaggttaggacgtg

SEQ ID NO: 397548 - DNA, 25 bp, Mus musculus
cttgcttaaagctggttaggacgtg

SEQ ID NO: 397549 - DNA, 25 bp, Mus musculus
cttgcttaagaaaacagtctgctgt

SEQ ID NO: 397550 - DNA, 25 bp, Mus musculus
cttgcttaagaatacagtctgctgt

SEQ ID NO: 397551 - DNA, 25 bp, Mus musculus
cttgcttaccaaccatctagatgtg

SEQ ID NO: 397552 - DNA, 25 bp, Mus musculus
cttgcttaccaagcatctagatgtg

SEQ ID NO: 397553 - DNA, 25 bp, Mus musculus
cttgcttagagccagaagggatgat

SEQ ID NO: 397554 - DNA, 25 bp, Mus musculus
cttgcttagagcgagaagggatgat

SEQ ID NO: 397555 - DNA, 25 bp, Mus musculus
cttgcttatgccaaaaaggagggat

SEQ ID NO: 397556 - DNA, 25 bp, Mus musculus
cttgcttatgcctaaaaggagggat

SEQ ID NO: 397557 - DNA, 25 bp, Mus musculus
cttgcttatggacgcattctctcaa

SEQ ID NO: 397558 - DNA, 25 bp, Mus musculus
cttgcttatggaggcattctctcaa

SEQ ID NO: 397559 - DNA, 25 bp, Mus musculus
cttgcttcccaactagagttgtcaa

SEQ ID NO: 397560 - DNA, 25 bp, Mus musculus
cttgcttcccaagtagagttgtcaa

SEQ ID NO: 397561 - DNA, 25 bp, Mus musculus
cttgcttcccagattggcaggattt

SEQ ID NO: 397562 - DNA, 25 bp, Mus musculus
cttgcttcccagtttggcaggattt

SEQ ID NO: 397563 - DNA, 25 bp, Mus musculus
cttgcttccggaactgctggtaaga

SEQ ID NO: 397564 - DNA, 25 bp, Mus musculus
cttgcttccggatctgctggtaaga

SEQ ID NO: 397565 - DNA, 25 bp, Mus musculus
cttgcttcgagccagccaatcagat

SEQ ID NO: 397566 - DNA, 25 bp, Mus musculus
cttgcttcgagcgagccaatcagat

SEQ ID NO: 397567 - DNA, 25 bp, Mus musculus
cttgcttcgattactttacccataa

SEQ ID NO: 397568 - DNA, 25 bp, Mus musculus
cttgcttcgatttctttacccataa

SEQ ID NO: 397569 - DNA, 25 bp, Mus musculus
cttgcttcggaacctgtagctgcta

SEQ ID NO: 397570 - DNA, 25 bp, Mus musculus
cttgcttcggaagctgtagctgcta

SEQ ID NO: 397571 - DNA, 25 bp, Mus musculus
cttgcttcgttgagttgcttggttg

SEQ ID NO: 397572 - DNA, 25 bp, Mus musculus
cttgcttcgttgtgttgcttggttg

SEQ ID NO: 397573 - DNA, 25 bp, Mus musculus
cttgcttctcaaaatgctggacatt

SEQ ID NO: 397574 - DNA, 25 bp, Mus musculus
cttgcttctcaatatgctggacatt

SEQ ID NO: 397575 - DNA, 25 bp, Mus musculus
cttgcttctccaatgtacatgtggg

SEQ ID NO: 397576 - DNA, 25 bp, Mus musculus
cttgcttctccattgtacatgtggg

SEQ ID NO: 397577 - DNA, 25 bp, Mus musculus
cttgcttctgctactcctacagatg

SEQ ID NO: 397578 - DNA, 25 bp, Mus musculus
cttgcttctgcttctcctacagatg

SEQ ID NO: 397579 - DNA, 25 bp, Mus musculus
cttgcttctgttcccttaagggtta

SEQ ID NO: 397580 - DNA, 25 bp, Mus musculus
cttgcttctgttgccttaagggtta

SEQ ID NO: 397581 - DNA, 25 bp, Mus musculus
cttgcttcttttcaaagagcgtcaa

SEQ ID NO: 397582 - DNA, 25 bp, Mus musculus
cttgcttcttttgaaagagcgtcaa

SEQ ID NO: 397583 - DNA, 25 bp, Mus musculus
cttgcttgacctaccaggattgagt

SEQ ID NO: 397584 - DNA, 25 bp, Mus musculus
cttgcttgaccttccaggattgagt

SEQ ID NO: 397585 - DNA, 25 bp, Mus musculus
cttgcttgagcacggagtctacaga

SEQ ID NO: 397586 - DNA, 25 bp, Mus musculus
cttgcttgagcagggagtctacaga

SEQ ID NO: 397587 - DNA, 25 bp, Mus musculus
cttgcttgcattcagtttagggttt

SEQ ID NO: 397588 - DNA, 25 bp, Mus musculus
cttgcttgcattgagtttagggttt

SEQ ID NO: 397589 - DNA, 25 bp, Mus musculus
cttgcttgcctcactaacaacaaaa

SEQ ID NO: 397590 - DNA, 25 bp, Mus musculus
cttgcttgcctctctaacaacaaaa

SEQ ID NO: 397591 - DNA, 25 bp, Mus musculus
cttgcttgctacacctaagaactta

SEQ ID NO: 397592 - DNA, 25 bp, Mus musculus
cttgcttgctactcctaagaactta

SEQ ID NO: 397593 - DNA, 25 bp, Mus musculus
cttgcttgctcaacttggtgagact

SEQ ID NO: 397594 - DNA, 25 bp, Mus musculus
cttgcttgctcatcttggtgagact

SEQ ID NO: 397595 - DNA, 25 bp, Mus musculus
cttgcttgctggacttcggtaagaa

SEQ ID NO: 397596 - DNA, 25 bp, Mus musculus
cttgcttgctggtcttcggtaagaa

SEQ ID NO: 397597 - DNA, 25 bp, Mus musculus
cttgcttgcttccaaataaaaattt

SEQ ID NO: 397598 - DNA, 25 bp, Mus musculus
cttgcttgcttcgaaataaaaattt

SEQ ID NO: 397599 - DNA, 25 bp, Mus musculus
cttgcttggctgagtgctttatacc

SEQ ID NO: 397600 - DNA, 25 bp, Mus musculus
cttgcttggctgtgtgctttatacc

SEQ ID NO: 397601 - DNA, 25 bp, Mus musculus
cttgcttggttaccccagcagcttc

SEQ ID NO: 397602 - DNA, 25 bp, Mus musculus
cttgcttggttagcccagcagcttc

SEQ ID NO: 397603 - DNA, 25 bp, Mus musculus
cttgcttgtatcagcaacgtggact

SEQ ID NO: 397604 - DNA, 25 bp, Mus musculus
cttgcttgtatctgcaacgtggact

SEQ ID NO: 397605 - DNA, 25 bp, Mus musculus
cttgcttgtgggattgtgtttcaaa

SEQ ID NO: 397606 - DNA, 25 bp, Mus musculus
cttgcttgtgggtttgtgtttcaaa

SEQ ID NO: 397607 - DNA, 25 bp, Mus musculus
cttgcttgttcgatggtcacttata

SEQ ID NO: 397608 - DNA, 25 bp, Mus musculus
cttgcttgttcgttggtcacttata

SEQ ID NO: 397609 - DNA, 25 bp, Mus musculus
cttgctttaaaacccattctgtaaa

SEQ ID NO: 397610 - DNA, 25 bp, Mus musculus
cttgctttaaaagccattctgtaaa

SEQ ID NO: 397611 - DNA, 25 bp, Mus musculus
cttgctttacacacatcttgttgtg

SEQ ID NO: 397612 - DNA, 25 bp, Mus musculus
cttgctttacactcatcttgttgtg

SEQ ID NO: 397613 - DNA, 25 bp, Mus musculus
cttgctttagtgcagtgggagtcct

SEQ ID NO: 397614 - DNA, 25 bp, Mus musculus
cttgctttagtggagtgggagtcct

SEQ ID NO: 397615 - DNA, 25 bp, Mus musculus
cttgctttatgaagttggtgttgaa

SEQ ID NO: 397616 - DNA, 25 bp, Mus musculus
cttgctttatgatgttggtgttgaa

SEQ ID NO: 397617 - DNA, 25 bp, Mus musculus
cttgctttatttctcctcgtttata

SEQ ID NO: 397618 - DNA, 25 bp, Mus musculus
cttgctttatttgtcctcgtttata

SEQ ID NO: 397619 - DNA, 25 bp, Mus musculus
cttgctttcacaactgttataatgt

SEQ ID NO: 397620 - DNA, 25 bp, Mus musculus
cttgctttcacatctgttataatgt

SEQ ID NO: 397621 - DNA, 25 bp, Mus musculus
cttgctttcactcggctgacatcaa

SEQ ID NO: 397622 - DNA, 25 bp, Mus musculus
cttgctttcactgggctgacatcaa

SEQ ID NO: 397623 - DNA, 25 bp, Mus musculus
cttgctttcatcaggttgtcagttc

SEQ ID NO: 397624 - DNA, 25 bp, Mus musculus
cttgctttcatctggttgtcagttc

SEQ ID NO: 397625 - DNA, 25 bp, Mus musculus
cttgctttctcaatttctctggaca

SEQ ID NO: 397626 - DNA, 25 bp, Mus musculus
cttgctttctcattttctctggaca

SEQ ID NO: 397627 - DNA, 25 bp, Mus musculus
cttgctttctggacttggttctgaa

SEQ ID NO: 397628 - DNA, 25 bp, Mus musculus
cttgctttctggtcttggttctgaa

SEQ ID NO: 397629 - DNA, 25 bp, Mus musculus
cttgctttctttcgagtcctgcaca

SEQ ID NO: 397630 - DNA, 25 bp, Mus musculus
cttgctttctttggagtcctgcaca

SEQ ID NO: 397631 - DNA, 25 bp, Mus musculus
cttgctttgcaactgtgagggcctg

SEQ ID NO: 397632 - DNA, 25 bp, Mus musculus
cttgctttgcaagtgtgagggcctg

SEQ ID NO: 397633 - DNA, 25 bp, Mus musculus
cttgctttgctacttagaagaggga

SEQ ID NO: 397634 - DNA, 25 bp, Mus musculus
cttgctttgctagttagaagaggga

SEQ ID NO: 397635 - DNA, 25 bp, Mus musculus
cttgctttgcttctcctcaaagaga

SEQ ID NO: 397636 - DNA, 25 bp, Mus musculus
cttgctttgcttgtcctcaaagaga

SEQ ID NO: 397637 - DNA, 25 bp, Mus musculus
cttgcttttgatagttcgagcagcg

SEQ ID NO: 397638 - DNA, 25 bp, Mus musculus
cttgcttttgattgttcgagcagcg

SEQ ID NO: 397639 - DNA, 25 bp, Mus musculus
cttgcttttgctataatgggtctga

SEQ ID NO: 397640 - DNA, 25 bp, Mus musculus
cttgcttttgctttaatgggtctga

SEQ ID NO: 397641 - DNA, 25 bp, Mus musculus
cttgctttttgaactgccgtggtta

SEQ ID NO: 397642 - DNA, 25 bp, Mus musculus
cttgctttttgatctgccgtggtta

SEQ ID NO: 397643 - DNA, 25 bp, Mus musculus
cttgcttttttaagtatgctatgta

SEQ ID NO: 397644 - DNA, 25 bp, Mus musculus
cttgcttttttatgtatgctatgta

SEQ ID NO: 397645 - DNA, 25 bp, Mus musculus
cttggaaagattacagcctgcgttg

SEQ ID NO: 397646 - DNA, 25 bp, Mus musculus
cttggaaagatttcagcctgcgttg

SEQ ID NO: 397647 - DNA, 25 bp, Mus musculus
cttggaacagccatgcctgtggaga

SEQ ID NO: 397648 - DNA, 25 bp, Mus musculus
cttggaacagccttgcctgtggaga

SEQ ID NO: 397649 - DNA, 25 bp, Mus musculus
cttggaacagggacagcatatgggt

SEQ ID NO: 397650 - DNA, 25 bp, Mus musculus
cttggaacagggtcagcatatgggt

SEQ ID NO: 397651 - DNA, 25 bp, Mus musculus
cttggaactcacagaactcactgtg

SEQ ID NO: 397652 - DNA, 25 bp, Mus musculus
cttggaactcactgaactcactgtg

SEQ ID NO: 397653 - DNA, 25 bp, Mus musculus
cttggaagctatatactacatggga

SEQ ID NO: 397654 - DNA, 25 bp, Mus musculus
cttggaagctatttactacatggga

SEQ ID NO: 397655 - DNA, 25 bp, Mus musculus
cttggaagcttcagacagggttttt

SEQ ID NO: 397656 - DNA, 25 bp, Mus musculus
cttggaagcttctgacagggttttt

SEQ ID NO: 397657 - DNA, 25 bp, Mus musculus
cttggaaggaagctgtgtacacact

SEQ ID NO: 397658 - DNA, 25 bp, Mus musculus
cttggaaggaaggtgtgtacacact

SEQ ID NO: 397659 - DNA, 25 bp, Mus musculus
cttggaaggttgacagcatggctct

SEQ ID NO: 397660 - DNA, 25 bp, Mus musculus
cttggaaggttgtcagcatggctct

SEQ ID NO: 397661 - DNA, 25 bp, Mus musculus
cttggaagtccacgatcaccagagt

SEQ ID NO: 397662 - DNA, 25 bp, Mus musculus
cttggaagtccaggatcaccagagt

SEQ ID NO: 397663 - DNA, 25 bp, Mus musculus
cttggaagtcttatacatacacaca

SEQ ID NO: 397664 - DNA, 25 bp, Mus musculus
cttggaagtcttttacatacacaca

SEQ ID NO: 397665 - DNA, 25 bp, Mus musculus
cttggaagttgacggagactcagac

SEQ ID NO: 397666 - DNA, 25 bp, Mus musculus
cttggaagttgagggagactcagac

SEQ ID NO: 397667 - DNA, 25 bp, Mus musculus
cttggaataaatcaagagcagaccc

SEQ ID NO: 397668 - DNA, 25 bp, Mus musculus
cttggaataaatgaagagcagaccc

SEQ ID NO: 397669 - DNA, 25 bp, Mus musculus
cttggaatactaccggcccaggtgg

SEQ ID NO: 397670 - DNA, 25 bp, Mus musculus
cttggaatactacctcatgcagata

SEQ ID NO: 397671 - DNA, 25 bp, Mus musculus
cttggaatactagcggcccaggtgg

SEQ ID NO: 397672 - DNA, 25 bp, Mus musculus
cttggaatactagctcatgcagata

SEQ ID NO: 397673 - DNA, 25 bp, Mus musculus
cttggaatagtcacccatttcagtt

SEQ ID NO: 397674 - DNA, 25 bp, Mus musculus
cttggaatagtctcccatttcagtt

SEQ ID NO: 397675 - DNA, 25 bp, Mus musculus
cttggaatcaatctgatcaatgtaa

SEQ ID NO: 397676 - DNA, 25 bp, Mus musculus
cttggaatcaatgtgatcaatgtaa

SEQ ID NO: 397677 - DNA, 25 bp, Mus musculus
cttggaatccctactgagaacagaa

SEQ ID NO: 397678 - DNA, 25 bp, Mus musculus
cttggaatcccttctgagaacagaa

SEQ ID NO: 397679 - DNA, 25 bp, Mus musculus
cttggaattgggaggccctggctca

SEQ ID NO: 397680 - DNA, 25 bp, Mus musculus
cttggaattgggtggccctggctca

SEQ ID NO: 397681 - DNA, 25 bp, Mus musculus
cttggaatttcactcttgtctgtat

SEQ ID NO: 397682 - DNA, 25 bp, Mus musculus
cttggaatttcagtcttgtctgtat

SEQ ID NO: 397683 - DNA, 25 bp, Mus musculus
cttggacaaagtattgggcagcctt

SEQ ID NO: 397684 - DNA, 25 bp, Mus musculus
cttggacaaagttttgggcagcctt

SEQ ID NO: 397685 - DNA, 25 bp, Mus musculus
cttggacacaagatacttcaatctc

SEQ ID NO: 397686 - DNA, 25 bp, Mus musculus
cttggacacaagttacttcaatctc

SEQ ID NO: 397687 - DNA, 25 bp, Mus musculus
cttggacacagacggccccttgatg

SEQ ID NO: 397688 - DNA, 25 bp, Mus musculus
cttggacacagagggccccttgatg

SEQ ID NO: 397689 - DNA, 25 bp, Mus musculus
cttggacacccaacagtttttgctg

SEQ ID NO: 397690 - DNA, 25 bp, Mus musculus
cttggacacccatcagtttttgctg

SEQ ID NO: 397691 - DNA, 25 bp, Mus musculus
cttggacacctaactatatcctcat

SEQ ID NO: 397692 - DNA, 25 bp, Mus musculus
cttggacacctatctatatcctcat

SEQ ID NO: 397693 - DNA, 25 bp, Mus musculus
cttggacagcgaccctttggtacat

SEQ ID NO: 397694 - DNA, 25 bp, Mus musculus
cttggacagcgagcctttggtacat

SEQ ID NO: 397695 - DNA, 25 bp, Mus musculus
cttggacagggcactctggtgcaga

SEQ ID NO: 397696 - DNA, 25 bp, Mus musculus
cttggacagggctctctggtgcaga

SEQ ID NO: 397697 - DNA, 25 bp, Mus musculus
cttggacagtttcctggccgtcgac

SEQ ID NO: 397698 - DNA, 25 bp, Mus musculus
cttggacagtttgctggccgtcgac

SEQ ID NO: 397699 - DNA, 25 bp, Mus musculus
cttggacatccacatggcttttggt

SEQ ID NO: 397700 - DNA, 25 bp, Mus musculus
cttggacatccagatggcttttggt

SEQ ID NO: 397701 - DNA, 25 bp, Mus musculus
cttggacattggacacttgtaggaa

SEQ ID NO: 397702 - DNA, 25 bp, Mus musculus
cttggacattggtcacttgtaggaa

SEQ ID NO: 397703 - DNA, 25 bp, Mus musculus
cttggaccaccaagccttgaatggt

SEQ ID NO: 397704 - DNA, 25 bp, Mus musculus
cttggaccaccatgccttgaatggt

SEQ ID NO: 397705 - DNA, 25 bp, Mus musculus
cttggaccataaatcactcagtttg

SEQ ID NO: 397706 - DNA, 25 bp, Mus musculus
cttggaccataattcactcagtttg

SEQ ID NO: 397707 - DNA, 25 bp, Mus musculus
cttggacctattatctatgttgcct

SEQ ID NO: 397708 - DNA, 25 bp, Mus musculus
cttggacctattttctatgttgcct

SEQ ID NO: 397709 - DNA, 25 bp, Mus musculus
cttggacctcggcactaatcggatt

SEQ ID NO: 397710 - DNA, 25 bp, Mus musculus
cttggacctcgggactaatcggatt

SEQ ID NO: 397711 - DNA, 25 bp, Mus musculus
cttggacctgatcaggcgcctgcct

SEQ ID NO: 397712 - DNA, 25 bp, Mus musculus
cttggacctgatgaggcgcctgcct

SEQ ID NO: 397713 - DNA, 25 bp, Mus musculus
cttggacgcacactgctgtgccttt

SEQ ID NO: 397714 - DNA, 25 bp, Mus musculus
cttggacgcacagtgctgtgccttt

SEQ ID NO: 397715 - DNA, 25 bp, Mus musculus
cttggactctgacgccattgaacaa

SEQ ID NO: 397716 - DNA, 25 bp, Mus musculus
cttggactctgaggccattgaacaa

SEQ ID NO: 397717 - DNA, 25 bp, Mus musculus
cttggactgggcagggtctagcttt

SEQ ID NO: 397718 - DNA, 25 bp, Mus musculus
cttggactgggctgggtctagcttt

SEQ ID NO: 397719 - DNA, 25 bp, Mus musculus
cttggactgttacatgagcccgccc

SEQ ID NO: 397720 - DNA, 25 bp, Mus musculus
cttggactgttagatgagcccgccc

SEQ ID NO: 397721 - DNA, 25 bp, Mus musculus
cttggacttctcatcgtttttgcag

SEQ ID NO: 397722 - DNA, 25 bp, Mus musculus
cttggacttctcttcgtttttgcag

SEQ ID NO: 397723 - DNA, 25 bp, Mus musculus
cttggactttccagatttcacggga

SEQ ID NO: 397724 - DNA, 25 bp, Mus musculus
cttggactttcctgatttcacggga

SEQ ID NO: 397725 - DNA, 25 bp, Mus musculus
cttggagaacataccttagcacccc

SEQ ID NO: 397726 - DNA, 25 bp, Mus musculus
cttggagaacattccttagcacccc

SEQ ID NO: 397727 - DNA, 25 bp, Mus musculus
cttggagaattgactggaggctttt

SEQ ID NO: 397728 - DNA, 25 bp, Mus musculus
cttggagaattgtctggaggctttt

SEQ ID NO: 397729 - DNA, 25 bp, Mus musculus
cttggagaccgactacagcatgtat

SEQ ID NO: 397730 - DNA, 25 bp, Mus musculus
cttggagaccgagtacagcatgtat

SEQ ID NO: 397731 - DNA, 25 bp, Mus musculus
cttggagacctgaaactcaggctga

SEQ ID NO: 397732 - DNA, 25 bp, Mus musculus
cttggagacctgtaactcaggctga

SEQ ID NO: 397733 - DNA, 25 bp, Mus musculus
cttggagactatcggagcctctgca

SEQ ID NO: 397734 - DNA, 25 bp, Mus musculus
cttggagactatgggagcctctgca

SEQ ID NO: 397735 - DNA, 25 bp, Mus musculus
cttggagactttcagctccttgaaa

SEQ ID NO: 397736 - DNA, 25 bp, Mus musculus
cttggagactttgagctccttgaaa

SEQ ID NO: 397737 - DNA, 25 bp, Mus musculus
cttggagagaccaaccccgcagact

SEQ ID NO: 397738 - DNA, 25 bp, Mus musculus
cttggagagacctaccccgcagact

SEQ ID NO: 397739 - DNA, 25 bp, Mus musculus
cttggagaggttcctcctatttggt

SEQ ID NO: 397740 - DNA, 25 bp, Mus musculus
cttggagaggttgctcctatttggt

SEQ ID NO: 397741 - DNA, 25 bp, Mus musculus
cttggagatcaacctgagctgccta

SEQ ID NO: 397742 - DNA, 25 bp, Mus musculus
cttggagatcaagctgagctgccta

SEQ ID NO: 397743 - DNA, 25 bp, Mus musculus
cttggagcatttacagccttactgg

SEQ ID NO: 397744 - DNA, 25 bp, Mus musculus
cttggagcattttcagccttactgg

SEQ ID NO: 397745 - DNA, 25 bp, Mus musculus
cttggagccatcattcagcagggaa

SEQ ID NO: 397746 - DNA, 25 bp, Mus musculus
cttggagccatctttcagcagggaa

SEQ ID NO: 397747 - DNA, 25 bp, Mus musculus
cttggagccctcaggtcctacagga

SEQ ID NO: 397748 - DNA, 25 bp, Mus musculus
cttggagccctctggtcctacagga

SEQ ID NO: 397749 - DNA, 25 bp, Mus musculus
cttggagcctgtacactgtgtttat

SEQ ID NO: 397750 - DNA, 25 bp, Mus musculus
cttggagcctgttcactgtgtttat

SEQ ID NO: 397751 - DNA, 25 bp, Mus musculus
cttggagccttcacttgtgagtaac

SEQ ID NO: 397752 - DNA, 25 bp, Mus musculus
cttggagccttctcttgtgagtaac

SEQ ID NO: 397753 - DNA, 25 bp, Mus musculus
cttggaggaaagaatcccactcgga

SEQ ID NO: 397754 - DNA, 25 bp, Mus musculus
cttggaggaaagtatcccactcgga

SEQ ID NO: 397755 - DNA, 25 bp, Mus musculus
cttggaggatcactagtgttacctg

SEQ ID NO: 397756 - DNA, 25 bp, Mus musculus
cttggaggatcagtagtgttacctg

SEQ ID NO: 397757 - DNA, 25 bp, Mus musculus
cttggaggcggcaggtgacaattta

SEQ ID NO: 397758 - DNA, 25 bp, Mus musculus
cttggaggcggctggtgacaattta

SEQ ID NO: 397759 - DNA, 25 bp, Mus musculus
cttggagggatcatctgacctctct

SEQ ID NO: 397760 - DNA, 25 bp, Mus musculus
cttggagggatcttctgacctctct

SEQ ID NO: 397761 - DNA, 25 bp, Mus musculus
cttggagtcagtccagccaaaggga

SEQ ID NO: 397762 - DNA, 25 bp, Mus musculus
cttggagtcagtgcagccaaaggga

SEQ ID NO: 397763 - DNA, 25 bp, Mus musculus
cttggagtctcaagagtaccagagt

SEQ ID NO: 397764 - DNA, 25 bp, Mus musculus
cttggagtctcatgagtaccagagt

SEQ ID NO: 397765 - DNA, 25 bp, Mus musculus
cttggagtctcgaggctgaaatcac

SEQ ID NO: 397766 - DNA, 25 bp, Mus musculus
cttggagtctcgtggctgaaatcac

SEQ ID NO: 397767 - DNA, 25 bp, Mus musculus
cttggagtgcagaagagcggcttaa

SEQ ID NO: 397768 - DNA, 25 bp, Mus musculus
cttggagtgcagtagagcggcttaa

SEQ ID NO: 397769 - DNA, 25 bp, Mus musculus
cttggagtgggcatagcaggacaca

SEQ ID NO: 397770 - DNA, 25 bp, Mus musculus
cttggagtgggcttagcaggacaca

SEQ ID NO: 397771 - DNA, 25 bp, Mus musculus
cttggagttatgacctacagtgata

SEQ ID NO: 397772 - DNA, 25 bp, Mus musculus
cttggagttatgtcctacagtgata

SEQ ID NO: 397773 - DNA, 25 bp, Mus musculus
cttggatacaagaactttaccactt

SEQ ID NO: 397774 - DNA, 25 bp, Mus musculus
cttggatacaagtactttaccactt

SEQ ID NO: 397775 - DNA, 25 bp, Mus musculus
cttggatagcagagcccaggaccac

SEQ ID NO: 397776 - DNA, 25 bp, Mus musculus
cttggatagcagtgcccaggaccac

SEQ ID NO: 397777 - DNA, 25 bp, Mus musculus
cttggatatcgaaacccatttccac

SEQ ID NO: 397778 - DNA, 25 bp, Mus musculus
cttggatatcgatacccatttccac

SEQ ID NO: 397779 - DNA, 25 bp, Mus musculus
cttggatcaaacacaccccatgtga

SEQ ID NO: 397780 - DNA, 25 bp, Mus musculus
cttggatcaaactcaccccatgtga

SEQ ID NO: 397781 - DNA, 25 bp, Mus musculus
cttggatcaacaatggatgctcaag

SEQ ID NO: 397782 - DNA, 25 bp, Mus musculus
cttggatcaacattggatgctcaag

SEQ ID NO: 397783 - DNA, 25 bp, Mus musculus
cttggatcacatacacttcctgtgg

SEQ ID NO: 397784 - DNA, 25 bp, Mus musculus
cttggatcacattcacttcctgtgg

SEQ ID NO: 397785 - DNA, 25 bp, Mus musculus
cttggatccactagccttcactggg

SEQ ID NO: 397786 - DNA, 25 bp, Mus musculus
cttggatccacttgccttcactggg

SEQ ID NO: 397787 - DNA, 25 bp, Mus musculus
cttggatctaagacttcagctgcaa

SEQ ID NO: 397788 - DNA, 25 bp, Mus musculus
cttggatctaagtcttcagctgcaa

SEQ ID NO: 397789 - DNA, 25 bp, Mus musculus
cttggatctcctaaatatttaaggt

SEQ ID NO: 397790 - DNA, 25 bp, Mus musculus
cttggatctccttaatatttaaggt

SEQ ID NO: 397791 - DNA, 25 bp, Mus musculus
cttggatctctccttctttagaacc

SEQ ID NO: 397792 - DNA, 25 bp, Mus musculus
cttggatctctcgttctttagaacc

SEQ ID NO: 397793 - DNA, 25 bp, Mus musculus
cttggatctgtgacttacttggtgc

SEQ ID NO: 397794 - DNA, 25 bp, Mus musculus
cttggatctgtgtcttacttggtgc

SEQ ID NO: 397795 - DNA, 25 bp, Mus musculus
cttggatcttcaatctctcctgata

SEQ ID NO: 397796 - DNA, 25 bp, Mus musculus
cttggatcttcattctctcctgata

SEQ ID NO: 397797 - DNA, 25 bp, Mus musculus
cttggatgctagaccatgggcttgc

SEQ ID NO: 397798 - DNA, 25 bp, Mus musculus
cttggatgctagtccatgggcttgc

SEQ ID NO: 397799 - DNA, 25 bp, Mus musculus
cttggatggatcatactggacagtt

SEQ ID NO: 397800 - DNA, 25 bp, Mus musculus
cttggatggatcttactggacagtt

SEQ ID NO: 397801 - DNA, 25 bp, Mus musculus
cttggatgggtcattcgcttttgct

SEQ ID NO: 397802 - DNA, 25 bp, Mus musculus
cttggatgggtctttcgcttttgct

SEQ ID NO: 397803 - DNA, 25 bp, Mus musculus
cttggatgttccaaatacagacagt

SEQ ID NO: 397804 - DNA, 25 bp, Mus musculus
cttggatgttcctaatacagacagt

SEQ ID NO: 397805 - DNA, 25 bp, Mus musculus
cttggatgtttaacagttgtgtgct

SEQ ID NO: 397806 - DNA, 25 bp, Mus musculus
cttggatgtttatcagttgtgtgct

SEQ ID NO: 397807 - DNA, 25 bp, Mus musculus
cttggattaattcatactacccttt

SEQ ID NO: 397808 - DNA, 25 bp, Mus musculus
cttggattaattgatactacccttt

SEQ ID NO: 397809 - DNA, 25 bp, Mus musculus
cttggattcccaaacacttaggaaa

SEQ ID NO: 397810 - DNA, 25 bp, Mus musculus
cttggattcccatacacttaggaaa

SEQ ID NO: 397811 - DNA, 25 bp, Mus musculus
cttggattccttaagttagcttagc

SEQ ID NO: 397812 - DNA, 25 bp, Mus musculus
cttggattccttctaaagagcttag

SEQ ID NO: 397813 - DNA, 25 bp, Mus musculus
cttggattccttgtaaagagcttag

SEQ ID NO: 397814 - DNA, 25 bp, Mus musculus
cttggattcctttagttagcttagc

SEQ ID NO: 397815 - DNA, 25 bp, Mus musculus
cttggattgcctatgatttcaggac

SEQ ID NO: 397816 - DNA, 25 bp, Mus musculus
cttggattgcctttgatttcaggac

SEQ ID NO: 397817 - DNA, 25 bp, Mus musculus
cttggatttccaagccacagctatc

SEQ ID NO: 397818 - DNA, 25 bp, Mus musculus
cttggatttccatgccacagctatc

SEQ ID NO: 397819 - DNA, 25 bp, Mus musculus
cttggatttcgaactctagccagag

SEQ ID NO: 397820 - DNA, 25 bp, Mus musculus
cttggatttcgatctctagccagag

SEQ ID NO: 397821 - DNA, 25 bp, Mus musculus
cttggatttgatcatgttgtacgat

SEQ ID NO: 397822 - DNA, 25 bp, Mus musculus
cttggatttgatgatgttgtacgat

SEQ ID NO: 397823 - DNA, 25 bp, Mus musculus
cttggatttgtgaacagaacttccc

SEQ ID NO: 397824 - DNA, 25 bp, Mus musculus
cttggatttgtgtacagaacttccc

SEQ ID NO: 397825 - DNA, 25 bp, Mus musculus
cttggattttctcaggtgctgctat

SEQ ID NO: 397826 - DNA, 25 bp, Mus musculus
cttggattttctgaggtgctgctat

SEQ ID NO: 397827 - DNA, 25 bp, Mus musculus
cttggcaaagccactgagtgttaga

SEQ ID NO: 397828 - DNA, 25 bp, Mus musculus
cttggcaaagcctctgagtgttaga

SEQ ID NO: 397829 - DNA, 25 bp, Mus musculus
cttggcaatgccaccttggagtcca

SEQ ID NO: 397830 - DNA, 25 bp, Mus musculus
cttggcaatgcctccttggagtcca

SEQ ID NO: 397831 - DNA, 25 bp, Mus musculus
cttggcaatgctaatgtatcgtaac

SEQ ID NO: 397832 - DNA, 25 bp, Mus musculus
cttggcaatgcttatgtatcgtaac

SEQ ID NO: 397833 - DNA, 25 bp, Mus musculus
cttggcacacatcaagtcctagctt

SEQ ID NO: 397834 - DNA, 25 bp, Mus musculus
cttggcacacatgaagtcctagctt

SEQ ID NO: 397835 - DNA, 25 bp, Mus musculus
cttggcacactcaacgcatgagaaa

SEQ ID NO: 397836 - DNA, 25 bp, Mus musculus
cttggcacactctacgcatgagaaa

SEQ ID NO: 397837 - DNA, 25 bp, Mus musculus
cttggcacatgcaatgctcagagga

SEQ ID NO: 397838 - DNA, 25 bp, Mus musculus
cttggcacatgctatgctcagagga

SEQ ID NO: 397839 - DNA, 25 bp, Mus musculus
cttggcacctacaggtcacgtataa

SEQ ID NO: 397840 - DNA, 25 bp, Mus musculus
cttggcacctactggtcacgtataa

SEQ ID NO: 397841 - DNA, 25 bp, Mus musculus
cttggcactaggaatttccttgact

SEQ ID NO: 397842 - DNA, 25 bp, Mus musculus
cttggcactaggtatttccttgact

SEQ ID NO: 397843 - DNA, 25 bp, Mus musculus
cttggcactgttagacaaagaactg

SEQ ID NO: 397844 - DNA, 25 bp, Mus musculus
cttggcactgtttgacaaagaactg

SEQ ID NO: 397845 - DNA, 25 bp, Mus musculus
cttggcacttgtagctgtcagaaaa

SEQ ID NO: 397846 - DNA, 25 bp, Mus musculus
cttggcacttgtcgcttttctgtca

SEQ ID NO: 397847 - DNA, 25 bp, Mus musculus
cttggcacttgtggcttttctgtca

SEQ ID NO: 397848 - DNA, 25 bp, Mus musculus
cttggcacttgttgctgtcagaaaa

SEQ ID NO: 397849 - DNA, 25 bp, Mus musculus
cttggcagaactagcactgactcta

SEQ ID NO: 397850 - DNA, 25 bp, Mus musculus
cttggcagaacttgcactgactcta

SEQ ID NO: 397851 - DNA, 25 bp, Mus musculus
cttggcagacatccattttccaggg

SEQ ID NO: 397852 - DNA, 25 bp, Mus musculus
cttggcagacatgcattttccaggg

SEQ ID NO: 397853 - DNA, 25 bp, Mus musculus
cttggcagaggacactacttctaga

SEQ ID NO: 397854 - DNA, 25 bp, Mus musculus
cttggcagaggagactacttctaga

SEQ ID NO: 397855 - DNA, 25 bp, Mus musculus
cttggcagccgcatcatgacaggaa

SEQ ID NO: 397856 - DNA, 25 bp, Mus musculus
cttggcagccgcttcatgacaggaa

SEQ ID NO: 397857 - DNA, 25 bp, Mus musculus
cttggcagcctgcagcatgggctat

SEQ ID NO: 397858 - DNA, 25 bp, Mus musculus
cttggcagcctggagcatgggctat

SEQ ID NO: 397859 - DNA, 25 bp, Mus musculus
cttggcagccttattgtcatggact

SEQ ID NO: 397860 - DNA, 25 bp, Mus musculus
cttggcagcctttttgtcatggact

SEQ ID NO: 397861 - DNA, 25 bp, Mus musculus
cttggcaggtggcattctagaaata

SEQ ID NO: 397862 - DNA, 25 bp, Mus musculus
cttggcaggtgggattctagaaata

SEQ ID NO: 397863 - DNA, 25 bp, Mus musculus
cttggcatcccacagatagattcta

SEQ ID NO: 397864 - DNA, 25 bp, Mus musculus
cttggcatcccagagatagattcta

SEQ ID NO: 397865 - DNA, 25 bp, Mus musculus
cttggcatcctcagattgtgactca

SEQ ID NO: 397866 - DNA, 25 bp, Mus musculus
cttggcatcctctgattgtgactca

SEQ ID NO: 397867 - DNA, 25 bp, Mus musculus
cttggcatctgtaaagtgggatcaa

SEQ ID NO: 397868 - DNA, 25 bp, Mus musculus
cttggcatctgttaagtgggatcaa

SEQ ID NO: 397869 - DNA, 25 bp, Mus musculus
cttggcatgcccagtgtgtgatgta

SEQ ID NO: 397870 - DNA, 25 bp, Mus musculus
cttggcatgccctgtgtgtgatgta

SEQ ID NO: 397871 - DNA, 25 bp, Mus musculus
cttggcatggtacagatggccttac

SEQ ID NO: 397872 - DNA, 25 bp, Mus musculus
cttggcatggtactccctgagcatg

SEQ ID NO: 397873 - DNA, 25 bp, Mus musculus
cttggcatggtagagatggccttac

SEQ ID NO: 397874 - DNA, 25 bp, Mus musculus
cttggcatggtagtccctgagcatg

SEQ ID NO: 397875 - DNA, 25 bp, Mus musculus
cttggcatggttccatatacgcgaa

SEQ ID NO: 397876 - DNA, 25 bp, Mus musculus
cttggcatggttgcatatacgcgaa

SEQ ID NO: 397877 - DNA, 25 bp, Mus musculus
cttggcatgtcaatgcattcagagc

SEQ ID NO: 397878 - DNA, 25 bp, Mus musculus
cttggcatgtcattgcattcagagc

SEQ ID NO: 397879 - DNA, 25 bp, Mus musculus
cttggcattcctacttttaccactt

SEQ ID NO: 397880 - DNA, 25 bp, Mus musculus
cttggcattccttcttttaccactt

SEQ ID NO: 397881 - DNA, 25 bp, Mus musculus
cttggcatttacatcactggtgtgg

SEQ ID NO: 397882 - DNA, 25 bp, Mus musculus
cttggcatttacttcactggtgtgg

SEQ ID NO: 397883 - DNA, 25 bp, Mus musculus
cttggcatttataccaacatttatt

SEQ ID NO: 397884 - DNA, 25 bp, Mus musculus
cttggcatttattccaacatttatt

SEQ ID NO: 397885 - DNA, 25 bp, Mus musculus
cttggccaaggaacacattctattc

SEQ ID NO: 397886 - DNA, 25 bp, Mus musculus
cttggccaaggatcacattctattc

SEQ ID NO: 397887 - DNA, 25 bp, Mus musculus
cttggccaatggcaatgacactatt

SEQ ID NO: 397888 - DNA, 25 bp, Mus musculus
cttggccaatgggaatgacactatt

SEQ ID NO: 397889 - DNA, 25 bp, Mus musculus
cttggccaatttagtccaacggaca

SEQ ID NO: 397890 - DNA, 25 bp, Mus musculus
cttggccaattttgtccaacggaca

SEQ ID NO: 397891 - DNA, 25 bp, Mus musculus
cttggccacctgatggagatttttt

SEQ ID NO: 397892 - DNA, 25 bp, Mus musculus
cttggccacctgttggagatttttt

SEQ ID NO: 397893 - DNA, 25 bp, Mus musculus
cttggccatggtcagaagagtcctt

SEQ ID NO: 397894 - DNA, 25 bp, Mus musculus
cttggccatggtgagaagagtcctt

SEQ ID NO: 397895 - DNA, 25 bp, Mus musculus
cttggccatttgcagtagtttagag

SEQ ID NO: 397896 - DNA, 25 bp, Mus musculus
cttggccatttggagtagtttagag

SEQ ID NO: 397897 - DNA, 25 bp, Mus musculus
cttggcccaggtacgcaaggagtat

SEQ ID NO: 397898 - DNA, 25 bp, Mus musculus
cttggcccaggttcgcaaggagtat

SEQ ID NO: 397899 - DNA, 25 bp, Mus musculus
cttggccccagtaagcaaacgagct

SEQ ID NO: 397900 - DNA, 25 bp, Mus musculus
cttggccccagttagcaaacgagct

SEQ ID NO: 397901 - DNA, 25 bp, Mus musculus
cttggccccattagggctatactta

SEQ ID NO: 397902 - DNA, 25 bp, Mus musculus
cttggccccatttgggctatactta

SEQ ID NO: 397903 - DNA, 25 bp, Mus musculus
cttggcccgaggagcttgggccagg

SEQ ID NO: 397904 - DNA, 25 bp, Mus musculus
cttggcccgaggtgcttgggccagg

SEQ ID NO: 397905 - DNA, 25 bp, Mus musculus
cttggcccgtttcatattcctgata

SEQ ID NO: 397906 - DNA, 25 bp, Mus musculus
cttggcccgtttgatattcctgata

SEQ ID NO: 397907 - DNA, 25 bp, Mus musculus
cttggccgggaacgactccagcaga

SEQ ID NO: 397908 - DNA, 25 bp, Mus musculus
cttggccgggaaggactccagcaga

SEQ ID NO: 397909 - DNA, 25 bp, Mus musculus
cttggcctacttatttgagcctggg

SEQ ID NO: 397910 - DNA, 25 bp, Mus musculus
cttggcctacttttttgagcctggg

SEQ ID NO: 397911 - DNA, 25 bp, Mus musculus
cttggcctcccaccctggaagggtt

SEQ ID NO: 397912 - DNA, 25 bp, Mus musculus
cttggcctcccacgttagcaagcag

SEQ ID NO: 397913 - DNA, 25 bp, Mus musculus
cttggcctcccagcctggaagggtt

SEQ ID NO: 397914 - DNA, 25 bp, Mus musculus
cttggcctcccaggttagcaagcag

SEQ ID NO: 397915 - DNA, 25 bp, Mus musculus
cttggcctcggcagtgtcgggctac

SEQ ID NO: 397916 - DNA, 25 bp, Mus musculus
cttggcctcggctgtgtcgggctac

SEQ ID NO: 397917 - DNA, 25 bp, Mus musculus
cttggcctggagatgtagtggtttt

SEQ ID NO: 397918 - DNA, 25 bp, Mus musculus
cttggcctggagttgtagtggtttt

SEQ ID NO: 397919 - DNA, 25 bp, Mus musculus
cttggcctgtctcatccctgtgggt

SEQ ID NO: 397920 - DNA, 25 bp, Mus musculus
cttggcctgtctgatccctgtgggt

SEQ ID NO: 397921 - DNA, 25 bp, Mus musculus
cttggcctgttactagccttatttt

SEQ ID NO: 397922 - DNA, 25 bp, Mus musculus
cttggcctgttagtagccttatttt

SEQ ID NO: 397923 - DNA, 25 bp, Mus musculus
cttggccttaggatcatctgcaaat

SEQ ID NO: 397924 - DNA, 25 bp, Mus musculus
cttggccttaggttcatctgcaaat

SEQ ID NO: 397925 - DNA, 25 bp, Mus musculus
cttggccttatccagagcaggaatt

SEQ ID NO: 397926 - DNA, 25 bp, Mus musculus
cttggccttatcgagagcaggaatt

SEQ ID NO: 397927 - DNA, 25 bp, Mus musculus
cttggccttttcatgtaggcctcat

SEQ ID NO: 397928 - DNA, 25 bp, Mus musculus
cttggccttttcttgtaggcctcat

SEQ ID NO: 397929 - DNA, 25 bp, Mus musculus
cttggcgactttctaactttggtga

SEQ ID NO: 397930 - DNA, 25 bp, Mus musculus
cttggcgactttgtaactttggtga

SEQ ID NO: 397931 - DNA, 25 bp, Mus musculus
cttggcgagcctcgcctgacatgga

SEQ ID NO: 397932 - DNA, 25 bp, Mus musculus
cttggcgagcctggcctgacatgga

SEQ ID NO: 397933 - DNA, 25 bp, Mus musculus
cttggcgatggcagctctgagatca

SEQ ID NO: 397934 - DNA, 25 bp, Mus musculus
cttggcgatggctgctctgagatca

SEQ ID NO: 397935 - DNA, 25 bp, Mus musculus
cttggcgcaagaccctttagctgct

SEQ ID NO: 397936 - DNA, 25 bp, Mus musculus
cttggcgcaagagcctttagctgct

SEQ ID NO: 397937 - DNA, 25 bp, Mus musculus
cttggcgcggacactgcaaagagca

SEQ ID NO: 397938 - DNA, 25 bp, Mus musculus
cttggcgcggactctgcaaagagca

SEQ ID NO: 397939 - DNA, 25 bp, Mus musculus
cttggcgctcacagggttatttaaa

SEQ ID NO: 397940 - DNA, 25 bp, Mus musculus
cttggcgctcactgggttatttaaa

SEQ ID NO: 397941 - DNA, 25 bp, Mus musculus
cttggcgcttggagtaccagataaa

SEQ ID NO: 397942 - DNA, 25 bp, Mus musculus
cttggcgcttggtgtaccagataaa

SEQ ID NO: 397943 - DNA, 25 bp, Mus musculus
cttggcgggaatatcacctttccat

SEQ ID NO: 397944 - DNA, 25 bp, Mus musculus
cttggcgggaatttcacctttccat

SEQ ID NO: 397945 - DNA, 25 bp, Mus musculus
cttggcggttcacctctgacttaaa

SEQ ID NO: 397946 - DNA, 25 bp, Mus musculus
cttggcggttcagctctgacttaaa

SEQ ID NO: 397947 - DNA, 25 bp, Mus musculus
cttggcgtagcaaaggtgcctttcc

SEQ ID NO: 397948 - DNA, 25 bp, Mus musculus
cttggcgtagcataggtgcctttcc

SEQ ID NO: 397949 - DNA, 25 bp, Mus musculus
cttggcgtatgtcaggccccggcta

SEQ ID NO: 397950 - DNA, 25 bp, Mus musculus
cttggcgtatgtgaggccccggcta

SEQ ID NO: 397951 - DNA, 25 bp, Mus musculus
cttggcgttagcacaggcactgtca

SEQ ID NO: 397952 - DNA, 25 bp, Mus musculus
cttggcgttagcatgtcacatagtg

SEQ ID NO: 397953 - DNA, 25 bp, Mus musculus
cttggcgttagctcaggcactgtca

SEQ ID NO: 397954 - DNA, 25 bp, Mus musculus
cttggcgttagcttgtcacatagtg

SEQ ID NO: 397955 - DNA, 25 bp, Mus musculus
cttggctacccgcatggagatcata

SEQ ID NO: 397956 - DNA, 25 bp, Mus musculus
cttggctacccggatggagatcata

SEQ ID NO: 397957 - DNA, 25 bp, Mus musculus
cttggctagcccaggttatacccaa

SEQ ID NO: 397958 - DNA, 25 bp, Mus musculus
cttggctagccctggttatacccaa

SEQ ID NO: 397959 - DNA, 25 bp, Mus musculus
cttggctagctcagtgtctgtcaga

SEQ ID NO: 397960 - DNA, 25 bp, Mus musculus
cttggctagctctgtgtctgtcaga

SEQ ID NO: 397961 - DNA, 25 bp, Mus musculus
cttggctagttaatttatgcagaaa

SEQ ID NO: 397962 - DNA, 25 bp, Mus musculus
cttggctagttattttatgcagaaa

SEQ ID NO: 397963 - DNA, 25 bp, Mus musculus
cttggctagtttcgtttgctttgac

SEQ ID NO: 397964 - DNA, 25 bp, Mus musculus
cttggctagtttggtttgctttgac

SEQ ID NO: 397965 - DNA, 25 bp, Mus musculus
cttggctatgacctttacagtacag

SEQ ID NO: 397966 - DNA, 25 bp, Mus musculus
cttggctatgacgtttacagtacag

SEQ ID NO: 397967 - DNA, 25 bp, Mus musculus
cttggctcaagtacccattctggaa

SEQ ID NO: 397968 - DNA, 25 bp, Mus musculus
cttggctcaagttcccattctggaa

SEQ ID NO: 397969 - DNA, 25 bp, Mus musculus
cttggctccttgactgctggtggag

SEQ ID NO: 397970 - DNA, 25 bp, Mus musculus
cttggctccttgtctgctggtggag

SEQ ID NO: 397971 - DNA, 25 bp, Mus musculus
cttggctcttccagggtagatgtca

SEQ ID NO: 397972 - DNA, 25 bp, Mus musculus
cttggctcttcctgggtagatgtca

SEQ ID NO: 397973 - DNA, 25 bp, Mus musculus
cttggctgcaatcccagtcccagga

SEQ ID NO: 397974 - DNA, 25 bp, Mus musculus
cttggctgcaatgccagtcccagga

SEQ ID NO: 397975 - DNA, 25 bp, Mus musculus
cttggctgctttagtcctgtagaaa

SEQ ID NO: 397976 - DNA, 25 bp, Mus musculus
cttggctgcttttgtcctgtagaaa

SEQ ID NO: 397977 - DNA, 25 bp, Mus musculus
cttggctggcagaggaagtccccga

SEQ ID NO: 397978 - DNA, 25 bp, Mus musculus
cttggctggcagtggaagtccccga

SEQ ID NO: 397979 - DNA, 25 bp, Mus musculus
cttggctgtctgagcttggcaaatt

SEQ ID NO: 397980 - DNA, 25 bp, Mus musculus
cttggctgtctgtgcttggcaaatt

SEQ ID NO: 397981 - DNA, 25 bp, Mus musculus
cttggctgtgctcaggtttttatta

SEQ ID NO: 397982 - DNA, 25 bp, Mus musculus
cttggctgtgctgaggtttttatta

SEQ ID NO: 397983 - DNA, 25 bp, Mus musculus
cttggctgttcacaatggaccagtt

SEQ ID NO: 397984 - DNA, 25 bp, Mus musculus
cttggctgttcagaatggaccagtt

SEQ ID NO: 397985 - DNA, 25 bp, Mus musculus
cttggcttagtaccatgctgataat

SEQ ID NO: 397986 - DNA, 25 bp, Mus musculus
cttggcttagtagcatgctgataat

SEQ ID NO: 397987 - DNA, 25 bp, Mus musculus
cttggcttcaagctaggcctggtgc

SEQ ID NO: 397988 - DNA, 25 bp, Mus musculus
cttggcttcaaggtaggcctggtgc

SEQ ID NO: 397989 - DNA, 25 bp, Mus musculus
cttggcttcaccagcaaggaccctt

SEQ ID NO: 397990 - DNA, 25 bp, Mus musculus
cttggcttcacctgcaaggaccctt

SEQ ID NO: 397991 - DNA, 25 bp, Mus musculus
cttggcttccaaaagtctgttgccc

SEQ ID NO: 397992 - DNA, 25 bp, Mus musculus
cttggcttccaatagtctgttgccc

SEQ ID NO: 397993 - DNA, 25 bp, Mus musculus
cttggcttcctaccttgcaacaaaa

SEQ ID NO: 397994 - DNA, 25 bp, Mus musculus
cttggcttcctagcttgcaacaaaa

SEQ ID NO: 397995 - DNA, 25 bp, Mus musculus
cttggcttcctgaatgtcacaacaa

SEQ ID NO: 397996 - DNA, 25 bp, Mus musculus
cttggcttcctgtatgtcacaacaa

SEQ ID NO: 397997 - DNA, 25 bp, Mus musculus
cttggcttcttcatgtgcaaacgca

SEQ ID NO: 397998 - DNA, 25 bp, Mus musculus
cttggcttcttcttgtgcaaacgca

SEQ ID NO: 397999 - DNA, 25 bp, Mus musculus
cttggcttgagacgagctgctgcta

SEQ ID NO: 398000 - DNA, 25 bp, Mus musculus
cttggcttgagaggagctgctgcta

SEQ ID NO: 398001 - DNA, 25 bp, Mus musculus
cttggcttgcacaggcacaaaccaa

SEQ ID NO: 398002 - DNA, 25 bp, Mus musculus
cttggcttgcactggcacaaaccaa

SEQ ID NO: 398003 - DNA, 25 bp, Mus musculus
cttggcttgcgtatgcctcagcgga

SEQ ID NO: 398004 - DNA, 25 bp, Mus musculus
cttggcttgcgtttgcctcagcgga

SEQ ID NO: 398005 - DNA, 25 bp, Mus musculus
cttggcttgtcaactgcgcggagga

SEQ ID NO: 398006 - DNA, 25 bp, Mus musculus
cttggcttgtcatctgcgcggagga

SEQ ID NO: 398007 - DNA, 25 bp, Mus musculus
cttggctttaaaatagaccctgtgg

SEQ ID NO: 398008 - DNA, 25 bp, Mus musculus
cttggctttaaattagaccctgtgg

SEQ ID NO: 398009 - DNA, 25 bp, Mus musculus
cttggctttagacgacttcagatta

SEQ ID NO: 398010 - DNA, 25 bp, Mus musculus
cttggctttagaggacttcagatta

SEQ ID NO: 398011 - DNA, 25 bp, Mus musculus
cttggctttcaccaggaagtacttt

SEQ ID NO: 398012 - DNA, 25 bp, Mus musculus
cttggctttcacgaggaagtacttt

SEQ ID NO: 398013 - DNA, 25 bp, Mus musculus
cttggctttctacagcggactgtga

SEQ ID NO: 398014 - DNA, 25 bp, Mus musculus
cttggctttctagagcggactgtga

SEQ ID NO: 398015 - DNA, 25 bp, Mus musculus
cttggctttgggagagttgagtctc

SEQ ID NO: 398016 - DNA, 25 bp, Mus musculus
cttggctttgggtgagttgagtctc

SEQ ID NO: 398017 - DNA, 25 bp, Mus musculus
cttggctttgtgcttcttgtggcca

SEQ ID NO: 398018 - DNA, 25 bp, Mus musculus
cttggctttgtggttcttgtggcca

SEQ ID NO: 398019 - DNA, 25 bp, Mus musculus
cttggcttttatcatgctaatattt

SEQ ID NO: 398020 - DNA, 25 bp, Mus musculus
cttggcttttatgatgctaatattt

SEQ ID NO: 398021 - DNA, 25 bp, Mus musculus
cttgggaaactgctttaggtagtca

SEQ ID NO: 398022 - DNA, 25 bp, Mus musculus
cttgggaaactggtttaggtagtca

SEQ ID NO: 398023 - DNA, 25 bp, Mus musculus
cttgggaaccagaataactcgtaga

SEQ ID NO: 398024 - DNA, 25 bp, Mus musculus
cttgggaaccagtataactcgtaga

SEQ ID NO: 398025 - DNA, 25 bp, Mus musculus
cttgggaacgacacgcagcggcgtc

SEQ ID NO: 398026 - DNA, 25 bp, Mus musculus
cttgggaacgactcgcagcggcgtc

SEQ ID NO: 398027 - DNA, 25 bp, Mus musculus
cttgggaactttacaatcctccgat

SEQ ID NO: 398028 - DNA, 25 bp, Mus musculus
cttgggaacttttcaatcctccgat

SEQ ID NO: 398029 - DNA, 25 bp, Mus musculus
cttgggaagcggattcgaagctaca

SEQ ID NO: 398030 - DNA, 25 bp, Mus musculus
cttgggaagcggtttcgaagctaca

SEQ ID NO: 398031 - DNA, 25 bp, Mus musculus
cttgggaagtttaagcctcagtctg

SEQ ID NO: 398032 - DNA, 25 bp, Mus musculus
cttgggaagttttagcctcagtctg

SEQ ID NO: 398033 - DNA, 25 bp, Mus musculus
cttgggaatacaacatagcagccta

SEQ ID NO: 398034 - DNA, 25 bp, Mus musculus
cttgggaatacatcatagcagccta

SEQ ID NO: 398035 - DNA, 25 bp, Mus musculus
cttgggaatttcactgccatgggac

SEQ ID NO: 398036 - DNA, 25 bp, Mus musculus
cttgggaatttctctgccatgggac

SEQ ID NO: 398037 - DNA, 25 bp, Mus musculus
cttgggacaaggatgaaaggagctt

SEQ ID NO: 398038 - DNA, 25 bp, Mus musculus
cttgggacaaggttgaaaggagctt

SEQ ID NO: 398039 - DNA, 25 bp, Mus musculus
cttgggacaatccacttcaatctgt

SEQ ID NO: 398040 - DNA, 25 bp, Mus musculus
cttgggacaatcgacttcaatctgt

SEQ ID NO: 398041 - DNA, 25 bp, Mus musculus
cttgggacccttagctgattccagg

SEQ ID NO: 398042 - DNA, 25 bp, Mus musculus
cttgggaccctttgctgattccagg

SEQ ID NO: 398043 - DNA, 25 bp, Mus musculus
cttgggacctgaacctagggcttca

SEQ ID NO: 398044 - DNA, 25 bp, Mus musculus
cttgggacctgatcctagggcttca

SEQ ID NO: 398045 - DNA, 25 bp, Mus musculus
cttgggactattatctacctctata

SEQ ID NO: 398046 - DNA, 25 bp, Mus musculus
cttgggactattttctacctctata

SEQ ID NO: 398047 - DNA, 25 bp, Mus musculus
cttgggactctgatagtgtcgaaac

SEQ ID NO: 398048 - DNA, 25 bp, Mus musculus
cttgggactctgttagtgtcgaaac

SEQ ID NO: 398049 - DNA, 25 bp, Mus musculus
cttgggactgcaatgatgaggccat

SEQ ID NO: 398050 - DNA, 25 bp, Mus musculus
cttgggactgcattgatgaggccat

SEQ ID NO: 398051 - DNA, 25 bp, Mus musculus
cttgggactggcacctgaattgttc

SEQ ID NO: 398052 - DNA, 25 bp, Mus musculus
cttgggactggctcctgaattgttc

SEQ ID NO: 398053 - DNA, 25 bp, Mus musculus
cttgggagaggcacattcacttgga

SEQ ID NO: 398054 - DNA, 25 bp, Mus musculus
cttgggagaggctcattcacttgga

SEQ ID NO: 398055 - DNA, 25 bp, Mus musculus
cttgggagccatccggacatctagg

SEQ ID NO: 398056 - DNA, 25 bp, Mus musculus
cttgggagccatgcggacatctagg

SEQ ID NO: 398057 - DNA, 25 bp, Mus musculus
cttgggagccttcggcattgatgct

SEQ ID NO: 398058 - DNA, 25 bp, Mus musculus
cttgggagccttgggcattgatgct

SEQ ID NO: 398059 - DNA, 25 bp, Mus musculus
cttgggaggtatacataatgaagtc

SEQ ID NO: 398060 - DNA, 25 bp, Mus musculus
cttgggaggtattcataatgaagtc

SEQ ID NO: 398061 - DNA, 25 bp, Mus musculus
cttgggatattaaaggctctgcctt

SEQ ID NO: 398062 - DNA, 25 bp, Mus musculus
cttgggatattataggctctgcctt

SEQ ID NO: 398063 - DNA, 25 bp, Mus musculus
cttgggatcccaaacagctaatatg

SEQ ID NO: 398064 - DNA, 25 bp, Mus musculus
cttgggatcccaaagtcctggtaca

SEQ ID NO: 398065 - DNA, 25 bp, Mus musculus
cttgggatcccatacagctaatatg

SEQ ID NO: 398066 - DNA, 25 bp, Mus musculus
cttgggatcccatagtcctggtaca

SEQ ID NO: 398067 - DNA, 25 bp, Mus musculus
cttgggatgatacagagtgcttgca

SEQ ID NO: 398068 - DNA, 25 bp, Mus musculus
cttgggatgatagagagtgcttgca

SEQ ID NO: 398069 - DNA, 25 bp, Mus musculus
cttgggatgtaaatctcagtttctt

SEQ ID NO: 398070 - DNA, 25 bp, Mus musculus
cttgggatgtaattctcagtttctt

SEQ ID NO: 398071 - DNA, 25 bp, Mus musculus
cttgggattcagagagcatgtccat

SEQ ID NO: 398072 - DNA, 25 bp, Mus musculus
cttgggattcagtgagcatgtccat

SEQ ID NO: 398073 - DNA, 25 bp, Mus musculus
cttgggattttaaagtgtgcactct

SEQ ID NO: 398074 - DNA, 25 bp, Mus musculus
cttgggattttatagtgtgcactct

SEQ ID NO: 398075 - DNA, 25 bp, Mus musculus
cttgggattttcctctttgagtcaa

SEQ ID NO: 398076 - DNA, 25 bp, Mus musculus
cttgggattttcgtctttgagtcaa

SEQ ID NO: 398077 - DNA, 25 bp, Mus musculus
cttgggcaatatcacgttggacaca

SEQ ID NO: 398078 - DNA, 25 bp, Mus musculus
cttgggcaatatgacgttggacaca

SEQ ID NO: 398079 - DNA, 25 bp, Mus musculus
cttgggcactgtctacatctgttaa

SEQ ID NO: 398080 - DNA, 25 bp, Mus musculus
cttgggcactgtgtacatctgttaa

SEQ ID NO: 398081 - DNA, 25 bp, Mus musculus
cttgggcagctgaaccgacgtggta

SEQ ID NO: 398082 - DNA, 25 bp, Mus musculus
cttgggcagctgtaccgacgtggta

SEQ ID NO: 398083 - DNA, 25 bp, Mus musculus
cttgggcaggttcgagttcgccata

SEQ ID NO: 398084 - DNA, 25 bp, Mus musculus
cttgggcaggttggagttcgccata

SEQ ID NO: 398085 - DNA, 25 bp, Mus musculus
cttgggcatccacagcagaatcaga

SEQ ID NO: 398086 - DNA, 25 bp, Mus musculus
cttgggcatccagagcagaatcaga

SEQ ID NO: 398087 - DNA, 25 bp, Mus musculus
cttgggcatctcagaatatagagaa

SEQ ID NO: 398088 - DNA, 25 bp, Mus musculus
cttgggcatctctgaatatagagaa

SEQ ID NO: 398089 - DNA, 25 bp, Mus musculus
cttgggcatgatcgtgacacgcttg

SEQ ID NO: 398090 - DNA, 25 bp, Mus musculus
cttgggcatgatggtgacacgcttg

SEQ ID NO: 398091 - DNA, 25 bp, Mus musculus
cttgggcatgtacctcggttggtaa

SEQ ID NO: 398092 - DNA, 25 bp, Mus musculus
cttgggcatgtagctcggttggtaa

SEQ ID NO: 398093 - DNA, 25 bp, Mus musculus
cttgggcattctagtatctcctgtg

SEQ ID NO: 398094 - DNA, 25 bp, Mus musculus
cttgggcattcttgtatctcctgtg

SEQ ID NO: 398095 - DNA, 25 bp, Mus musculus
cttgggccaactacaaatactgctt

SEQ ID NO: 398096 - DNA, 25 bp, Mus musculus
cttgggccaacttcaaatactgctt

SEQ ID NO: 398097 - DNA, 25 bp, Mus musculus
cttgggccactgaaactgatgctta

SEQ ID NO: 398098 - DNA, 25 bp, Mus musculus
cttgggccactgtaactgatgctta

SEQ ID NO: 398099 - DNA, 25 bp, Mus musculus
cttgggccaggaaaccatactgtgt

SEQ ID NO: 398100 - DNA, 25 bp, Mus musculus
cttgggccaggataccatactgtgt

SEQ ID NO: 398101 - DNA, 25 bp, Mus musculus
cttgggccaggtaatattcagcata

SEQ ID NO: 398102 - DNA, 25 bp, Mus musculus
cttgggccaggttatattcagcata

SEQ ID NO: 398103 - DNA, 25 bp, Mus musculus
cttgggccccagattataatcatca

SEQ ID NO: 398104 - DNA, 25 bp, Mus musculus
cttgggccccagtttataatcatca

SEQ ID NO: 398105 - DNA, 25 bp, Mus musculus
cttgggcccctgatactgatgatga

SEQ ID NO: 398106 - DNA, 25 bp, Mus musculus
cttgggcccctgttactgatgatga

SEQ ID NO: 398107 - DNA, 25 bp, Mus musculus
cttgggcctcatactacttagtttt

SEQ ID NO: 398108 - DNA, 25 bp, Mus musculus
cttgggcctcattctacttagtttt

SEQ ID NO: 398109 - DNA, 25 bp, Mus musculus
cttgggcctctaagaaagcttttgg

SEQ ID NO: 398110 - DNA, 25 bp, Mus musculus
cttgggcctctatgaaagcttttgg

SEQ ID NO: 398111 - DNA, 25 bp, Mus musculus
cttgggcctggtccaatcacattgg

SEQ ID NO: 398112 - DNA, 25 bp, Mus musculus
cttgggcctggtgcaatcacattgg

SEQ ID NO: 398113 - DNA, 25 bp, Mus musculus
cttgggcgctgtctggtcagtccat

SEQ ID NO: 398114 - DNA, 25 bp, Mus musculus
cttgggcgctgtgtggtcagtccat

SEQ ID NO: 398115 - DNA, 25 bp, Mus musculus
cttgggcgcttgagacctttggaaa

SEQ ID NO: 398116 - DNA, 25 bp, Mus musculus
cttgggcgcttgtgacctttggaaa

SEQ ID NO: 398117 - DNA, 25 bp, Mus musculus
cttgggctaaccactttgggaacag

SEQ ID NO: 398118 - DNA, 25 bp, Mus musculus
cttgggctaacctctttgggaacag

SEQ ID NO: 398119 - DNA, 25 bp, Mus musculus
cttgggctaaggctctgaaacacga

SEQ ID NO: 398120 - DNA, 25 bp, Mus musculus
cttgggctaagggtctgaaacacga

SEQ ID NO: 398121 - DNA, 25 bp, Mus musculus
cttgggctacctccgatgacagaaa

SEQ ID NO: 398122 - DNA, 25 bp, Mus musculus
cttgggctacctgcgatgacagaaa

SEQ ID NO: 398123 - DNA, 25 bp, Mus musculus
cttgggctatggaactagtgcagtt

SEQ ID NO: 398124 - DNA, 25 bp, Mus musculus
cttgggctatggtactagtgcagtt

SEQ ID NO: 398125 - DNA, 25 bp, Mus musculus
cttgggctcaaaacttactgtgatt

SEQ ID NO: 398126 - DNA, 25 bp, Mus musculus
cttgggctcaaatcttactgtgatt

SEQ ID NO: 398127 - DNA, 25 bp, Mus musculus
cttgggctcatgagcgagtattctc

SEQ ID NO: 398128 - DNA, 25 bp, Mus musculus
cttgggctcatgtgcgagtattctc

SEQ ID NO: 398129 - DNA, 25 bp, Mus musculus
cttgggctcgttatttctgactggg

SEQ ID NO: 398130 - DNA, 25 bp, Mus musculus
cttgggctcgttttttctgactggg

SEQ ID NO: 398131 - DNA, 25 bp, Mus musculus
cttgggctctgtcgaatattgattc

SEQ ID NO: 398132 - DNA, 25 bp, Mus musculus
cttgggctctgtggaatattgattc

SEQ ID NO: 398133 - DNA, 25 bp, Mus musculus
cttgggctctttcccctgaaagata

SEQ ID NO: 398134 - DNA, 25 bp, Mus musculus
cttgggctctttgccctgaaagata

SEQ ID NO: 398135 - DNA, 25 bp, Mus musculus
cttgggctgggcatattgaaacact

SEQ ID NO: 398136 - DNA, 25 bp, Mus musculus
cttgggctgggcttattgaaacact

SEQ ID NO: 398137 - DNA, 25 bp, Mus musculus
cttgggctgtacaaagtgcttggct

SEQ ID NO: 398138 - DNA, 25 bp, Mus musculus
cttgggctgtactaagtgcttggct

SEQ ID NO: 398139 - DNA, 25 bp, Mus musculus
cttgggctgtttacagctgcctgaa

SEQ ID NO: 398140 - DNA, 25 bp, Mus musculus
cttgggctgttttcagctgcctgaa

SEQ ID NO: 398141 - DNA, 25 bp, Mus musculus
cttgggcttctcatttgtctcttga

SEQ ID NO: 398142 - DNA, 25 bp, Mus musculus
cttgggcttctcttttgtctcttga

SEQ ID NO: 398143 - DNA, 25 bp, Mus musculus
cttgggctttccagataggtcctca

SEQ ID NO: 398144 - DNA, 25 bp, Mus musculus
cttgggctttcctgataggtcctca

SEQ ID NO: 398145 - DNA, 25 bp, Mus musculus
cttgggctttggaaccattgttaag

SEQ ID NO: 398146 - DNA, 25 bp, Mus musculus
cttgggctttggacacaacggacag

SEQ ID NO: 398147 - DNA, 25 bp, Mus musculus
cttgggctttggtaccattgttaag

SEQ ID NO: 398148 - DNA, 25 bp, Mus musculus
cttgggctttggtcacaacggacag

SEQ ID NO: 398149 - DNA, 25 bp, Mus musculus
cttgggtaatagcagccatttttag

SEQ ID NO: 398150 - DNA, 25 bp, Mus musculus
cttgggtaataggagccatttttag

SEQ ID NO: 398151 - DNA, 25 bp, Mus musculus
cttgggtaatctcggtgctgctgct

SEQ ID NO: 398152 - DNA, 25 bp, Mus musculus
cttgggtaatctgggtgctgctgct

SEQ ID NO: 398153 - DNA, 25 bp, Mus musculus
cttgggtaatttctctagcttgcta

SEQ ID NO: 398154 - DNA, 25 bp, Mus musculus
cttgggtaatttgtctagcttgcta

SEQ ID NO: 398155 - DNA, 25 bp, Mus musculus
cttgggtacagtacatggctagcat

SEQ ID NO: 398156 - DNA, 25 bp, Mus musculus
cttgggtacagttcatggctagcat

SEQ ID NO: 398157 - DNA, 25 bp, Mus musculus
cttgggtaccatctatgatgccact

SEQ ID NO: 398158 - DNA, 25 bp, Mus musculus
cttgggtaccatgtatgatgccact

SEQ ID NO: 398159 - DNA, 25 bp, Mus musculus
cttgggtacctgcatgtgtggacat

SEQ ID NO: 398160 - DNA, 25 bp, Mus musculus
cttgggtacctggatgtgtggacat

SEQ ID NO: 398161 - DNA, 25 bp, Mus musculus
cttgggtactacctaattcataagg

SEQ ID NO: 398162 - DNA, 25 bp, Mus musculus
cttgggtactacgtaattcataagg

SEQ ID NO: 398163 - DNA, 25 bp, Mus musculus
cttgggtactctagcgcttatgaaa

SEQ ID NO: 398164 - DNA, 25 bp, Mus musculus
cttgggtactcttgcgcttatgaaa

SEQ ID NO: 398165 - DNA, 25 bp, Mus musculus
cttgggtacttcatctatcattcac

SEQ ID NO: 398166 - DNA, 25 bp, Mus musculus
cttgggtacttcttctatcattcac

SEQ ID NO: 398167 - DNA, 25 bp, Mus musculus
cttgggtagttgacttgcatcttga

SEQ ID NO: 398168 - DNA, 25 bp, Mus musculus
cttgggtagttgtcttgcatcttga

SEQ ID NO: 398169 - DNA, 25 bp, Mus musculus
cttgggtatcttcgcacctgaggac

SEQ ID NO: 398170 - DNA, 25 bp, Mus musculus
cttgggtatcttggcacctgaggac

SEQ ID NO: 398171 - DNA, 25 bp, Mus musculus
cttgggtatgacaaacatgcttgct

SEQ ID NO: 398172 - DNA, 25 bp, Mus musculus
cttgggtatgactaacatgcttgct

SEQ ID NO: 398173 - DNA, 25 bp, Mus musculus
cttgggtcaacaactgtgtcggcga

SEQ ID NO: 398174 - DNA, 25 bp, Mus musculus
cttgggtcaacatctgtgtcggcga

SEQ ID NO: 398175 - DNA, 25 bp, Mus musculus
cttgggtcgtttaagtactgagcac

SEQ ID NO: 398176 - DNA, 25 bp, Mus musculus
cttgggtcgttttagtactgagcac

SEQ ID NO: 398177 - DNA, 25 bp, Mus musculus
cttgggtctcctcggtcagtagaac

SEQ ID NO: 398178 - DNA, 25 bp, Mus musculus
cttgggtctcctgggtcagtagaac

SEQ ID NO: 398179 - DNA, 25 bp, Mus musculus
cttgggtctgacacactcaaaactt

SEQ ID NO: 398180 - DNA, 25 bp, Mus musculus
cttgggtctgactcactcaaaactt

SEQ ID NO: 398181 - DNA, 25 bp, Mus musculus
cttgggtggagtactactgaaaatt

SEQ ID NO: 398182 - DNA, 25 bp, Mus musculus
cttgggtggagttctactgaaaatt

SEQ ID NO: 398183 - DNA, 25 bp, Mus musculus
cttgggtgtaatcttgctccctgat

SEQ ID NO: 398184 - DNA, 25 bp, Mus musculus
cttgggtgtaatgttgctccctgat

SEQ ID NO: 398185 - DNA, 25 bp, Mus musculus
cttgggtgtaggactctagtgttct

SEQ ID NO: 398186 - DNA, 25 bp, Mus musculus
cttgggtgtaggtctctagtgttct

SEQ ID NO: 398187 - DNA, 25 bp, Mus musculus
cttgggtgtcaaaaaagagagtttc

SEQ ID NO: 398188 - DNA, 25 bp, Mus musculus
cttgggtgtcaataaagagagtttc

SEQ ID NO: 398189 - DNA, 25 bp, Mus musculus
cttgggtgtcctcctgtaaagccat

SEQ ID NO: 398190 - DNA, 25 bp, Mus musculus
cttgggtgtcctgctgtaaagccat

SEQ ID NO: 398191 - DNA, 25 bp, Mus musculus
cttgggttaagactacagacatcag

SEQ ID NO: 398192 - DNA, 25 bp, Mus musculus
cttgggttaagagtacagacatcag

SEQ ID NO: 398193 - DNA, 25 bp, Mus musculus
cttgggttagatcaccgagactaaa

SEQ ID NO: 398194 - DNA, 25 bp, Mus musculus
cttgggttagatgaccgagactaaa

SEQ ID NO: 398195 - DNA, 25 bp, Mus musculus
cttgggttataaatgcacatatgca

SEQ ID NO: 398196 - DNA, 25 bp, Mus musculus
cttgggttataattgcacatatgca

SEQ ID NO: 398197 - DNA, 25 bp, Mus musculus
cttgggttcccacatctgattgcct

SEQ ID NO: 398198 - DNA, 25 bp, Mus musculus
cttgggttcccagatctgattgcct

SEQ ID NO: 398199 - DNA, 25 bp, Mus musculus
cttgggttctgtctatgcttctata

SEQ ID NO: 398200 - DNA, 25 bp, Mus musculus
cttgggttctgtgtatgcttctata

SEQ ID NO: 398201 - DNA, 25 bp, Mus musculus
cttgggttggaaactcaggactctg

SEQ ID NO: 398202 - DNA, 25 bp, Mus musculus
cttgggttggaatctcaggactctg

SEQ ID NO: 398203 - DNA, 25 bp, Mus musculus
cttgggttggagaagagcacttacc

SEQ ID NO: 398204 - DNA, 25 bp, Mus musculus
cttgggttggagtagagcacttacc

SEQ ID NO: 398205 - DNA, 25 bp, Mus musculus
cttgggttggctctcaatggtgtat

SEQ ID NO: 398206 - DNA, 25 bp, Mus musculus
cttgggttggctgtcaatggtgtat

SEQ ID NO: 398207 - DNA, 25 bp, Mus musculus
cttgggttgtttctgctgtggaaat

SEQ ID NO: 398208 - DNA, 25 bp, Mus musculus
cttgggttgtttgtgctgtggaaat

SEQ ID NO: 398209 - DNA, 25 bp, Mus musculus
cttgggtttcatccctagtctgaaa

SEQ ID NO: 398210 - DNA, 25 bp, Mus musculus
cttgggtttcatgcctagtctgaaa

SEQ ID NO: 398211 - DNA, 25 bp, Mus musculus
cttgggtttccaacctcctagatga

SEQ ID NO: 398212 - DNA, 25 bp, Mus musculus
cttgggtttccatcctcctagatga

SEQ ID NO: 398213 - DNA, 25 bp, Mus musculus
cttgggtttgatatccgactggctc

SEQ ID NO: 398214 - DNA, 25 bp, Mus musculus
cttgggtttgatttccgactggctc

SEQ ID NO: 398215 - DNA, 25 bp, Mus musculus
cttgggttttctctttgagtaatag

SEQ ID NO: 398216 - DNA, 25 bp, Mus musculus
cttgggttttctgtttgagtaatag

SEQ ID NO: 398217 - DNA, 25 bp, Mus musculus
cttgggttttttccacacgattgat

SEQ ID NO: 398218 - DNA, 25 bp, Mus musculus
cttgggttttttgcacacgattgat

SEQ ID NO: 398219 - DNA, 25 bp, Mus musculus
cttggtaaacaactacagtcagagc

SEQ ID NO: 398220 - DNA, 25 bp, Mus musculus
cttggtaaacaagtacagtcagagc

SEQ ID NO: 398221 - DNA, 25 bp, Mus musculus
cttggtaacagtcggtgctccatga

SEQ ID NO: 398222 - DNA, 25 bp, Mus musculus
cttggtaacagtgggtgctccatga

SEQ ID NO: 398223 - DNA, 25 bp, Mus musculus
cttggtaactccacaactctatttg

SEQ ID NO: 398224 - DNA, 25 bp, Mus musculus
cttggtaactcctcaactctatttg

SEQ ID NO: 398225 - DNA, 25 bp, Mus musculus
cttggtacaaccagctgcccatttt

SEQ ID NO: 398226 - DNA, 25 bp, Mus musculus
cttggtacaacctgctgcccatttt

SEQ ID NO: 398227 - DNA, 25 bp, Mus musculus
cttggtacctctcgcctatgtgaca

SEQ ID NO: 398228 - DNA, 25 bp, Mus musculus
cttggtacctctggcctatgtgaca

SEQ ID NO: 398229 - DNA, 25 bp, Mus musculus
cttggtactactactgatcttggag

SEQ ID NO: 398230 - DNA, 25 bp, Mus musculus
cttggtactacttctgatcttggag

SEQ ID NO: 398231 - DNA, 25 bp, Mus musculus
cttggtagaatgatagcacgtgaga

SEQ ID NO: 398232 - DNA, 25 bp, Mus musculus
cttggtagaatgttagcacgtgaga

SEQ ID NO: 398233 - DNA, 25 bp, Mus musculus
cttggtagatgcactggtggtacca

SEQ ID NO: 398234 - DNA, 25 bp, Mus musculus
cttggtagatgctctggtggtacca

SEQ ID NO: 398235 - DNA, 25 bp, Mus musculus
cttggtagctggagcagatgcccat

SEQ ID NO: 398236 - DNA, 25 bp, Mus musculus
cttggtagctggtgcagatgcccat

SEQ ID NO: 398237 - DNA, 25 bp, Mus musculus
cttggtaggcctctcttgatcagaa

SEQ ID NO: 398238 - DNA, 25 bp, Mus musculus
cttggtaggcctgtcttgatcagaa

SEQ ID NO: 398239 - DNA, 25 bp, Mus musculus
cttggtagtagccaggaacacactt

SEQ ID NO: 398240 - DNA, 25 bp, Mus musculus
cttggtagtagcgaggaacacactt

SEQ ID NO: 398241 - DNA, 25 bp, Mus musculus
cttggtatccaaaggcaggcggatt

SEQ ID NO: 398242 - DNA, 25 bp, Mus musculus
cttggtatccaatggcaggcggatt

SEQ ID NO: 398243 - DNA, 25 bp, Mus musculus
cttggtatccacagtctttgagttg

SEQ ID NO: 398244 - DNA, 25 bp, Mus musculus
cttggtatccactgtctttgagttg

SEQ ID NO: 398245 - DNA, 25 bp, Mus musculus
cttggtatctaacctgccttttgtt

SEQ ID NO: 398246 - DNA, 25 bp, Mus musculus
cttggtatctaagctgccttttgtt

SEQ ID NO: 398247 - DNA, 25 bp, Mus musculus
cttggtatgtttatccgaatcccat

SEQ ID NO: 398248 - DNA, 25 bp, Mus musculus
cttggtatgtttttccgaatcccat

SEQ ID NO: 398249 - DNA, 25 bp, Mus musculus
cttggtatttttagtcattattggc

SEQ ID NO: 398250 - DNA, 25 bp, Mus musculus
cttggtattttttgtcattattggc

SEQ ID NO: 398251 - DNA, 25 bp, Mus musculus
cttggtcaatttcgttgtgtaagag

SEQ ID NO: 398252 - DNA, 25 bp, Mus musculus
cttggtcaatttggttgtgtaagag

SEQ ID NO: 398253 - DNA, 25 bp, Mus musculus
cttggtcacctcatcaagctggaat

SEQ ID NO: 398254 - DNA, 25 bp, Mus musculus
cttggtcacctcttcaagctggaat

SEQ ID NO: 398255 - DNA, 25 bp, Mus musculus
cttggtcagggtagctgtgaattgt

SEQ ID NO: 398256 - DNA, 25 bp, Mus musculus
cttggtcagggttgctgtgaattgt

SEQ ID NO: 398257 - DNA, 25 bp, Mus musculus
cttggtcatctaccctaacttgaag

SEQ ID NO: 398258 - DNA, 25 bp, Mus musculus
cttggtcatctagcctaacttgaag

SEQ ID NO: 398259 - DNA, 25 bp, Mus musculus
cttggtccactcaacttgctgtgaa

SEQ ID NO: 398260 - DNA, 25 bp, Mus musculus
cttggtccactctacttgctgtgaa

SEQ ID NO: 398261 - DNA, 25 bp, Mus musculus
cttggtccaggtctgcacagttcaa

SEQ ID NO: 398262 - DNA, 25 bp, Mus musculus
cttggtccaggtgtgcacagttcaa

SEQ ID NO: 398263 - DNA, 25 bp, Mus musculus
cttggtccatccaagaaacgtgtta

SEQ ID NO: 398264 - DNA, 25 bp, Mus musculus
cttggtccatcctagaaacgtgtta

SEQ ID NO: 398265 - DNA, 25 bp, Mus musculus
cttggtcctctccacgaacagtgag

SEQ ID NO: 398266 - DNA, 25 bp, Mus musculus
cttggtcctctcgacgaacagtgag

SEQ ID NO: 398267 - DNA, 25 bp, Mus musculus
cttggtcctgtgagaaccttaataa

SEQ ID NO: 398268 - DNA, 25 bp, Mus musculus
cttggtcctgtgtgaaccttaataa

SEQ ID NO: 398269 - DNA, 25 bp, Mus musculus
cttggtccttagatgaaatgtttac

SEQ ID NO: 398270 - DNA, 25 bp, Mus musculus
cttggtccttagttgaaatgtttac

SEQ ID NO: 398271 - DNA, 25 bp, Mus musculus
cttggtccttgcacaatgtgctgta

SEQ ID NO: 398272 - DNA, 25 bp, Mus musculus
cttggtccttgctcaatgtgctgta

SEQ ID NO: 398273 - DNA, 25 bp, Mus musculus
cttggtctccgcagaggcccaggcg

SEQ ID NO: 398274 - DNA, 25 bp, Mus musculus
cttggtctccgctgaggcccaggcg

SEQ ID NO: 398275 - DNA, 25 bp, Mus musculus
cttggtctcttgatgccattagcaa

SEQ ID NO: 398276 - DNA, 25 bp, Mus musculus
cttggtctcttgttgccattagcaa

SEQ ID NO: 398277 - DNA, 25 bp, Mus musculus
cttggtctctttatgctgctgagtc

SEQ ID NO: 398278 - DNA, 25 bp, Mus musculus
cttggtctctttttgctgctgagtc

SEQ ID NO: 398279 - DNA, 25 bp, Mus musculus
cttggtctgagaaatattgtactgg

SEQ ID NO: 398280 - DNA, 25 bp, Mus musculus
cttggtctgagatatattgtactgg

SEQ ID NO: 398281 - DNA, 25 bp, Mus musculus
cttggtctgccactgttgagttgca

SEQ ID NO: 398282 - DNA, 25 bp, Mus musculus
cttggtctgccagtgttgagttgca

SEQ ID NO: 398283 - DNA, 25 bp, Mus musculus
cttggtctgtgaattgaggtgttgc

SEQ ID NO: 398284 - DNA, 25 bp, Mus musculus
cttggtctgtgatttgaggtgttgc

SEQ ID NO: 398285 - DNA, 25 bp, Mus musculus
cttggtctgtgtctggcgtactaac

SEQ ID NO: 398286 - DNA, 25 bp, Mus musculus
cttggtctgtgtgtggcgtactaac

SEQ ID NO: 398287 - DNA, 25 bp, Mus musculus
cttggtgaaagcaggcgtgttgccc

SEQ ID NO: 398288 - DNA, 25 bp, Mus musculus
cttggtgaaagctggcgtgttgccc

SEQ ID NO: 398289 - DNA, 25 bp, Mus musculus
cttggtgaacatatctgcccttgag

SEQ ID NO: 398290 - DNA, 25 bp, Mus musculus
cttggtgaacatttctgcccttgag

SEQ ID NO: 398291 - DNA, 25 bp, Mus musculus
cttggtgaaggcagaccctgacgta

SEQ ID NO: 398292 - DNA, 25 bp, Mus musculus
cttggtgaaggctgaccctgacgta

SEQ ID NO: 398293 - DNA, 25 bp, Mus musculus
cttggtgaatacaacagagctatga

SEQ ID NO: 398294 - DNA, 25 bp, Mus musculus
cttggtgaatactacagagctatga

SEQ ID NO: 398295 - DNA, 25 bp, Mus musculus
cttggtgaccagactctgagctgtg

SEQ ID NO: 398296 - DNA, 25 bp, Mus musculus
cttggtgaccagtctctgagctgtg

SEQ ID NO: 398297 - DNA, 25 bp, Mus musculus
cttggtgaccataactgaggtgatg

SEQ ID NO: 398298 - DNA, 25 bp, Mus musculus
cttggtgaccattactgaggtgatg

SEQ ID NO: 398299 - DNA, 25 bp, Mus musculus
cttggtgagatgagtctataatccc

SEQ ID NO: 398300 - DNA, 25 bp, Mus musculus
cttggtgagatgtgtctataatccc

SEQ ID NO: 398301 - DNA, 25 bp, Mus musculus
cttggtgatatgaactcctcgtttg

SEQ ID NO: 398302 - DNA, 25 bp, Mus musculus
cttggtgatatgtactcctcgtttg

SEQ ID NO: 398303 - DNA, 25 bp, Mus musculus
cttggtgcaagaaggcaggtttcct

SEQ ID NO: 398304 - DNA, 25 bp, Mus musculus
cttggtgcaagatggcaggtttcct

SEQ ID NO: 398305 - DNA, 25 bp, Mus musculus
cttggtgcacgtcccttaggaacat

SEQ ID NO: 398306 - DNA, 25 bp, Mus musculus
cttggtgcacgtgccttaggaacat

SEQ ID NO: 398307 - DNA, 25 bp, Mus musculus
cttggtgccacaagagacaggaggc

SEQ ID NO: 398308 - DNA, 25 bp, Mus musculus
cttggtgccacatgagacaggaggc

SEQ ID NO: 398309 - DNA, 25 bp, Mus musculus
cttggtgcctacaacagattcttca

SEQ ID NO: 398310 - DNA, 25 bp, Mus musculus
cttggtgcctactacagattcttca

SEQ ID NO: 398311 - DNA, 25 bp, Mus musculus
cttggtgctctcagtttttgtggca

SEQ ID NO: 398312 - DNA, 25 bp, Mus musculus
cttggtgctctctgtttttgtggca

SEQ ID NO: 398313 - DNA, 25 bp, Mus musculus
cttggtgcttacagttcctaaactt

SEQ ID NO: 398314 - DNA, 25 bp, Mus musculus
cttggtgcttactgttcctaaactt

SEQ ID NO: 398315 - DNA, 25 bp, Mus musculus
cttggtgcttatactcttaactaga

SEQ ID NO: 398316 - DNA, 25 bp, Mus musculus
cttggtgcttattctcttaactaga

SEQ ID NO: 398317 - DNA, 25 bp, Mus musculus
cttggtggaaatattaacatgcctt

SEQ ID NO: 398318 - DNA, 25 bp, Mus musculus
cttggtggaaattttaacatgcctt

SEQ ID NO: 398319 - DNA, 25 bp, Mus musculus
cttggtggaagcattgtgtatgact

SEQ ID NO: 398320 - DNA, 25 bp, Mus musculus
cttggtggaagctttgtgtatgact

SEQ ID NO: 398321 - DNA, 25 bp, Mus musculus
cttggtggacagcagcgtgtacttc

SEQ ID NO: 398322 - DNA, 25 bp, Mus musculus
cttggtggacaggagcgtgtacttc

SEQ ID NO: 398323 - DNA, 25 bp, Mus musculus
cttggtggacatcacaaagcagcct

SEQ ID NO: 398324 - DNA, 25 bp, Mus musculus
cttggtggacatgacaaagcagcct

SEQ ID NO: 398325 - DNA, 25 bp, Mus musculus
cttggtggaggcagctgagacctca

SEQ ID NO: 398326 - DNA, 25 bp, Mus musculus
cttggtggaggctgctgagacctca

SEQ ID NO: 398327 - DNA, 25 bp, Mus musculus
cttggtggcatcacagcacctgaga

SEQ ID NO: 398328 - DNA, 25 bp, Mus musculus
cttggtggcatccaaggtctcctat

SEQ ID NO: 398329 - DNA, 25 bp, Mus musculus
cttggtggcatcgaaggtctcctat

SEQ ID NO: 398330 - DNA, 25 bp, Mus musculus
cttggtggcatctcagcacctgaga

SEQ ID NO: 398331 - DNA, 25 bp, Mus musculus
cttggtggcatgctcttgagttaga

SEQ ID NO: 398332 - DNA, 25 bp, Mus musculus
cttggtggcatggtcttgagttaga

SEQ ID NO: 398333 - DNA, 25 bp, Mus musculus
cttggtggcgctatttattttctgt

SEQ ID NO: 398334 - DNA, 25 bp, Mus musculus
cttggtggcgctttttattttctgt

SEQ ID NO: 398335 - DNA, 25 bp, Mus musculus
cttggtggtatgacaaatgtttgct

SEQ ID NO: 398336 - DNA, 25 bp, Mus musculus
cttggtggtatgtcaaatgtttgct

SEQ ID NO: 398337 - DNA, 25 bp, Mus musculus
cttggtggtattcgcctcctcagat

SEQ ID NO: 398338 - DNA, 25 bp, Mus musculus
cttggtggtattggcctcctcagat

SEQ ID NO: 398339 - DNA, 25 bp, Mus musculus
cttggtggtcagctacttgtgtgaa

SEQ ID NO: 398340 - DNA, 25 bp, Mus musculus
cttggtggtcaggtacttgtgtgaa

SEQ ID NO: 398341 - DNA, 25 bp, Mus musculus
cttggtggtcctcctcccggatgat

SEQ ID NO: 398342 - DNA, 25 bp, Mus musculus
cttggtggtcctgctcccggatgat

SEQ ID NO: 398343 - DNA, 25 bp, Mus musculus
cttggtggtgtgagactttctacaa

SEQ ID NO: 398344 - DNA, 25 bp, Mus musculus
cttggtggtgtgtgactttctacaa

SEQ ID NO: 398345 - DNA, 25 bp, Mus musculus
cttggtggttttaaagtgcatgcta

SEQ ID NO: 398346 - DNA, 25 bp, Mus musculus
cttggtggtttttaagtgcatgcta

SEQ ID NO: 398347 - DNA, 25 bp, Mus musculus
cttggtgtagcccacaggtatgaga

SEQ ID NO: 398348 - DNA, 25 bp, Mus musculus
cttggtgtagccgacaggtatgaga

SEQ ID NO: 398349 - DNA, 25 bp, Mus musculus
cttggtgtatatctcattgcgggac

SEQ ID NO: 398350 - DNA, 25 bp, Mus musculus
cttggtgtatatgtcattgcgggac

SEQ ID NO: 398351 - DNA, 25 bp, Mus musculus
cttggtgtgaatcttgctggcttga

SEQ ID NO: 398352 - DNA, 25 bp, Mus musculus
cttggtgtgaatgttgctggcttga

SEQ ID NO: 398353 - DNA, 25 bp, Mus musculus
cttggtgtgcagcttcttacttgta

SEQ ID NO: 398354 - DNA, 25 bp, Mus musculus
cttggtgtgcaggttcttacttgta

SEQ ID NO: 398355 - DNA, 25 bp, Mus musculus
cttggtgtggagcactagaccgtca

SEQ ID NO: 398356 - DNA, 25 bp, Mus musculus
cttggtgtggaggactagaccgtca

SEQ ID NO: 398357 - DNA, 25 bp, Mus musculus
cttggtgtgtgtaaactcaaaaaga

SEQ ID NO: 398358 - DNA, 25 bp, Mus musculus
cttggtgtgtgtattatctactggt

SEQ ID NO: 398359 - DNA, 25 bp, Mus musculus
cttggtgtgtgttaactcaaaaaga

SEQ ID NO: 398360 - DNA, 25 bp, Mus musculus
cttggtgtgtgttttatctactggt

SEQ ID NO: 398361 - DNA, 25 bp, Mus musculus
cttggtgtgttactgtatttgtctt

SEQ ID NO: 398362 - DNA, 25 bp, Mus musculus
cttggtgtgttagtgtatttgtctt

SEQ ID NO: 398363 - DNA, 25 bp, Mus musculus
cttggtgttcctcccgtcaagatag

SEQ ID NO: 398364 - DNA, 25 bp, Mus musculus
cttggtgttcctgccgtcaagatag

SEQ ID NO: 398365 - DNA, 25 bp, Mus musculus
cttggtgttctccagtagagaccag

SEQ ID NO: 398366 - DNA, 25 bp, Mus musculus
cttggtgttctcgagtagagaccag

SEQ ID NO: 398367 - DNA, 25 bp, Mus musculus
cttggtgttggcactcaagcgcatc

SEQ ID NO: 398368 - DNA, 25 bp, Mus musculus
cttggtgttggctctcaagcgcatc

SEQ ID NO: 398369 - DNA, 25 bp, Mus musculus
cttggtgtttggatcttcattcttt

SEQ ID NO: 398370 - DNA, 25 bp, Mus musculus
cttggtgtttggttcttcattcttt

SEQ ID NO: 398371 - DNA, 25 bp, Mus musculus
cttggttaccaacgataccatagca

SEQ ID NO: 398372 - DNA, 25 bp, Mus musculus
cttggttaccaaggataccatagca

SEQ ID NO: 398373 - DNA, 25 bp, Mus musculus
cttggttagaaaaaggccgctcctg

SEQ ID NO: 398374 - DNA, 25 bp, Mus musculus
cttggttagaaataggccgctcctg

SEQ ID NO: 398375 - DNA, 25 bp, Mus musculus
cttggttatgttaacagcacttggg

SEQ ID NO: 398376 - DNA, 25 bp, Mus musculus
cttggttatgtttacagcacttggg

SEQ ID NO: 398377 - DNA, 25 bp, Mus musculus
cttggttcacatatcttctccagca

SEQ ID NO: 398378 - DNA, 25 bp, Mus musculus
cttggttcacatttcttctccagca

SEQ ID NO: 398379 - DNA, 25 bp, Mus musculus
cttggttcatcaaactccagaccat

SEQ ID NO: 398380 - DNA, 25 bp, Mus musculus
cttggttcatcatactccagaccat

SEQ ID NO: 398381 - DNA, 25 bp, Mus musculus
cttggttcatgacgttatttagcac

SEQ ID NO: 398382 - DNA, 25 bp, Mus musculus
cttggttcatgaggttatttagcac

SEQ ID NO: 398383 - DNA, 25 bp, Mus musculus
cttggttctgaccttgattttcaac

SEQ ID NO: 398384 - DNA, 25 bp, Mus musculus
cttggttctgacgttgattttcaac

SEQ ID NO: 398385 - DNA, 25 bp, Mus musculus
cttggttctgccattcattggcaag

SEQ ID NO: 398386 - DNA, 25 bp, Mus musculus
cttggttctgcctttcattggcaag

SEQ ID NO: 398387 - DNA, 25 bp, Mus musculus
cttggttctgctatccacgggataa

SEQ ID NO: 398388 - DNA, 25 bp, Mus musculus
cttggttctgctttccacgggataa

SEQ ID NO: 398389 - DNA, 25 bp, Mus musculus
cttggttctggcaaactgttgttta

SEQ ID NO: 398390 - DNA, 25 bp, Mus musculus
cttggttctggctaactgttgttta

SEQ ID NO: 398391 - DNA, 25 bp, Mus musculus
cttggttgccaaccaaacactttcc

SEQ ID NO: 398392 - DNA, 25 bp, Mus musculus
cttggttgccaagcaaacactttcc

SEQ ID NO: 398393 - DNA, 25 bp, Mus musculus
cttggttgctctactctatcagaaa

SEQ ID NO: 398394 - DNA, 25 bp, Mus musculus
cttggttgctcttctctatcagaaa

SEQ ID NO: 398395 - DNA, 25 bp, Mus musculus
cttggttggcacacggatggttata

SEQ ID NO: 398396 - DNA, 25 bp, Mus musculus
cttggttggcactcggatggttata

SEQ ID NO: 398397 - DNA, 25 bp, Mus musculus
cttggttgggctaaatgttactgac

SEQ ID NO: 398398 - DNA, 25 bp, Mus musculus
cttggttgggcttaatgttactgac

SEQ ID NO: 398399 - DNA, 25 bp, Mus musculus
cttggttggttcagccacaagcaca

SEQ ID NO: 398400 - DNA, 25 bp, Mus musculus
cttggttggttctgccacaagcaca

SEQ ID NO: 398401 - DNA, 25 bp, Mus musculus
cttggtttacccctgtgaacagtgt

SEQ ID NO: 398402 - DNA, 25 bp, Mus musculus
cttggtttacccgtgtgaacagtgt

SEQ ID NO: 398403 - DNA, 25 bp, Mus musculus
cttggtttacgaatggctggattct

SEQ ID NO: 398404 - DNA, 25 bp, Mus musculus
cttggtttacgattggctggattct

SEQ ID NO: 398405 - DNA, 25 bp, Mus musculus
cttggtttcaggcttacgagatcgt

SEQ ID NO: 398406 - DNA, 25 bp, Mus musculus
cttggtttcagggttacgagatcgt

SEQ ID NO: 398407 - DNA, 25 bp, Mus musculus
cttggtttccctcaggcagaagaat

SEQ ID NO: 398408 - DNA, 25 bp, Mus musculus
cttggtttccctcgcaatgcagttt

SEQ ID NO: 398409 - DNA, 25 bp, Mus musculus
cttggtttccctgaggcagaagaat

SEQ ID NO: 398410 - DNA, 25 bp, Mus musculus
cttggtttccctggcaatgcagttt

SEQ ID NO: 398411 - DNA, 25 bp, Mus musculus
cttggtttcgatataggagcctgga

SEQ ID NO: 398412 - DNA, 25 bp, Mus musculus
cttggtttcgatttaggagcctgga

SEQ ID NO: 398413 - DNA, 25 bp, Mus musculus
cttggtttctgaatgaccacctccc

SEQ ID NO: 398414 - DNA, 25 bp, Mus musculus
cttggtttctgattgaccacctccc

SEQ ID NO: 398415 - DNA, 25 bp, Mus musculus
cttggtttctgtactagttcctaga

SEQ ID NO: 398416 - DNA, 25 bp, Mus musculus
cttggtttctgttctagttcctaga

SEQ ID NO: 398417 - DNA, 25 bp, Mus musculus
cttggtttctttctccaagcatgac

SEQ ID NO: 398418 - DNA, 25 bp, Mus musculus
cttggtttctttgtccaagcatgac

SEQ ID NO: 398419 - DNA, 25 bp, Mus musculus
cttggtttgactactctatttcagg

SEQ ID NO: 398420 - DNA, 25 bp, Mus musculus
cttggtttgacttctctatttcagg

SEQ ID NO: 398421 - DNA, 25 bp, Mus musculus
cttggtttgcagctgaggcctaatt

SEQ ID NO: 398422 - DNA, 25 bp, Mus musculus
cttggtttgcaggtgaggcctaatt

SEQ ID NO: 398423 - DNA, 25 bp, Mus musculus
cttggttttagtctgctgtggtatt

SEQ ID NO: 398424 - DNA, 25 bp, Mus musculus
cttggttttagtgtgctgtggtatt

SEQ ID NO: 398425 - DNA, 25 bp, Mus musculus
cttggttttctcaatgggccacgaa

SEQ ID NO: 398426 - DNA, 25 bp, Mus musculus
cttggttttctctatgggccacgaa

SEQ ID NO: 398427 - DNA, 25 bp, Mus musculus
cttggttttgcaattcaactctggc

SEQ ID NO: 398428 - DNA, 25 bp, Mus musculus
cttggttttgcatttcaactctggc

SEQ ID NO: 398429 - DNA, 25 bp, Mus musculus
cttggttttgttcgaggatcctcac

SEQ ID NO: 398430 - DNA, 25 bp, Mus musculus
cttggttttgttggaggatcctcac

SEQ ID NO: 398431 - DNA, 25 bp, Mus musculus
cttgtaaaactcaggactccttctc

SEQ ID NO: 398432 - DNA, 25 bp, Mus musculus
cttgtaaaactctggactccttctc

SEQ ID NO: 398433 - DNA, 25 bp, Mus musculus
cttgtaaacagtctgcagaagcagt

SEQ ID NO: 398434 - DNA, 25 bp, Mus musculus
cttgtaaacagtgtgcagaagcagt

SEQ ID NO: 398435 - DNA, 25 bp, Mus musculus
cttgtaaatcaacaccctgttcatt

SEQ ID NO: 398436 - DNA, 25 bp, Mus musculus
cttgtaaatcaagaccctgttcatt

SEQ ID NO: 398437 - DNA, 25 bp, Mus musculus
cttgtaactcatagctatgtttctt

SEQ ID NO: 398438 - DNA, 25 bp, Mus musculus
cttgtaactcattgctatgtttctt

SEQ ID NO: 398439 - DNA, 25 bp, Mus musculus
cttgtaagtatcactctggagacta

SEQ ID NO: 398440 - DNA, 25 bp, Mus musculus
cttgtaagtatctctctggagacta

SEQ ID NO: 398441 - DNA, 25 bp, Mus musculus
cttgtaatatttacaacgatgctga

SEQ ID NO: 398442 - DNA, 25 bp, Mus musculus
cttgtaatattttcaacgatgctga

SEQ ID NO: 398443 - DNA, 25 bp, Mus musculus
cttgtaatggttcagtttggactga

SEQ ID NO: 398444 - DNA, 25 bp, Mus musculus
cttgtaatggttgagtttggactga

SEQ ID NO: 398445 - DNA, 25 bp, Mus musculus
cttgtacactgacgacactcctata

SEQ ID NO: 398446 - DNA, 25 bp, Mus musculus
cttgtacactgaggacactcctata

SEQ ID NO: 398447 - DNA, 25 bp, Mus musculus
cttgtaccctgtagcgggttctaga

SEQ ID NO: 398448 - DNA, 25 bp, Mus musculus
cttgtaccctgttgcgggttctaga

SEQ ID NO: 398449 - DNA, 25 bp, Mus musculus
cttgtaccgaagagggcttagtcta

SEQ ID NO: 398450 - DNA, 25 bp, Mus musculus
cttgtaccgaagtgggcttagtcta

SEQ ID NO: 398451 - DNA, 25 bp, Mus musculus
cttgtacctcaaaccataatatcat

SEQ ID NO: 398452 - DNA, 25 bp, Mus musculus
cttgtacctcaatccataatatcat

SEQ ID NO: 398453 - DNA, 25 bp, Mus musculus
cttgtacgttttcttctgctgctct

SEQ ID NO: 398454 - DNA, 25 bp, Mus musculus
cttgtacgttttgttctgctgctct

SEQ ID NO: 398455 - DNA, 25 bp, Mus musculus
cttgtactaactcacctgctattta

SEQ ID NO: 398456 - DNA, 25 bp, Mus musculus
cttgtactaactgacctgctattta

SEQ ID NO: 398457 - DNA, 25 bp, Mus musculus
cttgtactccaacgctcattatctg

SEQ ID NO: 398458 - DNA, 25 bp, Mus musculus
cttgtactccaaggctcattatctg

SEQ ID NO: 398459 - DNA, 25 bp, Mus musculus
cttgtactcctccttttggagtcag

SEQ ID NO: 398460 - DNA, 25 bp, Mus musculus
cttgtactcctcgttttggagtcag

SEQ ID NO: 398461 - DNA, 25 bp, Mus musculus
cttgtactgagacctggttgtcacc

SEQ ID NO: 398462 - DNA, 25 bp, Mus musculus
cttgtactgagagctggttgtcacc

SEQ ID NO: 398463 - DNA, 25 bp, Mus musculus
cttgtactgctaacttctcttcctc

SEQ ID NO: 398464 - DNA, 25 bp, Mus musculus
cttgtactgctatcttctcttcctc

SEQ ID NO: 398465 - DNA, 25 bp, Mus musculus
cttgtacttcgcatgtccaggaaag

SEQ ID NO: 398466 - DNA, 25 bp, Mus musculus
cttgtacttcgcttgtccaggaaag

SEQ ID NO: 398467 - DNA, 25 bp, Mus musculus
cttgtagaatcaatgtcagagtgtg

SEQ ID NO: 398468 - DNA, 25 bp, Mus musculus
cttgtagaatcattgtcagagtgtg

SEQ ID NO: 398469 - DNA, 25 bp, Mus musculus
cttgtagatcaacatgctcctgctc

SEQ ID NO: 398470 - DNA, 25 bp, Mus musculus
cttgtagatcaagatgctcctgctc

SEQ ID NO: 398471 - DNA, 25 bp, Mus musculus
cttgtagatggcattatttggctca

SEQ ID NO: 398472 - DNA, 25 bp, Mus musculus
cttgtagatggctttatttggctca

SEQ ID NO: 398473 - DNA, 25 bp, Mus musculus
cttgtagcaagacagtgaatggtaa

SEQ ID NO: 398474 - DNA, 25 bp, Mus musculus
cttgtagcaagagagtgaatggtaa

SEQ ID NO: 398475 - DNA, 25 bp, Mus musculus
cttgtagcacacatcagatttctga

SEQ ID NO: 398476 - DNA, 25 bp, Mus musculus
cttgtagcacacttcagatttctga

SEQ ID NO: 398477 - DNA, 25 bp, Mus musculus
cttgtagcattcaggactcacttat

SEQ ID NO: 398478 - DNA, 25 bp, Mus musculus
cttgtagcattctggactcacttat

SEQ ID NO: 398479 - DNA, 25 bp, Mus musculus
cttgtagcattgaatgcttcctgtg

SEQ ID NO: 398480 - DNA, 25 bp, Mus musculus
cttgtagcattgtatgcttcctgtg

SEQ ID NO: 398481 - DNA, 25 bp, Mus musculus
cttgtagctgagacgggcttcccgg

SEQ ID NO: 398482 - DNA, 25 bp, Mus musculus
cttgtagctgagtcgggcttcccgg

SEQ ID NO: 398483 - DNA, 25 bp, Mus musculus
cttgtaggtatcatgctggtgttgg

SEQ ID NO: 398484 - DNA, 25 bp, Mus musculus
cttgtaggtatcttgctggtgttgg

SEQ ID NO: 398485 - DNA, 25 bp, Mus musculus
cttgtagtttaaccagggcaacact

SEQ ID NO: 398486 - DNA, 25 bp, Mus musculus
cttgtagtttaagcagggcaacact

SEQ ID NO: 398487 - DNA, 25 bp, Mus musculus
cttgtatactacattcattttccct

SEQ ID NO: 398488 - DNA, 25 bp, Mus musculus
cttgtatactactttcattttccct

SEQ ID NO: 398489 - DNA, 25 bp, Mus musculus
cttgtatatataatccctccctgtg

SEQ ID NO: 398490 - DNA, 25 bp, Mus musculus
cttgtatatatattccctccctgtg

SEQ ID NO: 398491 - DNA, 25 bp, Mus musculus
cttgtatccctgacctataaactta

SEQ ID NO: 398492 - DNA, 25 bp, Mus musculus
cttgtatccctgtcctataaactta

SEQ ID NO: 398493 - DNA, 25 bp, Mus musculus
cttgtatggtgtccggtaaaaacca

SEQ ID NO: 398494 - DNA, 25 bp, Mus musculus
cttgtatggtgtgcggtaaaaacca

SEQ ID NO: 398495 - DNA, 25 bp, Mus musculus
cttgtatgtagtcttggttactggg

SEQ ID NO: 398496 - DNA, 25 bp, Mus musculus
cttgtatgtagtgttggttactggg

SEQ ID NO: 398497 - DNA, 25 bp, Mus musculus
cttgtatgtataattccagggttat

SEQ ID NO: 398498 - DNA, 25 bp, Mus musculus
cttgtatgtatatttccagggttat

SEQ ID NO: 398499 - DNA, 25 bp, Mus musculus
cttgtattaattctcccaggcatgt

SEQ ID NO: 398500 - DNA, 25 bp, Mus musculus
cttgtattaattgtcccaggcatgt

SEQ ID NO: 398501 - DNA, 25 bp, Mus musculus
cttgtattacgaatcgcacgatgag

SEQ ID NO: 398502 - DNA, 25 bp, Mus musculus
cttgtattacgattcgcacgatgag

SEQ ID NO: 398503 - DNA, 25 bp, Mus musculus
cttgtattcagtaatctcagacgat

SEQ ID NO: 398504 - DNA, 25 bp, Mus musculus
cttgtattcagttatctcagacgat

SEQ ID NO: 398505 - DNA, 25 bp, Mus musculus
cttgtattccagatctgagcagccc

SEQ ID NO: 398506 - DNA, 25 bp, Mus musculus
cttgtattccagttctgagcagccc

SEQ ID NO: 398507 - DNA, 25 bp, Mus musculus
cttgtattccctcagctctaaaaat

SEQ ID NO: 398508 - DNA, 25 bp, Mus musculus
cttgtattccctgagctctaaaaat

SEQ ID NO: 398509 - DNA, 25 bp, Mus musculus
cttgtattttccagcaattttggtt

SEQ ID NO: 398510 - DNA, 25 bp, Mus musculus
cttgtattttcctgcaattttggtt

SEQ ID NO: 398511 - DNA, 25 bp, Mus musculus
cttgtcaaaactcactaccctgtgc

SEQ ID NO: 398512 - DNA, 25 bp, Mus musculus
cttgtcaaaactgactaccctgtgc

SEQ ID NO: 398513 - DNA, 25 bp, Mus musculus
cttgtcaaactcagcagcaccatta

SEQ ID NO: 398514 - DNA, 25 bp, Mus musculus
cttgtcaaactctgcagcaccatta

SEQ ID NO: 398515 - DNA, 25 bp, Mus musculus
cttgtcaagccacggcctgtcttct

SEQ ID NO: 398516 - DNA, 25 bp, Mus musculus
cttgtcaagccagggcctgtcttct

SEQ ID NO: 398517 - DNA, 25 bp, Mus musculus
cttgtcaccaaacgatccttttcaa

SEQ ID NO: 398518 - DNA, 25 bp, Mus musculus
cttgtcaccaaaggatccttttcaa

SEQ ID NO: 398519 - DNA, 25 bp, Mus musculus
cttgtcaccaagatgaacggtttca

SEQ ID NO: 398520 - DNA, 25 bp, Mus musculus
cttgtcaccaagttgaacggtttca

SEQ ID NO: 398521 - DNA, 25 bp, Mus musculus
cttgtcaccttcagcacagtgatgc

SEQ ID NO: 398522 - DNA, 25 bp, Mus musculus
cttgtcaccttctgcacagtgatgc

SEQ ID NO: 398523 - DNA, 25 bp, Mus musculus
cttgtcaccttgacaccagctagat

SEQ ID NO: 398524 - DNA, 25 bp, Mus musculus
cttgtcaccttgtcaccagctagat

SEQ ID NO: 398525 - DNA, 25 bp, Mus musculus
cttgtcactgatctggaatgttcca

SEQ ID NO: 398526 - DNA, 25 bp, Mus musculus
cttgtcactgatgtggaatgttcca

SEQ ID NO: 398527 - DNA, 25 bp, Mus musculus
cttgtcacttagaagagcctttgaa

SEQ ID NO: 398528 - DNA, 25 bp, Mus musculus
cttgtcacttagtagagcctttgaa

SEQ ID NO: 398529 - DNA, 25 bp, Mus musculus
cttgtcagctcacttcagttgtatt

SEQ ID NO: 398530 - DNA, 25 bp, Mus musculus
cttgtcagctcagttcagttgtatt

SEQ ID NO: 398531 - DNA, 25 bp, Mus musculus
cttgtcagtgagcagtaactattgt

SEQ ID NO: 398532 - DNA, 25 bp, Mus musculus
cttgtcagtgaggagtaactattgt

SEQ ID NO: 398533 - DNA, 25 bp, Mus musculus
cttgtcatgaccatgtagcccagag

SEQ ID NO: 398534 - DNA, 25 bp, Mus musculus
cttgtcatgaccttgtagcccagag

SEQ ID NO: 398535 - DNA, 25 bp, Mus musculus
cttgtcatggatacgagcctgtgtc

SEQ ID NO: 398536 - DNA, 25 bp, Mus musculus
cttgtcatggattcgagcctgtgtc

SEQ ID NO: 398537 - DNA, 25 bp, Mus musculus
cttgtcattgacatcgatcgcacta

SEQ ID NO: 398538 - DNA, 25 bp, Mus musculus
cttgtcattgacttcgatcgcacta

SEQ ID NO: 398539 - DNA, 25 bp, Mus musculus
cttgtcatttctcatcaatcttggt

SEQ ID NO: 398540 - DNA, 25 bp, Mus musculus
cttgtcatttctgatcaatcttggt

SEQ ID NO: 398541 - DNA, 25 bp, Mus musculus
cttgtccaaaggctgctttggcctc

SEQ ID NO: 398542 - DNA, 25 bp, Mus musculus
cttgtccaaagggtgctttggcctc

SEQ ID NO: 398543 - DNA, 25 bp, Mus musculus
cttgtccaaggtaccatagctagta

SEQ ID NO: 398544 - DNA, 25 bp, Mus musculus
cttgtccaaggttccatagctagta

SEQ ID NO: 398545 - DNA, 25 bp, Mus musculus
cttgtccaagtacctgttcctgtga

SEQ ID NO: 398546 - DNA, 25 bp, Mus musculus
cttgtccaagtagctgttcctgtga

SEQ ID NO: 398547 - DNA, 25 bp, Mus musculus
cttgtccaatgaatctgcagtcctc

SEQ ID NO: 398548 - DNA, 25 bp, Mus musculus
cttgtccaatgattctgcagtcctc

SEQ ID NO: 398549 - DNA, 25 bp, Mus musculus
cttgtccacatgaatctcaatgcca

SEQ ID NO: 398550 - DNA, 25 bp, Mus musculus
cttgtccacatgtatctcaatgcca

SEQ ID NO: 398551 - DNA, 25 bp, Mus musculus
cttgtccagcttctcgtttttgaaa

SEQ ID NO: 398552 - DNA, 25 bp, Mus musculus
cttgtccagcttgtcgtttttgaaa

SEQ ID NO: 398553 - DNA, 25 bp, Mus musculus
cttgtccagtgtcgctgacccttga

SEQ ID NO: 398554 - DNA, 25 bp, Mus musculus
cttgtccagtgtggctgacccttga

SEQ ID NO: 398555 - DNA, 25 bp, Mus musculus
cttgtccatgacacttgcgagtctg

SEQ ID NO: 398556 - DNA, 25 bp, Mus musculus
cttgtccatgactcttgcgagtctg

SEQ ID NO: 398557 - DNA, 25 bp, Mus musculus
cttgtcccaagcactgtggtgagga

SEQ ID NO: 398558 - DNA, 25 bp, Mus musculus
cttgtcccaagctctgtggtgagga

SEQ ID NO: 398559 - DNA, 25 bp, Mus musculus
cttgtccccttgaattttactcata

SEQ ID NO: 398560 - DNA, 25 bp, Mus musculus
cttgtccccttgtattttactcata

SEQ ID NO: 398561 - DNA, 25 bp, Mus musculus
cttgtcccgagactatgatgcctta

SEQ ID NO: 398562 - DNA, 25 bp, Mus musculus
cttgtcccgagagtatgatgcctta

SEQ ID NO: 398563 - DNA, 25 bp, Mus musculus
cttgtccctcccattattgaaatta

SEQ ID NO: 398564 - DNA, 25 bp, Mus musculus
cttgtccctccctttattgaaatta

SEQ ID NO: 398565 - DNA, 25 bp, Mus musculus
cttgtccgcattcttcaaccacaag

SEQ ID NO: 398566 - DNA, 25 bp, Mus musculus
cttgtccgcattgttcaaccacaag

SEQ ID NO: 398567 - DNA, 25 bp, Mus musculus
cttgtccgtactcgcgctgttatta

SEQ ID NO: 398568 - DNA, 25 bp, Mus musculus
cttgtccgtactggcgctgttatta

SEQ ID NO: 398569 - DNA, 25 bp, Mus musculus
cttgtcctaagaatatttgctacga

SEQ ID NO: 398570 - DNA, 25 bp, Mus musculus
cttgtcctaagattatttgctacga

SEQ ID NO: 398571 - DNA, 25 bp, Mus musculus
cttgtcctagtaatattcagccttg

SEQ ID NO: 398572 - DNA, 25 bp, Mus musculus
cttgtcctagtattattcagccttg

SEQ ID NO: 398573 - DNA, 25 bp, Mus musculus
cttgtcctgaagagtagtaatggtt

SEQ ID NO: 398574 - DNA, 25 bp, Mus musculus
cttgtcctgaagtgtagtaatggtt

SEQ ID NO: 398575 - DNA, 25 bp, Mus musculus
cttgtcctgactccagtgaaggtga

SEQ ID NO: 398576 - DNA, 25 bp, Mus musculus
cttgtcctgactgcagtgaaggtga

SEQ ID NO: 398577 - DNA, 25 bp, Mus musculus
cttgtccttaaaacgtgccattctt

SEQ ID NO: 398578 - DNA, 25 bp, Mus musculus
cttgtccttaaatcgtgccattctt

SEQ ID NO: 398579 - DNA, 25 bp, Mus musculus
cttgtccttttgcattagtaagtat

SEQ ID NO: 398580 - DNA, 25 bp, Mus musculus
cttgtccttttggattagtaagtat

SEQ ID NO: 398581 - DNA, 25 bp, Mus musculus
cttgtcgaaaaccacactcggatct

SEQ ID NO: 398582 - DNA, 25 bp, Mus musculus
cttgtcgaaaacgacactcggatct

SEQ ID NO: 398583 - DNA, 25 bp, Mus musculus
cttgtcggaaggatgccatgaggat

SEQ ID NO: 398584 - DNA, 25 bp, Mus musculus
cttgtcggaaggttgccatgaggat

SEQ ID NO: 398585 - DNA, 25 bp, Mus musculus
cttgtcggctgcagtgtgtaagtca

SEQ ID NO: 398586 - DNA, 25 bp, Mus musculus
cttgtcggctgctgtgtgtaagtca

SEQ ID NO: 398587 - DNA, 25 bp, Mus musculus
cttgtcgtcctaaagcccaagctgg

SEQ ID NO: 398588 - DNA, 25 bp, Mus musculus
cttgtcgtcctatagcccaagctgg

SEQ ID NO: 398589 - DNA, 25 bp, Mus musculus
cttgtcgttggaccctggagccttg

SEQ ID NO: 398590 - DNA, 25 bp, Mus musculus
cttgtcgttggagcctggagccttg

SEQ ID NO: 398591 - DNA, 25 bp, Mus musculus
cttgtctaatccagggttgcaaaga

SEQ ID NO: 398592 - DNA, 25 bp, Mus musculus
cttgtctaatcctgggttgcaaaga

SEQ ID NO: 398593 - DNA, 25 bp, Mus musculus
cttgtctacccaataaagtgtggtt

SEQ ID NO: 398594 - DNA, 25 bp, Mus musculus
cttgtctacccattaaagtgtggtt

SEQ ID NO: 398595 - DNA, 25 bp, Mus musculus
cttgtctagacccagtcctgagcag

SEQ ID NO: 398596 - DNA, 25 bp, Mus musculus
cttgtctagaccgagtcctgagcag

SEQ ID NO: 398597 - DNA, 25 bp, Mus musculus
cttgtctatcaactgcggagtcctt

SEQ ID NO: 398598 - DNA, 25 bp, Mus musculus
cttgtctatcaagtgcggagtcctt

SEQ ID NO: 398599 - DNA, 25 bp, Mus musculus
cttgtctcacaacccagagcaaaaa

SEQ ID NO: 398600 - DNA, 25 bp, Mus musculus
cttgtctcacaagccagagcaaaaa

SEQ ID NO: 398601 - DNA, 25 bp, Mus musculus
cttgtctcccgtctctaaagtgtga

SEQ ID NO: 398602 - DNA, 25 bp, Mus musculus
cttgtctcccgtgtctaaagtgtga

SEQ ID NO: 398603 - DNA, 25 bp, Mus musculus
cttgtctctccacttggcagcacat

SEQ ID NO: 398604 - DNA, 25 bp, Mus musculus
cttgtctctccagttggcagcacat

SEQ ID NO: 398605 - DNA, 25 bp, Mus musculus
cttgtctctgatctttttctttctt

SEQ ID NO: 398606 - DNA, 25 bp, Mus musculus
cttgtctctgatgtttttctttctt

SEQ ID NO: 398607 - DNA, 25 bp, Mus musculus
cttgtctgataaaccactgcccatg

SEQ ID NO: 398608 - DNA, 25 bp, Mus musculus
cttgtctgataatccactgcccatg

SEQ ID NO: 398609 - DNA, 25 bp, Mus musculus
cttgtctgattgctcgttctcgaat

SEQ ID NO: 398610 - DNA, 25 bp, Mus musculus
cttgtctgattggtcgttctcgaat

SEQ ID NO: 398611 - DNA, 25 bp, Mus musculus
cttgtctgctctacacttggaagat

SEQ ID NO: 398612 - DNA, 25 bp, Mus musculus
cttgtctgctcttcacttggaagat

SEQ ID NO: 398613 - DNA, 25 bp, Mus musculus
cttgtctgctgtagcctttatgaac

SEQ ID NO: 398614 - DNA, 25 bp, Mus musculus
cttgtctgctgttgcctttatgaac

SEQ ID NO: 398615 - DNA, 25 bp, Mus musculus
cttgtctggcgtctgtgaaagccca

SEQ ID NO: 398616 - DNA, 25 bp, Mus musculus
cttgtctggcgtgtgtgaaagccca

SEQ ID NO: 398617 - DNA, 25 bp, Mus musculus
cttgtctggtcaatcatccttgtaa

SEQ ID NO: 398618 - DNA, 25 bp, Mus musculus
cttgtctggtcattcatccttgtaa

SEQ ID NO: 398619 - DNA, 25 bp, Mus musculus
cttgtctggtccattcctctatgac

SEQ ID NO: 398620 - DNA, 25 bp, Mus musculus
cttgtctggtcctttcctctatgac

SEQ ID NO: 398621 - DNA, 25 bp, Mus musculus
cttgtcttaggcacatttgttcctt

SEQ ID NO: 398622 - DNA, 25 bp, Mus musculus
cttgtcttaggcacgaccaataacc

SEQ ID NO: 398623 - DNA, 25 bp, Mus musculus
cttgtcttaggctcatttgttcctt

SEQ ID NO: 398624 - DNA, 25 bp, Mus musculus
cttgtcttaggctcgaccaataacc

SEQ ID NO: 398625 - DNA, 25 bp, Mus musculus
cttgtcttgattctatggtcggttg

SEQ ID NO: 398626 - DNA, 25 bp, Mus musculus
cttgtcttgattgtatggtcggttg

SEQ ID NO: 398627 - DNA, 25 bp, Mus musculus
cttgtcttgcatctttttcggaatg

SEQ ID NO: 398628 - DNA, 25 bp, Mus musculus
cttgtcttgcatgtttttcggaatg

SEQ ID NO: 398629 - DNA, 25 bp, Mus musculus
cttgtcttggacagcttttgtaatt

SEQ ID NO: 398630 - DNA, 25 bp, Mus musculus
cttgtcttggactgcttttgtaatt

SEQ ID NO: 398631 - DNA, 25 bp, Mus musculus
cttgtctttctccagtactgggttt

SEQ ID NO: 398632 - DNA, 25 bp, Mus musculus
cttgtctttctcgagtactgggttt

SEQ ID NO: 398633 - DNA, 25 bp, Mus musculus
cttgtctttctgagactgtaccaaa

SEQ ID NO: 398634 - DNA, 25 bp, Mus musculus
cttgtctttctgtgactgtaccaaa

SEQ ID NO: 398635 - DNA, 25 bp, Mus musculus
cttgtgaacgtcatctctggccttt

SEQ ID NO: 398636 - DNA, 25 bp, Mus musculus
cttgtgaacgtcttctctggccttt

SEQ ID NO: 398637 - DNA, 25 bp, Mus musculus
cttgtgaagctcaagtttctgtcta

SEQ ID NO: 398638 - DNA, 25 bp, Mus musculus
cttgtgaagctctagtttctgtcta

SEQ ID NO: 398639 - DNA, 25 bp, Mus musculus
cttgtgaagttcagaaacctcaaat

SEQ ID NO: 398640 - DNA, 25 bp, Mus musculus
cttgtgaagttctgaaacctcaaat

SEQ ID NO: 398641 - DNA, 25 bp, Mus musculus
cttgtgaatgaccaacgctgttcct

SEQ ID NO: 398642 - DNA, 25 bp, Mus musculus
cttgtgaatgacgaacgctgttcct

SEQ ID NO: 398643 - DNA, 25 bp, Mus musculus
cttgtgacaaacagcagaggtgata

SEQ ID NO: 398644 - DNA, 25 bp, Mus musculus
cttgtgacaaactgcagaggtgata

SEQ ID NO: 398645 - DNA, 25 bp, Mus musculus
cttgtgacaaggcatactgtgggac

SEQ ID NO: 398646 - DNA, 25 bp, Mus musculus
cttgtgacaagggatactgtgggac

SEQ ID NO: 398647 - DNA, 25 bp, Mus musculus
cttgtgacacctcggctgtgatcct

SEQ ID NO: 398648 - DNA, 25 bp, Mus musculus
cttgtgacacctgggctgtgatcct

SEQ ID NO: 398649 - DNA, 25 bp, Mus musculus
cttgtgacactgcacagtcctttct

SEQ ID NO: 398650 - DNA, 25 bp, Mus musculus
cttgtgacactggacagtcctttct

SEQ ID NO: 398651 - DNA, 25 bp, Mus musculus
cttgtgacatttccttcgctggtat

SEQ ID NO: 398652 - DNA, 25 bp, Mus musculus
cttgtgacatttgcttcgctggtat

SEQ ID NO: 398653 - DNA, 25 bp, Mus musculus
cttgtgaccagtactaatcttgagt

SEQ ID NO: 398654 - DNA, 25 bp, Mus musculus
cttgtgaccagttctaatcttgagt

SEQ ID NO: 398655 - DNA, 25 bp, Mus musculus
cttgtgactaaccaacccatgaact

SEQ ID NO: 398656 - DNA, 25 bp, Mus musculus
cttgtgactaacgaacccatgaact

SEQ ID NO: 398657 - DNA, 25 bp, Mus musculus
cttgtgagagctcgcaagcctgcac

SEQ ID NO: 398658 - DNA, 25 bp, Mus musculus
cttgtgagagctggcaagcctgcac

SEQ ID NO: 398659 - DNA, 25 bp, Mus musculus
cttgtgagatgcattttctttgctt

SEQ ID NO: 398660 - DNA, 25 bp, Mus musculus
cttgtgagatgctttttctttgctt

SEQ ID NO: 398661 - DNA, 25 bp, Mus musculus
cttgtgagcatgactcaggaggccc

SEQ ID NO: 398662 - DNA, 25 bp, Mus musculus
cttgtgagcatgtctcaggaggccc

SEQ ID NO: 398663 - DNA, 25 bp, Mus musculus
cttgtgagctggagtgcaccgagca

SEQ ID NO: 398664 - DNA, 25 bp, Mus musculus
cttgtgagctggtgtgcaccgagca

SEQ ID NO: 398665 - DNA, 25 bp, Mus musculus
cttgtgaggcctcaggtccgaagat

SEQ ID NO: 398666 - DNA, 25 bp, Mus musculus
cttgtgaggcctgaggtccgaagat

SEQ ID NO: 398667 - DNA, 25 bp, Mus musculus
cttgtgaggtctacgccacatggaa

SEQ ID NO: 398668 - DNA, 25 bp, Mus musculus
cttgtgaggtcttcgccacatggaa

SEQ ID NO: 398669 - DNA, 25 bp, Mus musculus
cttgtgatacttacagatgctgtta

SEQ ID NO: 398670 - DNA, 25 bp, Mus musculus
cttgtgatactttcagatgctgtta

SEQ ID NO: 398671 - DNA, 25 bp, Mus musculus
cttgtgatccgccagaaactgttgg

SEQ ID NO: 398672 - DNA, 25 bp, Mus musculus
cttgtgatccgcgagaaactgttgg

SEQ ID NO: 398673 - DNA, 25 bp, Mus musculus
cttgtgatctgtcccagtcattgca

SEQ ID NO: 398674 - DNA, 25 bp, Mus musculus
cttgtgatctgtgccagtcattgca

SEQ ID NO: 398675 - DNA, 25 bp, Mus musculus
cttgtgattccaagaggtctgctat

SEQ ID NO: 398676 - DNA, 25 bp, Mus musculus
cttgtgattccatgaggtctgctat

SEQ ID NO: 398677 - DNA, 25 bp, Mus musculus
cttgtgattgtaattctgatgtgct

SEQ ID NO: 398678 - DNA, 25 bp, Mus musculus
cttgtgattgtatttctgatgtgct

SEQ ID NO: 398679 - DNA, 25 bp, Mus musculus
cttgtgattttgattacggcccttg

SEQ ID NO: 398680 - DNA, 25 bp, Mus musculus
cttgtgattttgtttacggcccttg

SEQ ID NO: 398681 - DNA, 25 bp, Mus musculus
cttgtgcactttcttaatccccata

SEQ ID NO: 398682 - DNA, 25 bp, Mus musculus
cttgtgcactttgttaatccccata

SEQ ID NO: 398683 - DNA, 25 bp, Mus musculus
cttgtgcagcacctggttgggacat

SEQ ID NO: 398684 - DNA, 25 bp, Mus musculus
cttgtgcagcacgtggttgggacat

SEQ ID NO: 398685 - DNA, 25 bp, Mus musculus
cttgtgcatgagaacctgcctgggc

SEQ ID NO: 398686 - DNA, 25 bp, Mus musculus
cttgtgcatgagtacctgcctgggc

SEQ ID NO: 398687 - DNA, 25 bp, Mus musculus
cttgtgcattctaggccttgtaaat

SEQ ID NO: 398688 - DNA, 25 bp, Mus musculus
cttgtgcattcttggccttgtaaat

SEQ ID NO: 398689 - DNA, 25 bp, Mus musculus
cttgtgcattttctaaagccttaga

SEQ ID NO: 398690 - DNA, 25 bp, Mus musculus
cttgtgcattttgtaaagccttaga

SEQ ID NO: 398691 - DNA, 25 bp, Mus musculus
cttgtgcccaaaaatgttgtgcatt

SEQ ID NO: 398692 - DNA, 25 bp, Mus musculus
cttgtgcccaaatatgttgtgcatt

SEQ ID NO: 398693 - DNA, 25 bp, Mus musculus
cttgtgcccacactgtgtagagaag

SEQ ID NO: 398694 - DNA, 25 bp, Mus musculus
cttgtgcccacagtgtgtagagaag

SEQ ID NO: 398695 - DNA, 25 bp, Mus musculus
cttgtgcccctaatttacagatcga

SEQ ID NO: 398696 - DNA, 25 bp, Mus musculus
cttgtgcccctattttacagatcga

SEQ ID NO: 398697 - DNA, 25 bp, Mus musculus
cttgtgccgtctataagattgggta

SEQ ID NO: 398698 - DNA, 25 bp, Mus musculus
cttgtgccgtctttaagattgggta

SEQ ID NO: 398699 - DNA, 25 bp, Mus musculus
cttgtgcgcatgctcggtagctgca

SEQ ID NO: 398700 - DNA, 25 bp, Mus musculus
cttgtgcgcatggtcggtagctgca

SEQ ID NO: 398701 - DNA, 25 bp, Mus musculus
cttgtgctaaacaacatctgtgtgt

SEQ ID NO: 398702 - DNA, 25 bp, Mus musculus
cttgtgctaaactacatctgtgtgt

SEQ ID NO: 398703 - DNA, 25 bp, Mus musculus
cttgtgctagacaattgactgccgt

SEQ ID NO: 398704 - DNA, 25 bp, Mus musculus
cttgtgctagactattgactgccgt

SEQ ID NO: 398705 - DNA, 25 bp, Mus musculus
cttgtgctcaaaagggtttcttgtt

SEQ ID NO: 398706 - DNA, 25 bp, Mus musculus
cttgtgctcaaatgggtttcttgtt

SEQ ID NO: 398707 - DNA, 25 bp, Mus musculus
cttgtgcttcagaaagtacagttca

SEQ ID NO: 398708 - DNA, 25 bp, Mus musculus
cttgtgcttcagtaagtacagttca

SEQ ID NO: 398709 - DNA, 25 bp, Mus musculus
cttgtgcttgatcactgtgtgtgta

SEQ ID NO: 398710 - DNA, 25 bp, Mus musculus
cttgtgcttgatgactgtgtgtgta

SEQ ID NO: 398711 - DNA, 25 bp, Mus musculus
cttgtgcttggcatcaatgcggaga

SEQ ID NO: 398712 - DNA, 25 bp, Mus musculus
cttgtgcttggcttcaatgcggaga

SEQ ID NO: 398713 - DNA, 25 bp, Mus musculus
cttgtggaactacgcctggctttta

SEQ ID NO: 398714 - DNA, 25 bp, Mus musculus
cttgtggaactaggcctggctttta

SEQ ID NO: 398715 - DNA, 25 bp, Mus musculus
cttgtggaagctaccaggacctcta

SEQ ID NO: 398716 - DNA, 25 bp, Mus musculus
cttgtggaagcttccaggacctcta

SEQ ID NO: 398717 - DNA, 25 bp, Mus musculus
cttgtggacaaaaagcttttggcat

SEQ ID NO: 398718 - DNA, 25 bp, Mus musculus
cttgtggacaaatagcttttggcat

SEQ ID NO: 398719 - DNA, 25 bp, Mus musculus
cttgtggacaacatcctcctgtggg

SEQ ID NO: 398720 - DNA, 25 bp, Mus musculus
cttgtggacaacttcctcctgtggg

SEQ ID NO: 398721 - DNA, 25 bp, Mus musculus
cttgtggaccttcggctagtctaga

SEQ ID NO: 398722 - DNA, 25 bp, Mus musculus
cttgtggaccttgggctagtctaga

SEQ ID NO: 398723 - DNA, 25 bp, Mus musculus
cttgtggaggacaagaaatgattgt

SEQ ID NO: 398724 - DNA, 25 bp, Mus musculus
cttgtggaggactagaaatgattgt

SEQ ID NO: 398725 - DNA, 25 bp, Mus musculus
cttgtggattttctagatggtttca

SEQ ID NO: 398726 - DNA, 25 bp, Mus musculus
cttgtggattttgtagatggtttca

SEQ ID NO: 398727 - DNA, 25 bp, Mus musculus
cttgtggcagctatgatatgcgcaa

SEQ ID NO: 398728 - DNA, 25 bp, Mus musculus
cttgtggcagctttgatatgcgcaa

SEQ ID NO: 398729 - DNA, 25 bp, Mus musculus
cttgtggccaagagtagctcgtgta

SEQ ID NO: 398730 - DNA, 25 bp, Mus musculus
cttgtggccaagtgtagctcgtgta

SEQ ID NO: 398731 - DNA, 25 bp, Mus musculus
cttgtggccctgcaaaatactgtaa

SEQ ID NO: 398732 - DNA, 25 bp, Mus musculus
cttgtggccctggaaaatactgtaa

SEQ ID NO: 398733 - DNA, 25 bp, Mus musculus
cttgtggcgtaaccatttcatctgg

SEQ ID NO: 398734 - DNA, 25 bp, Mus musculus
cttgtggcgtaagcatttcatctgg

SEQ ID NO: 398735 - DNA, 25 bp, Mus musculus
cttgtggcgtgtcaactatgatgga

SEQ ID NO: 398736 - DNA, 25 bp, Mus musculus
cttgtggcgtgtgaactatgatgga

SEQ ID NO: 398737 - DNA, 25 bp, Mus musculus
cttgtggctcccaatactttttata

SEQ ID NO: 398738 - DNA, 25 bp, Mus musculus
cttgtggctccctatactttttata

SEQ ID NO: 398739 - DNA, 25 bp, Mus musculus
cttgtgggaatgaacatccctggtc

SEQ ID NO: 398740 - DNA, 25 bp, Mus musculus
cttgtgggaatgtacatccctggtc

SEQ ID NO: 398741 - DNA, 25 bp, Mus musculus
cttgtgggccatcaataagctttgt

SEQ ID NO: 398742 - DNA, 25 bp, Mus musculus
cttgtgggccatgaataagctttgt

SEQ ID NO: 398743 - DNA, 25 bp, Mus musculus
cttgtgggtagtccatagttgcctg

SEQ ID NO: 398744 - DNA, 25 bp, Mus musculus
cttgtgggtagtgcatagttgcctg

SEQ ID NO: 398745 - DNA, 25 bp, Mus musculus
cttgtggtaaggctgtcttttagaa

SEQ ID NO: 398746 - DNA, 25 bp, Mus musculus
cttgtggtaagggtgtcttttagaa

SEQ ID NO: 398747 - DNA, 25 bp, Mus musculus
cttgtggtccctatatttcttgtcg

SEQ ID NO: 398748 - DNA, 25 bp, Mus musculus
cttgtggtccctttatttcttgtcg

SEQ ID NO: 398749 - DNA, 25 bp, Mus musculus
cttgtggtcctgaaaaattccgcta

SEQ ID NO: 398750 - DNA, 25 bp, Mus musculus
cttgtggtcctgtaaaattccgcta

SEQ ID NO: 398751 - DNA, 25 bp, Mus musculus
cttgtggtggtaaggcttcttgaga

SEQ ID NO: 398752 - DNA, 25 bp, Mus musculus
cttgtggtggtatggcttcttgaga

SEQ ID NO: 398753 - DNA, 25 bp, Mus musculus
cttgtggtgtgaacagcagagctgc

SEQ ID NO: 398754 - DNA, 25 bp, Mus musculus
cttgtggtgtgatcagcagagctgc

SEQ ID NO: 398755 - DNA, 25 bp, Mus musculus
cttgtgtaactcactctgctggcac

SEQ ID NO: 398756 - DNA, 25 bp, Mus musculus
cttgtgtaactctctctgctggcac

SEQ ID NO: 398757 - DNA, 25 bp, Mus musculus
cttgtgtaagttatccagtcagtaa

SEQ ID NO: 398758 - DNA, 25 bp, Mus musculus
cttgtgtaagttttccagtcagtaa

SEQ ID NO: 398759 - DNA, 25 bp, Mus musculus
cttgtgtagcttatcgtgtcccgtt

SEQ ID NO: 398760 - DNA, 25 bp, Mus musculus
cttgtgtagcttttcgtgtcccgtt

SEQ ID NO: 398761 - DNA, 25 bp, Mus musculus
cttgtgtagggcaggtttctcaaca

SEQ ID NO: 398762 - DNA, 25 bp, Mus musculus
cttgtgtagggctggtttctcaaca

SEQ ID NO: 398763 - DNA, 25 bp, Mus musculus
cttgtgtcaccactagtgactgtga

SEQ ID NO: 398764 - DNA, 25 bp, Mus musculus
cttgtgtcaccagtagtgactgtga

SEQ ID NO: 398765 - DNA, 25 bp, Mus musculus
cttgtgtccagaatcccagatgggg

SEQ ID NO: 398766 - DNA, 25 bp, Mus musculus
cttgtgtccagattcccagatgggg

SEQ ID NO: 398767 - DNA, 25 bp, Mus musculus
cttgtgtgactaatagattagacta

SEQ ID NO: 398768 - DNA, 25 bp, Mus musculus
cttgtgtgactattagattagacta

SEQ ID NO: 398769 - DNA, 25 bp, Mus musculus
cttgtgtgcggtcttgtttgtgaat

SEQ ID NO: 398770 - DNA, 25 bp, Mus musculus
cttgtgtgcggtgttgtttgtgaat

SEQ ID NO: 398771 - DNA, 25 bp, Mus musculus
cttgtgtgctgtctgatctgggatc

SEQ ID NO: 398772 - DNA, 25 bp, Mus musculus
cttgtgtgctgtgtgatctgggatc

SEQ ID NO: 398773 - DNA, 25 bp, Mus musculus
cttgtgtgggccaggtaactatggt

SEQ ID NO: 398774 - DNA, 25 bp, Mus musculus
cttgtgtgggcctggtaactatggt

SEQ ID NO: 398775 - DNA, 25 bp, Mus musculus
cttgtgtgtatccaactccccagtg

SEQ ID NO: 398776 - DNA, 25 bp, Mus musculus
cttgtgtgtatcgaactccccagtg

SEQ ID NO: 398777 - DNA, 25 bp, Mus musculus
cttgtgtgtgtccttgtaatcttct

SEQ ID NO: 398778 - DNA, 25 bp, Mus musculus
cttgtgtgtgtcgttgtaatcttct

SEQ ID NO: 398779 - DNA, 25 bp, Mus musculus
cttgtgtgtgtgatgggccagaatc

SEQ ID NO: 398780 - DNA, 25 bp, Mus musculus
cttgtgtgtgtgttgggccagaatc

SEQ ID NO: 398781 - DNA, 25 bp, Mus musculus
cttgtgttaagtatcattgtgcaga

SEQ ID NO: 398782 - DNA, 25 bp, Mus musculus
cttgtgttaagtttcattgtgcaga

SEQ ID NO: 398783 - DNA, 25 bp, Mus musculus
cttgtgttaggtagtcctggcttgt

SEQ ID NO: 398784 - DNA, 25 bp, Mus musculus
cttgtgttaggttgtcctggcttgt

SEQ ID NO: 398785 - DNA, 25 bp, Mus musculus
cttgtgttcttgacgtgtgtgttcc

SEQ ID NO: 398786 - DNA, 25 bp, Mus musculus
cttgtgttcttgtcgtgtgtgttcc

SEQ ID NO: 398787 - DNA, 25 bp, Mus musculus
cttgtgttctttctgccaatacgca

SEQ ID NO: 398788 - DNA, 25 bp, Mus musculus
cttgtgttctttgtgccaatacgca

SEQ ID NO: 398789 - DNA, 25 bp, Mus musculus
cttgtgttgcagacactatagttct

SEQ ID NO: 398790 - DNA, 25 bp, Mus musculus
cttgtgttgcagtcactatagttct

SEQ ID NO: 398791 - DNA, 25 bp, Mus musculus
cttgtgttgtccctgatgccattat

SEQ ID NO: 398792 - DNA, 25 bp, Mus musculus
cttgtgttgtccgtgatgccattat

SEQ ID NO: 398793 - DNA, 25 bp, Mus musculus
cttgtgttgtggagagccccaaaca

SEQ ID NO: 398794 - DNA, 25 bp, Mus musculus
cttgtgttgtggtgagccccaaaca

SEQ ID NO: 398795 - DNA, 25 bp, Mus musculus
cttgtgtttactcggcagttggttc

SEQ ID NO: 398796 - DNA, 25 bp, Mus musculus
cttgtgtttactgggcagttggttc

SEQ ID NO: 398797 - DNA, 25 bp, Mus musculus
cttgtgtttgttaggatgctcagac

SEQ ID NO: 398798 - DNA, 25 bp, Mus musculus
cttgtgtttgtttggatgctcagac

SEQ ID NO: 398799 - DNA, 25 bp, Mus musculus
cttgttaacagactccattgccaga

SEQ ID NO: 398800 - DNA, 25 bp, Mus musculus
cttgttaacagagtccattgccaga

SEQ ID NO: 398801 - DNA, 25 bp, Mus musculus
cttgttaagagaaatgcttgacaga

SEQ ID NO: 398802 - DNA, 25 bp, Mus musculus
cttgttaagagatatgcttgacaga

SEQ ID NO: 398803 - DNA, 25 bp, Mus musculus
cttgttaatcttaatgcaccagcat

SEQ ID NO: 398804 - DNA, 25 bp, Mus musculus
cttgttaatctttatgcaccagcat

SEQ ID NO: 398805 - DNA, 25 bp, Mus musculus
cttgttaatgtcctgcagagccgaa

SEQ ID NO: 398806 - DNA, 25 bp, Mus musculus
cttgttaatgtcgtgcagagccgaa

SEQ ID NO: 398807 - DNA, 25 bp, Mus musculus
cttgttacagacaggtgccctggga

SEQ ID NO: 398808 - DNA, 25 bp, Mus musculus
cttgttacagactggtgccctggga

SEQ ID NO: 398809 - DNA, 25 bp, Mus musculus
cttgttacagcccatatatgcaata

SEQ ID NO: 398810 - DNA, 25 bp, Mus musculus
cttgttacagccgatatatgcaata

SEQ ID NO: 398811 - DNA, 25 bp, Mus musculus
cttgttacgtggctcctcaaggcct

SEQ ID NO: 398812 - DNA, 25 bp, Mus musculus
cttgttacgtgggtcctcaaggcct

SEQ ID NO: 398813 - DNA, 25 bp, Mus musculus
cttgttactcacagtggttcatcaa

SEQ ID NO: 398814 - DNA, 25 bp, Mus musculus
cttgttactcactgtggttcatcaa

SEQ ID NO: 398815 - DNA, 25 bp, Mus musculus
cttgttactttccacttctcaataa

SEQ ID NO: 398816 - DNA, 25 bp, Mus musculus
cttgttactttcgacttctcaataa

SEQ ID NO: 398817 - DNA, 25 bp, Mus musculus
cttgttagaatgaagcagagtgcta

SEQ ID NO: 398818 - DNA, 25 bp, Mus musculus
cttgttagaatgtagcagagtgcta

SEQ ID NO: 398819 - DNA, 25 bp, Mus musculus
cttgttaggaacacgcatatccctt

SEQ ID NO: 398820 - DNA, 25 bp, Mus musculus
cttgttaggaactcgcatatccctt

SEQ ID NO: 398821 - DNA, 25 bp, Mus musculus
cttgttaggccaaacttggtggata

SEQ ID NO: 398822 - DNA, 25 bp, Mus musculus
cttgttaggccatacttggtggata

SEQ ID NO: 398823 - DNA, 25 bp, Mus musculus
cttgttatccaactagccaggcttg

SEQ ID NO: 398824 - DNA, 25 bp, Mus musculus
cttgttatccaagtagccaggcttg

SEQ ID NO: 398825 - DNA, 25 bp, Mus musculus
cttgttatctaaaggcatagtggcc

SEQ ID NO: 398826 - DNA, 25 bp, Mus musculus
cttgttatctaatggcatagtggcc

SEQ ID NO: 398827 - DNA, 25 bp, Mus musculus
cttgttatggttatttctctgagaa

SEQ ID NO: 398828 - DNA, 25 bp, Mus musculus
cttgttatggttttttctctgagaa

SEQ ID NO: 398829 - DNA, 25 bp, Mus musculus
cttgttatgtttcttggctgttgtt

SEQ ID NO: 398830 - DNA, 25 bp, Mus musculus
cttgttatgtttgttggctgttgtt

SEQ ID NO: 398831 - DNA, 25 bp, Mus musculus
cttgttattataatcggtgctaggg

SEQ ID NO: 398832 - DNA, 25 bp, Mus musculus
cttgttattatattcggtgctaggg

SEQ ID NO: 398833 - DNA, 25 bp, Mus musculus
cttgttattgagatagtccagtgat

SEQ ID NO: 398834 - DNA, 25 bp, Mus musculus
cttgttattgagttagtccagtgat

SEQ ID NO: 398835 - DNA, 25 bp, Mus musculus
cttgttcaacacatttctcgtattg

SEQ ID NO: 398836 - DNA, 25 bp, Mus musculus
cttgttcaacacttttctcgtattg

SEQ ID NO: 398837 - DNA, 25 bp, Mus musculus
cttgttcaacatagggctggctgtt

SEQ ID NO: 398838 - DNA, 25 bp, Mus musculus
cttgttcaacattgggctggctgtt

SEQ ID NO: 398839 - DNA, 25 bp, Mus musculus
cttgttcagtatcgcctggccccag

SEQ ID NO: 398840 - DNA, 25 bp, Mus musculus
cttgttcagtatggcctggccccag

SEQ ID NO: 398841 - DNA, 25 bp, Mus musculus
cttgttcatattctggtcctggatc

SEQ ID NO: 398842 - DNA, 25 bp, Mus musculus
cttgttcatattgtggtcctggatc

SEQ ID NO: 398843 - DNA, 25 bp, Mus musculus
cttgttcatgccctctgtctattac

SEQ ID NO: 398844 - DNA, 25 bp, Mus musculus
cttgttcatgccgtctgtctattac

SEQ ID NO: 398845 - DNA, 25 bp, Mus musculus
cttgttcatgtaagatttcaataaa

SEQ ID NO: 398846 - DNA, 25 bp, Mus musculus
cttgttcatgtatgatttcaataaa

SEQ ID NO: 398847 - DNA, 25 bp, Mus musculus
cttgttccaagtcaaggcggcatca

SEQ ID NO: 398848 - DNA, 25 bp, Mus musculus
cttgttccaagtgaaggcggcatca

SEQ ID NO: 398849 - DNA, 25 bp, Mus musculus
cttgttcccacaatgttaacatgga

SEQ ID NO: 398850 - DNA, 25 bp, Mus musculus
cttgttcccacattgttaacatgga

SEQ ID NO: 398851 - DNA, 25 bp, Mus musculus
cttgttcgaaagctgcaggtttgtt

SEQ ID NO: 398852 - DNA, 25 bp, Mus musculus
cttgttcgaaaggtgcaggtttgtt

SEQ ID NO: 398853 - DNA, 25 bp, Mus musculus
cttgttctaaatatcaagtcctact

SEQ ID NO: 398854 - DNA, 25 bp, Mus musculus
cttgttctaaatttcaagtcctact

SEQ ID NO: 398855 - DNA, 25 bp, Mus musculus
cttgttctaatgcattgggttctga

SEQ ID NO: 398856 - DNA, 25 bp, Mus musculus
cttgttctaatggattgggttctga

SEQ ID NO: 398857 - DNA, 25 bp, Mus musculus
cttgttctacagctttgattctaat

SEQ ID NO: 398858 - DNA, 25 bp, Mus musculus
cttgttctacaggtttgattctaat

SEQ ID NO: 398859 - DNA, 25 bp, Mus musculus
cttgttctaggcacaggagtaggat

SEQ ID NO: 398860 - DNA, 25 bp, Mus musculus
cttgttctaggctcaggagtaggat

SEQ ID NO: 398861 - DNA, 25 bp, Mus musculus
cttgttctatgtcagtcggactttc

SEQ ID NO: 398862 - DNA, 25 bp, Mus musculus
cttgttctatgtgagtcggactttc

SEQ ID NO: 398863 - DNA, 25 bp, Mus musculus
cttgttctccgtcgcttagttagaa

SEQ ID NO: 398864 - DNA, 25 bp, Mus musculus
cttgttctccgtggcttagttagaa

SEQ ID NO: 398865 - DNA, 25 bp, Mus musculus
cttgttcttacaaatcgggattttg

SEQ ID NO: 398866 - DNA, 25 bp, Mus musculus
cttgttcttacatatcgggattttg

SEQ ID NO: 398867 - DNA, 25 bp, Mus musculus
cttgttcttaggctgactagctagc

SEQ ID NO: 398868 - DNA, 25 bp, Mus musculus
cttgttcttagggtgactagctagc

SEQ ID NO: 398869 - DNA, 25 bp, Mus musculus
cttgttcttattactcagagagatc

SEQ ID NO: 398870 - DNA, 25 bp, Mus musculus
cttgttcttatttctcagagagatc

SEQ ID NO: 398871 - DNA, 25 bp, Mus musculus
cttgttcttcacacaggctttttta

SEQ ID NO: 398872 - DNA, 25 bp, Mus musculus
cttgttcttcactcaggctttttta

SEQ ID NO: 398873 - DNA, 25 bp, Mus musculus
cttgttcttcagaacagccttcaaa

SEQ ID NO: 398874 - DNA, 25 bp, Mus musculus
cttgttcttcagtacagccttcaaa

SEQ ID NO: 398875 - DNA, 25 bp, Mus musculus
cttgttcttccacgtctttacatgg

SEQ ID NO: 398876 - DNA, 25 bp, Mus musculus
cttgttcttccaggtctttacatgg

SEQ ID NO: 398877 - DNA, 25 bp, Mus musculus
cttgttctttccctggcttatagaa

SEQ ID NO: 398878 - DNA, 25 bp, Mus musculus
cttgttctttccgtggcttatagaa

SEQ ID NO: 398879 - DNA, 25 bp, Mus musculus
cttgttctttgcctggattttggcc

SEQ ID NO: 398880 - DNA, 25 bp, Mus musculus
cttgttctttgcgtggattttggcc

SEQ ID NO: 398881 - DNA, 25 bp, Mus musculus
cttgttctttggataatgtggtgcc

SEQ ID NO: 398882 - DNA, 25 bp, Mus musculus
cttgttctttggttaatgtggtgcc

SEQ ID NO: 398883 - DNA, 25 bp, Mus musculus
cttgttctttgtatgggactgatga

SEQ ID NO: 398884 - DNA, 25 bp, Mus musculus
cttgttctttgtttgggactgatga

SEQ ID NO: 398885 - DNA, 25 bp, Mus musculus
cttgttctttttcctggttcagaga

SEQ ID NO: 398886 - DNA, 25 bp, Mus musculus
cttgttctttttgctggttcagaga

SEQ ID NO: 398887 - DNA, 25 bp, Mus musculus
cttgttgagacaagtttctggccct

SEQ ID NO: 398888 - DNA, 25 bp, Mus musculus
cttgttgagacatgtttctggccct

SEQ ID NO: 398889 - DNA, 25 bp, Mus musculus
cttgttgcaggcacagatccaggat

SEQ ID NO: 398890 - DNA, 25 bp, Mus musculus
cttgttgcaggctcagatccaggat

SEQ ID NO: 398891 - DNA, 25 bp, Mus musculus
cttgttgccattcccctagatgctg

SEQ ID NO: 398892 - DNA, 25 bp, Mus musculus
cttgttgccattgccctagatgctg

SEQ ID NO: 398893 - DNA, 25 bp, Mus musculus
cttgttgccttgagctcttttgtaa

SEQ ID NO: 398894 - DNA, 25 bp, Mus musculus
cttgttgccttgtgctcttttgtaa

SEQ ID NO: 398895 - DNA, 25 bp, Mus musculus
cttgttgctgaaagcgcgggcgcat

SEQ ID NO: 398896 - DNA, 25 bp, Mus musculus
cttgttgctgaatgcgcgggcgcat

SEQ ID NO: 398897 - DNA, 25 bp, Mus musculus
cttgttgctgatagttgcggttgct

SEQ ID NO: 398898 - DNA, 25 bp, Mus musculus
cttgttgctgattgttgcggttgct

SEQ ID NO: 398899 - DNA, 25 bp, Mus musculus
cttgttgctttcactctcagataaa

SEQ ID NO: 398900 - DNA, 25 bp, Mus musculus
cttgttgctttctctctcagataaa

SEQ ID NO: 398901 - DNA, 25 bp, Mus musculus
cttgttgctttgatcataatgtggt

SEQ ID NO: 398902 - DNA, 25 bp, Mus musculus
cttgttgctttgttcataatgtggt

SEQ ID NO: 398903 - DNA, 25 bp, Mus musculus
cttgttggccaacagcactactata

SEQ ID NO: 398904 - DNA, 25 bp, Mus musculus
cttgttggccaagagcactactata

SEQ ID NO: 398905 - DNA, 25 bp, Mus musculus
cttgttggctggctggcattccctc

SEQ ID NO: 398906 - DNA, 25 bp, Mus musculus
cttgttggctgggtggcattccctc

SEQ ID NO: 398907 - DNA, 25 bp, Mus musculus
cttgttggtggaaacgagccccgag

SEQ ID NO: 398908 - DNA, 25 bp, Mus musculus
cttgttggtggatacgagccccgag

SEQ ID NO: 398909 - DNA, 25 bp, Mus musculus
cttgttggttctccactgatgtggt

SEQ ID NO: 398910 - DNA, 25 bp, Mus musculus
cttgttggttctgcactgatgtggt

SEQ ID NO: 398911 - DNA, 25 bp, Mus musculus
cttgttgtaaatccagttgtctaat

SEQ ID NO: 398912 - DNA, 25 bp, Mus musculus
cttgttgtaaatgcagttgtctaat

SEQ ID NO: 398913 - DNA, 25 bp, Mus musculus
cttgttgtcatactatagcttccct

SEQ ID NO: 398914 - DNA, 25 bp, Mus musculus
cttgttgtcatagtatagcttccct

SEQ ID NO: 398915 - DNA, 25 bp, Mus musculus
cttgttgtcattagctaggcccaga

SEQ ID NO: 398916 - DNA, 25 bp, Mus musculus
cttgttgtcatttgctaggcccaga

SEQ ID NO: 398917 - DNA, 25 bp, Mus musculus
cttgttgtcctacatgtcccatatt

SEQ ID NO: 398918 - DNA, 25 bp, Mus musculus
cttgttgtcctagatgtcccatatt

SEQ ID NO: 398919 - DNA, 25 bp, Mus musculus
cttgttgtgagtcctttgtgctctt

SEQ ID NO: 398920 - DNA, 25 bp, Mus musculus
cttgttgtgagtgctttgtgctctt

SEQ ID NO: 398921 - DNA, 25 bp, Mus musculus
cttgttgtgcagaaagaggcccact

SEQ ID NO: 398922 - DNA, 25 bp, Mus musculus
cttgttgtgcagtaagaggcccact

SEQ ID NO: 398923 - DNA, 25 bp, Mus musculus
cttgtttacacaccgcagaattcgt

SEQ ID NO: 398924 - DNA, 25 bp, Mus musculus
cttgtttacacagcgcagaattcgt

SEQ ID NO: 398925 - DNA, 25 bp, Mus musculus
cttgtttagtggaggcggagcccat

SEQ ID NO: 398926 - DNA, 25 bp, Mus musculus
cttgtttagtggtggcggagcccat

SEQ ID NO: 398927 - DNA, 25 bp, Mus musculus
cttgtttatatcaggctggagagct

SEQ ID NO: 398928 - DNA, 25 bp, Mus musculus
cttgtttatatctggctggagagct

SEQ ID NO: 398929 - DNA, 25 bp, Mus musculus
cttgtttatcccagttgttatcaat

SEQ ID NO: 398930 - DNA, 25 bp, Mus musculus
cttgtttatccctgttgttatcaat

SEQ ID NO: 398931 - DNA, 25 bp, Mus musculus
cttgtttcactgagtggaggaggct

SEQ ID NO: 398932 - DNA, 25 bp, Mus musculus
cttgtttcactgtgtggaggaggct

SEQ ID NO: 398933 - DNA, 25 bp, Mus musculus
cttgtttccaagaatgtagaatctc

SEQ ID NO: 398934 - DNA, 25 bp, Mus musculus
cttgtttccaagtatgtagaatctc

SEQ ID NO: 398935 - DNA, 25 bp, Mus musculus
cttgtttccctgagacattcatgtt

SEQ ID NO: 398936 - DNA, 25 bp, Mus musculus
cttgtttccctgtgacattcatgtt

SEQ ID NO: 398937 - DNA, 25 bp, Mus musculus
cttgtttcctacagagcttcgggaa

SEQ ID NO: 398938 - DNA, 25 bp, Mus musculus
cttgtttcctactgagcttcgggaa

SEQ ID NO: 398939 - DNA, 25 bp, Mus musculus
cttgtttcctgtaatttctatcagt

SEQ ID NO: 398940 - DNA, 25 bp, Mus musculus
cttgtttcctgttatttctatcagt

SEQ ID NO: 398941 - DNA, 25 bp, Mus musculus
cttgtttccttgatacctggtttat

SEQ ID NO: 398942 - DNA, 25 bp, Mus musculus
cttgtttccttgttacctggtttat

SEQ ID NO: 398943 - DNA, 25 bp, Mus musculus
cttgtttctaacctcatctgatctt

SEQ ID NO: 398944 - DNA, 25 bp, Mus musculus
cttgtttctaacgtcatctgatctt

SEQ ID NO: 398945 - DNA, 25 bp, Mus musculus
cttgtttctaggatattgccctgta

SEQ ID NO: 398946 - DNA, 25 bp, Mus musculus
cttgtttctaggttattgccctgta

SEQ ID NO: 398947 - DNA, 25 bp, Mus musculus
cttgtttctgtccaatgtcatacat

SEQ ID NO: 398948 - DNA, 25 bp, Mus musculus
cttgtttctgtcgaatgtcatacat

SEQ ID NO: 398949 - DNA, 25 bp, Mus musculus
cttgtttcttgcatgtaaatggctt

SEQ ID NO: 398950 - DNA, 25 bp, Mus musculus
cttgtttcttgcttgtaaatggctt

SEQ ID NO: 398951 - DNA, 25 bp, Mus musculus
cttgtttgcctgcttgtatctgaca

SEQ ID NO: 398952 - DNA, 25 bp, Mus musculus
cttgtttgcctggttgtatctgaca

SEQ ID NO: 398953 - DNA, 25 bp, Mus musculus
cttgtttgctaccatgtctttctaa

SEQ ID NO: 398954 - DNA, 25 bp, Mus musculus
cttgtttgctacgatgtctttctaa

SEQ ID NO: 398955 - DNA, 25 bp, Mus musculus
cttgtttgctagattttcgtcagga

SEQ ID NO: 398956 - DNA, 25 bp, Mus musculus
cttgtttgctagtttttcgtcagga

SEQ ID NO: 398957 - DNA, 25 bp, Mus musculus
cttgtttggcctctgctagcaaaaa

SEQ ID NO: 398958 - DNA, 25 bp, Mus musculus
cttgtttggcctgtgctagcaaaaa

SEQ ID NO: 398959 - DNA, 25 bp, Mus musculus
cttgtttgggacagggccactcaaa

SEQ ID NO: 398960 - DNA, 25 bp, Mus musculus
cttgtttgggactgggccactcaaa

SEQ ID NO: 398961 - DNA, 25 bp, Mus musculus
cttgtttgtaccagccttgtttcag

SEQ ID NO: 398962 - DNA, 25 bp, Mus musculus
cttgtttgtacctgccttgtttcag

SEQ ID NO: 398963 - DNA, 25 bp, Mus musculus
cttgtttgtactcggagctctggac

SEQ ID NO: 398964 - DNA, 25 bp, Mus musculus
cttgtttgtactgggagctctggac

SEQ ID NO: 398965 - DNA, 25 bp, Mus musculus
cttgtttgttcaattccacatctgc

SEQ ID NO: 398966 - DNA, 25 bp, Mus musculus
cttgtttgttcatttccacatctgc

SEQ ID NO: 398967 - DNA, 25 bp, Mus musculus
cttgttttaattactttctcatctt

SEQ ID NO: 398968 - DNA, 25 bp, Mus musculus
cttgttttaatttctttctcatctt

SEQ ID NO: 398969 - DNA, 25 bp, Mus musculus
cttgttttagggaagccgttcacat

SEQ ID NO: 398970 - DNA, 25 bp, Mus musculus
cttgttttagggtagccgttcacat

SEQ ID NO: 398971 - DNA, 25 bp, Mus musculus
cttgttttatctagcgctcttaaaa

SEQ ID NO: 398972 - DNA, 25 bp, Mus musculus
cttgttttatcttgcgctcttaaaa

SEQ ID NO: 398973 - DNA, 25 bp, Mus musculus
cttgttttcatgcaatggctagtca

SEQ ID NO: 398974 - DNA, 25 bp, Mus musculus
cttgttttcatggaatggctagtca

SEQ ID NO: 398975 - DNA, 25 bp, Mus musculus
cttgttttccctaatgtgcatttta

SEQ ID NO: 398976 - DNA, 25 bp, Mus musculus
cttgttttccctctaaccatgtaga

SEQ ID NO: 398977 - DNA, 25 bp, Mus musculus
cttgttttccctgtaaccatgtaga

SEQ ID NO: 398978 - DNA, 25 bp, Mus musculus
cttgttttcccttatgtgcatttta

SEQ ID NO: 398979 - DNA, 25 bp, Mus musculus
cttgttttcctcacttctaaactga

SEQ ID NO: 398980 - DNA, 25 bp, Mus musculus
cttgttttcctctcttctaaactga

SEQ ID NO: 398981 - DNA, 25 bp, Mus musculus
cttgttttccttatgatgcttgaaa

SEQ ID NO: 398982 - DNA, 25 bp, Mus musculus
cttgttttccttttgatgcttgaaa

SEQ ID NO: 398983 - DNA, 25 bp, Mus musculus
cttgttttgacaatattgacgctga

SEQ ID NO: 398984 - DNA, 25 bp, Mus musculus
cttgttttgacattattgacgctga

SEQ ID NO: 398985 - DNA, 25 bp, Mus musculus
cttgttttgctcaaagtgctaggta

SEQ ID NO: 398986 - DNA, 25 bp, Mus musculus
cttgttttgctctaagtgctaggta

SEQ ID NO: 398987 - DNA, 25 bp, Mus musculus
cttgttttgggtagcttgcgtgatt

SEQ ID NO: 398988 - DNA, 25 bp, Mus musculus
cttgttttgggttgcttgcgtgatt

SEQ ID NO: 398989 - DNA, 25 bp, Mus musculus
cttgttttgtccctcatctagggag

SEQ ID NO: 398990 - DNA, 25 bp, Mus musculus
cttgttttgtccgtcatctagggag

SEQ ID NO: 398991 - DNA, 25 bp, Mus musculus
cttgtttttcagcattcgatcaggc

SEQ ID NO: 398992 - DNA, 25 bp, Mus musculus
cttgtttttcaggattcgatcaggc

SEQ ID NO: 398993 - DNA, 25 bp, Mus musculus
cttgtttttcatcgcactacaaggg

SEQ ID NO: 398994 - DNA, 25 bp, Mus musculus
cttgtttttcatggcactacaaggg

SEQ ID NO: 398995 - DNA, 25 bp, Mus musculus
cttgtttttctgatggcaaatggga

SEQ ID NO: 398996 - DNA, 25 bp, Mus musculus
cttgtttttctgttggcaaatggga

SEQ ID NO: 398997 - DNA, 25 bp, Mus musculus
ctttaaaacccacatgcacttactg

SEQ ID NO: 398998 - DNA, 25 bp, Mus musculus
ctttaaaacccagatgcacttactg

SEQ ID NO: 398999 - DNA, 25 bp, Mus musculus
ctttaaaagtctctggccatcatct

SEQ ID NO: 399000 - DNA, 25 bp, Mus musculus
ctttaaaagtctgtggccatcatct

SEQ ID NO: 399001 - DNA, 25 bp, Mus musculus
ctttaaaccacactaggagccattt

SEQ ID NO: 399002 - DNA, 25 bp, Mus musculus
ctttaaaccacagtaggagccattt

SEQ ID NO: 399003 - DNA, 25 bp, Mus musculus
ctttaaagatgtccccaaggctagg

SEQ ID NO: 399004 - DNA, 25 bp, Mus musculus
ctttaaagatgtgcccaaggctagg

SEQ ID NO: 399005 - DNA, 25 bp, Mus musculus
ctttaaaggagccattgacagcctc

SEQ ID NO: 399006 - DNA, 25 bp, Mus musculus
ctttaaaggagcgattgacagcctc

SEQ ID NO: 399007 - DNA, 25 bp, Mus musculus
ctttaaagggccagatccagcttgg

SEQ ID NO: 399008 - DNA, 25 bp, Mus musculus
ctttaaagggcctgatccagcttgg

SEQ ID NO: 399009 - DNA, 25 bp, Mus musculus
ctttaaatctctcggaagcagtgat

SEQ ID NO: 399010 - DNA, 25 bp, Mus musculus
ctttaaatctctgggaagcagtgat

SEQ ID NO: 399011 - DNA, 25 bp, Mus musculus
ctttaaatgggaatgctgctgctgc

SEQ ID NO: 399012 - DNA, 25 bp, Mus musculus
ctttaaatgggattgctgctgctgc

SEQ ID NO: 399013 - DNA, 25 bp, Mus musculus
ctttaaattattctacttctgtatg

SEQ ID NO: 399014 - DNA, 25 bp, Mus musculus
ctttaaattattctcttgctctgta

SEQ ID NO: 399015 - DNA, 25 bp, Mus musculus
ctttaaattattgtacttctgtatg

SEQ ID NO: 399016 - DNA, 25 bp, Mus musculus
ctttaaattattgtcttgctctgta

SEQ ID NO: 399017 - DNA, 25 bp, Mus musculus
ctttaaattcctctctgccctgtga

SEQ ID NO: 399018 - DNA, 25 bp, Mus musculus
ctttaaattcctgtctgccctgtga

SEQ ID NO: 399019 - DNA, 25 bp, Mus musculus
ctttaacaacatctcttccactggg

SEQ ID NO: 399020 - DNA, 25 bp, Mus musculus
ctttaacaacatgtcttccactggg

SEQ ID NO: 399021 - DNA, 25 bp, Mus musculus
ctttaacacgttcgctgagggagtc

SEQ ID NO: 399022 - DNA, 25 bp, Mus musculus
ctttaacacgttggctgagggagtc

SEQ ID NO: 399023 - DNA, 25 bp, Mus musculus
ctttaaccaactagcaatgctgttc

SEQ ID NO: 399024 - DNA, 25 bp, Mus musculus
ctttaaccaacttgcaatgctgttc

SEQ ID NO: 399025 - DNA, 25 bp, Mus musculus
ctttaaccttccacatactgacatt

SEQ ID NO: 399026 - DNA, 25 bp, Mus musculus
ctttaaccttcctcatactgacatt

SEQ ID NO: 399027 - DNA, 25 bp, Mus musculus
ctttaaccttggctcaatcgtttga

SEQ ID NO: 399028 - DNA, 25 bp, Mus musculus
ctttaaccttgggtcaatcgtttga

SEQ ID NO: 399029 - DNA, 25 bp, Mus musculus
ctttaacgcttcagaaacctctggg

SEQ ID NO: 399030 - DNA, 25 bp, Mus musculus
ctttaacgcttctgaaacctctggg

SEQ ID NO: 399031 - DNA, 25 bp, Mus musculus
ctttaactggcacggacgcccaggg

SEQ ID NO: 399032 - DNA, 25 bp, Mus musculus
ctttaactggcagggacgcccaggg

SEQ ID NO: 399033 - DNA, 25 bp, Mus musculus
ctttaactgtatctcttgagtattt

SEQ ID NO: 399034 - DNA, 25 bp, Mus musculus
ctttaactgtatgtcttgagtattt

SEQ ID NO: 399035 - DNA, 25 bp, Mus musculus
ctttaagagtctataattattccaa

SEQ ID NO: 399036 - DNA, 25 bp, Mus musculus
ctttaagagtctttaattattccaa

SEQ ID NO: 399037 - DNA, 25 bp, Mus musculus
ctttaagagtgtcacatagctgagt

SEQ ID NO: 399038 - DNA, 25 bp, Mus musculus
ctttaagagtgtgacatagctgagt

SEQ ID NO: 399039 - DNA, 25 bp, Mus musculus
ctttaagccaagctaggatagcaaa

SEQ ID NO: 399040 - DNA, 25 bp, Mus musculus
ctttaagccaaggtaggatagcaaa

SEQ ID NO: 399041 - DNA, 25 bp, Mus musculus
ctttaaggacttcatgcagccgcca

SEQ ID NO: 399042 - DNA, 25 bp, Mus musculus
ctttaaggacttgatgcagccgcca

SEQ ID NO: 399043 - DNA, 25 bp, Mus musculus
ctttaaggagctcggccgcatgtgc

SEQ ID NO: 399044 - DNA, 25 bp, Mus musculus
ctttaaggagctgggccgcatgtgc

SEQ ID NO: 399045 - DNA, 25 bp, Mus musculus
ctttaaggcctaatctgggccacag

SEQ ID NO: 399046 - DNA, 25 bp, Mus musculus
ctttaaggcctattctgggccacag

SEQ ID NO: 399047 - DNA, 25 bp, Mus musculus
ctttaagggaggagcttgcaggcac

SEQ ID NO: 399048 - DNA, 25 bp, Mus musculus
ctttaagggaggtgcttgcaggcac

SEQ ID NO: 399049 - DNA, 25 bp, Mus musculus
ctttaagggcgcagtctcaatgact

SEQ ID NO: 399050 - DNA, 25 bp, Mus musculus
ctttaagggcgctgtctcaatgact

SEQ ID NO: 399051 - DNA, 25 bp, Mus musculus
ctttaaggtcatctgctgcagtgcc

SEQ ID NO: 399052 - DNA, 25 bp, Mus musculus
ctttaaggtcatgtgctgcagtgcc

SEQ ID NO: 399053 - DNA, 25 bp, Mus musculus
ctttaagtcagaattctctcagaga

SEQ ID NO: 399054 - DNA, 25 bp, Mus musculus
ctttaagtcagatttctctcagaga

SEQ ID NO: 399055 - DNA, 25 bp, Mus musculus
ctttaagtcatgattgtgctgctgg

SEQ ID NO: 399056 - DNA, 25 bp, Mus musculus
ctttaagtcatgtttgtgctgctgg

SEQ ID NO: 399057 - DNA, 25 bp, Mus musculus
ctttaagtccctcggcagtactgca

SEQ ID NO: 399058 - DNA, 25 bp, Mus musculus
ctttaagtccctgggcagtactgca

SEQ ID NO: 399059 - DNA, 25 bp, Mus musculus
ctttaataagacctctttgttcctg

SEQ ID NO: 399060 - DNA, 25 bp, Mus musculus
ctttaataagacgtctttgttcctg

SEQ ID NO: 399061 - DNA, 25 bp, Mus musculus
ctttaataaggcagtgcctcctgat

SEQ ID NO: 399062 - DNA, 25 bp, Mus musculus
ctttaataaggctgtgcctcctgat

SEQ ID NO: 399063 - DNA, 25 bp, Mus musculus
ctttaatacaatcctcaaaatatct

SEQ ID NO: 399064 - DNA, 25 bp, Mus musculus
ctttaatacaatgctcaaaatatct

SEQ ID NO: 399065 - DNA, 25 bp, Mus musculus
ctttaatactatcagagcttctctt

SEQ ID NO: 399066 - DNA, 25 bp, Mus musculus
ctttaatactatgagagcttctctt

SEQ ID NO: 399067 - DNA, 25 bp, Mus musculus
ctttaatacttcaccagcagccacg

SEQ ID NO: 399068 - DNA, 25 bp, Mus musculus
ctttaatacttctccagcagccacg

SEQ ID NO: 399069 - DNA, 25 bp, Mus musculus
ctttaatccattctctcttttctat

SEQ ID NO: 399070 - DNA, 25 bp, Mus musculus
ctttaatccattgtctcttttctat

SEQ ID NO: 399071 - DNA, 25 bp, Mus musculus
ctttaatcctaccacagaaatcttg

SEQ ID NO: 399072 - DNA, 25 bp, Mus musculus
ctttaatcctacgacagaaatcttg

SEQ ID NO: 399073 - DNA, 25 bp, Mus musculus
ctttaatcctgtccttgaaatgaat

SEQ ID NO: 399074 - DNA, 25 bp, Mus musculus
ctttaatcctgtgcttgaaatgaat

SEQ ID NO: 399075 - DNA, 25 bp, Mus musculus
ctttaatgtgcacaccagtcagttt

SEQ ID NO: 399076 - DNA, 25 bp, Mus musculus
ctttaatgtgcagaccagtcagttt

SEQ ID NO: 399077 - DNA, 25 bp, Mus musculus
ctttaattatacatctagagctgct

SEQ ID NO: 399078 - DNA, 25 bp, Mus musculus
ctttaattatacttctagagctgct

SEQ ID NO: 399079 - DNA, 25 bp, Mus musculus
ctttaattcttgaaccatccataat

SEQ ID NO: 399080 - DNA, 25 bp, Mus musculus
ctttaattcttgtaccatccataat

SEQ ID NO: 399081 - DNA, 25 bp, Mus musculus
ctttaattgaagaactgcacttttt

SEQ ID NO: 399082 - DNA, 25 bp, Mus musculus
ctttaattgaagtactgcacttttt

SEQ ID NO: 399083 - DNA, 25 bp, Mus musculus
ctttaattttgcctttctctcagac

SEQ ID NO: 399084 - DNA, 25 bp, Mus musculus
ctttaattttgcgtttctctcagac

SEQ ID NO: 399085 - DNA, 25 bp, Mus musculus
ctttacaacgggagcaactcttaga

SEQ ID NO: 399086 - DNA, 25 bp, Mus musculus
ctttacaacgggtgcaactcttaga

SEQ ID NO: 399087 - DNA, 25 bp, Mus musculus
ctttacaagattagctgtggagctc

SEQ ID NO: 399088 - DNA, 25 bp, Mus musculus
ctttacaagatttgctgtggagctc

SEQ ID NO: 399089 - DNA, 25 bp, Mus musculus
ctttacacagagcatcgcaccgtga

SEQ ID NO: 399090 - DNA, 25 bp, Mus musculus
ctttacacagaggatcgcaccgtga

SEQ ID NO: 399091 - DNA, 25 bp, Mus musculus
ctttacacgcataggaatccttctg

SEQ ID NO: 399092 - DNA, 25 bp, Mus musculus
ctttacacgcattggaatccttctg

SEQ ID NO: 399093 - DNA, 25 bp, Mus musculus
ctttacactactacgggaatgccac

SEQ ID NO: 399094 - DNA, 25 bp, Mus musculus
ctttacactacttcgggaatgccac

SEQ ID NO: 399095 - DNA, 25 bp, Mus musculus
ctttacagaattccttcaaatgtct

SEQ ID NO: 399096 - DNA, 25 bp, Mus musculus
ctttacagaattgcttcaaatgtct

SEQ ID NO: 399097 - DNA, 25 bp, Mus musculus
ctttacagcataccccaagcaatga

SEQ ID NO: 399098 - DNA, 25 bp, Mus musculus
ctttacagcatagcccaagcaatga

SEQ ID NO: 399099 - DNA, 25 bp, Mus musculus
ctttacagctttaaaacctcaggtg

SEQ ID NO: 399100 - DNA, 25 bp, Mus musculus
ctttacagcttttaaacctcaggtg

SEQ ID NO: 399101 - DNA, 25 bp, Mus musculus
ctttacatacccagatcccttaatg

SEQ ID NO: 399102 - DNA, 25 bp, Mus musculus
ctttacataccctgatcccttaatg

SEQ ID NO: 399103 - DNA, 25 bp, Mus musculus
ctttacatcttcaattcttcttttt

SEQ ID NO: 399104 - DNA, 25 bp, Mus musculus
ctttacatcttctattcttcttttt

SEQ ID NO: 399105 - DNA, 25 bp, Mus musculus
ctttacatgtggccattaacagtgt

SEQ ID NO: 399106 - DNA, 25 bp, Mus musculus
ctttacatgtgggcattaacagtgt

SEQ ID NO: 399107 - DNA, 25 bp, Mus musculus
ctttacatgttaagcattgtctgat

SEQ ID NO: 399108 - DNA, 25 bp, Mus musculus
ctttacatgttatgcattgtctgat

SEQ ID NO: 399109 - DNA, 25 bp, Mus musculus
ctttacattaaaccagaccctgggt

SEQ ID NO: 399110 - DNA, 25 bp, Mus musculus
ctttacattaaagcagaccctgggt

SEQ ID NO: 399111 - DNA, 25 bp, Mus musculus
ctttacattccaaccatcctatgag

SEQ ID NO: 399112 - DNA, 25 bp, Mus musculus
ctttacattccatccatcctatgag

SEQ ID NO: 399113 - DNA, 25 bp, Mus musculus
ctttacattgctacctagtttacag

SEQ ID NO: 399114 - DNA, 25 bp, Mus musculus
ctttacattgcttcctagtttacag

SEQ ID NO: 399115 - DNA, 25 bp, Mus musculus
ctttaccacccaccacattttaaat

SEQ ID NO: 399116 - DNA, 25 bp, Mus musculus
ctttaccacccagcacattttaaat

SEQ ID NO: 399117 - DNA, 25 bp, Mus musculus
ctttaccagttcctctgaagcagcc

SEQ ID NO: 399118 - DNA, 25 bp, Mus musculus
ctttaccagttcgtctgaagcagcc

SEQ ID NO: 399119 - DNA, 25 bp, Mus musculus
ctttacccaatgatcaagccttaga

SEQ ID NO: 399120 - DNA, 25 bp, Mus musculus
ctttacccaatgttcaagccttaga

SEQ ID NO: 399121 - DNA, 25 bp, Mus musculus
ctttaccccatcactaaatcattgt

SEQ ID NO: 399122 - DNA, 25 bp, Mus musculus
ctttaccccatctctaaatcattgt

SEQ ID NO: 399123 - DNA, 25 bp, Mus musculus
ctttacccctgtagagtatcttgta

SEQ ID NO: 399124 - DNA, 25 bp, Mus musculus
ctttacccctgtagctatggtgaca

SEQ ID NO: 399125 - DNA, 25 bp, Mus musculus
ctttacccctgttgagtatcttgta

SEQ ID NO: 399126 - DNA, 25 bp, Mus musculus
ctttacccctgttgctatggtgaca

SEQ ID NO: 399127 - DNA, 25 bp, Mus musculus
ctttacctactgcttggctgtaaag

SEQ ID NO: 399128 - DNA, 25 bp, Mus musculus
ctttacctactggttggctgtaaag

SEQ ID NO: 399129 - DNA, 25 bp, Mus musculus
ctttacctagctaagtgttctgatg

SEQ ID NO: 399130 - DNA, 25 bp, Mus musculus
ctttacctagcttagtgttctgatg

SEQ ID NO: 399131 - DNA, 25 bp, Mus musculus
ctttacctatcaatcacaccacaat

SEQ ID NO: 399132 - DNA, 25 bp, Mus musculus
ctttacctatcattcacaccacaat

SEQ ID NO: 399133 - DNA, 25 bp, Mus musculus
ctttacctcaccatggacgaaattc

SEQ ID NO: 399134 - DNA, 25 bp, Mus musculus
ctttacctcaccttggacgaaattc

SEQ ID NO: 399135 - DNA, 25 bp, Mus musculus
ctttacctccctcatgctgaggtta

SEQ ID NO: 399136 - DNA, 25 bp, Mus musculus
ctttacctccctgatgctgaggtta

SEQ ID NO: 399137 - DNA, 25 bp, Mus musculus
ctttacctcggaacagcatcaaact

SEQ ID NO: 399138 - DNA, 25 bp, Mus musculus
ctttacctcggatcagcatcaaact

SEQ ID NO: 399139 - DNA, 25 bp, Mus musculus
ctttaccttaggactgggcggagat

SEQ ID NO: 399140 - DNA, 25 bp, Mus musculus
ctttaccttaggtctgggcggagat

SEQ ID NO: 399141 - DNA, 25 bp, Mus musculus
ctttaccttcaacaacgatgacatt

SEQ ID NO: 399142 - DNA, 25 bp, Mus musculus
ctttaccttcaagaacgatgacatt

SEQ ID NO: 399143 - DNA, 25 bp, Mus musculus
ctttaccttcatccgctctgagaaa

SEQ ID NO: 399144 - DNA, 25 bp, Mus musculus
ctttaccttcatgcgctctgagaaa

SEQ ID NO: 399145 - DNA, 25 bp, Mus musculus
ctttaccttcttccccttttgtctg

SEQ ID NO: 399146 - DNA, 25 bp, Mus musculus
ctttaccttcttgcccttttgtctg

SEQ ID NO: 399147 - DNA, 25 bp, Mus musculus
ctttaccttgtgatagaagtagcat

SEQ ID NO: 399148 - DNA, 25 bp, Mus musculus
ctttaccttgtgttagaagtagcat

SEQ ID NO: 399149 - DNA, 25 bp, Mus musculus
ctttacctttgcaaatatcatggca

SEQ ID NO: 399150 - DNA, 25 bp, Mus musculus
ctttacctttgctaatatcatggca

SEQ ID NO: 399151 - DNA, 25 bp, Mus musculus
ctttacgaggtaagcctggccttga

SEQ ID NO: 399152 - DNA, 25 bp, Mus musculus
ctttacgaggtatgcctggccttga

SEQ ID NO: 399153 - DNA, 25 bp, Mus musculus
ctttacgctcagacaagggaggcta

SEQ ID NO: 399154 - DNA, 25 bp, Mus musculus
ctttacgctcagtcaagggaggcta

SEQ ID NO: 399155 - DNA, 25 bp, Mus musculus
ctttacggtgtgaggctaggatgaa

SEQ ID NO: 399156 - DNA, 25 bp, Mus musculus
ctttacggtgtgtggctaggatgaa

SEQ ID NO: 399157 - DNA, 25 bp, Mus musculus
ctttacgtatgaccgcattcagtat

SEQ ID NO: 399158 - DNA, 25 bp, Mus musculus
ctttacgtatgagcgcattcagtat

SEQ ID NO: 399159 - DNA, 25 bp, Mus musculus
ctttacgtgggtaccggccatcaag

SEQ ID NO: 399160 - DNA, 25 bp, Mus musculus
ctttacgtgggttccggccatcaag

SEQ ID NO: 399161 - DNA, 25 bp, Mus musculus
ctttactaagcccaatgtcttcact

SEQ ID NO: 399162 - DNA, 25 bp, Mus musculus
ctttactaagccgaatgtcttcact

SEQ ID NO: 399163 - DNA, 25 bp, Mus musculus
ctttactagccccagatggagatct

SEQ ID NO: 399164 - DNA, 25 bp, Mus musculus
ctttactagcccgagatggagatct

SEQ ID NO: 399165 - DNA, 25 bp, Mus musculus
ctttactcattcctctgtgggccac

SEQ ID NO: 399166 - DNA, 25 bp, Mus musculus
ctttactcattcgtctgtgggccac

SEQ ID NO: 399167 - DNA, 25 bp, Mus musculus
ctttactccttacccgggtcaggtg

SEQ ID NO: 399168 - DNA, 25 bp, Mus musculus
ctttactccttagccgggtcaggtg

SEQ ID NO: 399169 - DNA, 25 bp, Mus musculus
ctttactcctttatgcctgttatga

SEQ ID NO: 399170 - DNA, 25 bp, Mus musculus
ctttactcctttttgcctgttatga

SEQ ID NO: 399171 - DNA, 25 bp, Mus musculus
ctttactcggtacagtggatctggt

SEQ ID NO: 399172 - DNA, 25 bp, Mus musculus
ctttactcggtagagtggatctggt

SEQ ID NO: 399173 - DNA, 25 bp, Mus musculus
ctttactctcttcgcgcagcaggga

SEQ ID NO: 399174 - DNA, 25 bp, Mus musculus
ctttactctcttggcgcagcaggga

SEQ ID NO: 399175 - DNA, 25 bp, Mus musculus
ctttactctttcaggtcactctggg

SEQ ID NO: 399176 - DNA, 25 bp, Mus musculus
ctttactctttctggtcactctggg

SEQ ID NO: 399177 - DNA, 25 bp, Mus musculus
ctttactgaacacgcagagctctca

SEQ ID NO: 399178 - DNA, 25 bp, Mus musculus
ctttactgaacaggcagagctctca

SEQ ID NO: 399179 - DNA, 25 bp, Mus musculus
ctttactgaagcacccaccatgatg

SEQ ID NO: 399180 - DNA, 25 bp, Mus musculus
ctttactgaagctcccaccatgatg

SEQ ID NO: 399181 - DNA, 25 bp, Mus musculus
ctttactgtgatatgatgggctaat

SEQ ID NO: 399182 - DNA, 25 bp, Mus musculus
ctttactgtgatttgatgggctaat

SEQ ID NO: 399183 - DNA, 25 bp, Mus musculus
ctttacttaagcattgatgtgggaa

SEQ ID NO: 399184 - DNA, 25 bp, Mus musculus
ctttacttaagctttgatgtgggaa

SEQ ID NO: 399185 - DNA, 25 bp, Mus musculus
ctttacttagtaaggacccaaatca

SEQ ID NO: 399186 - DNA, 25 bp, Mus musculus
ctttacttagtatggacccaaatca

SEQ ID NO: 399187 - DNA, 25 bp, Mus musculus
ctttacttatggcactggtatctca

SEQ ID NO: 399188 - DNA, 25 bp, Mus musculus
ctttacttatgggactggtatctca

SEQ ID NO: 399189 - DNA, 25 bp, Mus musculus
ctttacttgctcagttgggtgacag

SEQ ID NO: 399190 - DNA, 25 bp, Mus musculus
ctttacttgctctgttgggtgacag

SEQ ID NO: 399191 - DNA, 25 bp, Mus musculus
ctttacttgggacgcctgtgtctga

SEQ ID NO: 399192 - DNA, 25 bp, Mus musculus
ctttacttgggaggcctgtgtctga

SEQ ID NO: 399193 - DNA, 25 bp, Mus musculus
ctttagaacattacggtcaccagac

SEQ ID NO: 399194 - DNA, 25 bp, Mus musculus
ctttagaacatttcggtcaccagac

SEQ ID NO: 399195 - DNA, 25 bp, Mus musculus
ctttagaagtgtagcctagttgaac

SEQ ID NO: 399196 - DNA, 25 bp, Mus musculus
ctttagaagtgttgcctagttgaac

SEQ ID NO: 399197 - DNA, 25 bp, Mus musculus
ctttagacaaaccattcaggagaaa

SEQ ID NO: 399198 - DNA, 25 bp, Mus musculus
ctttagacaaacgattcaggagaaa

SEQ ID NO: 399199 - DNA, 25 bp, Mus musculus
ctttagaccctgacacgtggatgtt

SEQ ID NO: 399200 - DNA, 25 bp, Mus musculus
ctttagaccctgtcacgtggatgtt

SEQ ID NO: 399201 - DNA, 25 bp, Mus musculus
ctttagagacacacgcagcttttga

SEQ ID NO: 399202 - DNA, 25 bp, Mus musculus
ctttagagacactcgcagcttttga

SEQ ID NO: 399203 - DNA, 25 bp, Mus musculus
ctttagatttgaatggcagggcttc

SEQ ID NO: 399204 - DNA, 25 bp, Mus musculus
ctttagatttgattggcagggcttc

SEQ ID NO: 399205 - DNA, 25 bp, Mus musculus
ctttagcacaatacttgcttttaga

SEQ ID NO: 399206 - DNA, 25 bp, Mus musculus
ctttagcacaattcttgcttttaga

SEQ ID NO: 399207 - DNA, 25 bp, Mus musculus
ctttagcacccactgactgaactgt

SEQ ID NO: 399208 - DNA, 25 bp, Mus musculus
ctttagcacccagtgactgaactgt

SEQ ID NO: 399209 - DNA, 25 bp, Mus musculus
ctttagcatgagcagactggacgga

SEQ ID NO: 399210 - DNA, 25 bp, Mus musculus
ctttagcatgaggagactggacgga

SEQ ID NO: 399211 - DNA, 25 bp, Mus musculus
ctttagccagttcctatgtgttagc

SEQ ID NO: 399212 - DNA, 25 bp, Mus musculus
ctttagccagttgctatgtgttagc

SEQ ID NO: 399213 - DNA, 25 bp, Mus musculus
ctttagccgggtacagcgggcctga

SEQ ID NO: 399214 - DNA, 25 bp, Mus musculus
ctttagccgggttcagcgggcctga

SEQ ID NO: 399215 - DNA, 25 bp, Mus musculus
ctttagcctggcagatttagggtct

SEQ ID NO: 399216 - DNA, 25 bp, Mus musculus
ctttagcctggcattgttcagacat

SEQ ID NO: 399217 - DNA, 25 bp, Mus musculus
ctttagcctggctgatttagggtct

SEQ ID NO: 399218 - DNA, 25 bp, Mus musculus
ctttagcctggctttgttcagacat

SEQ ID NO: 399219 - DNA, 25 bp, Mus musculus
ctttagccttgtctgtccagagagc

SEQ ID NO: 399220 - DNA, 25 bp, Mus musculus
ctttagccttgtgtgtccagagagc

SEQ ID NO: 399221 - DNA, 25 bp, Mus musculus
ctttagctgcctcgagttgttgggt

SEQ ID NO: 399222 - DNA, 25 bp, Mus musculus
ctttagctgcctggagttgttgggt

SEQ ID NO: 399223 - DNA, 25 bp, Mus musculus
ctttagctgtttcaatgagatcgag

SEQ ID NO: 399224 - DNA, 25 bp, Mus musculus
ctttagctgtttgaatgagatcgag

SEQ ID NO: 399225 - DNA, 25 bp, Mus musculus
ctttagcttctaaatgatctccctt

SEQ ID NO: 399226 - DNA, 25 bp, Mus musculus
ctttagcttctatatgatctccctt

SEQ ID NO: 399227 - DNA, 25 bp, Mus musculus
ctttaggaaattatctcgtcataat

SEQ ID NO: 399228 - DNA, 25 bp, Mus musculus
ctttaggaaattttctcgtcataat

SEQ ID NO: 399229 - DNA, 25 bp, Mus musculus
ctttaggaatcgagagtcaggccat

SEQ ID NO: 399230 - DNA, 25 bp, Mus musculus
ctttaggaatcgtgagtcaggccat

SEQ ID NO: 399231 - DNA, 25 bp, Mus musculus
ctttaggagagcagcagtaatgttt

SEQ ID NO: 399232 - DNA, 25 bp, Mus musculus
ctttaggagagctgcagtaatgttt

SEQ ID NO: 399233 - DNA, 25 bp, Mus musculus
ctttaggattggatttacagcttat

SEQ ID NO: 399234 - DNA, 25 bp, Mus musculus
ctttaggattggttttacagcttat

SEQ ID NO: 399235 - DNA, 25 bp, Mus musculus
ctttaggccctactttcacacactt

SEQ ID NO: 399236 - DNA, 25 bp, Mus musculus
ctttaggccctagtttcacacactt

SEQ ID NO: 399237 - DNA, 25 bp, Mus musculus
ctttaggcgggcaggtcaggctcta

SEQ ID NO: 399238 - DNA, 25 bp, Mus musculus
ctttaggcgggctggtcaggctcta

SEQ ID NO: 399239 - DNA, 25 bp, Mus musculus
ctttagggacatcacctttgggtga

SEQ ID NO: 399240 - DNA, 25 bp, Mus musculus
ctttagggacatgacctttgggtga

SEQ ID NO: 399241 - DNA, 25 bp, Mus musculus
ctttagggagtgagtagtcatggct

SEQ ID NO: 399242 - DNA, 25 bp, Mus musculus
ctttagggagtgtgtagtcatggct

SEQ ID NO: 399243 - DNA, 25 bp, Mus musculus
ctttaggtgaagcagcctttggcaa

SEQ ID NO: 399244 - DNA, 25 bp, Mus musculus
ctttaggtgaaggagcctttggcaa

SEQ ID NO: 399245 - DNA, 25 bp, Mus musculus
ctttaggtgcgtcggcttcggacta

SEQ ID NO: 399246 - DNA, 25 bp, Mus musculus
ctttaggtgcgtgggcttcggacta

SEQ ID NO: 399247 - DNA, 25 bp, Mus musculus
ctttagtcactcatttctcaatcca

SEQ ID NO: 399248 - DNA, 25 bp, Mus musculus
ctttagtcactcttttctcaatcca

SEQ ID NO: 399249 - DNA, 25 bp, Mus musculus
ctttagtgaatgcttccagtctgat

SEQ ID NO: 399250 - DNA, 25 bp, Mus musculus
ctttagtgaatggttccagtctgat

SEQ ID NO: 399251 - DNA, 25 bp, Mus musculus
ctttagtgaggtagttgggacgatc

SEQ ID NO: 399252 - DNA, 25 bp, Mus musculus
ctttagtgaggttgttgggacgatc

SEQ ID NO: 399253 - DNA, 25 bp, Mus musculus
ctttagtggatgctgtgcttgttat

SEQ ID NO: 399254 - DNA, 25 bp, Mus musculus
ctttagtggatggtgtgcttgttat

SEQ ID NO: 399255 - DNA, 25 bp, Mus musculus
ctttagtgtgaaccccgggtcatgt

SEQ ID NO: 399256 - DNA, 25 bp, Mus musculus
ctttagtgtgaagcccgggtcatgt

SEQ ID NO: 399257 - DNA, 25 bp, Mus musculus
ctttagtgttcaccagctgagatct

SEQ ID NO: 399258 - DNA, 25 bp, Mus musculus
ctttagtgttcagcagctgagatct

SEQ ID NO: 399259 - DNA, 25 bp, Mus musculus
ctttagttcttcagcaacaccactt

SEQ ID NO: 399260 - DNA, 25 bp, Mus musculus
ctttagttcttctgcaacaccactt

SEQ ID NO: 399261 - DNA, 25 bp, Mus musculus
ctttagttggccacctctgtaaatt

SEQ ID NO: 399262 - DNA, 25 bp, Mus musculus
ctttagttggcctcctctgtaaatt

SEQ ID NO: 399263 - DNA, 25 bp, Mus musculus
ctttagttttggatagtagatgaca

SEQ ID NO: 399264 - DNA, 25 bp, Mus musculus
ctttagttttggttagtagatgaca

SEQ ID NO: 399265 - DNA, 25 bp, Mus musculus
ctttataaaactcgcctgtaggcat

SEQ ID NO: 399266 - DNA, 25 bp, Mus musculus
ctttataaaactggcctgtaggcat

SEQ ID NO: 399267 - DNA, 25 bp, Mus musculus
ctttataagatgcagttgggacaaa

SEQ ID NO: 399268 - DNA, 25 bp, Mus musculus
ctttataagatggagttgggacaaa

SEQ ID NO: 399269 - DNA, 25 bp, Mus musculus
ctttataatcctccagtgacacatt

SEQ ID NO: 399270 - DNA, 25 bp, Mus musculus
ctttataatcctgcagtgacacatt

SEQ ID NO: 399271 - DNA, 25 bp, Mus musculus
ctttataccaatctagcttgggcta

SEQ ID NO: 399272 - DNA, 25 bp, Mus musculus
ctttataccaatgtagcttgggcta

SEQ ID NO: 399273 - DNA, 25 bp, Mus musculus
ctttatacttggatagttactttca

SEQ ID NO: 399274 - DNA, 25 bp, Mus musculus
ctttatacttggttagttactttca

SEQ ID NO: 399275 - DNA, 25 bp, Mus musculus
ctttatacttttactctttgctgga

SEQ ID NO: 399276 - DNA, 25 bp, Mus musculus
ctttatactttttctctttgctgga

SEQ ID NO: 399277 - DNA, 25 bp, Mus musculus
ctttatagcacaccaatgtccacgt

SEQ ID NO: 399278 - DNA, 25 bp, Mus musculus
ctttatagcacagcaatgtccacgt

SEQ ID NO: 399279 - DNA, 25 bp, Mus musculus
ctttatatacctcttccttagtcac

SEQ ID NO: 399280 - DNA, 25 bp, Mus musculus
ctttatatacctgttccttagtcac

SEQ ID NO: 399281 - DNA, 25 bp, Mus musculus
ctttatatgattattcagcttgcag

SEQ ID NO: 399282 - DNA, 25 bp, Mus musculus
ctttatatgatttttcagcttgcag

SEQ ID NO: 399283 - DNA, 25 bp, Mus musculus
ctttatatgctcaggaaagcgacgt

SEQ ID NO: 399284 - DNA, 25 bp, Mus musculus
ctttatatgctctggaaagcgacgt

SEQ ID NO: 399285 - DNA, 25 bp, Mus musculus
ctttatatgttcatgtgtcagtgga

SEQ ID NO: 399286 - DNA, 25 bp, Mus musculus
ctttatatgttcttgtgtcagtgga

SEQ ID NO: 399287 - DNA, 25 bp, Mus musculus
ctttatcaacccaaagtcacccctg

SEQ ID NO: 399288 - DNA, 25 bp, Mus musculus
ctttatcaaccctaagtcacccctg

SEQ ID NO: 399289 - DNA, 25 bp, Mus musculus
ctttatcaagatcagctgccaggtc

SEQ ID NO: 399290 - DNA, 25 bp, Mus musculus
ctttatcaagatgagctgccaggtc

SEQ ID NO: 399291 - DNA, 25 bp, Mus musculus
ctttatcaagccagaatgcaacata

SEQ ID NO: 399292 - DNA, 25 bp, Mus musculus
ctttatcaagcctgaatgcaacata

SEQ ID NO: 399293 - DNA, 25 bp, Mus musculus
ctttatccatggcaacaagagcaac

SEQ ID NO: 399294 - DNA, 25 bp, Mus musculus
ctttatccatgggaacaagagcaac

SEQ ID NO: 399295 - DNA, 25 bp, Mus musculus
ctttatcccacacagttttccagga

SEQ ID NO: 399296 - DNA, 25 bp, Mus musculus
ctttatcccacagagttttccagga

SEQ ID NO: 399297 - DNA, 25 bp, Mus musculus
ctttatcctttccaggccttgtgtc

SEQ ID NO: 399298 - DNA, 25 bp, Mus musculus
ctttatcctttcgaggccttgtgtc

SEQ ID NO: 399299 - DNA, 25 bp, Mus musculus
ctttatctaatgacataacatctgg

SEQ ID NO: 399300 - DNA, 25 bp, Mus musculus
ctttatctaatgtcataacatctgg

SEQ ID NO: 399301 - DNA, 25 bp, Mus musculus
ctttatctctgaatcaagtcttgga

SEQ ID NO: 399302 - DNA, 25 bp, Mus musculus
ctttatctctgattcaagtcttgga

SEQ ID NO: 399303 - DNA, 25 bp, Mus musculus
ctttatctggttcatttagctggca

SEQ ID NO: 399304 - DNA, 25 bp, Mus musculus
ctttatctggttgatttagctggca

SEQ ID NO: 399305 - DNA, 25 bp, Mus musculus
ctttatctgtttcggagtcaaggtg

SEQ ID NO: 399306 - DNA, 25 bp, Mus musculus
ctttatctgtttgggagtcaaggtg

SEQ ID NO: 399307 - DNA, 25 bp, Mus musculus
ctttatcttaagcagccagggcata

SEQ ID NO: 399308 - DNA, 25 bp, Mus musculus
ctttatcttaaggagccagggcata

SEQ ID NO: 399309 - DNA, 25 bp, Mus musculus
ctttatcttatactaccagggaaat

SEQ ID NO: 399310 - DNA, 25 bp, Mus musculus
ctttatcttatagtaccagggaaat

SEQ ID NO: 399311 - DNA, 25 bp, Mus musculus
ctttatcttgggatggtggacctcc

SEQ ID NO: 399312 - DNA, 25 bp, Mus musculus
ctttatcttgggttggtggacctcc

SEQ ID NO: 399313 - DNA, 25 bp, Mus musculus
ctttatgactatcctggccaggagg

SEQ ID NO: 399314 - DNA, 25 bp, Mus musculus
ctttatgactatgctggccaggagg

SEQ ID NO: 399315 - DNA, 25 bp, Mus musculus
ctttatgatctaattgtaactttaa

SEQ ID NO: 399316 - DNA, 25 bp, Mus musculus
ctttatgatctatttgtaactttaa

SEQ ID NO: 399317 - DNA, 25 bp, Mus musculus
ctttatgcaccaccattggcgataa

SEQ ID NO: 399318 - DNA, 25 bp, Mus musculus
ctttatgcaccagcattggcgataa

SEQ ID NO: 399319 - DNA, 25 bp, Mus musculus
ctttatgcccggaacacacaacata

SEQ ID NO: 399320 - DNA, 25 bp, Mus musculus
ctttatgcccggtacacacaacata

SEQ ID NO: 399321 - DNA, 25 bp, Mus musculus
ctttatgccttcagtattgttccca

SEQ ID NO: 399322 - DNA, 25 bp, Mus musculus
ctttatgccttctgtattgttccca

SEQ ID NO: 399323 - DNA, 25 bp, Mus musculus
ctttatgctagaagaggctcctgtt

SEQ ID NO: 399324 - DNA, 25 bp, Mus musculus
ctttatgctagatgaggctcctgtt

SEQ ID NO: 399325 - DNA, 25 bp, Mus musculus
ctttatgtgattcatgcctgctggt

SEQ ID NO: 399326 - DNA, 25 bp, Mus musculus
ctttatgtgattgatgcctgctggt

SEQ ID NO: 399327 - DNA, 25 bp, Mus musculus
ctttatgtgtatccattcttgagta

SEQ ID NO: 399328 - DNA, 25 bp, Mus musculus
ctttatgtgtatgcattcttgagta

SEQ ID NO: 399329 - DNA, 25 bp, Mus musculus
ctttatgttcttcgagcttacgccc

SEQ ID NO: 399330 - DNA, 25 bp, Mus musculus
ctttatgttcttggagcttacgccc

SEQ ID NO: 399331 - DNA, 25 bp, Mus musculus
ctttatgttgtgctatcctggtcca

SEQ ID NO: 399332 - DNA, 25 bp, Mus musculus
ctttatgttgtggtatcctggtcca

SEQ ID NO: 399333 - DNA, 25 bp, Mus musculus
ctttattaagctacactaactcggt

SEQ ID NO: 399334 - DNA, 25 bp, Mus musculus
ctttattaagcttcactaactcggt

SEQ ID NO: 399335 - DNA, 25 bp, Mus musculus
ctttattacagtcaacagtgtttcc

SEQ ID NO: 399336 - DNA, 25 bp, Mus musculus
ctttattacagtgaacagtgtttcc

SEQ ID NO: 399337 - DNA, 25 bp, Mus musculus
ctttattatacacgccaggacaacc

SEQ ID NO: 399338 - DNA, 25 bp, Mus musculus
ctttattatacaggccaggacaacc

SEQ ID NO: 399339 - DNA, 25 bp, Mus musculus
ctttattatactaagatgctcacag

SEQ ID NO: 399340 - DNA, 25 bp, Mus musculus
ctttattatacttagatgctcacag

SEQ ID NO: 399341 - DNA, 25 bp, Mus musculus
ctttattatgcgattggacttctca

SEQ ID NO: 399342 - DNA, 25 bp, Mus musculus
ctttattatgcgtttggacttctca

SEQ ID NO: 399343 - DNA, 25 bp, Mus musculus
ctttattatgttatgttcctcaggt

SEQ ID NO: 399344 - DNA, 25 bp, Mus musculus
ctttattatgttttgttcctcaggt

SEQ ID NO: 399345 - DNA, 25 bp, Mus musculus
ctttattcacatctccatgctttca

SEQ ID NO: 399346 - DNA, 25 bp, Mus musculus
ctttattcacatgtccatgctttca

SEQ ID NO: 399347 - DNA, 25 bp, Mus musculus
ctttattcactcattcattgtgagt

SEQ ID NO: 399348 - DNA, 25 bp, Mus musculus
ctttattcactctttcattgtgagt

SEQ ID NO: 399349 - DNA, 25 bp, Mus musculus
ctttattcccagagttcagttctac

SEQ ID NO: 399350 - DNA, 25 bp, Mus musculus
ctttattcccagtgttcagttctac

SEQ ID NO: 399351 - DNA, 25 bp, Mus musculus
ctttattcgcagactcctggatttc

SEQ ID NO: 399352 - DNA, 25 bp, Mus musculus
ctttattcgcagtctcctggatttc

SEQ ID NO: 399353 - DNA, 25 bp, Mus musculus
ctttattctcagaatgccatcagcc

SEQ ID NO: 399354 - DNA, 25 bp, Mus musculus
ctttattctcagtatgccatcagcc

SEQ ID NO: 399355 - DNA, 25 bp, Mus musculus
ctttattcttaactgctgcataatg

SEQ ID NO: 399356 - DNA, 25 bp, Mus musculus
ctttattcttaagtgctgcataatg

SEQ ID NO: 399357 - DNA, 25 bp, Mus musculus
ctttattgaattatgtgctgccgta

SEQ ID NO: 399358 - DNA, 25 bp, Mus musculus
ctttattgaattttgtgctgccgta

SEQ ID NO: 399359 - DNA, 25 bp, Mus musculus
ctttattgctggaaatgttgcataa

SEQ ID NO: 399360 - DNA, 25 bp, Mus musculus
ctttattgctggtaatgttgcataa

SEQ ID NO: 399361 - DNA, 25 bp, Mus musculus
ctttattggcaaagagcgtccgctt

SEQ ID NO: 399362 - DNA, 25 bp, Mus musculus
ctttattggcaatgagcgtccgctt

SEQ ID NO: 399363 - DNA, 25 bp, Mus musculus
ctttattgttatagtcagggtcttg

SEQ ID NO: 399364 - DNA, 25 bp, Mus musculus
ctttattgttattgtcagggtcttg

SEQ ID NO: 399365 - DNA, 25 bp, Mus musculus
ctttattttttacctgctgtgggat

SEQ ID NO: 399366 - DNA, 25 bp, Mus musculus
ctttattttttagctgctgtgggat

SEQ ID NO: 399367 - DNA, 25 bp, Mus musculus
ctttcaaaagggaagccaatcacga

SEQ ID NO: 399368 - DNA, 25 bp, Mus musculus
ctttcaaaagggtagccaatcacga

SEQ ID NO: 399369 - DNA, 25 bp, Mus musculus
ctttcaaagcacacacaatctcatc

SEQ ID NO: 399370 - DNA, 25 bp, Mus musculus
ctttcaaagcactcacaatctcatc

SEQ ID NO: 399371 - DNA, 25 bp, Mus musculus
ctttcaaagcagctctctgtatctg

SEQ ID NO: 399372 - DNA, 25 bp, Mus musculus
ctttcaaagcaggtctctgtatctg

SEQ ID NO: 399373 - DNA, 25 bp, Mus musculus
ctttcaaagggtcagaagattcttc

SEQ ID NO: 399374 - DNA, 25 bp, Mus musculus
ctttcaaagggtgagaagattcttc

SEQ ID NO: 399375 - DNA, 25 bp, Mus musculus
ctttcaaataggacactgtactggc

SEQ ID NO: 399376 - DNA, 25 bp, Mus musculus
ctttcaaataggtcactgtactggc

SEQ ID NO: 399377 - DNA, 25 bp, Mus musculus
ctttcaactccaaactatcgtctgt

SEQ ID NO: 399378 - DNA, 25 bp, Mus musculus
ctttcaactccatactatcgtctgt

SEQ ID NO: 399379 - DNA, 25 bp, Mus musculus
ctttcaacttgacgtagccatgttt

SEQ ID NO: 399380 - DNA, 25 bp, Mus musculus
ctttcaacttgaggtagccatgttt

SEQ ID NO: 399381 - DNA, 25 bp, Mus musculus
ctttcaagccggcaatttctgcaaa

SEQ ID NO: 399382 - DNA, 25 bp, Mus musculus
ctttcaagccgggaatttctgcaaa

SEQ ID NO: 399383 - DNA, 25 bp, Mus musculus
ctttcaagcggcacgagcggcaggc

SEQ ID NO: 399384 - DNA, 25 bp, Mus musculus
ctttcaagcggctcgagcggcaggc

SEQ ID NO: 399385 - DNA, 25 bp, Mus musculus
ctttcaagctgtaatcaattgggta

SEQ ID NO: 399386 - DNA, 25 bp, Mus musculus
ctttcaagctgttatcaattgggta

SEQ ID NO: 399387 - DNA, 25 bp, Mus musculus
ctttcaagtcctatcgatcattttg

SEQ ID NO: 399388 - DNA, 25 bp, Mus musculus
ctttcaagtcctttcgatcattttg

SEQ ID NO: 399389 - DNA, 25 bp, Mus musculus
ctttcaagttaaaagcacgcagcag

SEQ ID NO: 399390 - DNA, 25 bp, Mus musculus
ctttcaagttaatagcacgcagcag

SEQ ID NO: 399391 - DNA, 25 bp, Mus musculus
ctttcaagttgtcagagcacatgga

SEQ ID NO: 399392 - DNA, 25 bp, Mus musculus
ctttcaagttgtgagagcacatgga

SEQ ID NO: 399393 - DNA, 25 bp, Mus musculus
ctttcaatacctctctgttcttcca

SEQ ID NO: 399394 - DNA, 25 bp, Mus musculus
ctttcaatacctgtctgttcttcca

SEQ ID NO: 399395 - DNA, 25 bp, Mus musculus
ctttcaatggaaaggcaatgaccac

SEQ ID NO: 399396 - DNA, 25 bp, Mus musculus
ctttcaatggaatggcaatgaccac

SEQ ID NO: 399397 - DNA, 25 bp, Mus musculus
ctttcaatggagagccgtgcagcgt

SEQ ID NO: 399398 - DNA, 25 bp, Mus musculus
ctttcaatggagtgccgtgcagcgt

SEQ ID NO: 399399 - DNA, 25 bp, Mus musculus
ctttcaatgtctatcaagttcagta

SEQ ID NO: 399400 - DNA, 25 bp, Mus musculus
ctttcaatgtctttcaagttcagta

SEQ ID NO: 399401 - DNA, 25 bp, Mus musculus
ctttcaatttacagagggtgtgcca

SEQ ID NO: 399402 - DNA, 25 bp, Mus musculus
ctttcaatttactgagggtgtgcca

SEQ ID NO: 399403 - DNA, 25 bp, Mus musculus
ctttcacacaaacttaagccagttg

SEQ ID NO: 399404 - DNA, 25 bp, Mus musculus
ctttcacacaaagttaagccagttg

SEQ ID NO: 399405 - DNA, 25 bp, Mus musculus
ctttcacagggcactacaggatgga

SEQ ID NO: 399406 - DNA, 25 bp, Mus musculus
ctttcacagggctctacaggatgga

SEQ ID NO: 399407 - DNA, 25 bp, Mus musculus
ctttcacattcccttgtaagcattc

SEQ ID NO: 399408 - DNA, 25 bp, Mus musculus
ctttcacattccgttgtaagcattc

SEQ ID NO: 399409 - DNA, 25 bp, Mus musculus
ctttcaccatagagccaatcatcac

SEQ ID NO: 399410 - DNA, 25 bp, Mus musculus
ctttcaccatagtgccaatcatcac

SEQ ID NO: 399411 - DNA, 25 bp, Mus musculus
ctttcacctctcataactcagggat

SEQ ID NO: 399412 - DNA, 25 bp, Mus musculus
ctttcacctctcttaactcagggat

SEQ ID NO: 399413 - DNA, 25 bp, Mus musculus
ctttcacgagggaagtacctgctaa

SEQ ID NO: 399414 - DNA, 25 bp, Mus musculus
ctttcacgagggtagtacctgctaa

SEQ ID NO: 399415 - DNA, 25 bp, Mus musculus
ctttcacgctgaaccaagagttcac

SEQ ID NO: 399416 - DNA, 25 bp, Mus musculus
ctttcacgctgatccaagagttcac

SEQ ID NO: 399417 - DNA, 25 bp, Mus musculus
ctttcacgcttcctgttgattgata

SEQ ID NO: 399418 - DNA, 25 bp, Mus musculus
ctttcacgcttcgtgttgattgata

SEQ ID NO: 399419 - DNA, 25 bp, Mus musculus
ctttcacgtctgagaagttcctgct

SEQ ID NO: 399420 - DNA, 25 bp, Mus musculus
ctttcacgtctgtgaagttcctgct

SEQ ID NO: 399421 - DNA, 25 bp, Mus musculus
ctttcactaaaactggctcacctca

SEQ ID NO: 399422 - DNA, 25 bp, Mus musculus
ctttcactaaaagtggctcacctca

SEQ ID NO: 399423 - DNA, 25 bp, Mus musculus
ctttcactaataaatcttttggatc

SEQ ID NO: 399424 - DNA, 25 bp, Mus musculus
ctttcactaatatatcttttggatc

SEQ ID NO: 399425 - DNA, 25 bp, Mus musculus
ctttcactattaaccgggtaggaag

SEQ ID NO: 399426 - DNA, 25 bp, Mus musculus
ctttcactattatccgggtaggaag

SEQ ID NO: 399427 - DNA, 25 bp, Mus musculus
ctttcactctgaccttctcaagaca

SEQ ID NO: 399428 - DNA, 25 bp, Mus musculus
ctttcactctgagcttctcaagaca

SEQ ID NO: 399429 - DNA, 25 bp, Mus musculus
ctttcactgagcatgtggaatcccc

SEQ ID NO: 399430 - DNA, 25 bp, Mus musculus
ctttcactgagcttgtggaatcccc

SEQ ID NO: 399431 - DNA, 25 bp, Mus musculus
ctttcactgtgtcccatgggagtca

SEQ ID NO: 399432 - DNA, 25 bp, Mus musculus
ctttcactgtgtgccatgggagtca

SEQ ID NO: 399433 - DNA, 25 bp, Mus musculus
ctttcacttgtaatggagactggcc

SEQ ID NO: 399434 - DNA, 25 bp, Mus musculus
ctttcacttgtattggagactggcc

SEQ ID NO: 399435 - DNA, 25 bp, Mus musculus
ctttcactttataggtaagacacct

SEQ ID NO: 399436 - DNA, 25 bp, Mus musculus
ctttcactttattggtaagacacct

SEQ ID NO: 399437 - DNA, 25 bp, Mus musculus
ctttcagaactgcacgattctggta

SEQ ID NO: 399438 - DNA, 25 bp, Mus musculus
ctttcagaactggacgattctggta

SEQ ID NO: 399439 - DNA, 25 bp, Mus musculus
ctttcagaattgactccggctttaa

SEQ ID NO: 399440 - DNA, 25 bp, Mus musculus
ctttcagaattgtctccggctttaa

SEQ ID NO: 399441 - DNA, 25 bp, Mus musculus
ctttcagacccaactgaatcacgtc

SEQ ID NO: 399442 - DNA, 25 bp, Mus musculus
ctttcagacccatctgaatcacgtc

SEQ ID NO: 399443 - DNA, 25 bp, Mus musculus
ctttcagactgcaggtgggcagagt

SEQ ID NO: 399444 - DNA, 25 bp, Mus musculus
ctttcagactgctggtgggcagagt

SEQ ID NO: 399445 - DNA, 25 bp, Mus musculus
ctttcagaggagcacaagtggccag

SEQ ID NO: 399446 - DNA, 25 bp, Mus musculus
ctttcagaggaggacaagtggccag

SEQ ID NO: 399447 - DNA, 25 bp, Mus musculus
ctttcagatagcattgggataccct

SEQ ID NO: 399448 - DNA, 25 bp, Mus musculus
ctttcagatagctttgggataccct

SEQ ID NO: 399449 - DNA, 25 bp, Mus musculus
ctttcagatgttattcatttagaac

SEQ ID NO: 399450 - DNA, 25 bp, Mus musculus
ctttcagatgtttttcatttagaac

SEQ ID NO: 399451 - DNA, 25 bp, Mus musculus
ctttcagattggctatggtggctca

SEQ ID NO: 399452 - DNA, 25 bp, Mus musculus
ctttcagattgggtatggtggctca

SEQ ID NO: 399453 - DNA, 25 bp, Mus musculus
ctttcagattttcgaccctcagact

SEQ ID NO: 399454 - DNA, 25 bp, Mus musculus
ctttcagattttggaccctcagact

SEQ ID NO: 399455 - DNA, 25 bp, Mus musculus
ctttcagcactactggtagcggcgt

SEQ ID NO: 399456 - DNA, 25 bp, Mus musculus
ctttcagcactagtggtagcggcgt

SEQ ID NO: 399457 - DNA, 25 bp, Mus musculus
ctttcagcatgaaaacgtgtggttt

SEQ ID NO: 399458 - DNA, 25 bp, Mus musculus
ctttcagcatgataacgtgtggttt

SEQ ID NO: 399459 - DNA, 25 bp, Mus musculus
ctttcagcatgcactgtgtgtcaca

SEQ ID NO: 399460 - DNA, 25 bp, Mus musculus
ctttcagcatgctctgtgtgtcaca

SEQ ID NO: 399461 - DNA, 25 bp, Mus musculus
ctttcagcccaacgccaagcagaag

SEQ ID NO: 399462 - DNA, 25 bp, Mus musculus
ctttcagcccaaggccaagcagaag

SEQ ID NO: 399463 - DNA, 25 bp, Mus musculus
ctttcagcctccctgatgaagagtt

SEQ ID NO: 399464 - DNA, 25 bp, Mus musculus
ctttcagcctccgtgatgaagagtt

SEQ ID NO: 399465 - DNA, 25 bp, Mus musculus
ctttcagctcacacaagggcaaggt

SEQ ID NO: 399466 - DNA, 25 bp, Mus musculus
ctttcagctcacattcacagatggt

SEQ ID NO: 399467 - DNA, 25 bp, Mus musculus
ctttcagctcactcaagggcaaggt

SEQ ID NO: 399468 - DNA, 25 bp, Mus musculus
ctttcagctcactttcacagatggt

SEQ ID NO: 399469 - DNA, 25 bp, Mus musculus
ctttcagctgaccttggcttatttt

SEQ ID NO: 399470 - DNA, 25 bp, Mus musculus
ctttcagctgacgttggcttatttt

SEQ ID NO: 399471 - DNA, 25 bp, Mus musculus
ctttcagctgtaatgttctcaaaat

SEQ ID NO: 399472 - DNA, 25 bp, Mus musculus
ctttcagctgtattgttctcaaaat

SEQ ID NO: 399473 - DNA, 25 bp, Mus musculus
ctttcagcttgtcccatgtttggac

SEQ ID NO: 399474 - DNA, 25 bp, Mus musculus
ctttcagcttgtgccatgtttggac

SEQ ID NO: 399475 - DNA, 25 bp, Mus musculus
ctttcaggaattcttcggcagagga

SEQ ID NO: 399476 - DNA, 25 bp, Mus musculus
ctttcaggaattgttcggcagagga

SEQ ID NO: 399477 - DNA, 25 bp, Mus musculus
ctttcaggcaaccaggagacatttt

SEQ ID NO: 399478 - DNA, 25 bp, Mus musculus
ctttcaggcaacgaggagacatttt

SEQ ID NO: 399479 - DNA, 25 bp, Mus musculus
ctttcaggtcagatctaactcaatt

SEQ ID NO: 399480 - DNA, 25 bp, Mus musculus
ctttcaggtcagttctaactcaatt

SEQ ID NO: 399481 - DNA, 25 bp, Mus musculus
ctttcaggtgcccttcacatggata

SEQ ID NO: 399482 - DNA, 25 bp, Mus musculus
ctttcaggtgccgttcacatggata

SEQ ID NO: 399483 - DNA, 25 bp, Mus musculus
ctttcaggttccatgctcagccaag

SEQ ID NO: 399484 - DNA, 25 bp, Mus musculus
ctttcaggttccttgctcagccaag

SEQ ID NO: 399485 - DNA, 25 bp, Mus musculus
ctttcagtcacccagaagcatgatt

SEQ ID NO: 399486 - DNA, 25 bp, Mus musculus
ctttcagtcaccgagaagcatgatt

SEQ ID NO: 399487 - DNA, 25 bp, Mus musculus
ctttcagtgcagaggcttgtgttct

SEQ ID NO: 399488 - DNA, 25 bp, Mus musculus
ctttcagtgcagtggcttgtgttct

SEQ ID NO: 399489 - DNA, 25 bp, Mus musculus
ctttcagtgctaattcatttgtcta

SEQ ID NO: 399490 - DNA, 25 bp, Mus musculus
ctttcagtgctatttcatttgtcta

SEQ ID NO: 399491 - DNA, 25 bp, Mus musculus
ctttcagttactatgtgtattgcac

SEQ ID NO: 399492 - DNA, 25 bp, Mus musculus
ctttcagttactttgtgtattgcac

SEQ ID NO: 399493 - DNA, 25 bp, Mus musculus
ctttcagttggtagttggttgtctc

SEQ ID NO: 399494 - DNA, 25 bp, Mus musculus
ctttcagttggttgttggttgtctc

SEQ ID NO: 399495 - DNA, 25 bp, Mus musculus
ctttcagttgttcatctcagcggag

SEQ ID NO: 399496 - DNA, 25 bp, Mus musculus
ctttcagttgttgatctcagcggag

SEQ ID NO: 399497 - DNA, 25 bp, Mus musculus
ctttcataaccacgcaatgctgtgt

SEQ ID NO: 399498 - DNA, 25 bp, Mus musculus
ctttcataaccaggcaatgctgtgt

SEQ ID NO: 399499 - DNA, 25 bp, Mus musculus
ctttcataccttcctttcacttaac

SEQ ID NO: 399500 - DNA, 25 bp, Mus musculus
ctttcataccttgctttcacttaac

SEQ ID NO: 399501 - DNA, 25 bp, Mus musculus
ctttcatagcttcctaggttctcaa

SEQ ID NO: 399502 - DNA, 25 bp, Mus musculus
ctttcatagcttgctaggttctcaa

SEQ ID NO: 399503 - DNA, 25 bp, Mus musculus
ctttcatcacgtcctgtggtggcaa

SEQ ID NO: 399504 - DNA, 25 bp, Mus musculus
ctttcatcacgtgctgtggtggcaa

SEQ ID NO: 399505 - DNA, 25 bp, Mus musculus
ctttcatcactactgacccttaaat

SEQ ID NO: 399506 - DNA, 25 bp, Mus musculus
ctttcatcactagtgacccttaaat

SEQ ID NO: 399507 - DNA, 25 bp, Mus musculus
ctttcatcagaaaccacctacttgg

SEQ ID NO: 399508 - DNA, 25 bp, Mus musculus
ctttcatcagaatccacctacttgg

SEQ ID NO: 399509 - DNA, 25 bp, Mus musculus
ctttcatcagcacacaggagactct

SEQ ID NO: 399510 - DNA, 25 bp, Mus musculus
ctttcatcagcagacaggagactct

SEQ ID NO: 399511 - DNA, 25 bp, Mus musculus
ctttcatcagcccaagagcggagaa

SEQ ID NO: 399512 - DNA, 25 bp, Mus musculus
ctttcatcagccgaagagcggagaa

SEQ ID NO: 399513 - DNA, 25 bp, Mus musculus
ctttcatcatttaggtggcttctct

SEQ ID NO: 399514 - DNA, 25 bp, Mus musculus
ctttcatcattttggtggcttctct

SEQ ID NO: 399515 - DNA, 25 bp, Mus musculus
ctttcatccaagcaggaccactgta

SEQ ID NO: 399516 - DNA, 25 bp, Mus musculus
ctttcatccaaggaggaccactgta

SEQ ID NO: 399517 - DNA, 25 bp, Mus musculus
ctttcatcctcacctgggaatcagg

SEQ ID NO: 399518 - DNA, 25 bp, Mus musculus
ctttcatcctcagctgggaatcagg

SEQ ID NO: 399519 - DNA, 25 bp, Mus musculus
ctttcatcctgacatctggcaggca

SEQ ID NO: 399520 - DNA, 25 bp, Mus musculus
ctttcatcctgagatctggcaggca

SEQ ID NO: 399521 - DNA, 25 bp, Mus musculus
ctttcatccttcaccaacaaagcat

SEQ ID NO: 399522 - DNA, 25 bp, Mus musculus
ctttcatccttctccaacaaagcat

SEQ ID NO: 399523 - DNA, 25 bp, Mus musculus
ctttcatcgtaaccctgtaagcagg

SEQ ID NO: 399524 - DNA, 25 bp, Mus musculus
ctttcatcgtaagcctgtaagcagg

SEQ ID NO: 399525 - DNA, 25 bp, Mus musculus
ctttcatctgaaaactgccttggta

SEQ ID NO: 399526 - DNA, 25 bp, Mus musculus
ctttcatctgaatactgccttggta

SEQ ID NO: 399527 - DNA, 25 bp, Mus musculus
ctttcatgcccaactaccaatgaat

SEQ ID NO: 399528 - DNA, 25 bp, Mus musculus
ctttcatgcccatctaccaatgaat

SEQ ID NO: 399529 - DNA, 25 bp, Mus musculus
ctttcatgggagaagaggcgtctat

SEQ ID NO: 399530 - DNA, 25 bp, Mus musculus
ctttcatgggagtagaggcgtctat

SEQ ID NO: 399531 - DNA, 25 bp, Mus musculus
ctttcatgggatcagggatatgcct

SEQ ID NO: 399532 - DNA, 25 bp, Mus musculus
ctttcatgggatgagggatatgcct

SEQ ID NO: 399533 - DNA, 25 bp, Mus musculus
ctttcatggtggatgtgaatgccca

SEQ ID NO: 399534 - DNA, 25 bp, Mus musculus
ctttcatggtggttgtgaatgccca

SEQ ID NO: 399535 - DNA, 25 bp, Mus musculus
ctttcatggtttagactccctattc

SEQ ID NO: 399536 - DNA, 25 bp, Mus musculus
ctttcatggttttgactccctattc

SEQ ID NO: 399537 - DNA, 25 bp, Mus musculus
ctttcattctctaataggtctagtt

SEQ ID NO: 399538 - DNA, 25 bp, Mus musculus
ctttcattctcttataggtctagtt

SEQ ID NO: 399539 - DNA, 25 bp, Mus musculus
ctttcattctgaaccaccaggggtc

SEQ ID NO: 399540 - DNA, 25 bp, Mus musculus
ctttcattctgatccaccaggggtc

SEQ ID NO: 399541 - DNA, 25 bp, Mus musculus
ctttcattctgtccaaggagggatc

SEQ ID NO: 399542 - DNA, 25 bp, Mus musculus
ctttcattctgtgcaaggagggatc

SEQ ID NO: 399543 - DNA, 25 bp, Mus musculus
ctttcattcttcaccatttttgatt

SEQ ID NO: 399544 - DNA, 25 bp, Mus musculus
ctttcattcttctccatttttgatt

SEQ ID NO: 399545 - DNA, 25 bp, Mus musculus
ctttcattgctcattctaactggaa

SEQ ID NO: 399546 - DNA, 25 bp, Mus musculus
ctttcattgctctttctaactggaa

SEQ ID NO: 399547 - DNA, 25 bp, Mus musculus
ctttcattgcttacttgtgagctct

SEQ ID NO: 399548 - DNA, 25 bp, Mus musculus
ctttcattgctttcttgtgagctct

SEQ ID NO: 399549 - DNA, 25 bp, Mus musculus
ctttcattgtatagtgatttctttt

SEQ ID NO: 399550 - DNA, 25 bp, Mus musculus
ctttcattgtattgtgatttctttt

SEQ ID NO: 399551 - DNA, 25 bp, Mus musculus
ctttcatttatcactatttgcctta

SEQ ID NO: 399552 - DNA, 25 bp, Mus musculus
ctttcatttatctctatttgcctta

SEQ ID NO: 399553 - DNA, 25 bp, Mus musculus
ctttcatttgatctctgtattgcca

SEQ ID NO: 399554 - DNA, 25 bp, Mus musculus
ctttcatttgatgtctgtattgcca

SEQ ID NO: 399555 - DNA, 25 bp, Mus musculus
ctttccaaactaaattagtgggcca

SEQ ID NO: 399556 - DNA, 25 bp, Mus musculus
ctttccaaactatattagtgggcca

SEQ ID NO: 399557 - DNA, 25 bp, Mus musculus
ctttccaaactgactctgtaattgt

SEQ ID NO: 399558 - DNA, 25 bp, Mus musculus
ctttccaaactgtctctgtaattgt

SEQ ID NO: 399559 - DNA, 25 bp, Mus musculus
ctttccaaatgacgcctttttagct

SEQ ID NO: 399560 - DNA, 25 bp, Mus musculus
ctttccaaatgaggcctttttagct

SEQ ID NO: 399561 - DNA, 25 bp, Mus musculus
ctttccaacttaccttagtgctcta

SEQ ID NO: 399562 - DNA, 25 bp, Mus musculus
ctttccaacttagcttagtgctcta

SEQ ID NO: 399563 - DNA, 25 bp, Mus musculus
ctttccaacttcagcacatgatcaa

SEQ ID NO: 399564 - DNA, 25 bp, Mus musculus
ctttccaacttctgcacatgatcaa

SEQ ID NO: 399565 - DNA, 25 bp, Mus musculus
ctttccaagctccatatagtgacag

SEQ ID NO: 399566 - DNA, 25 bp, Mus musculus
ctttccaagctcgatatagtgacag

SEQ ID NO: 399567 - DNA, 25 bp, Mus musculus
ctttccaatcatctactaactatcc

SEQ ID NO: 399568 - DNA, 25 bp, Mus musculus
ctttccaatcatgtactaactatcc

SEQ ID NO: 399569 - DNA, 25 bp, Mus musculus
ctttccacctctcctgtttttaaga

SEQ ID NO: 399570 - DNA, 25 bp, Mus musculus
ctttccacctctgctgtttttaaga

SEQ ID NO: 399571 - DNA, 25 bp, Mus musculus
ctttccaccttaagtccttgagaga

SEQ ID NO: 399572 - DNA, 25 bp, Mus musculus
ctttccaccttatgtccttgagaga

SEQ ID NO: 399573 - DNA, 25 bp, Mus musculus
ctttccacggcaagggtgttggcca

SEQ ID NO: 399574 - DNA, 25 bp, Mus musculus
ctttccacggcatgggtgttggcca

SEQ ID NO: 399575 - DNA, 25 bp, Mus musculus
ctttccactctccagtttagaattc

SEQ ID NO: 399576 - DNA, 25 bp, Mus musculus
ctttccactctcgagtttagaattc

SEQ ID NO: 399577 - DNA, 25 bp, Mus musculus
ctttccactgagctgggtagggcat

SEQ ID NO: 399578 - DNA, 25 bp, Mus musculus
ctttccactgaggtgggtagggcat

SEQ ID NO: 399579 - DNA, 25 bp, Mus musculus
ctttccactgtcagagctttcctga

SEQ ID NO: 399580 - DNA, 25 bp, Mus musculus
ctttccactgtctgagctttcctga

SEQ ID NO: 399581 - DNA, 25 bp, Mus musculus
ctttccacttctcaataaatgtttg

SEQ ID NO: 399582 - DNA, 25 bp, Mus musculus
ctttccacttctgaataaatgtttg

SEQ ID NO: 399583 - DNA, 25 bp, Mus musculus
ctttccacttttattaatcactgag

SEQ ID NO: 399584 - DNA, 25 bp, Mus musculus
ctttccactttttttaatcactgag

SEQ ID NO: 399585 - DNA, 25 bp, Mus musculus
ctttccagacccctatgtaggaatg

SEQ ID NO: 399586 - DNA, 25 bp, Mus musculus
ctttccagacccgtatgtaggaatg

SEQ ID NO: 399587 - DNA, 25 bp, Mus musculus
ctttccagagacagttttcacagca

SEQ ID NO: 399588 - DNA, 25 bp, Mus musculus
ctttccagagactgttttcacagca

SEQ ID NO: 399589 - DNA, 25 bp, Mus musculus
ctttccagagtcagtcagctgcata

SEQ ID NO: 399590 - DNA, 25 bp, Mus musculus
ctttccagagtctgtcagctgcata

SEQ ID NO: 399591 - DNA, 25 bp, Mus musculus
ctttccagatccaactcgaacagga

SEQ ID NO: 399592 - DNA, 25 bp, Mus musculus
ctttccagatcctactcgaacagga

SEQ ID NO: 399593 - DNA, 25 bp, Mus musculus
ctttccagatggatcctacttacat

SEQ ID NO: 399594 - DNA, 25 bp, Mus musculus
ctttccagatggttcctacttacat

SEQ ID NO: 399595 - DNA, 25 bp, Mus musculus
ctttccagattcctggcccaggtga

SEQ ID NO: 399596 - DNA, 25 bp, Mus musculus
ctttccagattcgtggcccaggtga

SEQ ID NO: 399597 - DNA, 25 bp, Mus musculus
ctttccagcagtctttagtgaaaac

SEQ ID NO: 399598 - DNA, 25 bp, Mus musculus
ctttccagcagtgtttagtgaaaac

SEQ ID NO: 399599 - DNA, 25 bp, Mus musculus
ctttccagccagatcaacgagagtc

SEQ ID NO: 399600 - DNA, 25 bp, Mus musculus
ctttccagccagttcaacgagagtc

SEQ ID NO: 399601 - DNA, 25 bp, Mus musculus
ctttccagcccaagactggtgagta

SEQ ID NO: 399602 - DNA, 25 bp, Mus musculus
ctttccagcccatgactggtgagta

SEQ ID NO: 399603 - DNA, 25 bp, Mus musculus
ctttccagccctatggtgttttgat

SEQ ID NO: 399604 - DNA, 25 bp, Mus musculus
ctttccagccctttggtgttttgat

SEQ ID NO: 399605 - DNA, 25 bp, Mus musculus
ctttccagctgtaaaaccaccatag

SEQ ID NO: 399606 - DNA, 25 bp, Mus musculus
ctttccagctgttaaaccaccatag

SEQ ID NO: 399607 - DNA, 25 bp, Mus musculus
ctttccaggatcatcttacactcta

SEQ ID NO: 399608 - DNA, 25 bp, Mus musculus
ctttccaggatcttcttacactcta

SEQ ID NO: 399609 - DNA, 25 bp, Mus musculus
ctttccaggttcatagcatctcact

SEQ ID NO: 399610 - DNA, 25 bp, Mus musculus
ctttccaggttcttagcatctcact

SEQ ID NO: 399611 - DNA, 25 bp, Mus musculus
ctttccagtcttagcttaggctgag

SEQ ID NO: 399612 - DNA, 25 bp, Mus musculus
ctttccagtctttgcttaggctgag

SEQ ID NO: 399613 - DNA, 25 bp, Mus musculus
ctttccagtgcacatgtccaagctg

SEQ ID NO: 399614 - DNA, 25 bp, Mus musculus
ctttccagtgcagatgtccaagctg

SEQ ID NO: 399615 - DNA, 25 bp, Mus musculus
ctttccataaacaacatgtccactg

SEQ ID NO: 399616 - DNA, 25 bp, Mus musculus
ctttccataaactacatgtccactg

SEQ ID NO: 399617 - DNA, 25 bp, Mus musculus
ctttccatatctctctttagtcctt

SEQ ID NO: 399618 - DNA, 25 bp, Mus musculus
ctttccatatctgtctttagtcctt

SEQ ID NO: 399619 - DNA, 25 bp, Mus musculus
ctttccatccagctagttcatctag

SEQ ID NO: 399620 - DNA, 25 bp, Mus musculus
ctttccatccaggtagttcatctag

SEQ ID NO: 399621 - DNA, 25 bp, Mus musculus
ctttccatctggagtaagtctatgt

SEQ ID NO: 399622 - DNA, 25 bp, Mus musculus
ctttccatctggtgtaagtctatgt

SEQ ID NO: 399623 - DNA, 25 bp, Mus musculus
ctttccatgcttaaagttgactctt

SEQ ID NO: 399624 - DNA, 25 bp, Mus musculus
ctttccatgctttaagttgactctt

SEQ ID NO: 399625 - DNA, 25 bp, Mus musculus
ctttccatgtggagatagtcttgca

SEQ ID NO: 399626 - DNA, 25 bp, Mus musculus
ctttccatgtggcatctcttgtatg

SEQ ID NO: 399627 - DNA, 25 bp, Mus musculus
ctttccatgtgggatctcttgtatg

SEQ ID NO: 399628 - DNA, 25 bp, Mus musculus
ctttccatgtggtgatagtcttgca

SEQ ID NO: 399629 - DNA, 25 bp, Mus musculus
ctttccattctgattcttgtcaaat

SEQ ID NO: 399630 - DNA, 25 bp, Mus musculus
ctttccattctgtttcttgtcaaat

SEQ ID NO: 399631 - DNA, 25 bp, Mus musculus
ctttccattcttctagctatttcac

SEQ ID NO: 399632 - DNA, 25 bp, Mus musculus
ctttccattcttgtagctatttcac

SEQ ID NO: 399633 - DNA, 25 bp, Mus musculus
ctttccattggaatgcattgctaac

SEQ ID NO: 399634 - DNA, 25 bp, Mus musculus
ctttccattggattgcattgctaac

SEQ ID NO: 399635 - DNA, 25 bp, Mus musculus
ctttccattgtccactttctgattt

SEQ ID NO: 399636 - DNA, 25 bp, Mus musculus
ctttccattgtcgactttctgattt

SEQ ID NO: 399637 - DNA, 25 bp, Mus musculus
ctttcccaaaatccgtcatttcatt

SEQ ID NO: 399638 - DNA, 25 bp, Mus musculus
ctttcccaaaatgcgtcatttcatt

SEQ ID NO: 399639 - DNA, 25 bp, Mus musculus
ctttcccaactaaaatctgagatgc

SEQ ID NO: 399640 - DNA, 25 bp, Mus musculus
ctttcccaactataatctgagatgc

SEQ ID NO: 399641 - DNA, 25 bp, Mus musculus
ctttcccaagagctttcagctgact

SEQ ID NO: 399642 - DNA, 25 bp, Mus musculus
ctttcccaagaggtttcagctgact

SEQ ID NO: 399643 - DNA, 25 bp, Mus musculus
ctttcccaccctctagtttgagatg

SEQ ID NO: 399644 - DNA, 25 bp, Mus musculus
ctttcccaccctgtagtttgagatg

SEQ ID NO: 399645 - DNA, 25 bp, Mus musculus
ctttcccagcttcgaactaggaggg

SEQ ID NO: 399646 - DNA, 25 bp, Mus musculus
ctttcccagcttggaactaggaggg

SEQ ID NO: 399647 - DNA, 25 bp, Mus musculus
ctttcccatagtagtcctcttgaga

SEQ ID NO: 399648 - DNA, 25 bp, Mus musculus
ctttcccatagttgtcctcttgaga

SEQ ID NO: 399649 - DNA, 25 bp, Mus musculus
ctttcccatttcacagaacttttag

SEQ ID NO: 399650 - DNA, 25 bp, Mus musculus
ctttcccatttctcagaacttttag

SEQ ID NO: 399651 - DNA, 25 bp, Mus musculus
ctttccccaaatatacagtgccatg

SEQ ID NO: 399652 - DNA, 25 bp, Mus musculus
ctttccccaaatttacagtgccatg

SEQ ID NO: 399653 - DNA, 25 bp, Mus musculus
ctttccccaaggacatagcttagaa

SEQ ID NO: 399654 - DNA, 25 bp, Mus musculus
ctttccccaaggtcatagcttagaa

SEQ ID NO: 399655 - DNA, 25 bp, Mus musculus
ctttccccagacaactgctaagaac

SEQ ID NO: 399656 - DNA, 25 bp, Mus musculus
ctttccccagactactgctaagaac

SEQ ID NO: 399657 - DNA, 25 bp, Mus musculus
ctttccccagtgagactcattaaga

SEQ ID NO: 399658 - DNA, 25 bp, Mus musculus
ctttccccagtgtgactcattaaga

SEQ ID NO: 399659 - DNA, 25 bp, Mus musculus
ctttccccataccttgtgacaaaag

SEQ ID NO: 399660 - DNA, 25 bp, Mus musculus
ctttccccatacgttgtgacaaaag

SEQ ID NO: 399661 - DNA, 25 bp, Mus musculus
ctttcccgaggcagtacagcattta

SEQ ID NO: 399662 - DNA, 25 bp, Mus musculus
ctttcccgaggctgtacagcattta

SEQ ID NO: 399663 - DNA, 25 bp, Mus musculus
ctttcccgatatctgttagacaccc

SEQ ID NO: 399664 - DNA, 25 bp, Mus musculus
ctttcccgatatgtgttagacaccc

SEQ ID NO: 399665 - DNA, 25 bp, Mus musculus
ctttcccgggatccagcagtaaaat

SEQ ID NO: 399666 - DNA, 25 bp, Mus musculus
ctttcccgggatgcagcagtaaaat

SEQ ID NO: 399667 - DNA, 25 bp, Mus musculus
ctttcccgggtgattttcattatct

SEQ ID NO: 399668 - DNA, 25 bp, Mus musculus
ctttcccgggtgtttttcattatct

SEQ ID NO: 399669 - DNA, 25 bp, Mus musculus
ctttccctaaacacagcatctggtt

SEQ ID NO: 399670 - DNA, 25 bp, Mus musculus
ctttccctaaactcagcatctggtt

SEQ ID NO: 399671 - DNA, 25 bp, Mus musculus
ctttccctaaatccagaatttttat

SEQ ID NO: 399672 - DNA, 25 bp, Mus musculus
ctttccctaaatgcagaatttttat

SEQ ID NO: 399673 - DNA, 25 bp, Mus musculus
ctttccctactgaacacggagaaat

SEQ ID NO: 399674 - DNA, 25 bp, Mus musculus
ctttccctactgatcattgtaaagg

SEQ ID NO: 399675 - DNA, 25 bp, Mus musculus
ctttccctactgtacacggagaaat

SEQ ID NO: 399676 - DNA, 25 bp, Mus musculus
ctttccctactgttcattgtaaagg

SEQ ID NO: 399677 - DNA, 25 bp, Mus musculus
ctttccctatacaccgtgaacagaa

SEQ ID NO: 399678 - DNA, 25 bp, Mus musculus
ctttccctatactccgtgaacagaa

SEQ ID NO: 399679 - DNA, 25 bp, Mus musculus
ctttccctccatagcaatatattat

SEQ ID NO: 399680 - DNA, 25 bp, Mus musculus
ctttccctccattgcaatatattat

SEQ ID NO: 399681 - DNA, 25 bp, Mus musculus
ctttccctgactccaaacttcattg

SEQ ID NO: 399682 - DNA, 25 bp, Mus musculus
ctttccctgactgcaaacttcattg

SEQ ID NO: 399683 - DNA, 25 bp, Mus musculus
ctttccctgcagattttgttttgtc

SEQ ID NO: 399684 - DNA, 25 bp, Mus musculus
ctttccctgcagtttttgttttgtc

SEQ ID NO: 399685 - DNA, 25 bp, Mus musculus
ctttccctgctcagagataggtgga

SEQ ID NO: 399686 - DNA, 25 bp, Mus musculus
ctttccctgctctgagataggtgga

SEQ ID NO: 399687 - DNA, 25 bp, Mus musculus
ctttccctggacatgcatccagaag

SEQ ID NO: 399688 - DNA, 25 bp, Mus musculus
ctttccctggacttgcatccagaag

SEQ ID NO: 399689 - DNA, 25 bp, Mus musculus
ctttccctgggcatttttgatggct

SEQ ID NO: 399690 - DNA, 25 bp, Mus musculus
ctttccctgggcttttttgatggct

SEQ ID NO: 399691 - DNA, 25 bp, Mus musculus
ctttcccttgcacagcctcgcgaag

SEQ ID NO: 399692 - DNA, 25 bp, Mus musculus
ctttcccttgcagagcctcgcgaag

SEQ ID NO: 399693 - DNA, 25 bp, Mus musculus
ctttccctttaaagacatggagctc

SEQ ID NO: 399694 - DNA, 25 bp, Mus musculus
ctttccctttaatgacatggagctc

SEQ ID NO: 399695 - DNA, 25 bp, Mus musculus
ctttccgacataacttctggggctc

SEQ ID NO: 399696 - DNA, 25 bp, Mus musculus
ctttccgacatatcttctggggctc

SEQ ID NO: 399697 - DNA, 25 bp, Mus musculus
ctttccgagatgatccgggacatga

SEQ ID NO: 399698 - DNA, 25 bp, Mus musculus
ctttccgagatgttccgggacatga

SEQ ID NO: 399699 - DNA, 25 bp, Mus musculus
ctttccgcaaaactatatacctcag

SEQ ID NO: 399700 - DNA, 25 bp, Mus musculus
ctttccgcaaaagtatatacctcag

SEQ ID NO: 399701 - DNA, 25 bp, Mus musculus
ctttccgcaggaattgccgtctgta

SEQ ID NO: 399702 - DNA, 25 bp, Mus musculus
ctttccgcaggatttgccgtctgta

SEQ ID NO: 399703 - DNA, 25 bp, Mus musculus
ctttccgcttatcaactccaatatt

SEQ ID NO: 399704 - DNA, 25 bp, Mus musculus
ctttccgcttatgaactccaatatt

SEQ ID NO: 399705 - DNA, 25 bp, Mus musculus
ctttccgcttttaggtggtggatgt

SEQ ID NO: 399706 - DNA, 25 bp, Mus musculus
ctttccgctttttggtggtggatgt

SEQ ID NO: 399707 - DNA, 25 bp, Mus musculus
ctttccggcaccatatggacatgaa

SEQ ID NO: 399708 - DNA, 25 bp, Mus musculus
ctttccggcaccttatggacatgaa

SEQ ID NO: 399709 - DNA, 25 bp, Mus musculus
ctttccggctccagttttaagcata

SEQ ID NO: 399710 - DNA, 25 bp, Mus musculus
ctttccggctcctgttttaagcata

SEQ ID NO: 399711 - DNA, 25 bp, Mus musculus
ctttccgggcgtacaagatgtcgaa

SEQ ID NO: 399712 - DNA, 25 bp, Mus musculus
ctttccgggcgttcaagatgtcgaa

SEQ ID NO: 399713 - DNA, 25 bp, Mus musculus
ctttccgtagatatgccgatggtaa

SEQ ID NO: 399714 - DNA, 25 bp, Mus musculus
ctttccgtagatttgccgatggtaa

SEQ ID NO: 399715 - DNA, 25 bp, Mus musculus
ctttccgtgctgaacggtgatgctt

SEQ ID NO: 399716 - DNA, 25 bp, Mus musculus
ctttccgtgctgtacggtgatgctt

SEQ ID NO: 399717 - DNA, 25 bp, Mus musculus
ctttccgttccgagctaaacagtat

SEQ ID NO: 399718 - DNA, 25 bp, Mus musculus
ctttccgttccgtgctaaacagtat

SEQ ID NO: 399719 - DNA, 25 bp, Mus musculus
ctttcctaacatcatctttcctttc

SEQ ID NO: 399720 - DNA, 25 bp, Mus musculus
ctttcctaacatgatctttcctttc

SEQ ID NO: 399721 - DNA, 25 bp, Mus musculus
ctttcctaaccactctactttatga

SEQ ID NO: 399722 - DNA, 25 bp, Mus musculus
ctttcctaaccagtctactttatga

SEQ ID NO: 399723 - DNA, 25 bp, Mus musculus
ctttcctaagtcagtagctattccc

SEQ ID NO: 399724 - DNA, 25 bp, Mus musculus
ctttcctaagtctgtagctattccc

SEQ ID NO: 399725 - DNA, 25 bp, Mus musculus
ctttcctacacacacgatgggtttg

SEQ ID NO: 399726 - DNA, 25 bp, Mus musculus
ctttcctacacagacgatgggtttg

SEQ ID NO: 399727 - DNA, 25 bp, Mus musculus
ctttcctacagaaagcttctgtaat

SEQ ID NO: 399728 - DNA, 25 bp, Mus musculus
ctttcctacagatagcttctgtaat

SEQ ID NO: 399729 - DNA, 25 bp, Mus musculus
ctttcctactttactattagcgcca

SEQ ID NO: 399730 - DNA, 25 bp, Mus musculus
ctttcctacttttctattagcgcca

SEQ ID NO: 399731 - DNA, 25 bp, Mus musculus
ctttcctagattcacttacacacat

SEQ ID NO: 399732 - DNA, 25 bp, Mus musculus
ctttcctagattgacttacacacat

SEQ ID NO: 399733 - DNA, 25 bp, Mus musculus
ctttcctagcgaagcttgttgctga

SEQ ID NO: 399734 - DNA, 25 bp, Mus musculus
ctttcctagcgatgcttgttgctga

SEQ ID NO: 399735 - DNA, 25 bp, Mus musculus
ctttcctatgtcctgtgacctacaa

SEQ ID NO: 399736 - DNA, 25 bp, Mus musculus
ctttcctatgtcgtgtgacctacaa

SEQ ID NO: 399737 - DNA, 25 bp, Mus musculus
ctttcctcagtgactatggttagga

SEQ ID NO: 399738 - DNA, 25 bp, Mus musculus
ctttcctcagtgtctatggttagga

SEQ ID NO: 399739 - DNA, 25 bp, Mus musculus
ctttcctcctgtcctagtagaacaa

SEQ ID NO: 399740 - DNA, 25 bp, Mus musculus
ctttcctcctgtgctagtagaacaa

SEQ ID NO: 399741 - DNA, 25 bp, Mus musculus
ctttcctcggtcagctgttcttcca

SEQ ID NO: 399742 - DNA, 25 bp, Mus musculus
ctttcctcggtctgctgttcttcca

SEQ ID NO: 399743 - DNA, 25 bp, Mus musculus
ctttcctctaatagggttccttcag

SEQ ID NO: 399744 - DNA, 25 bp, Mus musculus
ctttcctctaattgggttccttcag

SEQ ID NO: 399745 - DNA, 25 bp, Mus musculus
ctttcctctcaaagggtgtgtacac

SEQ ID NO: 399746 - DNA, 25 bp, Mus musculus
ctttcctctcaatgggtgtgtacac

SEQ ID NO: 399747 - DNA, 25 bp, Mus musculus
ctttcctctctaatttgtgcatttg

SEQ ID NO: 399748 - DNA, 25 bp, Mus musculus
ctttcctctctattttgtgcatttg

SEQ ID NO: 399749 - DNA, 25 bp, Mus musculus
ctttcctctggaattctaactgtat

SEQ ID NO: 399750 - DNA, 25 bp, Mus musculus
ctttcctctggatttctaactgtat

SEQ ID NO: 399751 - DNA, 25 bp, Mus musculus
ctttcctgaaacaaagctggttaca

SEQ ID NO: 399752 - DNA, 25 bp, Mus musculus
ctttcctgaaactaagctggttaca

SEQ ID NO: 399753 - DNA, 25 bp, Mus musculus
ctttcctgaactaacctttgtgaca

SEQ ID NO: 399754 - DNA, 25 bp, Mus musculus
ctttcctgaacttacctttgtgaca

SEQ ID NO: 399755 - DNA, 25 bp, Mus musculus
ctttcctgaatcaatcctctttggt

SEQ ID NO: 399756 - DNA, 25 bp, Mus musculus
ctttcctgaatctatcctctttggt

SEQ ID NO: 399757 - DNA, 25 bp, Mus musculus
ctttcctgagaaaggcacagccaag

SEQ ID NO: 399758 - DNA, 25 bp, Mus musculus
ctttcctgagaatggcacagccaag

SEQ ID NO: 399759 - DNA, 25 bp, Mus musculus
ctttcctgagtccaagccagttttg

SEQ ID NO: 399760 - DNA, 25 bp, Mus musculus
ctttcctgagtcgaagccagttttg

SEQ ID NO: 399761 - DNA, 25 bp, Mus musculus
ctttcctgcaatcacgtattccatg

SEQ ID NO: 399762 - DNA, 25 bp, Mus musculus
ctttcctgcaatgacgtattccatg

SEQ ID NO: 399763 - DNA, 25 bp, Mus musculus
ctttcctgcatcataaacacacttg

SEQ ID NO: 399764 - DNA, 25 bp, Mus musculus
ctttcctgcatcttaaacacacttg

SEQ ID NO: 399765 - DNA, 25 bp, Mus musculus
ctttcctgccacagattcagtgagt

SEQ ID NO: 399766 - DNA, 25 bp, Mus musculus
ctttcctgccactgattcagtgagt

SEQ ID NO: 399767 - DNA, 25 bp, Mus musculus
ctttcctgccccaagttaatggcat

SEQ ID NO: 399768 - DNA, 25 bp, Mus musculus
ctttcctgcccctagttaatggcat

SEQ ID NO: 399769 - DNA, 25 bp, Mus musculus
ctttcctggcgtagtttaaagcagc

SEQ ID NO: 399770 - DNA, 25 bp, Mus musculus
ctttcctggcgttgtttaaagcagc

SEQ ID NO: 399771 - DNA, 25 bp, Mus musculus
ctttcctgggacattctgtattttg

SEQ ID NO: 399772 - DNA, 25 bp, Mus musculus
ctttcctgggactttctgtattttg

SEQ ID NO: 399773 - DNA, 25 bp, Mus musculus
ctttcctgtcatcgcttttggtaaa

SEQ ID NO: 399774 - DNA, 25 bp, Mus musculus
ctttcctgtcatggcttttggtaaa

SEQ ID NO: 399775 - DNA, 25 bp, Mus musculus
ctttcctgtcctcaatttgtcttca

SEQ ID NO: 399776 - DNA, 25 bp, Mus musculus
ctttcctgtcctgaatttgtcttca

SEQ ID NO: 399777 - DNA, 25 bp, Mus musculus
ctttcctgtgacatcatgctcagat

SEQ ID NO: 399778 - DNA, 25 bp, Mus musculus
ctttcctgtgacttcatgctcagat

SEQ ID NO: 399779 - DNA, 25 bp, Mus musculus
ctttcctgtttcatggctgaagatg

SEQ ID NO: 399780 - DNA, 25 bp, Mus musculus
ctttcctgtttcttggctgaagatg

SEQ ID NO: 399781 - DNA, 25 bp, Mus musculus
ctttccttaagaccctattgatcag

SEQ ID NO: 399782 - DNA, 25 bp, Mus musculus
ctttccttaagagcctattgatcag

SEQ ID NO: 399783 - DNA, 25 bp, Mus musculus
ctttccttacctcatagcttgttta

SEQ ID NO: 399784 - DNA, 25 bp, Mus musculus
ctttccttacctgatagcttgttta

SEQ ID NO: 399785 - DNA, 25 bp, Mus musculus
ctttccttacttccatttccagatt

SEQ ID NO: 399786 - DNA, 25 bp, Mus musculus
ctttccttacttgcatttccagatt

SEQ ID NO: 399787 - DNA, 25 bp, Mus musculus
ctttccttatctctggtctactgtg

SEQ ID NO: 399788 - DNA, 25 bp, Mus musculus
ctttccttatctgtggtctactgtg

SEQ ID NO: 399789 - DNA, 25 bp, Mus musculus
ctttccttcacacaatgctggcaca

SEQ ID NO: 399790 - DNA, 25 bp, Mus musculus
ctttccttcacagaatgctggcaca

SEQ ID NO: 399791 - DNA, 25 bp, Mus musculus
ctttccttcagcacaaggccagagt

SEQ ID NO: 399792 - DNA, 25 bp, Mus musculus
ctttccttcagctcaaggccagagt

SEQ ID NO: 399793 - DNA, 25 bp, Mus musculus
ctttccttcattatcatcgtcatta

SEQ ID NO: 399794 - DNA, 25 bp, Mus musculus
ctttccttcattttcatcgtcatta

SEQ ID NO: 399795 - DNA, 25 bp, Mus musculus
ctttccttccatattgcaaagcctg

SEQ ID NO: 399796 - DNA, 25 bp, Mus musculus
ctttccttccattttgcaaagcctg

SEQ ID NO: 399797 - DNA, 25 bp, Mus musculus
ctttccttccctagaacaacagcaa

SEQ ID NO: 399798 - DNA, 25 bp, Mus musculus
ctttccttccctcatggatgtgggt

SEQ ID NO: 399799 - DNA, 25 bp, Mus musculus
ctttccttccctgatggatgtgggt

SEQ ID NO: 399800 - DNA, 25 bp, Mus musculus
ctttccttcccttgaacaacagcaa

SEQ ID NO: 399801 - DNA, 25 bp, Mus musculus
ctttccttcctaattgcgggtgatg

SEQ ID NO: 399802 - DNA, 25 bp, Mus musculus
ctttccttcctatttgcgggtgatg

SEQ ID NO: 399803 - DNA, 25 bp, Mus musculus
ctttccttctttcaatcatactcag

SEQ ID NO: 399804 - DNA, 25 bp, Mus musculus
ctttccttctttgaatcatactcag

SEQ ID NO: 399805 - DNA, 25 bp, Mus musculus
ctttccttgagtcagctgtttcatg

SEQ ID NO: 399806 - DNA, 25 bp, Mus musculus
ctttccttgagtgagctgtttcatg

SEQ ID NO: 399807 - DNA, 25 bp, Mus musculus
ctttccttgatactacactatttgt

SEQ ID NO: 399808 - DNA, 25 bp, Mus musculus
ctttccttgatagtacactatttgt

SEQ ID NO: 399809 - DNA, 25 bp, Mus musculus
ctttccttgctacagggcatttttg

SEQ ID NO: 399810 - DNA, 25 bp, Mus musculus
ctttccttgctagagggcatttttg

SEQ ID NO: 399811 - DNA, 25 bp, Mus musculus
ctttccttgctgaggcgtaagctaa

SEQ ID NO: 399812 - DNA, 25 bp, Mus musculus
ctttccttgctgagtaacctcagga

SEQ ID NO: 399813 - DNA, 25 bp, Mus musculus
ctttccttgctgtggcgtaagctaa

SEQ ID NO: 399814 - DNA, 25 bp, Mus musculus
ctttccttgctgtgtaacctcagga

SEQ ID NO: 399815 - DNA, 25 bp, Mus musculus
ctttccttggctattatcatgctaa

SEQ ID NO: 399816 - DNA, 25 bp, Mus musculus
ctttccttggcttttatcatgctaa

SEQ ID NO: 399817 - DNA, 25 bp, Mus musculus
ctttccttgtggagcatctgtggtt

SEQ ID NO: 399818 - DNA, 25 bp, Mus musculus
ctttccttgtggtgcatctgtggtt

SEQ ID NO: 399819 - DNA, 25 bp, Mus musculus
ctttccttgttgaggcaaaaactag

SEQ ID NO: 399820 - DNA, 25 bp, Mus musculus
ctttccttgttgtggcaaaaactag

SEQ ID NO: 399821 - DNA, 25 bp, Mus musculus
ctttcctttcagatagtcatgtata

SEQ ID NO: 399822 - DNA, 25 bp, Mus musculus
ctttcctttcagttagtcatgtata

SEQ ID NO: 399823 - DNA, 25 bp, Mus musculus
ctttcctttgccaatcccagaataa

SEQ ID NO: 399824 - DNA, 25 bp, Mus musculus
ctttcctttgcctatcccagaataa

SEQ ID NO: 399825 - DNA, 25 bp, Mus musculus
ctttcgaaacttaccaggtgatcaa

SEQ ID NO: 399826 - DNA, 25 bp, Mus musculus
ctttcgaaactttccaggtgatcaa

SEQ ID NO: 399827 - DNA, 25 bp, Mus musculus
ctttcgaatctgaccccaagaggaa

SEQ ID NO: 399828 - DNA, 25 bp, Mus musculus
ctttcgaatctgtccccaagaggaa

SEQ ID NO: 399829 - DNA, 25 bp, Mus musculus
ctttcgaatggcactaccttaggga

SEQ ID NO: 399830 - DNA, 25 bp, Mus musculus
ctttcgaatggctctaccttaggga

SEQ ID NO: 399831 - DNA, 25 bp, Mus musculus
ctttcgagatgacgcagctggctat

SEQ ID NO: 399832 - DNA, 25 bp, Mus musculus
ctttcgagatgaggcagctggctat

SEQ ID NO: 399833 - DNA, 25 bp, Mus musculus
ctttcgagccgtagagccagggctg

SEQ ID NO: 399834 - DNA, 25 bp, Mus musculus
ctttcgagccgttgagccagggctg

SEQ ID NO: 399835 - DNA, 25 bp, Mus musculus
ctttcgagtggcagagattgcaggc

SEQ ID NO: 399836 - DNA, 25 bp, Mus musculus
ctttcgagtggctgagattgcaggc

SEQ ID NO: 399837 - DNA, 25 bp, Mus musculus
ctttcgatgaggcatgtagaccagg

SEQ ID NO: 399838 - DNA, 25 bp, Mus musculus
ctttcgatgagggatgtagaccagg

SEQ ID NO: 399839 - DNA, 25 bp, Mus musculus
ctttcgatttttcgcgttcagtagt

SEQ ID NO: 399840 - DNA, 25 bp, Mus musculus
ctttcgatttttggcgttcagtagt

SEQ ID NO: 399841 - DNA, 25 bp, Mus musculus
ctttcgcagagtccatttatctgta

SEQ ID NO: 399842 - DNA, 25 bp, Mus musculus
ctttcgcagagtgcatttatctgta

SEQ ID NO: 399843 - DNA, 25 bp, Mus musculus
ctttcgccacctatgggcagaagac

SEQ ID NO: 399844 - DNA, 25 bp, Mus musculus
ctttcgccacctttgggcagaagac

SEQ ID NO: 399845 - DNA, 25 bp, Mus musculus
ctttcgccagcgcttccggcagttt

SEQ ID NO: 399846 - DNA, 25 bp, Mus musculus
ctttcgccagcggttccggcagttt

SEQ ID NO: 399847 - DNA, 25 bp, Mus musculus
ctttcgccattgcaccagagtatga

SEQ ID NO: 399848 - DNA, 25 bp, Mus musculus
ctttcgccattggaccagagtatga

SEQ ID NO: 399849 - DNA, 25 bp, Mus musculus
ctttcgcctgctcggaatgtggcaa

SEQ ID NO: 399850 - DNA, 25 bp, Mus musculus
ctttcgcctgctgggaatgtggcaa

SEQ ID NO: 399851 - DNA, 25 bp, Mus musculus
ctttcggagcatagtggagcacgtt

SEQ ID NO: 399852 - DNA, 25 bp, Mus musculus
ctttcggagcattgtggagcacgtt

SEQ ID NO: 399853 - DNA, 25 bp, Mus musculus
ctttcggcaacactatggacggcat

SEQ ID NO: 399854 - DNA, 25 bp, Mus musculus
ctttcggcaacagtatggacggcat

SEQ ID NO: 399855 - DNA, 25 bp, Mus musculus
ctttcggcagataactcagagcatg

SEQ ID NO: 399856 - DNA, 25 bp, Mus musculus
ctttcggcagattactcagagcatg

SEQ ID NO: 399857 - DNA, 25 bp, Mus musculus
ctttcggcatatacgtctttgatag

SEQ ID NO: 399858 - DNA, 25 bp, Mus musculus
ctttcggcatattcgtctttgatag

SEQ ID NO: 399859 - DNA, 25 bp, Mus musculus
ctttcggcttagattcaaggtcact

SEQ ID NO: 399860 - DNA, 25 bp, Mus musculus
ctttcggcttagtttcaaggtcact

SEQ ID NO: 399861 - DNA, 25 bp, Mus musculus
ctttcgggctttatcaattctgaat

SEQ ID NO: 399862 - DNA, 25 bp, Mus musculus
ctttcgggctttttcaattctgaat

SEQ ID NO: 399863 - DNA, 25 bp, Mus musculus
ctttcggtcacgatcttatttgtgg

SEQ ID NO: 399864 - DNA, 25 bp, Mus musculus
ctttcggtcacgttcttatttgtgg

SEQ ID NO: 399865 - DNA, 25 bp, Mus musculus
ctttcgtacaaactctgaatgtggt

SEQ ID NO: 399866 - DNA, 25 bp, Mus musculus
ctttcgtacaaagtctgaatgtggt

SEQ ID NO: 399867 - DNA, 25 bp, Mus musculus
ctttcgtacagtcctcgctcaaggg

SEQ ID NO: 399868 - DNA, 25 bp, Mus musculus
ctttcgtacagtgctcgctcaaggg

SEQ ID NO: 399869 - DNA, 25 bp, Mus musculus
ctttcgtagggcaaaggagcaccag

SEQ ID NO: 399870 - DNA, 25 bp, Mus musculus
ctttcgtagggctaaggagcaccag

SEQ ID NO: 399871 - DNA, 25 bp, Mus musculus
ctttcgtctttcaagtgccatgata

SEQ ID NO: 399872 - DNA, 25 bp, Mus musculus
ctttcgtctttctagtgccatgata

SEQ ID NO: 399873 - DNA, 25 bp, Mus musculus
ctttcgtgatgtccggtcgtggcaa

SEQ ID NO: 399874 - DNA, 25 bp, Mus musculus
ctttcgtgatgtgcggtcgtggcaa

SEQ ID NO: 399875 - DNA, 25 bp, Mus musculus
ctttcgttcctactcacttgggagt

SEQ ID NO: 399876 - DNA, 25 bp, Mus musculus
ctttcgttcctagtcacttgggagt

SEQ ID NO: 399877 - DNA, 25 bp, Mus musculus
ctttcgttgctgctgatagttggta

SEQ ID NO: 399878 - DNA, 25 bp, Mus musculus
ctttcgttgctggtgatagttggta

SEQ ID NO: 399879 - DNA, 25 bp, Mus musculus
ctttcgtttcttcttggtttgcaga

SEQ ID NO: 399880 - DNA, 25 bp, Mus musculus
ctttcgtttcttgttggtttgcaga

SEQ ID NO: 399881 - DNA, 25 bp, Mus musculus
ctttctaaagcaccaaagcccagct

SEQ ID NO: 399882 - DNA, 25 bp, Mus musculus
ctttctaaagcagcaaagcccagct

SEQ ID NO: 399883 - DNA, 25 bp, Mus musculus
ctttctaagtagaccctcaactggg

SEQ ID NO: 399884 - DNA, 25 bp, Mus musculus
ctttctaagtagtccctcaactggg

SEQ ID NO: 399885 - DNA, 25 bp, Mus musculus
ctttctaagtgacctgggatcctga

SEQ ID NO: 399886 - DNA, 25 bp, Mus musculus
ctttctaagtgagctgggatcctga

SEQ ID NO: 399887 - DNA, 25 bp, Mus musculus
ctttctaatgttatgcgctgataag

SEQ ID NO: 399888 - DNA, 25 bp, Mus musculus
ctttctaatgttttgcgctgataag

SEQ ID NO: 399889 - DNA, 25 bp, Mus musculus
ctttctacaaaacagtgagtaccaa

SEQ ID NO: 399890 - DNA, 25 bp, Mus musculus
ctttctacaaaagagtgagtaccaa

SEQ ID NO: 399891 - DNA, 25 bp, Mus musculus
ctttctacagtcaaagctcaatgct

SEQ ID NO: 399892 - DNA, 25 bp, Mus musculus
ctttctacagtctaagctcaatgct

SEQ ID NO: 399893 - DNA, 25 bp, Mus musculus
ctttctacagttcattggtgctcca

SEQ ID NO: 399894 - DNA, 25 bp, Mus musculus
ctttctacagttgattggtgctcca

SEQ ID NO: 399895 - DNA, 25 bp, Mus musculus
ctttctaccagtaggtatggctgac

SEQ ID NO: 399896 - DNA, 25 bp, Mus musculus
ctttctaccagttggtatggctgac

SEQ ID NO: 399897 - DNA, 25 bp, Mus musculus
ctttctaccattctagcttcaaggt

SEQ ID NO: 399898 - DNA, 25 bp, Mus musculus
ctttctaccattgtagcttcaaggt

SEQ ID NO: 399899 - DNA, 25 bp, Mus musculus
ctttctacccaaagtgttgtcctta

SEQ ID NO: 399900 - DNA, 25 bp, Mus musculus
ctttctacccaatgtgttgtcctta

SEQ ID NO: 399901 - DNA, 25 bp, Mus musculus
ctttctaccctgaattgttggattt

SEQ ID NO: 399902 - DNA, 25 bp, Mus musculus
ctttctaccctgtattgttggattt

SEQ ID NO: 399903 - DNA, 25 bp, Mus musculus
ctttctacctttagatattgggatt

SEQ ID NO: 399904 - DNA, 25 bp, Mus musculus
ctttctaccttttgatattgggatt

SEQ ID NO: 399905 - DNA, 25 bp, Mus musculus
ctttctacgctcactggcagagttt

SEQ ID NO: 399906 - DNA, 25 bp, Mus musculus
ctttctacgctctctggcagagttt

SEQ ID NO: 399907 - DNA, 25 bp, Mus musculus
ctttctactttgcaagtctacagag

SEQ ID NO: 399908 - DNA, 25 bp, Mus musculus
ctttctactttggaagtctacagag

SEQ ID NO: 399909 - DNA, 25 bp, Mus musculus
ctttctagatgaccagtgtgacaca

SEQ ID NO: 399910 - DNA, 25 bp, Mus musculus
ctttctagatgagcagtgtgacaca

SEQ ID NO: 399911 - DNA, 25 bp, Mus musculus
ctttctagcttccagtctaaccaaa

SEQ ID NO: 399912 - DNA, 25 bp, Mus musculus
ctttctagcttcgagtctaaccaaa

SEQ ID NO: 399913 - DNA, 25 bp, Mus musculus
ctttctatccttagccttaccataa

SEQ ID NO: 399914 - DNA, 25 bp, Mus musculus
ctttctatcctttgccttaccataa

SEQ ID NO: 399915 - DNA, 25 bp, Mus musculus
ctttctatctccatcattatcaaca

SEQ ID NO: 399916 - DNA, 25 bp, Mus musculus
ctttctatctccttcattatcaaca

SEQ ID NO: 399917 - DNA, 25 bp, Mus musculus
ctttctatctggaatgtctgcaggt

SEQ ID NO: 399918 - DNA, 25 bp, Mus musculus
ctttctatctggtatgtctgcaggt

SEQ ID NO: 399919 - DNA, 25 bp, Mus musculus
ctttctattttacctcgtctttata

SEQ ID NO: 399920 - DNA, 25 bp, Mus musculus
ctttctattttagctcgtctttata

SEQ ID NO: 399921 - DNA, 25 bp, Mus musculus
ctttctcaaactaagcaggcaggat

SEQ ID NO: 399922 - DNA, 25 bp, Mus musculus
ctttctcaaacttagcaggcaggat

SEQ ID NO: 399923 - DNA, 25 bp, Mus musculus
ctttctcacttgaagggtgtcctgg

SEQ ID NO: 399924 - DNA, 25 bp, Mus musculus
ctttctcacttgtagggtgtcctgg

SEQ ID NO: 399925 - DNA, 25 bp, Mus musculus
ctttctcagagactctttcctgtgt

SEQ ID NO: 399926 - DNA, 25 bp, Mus musculus
ctttctcagagagtctttcctgtgt

SEQ ID NO: 399927 - DNA, 25 bp, Mus musculus
ctttctcagagcaggagacattttt

SEQ ID NO: 399928 - DNA, 25 bp, Mus musculus
ctttctcagagctggagacattttt

SEQ ID NO: 399929 - DNA, 25 bp, Mus musculus
ctttctcagattacacagtttgtat

SEQ ID NO: 399930 - DNA, 25 bp, Mus musculus
ctttctcagatttcacagtttgtat

SEQ ID NO: 399931 - DNA, 25 bp, Mus musculus
ctttctcagcgaagggaggcatcct

SEQ ID NO: 399932 - DNA, 25 bp, Mus musculus
ctttctcagcgatgggaggcatcct

SEQ ID NO: 399933 - DNA, 25 bp, Mus musculus
ctttctcaggaactcaatttaacta

SEQ ID NO: 399934 - DNA, 25 bp, Mus musculus
ctttctcaggaagtcaatttaacta

SEQ ID NO: 399935 - DNA, 25 bp, Mus musculus
ctttctcagtgcaggtgacgaacat

SEQ ID NO: 399936 - DNA, 25 bp, Mus musculus
ctttctcagtgctggtgacgaacat

SEQ ID NO: 399937 - DNA, 25 bp, Mus musculus
ctttctcagtgtctgtatggtccat

SEQ ID NO: 399938 - DNA, 25 bp, Mus musculus
ctttctcagtgtgtgtatggtccat

SEQ ID NO: 399939 - DNA, 25 bp, Mus musculus
ctttctcataggattggtgcaggat

SEQ ID NO: 399940 - DNA, 25 bp, Mus musculus
ctttctcataggtttggtgcaggat

SEQ ID NO: 399941 - DNA, 25 bp, Mus musculus
ctttctcatattaaaacttgggtca

SEQ ID NO: 399942 - DNA, 25 bp, Mus musculus
ctttctcatatttaaacttgggtca

SEQ ID NO: 399943 - DNA, 25 bp, Mus musculus
ctttctcatcccagattaacagtga

SEQ ID NO: 399944 - DNA, 25 bp, Mus musculus
ctttctcatccctgattaacagtga

SEQ ID NO: 399945 - DNA, 25 bp, Mus musculus
ctttctcatcctacattatccattt

SEQ ID NO: 399946 - DNA, 25 bp, Mus musculus
ctttctcatccttcattatccattt

SEQ ID NO: 399947 - DNA, 25 bp, Mus musculus
ctttctcatttgacagctctgttgg

SEQ ID NO: 399948 - DNA, 25 bp, Mus musculus
ctttctcatttgtcagctctgttgg

SEQ ID NO: 399949 - DNA, 25 bp, Mus musculus
ctttctcattttcgcatcgttaaga

SEQ ID NO: 399950 - DNA, 25 bp, Mus musculus
ctttctcattttggcatcgttaaga

SEQ ID NO: 399951 - DNA, 25 bp, Mus musculus
ctttctccaagcaatatacaattat

SEQ ID NO: 399952 - DNA, 25 bp, Mus musculus
ctttctccaagctatatacaattat

SEQ ID NO: 399953 - DNA, 25 bp, Mus musculus
ctttctccacttcatggcacaggag

SEQ ID NO: 399954 - DNA, 25 bp, Mus musculus
ctttctccacttgatggcacaggag

SEQ ID NO: 399955 - DNA, 25 bp, Mus musculus
ctttctccaggaatccatttctatc

SEQ ID NO: 399956 - DNA, 25 bp, Mus musculus
ctttctccaggattccatttctatc

SEQ ID NO: 399957 - DNA, 25 bp, Mus musculus
ctttctcccatcaggtttcaccaaa

SEQ ID NO: 399958 - DNA, 25 bp, Mus musculus
ctttctcccatctggtttcaccaaa

SEQ ID NO: 399959 - DNA, 25 bp, Mus musculus
ctttctcccattattaatgccctga

SEQ ID NO: 399960 - DNA, 25 bp, Mus musculus
ctttctcccatttttaatgccctga

SEQ ID NO: 399961 - DNA, 25 bp, Mus musculus
ctttctccgcggagtggtaaattat

SEQ ID NO: 399962 - DNA, 25 bp, Mus musculus
ctttctccgcggtgtggtaaattat

SEQ ID NO: 399963 - DNA, 25 bp, Mus musculus
ctttctcctgttcccttatctggaa

SEQ ID NO: 399964 - DNA, 25 bp, Mus musculus
ctttctcctgttgccttatctggaa

SEQ ID NO: 399965 - DNA, 25 bp, Mus musculus
ctttctccttgtattctcgtaggga

SEQ ID NO: 399966 - DNA, 25 bp, Mus musculus
ctttctccttgttttctcgtaggga

SEQ ID NO: 399967 - DNA, 25 bp, Mus musculus
ctttctcctttcaattcactctaga

SEQ ID NO: 399968 - DNA, 25 bp, Mus musculus
ctttctcctttctattcactctaga

SEQ ID NO: 399969 - DNA, 25 bp, Mus musculus
ctttctcggcccatggctgtcttca

SEQ ID NO: 399970 - DNA, 25 bp, Mus musculus
ctttctcggcccttggctgtcttca

SEQ ID NO: 399971 - DNA, 25 bp, Mus musculus
ctttctcgggttaactgtcgatgga

SEQ ID NO: 399972 - DNA, 25 bp, Mus musculus
ctttctcgggtttactgtcgatgga

SEQ ID NO: 399973 - DNA, 25 bp, Mus musculus
ctttctctaatcaagctggcagggc

SEQ ID NO: 399974 - DNA, 25 bp, Mus musculus
ctttctctaatctagctggcagggc

SEQ ID NO: 399975 - DNA, 25 bp, Mus musculus
ctttctctagagactgtttccactt

SEQ ID NO: 399976 - DNA, 25 bp, Mus musculus
ctttctctagagtctgtttccactt

SEQ ID NO: 399977 - DNA, 25 bp, Mus musculus
ctttctctagatcaaagcttgcggc

SEQ ID NO: 399978 - DNA, 25 bp, Mus musculus
ctttctctagatgaaagcttgcggc

SEQ ID NO: 399979 - DNA, 25 bp, Mus musculus
ctttctctagctccattactgttaa

SEQ ID NO: 399980 - DNA, 25 bp, Mus musculus
ctttctctagctgcattactgttaa

SEQ ID NO: 399981 - DNA, 25 bp, Mus musculus
ctttctctccacagggcacttgagg

SEQ ID NO: 399982 - DNA, 25 bp, Mus musculus
ctttctctccactgggcacttgagg

SEQ ID NO: 399983 - DNA, 25 bp, Mus musculus
ctttctctccatagacctttgtgtt

SEQ ID NO: 399984 - DNA, 25 bp, Mus musculus
ctttctctccattgacctttgtgtt

SEQ ID NO: 399985 - DNA, 25 bp, Mus musculus
ctttctctccccattcaaagcatgt

SEQ ID NO: 399986 - DNA, 25 bp, Mus musculus
ctttctctcccctttcaaagcatgt

SEQ ID NO: 399987 - DNA, 25 bp, Mus musculus
ctttctctccggattcagcaaattg

SEQ ID NO: 399988 - DNA, 25 bp, Mus musculus
ctttctctccggtttcagcaaattg

SEQ ID NO: 399989 - DNA, 25 bp, Mus musculus
ctttctctctaacaagtgcctcaaa

SEQ ID NO: 399990 - DNA, 25 bp, Mus musculus
ctttctctctaagaagtgcctcaaa

SEQ ID NO: 399991 - DNA, 25 bp, Mus musculus
ctttctctctgcacttaggattggt

SEQ ID NO: 399992 - DNA, 25 bp, Mus musculus
ctttctctctgcagttcaaaacaag

SEQ ID NO: 399993 - DNA, 25 bp, Mus musculus
ctttctctctgctcttaggattggt

SEQ ID NO: 399994 - DNA, 25 bp, Mus musculus
ctttctctctgctgttcaaaacaag

SEQ ID NO: 399995 - DNA, 25 bp, Mus musculus
ctttctctctttcatcctcaagaat

SEQ ID NO: 399996 - DNA, 25 bp, Mus musculus
ctttctctctttgatcctcaagaat

SEQ ID NO: 399997 - DNA, 25 bp, Mus musculus
ctttctctgaagatggcacaggagg

SEQ ID NO: 399998 - DNA, 25 bp, Mus musculus
ctttctctgaagttggcacaggagg

SEQ ID NO: 399999 - DNA, 25 bp, Mus musculus
ctttctctgaccactgaatcgagtc

SEQ ID NO: 400000 - DNA, 25 bp, Mus musculus
ctttctctgaccactttgttttatg

SEQ ID NO: 400001 - DNA, 25 bp, Mus musculus
ctttctctgacctctgaatcgagtc

SEQ ID NO: 400002 - DNA, 25 bp, Mus musculus
ctttctctgacctctttgttttatg

SEQ ID NO: 400003 - DNA, 25 bp, Mus musculus
ctttctctgccgagtacaggtaaca

SEQ ID NO: 400004 - DNA, 25 bp, Mus musculus
ctttctctgccgtgtacaggtaaca

SEQ ID NO: 400005 - DNA, 25 bp, Mus musculus
ctttctctggctaagtaggtagatg

SEQ ID NO: 400006 - DNA, 25 bp, Mus musculus
ctttctctggcttagtaggtagatg

SEQ ID NO: 400007 - DNA, 25 bp, Mus musculus
ctttctctgggcatttacagttggc

SEQ ID NO: 400008 - DNA, 25 bp, Mus musculus
ctttctctgggcttttacagttggc

SEQ ID NO: 400009 - DNA, 25 bp, Mus musculus
ctttctctgtctcggattgaactga

SEQ ID NO: 400010 - DNA, 25 bp, Mus musculus
ctttctctgtctgggattgaactga

SEQ ID NO: 400011 - DNA, 25 bp, Mus musculus
ctttctcttcatcccatgtgtagta

SEQ ID NO: 400012 - DNA, 25 bp, Mus musculus
ctttctcttcatgccatgtgtagta

SEQ ID NO: 400013 - DNA, 25 bp, Mus musculus
ctttctcttccccaagaatacacag

SEQ ID NO: 400014 - DNA, 25 bp, Mus musculus
ctttctcttcccgaagaatacacag

SEQ ID NO: 400015 - DNA, 25 bp, Mus musculus
ctttctcttcgtactttagctgtag

SEQ ID NO: 400016 - DNA, 25 bp, Mus musculus
ctttctcttcgttctttagctgtag

SEQ ID NO: 400017 - DNA, 25 bp, Mus musculus
ctttctcttggcagcagtggtcttt

SEQ ID NO: 400018 - DNA, 25 bp, Mus musculus
ctttctcttggctgcagtggtcttt

SEQ ID NO: 400019 - DNA, 25 bp, Mus musculus
ctttctctttacactgtttgttaca

SEQ ID NO: 400020 - DNA, 25 bp, Mus musculus
ctttctctttactctgtttgttaca

SEQ ID NO: 400021 - DNA, 25 bp, Mus musculus
ctttctctttgacatggccacagga

SEQ ID NO: 400022 - DNA, 25 bp, Mus musculus
ctttctctttgagatggccacagga

SEQ ID NO: 400023 - DNA, 25 bp, Mus musculus
ctttctgaaaaacagcgatgacttc

SEQ ID NO: 400024 - DNA, 25 bp, Mus musculus
ctttctgaaaaagagcgatgacttc

SEQ ID NO: 400025 - DNA, 25 bp, Mus musculus
ctttctgaacaaccaagccaggtat

SEQ ID NO: 400026 - DNA, 25 bp, Mus musculus
ctttctgaacaagcaagccaggtat

SEQ ID NO: 400027 - DNA, 25 bp, Mus musculus
ctttctgaacccacacatcttaaga

SEQ ID NO: 400028 - DNA, 25 bp, Mus musculus
ctttctgaaccctcacatcttaaga

SEQ ID NO: 400029 - DNA, 25 bp, Mus musculus
ctttctgaactcctgttgtaatggc

SEQ ID NO: 400030 - DNA, 25 bp, Mus musculus
ctttctgaactcgtgttgtaatggc

SEQ ID NO: 400031 - DNA, 25 bp, Mus musculus
ctttctgaagctctggacttggatg

SEQ ID NO: 400032 - DNA, 25 bp, Mus musculus
ctttctgaagctgtggacttggatg

SEQ ID NO: 400033 - DNA, 25 bp, Mus musculus
ctttctgacactatcacttttgcag

SEQ ID NO: 400034 - DNA, 25 bp, Mus musculus
ctttctgacactttcacttttgcag

SEQ ID NO: 400035 - DNA, 25 bp, Mus musculus
ctttctgacccgagaggtacatttg

SEQ ID NO: 400036 - DNA, 25 bp, Mus musculus
ctttctgacccgtgaggtacatttg

SEQ ID NO: 400037 - DNA, 25 bp, Mus musculus
ctttctgaccttccttaggtaccag

SEQ ID NO: 400038 - DNA, 25 bp, Mus musculus
ctttctgaccttgcttaggtaccag

SEQ ID NO: 400039 - DNA, 25 bp, Mus musculus
ctttctgactaaagccgagggtggc

SEQ ID NO: 400040 - DNA, 25 bp, Mus musculus
ctttctgactaatgccgagggtggc

SEQ ID NO: 400041 - DNA, 25 bp, Mus musculus
ctttctgactttcttatcctttaat

SEQ ID NO: 400042 - DNA, 25 bp, Mus musculus
ctttctgactttgttatcctttaat

SEQ ID NO: 400043 - DNA, 25 bp, Mus musculus
ctttctgagaggaccacgcttatgc

SEQ ID NO: 400044 - DNA, 25 bp, Mus musculus
ctttctgagaggtccacgcttatgc

SEQ ID NO: 400045 - DNA, 25 bp, Mus musculus
ctttctgagctcatcctacagggaa

SEQ ID NO: 400046 - DNA, 25 bp, Mus musculus
ctttctgagctcttcctacagggaa

SEQ ID NO: 400047 - DNA, 25 bp, Mus musculus
ctttctgagggaagttagtgccaaa

SEQ ID NO: 400048 - DNA, 25 bp, Mus musculus
ctttctgagggatgttagtgccaaa

SEQ ID NO: 400049 - DNA, 25 bp, Mus musculus
ctttctgagggtacttcccacaatg

SEQ ID NO: 400050 - DNA, 25 bp, Mus musculus
ctttctgagggttcttcccacaatg

SEQ ID NO: 400051 - DNA, 25 bp, Mus musculus
ctttctgatcccataatgttcctta

SEQ ID NO: 400052 - DNA, 25 bp, Mus musculus
ctttctgatcccttaatgttcctta

SEQ ID NO: 400053 - DNA, 25 bp, Mus musculus
ctttctgatgtgagagtgctagcta

SEQ ID NO: 400054 - DNA, 25 bp, Mus musculus
ctttctgatgtgtgagtgctagcta

SEQ ID NO: 400055 - DNA, 25 bp, Mus musculus
ctttctgatgttctatggctgataa

SEQ ID NO: 400056 - DNA, 25 bp, Mus musculus
ctttctgatgttgtatggctgataa

SEQ ID NO: 400057 - DNA, 25 bp, Mus musculus
ctttctgattctaggtcaatttggt

SEQ ID NO: 400058 - DNA, 25 bp, Mus musculus
ctttctgattcttggtcaatttggt

SEQ ID NO: 400059 - DNA, 25 bp, Mus musculus
ctttctgatttcactccataccatt

SEQ ID NO: 400060 - DNA, 25 bp, Mus musculus
ctttctgatttctctccataccatt

SEQ ID NO: 400061 - DNA, 25 bp, Mus musculus
ctttctgcaaacactttcccacaag

SEQ ID NO: 400062 - DNA, 25 bp, Mus musculus
ctttctgcaaactctttcccacaag

SEQ ID NO: 400063 - DNA, 25 bp, Mus musculus
ctttctgcaaatcacaaagcctggt

SEQ ID NO: 400064 - DNA, 25 bp, Mus musculus
ctttctgcaaatgacaaagcctggt

SEQ ID NO: 400065 - DNA, 25 bp, Mus musculus
ctttctgcacctcaagtcaacgaga

SEQ ID NO: 400066 - DNA, 25 bp, Mus musculus
ctttctgcacctgaagtcaacgaga

SEQ ID NO: 400067 - DNA, 25 bp, Mus musculus
ctttctgccagtccaattgtgagta

SEQ ID NO: 400068 - DNA, 25 bp, Mus musculus
ctttctgccagtgcaattgtgagta

SEQ ID NO: 400069 - DNA, 25 bp, Mus musculus
ctttctgccctgatatgattttgaa

SEQ ID NO: 400070 - DNA, 25 bp, Mus musculus
ctttctgccctgctaatcttgaaaa

SEQ ID NO: 400071 - DNA, 25 bp, Mus musculus
ctttctgccctggtaatcttgaaaa

SEQ ID NO: 400072 - DNA, 25 bp, Mus musculus
ctttctgccctgttatgattttgaa

SEQ ID NO: 400073 - DNA, 25 bp, Mus musculus
ctttctgcctcaactcagagatgat

SEQ ID NO: 400074 - DNA, 25 bp, Mus musculus
ctttctgcctcatctcagagatgat

SEQ ID NO: 400075 - DNA, 25 bp, Mus musculus
ctttctgctacccagatcacagtga

SEQ ID NO: 400076 - DNA, 25 bp, Mus musculus
ctttctgctaccgagatcacagtga

SEQ ID NO: 400077 - DNA, 25 bp, Mus musculus
ctttctgctactctgactgatgaag

SEQ ID NO: 400078 - DNA, 25 bp, Mus musculus
ctttctgctactgtgactgatgaag

SEQ ID NO: 400079 - DNA, 25 bp, Mus musculus
ctttctgctctgagcttagcacgta

SEQ ID NO: 400080 - DNA, 25 bp, Mus musculus
ctttctgctctgtgcttagcacgta

SEQ ID NO: 400081 - DNA, 25 bp, Mus musculus
ctttctgctgtgacttgactcttaa

SEQ ID NO: 400082 - DNA, 25 bp, Mus musculus
ctttctgctgtgtcttgactcttaa

SEQ ID NO: 400083 - DNA, 25 bp, Mus musculus
ctttctgcttttaaccttagctctt

SEQ ID NO: 400084 - DNA, 25 bp, Mus musculus
ctttctgctttttaccttagctctt

SEQ ID NO: 400085 - DNA, 25 bp, Mus musculus
ctttctggaaacagcgcagccagcc

SEQ ID NO: 400086 - DNA, 25 bp, Mus musculus
ctttctggaaactgcgcagccagcc

SEQ ID NO: 400087 - DNA, 25 bp, Mus musculus
ctttctggaagacagcggcttcctt

SEQ ID NO: 400088 - DNA, 25 bp, Mus musculus
ctttctggaagagagcggcttcctt

SEQ ID NO: 400089 - DNA, 25 bp, Mus musculus
ctttctggaagcagggacttacctc

SEQ ID NO: 400090 - DNA, 25 bp, Mus musculus
ctttctggaagctgggacttacctc

SEQ ID NO: 400091 - DNA, 25 bp, Mus musculus
ctttctggagaacttaaattggatt

SEQ ID NO: 400092 - DNA, 25 bp, Mus musculus
ctttctggagaagttaaattggatt

SEQ ID NO: 400093 - DNA, 25 bp, Mus musculus
ctttctggatggcaatcaagtagta

SEQ ID NO: 400094 - DNA, 25 bp, Mus musculus
ctttctggatgggaatcaagtagta

SEQ ID NO: 400095 - DNA, 25 bp, Mus musculus
ctttctggcaggcttcaaatcacaa

SEQ ID NO: 400096 - DNA, 25 bp, Mus musculus
ctttctggcagggttcaaatcacaa

SEQ ID NO: 400097 - DNA, 25 bp, Mus musculus
ctttctggccataatgctgtaaaac

SEQ ID NO: 400098 - DNA, 25 bp, Mus musculus
ctttctggccattatgctgtaaaac

SEQ ID NO: 400099 - DNA, 25 bp, Mus musculus
ctttctgggatgagctgacccacag

SEQ ID NO: 400100 - DNA, 25 bp, Mus musculus
ctttctgggatgtgctgacccacag

SEQ ID NO: 400101 - DNA, 25 bp, Mus musculus
ctttctgggattcttgtgtcggaga

SEQ ID NO: 400102 - DNA, 25 bp, Mus musculus
ctttctgggattgttgtgtcggaga

SEQ ID NO: 400103 - DNA, 25 bp, Mus musculus
ctttctgggctcattatcagggtga

SEQ ID NO: 400104 - DNA, 25 bp, Mus musculus
ctttctgggctctttatcagggtga

SEQ ID NO: 400105 - DNA, 25 bp, Mus musculus
ctttctgggctgcatatacacttgt

SEQ ID NO: 400106 - DNA, 25 bp, Mus musculus
ctttctgggctggatatacacttgt

SEQ ID NO: 400107 - DNA, 25 bp, Mus musculus
ctttctgggcttcgcagccatgaaa

SEQ ID NO: 400108 - DNA, 25 bp, Mus musculus
ctttctgggcttggcagccatgaaa

SEQ ID NO: 400109 - DNA, 25 bp, Mus musculus
ctttctgggtggcagatgtctgggt

SEQ ID NO: 400110 - DNA, 25 bp, Mus musculus
ctttctgggtgggagatgtctgggt

SEQ ID NO: 400111 - DNA, 25 bp, Mus musculus
ctttctggtaagagcaggctagcca

SEQ ID NO: 400112 - DNA, 25 bp, Mus musculus
ctttctggtaagtgcaggctagcca

SEQ ID NO: 400113 - DNA, 25 bp, Mus musculus
ctttctggtttgcttcttgagcttt

SEQ ID NO: 400114 - DNA, 25 bp, Mus musculus
ctttctggtttggttcttgagcttt

SEQ ID NO: 400115 - DNA, 25 bp, Mus musculus
ctttctgtaagactggagcatgctc

SEQ ID NO: 400116 - DNA, 25 bp, Mus musculus
ctttctgtaagagtggagcatgctc

SEQ ID NO: 400117 - DNA, 25 bp, Mus musculus
ctttctgtagtcactatggtaacaa

SEQ ID NO: 400118 - DNA, 25 bp, Mus musculus
ctttctgtagtctctatggtaacaa

SEQ ID NO: 400119 - DNA, 25 bp, Mus musculus
ctttctgtatgtattattgcctttt

SEQ ID NO: 400120 - DNA, 25 bp, Mus musculus
ctttctgtatgttttattgcctttt

SEQ ID NO: 400121 - DNA, 25 bp, Mus musculus
ctttctgtcagcaagattcctggta

SEQ ID NO: 400122 - DNA, 25 bp, Mus musculus
ctttctgtcagctagattcctggta

SEQ ID NO: 400123 - DNA, 25 bp, Mus musculus
ctttctgtccacatggaagtgcgct

SEQ ID NO: 400124 - DNA, 25 bp, Mus musculus
ctttctgtccacttggaagtgcgct

SEQ ID NO: 400125 - DNA, 25 bp, Mus musculus
ctttctgtctagctttgaacaaact

SEQ ID NO: 400126 - DNA, 25 bp, Mus musculus
ctttctgtctaggtttgaacaaact

SEQ ID NO: 400127 - DNA, 25 bp, Mus musculus
ctttctgtgaagcagggcaatcctg

SEQ ID NO: 400128 - DNA, 25 bp, Mus musculus
ctttctgtgaaggagggcaatcctg

SEQ ID NO: 400129 - DNA, 25 bp, Mus musculus
ctttctgtgacccttgaagtggtga

SEQ ID NO: 400130 - DNA, 25 bp, Mus musculus
ctttctgtgaccgttgaagtggtga

SEQ ID NO: 400131 - DNA, 25 bp, Mus musculus
ctttctgtggcaagtttgagtcccc

SEQ ID NO: 400132 - DNA, 25 bp, Mus musculus
ctttctgtggcatgtttgagtcccc

SEQ ID NO: 400133 - DNA, 25 bp, Mus musculus
ctttctgtggctcttatgaccatgt

SEQ ID NO: 400134 - DNA, 25 bp, Mus musculus
ctttctgtggctgttatgaccatgt

SEQ ID NO: 400135 - DNA, 25 bp, Mus musculus
ctttctgtgggtactgtgaattcaa

SEQ ID NO: 400136 - DNA, 25 bp, Mus musculus
ctttctgtgggttctgtgaattcaa

SEQ ID NO: 400137 - DNA, 25 bp, Mus musculus
ctttctgtgtctagaagtgctttaa

SEQ ID NO: 400138 - DNA, 25 bp, Mus musculus
ctttctgtgtcttgaagtgctttaa

SEQ ID NO: 400139 - DNA, 25 bp, Mus musculus
ctttctgtgtgtcatctgtgcactg

SEQ ID NO: 400140 - DNA, 25 bp, Mus musculus
ctttctgtgtgtgatctgtgcactg

SEQ ID NO: 400141 - DNA, 25 bp, Mus musculus
ctttctgtgttcagatgcagtaaca

SEQ ID NO: 400142 - DNA, 25 bp, Mus musculus
ctttctgtgttctgatgcagtaaca

SEQ ID NO: 400143 - DNA, 25 bp, Mus musculus
ctttctgttccccttacaaagatgt

SEQ ID NO: 400144 - DNA, 25 bp, Mus musculus
ctttctgttcccgttacaaagatgt

SEQ ID NO: 400145 - DNA, 25 bp, Mus musculus
ctttctgttctgaggactcggtgca

SEQ ID NO: 400146 - DNA, 25 bp, Mus musculus
ctttctgttctgtggactcggtgca

SEQ ID NO: 400147 - DNA, 25 bp, Mus musculus
ctttctgttcttatagtgtacgatc

SEQ ID NO: 400148 - DNA, 25 bp, Mus musculus
ctttctgttcttttagtgtacgatc

SEQ ID NO: 400149 - DNA, 25 bp, Mus musculus
ctttctgttgtcagctatcttcagc

SEQ ID NO: 400150 - DNA, 25 bp, Mus musculus
ctttctgttgtctgctatcttcagc

SEQ ID NO: 400151 - DNA, 25 bp, Mus musculus
ctttctgtttttaaccattatctga

SEQ ID NO: 400152 - DNA, 25 bp, Mus musculus
ctttctgttttttaccattatctga

SEQ ID NO: 400153 - DNA, 25 bp, Mus musculus
ctttcttaactcattcaactcagga

SEQ ID NO: 400154 - DNA, 25 bp, Mus musculus
ctttcttaactctttcaactcagga

SEQ ID NO: 400155 - DNA, 25 bp, Mus musculus
ctttcttaagcaccccttgtgcttc

SEQ ID NO: 400156 - DNA, 25 bp, Mus musculus
ctttcttaagcagcccttgtgcttc

SEQ ID NO: 400157 - DNA, 25 bp, Mus musculus
ctttcttaaggtaattgcgttgact

SEQ ID NO: 400158 - DNA, 25 bp, Mus musculus
ctttcttaaggttattgcgttgact

SEQ ID NO: 400159 - DNA, 25 bp, Mus musculus
ctttcttaagtacggtcaggccctg

SEQ ID NO: 400160 - DNA, 25 bp, Mus musculus
ctttcttaagtagggtcaggccctg

SEQ ID NO: 400161 - DNA, 25 bp, Mus musculus
ctttcttagcttctgggtctttgga

SEQ ID NO: 400162 - DNA, 25 bp, Mus musculus
ctttcttagcttgtgggtctttgga

SEQ ID NO: 400163 - DNA, 25 bp, Mus musculus
ctttcttaggaccatgtctcacctt

SEQ ID NO: 400164 - DNA, 25 bp, Mus musculus
ctttcttaggacgatgtctcacctt

SEQ ID NO: 400165 - DNA, 25 bp, Mus musculus
ctttcttatcacacgactgttagac

SEQ ID NO: 400166 - DNA, 25 bp, Mus musculus
ctttcttatcactcgactgttagac

SEQ ID NO: 400167 - DNA, 25 bp, Mus musculus
ctttcttattaccaggatgcctcac

SEQ ID NO: 400168 - DNA, 25 bp, Mus musculus
ctttcttattacgaggatgcctcac

SEQ ID NO: 400169 - DNA, 25 bp, Mus musculus
ctttcttattccactgcaaacctga

SEQ ID NO: 400170 - DNA, 25 bp, Mus musculus
ctttcttattcctctgcaaacctga

SEQ ID NO: 400171 - DNA, 25 bp, Mus musculus
ctttcttatttcaactgcaaccaga

SEQ ID NO: 400172 - DNA, 25 bp, Mus musculus
ctttcttatttcagtacccaatcct

SEQ ID NO: 400173 - DNA, 25 bp, Mus musculus
ctttcttatttctactgcaaccaga

SEQ ID NO: 400174 - DNA, 25 bp, Mus musculus
ctttcttatttctgtacccaatcct

SEQ ID NO: 400175 - DNA, 25 bp, Mus musculus
ctttcttcaactaatatctactagg

SEQ ID NO: 400176 - DNA, 25 bp, Mus musculus
ctttcttcaacttatatctactagg

SEQ ID NO: 400177 - DNA, 25 bp, Mus musculus
ctttcttcaagaaactcctacagga

SEQ ID NO: 400178 - DNA, 25 bp, Mus musculus
ctttcttcaagatactcctacagga

SEQ ID NO: 400179 - DNA, 25 bp, Mus musculus
ctttcttcactcatcctcaagttga

SEQ ID NO: 400180 - DNA, 25 bp, Mus musculus
ctttcttcactcttcctcaagttga

SEQ ID NO: 400181 - DNA, 25 bp, Mus musculus
ctttcttccagacccgatgtatgta

SEQ ID NO: 400182 - DNA, 25 bp, Mus musculus
ctttcttccagagccgatgtatgta

SEQ ID NO: 400183 - DNA, 25 bp, Mus musculus
ctttcttcccatcctttgtacaata

SEQ ID NO: 400184 - DNA, 25 bp, Mus musculus
ctttcttcccatgctttgtacaata

SEQ ID NO: 400185 - DNA, 25 bp, Mus musculus
ctttcttccgagagctttagagctt

SEQ ID NO: 400186 - DNA, 25 bp, Mus musculus
ctttcttccgagtgctttagagctt

SEQ ID NO: 400187 - DNA, 25 bp, Mus musculus
ctttcttcctaactgtacattatta

SEQ ID NO: 400188 - DNA, 25 bp, Mus musculus
ctttcttcctaagtgtacattatta

SEQ ID NO: 400189 - DNA, 25 bp, Mus musculus
ctttcttcctagataactgtagttt

SEQ ID NO: 400190 - DNA, 25 bp, Mus musculus
ctttcttcctagttaactgtagttt

SEQ ID NO: 400191 - DNA, 25 bp, Mus musculus
ctttcttcctatcacgtttctatgt

SEQ ID NO: 400192 - DNA, 25 bp, Mus musculus
ctttcttcctatgacgtttctatgt

SEQ ID NO: 400193 - DNA, 25 bp, Mus musculus
ctttcttcctggctatagcattgga

SEQ ID NO: 400194 - DNA, 25 bp, Mus musculus
ctttcttcctgggtatagcattgga

SEQ ID NO: 400195 - DNA, 25 bp, Mus musculus
ctttcttcgaggaaccagctgcctt

SEQ ID NO: 400196 - DNA, 25 bp, Mus musculus
ctttcttcgaggtaccagctgcctt

SEQ ID NO: 400197 - DNA, 25 bp, Mus musculus
ctttcttctcagacttaccgtagga

SEQ ID NO: 400198 - DNA, 25 bp, Mus musculus
ctttcttctcagtcttaccgtagga

SEQ ID NO: 400199 - DNA, 25 bp, Mus musculus
ctttcttctcttaccacaggagtat

SEQ ID NO: 400200 - DNA, 25 bp, Mus musculus
ctttcttctctttccacaggagtat

SEQ ID NO: 400201 - DNA, 25 bp, Mus musculus
ctttcttcttcccatacatacagat

SEQ ID NO: 400202 - DNA, 25 bp, Mus musculus
ctttcttcttccgatacatacagat

SEQ ID NO: 400203 - DNA, 25 bp, Mus musculus
ctttcttctttaattcagctgggag

SEQ ID NO: 400204 - DNA, 25 bp, Mus musculus
ctttcttctttatttcagctgggag

SEQ ID NO: 400205 - DNA, 25 bp, Mus musculus
ctttcttctttgctgtttacagtct

SEQ ID NO: 400206 - DNA, 25 bp, Mus musculus
ctttcttctttggtgtttacagtct

SEQ ID NO: 400207 - DNA, 25 bp, Mus musculus
ctttcttgaacaaagccactctttt

SEQ ID NO: 400208 - DNA, 25 bp, Mus musculus
ctttcttgaacatagccactctttt

SEQ ID NO: 400209 - DNA, 25 bp, Mus musculus
ctttcttgaccaaatttcctctttg

SEQ ID NO: 400210 - DNA, 25 bp, Mus musculus
ctttcttgaccatatttcctctttg

SEQ ID NO: 400211 - DNA, 25 bp, Mus musculus
ctttcttgcaggagttttccttcag

SEQ ID NO: 400212 - DNA, 25 bp, Mus musculus
ctttcttgcaggtgttttccttcag

SEQ ID NO: 400213 - DNA, 25 bp, Mus musculus
ctttcttgcgctctttctctatttc

SEQ ID NO: 400214 - DNA, 25 bp, Mus musculus
ctttcttgcgctgtttctctatttc

SEQ ID NO: 400215 - DNA, 25 bp, Mus musculus
ctttcttggagaaattacgtggcta

SEQ ID NO: 400216 - DNA, 25 bp, Mus musculus
ctttcttggagatattacgtggcta

SEQ ID NO: 400217 - DNA, 25 bp, Mus musculus
ctttcttgggacaatcaggatggta

SEQ ID NO: 400218 - DNA, 25 bp, Mus musculus
ctttcttgggactatcaggatggta

SEQ ID NO: 400219 - DNA, 25 bp, Mus musculus
ctttcttgggcaattgcttacgaga

SEQ ID NO: 400220 - DNA, 25 bp, Mus musculus
ctttcttgggcatttgcttacgaga

SEQ ID NO: 400221 - DNA, 25 bp, Mus musculus
ctttcttgtcatattgtcaaccggt

SEQ ID NO: 400222 - DNA, 25 bp, Mus musculus
ctttcttgtcattttgtcaaccggt

SEQ ID NO: 400223 - DNA, 25 bp, Mus musculus
ctttcttgtggtatgattctttgat

SEQ ID NO: 400224 - DNA, 25 bp, Mus musculus
ctttcttgtggtttgattctttgat

SEQ ID NO: 400225 - DNA, 25 bp, Mus musculus
ctttcttgttcacttcgccatagtt

SEQ ID NO: 400226 - DNA, 25 bp, Mus musculus
ctttcttgttcagttcgccatagtt

SEQ ID NO: 400227 - DNA, 25 bp, Mus musculus
ctttcttgttgaatctgggttccta

SEQ ID NO: 400228 - DNA, 25 bp, Mus musculus
ctttcttgttgattctgggttccta

SEQ ID NO: 400229 - DNA, 25 bp, Mus musculus
ctttcttgtttgagacgcctgtgac

SEQ ID NO: 400230 - DNA, 25 bp, Mus musculus
ctttcttgtttgtgacgcctgtgac

SEQ ID NO: 400231 - DNA, 25 bp, Mus musculus
ctttctttagatctgctgtgtttca

SEQ ID NO: 400232 - DNA, 25 bp, Mus musculus
ctttctttagatgtgctgtgtttca

SEQ ID NO: 400233 - DNA, 25 bp, Mus musculus
ctttctttagtaaggcttgcaagct

SEQ ID NO: 400234 - DNA, 25 bp, Mus musculus
ctttctttagtatggcttgcaagct

SEQ ID NO: 400235 - DNA, 25 bp, Mus musculus
ctttctttccccagccagataaaag

SEQ ID NO: 400236 - DNA, 25 bp, Mus musculus
ctttctttcccctgccagataaaag

SEQ ID NO: 400237 - DNA, 25 bp, Mus musculus
ctttctttcgagattggttgagcat

SEQ ID NO: 400238 - DNA, 25 bp, Mus musculus
ctttctttcgagtttggttgagcat

SEQ ID NO: 400239 - DNA, 25 bp, Mus musculus
ctttctttctacctttagatattgg

SEQ ID NO: 400240 - DNA, 25 bp, Mus musculus
ctttctttctacgtttagatattgg

SEQ ID NO: 400241 - DNA, 25 bp, Mus musculus
ctttctttctctagttaatgctttt

SEQ ID NO: 400242 - DNA, 25 bp, Mus musculus
ctttctttctcttgttaatgctttt

SEQ ID NO: 400243 - DNA, 25 bp, Mus musculus
ctttctttcttcattgtatgtagga

SEQ ID NO: 400244 - DNA, 25 bp, Mus musculus
ctttctttcttctttgtatgtagga

SEQ ID NO: 400245 - DNA, 25 bp, Mus musculus
ctttctttgaatcaatactgcaatg

SEQ ID NO: 400246 - DNA, 25 bp, Mus musculus
ctttctttgaatgaatactgcaatg

SEQ ID NO: 400247 - DNA, 25 bp, Mus musculus
ctttctttgccgagaagctgtacga

SEQ ID NO: 400248 - DNA, 25 bp, Mus musculus
ctttctttgccgtgaagctgtacga

SEQ ID NO: 400249 - DNA, 25 bp, Mus musculus
ctttcttttagtcactgggttagag

SEQ ID NO: 400250 - DNA, 25 bp, Mus musculus
ctttcttttagtgactgggttagag

SEQ ID NO: 400251 - DNA, 25 bp, Mus musculus
ctttcttttccccaacagagcaaga

SEQ ID NO: 400252 - DNA, 25 bp, Mus musculus
ctttcttttcccgaacagagcaaga

SEQ ID NO: 400253 - DNA, 25 bp, Mus musculus
ctttcttttcgtattcatatggacg

SEQ ID NO: 400254 - DNA, 25 bp, Mus musculus
ctttcttttcgttttcatatggacg

SEQ ID NO: 400255 - DNA, 25 bp, Mus musculus
ctttcttttctgactccatagtaaa

SEQ ID NO: 400256 - DNA, 25 bp, Mus musculus
ctttcttttctgtctccatagtaaa

SEQ ID NO: 400257 - DNA, 25 bp, Mus musculus
ctttcttttgatcagtaggttacca

SEQ ID NO: 400258 - DNA, 25 bp, Mus musculus
ctttcttttgatgagtaggttacca

SEQ ID NO: 400259 - DNA, 25 bp, Mus musculus
ctttcttttggccacctgtgatcag

SEQ ID NO: 400260 - DNA, 25 bp, Mus musculus
ctttcttttggcgacctgtgatcag

SEQ ID NO: 400261 - DNA, 25 bp, Mus musculus
ctttcttttgtcaccaagctgtata

SEQ ID NO: 400262 - DNA, 25 bp, Mus musculus
ctttcttttgtctccaagctgtata

SEQ ID NO: 400263 - DNA, 25 bp, Mus musculus
ctttctttttcaatgccagcagttc

SEQ ID NO: 400264 - DNA, 25 bp, Mus musculus
ctttctttttcattgccagcagttc

SEQ ID NO: 400265 - DNA, 25 bp, Mus musculus
ctttctttttgaccatcttcttact

SEQ ID NO: 400266 - DNA, 25 bp, Mus musculus
ctttctttttgagcatcttcttact

SEQ ID NO: 400267 - DNA, 25 bp, Mus musculus
ctttgaaaatcacaagccccttggc

SEQ ID NO: 400268 - DNA, 25 bp, Mus musculus
ctttgaaaatcagaagccccttggc

SEQ ID NO: 400269 - DNA, 25 bp, Mus musculus
ctttgaaacctacttgtcatctttt

SEQ ID NO: 400270 - DNA, 25 bp, Mus musculus
ctttgaaacctagttgtcatctttt

SEQ ID NO: 400271 - DNA, 25 bp, Mus musculus
ctttgaaagcatcaagctgtaggaa

SEQ ID NO: 400272 - DNA, 25 bp, Mus musculus
ctttgaaagcatgaagctgtaggaa

SEQ ID NO: 400273 - DNA, 25 bp, Mus musculus
ctttgaaagtttctgccgttgccct

SEQ ID NO: 400274 - DNA, 25 bp, Mus musculus
ctttgaaagtttgtgccgttgccct

SEQ ID NO: 400275 - DNA, 25 bp, Mus musculus
ctttgaaattgcatcctccattaaa

SEQ ID NO: 400276 - DNA, 25 bp, Mus musculus
ctttgaaattgcttcctccattaaa

SEQ ID NO: 400277 - DNA, 25 bp, Mus musculus
ctttgaactcttccagctgaggctg

SEQ ID NO: 400278 - DNA, 25 bp, Mus musculus
ctttgaactcttgcagctgaggctg

SEQ ID NO: 400279 - DNA, 25 bp, Mus musculus
ctttgaagaatactgagcagaccca

SEQ ID NO: 400280 - DNA, 25 bp, Mus musculus
ctttgaagaatagtgagcagaccca

SEQ ID NO: 400281 - DNA, 25 bp, Mus musculus
ctttgaagacaaccccagagacctt

SEQ ID NO: 400282 - DNA, 25 bp, Mus musculus
ctttgaagacaagcccagagacctt

SEQ ID NO: 400283 - DNA, 25 bp, Mus musculus
ctttgaagatatacacactgtactt

SEQ ID NO: 400284 - DNA, 25 bp, Mus musculus
ctttgaagatattcacactgtactt

SEQ ID NO: 400285 - DNA, 25 bp, Mus musculus
ctttgaagatctctccatattcagg

SEQ ID NO: 400286 - DNA, 25 bp, Mus musculus
ctttgaagatctgtccatattcagg

SEQ ID NO: 400287 - DNA, 25 bp, Mus musculus
ctttgaagccgtacctatgtctatg

SEQ ID NO: 400288 - DNA, 25 bp, Mus musculus
ctttgaagccgttcctatgtctatg

SEQ ID NO: 400289 - DNA, 25 bp, Mus musculus
ctttgaagcgcaaggccaggcggga

SEQ ID NO: 400290 - DNA, 25 bp, Mus musculus
ctttgaagcgcatggccaggcggga

SEQ ID NO: 400291 - DNA, 25 bp, Mus musculus
ctttgaagcttaagattgggactgt

SEQ ID NO: 400292 - DNA, 25 bp, Mus musculus
ctttgaagcttatgattgggactgt

SEQ ID NO: 400293 - DNA, 25 bp, Mus musculus
ctttgaaggacacgccctcagtttg

SEQ ID NO: 400294 - DNA, 25 bp, Mus musculus
ctttgaaggacaggccctcagtttg

SEQ ID NO: 400295 - DNA, 25 bp, Mus musculus
ctttgaatactcagtgatttgctcc

SEQ ID NO: 400296 - DNA, 25 bp, Mus musculus
ctttgaatactctgtgatttgctcc

SEQ ID NO: 400297 - DNA, 25 bp, Mus musculus
ctttgaatagcaatttcctgggtaa

SEQ ID NO: 400298 - DNA, 25 bp, Mus musculus
ctttgaatagcattttcctgggtaa

SEQ ID NO: 400299 - DNA, 25 bp, Mus musculus
ctttgaatcaggaagcgtctggaat

SEQ ID NO: 400300 - DNA, 25 bp, Mus musculus
ctttgaatcaggtagcgtctggaat

SEQ ID NO: 400301 - DNA, 25 bp, Mus musculus
ctttgaatctcacatatatatctta

SEQ ID NO: 400302 - DNA, 25 bp, Mus musculus
ctttgaatctcagatatatatctta

SEQ ID NO: 400303 - DNA, 25 bp, Mus musculus
ctttgaatgtgcagtctatttttat

SEQ ID NO: 400304 - DNA, 25 bp, Mus musculus
ctttgaatgtgctgtctatttttat

SEQ ID NO: 400305 - DNA, 25 bp, Mus musculus
ctttgaatttcaactgtagctgagt

SEQ ID NO: 400306 - DNA, 25 bp, Mus musculus
ctttgaatttcatctgtagctgagt

SEQ ID NO: 400307 - DNA, 25 bp, Mus musculus
ctttgacaaaacctaacttgcgcag

SEQ ID NO: 400308 - DNA, 25 bp, Mus musculus
ctttgacaaaacgtaacttgcgcag

SEQ ID NO: 400309 - DNA, 25 bp, Mus musculus
ctttgacacagtacctaatgctttg

SEQ ID NO: 400310 - DNA, 25 bp, Mus musculus
ctttgacacagttcctaatgctttg

SEQ ID NO: 400311 - DNA, 25 bp, Mus musculus
ctttgacaccaaccatgatggctct

SEQ ID NO: 400312 - DNA, 25 bp, Mus musculus
ctttgacaccaagcatgatggctct

SEQ ID NO: 400313 - DNA, 25 bp, Mus musculus
ctttgacacctgatgaccaatcatt

SEQ ID NO: 400314 - DNA, 25 bp, Mus musculus
ctttgacacctgttgaccaatcatt

SEQ ID NO: 400315 - DNA, 25 bp, Mus musculus
ctttgacacgtacccaagttatgga

SEQ ID NO: 400316 - DNA, 25 bp, Mus musculus
ctttgacacgtagccaagttatgga

SEQ ID NO: 400317 - DNA, 25 bp, Mus musculus
ctttgacaggcactgcaacatggtg

SEQ ID NO: 400318 - DNA, 25 bp, Mus musculus
ctttgacaggcagtgcaacatggtg

SEQ ID NO: 400319 - DNA, 25 bp, Mus musculus
ctttgacagtaaccgtcttcacttc

SEQ ID NO: 400320 - DNA, 25 bp, Mus musculus
ctttgacagtaagcgtcttcacttc

SEQ ID NO: 400321 - DNA, 25 bp, Mus musculus
ctttgacagtcccatcacaggaact

SEQ ID NO: 400322 - DNA, 25 bp, Mus musculus
ctttgacagtccgatcacaggaact

SEQ ID NO: 400323 - DNA, 25 bp, Mus musculus
ctttgacatacgattcctgtggaaa

SEQ ID NO: 400324 - DNA, 25 bp, Mus musculus
ctttgacatacgtttcctgtggaaa

SEQ ID NO: 400325 - DNA, 25 bp, Mus musculus
ctttgacatccactagactccaagt

SEQ ID NO: 400326 - DNA, 25 bp, Mus musculus
ctttgacatccagtagactccaagt

SEQ ID NO: 400327 - DNA, 25 bp, Mus musculus
ctttgacatggccagcttcagactc

SEQ ID NO: 400328 - DNA, 25 bp, Mus musculus
ctttgacatggcgagcttcagactc

SEQ ID NO: 400329 - DNA, 25 bp, Mus musculus
ctttgacattacaaggtatatatgg

SEQ ID NO: 400330 - DNA, 25 bp, Mus musculus
ctttgacattactaggtatatatgg

SEQ ID NO: 400331 - DNA, 25 bp, Mus musculus
ctttgaccacataaagctgcctcag

SEQ ID NO: 400332 - DNA, 25 bp, Mus musculus
ctttgaccacattaagctgcctcag

SEQ ID NO: 400333 - DNA, 25 bp, Mus musculus
ctttgaccacttagcttgtctgtgt

SEQ ID NO: 400334 - DNA, 25 bp, Mus musculus
ctttgaccactttgcttgtctgtgt

SEQ ID NO: 400335 - DNA, 25 bp, Mus musculus
ctttgaccagcacagcagcaatata

SEQ ID NO: 400336 - DNA, 25 bp, Mus musculus
ctttgaccagcagagcagcaatata

SEQ ID NO: 400337 - DNA, 25 bp, Mus musculus
ctttgaccagtgaattgcgatccaa

SEQ ID NO: 400338 - DNA, 25 bp, Mus musculus
ctttgaccagtgtattgcgatccaa

SEQ ID NO: 400339 - DNA, 25 bp, Mus musculus
ctttgaccgagtcaatcctgggatc

SEQ ID NO: 400340 - DNA, 25 bp, Mus musculus
ctttgaccgagtgaatcctgggatc

SEQ ID NO: 400341 - DNA, 25 bp, Mus musculus
ctttgacctaggcattgtttttgtt

SEQ ID NO: 400342 - DNA, 25 bp, Mus musculus
ctttgacctagggattgtttttgtt

SEQ ID NO: 400343 - DNA, 25 bp, Mus musculus
ctttgacctccaaatgcttactgtg

SEQ ID NO: 400344 - DNA, 25 bp, Mus musculus
ctttgacctccaattgcagctgttt

SEQ ID NO: 400345 - DNA, 25 bp, Mus musculus
ctttgacctccatatgcttactgtg

SEQ ID NO: 400346 - DNA, 25 bp, Mus musculus
ctttgacctccatttgcagctgttt

SEQ ID NO: 400347 - DNA, 25 bp, Mus musculus
ctttgacctggcaagagctgacttc

SEQ ID NO: 400348 - DNA, 25 bp, Mus musculus
ctttgacctggctagagctgacttc

SEQ ID NO: 400349 - DNA, 25 bp, Mus musculus
ctttgaccttggcacctttgtagaa

SEQ ID NO: 400350 - DNA, 25 bp, Mus musculus
ctttgaccttgggacctttgtagaa

SEQ ID NO: 400351 - DNA, 25 bp, Mus musculus
ctttgacggataaccttcaaccatt

SEQ ID NO: 400352 - DNA, 25 bp, Mus musculus
ctttgacggatatccttcaaccatt

SEQ ID NO: 400353 - DNA, 25 bp, Mus musculus
ctttgactacgaacctaaggaagac

SEQ ID NO: 400354 - DNA, 25 bp, Mus musculus
ctttgactacgatcctaaggaagac

SEQ ID NO: 400355 - DNA, 25 bp, Mus musculus
ctttgactagtaactatcacgtggt

SEQ ID NO: 400356 - DNA, 25 bp, Mus musculus
ctttgactagtatctatcacgtggt

SEQ ID NO: 400357 - DNA, 25 bp, Mus musculus
ctttgactccttcatctgacagcat

SEQ ID NO: 400358 - DNA, 25 bp, Mus musculus
ctttgactccttgatctgacagcat

SEQ ID NO: 400359 - DNA, 25 bp, Mus musculus
ctttgactgatccaatccgttgcgc

SEQ ID NO: 400360 - DNA, 25 bp, Mus musculus
ctttgactgatcgaatccgttgcgc

SEQ ID NO: 400361 - DNA, 25 bp, Mus musculus
ctttgactgcaaagcactctgagaa

SEQ ID NO: 400362 - DNA, 25 bp, Mus musculus
ctttgactgcaatgcactctgagaa

SEQ ID NO: 400363 - DNA, 25 bp, Mus musculus
ctttgactgttgaaattggttaact

SEQ ID NO: 400364 - DNA, 25 bp, Mus musculus
ctttgactgttgtaattggttaact

SEQ ID NO: 400365 - DNA, 25 bp, Mus musculus
ctttgacttcaaacttcccgtagat

SEQ ID NO: 400366 - DNA, 25 bp, Mus musculus
ctttgacttcaatcttcccgtagat

SEQ ID NO: 400367 - DNA, 25 bp, Mus musculus
ctttgacttcagattttcaggaccc

SEQ ID NO: 400368 - DNA, 25 bp, Mus musculus
ctttgacttcagtttttcaggaccc

SEQ ID NO: 400369 - DNA, 25 bp, Mus musculus
ctttgacttccacccgattgatata

SEQ ID NO: 400370 - DNA, 25 bp, Mus musculus
ctttgacttccagccgattgatata

SEQ ID NO: 400371 - DNA, 25 bp, Mus musculus
ctttgacttcctctctcagcagtaa

SEQ ID NO: 400372 - DNA, 25 bp, Mus musculus
ctttgacttcctgtctcagcagtaa

SEQ ID NO: 400373 - DNA, 25 bp, Mus musculus
ctttgactttggcaattgcctacca

SEQ ID NO: 400374 - DNA, 25 bp, Mus musculus
ctttgactttgggaattgcctacca

SEQ ID NO: 400375 - DNA, 25 bp, Mus musculus
ctttgagaaactaccatgggacaaa

SEQ ID NO: 400376 - DNA, 25 bp, Mus musculus
ctttgagaaacttccatgggacaaa

SEQ ID NO: 400377 - DNA, 25 bp, Mus musculus
ctttgagaagagaatcgaagggtca

SEQ ID NO: 400378 - DNA, 25 bp, Mus musculus
ctttgagaagagtatcgaagggtca

SEQ ID NO: 400379 - DNA, 25 bp, Mus musculus
ctttgagaagtcacctgtcctgtag

SEQ ID NO: 400380 - DNA, 25 bp, Mus musculus
ctttgagaagtctcctgtcctgtag

SEQ ID NO: 400381 - DNA, 25 bp, Mus musculus
ctttgagaatgtatagcccggttga

SEQ ID NO: 400382 - DNA, 25 bp, Mus musculus
ctttgagaatgtttagcccggttga

SEQ ID NO: 400383 - DNA, 25 bp, Mus musculus
ctttgagacattcccacaggttgcc

SEQ ID NO: 400384 - DNA, 25 bp, Mus musculus
ctttgagacattgccacaggttgcc

SEQ ID NO: 400385 - DNA, 25 bp, Mus musculus
ctttgagacgcaaaagctggctttt

SEQ ID NO: 400386 - DNA, 25 bp, Mus musculus
ctttgagacgcataagctggctttt

SEQ ID NO: 400387 - DNA, 25 bp, Mus musculus
ctttgagagaagaaattgaccctct

SEQ ID NO: 400388 - DNA, 25 bp, Mus musculus
ctttgagagaagtaattgaccctct

SEQ ID NO: 400389 - DNA, 25 bp, Mus musculus
ctttgagagagaagtcagacacctg

SEQ ID NO: 400390 - DNA, 25 bp, Mus musculus
ctttgagagagatgtcagacacctg

SEQ ID NO: 400391 - DNA, 25 bp, Mus musculus
ctttgagagcttctatggaggaaag

SEQ ID NO: 400392 - DNA, 25 bp, Mus musculus
ctttgagagcttgtatggaggaaag

SEQ ID NO: 400393 - DNA, 25 bp, Mus musculus
ctttgagcaaggaggcagggagacc

SEQ ID NO: 400394 - DNA, 25 bp, Mus musculus
ctttgagcaaggtggcagggagacc

SEQ ID NO: 400395 - DNA, 25 bp, Mus musculus
ctttgagcacatcatccccaaggcc

SEQ ID NO: 400396 - DNA, 25 bp, Mus musculus
ctttgagcacatgatccccaaggcc

SEQ ID NO: 400397 - DNA, 25 bp, Mus musculus
ctttgagcagacaatcttgaaggaa

SEQ ID NO: 400398 - DNA, 25 bp, Mus musculus
ctttgagcagactatcttgaaggaa

SEQ ID NO: 400399 - DNA, 25 bp, Mus musculus
ctttgagcagcacttaagtcttttt

SEQ ID NO: 400400 - DNA, 25 bp, Mus musculus
ctttgagcagcagttaagtcttttt

SEQ ID NO: 400401 - DNA, 25 bp, Mus musculus
ctttgagcagtgcacggagcacaaa

SEQ ID NO: 400402 - DNA, 25 bp, Mus musculus
ctttgagcagtggacggagcacaaa

SEQ ID NO: 400403 - DNA, 25 bp, Mus musculus
ctttgagcatggaacgtgcttacct

SEQ ID NO: 400404 - DNA, 25 bp, Mus musculus
ctttgagcatggtacgtgcttacct

SEQ ID NO: 400405 - DNA, 25 bp, Mus musculus
ctttgagcccaacgtggaggtaact

SEQ ID NO: 400406 - DNA, 25 bp, Mus musculus
ctttgagcccaaggtggaggtaact

SEQ ID NO: 400407 - DNA, 25 bp, Mus musculus
ctttgagccttacctttctggtttt

SEQ ID NO: 400408 - DNA, 25 bp, Mus musculus
ctttgagccttagctttctggtttt

SEQ ID NO: 400409 - DNA, 25 bp, Mus musculus
ctttgagctgctagatctggacggg

SEQ ID NO: 400410 - DNA, 25 bp, Mus musculus
ctttgagctgcttgatctggacggg

SEQ ID NO: 400411 - DNA, 25 bp, Mus musculus
ctttgagctggaccgcaggttcaag

SEQ ID NO: 400412 - DNA, 25 bp, Mus musculus
ctttgagctggagcgcaggttcaag

SEQ ID NO: 400413 - DNA, 25 bp, Mus musculus
ctttgagctgttaagagttatcttt

SEQ ID NO: 400414 - DNA, 25 bp, Mus musculus
ctttgagctgtttagagttatcttt

SEQ ID NO: 400415 - DNA, 25 bp, Mus musculus
ctttgagcttgtctttgaacgccag

SEQ ID NO: 400416 - DNA, 25 bp, Mus musculus
ctttgagcttgtgtttgaacgccag

SEQ ID NO: 400417 - DNA, 25 bp, Mus musculus
ctttgagctttcctgtgtgaaaaac

SEQ ID NO: 400418 - DNA, 25 bp, Mus musculus
ctttgagctttcgtgtgtgaaaaac

SEQ ID NO: 400419 - DNA, 25 bp, Mus musculus
ctttgaggatgaacacacgtgttct

SEQ ID NO: 400420 - DNA, 25 bp, Mus musculus
ctttgaggatgaaggtggcccctat

SEQ ID NO: 400421 - DNA, 25 bp, Mus musculus
ctttgaggatgatcacacgtgttct

SEQ ID NO: 400422 - DNA, 25 bp, Mus musculus
ctttgaggatgatggtggcccctat

SEQ ID NO: 400423 - DNA, 25 bp, Mus musculus
ctttgaggatggcaccctgtggcct

SEQ ID NO: 400424 - DNA, 25 bp, Mus musculus
ctttgaggatgggaccctgtggcct

SEQ ID NO: 400425 - DNA, 25 bp, Mus musculus
ctttgaggcaacaggcaaacagcca

SEQ ID NO: 400426 - DNA, 25 bp, Mus musculus
ctttgaggcaactggcaaacagcca

SEQ ID NO: 400427 - DNA, 25 bp, Mus musculus
ctttgaggcaagagttccctttggg

SEQ ID NO: 400428 - DNA, 25 bp, Mus musculus
ctttgaggcaagtgttccctttggg

SEQ ID NO: 400429 - DNA, 25 bp, Mus musculus
ctttgaggccagcacattgctagct

SEQ ID NO: 400430 - DNA, 25 bp, Mus musculus
ctttgaggccagctgcagtctactg

SEQ ID NO: 400431 - DNA, 25 bp, Mus musculus
ctttgaggccaggacattgctagct

SEQ ID NO: 400432 - DNA, 25 bp, Mus musculus
ctttgaggccaggtgcagtctactg

SEQ ID NO: 400433 - DNA, 25 bp, Mus musculus
ctttgaggcctacacgaagatttgt

SEQ ID NO: 400434 - DNA, 25 bp, Mus musculus
ctttgaggcctagacgaagatttgt

SEQ ID NO: 400435 - DNA, 25 bp, Mus musculus
ctttgaggcgatagtagaacacaga

SEQ ID NO: 400436 - DNA, 25 bp, Mus musculus
ctttgaggcgattgtagaacacaga

SEQ ID NO: 400437 - DNA, 25 bp, Mus musculus
ctttgagggttcatgaatattttaa

SEQ ID NO: 400438 - DNA, 25 bp, Mus musculus
ctttgagggttcttgaatattttaa

SEQ ID NO: 400439 - DNA, 25 bp, Mus musculus
ctttgaggtgtcagcatctgggttg

SEQ ID NO: 400440 - DNA, 25 bp, Mus musculus
ctttgaggtgtctgcatctgggttg

SEQ ID NO: 400441 - DNA, 25 bp, Mus musculus
ctttgagtaacgattctcctgcctc

SEQ ID NO: 400442 - DNA, 25 bp, Mus musculus
ctttgagtaacgtttctcctgcctc

SEQ ID NO: 400443 - DNA, 25 bp, Mus musculus
ctttgagtgtggctctcaggttagt

SEQ ID NO: 400444 - DNA, 25 bp, Mus musculus
ctttgagtgtgggtctcaggttagt

SEQ ID NO: 400445 - DNA, 25 bp, Mus musculus
ctttgagttaagacgccagcttggt

SEQ ID NO: 400446 - DNA, 25 bp, Mus musculus
ctttgagttaagtcgccagcttggt

SEQ ID NO: 400447 - DNA, 25 bp, Mus musculus
ctttgagttattcttatgttattta

SEQ ID NO: 400448 - DNA, 25 bp, Mus musculus
ctttgagttattgttatgttattta

SEQ ID NO: 400449 - DNA, 25 bp, Mus musculus
ctttgagttgtgcacgatggagcat

SEQ ID NO: 400450 - DNA, 25 bp, Mus musculus
ctttgagttgtggacgatggagcat

SEQ ID NO: 400451 - DNA, 25 bp, Mus musculus
ctttgatatattaggctagctctgc

SEQ ID NO: 400452 - DNA, 25 bp, Mus musculus
ctttgatatatttggctagctctgc

SEQ ID NO: 400453 - DNA, 25 bp, Mus musculus
ctttgatatcagctgaccataatga

SEQ ID NO: 400454 - DNA, 25 bp, Mus musculus
ctttgatatcaggtgaccataatga

SEQ ID NO: 400455 - DNA, 25 bp, Mus musculus
ctttgatatgcgcaagacagctgat

SEQ ID NO: 400456 - DNA, 25 bp, Mus musculus
ctttgatatgcggaagacagctgat

SEQ ID NO: 400457 - DNA, 25 bp, Mus musculus
ctttgatattttaccctatttctgg

SEQ ID NO: 400458 - DNA, 25 bp, Mus musculus
ctttgatatttttccctatttctgg

SEQ ID NO: 400459 - DNA, 25 bp, Mus musculus
ctttgatcagttcgtcatcacccac

SEQ ID NO: 400460 - DNA, 25 bp, Mus musculus
ctttgatcagttggtcatcacccac

SEQ ID NO: 400461 - DNA, 25 bp, Mus musculus
ctttgatcccttatgtcttgagttg

SEQ ID NO: 400462 - DNA, 25 bp, Mus musculus
ctttgatcccttttgtcttgagttg

SEQ ID NO: 400463 - DNA, 25 bp, Mus musculus
ctttgatcgatactaacctgtggtt

SEQ ID NO: 400464 - DNA, 25 bp, Mus musculus
ctttgatcgatagtaacctgtggtt

SEQ ID NO: 400465 - DNA, 25 bp, Mus musculus
ctttgatcgtaaaaggtatcttcat

SEQ ID NO: 400466 - DNA, 25 bp, Mus musculus
ctttgatcgtaataggtatcttcat

SEQ ID NO: 400467 - DNA, 25 bp, Mus musculus
ctttgatctatcatgatggctttct

SEQ ID NO: 400468 - DNA, 25 bp, Mus musculus
ctttgatctatcttgatggctttct

SEQ ID NO: 400469 - DNA, 25 bp, Mus musculus
ctttgatctcggcatggacggcata

SEQ ID NO: 400470 - DNA, 25 bp, Mus musculus
ctttgatctcgggatggacggcata

SEQ ID NO: 400471 - DNA, 25 bp, Mus musculus
ctttgatctctaaatgtgcacatat

SEQ ID NO: 400472 - DNA, 25 bp, Mus musculus
ctttgatctctatatgtgcacatat

SEQ ID NO: 400473 - DNA, 25 bp, Mus musculus
ctttgatcttgaatggacccagcta

SEQ ID NO: 400474 - DNA, 25 bp, Mus musculus
ctttgatcttgattggacccagcta

SEQ ID NO: 400475 - DNA, 25 bp, Mus musculus
ctttgatgaaaccaaggctgacctt

SEQ ID NO: 400476 - DNA, 25 bp, Mus musculus
ctttgatgaaacgaaggctgacctt

SEQ ID NO: 400477 - DNA, 25 bp, Mus musculus
ctttgatgagtccaggccttacagc

SEQ ID NO: 400478 - DNA, 25 bp, Mus musculus
ctttgatgagtcgaggccttacagc

SEQ ID NO: 400479 - DNA, 25 bp, Mus musculus
ctttgatgagtgatctatcacccac

SEQ ID NO: 400480 - DNA, 25 bp, Mus musculus
ctttgatgagtgttctatcacccac

SEQ ID NO: 400481 - DNA, 25 bp, Mus musculus
ctttgatgccaaccgaggtgcagct

SEQ ID NO: 400482 - DNA, 25 bp, Mus musculus
ctttgatgccaagcgaggtgcagct

SEQ ID NO: 400483 - DNA, 25 bp, Mus musculus
ctttgatgcgggactgcagagaagc

SEQ ID NO: 400484 - DNA, 25 bp, Mus musculus
ctttgatgcgggtctgcagagaagc

SEQ ID NO: 400485 - DNA, 25 bp, Mus musculus
ctttgatgcgtcaacgtctcagatt

SEQ ID NO: 400486 - DNA, 25 bp, Mus musculus
ctttgatgcgtctacgtctcagatt

SEQ ID NO: 400487 - DNA, 25 bp, Mus musculus
ctttgatggctaactgtgcactgca

SEQ ID NO: 400488 - DNA, 25 bp, Mus musculus
ctttgatggctatctgtgcactgca

SEQ ID NO: 400489 - DNA, 25 bp, Mus musculus
ctttgatgggcccaagtccctgaaa

SEQ ID NO: 400490 - DNA, 25 bp, Mus musculus
ctttgatgggccgaagtccctgaaa

SEQ ID NO: 400491 - DNA, 25 bp, Mus musculus
ctttgatgtagtactctaggttgct

SEQ ID NO: 400492 - DNA, 25 bp, Mus musculus
ctttgatgtagttctctaggttgct

SEQ ID NO: 400493 - DNA, 25 bp, Mus musculus
ctttgatgtctgagtggattagtcc

SEQ ID NO: 400494 - DNA, 25 bp, Mus musculus
ctttgatgtctgtgtggattagtcc

SEQ ID NO: 400495 - DNA, 25 bp, Mus musculus
ctttgatgtggtccccaaaatgctt

SEQ ID NO: 400496 - DNA, 25 bp, Mus musculus
ctttgatgtggtgcccaaaatgctt

SEQ ID NO: 400497 - DNA, 25 bp, Mus musculus
ctttgattactcatgaaagcttata

SEQ ID NO: 400498 - DNA, 25 bp, Mus musculus
ctttgattactcttgaaagcttata

SEQ ID NO: 400499 - DNA, 25 bp, Mus musculus
ctttgattgaatcggtgctgcggat

SEQ ID NO: 400500 - DNA, 25 bp, Mus musculus
ctttgattgaatgggtgctgcggat

SEQ ID NO: 400501 - DNA, 25 bp, Mus musculus
ctttgatttcacatccagttgcagg

SEQ ID NO: 400502 - DNA, 25 bp, Mus musculus
ctttgatttcacttccagttgcagg

SEQ ID NO: 400503 - DNA, 25 bp, Mus musculus
ctttgatttgctatactgggatttt

SEQ ID NO: 400504 - DNA, 25 bp, Mus musculus
ctttgatttgctttactgggatttt

SEQ ID NO: 400505 - DNA, 25 bp, Mus musculus
ctttgcaaaattcttgacgctcccc

SEQ ID NO: 400506 - DNA, 25 bp, Mus musculus
ctttgcaaaattgttgacgctcccc

SEQ ID NO: 400507 - DNA, 25 bp, Mus musculus
ctttgcaaagcacgaatcgggttca

SEQ ID NO: 400508 - DNA, 25 bp, Mus musculus
ctttgcaaagcaggaatcgggttca

SEQ ID NO: 400509 - DNA, 25 bp, Mus musculus
ctttgcaaaggtatctagactgtct

SEQ ID NO: 400510 - DNA, 25 bp, Mus musculus
ctttgcaaaggtttctagactgtct

SEQ ID NO: 400511 - DNA, 25 bp, Mus musculus
ctttgcaagcaaacttggtttttat

SEQ ID NO: 400512 - DNA, 25 bp, Mus musculus
ctttgcaagcaatcttggtttttat

SEQ ID NO: 400513 - DNA, 25 bp, Mus musculus
ctttgcaagtcaaccatgtcattcc

SEQ ID NO: 400514 - DNA, 25 bp, Mus musculus
ctttgcaagtcacgccgtctactgt

SEQ ID NO: 400515 - DNA, 25 bp, Mus musculus
ctttgcaagtcaggccgtctactgt

SEQ ID NO: 400516 - DNA, 25 bp, Mus musculus
ctttgcaagtcatccatgtcattcc

SEQ ID NO: 400517 - DNA, 25 bp, Mus musculus
ctttgcaattatacagctctgtcat

SEQ ID NO: 400518 - DNA, 25 bp, Mus musculus
ctttgcaattattcagctctgtcat

SEQ ID NO: 400519 - DNA, 25 bp, Mus musculus
ctttgcacaccaatttgccttttaa

SEQ ID NO: 400520 - DNA, 25 bp, Mus musculus
ctttgcacaccattttgccttttaa

SEQ ID NO: 400521 - DNA, 25 bp, Mus musculus
ctttgcacgtgcatgaaattattgt

SEQ ID NO: 400522 - DNA, 25 bp, Mus musculus
ctttgcacgtgcttgaaattattgt

SEQ ID NO: 400523 - DNA, 25 bp, Mus musculus
ctttgcactattacaccaaggccag

SEQ ID NO: 400524 - DNA, 25 bp, Mus musculus
ctttgcactatttcaccaaggccag

SEQ ID NO: 400525 - DNA, 25 bp, Mus musculus
ctttgcacttttaatcctcctggaa

SEQ ID NO: 400526 - DNA, 25 bp, Mus musculus
ctttgcactttttatcctcctggaa

SEQ ID NO: 400527 - DNA, 25 bp, Mus musculus
ctttgcagacatactccctcttggt

SEQ ID NO: 400528 - DNA, 25 bp, Mus musculus
ctttgcagacattctccctcttggt

SEQ ID NO: 400529 - DNA, 25 bp, Mus musculus
ctttgcagatgaagtagcagcttac

SEQ ID NO: 400530 - DNA, 25 bp, Mus musculus
ctttgcagatgatgtagcagcttac

SEQ ID NO: 400531 - DNA, 25 bp, Mus musculus
ctttgcagatgtcaagatgtggccc

SEQ ID NO: 400532 - DNA, 25 bp, Mus musculus
ctttgcagatgtgaagatgtggccc

SEQ ID NO: 400533 - DNA, 25 bp, Mus musculus
ctttgcagctaaagccccttcagaa

SEQ ID NO: 400534 - DNA, 25 bp, Mus musculus
ctttgcagctaatgccccttcagaa

SEQ ID NO: 400535 - DNA, 25 bp, Mus musculus
ctttgcagggcaacagggcttggta

SEQ ID NO: 400536 - DNA, 25 bp, Mus musculus
ctttgcagggcatcagggcttggta

SEQ ID NO: 400537 - DNA, 25 bp, Mus musculus
ctttgcagtctgaggagaattgtcc

SEQ ID NO: 400538 - DNA, 25 bp, Mus musculus
ctttgcagtctgtggagaattgtcc

SEQ ID NO: 400539 - DNA, 25 bp, Mus musculus
ctttgcagtgttcagttattgttat

SEQ ID NO: 400540 - DNA, 25 bp, Mus musculus
ctttgcagtgttgagttattgttat

SEQ ID NO: 400541 - DNA, 25 bp, Mus musculus
ctttgcataataatcttcctgagga

SEQ ID NO: 400542 - DNA, 25 bp, Mus musculus
ctttgcataatattcttcctgagga

SEQ ID NO: 400543 - DNA, 25 bp, Mus musculus
ctttgcatagcaaagaactgtctgg

SEQ ID NO: 400544 - DNA, 25 bp, Mus musculus
ctttgcatagcatagaactgtctgg

SEQ ID NO: 400545 - DNA, 25 bp, Mus musculus
ctttgcatatcaaagtagactccga

SEQ ID NO: 400546 - DNA, 25 bp, Mus musculus
ctttgcatatcatagtagactccga

SEQ ID NO: 400547 - DNA, 25 bp, Mus musculus
ctttgcatcaagctgacccagcaga

SEQ ID NO: 400548 - DNA, 25 bp, Mus musculus
ctttgcatcaaggtgacccagcaga

SEQ ID NO: 400549 - DNA, 25 bp, Mus musculus
ctttgcatcactacaaactaatgaa

SEQ ID NO: 400550 - DNA, 25 bp, Mus musculus
ctttgcatcacttcaaactaatgaa

SEQ ID NO: 400551 - DNA, 25 bp, Mus musculus
ctttgcatctctactgactgaaaac

SEQ ID NO: 400552 - DNA, 25 bp, Mus musculus
ctttgcatctcttctgactgaaaac

SEQ ID NO: 400553 - DNA, 25 bp, Mus musculus
ctttgcatctgtcccaggcattaat

SEQ ID NO: 400554 - DNA, 25 bp, Mus musculus
ctttgcatctgtgccaggcattaat

SEQ ID NO: 400555 - DNA, 25 bp, Mus musculus
ctttgcatgcacaacatttgggttc

SEQ ID NO: 400556 - DNA, 25 bp, Mus musculus
ctttgcatgcactacatttgggttc

SEQ ID NO: 400557 - DNA, 25 bp, Mus musculus
ctttgcatggaccttgtacatagtt

SEQ ID NO: 400558 - DNA, 25 bp, Mus musculus
ctttgcatggacgttgtacatagtt

SEQ ID NO: 400559 - DNA, 25 bp, Mus musculus
ctttgcatgttgagtgtgatatacc

SEQ ID NO: 400560 - DNA, 25 bp, Mus musculus
ctttgcatgttgtgtgtgatatacc

SEQ ID NO: 400561 - DNA, 25 bp, Mus musculus
ctttgcattttgacccaatggatca

SEQ ID NO: 400562 - DNA, 25 bp, Mus musculus
ctttgcattttgtcccaatggatca

SEQ ID NO: 400563 - DNA, 25 bp, Mus musculus
ctttgcatttttaagccagcgactt

SEQ ID NO: 400564 - DNA, 25 bp, Mus musculus
ctttgcattttttagccagcgactt

SEQ ID NO: 400565 - DNA, 25 bp, Mus musculus
ctttgccaaatcaccacattactta

SEQ ID NO: 400566 - DNA, 25 bp, Mus musculus
ctttgccaaatctccacattactta

SEQ ID NO: 400567 - DNA, 25 bp, Mus musculus
ctttgccaagagatacgtcacgctg

SEQ ID NO: 400568 - DNA, 25 bp, Mus musculus
ctttgccaagagttacgtcacgctg

SEQ ID NO: 400569 - DNA, 25 bp, Mus musculus
ctttgccaaggaactgtggcccaga

SEQ ID NO: 400570 - DNA, 25 bp, Mus musculus
ctttgccaaggatctgtggcccaga

SEQ ID NO: 400571 - DNA, 25 bp, Mus musculus
ctttgccacagaactgacagactat

SEQ ID NO: 400572 - DNA, 25 bp, Mus musculus
ctttgccacagatctgacagactat

SEQ ID NO: 400573 - DNA, 25 bp, Mus musculus
ctttgccaccataccttaggaattt

SEQ ID NO: 400574 - DNA, 25 bp, Mus musculus
ctttgccaccatctcagtaaatcat

SEQ ID NO: 400575 - DNA, 25 bp, Mus musculus
ctttgccaccatgtcagtaaatcat

SEQ ID NO: 400576 - DNA, 25 bp, Mus musculus
ctttgccaccattccttaggaattt

SEQ ID NO: 400577 - DNA, 25 bp, Mus musculus
ctttgccacccaaacttgtttgaag

SEQ ID NO: 400578 - DNA, 25 bp, Mus musculus
ctttgccacccatacttgtttgaag

SEQ ID NO: 400579 - DNA, 25 bp, Mus musculus
ctttgccacctgcttctcaaattca

SEQ ID NO: 400580 - DNA, 25 bp, Mus musculus
ctttgccacctggttctcaaattca

SEQ ID NO: 400581 - DNA, 25 bp, Mus musculus
ctttgccagcataagaccacatcat

SEQ ID NO: 400582 - DNA, 25 bp, Mus musculus
ctttgccagcattagaccacatcat

SEQ ID NO: 400583 - DNA, 25 bp, Mus musculus
ctttgccagctgcactgcaggcgac

SEQ ID NO: 400584 - DNA, 25 bp, Mus musculus
ctttgccagctggactgcaggcgac

SEQ ID NO: 400585 - DNA, 25 bp, Mus musculus
ctttgccatgctccttcaggaaggg

SEQ ID NO: 400586 - DNA, 25 bp, Mus musculus
ctttgccatgctgcttcaggaaggg

SEQ ID NO: 400587 - DNA, 25 bp, Mus musculus
ctttgccatgtcattgagcctgtcc

SEQ ID NO: 400588 - DNA, 25 bp, Mus musculus
ctttgccatgtctttgagcctgtcc

SEQ ID NO: 400589 - DNA, 25 bp, Mus musculus
ctttgccccgacactgtgtataagc

SEQ ID NO: 400590 - DNA, 25 bp, Mus musculus
ctttgccccgactctgtgtataagc

SEQ ID NO: 400591 - DNA, 25 bp, Mus musculus
ctttgcccctgcatactaaagaggt

SEQ ID NO: 400592 - DNA, 25 bp, Mus musculus
ctttgcccctgcttactaaagaggt

SEQ ID NO: 400593 - DNA, 25 bp, Mus musculus
ctttgcccctggcaagagcttccaa

SEQ ID NO: 400594 - DNA, 25 bp, Mus musculus
ctttgcccctgggaagagcttccaa

SEQ ID NO: 400595 - DNA, 25 bp, Mus musculus
ctttgccctgatattgaccagaata

SEQ ID NO: 400596 - DNA, 25 bp, Mus musculus
ctttgccctgattttgaccagaata

SEQ ID NO: 400597 - DNA, 25 bp, Mus musculus
ctttgccctgtcacctgttattata

SEQ ID NO: 400598 - DNA, 25 bp, Mus musculus
ctttgccctgtctcctgttattata

SEQ ID NO: 400599 - DNA, 25 bp, Mus musculus
ctttgcccttccacttgtgttagga

SEQ ID NO: 400600 - DNA, 25 bp, Mus musculus
ctttgcccttcctcttgtgttagga

SEQ ID NO: 400601 - DNA, 25 bp, Mus musculus
ctttgccgagatccccaatctagaa

SEQ ID NO: 400602 - DNA, 25 bp, Mus musculus
ctttgccgagatgcccaatctagaa

SEQ ID NO: 400603 - DNA, 25 bp, Mus musculus
ctttgccgcaagacacaggtgtgtt

SEQ ID NO: 400604 - DNA, 25 bp, Mus musculus
ctttgccgcaagtcacaggtgtgtt

SEQ ID NO: 400605 - DNA, 25 bp, Mus musculus
ctttgccgttggaaccagagttgct

SEQ ID NO: 400606 - DNA, 25 bp, Mus musculus
ctttgccgttggtaccagagttgct

SEQ ID NO: 400607 - DNA, 25 bp, Mus musculus
ctttgcctacagaccacattgctca

SEQ ID NO: 400608 - DNA, 25 bp, Mus musculus
ctttgcctacagtccacattgctca

SEQ ID NO: 400609 - DNA, 25 bp, Mus musculus
ctttgcctagagaaacagtcactgc

SEQ ID NO: 400610 - DNA, 25 bp, Mus musculus
ctttgcctagagtaacagtcactgc

SEQ ID NO: 400611 - DNA, 25 bp, Mus musculus
ctttgcctcccacctatgctgaaaa

SEQ ID NO: 400612 - DNA, 25 bp, Mus musculus
ctttgcctcccagctatgctgaaaa

SEQ ID NO: 400613 - DNA, 25 bp, Mus musculus
ctttgcctccggagaacttctcact

SEQ ID NO: 400614 - DNA, 25 bp, Mus musculus
ctttgcctccggtgaacttctcact

SEQ ID NO: 400615 - DNA, 25 bp, Mus musculus
ctttgcctccttacttcatatatat

SEQ ID NO: 400616 - DNA, 25 bp, Mus musculus
ctttgcctcctttcttcatatatat

SEQ ID NO: 400617 - DNA, 25 bp, Mus musculus
ctttgcctcggtcttttcttgtttg

SEQ ID NO: 400618 - DNA, 25 bp, Mus musculus
ctttgcctcggtgttttcttgtttg

SEQ ID NO: 400619 - DNA, 25 bp, Mus musculus
ctttgcctgctactgtttgggagag

SEQ ID NO: 400620 - DNA, 25 bp, Mus musculus
ctttgcctgctagtgtttgggagag

SEQ ID NO: 400621 - DNA, 25 bp, Mus musculus
ctttgcctgctcactaacttgtaaa

SEQ ID NO: 400622 - DNA, 25 bp, Mus musculus
ctttgcctgctctctaacttgtaaa

SEQ ID NO: 400623 - DNA, 25 bp, Mus musculus
ctttgcctggatctatataactgat

SEQ ID NO: 400624 - DNA, 25 bp, Mus musculus
ctttgcctggatgtatataactgat

SEQ ID NO: 400625 - DNA, 25 bp, Mus musculus
ctttgcctggctcgagtacaaggaa

SEQ ID NO: 400626 - DNA, 25 bp, Mus musculus
ctttgcctggctggagtacaaggaa

SEQ ID NO: 400627 - DNA, 25 bp, Mus musculus
ctttgcctggtaattggtgactgaa

SEQ ID NO: 400628 - DNA, 25 bp, Mus musculus
ctttgcctggtatttggtgactgaa

SEQ ID NO: 400629 - DNA, 25 bp, Mus musculus
ctttgcctgtaaaaaattcactgtt

SEQ ID NO: 400630 - DNA, 25 bp, Mus musculus
ctttgcctgtaataaattcactgtt

SEQ ID NO: 400631 - DNA, 25 bp, Mus musculus
ctttgcctgtccctgtaataaaaca

SEQ ID NO: 400632 - DNA, 25 bp, Mus musculus
ctttgcctgtccgtgtaataaaaca

SEQ ID NO: 400633 - DNA, 25 bp, Mus musculus
ctttgccttaaacccttgggtcctg

SEQ ID NO: 400634 - DNA, 25 bp, Mus musculus
ctttgccttaaagccttgggtcctg

SEQ ID NO: 400635 - DNA, 25 bp, Mus musculus
ctttgccttaggaaggtgttggcca

SEQ ID NO: 400636 - DNA, 25 bp, Mus musculus
ctttgccttaggtaggtgttggcca

SEQ ID NO: 400637 - DNA, 25 bp, Mus musculus
ctttgccttgatattcccttgaatg

SEQ ID NO: 400638 - DNA, 25 bp, Mus musculus
ctttgccttgattttcccttgaatg

SEQ ID NO: 400639 - DNA, 25 bp, Mus musculus
ctttgcctttaaacgtttgtcgcat

SEQ ID NO: 400640 - DNA, 25 bp, Mus musculus
ctttgcctttaatcgtttgtcgcat

SEQ ID NO: 400641 - DNA, 25 bp, Mus musculus
ctttgcctttatatatgcgctcgac

SEQ ID NO: 400642 - DNA, 25 bp, Mus musculus
ctttgcctttatcctggtgatgctg

SEQ ID NO: 400643 - DNA, 25 bp, Mus musculus
ctttgcctttatgctggtgatgctg

SEQ ID NO: 400644 - DNA, 25 bp, Mus musculus
ctttgcctttatttatgcgctcgac

SEQ ID NO: 400645 - DNA, 25 bp, Mus musculus
ctttgcgaggttctctgctgaactg

SEQ ID NO: 400646 - DNA, 25 bp, Mus musculus
ctttgcgaggttgtctgctgaactg

SEQ ID NO: 400647 - DNA, 25 bp, Mus musculus
ctttgcgatgcccatgttattggaa

SEQ ID NO: 400648 - DNA, 25 bp, Mus musculus
ctttgcgatgccgatgttattggaa

SEQ ID NO: 400649 - DNA, 25 bp, Mus musculus
ctttgcgccgcacaggacttcgggt

SEQ ID NO: 400650 - DNA, 25 bp, Mus musculus
ctttgcgccgcagaggacttcgggt

SEQ ID NO: 400651 - DNA, 25 bp, Mus musculus
ctttgcggctctctacacattttta

SEQ ID NO: 400652 - DNA, 25 bp, Mus musculus
ctttgcggctctgtacacattttta

SEQ ID NO: 400653 - DNA, 25 bp, Mus musculus
ctttgcgtgctgatctgtattgtaa

SEQ ID NO: 400654 - DNA, 25 bp, Mus musculus
ctttgcgtgctgttctgtattgtaa

SEQ ID NO: 400655 - DNA, 25 bp, Mus musculus
ctttgctacgtgatgcccatggatg

SEQ ID NO: 400656 - DNA, 25 bp, Mus musculus
ctttgctacgtgttgcccatggatg

SEQ ID NO: 400657 - DNA, 25 bp, Mus musculus
ctttgctactgcattaacaaagaat

SEQ ID NO: 400658 - DNA, 25 bp, Mus musculus
ctttgctactgctttaacaaagaat

SEQ ID NO: 400659 - DNA, 25 bp, Mus musculus
ctttgctaggcaattgatggaactt

SEQ ID NO: 400660 - DNA, 25 bp, Mus musculus
ctttgctaggcatttgatggaactt

SEQ ID NO: 400661 - DNA, 25 bp, Mus musculus
ctttgctatatgaaaatagggccac

SEQ ID NO: 400662 - DNA, 25 bp, Mus musculus
ctttgctatatgtaaatagggccac

SEQ ID NO: 400663 - DNA, 25 bp, Mus musculus
ctttgctatgtacggaggctgctgc

SEQ ID NO: 400664 - DNA, 25 bp, Mus musculus
ctttgctatgtagggaggctgctgc

SEQ ID NO: 400665 - DNA, 25 bp, Mus musculus
ctttgctattatcagaatttcttaa

SEQ ID NO: 400666 - DNA, 25 bp, Mus musculus
ctttgctattatgagaatttcttaa

SEQ ID NO: 400667 - DNA, 25 bp, Mus musculus
ctttgctccagccataccttaataa

SEQ ID NO: 400668 - DNA, 25 bp, Mus musculus
ctttgctccagcgataccttaataa

SEQ ID NO: 400669 - DNA, 25 bp, Mus musculus
ctttgctcctacagggacttttgta

SEQ ID NO: 400670 - DNA, 25 bp, Mus musculus
ctttgctcctactgggacttttgta

SEQ ID NO: 400671 - DNA, 25 bp, Mus musculus
ctttgctcgaatagggctcttcagt

SEQ ID NO: 400672 - DNA, 25 bp, Mus musculus
ctttgctcgaattgggctcttcagt

SEQ ID NO: 400673 - DNA, 25 bp, Mus musculus
ctttgctctacacaaaagcttatca

SEQ ID NO: 400674 - DNA, 25 bp, Mus musculus
ctttgctctacaccctccagttttt

SEQ ID NO: 400675 - DNA, 25 bp, Mus musculus
ctttgctctacagaaaagcttatca

SEQ ID NO: 400676 - DNA, 25 bp, Mus musculus
ctttgctctacagcctccagttttt

SEQ ID NO: 400677 - DNA, 25 bp, Mus musculus
ctttgctctcaaaaacttagttaca

SEQ ID NO: 400678 - DNA, 25 bp, Mus musculus
ctttgctctcaataacttagttaca

SEQ ID NO: 400679 - DNA, 25 bp, Mus musculus
ctttgctctcttcattttccgaaat

SEQ ID NO: 400680 - DNA, 25 bp, Mus musculus
ctttgctctcttgattttccgaaat

SEQ ID NO: 400681 - DNA, 25 bp, Mus musculus
ctttgctctgggagtgtttgtatat

SEQ ID NO: 400682 - DNA, 25 bp, Mus musculus
ctttgctctgggtgtgtttgtatat

SEQ ID NO: 400683 - DNA, 25 bp, Mus musculus
ctttgctcttcccacatacagttag

SEQ ID NO: 400684 - DNA, 25 bp, Mus musculus
ctttgctcttccgacatacagttag

SEQ ID NO: 400685 - DNA, 25 bp, Mus musculus
ctttgctcttggaatgctcatctga

SEQ ID NO: 400686 - DNA, 25 bp, Mus musculus
ctttgctcttggtatgctcatctga

SEQ ID NO: 400687 - DNA, 25 bp, Mus musculus
ctttgctctttgcaaagcctgaccc

SEQ ID NO: 400688 - DNA, 25 bp, Mus musculus
ctttgctctttggaaagcctgaccc

SEQ ID NO: 400689 - DNA, 25 bp, Mus musculus
ctttgctgaattcttgatcccttta

SEQ ID NO: 400690 - DNA, 25 bp, Mus musculus
ctttgctgaattgttgatcccttta

SEQ ID NO: 400691 - DNA, 25 bp, Mus musculus
ctttgctgaggtctgtcttacacag

SEQ ID NO: 400692 - DNA, 25 bp, Mus musculus
ctttgctgaggtgtgtcttacacag

SEQ ID NO: 400693 - DNA, 25 bp, Mus musculus
ctttgctgccatactgtgggagaat

SEQ ID NO: 400694 - DNA, 25 bp, Mus musculus
ctttgctgccattctgtgggagaat

SEQ ID NO: 400695 - DNA, 25 bp, Mus musculus
ctttgctgctacatcatttgttctg

SEQ ID NO: 400696 - DNA, 25 bp, Mus musculus
ctttgctgctacttcatttgttctg

SEQ ID NO: 400697 - DNA, 25 bp, Mus musculus
ctttgctggccaaattcctcctgtc

SEQ ID NO: 400698 - DNA, 25 bp, Mus musculus
ctttgctggccatattcctcctgtc

SEQ ID NO: 400699 - DNA, 25 bp, Mus musculus
ctttgcttaaatatgaatactcagt

SEQ ID NO: 400700 - DNA, 25 bp, Mus musculus
ctttgcttaaatttgaatactcagt

SEQ ID NO: 400701 - DNA, 25 bp, Mus musculus
ctttgcttcagtaagtaggccagca

SEQ ID NO: 400702 - DNA, 25 bp, Mus musculus
ctttgcttcagttagtaggccagca

SEQ ID NO: 400703 - DNA, 25 bp, Mus musculus
ctttgcttcattccggcggcagcag

SEQ ID NO: 400704 - DNA, 25 bp, Mus musculus
ctttgcttcattgcggcggcagcag

SEQ ID NO: 400705 - DNA, 25 bp, Mus musculus
ctttgcttccctcatcgcataagaa

SEQ ID NO: 400706 - DNA, 25 bp, Mus musculus
ctttgcttccctgatcgcataagaa

SEQ ID NO: 400707 - DNA, 25 bp, Mus musculus
ctttgcttgcggaagattttcttta

SEQ ID NO: 400708 - DNA, 25 bp, Mus musculus
ctttgcttgcggtagattttcttta

SEQ ID NO: 400709 - DNA, 25 bp, Mus musculus
ctttgcttgctcagtgtggcggaga

SEQ ID NO: 400710 - DNA, 25 bp, Mus musculus
ctttgcttgctctgtgtggcggaga

SEQ ID NO: 400711 - DNA, 25 bp, Mus musculus
ctttgctttactctttatgctcatg

SEQ ID NO: 400712 - DNA, 25 bp, Mus musculus
ctttgctttactgtttatgctcatg

SEQ ID NO: 400713 - DNA, 25 bp, Mus musculus
ctttgctttcatattttgactgagg

SEQ ID NO: 400714 - DNA, 25 bp, Mus musculus
ctttgctttcattttttgactgagg

SEQ ID NO: 400715 - DNA, 25 bp, Mus musculus
ctttgctttctaatccattaaccat

SEQ ID NO: 400716 - DNA, 25 bp, Mus musculus
ctttgctttctattccattaaccat

SEQ ID NO: 400717 - DNA, 25 bp, Mus musculus
ctttgctttctgagcatcagggagg

SEQ ID NO: 400718 - DNA, 25 bp, Mus musculus
ctttgctttctgtgcatcagggagg

SEQ ID NO: 400719 - DNA, 25 bp, Mus musculus
ctttgctttgtcatctcagacatac

SEQ ID NO: 400720 - DNA, 25 bp, Mus musculus
ctttgctttgtcttctcagacatac

SEQ ID NO: 400721 - DNA, 25 bp, Mus musculus
ctttgctttgtgagaccacatgctt

SEQ ID NO: 400722 - DNA, 25 bp, Mus musculus
ctttgctttgtgtgaccacatgctt

SEQ ID NO: 400723 - DNA, 25 bp, Mus musculus
ctttgcttttgcagggtgtcccgaa

SEQ ID NO: 400724 - DNA, 25 bp, Mus musculus
ctttgcttttgctgggtgtcccgaa

SEQ ID NO: 400725 - DNA, 25 bp, Mus musculus
ctttgctttttcagtatgttgaata

SEQ ID NO: 400726 - DNA, 25 bp, Mus musculus
ctttgctttttctgtatgttgaata

SEQ ID NO: 400727 - DNA, 25 bp, Mus musculus
ctttggaactgtccgtaacaacttt

SEQ ID NO: 400728 - DNA, 25 bp, Mus musculus
ctttggaactgtgcgtaacaacttt

SEQ ID NO: 400729 - DNA, 25 bp, Mus musculus
ctttggaagcctccagatcaccaga

SEQ ID NO: 400730 - DNA, 25 bp, Mus musculus
ctttggaagcctgcagatcaccaga

SEQ ID NO: 400731 - DNA, 25 bp, Mus musculus
ctttggaatgctcccatttactatt

SEQ ID NO: 400732 - DNA, 25 bp, Mus musculus
ctttggaatgctgccatttactatt

SEQ ID NO: 400733 - DNA, 25 bp, Mus musculus
ctttggaattcgctactgtgtaact

SEQ ID NO: 400734 - DNA, 25 bp, Mus musculus
ctttggaattcggtactgtgtaact

SEQ ID NO: 400735 - DNA, 25 bp, Mus musculus
ctttggacatatccttaaatactga

SEQ ID NO: 400736 - DNA, 25 bp, Mus musculus
ctttggacatatgcttaaatactga

SEQ ID NO: 400737 - DNA, 25 bp, Mus musculus
ctttggaccttccacctagctttgt

SEQ ID NO: 400738 - DNA, 25 bp, Mus musculus
ctttggaccttcgacctagctttgt

SEQ ID NO: 400739 - DNA, 25 bp, Mus musculus
ctttggactctactgtgctatgtac

SEQ ID NO: 400740 - DNA, 25 bp, Mus musculus
ctttggactctagtgtgctatgtac

SEQ ID NO: 400741 - DNA, 25 bp, Mus musculus
ctttggactctgactcctgatagag

SEQ ID NO: 400742 - DNA, 25 bp, Mus musculus
ctttggactctgtctcctgatagag

SEQ ID NO: 400743 - DNA, 25 bp, Mus musculus
ctttggactggaagggaataaccaa

SEQ ID NO: 400744 - DNA, 25 bp, Mus musculus
ctttggactggatgggaataaccaa

SEQ ID NO: 400745 - DNA, 25 bp, Mus musculus
ctttggactgtgcagccgtattaac

SEQ ID NO: 400746 - DNA, 25 bp, Mus musculus
ctttggactgtggagccgtattaac

SEQ ID NO: 400747 - DNA, 25 bp, Mus musculus
ctttggagacaaccattctgctgaa

SEQ ID NO: 400748 - DNA, 25 bp, Mus musculus
ctttggagacaagcattctgctgaa

SEQ ID NO: 400749 - DNA, 25 bp, Mus musculus
ctttggagcacacctgagagcacat

SEQ ID NO: 400750 - DNA, 25 bp, Mus musculus
ctttggagcacagctgagagcacat

SEQ ID NO: 400751 - DNA, 25 bp, Mus musculus
ctttggaggaataagctaagttgga

SEQ ID NO: 400752 - DNA, 25 bp, Mus musculus
ctttggaggaattagctaagttgga

SEQ ID NO: 400753 - DNA, 25 bp, Mus musculus
ctttggaggacactgtttagaaact

SEQ ID NO: 400754 - DNA, 25 bp, Mus musculus
ctttggaggacagtgtttagaaact

SEQ ID NO: 400755 - DNA, 25 bp, Mus musculus
ctttggaggtctctgcatgcatgtc

SEQ ID NO: 400756 - DNA, 25 bp, Mus musculus
ctttggaggtctgtgcatgcatgtc

SEQ ID NO: 400757 - DNA, 25 bp, Mus musculus
ctttggagtacaagtggcagcagta

SEQ ID NO: 400758 - DNA, 25 bp, Mus musculus
ctttggagtacatgtggcagcagta

SEQ ID NO: 400759 - DNA, 25 bp, Mus musculus
ctttggataccaagctggtggctgg

SEQ ID NO: 400760 - DNA, 25 bp, Mus musculus
ctttggataccactacggaggcgct

SEQ ID NO: 400761 - DNA, 25 bp, Mus musculus
ctttggataccagtacggaggcgct

SEQ ID NO: 400762 - DNA, 25 bp, Mus musculus
ctttggataccatgctggtggctgg

SEQ ID NO: 400763 - DNA, 25 bp, Mus musculus
ctttggatactgaagtgcaagagca

SEQ ID NO: 400764 - DNA, 25 bp, Mus musculus
ctttggatactgtagtgcaagagca

SEQ ID NO: 400765 - DNA, 25 bp, Mus musculus
ctttggatcatcaaactcgtctgtc

SEQ ID NO: 400766 - DNA, 25 bp, Mus musculus
ctttggatcatctaactcgtctgtc

SEQ ID NO: 400767 - DNA, 25 bp, Mus musculus
ctttggatctacagcatcagcccct

SEQ ID NO: 400768 - DNA, 25 bp, Mus musculus
ctttggatctactgcatcagcccct

SEQ ID NO: 400769 - DNA, 25 bp, Mus musculus
ctttggatgctaagctcgtgtctcc

SEQ ID NO: 400770 - DNA, 25 bp, Mus musculus
ctttggatgctatgctcgtgtctcc

SEQ ID NO: 400771 - DNA, 25 bp, Mus musculus
ctttggatgcttaaattgaggcctt

SEQ ID NO: 400772 - DNA, 25 bp, Mus musculus
ctttggatgctttaattgaggcctt

SEQ ID NO: 400773 - DNA, 25 bp, Mus musculus
ctttggatggaacctgaacagtgct

SEQ ID NO: 400774 - DNA, 25 bp, Mus musculus
ctttggatggaagctgaacagtgct

SEQ ID NO: 400775 - DNA, 25 bp, Mus musculus
ctttggattggtctattgtggattc

SEQ ID NO: 400776 - DNA, 25 bp, Mus musculus
ctttggattggtgtattgtggattc

SEQ ID NO: 400777 - DNA, 25 bp, Mus musculus
ctttggatttttcaagggccgtcat

SEQ ID NO: 400778 - DNA, 25 bp, Mus musculus
ctttggatttttgaagggccgtcat

SEQ ID NO: 400779 - DNA, 25 bp, Mus musculus
ctttggcaagatcacgatgtttcat

SEQ ID NO: 400780 - DNA, 25 bp, Mus musculus
ctttggcaagatgacgatgtttcat

SEQ ID NO: 400781 - DNA, 25 bp, Mus musculus
ctttggcaatggctcggatgtgacc

SEQ ID NO: 400782 - DNA, 25 bp, Mus musculus
ctttggcaatgggtcggatgtgacc

SEQ ID NO: 400783 - DNA, 25 bp, Mus musculus
ctttggcaatgtcagctggtcagga

SEQ ID NO: 400784 - DNA, 25 bp, Mus musculus
ctttggcaatgtgagctggtcagga

SEQ ID NO: 400785 - DNA, 25 bp, Mus musculus
ctttggcacctgagttactggactg

SEQ ID NO: 400786 - DNA, 25 bp, Mus musculus
ctttggcacctgtgttactggactg

SEQ ID NO: 400787 - DNA, 25 bp, Mus musculus
ctttggcacgtgctcctttaattga

SEQ ID NO: 400788 - DNA, 25 bp, Mus musculus
ctttggcacgtggtcctttaattga

SEQ ID NO: 400789 - DNA, 25 bp, Mus musculus
ctttggcactcaccgttcagtttta

SEQ ID NO: 400790 - DNA, 25 bp, Mus musculus
ctttggcactcagcgttcagtttta

SEQ ID NO: 400791 - DNA, 25 bp, Mus musculus
ctttggcagaagcagatttactatt

SEQ ID NO: 400792 - DNA, 25 bp, Mus musculus
ctttggcagaaggagatttactatt

SEQ ID NO: 400793 - DNA, 25 bp, Mus musculus
ctttggcagcctaggtttgctgtaa

SEQ ID NO: 400794 - DNA, 25 bp, Mus musculus
ctttggcagccttggtttgctgtaa

SEQ ID NO: 400795 - DNA, 25 bp, Mus musculus
ctttggcagcttatagttcctgctg

SEQ ID NO: 400796 - DNA, 25 bp, Mus musculus
ctttggcagcttttagttcctgctg

SEQ ID NO: 400797 - DNA, 25 bp, Mus musculus
ctttggcatggtcaacacttcattt

SEQ ID NO: 400798 - DNA, 25 bp, Mus musculus
ctttggcatggtcaattgggcattt

SEQ ID NO: 400799 - DNA, 25 bp, Mus musculus
ctttggcatggtgaacacttcattt

SEQ ID NO: 400800 - DNA, 25 bp, Mus musculus
ctttggcatggtgaattgggcattt

SEQ ID NO: 400801 - DNA, 25 bp, Mus musculus
ctttggcattgacagacctgggtct

SEQ ID NO: 400802 - DNA, 25 bp, Mus musculus
ctttggcattgagagacctgggtct

SEQ ID NO: 400803 - DNA, 25 bp, Mus musculus
ctttggccagagagagtacttacga

SEQ ID NO: 400804 - DNA, 25 bp, Mus musculus
ctttggccagagtgagtacttacga

SEQ ID NO: 400805 - DNA, 25 bp, Mus musculus
ctttggccatggatgtaggtgatca

SEQ ID NO: 400806 - DNA, 25 bp, Mus musculus
ctttggccatggttgtaggtgatca

SEQ ID NO: 400807 - DNA, 25 bp, Mus musculus
ctttggccattcagcatagagtcca

SEQ ID NO: 400808 - DNA, 25 bp, Mus musculus
ctttggccattctgcatagagtcca

SEQ ID NO: 400809 - DNA, 25 bp, Mus musculus
ctttggcccctgacccggatgagag

SEQ ID NO: 400810 - DNA, 25 bp, Mus musculus
ctttggcccctgtcccggatgagag

SEQ ID NO: 400811 - DNA, 25 bp, Mus musculus
ctttggcctagtccagacaggagcc

SEQ ID NO: 400812 - DNA, 25 bp, Mus musculus
ctttggcctagtgcagacaggagcc

SEQ ID NO: 400813 - DNA, 25 bp, Mus musculus
ctttggcctattagtgtggacactt

SEQ ID NO: 400814 - DNA, 25 bp, Mus musculus
ctttggcctatttgtgtggacactt

SEQ ID NO: 400815 - DNA, 25 bp, Mus musculus
ctttggcctgctcggtcaagaacat

SEQ ID NO: 400816 - DNA, 25 bp, Mus musculus
ctttggcctgctgggtcaagaacat

SEQ ID NO: 400817 - DNA, 25 bp, Mus musculus
ctttggcctggtacagccgggtagt

SEQ ID NO: 400818 - DNA, 25 bp, Mus musculus
ctttggcctggttcagccgggtagt

SEQ ID NO: 400819 - DNA, 25 bp, Mus musculus
ctttggcgcagtcaacaacgtcaag

SEQ ID NO: 400820 - DNA, 25 bp, Mus musculus
ctttggcgcagtgaacaacgtcaag

SEQ ID NO: 400821 - DNA, 25 bp, Mus musculus
ctttggcggagcactgaagttctga

SEQ ID NO: 400822 - DNA, 25 bp, Mus musculus
ctttggcggagctctgaagttctga

SEQ ID NO: 400823 - DNA, 25 bp, Mus musculus
ctttggcggctcatgttttgaagat

SEQ ID NO: 400824 - DNA, 25 bp, Mus musculus
ctttggcggctcttgttttgaagat

SEQ ID NO: 400825 - DNA, 25 bp, Mus musculus
ctttggctagggatgctgctgttca

SEQ ID NO: 400826 - DNA, 25 bp, Mus musculus
ctttggctagggttgctgctgttca

SEQ ID NO: 400827 - DNA, 25 bp, Mus musculus
ctttggctgccaattgggtgtttta

SEQ ID NO: 400828 - DNA, 25 bp, Mus musculus
ctttggctgccatttgggtgtttta

SEQ ID NO: 400829 - DNA, 25 bp, Mus musculus
ctttggctgcctatgggacgaagat

SEQ ID NO: 400830 - DNA, 25 bp, Mus musculus
ctttggctgcctctgaattgtgtgt

SEQ ID NO: 400831 - DNA, 25 bp, Mus musculus
ctttggctgcctgtgaattgtgtgt

SEQ ID NO: 400832 - DNA, 25 bp, Mus musculus
ctttggctgcctttgggacgaagat

SEQ ID NO: 400833 - DNA, 25 bp, Mus musculus
ctttggcttccacatgcacatgtga

SEQ ID NO: 400834 - DNA, 25 bp, Mus musculus
ctttggcttccagatgcacatgtga

SEQ ID NO: 400835 - DNA, 25 bp, Mus musculus
ctttggcttgaaaatattggcgatt

SEQ ID NO: 400836 - DNA, 25 bp, Mus musculus
ctttggcttgaatatattggcgatt

SEQ ID NO: 400837 - DNA, 25 bp, Mus musculus
ctttggcttggtatggatgattctt

SEQ ID NO: 400838 - DNA, 25 bp, Mus musculus
ctttggcttggtttggatgattctt

SEQ ID NO: 400839 - DNA, 25 bp, Mus musculus
ctttggctttttcttctgacgaaga

SEQ ID NO: 400840 - DNA, 25 bp, Mus musculus
ctttggctttttgttctgacgaaga

SEQ ID NO: 400841 - DNA, 25 bp, Mus musculus
ctttgggaaaggctgctcattaaat

SEQ ID NO: 400842 - DNA, 25 bp, Mus musculus
ctttgggaaagggtgctcattaaat

SEQ ID NO: 400843 - DNA, 25 bp, Mus musculus
ctttgggaatcaatacagttgtgca

SEQ ID NO: 400844 - DNA, 25 bp, Mus musculus
ctttgggaatcattacagttgtgca

SEQ ID NO: 400845 - DNA, 25 bp, Mus musculus
ctttgggacattacactgcctgtga

SEQ ID NO: 400846 - DNA, 25 bp, Mus musculus
ctttgggacatttcactgcctgtga

SEQ ID NO: 400847 - DNA, 25 bp, Mus musculus
ctttgggacttgcttccctgtgtga

SEQ ID NO: 400848 - DNA, 25 bp, Mus musculus
ctttgggacttggttccctgtgtga

SEQ ID NO: 400849 - DNA, 25 bp, Mus musculus
ctttgggagatcattacctatggga

SEQ ID NO: 400850 - DNA, 25 bp, Mus musculus
ctttgggagatctttacctatggga

SEQ ID NO: 400851 - DNA, 25 bp, Mus musculus
ctttgggagttcctcatttccacct

SEQ ID NO: 400852 - DNA, 25 bp, Mus musculus
ctttgggagttcgtcatttccacct

SEQ ID NO: 400853 - DNA, 25 bp, Mus musculus
ctttgggatcttattgtacatactg

SEQ ID NO: 400854 - DNA, 25 bp, Mus musculus
ctttgggatctttttgtacatactg

SEQ ID NO: 400855 - DNA, 25 bp, Mus musculus
ctttgggatgacatactttcggtat

SEQ ID NO: 400856 - DNA, 25 bp, Mus musculus
ctttgggatgacttactttcggtat

SEQ ID NO: 400857 - DNA, 25 bp, Mus musculus
ctttgggattcaatacgagtttgat

SEQ ID NO: 400858 - DNA, 25 bp, Mus musculus
ctttgggattcattacgagtttgat

SEQ ID NO: 400859 - DNA, 25 bp, Mus musculus
ctttgggcacacatcagcttagtaa

SEQ ID NO: 400860 - DNA, 25 bp, Mus musculus
ctttgggcacacttcagcttagtaa

SEQ ID NO: 400861 - DNA, 25 bp, Mus musculus
ctttgggcagcgagaaggcacttac

SEQ ID NO: 400862 - DNA, 25 bp, Mus musculus
ctttgggcagcgtgaaggcacttac

SEQ ID NO: 400863 - DNA, 25 bp, Mus musculus
ctttgggcataaatagtcagtgcac

SEQ ID NO: 400864 - DNA, 25 bp, Mus musculus
ctttgggcataattagtcagtgcac

SEQ ID NO: 400865 - DNA, 25 bp, Mus musculus
ctttgggcatctctctggtgtgtgt

SEQ ID NO: 400866 - DNA, 25 bp, Mus musculus
ctttgggcatctgtctggtgtgtgt

SEQ ID NO: 400867 - DNA, 25 bp, Mus musculus
ctttgggccctgacaagtgaaatca

SEQ ID NO: 400868 - DNA, 25 bp, Mus musculus
ctttgggccctgtcaagtgaaatca

SEQ ID NO: 400869 - DNA, 25 bp, Mus musculus
ctttgggccgaacctggcttaagaa

SEQ ID NO: 400870 - DNA, 25 bp, Mus musculus
ctttgggccgaagctggcttaagaa

SEQ ID NO: 400871 - DNA, 25 bp, Mus musculus
ctttgggcgatcagcttggctgaca

SEQ ID NO: 400872 - DNA, 25 bp, Mus musculus
ctttgggcgatctgcttggctgaca

SEQ ID NO: 400873 - DNA, 25 bp, Mus musculus
ctttgggctgaacgtctgacgctcc

SEQ ID NO: 400874 - DNA, 25 bp, Mus musculus
ctttgggctgaaggtctgacgctcc

SEQ ID NO: 400875 - DNA, 25 bp, Mus musculus
ctttgggctgacatccatgactggt

SEQ ID NO: 400876 - DNA, 25 bp, Mus musculus
ctttgggctgacttccatgactggt

SEQ ID NO: 400877 - DNA, 25 bp, Mus musculus
ctttgggctgtaacaaggctcctga

SEQ ID NO: 400878 - DNA, 25 bp, Mus musculus
ctttgggctgtatcaaggctcctga

SEQ ID NO: 400879 - DNA, 25 bp, Mus musculus
ctttgggtcaggagtagggccttca

SEQ ID NO: 400880 - DNA, 25 bp, Mus musculus
ctttgggtcaggtgtagggccttca

SEQ ID NO: 400881 - DNA, 25 bp, Mus musculus
ctttgggtcctgcacttgctctgta

SEQ ID NO: 400882 - DNA, 25 bp, Mus musculus
ctttgggtcctggacttgctctgta

SEQ ID NO: 400883 - DNA, 25 bp, Mus musculus
ctttgggtcgggacgctgcatccag

SEQ ID NO: 400884 - DNA, 25 bp, Mus musculus
ctttgggtcgggtcgctgcatccag

SEQ ID NO: 400885 - DNA, 25 bp, Mus musculus
ctttgggtctacattcagtgggtcc

SEQ ID NO: 400886 - DNA, 25 bp, Mus musculus
ctttgggtctactttcagtgggtcc

SEQ ID NO: 400887 - DNA, 25 bp, Mus musculus
ctttgggtgcctacgagaatggtgt

SEQ ID NO: 400888 - DNA, 25 bp, Mus musculus
ctttgggtgccttcgagaatggtgt

SEQ ID NO: 400889 - DNA, 25 bp, Mus musculus
ctttgggtgggaattctgtgttgtc

SEQ ID NO: 400890 - DNA, 25 bp, Mus musculus
ctttgggtgggatttctgtgttgtc

SEQ ID NO: 400891 - DNA, 25 bp, Mus musculus
ctttgggttcctctagctcctgctg

SEQ ID NO: 400892 - DNA, 25 bp, Mus musculus
ctttgggttcctgtagctcctgctg

SEQ ID NO: 400893 - DNA, 25 bp, Mus musculus
ctttgggttgctacatatcgaatga

SEQ ID NO: 400894 - DNA, 25 bp, Mus musculus
ctttgggttgcttcatatcgaatga

SEQ ID NO: 400895 - DNA, 25 bp, Mus musculus
ctttgggttttcatgctgaagttct

SEQ ID NO: 400896 - DNA, 25 bp, Mus musculus
ctttgggttttcttgctgaagttct

SEQ ID NO: 400897 - DNA, 25 bp, Mus musculus
ctttggtacaggaggctagctttgc

SEQ ID NO: 400898 - DNA, 25 bp, Mus musculus
ctttggtacaggtggctagctttgc

SEQ ID NO: 400899 - DNA, 25 bp, Mus musculus
ctttggtaccagctgtgacttttca

SEQ ID NO: 400900 - DNA, 25 bp, Mus musculus
ctttggtaccaggtgtgacttttca

SEQ ID NO: 400901 - DNA, 25 bp, Mus musculus
ctttggtcactcaactgggtgactt

SEQ ID NO: 400902 - DNA, 25 bp, Mus musculus
ctttggtcactctactgggtgactt

SEQ ID NO: 400903 - DNA, 25 bp, Mus musculus
ctttggtcagggaattcggtcatcc

SEQ ID NO: 400904 - DNA, 25 bp, Mus musculus
ctttggtcagggtattcggtcatcc

SEQ ID NO: 400905 - DNA, 25 bp, Mus musculus
ctttggtcaggtattcgtcatccga

SEQ ID NO: 400906 - DNA, 25 bp, Mus musculus
ctttggtcaggttttcgtcatccga

SEQ ID NO: 400907 - DNA, 25 bp, Mus musculus
ctttggtccatgacgaactaagttt

SEQ ID NO: 400908 - DNA, 25 bp, Mus musculus
ctttggtccatgtcgaactaagttt

SEQ ID NO: 400909 - DNA, 25 bp, Mus musculus
ctttggtcccaacgccttagctggg

SEQ ID NO: 400910 - DNA, 25 bp, Mus musculus
ctttggtcccaaggccttagctggg

SEQ ID NO: 400911 - DNA, 25 bp, Mus musculus
ctttggtcctgtacagacttgtcag

SEQ ID NO: 400912 - DNA, 25 bp, Mus musculus
ctttggtcctgttcagacttgtcag

SEQ ID NO: 400913 - DNA, 25 bp, Mus musculus
ctttggtcgaaacatatggcacaat

SEQ ID NO: 400914 - DNA, 25 bp, Mus musculus
ctttggtcgaaagatatggcacaat

SEQ ID NO: 400915 - DNA, 25 bp, Mus musculus
ctttggtctttacctaagaagccat

SEQ ID NO: 400916 - DNA, 25 bp, Mus musculus
ctttggtctttagctaagaagccat

SEQ ID NO: 400917 - DNA, 25 bp, Mus musculus
ctttggtcttttctttatcccagag

SEQ ID NO: 400918 - DNA, 25 bp, Mus musculus
ctttggtcttttgtttatcccagag

SEQ ID NO: 400919 - DNA, 25 bp, Mus musculus
ctttggtgaagacctgatgccctga

SEQ ID NO: 400920 - DNA, 25 bp, Mus musculus
ctttggtgaagagctgatgccctga

SEQ ID NO: 400921 - DNA, 25 bp, Mus musculus
ctttggtgaagtagcagcctgctga

SEQ ID NO: 400922 - DNA, 25 bp, Mus musculus
ctttggtgaagttgcagcctgctga

SEQ ID NO: 400923 - DNA, 25 bp, Mus musculus
ctttggtgacagctctgctcgaata

SEQ ID NO: 400924 - DNA, 25 bp, Mus musculus
ctttggtgacaggtctgctcgaata

SEQ ID NO: 400925 - DNA, 25 bp, Mus musculus
ctttggtgaggcctgacagtttatc

SEQ ID NO: 400926 - DNA, 25 bp, Mus musculus
ctttggtgaggcgtgacagtttatc

SEQ ID NO: 400927 - DNA, 25 bp, Mus musculus
ctttggtgatcgctactttgggaca

SEQ ID NO: 400928 - DNA, 25 bp, Mus musculus
ctttggtgatcggtactttgggaca

SEQ ID NO: 400929 - DNA, 25 bp, Mus musculus
ctttggtggtcgaggtggaggcaga

SEQ ID NO: 400930 - DNA, 25 bp, Mus musculus
ctttggtggtcgtggtggaggcaga

SEQ ID NO: 400931 - DNA, 25 bp, Mus musculus
ctttggtgtgtgagattcgcctcta

SEQ ID NO: 400932 - DNA, 25 bp, Mus musculus
ctttggtgtgtgtgattcgcctcta

SEQ ID NO: 400933 - DNA, 25 bp, Mus musculus
ctttggttaggtctagcatagatac

SEQ ID NO: 400934 - DNA, 25 bp, Mus musculus
ctttggttaggtgtagcatagatac

SEQ ID NO: 400935 - DNA, 25 bp, Mus musculus
ctttggttatttcctggtgttgtca

SEQ ID NO: 400936 - DNA, 25 bp, Mus musculus
ctttggttatttgctggtgttgtca

SEQ ID NO: 400937 - DNA, 25 bp, Mus musculus
ctttggttccatactaattgtccta

SEQ ID NO: 400938 - DNA, 25 bp, Mus musculus
ctttggttccattctaattgtccta

SEQ ID NO: 400939 - DNA, 25 bp, Mus musculus
ctttggttgcgcagacctagggaat

SEQ ID NO: 400940 - DNA, 25 bp, Mus musculus
ctttggttgcgctgacctagggaat

SEQ ID NO: 400941 - DNA, 25 bp, Mus musculus
ctttggttgctaaattaaactgtaa

SEQ ID NO: 400942 - DNA, 25 bp, Mus musculus
ctttggttgctatattaaactgtaa

SEQ ID NO: 400943 - DNA, 25 bp, Mus musculus
ctttggttgctgaagcttattttca

SEQ ID NO: 400944 - DNA, 25 bp, Mus musculus
ctttggttgctgtagcttattttca

SEQ ID NO: 400945 - DNA, 25 bp, Mus musculus
ctttggtttcatattcttagctact

SEQ ID NO: 400946 - DNA, 25 bp, Mus musculus
ctttggtttcattttcttagctact

SEQ ID NO: 400947 - DNA, 25 bp, Mus musculus
ctttggtttggccatgttctatctt

SEQ ID NO: 400948 - DNA, 25 bp, Mus musculus
ctttggtttggcgatgttctatctt

SEQ ID NO: 400949 - DNA, 25 bp, Mus musculus
ctttggtttgtaatgctctggagaa

SEQ ID NO: 400950 - DNA, 25 bp, Mus musculus
ctttggtttgtattgctctggagaa

SEQ ID NO: 400951 - DNA, 25 bp, Mus musculus
ctttgtaaatatccctcaacagaca

SEQ ID NO: 400952 - DNA, 25 bp, Mus musculus
ctttgtaaatatgcctcaacagaca

SEQ ID NO: 400953 - DNA, 25 bp, Mus musculus
ctttgtaacaggacttttcagctta

SEQ ID NO: 400954 - DNA, 25 bp, Mus musculus
ctttgtaacaggtcttttcagctta

SEQ ID NO: 400955 - DNA, 25 bp, Mus musculus
ctttgtaattatatctactgagtag

SEQ ID NO: 400956 - DNA, 25 bp, Mus musculus
ctttgtaattatttctactgagtag

SEQ ID NO: 400957 - DNA, 25 bp, Mus musculus
ctttgtacctctaagctgtctctag

SEQ ID NO: 400958 - DNA, 25 bp, Mus musculus
ctttgtacctcttagctgtctctag

SEQ ID NO: 400959 - DNA, 25 bp, Mus musculus
ctttgtactaagctcatatctggct

SEQ ID NO: 400960 - DNA, 25 bp, Mus musculus
ctttgtactaaggtcatatctggct

SEQ ID NO: 400961 - DNA, 25 bp, Mus musculus
ctttgtactatgacagttccaccat

SEQ ID NO: 400962 - DNA, 25 bp, Mus musculus
ctttgtactatgtcagttccaccat

SEQ ID NO: 400963 - DNA, 25 bp, Mus musculus
ctttgtactgctacatgccatgaaa

SEQ ID NO: 400964 - DNA, 25 bp, Mus musculus
ctttgtactgcttcatgccatgaaa

SEQ ID NO: 400965 - DNA, 25 bp, Mus musculus
ctttgtactgtaccctctagagtgg

SEQ ID NO: 400966 - DNA, 25 bp, Mus musculus
ctttgtactgtagcctctagagtgg

SEQ ID NO: 400967 - DNA, 25 bp, Mus musculus
ctttgtagaaagactccccagtata

SEQ ID NO: 400968 - DNA, 25 bp, Mus musculus
ctttgtagaaagtctccccagtata

SEQ ID NO: 400969 - DNA, 25 bp, Mus musculus
ctttgtagctgaagttattttacca

SEQ ID NO: 400970 - DNA, 25 bp, Mus musculus
ctttgtagctgatgttattttacca

SEQ ID NO: 400971 - DNA, 25 bp, Mus musculus
ctttgtagggttactgcaggttaat

SEQ ID NO: 400972 - DNA, 25 bp, Mus musculus
ctttgtagggtttctgcaggttaat

SEQ ID NO: 400973 - DNA, 25 bp, Mus musculus
ctttgtagtatcagaatgtcatcca

SEQ ID NO: 400974 - DNA, 25 bp, Mus musculus
ctttgtagtatctgaatgtcatcca

SEQ ID NO: 400975 - DNA, 25 bp, Mus musculus
ctttgtagtcctcgagggttgtgct

SEQ ID NO: 400976 - DNA, 25 bp, Mus musculus
ctttgtagtcctggagggttgtgct

SEQ ID NO: 400977 - DNA, 25 bp, Mus musculus
ctttgtagttctagatactcagcta

SEQ ID NO: 400978 - DNA, 25 bp, Mus musculus
ctttgtagttcttgatactcagcta

SEQ ID NO: 400979 - DNA, 25 bp, Mus musculus
ctttgtatatgaaacgagttcccaa

SEQ ID NO: 400980 - DNA, 25 bp, Mus musculus
ctttgtatatgatacgagttcccaa

SEQ ID NO: 400981 - DNA, 25 bp, Mus musculus
ctttgtatctgaatgtagttgtatt

SEQ ID NO: 400982 - DNA, 25 bp, Mus musculus
ctttgtatctgattgtagttgtatt

SEQ ID NO: 400983 - DNA, 25 bp, Mus musculus
ctttgtatgacacaaaagccactca

SEQ ID NO: 400984 - DNA, 25 bp, Mus musculus
ctttgtatgacagaaaagccactca

SEQ ID NO: 400985 - DNA, 25 bp, Mus musculus
ctttgtatgccgcttatgtgccatt

SEQ ID NO: 400986 - DNA, 25 bp, Mus musculus
ctttgtatgccggttatgtgccatt

SEQ ID NO: 400987 - DNA, 25 bp, Mus musculus
ctttgtatggcaatgtaaatagatt

SEQ ID NO: 400988 - DNA, 25 bp, Mus musculus
ctttgtatggcattgtaaatagatt

SEQ ID NO: 400989 - DNA, 25 bp, Mus musculus
ctttgtatgggactgatgatctgta

SEQ ID NO: 400990 - DNA, 25 bp, Mus musculus
ctttgtatgggagtgatgatctgta

SEQ ID NO: 400991 - DNA, 25 bp, Mus musculus
ctttgtattctgcaaccgtaaattg

SEQ ID NO: 400992 - DNA, 25 bp, Mus musculus
ctttgtattctggaaccgtaaattg

SEQ ID NO: 400993 - DNA, 25 bp, Mus musculus
ctttgtattgtactgccattcctaa

SEQ ID NO: 400994 - DNA, 25 bp, Mus musculus
ctttgtattgtagtgccattcctaa

SEQ ID NO: 400995 - DNA, 25 bp, Mus musculus
ctttgtatttggctctttctattgt

SEQ ID NO: 400996 - DNA, 25 bp, Mus musculus
ctttgtatttgggtctttctattgt

SEQ ID NO: 400997 - DNA, 25 bp, Mus musculus
ctttgtcaacaacggcccttgaagg

SEQ ID NO: 400998 - DNA, 25 bp, Mus musculus
ctttgtcaacaagggcccttgaagg

SEQ ID NO: 400999 - DNA, 25 bp, Mus musculus
ctttgtcaagacctggtgacgagag

SEQ ID NO: 401000 - DNA, 25 bp, Mus musculus
ctttgtcaagacgtggtgacgagag

SEQ ID NO: 401001 - DNA, 25 bp, Mus musculus
ctttgtcacaagactaaatcaggta

SEQ ID NO: 401002 - DNA, 25 bp, Mus musculus
ctttgtcacaagtctaaatcaggta

SEQ ID NO: 401003 - DNA, 25 bp, Mus musculus
ctttgtcacagtaatcactcgatat

SEQ ID NO: 401004 - DNA, 25 bp, Mus musculus
ctttgtcacagtagtctctgatgtg

SEQ ID NO: 401005 - DNA, 25 bp, Mus musculus
ctttgtcacagttatcactcgatat

SEQ ID NO: 401006 - DNA, 25 bp, Mus musculus
ctttgtcacagttgtctctgatgtg

SEQ ID NO: 401007 - DNA, 25 bp, Mus musculus
ctttgtcacccactattacaggctt

SEQ ID NO: 401008 - DNA, 25 bp, Mus musculus
ctttgtcacccagtattacaggctt

SEQ ID NO: 401009 - DNA, 25 bp, Mus musculus
ctttgtcactctcttttgtactcat

SEQ ID NO: 401010 - DNA, 25 bp, Mus musculus
ctttgtcactctgttttgtactcat

SEQ ID NO: 401011 - DNA, 25 bp, Mus musculus
ctttgtcagacactggacagttttg

SEQ ID NO: 401012 - DNA, 25 bp, Mus musculus
ctttgtcagacagtggacagttttg

SEQ ID NO: 401013 - DNA, 25 bp, Mus musculus
ctttgtcagcttctctggactgtga

SEQ ID NO: 401014 - DNA, 25 bp, Mus musculus
ctttgtcagcttgtctggactgtga

SEQ ID NO: 401015 - DNA, 25 bp, Mus musculus
ctttgtcagtgaactctgatagaat

SEQ ID NO: 401016 - DNA, 25 bp, Mus musculus
ctttgtcagtgatctctgatagaat

SEQ ID NO: 401017 - DNA, 25 bp, Mus musculus
ctttgtcatgtccagtgtgtgtata

SEQ ID NO: 401018 - DNA, 25 bp, Mus musculus
ctttgtcatgtcgagtgtgtgtata

SEQ ID NO: 401019 - DNA, 25 bp, Mus musculus
ctttgtcattaaacagtttccttag

SEQ ID NO: 401020 - DNA, 25 bp, Mus musculus
ctttgtcattaatcagtttccttag

SEQ ID NO: 401021 - DNA, 25 bp, Mus musculus
ctttgtccaaggctagggtggcaat

SEQ ID NO: 401022 - DNA, 25 bp, Mus musculus
ctttgtccaagggtagggtggcaat

SEQ ID NO: 401023 - DNA, 25 bp, Mus musculus
ctttgtccatgtaaccgatctttct

SEQ ID NO: 401024 - DNA, 25 bp, Mus musculus
ctttgtccatgttaccgatctttct

SEQ ID NO: 401025 - DNA, 25 bp, Mus musculus
ctttgtccccacatacagatcagaa

SEQ ID NO: 401026 - DNA, 25 bp, Mus musculus
ctttgtccccacttacagatcagaa

SEQ ID NO: 401027 - DNA, 25 bp, Mus musculus
ctttgtcccgacactttgaagatgg

SEQ ID NO: 401028 - DNA, 25 bp, Mus musculus
ctttgtcccgactctttgaagatgg

SEQ ID NO: 401029 - DNA, 25 bp, Mus musculus
ctttgtccgcagcaattactgcatt

SEQ ID NO: 401030 - DNA, 25 bp, Mus musculus
ctttgtccgcaggaattactgcatt

SEQ ID NO: 401031 - DNA, 25 bp, Mus musculus
ctttgtcctcagcgaggtgattttt

SEQ ID NO: 401032 - DNA, 25 bp, Mus musculus
ctttgtcctcagggaggtgattttt

SEQ ID NO: 401033 - DNA, 25 bp, Mus musculus
ctttgtcctgacacctatgtatatg

SEQ ID NO: 401034 - DNA, 25 bp, Mus musculus
ctttgtcctgactcctatgtatatg

SEQ ID NO: 401035 - DNA, 25 bp, Mus musculus
ctttgtccttgcagggtgaggccaa

SEQ ID NO: 401036 - DNA, 25 bp, Mus musculus
ctttgtccttgctgggtgaggccaa

SEQ ID NO: 401037 - DNA, 25 bp, Mus musculus
ctttgtccttggaccctggcaccag

SEQ ID NO: 401038 - DNA, 25 bp, Mus musculus
ctttgtccttggtccctggcaccag

SEQ ID NO: 401039 - DNA, 25 bp, Mus musculus
ctttgtcctttgcttggcctaagat

SEQ ID NO: 401040 - DNA, 25 bp, Mus musculus
ctttgtcctttggttggcctaagat

SEQ ID NO: 401041 - DNA, 25 bp, Mus musculus
ctttgtctaccaaggtggattttat

SEQ ID NO: 401042 - DNA, 25 bp, Mus musculus
ctttgtctaccatggtggattttat

SEQ ID NO: 401043 - DNA, 25 bp, Mus musculus
ctttgtctacctcaatatgttatga

SEQ ID NO: 401044 - DNA, 25 bp, Mus musculus
ctttgtctacctgaatatgttatga

SEQ ID NO: 401045 - DNA, 25 bp, Mus musculus
ctttgtctcagcaggcagaggttga

SEQ ID NO: 401046 - DNA, 25 bp, Mus musculus
ctttgtctcagcctgttatgtgcaa

SEQ ID NO: 401047 - DNA, 25 bp, Mus musculus
ctttgtctcagcgtgttatgtgcaa

SEQ ID NO: 401048 - DNA, 25 bp, Mus musculus
ctttgtctcagctggcagaggttga

SEQ ID NO: 401049 - DNA, 25 bp, Mus musculus
ctttgtctctatcttgtctctttta

SEQ ID NO: 401050 - DNA, 25 bp, Mus musculus
ctttgtctctatgttgtctctttta

SEQ ID NO: 401051 - DNA, 25 bp, Mus musculus
ctttgtctctttctactggaatgtg

SEQ ID NO: 401052 - DNA, 25 bp, Mus musculus
ctttgtctctttgtactggaatgtg

SEQ ID NO: 401053 - DNA, 25 bp, Mus musculus
ctttgtctgaagcaccagggagttt

SEQ ID NO: 401054 - DNA, 25 bp, Mus musculus
ctttgtctgaaggaccagggagttt

SEQ ID NO: 401055 - DNA, 25 bp, Mus musculus
ctttgtctgcctcctgttttagaat

SEQ ID NO: 401056 - DNA, 25 bp, Mus musculus
ctttgtctgcctgctgttttagaat

SEQ ID NO: 401057 - DNA, 25 bp, Mus musculus
ctttgtctgtacaaagctgtatttt

SEQ ID NO: 401058 - DNA, 25 bp, Mus musculus
ctttgtctgtactaagctgtatttt

SEQ ID NO: 401059 - DNA, 25 bp, Mus musculus
ctttgtctgttcacgggttctggat

SEQ ID NO: 401060 - DNA, 25 bp, Mus musculus
ctttgtctgttctcgggttctggat

SEQ ID NO: 401061 - DNA, 25 bp, Mus musculus
ctttgtcttaggaacatttcatcac

SEQ ID NO: 401062 - DNA, 25 bp, Mus musculus
ctttgtcttaggtacatttcatcac

SEQ ID NO: 401063 - DNA, 25 bp, Mus musculus
ctttgtcttatcactattcctgtag

SEQ ID NO: 401064 - DNA, 25 bp, Mus musculus
ctttgtcttatctctattcctgtag

SEQ ID NO: 401065 - DNA, 25 bp, Mus musculus
ctttgtcttccacgtgtgctgatga

SEQ ID NO: 401066 - DNA, 25 bp, Mus musculus
ctttgtcttccactgtgctttaaga

SEQ ID NO: 401067 - DNA, 25 bp, Mus musculus
ctttgtcttccaggtgtgctgatga

SEQ ID NO: 401068 - DNA, 25 bp, Mus musculus
ctttgtcttccagtgtgctttaaga

SEQ ID NO: 401069 - DNA, 25 bp, Mus musculus
ctttgtcttgacaggtgtgggttaa

SEQ ID NO: 401070 - DNA, 25 bp, Mus musculus
ctttgtcttgacataatcatccagc

SEQ ID NO: 401071 - DNA, 25 bp, Mus musculus
ctttgtcttgactggtgtgggttaa

SEQ ID NO: 401072 - DNA, 25 bp, Mus musculus
ctttgtcttgacttaatcatccagc

SEQ ID NO: 401073 - DNA, 25 bp, Mus musculus
ctttgtcttgagctatctctggtta

SEQ ID NO: 401074 - DNA, 25 bp, Mus musculus
ctttgtcttgaggtatctctggtta

SEQ ID NO: 401075 - DNA, 25 bp, Mus musculus
ctttgtcttgtcctgtaaaggcact

SEQ ID NO: 401076 - DNA, 25 bp, Mus musculus
ctttgtcttgtcgtgtaaaggcact

SEQ ID NO: 401077 - DNA, 25 bp, Mus musculus
ctttgtgaacatccctacaatgcac

SEQ ID NO: 401078 - DNA, 25 bp, Mus musculus
ctttgtgaacatgcctacaatgcac

SEQ ID NO: 401079 - DNA, 25 bp, Mus musculus
ctttgtgaacgtcagcaacctggga

SEQ ID NO: 401080 - DNA, 25 bp, Mus musculus
ctttgtgaacgtgagcaacctggga

SEQ ID NO: 401081 - DNA, 25 bp, Mus musculus
ctttgtgaagctcgttggtttttat

SEQ ID NO: 401082 - DNA, 25 bp, Mus musculus
ctttgtgaagctggttggtttttat

SEQ ID NO: 401083 - DNA, 25 bp, Mus musculus
ctttgtgacatcatgtagggtttcc

SEQ ID NO: 401084 - DNA, 25 bp, Mus musculus
ctttgtgacatcttgtagggtttcc

SEQ ID NO: 401085 - DNA, 25 bp, Mus musculus
ctttgtgaccccaggcttaggagag

SEQ ID NO: 401086 - DNA, 25 bp, Mus musculus
ctttgtgacccctggcttaggagag

SEQ ID NO: 401087 - DNA, 25 bp, Mus musculus
ctttgtgacgtgagctcagactgga

SEQ ID NO: 401088 - DNA, 25 bp, Mus musculus
ctttgtgacgtgtgctcagactgga

SEQ ID NO: 401089 - DNA, 25 bp, Mus musculus
ctttgtgagagcatccagggatttt

SEQ ID NO: 401090 - DNA, 25 bp, Mus musculus
ctttgtgagagcttccagggatttt

SEQ ID NO: 401091 - DNA, 25 bp, Mus musculus
ctttgtgagagtagggttggcacca

SEQ ID NO: 401092 - DNA, 25 bp, Mus musculus
ctttgtgagagttgggttggcacca

SEQ ID NO: 401093 - DNA, 25 bp, Mus musculus
ctttgtgagttaccatttgtgttta

SEQ ID NO: 401094 - DNA, 25 bp, Mus musculus
ctttgtgagttagcatttgtgttta

SEQ ID NO: 401095 - DNA, 25 bp, Mus musculus
ctttgtgatggacgcttttctctgt

SEQ ID NO: 401096 - DNA, 25 bp, Mus musculus
ctttgtgatggaggcttttctctgt

SEQ ID NO: 401097 - DNA, 25 bp, Mus musculus
ctttgtgatgtacctgggatatgct

SEQ ID NO: 401098 - DNA, 25 bp, Mus musculus
ctttgtgatgtagctgggatatgct

SEQ ID NO: 401099 - DNA, 25 bp, Mus musculus
ctttgtgccacacgtcatgatcgtg

SEQ ID NO: 401100 - DNA, 25 bp, Mus musculus
ctttgtgccacaggtcatgatcgtg

SEQ ID NO: 401101 - DNA, 25 bp, Mus musculus
ctttgtgcccaaatcctaggtcata

SEQ ID NO: 401102 - DNA, 25 bp, Mus musculus
ctttgtgcccaattcctaggtcata

SEQ ID NO: 401103 - DNA, 25 bp, Mus musculus
ctttgtgccgggaaacaagccttgt

SEQ ID NO: 401104 - DNA, 25 bp, Mus musculus
ctttgtgccgggtaacaagccttgt

SEQ ID NO: 401105 - DNA, 25 bp, Mus musculus
ctttgtgcctcccaataaagtagcc

SEQ ID NO: 401106 - DNA, 25 bp, Mus musculus
ctttgtgcctccgaataaagtagcc

SEQ ID NO: 401107 - DNA, 25 bp, Mus musculus
ctttgtgctcatattgtaattttta

SEQ ID NO: 401108 - DNA, 25 bp, Mus musculus
ctttgtgctcattttgtaattttta

SEQ ID NO: 401109 - DNA, 25 bp, Mus musculus
ctttgtgctcccaattttatacaga

SEQ ID NO: 401110 - DNA, 25 bp, Mus musculus
ctttgtgctccctattttatacaga

SEQ ID NO: 401111 - DNA, 25 bp, Mus musculus
ctttgtgctctacattacgcagtgt

SEQ ID NO: 401112 - DNA, 25 bp, Mus musculus
ctttgtgctctagattacgcagtgt

SEQ ID NO: 401113 - DNA, 25 bp, Mus musculus
ctttgtgctgagatagacatctgta

SEQ ID NO: 401114 - DNA, 25 bp, Mus musculus
ctttgtgctgagttagacatctgta

SEQ ID NO: 401115 - DNA, 25 bp, Mus musculus
ctttgtgctgatagtgtgtcaaaat

SEQ ID NO: 401116 - DNA, 25 bp, Mus musculus
ctttgtgctgattgtgtgtcaaaat

SEQ ID NO: 401117 - DNA, 25 bp, Mus musculus
ctttgtgctgctcgaattcgtggca

SEQ ID NO: 401118 - DNA, 25 bp, Mus musculus
ctttgtgctgctggaattcgtggca

SEQ ID NO: 401119 - DNA, 25 bp, Mus musculus
ctttgtgctgtgactgtcagtcctg

SEQ ID NO: 401120 - DNA, 25 bp, Mus musculus
ctttgtgctgtgtctgtcagtcctg

SEQ ID NO: 401121 - DNA, 25 bp, Mus musculus
ctttgtgcttctcgttaggcgatga

SEQ ID NO: 401122 - DNA, 25 bp, Mus musculus
ctttgtgcttctggttaggcgatga

SEQ ID NO: 401123 - DNA, 25 bp, Mus musculus
ctttgtgcttgtcacatgttcattt

SEQ ID NO: 401124 - DNA, 25 bp, Mus musculus
ctttgtgcttgtgacatgttcattt

SEQ ID NO: 401125 - DNA, 25 bp, Mus musculus
ctttgtggacatccagaatttctat

SEQ ID NO: 401126 - DNA, 25 bp, Mus musculus
ctttgtggacatcggcagttctgat

SEQ ID NO: 401127 - DNA, 25 bp, Mus musculus
ctttgtggacatgcagaatttctat

SEQ ID NO: 401128 - DNA, 25 bp, Mus musculus
ctttgtggacatgggcagttctgat

SEQ ID NO: 401129 - DNA, 25 bp, Mus musculus
ctttgtggagggactggcttcagca

SEQ ID NO: 401130 - DNA, 25 bp, Mus musculus
ctttgtggagggtctggcttcagca

SEQ ID NO: 401131 - DNA, 25 bp, Mus musculus
ctttgtggatttcctcattaactat

SEQ ID NO: 401132 - DNA, 25 bp, Mus musculus
ctttgtggatttgctcattaactat

SEQ ID NO: 401133 - DNA, 25 bp, Mus musculus
ctttgtggcaaacccgatgtggctg

SEQ ID NO: 401134 - DNA, 25 bp, Mus musculus
ctttgtggcaaagccgatgtggctg

SEQ ID NO: 401135 - DNA, 25 bp, Mus musculus
ctttgtggcattaagcttcaagctt

SEQ ID NO: 401136 - DNA, 25 bp, Mus musculus
ctttgtggcatttagcttcaagctt

SEQ ID NO: 401137 - DNA, 25 bp, Mus musculus
ctttgtggcctgaatacagtttgca

SEQ ID NO: 401138 - DNA, 25 bp, Mus musculus
ctttgtggcctgtatacagtttgca

SEQ ID NO: 401139 - DNA, 25 bp, Mus musculus
ctttgtggcgctcttcgtaagatat

SEQ ID NO: 401140 - DNA, 25 bp, Mus musculus
ctttgtggcgctgttcgtaagatat

SEQ ID NO: 401141 - DNA, 25 bp, Mus musculus
ctttgtggcgtgagatctctgggcc

SEQ ID NO: 401142 - DNA, 25 bp, Mus musculus
ctttgtggcgtgtgatctctgggcc

SEQ ID NO: 401143 - DNA, 25 bp, Mus musculus
ctttgtgggccaaaagttcaccgta

SEQ ID NO: 401144 - DNA, 25 bp, Mus musculus
ctttgtgggccataagttcaccgta

SEQ ID NO: 401145 - DNA, 25 bp, Mus musculus
ctttgtgggctacggctgctactgc

SEQ ID NO: 401146 - DNA, 25 bp, Mus musculus
ctttgtgggctagggctgctactgc

SEQ ID NO: 401147 - DNA, 25 bp, Mus musculus
ctttgtgggtcactcatgtaggctc

SEQ ID NO: 401148 - DNA, 25 bp, Mus musculus
ctttgtgggtcagtcatgtaggctc

SEQ ID NO: 401149 - DNA, 25 bp, Mus musculus
ctttgtgggttaagacttgtctatt

SEQ ID NO: 401150 - DNA, 25 bp, Mus musculus
ctttgtgggttatgacttgtctatt

SEQ ID NO: 401151 - DNA, 25 bp, Mus musculus
ctttgtggtcggagtactttgagct

SEQ ID NO: 401152 - DNA, 25 bp, Mus musculus
ctttgtggtcggtgtactttgagct

SEQ ID NO: 401153 - DNA, 25 bp, Mus musculus
ctttgtggtggtcaggcgtccctac

SEQ ID NO: 401154 - DNA, 25 bp, Mus musculus
ctttgtggtggtgaggcgtccctac

SEQ ID NO: 401155 - DNA, 25 bp, Mus musculus
ctttgtgtactcaccgtcgaagaat

SEQ ID NO: 401156 - DNA, 25 bp, Mus musculus
ctttgtgtactctccgtcgaagaat

SEQ ID NO: 401157 - DNA, 25 bp, Mus musculus
ctttgtgtacttcaagtcttggagc

SEQ ID NO: 401158 - DNA, 25 bp, Mus musculus
ctttgtgtacttgaagtcttggagc

SEQ ID NO: 401159 - DNA, 25 bp, Mus musculus
ctttgtgtatcaagagactatggct

SEQ ID NO: 401160 - DNA, 25 bp, Mus musculus
ctttgtgtatcatgagactatggct

SEQ ID NO: 401161 - DNA, 25 bp, Mus musculus
ctttgtgtatgacttctgccttggg

SEQ ID NO: 401162 - DNA, 25 bp, Mus musculus
ctttgtgtatgagttctgccttggg

SEQ ID NO: 401163 - DNA, 25 bp, Mus musculus
ctttgtgtccttagtgcaggcttat

SEQ ID NO: 401164 - DNA, 25 bp, Mus musculus
ctttgtgtcctttgtgcaggcttat

SEQ ID NO: 401165 - DNA, 25 bp, Mus musculus
ctttgtgtcgccacttgatgcccaa

SEQ ID NO: 401166 - DNA, 25 bp, Mus musculus
ctttgtgtcgcctcttgatgcccaa

SEQ ID NO: 401167 - DNA, 25 bp, Mus musculus
ctttgtgtctgaccctgcccctgtg

SEQ ID NO: 401168 - DNA, 25 bp, Mus musculus
ctttgtgtctgagcctgcccctgtg

SEQ ID NO: 401169 - DNA, 25 bp, Mus musculus
ctttgtgtgcacctggaggtcccag

SEQ ID NO: 401170 - DNA, 25 bp, Mus musculus
ctttgtgtgcacgtggaggtcccag

SEQ ID NO: 401171 - DNA, 25 bp, Mus musculus
ctttgtgtgcatcaccgtgcgattt

SEQ ID NO: 401172 - DNA, 25 bp, Mus musculus
ctttgtgtgcatgaccgtgcgattt

SEQ ID NO: 401173 - DNA, 25 bp, Mus musculus
ctttgtgtgcgcagagtgtggccaa

SEQ ID NO: 401174 - DNA, 25 bp, Mus musculus
ctttgtgtgcgctgagtgtggccaa

SEQ ID NO: 401175 - DNA, 25 bp, Mus musculus
ctttgtgtggaaaacgacagcagca

SEQ ID NO: 401176 - DNA, 25 bp, Mus musculus
ctttgtgtggaatacgacagcagca

SEQ ID NO: 401177 - DNA, 25 bp, Mus musculus
ctttgtgtgggaccctggcatcatc

SEQ ID NO: 401178 - DNA, 25 bp, Mus musculus
ctttgtgtgggagcctggcatcatc

SEQ ID NO: 401179 - DNA, 25 bp, Mus musculus
ctttgtgtgtgacctagacccagaa

SEQ ID NO: 401180 - DNA, 25 bp, Mus musculus
ctttgtgtgtgagctagacccagaa

SEQ ID NO: 401181 - DNA, 25 bp, Mus musculus
ctttgtgttactctgtggtttgggt

SEQ ID NO: 401182 - DNA, 25 bp, Mus musculus
ctttgtgttactgtgtggtttgggt

SEQ ID NO: 401183 - DNA, 25 bp, Mus musculus
ctttgtgttctgatatactgtttta

SEQ ID NO: 401184 - DNA, 25 bp, Mus musculus
ctttgtgttctgttatactgtttta

SEQ ID NO: 401185 - DNA, 25 bp, Mus musculus
ctttgtgtttccatgtaagctgaga

SEQ ID NO: 401186 - DNA, 25 bp, Mus musculus
ctttgtgtttccttgtaagctgaga

SEQ ID NO: 401187 - DNA, 25 bp, Mus musculus
ctttgttaaagcatcccatgggtga

SEQ ID NO: 401188 - DNA, 25 bp, Mus musculus
ctttgttaaagcttcccatgggtga

SEQ ID NO: 401189 - DNA, 25 bp, Mus musculus
ctttgttaaccaatccagaggcaga

SEQ ID NO: 401190 - DNA, 25 bp, Mus musculus
ctttgttaaccattccagaggcaga

SEQ ID NO: 401191 - DNA, 25 bp, Mus musculus
ctttgttactttctctgcagaagct

SEQ ID NO: 401192 - DNA, 25 bp, Mus musculus
ctttgttactttgtctgcagaagct

SEQ ID NO: 401193 - DNA, 25 bp, Mus musculus
ctttgttagtgcacttcctatgact

SEQ ID NO: 401194 - DNA, 25 bp, Mus musculus
ctttgttagtgctcttcctatgact

SEQ ID NO: 401195 - DNA, 25 bp, Mus musculus
ctttgttagtgtcagaatcccagtt

SEQ ID NO: 401196 - DNA, 25 bp, Mus musculus
ctttgttagtgtgagaatcccagtt

SEQ ID NO: 401197 - DNA, 25 bp, Mus musculus
ctttgttagttgagaacatgagccc

SEQ ID NO: 401198 - DNA, 25 bp, Mus musculus
ctttgttagttgtgaacatgagccc

SEQ ID NO: 401199 - DNA, 25 bp, Mus musculus
ctttgttcaagtaaatccaacagtg

SEQ ID NO: 401200 - DNA, 25 bp, Mus musculus
ctttgttcaagttaatccaacagtg

SEQ ID NO: 401201 - DNA, 25 bp, Mus musculus
ctttgttcaggtagaggccccagaa

SEQ ID NO: 401202 - DNA, 25 bp, Mus musculus
ctttgttcaggttgaggccccagaa

SEQ ID NO: 401203 - DNA, 25 bp, Mus musculus
ctttgttccacaatcagaaattcta

SEQ ID NO: 401204 - DNA, 25 bp, Mus musculus
ctttgttccacattcagaaattcta

SEQ ID NO: 401205 - DNA, 25 bp, Mus musculus
ctttgttcccctacagagaggaaat

SEQ ID NO: 401206 - DNA, 25 bp, Mus musculus
ctttgttccccttcagagaggaaat

SEQ ID NO: 401207 - DNA, 25 bp, Mus musculus
ctttgttcccttcaagactggtgag

SEQ ID NO: 401208 - DNA, 25 bp, Mus musculus
ctttgttcccttgaagactggtgag

SEQ ID NO: 401209 - DNA, 25 bp, Mus musculus
ctttgttcctcactgcagaaatgct

SEQ ID NO: 401210 - DNA, 25 bp, Mus musculus
ctttgttcctcagtgcagaaatgct

SEQ ID NO: 401211 - DNA, 25 bp, Mus musculus
ctttgttcctgacgcttcagtatca

SEQ ID NO: 401212 - DNA, 25 bp, Mus musculus
ctttgttcctgaggcttcagtatca

SEQ ID NO: 401213 - DNA, 25 bp, Mus musculus
ctttgttcctgcagtctttgaatga

SEQ ID NO: 401214 - DNA, 25 bp, Mus musculus
ctttgttcctgctgtctttgaatga

SEQ ID NO: 401215 - DNA, 25 bp, Mus musculus
ctttgttcctgtaccagagaagcat

SEQ ID NO: 401216 - DNA, 25 bp, Mus musculus
ctttgttcctgttccagagaagcat

SEQ ID NO: 401217 - DNA, 25 bp, Mus musculus
ctttgttctaaccacatgtttccct

SEQ ID NO: 401218 - DNA, 25 bp, Mus musculus
ctttgttctaacgacatgtttccct

SEQ ID NO: 401219 - DNA, 25 bp, Mus musculus
ctttgttctactcctcttggcttgt

SEQ ID NO: 401220 - DNA, 25 bp, Mus musculus
ctttgttctactgctcttggcttgt

SEQ ID NO: 401221 - DNA, 25 bp, Mus musculus
ctttgttctattaaattgggtgcca

SEQ ID NO: 401222 - DNA, 25 bp, Mus musculus
ctttgttctatttaattgggtgcca

SEQ ID NO: 401223 - DNA, 25 bp, Mus musculus
ctttgttctcatcaaaggacatgaa

SEQ ID NO: 401224 - DNA, 25 bp, Mus musculus
ctttgttctcatgaaaggacatgaa

SEQ ID NO: 401225 - DNA, 25 bp, Mus musculus
ctttgttctgctacttaatgactaa

SEQ ID NO: 401226 - DNA, 25 bp, Mus musculus
ctttgttctgcttcttaatgactaa

SEQ ID NO: 401227 - DNA, 25 bp, Mus musculus
ctttgttgaaccagacttgtaatgc

SEQ ID NO: 401228 - DNA, 25 bp, Mus musculus
ctttgttgaacctgacttgtaatgc

SEQ ID NO: 401229 - DNA, 25 bp, Mus musculus
ctttgttgccttagaagtgtgtcgg

SEQ ID NO: 401230 - DNA, 25 bp, Mus musculus
ctttgttgcctttgaagtgtgtcgg

SEQ ID NO: 401231 - DNA, 25 bp, Mus musculus
ctttgttggccaagcttcagggaaa

SEQ ID NO: 401232 - DNA, 25 bp, Mus musculus
ctttgttggccatgcttcagggaaa

SEQ ID NO: 401233 - DNA, 25 bp, Mus musculus
ctttgttggtgaagctactaagcat

SEQ ID NO: 401234 - DNA, 25 bp, Mus musculus
ctttgttggtgatgctactaagcat

SEQ ID NO: 401235 - DNA, 25 bp, Mus musculus
ctttgttgtgttaactcgtggcttt

SEQ ID NO: 401236 - DNA, 25 bp, Mus musculus
ctttgttgtgtttactcgtggcttt

SEQ ID NO: 401237 - DNA, 25 bp, Mus musculus
ctttgtttacaaattcctggtcagt

SEQ ID NO: 401238 - DNA, 25 bp, Mus musculus
ctttgtttacaatttcctggtcagt

SEQ ID NO: 401239 - DNA, 25 bp, Mus musculus
ctttgtttacacagctagggaagga

SEQ ID NO: 401240 - DNA, 25 bp, Mus musculus
ctttgtttacactgctagggaagga

SEQ ID NO: 401241 - DNA, 25 bp, Mus musculus
ctttgtttcccgagatactgtaaag

SEQ ID NO: 401242 - DNA, 25 bp, Mus musculus
ctttgtttcccgtgatactgtaaag

SEQ ID NO: 401243 - DNA, 25 bp, Mus musculus
ctttgtttcctaactgtggcttcag

SEQ ID NO: 401244 - DNA, 25 bp, Mus musculus
ctttgtttcctatctgtggcttcag

SEQ ID NO: 401245 - DNA, 25 bp, Mus musculus
ctttgtttctatcattcccttctat

SEQ ID NO: 401246 - DNA, 25 bp, Mus musculus
ctttgtttctatgattcccttctat

SEQ ID NO: 401247 - DNA, 25 bp, Mus musculus
ctttgtttctcgctatgacttctga

SEQ ID NO: 401248 - DNA, 25 bp, Mus musculus
ctttgtttctcggtatgacttctga

SEQ ID NO: 401249 - DNA, 25 bp, Mus musculus
ctttgtttcttcactataatatggt

SEQ ID NO: 401250 - DNA, 25 bp, Mus musculus
ctttgtttcttctctataatatggt

SEQ ID NO: 401251 - DNA, 25 bp, Mus musculus
ctttgtttcttgatggaactcccct

SEQ ID NO: 401252 - DNA, 25 bp, Mus musculus
ctttgtttcttgttggaactcccct

SEQ ID NO: 401253 - DNA, 25 bp, Mus musculus
ctttgtttgcgaaggatcaggttga

SEQ ID NO: 401254 - DNA, 25 bp, Mus musculus
ctttgtttgcgatggatcaggttga

SEQ ID NO: 401255 - DNA, 25 bp, Mus musculus
ctttgtttgctgatactgaccatga

SEQ ID NO: 401256 - DNA, 25 bp, Mus musculus
ctttgtttgctgttactgaccatga

SEQ ID NO: 401257 - DNA, 25 bp, Mus musculus
ctttgtttggtgattgtgtctgtat

SEQ ID NO: 401258 - DNA, 25 bp, Mus musculus
ctttgtttggtgtttgtgtctgtat

SEQ ID NO: 401259 - DNA, 25 bp, Mus musculus
ctttgttttggactacagaccctga

SEQ ID NO: 401260 - DNA, 25 bp, Mus musculus
ctttgttttggagtacagaccctga

SEQ ID NO: 401261 - DNA, 25 bp, Mus musculus
cttttaaaacgtatgctgagtctgg

SEQ ID NO: 401262 - DNA, 25 bp, Mus musculus
cttttaaaacgtttgctgagtctgg

SEQ ID NO: 401263 - DNA, 25 bp, Mus musculus
cttttaaactgtacactggcttgga

SEQ ID NO: 401264 - DNA, 25 bp, Mus musculus
cttttaaactgttcactggcttgga

SEQ ID NO: 401265 - DNA, 25 bp, Mus musculus
cttttaaataagctcgtgtcacgta

SEQ ID NO: 401266 - DNA, 25 bp, Mus musculus
cttttaaataaggtcgtgtcacgta

SEQ ID NO: 401267 - DNA, 25 bp, Mus musculus
cttttaaatgtccttgtgccaagta

SEQ ID NO: 401268 - DNA, 25 bp, Mus musculus
cttttaaatgtcgttgtgccaagta

SEQ ID NO: 401269 - DNA, 25 bp, Mus musculus
cttttaaattctatgcccacttctg

SEQ ID NO: 401270 - DNA, 25 bp, Mus musculus
cttttaaattctttgcccacttctg

SEQ ID NO: 401271 - DNA, 25 bp, Mus musculus
cttttaacgtctctggaagcactgt

SEQ ID NO: 401272 - DNA, 25 bp, Mus musculus
cttttaacgtctgtggaagcactgt

SEQ ID NO: 401273 - DNA, 25 bp, Mus musculus
cttttaagaattccggaactttcag

SEQ ID NO: 401274 - DNA, 25 bp, Mus musculus
cttttaagaattgcggaactttcag

SEQ ID NO: 401275 - DNA, 25 bp, Mus musculus
cttttaagcactaacatgggttggg

SEQ ID NO: 401276 - DNA, 25 bp, Mus musculus
cttttaagcacttacatgggttggg

SEQ ID NO: 401277 - DNA, 25 bp, Mus musculus
cttttaagcagcaggtggaagctct

SEQ ID NO: 401278 - DNA, 25 bp, Mus musculus
cttttaagcagctggtggaagctct

SEQ ID NO: 401279 - DNA, 25 bp, Mus musculus
cttttaagcccaccatcctggtgaa

SEQ ID NO: 401280 - DNA, 25 bp, Mus musculus
cttttaagcccagcatcctggtgaa

SEQ ID NO: 401281 - DNA, 25 bp, Mus musculus
cttttaaggctgctgtggtcaggca

SEQ ID NO: 401282 - DNA, 25 bp, Mus musculus
cttttaaggctggtgtggtcaggca

SEQ ID NO: 401283 - DNA, 25 bp, Mus musculus
cttttaatacgtcagtgtccatgtt

SEQ ID NO: 401284 - DNA, 25 bp, Mus musculus
cttttaatacgtgagtgtccatgtt

SEQ ID NO: 401285 - DNA, 25 bp, Mus musculus
cttttaatctggaatgagctacaat

SEQ ID NO: 401286 - DNA, 25 bp, Mus musculus
cttttaatctggtatgagctacaat

SEQ ID NO: 401287 - DNA, 25 bp, Mus musculus
cttttaattataaattgagcccaag

SEQ ID NO: 401288 - DNA, 25 bp, Mus musculus
cttttaattatatattgagcccaag

SEQ ID NO: 401289 - DNA, 25 bp, Mus musculus
cttttactacaacatccacaggcac

SEQ ID NO: 401290 - DNA, 25 bp, Mus musculus
cttttactacaagatccacaggcac

SEQ ID NO: 401291 - DNA, 25 bp, Mus musculus
cttttactagtcacagggtcctgct

SEQ ID NO: 401292 - DNA, 25 bp, Mus musculus
cttttactagtctcagggtcctgct

SEQ ID NO: 401293 - DNA, 25 bp, Mus musculus
cttttactatggaggttggccggct

SEQ ID NO: 401294 - DNA, 25 bp, Mus musculus
cttttactatggtggttggccggct

SEQ ID NO: 401295 - DNA, 25 bp, Mus musculus
cttttactcagtctcaggtgctgca

SEQ ID NO: 401296 - DNA, 25 bp, Mus musculus
cttttactcagtgtcaggtgctgca

SEQ ID NO: 401297 - DNA, 25 bp, Mus musculus
cttttactctctcaatccggaagga

SEQ ID NO: 401298 - DNA, 25 bp, Mus musculus
cttttactctctgaatccggaagga

SEQ ID NO: 401299 - DNA, 25 bp, Mus musculus
cttttactgtcgctagaggttgcat

SEQ ID NO: 401300 - DNA, 25 bp, Mus musculus
cttttactgtcggtagaggttgcat

SEQ ID NO: 401301 - DNA, 25 bp, Mus musculus
cttttactgtgtcgttgttaagact

SEQ ID NO: 401302 - DNA, 25 bp, Mus musculus
cttttactgtgtggttgttaagact

SEQ ID NO: 401303 - DNA, 25 bp, Mus musculus
cttttactttcaagttagtccttag

SEQ ID NO: 401304 - DNA, 25 bp, Mus musculus
cttttactttcatgttagtccttag

SEQ ID NO: 401305 - DNA, 25 bp, Mus musculus
cttttacttttcagtcaagcaccca

SEQ ID NO: 401306 - DNA, 25 bp, Mus musculus
cttttacttttctgtcaagcaccca

SEQ ID NO: 401307 - DNA, 25 bp, Mus musculus
cttttagaggcaaggcatagggact

SEQ ID NO: 401308 - DNA, 25 bp, Mus musculus
cttttagaggcatggcatagggact

SEQ ID NO: 401309 - DNA, 25 bp, Mus musculus
cttttagtctaactccaggaagcct

SEQ ID NO: 401310 - DNA, 25 bp, Mus musculus
cttttagtctaagtccaggaagcct

SEQ ID NO: 401311 - DNA, 25 bp, Mus musculus
cttttagtgagtcagtcacctccac

SEQ ID NO: 401312 - DNA, 25 bp, Mus musculus
cttttagtgagtgagtcacctccac

SEQ ID NO: 401313 - DNA, 25 bp, Mus musculus
cttttagtgctgctgtctgtttatg

SEQ ID NO: 401314 - DNA, 25 bp, Mus musculus
cttttagtgctggtgtctgtttatg

SEQ ID NO: 401315 - DNA, 25 bp, Mus musculus
cttttataagcaacattatttatct

SEQ ID NO: 401316 - DNA, 25 bp, Mus musculus
cttttataagcatcattatttatct

SEQ ID NO: 401317 - DNA, 25 bp, Mus musculus
cttttataccttacttccttgatct

SEQ ID NO: 401318 - DNA, 25 bp, Mus musculus
cttttatacctttcttccttgatct

SEQ ID NO: 401319 - DNA, 25 bp, Mus musculus
cttttatagaaaatgtgggtggctc

SEQ ID NO: 401320 - DNA, 25 bp, Mus musculus
cttttatagaaattgtgggtggctc

SEQ ID NO: 401321 - DNA, 25 bp, Mus musculus
cttttatatatccggttgtcatctt

SEQ ID NO: 401322 - DNA, 25 bp, Mus musculus
cttttatatatcgggttgtcatctt

SEQ ID NO: 401323 - DNA, 25 bp, Mus musculus
cttttatatcagagctgcgtctcaa

SEQ ID NO: 401324 - DNA, 25 bp, Mus musculus
cttttatatcagtgctgcgtctcaa

SEQ ID NO: 401325 - DNA, 25 bp, Mus musculus
cttttatccttcaggttcttgttct

SEQ ID NO: 401326 - DNA, 25 bp, Mus musculus
cttttatccttctggttcttgttct

SEQ ID NO: 401327 - DNA, 25 bp, Mus musculus
cttttatctctgaatctgaacgtga

SEQ ID NO: 401328 - DNA, 25 bp, Mus musculus
cttttatctctgtatctgaacgtga

SEQ ID NO: 401329 - DNA, 25 bp, Mus musculus
cttttatctgaacgtgacgggccct

SEQ ID NO: 401330 - DNA, 25 bp, Mus musculus
cttttatctgaaggtgacgggccct

SEQ ID NO: 401331 - DNA, 25 bp, Mus musculus
cttttatctgtcattgctgctagat

SEQ ID NO: 401332 - DNA, 25 bp, Mus musculus
cttttatctgtctttgctgctagat

SEQ ID NO: 401333 - DNA, 25 bp, Mus musculus
cttttatggcctatttgagagtctt

SEQ ID NO: 401334 - DNA, 25 bp, Mus musculus
cttttatggcctttttgagagtctt

SEQ ID NO: 401335 - DNA, 25 bp, Mus musculus
cttttatgtgggacaccgccaggag

SEQ ID NO: 401336 - DNA, 25 bp, Mus musculus
cttttatgtgggtcaccgccaggag

SEQ ID NO: 401337 - DNA, 25 bp, Mus musculus
cttttatgttcgcacctcagctgac

SEQ ID NO: 401338 - DNA, 25 bp, Mus musculus
cttttatgttcggacctcagctgac

SEQ ID NO: 401339 - DNA, 25 bp, Mus musculus
cttttattaccaactcgagagccag

SEQ ID NO: 401340 - DNA, 25 bp, Mus musculus
cttttattaccatctcgagagccag

SEQ ID NO: 401341 - DNA, 25 bp, Mus musculus
cttttattatctcgagtgcttgcta

SEQ ID NO: 401342 - DNA, 25 bp, Mus musculus
cttttattatctggagtgcttgcta

SEQ ID NO: 401343 - DNA, 25 bp, Mus musculus
cttttattctcgcaagagcagctta

SEQ ID NO: 401344 - DNA, 25 bp, Mus musculus
cttttattctcggaagagcagctta

SEQ ID NO: 401345 - DNA, 25 bp, Mus musculus
cttttatttatcacatctgcagatg

SEQ ID NO: 401346 - DNA, 25 bp, Mus musculus
cttttatttatctcatctgcagatg

SEQ ID NO: 401347 - DNA, 25 bp, Mus musculus
cttttcaaagacaacgacgacttcg

SEQ ID NO: 401348 - DNA, 25 bp, Mus musculus
cttttcaaagactacgacgacttcg

SEQ ID NO: 401349 - DNA, 25 bp, Mus musculus
cttttcaactttataagggctacat

SEQ ID NO: 401350 - DNA, 25 bp, Mus musculus
cttttcaactttttaagggctacat

SEQ ID NO: 401351 - DNA, 25 bp, Mus musculus
cttttcaagatcaagttgcttccaa

SEQ ID NO: 401352 - DNA, 25 bp, Mus musculus
cttttcaagatctagttgcttccaa

SEQ ID NO: 401353 - DNA, 25 bp, Mus musculus
cttttcaaggtcctggtgatcactg

SEQ ID NO: 401354 - DNA, 25 bp, Mus musculus
cttttcaaggtcgtggtgatcactg

SEQ ID NO: 401355 - DNA, 25 bp, Mus musculus
cttttcaagtacaacatccagagta

SEQ ID NO: 401356 - DNA, 25 bp, Mus musculus
cttttcaagtactacatccagagta

SEQ ID NO: 401357 - DNA, 25 bp, Mus musculus
cttttcaagtatcggagactctggg

SEQ ID NO: 401358 - DNA, 25 bp, Mus musculus
cttttcaagtatgggagactctggg

SEQ ID NO: 401359 - DNA, 25 bp, Mus musculus
cttttcaataggattatctcatcaa

SEQ ID NO: 401360 - DNA, 25 bp, Mus musculus
cttttcaataggtttatctcatcaa

SEQ ID NO: 401361 - DNA, 25 bp, Mus musculus
cttttcaatgggatactatgtggtg

SEQ ID NO: 401362 - DNA, 25 bp, Mus musculus
cttttcaatgggttactatgtggtg

SEQ ID NO: 401363 - DNA, 25 bp, Mus musculus
cttttcacagtccaatagtctccaa

SEQ ID NO: 401364 - DNA, 25 bp, Mus musculus
cttttcacagtcgaatagtctccaa

SEQ ID NO: 401365 - DNA, 25 bp, Mus musculus
cttttcacatatacagtgtctccta

SEQ ID NO: 401366 - DNA, 25 bp, Mus musculus
cttttcacatattcagtgtctccta

SEQ ID NO: 401367 - DNA, 25 bp, Mus musculus
cttttcactcaaatctattccttta

SEQ ID NO: 401368 - DNA, 25 bp, Mus musculus
cttttcactcaattctattccttta

SEQ ID NO: 401369 - DNA, 25 bp, Mus musculus
cttttcagacatcatactaacgtgt

SEQ ID NO: 401370 - DNA, 25 bp, Mus musculus
cttttcagacatgatactaacgtgt

SEQ ID NO: 401371 - DNA, 25 bp, Mus musculus
cttttcagagccaggccgtgctggg

SEQ ID NO: 401372 - DNA, 25 bp, Mus musculus
cttttcagagcctggccgtgctggg

SEQ ID NO: 401373 - DNA, 25 bp, Mus musculus
cttttcagagctaagagagcgttag

SEQ ID NO: 401374 - DNA, 25 bp, Mus musculus
cttttcagagcttagagagcgttag

SEQ ID NO: 401375 - DNA, 25 bp, Mus musculus
cttttcagcacaccttaactaacac

SEQ ID NO: 401376 - DNA, 25 bp, Mus musculus
cttttcagcacagcttaactaacac

SEQ ID NO: 401377 - DNA, 25 bp, Mus musculus
cttttcagctctacctaatttactt

SEQ ID NO: 401378 - DNA, 25 bp, Mus musculus
cttttcagctcttcctaatttactt

SEQ ID NO: 401379 - DNA, 25 bp, Mus musculus
cttttcagtattattcatccaggac

SEQ ID NO: 401380 - DNA, 25 bp, Mus musculus
cttttcagtatttttcatccaggac

SEQ ID NO: 401381 - DNA, 25 bp, Mus musculus
cttttcagtggccaaacggtcagct

SEQ ID NO: 401382 - DNA, 25 bp, Mus musculus
cttttcagtggcgaaacggtcagct

SEQ ID NO: 401383 - DNA, 25 bp, Mus musculus
cttttcataacgagtaattgcttgt

SEQ ID NO: 401384 - DNA, 25 bp, Mus musculus
cttttcataacgtgtaattgcttgt

SEQ ID NO: 401385 - DNA, 25 bp, Mus musculus
cttttcatacccagagctattctta

SEQ ID NO: 401386 - DNA, 25 bp, Mus musculus
cttttcataccctgagctattctta

SEQ ID NO: 401387 - DNA, 25 bp, Mus musculus
cttttcatagagatccttgtacaga

SEQ ID NO: 401388 - DNA, 25 bp, Mus musculus
cttttcatagagttccttgtacaga

SEQ ID NO: 401389 - DNA, 25 bp, Mus musculus
cttttcatcatgcaggcttaaccct

SEQ ID NO: 401390 - DNA, 25 bp, Mus musculus
cttttcatcatggaggcttaaccct

SEQ ID NO: 401391 - DNA, 25 bp, Mus musculus
cttttcatcccaaactatattctgt

SEQ ID NO: 401392 - DNA, 25 bp, Mus musculus
cttttcatcccatactatattctgt

SEQ ID NO: 401393 - DNA, 25 bp, Mus musculus
cttttcatgtgacattcccagtcaa

SEQ ID NO: 401394 - DNA, 25 bp, Mus musculus
cttttcatgtgagattcccagtcaa

SEQ ID NO: 401395 - DNA, 25 bp, Mus musculus
cttttcattcgtcagcagagctgct

SEQ ID NO: 401396 - DNA, 25 bp, Mus musculus
cttttcattcgtgagcagagctgct

SEQ ID NO: 401397 - DNA, 25 bp, Mus musculus
cttttcattctcaaaactgcaccta

SEQ ID NO: 401398 - DNA, 25 bp, Mus musculus
cttttcattctctaaactgcaccta

SEQ ID NO: 401399 - DNA, 25 bp, Mus musculus
cttttccaaaccaatactgagctct

SEQ ID NO: 401400 - DNA, 25 bp, Mus musculus
cttttccaaacctatactgagctct

SEQ ID NO: 401401 - DNA, 25 bp, Mus musculus
cttttccaacacatcagctatagct

SEQ ID NO: 401402 - DNA, 25 bp, Mus musculus
cttttccaacacttcagctatagct

SEQ ID NO: 401403 - DNA, 25 bp, Mus musculus
cttttccaacctcgaagggctgctt

SEQ ID NO: 401404 - DNA, 25 bp, Mus musculus
cttttccaacctggaagggctgctt

SEQ ID NO: 401405 - DNA, 25 bp, Mus musculus
cttttccaagatctaccactcactt

SEQ ID NO: 401406 - DNA, 25 bp, Mus musculus
cttttccaagatgtaccactcactt

SEQ ID NO: 401407 - DNA, 25 bp, Mus musculus
cttttccaattaaggtctcaccttg

SEQ ID NO: 401408 - DNA, 25 bp, Mus musculus
cttttccaattatggtctcaccttg

SEQ ID NO: 401409 - DNA, 25 bp, Mus musculus
cttttccacagtctcacaggtttgt

SEQ ID NO: 401410 - DNA, 25 bp, Mus musculus
cttttccacagtgtcacaggtttgt

SEQ ID NO: 401411 - DNA, 25 bp, Mus musculus
cttttccaccaaaatctgtaactga

SEQ ID NO: 401412 - DNA, 25 bp, Mus musculus
cttttccaccaatatctgtaactga

SEQ ID NO: 401413 - DNA, 25 bp, Mus musculus
cttttccactccaagaacaacgact

SEQ ID NO: 401414 - DNA, 25 bp, Mus musculus
cttttccactcctagaacaacgact

SEQ ID NO: 401415 - DNA, 25 bp, Mus musculus
cttttccagatgcaaggcctacaca

SEQ ID NO: 401416 - DNA, 25 bp, Mus musculus
cttttccagatggaaggcctacaca

SEQ ID NO: 401417 - DNA, 25 bp, Mus musculus
cttttccagtagcaataaagctttg

SEQ ID NO: 401418 - DNA, 25 bp, Mus musculus
cttttccagtaggaataaagctttg

SEQ ID NO: 401419 - DNA, 25 bp, Mus musculus
cttttccatggcatacttctaagta

SEQ ID NO: 401420 - DNA, 25 bp, Mus musculus
cttttccatggcttacttctaagta

SEQ ID NO: 401421 - DNA, 25 bp, Mus musculus
cttttccatgtgcttggtttttcct

SEQ ID NO: 401422 - DNA, 25 bp, Mus musculus
cttttccatgtggttggtttttcct

SEQ ID NO: 401423 - DNA, 25 bp, Mus musculus
cttttcccaacaactctttcagatg

SEQ ID NO: 401424 - DNA, 25 bp, Mus musculus
cttttcccaacatctctttcagatg

SEQ ID NO: 401425 - DNA, 25 bp, Mus musculus
cttttccccaagctttattagtcat

SEQ ID NO: 401426 - DNA, 25 bp, Mus musculus
cttttccccaaggtttattagtcat

SEQ ID NO: 401427 - DNA, 25 bp, Mus musculus
cttttccccactcaggtgactataa

SEQ ID NO: 401428 - DNA, 25 bp, Mus musculus
cttttccccactgaggtgactataa

SEQ ID NO: 401429 - DNA, 25 bp, Mus musculus
cttttccccttacagtcactgttag

SEQ ID NO: 401430 - DNA, 25 bp, Mus musculus
cttttccccttagagtcactgttag

SEQ ID NO: 401431 - DNA, 25 bp, Mus musculus
cttttccctagcagggcttccttgc

SEQ ID NO: 401432 - DNA, 25 bp, Mus musculus
cttttccctagctgggcttccttgc

SEQ ID NO: 401433 - DNA, 25 bp, Mus musculus
cttttccctcataccatatgcattt

SEQ ID NO: 401434 - DNA, 25 bp, Mus musculus
cttttccctcattccatatgcattt

SEQ ID NO: 401435 - DNA, 25 bp, Mus musculus
cttttccctgctcggccagacaaga

SEQ ID NO: 401436 - DNA, 25 bp, Mus musculus
cttttccctgctgggccagacaaga

SEQ ID NO: 401437 - DNA, 25 bp, Mus musculus
cttttccctgttagaactttgtgtg

SEQ ID NO: 401438 - DNA, 25 bp, Mus musculus
cttttccctgtttgaactttgtgtg

SEQ ID NO: 401439 - DNA, 25 bp, Mus musculus
cttttcccttgaagaccctgcttct

SEQ ID NO: 401440 - DNA, 25 bp, Mus musculus
cttttcccttgatgaccctgcttct

SEQ ID NO: 401441 - DNA, 25 bp, Mus musculus
cttttccggttcatttgcatcgata

SEQ ID NO: 401442 - DNA, 25 bp, Mus musculus
cttttccggttcttttgcatcgata

SEQ ID NO: 401443 - DNA, 25 bp, Mus musculus
cttttcctacttatccccaggatct

SEQ ID NO: 401444 - DNA, 25 bp, Mus musculus
cttttcctacttttccccaggatct

SEQ ID NO: 401445 - DNA, 25 bp, Mus musculus
cttttcctagctattctagcctaag

SEQ ID NO: 401446 - DNA, 25 bp, Mus musculus
cttttcctagcttttctagcctaag

SEQ ID NO: 401447 - DNA, 25 bp, Mus musculus
cttttcctatccagattcaaatggg

SEQ ID NO: 401448 - DNA, 25 bp, Mus musculus
cttttcctatcctgattcaaatggg

SEQ ID NO: 401449 - DNA, 25 bp, Mus musculus
cttttcctcaggcatacattggcct

SEQ ID NO: 401450 - DNA, 25 bp, Mus musculus
cttttcctcagggatacattggcct

SEQ ID NO: 401451 - DNA, 25 bp, Mus musculus
cttttcctccaaaaaattgctatgt

SEQ ID NO: 401452 - DNA, 25 bp, Mus musculus
cttttcctccaataaattgctatgt

SEQ ID NO: 401453 - DNA, 25 bp, Mus musculus
cttttcctccacaattctaacagtg

SEQ ID NO: 401454 - DNA, 25 bp, Mus musculus
cttttcctccactattctaacagtg

SEQ ID NO: 401455 - DNA, 25 bp, Mus musculus
cttttcctcggcaatacatatacct

SEQ ID NO: 401456 - DNA, 25 bp, Mus musculus
cttttcctcggctatacatatacct

SEQ ID NO: 401457 - DNA, 25 bp, Mus musculus
cttttcctcgttcgtgttgctgatt

SEQ ID NO: 401458 - DNA, 25 bp, Mus musculus
cttttcctcgttggtgttgctgatt

SEQ ID NO: 401459 - DNA, 25 bp, Mus musculus
cttttcctctttaggcacattgaat

SEQ ID NO: 401460 - DNA, 25 bp, Mus musculus
cttttcctcttttggcacattgaat

SEQ ID NO: 401461 - DNA, 25 bp, Mus musculus
cttttcctgaagatcaactctctat

SEQ ID NO: 401462 - DNA, 25 bp, Mus musculus
cttttcctgaagttcaactctctat

SEQ ID NO: 401463 - DNA, 25 bp, Mus musculus
cttttcctgaccatttatacaaatg

SEQ ID NO: 401464 - DNA, 25 bp, Mus musculus
cttttcctgaccttttatacaaatg

SEQ ID NO: 401465 - DNA, 25 bp, Mus musculus
cttttcctgatcactatgcattttg

SEQ ID NO: 401466 - DNA, 25 bp, Mus musculus
cttttcctgatctctatgcattttg

SEQ ID NO: 401467 - DNA, 25 bp, Mus musculus
cttttcctggacacttcctagcgcc

SEQ ID NO: 401468 - DNA, 25 bp, Mus musculus
cttttcctggactcttcctagcgcc

SEQ ID NO: 401469 - DNA, 25 bp, Mus musculus
cttttcctgggaccagatctgcctg

SEQ ID NO: 401470 - DNA, 25 bp, Mus musculus
cttttcctgggagcagatctgcctg

SEQ ID NO: 401471 - DNA, 25 bp, Mus musculus
cttttcctgtaacactccactgtgc

SEQ ID NO: 401472 - DNA, 25 bp, Mus musculus
cttttcctgtaagactccactgtgc

SEQ ID NO: 401473 - DNA, 25 bp, Mus musculus
cttttcctgtgtccagaactgactc

SEQ ID NO: 401474 - DNA, 25 bp, Mus musculus
cttttcctgtgtgcagaactgactc

SEQ ID NO: 401475 - DNA, 25 bp, Mus musculus
cttttccttaacatggtgggtgagt

SEQ ID NO: 401476 - DNA, 25 bp, Mus musculus
cttttccttaacttggtgggtgagt

SEQ ID NO: 401477 - DNA, 25 bp, Mus musculus
cttttccttcaccagcagtgggata

SEQ ID NO: 401478 - DNA, 25 bp, Mus musculus
cttttccttcacgagcagtgggata

SEQ ID NO: 401479 - DNA, 25 bp, Mus musculus
cttttccttctgcacatgcactgga

SEQ ID NO: 401480 - DNA, 25 bp, Mus musculus
cttttccttctggacatgcactgga

SEQ ID NO: 401481 - DNA, 25 bp, Mus musculus
cttttccttggccagtttcagactc

SEQ ID NO: 401482 - DNA, 25 bp, Mus musculus
cttttccttggcgagtttcagactc

SEQ ID NO: 401483 - DNA, 25 bp, Mus musculus
cttttccttttgaattactgggcag

SEQ ID NO: 401484 - DNA, 25 bp, Mus musculus
cttttccttttgtattactgggcag

SEQ ID NO: 401485 - DNA, 25 bp, Mus musculus
cttttcgcattcaccatgatttccc

SEQ ID NO: 401486 - DNA, 25 bp, Mus musculus
cttttcgcattctccatgatttccc

SEQ ID NO: 401487 - DNA, 25 bp, Mus musculus
cttttcgctttacccatggcggaga

SEQ ID NO: 401488 - DNA, 25 bp, Mus musculus
cttttcgctttagccatggcggaga

SEQ ID NO: 401489 - DNA, 25 bp, Mus musculus
cttttcggttgtaggcagagcagag

SEQ ID NO: 401490 - DNA, 25 bp, Mus musculus
cttttcggttgttggcagagcagag

SEQ ID NO: 401491 - DNA, 25 bp, Mus musculus
cttttctaactcacttgggaacatt

SEQ ID NO: 401492 - DNA, 25 bp, Mus musculus
cttttctaactctcttgggaacatt

SEQ ID NO: 401493 - DNA, 25 bp, Mus musculus
cttttctaccgtctggcatttgcca

SEQ ID NO: 401494 - DNA, 25 bp, Mus musculus
cttttctaccgtgtggcatttgcca

SEQ ID NO: 401495 - DNA, 25 bp, Mus musculus
cttttctagaaaccccgagacctct

SEQ ID NO: 401496 - DNA, 25 bp, Mus musculus
cttttctagaaagcccgagacctct

SEQ ID NO: 401497 - DNA, 25 bp, Mus musculus
cttttctatattcaggtggccacca

SEQ ID NO: 401498 - DNA, 25 bp, Mus musculus
cttttctatattgaggtggccacca

SEQ ID NO: 401499 - DNA, 25 bp, Mus musculus
cttttctatggccaggactctctga

SEQ ID NO: 401500 - DNA, 25 bp, Mus musculus
cttttctatggcgaggactctctga

SEQ ID NO: 401501 - DNA, 25 bp, Mus musculus
cttttctcacatcagcacatgcttt

SEQ ID NO: 401502 - DNA, 25 bp, Mus musculus
cttttctcacatgagcacatgcttt

SEQ ID NO: 401503 - DNA, 25 bp, Mus musculus
cttttctcagatcaggtccgtctaa

SEQ ID NO: 401504 - DNA, 25 bp, Mus musculus
cttttctcagatgaggtccgtctaa

SEQ ID NO: 401505 - DNA, 25 bp, Mus musculus
cttttctcagggactctaggtcaaa

SEQ ID NO: 401506 - DNA, 25 bp, Mus musculus
cttttctcagggtctctaggtcaaa

SEQ ID NO: 401507 - DNA, 25 bp, Mus musculus
cttttctcatctcacgttaggctaa

SEQ ID NO: 401508 - DNA, 25 bp, Mus musculus
cttttctcatctgacgttaggctaa

SEQ ID NO: 401509 - DNA, 25 bp, Mus musculus
cttttctcatggcacttgaagtgac

SEQ ID NO: 401510 - DNA, 25 bp, Mus musculus
cttttctcatgggacttgaagtgac

SEQ ID NO: 401511 - DNA, 25 bp, Mus musculus
cttttctcatttcaactcctgtgat

SEQ ID NO: 401512 - DNA, 25 bp, Mus musculus
cttttctcatttgaactcctgtgat

SEQ ID NO: 401513 - DNA, 25 bp, Mus musculus
cttttctccaatcgcttcgcaggaa

SEQ ID NO: 401514 - DNA, 25 bp, Mus musculus
cttttctccaatggcttcgcaggaa

SEQ ID NO: 401515 - DNA, 25 bp, Mus musculus
cttttctccctgcatgtgatggtga

SEQ ID NO: 401516 - DNA, 25 bp, Mus musculus
cttttctccctggatgtgatggtga

SEQ ID NO: 401517 - DNA, 25 bp, Mus musculus
cttttctcctatatcctgtactcta

SEQ ID NO: 401518 - DNA, 25 bp, Mus musculus
cttttctcctatttcctgtactcta

SEQ ID NO: 401519 - DNA, 25 bp, Mus musculus
cttttctcgaagcatgacaagtgta

SEQ ID NO: 401520 - DNA, 25 bp, Mus musculus
cttttctcgaaggatgacaagtgta

SEQ ID NO: 401521 - DNA, 25 bp, Mus musculus
cttttctctactagacaccttttga

SEQ ID NO: 401522 - DNA, 25 bp, Mus musculus
cttttctctacttgacaccttttga

SEQ ID NO: 401523 - DNA, 25 bp, Mus musculus
cttttctctcataatgttctttcaa

SEQ ID NO: 401524 - DNA, 25 bp, Mus musculus
cttttctctcattatgttctttcaa

SEQ ID NO: 401525 - DNA, 25 bp, Mus musculus
cttttctctccacacatctgagata

SEQ ID NO: 401526 - DNA, 25 bp, Mus musculus
cttttctctccagacatctgagata

SEQ ID NO: 401527 - DNA, 25 bp, Mus musculus
cttttctctctgaaggccctaagaa

SEQ ID NO: 401528 - DNA, 25 bp, Mus musculus
cttttctctctgtaggccctaagaa

SEQ ID NO: 401529 - DNA, 25 bp, Mus musculus
cttttctctgatatggcccattcga

SEQ ID NO: 401530 - DNA, 25 bp, Mus musculus
cttttctctgatttggcccattcga

SEQ ID NO: 401531 - DNA, 25 bp, Mus musculus
cttttctctggacctcatcgaacga

SEQ ID NO: 401532 - DNA, 25 bp, Mus musculus
cttttctctggagctcatcgaacga

SEQ ID NO: 401533 - DNA, 25 bp, Mus musculus
cttttctcttataggttgctgtgtc

SEQ ID NO: 401534 - DNA, 25 bp, Mus musculus
cttttctcttattggttgctgtgtc

SEQ ID NO: 401535 - DNA, 25 bp, Mus musculus
cttttctctttcagactttggcatc

SEQ ID NO: 401536 - DNA, 25 bp, Mus musculus
cttttctctttctgactttggcatc

SEQ ID NO: 401537 - DNA, 25 bp, Mus musculus
cttttctctttgctctcatagacag

SEQ ID NO: 401538 - DNA, 25 bp, Mus musculus
cttttctctttggtctcatagacag

SEQ ID NO: 401539 - DNA, 25 bp, Mus musculus
cttttctggactacaatctttcaca

SEQ ID NO: 401540 - DNA, 25 bp, Mus musculus
cttttctggacttcaatctttcaca

SEQ ID NO: 401541 - DNA, 25 bp, Mus musculus
cttttctgtaaaaaggagcctgcct

SEQ ID NO: 401542 - DNA, 25 bp, Mus musculus
cttttctgtaaataggagcctgcct

SEQ ID NO: 401543 - DNA, 25 bp, Mus musculus
cttttctgtactactaatttttgct

SEQ ID NO: 401544 - DNA, 25 bp, Mus musculus
cttttctgtacttctaatttttgct

SEQ ID NO: 401545 - DNA, 25 bp, Mus musculus
cttttctgtcatatggcatttcctg

SEQ ID NO: 401546 - DNA, 25 bp, Mus musculus
cttttctgtcatttggcatttcctg

SEQ ID NO: 401547 - DNA, 25 bp, Mus musculus
cttttctgtgtgaccatttcctgtg

SEQ ID NO: 401548 - DNA, 25 bp, Mus musculus
cttttctgtgtgtccatttcctgtg

SEQ ID NO: 401549 - DNA, 25 bp, Mus musculus
cttttctgtttcaagtgacatgttt

SEQ ID NO: 401550 - DNA, 25 bp, Mus musculus
cttttctgtttctagtgacatgttt

SEQ ID NO: 401551 - DNA, 25 bp, Mus musculus
cttttcttagtacttgcccaaggtg

SEQ ID NO: 401552 - DNA, 25 bp, Mus musculus
cttttcttagtagttgcccaaggtg

SEQ ID NO: 401553 - DNA, 25 bp, Mus musculus
cttttcttcaagacatactgtattt

SEQ ID NO: 401554 - DNA, 25 bp, Mus musculus
cttttcttcaagtcatactgtattt

SEQ ID NO: 401555 - DNA, 25 bp, Mus musculus
cttttcttcagaaaccagatttgat

SEQ ID NO: 401556 - DNA, 25 bp, Mus musculus
cttttcttcagataccagatttgat

SEQ ID NO: 401557 - DNA, 25 bp, Mus musculus
cttttcttcagcatcggtgagggag

SEQ ID NO: 401558 - DNA, 25 bp, Mus musculus
cttttcttcagcttcggtgagggag

SEQ ID NO: 401559 - DNA, 25 bp, Mus musculus
cttttcttctaaatccatgggcacc

SEQ ID NO: 401560 - DNA, 25 bp, Mus musculus
cttttcttctaattccatgggcacc

SEQ ID NO: 401561 - DNA, 25 bp, Mus musculus
cttttcttctcgagggctctgaaag

SEQ ID NO: 401562 - DNA, 25 bp, Mus musculus
cttttcttctcgtgggctctgaaag

SEQ ID NO: 401563 - DNA, 25 bp, Mus musculus
cttttcttgatacgcctagtacaat

SEQ ID NO: 401564 - DNA, 25 bp, Mus musculus
cttttcttgataggcctagtacaat

SEQ ID NO: 401565 - DNA, 25 bp, Mus musculus
cttttctttatactccttttccatg

SEQ ID NO: 401566 - DNA, 25 bp, Mus musculus
cttttctttatagtccttttccatg

SEQ ID NO: 401567 - DNA, 25 bp, Mus musculus
cttttctttcatagatctcagacta

SEQ ID NO: 401568 - DNA, 25 bp, Mus musculus
cttttctttcattgatctcagacta

SEQ ID NO: 401569 - DNA, 25 bp, Mus musculus
cttttctttcctagcattctttctg

SEQ ID NO: 401570 - DNA, 25 bp, Mus musculus
cttttctttccttgcattctttctg

SEQ ID NO: 401571 - DNA, 25 bp, Mus musculus
cttttctttcttacgatgaggcatg

SEQ ID NO: 401572 - DNA, 25 bp, Mus musculus
cttttctttctttcgatgaggcatg

SEQ ID NO: 401573 - DNA, 25 bp, Mus musculus
cttttctttgttctagggacagtct

SEQ ID NO: 401574 - DNA, 25 bp, Mus musculus
cttttctttgttgtagggacagtct

SEQ ID NO: 401575 - DNA, 25 bp, Mus musculus
cttttcttttctcgagtgtgtggtg

SEQ ID NO: 401576 - DNA, 25 bp, Mus musculus
cttttcttttctggagtgtgtggtg

SEQ ID NO: 401577 - DNA, 25 bp, Mus musculus
cttttgaaagtgagtttgcctccct

SEQ ID NO: 401578 - DNA, 25 bp, Mus musculus
cttttgaaagtgtgtttgcctccct

SEQ ID NO: 401579 - DNA, 25 bp, Mus musculus
cttttgacaacaacagggcctggct

SEQ ID NO: 401580 - DNA, 25 bp, Mus musculus
cttttgacaacactaggtagcattt

SEQ ID NO: 401581 - DNA, 25 bp, Mus musculus
cttttgacaacagtaggtagcattt

SEQ ID NO: 401582 - DNA, 25 bp, Mus musculus
cttttgacaacatcagggcctggct

SEQ ID NO: 401583 - DNA, 25 bp, Mus musculus
cttttgacaggaacccttggccagg

SEQ ID NO: 401584 - DNA, 25 bp, Mus musculus
cttttgacaggatcccttggccagg

SEQ ID NO: 401585 - DNA, 25 bp, Mus musculus
cttttgacatgtcctgttggccagt

SEQ ID NO: 401586 - DNA, 25 bp, Mus musculus
cttttgacatgtgctgttggccagt

SEQ ID NO: 401587 - DNA, 25 bp, Mus musculus
cttttgacccacactgtagtggcaa

SEQ ID NO: 401588 - DNA, 25 bp, Mus musculus
cttttgacccactctgtagtggcaa

SEQ ID NO: 401589 - DNA, 25 bp, Mus musculus
cttttgataccaacttgttttcttt

SEQ ID NO: 401590 - DNA, 25 bp, Mus musculus
cttttgataccatcttgttttcttt

SEQ ID NO: 401591 - DNA, 25 bp, Mus musculus
cttttgatcttcagattcctcttgg

SEQ ID NO: 401592 - DNA, 25 bp, Mus musculus
cttttgatcttctgattcctcttgg

SEQ ID NO: 401593 - DNA, 25 bp, Mus musculus
cttttgatgcatcccgtctggaaga

SEQ ID NO: 401594 - DNA, 25 bp, Mus musculus
cttttgatgcatgccgtctggaaga

SEQ ID NO: 401595 - DNA, 25 bp, Mus musculus
cttttgattccaatgtcttttatga

SEQ ID NO: 401596 - DNA, 25 bp, Mus musculus
cttttgattccattgtcttttatga

SEQ ID NO: 401597 - DNA, 25 bp, Mus musculus
cttttgattgttcgagcagcgtgtg

SEQ ID NO: 401598 - DNA, 25 bp, Mus musculus
cttttgattgttggagcagcgtgtg

SEQ ID NO: 401599 - DNA, 25 bp, Mus musculus
cttttgcactttattacggacctat

SEQ ID NO: 401600 - DNA, 25 bp, Mus musculus
cttttgcacttttttacggacctat

SEQ ID NO: 401601 - DNA, 25 bp, Mus musculus
cttttgcagcccaagagctgggaca

SEQ ID NO: 401602 - DNA, 25 bp, Mus musculus
cttttgcagccctagagctgggaca

SEQ ID NO: 401603 - DNA, 25 bp, Mus musculus
cttttgcatgctaaaggatcccaaa

SEQ ID NO: 401604 - DNA, 25 bp, Mus musculus
cttttgcatgcttaaggatcccaaa

SEQ ID NO: 401605 - DNA, 25 bp, Mus musculus
cttttgcatttgatcatattccaaa

SEQ ID NO: 401606 - DNA, 25 bp, Mus musculus
cttttgcatttgttcatattccaaa

SEQ ID NO: 401607 - DNA, 25 bp, Mus musculus
cttttgccaagaagctacagctaaa

SEQ ID NO: 401608 - DNA, 25 bp, Mus musculus
cttttgccaagatgctacagctaaa

SEQ ID NO: 401609 - DNA, 25 bp, Mus musculus
cttttgccacttattgacatcagtg

SEQ ID NO: 401610 - DNA, 25 bp, Mus musculus
cttttgccactttttgacatcagtg

SEQ ID NO: 401611 - DNA, 25 bp, Mus musculus
cttttgccagacctagctgactaga

SEQ ID NO: 401612 - DNA, 25 bp, Mus musculus
cttttgccagacgtagctgactaga

SEQ ID NO: 401613 - DNA, 25 bp, Mus musculus
cttttgccatcacccctaaagaaag

SEQ ID NO: 401614 - DNA, 25 bp, Mus musculus
cttttgccatcagccctaaagaaag

SEQ ID NO: 401615 - DNA, 25 bp, Mus musculus
cttttgccccatcacagtgatcctg

SEQ ID NO: 401616 - DNA, 25 bp, Mus musculus
cttttgccccatgacagtgatcctg

SEQ ID NO: 401617 - DNA, 25 bp, Mus musculus
cttttgccctatactgagctgtgaa

SEQ ID NO: 401618 - DNA, 25 bp, Mus musculus
cttttgccctattctgagctgtgaa

SEQ ID NO: 401619 - DNA, 25 bp, Mus musculus
cttttgcctagtagccacatctcag

SEQ ID NO: 401620 - DNA, 25 bp, Mus musculus
cttttgcctagttgccacatctcag

SEQ ID NO: 401621 - DNA, 25 bp, Mus musculus
cttttgcctcagaaggagtgggtta

SEQ ID NO: 401622 - DNA, 25 bp, Mus musculus
cttttgcctcagtaggagtgggtta

SEQ ID NO: 401623 - DNA, 25 bp, Mus musculus
cttttgcgctgaaggatgaccacat

SEQ ID NO: 401624 - DNA, 25 bp, Mus musculus
cttttgcgctgatggatgaccacat

SEQ ID NO: 401625 - DNA, 25 bp, Mus musculus
cttttgctacaaacgagtggccacc

SEQ ID NO: 401626 - DNA, 25 bp, Mus musculus
cttttgctacaatcgagtggccacc

SEQ ID NO: 401627 - DNA, 25 bp, Mus musculus
cttttgctctgtcatgttacatcct

SEQ ID NO: 401628 - DNA, 25 bp, Mus musculus
cttttgctctgtgatgttacatcct

SEQ ID NO: 401629 - DNA, 25 bp, Mus musculus
cttttgctcttcctagtggcaccct

SEQ ID NO: 401630 - DNA, 25 bp, Mus musculus
cttttgctcttcgtagtggcaccct

SEQ ID NO: 401631 - DNA, 25 bp, Mus musculus
cttttgctgcgaatggaggctacaa

SEQ ID NO: 401632 - DNA, 25 bp, Mus musculus
cttttgctgcgattggaggctacaa

SEQ ID NO: 401633 - DNA, 25 bp, Mus musculus
cttttgctggctctacatcatgtaa

SEQ ID NO: 401634 - DNA, 25 bp, Mus musculus
cttttgctggctgtacatcatgtaa

SEQ ID NO: 401635 - DNA, 25 bp, Mus musculus
cttttgctggttaggttcattgttg

SEQ ID NO: 401636 - DNA, 25 bp, Mus musculus
cttttgctggtttggttcattgttg

SEQ ID NO: 401637 - DNA, 25 bp, Mus musculus
cttttgctgtaaaactgcttgagtc

SEQ ID NO: 401638 - DNA, 25 bp, Mus musculus
cttttgctgtaatactgcttgagtc

SEQ ID NO: 401639 - DNA, 25 bp, Mus musculus
cttttgcttatacttttactgtaca

SEQ ID NO: 401640 - DNA, 25 bp, Mus musculus
cttttgcttatagttttactgtaca

SEQ ID NO: 401641 - DNA, 25 bp, Mus musculus
cttttgcttatgacaactttcttga

SEQ ID NO: 401642 - DNA, 25 bp, Mus musculus
cttttgcttatgtcaactttcttga

SEQ ID NO: 401643 - DNA, 25 bp, Mus musculus
cttttgcttggtatgtcaggtagac

SEQ ID NO: 401644 - DNA, 25 bp, Mus musculus
cttttgcttggtttgtcaggtagac

SEQ ID NO: 401645 - DNA, 25 bp, Mus musculus
cttttggagctgatgattggaacct

SEQ ID NO: 401646 - DNA, 25 bp, Mus musculus
cttttggagctgttgattggaacct

SEQ ID NO: 401647 - DNA, 25 bp, Mus musculus
cttttggagcttcagttctatctac

SEQ ID NO: 401648 - DNA, 25 bp, Mus musculus
cttttggagcttgagttctatctac

SEQ ID NO: 401649 - DNA, 25 bp, Mus musculus
cttttggaggagcaacagttcttca

SEQ ID NO: 401650 - DNA, 25 bp, Mus musculus
cttttggaggaggaacagttcttca

SEQ ID NO: 401651 - DNA, 25 bp, Mus musculus
cttttggaggtgcactgtgcctttc

SEQ ID NO: 401652 - DNA, 25 bp, Mus musculus
cttttggaggtggactgtgcctttc

SEQ ID NO: 401653 - DNA, 25 bp, Mus musculus
cttttggattagatatgtgtataga

SEQ ID NO: 401654 - DNA, 25 bp, Mus musculus
cttttggattagttatgtgtataga

SEQ ID NO: 401655 - DNA, 25 bp, Mus musculus
cttttggccacgctacgtgaaggtg

SEQ ID NO: 401656 - DNA, 25 bp, Mus musculus
cttttggccacggtacgtgaaggtg

SEQ ID NO: 401657 - DNA, 25 bp, Mus musculus
cttttggcctccaggatgggggtca

SEQ ID NO: 401658 - DNA, 25 bp, Mus musculus
cttttggcctccattagcatgtgtt

SEQ ID NO: 401659 - DNA, 25 bp, Mus musculus
cttttggcctcctggatgggggtca

SEQ ID NO: 401660 - DNA, 25 bp, Mus musculus
cttttggcctcctttagcatgtgtt

SEQ ID NO: 401661 - DNA, 25 bp, Mus musculus
cttttggctcctaagatctgctgga

SEQ ID NO: 401662 - DNA, 25 bp, Mus musculus
cttttggctccttagatctgctgga

SEQ ID NO: 401663 - DNA, 25 bp, Mus musculus
cttttggctggcacattgtgtagga

SEQ ID NO: 401664 - DNA, 25 bp, Mus musculus
cttttggctggctcattgtgtagga

SEQ ID NO: 401665 - DNA, 25 bp, Mus musculus
cttttggcttttctaatttgtactg

SEQ ID NO: 401666 - DNA, 25 bp, Mus musculus
cttttggcttttgtaatttgtactg

SEQ ID NO: 401667 - DNA, 25 bp, Mus musculus
cttttgggataccacctgaggttat

SEQ ID NO: 401668 - DNA, 25 bp, Mus musculus
cttttgggatacgacctgaggttat

SEQ ID NO: 401669 - DNA, 25 bp, Mus musculus
cttttgggatcgatctctgtgagat

SEQ ID NO: 401670 - DNA, 25 bp, Mus musculus
cttttgggatcgttctctgtgagat

SEQ ID NO: 401671 - DNA, 25 bp, Mus musculus
cttttgggatgacaacgctggcaaa

SEQ ID NO: 401672 - DNA, 25 bp, Mus musculus
cttttgggatgagaacgctggcaaa

SEQ ID NO: 401673 - DNA, 25 bp, Mus musculus
cttttgggattgatgacggcctgta

SEQ ID NO: 401674 - DNA, 25 bp, Mus musculus
cttttgggattgttgacggcctgta

SEQ ID NO: 401675 - DNA, 25 bp, Mus musculus
cttttgggcaggaagacagactctt

SEQ ID NO: 401676 - DNA, 25 bp, Mus musculus
cttttgggcaggtagacagactctt

SEQ ID NO: 401677 - DNA, 25 bp, Mus musculus
cttttgggcataatagtacaactat

SEQ ID NO: 401678 - DNA, 25 bp, Mus musculus
cttttgggcatattagtacaactat

SEQ ID NO: 401679 - DNA, 25 bp, Mus musculus
cttttgggcatccttagtcaatgaa

SEQ ID NO: 401680 - DNA, 25 bp, Mus musculus
cttttgggcatcgttagtcaatgaa

SEQ ID NO: 401681 - DNA, 25 bp, Mus musculus
cttttgggcctaacatgccttttga

SEQ ID NO: 401682 - DNA, 25 bp, Mus musculus
cttttgggcctatcatgccttttga

SEQ ID NO: 401683 - DNA, 25 bp, Mus musculus
cttttgggtaatcctggccaggcag

SEQ ID NO: 401684 - DNA, 25 bp, Mus musculus
cttttgggtaatgctggccaggcag

SEQ ID NO: 401685 - DNA, 25 bp, Mus musculus
cttttgggtaccaagcggagctgaa

SEQ ID NO: 401686 - DNA, 25 bp, Mus musculus
cttttgggtacctagcggagctgaa

SEQ ID NO: 401687 - DNA, 25 bp, Mus musculus
cttttggtctccatggatttgaaaa

SEQ ID NO: 401688 - DNA, 25 bp, Mus musculus
cttttggtctccttggatttgaaaa

SEQ ID NO: 401689 - DNA, 25 bp, Mus musculus
cttttggtgaccaggaactagatca

SEQ ID NO: 401690 - DNA, 25 bp, Mus musculus
cttttggtgacctggaactagatca

SEQ ID NO: 401691 - DNA, 25 bp, Mus musculus
cttttggtgatgatcgtgctgggct

SEQ ID NO: 401692 - DNA, 25 bp, Mus musculus
cttttggtgatgttcgtgctgggct

SEQ ID NO: 401693 - DNA, 25 bp, Mus musculus
cttttggttagcatcgtcactcact

SEQ ID NO: 401694 - DNA, 25 bp, Mus musculus
cttttggttagcttcgtcactcact

SEQ ID NO: 401695 - DNA, 25 bp, Mus musculus
cttttggttctcagcacggccacag

SEQ ID NO: 401696 - DNA, 25 bp, Mus musculus
cttttggttctctgcacggccacag

SEQ ID NO: 401697 - DNA, 25 bp, Mus musculus
cttttgtaccttagaagatttgtct

SEQ ID NO: 401698 - DNA, 25 bp, Mus musculus
cttttgtacctttgaagatttgtct

SEQ ID NO: 401699 - DNA, 25 bp, Mus musculus
cttttgtactgacccggctgggagc

SEQ ID NO: 401700 - DNA, 25 bp, Mus musculus
cttttgtactgagccggctgggagc

SEQ ID NO: 401701 - DNA, 25 bp, Mus musculus
cttttgtcacaaagatgaatgcaca

SEQ ID NO: 401702 - DNA, 25 bp, Mus musculus
cttttgtcacaatgatgaatgcaca

SEQ ID NO: 401703 - DNA, 25 bp, Mus musculus
cttttgtccagtaaggctcagcttg

SEQ ID NO: 401704 - DNA, 25 bp, Mus musculus
cttttgtccagttaggctcagcttg

SEQ ID NO: 401705 - DNA, 25 bp, Mus musculus
cttttgtcccttcccttttgtctgg

SEQ ID NO: 401706 - DNA, 25 bp, Mus musculus
cttttgtcccttgccttttgtctgg

SEQ ID NO: 401707 - DNA, 25 bp, Mus musculus
cttttgtctagcaccttagtaccaa

SEQ ID NO: 401708 - DNA, 25 bp, Mus musculus
cttttgtctagctccttagtaccaa

SEQ ID NO: 401709 - DNA, 25 bp, Mus musculus
cttttgtcttctattcgtgtaaata

SEQ ID NO: 401710 - DNA, 25 bp, Mus musculus
cttttgtcttcttttcgtgtaaata

SEQ ID NO: 401711 - DNA, 25 bp, Mus musculus
cttttgtcttttatgaggtagcgtc

SEQ ID NO: 401712 - DNA, 25 bp, Mus musculus
cttttgtcttttttgaggtagcgtc

SEQ ID NO: 401713 - DNA, 25 bp, Mus musculus
cttttgtgacaacctggaatacttt

SEQ ID NO: 401714 - DNA, 25 bp, Mus musculus
cttttgtgacaagctggaatacttt

SEQ ID NO: 401715 - DNA, 25 bp, Mus musculus
cttttgtgacacagtggtttaccgg

SEQ ID NO: 401716 - DNA, 25 bp, Mus musculus
cttttgtgacactgtggtttaccgg

SEQ ID NO: 401717 - DNA, 25 bp, Mus musculus
cttttgtgccatattagggtggaga

SEQ ID NO: 401718 - DNA, 25 bp, Mus musculus
cttttgtgccattttagggtggaga

SEQ ID NO: 401719 - DNA, 25 bp, Mus musculus
cttttgtggaacaggcagctctgcc

SEQ ID NO: 401720 - DNA, 25 bp, Mus musculus
cttttgtggaactggcagctctgcc

SEQ ID NO: 401721 - DNA, 25 bp, Mus musculus
cttttgtggtgacggcccgactgct

SEQ ID NO: 401722 - DNA, 25 bp, Mus musculus
cttttgtggtgagggcccgactgct

SEQ ID NO: 401723 - DNA, 25 bp, Mus musculus
cttttgtgtatactcggctttgtca

SEQ ID NO: 401724 - DNA, 25 bp, Mus musculus
cttttgtgtatagtcggctttgtca

SEQ ID NO: 401725 - DNA, 25 bp, Mus musculus
cttttgtgtcaaacctagtgtgtct

SEQ ID NO: 401726 - DNA, 25 bp, Mus musculus
cttttgtgtcaatcctagtgtgtct

SEQ ID NO: 401727 - DNA, 25 bp, Mus musculus
cttttgtgtcatcttgcagcagagt

SEQ ID NO: 401728 - DNA, 25 bp, Mus musculus
cttttgtgtcatgttgcagcagagt

SEQ ID NO: 401729 - DNA, 25 bp, Mus musculus
cttttgttatctagctgtttcctgt

SEQ ID NO: 401730 - DNA, 25 bp, Mus musculus
cttttgttatcttgctgtttcctgt

SEQ ID NO: 401731 - DNA, 25 bp, Mus musculus
cttttgttatttcctctagtagtca

SEQ ID NO: 401732 - DNA, 25 bp, Mus musculus
cttttgttatttgctctagtagtca

SEQ ID NO: 401733 - DNA, 25 bp, Mus musculus
cttttgttcaacacatagcgattct

SEQ ID NO: 401734 - DNA, 25 bp, Mus musculus
cttttgttcaactcatagcgattct

SEQ ID NO: 401735 - DNA, 25 bp, Mus musculus
cttttgttccacagtactcatgtta

SEQ ID NO: 401736 - DNA, 25 bp, Mus musculus
cttttgttccactgtactcatgtta

SEQ ID NO: 401737 - DNA, 25 bp, Mus musculus
cttttgttcccacccagctaactgc

SEQ ID NO: 401738 - DNA, 25 bp, Mus musculus
cttttgttcccagccagctaactgc

SEQ ID NO: 401739 - DNA, 25 bp, Mus musculus
cttttgttctgaattctctgtgaga

SEQ ID NO: 401740 - DNA, 25 bp, Mus musculus
cttttgttctgatttctctgtgaga

SEQ ID NO: 401741 - DNA, 25 bp, Mus musculus
cttttgttctgtcattatggattct

SEQ ID NO: 401742 - DNA, 25 bp, Mus musculus
cttttgttctgtgattatggattct

SEQ ID NO: 401743 - DNA, 25 bp, Mus musculus
cttttgttggcaagcactaagcata

SEQ ID NO: 401744 - DNA, 25 bp, Mus musculus
cttttgttggcatgcactaagcata

SEQ ID NO: 401745 - DNA, 25 bp, Mus musculus
cttttgttggttccccacattttga

SEQ ID NO: 401746 - DNA, 25 bp, Mus musculus
cttttgttggttgcccacattttga

SEQ ID NO: 401747 - DNA, 25 bp, Mus musculus
cttttgtttaacatgatgggttcca

SEQ ID NO: 401748 - DNA, 25 bp, Mus musculus
cttttgtttaacttgatgggttcca

SEQ ID NO: 401749 - DNA, 25 bp, Mus musculus
cttttgttttgcatttacagtctgg

SEQ ID NO: 401750 - DNA, 25 bp, Mus musculus
cttttgttttgcttttacagtctgg

SEQ ID NO: 401751 - DNA, 25 bp, Mus musculus
ctttttaaagacaatatcaacttga

SEQ ID NO: 401752 - DNA, 25 bp, Mus musculus
ctttttaaagactatatcaacttga

SEQ ID NO: 401753 - DNA, 25 bp, Mus musculus
ctttttaaagctcctaggtggcggt

SEQ ID NO: 401754 - DNA, 25 bp, Mus musculus
ctttttaaagctgctaggtggcggt

SEQ ID NO: 401755 - DNA, 25 bp, Mus musculus
ctttttacattcagaagatgctgct

SEQ ID NO: 401756 - DNA, 25 bp, Mus musculus
ctttttacattctgaagatgctgct

SEQ ID NO: 401757 - DNA, 25 bp, Mus musculus
ctttttacccttactgcaagctgaa

SEQ ID NO: 401758 - DNA, 25 bp, Mus musculus
ctttttaccctttctgcaagctgaa

SEQ ID NO: 401759 - DNA, 25 bp, Mus musculus
ctttttacgtgaccgcataatccca

SEQ ID NO: 401760 - DNA, 25 bp, Mus musculus
ctttttacgtgagcgcataatccca

SEQ ID NO: 401761 - DNA, 25 bp, Mus musculus
ctttttagggttctctgtgtgtgta

SEQ ID NO: 401762 - DNA, 25 bp, Mus musculus
ctttttagggttgtctgtgtgtgta

SEQ ID NO: 401763 - DNA, 25 bp, Mus musculus
ctttttaggtggctaatcatcggct

SEQ ID NO: 401764 - DNA, 25 bp, Mus musculus
ctttttaggtgggtaatcatcggct

SEQ ID NO: 401765 - DNA, 25 bp, Mus musculus
ctttttagttctctgcatgcattaa

SEQ ID NO: 401766 - DNA, 25 bp, Mus musculus
ctttttagttctgtgcatgcattaa

SEQ ID NO: 401767 - DNA, 25 bp, Mus musculus
ctttttataggccttgtgagagctg

SEQ ID NO: 401768 - DNA, 25 bp, Mus musculus
ctttttataggcgttgtgagagctg

SEQ ID NO: 401769 - DNA, 25 bp, Mus musculus
ctttttatatacatacttatgagca

SEQ ID NO: 401770 - DNA, 25 bp, Mus musculus
ctttttatatacttacttatgagca

SEQ ID NO: 401771 - DNA, 25 bp, Mus musculus
ctttttatatcacctcctagagtat

SEQ ID NO: 401772 - DNA, 25 bp, Mus musculus
ctttttatatcagctcctagagtat

SEQ ID NO: 401773 - DNA, 25 bp, Mus musculus
ctttttatatggcaacgctggctta

SEQ ID NO: 401774 - DNA, 25 bp, Mus musculus
ctttttatatgggaacgctggctta

SEQ ID NO: 401775 - DNA, 25 bp, Mus musculus
ctttttatccaaacatgaggccagg

SEQ ID NO: 401776 - DNA, 25 bp, Mus musculus
ctttttatccaatcatgaggccagg

SEQ ID NO: 401777 - DNA, 25 bp, Mus musculus
ctttttatgattcctgtaccgaccc

SEQ ID NO: 401778 - DNA, 25 bp, Mus musculus
ctttttatgattgctgtaccgaccc

SEQ ID NO: 401779 - DNA, 25 bp, Mus musculus
ctttttatttctcggtgactgtggc

SEQ ID NO: 401780 - DNA, 25 bp, Mus musculus
ctttttatttctgggtgactgtggc

SEQ ID NO: 401781 - DNA, 25 bp, Mus musculus
ctttttcaaaacactgcttcagcaa

SEQ ID NO: 401782 - DNA, 25 bp, Mus musculus
ctttttcaaaactctgcttcagcaa

SEQ ID NO: 401783 - DNA, 25 bp, Mus musculus
ctttttcaagacctaactgcagccg

SEQ ID NO: 401784 - DNA, 25 bp, Mus musculus
ctttttcaagacgtaactgcagccg

SEQ ID NO: 401785 - DNA, 25 bp, Mus musculus
ctttttcaatatataggttagcata

SEQ ID NO: 401786 - DNA, 25 bp, Mus musculus
ctttttcaatatttaggttagcata

SEQ ID NO: 401787 - DNA, 25 bp, Mus musculus
ctttttcaatggatgggacaatggc

SEQ ID NO: 401788 - DNA, 25 bp, Mus musculus
ctttttcaatggttgggacaatggc

SEQ ID NO: 401789 - DNA, 25 bp, Mus musculus
ctttttcacacaaccttgcttttga

SEQ ID NO: 401790 - DNA, 25 bp, Mus musculus
ctttttcacacatccttgcttttga

SEQ ID NO: 401791 - DNA, 25 bp, Mus musculus
ctttttcaccctacagagaatttct

SEQ ID NO: 401792 - DNA, 25 bp, Mus musculus
ctttttcacccttcagagaatttct

SEQ ID NO: 401793 - DNA, 25 bp, Mus musculus
ctttttcacttgataaatgctatca

SEQ ID NO: 401794 - DNA, 25 bp, Mus musculus
ctttttcacttgttaaatgctatca

SEQ ID NO: 401795 - DNA, 25 bp, Mus musculus
ctttttcagaaacctcaacagggaa

SEQ ID NO: 401796 - DNA, 25 bp, Mus musculus
ctttttcagaaagctcaacagggaa

SEQ ID NO: 401797 - DNA, 25 bp, Mus musculus
ctttttcaggatacacatgtgtact

SEQ ID NO: 401798 - DNA, 25 bp, Mus musculus
ctttttcaggattcacatgtgtact

SEQ ID NO: 401799 - DNA, 25 bp, Mus musculus
ctttttcagtatactttgccatcaa

SEQ ID NO: 401800 - DNA, 25 bp, Mus musculus
ctttttcagtattctttgccatcaa

SEQ ID NO: 401801 - DNA, 25 bp, Mus musculus
ctttttcatcacagtcatagccatg

SEQ ID NO: 401802 - DNA, 25 bp, Mus musculus
ctttttcatcactgtcatagccatg

SEQ ID NO: 401803 - DNA, 25 bp, Mus musculus
ctttttcatttcaagcagaggcaag

SEQ ID NO: 401804 - DNA, 25 bp, Mus musculus
ctttttcatttctagcagaggcaag

SEQ ID NO: 401805 - DNA, 25 bp, Mus musculus
ctttttccataaacctaaaggactg

SEQ ID NO: 401806 - DNA, 25 bp, Mus musculus
ctttttccataatcctaaaggactg

SEQ ID NO: 401807 - DNA, 25 bp, Mus musculus
ctttttcccatcagagagcctaggt

SEQ ID NO: 401808 - DNA, 25 bp, Mus musculus
ctttttcccatctgagagcctaggt

SEQ ID NO: 401809 - DNA, 25 bp, Mus musculus
ctttttcctcacacacatctatgat

SEQ ID NO: 401810 - DNA, 25 bp, Mus musculus
ctttttcctcactcacatctatgat

SEQ ID NO: 401811 - DNA, 25 bp, Mus musculus
ctttttcctctcagggatgctctga

SEQ ID NO: 401812 - DNA, 25 bp, Mus musculus
ctttttcctctctgggatgctctga

SEQ ID NO: 401813 - DNA, 25 bp, Mus musculus
ctttttcctcttcatccaaagacta

SEQ ID NO: 401814 - DNA, 25 bp, Mus musculus
ctttttcctcttgatccaaagacta

SEQ ID NO: 401815 - DNA, 25 bp, Mus musculus
ctttttcctttcatagttgtgcact

SEQ ID NO: 401816 - DNA, 25 bp, Mus musculus
ctttttcctttcttagttgtgcact

SEQ ID NO: 401817 - DNA, 25 bp, Mus musculus
ctttttcgaaaactgcagacagcaa

SEQ ID NO: 401818 - DNA, 25 bp, Mus musculus
ctttttcgaaaagtgcagacagcaa

SEQ ID NO: 401819 - DNA, 25 bp, Mus musculus
ctttttcgaaatccattccagagga

SEQ ID NO: 401820 - DNA, 25 bp, Mus musculus
ctttttcgaaatgcattccagagga

SEQ ID NO: 401821 - DNA, 25 bp, Mus musculus
ctttttcggcaacacaactgaatgt

SEQ ID NO: 401822 - DNA, 25 bp, Mus musculus
ctttttcggcaagacaactgaatgt

SEQ ID NO: 401823 - DNA, 25 bp, Mus musculus
ctttttctagtgccatgatgtaatg

SEQ ID NO: 401824 - DNA, 25 bp, Mus musculus
ctttttctagtggcatgatgtaatg

SEQ ID NO: 401825 - DNA, 25 bp, Mus musculus
ctttttctattacgcagctggcttt

SEQ ID NO: 401826 - DNA, 25 bp, Mus musculus
ctttttctattaggcagctggcttt

SEQ ID NO: 401827 - DNA, 25 bp, Mus musculus
ctttttctctcacttaccatggatt

SEQ ID NO: 401828 - DNA, 25 bp, Mus musculus
ctttttctctcagttaccatggatt

SEQ ID NO: 401829 - DNA, 25 bp, Mus musculus
ctttttctctttagatggacacaat

SEQ ID NO: 401830 - DNA, 25 bp, Mus musculus
ctttttctcttttgatggacacaat

SEQ ID NO: 401831 - DNA, 25 bp, Mus musculus
ctttttctggccaccgatggtgaca

SEQ ID NO: 401832 - DNA, 25 bp, Mus musculus
ctttttctggcctccgatggtgaca

SEQ ID NO: 401833 - DNA, 25 bp, Mus musculus
ctttttctgggaatgcaaactgctt

SEQ ID NO: 401834 - DNA, 25 bp, Mus musculus
ctttttctgggattgcaaactgctt

SEQ ID NO: 401835 - DNA, 25 bp, Mus musculus
ctttttcttaaacgcaagacctcag

SEQ ID NO: 401836 - DNA, 25 bp, Mus musculus
ctttttcttaaaggcaagacctcag

SEQ ID NO: 401837 - DNA, 25 bp, Mus musculus
ctttttcttcccagacactattctg

SEQ ID NO: 401838 - DNA, 25 bp, Mus musculus
ctttttcttccctgacactattctg

SEQ ID NO: 401839 - DNA, 25 bp, Mus musculus
ctttttcttcctaggatctggagaa

SEQ ID NO: 401840 - DNA, 25 bp, Mus musculus
ctttttcttccttggatctggagaa

SEQ ID NO: 401841 - DNA, 25 bp, Mus musculus
ctttttcttgtaaccagagtgactg

SEQ ID NO: 401842 - DNA, 25 bp, Mus musculus
ctttttcttgtatccagagtgactg

SEQ ID NO: 401843 - DNA, 25 bp, Mus musculus
ctttttcttgtgacaggatgcgtat

SEQ ID NO: 401844 - DNA, 25 bp, Mus musculus
ctttttcttgtgtcaggatgcgtat

SEQ ID NO: 401845 - DNA, 25 bp, Mus musculus
ctttttgacataactgaactcagga

SEQ ID NO: 401846 - DNA, 25 bp, Mus musculus
ctttttgacatatctgaactcagga

SEQ ID NO: 401847 - DNA, 25 bp, Mus musculus
ctttttgactaaacatcctcagaat

SEQ ID NO: 401848 - DNA, 25 bp, Mus musculus
ctttttgactaatcatcctcagaat

SEQ ID NO: 401849 - DNA, 25 bp, Mus musculus
ctttttgactagaaggcagcatcct

SEQ ID NO: 401850 - DNA, 25 bp, Mus musculus
ctttttgactagtaggcagcatcct

SEQ ID NO: 401851 - DNA, 25 bp, Mus musculus
ctttttgactataccttttgcagac

SEQ ID NO: 401852 - DNA, 25 bp, Mus musculus
ctttttgactattccttttgcagac

SEQ ID NO: 401853 - DNA, 25 bp, Mus musculus
ctttttgaggatccctgccagcaca

SEQ ID NO: 401854 - DNA, 25 bp, Mus musculus
ctttttgaggatgcctgccagcaca

SEQ ID NO: 401855 - DNA, 25 bp, Mus musculus
ctttttgagggacctgggccactgg

SEQ ID NO: 401856 - DNA, 25 bp, Mus musculus
ctttttgagggagctgggccactgg

SEQ ID NO: 401857 - DNA, 25 bp, Mus musculus
ctttttgatgctctactttctgttc

SEQ ID NO: 401858 - DNA, 25 bp, Mus musculus
ctttttgatgctgtactttctgttc

SEQ ID NO: 401859 - DNA, 25 bp, Mus musculus
ctttttgcaaagcagcattagcgct

SEQ ID NO: 401860 - DNA, 25 bp, Mus musculus
ctttttgcaaaggagcattagcgct

SEQ ID NO: 401861 - DNA, 25 bp, Mus musculus
ctttttgcagtacgtgtatcaatat

SEQ ID NO: 401862 - DNA, 25 bp, Mus musculus
ctttttgcagtaggtgtatcaatat

SEQ ID NO: 401863 - DNA, 25 bp, Mus musculus
ctttttgcccaaaaagcgtctcttt

SEQ ID NO: 401864 - DNA, 25 bp, Mus musculus
ctttttgcccaataagcgtctcttt

SEQ ID NO: 401865 - DNA, 25 bp, Mus musculus
ctttttgcccacattaccatctaga

SEQ ID NO: 401866 - DNA, 25 bp, Mus musculus
ctttttgcccactttaccatctaga

SEQ ID NO: 401867 - DNA, 25 bp, Mus musculus
ctttttgccccaacttgtatgtgaa

SEQ ID NO: 401868 - DNA, 25 bp, Mus musculus
ctttttgccccatcttgtatgtgaa

SEQ ID NO: 401869 - DNA, 25 bp, Mus musculus
ctttttgcttatctttggtttggat

SEQ ID NO: 401870 - DNA, 25 bp, Mus musculus
ctttttgcttatgtttggtttggat

SEQ ID NO: 401871 - DNA, 25 bp, Mus musculus
ctttttgcttcaagagacacacttt

SEQ ID NO: 401872 - DNA, 25 bp, Mus musculus
ctttttgcttcatgagacacacttt

SEQ ID NO: 401873 - DNA, 25 bp, Mus musculus
ctttttgcttctactttcatcctaa

SEQ ID NO: 401874 - DNA, 25 bp, Mus musculus
ctttttgcttcttctttcatcctaa

SEQ ID NO: 401875 - DNA, 25 bp, Mus musculus
ctttttggcaacacctctgggaaag

SEQ ID NO: 401876 - DNA, 25 bp, Mus musculus
ctttttggcaactcctctgggaaag

SEQ ID NO: 401877 - DNA, 25 bp, Mus musculus
ctttttggcattatatgtcgcatag

SEQ ID NO: 401878 - DNA, 25 bp, Mus musculus
ctttttggcattttatgtcgcatag

SEQ ID NO: 401879 - DNA, 25 bp, Mus musculus
ctttttggccacatgcagtgactat

SEQ ID NO: 401880 - DNA, 25 bp, Mus musculus
ctttttggccacttgcagtgactat

SEQ ID NO: 401881 - DNA, 25 bp, Mus musculus
ctttttggctttatgaatacagact

SEQ ID NO: 401882 - DNA, 25 bp, Mus musculus
ctttttggctttttgaatacagact

SEQ ID NO: 401883 - DNA, 25 bp, Mus musculus
ctttttgggaccagctccacaggga

SEQ ID NO: 401884 - DNA, 25 bp, Mus musculus
ctttttgggacctgctccacaggga

SEQ ID NO: 401885 - DNA, 25 bp, Mus musculus
ctttttgggtatatgcactatttgg

SEQ ID NO: 401886 - DNA, 25 bp, Mus musculus
ctttttgggtatttgcactatttgg

SEQ ID NO: 401887 - DNA, 25 bp, Mus musculus
ctttttgtgactcagaaccaaccgt

SEQ ID NO: 401888 - DNA, 25 bp, Mus musculus
ctttttgtgactgagaaccaaccgt

SEQ ID NO: 401889 - DNA, 25 bp, Mus musculus
ctttttgttcttcacggatccttgg

SEQ ID NO: 401890 - DNA, 25 bp, Mus musculus
ctttttgttcttgacggatccttgg

SEQ ID NO: 401891 - DNA, 25 bp, Mus musculus
ctttttgtttgtaccactggaattg

SEQ ID NO: 401892 - DNA, 25 bp, Mus musculus
ctttttgtttgttccactggaattg

SEQ ID NO: 401893 - DNA, 25 bp, Mus musculus
cttttttaagttctggctatcctgg

SEQ ID NO: 401894 - DNA, 25 bp, Mus musculus
cttttttaagttgtggctatcctgg

SEQ ID NO: 401895 - DNA, 25 bp, Mus musculus
cttttttagtctaagtatgatcatc

SEQ ID NO: 401896 - DNA, 25 bp, Mus musculus
cttttttagtctatcatcttctcca

SEQ ID NO: 401897 - DNA, 25 bp, Mus musculus
cttttttagtcttagtatgatcatc

SEQ ID NO: 401898 - DNA, 25 bp, Mus musculus
cttttttagtctttcatcttctcca

SEQ ID NO: 401899 - DNA, 25 bp, Mus musculus
cttttttcacgtctcatgtgttctt

SEQ ID NO: 401900 - DNA, 25 bp, Mus musculus
cttttttcacgtgtcatgtgttctt

SEQ ID NO: 401901 - DNA, 25 bp, Mus musculus
cttttttcagtgaccatgcttaggg

SEQ ID NO: 401902 - DNA, 25 bp, Mus musculus
cttttttcagtgtccatgcttaggg

SEQ ID NO: 401903 - DNA, 25 bp, Mus musculus
cttttttccactccttctgaagaag

SEQ ID NO: 401904 - DNA, 25 bp, Mus musculus
cttttttccactgcttctgaagaag

SEQ ID NO: 401905 - DNA, 25 bp, Mus musculus
cttttttcccatagcccttgcacta

SEQ ID NO: 401906 - DNA, 25 bp, Mus musculus
cttttttcccattgcccttgcacta

SEQ ID NO: 401907 - DNA, 25 bp, Mus musculus
cttttttcctcgactactgtagcaa

SEQ ID NO: 401908 - DNA, 25 bp, Mus musculus
cttttttcctcgtctactgtagcaa

SEQ ID NO: 401909 - DNA, 25 bp, Mus musculus
cttttttgaaacactcctgctgact

SEQ ID NO: 401910 - DNA, 25 bp, Mus musculus
cttttttgaaactctcctgctgact

SEQ ID NO: 401911 - DNA, 25 bp, Mus musculus
cttttttgaagacacagcaccctgt

SEQ ID NO: 401912 - DNA, 25 bp, Mus musculus
cttttttgaagagacagcaccctgt

SEQ ID NO: 401913 - DNA, 25 bp, Mus musculus
cttttttgaatcagcttgcctcttt

SEQ ID NO: 401914 - DNA, 25 bp, Mus musculus
cttttttgaatctgcttgcctcttt

SEQ ID NO: 401915 - DNA, 25 bp, Mus musculus
cttttttggcacagaatagttgact

SEQ ID NO: 401916 - DNA, 25 bp, Mus musculus
cttttttggcactgaatagttgact

SEQ ID NO: 401917 - DNA, 25 bp, Mus musculus
cttttttggttaccattttccagtg

SEQ ID NO: 401918 - DNA, 25 bp, Mus musculus
cttttttggttagcattttccagtg

SEQ ID NO: 401919 - DNA, 25 bp, Mus musculus
cttttttgtagcagtctgagtgtgt

SEQ ID NO: 401920 - DNA, 25 bp, Mus musculus
cttttttgtagctgtctgagtgtgt

SEQ ID NO: 401921 - DNA, 25 bp, Mus musculus
cttttttgtgtgactcctgaattaa

SEQ ID NO: 401922 - DNA, 25 bp, Mus musculus
cttttttgtgtgtctcctgaattaa

SEQ ID NO: 401923 - DNA, 25 bp, Mus musculus
gaaaaaaacaagaagccataattat

SEQ ID NO: 401924 - DNA, 25 bp, Mus musculus
gaaaaaaacaagtagccataattat

SEQ ID NO: 401925 - DNA, 25 bp, Mus musculus
gaaaaaacactaagccacctgcttg

SEQ ID NO: 401926 - DNA, 25 bp, Mus musculus
gaaaaaacactatgccacctgcttg

SEQ ID NO: 401927 - DNA, 25 bp, Mus musculus
gaaaaaacatgcacctggccacaaa

SEQ ID NO: 401928 - DNA, 25 bp, Mus musculus
gaaaaaacatgccttcttgtggaac

SEQ ID NO: 401929 - DNA, 25 bp, Mus musculus
gaaaaaacatgcgttcttgtggaac

SEQ ID NO: 401930 - DNA, 25 bp, Mus musculus
gaaaaaacatgctcctggccacaaa

SEQ ID NO: 401931 - DNA, 25 bp, Mus musculus
gaaaaaacgccactccgaataggag

SEQ ID NO: 401932 - DNA, 25 bp, Mus musculus
gaaaaaacgccagtccgaataggag

SEQ ID NO: 401933 - DNA, 25 bp, Mus musculus
gaaaaaactgccaattcgaggaggg

SEQ ID NO: 401934 - DNA, 25 bp, Mus musculus
gaaaaaactgcctattcgaggaggg

SEQ ID NO: 401935 - DNA, 25 bp, Mus musculus
gaaaaaagcaagacacggccccgct

SEQ ID NO: 401936 - DNA, 25 bp, Mus musculus
gaaaaaagcaagtcacggccccgct

SEQ ID NO: 401937 - DNA, 25 bp, Mus musculus
gaaaaaagccagaccagctttctag

SEQ ID NO: 401938 - DNA, 25 bp, Mus musculus
gaaaaaagccagtccagctttctag

SEQ ID NO: 401939 - DNA, 25 bp, Mus musculus
gaaaaaagccctaacccacatggtg

SEQ ID NO: 401940 - DNA, 25 bp, Mus musculus
gaaaaaagcccttacccacatggtg

SEQ ID NO: 401941 - DNA, 25 bp, Mus musculus
gaaaaaaggcatatcctacccagtg

SEQ ID NO: 401942 - DNA, 25 bp, Mus musculus
gaaaaaaggcatttcctacccagtg

SEQ ID NO: 401943 - DNA, 25 bp, Mus musculus
gaaaaaaggtatcaggatcccctgg

SEQ ID NO: 401944 - DNA, 25 bp, Mus musculus
gaaaaaaggtatgaggatcccctgg

SEQ ID NO: 401945 - DNA, 25 bp, Mus musculus
gaaaaaagtcaccattctgcattta

SEQ ID NO: 401946 - DNA, 25 bp, Mus musculus
gaaaaaagtcacgattctgcattta

SEQ ID NO: 401947 - DNA, 25 bp, Mus musculus
gaaaaaagtgttagactgtcccatt

SEQ ID NO: 401948 - DNA, 25 bp, Mus musculus
gaaaaaagtgtttgactgtcccatt

SEQ ID NO: 401949 - DNA, 25 bp, Mus musculus
gaaaaaatacgtcggcaagtaggat

SEQ ID NO: 401950 - DNA, 25 bp, Mus musculus
gaaaaaatacgtgggcaagtaggat

SEQ ID NO: 401951 - DNA, 25 bp, Mus musculus
gaaaaaatatgaagacacgggacct

SEQ ID NO: 401952 - DNA, 25 bp, Mus musculus
gaaaaaatatgatgacacgggacct

SEQ ID NO: 401953 - DNA, 25 bp, Mus musculus
gaaaaaatctagacctgtgcttgtg

SEQ ID NO: 401954 - DNA, 25 bp, Mus musculus
gaaaaaatctagtcctgtgcttgtg

SEQ ID NO: 401955 - DNA, 25 bp, Mus musculus
gaaaaaatcttacccagagtggcac

SEQ ID NO: 401956 - DNA, 25 bp, Mus musculus
gaaaaaatcttagccagagtggcac

SEQ ID NO: 401957 - DNA, 25 bp, Mus musculus
gaaaaaatcttcactgcaaacagct

SEQ ID NO: 401958 - DNA, 25 bp, Mus musculus
gaaaaaatcttctctgcaaacagct

SEQ ID NO: 401959 - DNA, 25 bp, Mus musculus
gaaaaaatggtccaggccttcatgg

SEQ ID NO: 401960 - DNA, 25 bp, Mus musculus
gaaaaaatggtcgaggccttcatgg

SEQ ID NO: 401961 - DNA, 25 bp, Mus musculus
gaaaaaattccccagcaatctaaga

SEQ ID NO: 401962 - DNA, 25 bp, Mus musculus
gaaaaaattcccgagcaatctaaga

SEQ ID NO: 401963 - DNA, 25 bp, Mus musculus
gaaaaaattggcattctagctttat

SEQ ID NO: 401964 - DNA, 25 bp, Mus musculus
gaaaaaattggctttctagctttat

SEQ ID NO: 401965 - DNA, 25 bp, Mus musculus
gaaaaacaaaaaaggcagcctggct

SEQ ID NO: 401966 - DNA, 25 bp, Mus musculus
gaaaaacaaaaatggcagcctggct

SEQ ID NO: 401967 - DNA, 25 bp, Mus musculus
gaaaaacaacaacagctctcggttt

SEQ ID NO: 401968 - DNA, 25 bp, Mus musculus
gaaaaacaacaagagctctcggttt

SEQ ID NO: 401969 - DNA, 25 bp, Mus musculus
gaaaaacaaccacattgctgcaggg

SEQ ID NO: 401970 - DNA, 25 bp, Mus musculus
gaaaaacaaccagattgctgcaggg

SEQ ID NO: 401971 - DNA, 25 bp, Mus musculus
gaaaaacaacccagcgaaggcgcct

SEQ ID NO: 401972 - DNA, 25 bp, Mus musculus
gaaaaacaaccctgcgaaggcgcct

SEQ ID NO: 401973 - DNA, 25 bp, Mus musculus
gaaaaacaaggacggccactgcatg

SEQ ID NO: 401974 - DNA, 25 bp, Mus musculus
gaaaaacaaggagggccactgcatg

SEQ ID NO: 401975 - DNA, 25 bp, Mus musculus
gaaaaacaatcacaggctccacaga

SEQ ID NO: 401976 - DNA, 25 bp, Mus musculus
gaaaaacaatcagaggctccacaga

SEQ ID NO: 401977 - DNA, 25 bp, Mus musculus
gaaaaacaatctacctctgtacgag

SEQ ID NO: 401978 - DNA, 25 bp, Mus musculus
gaaaaacaatcttcctctgtacgag

SEQ ID NO: 401979 - DNA, 25 bp, Mus musculus
gaaaaacaatttcaactgtcagaac

SEQ ID NO: 401980 - DNA, 25 bp, Mus musculus
gaaaaacaatttgaactgtcagaac

SEQ ID NO: 401981 - DNA, 25 bp, Mus musculus
gaaaaacacagccatctcttcatgt

SEQ ID NO: 401982 - DNA, 25 bp, Mus musculus
gaaaaacacagcgatctcttcatgt

SEQ ID NO: 401983 - DNA, 25 bp, Mus musculus
gaaaaacaccatagactttgacttg

SEQ ID NO: 401984 - DNA, 25 bp, Mus musculus
gaaaaacaccattgactttgacttg

SEQ ID NO: 401985 - DNA, 25 bp, Mus musculus
gaaaaacaccctaaccagcacaaag

SEQ ID NO: 401986 - DNA, 25 bp, Mus musculus
gaaaaacacccttaccagcacaaag

SEQ ID NO: 401987 - DNA, 25 bp, Mus musculus
gaaaaacactgtcggtgacgtctcc

SEQ ID NO: 401988 - DNA, 25 bp, Mus musculus
gaaaaacactgtgggtgacgtctcc

SEQ ID NO: 401989 - DNA, 25 bp, Mus musculus
gaaaaacacttgagtctcctgtggg

SEQ ID NO: 401990 - DNA, 25 bp, Mus musculus
gaaaaacacttgtgtctcctgtggg

SEQ ID NO: 401991 - DNA, 25 bp, Mus musculus
gaaaaacagattactcttctgtctg

SEQ ID NO: 401992 - DNA, 25 bp, Mus musculus
gaaaaacagatttctcttctgtctg

SEQ ID NO: 401993 - DNA, 25 bp, Mus musculus
gaaaaacagtaacaccacatcatag

SEQ ID NO: 401994 - DNA, 25 bp, Mus musculus
gaaaaacagtaagaccacatcatag

SEQ ID NO: 401995 - DNA, 25 bp, Mus musculus
gaaaaacagtcaagtctctcagaaa

SEQ ID NO: 401996 - DNA, 25 bp, Mus musculus
gaaaaacagtcatgtctctcagaaa

SEQ ID NO: 401997 - DNA, 25 bp, Mus musculus
gaaaaacagttaacatgagacaaag

SEQ ID NO: 401998 - DNA, 25 bp, Mus musculus
gaaaaacagttatcatgagacaaag

SEQ ID NO: 401999 - DNA, 25 bp, Mus musculus
gaaaaacatcatctaggtattaccc

SEQ ID NO: 402000 - DNA, 25 bp, Mus musculus
gaaaaacatcatgtaggtattaccc

SEQ ID NO: 402001 - DNA, 25 bp, Mus musculus
gaaaaacatctcagtggtttattaa

SEQ ID NO: 402002 - DNA, 25 bp, Mus musculus
gaaaaacatctctgtggtttattaa

SEQ ID NO: 402003 - DNA, 25 bp, Mus musculus
gaaaaacatttgagtccacttgttg

SEQ ID NO: 402004 - DNA, 25 bp, Mus musculus
gaaaaacatttgtgtccacttgttg

SEQ ID NO: 402005 - DNA, 25 bp, Mus musculus
gaaaaaccaacgctcctggatcggc

SEQ ID NO: 402006 - DNA, 25 bp, Mus musculus
gaaaaaccaacggtcctggatcggc

SEQ ID NO: 402007 - DNA, 25 bp, Mus musculus
gaaaaaccaataatccttgactaag

SEQ ID NO: 402008 - DNA, 25 bp, Mus musculus
gaaaaaccaatattccttgactaag

SEQ ID NO: 402009 - DNA, 25 bp, Mus musculus
gaaaaaccagaaccaagtctccaga

SEQ ID NO: 402010 - DNA, 25 bp, Mus musculus
gaaaaaccagaagcaagtctccaga

SEQ ID NO: 402011 - DNA, 25 bp, Mus musculus
gaaaaaccagtgacctacaagcata

SEQ ID NO: 402012 - DNA, 25 bp, Mus musculus
gaaaaaccagtgagagaccaagatc

SEQ ID NO: 402013 - DNA, 25 bp, Mus musculus
gaaaaaccagtgtcctacaagcata

SEQ ID NO: 402014 - DNA, 25 bp, Mus musculus
gaaaaaccagtgtgagaccaagatc

SEQ ID NO: 402015 - DNA, 25 bp, Mus musculus
gaaaaaccatacaatatcccagcag

SEQ ID NO: 402016 - DNA, 25 bp, Mus musculus
gaaaaaccatactatatcccagcag

SEQ ID NO: 402017 - DNA, 25 bp, Mus musculus
gaaaaacccatacttgagcatctaa

SEQ ID NO: 402018 - DNA, 25 bp, Mus musculus
gaaaaacccatagttgagcatctaa

SEQ ID NO: 402019 - DNA, 25 bp, Mus musculus
gaaaaacccatgctgcagggtaacc

SEQ ID NO: 402020 - DNA, 25 bp, Mus musculus
gaaaaacccatggtgcagggtaacc

SEQ ID NO: 402021 - DNA, 25 bp, Mus musculus
gaaaaaccccatagtcatcttgcta

SEQ ID NO: 402022 - DNA, 25 bp, Mus musculus
gaaaaaccccattgtcatcttgcta

SEQ ID NO: 402023 - DNA, 25 bp, Mus musculus
gaaaaaccctctaactggctggtga

SEQ ID NO: 402024 - DNA, 25 bp, Mus musculus
gaaaaaccctcttactggctggtga

SEQ ID NO: 402025 - DNA, 25 bp, Mus musculus
gaaaaacccttactcaatgaaatga

SEQ ID NO: 402026 - DNA, 25 bp, Mus musculus
gaaaaacccttagtcaatgaaatga

SEQ ID NO: 402027 - DNA, 25 bp, Mus musculus
gaaaaaccggcgatcatctccatga

SEQ ID NO: 402028 - DNA, 25 bp, Mus musculus
gaaaaaccggcgttcatctccatga

SEQ ID NO: 402029 - DNA, 25 bp, Mus musculus
gaaaaaccgtgcaggcaaggctgag

SEQ ID NO: 402030 - DNA, 25 bp, Mus musculus
gaaaaaccgtgctggcaaggctgag

SEQ ID NO: 402031 - DNA, 25 bp, Mus musculus
gaaaaacctagtaccattcctgcac

SEQ ID NO: 402032 - DNA, 25 bp, Mus musculus
gaaaaacctagttccattcctgcac

SEQ ID NO: 402033 - DNA, 25 bp, Mus musculus
gaaaaacctatgctggtgactccag

SEQ ID NO: 402034 - DNA, 25 bp, Mus musculus
gaaaaacctatggtggtgactccag

SEQ ID NO: 402035 - DNA, 25 bp, Mus musculus
gaaaaacctgctagttatacgagaa

SEQ ID NO: 402036 - DNA, 25 bp, Mus musculus
gaaaaacctgctattggtacagtgt

SEQ ID NO: 402037 - DNA, 25 bp, Mus musculus
gaaaaacctgctcaacctattatgg

SEQ ID NO: 402038 - DNA, 25 bp, Mus musculus
gaaaaacctgctgaacctattatgg

SEQ ID NO: 402039 - DNA, 25 bp, Mus musculus
gaaaaacctgcttgttatacgagaa

SEQ ID NO: 402040 - DNA, 25 bp, Mus musculus
gaaaaacctgcttttggtacagtgt

SEQ ID NO: 402041 - DNA, 25 bp, Mus musculus
gaaaaaccttaaactctgtaccaca

SEQ ID NO: 402042 - DNA, 25 bp, Mus musculus
gaaaaaccttaatctctgtaccaca

SEQ ID NO: 402043 - DNA, 25 bp, Mus musculus
gaaaaaccttatccaggccatgtgg

SEQ ID NO: 402044 - DNA, 25 bp, Mus musculus
gaaaaaccttatgcaggccatgtgg

SEQ ID NO: 402045 - DNA, 25 bp, Mus musculus
gaaaaaccttctaagcaaactcagg

SEQ ID NO: 402046 - DNA, 25 bp, Mus musculus
gaaaaaccttcttagcaaactcagg

SEQ ID NO: 402047 - DNA, 25 bp, Mus musculus
gaaaaacctttcatgctcctggagt

SEQ ID NO: 402048 - DNA, 25 bp, Mus musculus
gaaaaacctttcttgctcctggagt

SEQ ID NO: 402049 - DNA, 25 bp, Mus musculus
gaaaaacctttgcacagctgttctg

SEQ ID NO: 402050 - DNA, 25 bp, Mus musculus
gaaaaacctttggacagctgttctg

SEQ ID NO: 402051 - DNA, 25 bp, Mus musculus
gaaaaaccttttccaatgctctttg

SEQ ID NO: 402052 - DNA, 25 bp, Mus musculus
gaaaaaccttttgcaatgctctttg

SEQ ID NO: 402053 - DNA, 25 bp, Mus musculus
gaaaaacgaaggactgcacagcaat

SEQ ID NO: 402054 - DNA, 25 bp, Mus musculus
gaaaaacgaaggtctgcacagcaat

SEQ ID NO: 402055 - DNA, 25 bp, Mus musculus
gaaaaacgatgtcttctccctttat

SEQ ID NO: 402056 - DNA, 25 bp, Mus musculus
gaaaaacgatgtgttctccctttat

SEQ ID NO: 402057 - DNA, 25 bp, Mus musculus
gaaaaacgattcagcaactttccct

SEQ ID NO: 402058 - DNA, 25 bp, Mus musculus
gaaaaacgattctgcaactttccct

SEQ ID NO: 402059 - DNA, 25 bp, Mus musculus
gaaaaacgcccaacgagcgaattcc

SEQ ID NO: 402060 - DNA, 25 bp, Mus musculus
gaaaaacgcccatcgagcgaattcc

SEQ ID NO: 402061 - DNA, 25 bp, Mus musculus
gaaaaacgcctgaccacttctaatt

SEQ ID NO: 402062 - DNA, 25 bp, Mus musculus
gaaaaacgcctgtccacttctaatt

SEQ ID NO: 402063 - DNA, 25 bp, Mus musculus
gaaaaacggtggaggactatttctg

SEQ ID NO: 402064 - DNA, 25 bp, Mus musculus
gaaaaacggtggtggactatttctg

SEQ ID NO: 402065 - DNA, 25 bp, Mus musculus
gaaaaacggtgtactacctgctata

SEQ ID NO: 402066 - DNA, 25 bp, Mus musculus
gaaaaacggtgttctacctgctata

SEQ ID NO: 402067 - DNA, 25 bp, Mus musculus
gaaaaacgtttgagctccttgaaag

SEQ ID NO: 402068 - DNA, 25 bp, Mus musculus
gaaaaacgtttgtgctccttgaaag

SEQ ID NO: 402069 - DNA, 25 bp, Mus musculus
gaaaaactacagcttgactgctggg

SEQ ID NO: 402070 - DNA, 25 bp, Mus musculus
gaaaaactacaggttgactgctggg

SEQ ID NO: 402071 - DNA, 25 bp, Mus musculus
gaaaaactacctcctaatactcata

SEQ ID NO: 402072 - DNA, 25 bp, Mus musculus
gaaaaactacctgctaatactcata

SEQ ID NO: 402073 - DNA, 25 bp, Mus musculus
gaaaaactatttccttcctcaaatg

SEQ ID NO: 402074 - DNA, 25 bp, Mus musculus
gaaaaactatttgcttcctcaaatg

SEQ ID NO: 402075 - DNA, 25 bp, Mus musculus
gaaaaactcaggcttcacgtccgtt

SEQ ID NO: 402076 - DNA, 25 bp, Mus musculus
gaaaaactcagggttcacgtccgtt

SEQ ID NO: 402077 - DNA, 25 bp, Mus musculus
gaaaaactcagtacctagtcccaag

SEQ ID NO: 402078 - DNA, 25 bp, Mus musculus
gaaaaactcagttcctagtcccaag

SEQ ID NO: 402079 - DNA, 25 bp, Mus musculus
gaaaaactcatcatgtgcttactat

SEQ ID NO: 402080 - DNA, 25 bp, Mus musculus
gaaaaactcatcttgtgcttactat

SEQ ID NO: 402081 - DNA, 25 bp, Mus musculus
gaaaaactccaccattgtcttccct

SEQ ID NO: 402082 - DNA, 25 bp, Mus musculus
gaaaaactccacgattgtcttccct

SEQ ID NO: 402083 - DNA, 25 bp, Mus musculus
gaaaaactctccactcttagtagct

SEQ ID NO: 402084 - DNA, 25 bp, Mus musculus
gaaaaactctcctctcttagtagct

SEQ ID NO: 402085 - DNA, 25 bp, Mus musculus
gaaaaactcttacatgctgccagga

SEQ ID NO: 402086 - DNA, 25 bp, Mus musculus
gaaaaactcttagatgctgccagga

SEQ ID NO: 402087 - DNA, 25 bp, Mus musculus
gaaaaactgaaaatatcctgggtat

SEQ ID NO: 402088 - DNA, 25 bp, Mus musculus
gaaaaactgaaattatcctgggtat

SEQ ID NO: 402089 - DNA, 25 bp, Mus musculus
gaaaaactgagcacttaactcctcc

SEQ ID NO: 402090 - DNA, 25 bp, Mus musculus
gaaaaactgagctcttaactcctcc

SEQ ID NO: 402091 - DNA, 25 bp, Mus musculus
gaaaaactggaaatcttggcaatgt

SEQ ID NO: 402092 - DNA, 25 bp, Mus musculus
gaaaaactggaattcttggcaatgt

SEQ ID NO: 402093 - DNA, 25 bp, Mus musculus
gaaaaacttaacattacaggcactg

SEQ ID NO: 402094 - DNA, 25 bp, Mus musculus
gaaaaacttaactttacaggcactg

SEQ ID NO: 402095 - DNA, 25 bp, Mus musculus
gaaaaacttacaatccctatcatag

SEQ ID NO: 402096 - DNA, 25 bp, Mus musculus
gaaaaacttacattccctatcatag

SEQ ID NO: 402097 - DNA, 25 bp, Mus musculus
gaaaaacttccacatcgtccacggg

SEQ ID NO: 402098 - DNA, 25 bp, Mus musculus
gaaaaacttccagatcgtccacggg

SEQ ID NO: 402099 - DNA, 25 bp, Mus musculus
gaaaaacttctacctcactgagtgg

SEQ ID NO: 402100 - DNA, 25 bp, Mus musculus
gaaaaacttctagctcactgagtgg

SEQ ID NO: 402101 - DNA, 25 bp, Mus musculus
gaaaaacttgacagcactcctctag

SEQ ID NO: 402102 - DNA, 25 bp, Mus musculus
gaaaaacttgactgcactcctctag

SEQ ID NO: 402103 - DNA, 25 bp, Mus musculus
gaaaaacttgctattctgtttccaa

SEQ ID NO: 402104 - DNA, 25 bp, Mus musculus
gaaaaacttgctattggcgccatca

SEQ ID NO: 402105 - DNA, 25 bp, Mus musculus
gaaaaacttgcttttctgtttccaa

SEQ ID NO: 402106 - DNA, 25 bp, Mus musculus
gaaaaacttgcttttggcgccatca

SEQ ID NO: 402107 - DNA, 25 bp, Mus musculus
gaaaaactttcaacaccttctcgta

SEQ ID NO: 402108 - DNA, 25 bp, Mus musculus
gaaaaactttcatcaccttctcgta

SEQ ID NO: 402109 - DNA, 25 bp, Mus musculus
gaaaaagaaaaacacctcatcctag

SEQ ID NO: 402110 - DNA, 25 bp, Mus musculus
gaaaaagaaaaagacctcatcctag

SEQ ID NO: 402111 - DNA, 25 bp, Mus musculus
gaaaaagaagcaccgcttcgggctg

SEQ ID NO: 402112 - DNA, 25 bp, Mus musculus
gaaaaagaagcagcgcttcgggctg

SEQ ID NO: 402113 - DNA, 25 bp, Mus musculus
gaaaaagaagccacccaaggccagg

SEQ ID NO: 402114 - DNA, 25 bp, Mus musculus
gaaaaagaagccactactacctagt

SEQ ID NO: 402115 - DNA, 25 bp, Mus musculus
gaaaaagaagcctcccaaggccagg

SEQ ID NO: 402116 - DNA, 25 bp, Mus musculus
gaaaaagaagcctctactacctagt

SEQ ID NO: 402117 - DNA, 25 bp, Mus musculus
gaaaaagaattaccttctctcagga

SEQ ID NO: 402118 - DNA, 25 bp, Mus musculus
gaaaaagaattagcttctctcagga

SEQ ID NO: 402119 - DNA, 25 bp, Mus musculus
gaaaaagacactatcctcttcacaa

SEQ ID NO: 402120 - DNA, 25 bp, Mus musculus
gaaaaagacactttcctcttcacaa

SEQ ID NO: 402121 - DNA, 25 bp, Mus musculus
gaaaaagacagtcagtctgcccact

SEQ ID NO: 402122 - DNA, 25 bp, Mus musculus
gaaaaagacagtctatccacagaga

SEQ ID NO: 402123 - DNA, 25 bp, Mus musculus
gaaaaagacagtgagtctgcccact

SEQ ID NO: 402124 - DNA, 25 bp, Mus musculus
gaaaaagacagtgtatccacagaga

SEQ ID NO: 402125 - DNA, 25 bp, Mus musculus
gaaaaagaccagctaaggcccaagg

SEQ ID NO: 402126 - DNA, 25 bp, Mus musculus
gaaaaagaccaggtaaggcccaagg

SEQ ID NO: 402127 - DNA, 25 bp, Mus musculus
gaaaaagaccctacagccataggca

SEQ ID NO: 402128 - DNA, 25 bp, Mus musculus
gaaaaagacccttcagccataggca

SEQ ID NO: 402129 - DNA, 25 bp, Mus musculus
gaaaaagacctaagactgttttggg

SEQ ID NO: 402130 - DNA, 25 bp, Mus musculus
gaaaaagacctatgactgttttggg

SEQ ID NO: 402131 - DNA, 25 bp, Mus musculus
gaaaaagaccttcttctctctgtga

SEQ ID NO: 402132 - DNA, 25 bp, Mus musculus
gaaaaagaccttgttctctctgtga

SEQ ID NO: 402133 - DNA, 25 bp, Mus musculus
gaaaaagactgaaggccaagagaga

SEQ ID NO: 402134 - DNA, 25 bp, Mus musculus
gaaaaagactgatggccaagagaga

SEQ ID NO: 402135 - DNA, 25 bp, Mus musculus
gaaaaagactgtaatccgcaatgca

SEQ ID NO: 402136 - DNA, 25 bp, Mus musculus
gaaaaagactgttatccgcaatgca

SEQ ID NO: 402137 - DNA, 25 bp, Mus musculus
gaaaaagacttcaatcacaccccaa

SEQ ID NO: 402138 - DNA, 25 bp, Mus musculus
gaaaaagacttctatcacaccccaa

SEQ ID NO: 402139 - DNA, 25 bp, Mus musculus
gaaaaagacttgaatccaacccaag

SEQ ID NO: 402140 - DNA, 25 bp, Mus musculus
gaaaaagacttgtatccaacccaag

SEQ ID NO: 402141 - DNA, 25 bp, Mus musculus
gaaaaagactttcctctggagacag

SEQ ID NO: 402142 - DNA, 25 bp, Mus musculus
gaaaaagactttgctctggagacag

SEQ ID NO: 402143 - DNA, 25 bp, Mus musculus
gaaaaagagatgaccccgcagctct

SEQ ID NO: 402144 - DNA, 25 bp, Mus musculus
gaaaaagagatgtccccgcagctct

SEQ ID NO: 402145 - DNA, 25 bp, Mus musculus
gaaaaagaggttctagcggcgccca

SEQ ID NO: 402146 - DNA, 25 bp, Mus musculus
gaaaaagaggttgtagcggcgccca

SEQ ID NO: 402147 - DNA, 25 bp, Mus musculus
gaaaaagatatgagccaggtaccct

SEQ ID NO: 402148 - DNA, 25 bp, Mus musculus
gaaaaagatatgtgccaggtaccct

SEQ ID NO: 402149 - DNA, 25 bp, Mus musculus
gaaaaagatcctctcgacctgcttc

SEQ ID NO: 402150 - DNA, 25 bp, Mus musculus
gaaaaagatcctgtcgacctgcttc

SEQ ID NO: 402151 - DNA, 25 bp, Mus musculus
gaaaaagatcgtaatgtttgtgtgc

SEQ ID NO: 402152 - DNA, 25 bp, Mus musculus
gaaaaagatcgttatgtttgtgtgc

SEQ ID NO: 402153 - DNA, 25 bp, Mus musculus
gaaaaagatgagaccccactttcca

SEQ ID NO: 402154 - DNA, 25 bp, Mus musculus
gaaaaagatgagtccccactttcca

SEQ ID NO: 402155 - DNA, 25 bp, Mus musculus
gaaaaagatttcaaataaagcctgc

SEQ ID NO: 402156 - DNA, 25 bp, Mus musculus
gaaaaagatttctaataaagcctgc

SEQ ID NO: 402157 - DNA, 25 bp, Mus musculus
gaaaaagcaccaacctccaacacga

SEQ ID NO: 402158 - DNA, 25 bp, Mus musculus
gaaaaagcaccatcctccaacacga

SEQ ID NO: 402159 - DNA, 25 bp, Mus musculus
gaaaaagcacctaagcaacgaggtt

SEQ ID NO: 402160 - DNA, 25 bp, Mus musculus
gaaaaagcaccttagcaacgaggtt

SEQ ID NO: 402161 - DNA, 25 bp, Mus musculus
gaaaaagcacttacagctctgtcag

SEQ ID NO: 402162 - DNA, 25 bp, Mus musculus
gaaaaagcacttatcagggccctca

SEQ ID NO: 402163 - DNA, 25 bp, Mus musculus
gaaaaagcactttcagctctgtcag

SEQ ID NO: 402164 - DNA, 25 bp, Mus musculus
gaaaaagcacttttcagggccctca

SEQ ID NO: 402165 - DNA, 25 bp, Mus musculus
gaaaaagcagcaccgttgagtatgg

SEQ ID NO: 402166 - DNA, 25 bp, Mus musculus
gaaaaagcagcagcgttgagtatgg

SEQ ID NO: 402167 - DNA, 25 bp, Mus musculus
gaaaaagcatccaaacagggtcttg

SEQ ID NO: 402168 - DNA, 25 bp, Mus musculus
gaaaaagcatccctccggccttctc

SEQ ID NO: 402169 - DNA, 25 bp, Mus musculus
gaaaaagcatccgtccggccttctc

SEQ ID NO: 402170 - DNA, 25 bp, Mus musculus
gaaaaagcatcctaacagggtcttg

SEQ ID NO: 402171 - DNA, 25 bp, Mus musculus
gaaaaagcatcgaggccttgagccc

SEQ ID NO: 402172 - DNA, 25 bp, Mus musculus
gaaaaagcatcgtggccttgagccc

SEQ ID NO: 402173 - DNA, 25 bp, Mus musculus
gaaaaagcattcagatccacttcat

SEQ ID NO: 402174 - DNA, 25 bp, Mus musculus
gaaaaagcattctgatccacttcat

SEQ ID NO: 402175 - DNA, 25 bp, Mus musculus
gaaaaagccactagcggtgtttgta

SEQ ID NO: 402176 - DNA, 25 bp, Mus musculus
gaaaaagccacttgcggtgtttgta

SEQ ID NO: 402177 - DNA, 25 bp, Mus musculus
gaaaaagccccacatgaatataaac

SEQ ID NO: 402178 - DNA, 25 bp, Mus musculus
gaaaaagccccagatgaatataaac

SEQ ID NO: 402179 - DNA, 25 bp, Mus musculus
gaaaaagccccgcatgttgaactga

SEQ ID NO: 402180 - DNA, 25 bp, Mus musculus
gaaaaagccccggatgttgaactga

SEQ ID NO: 402181 - DNA, 25 bp, Mus musculus
gaaaaagccctaatcctatggaata

SEQ ID NO: 402182 - DNA, 25 bp, Mus musculus
gaaaaagccctattcctatggaata

SEQ ID NO: 402183 - DNA, 25 bp, Mus musculus
gaaaaagcccttcaagctcctaggt

SEQ ID NO: 402184 - DNA, 25 bp, Mus musculus
gaaaaagcccttgaagctcctaggt

SEQ ID NO: 402185 - DNA, 25 bp, Mus musculus
gaaaaagcctaaagcgcattcatga

SEQ ID NO: 402186 - DNA, 25 bp, Mus musculus
gaaaaagcctaatgcgcattcatga

SEQ ID NO: 402187 - DNA, 25 bp, Mus musculus
gaaaaagcctccagggagacatagg

SEQ ID NO: 402188 - DNA, 25 bp, Mus musculus
gaaaaagcctcctgggagacatagg

SEQ ID NO: 402189 - DNA, 25 bp, Mus musculus
gaaaaagcctctatgttatcggcct

SEQ ID NO: 402190 - DNA, 25 bp, Mus musculus
gaaaaagcctctttgttatcggcct

SEQ ID NO: 402191 - DNA, 25 bp, Mus musculus
gaaaaagcctgtactatggcgttcg

SEQ ID NO: 402192 - DNA, 25 bp, Mus musculus
gaaaaagcctgttctatggcgttcg

SEQ ID NO: 402193 - DNA, 25 bp, Mus musculus
gaaaaagcgcctctttccatttttg

SEQ ID NO: 402194 - DNA, 25 bp, Mus musculus
gaaaaagcgcctgtttccatttttg

SEQ ID NO: 402195 - DNA, 25 bp, Mus musculus
gaaaaagcgctgaaatactgaacca

SEQ ID NO: 402196 - DNA, 25 bp, Mus musculus
gaaaaagcgctgtaatactgaacca

SEQ ID NO: 402197 - DNA, 25 bp, Mus musculus
gaaaaagctagaatacctcaaagag

SEQ ID NO: 402198 - DNA, 25 bp, Mus musculus
gaaaaagctagattacctcaaagag

SEQ ID NO: 402199 - DNA, 25 bp, Mus musculus
gaaaaagctcataaacagccccttg

SEQ ID NO: 402200 - DNA, 25 bp, Mus musculus
gaaaaagctcattaacagccccttg

SEQ ID NO: 402201 - DNA, 25 bp, Mus musculus
gaaaaagctcctcaactcaaaggta

SEQ ID NO: 402202 - DNA, 25 bp, Mus musculus
gaaaaagctcctcagttgcccaaac

SEQ ID NO: 402203 - DNA, 25 bp, Mus musculus
gaaaaagctcctgaactcaaaggta

SEQ ID NO: 402204 - DNA, 25 bp, Mus musculus
gaaaaagctcctgagttgcccaaac

SEQ ID NO: 402205 - DNA, 25 bp, Mus musculus
gaaaaagctgctagatgtcagaaag

SEQ ID NO: 402206 - DNA, 25 bp, Mus musculus
gaaaaagctgcttgatgtcagaaag

SEQ ID NO: 402207 - DNA, 25 bp, Mus musculus
gaaaaagctgggaatccgctctgcc

SEQ ID NO: 402208 - DNA, 25 bp, Mus musculus
gaaaaagctgggtatccgctctgcc

SEQ ID NO: 402209 - DNA, 25 bp, Mus musculus
gaaaaagctgtgatactttctagta

SEQ ID NO: 402210 - DNA, 25 bp, Mus musculus
gaaaaagctgtgttactttctagta

SEQ ID NO: 402211 - DNA, 25 bp, Mus musculus
gaaaaagcttcaaccactgacaaat

SEQ ID NO: 402212 - DNA, 25 bp, Mus musculus
gaaaaagcttcatccactgacaaat

SEQ ID NO: 402213 - DNA, 25 bp, Mus musculus
gaaaaagcttctagctggacttgcc

SEQ ID NO: 402214 - DNA, 25 bp, Mus musculus
gaaaaagcttcttgctggacttgcc

SEQ ID NO: 402215 - DNA, 25 bp, Mus musculus
gaaaaagcttttctctcaggtgagt

SEQ ID NO: 402216 - DNA, 25 bp, Mus musculus
gaaaaagcttttgtctcaggtgagt

SEQ ID NO: 402217 - DNA, 25 bp, Mus musculus
gaaaaaggaaccacatctggatgaa

SEQ ID NO: 402218 - DNA, 25 bp, Mus musculus
gaaaaaggaacctcatctggatgaa

SEQ ID NO: 402219 - DNA, 25 bp, Mus musculus
gaaaaaggaagcccagggcccagct

SEQ ID NO: 402220 - DNA, 25 bp, Mus musculus
gaaaaaggaagcgcagggcccagct

SEQ ID NO: 402221 - DNA, 25 bp, Mus musculus
gaaaaaggagctaggccatgtcaat

SEQ ID NO: 402222 - DNA, 25 bp, Mus musculus
gaaaaaggagcttggccatgtcaat

SEQ ID NO: 402223 - DNA, 25 bp, Mus musculus
gaaaaaggcaaacacgcctgccgct

SEQ ID NO: 402224 - DNA, 25 bp, Mus musculus
gaaaaaggcaaagacgcctgccgct

SEQ ID NO: 402225 - DNA, 25 bp, Mus musculus
gaaaaaggcaccagctcctgcagga

SEQ ID NO: 402226 - DNA, 25 bp, Mus musculus
gaaaaaggcaccagttctgaagact

SEQ ID NO: 402227 - DNA, 25 bp, Mus musculus
gaaaaaggcacctgctcctgcagga

SEQ ID NO: 402228 - DNA, 25 bp, Mus musculus
gaaaaaggcacctgttctgaagact

SEQ ID NO: 402229 - DNA, 25 bp, Mus musculus
gaaaaaggcagtattctctcacagc

SEQ ID NO: 402230 - DNA, 25 bp, Mus musculus
gaaaaaggcagttttctctcacagc

SEQ ID NO: 402231 - DNA, 25 bp, Mus musculus
gaaaaaggctcactccctgttaaga

SEQ ID NO: 402232 - DNA, 25 bp, Mus musculus
gaaaaaggctcagtccctgttaaga

SEQ ID NO: 402233 - DNA, 25 bp, Mus musculus
gaaaaaggctttctccttccagagt

SEQ ID NO: 402234 - DNA, 25 bp, Mus musculus
gaaaaaggctttgtccttccagagt

SEQ ID NO: 402235 - DNA, 25 bp, Mus musculus
gaaaaagggatccgagccatcatcg

SEQ ID NO: 402236 - DNA, 25 bp, Mus musculus
gaaaaagggatcggagccatcatcg

SEQ ID NO: 402237 - DNA, 25 bp, Mus musculus
gaaaaagggcgcagtcttgcaccac

SEQ ID NO: 402238 - DNA, 25 bp, Mus musculus
gaaaaagggcgctgtcttgcaccac

SEQ ID NO: 402239 - DNA, 25 bp, Mus musculus
gaaaaaggtacaaccagcagtggta

SEQ ID NO: 402240 - DNA, 25 bp, Mus musculus
gaaaaaggtacatccagcagtggta

SEQ ID NO: 402241 - DNA, 25 bp, Mus musculus
gaaaaaggtgcaagctgcccatacc

SEQ ID NO: 402242 - DNA, 25 bp, Mus musculus
gaaaaaggtgcatgctgcccatacc

SEQ ID NO: 402243 - DNA, 25 bp, Mus musculus
gaaaaaggtggcatacgctgaccgg

SEQ ID NO: 402244 - DNA, 25 bp, Mus musculus
gaaaaaggtggcttacgctgaccgg

SEQ ID NO: 402245 - DNA, 25 bp, Mus musculus
gaaaaaggtgttaccactcttgaag

SEQ ID NO: 402246 - DNA, 25 bp, Mus musculus
gaaaaaggtgtttccactcttgaag

SEQ ID NO: 402247 - DNA, 25 bp, Mus musculus
gaaaaaggttgcagagtccgccctc

SEQ ID NO: 402248 - DNA, 25 bp, Mus musculus
gaaaaaggttgctgagtccgccctc

SEQ ID NO: 402249 - DNA, 25 bp, Mus musculus
gaaaaagtacaaagcccaccagtgc

SEQ ID NO: 402250 - DNA, 25 bp, Mus musculus
gaaaaagtacaatgcccaccagtgc

SEQ ID NO: 402251 - DNA, 25 bp, Mus musculus
gaaaaagtagcgcattaccaatgaa

SEQ ID NO: 402252 - DNA, 25 bp, Mus musculus
gaaaaagtagcggattaccaatgaa

SEQ ID NO: 402253 - DNA, 25 bp, Mus musculus
gaaaaagtcaccctatattatagaa

SEQ ID NO: 402254 - DNA, 25 bp, Mus musculus
gaaaaagtcaccgtatattatagaa

SEQ ID NO: 402255 - DNA, 25 bp, Mus musculus
gaaaaagtcctcacatggcatagat

SEQ ID NO: 402256 - DNA, 25 bp, Mus musculus
gaaaaagtcctcctaaagccgatga

SEQ ID NO: 402257 - DNA, 25 bp, Mus musculus
gaaaaagtcctcgtaaagccgatga

SEQ ID NO: 402258 - DNA, 25 bp, Mus musculus
gaaaaagtcctctcatggcatagat

SEQ ID NO: 402259 - DNA, 25 bp, Mus musculus
gaaaaagtctaaaaccacgcctgag

SEQ ID NO: 402260 - DNA, 25 bp, Mus musculus
gaaaaagtctaataccacgcctgag

SEQ ID NO: 402261 - DNA, 25 bp, Mus musculus
gaaaaagtctcactggcaggccaga

SEQ ID NO: 402262 - DNA, 25 bp, Mus musculus
gaaaaagtctcagtggcaggccaga

SEQ ID NO: 402263 - DNA, 25 bp, Mus musculus
gaaaaagtctcgatccagaagcaga

SEQ ID NO: 402264 - DNA, 25 bp, Mus musculus
gaaaaagtctcgttccagaagcaga

SEQ ID NO: 402265 - DNA, 25 bp, Mus musculus
gaaaaagtctgtacccacggtcact

SEQ ID NO: 402266 - DNA, 25 bp, Mus musculus
gaaaaagtctgttcccacggtcact

SEQ ID NO: 402267 - DNA, 25 bp, Mus musculus
gaaaaagtgaccacaccttgaaaag

SEQ ID NO: 402268 - DNA, 25 bp, Mus musculus
gaaaaagtgacctcaccttgaaaag

SEQ ID NO: 402269 - DNA, 25 bp, Mus musculus
gaaaaagtgactcagccaaggaaga

SEQ ID NO: 402270 - DNA, 25 bp, Mus musculus
gaaaaagtgactgagccaaggaaga

SEQ ID NO: 402271 - DNA, 25 bp, Mus musculus
gaaaaagtgtttccttgttgtagct

SEQ ID NO: 402272 - DNA, 25 bp, Mus musculus
gaaaaagtgtttgcttgttgtagct

SEQ ID NO: 402273 - DNA, 25 bp, Mus musculus
gaaaaagttctaccagcctgacaag

SEQ ID NO: 402274 - DNA, 25 bp, Mus musculus
gaaaaagttctagcagcctgacaag

SEQ ID NO: 402275 - DNA, 25 bp, Mus musculus
gaaaaagttctcatgtgctccgcaa

SEQ ID NO: 402276 - DNA, 25 bp, Mus musculus
gaaaaagttctcttgtgctccgcaa

SEQ ID NO: 402277 - DNA, 25 bp, Mus musculus
gaaaaagttgatccccttaacagag

SEQ ID NO: 402278 - DNA, 25 bp, Mus musculus
gaaaaagttgatgcccttaacagag

SEQ ID NO: 402279 - DNA, 25 bp, Mus musculus
gaaaaagttggcatcattttgtaac

SEQ ID NO: 402280 - DNA, 25 bp, Mus musculus
gaaaaagttggcttcattttgtaac

SEQ ID NO: 402281 - DNA, 25 bp, Mus musculus
gaaaaagtttcaagcatgctttcat

SEQ ID NO: 402282 - DNA, 25 bp, Mus musculus
gaaaaagtttcactcagcttgcctg

SEQ ID NO: 402283 - DNA, 25 bp, Mus musculus
gaaaaagtttcagtcagcttgcctg

SEQ ID NO: 402284 - DNA, 25 bp, Mus musculus
gaaaaagtttcatgcatgctttcat

SEQ ID NO: 402285 - DNA, 25 bp, Mus musculus
gaaaaagtttgacattatcctaggc

SEQ ID NO: 402286 - DNA, 25 bp, Mus musculus
gaaaaagtttgagattatcctaggc

SEQ ID NO: 402287 - DNA, 25 bp, Mus musculus
gaaaaataaacgcagcagcacagtg

SEQ ID NO: 402288 - DNA, 25 bp, Mus musculus
gaaaaataaacggagcagcacagtg

SEQ ID NO: 402289 - DNA, 25 bp, Mus musculus
gaaaaataactgagctcccacaaca

SEQ ID NO: 402290 - DNA, 25 bp, Mus musculus
gaaaaataactgtgctcccacaaca

SEQ ID NO: 402291 - DNA, 25 bp, Mus musculus
gaaaaataacttctcggatactgga

SEQ ID NO: 402292 - DNA, 25 bp, Mus musculus
gaaaaataacttgtcggatactgga

SEQ ID NO: 402293 - DNA, 25 bp, Mus musculus
gaaaaataatgtaaccctgtagact

SEQ ID NO: 402294 - DNA, 25 bp, Mus musculus
gaaaaataatgttaccctgtagact

SEQ ID NO: 402295 - DNA, 25 bp, Mus musculus
gaaaaatacattaccttgtcttcct

SEQ ID NO: 402296 - DNA, 25 bp, Mus musculus
gaaaaatacatttccttgtcttcct

SEQ ID NO: 402297 - DNA, 25 bp, Mus musculus
gaaaaatacccacgtgacaagcact

SEQ ID NO: 402298 - DNA, 25 bp, Mus musculus
gaaaaatacccaggtgacaagcact

SEQ ID NO: 402299 - DNA, 25 bp, Mus musculus
gaaaaatagaaactgtgggcccaat

SEQ ID NO: 402300 - DNA, 25 bp, Mus musculus
gaaaaatagaaagtgtgggcccaat

SEQ ID NO: 402301 - DNA, 25 bp, Mus musculus
gaaaaatatccacaggaacctatgg

SEQ ID NO: 402302 - DNA, 25 bp, Mus musculus
gaaaaatatccacgtgggtctctcc

SEQ ID NO: 402303 - DNA, 25 bp, Mus musculus
gaaaaatatccagaggaacctatgg

SEQ ID NO: 402304 - DNA, 25 bp, Mus musculus
gaaaaatatccaggtgggtctctcc

SEQ ID NO: 402305 - DNA, 25 bp, Mus musculus
gaaaaatcaaatacaggatggcatc

SEQ ID NO: 402306 - DNA, 25 bp, Mus musculus
gaaaaatcaaattcaggatggcatc

SEQ ID NO: 402307 - DNA, 25 bp, Mus musculus
gaaaaatcacaaacactgatctcag

SEQ ID NO: 402308 - DNA, 25 bp, Mus musculus
gaaaaatcacaatcactgatctcag

SEQ ID NO: 402309 - DNA, 25 bp, Mus musculus
gaaaaatcagaaatccttcatggtt

SEQ ID NO: 402310 - DNA, 25 bp, Mus musculus
gaaaaatcagaattccttcatggtt

SEQ ID NO: 402311 - DNA, 25 bp, Mus musculus
gaaaaatcagacaaagccttgctag

SEQ ID NO: 402312 - DNA, 25 bp, Mus musculus
gaaaaatcagactaagccttgctag

SEQ ID NO: 402313 - DNA, 25 bp, Mus musculus
gaaaaatcaggtccgcttgggttag

SEQ ID NO: 402314 - DNA, 25 bp, Mus musculus
gaaaaatcaggtgcgcttgggttag

SEQ ID NO: 402315 - DNA, 25 bp, Mus musculus
gaaaaatcagtccattcttgttata

SEQ ID NO: 402316 - DNA, 25 bp, Mus musculus
gaaaaatcagtcgattcttgttata

SEQ ID NO: 402317 - DNA, 25 bp, Mus musculus
gaaaaatcataactgctgtcctgcc

SEQ ID NO: 402318 - DNA, 25 bp, Mus musculus
gaaaaatcataagtgctgtcctgcc

SEQ ID NO: 402319 - DNA, 25 bp, Mus musculus
gaaaaatccaaccactgggcaaaca

SEQ ID NO: 402320 - DNA, 25 bp, Mus musculus
gaaaaatccaacgactgggcaaaca

SEQ ID NO: 402321 - DNA, 25 bp, Mus musculus
gaaaaatccatccagcttcctgtaa

SEQ ID NO: 402322 - DNA, 25 bp, Mus musculus
gaaaaatccatcgagcttcctgtaa

SEQ ID NO: 402323 - DNA, 25 bp, Mus musculus
gaaaaatccattccacacttaaagg

SEQ ID NO: 402324 - DNA, 25 bp, Mus musculus
gaaaaatccattgcacacttaaagg

SEQ ID NO: 402325 - DNA, 25 bp, Mus musculus
gaaaaatccctcagctatacaaggc

SEQ ID NO: 402326 - DNA, 25 bp, Mus musculus
gaaaaatccctcctttgttcctgtg

SEQ ID NO: 402327 - DNA, 25 bp, Mus musculus
gaaaaatccctcgtttgttcctgtg

SEQ ID NO: 402328 - DNA, 25 bp, Mus musculus
gaaaaatccctctgctatacaaggc

SEQ ID NO: 402329 - DNA, 25 bp, Mus musculus
gaaaaatccttgaccgatccatcaa

SEQ ID NO: 402330 - DNA, 25 bp, Mus musculus
gaaaaatccttgtccgatccatcaa

SEQ ID NO: 402331 - DNA, 25 bp, Mus musculus
gaaaaatctccccagcaaccacagc

SEQ ID NO: 402332 - DNA, 25 bp, Mus musculus
gaaaaatctcccgagcaaccacagc

SEQ ID NO: 402333 - DNA, 25 bp, Mus musculus
gaaaaatctgttctttaacatggat

SEQ ID NO: 402334 - DNA, 25 bp, Mus musculus
gaaaaatctgttgtttaacatggat

SEQ ID NO: 402335 - DNA, 25 bp, Mus musculus
gaaaaatcttaaaatccaaggccag

SEQ ID NO: 402336 - DNA, 25 bp, Mus musculus
gaaaaatcttaatatccaaggccag

SEQ ID NO: 402337 - DNA, 25 bp, Mus musculus
gaaaaatcttcacgtccctggaata

SEQ ID NO: 402338 - DNA, 25 bp, Mus musculus
gaaaaatcttcaggtccctggaata

SEQ ID NO: 402339 - DNA, 25 bp, Mus musculus
gaaaaatgaaccacaccctattaga

SEQ ID NO: 402340 - DNA, 25 bp, Mus musculus
gaaaaatgaaccctcagtcggcctt

SEQ ID NO: 402341 - DNA, 25 bp, Mus musculus
gaaaaatgaaccgtcagtcggcctt

SEQ ID NO: 402342 - DNA, 25 bp, Mus musculus
gaaaaatgaacctcaccctattaga

SEQ ID NO: 402343 - DNA, 25 bp, Mus musculus
gaaaaatgacctcagagcattgaag

SEQ ID NO: 402344 - DNA, 25 bp, Mus musculus
gaaaaatgacctgagagcattgaag

SEQ ID NO: 402345 - DNA, 25 bp, Mus musculus
gaaaaatgagccctccgtcgagaac

SEQ ID NO: 402346 - DNA, 25 bp, Mus musculus
gaaaaatgagccgtccgtcgagaac

SEQ ID NO: 402347 - DNA, 25 bp, Mus musculus
gaaaaatgcatcaggtgtggtgaca

SEQ ID NO: 402348 - DNA, 25 bp, Mus musculus
gaaaaatgcatctggtgtggtgaca

SEQ ID NO: 402349 - DNA, 25 bp, Mus musculus
gaaaaatgccaccttccgatgaaaa

SEQ ID NO: 402350 - DNA, 25 bp, Mus musculus
gaaaaatgccacgttccgatgaaaa

SEQ ID NO: 402351 - DNA, 25 bp, Mus musculus
gaaaaatgccatagagctgctcagc

SEQ ID NO: 402352 - DNA, 25 bp, Mus musculus
gaaaaatgccattgagctgctcagc

SEQ ID NO: 402353 - DNA, 25 bp, Mus musculus
gaaaaatgcctacaagtttgcttga

SEQ ID NO: 402354 - DNA, 25 bp, Mus musculus
gaaaaatgcctagaagtttgcttga

SEQ ID NO: 402355 - DNA, 25 bp, Mus musculus
gaaaaatgcctgacagcgccggtca

SEQ ID NO: 402356 - DNA, 25 bp, Mus musculus
gaaaaatgcctgtcagcgccggtca

SEQ ID NO: 402357 - DNA, 25 bp, Mus musculus
gaaaaatggtctacaccggctgtaa

SEQ ID NO: 402358 - DNA, 25 bp, Mus musculus
gaaaaatggtcttcaccggctgtaa

SEQ ID NO: 402359 - DNA, 25 bp, Mus musculus
gaaaaatgtatgaatcttcagtatt

SEQ ID NO: 402360 - DNA, 25 bp, Mus musculus
gaaaaatgtatgtatcttcagtatt

SEQ ID NO: 402361 - DNA, 25 bp, Mus musculus
gaaaaatgtcatcccatcctttgcc

SEQ ID NO: 402362 - DNA, 25 bp, Mus musculus
gaaaaatgtcatgccatcctttgcc

SEQ ID NO: 402363 - DNA, 25 bp, Mus musculus
gaaaaatgtccccatcccagacaca

SEQ ID NO: 402364 - DNA, 25 bp, Mus musculus
gaaaaatgtcccgatcccagacaca

SEQ ID NO: 402365 - DNA, 25 bp, Mus musculus
gaaaaatgtctcctagcaagtgctt

SEQ ID NO: 402366 - DNA, 25 bp, Mus musculus
gaaaaatgtctcgtagcaagtgctt

SEQ ID NO: 402367 - DNA, 25 bp, Mus musculus
gaaaaatgtggaacctctttatacc

SEQ ID NO: 402368 - DNA, 25 bp, Mus musculus
gaaaaatgtggatcctctttatacc

SEQ ID NO: 402369 - DNA, 25 bp, Mus musculus
gaaaaatgtgtgcagcctcaagctg

SEQ ID NO: 402370 - DNA, 25 bp, Mus musculus
gaaaaatgtgtggagcctcaagctg

SEQ ID NO: 402371 - DNA, 25 bp, Mus musculus
gaaaaatgttccaggcgccggacct

SEQ ID NO: 402372 - DNA, 25 bp, Mus musculus
gaaaaatgttcctggcgccggacct

SEQ ID NO: 402373 - DNA, 25 bp, Mus musculus
gaaaaattaaagagacctcgatcta

SEQ ID NO: 402374 - DNA, 25 bp, Mus musculus
gaaaaattaaagtgacctcgatcta

SEQ ID NO: 402375 - DNA, 25 bp, Mus musculus
gaaaaattaactctagcgcttcatt

SEQ ID NO: 402376 - DNA, 25 bp, Mus musculus
gaaaaattaactgtagcgcttcatt

SEQ ID NO: 402377 - DNA, 25 bp, Mus musculus
gaaaaattaatcacgtggctaaaca

SEQ ID NO: 402378 - DNA, 25 bp, Mus musculus
gaaaaattaatctcgtggctaaaca

SEQ ID NO: 402379 - DNA, 25 bp, Mus musculus
gaaaaattactactagcctggtctt

SEQ ID NO: 402380 - DNA, 25 bp, Mus musculus
gaaaaattactagtagcctggtctt

SEQ ID NO: 402381 - DNA, 25 bp, Mus musculus
gaaaaattactgacttgatttcaaa

SEQ ID NO: 402382 - DNA, 25 bp, Mus musculus
gaaaaattactgtcttgatttcaaa

SEQ ID NO: 402383 - DNA, 25 bp, Mus musculus
gaaaaattatccatgctgtatactt

SEQ ID NO: 402384 - DNA, 25 bp, Mus musculus
gaaaaattatccttgctgtatactt

SEQ ID NO: 402385 - DNA, 25 bp, Mus musculus
gaaaaattcaaacccatcgagtata

SEQ ID NO: 402386 - DNA, 25 bp, Mus musculus
gaaaaattcaaagccatcgagtata

SEQ ID NO: 402387 - DNA, 25 bp, Mus musculus
gaaaaattccacataatgcctatgc

SEQ ID NO: 402388 - DNA, 25 bp, Mus musculus
gaaaaattccacttaatgcctatgc

SEQ ID NO: 402389 - DNA, 25 bp, Mus musculus
gaaaaattcctacgtcagcactatg

SEQ ID NO: 402390 - DNA, 25 bp, Mus musculus
gaaaaattcctaggtcagcactatg

SEQ ID NO: 402391 - DNA, 25 bp, Mus musculus
gaaaaattcctgacattacagaact

SEQ ID NO: 402392 - DNA, 25 bp, Mus musculus
gaaaaattcctgtcattacagaact

SEQ ID NO: 402393 - DNA, 25 bp, Mus musculus
gaaaaattccttcgaccgcggcagc

SEQ ID NO: 402394 - DNA, 25 bp, Mus musculus
gaaaaattccttggaccgcggcagc

SEQ ID NO: 402395 - DNA, 25 bp, Mus musculus
gaaaaattgtaactgcttttgagga

SEQ ID NO: 402396 - DNA, 25 bp, Mus musculus
gaaaaattgtaagtgcttttgagga

SEQ ID NO: 402397 - DNA, 25 bp, Mus musculus
gaaaaattgttcactaaccaggatt

SEQ ID NO: 402398 - DNA, 25 bp, Mus musculus
gaaaaattgttctctaaccaggatt

SEQ ID NO: 402399 - DNA, 25 bp, Mus musculus
gaaaaatttacaactgagtccctga

SEQ ID NO: 402400 - DNA, 25 bp, Mus musculus
gaaaaatttacatctgagtccctga

SEQ ID NO: 402401 - DNA, 25 bp, Mus musculus
gaaaaatttcccaattcaagctaca

SEQ ID NO: 402402 - DNA, 25 bp, Mus musculus
gaaaaatttccctattcaagctaca

SEQ ID NO: 402403 - DNA, 25 bp, Mus musculus
gaaaaatttgagacgtcgtcgagac

SEQ ID NO: 402404 - DNA, 25 bp, Mus musculus
gaaaaatttgagtcgtcgtcgagac

SEQ ID NO: 402405 - DNA, 25 bp, Mus musculus
gaaaaatttgtgcatagactctcca

SEQ ID NO: 402406 - DNA, 25 bp, Mus musculus
gaaaaatttgtggatagactctcca

SEQ ID NO: 402407 - DNA, 25 bp, Mus musculus
gaaaacaaaaggctgcgggcccatt

SEQ ID NO: 402408 - DNA, 25 bp, Mus musculus
gaaaacaaaagggtgcgggcccatt

SEQ ID NO: 402409 - DNA, 25 bp, Mus musculus
gaaaacaaatacatggcagactcaa

SEQ ID NO: 402410 - DNA, 25 bp, Mus musculus
gaaaacaaatacttggcagactcaa

SEQ ID NO: 402411 - DNA, 25 bp, Mus musculus
gaaaacaaatagacccctggtccat

SEQ ID NO: 402412 - DNA, 25 bp, Mus musculus
gaaaacaaatagtcccctggtccat

SEQ ID NO: 402413 - DNA, 25 bp, Mus musculus
gaaaacaaatgcctcattccacctt

SEQ ID NO: 402414 - DNA, 25 bp, Mus musculus
gaaaacaaatgcgtcattccacctt

SEQ ID NO: 402415 - DNA, 25 bp, Mus musculus
gaaaacaacattaactactttgaag

SEQ ID NO: 402416 - DNA, 25 bp, Mus musculus
gaaaacaacatttactactttgaag

SEQ ID NO: 402417 - DNA, 25 bp, Mus musculus
gaaaacaacccgagtcgacgagagt

SEQ ID NO: 402418 - DNA, 25 bp, Mus musculus
gaaaacaacccgtgtcgacgagagt

SEQ ID NO: 402419 - DNA, 25 bp, Mus musculus
gaaaacaacctgattctgacccttt

SEQ ID NO: 402420 - DNA, 25 bp, Mus musculus
gaaaacaacctgtttctgacccttt

SEQ ID NO: 402421 - DNA, 25 bp, Mus musculus
gaaaacaacgggagtctccgccaga

SEQ ID NO: 402422 - DNA, 25 bp, Mus musculus
gaaaacaacgggtgtctccgccaga

SEQ ID NO: 402423 - DNA, 25 bp, Mus musculus
gaaaacaactacaatctggcccatg

SEQ ID NO: 402424 - DNA, 25 bp, Mus musculus
gaaaacaactactatctggcccatg

SEQ ID NO: 402425 - DNA, 25 bp, Mus musculus
gaaaacaactccatctgatattgtg

SEQ ID NO: 402426 - DNA, 25 bp, Mus musculus
gaaaacaactccttctgatattgtg

SEQ ID NO: 402427 - DNA, 25 bp, Mus musculus
gaaaacaactggcttttgcatatta

SEQ ID NO: 402428 - DNA, 25 bp, Mus musculus
gaaaacaactgggttttgcatatta

SEQ ID NO: 402429 - DNA, 25 bp, Mus musculus
gaaaacaacttaattgctgcagaga

SEQ ID NO: 402430 - DNA, 25 bp, Mus musculus
gaaaacaacttatttgctgcagaga

SEQ ID NO: 402431 - DNA, 25 bp, Mus musculus
gaaaacaacttccttccaggctttg

SEQ ID NO: 402432 - DNA, 25 bp, Mus musculus
gaaaacaacttcgttccaggctttg

SEQ ID NO: 402433 - DNA, 25 bp, Mus musculus
gaaaacaacttgctgacagcctcag

SEQ ID NO: 402434 - DNA, 25 bp, Mus musculus
gaaaacaacttggtgacagcctcag

SEQ ID NO: 402435 - DNA, 25 bp, Mus musculus
gaaaacaactttaccgaacactgag

SEQ ID NO: 402436 - DNA, 25 bp, Mus musculus
gaaaacaacttttccgaacactgag

SEQ ID NO: 402437 - DNA, 25 bp, Mus musculus
gaaaacaagattcctactgcccaga

SEQ ID NO: 402438 - DNA, 25 bp, Mus musculus
gaaaacaagattgctactgcccaga

SEQ ID NO: 402439 - DNA, 25 bp, Mus musculus
gaaaacaagccaaacagacactcag

SEQ ID NO: 402440 - DNA, 25 bp, Mus musculus
gaaaacaagccatacagacactcag

SEQ ID NO: 402441 - DNA, 25 bp, Mus musculus
gaaaacaagctcagtcgccggcaga

SEQ ID NO: 402442 - DNA, 25 bp, Mus musculus
gaaaacaagctctgtcgccggcaga

SEQ ID NO: 402443 - DNA, 25 bp, Mus musculus
gaaaacaaggctccatttagttgat

SEQ ID NO: 402444 - DNA, 25 bp, Mus musculus
gaaaacaaggctgcatttagttgat

SEQ ID NO: 402445 - DNA, 25 bp, Mus musculus
gaaaacaagtgtagaggcctctgta

SEQ ID NO: 402446 - DNA, 25 bp, Mus musculus
gaaaacaagtgttgaggcctctgta

SEQ ID NO: 402447 - DNA, 25 bp, Mus musculus
gaaaacaagtttagcactctgagtg

SEQ ID NO: 402448 - DNA, 25 bp, Mus musculus
gaaaacaagttttgcactctgagtg

SEQ ID NO: 402449 - DNA, 25 bp, Mus musculus
gaaaacaatagcatgtcatccacaa

SEQ ID NO: 402450 - DNA, 25 bp, Mus musculus
gaaaacaatagcttgtcatccacaa

SEQ ID NO: 402451 - DNA, 25 bp, Mus musculus
gaaaacaatatcactctaacagtat

SEQ ID NO: 402452 - DNA, 25 bp, Mus musculus
gaaaacaatatctctctaacagtat

SEQ ID NO: 402453 - DNA, 25 bp, Mus musculus
gaaaacaatctaaatgtaacatatg

SEQ ID NO: 402454 - DNA, 25 bp, Mus musculus
gaaaacaatctatatgtaacatatg

SEQ ID NO: 402455 - DNA, 25 bp, Mus musculus
gaaaacaatgtaataggaagccctt

SEQ ID NO: 402456 - DNA, 25 bp, Mus musculus
gaaaacaatgtattaggaagccctt

SEQ ID NO: 402457 - DNA, 25 bp, Mus musculus
gaaaacacaagtaaccagtctcagg

SEQ ID NO: 402458 - DNA, 25 bp, Mus musculus
gaaaacacaagttaccagtctcagg

SEQ ID NO: 402459 - DNA, 25 bp, Mus musculus
gaaaacacacagaaccttcgcagct

SEQ ID NO: 402460 - DNA, 25 bp, Mus musculus
gaaaacacacagtaccttcgcagct

SEQ ID NO: 402461 - DNA, 25 bp, Mus musculus
gaaaacacagccaggtagcgctccg

SEQ ID NO: 402462 - DNA, 25 bp, Mus musculus
gaaaacacagcctggtagcgctccg

SEQ ID NO: 402463 - DNA, 25 bp, Mus musculus
gaaaacacaggaacttttcttacat

SEQ ID NO: 402464 - DNA, 25 bp, Mus musculus
gaaaacacaggatcttttcttacat

SEQ ID NO: 402465 - DNA, 25 bp, Mus musculus
gaaaacacatataagaacgcccaaa

SEQ ID NO: 402466 - DNA, 25 bp, Mus musculus
gaaaacacatattagaacgcccaaa

SEQ ID NO: 402467 - DNA, 25 bp, Mus musculus
gaaaacacatgtagcccagaactca

SEQ ID NO: 402468 - DNA, 25 bp, Mus musculus
gaaaacacatgtattcaccaatgtg

SEQ ID NO: 402469 - DNA, 25 bp, Mus musculus
gaaaacacatgttgcccagaactca

SEQ ID NO: 402470 - DNA, 25 bp, Mus musculus
gaaaacacatgttttcaccaatgtg

SEQ ID NO: 402471 - DNA, 25 bp, Mus musculus
gaaaacaccaatacctcttaaattg

SEQ ID NO: 402472 - DNA, 25 bp, Mus musculus
gaaaacaccaattcctcttaaattg

SEQ ID NO: 402473 - DNA, 25 bp, Mus musculus
gaaaacaccaccaaaggccagaaag

SEQ ID NO: 402474 - DNA, 25 bp, Mus musculus
gaaaacaccacctaaggccagaaag

SEQ ID NO: 402475 - DNA, 25 bp, Mus musculus
gaaaacaccagtcgcagcaaccatg

SEQ ID NO: 402476 - DNA, 25 bp, Mus musculus
gaaaacaccagtggcagcaaccatg

SEQ ID NO: 402477 - DNA, 25 bp, Mus musculus
gaaaacaccattcattcttgcttta

SEQ ID NO: 402478 - DNA, 25 bp, Mus musculus
gaaaacaccattgattcttgcttta

SEQ ID NO: 402479 - DNA, 25 bp, Mus musculus
gaaaacacccatccttagactactg

SEQ ID NO: 402480 - DNA, 25 bp, Mus musculus
gaaaacacccatgcttagactactg

SEQ ID NO: 402481 - DNA, 25 bp, Mus musculus
gaaaacaccctaaaggcttgcctat

SEQ ID NO: 402482 - DNA, 25 bp, Mus musculus
gaaaacaccctataggcttgcctat

SEQ ID NO: 402483 - DNA, 25 bp, Mus musculus
gaaaacaccgagctcagctacactt

SEQ ID NO: 402484 - DNA, 25 bp, Mus musculus
gaaaacaccgaggtcagctacactt

SEQ ID NO: 402485 - DNA, 25 bp, Mus musculus
gaaaacacctccactatgaatcagt

SEQ ID NO: 402486 - DNA, 25 bp, Mus musculus
gaaaacacctcctctatgaatcagt

SEQ ID NO: 402487 - DNA, 25 bp, Mus musculus
gaaaacacctgtaggcctaagtaat

SEQ ID NO: 402488 - DNA, 25 bp, Mus musculus
gaaaacacctgttggcctaagtaat

SEQ ID NO: 402489 - DNA, 25 bp, Mus musculus
gaaaacacctttaactccagatgta

SEQ ID NO: 402490 - DNA, 25 bp, Mus musculus
gaaaacaccttttactccagatgta

SEQ ID NO: 402491 - DNA, 25 bp, Mus musculus
gaaaacacgataatggctctccaca

SEQ ID NO: 402492 - DNA, 25 bp, Mus musculus
gaaaacacgatattggctctccaca

SEQ ID NO: 402493 - DNA, 25 bp, Mus musculus
gaaaacacgggcacctctctgaggg

SEQ ID NO: 402494 - DNA, 25 bp, Mus musculus
gaaaacacgggctcctctctgaggg

SEQ ID NO: 402495 - DNA, 25 bp, Mus musculus
gaaaacacgttcatagcttcccagc

SEQ ID NO: 402496 - DNA, 25 bp, Mus musculus
gaaaacacgttcttagcttcccagc

SEQ ID NO: 402497 - DNA, 25 bp, Mus musculus
gaaaacactacactccttgtccatt

SEQ ID NO: 402498 - DNA, 25 bp, Mus musculus
gaaaacactacagtccttgtccatt

SEQ ID NO: 402499 - DNA, 25 bp, Mus musculus
gaaaacactagaaggcctgaacaaa

SEQ ID NO: 402500 - DNA, 25 bp, Mus musculus
gaaaacactagatggcctgaacaaa

SEQ ID NO: 402501 - DNA, 25 bp, Mus musculus
gaaaacactcaacagtccatctaag

SEQ ID NO: 402502 - DNA, 25 bp, Mus musculus
gaaaacactcaagagtccatctaag

SEQ ID NO: 402503 - DNA, 25 bp, Mus musculus
gaaaacactcctacaactttctgag

SEQ ID NO: 402504 - DNA, 25 bp, Mus musculus
gaaaacactccttcaactttctgag

SEQ ID NO: 402505 - DNA, 25 bp, Mus musculus
gaaaacactcggctccctgggacag

SEQ ID NO: 402506 - DNA, 25 bp, Mus musculus
gaaaacactcgggtccctgggacag

SEQ ID NO: 402507 - DNA, 25 bp, Mus musculus
gaaaacactctccaaggctctatga

SEQ ID NO: 402508 - DNA, 25 bp, Mus musculus
gaaaacactctcgaaggctctatga

SEQ ID NO: 402509 - DNA, 25 bp, Mus musculus
gaaaacactgccaaacatgcctaaa

SEQ ID NO: 402510 - DNA, 25 bp, Mus musculus
gaaaacactgccacagcggcggacc

SEQ ID NO: 402511 - DNA, 25 bp, Mus musculus
gaaaacactgcctaacatgcctaaa

SEQ ID NO: 402512 - DNA, 25 bp, Mus musculus
gaaaacactgcctcagcggcggacc

SEQ ID NO: 402513 - DNA, 25 bp, Mus musculus
gaaaacactgtaccctaactgaaca

SEQ ID NO: 402514 - DNA, 25 bp, Mus musculus
gaaaacactgtagcctaactgaaca

SEQ ID NO: 402515 - DNA, 25 bp, Mus musculus
gaaaacacttccctcctatgactag

SEQ ID NO: 402516 - DNA, 25 bp, Mus musculus
gaaaacacttccgtcctatgactag

SEQ ID NO: 402517 - DNA, 25 bp, Mus musculus
gaaaacacttggcttctgctgtatg

SEQ ID NO: 402518 - DNA, 25 bp, Mus musculus
gaaaacacttgggttctgctgtatg

SEQ ID NO: 402519 - DNA, 25 bp, Mus musculus
gaaaacactttacgatgctgagcta

SEQ ID NO: 402520 - DNA, 25 bp, Mus musculus
gaaaacactttaggatgctgagcta

SEQ ID NO: 402521 - DNA, 25 bp, Mus musculus
gaaaacagatacacagaacagacat

SEQ ID NO: 402522 - DNA, 25 bp, Mus musculus
gaaaacagatactcagaacagacat

SEQ ID NO: 402523 - DNA, 25 bp, Mus musculus
gaaaacagatcacgatccttgcact

SEQ ID NO: 402524 - DNA, 25 bp, Mus musculus
gaaaacagatcaggatccttgcact

SEQ ID NO: 402525 - DNA, 25 bp, Mus musculus
gaaaacagattacaagctcttcagc

SEQ ID NO: 402526 - DNA, 25 bp, Mus musculus
gaaaacagattagaagctcttcagc

SEQ ID NO: 402527 - DNA, 25 bp, Mus musculus
gaaaacagattgcacgtccgcatcc

SEQ ID NO: 402528 - DNA, 25 bp, Mus musculus
gaaaacagattggacgtccgcatcc

SEQ ID NO: 402529 - DNA, 25 bp, Mus musculus
gaaaacagcaatagtgtgctcatgt

SEQ ID NO: 402530 - DNA, 25 bp, Mus musculus
gaaaacagcaattgtgtgctcatgt

SEQ ID NO: 402531 - DNA, 25 bp, Mus musculus
gaaaacagcagacaaggatgtcatt

SEQ ID NO: 402532 - DNA, 25 bp, Mus musculus
gaaaacagcagagaaggatgtcatt

SEQ ID NO: 402533 - DNA, 25 bp, Mus musculus
gaaaacagcagtaccccagaggagt

SEQ ID NO: 402534 - DNA, 25 bp, Mus musculus
gaaaacagcagttccccagaggagt

SEQ ID NO: 402535 - DNA, 25 bp, Mus musculus
gaaaacagcatacacgttcctcatg

SEQ ID NO: 402536 - DNA, 25 bp, Mus musculus
gaaaacagcatagacgttcctcatg

SEQ ID NO: 402537 - DNA, 25 bp, Mus musculus
gaaaacagcatcatcctcaacggca

SEQ ID NO: 402538 - DNA, 25 bp, Mus musculus
gaaaacagcatcttcctcaacggca

SEQ ID NO: 402539 - DNA, 25 bp, Mus musculus
gaaaacagcatgactgctccttcac

SEQ ID NO: 402540 - DNA, 25 bp, Mus musculus
gaaaacagcatgtctgctccttcac

SEQ ID NO: 402541 - DNA, 25 bp, Mus musculus
gaaaacagcgagcaagtccaccaga

SEQ ID NO: 402542 - DNA, 25 bp, Mus musculus
gaaaacagcgaggaagtccaccaga

SEQ ID NO: 402543 - DNA, 25 bp, Mus musculus
gaaaacagcgttactgggagcttcc

SEQ ID NO: 402544 - DNA, 25 bp, Mus musculus
gaaaacagcgtttctgggagcttcc

SEQ ID NO: 402545 - DNA, 25 bp, Mus musculus
gaaaacagctgaactcttgggaagg

SEQ ID NO: 402546 - DNA, 25 bp, Mus musculus
gaaaacagctgatctcttgggaagg

SEQ ID NO: 402547 - DNA, 25 bp, Mus musculus
gaaaacagctttactgggagcctga

SEQ ID NO: 402548 - DNA, 25 bp, Mus musculus
gaaaacagcttttctgggagcctga

SEQ ID NO: 402549 - DNA, 25 bp, Mus musculus
gaaaacaggatcagccctatccgtg

SEQ ID NO: 402550 - DNA, 25 bp, Mus musculus
gaaaacaggatctgccctatccgtg

SEQ ID NO: 402551 - DNA, 25 bp, Mus musculus
gaaaacaggcgtcactgcatttcca

SEQ ID NO: 402552 - DNA, 25 bp, Mus musculus
gaaaacaggcgtgactgcatttcca

SEQ ID NO: 402553 - DNA, 25 bp, Mus musculus
gaaaacaggctaacttttgatgtgc

SEQ ID NO: 402554 - DNA, 25 bp, Mus musculus
gaaaacaggctaccttatcatactt

SEQ ID NO: 402555 - DNA, 25 bp, Mus musculus
gaaaacaggctagcttatcatactt

SEQ ID NO: 402556 - DNA, 25 bp, Mus musculus
gaaaacaggctatcttttgatgtgc

SEQ ID NO: 402557 - DNA, 25 bp, Mus musculus
gaaaacaggctcctgcaagctgtct

SEQ ID NO: 402558 - DNA, 25 bp, Mus musculus
gaaaacaggctcgtgcaagctgtct

SEQ ID NO: 402559 - DNA, 25 bp, Mus musculus
gaaaacaggctgagttcagcctccc

SEQ ID NO: 402560 - DNA, 25 bp, Mus musculus
gaaaacaggctgtgttcagcctccc

SEQ ID NO: 402561 - DNA, 25 bp, Mus musculus
gaaaacaggtacacggtttccaatg

SEQ ID NO: 402562 - DNA, 25 bp, Mus musculus
gaaaacaggtactcggtttccaatg

SEQ ID NO: 402563 - DNA, 25 bp, Mus musculus
gaaaacaggtgcacccttaacaaga

SEQ ID NO: 402564 - DNA, 25 bp, Mus musculus
gaaaacaggtgctcccttaacaaga

SEQ ID NO: 402565 - DNA, 25 bp, Mus musculus
gaaaacagtgctatactaagaagcc

SEQ ID NO: 402566 - DNA, 25 bp, Mus musculus
gaaaacagtgctttactaagaagcc

SEQ ID NO: 402567 - DNA, 25 bp, Mus musculus
gaaaacagtggccacttcttcccaa

SEQ ID NO: 402568 - DNA, 25 bp, Mus musculus
gaaaacagtggcgacttcttcccaa

SEQ ID NO: 402569 - DNA, 25 bp, Mus musculus
gaaaacagtgtacccagctgtgacc

SEQ ID NO: 402570 - DNA, 25 bp, Mus musculus
gaaaacagtgtagccagctgtgacc

SEQ ID NO: 402571 - DNA, 25 bp, Mus musculus
gaaaacagttcacagggcccaactc

SEQ ID NO: 402572 - DNA, 25 bp, Mus musculus
gaaaacagttcagagggcccaactc

SEQ ID NO: 402573 - DNA, 25 bp, Mus musculus
gaaaacagttctaccgcatgtttat

SEQ ID NO: 402574 - DNA, 25 bp, Mus musculus
gaaaacagttcttccgcatgtttat

SEQ ID NO: 402575 - DNA, 25 bp, Mus musculus
gaaaacagttttacgcccagtcatc

SEQ ID NO: 402576 - DNA, 25 bp, Mus musculus
gaaaacagtttttcgcccagtcatc

SEQ ID NO: 402577 - DNA, 25 bp, Mus musculus
gaaaacatacacaagtcccaaccct

SEQ ID NO: 402578 - DNA, 25 bp, Mus musculus
gaaaacatacactagtcccaaccct

SEQ ID NO: 402579 - DNA, 25 bp, Mus musculus
gaaaacatacagactgctccctgtc

SEQ ID NO: 402580 - DNA, 25 bp, Mus musculus
gaaaacatacagtctgctccctgtc

SEQ ID NO: 402581 - DNA, 25 bp, Mus musculus
gaaaacatagttcggcactgacaca

SEQ ID NO: 402582 - DNA, 25 bp, Mus musculus
gaaaacatagttgggcactgacaca

SEQ ID NO: 402583 - DNA, 25 bp, Mus musculus
gaaaacatatcactgccctaatctc

SEQ ID NO: 402584 - DNA, 25 bp, Mus musculus
gaaaacatatcagtgccctaatctc

SEQ ID NO: 402585 - DNA, 25 bp, Mus musculus
gaaaacatatccaagcagacctctt

SEQ ID NO: 402586 - DNA, 25 bp, Mus musculus
gaaaacatatcctagcagacctctt

SEQ ID NO: 402587 - DNA, 25 bp, Mus musculus
gaaaacatattcctcccaagtggtt

SEQ ID NO: 402588 - DNA, 25 bp, Mus musculus
gaaaacatattcgtcccaagtggtt

SEQ ID NO: 402589 - DNA, 25 bp, Mus musculus
gaaaacatattgacttcataagaat

SEQ ID NO: 402590 - DNA, 25 bp, Mus musculus
gaaaacatattgtcttcataagaat

SEQ ID NO: 402591 - DNA, 25 bp, Mus musculus
gaaaacatcaacacagacaggtctt

SEQ ID NO: 402592 - DNA, 25 bp, Mus musculus
gaaaacatcaactcagacaggtctt

SEQ ID NO: 402593 - DNA, 25 bp, Mus musculus
gaaaacatcaagactgtgaacttga

SEQ ID NO: 402594 - DNA, 25 bp, Mus musculus
gaaaacatcaagtctgtgaacttga

SEQ ID NO: 402595 - DNA, 25 bp, Mus musculus
gaaaacatcactaagcacagaggct

SEQ ID NO: 402596 - DNA, 25 bp, Mus musculus
gaaaacatcacttagcacagaggct

SEQ ID NO: 402597 - DNA, 25 bp, Mus musculus
gaaaacatcagtaaacccctcacta

SEQ ID NO: 402598 - DNA, 25 bp, Mus musculus
gaaaacatcagttaacccctcacta

SEQ ID NO: 402599 - DNA, 25 bp, Mus musculus
gaaaacatcatccttgaggctcacc

SEQ ID NO: 402600 - DNA, 25 bp, Mus musculus
gaaaacatcatcgttgaggctcacc

SEQ ID NO: 402601 - DNA, 25 bp, Mus musculus
gaaaacatcatgctggtggatccat

SEQ ID NO: 402602 - DNA, 25 bp, Mus musculus
gaaaacatcatggtggtggatccat

SEQ ID NO: 402603 - DNA, 25 bp, Mus musculus
gaaaacatcattcgctacgacgacg

SEQ ID NO: 402604 - DNA, 25 bp, Mus musculus
gaaaacatcattggctacgacgacg

SEQ ID NO: 402605 - DNA, 25 bp, Mus musculus
gaaaacatccagagtcacttctgtg

SEQ ID NO: 402606 - DNA, 25 bp, Mus musculus
gaaaacatccagtgtcacttctgtg

SEQ ID NO: 402607 - DNA, 25 bp, Mus musculus
gaaaacatcccacagtcttcaaacc

SEQ ID NO: 402608 - DNA, 25 bp, Mus musculus
gaaaacatcccagagtcttcaaacc

SEQ ID NO: 402609 - DNA, 25 bp, Mus musculus
gaaaacatcggcaaaggcactggaa

SEQ ID NO: 402610 - DNA, 25 bp, Mus musculus
gaaaacatcggctaaggcactggaa

SEQ ID NO: 402611 - DNA, 25 bp, Mus musculus
gaaaacatcgttctgcagcaaggag

SEQ ID NO: 402612 - DNA, 25 bp, Mus musculus
gaaaacatcgttgtgcagcaaggag

SEQ ID NO: 402613 - DNA, 25 bp, Mus musculus
gaaaacatctagactttggccttcc

SEQ ID NO: 402614 - DNA, 25 bp, Mus musculus
gaaaacatctagtctttggccttcc

SEQ ID NO: 402615 - DNA, 25 bp, Mus musculus
gaaaacatctcaattcccatcgatc

SEQ ID NO: 402616 - DNA, 25 bp, Mus musculus
gaaaacatctcatttcccatcgatc

SEQ ID NO: 402617 - DNA, 25 bp, Mus musculus
gaaaacatctgcaatctatatgggc

SEQ ID NO: 402618 - DNA, 25 bp, Mus musculus
gaaaacatctgctatctatatgggc

SEQ ID NO: 402619 - DNA, 25 bp, Mus musculus
gaaaacatcttcctaccggtctgta

SEQ ID NO: 402620 - DNA, 25 bp, Mus musculus
gaaaacatcttcgtaccggtctgta

SEQ ID NO: 402621 - DNA, 25 bp, Mus musculus
gaaaacatctttcgcgctgggaatt

SEQ ID NO: 402622 - DNA, 25 bp, Mus musculus
gaaaacatctttggcgctgggaatt

SEQ ID NO: 402623 - DNA, 25 bp, Mus musculus
gaaaacatgagcacagagcaacaga

SEQ ID NO: 402624 - DNA, 25 bp, Mus musculus
gaaaacatgagctcagagcaacaga

SEQ ID NO: 402625 - DNA, 25 bp, Mus musculus
gaaaacatgatcacctttttcccct

SEQ ID NO: 402626 - DNA, 25 bp, Mus musculus
gaaaacatgatctcctttttcccct

SEQ ID NO: 402627 - DNA, 25 bp, Mus musculus
gaaaacatgcaacgtccaatactaa

SEQ ID NO: 402628 - DNA, 25 bp, Mus musculus
gaaaacatgcaaggtccaatactaa

SEQ ID NO: 402629 - DNA, 25 bp, Mus musculus
gaaaacatggccagacctagctcac

SEQ ID NO: 402630 - DNA, 25 bp, Mus musculus
gaaaacatggcctgacctagctcac

SEQ ID NO: 402631 - DNA, 25 bp, Mus musculus
gaaaacatggctaagcctcacagtt

SEQ ID NO: 402632 - DNA, 25 bp, Mus musculus
gaaaacatggcttagcctcacagtt

SEQ ID NO: 402633 - DNA, 25 bp, Mus musculus
gaaaacatggtgcactcgggagtat

SEQ ID NO: 402634 - DNA, 25 bp, Mus musculus
gaaaacatggtggactcgggagtat

SEQ ID NO: 402635 - DNA, 25 bp, Mus musculus
gaaaacatgtctatagaaaccctga

SEQ ID NO: 402636 - DNA, 25 bp, Mus musculus
gaaaacatgtctttagaaaccctga

SEQ ID NO: 402637 - DNA, 25 bp, Mus musculus
gaaaacattaaaacgcccacagtat

SEQ ID NO: 402638 - DNA, 25 bp, Mus musculus
gaaaacattaaatcgcccacagtat

SEQ ID NO: 402639 - DNA, 25 bp, Mus musculus
gaaaacattatcatcaccctacaga

SEQ ID NO: 402640 - DNA, 25 bp, Mus musculus
gaaaacattatcttcaccctacaga

SEQ ID NO: 402641 - DNA, 25 bp, Mus musculus
gaaaacattcatccttcttcaatag

SEQ ID NO: 402642 - DNA, 25 bp, Mus musculus
gaaaacattcatgcttcttcaatag

SEQ ID NO: 402643 - DNA, 25 bp, Mus musculus
gaaaacattccaaggcccagggaag

SEQ ID NO: 402644 - DNA, 25 bp, Mus musculus
gaaaacattccatggcccagggaag

SEQ ID NO: 402645 - DNA, 25 bp, Mus musculus
gaaaacattgctaagcctctggatc

SEQ ID NO: 402646 - DNA, 25 bp, Mus musculus
gaaaacattgctccagatccaatcg

SEQ ID NO: 402647 - DNA, 25 bp, Mus musculus
gaaaacattgctgcagatccaatcg

SEQ ID NO: 402648 - DNA, 25 bp, Mus musculus
gaaaacattgcttagcctctggatc

SEQ ID NO: 402649 - DNA, 25 bp, Mus musculus
gaaaacattgtgcaacttcattaag

SEQ ID NO: 402650 - DNA, 25 bp, Mus musculus
gaaaacattgtggaacttcattaag

SEQ ID NO: 402651 - DNA, 25 bp, Mus musculus
gaaaacattgttcaccgtagaaggt

SEQ ID NO: 402652 - DNA, 25 bp, Mus musculus
gaaaacattgttccaaaccctcttg

SEQ ID NO: 402653 - DNA, 25 bp, Mus musculus
gaaaacattgttgaccgtagaaggt

SEQ ID NO: 402654 - DNA, 25 bp, Mus musculus
gaaaacattgttgcaaaccctcttg

SEQ ID NO: 402655 - DNA, 25 bp, Mus musculus
gaaaacatttcccttttgttgatat

SEQ ID NO: 402656 - DNA, 25 bp, Mus musculus
gaaaacatttccgttttgttgatat

SEQ ID NO: 402657 - DNA, 25 bp, Mus musculus
gaaaacatttgtccccatgactgag

SEQ ID NO: 402658 - DNA, 25 bp, Mus musculus
gaaaacatttgtgcccatgactgag

SEQ ID NO: 402659 - DNA, 25 bp, Mus musculus
gaaaaccaaagcagtgaagaccacc

SEQ ID NO: 402660 - DNA, 25 bp, Mus musculus
gaaaaccaaagctgtgaagaccacc

SEQ ID NO: 402661 - DNA, 25 bp, Mus musculus
gaaaaccaacaaatccctgagcaga

SEQ ID NO: 402662 - DNA, 25 bp, Mus musculus
gaaaaccaacaattccctgagcaga

SEQ ID NO: 402663 - DNA, 25 bp, Mus musculus
gaaaaccaacagatggcgcttcctc

SEQ ID NO: 402664 - DNA, 25 bp, Mus musculus
gaaaaccaacagttggcgcttcctc

SEQ ID NO: 402665 - DNA, 25 bp, Mus musculus
gaaaaccaactacctcgtcatgggc

SEQ ID NO: 402666 - DNA, 25 bp, Mus musculus
gaaaaccaactagctcgtcatgggc

SEQ ID NO: 402667 - DNA, 25 bp, Mus musculus
gaaaaccaactgattcactggaaga

SEQ ID NO: 402668 - DNA, 25 bp, Mus musculus
gaaaaccaactgtttcactggaaga

SEQ ID NO: 402669 - DNA, 25 bp, Mus musculus
gaaaaccaacttcccatatctgatc

SEQ ID NO: 402670 - DNA, 25 bp, Mus musculus
gaaaaccaacttgccatatctgatc

SEQ ID NO: 402671 - DNA, 25 bp, Mus musculus
gaaaaccaagcaaaggatgtacaga

SEQ ID NO: 402672 - DNA, 25 bp, Mus musculus
gaaaaccaagcataggatgtacaga

SEQ ID NO: 402673 - DNA, 25 bp, Mus musculus
gaaaaccaagccctcgtgacaactg

SEQ ID NO: 402674 - DNA, 25 bp, Mus musculus
gaaaaccaagccgtcgtgacaactg

SEQ ID NO: 402675 - DNA, 25 bp, Mus musculus
gaaaaccaagttactgctcctcacg

SEQ ID NO: 402676 - DNA, 25 bp, Mus musculus
gaaaaccaagtttctgctcctcacg

SEQ ID NO: 402677 - DNA, 25 bp, Mus musculus
gaaaaccacaaactgccctgatctt

SEQ ID NO: 402678 - DNA, 25 bp, Mus musculus
gaaaaccacaaagtgccctgatctt

SEQ ID NO: 402679 - DNA, 25 bp, Mus musculus
gaaaaccacagaagcagtccttaaa

SEQ ID NO: 402680 - DNA, 25 bp, Mus musculus
gaaaaccacagatgcagtccttaaa

SEQ ID NO: 402681 - DNA, 25 bp, Mus musculus
gaaaaccacagccagtccttcagtt

SEQ ID NO: 402682 - DNA, 25 bp, Mus musculus
gaaaaccacagcgagtccttcagtt

SEQ ID NO: 402683 - DNA, 25 bp, Mus musculus
gaaaaccacagtaccgatctttctg

SEQ ID NO: 402684 - DNA, 25 bp, Mus musculus
gaaaaccacagttccgatctttctg

SEQ ID NO: 402685 - DNA, 25 bp, Mus musculus
gaaaaccacgatcctaacttcattg

SEQ ID NO: 402686 - DNA, 25 bp, Mus musculus
gaaaaccacgatgctaacttcattg

SEQ ID NO: 402687 - DNA, 25 bp, Mus musculus
gaaaaccactctagaattccgtctt

SEQ ID NO: 402688 - DNA, 25 bp, Mus musculus
gaaaaccactctcgctctgtggaaa

SEQ ID NO: 402689 - DNA, 25 bp, Mus musculus
gaaaaccactctggctctgtggaaa

SEQ ID NO: 402690 - DNA, 25 bp, Mus musculus
gaaaaccactcttgaattccgtctt

SEQ ID NO: 402691 - DNA, 25 bp, Mus musculus
gaaaaccactgaaacttcgttccag

SEQ ID NO: 402692 - DNA, 25 bp, Mus musculus
gaaaaccactgatacttcgttccag

SEQ ID NO: 402693 - DNA, 25 bp, Mus musculus
gaaaaccactgtcaatttccacatt

SEQ ID NO: 402694 - DNA, 25 bp, Mus musculus
gaaaaccactgtgaatttccacatt

SEQ ID NO: 402695 - DNA, 25 bp, Mus musculus
gaaaaccagaaacccagtgactcca

SEQ ID NO: 402696 - DNA, 25 bp, Mus musculus
gaaaaccagaaagccagtgactcca

SEQ ID NO: 402697 - DNA, 25 bp, Mus musculus
gaaaaccagagtcttcccagtcctt

SEQ ID NO: 402698 - DNA, 25 bp, Mus musculus
gaaaaccagagtgttcccagtcctt

SEQ ID NO: 402699 - DNA, 25 bp, Mus musculus
gaaaaccagcaaccaaatcatcaac

SEQ ID NO: 402700 - DNA, 25 bp, Mus musculus
gaaaaccagcaacgctcactgagca

SEQ ID NO: 402701 - DNA, 25 bp, Mus musculus
gaaaaccagcaagcaaatcatcaac

SEQ ID NO: 402702 - DNA, 25 bp, Mus musculus
gaaaaccagcaaggctcactgagca

SEQ ID NO: 402703 - DNA, 25 bp, Mus musculus
gaaaaccagcatcttgtcagccctg

SEQ ID NO: 402704 - DNA, 25 bp, Mus musculus
gaaaaccagcatgttgtcagccctg

SEQ ID NO: 402705 - DNA, 25 bp, Mus musculus
gaaaaccagcctacctggcctggct

SEQ ID NO: 402706 - DNA, 25 bp, Mus musculus
gaaaaccagccttcctggcctggct

SEQ ID NO: 402707 - DNA, 25 bp, Mus musculus
gaaaaccagcgcatcagtgggttct

SEQ ID NO: 402708 - DNA, 25 bp, Mus musculus
gaaaaccagcgcttcagtgggttct

SEQ ID NO: 402709 - DNA, 25 bp, Mus musculus
gaaaaccagctcagacttttgtccc

SEQ ID NO: 402710 - DNA, 25 bp, Mus musculus
gaaaaccagctctgacttttgtccc

SEQ ID NO: 402711 - DNA, 25 bp, Mus musculus
gaaaaccagggcacgaggcccctct

SEQ ID NO: 402712 - DNA, 25 bp, Mus musculus
gaaaaccagggctcgaggcccctct

SEQ ID NO: 402713 - DNA, 25 bp, Mus musculus
gaaaaccagtatctcacctgccggg

SEQ ID NO: 402714 - DNA, 25 bp, Mus musculus
gaaaaccagtatgtcacctgccggg

SEQ ID NO: 402715 - DNA, 25 bp, Mus musculus
gaaaaccagtcaaatcatgaagcca

SEQ ID NO: 402716 - DNA, 25 bp, Mus musculus
gaaaaccagtcatatcatgaagcca

SEQ ID NO: 402717 - DNA, 25 bp, Mus musculus
gaaaaccataaacaccttcactggg

SEQ ID NO: 402718 - DNA, 25 bp, Mus musculus
gaaaaccataaagaccttcactggg

SEQ ID NO: 402719 - DNA, 25 bp, Mus musculus
gaaaaccatcagacgggagtcttag

SEQ ID NO: 402720 - DNA, 25 bp, Mus musculus
gaaaaccatcagtcgggagtcttag

SEQ ID NO: 402721 - DNA, 25 bp, Mus musculus
gaaaaccatcgccaagcggctggtc

SEQ ID NO: 402722 - DNA, 25 bp, Mus musculus
gaaaaccatcgcgaagcggctggtc

SEQ ID NO: 402723 - DNA, 25 bp, Mus musculus
gaaaaccatctacctgactctatca

SEQ ID NO: 402724 - DNA, 25 bp, Mus musculus
gaaaaccatctagctgactctatca

SEQ ID NO: 402725 - DNA, 25 bp, Mus musculus
gaaaaccatctcattgcaatgcaga

SEQ ID NO: 402726 - DNA, 25 bp, Mus musculus
gaaaaccatctctttgcaatgcaga

SEQ ID NO: 402727 - DNA, 25 bp, Mus musculus
gaaaaccatgtcaaggactgaatga

SEQ ID NO: 402728 - DNA, 25 bp, Mus musculus
gaaaaccatgtctaggactgaatga

SEQ ID NO: 402729 - DNA, 25 bp, Mus musculus
gaaaaccatgtgatctatttctgga

SEQ ID NO: 402730 - DNA, 25 bp, Mus musculus
gaaaaccatgtgttctatttctgga

SEQ ID NO: 402731 - DNA, 25 bp, Mus musculus
gaaaaccatgttctgcttgtttgaa

SEQ ID NO: 402732 - DNA, 25 bp, Mus musculus
gaaaaccatgttgtgcttgtttgaa

SEQ ID NO: 402733 - DNA, 25 bp, Mus musculus
gaaaaccattctacaacacttacat

SEQ ID NO: 402734 - DNA, 25 bp, Mus musculus
gaaaaccattcttcaacacttacat

SEQ ID NO: 402735 - DNA, 25 bp, Mus musculus
gaaaaccattttcctcaatgaggcc

SEQ ID NO: 402736 - DNA, 25 bp, Mus musculus
gaaaaccattttgctcaatgaggcc

SEQ ID NO: 402737 - DNA, 25 bp, Mus musculus
gaaaacccaaagagcggctgtcagg

SEQ ID NO: 402738 - DNA, 25 bp, Mus musculus
gaaaacccaaagtgcggctgtcagg

SEQ ID NO: 402739 - DNA, 25 bp, Mus musculus
gaaaacccaatactctagatcttac

SEQ ID NO: 402740 - DNA, 25 bp, Mus musculus
gaaaacccaatagtctagatcttac

SEQ ID NO: 402741 - DNA, 25 bp, Mus musculus
gaaaacccaatgaatgcagccaaag

SEQ ID NO: 402742 - DNA, 25 bp, Mus musculus
gaaaacccaatgtatgcagccaaag

SEQ ID NO: 402743 - DNA, 25 bp, Mus musculus
gaaaacccacttaacagggatggca

SEQ ID NO: 402744 - DNA, 25 bp, Mus musculus
gaaaacccactttacagggatggca

SEQ ID NO: 402745 - DNA, 25 bp, Mus musculus
gaaaacccagaactccgtctatgct

SEQ ID NO: 402746 - DNA, 25 bp, Mus musculus
gaaaacccagaagtccgtctatgct

SEQ ID NO: 402747 - DNA, 25 bp, Mus musculus
gaaaacccagagctcccattgaatt

SEQ ID NO: 402748 - DNA, 25 bp, Mus musculus
gaaaacccagaggtcccattgaatt

SEQ ID NO: 402749 - DNA, 25 bp, Mus musculus
gaaaacccagcacacatgattgaag

SEQ ID NO: 402750 - DNA, 25 bp, Mus musculus
gaaaacccagcagacatgattgaag

SEQ ID NO: 402751 - DNA, 25 bp, Mus musculus
gaaaacccagggaatcttccctcag

SEQ ID NO: 402752 - DNA, 25 bp, Mus musculus
gaaaacccagggtatcttccctcag

SEQ ID NO: 402753 - DNA, 25 bp, Mus musculus
gaaaacccaggtcactgcgactttg

SEQ ID NO: 402754 - DNA, 25 bp, Mus musculus
gaaaacccaggtgactgcgactttg

SEQ ID NO: 402755 - DNA, 25 bp, Mus musculus
gaaaacccatctagcgtggataaat

SEQ ID NO: 402756 - DNA, 25 bp, Mus musculus
gaaaacccatcttgcgtggataaat

SEQ ID NO: 402757 - DNA, 25 bp, Mus musculus
gaaaacccatgacctatccagatag

SEQ ID NO: 402758 - DNA, 25 bp, Mus musculus
gaaaacccatgagctatccagatag

SEQ ID NO: 402759 - DNA, 25 bp, Mus musculus
gaaaacccatggcactagtgttaaa

SEQ ID NO: 402760 - DNA, 25 bp, Mus musculus
gaaaacccatgggactagtgttaaa

SEQ ID NO: 402761 - DNA, 25 bp, Mus musculus
gaaaacccattaacttgccagttgt

SEQ ID NO: 402762 - DNA, 25 bp, Mus musculus
gaaaacccattatcttgccagttgt

SEQ ID NO: 402763 - DNA, 25 bp, Mus musculus
gaaaacccatttcgcttgctttaat

SEQ ID NO: 402764 - DNA, 25 bp, Mus musculus
gaaaacccatttggcttgctttaat

SEQ ID NO: 402765 - DNA, 25 bp, Mus musculus
gaaaaccccagcaggcttcttaagg

SEQ ID NO: 402766 - DNA, 25 bp, Mus musculus
gaaaaccccagctggcttcttaagg

SEQ ID NO: 402767 - DNA, 25 bp, Mus musculus
gaaaaccccagtcaagtcggagtct

SEQ ID NO: 402768 - DNA, 25 bp, Mus musculus
gaaaaccccagtgaagtcggagtct

SEQ ID NO: 402769 - DNA, 25 bp, Mus musculus
gaaaaccccatcatatacacatact

SEQ ID NO: 402770 - DNA, 25 bp, Mus musculus
gaaaaccccatcttatacacatact

SEQ ID NO: 402771 - DNA, 25 bp, Mus musculus
gaaaacccctgactcgatagctcta

SEQ ID NO: 402772 - DNA, 25 bp, Mus musculus
gaaaacccctgagtcgatagctcta

SEQ ID NO: 402773 - DNA, 25 bp, Mus musculus
gaaaaccccttcacgggatgtactg

SEQ ID NO: 402774 - DNA, 25 bp, Mus musculus
gaaaaccccttctcgggatgtactg

SEQ ID NO: 402775 - DNA, 25 bp, Mus musculus
gaaaacccggcccattctagagaag

SEQ ID NO: 402776 - DNA, 25 bp, Mus musculus
gaaaacccggccgattctagagaag

SEQ ID NO: 402777 - DNA, 25 bp, Mus musculus
gaaaaccctaaacaatggctgactt

SEQ ID NO: 402778 - DNA, 25 bp, Mus musculus
gaaaaccctaaagaatggctgactt

SEQ ID NO: 402779 - DNA, 25 bp, Mus musculus
gaaaaccctaagaagtcgcaccata

SEQ ID NO: 402780 - DNA, 25 bp, Mus musculus
gaaaaccctaagtagtcgcaccata

SEQ ID NO: 402781 - DNA, 25 bp, Mus musculus
gaaaaccctagcaagccctggaaag

SEQ ID NO: 402782 - DNA, 25 bp, Mus musculus
gaaaaccctagctagccctggaaag

SEQ ID NO: 402783 - DNA, 25 bp, Mus musculus
gaaaaccctcacactgagtacgggc

SEQ ID NO: 402784 - DNA, 25 bp, Mus musculus
gaaaaccctcactctgagtacgggc

SEQ ID NO: 402785 - DNA, 25 bp, Mus musculus
gaaaaccctgccatggatcccaaag

SEQ ID NO: 402786 - DNA, 25 bp, Mus musculus
gaaaaccctgccttggatcccaaag

SEQ ID NO: 402787 - DNA, 25 bp, Mus musculus
gaaaaccctgtcactctaatatact

SEQ ID NO: 402788 - DNA, 25 bp, Mus musculus
gaaaaccctgtctctctaatatact

SEQ ID NO: 402789 - DNA, 25 bp, Mus musculus
gaaaacccttagctttcatttgtat

SEQ ID NO: 402790 - DNA, 25 bp, Mus musculus
gaaaacccttaggtttcatttgtat

SEQ ID NO: 402791 - DNA, 25 bp, Mus musculus
gaaaacccttgccaaaatgtcagag

SEQ ID NO: 402792 - DNA, 25 bp, Mus musculus
gaaaacccttgcgaaaatgtcagag

SEQ ID NO: 402793 - DNA, 25 bp, Mus musculus
gaaaaccctttgaacattatgttga

SEQ ID NO: 402794 - DNA, 25 bp, Mus musculus
gaaaaccctttgcatgctaagctcg

SEQ ID NO: 402795 - DNA, 25 bp, Mus musculus
gaaaaccctttggatgctaagctcg

SEQ ID NO: 402796 - DNA, 25 bp, Mus musculus
gaaaaccctttgtacattatgttga

SEQ ID NO: 402797 - DNA, 25 bp, Mus musculus
gaaaacccttttcaagcaatagcag

SEQ ID NO: 402798 - DNA, 25 bp, Mus musculus
gaaaacccttttgaagcaatagcag

SEQ ID NO: 402799 - DNA, 25 bp, Mus musculus
gaaaaccgactcctgcctttcaggt

SEQ ID NO: 402800 - DNA, 25 bp, Mus musculus
gaaaaccgactcgtgcctttcaggt

SEQ ID NO: 402801 - DNA, 25 bp, Mus musculus
gaaaaccgcaagcagaggcagcagt

SEQ ID NO: 402802 - DNA, 25 bp, Mus musculus
gaaaaccgcaaggagaggcagcagt

SEQ ID NO: 402803 - DNA, 25 bp, Mus musculus
gaaaaccgctttccatagtaatcaa

SEQ ID NO: 402804 - DNA, 25 bp, Mus musculus
gaaaaccgctttcgaaaacatgctg

SEQ ID NO: 402805 - DNA, 25 bp, Mus musculus
gaaaaccgctttgcatagtaatcaa

SEQ ID NO: 402806 - DNA, 25 bp, Mus musculus
gaaaaccgctttggaaaacatgctg

SEQ ID NO: 402807 - DNA, 25 bp, Mus musculus
gaaaaccgggagatgcttcaatttg

SEQ ID NO: 402808 - DNA, 25 bp, Mus musculus
gaaaaccgggagttgcttcaatttg

SEQ ID NO: 402809 - DNA, 25 bp, Mus musculus
gaaaaccggttactcaatgttgtct

SEQ ID NO: 402810 - DNA, 25 bp, Mus musculus
gaaaaccggttagtcaatgttgtct

SEQ ID NO: 402811 - DNA, 25 bp, Mus musculus
gaaaaccgtgctccaaggtattttt

SEQ ID NO: 402812 - DNA, 25 bp, Mus musculus
gaaaaccgtgctgcaaggtattttt

SEQ ID NO: 402813 - DNA, 25 bp, Mus musculus
gaaaacctaccactgaaactagtga

SEQ ID NO: 402814 - DNA, 25 bp, Mus musculus
gaaaacctaccagtgaaactagtga

SEQ ID NO: 402815 - DNA, 25 bp, Mus musculus
gaaaacctagctatctcagcttaag

SEQ ID NO: 402816 - DNA, 25 bp, Mus musculus
gaaaacctagctttctcagcttaag

SEQ ID NO: 402817 - DNA, 25 bp, Mus musculus
gaaaacctaggcaccctgaagccag

SEQ ID NO: 402818 - DNA, 25 bp, Mus musculus
gaaaacctaggctccctgaagccag

SEQ ID NO: 402819 - DNA, 25 bp, Mus musculus
gaaaacctataaacgacctcccatg

SEQ ID NO: 402820 - DNA, 25 bp, Mus musculus
gaaaacctataatcgacctcccatg

SEQ ID NO: 402821 - DNA, 25 bp, Mus musculus
gaaaacctcaagaccgaagcctgac

SEQ ID NO: 402822 - DNA, 25 bp, Mus musculus
gaaaacctcaagtccgaagcctgac

SEQ ID NO: 402823 - DNA, 25 bp, Mus musculus
gaaaacctcacaatcagtcttgagt

SEQ ID NO: 402824 - DNA, 25 bp, Mus musculus
gaaaacctcacattcagtcttgagt

SEQ ID NO: 402825 - DNA, 25 bp, Mus musculus
gaaaacctcagaagcttgcttctgc

SEQ ID NO: 402826 - DNA, 25 bp, Mus musculus
gaaaacctcagatgcttgcttctgc

SEQ ID NO: 402827 - DNA, 25 bp, Mus musculus
gaaaacctcatgacttgctctagat

SEQ ID NO: 402828 - DNA, 25 bp, Mus musculus
gaaaacctcatgtcttgctctagat

SEQ ID NO: 402829 - DNA, 25 bp, Mus musculus
gaaaacctctacaagtatcacgtgt

SEQ ID NO: 402830 - DNA, 25 bp, Mus musculus
gaaaacctctactagtatcacgtgt

SEQ ID NO: 402831 - DNA, 25 bp, Mus musculus
gaaaacctctcaagcattgggaacg

SEQ ID NO: 402832 - DNA, 25 bp, Mus musculus
gaaaacctctcatgcattgggaacg

SEQ ID NO: 402833 - DNA, 25 bp, Mus musculus
gaaaacctgaataatgggactttga

SEQ ID NO: 402834 - DNA, 25 bp, Mus musculus
gaaaacctgaattatgggactttga

SEQ ID NO: 402835 - DNA, 25 bp, Mus musculus
gaaaacctgagacgccgtctagaaa

SEQ ID NO: 402836 - DNA, 25 bp, Mus musculus
gaaaacctgagaggccgtctagaaa

SEQ ID NO: 402837 - DNA, 25 bp, Mus musculus
gaaaacctgaggattgtattgcttt

SEQ ID NO: 402838 - DNA, 25 bp, Mus musculus
gaaaacctgaggtttgtattgcttt

SEQ ID NO: 402839 - DNA, 25 bp, Mus musculus
gaaaacctgatcagcactgtagctt

SEQ ID NO: 402840 - DNA, 25 bp, Mus musculus
gaaaacctgatctgcactgtagctt

SEQ ID NO: 402841 - DNA, 25 bp, Mus musculus
gaaaacctgcagaaacgtcatgtca

SEQ ID NO: 402842 - DNA, 25 bp, Mus musculus
gaaaacctgcagtaacgtcatgtca

SEQ ID NO: 402843 - DNA, 25 bp, Mus musculus
gaaaacctgccacttcttatgtgag

SEQ ID NO: 402844 - DNA, 25 bp, Mus musculus
gaaaacctgccagttcttatgtgag

SEQ ID NO: 402845 - DNA, 25 bp, Mus musculus
gaaaacctggacagggagacccttg

SEQ ID NO: 402846 - DNA, 25 bp, Mus musculus
gaaaacctggactgggagacccttg

SEQ ID NO: 402847 - DNA, 25 bp, Mus musculus
gaaaacctggagagtccagtgctaa

SEQ ID NO: 402848 - DNA, 25 bp, Mus musculus
gaaaacctggagctcctgttgcacc

SEQ ID NO: 402849 - DNA, 25 bp, Mus musculus
gaaaacctggaggtcctgttgcacc

SEQ ID NO: 402850 - DNA, 25 bp, Mus musculus
gaaaacctggagtgtccagtgctaa

SEQ ID NO: 402851 - DNA, 25 bp, Mus musculus
gaaaacctgggaacacgtgtatata

SEQ ID NO: 402852 - DNA, 25 bp, Mus musculus
gaaaacctgggatcacgtgtatata

SEQ ID NO: 402853 - DNA, 25 bp, Mus musculus
gaaaacctgtcaagcgggattattt

SEQ ID NO: 402854 - DNA, 25 bp, Mus musculus
gaaaacctgtcatgcgggattattt

SEQ ID NO: 402855 - DNA, 25 bp, Mus musculus
gaaaacctgtgccaatcagtctcaa

SEQ ID NO: 402856 - DNA, 25 bp, Mus musculus
gaaaacctgtgcgaatcagtctcaa

SEQ ID NO: 402857 - DNA, 25 bp, Mus musculus
gaaaacctgtggagtggaccaacaa

SEQ ID NO: 402858 - DNA, 25 bp, Mus musculus
gaaaacctgtggtgtggaccaacaa

SEQ ID NO: 402859 - DNA, 25 bp, Mus musculus
gaaaacctgttaatacctgtgtgct

SEQ ID NO: 402860 - DNA, 25 bp, Mus musculus
gaaaacctgttattacctgtgtgct

SEQ ID NO: 402861 - DNA, 25 bp, Mus musculus
gaaaaccttaatccgtcctgggcaa

SEQ ID NO: 402862 - DNA, 25 bp, Mus musculus
gaaaaccttaatgcgtcctgggcaa

SEQ ID NO: 402863 - DNA, 25 bp, Mus musculus
gaaaaccttcccatatcaatctacc

SEQ ID NO: 402864 - DNA, 25 bp, Mus musculus
gaaaaccttcccttatcaatctacc

SEQ ID NO: 402865 - DNA, 25 bp, Mus musculus
gaaaaccttctaccatactattact

SEQ ID NO: 402866 - DNA, 25 bp, Mus musculus
gaaaaccttctagcatactattact

SEQ ID NO: 402867 - DNA, 25 bp, Mus musculus
gaaaaccttctcctcgtgcaagtaa

SEQ ID NO: 402868 - DNA, 25 bp, Mus musculus
gaaaaccttctcgtcgtgcaagtaa

SEQ ID NO: 402869 - DNA, 25 bp, Mus musculus
gaaaaccttgctcctgtaatgtctg

SEQ ID NO: 402870 - DNA, 25 bp, Mus musculus
gaaaaccttgctgctgtaatgtctg

SEQ ID NO: 402871 - DNA, 25 bp, Mus musculus
gaaaaccttggcatggagaactttg

SEQ ID NO: 402872 - DNA, 25 bp, Mus musculus
gaaaaccttggcttggagaactttg

SEQ ID NO: 402873 - DNA, 25 bp, Mus musculus
gaaaaccttgggatatgggccactc

SEQ ID NO: 402874 - DNA, 25 bp, Mus musculus
gaaaaccttgggttatgggccactc

SEQ ID NO: 402875 - DNA, 25 bp, Mus musculus
gaaaaccttgttagttctcctggag

SEQ ID NO: 402876 - DNA, 25 bp, Mus musculus
gaaaaccttgttcaacccagctcca

SEQ ID NO: 402877 - DNA, 25 bp, Mus musculus
gaaaaccttgttgaacccagctcca

SEQ ID NO: 402878 - DNA, 25 bp, Mus musculus
gaaaaccttgtttgttctcctggag

SEQ ID NO: 402879 - DNA, 25 bp, Mus musculus
gaaaacctttacaccagggactgat

SEQ ID NO: 402880 - DNA, 25 bp, Mus musculus
gaaaacctttactccagggactgat

SEQ ID NO: 402881 - DNA, 25 bp, Mus musculus
gaaaacctttgccatagcttcgaga

SEQ ID NO: 402882 - DNA, 25 bp, Mus musculus
gaaaacctttgcgatagcttcgaga

SEQ ID NO: 402883 - DNA, 25 bp, Mus musculus
gaaaacgaagaaaccctgcggcgag

SEQ ID NO: 402884 - DNA, 25 bp, Mus musculus
gaaaacgaagaatccctgcggcgag

SEQ ID NO: 402885 - DNA, 25 bp, Mus musculus
gaaaacgaaggcctcgtcgctcagt

SEQ ID NO: 402886 - DNA, 25 bp, Mus musculus
gaaaacgaaggcgtcgtcgctcagt

SEQ ID NO: 402887 - DNA, 25 bp, Mus musculus
gaaaacgaagtgactccgtcggtgt

SEQ ID NO: 402888 - DNA, 25 bp, Mus musculus
gaaaacgaagtgtctccgtcggtgt

SEQ ID NO: 402889 - DNA, 25 bp, Mus musculus
gaaaacgactttagccttggtgttg

SEQ ID NO: 402890 - DNA, 25 bp, Mus musculus
gaaaacgacttttgccttggtgttg

SEQ ID NO: 402891 - DNA, 25 bp, Mus musculus
gaaaacgagaacacagccctagcag

SEQ ID NO: 402892 - DNA, 25 bp, Mus musculus
gaaaacgagaactcagccctagcag

SEQ ID NO: 402893 - DNA, 25 bp, Mus musculus
gaaaacgagacaacgcctctggagc

SEQ ID NO: 402894 - DNA, 25 bp, Mus musculus
gaaaacgagacatcgcctctggagc

SEQ ID NO: 402895 - DNA, 25 bp, Mus musculus
gaaaacgagcctccgcaggaggacc

SEQ ID NO: 402896 - DNA, 25 bp, Mus musculus
gaaaacgagcctgcgcaggaggacc

SEQ ID NO: 402897 - DNA, 25 bp, Mus musculus
gaaaacgattcaaattgcagaagac

SEQ ID NO: 402898 - DNA, 25 bp, Mus musculus
gaaaacgattcatattgcagaagac

SEQ ID NO: 402899 - DNA, 25 bp, Mus musculus
gaaaacgcaatcaccttccatatct

SEQ ID NO: 402900 - DNA, 25 bp, Mus musculus
gaaaacgcaatctccttccatatct

SEQ ID NO: 402901 - DNA, 25 bp, Mus musculus
gaaaacgcagtccatgtatcaactt

SEQ ID NO: 402902 - DNA, 25 bp, Mus musculus
gaaaacgcagtcgatgtatcaactt

SEQ ID NO: 402903 - DNA, 25 bp, Mus musculus
gaaaacgcagtgcacggccaagtgt

SEQ ID NO: 402904 - DNA, 25 bp, Mus musculus
gaaaacgcagtggacggccaagtgt

SEQ ID NO: 402905 - DNA, 25 bp, Mus musculus
gaaaacgcatctctctcagagctga

SEQ ID NO: 402906 - DNA, 25 bp, Mus musculus
gaaaacgcatctgtctcagagctga

SEQ ID NO: 402907 - DNA, 25 bp, Mus musculus
gaaaacgcatggaaacttatatcaa

SEQ ID NO: 402908 - DNA, 25 bp, Mus musculus
gaaaacgcatggtaacttatatcaa

SEQ ID NO: 402909 - DNA, 25 bp, Mus musculus
gaaaacgcatttctcctcagaatat

SEQ ID NO: 402910 - DNA, 25 bp, Mus musculus
gaaaacgcatttgtcctcagaatat

SEQ ID NO: 402911 - DNA, 25 bp, Mus musculus
gaaaacgccaggagctggtcaccaa

SEQ ID NO: 402912 - DNA, 25 bp, Mus musculus
gaaaacgccaggtgctggtcaccaa

SEQ ID NO: 402913 - DNA, 25 bp, Mus musculus
gaaaacgcccacatgtgtgaactgt

SEQ ID NO: 402914 - DNA, 25 bp, Mus musculus
gaaaacgcccacttgtgtgaactgt

SEQ ID NO: 402915 - DNA, 25 bp, Mus musculus
gaaaacgccctcagttaaagattct

SEQ ID NO: 402916 - DNA, 25 bp, Mus musculus
gaaaacgccctctgttaaagattct

SEQ ID NO: 402917 - DNA, 25 bp, Mus musculus
gaaaacgccgataagcacaatctaa

SEQ ID NO: 402918 - DNA, 25 bp, Mus musculus
gaaaacgccgattagcacaatctaa

SEQ ID NO: 402919 - DNA, 25 bp, Mus musculus
gaaaacgccggcagagtttgccaaa

SEQ ID NO: 402920 - DNA, 25 bp, Mus musculus
gaaaacgccggctgagtttgccaaa

SEQ ID NO: 402921 - DNA, 25 bp, Mus musculus
gaaaacgctacacacactgactgga

SEQ ID NO: 402922 - DNA, 25 bp, Mus musculus
gaaaacgctacagacactgactgga

SEQ ID NO: 402923 - DNA, 25 bp, Mus musculus
gaaaacgctgaacgtcgcttggcaa

SEQ ID NO: 402924 - DNA, 25 bp, Mus musculus
gaaaacgctgaaggtcgcttggcaa

SEQ ID NO: 402925 - DNA, 25 bp, Mus musculus
gaaaacgctgtacatgctttgccca

SEQ ID NO: 402926 - DNA, 25 bp, Mus musculus
gaaaacgctgtagatgctttgccca

SEQ ID NO: 402927 - DNA, 25 bp, Mus musculus
gaaaacgcttacattagttcccaag

SEQ ID NO: 402928 - DNA, 25 bp, Mus musculus
gaaaacgcttactttagttcccaag

SEQ ID NO: 402929 - DNA, 25 bp, Mus musculus
gaaaacgcttcaaactcataatgac

SEQ ID NO: 402930 - DNA, 25 bp, Mus musculus
gaaaacgcttcatactcataatgac

SEQ ID NO: 402931 - DNA, 25 bp, Mus musculus
gaaaacggagagattctcctcgccc

SEQ ID NO: 402932 - DNA, 25 bp, Mus musculus
gaaaacggagagtttctcctcgccc

SEQ ID NO: 402933 - DNA, 25 bp, Mus musculus
gaaaacggagccatccagggactga

SEQ ID NO: 402934 - DNA, 25 bp, Mus musculus
gaaaacggagccttccagggactga

SEQ ID NO: 402935 - DNA, 25 bp, Mus musculus
gaaaacggaggtctcacgccagaaa

SEQ ID NO: 402936 - DNA, 25 bp, Mus musculus
gaaaacggaggtgtcacgccagaaa

SEQ ID NO: 402937 - DNA, 25 bp, Mus musculus
gaaaacggagtcagctcctgtctca

SEQ ID NO: 402938 - DNA, 25 bp, Mus musculus
gaaaacggagtctgctcctgtctca

SEQ ID NO: 402939 - DNA, 25 bp, Mus musculus
gaaaacggctacatgcaccaggact

SEQ ID NO: 402940 - DNA, 25 bp, Mus musculus
gaaaacggctacttgcaccaggact

SEQ ID NO: 402941 - DNA, 25 bp, Mus musculus
gaaaacgggcttatctggttgcctg

SEQ ID NO: 402942 - DNA, 25 bp, Mus musculus
gaaaacgggcttttctggttgcctg

SEQ ID NO: 402943 - DNA, 25 bp, Mus musculus
gaaaacggtcaacatgttcctgctc

SEQ ID NO: 402944 - DNA, 25 bp, Mus musculus
gaaaacggtcaagatgttcctgctc

SEQ ID NO: 402945 - DNA, 25 bp, Mus musculus
gaaaacggtcccatctcagggttca

SEQ ID NO: 402946 - DNA, 25 bp, Mus musculus
gaaaacggtcccttctcagggttca

SEQ ID NO: 402947 - DNA, 25 bp, Mus musculus
gaaaacgtcacgctgaatatatgac

SEQ ID NO: 402948 - DNA, 25 bp, Mus musculus
gaaaacgtcacggtgaatatatgac

SEQ ID NO: 402949 - DNA, 25 bp, Mus musculus
gaaaacgtcagtcttcacaaaaagt

SEQ ID NO: 402950 - DNA, 25 bp, Mus musculus
gaaaacgtcagtgttcacaaaaagt

SEQ ID NO: 402951 - DNA, 25 bp, Mus musculus
gaaaacgtcccgagagtactctaca

SEQ ID NO: 402952 - DNA, 25 bp, Mus musculus
gaaaacgtcccgtgagtactctaca

SEQ ID NO: 402953 - DNA, 25 bp, Mus musculus
gaaaacgtcgtactgaaactcacta

SEQ ID NO: 402954 - DNA, 25 bp, Mus musculus
gaaaacgtcgtagtgaaactcacta

SEQ ID NO: 402955 - DNA, 25 bp, Mus musculus
gaaaacgtgaccatggcctcgtggg

SEQ ID NO: 402956 - DNA, 25 bp, Mus musculus
gaaaacgtgaccttggcctcgtggg

SEQ ID NO: 402957 - DNA, 25 bp, Mus musculus
gaaaacgtgctgaggtggtactata

SEQ ID NO: 402958 - DNA, 25 bp, Mus musculus
gaaaacgtgctgtggtggtactata

SEQ ID NO: 402959 - DNA, 25 bp, Mus musculus
gaaaacgtggttctttttatgcagt

SEQ ID NO: 402960 - DNA, 25 bp, Mus musculus
gaaaacgtggttgtttttatgcagt

SEQ ID NO: 402961 - DNA, 25 bp, Mus musculus
gaaaacgtgtgcacagagtggctta

SEQ ID NO: 402962 - DNA, 25 bp, Mus musculus
gaaaacgtgtgctcagagtggctta

SEQ ID NO: 402963 - DNA, 25 bp, Mus musculus
gaaaacgtgtgtctggcctatggta

SEQ ID NO: 402964 - DNA, 25 bp, Mus musculus
gaaaacgtgtgtgtggcctatggta

SEQ ID NO: 402965 - DNA, 25 bp, Mus musculus
gaaaacgttaacacatacttcatgt

SEQ ID NO: 402966 - DNA, 25 bp, Mus musculus
gaaaacgttaactcatacttcatgt
